United States Patent 7,655,785 (BIOINFORMATICALLY DETECTABLE GROUP OF NOVEL REGULATORY OLIGONUCLEOTIDES AND USES THEREOF) - sequence listing, part 3

SEQ ID NO: 77589 - RNA, 22 nt, Homo sapiens
ucacuggccaaauucuggguga

SEQ ID NO: 77590 - RNA, 20 nt, Homo sapiens
ucacugugaacuucuugagg

SEQ ID NO: 77591 - RNA, 22 nt, Homo sapiens
ucacugugguuggaaggcuuaa

SEQ ID NO: 77592 - RNA, 22 nt, Homo sapiens
ucacugugugucucuguaucug

SEQ ID NO: 77593 - RNA, 22 nt, Homo sapiens
ucacuuugacggccaacuucua

SEQ ID NO: 77594 - RNA, 22 nt, Homo sapiens
ucacuuuguauagcgacuggcu

SEQ ID NO: 77595 - RNA, 22 nt, Homo sapiens
ucagacacugcccuccaccugu

SEQ ID NO: 77596 - RNA, 22 nt, Homo sapiens
ucagaccauuucauuacagacu

SEQ ID NO: 77597 - RNA, 22 nt, Homo sapiens
ucagaguguuuuccaacuuggu

SEQ ID NO: 77598 - RNA, 22 nt, Homo sapiens
ucagauacuggugacaugaaug

SEQ ID NO: 77599 - RNA, 22 nt, Homo sapiens
ucagaucacuggcgcuggcgga

SEQ ID NO: 77600 - RNA, 22 nt, Homo sapiens
ucagaucaugcuuaugauggga

SEQ ID NO: 77601 - RNA, 22 nt, Homo sapiens
ucagaucuucagcaggggcccc

SEQ ID NO: 77602 - RNA, 22 nt, Homo sapiens
ucagaugaugucccuguucuaa

SEQ ID NO: 77603 - RNA, 22 nt, Homo sapiens
ucagaugcauccauaccccacu

SEQ ID NO: 77604 - RNA, 22 nt, Homo sapiens
ucagcaaugaccuaagcaaaua

SEQ ID NO: 77605 - RNA, 22 nt, Homo sapiens
ucagcaaugcugcacucuacug

SEQ ID NO: 77606 - RNA, 22 nt, Homo sapiens
ucagcacauucaaggccugccu

SEQ ID NO: 77607 - RNA, 22 nt, Homo sapiens
ucagcguguggacggccaucuu

SEQ ID NO: 77608 - RNA, 22 nt, Homo sapiens
ucaggcaccuuccucuuaucug

SEQ ID NO: 77609 - RNA, 22 nt, Homo sapiens
ucagggacuuacaaaccagaag

SEQ ID NO: 77610 - RNA, 22 nt, Homo sapiens
ucagguagcuagauuaugugag

SEQ ID NO: 77611 - RNA, 23 nt, Homo sapiens
ucagguaggccuagaguauucuu

SEQ ID NO: 77612 - RNA, 22 nt, Homo sapiens
ucagguaguuugugggagauga

SEQ ID NO: 77613 - RNA, 22 nt, Homo sapiens
ucagguauuuauagcaaugcaa

SEQ ID NO: 77614 - RNA, 22 nt, Homo sapiens
ucaggucauuccaggagggcca

SEQ ID NO: 77615 - RNA, 22 nt, Homo sapiens
ucaggugccuuggcuaauuguu

SEQ ID NO: 77616 - RNA, 22 nt, Homo sapiens
ucaguaaaugcuguucucuuuu

SEQ ID NO: 77617 - RNA, 22 nt, Homo sapiens
ucaguaaauguuaggacauuuc

SEQ ID NO: 77618 - RNA, 22 nt, Homo sapiens
ucaguagagacaggauuucacc

SEQ ID NO: 77619 - RNA, 22 nt, Homo sapiens
ucaguagcaugaaaacagacua

SEQ ID NO: 77620 - RNA, 18 nt, Homo sapiens
ucagucacugccuggcuu

SEQ ID NO: 77621 - RNA, 22 nt, Homo sapiens
ucagugacugcugcuuguauac

SEQ ID NO: 77622 - RNA, 22 nt, Homo sapiens
ucagugacuggguauuaaauca

SEQ ID NO: 77623 - RNA, 20 nt, Homo sapiens
ucagugcagauuguccaagu

SEQ ID NO: 77624 - RNA, 17 nt, Homo sapiens
ucagugcauuuaagaga

SEQ ID NO: 77625 - RNA, 21 nt, Homo sapiens
ucagugcugugggcaaggugc

SEQ ID NO: 77626 - RNA, 22 nt, Homo sapiens
ucagugcuuuuuguugucauca

SEQ ID NO: 77627 - RNA, 22 nt, Homo sapiens
ucaguggacuuagucuuucccc

SEQ ID NO: 77628 - RNA, 22 nt, Homo sapiens
ucaguggagagcuuccaggauu

SEQ ID NO: 77629 - RNA, 21 nt, Homo sapiens
augagauguuagacuuuagac

SEQ ID NO: 77630 - RNA, 22 nt, Homo sapiens
augagauucuuagagaagucug

SEQ ID NO: 77631 - RNA, 22 nt, Homo sapiens
augagauuguuugugugaaaua

SEQ ID NO: 77632 - RNA, 19 nt, Homo sapiens
augagcaauaguuuuaauc

SEQ ID NO: 77633 - RNA, 22 nt, Homo sapiens
augagcuaggacagaaugucag

SEQ ID NO: 77634 - RNA, 22 nt, Homo sapiens
augagcuccucaaggucagaga

SEQ ID NO: 77635 - RNA, 22 nt, Homo sapiens
augaggaagucaggcccagggg

SEQ ID NO: 77636 - RNA, 22 nt, Homo sapiens
augaggacaucuuccuuaugga

SEQ ID NO: 77637 - RNA, 22 nt, Homo sapiens
augaggagauauuaaauaccau

SEQ ID NO: 77638 - RNA, 22 nt, Homo sapiens
augagggcggacgcccuggaga

SEQ ID NO: 77639 - RNA, 22 nt, Homo sapiens
augaggugcagaggaaaugagu

SEQ ID NO: 77640 - RNA, 22 nt, Homo sapiens
augaggugggcggcuuggaaga

SEQ ID NO: 77641 - RNA, 21 nt, Homo sapiens
augagguguacuguggugaaa

SEQ ID NO: 77642 - RNA, 22 nt, Homo sapiens
augaguauguucuguauuuuca

SEQ ID NO: 77643 - RNA, 22 nt, Homo sapiens
augaguuccuuccuugccuagg

SEQ ID NO: 77644 - RNA, 22 nt, Homo sapiens
augaguugaagcuacaagaggc

SEQ ID NO: 77645 - RNA, 22 nt, Homo sapiens
augauacugaguugaguucuca

SEQ ID NO: 77646 - RNA, 22 nt, Homo sapiens
augauaugagaaaggaucaaca

SEQ ID NO: 77647 - RNA, 22 nt, Homo sapiens
augauauguuuguagcuaucuc

SEQ ID NO: 77648 - RNA, 22 nt, Homo sapiens
augauauuauucuagcccagag

SEQ ID NO: 77649 - RNA, 22 nt, Homo sapiens
augauccagugaguuucaguuc

SEQ ID NO: 77650 - RNA, 22 nt, Homo sapiens
augaucuguagaacuaguccuu

SEQ ID NO: 77651 - RNA, 22 nt, Homo sapiens
augaugcugcaguuguugccaa

SEQ ID NO: 77652 - RNA, 22 nt, Homo sapiens
augauggagguagauuguccau

SEQ ID NO: 77653 - RNA, 22 nt, Homo sapiens
augauguccacagggguguuca

SEQ ID NO: 77654 - RNA, 22 nt, Homo sapiens
augauguguucuguguucccau

SEQ ID NO: 77655 - RNA, 22 nt, Homo sapiens
augcaaacaucauagaguguac

SEQ ID NO: 77656 - RNA, 22 nt, Homo sapiens
augcaagacaccacgugagaau

SEQ ID NO: 77657 - RNA, 22 nt, Homo sapiens
augcaauggaaaggacaauuac

SEQ ID NO: 77658 - RNA, 22 nt, Homo sapiens
augcaauucuagauugauagua

SEQ ID NO: 77659 - RNA, 22 nt, Homo sapiens
augcacuguuuucuugaugaga

SEQ ID NO: 77660 - RNA, 22 nt, Homo sapiens
augcagagaaaucuaaaauaug

SEQ ID NO: 77661 - RNA, 22 nt, Homo sapiens
augcagaucacauuuuucuguc

SEQ ID NO: 77662 - RNA, 22 nt, Homo sapiens
augcagguguuuugcacugagu

SEQ ID NO: 77663 - RNA, 22 nt, Homo sapiens
augcagugugcaacagauuaag

SEQ ID NO: 77664 - RNA, 22 nt, Homo sapiens
augcauagugggaugcucugug

SEQ ID NO: 77665 - RNA, 18 nt, Homo sapiens
augcauauuuuaaguugu

SEQ ID NO: 77666 - RNA, 22 nt, Homo sapiens
augccacagaaauaaccaaaau

SEQ ID NO: 77667 - RNA, 22 nt, Homo sapiens
augccacugcacuucagccugc

SEQ ID NO: 77668 - RNA, 22 nt, Homo sapiens
augccacugcauaagguuuuca

SEQ ID NO: 77669 - RNA, 22 nt, Homo sapiens
augccacuguacucuagccuag

SEQ ID NO: 77670 - RNA, 22 nt, Homo sapiens
augccacuguuuaugucacuua

SEQ ID NO: 77671 - RNA, 22 nt, Homo sapiens
augcuacuggauuuguauaaau

SEQ ID NO: 77672 - RNA, 22 nt, Homo sapiens
augcuguuuugaauucucuaga

SEQ ID NO: 77673 - RNA, 22 nt, Homo sapiens
augcuuguguuggggcagugga

SEQ ID NO: 77674 - RNA, 22 nt, Homo sapiens
auggaaagcuguuccuacacaa

SEQ ID NO: 77675 - RNA, 22 nt, Homo sapiens
auggaaaugaagggcuggcccu

SEQ ID NO: 77676 - RNA, 22 nt, Homo sapiens
auggaacauuauagauguaaaa

SEQ ID NO: 77677 - RNA, 22 nt, Homo sapiens
auggaacugaagugcugcccuu

SEQ ID NO: 77678 - RNA, 19 nt, Homo sapiens
auggaacugcuggagccac

SEQ ID NO: 77679 - RNA, 22 nt, Homo sapiens
auggaagaauugucggggaugu

SEQ ID NO: 77680 - RNA, 22 nt, Homo sapiens
auggaagacuccucuuugggua

SEQ ID NO: 77681 - RNA, 22 nt, Homo sapiens
auggaagcauaguauucuauug

SEQ ID NO: 77682 - RNA, 22 nt, Homo sapiens
auggaaggagaggaaugaauga

SEQ ID NO: 77683 - RNA, 22 nt, Homo sapiens
auggaaucauccuccugggagc

SEQ ID NO: 77684 - RNA, 22 nt, Homo sapiens
auggaaugccauuuauaaugga

SEQ ID NO: 77685 - RNA, 22 nt, Homo sapiens
auggaauggcacuuugaagauu

SEQ ID NO: 77686 - RNA, 22 nt, Homo sapiens
auggaauguaaguuauguuugc

SEQ ID NO: 77687 - RNA, 21 nt, Homo sapiens
auggacugugugacccugcac

SEQ ID NO: 77688 - RNA, 22 nt, Homo sapiens
auggacuuuuuguucagugucu

SEQ ID NO: 77689 - RNA, 22 nt, Homo sapiens
auggagcuugacaguuguagag

SEQ ID NO: 77690 - RNA, 22 nt, Homo sapiens
auggaggacaaugucaccuuca

SEQ ID NO: 77691 - RNA, 22 nt, Homo sapiens
auggaggaggaagcugaaacaa

SEQ ID NO: 77692 - RNA, 22 nt, Homo sapiens
auggaggccuacagaauuuugg

SEQ ID NO: 77693 - RNA, 22 nt, Homo sapiens
auggagugagaauggagguucc

SEQ ID NO: 77694 - RNA, 22 nt, Homo sapiens
auggaguguucugaauccuuug

SEQ ID NO: 77695 - RNA, 19 nt, Homo sapiens
auggauacauuuucugcua

SEQ ID NO: 77696 - RNA, 22 nt, Homo sapiens
auggauagucucacucacauac

SEQ ID NO: 77697 - RNA, 22 nt, Homo sapiens
auggauauuuuuugaacauaga

SEQ ID NO: 77698 - RNA, 22 nt, Homo sapiens
auggauuuguaguacaugguug

SEQ ID NO: 77699 - RNA, 22 nt, Homo sapiens
auggauuuugaacuugagaguu

SEQ ID NO: 77700 - RNA, 22 nt, Homo sapiens
auggauuuuggggccagaggca

SEQ ID NO: 77701 - RNA, 22 nt, Homo sapiens
auggcaaaaaaugcaauuacuu

SEQ ID NO: 77702 - RNA, 22 nt, Homo sapiens
auggcaauguaagucagaaaaa

SEQ ID NO: 77703 - RNA, 22 nt, Homo sapiens
auggcacagaguagaugcucaa

SEQ ID NO: 77704 - RNA, 22 nt, Homo sapiens
auggcacuacugggaaugucuu

SEQ ID NO: 77705 - RNA, 22 nt, Homo sapiens
auggcacugccuggcuucaugg

SEQ ID NO: 77706 - RNA, 18 nt, Homo sapiens
auggcagaacaauuuaca

SEQ ID NO: 77707 - RNA, 22 nt, Homo sapiens
auggcagcaccccacucuacug

SEQ ID NO: 77708 - RNA, 22 nt, Homo sapiens
auggcaguuuauucuaaaucaa

SEQ ID NO: 77709 - RNA, 22 nt, Homo sapiens
auggcaguuucacucugggauu

SEQ ID NO: 77710 - RNA, 22 nt, Homo sapiens
auggccuaugacagguauguug

SEQ ID NO: 77711 - RNA, 22 nt, Homo sapiens
auggccuuuacaauuugguaug

SEQ ID NO: 77712 - RNA, 22 nt, Homo sapiens
auggcggugugaucuuggcuca

SEQ ID NO: 77713 - RNA, 22 nt, Homo sapiens
auggcuauucuucuuuugucag

SEQ ID NO: 77714 - RNA, 22 nt, Homo sapiens
auggcugugagaucgacuuauu

SEQ ID NO: 77715 - RNA, 22 nt, Homo sapiens
auggcuguuuaagaguuucauu

SEQ ID NO: 77716 - RNA, 22 nt, Homo sapiens
auggcuucuuacucuucugcau

SEQ ID NO: 77717 - RNA, 22 nt, Homo sapiens
auggcuucuucuaaaagugggg

SEQ ID NO: 77718 - RNA, 22 nt, Homo sapiens
auggcuuuaagagugucugaau

SEQ ID NO: 77719 - RNA, 22 nt, Homo sapiens
ugucuagaucugaauguaauug

SEQ ID NO: 77720 - RNA, 22 nt, Homo sapiens
ugucuaguuuugaaguauagca

SEQ ID NO: 77721 - RNA, 22 nt, Homo sapiens
ugucucaguucccuucucugga

SEQ ID NO: 77722 - RNA, 22 nt, Homo sapiens
ugucucaguuucuguggguuag

SEQ ID NO: 77723 - RNA, 22 nt, Homo sapiens
ugucuuguagacaauguauagu

SEQ ID NO: 77724 - RNA, 22 nt, Homo sapiens
ugucuuguagacugaaggcuuc

SEQ ID NO: 77725 - RNA, 22 nt, Homo sapiens
ugucuuugguucaggcaaggag

SEQ ID NO: 77726 - RNA, 22 nt, Homo sapiens
ugugaaacacgaaagucuaaaa

SEQ ID NO: 77727 - RNA, 22 nt, Homo sapiens
ugugaaaucagauagccuuuuu

SEQ ID NO: 77728 - RNA, 22 nt, Homo sapiens
ugugaacagcagcugggcuuug

SEQ ID NO: 77729 - RNA, 22 nt, Homo sapiens
ugugaacauuuuguauauauua

SEQ ID NO: 77730 - RNA, 22 nt, Homo sapiens
ugugaacugagcauuaacuaca

SEQ ID NO: 77731 - RNA, 20 nt, Homo sapiens
ugugaacuguagauagucuu

SEQ ID NO: 77732 - RNA, 22 nt, Homo sapiens
ugugaagaugagaugacgcccu

SEQ ID NO: 77733 - RNA, 22 nt, Homo sapiens
ugugaagauguuucuuaauuga

SEQ ID NO: 77734 - RNA, 22 nt, Homo sapiens
ugugaaugauggagugucgaau

SEQ ID NO: 77735 - RNA, 22 nt, Homo sapiens
ugugaauggugcugccgugaag

SEQ ID NO: 77736 - RNA, 22 nt, Homo sapiens
ugugaauguaaccuuauuugga

SEQ ID NO: 77737 - RNA, 22 nt, Homo sapiens
ugugaccaaaaucaacauaccu

SEQ ID NO: 77738 - RNA, 17 nt, Homo sapiens
ugugacccugggcuacc

SEQ ID NO: 77739 - RNA, 21 nt, Homo sapiens
ugugaccucugucucugaguc

SEQ ID NO: 77740 - RNA, 22 nt, Homo sapiens
ugugacucuggcacauggugag

SEQ ID NO: 77741 - RNA, 21 nt, Homo sapiens
ugugacuguugcauuugucgu

SEQ ID NO: 77742 - RNA, 22 nt, Homo sapiens
ugugagcuauggaguuguagag

SEQ ID NO: 77743 - RNA, 22 nt, Homo sapiens
ugugaucaaccugcagggcugg

SEQ ID NO: 77744 - RNA, 22 nt, Homo sapiens
ugugaucauuucaggaauuuug

SEQ ID NO: 77745 - RNA, 22 nt, Homo sapiens
ugugaugaaggcauagggaugu

SEQ ID NO: 77746 - RNA, 22 nt, Homo sapiens
ugugaugauuugauaaacguau

SEQ ID NO: 77747 - RNA, 18 nt, Homo sapiens
ugugauggauauguuaau

SEQ ID NO: 77748 - RNA, 22 nt, Homo sapiens
ugugaugguuuggaagcuucuu

SEQ ID NO: 77749 - RNA, 22 nt, Homo sapiens
ugugaugugaugagaaguuccu

SEQ ID NO: 77750 - RNA, 22 nt, Homo sapiens
ugugauugauuaaugugugcua

SEQ ID NO: 77751 - RNA, 22 nt, Homo sapiens
ugugcaaauuagcacaacccga

SEQ ID NO: 77752 - RNA, 22 nt, Homo sapiens
ugugcaaucuuccauuuuuagg

SEQ ID NO: 77753 - RNA, 22 nt, Homo sapiens
ugugcacaacaugcagguuugu

SEQ ID NO: 77754 - RNA, 22 nt, Homo sapiens
ugugcacaacgugcagguuugu

SEQ ID NO: 77755 - RNA, 22 nt, Homo sapiens
ugugcacaauguacagguuagu

SEQ ID NO: 77756 - RNA, 22 nt, Homo sapiens
ugugcacaugauauaucacaua

SEQ ID NO: 77757 - RNA, 22 nt, Homo sapiens
ugugccacuguucuguaaagug

SEQ ID NO: 77758 - RNA, 22 nt, Homo sapiens
ugugcuauguuauucacauggg

SEQ ID NO: 77759 - RNA, 22 nt, Homo sapiens
ugugcucaucucagucaacugu

SEQ ID NO: 77760 - RNA, 22 nt, Homo sapiens
uguggaaauaaaagaaagguua

SEQ ID NO: 77761 - RNA, 22 nt, Homo sapiens
uguggcaaauggucaggaagaa

SEQ ID NO: 77762 - RNA, 21 nt, Homo sapiens
uguggcaauggccucacagau

SEQ ID NO: 77763 - RNA, 22 nt, Homo sapiens
uguggcucuucuguucuccacu

SEQ ID NO: 77764 - RNA, 22 nt, Homo sapiens
uguggcugguggcaccuuuucc

SEQ ID NO: 77765 - RNA, 18 nt, Homo sapiens
uguggcuguuuuccaaua

SEQ ID NO: 77766 - RNA, 22 nt, Homo sapiens
uguggcuucuuugguucaguau

SEQ ID NO: 77767 - RNA, 22 nt, Homo sapiens
uguggcuuuguaaccauggguc

SEQ ID NO: 77768 - RNA, 22 nt, Homo sapiens
ugugggaggugcuaauguaaau

SEQ ID NO: 77769 - RNA, 22 nt, Homo sapiens
ugugguuuuauaaacgugaccu

SEQ ID NO: 77770 - RNA, 22 nt, Homo sapiens
ugugguuuuucacauuuagaga

SEQ ID NO: 77771 - RNA, 22 nt, Homo sapiens
ugugguuuuuuucuccaauagg

SEQ ID NO: 77772 - RNA, 22 nt, Homo sapiens
uguguauaucacugcaugagug

SEQ ID NO: 77773 - RNA, 22 nt, Homo sapiens
ugugucuugcuggugccugcau

SEQ ID NO: 77774 - RNA, 22 nt, Homo sapiens
uguuacacugugcacuaaauuu

SEQ ID NO: 77775 - RNA, 22 nt, Homo sapiens
uguuaugaagaugccugguaca

SEQ ID NO: 77776 - RNA, 16 nt, Homo sapiens
uguuauggagacagcu

SEQ ID NO: 77777 - RNA, 22 nt, Homo sapiens
uguucaauucccaccuaugagu

SEQ ID NO: 77778 - RNA, 22 nt, Homo sapiens
uguucuggagaggcaggccaca

SEQ ID NO: 77779 - RNA, 22 nt, Homo sapiens
uguucuggagccgguucaaaug

SEQ ID NO: 77780 - RNA, 22 nt, Homo sapiens
uguugcacuccagccugggcaa

SEQ ID NO: 77781 - RNA, 19 nt, Homo sapiens
uguugcacuccagcuuggg

SEQ ID NO: 77782 - RNA, 22 nt, Homo sapiens
uguugcacucuagccugggcaa

SEQ ID NO: 77783 - RNA, 22 nt, Homo sapiens
uguugcauuugucaaggucaag

SEQ ID NO: 77784 - RNA, 22 nt, Homo sapiens
uguuugcuguguggaguagcag

SEQ ID NO: 77785 - RNA, 22 nt, Homo sapiens
uguuuguuugauaugggauaaa

SEQ ID NO: 77786 - RNA, 22 nt, Homo sapiens
uuaaaagcuaucuccaagguca

SEQ ID NO: 77787 - RNA, 22 nt, Homo sapiens
uuaaaaguauaggccuggcaua

SEQ ID NO: 77788 - RNA, 22 nt, Homo sapiens
uuaaagccauaccugagagagu

SEQ ID NO: 77789 - RNA, 22 nt, Homo sapiens
uuaaagugcacacgggucaggc

SEQ ID NO: 77790 - RNA, 22 nt, Homo sapiens
uuaaaguguuugcagacaggug

SEQ ID NO: 77791 - RNA, 22 nt, Homo sapiens
uuaaaugcauagaauguguagu

SEQ ID NO: 77792 - RNA, 20 nt, Homo sapiens
uugauucccucuaaacucgc

SEQ ID NO: 77793 - RNA, 22 nt, Homo sapiens
uugcaaacaucuuguuucacau

SEQ ID NO: 77794 - RNA, 23 nt, Homo sapiens
uugcaaagccugaaacucuucag

SEQ ID NO: 77795 - RNA, 22 nt, Homo sapiens
uugcaaaguugccaaggaagga

SEQ ID NO: 77796 - RNA, 22 nt, Homo sapiens
uugcaaaucucuuguguuuggu

SEQ ID NO: 77797 - RNA, 22 nt, Homo sapiens
uugcaacauguauucuggugau

SEQ ID NO: 77798 - RNA, 22 nt, Homo sapiens
uugcaacauuguaaguuuauau

SEQ ID NO: 77799 - RNA, 22 nt, Homo sapiens
uugcaagaaaucagagccuucc

SEQ ID NO: 77800 - RNA, 22 nt, Homo sapiens
uugcaagauguuaacauuggag

SEQ ID NO: 77801 - RNA, 20 nt, Homo sapiens
uugcacagagaaggaggcag

SEQ ID NO: 77802 - RNA, 22 nt, Homo sapiens
ugauggcauuuggaguugggac

SEQ ID NO: 77803 - RNA, 22 nt, Homo sapiens
ugauggccuguucuccauaugu

SEQ ID NO: 77804 - RNA, 22 nt, Homo sapiens
ugaugguguuaccaucuuuacu

SEQ ID NO: 77805 - RNA, 22 nt, Homo sapiens
ugaugguuuuauuaauaggacc

SEQ ID NO: 77806 - RNA, 20 nt, Homo sapiens
ugauguccaggcagagguuu

SEQ ID NO: 77807 - RNA, 22 nt, Homo sapiens
ugauguccaguucauagaaacu

SEQ ID NO: 77808 - RNA, 22 nt, Homo sapiens
ugauguguuuuguaguucaacu

SEQ ID NO: 77809 - RNA, 22 nt, Homo sapiens
ugauguugaauuguucagcguc

SEQ ID NO: 77810 - RNA, 22 nt, Homo sapiens
ugauguugacuguaggcagaga

SEQ ID NO: 77811 - RNA, 20 nt, Homo sapiens
ugauuaguccacuuggcucu

SEQ ID NO: 77812 - RNA, 22 nt, Homo sapiens
ugauucccucaagugccuuaug

SEQ ID NO: 77813 - RNA, 22 nt, Homo sapiens
ugauugacauacauaggugugg

SEQ ID NO: 77814 - RNA, 22 nt, Homo sapiens
ugauugacauucuuuggaguau

SEQ ID NO: 77815 - RNA, 22 nt, Homo sapiens
ugauugcacaccugcacucaag

SEQ ID NO: 77816 - RNA, 22 nt, Homo sapiens
ugauuuguuuagugccaaguuu

SEQ ID NO: 77817 - RNA, 22 nt, Homo sapiens
ugcaaacuuccuugggcagcau

SEQ ID NO: 77818 - RNA, 22 nt, Homo sapiens
ugcaaauguuaggugucauuau

SEQ ID NO: 77819 - RNA, 22 nt, Homo sapiens
ugcaagaaacauauuccacaag

SEQ ID NO: 77820 - RNA, 22 nt, Homo sapiens
ugcaagaaucuuucaggcuagc

SEQ ID NO: 77821 - RNA, 22 nt, Homo sapiens
ugcaaguggauuuuuccccaga

SEQ ID NO: 77822 - RNA, 20 nt, Homo sapiens
ugcaaguugccuuuggaggc

SEQ ID NO: 77823 - RNA, 22 nt, Homo sapiens
ugcaauuuaaugugucccaauu

SEQ ID NO: 77824 - RNA, 22 nt, Homo sapiens
ugcacacucuguaugagaaucu

SEQ ID NO: 77825 - RNA, 22 nt, Homo sapiens
ugcaccacugcaccccagucug

SEQ ID NO: 77826 - RNA, 22 nt, Homo sapiens
ugcaccacugcacuccacccug

SEQ ID NO: 77827 - RNA, 22 nt, Homo sapiens
ugcaccauugcacuccagccug

SEQ ID NO: 77828 - RNA, 22 nt, Homo sapiens
ugcaccauugucaccuggguga

SEQ ID NO: 77829 - RNA, 22 nt, Homo sapiens
ugcacugucuugucgcauagca

SEQ ID NO: 77830 - RNA, 16 nt, Homo sapiens
ugcagaguaggugaau

SEQ ID NO: 77831 - RNA, 20 nt, Homo sapiens
ugcagauucaaccaacugug

SEQ ID NO: 77832 - RNA, 22 nt, Homo sapiens
ugcagcacaguagguuugcaau

SEQ ID NO: 77833 - RNA, 20 nt, Homo sapiens
ugcagcacugggaaugcagu

SEQ ID NO: 77834 - RNA, 21 nt, Homo sapiens
ugcagccauucagcccuaugc

SEQ ID NO: 77835 - RNA, 23 nt, Homo sapiens
ugcaguagugagaucuaggcuca

SEQ ID NO: 77836 - RNA, 22 nt, Homo sapiens
ugcagugugaaagagccugaca

SEQ ID NO: 77837 - RNA, 22 nt, Homo sapiens
ugcaguguggcucacgccugua

SEQ ID NO: 77838 - RNA, 22 nt, Homo sapiens
ugcauacugggagguugggugu

SEQ ID NO: 77839 - RNA, 19 nt, Homo sapiens
ugcauaggguuacauacuc

SEQ ID NO: 77840 - RNA, 23 nt, Homo sapiens
ugcauaguacccaauacuuuauc

SEQ ID NO: 77841 - RNA, 22 nt, Homo sapiens
ugcauaucuucagccgggcacg

SEQ ID NO: 77842 - RNA, 22 nt, Homo sapiens
ugcauaugcagcauuuaugauu

SEQ ID NO: 77843 - RNA, 22 nt, Homo sapiens
ugcauaugucuuuauagcagca

SEQ ID NO: 77844 - RNA, 22 nt, Homo sapiens
ugcauauguugaaccaggcuug

SEQ ID NO: 77845 - RNA, 22 nt, Homo sapiens
ugcauauguugagaugcauauu

SEQ ID NO: 77846 - RNA, 22 nt, Homo sapiens
ugcauauuuuauaaagauggaa

SEQ ID NO: 77847 - RNA, 22 nt, Homo sapiens
ugcaucaggcugcuuauuacaa

SEQ ID NO: 77848 - RNA, 22 nt, Homo sapiens
ugcaugaugcugagauuuggga

SEQ ID NO: 77849 - RNA, 21 nt, Homo sapiens
ugcauggagaacacugagggu

SEQ ID NO: 77850 - RNA, 22 nt, Homo sapiens
ugcauggagcucucuuuggacu

SEQ ID NO: 77851 - RNA, 22 nt, Homo sapiens
ugcauggucauacauggcaccc

SEQ ID NO: 77852 - RNA, 22 nt, Homo sapiens
ugcauguucuuacucauacaug

SEQ ID NO: 77853 - RNA, 22 nt, Homo sapiens
ugcauugccgugauuacugucu

SEQ ID NO: 77854 - RNA, 21 nt, Homo sapiens
ugcauugucuugaguuuaaau

SEQ ID NO: 77855 - RNA, 22 nt, Homo sapiens
ugcauuguuccgaauguguccu

SEQ ID NO: 77856 - RNA, 21 nt, Homo sapiens
ugcauuguugcugagagcagg

SEQ ID NO: 77857 - RNA, 22 nt, Homo sapiens
ugcauuguuuagaaacacuggg

SEQ ID NO: 77858 - RNA, 22 nt, Homo sapiens
ugcauuguuuuugguucccagg

SEQ ID NO: 77859 - RNA, 20 nt, Homo sapiens
ugccaagaugacuauagcuc

SEQ ID NO: 77860 - RNA, 22 nt, Homo sapiens
ugccagagacguagggaauauu

SEQ ID NO: 77861 - RNA, 22 nt, Homo sapiens
ugccagaugcaguguucaacaa

SEQ ID NO: 77862 - RNA, 22 nt, Homo sapiens
ugccaggaugaggucaauguuu

SEQ ID NO: 77863 - RNA, 22 nt, Homo sapiens
ugccaugaagagaggaagcagu

SEQ ID NO: 77864 - RNA, 22 nt, Homo sapiens
ugcccguaauuccagcacuuug

SEQ ID NO: 77865 - RNA, 22 nt, Homo sapiens
ugcccuguaucccacuguuuca

SEQ ID NO: 77866 - RNA, 22 nt, Homo sapiens
ugccuaggcuggaaugcagugg

SEQ ID NO: 77867 - RNA, 20 nt, Homo sapiens
ugccugacacucuuugcuuc

SEQ ID NO: 77868 - RNA, 22 nt, Homo sapiens
ugccugauacccucugucucuc

SEQ ID NO: 77869 - RNA, 22 nt, Homo sapiens
ugccugcugucuaauauauucu

SEQ ID NO: 77870 - RNA, 16 nt, Homo sapiens
ugccuucuucuguauu

SEQ ID NO: 77871 - RNA, 22 nt, Homo sapiens
ugccuuuguucuggaaugggaa

SEQ ID NO: 77872 - RNA, 22 nt, Homo sapiens
ugcgauuauuaugucacuuccu

SEQ ID NO: 77873 - RNA, 22 nt, Homo sapiens
ugcgccauugcacuccagccug

SEQ ID NO: 77874 - RNA, 22 nt, Homo sapiens
ugcgccauugcauuccagccug

SEQ ID NO: 77875 - RNA, 22 nt, Homo sapiens
ugcguaggcuagagugcagugg

SEQ ID NO: 77876 - RNA, 21 nt, Homo sapiens
ugcuacugucacuuccuuugu

SEQ ID NO: 77877 - RNA, 22 nt, Homo sapiens
ugcuagaagaucacacacauca

SEQ ID NO: 77878 - RNA, 23 nt, Homo sapiens
ugcuauguaagcauuuauuaaau

SEQ ID NO: 77879 - RNA, 22 nt, Homo sapiens
ugcuauguccccacccaaaucu

SEQ ID NO: 77880 - RNA, 22 nt, Homo sapiens
ugcuauguuuucccuccuuauc

SEQ ID NO: 77881 - RNA, 22 nt, Homo sapiens
ugcucaccugcugcucaccucc

SEQ ID NO: 77882 - RNA, 23 nt, Homo sapiens
ugcuccccucauggaugaauaaa

SEQ ID NO: 77883 - RNA, 22 nt, Homo sapiens
ugcugcaaucucggcacuuugg

SEQ ID NO: 77884 - RNA, 20 nt, Homo sapiens
ugcugcacuuaagcaugggc

SEQ ID NO: 77885 - RNA, 22 nt, Homo sapiens
ugcugguggucccauaugauua

SEQ ID NO: 77886 - RNA, 21 nt, Homo sapiens
ugcuuacugaauguuaauuuc

SEQ ID NO: 77887 - RNA, 17 nt, Homo sapiens
ugcuuagagagccucag

SEQ ID NO: 77888 - RNA, 22 nt, Homo sapiens
ugcuuaggcuuccuuacaguau

SEQ ID NO: 77889 - RNA, 18 nt, Homo sapiens
ugcuuagucauuuucaau

SEQ ID NO: 77890 - RNA, 22 nt, Homo sapiens
ugcuuaguuguauguuccacau

SEQ ID NO: 77891 - RNA, 22 nt, Homo sapiens
ugcuugagacacauaugaauuu

SEQ ID NO: 77892 - RNA, 22 nt, Homo sapiens
ugcuuugguagaaaucuuuggu

SEQ ID NO: 77893 - RNA, 22 nt, Homo sapiens
uggaaaacaugcacauuggauu

SEQ ID NO: 77894 - RNA, 22 nt, Homo sapiens
uggaaacuuauguucuucugug

SEQ ID NO: 77895 - RNA, 21 nt, Homo sapiens
uggaaacuucuagcuuacgua

SEQ ID NO: 77896 - RNA, 20 nt, Homo sapiens
uggaaaguaagucaugauau

SEQ ID NO: 77897 - RNA, 22 nt, Homo sapiens
uaucauggaaagauguugaaau

SEQ ID NO: 77898 - RNA, 22 nt, Homo sapiens
uaucauggaaugagguuggaca

SEQ ID NO: 77899 - RNA, 22 nt, Homo sapiens
uaucaugggggguguacacucc

SEQ ID NO: 77900 - RNA, 23 nt, Homo sapiens
uaucucaaugcacagagaggaaa

SEQ ID NO: 77901 - RNA, 22 nt, Homo sapiens
uaucucacauauucaguagguu

SEQ ID NO: 77902 - RNA, 22 nt, Homo sapiens
uaucucuuuucauguguaaaug

SEQ ID NO: 77903 - RNA, 22 nt, Homo sapiens
uaugaacacuuuugggaggcau

SEQ ID NO: 77904 - RNA, 22 nt, Homo sapiens
uaugaagccaggauuuauuauu

SEQ ID NO: 77905 - RNA, 22 nt, Homo sapiens
uaugaauuuuauccaggauaua

SEQ ID NO: 77906 - RNA, 23 nt, Homo sapiens
uaugacagaggaagggggagcug

SEQ ID NO: 77907 - RNA, 22 nt, Homo sapiens
uaugaccuuguccccucucgcc

SEQ ID NO: 77908 - RNA, 19 nt, Homo sapiens
uaugagcuaugacaugcau

SEQ ID NO: 77909 - RNA, 19 nt, Homo sapiens
uaugcaacuuauagugcug

SEQ ID NO: 77910 - RNA, 22 nt, Homo sapiens
uaugcacacguguccaugugca

SEQ ID NO: 77911 - RNA, 22 nt, Homo sapiens
uaugcacaugcaugcuugaaua

SEQ ID NO: 77912 - RNA, 22 nt, Homo sapiens
uaugcagacauuguuccaacca

SEQ ID NO: 77913 - RNA, 22 nt, Homo sapiens
uaugccucuucauaaaguauga

SEQ ID NO: 77914 - RNA, 22 nt, Homo sapiens
uaugccuuugaccauuuuguga

SEQ ID NO: 77915 - RNA, 22 nt, Homo sapiens
uaugccuuuugguucaagcaac

SEQ ID NO: 77916 - RNA, 22 nt, Homo sapiens
uaugcuuauuaaaacagugugu

SEQ ID NO: 77917 - RNA, 22 nt, Homo sapiens
uauggaaaucuuaccuuauggu

SEQ ID NO: 77918 - RNA, 22 nt, Homo sapiens
uauggacuuuaggauagcuuuu

SEQ ID NO: 77919 - RNA, 22 nt, Homo sapiens
uauggauauuacuccacaaaga

SEQ ID NO: 77920 - RNA, 22 nt, Homo sapiens
uauggauguuaagguucacagc

SEQ ID NO: 77921 - RNA, 22 nt, Homo sapiens
uauggauucuagcucaguaggu

SEQ ID NO: 77922 - RNA, 22 nt, Homo sapiens
uauggauuugcauuccccaugu

SEQ ID NO: 77923 - RNA, 21 nt, Homo sapiens
uauggauuugccuauucugga

SEQ ID NO: 77924 - RNA, 22 nt, Homo sapiens
uauggccacugucuuugaguca

SEQ ID NO: 77925 - RNA, 22 nt, Homo sapiens
uauggccccuacaugugcaaaa

SEQ ID NO: 77926 - RNA, 22 nt, Homo sapiens
uauggcugugacuuaucuuguu

SEQ ID NO: 77927 - RNA, 21 nt, Homo sapiens
uauggcuuagucaguguuucc

SEQ ID NO: 77928 - RNA, 22 nt, Homo sapiens
uauggcuucuuuaaauugaggu

SEQ ID NO: 77929 - RNA, 22 nt, Homo sapiens
uauggcuuuguucaacagccuc

SEQ ID NO: 77930 - RNA, 22 nt, Homo sapiens
uauggcuuuuaacugucguaug

SEQ ID NO: 77931 - RNA, 22 nt, Homo sapiens
uauggguaguacaaaguguaua

SEQ ID NO: 77932 - RNA, 22 nt, Homo sapiens
uaugggucuuaaaucacuuagu

SEQ ID NO: 77933 - RNA, 22 nt, Homo sapiens
uaugguuuuggaauccugcaga

SEQ ID NO: 77934 - RNA, 22 nt, Homo sapiens
uaugucuauuauguagcaggaa

SEQ ID NO: 77935 - RNA, 22 nt, Homo sapiens
uaugugcaaauuaauugcuaga

SEQ ID NO: 77936 - RNA, 18 nt, Homo sapiens
uauuaagcuagauauuau

SEQ ID NO: 77937 - RNA, 22 nt, Homo sapiens
uauuaagcuaguugucagugcu

SEQ ID NO: 77938 - RNA, 22 nt, Homo sapiens
ucucauggagguagagaguaaa

SEQ ID NO: 77939 - RNA, 23 nt, Homo sapiens
ucucauuccuugaaaauaaugac

SEQ ID NO: 77940 - RNA, 22 nt, Homo sapiens
ucucauugauucuggggugaug

SEQ ID NO: 77941 - RNA, 22 nt, Homo sapiens
ucuccaguuuccuucgucuauc

SEQ ID NO: 77942 - RNA, 22 nt, Homo sapiens
ucuccggguggcggcgaaggga

SEQ ID NO: 77943 - RNA, 22 nt, Homo sapiens
ucucugauuaaacaagauagug

SEQ ID NO: 77944 - RNA, 22 nt, Homo sapiens
ucucuggauaucuacuuauguu

SEQ ID NO: 77945 - RNA, 22 nt, Homo sapiens
ucucugguuuucaaagcaguau

SEQ ID NO: 77946 - RNA, 22 nt, Homo sapiens
ucucuuggcggaaguugcagug

SEQ ID NO: 77947 - RNA, 22 nt, Homo sapiens
ucugaaucguucccaugcagga

SEQ ID NO: 77948 - RNA, 22 nt, Homo sapiens
ucugacagugugaauauugacu

SEQ ID NO: 77949 - RNA, 22 nt, Homo sapiens
ucugagaucaugucugugcugu

SEQ ID NO: 77950 - RNA, 22 nt, Homo sapiens
ucugagguaggugcauggauac

SEQ ID NO: 77951 - RNA, 22 nt, Homo sapiens
ucugagguuaaauuuuauaguu

SEQ ID NO: 77952 - RNA, 22 nt, Homo sapiens
ucugcauaucaugcagaacuau

SEQ ID NO: 77953 - RNA, 22 nt, Homo sapiens
ucugccuacugagcacacagug

SEQ ID NO: 77954 - RNA, 22 nt, Homo sapiens
ucuggaauguaaaguuuauggg

SEQ ID NO: 77955 - RNA, 22 nt, Homo sapiens
ucuggauuuuugaggcaauaua

SEQ ID NO: 77956 - RNA, 22 nt, Homo sapiens
ucuggccuacaaguaauuuuau

SEQ ID NO: 77957 - RNA, 22 nt, Homo sapiens
ucuggccuacaucauuuuuccg

SEQ ID NO: 77958 - RNA, 22 nt, Homo sapiens
ucuggccuagaacaauuaauua

SEQ ID NO: 77959 - RNA, 22 nt, Homo sapiens
ucuggccuccuaugagaaucga

SEQ ID NO: 77960 - RNA, 16 nt, Homo sapiens
ucuggcucuacaguuc

SEQ ID NO: 77961 - RNA, 21 nt, Homo sapiens
ucuggcuuucauuccccuucu

SEQ ID NO: 77962 - RNA, 22 nt, Homo sapiens
ucugggguuagucaaagguaug

SEQ ID NO: 77963 - RNA, 20 nt, Homo sapiens
ucuggguuuuggccacgccc

SEQ ID NO: 77964 - RNA, 22 nt, Homo sapiens
ucuggguuuuguaccgugcucg

SEQ ID NO: 77965 - RNA, 22 nt, Homo sapiens
ucuggguuuuuccauugccggu

SEQ ID NO: 77966 - RNA, 22 nt, Homo sapiens
ucuguacuccuugaguagugcu

SEQ ID NO: 77967 - RNA, 19 nt, Homo sapiens
ucugucacuggggguauuc

SEQ ID NO: 77968 - RNA, 22 nt, Homo sapiens
ucugugcauggcagaggaauga

SEQ ID NO: 77969 - RNA, 22 nt, Homo sapiens
ucugugcauuguaggauguuua

SEQ ID NO: 77970 - RNA, 22 nt, Homo sapiens
ucugugcggucuguguuaugaa

SEQ ID NO: 77971 - RNA, 22 nt, Homo sapiens
ucugugcugagaguugaaaguu

SEQ ID NO: 77972 - RNA, 22 nt, Homo sapiens
ucuguggucagaguccuuggcc

SEQ ID NO: 77973 - RNA, 22 nt, Homo sapiens
ucuguggugggcuccacccagu

SEQ ID NO: 77974 - RNA, 22 nt, Homo sapiens
ucugugguucuagcuacuuugg

SEQ ID NO: 77975 - RNA, 22 nt, Homo sapiens
ucuguguuugaucaagauugua

SEQ ID NO: 77976 - RNA, 22 nt, Homo sapiens
ucuuaggugaugauugauguga

SEQ ID NO: 77977 - RNA, 22 nt, Homo sapiens
ucuuaggugggccaucacccca

SEQ ID NO: 77978 - RNA, 22 nt, Homo sapiens
ucuuauuuggggaaaggguccu

SEQ ID NO: 77979 - RNA, 17 nt, Homo sapiens
ucuucuguuacuguggc

SEQ ID NO: 77980 - RNA, 22 nt, Homo sapiens
ucuugcacaaauuauuuuaacu

SEQ ID NO: 77981 - RNA, 22 nt, Homo sapiens
ucuugcaccuacaugcuuuguc

SEQ ID NO: 77982 - RNA, 20 nt, Homo sapiens
ucuugggaauguagccuagg

SEQ ID NO: 77983 - RNA, 22 nt, Homo sapiens
ucuugggugaguuugugaauaa

SEQ ID NO: 77984 - RNA, 22 nt, Homo sapiens
ucuugguugaaaauucauaaua

SEQ ID NO: 77985 - RNA, 22 nt, Homo sapiens
ucuugguuuauugauggagagg

SEQ ID NO: 77986 - RNA, 22 nt, Homo sapiens
ucuugucacugcauccccagcu

SEQ ID NO: 77987 - RNA, 22 nt, Homo sapiens
ucuuuagugacaguugugcaag

SEQ ID NO: 77988 - RNA, 20 nt, Homo sapiens
ucuuucgguuaccaggcagu

SEQ ID NO: 77989 - RNA, 22 nt, Homo sapiens
ucuuugauaagauccagaagaa

SEQ ID NO: 77990 - RNA, 22 nt, Homo sapiens
ucuuugauguucugaaagaugg

SEQ ID NO: 77991 - RNA, 22 nt, Homo sapiens
ucuuuggagacaaccccagucu

SEQ ID NO: 77992 - RNA, 23 nt, Homo sapiens
ucuuuggcucuaauauaccuugu

SEQ ID NO: 77993 - RNA, 22 nt, Homo sapiens
ucagugaacgaggaggagggug

SEQ ID NO: 77994 - RNA, 20 nt, Homo sapiens
ucagugauugguuuaguuau

SEQ ID NO: 77995 - RNA, 22 nt, Homo sapiens
ucagugcuguuugcccucguuu

SEQ ID NO: 77996 - RNA, 22 nt, Homo sapiens
ucagugcuuggcacagagagcu

SEQ ID NO: 77997 - RNA, 22 nt, Homo sapiens
ucaguggagcuacaauucuggg

SEQ ID NO: 77998 - RNA, 22 nt, Homo sapiens
ucaguggauuauuaaagucacc

SEQ ID NO: 77999 - RNA, 22 nt, Homo sapiens
ucaguucauggaggugucugcu

SEQ ID NO: 78000 - RNA, 18 nt, Homo sapiens
ucauagaucaugacagug

SEQ ID NO: 78001 - RNA, 20 nt, Homo sapiens
ucauagcuuuuuccacuuua

SEQ ID NO: 78002 - RNA, 20 nt, Homo sapiens
ucauagggugguggcagugg

SEQ ID NO: 78003 - RNA, 22 nt, Homo sapiens
ucauaguacuuuguuuugaaaa

SEQ ID NO: 78004 - RNA, 19 nt, Homo sapiens
ucauagucuaagaugagaa

SEQ ID NO: 78005 - RNA, 21 nt, Homo sapiens
ucauauguaucuuugugccuc

SEQ ID NO: 78006 - RNA, 22 nt, Homo sapiens
ucauauguaugugcaauuuugu

SEQ ID NO: 78007 - RNA, 22 nt, Homo sapiens
ucauaugucauaguaugaucuu

SEQ ID NO: 78008 - RNA, 23 nt, Homo sapiens
ucaucacagcauuuccugguauu

SEQ ID NO: 78009 - RNA, 20 nt, Homo sapiens
ucaucaguuggugcucgcug

SEQ ID NO: 78010 - RNA, 22 nt, Homo sapiens
ucaugaaguaguuaacugguug

SEQ ID NO: 78011 - RNA, 22 nt, Homo sapiens
ucaugacacagcauacugacuu

SEQ ID NO: 78012 - RNA, 22 nt, Homo sapiens
ucaugcaaugcaaggggaaauu

SEQ ID NO: 78013 - RNA, 22 nt, Homo sapiens
ucauggcacugaugagaguuuc

SEQ ID NO: 78014 - RNA, 22 nt, Homo sapiens
ucauggcuuuuauuauguugag

SEQ ID NO: 78015 - RNA, 22 nt, Homo sapiens
ucauggggugagcuacaggcac

SEQ ID NO: 78016 - RNA, 22 nt, Homo sapiens
ucaugugagcacagagcaagau

SEQ ID NO: 78017 - RNA, 22 nt, Homo sapiens
ucauguguugcacugaggaccu

SEQ ID NO: 78018 - RNA, 22 nt, Homo sapiens
ucauuagagacagggugucacu

SEQ ID NO: 78019 - RNA, 22 nt, Homo sapiens
ucauucauucauccagcuugag

SEQ ID NO: 78020 - RNA, 22 nt, Homo sapiens
ucauugagacuuguuuuguggc

SEQ ID NO: 78021 - RNA, 22 nt, Homo sapiens
ucauugcacuccagccugggug

SEQ ID NO: 78022 - RNA, 22 nt, Homo sapiens
uggaauuaauccuccugguuuc

SEQ ID NO: 78023 - RNA, 21 nt, Homo sapiens
uggaauuaauggagagguguu

SEQ ID NO: 78024 - RNA, 22 nt, Homo sapiens
uggacagaaacauguuuucagu

SEQ ID NO: 78025 - RNA, 22 nt, Homo sapiens
uggacagacaagguuauagauc

SEQ ID NO: 78026 - RNA, 22 nt, Homo sapiens
uggacaugaagggcacaggagg

SEQ ID NO: 78027 - RNA, 20 nt, Homo sapiens
uggaccagagagguggggac

SEQ ID NO: 78028 - RNA, 21 nt, Homo sapiens
uggaccccuacuucucaccau

SEQ ID NO: 78029 - RNA, 21 nt, Homo sapiens
uggaccccuuccuugcaccau

SEQ ID NO: 78030 - RNA, 21 nt, Homo sapiens
uggaccccuuucuuacaccgu

SEQ ID NO: 78031 - RNA, 22 nt, Homo sapiens
uggacuagagggugggcgaggu

SEQ ID NO: 78032 - RNA, 22 nt, Homo sapiens
uggacuguaaauuggggacucu

SEQ ID NO: 78033 - RNA, 22 nt, Homo sapiens
uggagacugaucccucuuuccu

SEQ ID NO: 78034 - RNA, 22 nt, Homo sapiens
uggagagcaaaaucaauccaaa

SEQ ID NO: 78035 - RNA, 22 nt, Homo sapiens
uggagagugagggccuccuuaa

SEQ ID NO: 78036 - RNA, 22 nt, Homo sapiens
uggagcaaaguugaggccaagc

SEQ ID NO: 78037 - RNA, 22 nt, Homo sapiens
uggagguagggccuaggaaucu

SEQ ID NO: 78038 - RNA, 22 nt, Homo sapiens
uggagguaggugauauguagca

SEQ ID NO: 78039 - RNA, 20 nt, Homo sapiens
uggaggucaucugucacuac

SEQ ID NO: 78040 - RNA, 22 nt, Homo sapiens
uggaguaggccuaagaaugaca

SEQ ID NO: 78041 - RNA, 19 nt, Homo sapiens
uggagucaucaugcugcua

SEQ ID NO: 78042 - RNA, 22 nt, Homo sapiens
uggagucgugcccuugcauuua

SEQ ID NO: 78043 - RNA, 22 nt, Homo sapiens
uggagugcaauggcaccaucuu

SEQ ID NO: 78044 - RNA, 22 nt, Homo sapiens
uggagugcaauggugagaucuu

SEQ ID NO: 78045 - RNA, 22 nt, Homo sapiens
uggagugcgugucugaguuuuu

SEQ ID NO: 78046 - RNA, 16 nt, Homo sapiens
uggaguguuuguuaga

SEQ ID NO: 78047 - RNA, 22 nt, Homo sapiens
uggauagaacuaagugcuuaga

SEQ ID NO: 78048 - RNA, 22 nt, Homo sapiens
uggauagauacuauccaggacu

SEQ ID NO: 78049 - RNA, 22 nt, Homo sapiens
uggauaguaauaaacauauagg

SEQ ID NO: 78050 - RNA, 22 nt, Homo sapiens
uggauagugauaagguagauga

SEQ ID NO: 78051 - RNA, 18 nt, Homo sapiens
uggauaugaaauucugga

SEQ ID NO: 78052 - RNA, 22 nt, Homo sapiens
uggauauguucuuuguguaagg

SEQ ID NO: 78053 - RNA, 22 nt, Homo sapiens
uggaucaugcgaggccuccccu

SEQ ID NO: 78054 - RNA, 22 nt, Homo sapiens
uggaugaagagaugguaguugc

SEQ ID NO: 78055 - RNA, 22 nt, Homo sapiens
uggaugacauccuuguaugcag

SEQ ID NO: 78056 - RNA, 21 nt, Homo sapiens
uggaugccuaggcagaaguuu

SEQ ID NO: 78057 - RNA, 22 nt, Homo sapiens
uggauggagaggcuugugaugc

SEQ ID NO: 78058 - RNA, 22 nt, Homo sapiens
uggauggucagaggguuucugu

SEQ ID NO: 78059 - RNA, 22 nt, Homo sapiens
uggauugagaagcuguggcuca

SEQ ID NO: 78060 - RNA, 18 nt, Homo sapiens
uggauuggaaaaguuccu

SEQ ID NO: 78061 - RNA, 22 nt, Homo sapiens
uggauuguaacauagaguaaau

SEQ ID NO: 78062 - RNA, 21 nt, Homo sapiens
uggauuguacacccuaucauu

SEQ ID NO: 78063 - RNA, 18 nt, Homo sapiens
uggauuguacuguguucu

SEQ ID NO: 78064 - RNA, 21 nt, Homo sapiens
uggcaaaaugggcaguggguu

SEQ ID NO: 78065 - RNA, 22 nt, Homo sapiens
uggcaaagugugacgugggggu

SEQ ID NO: 78066 - RNA, 22 nt, Homo sapiens
uggcaaaugaagucagcuguac

SEQ ID NO: 78067 - RNA, 22 nt, Homo sapiens
uggcaaauuccaaaguuaauuc

SEQ ID NO: 78068 - RNA, 22 nt, Homo sapiens
uggcaagaaggauuuauuccuu

SEQ ID NO: 78069 - RNA, 23 nt, Homo sapiens
uggcaagaauucuuaccgugugg

SEQ ID NO: 78070 - RNA, 22 nt, Homo sapiens
uggcaagagcugcauucaucug

SEQ ID NO: 78071 - RNA, 22 nt, Homo sapiens
uggcaagaucacaauuacuuuu

SEQ ID NO: 78072 - RNA, 20 nt, Homo sapiens
uggcaagauggcagaauaga

SEQ ID NO: 78073 - RNA, 22 nt, Homo sapiens
uggcaagcaggacuaaagcacc

SEQ ID NO: 78074 - RNA, 22 nt, Homo sapiens
uggcaagcuuuaauugacucuu

SEQ ID NO: 78075 - RNA, 22 nt, Homo sapiens
uggcaauaaggacuccuuaggu

SEQ ID NO: 78076 - RNA, 22 nt, Homo sapiens
uggcaauauccacaauuacuuu

SEQ ID NO: 78077 - RNA, 19 nt, Homo sapiens
uggcaaugucagcagagau

SEQ ID NO: 78078 - RNA, 22 nt, Homo sapiens
uggcaauguggaaugguccagg

SEQ ID NO: 78079 - RNA, 19 nt, Homo sapiens
uggcacauguauacuuaug

SEQ ID NO: 78080 - RNA, 22 nt, Homo sapiens
uggcaccauccaggugucucua

SEQ ID NO: 78081 - RNA, 20 nt, Homo sapiens
uggcaccugacagauagcca

SEQ ID NO: 78082 - RNA, 22 nt, Homo sapiens
uggcacuaugugacaagguuuu

SEQ ID NO: 78083 - RNA, 19 nt, Homo sapiens
uggcacuugacguccggau

SEQ ID NO: 78084 - RNA, 22 nt, Homo sapiens
uggcagcgcaguugaaaaagaa

SEQ ID NO: 78085 - RNA, 22 nt, Homo sapiens
uggcagcugcuucaugggaugc

SEQ ID NO: 78086 - RNA, 22 nt, Homo sapiens
uggcaguuuacaaaugccauga

SEQ ID NO: 78087 - RNA, 22 nt, Homo sapiens
uggcauaugguauuugauaucu

SEQ ID NO: 78088 - RNA, 22 nt, Homo sapiens
uggcauggggcagaacauuaca

SEQ ID NO: 78089 - RNA, 22 nt, Homo sapiens
ucucaauuugauuacauucaua

SEQ ID NO: 78090 - RNA, 22 nt, Homo sapiens
ucucagagccuaggguuuuuca

SEQ ID NO: 78091 - RNA, 22 nt, Homo sapiens
ucucagugaauguggaaaaagc

SEQ ID NO: 78092 - RNA, 22 nt, Homo sapiens
ucucagugaauugguuuugucu

SEQ ID NO: 78093 - RNA, 22 nt, Homo sapiens
ucucaugaagguggagaguagg

SEQ ID NO: 78094 - RNA, 20 nt, Homo sapiens
ucucauggagggaaagagca

SEQ ID NO: 78095 - RNA, 20 nt, Homo sapiens
ucucauggagguagagaaua

SEQ ID NO: 78096 - RNA, 20 nt, Homo sapiens
ucucccaaacagcaggcccu

SEQ ID NO: 78097 - RNA, 22 nt, Homo sapiens
ucucccauccguacacggauug

SEQ ID NO: 78098 - RNA, 22 nt, Homo sapiens
ucucccuaccugagccgagcca

SEQ ID NO: 78099 - RNA, 21 nt, Homo sapiens
ucucucaaccaggaagugggc

SEQ ID NO: 78100 - RNA, 22 nt, Homo sapiens
ucucugacacugaccccaaaaa

SEQ ID NO: 78101 - RNA, 22 nt, Homo sapiens
ucucugauuauugcauuucauu

SEQ ID NO: 78102 - RNA, 19 nt, Homo sapiens
ucucugguguuggagggga

SEQ ID NO: 78103 - RNA, 22 nt, Homo sapiens
ucucuguuuauuuuugguguau

SEQ ID NO: 78104 - RNA, 22 nt, Homo sapiens
ucugacacuucugcagaauuga

SEQ ID NO: 78105 - RNA, 22 nt, Homo sapiens
ucugacucuggagucucagguu

SEQ ID NO: 78106 - RNA, 22 nt, Homo sapiens
ucugagguuacugcuuuguaga

SEQ ID NO: 78107 - RNA, 22 nt, Homo sapiens
ucugagucaucacaaaugaugc

SEQ ID NO: 78108 - RNA, 23 nt, Homo sapiens
ucugauguuauaaaauucuuugg

SEQ ID NO: 78109 - RNA, 20 nt, Homo sapiens
ucugauugcaacugcaugag

SEQ ID NO: 78110 - RNA, 22 nt, Homo sapiens
ucugccacugucauugugugau

SEQ ID NO: 78111 - RNA, 22 nt, Homo sapiens
ucuggagugugaaguggauaug

SEQ ID NO: 78112 - RNA, 22 nt, Homo sapiens
ucuggcauuuucucugcuugca

SEQ ID NO: 78113 - RNA, 20 nt, Homo sapiens
ucuggccccuccaaaucuca

SEQ ID NO: 78114 - RNA, 21 nt, Homo sapiens
ucuggccccuccaaaucucau

SEQ ID NO: 78115 - RNA, 22 nt, Homo sapiens
gucucacagcuagcugcuuuau

SEQ ID NO: 78116 - RNA, 18 nt, Homo sapiens
gucucacaugguggaagc

SEQ ID NO: 78117 - RNA, 22 nt, Homo sapiens
gucucccagccuacaucuuucu

SEQ ID NO: 78118 - RNA, 22 nt, Homo sapiens
gucucuugguuuagagcauuua

SEQ ID NO: 78119 - RNA, 22 nt, Homo sapiens
gucugagcauggggccggcagg

SEQ ID NO: 78120 - RNA, 22 nt, Homo sapiens
gucugguacuuguuuguaaggg

SEQ ID NO: 78121 - RNA, 21 nt, Homo sapiens
gucugguguuuuaaugaggac

SEQ ID NO: 78122 - RNA, 22 nt, Homo sapiens
gucugguuccugggagauuucu

SEQ ID NO: 78123 - RNA, 22 nt, Homo sapiens
gucugguuggaguaguuuucag

SEQ ID NO: 78124 - RNA, 22 nt, Homo sapiens
gucugugcauuaauacgugcug

SEQ ID NO: 78125 - RNA, 22 nt, Homo sapiens
gucuuagguuuaaucacuucua

SEQ ID NO: 78126 - RNA, 22 nt, Homo sapiens
gucuugcacuuaccuaagaacu

SEQ ID NO: 78127 - RNA, 20 nt, Homo sapiens
gucuugcuccguugcccagg

SEQ ID NO: 78128 - RNA, 22 nt, Homo sapiens
gucuuggagacauugccauuga

SEQ ID NO: 78129 - RNA, 22 nt, Homo sapiens
gucuuuggaaaaaaugucuguu

SEQ ID NO: 78130 - RNA, 22 nt, Homo sapiens
gucuuuguuauuaugaaucaac

SEQ ID NO: 78131 - RNA, 22 nt, Homo sapiens
gugaaauguguagaggaucugg

SEQ ID NO: 78132 - RNA, 22 nt, Homo sapiens
gugaacagaaccugggaucgaa

SEQ ID NO: 78133 - RNA, 20 nt, Homo sapiens
gugaauacauuugguuucau

SEQ ID NO: 78134 - RNA, 22 nt, Homo sapiens
gugacacagcaagacuccgucu

SEQ ID NO: 78135 - RNA, 22 nt, Homo sapiens
gugacagaguaagacccuguau

SEQ ID NO: 78136 - RNA, 22 nt, Homo sapiens
gugacgucauuguuccuggcuc

SEQ ID NO: 78137 - RNA, 22 nt, Homo sapiens
gugacuaagauucuuugauaug

SEQ ID NO: 78138 - RNA, 22 nt, Homo sapiens
gugacugcauauaaguguaugu

SEQ ID NO: 78139 - RNA, 22 nt, Homo sapiens
gugacugggaguggugaagaua

SEQ ID NO: 78140 - RNA, 22 nt, Homo sapiens
gugagaagaaaaauauggcugu

SEQ ID NO: 78141 - RNA, 22 nt, Homo sapiens
gugagaccaauguacuaccuuc

SEQ ID NO: 78142 - RNA, 22 nt, Homo sapiens
gugagaggaggcagcuuuuaca

SEQ ID NO: 78143 - RNA, 22 nt, Homo sapiens
gugagauaaugucucauugugg

SEQ ID NO: 78144 - RNA, 22 nt, Homo sapiens
gugagauacuagagauauagug

SEQ ID NO: 78145 - RNA, 22 nt, Homo sapiens
gugagauaucuagacuagggaa

SEQ ID NO: 78146 - RNA, 22 nt, Homo sapiens
gugagauuaccauuuaaaucag

SEQ ID NO: 78147 - RNA, 22 nt, Homo sapiens
gugagcaguguccuugggggca

SEQ ID NO: 78148 - RNA, 22 nt, Homo sapiens
gugagccaugauuuuaccacug

SEQ ID NO: 78149 - RNA, 22 nt, Homo sapiens
gugaggcacugcugcuuuccag

SEQ ID NO: 78150 - RNA, 22 nt, Homo sapiens
gugaggcugguccugccuccca

SEQ ID NO: 78151 - RNA, 22 nt, Homo sapiens
gugaggcuuuuccuguuagacu

SEQ ID NO: 78152 - RNA, 22 nt, Homo sapiens
gugagggagcuggaauauuuau

SEQ ID NO: 78153 - RNA, 22 nt, Homo sapiens
gugagggaugugaaaaagguca

SEQ ID NO: 78154 - RNA, 20 nt, Homo sapiens
gugagguagaggguuaccug

SEQ ID NO: 78155 - RNA, 22 nt, Homo sapiens
gugagucagucuguguagggcu

SEQ ID NO: 78156 - RNA, 20 nt, Homo sapiens
gugagucauuaguaaccaaa

SEQ ID NO: 78157 - RNA, 22 nt, Homo sapiens
gugaguuauuauuuauguaaac

SEQ ID NO: 78158 - RNA, 22 nt, Homo sapiens
gugauacugcuuauuaauuuaa

SEQ ID NO: 78159 - RNA, 22 nt, Homo sapiens
gugauagaucugggauucagaa

SEQ ID NO: 78160 - RNA, 22 nt, Homo sapiens
gugauaucuuacaauucucuuu

SEQ ID NO: 78161 - RNA, 22 nt, Homo sapiens
gugaucucauuuggaauuagag

SEQ ID NO: 78162 - RNA, 22 nt, Homo sapiens
gugauugcauuaugaauauuau

SEQ ID NO: 78163 - RNA, 22 nt, Homo sapiens
gugauugucuaaucaagauaca

SEQ ID NO: 78164 - RNA, 22 nt, Homo sapiens
uagauucauuuuagcaaaaguu

SEQ ID NO: 78165 - RNA, 22 nt, Homo sapiens
uagcacagugucauucuaggua

SEQ ID NO: 78166 - RNA, 22 nt, Homo sapiens
uagcacaguucacccucgauuu

SEQ ID NO: 78167 - RNA, 20 nt, Homo sapiens
uagcacaucuggcuguagag

SEQ ID NO: 78168 - RNA, 22 nt, Homo sapiens
uagcacaucuucuuggccugca

SEQ ID NO: 78169 - RNA, 22 nt, Homo sapiens
uagcaccaaacauauacucagu

SEQ ID NO: 78170 - RNA, 22 nt, Homo sapiens
uagcaccacaaucaagauacag

SEQ ID NO: 78171 - RNA, 22 nt, Homo sapiens
uagcaccaggguugacugaccu

SEQ ID NO: 78172 - RNA, 22 nt, Homo sapiens
uagcaccuuagcauuucuagug

SEQ ID NO: 78173 - RNA, 22 nt, Homo sapiens
uagcacuauguuaucacauacu

SEQ ID NO: 78174 - RNA, 18 nt, Homo sapiens
uagcagacaucauugggg

SEQ ID NO: 78175 - RNA, 22 nt, Homo sapiens
uagcagcauuuuuguagaguau

SEQ ID NO: 78176 - RNA, 22 nt, Homo sapiens
uagcagcuuuauugagguaaau

SEQ ID NO: 78177 - RNA, 22 nt, Homo sapiens
uagcaguagacagacuuuggcu

SEQ ID NO: 78178 - RNA, 22 nt, Homo sapiens
uagcauaauuuguagaaaauca

SEQ ID NO: 78179 - RNA, 21 nt, Homo sapiens
uagcauacauuuugcaucuua

SEQ ID NO: 78180 - RNA, 22 nt, Homo sapiens
uagcccagugagguugauuugg

SEQ ID NO: 78181 - RNA, 22 nt, Homo sapiens
uagccgggugugguggaacucc

SEQ ID NO: 78182 - RNA, 22 nt, Homo sapiens
uagccuguggugaauguuucug

SEQ ID NO: 78183 - RNA, 22 nt, Homo sapiens
uagcuaaauucagcucuaggua

SEQ ID NO: 78184 - RNA, 19 nt, Homo sapiens
uagcuagauuggguacuua

SEQ ID NO: 78185 - RNA, 22 nt, Homo sapiens
uagcuccagugggguuacugcu

SEQ ID NO: 78186 - RNA, 17 nt, Homo sapiens
uagcucuauuucuagcc

SEQ ID NO: 78187 - RNA, 22 nt, Homo sapiens
uagcugcauccugugcacucaa

SEQ ID NO: 78188 - RNA, 22 nt, Homo sapiens
uagcugguucuccaggagcuag

SEQ ID NO: 78189 - RNA, 22 nt, Homo sapiens
uagcuucuccauagcuccaugu

SEQ ID NO: 78190 - RNA, 23 nt, Homo sapiens
uagcuucucccagaccugcuccc

SEQ ID NO: 78191 - RNA, 22 nt, Homo sapiens
uaggacaaugguacagcagaaa

SEQ ID NO: 78192 - RNA, 22 nt, Homo sapiens
uaggagcacaaaccccauugug

SEQ ID NO: 78193 - RNA, 22 nt, Homo sapiens
uaggagcacagcagcauguggg

SEQ ID NO: 78194 - RNA, 22 nt, Homo sapiens
uaggagugugaacccuaugaac

SEQ ID NO: 78195 - RNA, 22 nt, Homo sapiens
uaggagugugaacccuguuuug

SEQ ID NO: 78196 - RNA, 22 nt, Homo sapiens
uaggcaauguggcgaaacucug

SEQ ID NO: 78197 - RNA, 22 nt, Homo sapiens
uaggcacugagaauaugaggau

SEQ ID NO: 78198 - RNA, 22 nt, Homo sapiens
uaggcaguguucucacuuguaa

SEQ ID NO: 78199 - RNA, 22 nt, Homo sapiens
uaggcaguuuuccuuucacagu

SEQ ID NO: 78200 - RNA, 22 nt, Homo sapiens
uaggcauuuuucugauaaacua

SEQ ID NO: 78201 - RNA, 22 nt, Homo sapiens
uagggaguguccuuucgggaaa

SEQ ID NO: 78202 - RNA, 22 nt, Homo sapiens
uagggcaaggaacaguuaaaaa

SEQ ID NO: 78203 - RNA, 19 nt, Homo sapiens
uagggcacgaggcagaguc

SEQ ID NO: 78204 - RNA, 22 nt, Homo sapiens
uagggcauguguggaguguaug

SEQ ID NO: 78205 - RNA, 22 nt, Homo sapiens
uagggcauuuagaggcuauuaa

SEQ ID NO: 78206 - RNA, 22 nt, Homo sapiens
uaggguaguaauaguuguuuca

SEQ ID NO: 78207 - RNA, 19 nt, Homo sapiens
uagguacauucaagucucc

SEQ ID NO: 78208 - RNA, 22 nt, Homo sapiens
uagguagaaucuugaagccauu

SEQ ID NO: 78209 - RNA, 22 nt, Homo sapiens
ucaguggauuuaaccugaauca

SEQ ID NO: 78210 - RNA, 22 nt, Homo sapiens
ucagugucaucuggguuguuug

SEQ ID NO: 78211 - RNA, 23 nt, Homo sapiens
ucagugucuggauccugcucagu

SEQ ID NO: 78212 - RNA, 22 nt, Homo sapiens
ucagugucugugauggagaggu

SEQ ID NO: 78213 - RNA, 22 nt, Homo sapiens
ucagugucugugcaccgcugga

SEQ ID NO: 78214 - RNA, 22 nt, Homo sapiens
ucaguuaaugcugccugcugga

SEQ ID NO: 78215 - RNA, 22 nt, Homo sapiens
ucaguuuagguguaacggccac

SEQ ID NO: 78216 - RNA, 22 nt, Homo sapiens
ucaguuuguauuucagguugca

SEQ ID NO: 78217 - RNA, 22 nt, Homo sapiens
ucauaaaguuguuuuaauggga

SEQ ID NO: 78218 - RNA, 22 nt, Homo sapiens
ucauacaguaguccucacuugu

SEQ ID NO: 78219 - RNA, 22 nt, Homo sapiens
ucauaguagucacuuaauaaau

SEQ ID NO: 78220 - RNA, 22 nt, Homo sapiens
ucauauugguuaaaauaguggg

SEQ ID NO: 78221 - RNA, 22 nt, Homo sapiens
ucaucagguaugucagcggagu

SEQ ID NO: 78222 - RNA, 21 nt, Homo sapiens
ucaucagucaaagacaauggu

SEQ ID NO: 78223 - RNA, 22 nt, Homo sapiens
ucaucagugcuugcaaauuauu

SEQ ID NO: 78224 - RNA, 22 nt, Homo sapiens
ucaugacacuggcaggagcuaa

SEQ ID NO: 78225 - RNA, 22 nt, Homo sapiens
ucaugcaucuuguggaauuuga

SEQ ID NO: 78226 - RNA, 21 nt, Homo sapiens
ucaugccacugcacuuuagcc

SEQ ID NO: 78227 - RNA, 22 nt, Homo sapiens
ucauguacuuguagucccggcu

SEQ ID NO: 78228 - RNA, 22 nt, Homo sapiens
ucauucauucuucaguggguac

SEQ ID NO: 78229 - RNA, 22 nt, Homo sapiens
ucauucuuucuguggaggggcu

SEQ ID NO: 78230 - RNA, 22 nt, Homo sapiens
ucauugcaaucucugccucccg

SEQ ID NO: 78231 - RNA, 22 nt, Homo sapiens
ucauuggauggaaugcucugua

SEQ ID NO: 78232 - RNA, 21 nt, Homo sapiens
ucauugggugcagcccacccu

SEQ ID NO: 78233 - RNA, 22 nt, Homo sapiens
uccaaaucucuggcacugggau

SEQ ID NO: 78234 - RNA, 19 nt, Homo sapiens
uccacagugguugaacuag

SEQ ID NO: 78235 - RNA, 22 nt, Homo sapiens
uccacagugguugaacuaguaa

SEQ ID NO: 78236 - RNA, 18 nt, Homo sapiens
uccacgugcuuuccagau

SEQ ID NO: 78237 - RNA, 22 nt, Homo sapiens
uccagaguggugaugcuggggc

SEQ ID NO: 78238 - RNA, 21 nt, Homo sapiens
uccagcuuugagaguuguggu

SEQ ID NO: 78239 - RNA, 22 nt, Homo sapiens
uccagguacucagggggcugag

SEQ ID NO: 78240 - RNA, 22 nt, Homo sapiens
uccagguuucaugcucuuuauu

SEQ ID NO: 78241 - RNA, 22 nt, Homo sapiens
uccaguagaauuuuauucaaca

SEQ ID NO: 78242 - RNA, 22 nt, Homo sapiens
uccaguggacagacauaccaug

SEQ ID NO: 78243 - RNA, 22 nt, Homo sapiens
uccaguguuucuuccacuauuu

SEQ ID NO: 78244 - RNA, 22 nt, Homo sapiens
uccaguuguuauuuuuauaaag

SEQ ID NO: 78245 - RNA, 22 nt, Homo sapiens
uccaguuuggaggcuugaugug

SEQ ID NO: 78246 - RNA, 18 nt, Homo sapiens
uccaguuuucccagcauc

SEQ ID NO: 78247 - RNA, 22 nt, Homo sapiens
uccauagacauuuuaagguagu

SEQ ID NO: 78248 - RNA, 22 nt, Homo sapiens
uccaugugaaaaggucgugaua

SEQ ID NO: 78249 - RNA, 22 nt, Homo sapiens
uccaugugaaaucuaugaggac

SEQ ID NO: 78250 - RNA, 18 nt, Homo sapiens
uccauugcagcauuauuu

SEQ ID NO: 78251 - RNA, 19 nt, Homo sapiens
ucccaagaugcucauacau

SEQ ID NO: 78252 - RNA, 19 nt, Homo sapiens
ucccaauguuuccaggcag

SEQ ID NO: 78253 - RNA, 20 nt, Homo sapiens
ucccaguaggagaaggaagg

SEQ ID NO: 78254 - RNA, 22 nt, Homo sapiens
ucccagugaaaccccaccuuca

SEQ ID NO: 78255 - RNA, 17 nt, Homo sapiens
ucccauguuucuucuac

SEQ ID NO: 78256 - RNA, 19 nt, Homo sapiens
uccccaguuuuccguucag

SEQ ID NO: 78257 - RNA, 22 nt, Homo sapiens
uccccgagcccaggcugugacu

SEQ ID NO: 78258 - RNA, 19 nt, Homo sapiens
uccccgggucuagugcagc

SEQ ID NO: 78259 - RNA, 22 nt, Homo sapiens
uccccugagaacuugcuagaaa

SEQ ID NO: 78260 - RNA, 17 nt, Homo sapiens
uaaagccagucaaguca

SEQ ID NO: 78261 - RNA, 16 nt, Homo sapiens
uaaagcuaaucacuuu

SEQ ID NO: 78262 - RNA, 22 nt, Homo sapiens
uaaagcuacagagcggaaaauu

SEQ ID NO: 78263 - RNA, 22 nt, Homo sapiens
uaaagcuaugagaacaccguag

SEQ ID NO: 78264 - RNA, 22 nt, Homo sapiens
uaaagcuuggauuuaggcuaau

SEQ ID NO: 78265 - RNA, 18 nt, Homo sapiens
uaaaggcacuguguuguu

SEQ ID NO: 78266 - RNA, 22 nt, Homo sapiens
uaaaguuauugccccucaguua

SEQ ID NO: 78267 - RNA, 22 nt, Homo sapiens
uaaaugcuuaauugaaugugga

SEQ ID NO: 78268 - RNA, 22 nt, Homo sapiens
uaacaacauucuaacugacggc

SEQ ID NO: 78269 - RNA, 22 nt, Homo sapiens
uaacacagagcuccuaaucccu

SEQ ID NO: 78270 - RNA, 22 nt, Homo sapiens
uaacacccuucuccagguacau

SEQ ID NO: 78271 - RNA, 22 nt, Homo sapiens
uaacaggcaaggucacaccuug

SEQ ID NO: 78272 - RNA, 22 nt, Homo sapiens
uaacaguauaugugguaucuau

SEQ ID NO: 78273 - RNA, 22 nt, Homo sapiens
uaacaguguauuccuuuggaca

SEQ ID NO: 78274 - RNA, 22 nt, Homo sapiens
uaacauugcuggacuaccugcu

SEQ ID NO: 78275 - RNA, 22 nt, Homo sapiens
uaacccacgcagaauggacaag

SEQ ID NO: 78276 - RNA, 21 nt, Homo sapiens
uaacccugaaggagcucugga

SEQ ID NO: 78277 - RNA, 22 nt, Homo sapiens
uaacccuuacaacuacacucgu

SEQ ID NO: 78278 - RNA, 22 nt, Homo sapiens
uaacuacuucugcuucagagua

SEQ ID NO: 78279 - RNA, 22 nt, Homo sapiens
uaacuccauuuggacucaguau

SEQ ID NO: 78280 - RNA, 22 nt, Homo sapiens
uaacuguggaaaugacuuuaaa

SEQ ID NO: 78281 - RNA, 22 nt, Homo sapiens
uaagacacauguguucccaggc

SEQ ID NO: 78282 - RNA, 22 nt, Homo sapiens
uaagagcuaggauuuuaaauca

SEQ ID NO: 78283 - RNA, 19 nt, Homo sapiens
uaagaugaagcugucuggg

SEQ ID NO: 78284 - RNA, 22 nt, Homo sapiens
uaagcagugcaagaauggaaua

SEQ ID NO: 78285 - RNA, 20 nt, Homo sapiens
uaagccacacagucuaaggu

SEQ ID NO: 78286 - RNA, 22 nt, Homo sapiens
uaagccuaggucugugcucuuc

SEQ ID NO: 78287 - RNA, 22 nt, Homo sapiens
uaagcuaauguguuuucucuua

SEQ ID NO: 78288 - RNA, 22 nt, Homo sapiens
uaagcuagcauagggguaaauu

SEQ ID NO: 78289 - RNA, 22 nt, Homo sapiens
uaaggaaccagaaguggguagc

SEQ ID NO: 78290 - RNA, 22 nt, Homo sapiens
uaaggaaggcugugugcuuuua

SEQ ID NO: 78291 - RNA, 22 nt, Homo sapiens
uaaggcaaaccuuggcugcagu

SEQ ID NO: 78292 - RNA, 22 nt, Homo sapiens
uaaggcacauaggccuggaaac

SEQ ID NO: 78293 - RNA, 22 nt, Homo sapiens
uaaggcccggccuuuccaagca

SEQ ID NO: 78294 - RNA, 22 nt, Homo sapiens
uaaggcuugaucuuggugagau

SEQ ID NO: 78295 - RNA, 22 nt, Homo sapiens
uaaggcuuugguagguuugguc

SEQ ID NO: 78296 - RNA, 22 nt, Homo sapiens
uaaggcuuuuguucagcguggg

SEQ ID NO: 78297 - RNA, 22 nt, Homo sapiens
uaagguuuuugauaugcugcug

SEQ ID NO: 78298 - RNA, 22 nt, Homo sapiens
uaaguaauugcagcaauuugcc

SEQ ID NO: 78299 - RNA, 22 nt, Homo sapiens
uaaguaauugugguuucugcca

SEQ ID NO: 78300 - RNA, 22 nt, Homo sapiens
uaaguacugucagaauuggacu

SEQ ID NO: 78301 - RNA, 22 nt, Homo sapiens
uaaguagaggaaucauuuugug

SEQ ID NO: 78302 - RNA, 22 nt, Homo sapiens
uaaguagugugcauguauguau

SEQ ID NO: 78303 - RNA, 22 nt, Homo sapiens
cccaguuuugccacuuacuagc

SEQ ID NO: 78304 - RNA, 22 nt, Homo sapiens
cccaguuuugcuucucaugagg

SEQ ID NO: 78305 - RNA, 22 nt, Homo sapiens
ccccaguguguaaaggccuugc

SEQ ID NO: 78306 - RNA, 22 nt, Homo sapiens
ccccauuguugugguuuuaucu

SEQ ID NO: 78307 - RNA, 22 nt, Homo sapiens
ccccugaaacucacucauuauc

SEQ ID NO: 78308 - RNA, 17 nt, Homo sapiens
ccccugagcgaugcagu

SEQ ID NO: 78309 - RNA, 20 nt, Homo sapiens
ccccuggaguggggcugcuu

SEQ ID NO: 78310 - RNA, 22 nt, Homo sapiens
ccccuguaaacuggcuucccug

SEQ ID NO: 78311 - RNA, 22 nt, Homo sapiens
cccgggcugaaaucagauuugu

SEQ ID NO: 78312 - RNA, 20 nt, Homo sapiens
cccuaagccagaugcugggg

SEQ ID NO: 78313 - RNA, 22 nt, Homo sapiens
cccugagaugugaauuucagag

SEQ ID NO: 78314 - RNA, 22 nt, Homo sapiens
cccuguguuuagcugaagguuu

SEQ ID NO: 78315 - RNA, 23 nt, Homo sapiens
ccgugagagaguucauagaaagc

SEQ ID NO: 78316 - RNA, 22 nt, Homo sapiens
ccuaggcacugggguccagccc

SEQ ID NO: 78317 - RNA, 22 nt, Homo sapiens
ccucauggagaaccucugcuag

SEQ ID NO: 78318 - RNA, 22 nt, Homo sapiens
ccucauugcuaucccaggcuga

SEQ ID NO: 78319 - RNA, 22 nt, Homo sapiens
ccucccuuuguugcaagggaaa

SEQ ID NO: 78320 - RNA, 21 nt, Homo sapiens
ccugaagaagugaccucugag

SEQ ID NO: 78321 - RNA, 22 nt, Homo sapiens
ccugagacugauugacucacaa

SEQ ID NO: 78322 - RNA, 21 nt, Homo sapiens
ccugauguucacuuggccuuc

SEQ ID NO: 78323 - RNA, 22 nt, Homo sapiens
ccuguagcauccaagaagcugc

SEQ ID NO: 78324 - RNA, 22 nt, Homo sapiens
ccuuggcacuacugacauugua

SEQ ID NO: 78325 - RNA, 22 nt, Homo sapiens
ccuuggcacuuugccacagugc

SEQ ID NO: 78326 - RNA, 19 nt, Homo sapiens
ccuugguuagguauauucc

SEQ ID NO: 78327 - RNA, 22 nt, Homo sapiens
cgcccuguagcuagcuagaggu

SEQ ID NO: 78328 - RNA, 22 nt, Homo sapiens
cggcaguggguaagccaagcuu

SEQ ID NO: 78329 - RNA, 22 nt, Homo sapiens
cggucacagugauucaaggguc

SEQ ID NO: 78330 - RNA, 22 nt, Homo sapiens
cggugcaaauguaauugcaguu

SEQ ID NO: 78331 - RNA, 22 nt, Homo sapiens
cgugaggaaaacagaggguguu

SEQ ID NO: 78332 - RNA, 22 nt, Homo sapiens
cuaaagucacgauuugugggua

SEQ ID NO: 78333 - RNA, 23 nt, Homo sapiens
cuaaagucugucacugaggacuu

SEQ ID NO: 78334 - RNA, 22 nt, Homo sapiens
cuaacacagagguuuauuucuc

SEQ ID NO: 78335 - RNA, 18 nt, Homo sapiens
cuaagacacuuggcagag

SEQ ID NO: 78336 - RNA, 21 nt, Homo sapiens
cuaaggaaagcuaugaacccu

SEQ ID NO: 78337 - RNA, 22 nt, Homo sapiens
cuaauucuggccaaagggauaa

SEQ ID NO: 78338 - RNA, 22 nt, Homo sapiens
cuacagcagcccaguccccgaa

SEQ ID NO: 78339 - RNA, 22 nt, Homo sapiens
cuacagguaugaaagggaguau

SEQ ID NO: 78340 - RNA, 23 nt, Homo sapiens
cuacagugccugucucuuuggcc

SEQ ID NO: 78341 - RNA, 21 nt, Homo sapiens
cuacccuguauuagagaaaga

SEQ ID NO: 78342 - RNA, 22 nt, Homo sapiens
cuacccuuaaguuucugugggg

SEQ ID NO: 78343 - RNA, 22 nt, Homo sapiens
cuaccuggguggcucaugacuu

SEQ ID NO: 78344 - RNA, 22 nt, Homo sapiens
cuacuauguagagauauugaau

SEQ ID NO: 78345 - RNA, 22 nt, Homo sapiens
cuacugacacuacugcaaucau

SEQ ID NO: 78346 - RNA, 22 nt, Homo sapiens
cuagaagcauauucagaacaga

SEQ ID NO: 78347 - RNA, 22 nt, Homo sapiens
cuagaguguaguuuucuuagga

SEQ ID NO: 78348 - RNA, 22 nt, Homo sapiens
cuagcacauuuaucuuuauaca

SEQ ID NO: 78349 - RNA, 22 nt, Homo sapiens
cuagcagacaggcugggagcag

SEQ ID NO: 78350 - RNA, 22 nt, Homo sapiens
cuagcuuuugauguaaagugag

SEQ ID NO: 78351 - RNA, 22 nt, Homo sapiens
cuaggaaguauguguuauugcu

SEQ ID NO: 78352 - RNA, 22 nt, Homo sapiens
cuaggcacgccugggucuccag

SEQ ID NO: 78353 - RNA, 22 nt, Homo sapiens
cuaggcacugauaguuguauuu

SEQ ID NO: 78354 - RNA, 22 nt, Homo sapiens
cuaggcuguagagaaguucagu

SEQ ID NO: 78355 - RNA, 22 nt, Homo sapiens
cuaggugauccacugcucucuu

SEQ ID NO: 78356 - RNA, 22 nt, Homo sapiens
cuagguucucaaaccagcguca

SEQ ID NO: 78357 - RNA, 22 nt, Homo sapiens
cuagugcaauccuuugauggua

SEQ ID NO: 78358 - RNA, 22 nt, Homo sapiens
cuauaacagugugguuuggaga

SEQ ID NO: 78359 - RNA, 22 nt, Homo sapiens
cuauaguauaguuugaagucag

SEQ ID NO: 78360 - RNA, 22 nt, Homo sapiens
cuaugagcuuuuuuaagccuca

SEQ ID NO: 78361 - RNA, 22 nt, Homo sapiens
cuaugagucugcagaucuauua

SEQ ID NO: 78362 - RNA, 22 nt, Homo sapiens
cuaugcauuuuggaggagggaa

SEQ ID NO: 78363 - RNA, 22 nt, Homo sapiens
cuauggauuuacuguauagggu

SEQ ID NO: 78364 - RNA, 22 nt, Homo sapiens
cuauggcucugucuuuuaaguu

SEQ ID NO: 78365 - RNA, 22 nt, Homo sapiens
cuauggcuguaugacgugcaug

SEQ ID NO: 78366 - RNA, 22 nt, Homo sapiens
cuaugguaggggcuggaggaag

SEQ ID NO: 78367 - RNA, 22 nt, Homo sapiens
cuaugguuucuccauaucauca

SEQ ID NO: 78368 - RNA, 22 nt, Homo sapiens
cuauuacuuuuauugaacucag

SEQ ID NO: 78369 - RNA, 22 nt, Homo sapiens
cuauucacaauagccaagauuu

SEQ ID NO: 78370 - RNA, 20 nt, Homo sapiens
cuauugacauuuggggcuag

SEQ ID NO: 78371 - RNA, 22 nt, Homo sapiens
cucaaaguguggucuguggguu

SEQ ID NO: 78372 - RNA, 22 nt, Homo sapiens
cucaaguaauccucccgccuug

SEQ ID NO: 78373 - RNA, 22 nt, Homo sapiens
cucaaguacaugggauuacagg

SEQ ID NO: 78374 - RNA, 22 nt, Homo sapiens
cucaaguagugguuuucauuga

SEQ ID NO: 78375 - RNA, 22 nt, Homo sapiens
cucaauuuggaauugucaguaa

SEQ ID NO: 78376 - RNA, 22 nt, Homo sapiens
cucacagucagaagggacuugc

SEQ ID NO: 78377 - RNA, 20 nt, Homo sapiens
cucaccagguguaggcugag

SEQ ID NO: 78378 - RNA, 22 nt, Homo sapiens
cucaccuugugauccaccggcc

SEQ ID NO: 78379 - RNA, 22 nt, Homo sapiens
cucacggcccugcgcacuggca

SEQ ID NO: 78380 - RNA, 22 nt, Homo sapiens
cucacugucaacauguauuugg

SEQ ID NO: 78381 - RNA, 22 nt, Homo sapiens
cucacugugguguccuuaggua

SEQ ID NO: 78382 - RNA, 22 nt, Homo sapiens
cucagggugguggacucuaaua

SEQ ID NO: 78383 - RNA, 22 nt, Homo sapiens
cucaguacuugcacagaagaac

SEQ ID NO: 78384 - RNA, 22 nt, Homo sapiens
cucaguguuaaggccaccucug

SEQ ID NO: 78385 - RNA, 22 nt, Homo sapiens
cucaugcugucuucugggguaa

SEQ ID NO: 78386 - RNA, 22 nt, Homo sapiens
cucauggaauacuucacagcca

SEQ ID NO: 78387 - RNA, 19 nt, Homo sapiens
cucauggagaaggagaaua

SEQ ID NO: 78388 - RNA, 22 nt, Homo sapiens
cucauuaguuguuuuaagauga

SEQ ID NO: 78389 - RNA, 22 nt, Homo sapiens
cuccacugagcaggugggaggc

SEQ ID NO: 78390 - RNA, 23 nt, Homo sapiens
cuccaugagccguccagggccug

SEQ ID NO: 78391 - RNA, 22 nt, Homo sapiens
cucccacccucauuuuuaggca

SEQ ID NO: 78392 - RNA, 22 nt, Homo sapiens
auggcuuuuuucuugggcacuc

SEQ ID NO: 78393 - RNA, 22 nt, Homo sapiens
augggacugggugccguggagc

SEQ ID NO: 78394 - RNA, 22 nt, Homo sapiens
augggcaaauguuggaaauucc

SEQ ID NO: 78395 - RNA, 22 nt, Homo sapiens
augggcuaguaaagacaaacuu

SEQ ID NO: 78396 - RNA, 21 nt, Homo sapiens
augggguagaagagaaggcuu

SEQ ID NO: 78397 - RNA, 22 nt, Homo sapiens
augggguaggcuugcuguagua

SEQ ID NO: 78398 - RNA, 22 nt, Homo sapiens
augguacuggggucccggaguu

SEQ ID NO: 78399 - RNA, 22 nt, Homo sapiens
ggcaagaaccagggauuugcgu

SEQ ID NO: 78400 - RNA, 17 nt, Homo sapiens
ggcaagaaguggaacuc

SEQ ID NO: 78401 - RNA, 22 nt, Homo sapiens
ggcaagaucuuggcucacugaa

SEQ ID NO: 78402 - RNA, 22 nt, Homo sapiens
ggcaagugggagggaguguuuc

SEQ ID NO: 78403 - RNA, 21 nt, Homo sapiens
ggcaagugugagguuuggggu

SEQ ID NO: 78404 - RNA, 22 nt, Homo sapiens
ggcaauauauucugaauucagu

SEQ ID NO: 78405 - RNA, 22 nt, Homo sapiens
ggcaccauggaaggacgggagc

SEQ ID NO: 78406 - RNA, 19 nt, Homo sapiens
ggcaccuuuuccaaaaaug

SEQ ID NO: 78407 - RNA, 22 nt, Homo sapiens
ggcacgguggcucacgccugua

SEQ ID NO: 78408 - RNA, 22 nt, Homo sapiens
ggcacugugaugugagggggua

SEQ ID NO: 78409 - RNA, 22 nt, Homo sapiens
ggcacuguggcucaagccugua

SEQ ID NO: 78410 - RNA, 22 nt, Homo sapiens
ggcagaauugcugaggaugcua

SEQ ID NO: 78411 - RNA, 22 nt, Homo sapiens
ggcagaguggacauuuaaaugu

SEQ ID NO: 78412 - RNA, 22 nt, Homo sapiens
ggcagaucauuggccucaguuu

SEQ ID NO: 78413 - RNA, 22 nt, Homo sapiens
ggcagcucaggccccgcgcuga

SEQ ID NO: 78414 - RNA, 22 nt, Homo sapiens
ggcaguggaagugccaguuucu

SEQ ID NO: 78415 - RNA, 22 nt, Homo sapiens
ggcaguguaauaauuuauuaau

SEQ ID NO: 78416 - RNA, 22 nt, Homo sapiens
ggcaguguuauuauauuuuugg

SEQ ID NO: 78417 - RNA, 22 nt, Homo sapiens
ggcaguuucucaggcaggggua

SEQ ID NO: 78418 - RNA, 22 nt, Homo sapiens
ggcaugaugcgcacgccuguag

SEQ ID NO: 78419 - RNA, 22 nt, Homo sapiens
ggcauguugauagguagaugua

SEQ ID NO: 78420 - RNA, 22 nt, Homo sapiens
ggcauguuuaguagaauguggu

SEQ ID NO: 78421 - RNA, 22 nt, Homo sapiens
ggccuguaggguauugguaggg

SEQ ID NO: 78422 - RNA, 22 nt, Homo sapiens
ggcgccauugcacuccagccug

SEQ ID NO: 78423 - RNA, 22 nt, Homo sapiens
ggcucguguuuucuguccaguu

SEQ ID NO: 78424 - RNA, 22 nt, Homo sapiens
ggcuuggaggaaugugagggcu

SEQ ID NO: 78425 - RNA, 22 nt, Homo sapiens
gggaagauauaggcugggcacc

SEQ ID NO: 78426 - RNA, 22 nt, Homo sapiens
gggaagugugcagaguucucuu

SEQ ID NO: 78427 - RNA, 18 nt, Homo sapiens
gggaauauggggaguuga

SEQ ID NO: 78428 - RNA, 20 nt, Homo sapiens
gggaaugcaaauucucaucc

SEQ ID NO: 78429 - RNA, 22 nt, Homo sapiens
gggagguuguauguaugcgggg

SEQ ID NO: 78430 - RNA, 22 nt, Homo sapiens
gggaguagagaguuucucugac

SEQ ID NO: 78431 - RNA, 22 nt, Homo sapiens
gggagugugcacacaugguaua

SEQ ID NO: 78432 - RNA, 22 nt, Homo sapiens
gggaguguguaggacccagugu

SEQ ID NO: 78433 - RNA, 22 nt, Homo sapiens
gggaucaacuuauacuaaaauu

SEQ ID NO: 78434 - RNA, 22 nt, Homo sapiens
gggauguuuuauacugagccug

SEQ ID NO: 78435 - RNA, 22 nt, Homo sapiens
gggauuauugugauuucauguu

SEQ ID NO: 78436 - RNA, 20 nt, Homo sapiens
gggcaaguaugugggaaguc

SEQ ID NO: 78437 - RNA, 22 nt, Homo sapiens
gggcagaugucuggacaccuca

SEQ ID NO: 78438 - RNA, 22 nt, Homo sapiens
gggcaugugugugcacacacau

SEQ ID NO: 78439 - RNA, 22 nt, Homo sapiens
gggcauugugggcagagggcag

SEQ ID NO: 78440 - RNA, 22 nt, Homo sapiens
gggccagaugcauuuguuauuu

SEQ ID NO: 78441 - RNA, 22 nt, Homo sapiens
gggcgagaaucggcugcucagc

SEQ ID NO: 78442 - RNA, 22 nt, Homo sapiens
gggguauguaagugagugagug

SEQ ID NO: 78443 - RNA, 22 nt, Homo sapiens
gggguuuuaccuucguauucuu

SEQ ID NO: 78444 - RNA, 22 nt, Homo sapiens
gggugguuuuauuaucagugac

SEQ ID NO: 78445 - RNA, 22 nt, Homo sapiens
ggguucccuucuggcucagggu

SEQ ID NO: 78446 - RNA, 22 nt, Homo sapiens
gguaaaucuucacuaagacuga

SEQ ID NO: 78447 - RNA, 22 nt, Homo sapiens
gguaacaguggggcuaugcuua

SEQ ID NO: 78448 - RNA, 22 nt, Homo sapiens
gguaaguuuggggcuaauuugu

SEQ ID NO: 78449 - RNA, 17 nt, Homo sapiens
gguacguuuuguucugu

SEQ ID NO: 78450 - RNA, 22 nt, Homo sapiens
gguaggcacuggugggaagaga

SEQ ID NO: 78451 - RNA, 22 nt, Homo sapiens
gguauguuuagaccauuuacau

SEQ ID NO: 78452 - RNA, 22 nt, Homo sapiens
gguauuauuugccuuuuacuga

SEQ ID NO: 78453 - RNA, 22 nt, Homo sapiens
gguauugguugagauuaacuuu

SEQ ID NO: 78454 - RNA, 22 nt, Homo sapiens
ggucaaguaauccuggguguca

SEQ ID NO: 78455 - RNA, 19 nt, Homo sapiens
ggucacagggguuacaagg

SEQ ID NO: 78456 - RNA, 22 nt, Homo sapiens
ggucacauuggacuaucaaguu

SEQ ID NO: 78457 - RNA, 22 nt, Homo sapiens
ggucacccugaugcuggugguc

SEQ ID NO: 78458 - RNA, 22 nt, Homo sapiens
ggucagauggcagcugggccug

SEQ ID NO: 78459 - RNA, 22 nt, Homo sapiens
ggucaggagaaugguaacugag

SEQ ID NO: 78460 - RNA, 22 nt, Homo sapiens
ggucauggagcuuuacuuuaug

SEQ ID NO: 78461 - RNA, 19 nt, Homo sapiens
ggugagaaauuaugggucu

SEQ ID NO: 78462 - RNA, 22 nt, Homo sapiens
ggugaguggugcuuaaguucag

SEQ ID NO: 78463 - RNA, 22 nt, Homo sapiens
ggugaucauugucucuaguaug

SEQ ID NO: 78464 - RNA, 22 nt, Homo sapiens
ggugcagcacaccaacauggca

SEQ ID NO: 78465 - RNA, 22 nt, Homo sapiens
ggugcuugaggaacggaggcug

SEQ ID NO: 78466 - RNA, 22 nt, Homo sapiens
gguggcuuuuugugauggcuga

SEQ ID NO: 78467 - RNA, 19 nt, Homo sapiens
gguucaguuuauaaagaug

SEQ ID NO: 78468 - RNA, 18 nt, Homo sapiens
guaaauguaucuauugcc

SEQ ID NO: 78469 - RNA, 22 nt, Homo sapiens
guaaauguccugcuacagagug

SEQ ID NO: 78470 - RNA, 22 nt, Homo sapiens
guaacucugucacuuacuaguu

SEQ ID NO: 78471 - RNA, 22 nt, Homo sapiens
guaaggaguaguguaacagugc

SEQ ID NO: 78472 - RNA, 22 nt, Homo sapiens
guaaggcuguuaucuucacguc

SEQ ID NO: 78473 - RNA, 22 nt, Homo sapiens
guaaguagcuuuagauauaaau

SEQ ID NO: 78474 - RNA, 22 nt, Homo sapiens
aagugcccuauuuggcccuuga

SEQ ID NO: 78475 - RNA, 22 nt, Homo sapiens
aagugcucuugugggaagagag

SEQ ID NO: 78476 - RNA, 22 nt, Homo sapiens
aagugcuggccuacucaaucga

SEQ ID NO: 78477 - RNA, 20 nt, Homo sapiens
aagugcuuccuuuuagaggg

SEQ ID NO: 78478 - RNA, 22 nt, Homo sapiens
aagugcuucuuuccucgagaag

SEQ ID NO: 78479 - RNA, 22 nt, Homo sapiens
aagugguucuaugaguuugcaa

SEQ ID NO: 78480 - RNA, 22 nt, Homo sapiens
aagugguuuuaaucuggugagu

SEQ ID NO: 78481 - RNA, 22 nt, Homo sapiens
aaguuaauguuuaagacuccua

SEQ ID NO: 78482 - RNA, 23 nt, Homo sapiens
aaguucaugcucaucuguuacac

SEQ ID NO: 78483 - RNA, 21 nt, Homo sapiens
aauaaagcaaccuuaugccau

SEQ ID NO: 78484 - RNA, 22 nt, Homo sapiens
aauaaagcaggguccuugcacu

SEQ ID NO: 78485 - RNA, 22 nt, Homo sapiens
aauaagcauaguaccugauagg

SEQ ID NO: 78486 - RNA, 22 nt, Homo sapiens
aauaaguugagaugaggucaua

SEQ ID NO: 78487 - RNA, 22 nt, Homo sapiens
aauacagcacacagaugggucu

SEQ ID NO: 78488 - RNA, 22 nt, Homo sapiens
aauacucaguccuggugaggcu

SEQ ID NO: 78489 - RNA, 22 nt, Homo sapiens
aauacugagaugugagguacua

SEQ ID NO: 78490 - RNA, 22 nt, Homo sapiens
aauacugugauaucgagcgauu

SEQ ID NO: 78491 - RNA, 22 nt, Homo sapiens
aauagcuguccuuagaagugug

SEQ ID NO: 78492 - RNA, 22 nt, Homo sapiens
aauagcuguuuuuaauuccugc

SEQ ID NO: 78493 - RNA, 22 nt, Homo sapiens
aauagugcugugcagugagugg

SEQ ID NO: 78494 - RNA, 19 nt, Homo sapiens
aauauugacaguggugucu

SEQ ID NO: 78495 - RNA, 22 nt, Homo sapiens
aauauugucaaaauggauucca

SEQ ID NO: 78496 - RNA, 22 nt, Homo sapiens
aaucacauugaaucugcuaccu

SEQ ID NO: 78497 - RNA, 22 nt, Homo sapiens
aaucaccaugcacuacagccuu

SEQ ID NO: 78498 - RNA, 22 nt, Homo sapiens
aaucacuuugcuacaaggcagu

SEQ ID NO: 78499 - RNA, 22 nt, Homo sapiens
aaucacuuuggcaccaaccuaa

SEQ ID NO: 78500 - RNA, 22 nt, Homo sapiens
aaucagauuccagugguuggaa

SEQ ID NO: 78501 - RNA, 16 nt, Homo sapiens
aauccauuggcccugc

SEQ ID NO: 78502 - RNA, 22 nt, Homo sapiens
aaucccuggacuuucggaggcu

SEQ ID NO: 78503 - RNA, 22 nt, Homo sapiens
aaucccuuuguccagucucuuu

SEQ ID NO: 78504 - RNA, 22 nt, Homo sapiens
aauccugucuugccauccaaua

SEQ ID NO: 78505 - RNA, 22 nt, Homo sapiens
aaucucaacacuuugggaggcu

SEQ ID NO: 78506 - RNA, 22 nt, Homo sapiens
aaucucagagauaucugugucc

SEQ ID NO: 78507 - RNA, 22 nt, Homo sapiens
aaucugggguuguuuggggagu

SEQ ID NO: 78508 - RNA, 22 nt, Homo sapiens
aaucuguagaaggugcacauuc

SEQ ID NO: 78509 - RNA, 22 nt, Homo sapiens
aaucugucaguuuuguguuaau

SEQ ID NO: 78510 - RNA, 22 nt, Homo sapiens
aaugacagugcuaaagaacccu

SEQ ID NO: 78511 - RNA, 22 nt, Homo sapiens
aaugacccugauuggcaaguug

SEQ ID NO: 78512 - RNA, 22 nt, Homo sapiens
aaugacugugauauuuuucuuc

SEQ ID NO: 78513 - RNA, 22 nt, Homo sapiens
aaugccacugugccugccaagg

SEQ ID NO: 78514 - RNA, 22 nt, Homo sapiens
aauggagcugaguggccuuggg

SEQ ID NO: 78515 - RNA, 22 nt, Homo sapiens
aauggcacaagaguaaacuguu

SEQ ID NO: 78516 - RNA, 22 nt, Homo sapiens
aauggcaguagauggaugggua

SEQ ID NO: 78517 - RNA, 22 nt, Homo sapiens
aauggcuauuucaugugguagg

SEQ ID NO: 78518 - RNA, 22 nt, Homo sapiens
aauggcucugauguuguuguga

SEQ ID NO: 78519 - RNA, 18 nt, Homo sapiens
aauggcucuggguucuaa

SEQ ID NO: 78520 - RNA, 22 nt, Homo sapiens
aauggcuuuuaauauccauaau

SEQ ID NO: 78521 - RNA, 21 nt, Homo sapiens
aaugguguugccaacaaggug

SEQ ID NO: 78522 - RNA, 22 nt, Homo sapiens
aaugguguuuccguuaagcuga

SEQ ID NO: 78523 - RNA, 22 nt, Homo sapiens
aaugugccuacagugggcuguu

SEQ ID NO: 78524 - RNA, 22 nt, Homo sapiens
aaugugccuacuggagcuugca

SEQ ID NO: 78525 - RNA, 22 nt, Homo sapiens
aaugugcuucuggcugugguca

SEQ ID NO: 78526 - RNA, 22 nt, Homo sapiens
aaugugcuuugaaaagagcuga

SEQ ID NO: 78527 - RNA, 22 nt, Homo sapiens
aauuaguuggcugccuaugauu

SEQ ID NO: 78528 - RNA, 22 nt, Homo sapiens
aauuaguugucgugagaguggu

SEQ ID NO: 78529 - RNA, 22 nt, Homo sapiens
aauucacuuguggcagauccuu

SEQ ID NO: 78530 - RNA, 22 nt, Homo sapiens
aauugaaugauaugggacauuu

SEQ ID NO: 78531 - RNA, 22 nt, Homo sapiens
aauugcaauggacaaugcagca

SEQ ID NO: 78532 - RNA, 22 nt, Homo sapiens
aauugcacuaagcauaguccag

SEQ ID NO: 78533 - RNA, 22 nt, Homo sapiens
aauugcauaugcaguagaucua

SEQ ID NO: 78534 - RNA, 22 nt, Homo sapiens
aauugcucuccuccaaggucuu

SEQ ID NO: 78535 - RNA, 22 nt, Homo sapiens
aauugcuuuuauuuagggccag

SEQ ID NO: 78536 - RNA, 22 nt, Homo sapiens
aauugguuaagauaagaucaua

SEQ ID NO: 78537 - RNA, 22 nt, Homo sapiens
aauuguacucccaucauuccua

SEQ ID NO: 78538 - RNA, 22 nt, Homo sapiens
aauugugcuuguaggccaggca

SEQ ID NO: 78539 - RNA, 22 nt, Homo sapiens
acaaagcgcuucucuuuagagu

SEQ ID NO: 78540 - RNA, 22 nt, Homo sapiens
acaaagugccuccuuuuagagu

SEQ ID NO: 78541 - RNA, 17 nt, Homo sapiens
acaaauugccagcuagg

SEQ ID NO: 78542 - RNA, 22 nt, Homo sapiens
acaauguauauuuuacuguagg

SEQ ID NO: 78543 - RNA, 22 nt, Homo sapiens
acacacgugcauguaugcguau

SEQ ID NO: 78544 - RNA, 23 nt, Homo sapiens
acacaguaaacuaaaagcuagcu

SEQ ID NO: 78545 - RNA, 22 nt, Homo sapiens
acacaguauaugacaaugcuuu

SEQ ID NO: 78546 - RNA, 22 nt, Homo sapiens
acacagucaaauccacuuggcu

SEQ ID NO: 78547 - RNA, 22 nt, Homo sapiens
acacagugucuguguauuuaaa

SEQ ID NO: 78548 - RNA, 22 nt, Homo sapiens
acacaguguuuauugugguuag

SEQ ID NO: 78549 - RNA, 22 nt, Homo sapiens
acacauacacauaugguguaua

SEQ ID NO: 78550 - RNA, 22 nt, Homo sapiens
acacaugcuccacuguggccuc

SEQ ID NO: 78551 - RNA, 22 nt, Homo sapiens
acacaugugaaaaaaauguuac

SEQ ID NO: 78552 - RNA, 22 nt, Homo sapiens
acacaugugcguagacucuuua

SEQ ID NO: 78553 - RNA, 22 nt, Homo sapiens
acaccuguggucccaguaacuu

SEQ ID NO: 78554 - RNA, 22 nt, Homo sapiens
acacuauugagguuuguuugca

SEQ ID NO: 78555 - RNA, 22 nt, Homo sapiens
uucaaaguaaaaauguguucac

SEQ ID NO: 78556 - RNA, 22 nt, Homo sapiens
uucaagaauuaaaguggcuuuu

SEQ ID NO: 78557 - RNA, 22 nt, Homo sapiens
uucacaguacucccuggaauua

SEQ ID NO: 78558 - RNA, 22 nt, Homo sapiens
uucagugucauuaacacaguag

SEQ ID NO: 78559 - RNA, 22 nt, Homo sapiens
uucauaguucuuuuagucauua

SEQ ID NO: 78560 - RNA, 22 nt, Homo sapiens
uuccaguaauagcacagcauug

SEQ ID NO: 78561 - RNA, 22 nt, Homo sapiens
uuccaugagaugcaucaaagcu

SEQ ID NO: 78562 - RNA, 22 nt, Homo sapiens
uuccauuuguucggugucgcca

SEQ ID NO: 78563 - RNA, 22 nt, Homo sapiens
ucaugucuuguuguauuuauuu

SEQ ID NO: 78564 - RNA, 18 nt, Homo sapiens
uccacgugcuuuccagau

SEQ ID NO: 78565 - RNA, 22 nt, Homo sapiens
uccacguggucuaucuguccuu

SEQ ID NO: 78566 - RNA, 22 nt, Homo sapiens
ucccauguagcuaggauuacag

SEQ ID NO: 78567 - RNA, 19 nt, Homo sapiens
uccccgggucuagugcagc

SEQ ID NO: 78568 - RNA, 22 nt, Homo sapiens
uccucaguggauuggauggugc

SEQ ID NO: 78569 - RNA, 22 nt, Homo sapiens
ucguggccugugaguccucccc

SEQ ID NO: 78570 - RNA, 22 nt, Homo sapiens
ucucauggcucacccugcauag

SEQ ID NO: 78571 - RNA, 22 nt, Homo sapiens
ucugacaaugaacaaucuauag

SEQ ID NO: 78572 - RNA, 23 nt, Homo sapiens
ucuggaucauucguagugccagc

SEQ ID NO: 78573 - RNA, 21 nt, Homo sapiens
ucuggccccuccaaaucucau

SEQ ID NO: 78574 - RNA, 22 nt, Homo sapiens
ucugguuccuuggcuucggguc

SEQ ID NO: 78575 - RNA, 22 nt, Homo sapiens
ucugucuuguccucacccuaga

SEQ ID NO: 78576 - RNA, 22 nt, Homo sapiens
ucuugcaccuacaugcuuuguc

SEQ ID NO: 78577 - RNA, 22 nt, Homo sapiens
ugaaaguuauauugugaaauuc

SEQ ID NO: 78578 - RNA, 22 nt, Homo sapiens
ugaaaucuaaaauguuccaaga

SEQ ID NO: 78579 - RNA, 20 nt, Homo sapiens
ugaaaucuucacuaagucuc

SEQ ID NO: 78580 - RNA, 22 nt, Homo sapiens
ugaaaugcuaauucguagcuaa

SEQ ID NO: 78581 - RNA, 22 nt, Homo sapiens
ugaaauguuaaacaaguggcuc

SEQ ID NO: 78582 - RNA, 22 nt, Homo sapiens
ugaaauuuuuuauucguuggcu

SEQ ID NO: 78583 - RNA, 22 nt, Homo sapiens
ugacaacugauuaacuccuuua

SEQ ID NO: 78584 - RNA, 22 nt, Homo sapiens
ugacagugugagauccugucuc

SEQ ID NO: 78585 - RNA, 22 nt, Homo sapiens
ugacuaaggaaggauuaugugc

SEQ ID NO: 78586 - RNA, 22 nt, Homo sapiens
ugacucaguuucucagguagua

SEQ ID NO: 78587 - RNA, 22 nt, Homo sapiens
ugacuggagaccucaguagggu

SEQ ID NO: 78588 - RNA, 22 nt, Homo sapiens
ugacugucuagauagagcuugg

SEQ ID NO: 78589 - RNA, 22 nt, Homo sapiens
ugacugugcagcuccaucaggg

SEQ ID NO: 78590 - RNA, 22 nt, Homo sapiens
ugagauaggaucuugcucuguu

SEQ ID NO: 78591 - RNA, 22 nt, Homo sapiens
ugagaucuuugcuguccucacc

SEQ ID NO: 78592 - RNA, 22 nt, Homo sapiens
ugagaugagaaucaguucuaau

SEQ ID NO: 78593 - RNA, 22 nt, Homo sapiens
ugagaugaguucucgcucuguc

SEQ ID NO: 78594 - RNA, 22 nt, Homo sapiens
ugagaugaguugcgcucugucg

SEQ ID NO: 78595 - RNA, 18 nt, Homo sapiens
ugaggaaaggguuugcua

SEQ ID NO: 78596 - RNA, 22 nt, Homo sapiens
ugaggagugagaaauugguuuc

SEQ ID NO: 78597 - RNA, 22 nt, Homo sapiens
ugagucuguucucacauugcua

SEQ ID NO: 78598 - RNA, 22 nt, Homo sapiens
ugaguguccaaguaaggugaaa

SEQ ID NO: 78599 - RNA, 22 nt, Homo sapiens
ugaguuccuugugugaccuugc

SEQ ID NO: 78600 - RNA, 18 nt, Homo sapiens
ugcaaacauguguguguu

SEQ ID NO: 78601 - RNA, 20 nt, Homo sapiens
ugcagcacgggcccuuucca

SEQ ID NO: 78602 - RNA, 22 nt, Homo sapiens
ugcauaugcagcauuuaugauu

SEQ ID NO: 78603 - RNA, 22 nt, Homo sapiens
ugcauauguugaaccagccuug

SEQ ID NO: 78604 - RNA, 22 nt, Homo sapiens
ugccaggaugaggucaauguuu

SEQ ID NO: 78605 - RNA, 21 nt, Homo sapiens
ugcuauguuguccaggcuggc

SEQ ID NO: 78606 - RNA, 20 nt, Homo sapiens
ugcugcacuuaagcaugggc

SEQ ID NO: 78607 - RNA, 22 nt, Homo sapiens
ugcugguguggucuagccgcuu

SEQ ID NO: 78608 - RNA, 22 nt, Homo sapiens
ugcugguuuucaucaucagugg

SEQ ID NO: 78609 - RNA, 22 nt, Homo sapiens
ugcuguuguuugaugaaguaau

SEQ ID NO: 78610 - RNA, 22 nt, Homo sapiens
ugcuuuguugaaaaucauuugg

SEQ ID NO: 78611 - RNA, 22 nt, Homo sapiens
uggaagacucuagucucuugag

SEQ ID NO: 78612 - RNA, 22 nt, Homo sapiens
uggaaguuaaaugacucuuucu

SEQ ID NO: 78613 - RNA, 19 nt, Homo sapiens
uggaaugaaauguuagggg

SEQ ID NO: 78614 - RNA, 21 nt, Homo sapiens
uggaauuaauggagagguguu

SEQ ID NO: 78615 - RNA, 22 nt, Homo sapiens
uggacagagagaccggcauuuu

SEQ ID NO: 78616 - RNA, 21 nt, Homo sapiens
uggaccccuacuucucaccau

SEQ ID NO: 78617 - RNA, 22 nt, Homo sapiens
uggaccccugcucgggagcccu

SEQ ID NO: 78618 - RNA, 19 nt, Homo sapiens
uggaccccuuccuuacacc

SEQ ID NO: 78619 - RNA, 22 nt, Homo sapiens
uggacuguaagugccuugagua

SEQ ID NO: 78620 - RNA, 22 nt, Homo sapiens
uggcaggugcacuggcuuugaa

SEQ ID NO: 78621 - RNA, 22 nt, Homo sapiens
uggcaugaagaccccauccuuu

SEQ ID NO: 78622 - RNA, 22 nt, Homo sapiens
ugggaagaugcugcuucuuccu

SEQ ID NO: 78623 - RNA, 22 nt, Homo sapiens
ugggauccaugugguuuaagca

SEQ ID NO: 78624 - RNA, 22 nt, Homo sapiens
uggucuucuggccuccagaacc

SEQ ID NO: 78625 - RNA, 19 nt, Homo sapiens
uggugccuuguucuuggau

SEQ ID NO: 78626 - RNA, 22 nt, Homo sapiens
ugguggcuuuucguagguucac

SEQ ID NO: 78627 - RNA, 22 nt, Homo sapiens
uguaguuugaaagcucccucug

SEQ ID NO: 78628 - RNA, 22 nt, Homo sapiens
ugucaaacauuaugaugcucua

SEQ ID NO: 78629 - RNA, 22 nt, Homo sapiens
ugucaucauuccaucagggcuu

SEQ ID NO: 78630 - RNA, 21 nt, Homo sapiens
ugucugagagaggagaucuac

SEQ ID NO: 78631 - RNA, 22 nt, Homo sapiens
ugugaagaaagucauugguagc

SEQ ID NO: 78632 - RNA, 22 nt, Homo sapiens
ugugccacuccaaccuggguga

SEQ ID NO: 78633 - RNA, 22 nt, Homo sapiens
ugugcgcaucggggccugcuuc

SEQ ID NO: 78634 - RNA, 22 nt, Homo sapiens
ugugcuuguaaaggccagagca

SEQ ID NO: 78635 - RNA, 19 nt, Homo sapiens
uguugcacauaucaauaug

SEQ ID NO: 78636 - RNA, 19 nt, Homo sapiens
uguugcacuccagcuuggg

SEQ ID NO: 78637 - RNA, 20 nt, Homo sapiens
uguugcacucuagccugggu

SEQ ID NO: 78638 - RNA, 22 nt, Homo sapiens
uguugcacugguaauguacuga

SEQ ID NO: 78639 - RNA, 22 nt, Homo sapiens
uguuucuacugucucuguagua

SEQ ID NO: 78640 - RNA, 22 nt, Homo sapiens
uuaaugaacuuuauuuuguaga

SEQ ID NO: 78641 - RNA, 22 nt, Homo sapiens
uuagacaguggugcacugcacu

SEQ ID NO: 78642 - RNA, 22 nt, Homo sapiens
uuagcagcaugaaaauggacug

SEQ ID NO: 78643 - RNA, 22 nt, Homo sapiens
uuagcucaguuggugagagcgu

SEQ ID NO: 78644 - RNA, 22 nt, Homo sapiens
uuauaaacaugaagauuugggg

SEQ ID NO: 78645 - RNA, 22 nt, Homo sapiens
uucaaaaccucugcuuaagccc

SEQ ID NO: 78646 - RNA, 23 nt, Homo sapiens
aguggucuccugggcccagcugu

SEQ ID NO: 78647 - RNA, 22 nt, Homo sapiens
auaaaagcaggucuaggucagg

SEQ ID NO: 78648 - RNA, 22 nt, Homo sapiens
auagugcugcaauaaacauaca

SEQ ID NO: 78649 - RNA, 22 nt, Homo sapiens
auagugcuggaauaaauauacg

SEQ ID NO: 78650 - RNA, 22 nt, Homo sapiens
auauagcaaugaaagagaugaa

SEQ ID NO: 78651 - RNA, 18 nt, Homo sapiens
auauugccuucagacuag

SEQ ID NO: 78652 - RNA, 22 nt, Homo sapiens
aucacagaacuuugagcagaga

SEQ ID NO: 78653 - RNA, 22 nt, Homo sapiens
aucacagguacuauggcugaca

SEQ ID NO: 78654 - RNA, 22 nt, Homo sapiens
aucagagccugugugcccugaa

SEQ ID NO: 78655 - RNA, 22 nt, Homo sapiens
aucaggaaccuuuuuggugugu

SEQ ID NO: 78656 - RNA, 20 nt, Homo sapiens
aucucugggcaaaggaaaau

SEQ ID NO: 78657 - RNA, 22 nt, Homo sapiens
aucugcaaauaaugaagauugg

SEQ ID NO: 78658 - RNA, 22 nt, Homo sapiens
aucuugcauuugcuaaaaugca

SEQ ID NO: 78659 - RNA, 22 nt, Homo sapiens
aucuuugcugagaugcauggca

SEQ ID NO: 78660 - RNA, 22 nt, Homo sapiens
augaaauguaugagucuggguu

SEQ ID NO: 78661 - RNA, 20 nt, Homo sapiens
augaagugaaguuagggaac

SEQ ID NO: 78662 - RNA, 22 nt, Homo sapiens
augaaguuagcucauuucuuuu

SEQ ID NO: 78663 - RNA, 22 nt, Homo sapiens
augaauguaaagaaugugggaa

SEQ ID NO: 78664 - RNA, 22 nt, Homo sapiens
cuuccugaguccugggcucaca

SEQ ID NO: 78665 - RNA, 22 nt, Homo sapiens
cuuuacaguuggacucacgagg

SEQ ID NO: 78666 - RNA, 21 nt, Homo sapiens
cuuuugcacuccagccugggu

SEQ ID NO: 78667 - RNA, 22 nt, Homo sapiens
gaaccagcagacuuugacaggu

SEQ ID NO: 78668 - RNA, 22 nt, Homo sapiens
gaaucacaguuauuagagcagc

SEQ ID NO: 78669 - RNA, 21 nt, Homo sapiens
gagaaucaucauggcugcaua

SEQ ID NO: 78670 - RNA, 22 nt, Homo sapiens
gagacggagucucgcucuguca

SEQ ID NO: 78671 - RNA, 22 nt, Homo sapiens
gagagguaguuuuuuggucguc

SEQ ID NO: 78672 - RNA, 20 nt, Homo sapiens
gagauguugaucagggcuau

SEQ ID NO: 78673 - RNA, 22 nt, Homo sapiens
gagcaucaguggccucaucuca

SEQ ID NO: 78674 - RNA, 22 nt, Homo sapiens
gagcuccuccccuuggcuuuca

SEQ ID NO: 78675 - RNA, 20 nt, Homo sapiens
gagcugguguacugccgggc

SEQ ID NO: 78676 - RNA, 22 nt, Homo sapiens
gagcuuggguuaaaguugccuu

SEQ ID NO: 78677 - RNA, 22 nt, Homo sapiens
gaggcagucugucccuuagcag

SEQ ID NO: 78678 - RNA, 22 nt, Homo sapiens
gaggcaguguguccguucucgg

SEQ ID NO: 78679 - RNA, 21 nt, Homo sapiens
gagguaccucauguaagugga

SEQ ID NO: 78680 - RNA, 22 nt, Homo sapiens
gaggugaaggucucaauaaaua

SEQ ID NO: 78681 - RNA, 22 nt, Homo sapiens
gaguauguauaugagugugucu

SEQ ID NO: 78682 - RNA, 22 nt, Homo sapiens
gaguuuguacuaauuuguugua

SEQ ID NO: 78683 - RNA, 22 nt, Homo sapiens
gaucuggagguuuuccucauga

SEQ ID NO: 78684 - RNA, 22 nt, Homo sapiens
gaugacagcugacucccuugcu

SEQ ID NO: 78685 - RNA, 22 nt, Homo sapiens
gauguguuuguuucuggaggag

SEQ ID NO: 78686 - RNA, 21 nt, Homo sapiens
gcaaacauccuuugaugccag

SEQ ID NO: 78687 - RNA, 22 nt, Homo sapiens
gcacugggccacauuuauuuuc

SEQ ID NO: 78688 - RNA, 22 nt, Homo sapiens
gcaguguucugggcaggaagaa

SEQ ID NO: 78689 - RNA, 22 nt, Homo sapiens
gcauggauguugauggcugcug

SEQ ID NO: 78690 - RNA, 22 nt, Homo sapiens
gccccaguacaggcuccuuaga

SEQ ID NO: 78691 - RNA, 22 nt, Homo sapiens
gccucaguuguggccagggauu

SEQ ID NO: 78692 - RNA, 22 nt, Homo sapiens
gcucaugggcagugugauuguu

SEQ ID NO: 78693 - RNA, 19 nt, Homo sapiens
gcuuuguggggaaggagcc

SEQ ID NO: 78694 - RNA, 22 nt, Homo sapiens
ggacuaggagcuaggaagaucu

SEQ ID NO: 78695 - RNA, 22 nt, Homo sapiens
ggacuagggacauggggagcug

SEQ ID NO: 78696 - RNA, 22 nt, Homo sapiens
ggagcugugauuugaguccaga

SEQ ID NO: 78697 - RNA, 22 nt, Homo sapiens
ggcaaagaugaccauuacuuuu

SEQ ID NO: 78698 - RNA, 22 nt, Homo sapiens
ggcaagaggagauucugcuccc

SEQ ID NO: 78699 - RNA, 22 nt, Homo sapiens
ggcaagaucuuggcucacugaa

SEQ ID NO: 78700 - RNA, 22 nt, Homo sapiens
ggcaugguggugugugccuaua

SEQ ID NO: 78701 - RNA, 22 nt, Homo sapiens
ggcuacauuguuacaauuagua

SEQ ID NO: 78702 - RNA, 22 nt, Homo sapiens
ggcuagagaauagugccacuaa

SEQ ID NO: 78703 - RNA, 22 nt, Homo sapiens
ggcucagugggguccugguucu

SEQ ID NO: 78704 - RNA, 21 nt, Homo sapiens
ggcucuguggucucagguuuc

SEQ ID NO: 78705 - RNA, 22 nt, Homo sapiens
gggcagaugucuggacaccuca

SEQ ID NO: 78706 - RNA, 22 nt, Homo sapiens
gggcaugaugucuuaugccuau

SEQ ID NO: 78707 - RNA, 22 nt, Homo sapiens
ggucaacaucaucaugguaagu

SEQ ID NO: 78708 - RNA, 22 nt, Homo sapiens
guaaucucagcuacuugggagg

SEQ ID NO: 78709 - RNA, 22 nt, Homo sapiens
guagcagcuacuaaguugcugu

SEQ ID NO: 78710 - RNA, 22 nt, Homo sapiens
guauacaguugacccuugaacc

SEQ ID NO: 78711 - RNA, 22 nt, Homo sapiens
gucacaggaaacuaauaugcgc

SEQ ID NO: 78712 - RNA, 22 nt, Homo sapiens
gucacugggugcugcgccuguc

SEQ ID NO: 78713 - RNA, 18 nt, Homo sapiens
guccauuuguugguacac

SEQ ID NO: 78714 - RNA, 22 nt, Homo sapiens
guccauuuguuuccagagcacu

SEQ ID NO: 78715 - RNA, 22 nt, Homo sapiens
guccuggagaagcguggaccgg

SEQ ID NO: 78716 - RNA, 22 nt, Homo sapiens
gucucugguugcuuuuguacca

SEQ ID NO: 78717 - RNA, 22 nt, Homo sapiens
gugagagaaugacuauguguuu

SEQ ID NO: 78718 - RNA, 22 nt, Homo sapiens
gugagccaugauuuuaccacug

SEQ ID NO: 78719 - RNA, 22 nt, Homo sapiens
gugagcuaagcaaauaugagcc

SEQ ID NO: 78720 - RNA, 22 nt, Homo sapiens
gugcaauucacuguuaugucug

SEQ ID NO: 78721 - RNA, 23 nt, Homo sapiens
gugccuucugagccuagucucca

SEQ ID NO: 78722 - RNA, 22 nt, Homo sapiens
gugcuuuguuguggcaguggca

SEQ ID NO: 78723 - RNA, 22 nt, Homo sapiens
guggaucacuugaggucaagag

SEQ ID NO: 78724 - RNA, 22 nt, Homo sapiens
guggcagagucagagggaaaug

SEQ ID NO: 78725 - RNA, 22 nt, Homo sapiens
guguaaaacaauuagaggauuu

SEQ ID NO: 78726 - RNA, 22 nt, Homo sapiens
guguaugguaggaugacggagu

SEQ ID NO: 78727 - RNA, 22 nt, Homo sapiens
guguauguuucucccugucccu

SEQ ID NO: 78728 - RNA, 22 nt, Homo sapiens
gugugcacaaucuggcaugugc

SEQ ID NO: 78729 - RNA, 22 nt, Homo sapiens
guucaucagggauacuggcuua

SEQ ID NO: 78730 - RNA, 22 nt, Homo sapiens
guuggguaauggggcgcaccgu

SEQ ID NO: 78731 - RNA, 22 nt, Homo sapiens
guuuggcuuucucucuauccug

SEQ ID NO: 78732 - RNA, 22 nt, Homo sapiens
uaaagaugcugggaaggcuagg

SEQ ID NO: 78733 - RNA, 22 nt, Homo sapiens
uacacagucaaaaauuuccagg

SEQ ID NO: 78734 - RNA, 22 nt, Homo sapiens
uacaguccaugcauuauccucc

SEQ ID NO: 78735 - RNA, 22 nt, Homo sapiens
uacucaguaagugcuggcugcu

SEQ ID NO: 78736 - RNA, 18 nt, Homo sapiens
uacugcacucuccagccu

SEQ ID NO: 78737 - RNA, 18 nt, Homo sapiens
uagaauauaggucauucu

SEQ ID NO: 78738 - RNA, 22 nt, Homo sapiens
uagagguauaccaaaaaggcau

SEQ ID NO: 78739 - RNA, 22 nt, Homo sapiens
uagagguauuaacaguagaaga

SEQ ID NO: 78740 - RNA, 22 nt, Homo sapiens
uagauuauuggcugauuugauc

SEQ ID NO: 78741 - RNA, 22 nt, Homo sapiens
uagcagcaaagcaggaucugcu

SEQ ID NO: 78742 - RNA, 22 nt, Homo sapiens
uagcagcaccccacucuacugg

SEQ ID NO: 78743 - RNA, 22 nt, Homo sapiens
uagcagcauaaauggacuaaga

SEQ ID NO: 78744 - RNA, 19 nt, Homo sapiens
uagcagcaugauuuauaau

SEQ ID NO: 78745 - RNA, 22 nt, Homo sapiens
uagcagcuuuauugagguaaau

SEQ ID NO: 78746 - RNA, 17 nt, Homo sapiens
uagcucuauuucuagcc

SEQ ID NO: 78747 - RNA, 22 nt, Homo sapiens
uagcuggaguuuuuguuauagg

SEQ ID NO: 78748 - RNA, 23 nt, Homo sapiens
uagcuucucccagaccugcuccc

SEQ ID NO: 78749 - RNA, 22 nt, Homo sapiens
uaggauaguccuccugagaccu

SEQ ID NO: 78750 - RNA, 22 nt, Homo sapiens
uaggucaguuuuggcuuggcuu

SEQ ID NO: 78751 - RNA, 22 nt, Homo sapiens
uaggugaaugcuggaagaaaug

SEQ ID NO: 78752 - RNA, 22 nt, Homo sapiens
uagucccuuucuauuaaugaga

SEQ ID NO: 78753 - RNA, 22 nt, Homo sapiens
uaucacaggucaggaaucuugc

SEQ ID NO: 78754 - RNA, 22 nt, Homo sapiens
uaucagcagagucauacuucaa

SEQ ID NO: 78755 - RNA, 22 nt, Homo sapiens
uaucagcagcaggggcugcaga

SEQ ID NO: 78756 - RNA, 22 nt, Homo sapiens
uaucucagagaaucagauuuac

SEQ ID NO: 78757 - RNA, 20 nt, Homo sapiens
uaucucaguuuguccuaaac

SEQ ID NO: 78758 - RNA, 22 nt, Homo sapiens
uauggcccuuaaguauugguug

SEQ ID NO: 78759 - RNA, 22 nt, Homo sapiens
uaugugcaaauuaauugcuaga

SEQ ID NO: 78760 - RNA, 22 nt, Homo sapiens
ucaagcaauucuccucucagcc

SEQ ID NO: 78761 - RNA, 20 nt, Homo sapiens
ucaaggcaggaacuguacau

SEQ ID NO: 78762 - RNA, 22 nt, Homo sapiens
ucaaugcaugugacaaagagua

SEQ ID NO: 78763 - RNA, 20 nt, Homo sapiens
ucacccugacaucugcccag

SEQ ID NO: 78764 - RNA, 21 nt, Homo sapiens
ucagaagcucccagggaggac

SEQ ID NO: 78765 - RNA, 22 nt, Homo sapiens
ucagugauugcuuucauggaaa

SEQ ID NO: 78766 - RNA, 21 nt, Homo sapiens
ucagugcaauucuauggggaa

SEQ ID NO: 78767 - RNA, 21 nt, Homo sapiens
ucaucaagcuguagacaugau

SEQ ID NO: 78768 - RNA, 22 nt, Homo sapiens
ucauggggugcuuugcuagauu

SEQ ID NO: 78769 - RNA, 19 nt, Homo sapiens
acugcacuccuccuugggu

SEQ ID NO: 78770 - RNA, 22 nt, Homo sapiens
acugcacucuagcuugggugac

SEQ ID NO: 78771 - RNA, 22 nt, Homo sapiens
acugcacuuauccuccaauguu

SEQ ID NO: 78772 - RNA, 22 nt, Homo sapiens
acugcacuucagccuugugaca

SEQ ID NO: 78773 - RNA, 22 nt, Homo sapiens
agaaccaaucccacauggauac

SEQ ID NO: 78774 - RNA, 22 nt, Homo sapiens
agagugaagcuuuuuauauucu

SEQ ID NO: 78775 - RNA, 22 nt, Homo sapiens
agcaccaugggcugaguaagug

SEQ ID NO: 78776 - RNA, 22 nt, Homo sapiens
agcagcaucgggaaguuggcca

SEQ ID NO: 78777 - RNA, 22 nt, Homo sapiens
agcagcaugaggggacuucugc

SEQ ID NO: 78778 - RNA, 22 nt, Homo sapiens
agcagcauuaugauauaucuua

SEQ ID NO: 78779 - RNA, 22 nt, Homo sapiens
agcagcauuccaaaaaucugcu

SEQ ID NO: 78780 - RNA, 22 nt, Homo sapiens
agcccagagacuguguaaauuu

SEQ ID NO: 78781 - RNA, 21 nt, Homo sapiens
agccugugggucauaguugcc

SEQ ID NO: 78782 - RNA, 22 nt, Homo sapiens
agcuccuuucugcaggcagguc

SEQ ID NO: 78783 - RNA, 22 nt, Homo sapiens
agcuuguuuucccauaacuaga

SEQ ID NO: 78784 - RNA, 22 nt, Homo sapiens
aggaaauguuggucccauuucu

SEQ ID NO: 78785 - RNA, 23 nt, Homo sapiens
aggaauggaaaaccaaguaucau

SEQ ID NO: 78786 - RNA, 22 nt, Homo sapiens
aggcaugauggcuccagaucau

SEQ ID NO: 78787 - RNA, 23 nt, Homo sapiens
aggcauuguacaguaauggaaaa

SEQ ID NO: 78788 - RNA, 21 nt, Homo sapiens
agguaguuuuccuuuuggagu

SEQ ID NO: 78789 - RNA, 22 nt, Homo sapiens
agguauguauguaugggagaaa

SEQ ID NO: 78790 - RNA, 22 nt, Homo sapiens
aggugguguuggguuccagccc

SEQ ID NO: 78791 - RNA, 22 nt, Homo sapiens
agguuguugcaugcuccuuagg

SEQ ID NO: 78792 - RNA, 22 nt, Homo sapiens
aguacaauguugaguagaagug

SEQ ID NO: 78793 - RNA, 22 nt, Homo sapiens
aguagcaauggcucugagcuau

SEQ ID NO: 78794 - RNA, 19 nt, Homo sapiens
agugagccaagauccuacc

SEQ ID NO: 78795 - RNA, 22 nt, Homo sapiens
agugcaaugauccggugcuggg

SEQ ID NO: 78796 - RNA, 22 nt, Homo sapiens
agugccacugcacucuagccug

SEQ ID NO: 78797 - RNA, 19 nt, Homo sapiens
aguggguguuuucuguuug

SEQ ID NO: 78798 - RNA, 22 nt, Homo sapiens
aguuggcacugagcugugauug

SEQ ID NO: 78799 - RNA, 22 nt, Homo sapiens
auacugucucuugcuccugccc

SEQ ID NO: 78800 - RNA, 22 nt, Homo sapiens
auagaaucaucugugcacuagu

SEQ ID NO: 78801 - RNA, 22 nt, Homo sapiens
auagcagaacagugucucacug

SEQ ID NO: 78802 - RNA, 22 nt, Homo sapiens
auaggagcacaaacuauuguga

SEQ ID NO: 78803 - RNA, 22 nt, Homo sapiens
auagugcugcaauaaacauaug

SEQ ID NO: 78804 - RNA, 22 nt, Homo sapiens
auagugcugccauaaacauacg

SEQ ID NO: 78805 - RNA, 17 nt, Homo sapiens
auaugucugcuggggga

SEQ ID NO: 78806 - RNA, 20 nt, Homo sapiens
aucaaagacuuagaggggga

SEQ ID NO: 78807 - RNA, 22 nt, Homo sapiens
aucaaagccaugcucaguuuuc

SEQ ID NO: 78808 - RNA, 22 nt, Homo sapiens
aucacagauauggguuuaaauc

SEQ ID NO: 78809 - RNA, 22 nt, Homo sapiens
aucacuggucaugagagaagua

SEQ ID NO: 78810 - RNA, 22 nt, Homo sapiens
aucagcauucccaaaugaugug

SEQ ID NO: 78811 - RNA, 18 nt, Homo sapiens
aucagggugaagagagga

SEQ ID NO: 78812 - RNA, 22 nt, Homo sapiens
aucauguuuauguguaggauau

SEQ ID NO: 78813 - RNA, 22 nt, Homo sapiens
aucgcaccauugcacuccagca

SEQ ID NO: 78814 - RNA, 19 nt, Homo sapiens
aucuggaguuccuggggcu

SEQ ID NO: 78815 - RNA, 18 nt, Homo sapiens
augaccugcggguuauau

SEQ ID NO: 78816 - RNA, 22 nt, Homo sapiens
augagcaaagagaugagacccu

SEQ ID NO: 78817 - RNA, 22 nt, Homo sapiens
augagggaagcucacgugucca

SEQ ID NO: 78818 - RNA, 22 nt, Homo sapiens
augcacuguuguuauuggauaa

SEQ ID NO: 78819 - RNA, 22 nt, Homo sapiens
augcuggugguucacaugcgca

SEQ ID NO: 78820 - RNA, 22 nt, Homo sapiens
auggcccuguguggagcugcug

SEQ ID NO: 78821 - RNA, 22 nt, Homo sapiens
auggcugugaaaugguaggugg

SEQ ID NO: 78822 - RNA, 22 nt, Homo sapiens
auggcuguuuaagaguuucauu

SEQ ID NO: 78823 - RNA, 22 nt, Homo sapiens
auggcuguuuuuuauguuacag

SEQ ID NO: 78824 - RNA, 17 nt, Homo sapiens
augugaauguucaaaua

SEQ ID NO: 78825 - RNA, 22 nt, Homo sapiens
augugcaagaucauuaaagcuc

SEQ ID NO: 78826 - RNA, 22 nt, Homo sapiens
auucaacuaauuauugaagaug

SEQ ID NO: 78827 - RNA, 22 nt, Homo sapiens
auucaaggacuggauugcggga

SEQ ID NO: 78828 - RNA, 22 nt, Homo sapiens
auugaauuugguuugcuaagaa

SEQ ID NO: 78829 - RNA, 22 nt, Homo sapiens
auugcaacuuccgccuccuggg

SEQ ID NO: 78830 - RNA, 21 nt, Homo sapiens
auugcacuccagccugggcga

SEQ ID NO: 78831 - RNA, 22 nt, Homo sapiens
auugcacuccagccugggcgac

SEQ ID NO: 78832 - RNA, 22 nt, Homo sapiens
caaagugcugaaagaggccagg

SEQ ID NO: 78833 - RNA, 22 nt, Homo sapiens
caaagugcugggaugggccagg

SEQ ID NO: 78834 - RNA, 22 nt, Homo sapiens
caacauccaccuccuggguuca

SEQ ID NO: 78835 - RNA, 22 nt, Homo sapiens
cacaaugucuaagauguuucua

SEQ ID NO: 78836 - RNA, 22 nt, Homo sapiens
cagacagugucccgagucccug

SEQ ID NO: 78837 - RNA, 22 nt, Homo sapiens
cagccggguggcuccuagggua

SEQ ID NO: 78838 - RNA, 22 nt, Homo sapiens
cauaaagauggaggaggccagg

SEQ ID NO: 78839 - RNA, 22 nt, Homo sapiens
cauggcccugggcugggcgaac

SEQ ID NO: 78840 - RNA, 22 nt, Homo sapiens
cauggcucuuguuuacucccag

SEQ ID NO: 78841 - RNA, 23 nt, Homo sapiens
cauggcuguuaacacuguuugag

SEQ ID NO: 78842 - RNA, 23 nt, Homo sapiens
ccacaaugguugaacuagauuac

SEQ ID NO: 78843 - RNA, 22 nt, Homo sapiens
ccagaguugccucagguuucug

SEQ ID NO: 78844 - RNA, 22 nt, Homo sapiens
cccagaguucuuaaauacugag

SEQ ID NO: 78845 - RNA, 22 nt, Homo sapiens
ccugagacgaauggagugaaca

SEQ ID NO: 78846 - RNA, 22 nt, Homo sapiens
ccugguguuuugauggucgggu

SEQ ID NO: 78847 - RNA, 22 nt, Homo sapiens
ccuucauccuccagcaggcuag

SEQ ID NO: 78848 - RNA, 22 nt, Homo sapiens
cuaagugaacugucacugagaa

SEQ ID NO: 78849 - RNA, 18 nt, Homo sapiens
cucaaccucaugcagggc

SEQ ID NO: 78850 - RNA, 22 nt, Homo sapiens
cucaccuugugauccacccacc

SEQ ID NO: 78851 - RNA, 22 nt, Homo sapiens
cucaggguacuucuccuuugcu

SEQ ID NO: 78852 - RNA, 22 nt, Homo sapiens
cucauggagauagagaauagaa

SEQ ID NO: 78853 - RNA, 22 nt, Homo sapiens
cucauugcaaucucugccuccc

SEQ ID NO: 78854 - RNA, 23 nt, Homo sapiens
cuccaugagccguccagggccug

SEQ ID NO: 78855 - RNA, 22 nt, Homo sapiens
cucucaagaugcugggauuaca

SEQ ID NO: 78856 - RNA, 22 nt, Homo sapiens
cucugguggaagcagggggcaa

SEQ ID NO: 78857 - RNA, 22 nt, Homo sapiens
cucugguuucgcaggaaauaga

SEQ ID NO: 78858 - RNA, 22 nt, Homo sapiens
cugaaucauugcauuaucaagg

SEQ ID NO: 78859 - RNA, 22 nt, Homo sapiens
cugagguuguucuucucagugg

SEQ ID NO: 78860 - RNA, 22 nt, Homo sapiens
cugcacugagacccucuuugcu

SEQ ID NO: 78861 - RNA, 22 nt, Homo sapiens
cugcauaaucaucucucugcau

SEQ ID NO: 78862 - RNA, 22 nt, Homo sapiens
cuggaaacaucuuaggaaugca

SEQ ID NO: 78863 - RNA, 22 nt, Homo sapiens
cuggaguaugaaccauguauca

SEQ ID NO: 78864 - RNA, 21 nt, Homo sapiens
uaucacaguagaauaggaucu

SEQ ID NO: 78865 - RNA, 22 nt, Homo sapiens
uauggaaaucuuaccuuauggu

SEQ ID NO: 78866 - RNA, 22 nt, Homo sapiens
uaugucuauuauguagcaggaa

SEQ ID NO: 78867 - RNA, 22 nt, Homo sapiens
uaugucuggaguuacugagcug

SEQ ID NO: 78868 - RNA, 20 nt, Homo sapiens
uauuacagaguaauggugga

SEQ ID NO: 78869 - RNA, 22 nt, Homo sapiens
ucaaaucaucuuuuccaaagcu

SEQ ID NO: 78870 - RNA, 22 nt, Homo sapiens
ucaagcaauucugcugccucag

SEQ ID NO: 78871 - RNA, 23 nt, Homo sapiens
ucacacuuaagagaaaugcagcu

SEQ ID NO: 78872 - RNA, 22 nt, Homo sapiens
ucacagaugcuugacccauuuc

SEQ ID NO: 78873 - RNA, 22 nt, Homo sapiens
ucacaggguguuauuagaauua

SEQ ID NO: 78874 - RNA, 22 nt, Homo sapiens
ucacauggaggugauaguugaa

SEQ ID NO: 78875 - RNA, 22 nt, Homo sapiens
ucacccuguguuuugcguuugc

SEQ ID NO: 78876 - RNA, 19 nt, Homo sapiens
ucacuggacagcacacuca

SEQ ID NO: 78877 - RNA, 22 nt, Homo sapiens
ucacuggacucuagccugggug

SEQ ID NO: 78878 - RNA, 22 nt, Homo sapiens
ucacuuuguauagcgacuggcu

SEQ ID NO: 78879 - RNA, 22 nt, Homo sapiens
ucagaaccuccuagcaguguuc

SEQ ID NO: 78880 - RNA, 22 nt, Homo sapiens
ucagaucuucagcaggggcccc

SEQ ID NO: 78881 - RNA, 22 nt, Homo sapiens
ucaguccccucgcugagucuac

SEQ ID NO: 78882 - RNA, 22 nt, Homo sapiens
ucagugccucaguuuuuaaaga

SEQ ID NO: 78883 - RNA, 22 nt, Homo sapiens
ucagugcuguaccaucuaagga

SEQ ID NO: 78884 - RNA, 22 nt, Homo sapiens
ucaucaggaaacuuaugcagug

SEQ ID NO: 78885 - RNA, 22 nt, Homo sapiens
uccaaaucucuggcacugggau

SEQ ID NO: 78886 - RNA, 22 nt, Homo sapiens
uccagaguggugaugcuggggc

SEQ ID NO: 78887 - RNA, 22 nt, Homo sapiens
uccagugugcaggcaaguuuga

SEQ ID NO: 78888 - RNA, 22 nt, Homo sapiens
uccaguuuucuuuccuagggcu

SEQ ID NO: 78889 - RNA, 22 nt, Homo sapiens
uccauuuguucagcuucaggaa

SEQ ID NO: 78890 - RNA, 19 nt, Homo sapiens
uccccaguuuuccguucag

SEQ ID NO: 78891 - RNA, 23 nt, Homo sapiens
uccccgggagcaccagcuuguug

SEQ ID NO: 78892 - RNA, 22 nt, Homo sapiens
ucccuguguuccuuuugaauug

SEQ ID NO: 78893 - RNA, 23 nt, Homo sapiens
uccuugguuggcgcccuaugugu

SEQ ID NO: 78894 - RNA, 22 nt, Homo sapiens
ucgcaccauugcacuccagcca

SEQ ID NO: 78895 - RNA, 22 nt, Homo sapiens
ucucaaguaacugggacaauaa

SEQ ID NO: 78896 - RNA, 22 nt, Homo sapiens
ucucagugugguaaaaguuuuu

SEQ ID NO: 78897 - RNA, 20 nt, Homo sapiens
ucucauggagggaaagagca

SEQ ID NO: 78898 - RNA, 22 nt, Homo sapiens
ucucauggagucaggagcagaa

SEQ ID NO: 78899 - RNA, 22 nt, Homo sapiens
ucucccauccaugaacuucugu

SEQ ID NO: 78900 - RNA, 17 nt, Homo sapiens
ucucccaucccuuucuc

SEQ ID NO: 78901 - RNA, 22 nt, Homo sapiens
ucuccggguggcggcgaaggga

SEQ ID NO: 78902 - RNA, 22 nt, Homo sapiens
ucugagcaauagauguggauau

SEQ ID NO: 78903 - RNA, 22 nt, Homo sapiens
ucugagcaugcaucuugccugg

SEQ ID NO: 78904 - RNA, 22 nt, Homo sapiens
ucuggcaagagccgagggcagu

SEQ ID NO: 78905 - RNA, 20 nt, Homo sapiens
ucuggccccucuaaaucuca

SEQ ID NO: 78906 - RNA, 22 nt, Homo sapiens
ugaaacauacacucugaugggg

SEQ ID NO: 78907 - RNA, 22 nt, Homo sapiens
ugaaauguaaguugucuagucu

SEQ ID NO: 78908 - RNA, 22 nt, Homo sapiens
ugaaguaauguuuuauucuauu

SEQ ID NO: 78909 - RNA, 22 nt, Homo sapiens
ugaagugaaugguaaguaugcc

SEQ ID NO: 78910 - RNA, 22 nt, Homo sapiens
ugacuggaacuuuagugagucu

SEQ ID NO: 78911 - RNA, 22 nt, Homo sapiens
ugacuggagucuugcucugucg

SEQ ID NO: 78912 - RNA, 22 nt, Homo sapiens
ugacuugaaacgugaacagauc

SEQ ID NO: 78913 - RNA, 22 nt, Homo sapiens
ugacuugaucauuacacauucu

SEQ ID NO: 78914 - RNA, 22 nt, Homo sapiens
ugagaagcauaccagugucugu

SEQ ID NO: 78915 - RNA, 22 nt, Homo sapiens
ugagacugagucucgcucuauu

SEQ ID NO: 78916 - RNA, 22 nt, Homo sapiens
ugagacugagucuugcucuauu

SEQ ID NO: 78917 - RNA, 22 nt, Homo sapiens
ugagacugaguuucacuuuugu

SEQ ID NO: 78918 - RNA, 22 nt, Homo sapiens
ugagacugaguuucgcucuugu

SEQ ID NO: 78919 - RNA, 22 nt, Homo sapiens
ugagacugaguuuugccuuugu

SEQ ID NO: 78920 - RNA, 22 nt, Homo sapiens
ugagaucaugccacugcacuuc

SEQ ID NO: 78921 - RNA, 22 nt, Homo sapiens
ugagauccaugcuauuugggcu

SEQ ID NO: 78922 - RNA, 22 nt, Homo sapiens
ugagaugaggucucgcucuguc

SEQ ID NO: 78923 - RNA, 22 nt, Homo sapiens
ugagaugaugggauaagagggc

SEQ ID NO: 78924 - RNA, 22 nt, Homo sapiens
ugagaugugaagaucacaugaa

SEQ ID NO: 78925 - RNA, 22 nt, Homo sapiens
ugagcagagaagugcccugcgc

SEQ ID NO: 78926 - RNA, 22 nt, Homo sapiens
ugagcagagggagaaguaaauu

SEQ ID NO: 78927 - RNA, 22 nt, Homo sapiens
ugaggcaggagaacggcuugaa

SEQ ID NO: 78928 - RNA, 22 nt, Homo sapiens
ugaggugcagcaauccucaugu

SEQ ID NO: 78929 - RNA, 22 nt, Homo sapiens
ugaguuaauuuuuguaucaugu

SEQ ID NO: 78930 - RNA, 22 nt, Homo sapiens
ugaguuccuuucccaguccagu

SEQ ID NO: 78931 - RNA, 22 nt, Homo sapiens
ugaguucuuuguagauucugug

SEQ ID NO: 78932 - RNA, 22 nt, Homo sapiens
ugaguucuuuuacauuuugaau

SEQ ID NO: 78933 - RNA, 22 nt, Homo sapiens
ugaugacauugucacagucuga

SEQ ID NO: 78934 - RNA, 22 nt, Homo sapiens
ugauuuguuucaggaguuuucu

SEQ ID NO: 78935 - RNA, 22 nt, Homo sapiens
ugcaaacuuccuugggcagcau

SEQ ID NO: 78936 - RNA, 19 nt, Homo sapiens
ugcaaauucuaaaaacuga

SEQ ID NO: 78937 - RNA, 22 nt, Homo sapiens
ugcaaucauuuggaggagaaga

SEQ ID NO: 78938 - RNA, 22 nt, Homo sapiens
ugcagcacaguagguuugcaau

SEQ ID NO: 78939 - RNA, 22 nt, Homo sapiens
ugcauccauucuagacucaucu

SEQ ID NO: 78940 - RNA, 20 nt, Homo sapiens
ugccugacacucuuugcuuc

SEQ ID NO: 78941 - RNA, 22 nt, Homo sapiens
ugcuaugucagccaggcugguc

SEQ ID NO: 78942 - RNA, 22 nt, Homo sapiens
ugcugcacuuauggcucugagg

SEQ ID NO: 78943 - RNA, 22 nt, Homo sapiens
uggaaauaaaauagaguuugcc

SEQ ID NO: 78944 - RNA, 22 nt, Homo sapiens
uggaaugguaucuuguuggggu

SEQ ID NO: 78945 - RNA, 21 nt, Homo sapiens
uggaccccuuccuuacaucau

SEQ ID NO: 78946 - RNA, 22 nt, Homo sapiens
uuccuuguuuauuuacaggagg

SEQ ID NO: 78947 - RNA, 21 nt, Homo sapiens
uucuacuccggcguuguuuuu

SEQ ID NO: 78948 - RNA, 22 nt, Homo sapiens
uucuacuccucauggcagguug

SEQ ID NO: 78949 - RNA, 22 nt, Homo sapiens
uucucaaggagccuucguaacu

SEQ ID NO: 78950 - RNA, 22 nt, Homo sapiens
uucucauggaacaucuguacug

SEQ ID NO: 78951 - RNA, 19 nt, Homo sapiens
uucucugguuguacuaccc

SEQ ID NO: 78952 - RNA, 22 nt, Homo sapiens
uucuggccuccauuuuucuccu

SEQ ID NO: 78953 - RNA, 22 nt, Homo sapiens
uugaaccauucuuuugauagag

SEQ ID NO: 78954 - RNA, 22 nt, Homo sapiens
uugagauggagucucacgcauu

SEQ ID NO: 78955 - RNA, 22 nt, Homo sapiens
uugagauggagucucacucuuc

SEQ ID NO: 78956 - RNA, 22 nt, Homo sapiens
uugagauggagucucacucuuu

SEQ ID NO: 78957 - RNA, 22 nt, Homo sapiens
uugagauggagucucgcacugu

SEQ ID NO: 78958 - RNA, 22 nt, Homo sapiens
uugagauggaguuucaauauug

SEQ ID NO: 78959 - RNA, 22 nt, Homo sapiens
uugagauggaguuucacucuug

SEQ ID NO: 78960 - RNA, 22 nt, Homo sapiens
uugagccaaggauugucuuucc

SEQ ID NO: 78961 - RNA, 16 nt, Homo sapiens
uugaggcaugucucag

SEQ ID NO: 78962 - RNA, 22 nt, Homo sapiens
uugagguggugucuugcucugu

SEQ ID NO: 78963 - RNA, 22 nt, Homo sapiens
uugcaugucauaacugauggaa

SEQ ID NO: 78964 - RNA, 22 nt, Homo sapiens
uugccuuuguuggaaacaagug

SEQ ID NO: 78965 - RNA, 19 nt, Homo sapiens
uuggaauuuuagaguuuga

SEQ ID NO: 78966 - RNA, 22 nt, Homo sapiens
uuggagcacuggggcacugaca

SEQ ID NO: 78967 - RNA, 22 nt, Homo sapiens
uuggauuuugguggcaacucau

SEQ ID NO: 78968 - RNA, 22 nt, Homo sapiens
uuggcuguguuccucaaggagu

SEQ ID NO: 78969 - RNA, 22 nt, Homo sapiens
uuggcuucuggacuauugugca

SEQ ID NO: 78970 - RNA, 22 nt, Homo sapiens
uuggucagcucaauggagaggg

SEQ ID NO: 78971 - RNA, 22 nt, Homo sapiens
uuguacuuuuaguagagacggg

SEQ ID NO: 78972 - RNA, 20 nt, Homo sapiens
uugugcauugggccauuggg

SEQ ID NO: 78973 - RNA, 22 nt, Homo sapiens
uuuagcaaugcuguggggaagu

SEQ ID NO: 78974 - RNA, 22 nt, Homo sapiens
uuuagcucauucaauuucaguc

SEQ ID NO: 78975 - RNA, 22 nt, Homo sapiens
uuucccugaaggcucugaaguc

SEQ ID NO: 78976 - RNA, 22 nt, Homo sapiens
uuuccuggagaaucuuaacaaa

SEQ ID NO: 78977 - RNA, 22 nt, Homo sapiens
uuucugugguccucuugaaggu

SEQ ID NO: 78978 - RNA, 22 nt, Homo sapiens
uuugcaucuuuugcuuccugga

SEQ ID NO: 78979 - RNA, 22 nt, Homo sapiens
uuuggaaugaaacagcagagcc

SEQ ID NO: 78980 - RNA, 22 nt, Homo sapiens
uuuggaaugugcacucagauug

SEQ ID NO: 78981 - RNA, 22 nt, Homo sapiens
uuuggauagugugguccuuuua

SEQ ID NO: 78982 - RNA, 22 nt, Homo sapiens
uuuggcagaaaacaagaaucug

SEQ ID NO: 78983 - RNA, 22 nt, Homo sapiens
uuuggcaugggcuauuugcuuu

SEQ ID NO: 78984 - RNA, 22 nt, Homo sapiens
uuuggcauuuuacuacucaaau

SEQ ID NO: 78985 - RNA, 18 nt, Homo sapiens
uuuggcuguucaugacuc

SEQ ID NO: 78986 - RNA, 22 nt, Homo sapiens
uuuggcuuuuguaauaacugcc

SEQ ID NO: 78987 - RNA, 22 nt, Homo sapiens
uuugggaaaugaaguugguaga

SEQ ID NO: 78988 - RNA, 22 nt, Homo sapiens
uuugugauugcacacucaagau

SEQ ID NO: 78989 - RNA, 22 nt, Homo sapiens
uuuguguggccuuggccuggca

SEQ ID NO: 78990 - RNA, 22 nt, Homo sapiens
uuugugugugauuauaaaaggu

SEQ ID NO: 78991 - RNA, 22 nt, Homo sapiens
uuuugcaguuacagagagugag

SEQ ID NO: 78992 - RNA, 22 nt, Homo sapiens
uuuuggcucugucuguaucuuu

SEQ ID NO: 78993 - RNA, 22 nt, Homo sapiens
cacccuugcagggacagcuuug

SEQ ID NO: 78994 - RNA, 22 nt, Homo sapiens
caccggauucauggggaagaag

SEQ ID NO: 78995 - RNA, 22 nt, Homo sapiens
cagagguauugcaaaagccuag

SEQ ID NO: 78996 - RNA, 22 nt, Homo sapiens
cagagugcauguuuagaugagu

SEQ ID NO: 78997 - RNA, 22 nt, Homo sapiens
cagcuaaauuguuaaauccaag

SEQ ID NO: 78998 - RNA, 22 nt, Homo sapiens
cagcuguuguuaugucugcagg

SEQ ID NO: 78999 - RNA, 22 nt, Homo sapiens
cagggcauugucuucuuaguac

SEQ ID NO: 79000 - RNA, 22 nt, Homo sapiens
cagugcaaccuccaucucucgg

SEQ ID NO: 79001 - RNA, 21 nt, Homo sapiens
caucacauuacucaaaguccu

SEQ ID NO: 79002 - RNA, 22 nt, Homo sapiens
ccaggguuccacgccuggcugu

SEQ ID NO: 79003 - RNA, 22 nt, Homo sapiens
ccaucccuuucugagcaguucc

SEQ ID NO: 79004 - RNA, 22 nt, Homo sapiens
cccaguuuugcuucucaugagg

SEQ ID NO: 79005 - RNA, 22 nt, Homo sapiens
ccccguuacagccucagugccu

SEQ ID NO: 79006 - RNA, 22 nt, Homo sapiens
ccucauggagaacuucugcuag

SEQ ID NO: 79007 - RNA, 22 nt, Homo sapiens
ccucuuuguugagacuucacca

SEQ ID NO: 79008 - RNA, 22 nt, Homo sapiens
ccuggaucauugucauucccaa

SEQ ID NO: 79009 - RNA, 22 nt, Homo sapiens
ccugucuugauuaaauuacuua

SEQ ID NO: 79010 - RNA, 22 nt, Homo sapiens
ccuuggcacuuugccacagugc

SEQ ID NO: 79011 - RNA, 19 nt, Homo sapiens
cuaaaugggucccuagugg

SEQ ID NO: 79012 - RNA, 22 nt, Homo sapiens
cuaaggaaggacugaaaggaca

SEQ ID NO: 79013 - RNA, 22 nt, Homo sapiens
cuaugucuuucauauuuugggg

SEQ ID NO: 79014 - RNA, 22 nt, Homo sapiens
cucaaguacaugggauuacagg

SEQ ID NO: 79015 - RNA, 22 nt, Homo sapiens
cucccacccucauuuuuaggca

SEQ ID NO: 79016 - RNA, 20 nt, Homo sapiens
cuccuucauuccuuuggacc

SEQ ID NO: 79017 - RNA, 22 nt, Homo sapiens
cucucugagccauggcugcccu

SEQ ID NO: 79018 - RNA, 22 nt, Homo sapiens
cugagaacaucauucagauauu

SEQ ID NO: 79019 - RNA, 22 nt, Homo sapiens
cugagcacugagauccucuagc

SEQ ID NO: 79020 - RNA, 22 nt, Homo sapiens
cugagguaauuuguugccagua

SEQ ID NO: 79021 - RNA, 22 nt, Homo sapiens
cugaucuguagcagccaccaca

SEQ ID NO: 79022 - RNA, 22 nt, Homo sapiens
cugauuuguccccagccucaug

SEQ ID NO: 79023 - RNA, 19 nt, Homo sapiens
cugcacugagaaaaggagg

SEQ ID NO: 79024 - RNA, 22 nt, Homo sapiens
cugcagguaggggcagcuuugg

SEQ ID NO: 79025 - RNA, 22 nt, Homo sapiens
cugcuggucuuuaaggucuagg

SEQ ID NO: 79026 - RNA, 20 nt, Homo sapiens
cuggaugucgaggcagaggu

SEQ ID NO: 79027 - RNA, 22 nt, Homo sapiens
gugagauggagucuugcuuugu

SEQ ID NO: 79028 - RNA, 22 nt, Homo sapiens
gugagcauaggaggcuucuguu

SEQ ID NO: 79029 - RNA, 17 nt, Homo sapiens
gugagguggguaguauc

SEQ ID NO: 79030 - RNA, 21 nt, Homo sapiens
gugcacaguaguguuuaauag

SEQ ID NO: 79031 - RNA, 22 nt, Homo sapiens
guggaaguuaagugacuuucug

SEQ ID NO: 79032 - RNA, 22 nt, Homo sapiens
guggcaagaauguacaaaaggu

SEQ ID NO: 79033 - RNA, 22 nt, Homo sapiens
guggcaaguguuccaagaggcg

SEQ ID NO: 79034 - RNA, 22 nt, Homo sapiens
guggcagaaaagagaagcaaug

SEQ ID NO: 79035 - RNA, 18 nt, Homo sapiens
gugucugguuaugggagu

SEQ ID NO: 79036 - RNA, 21 nt, Homo sapiens
gugugcuugaauucagcuguc

SEQ ID NO: 79037 - RNA, 22 nt, Homo sapiens
guuugccuuuuagauaggaaug

SEQ ID NO: 79038 - RNA, 22 nt, Homo sapiens
uaaagugcugagaugaggcugg

SEQ ID NO: 79039 - RNA, 22 nt, Homo sapiens
uaaauggauauugccaucuccu

SEQ ID NO: 79040 - RNA, 21 nt, Homo sapiens
uaacagcuccacuccauucuc

SEQ ID NO: 79041 - RNA, 22 nt, Homo sapiens
uaaguugcagguugugauucca

SEQ ID NO: 79042 - RNA, 23 nt, Homo sapiens
uacagcugcagaaucaggcuaag

SEQ ID NO: 79043 - RNA, 22 nt, Homo sapiens
uagcagcagugguguauuuaga

SEQ ID NO: 79044 - RNA, 22 nt, Homo sapiens
uaggcacacaucuacuacaaau

SEQ ID NO: 79045 - RNA, 22 nt, Homo sapiens
uagggcaugugggaaguuauaa

SEQ ID NO: 79046 - RNA, 22 nt, Homo sapiens
uaucacagaggguauccuagag

SEQ ID NO: 79047 - RNA, 22 nt, Homo sapiens
uaucacagcauugucuauaaua

SEQ ID NO: 79048 - RNA, 22 nt, Homo sapiens
uaugaaagcuacuucucacaau

SEQ ID NO: 79049 - RNA, 22 nt, Homo sapiens
uaugccuuuuggcucaagaaac

SEQ ID NO: 79050 - RNA, 22 nt, Homo sapiens
uauuacugucaauaucacagaa

SEQ ID NO: 79051 - RNA, 22 nt, Homo sapiens
uauucaagccaaauucaagcca

SEQ ID NO: 79052 - RNA, 20 nt, Homo sapiens
uauugccuaaauaccagaau

SEQ ID NO: 79053 - RNA, 22 nt, Homo sapiens
ucaaagugacaaaguugcagca

SEQ ID NO: 79054 - RNA, 22 nt, Homo sapiens
ucaaaugauucacccaccuuug

SEQ ID NO: 79055 - RNA, 22 nt, Homo sapiens
ucaagcaauucgccugucucag

SEQ ID NO: 79056 - RNA, 22 nt, Homo sapiens
ucaagcaauucuccugccucag

SEQ ID NO: 79057 - RNA, 20 nt, Homo sapiens
ucaaggcacgaauaaaaguu

SEQ ID NO: 79058 - RNA, 22 nt, Homo sapiens
ucaaugaaugaugguugguaug

SEQ ID NO: 79059 - RNA, 19 nt, Homo sapiens
ucacaggguugacuugagg

SEQ ID NO: 79060 - RNA, 22 nt, Homo sapiens
ucacaguugauugaaacacagc

SEQ ID NO: 79061 - RNA, 22 nt, Homo sapiens
ucacccugacaugcggccgaac

SEQ ID NO: 79062 - RNA, 22 nt, Homo sapiens
ucagauguuuuguuuaucugcu

SEQ ID NO: 79063 - RNA, 22 nt, Homo sapiens
ucagcaaugcugcacucuacug

SEQ ID NO: 79064 - RNA, 22 nt, Homo sapiens
ucagugccauugccauaugagu

SEQ ID NO: 79065 - RNA, 22 nt, Homo sapiens
ucaucagguaugucagcggagu

SEQ ID NO: 79066 - RNA, 22 nt, Homo sapiens
ucauggcuuuuauuauguugag

SEQ ID NO: 79067 - RNA, 19 nt, Homo sapiens
ucauggcuuuuucagcugu

SEQ ID NO: 79068 - RNA, 18 nt, Homo sapiens
uccaguuuucccagcauc

SEQ ID NO: 79069 - RNA, 22 nt, Homo sapiens
ucccuggacagccuugccuggg

SEQ ID NO: 79070 - RNA, 22 nt, Homo sapiens
ucccuggagcaagagaagaagg

SEQ ID NO: 79071 - RNA, 22 nt, Homo sapiens
uccugagaauagaguugcaugu

SEQ ID NO: 79072 - RNA, 22 nt, Homo sapiens
uccugcauucauccugguguug

SEQ ID NO: 79073 - RNA, 22 nt, Homo sapiens
uccuucaguccaguggguuuug

SEQ ID NO: 79074 - RNA, 22 nt, Homo sapiens
uccuugguugauccugugcaga

SEQ ID NO: 79075 - RNA, 22 nt, Homo sapiens
ucgcauuucccucuguagcuuc

SEQ ID NO: 79076 - RNA, 17 nt, Homo sapiens
ucuaauaauaugcauuu

SEQ ID NO: 79077 - RNA, 22 nt, Homo sapiens
ucuauggaguuugaaugagaaa

SEQ ID NO: 79078 - RNA, 22 nt, Homo sapiens
ucucaauuugauuacauucaua

SEQ ID NO: 79079 - RNA, 22 nt, Homo sapiens
ucucacaccccucucauauacc

SEQ ID NO: 79080 - RNA, 22 nt, Homo sapiens
ucucagugaaauaaauuauuuu

SEQ ID NO: 79081 - RNA, 22 nt, Homo sapiens
ucucagugaauguggaaaaagc

SEQ ID NO: 79082 - RNA, 22 nt, Homo sapiens
ucucagugaauugguuuugucu

SEQ ID NO: 79083 - RNA, 22 nt, Homo sapiens
ucucagugacugcugggucccc

SEQ ID NO: 79084 - RNA, 22 nt, Homo sapiens
ucucaguggcuuccucacuuuu

SEQ ID NO: 79085 - RNA, 22 nt, Homo sapiens
ucucaguguuaucuaucugccu

SEQ ID NO: 79086 - RNA, 19 nt, Homo sapiens
ucucaguguuggucaggug

SEQ ID NO: 79087 - RNA, 22 nt, Homo sapiens
ucucuugguugaacaguuugga

SEQ ID NO: 79088 - RNA, 22 nt, Homo sapiens
ucugacucugugaugggcccaa

SEQ ID NO: 79089 - RNA, 22 nt, Homo sapiens
ucugagguaggugcauggauac

SEQ ID NO: 79090 - RNA, 21 nt, Homo sapiens
ucugagucauucaguggccug

SEQ ID NO: 79091 - RNA, 21 nt, Homo sapiens
ucuggcccccucaaaucucau

SEQ ID NO: 79092 - RNA, 22 nt, Homo sapiens
ucuggccccucucaaaucucau

SEQ ID NO: 79093 - RNA, 22 nt, Homo sapiens
ucuggccuccuaugagaaucga

SEQ ID NO: 79094 - RNA, 22 nt, Homo sapiens
ucuggucccugcacauauuuuc

SEQ ID NO: 79095 - RNA, 22 nt, Homo sapiens
ucugucaaaucuuauguuguag

SEQ ID NO: 79096 - RNA, 22 nt, Homo sapiens
ucugugcuugucauaugcuuug

SEQ ID NO: 79097 - RNA, 22 nt, Homo sapiens
ucuguguuuagacccaggguag

SEQ ID NO: 79098 - RNA, 22 nt, Homo sapiens
ucuugguuaggggaaauaggca

SEQ ID NO: 79099 - RNA, 22 nt, Homo sapiens
ucuuuguguaggucaaucuggc

SEQ ID NO: 79100 - RNA, 22 nt, Homo sapiens
ucuuuuguucuauucaggccuu

SEQ ID NO: 79101 - RNA, 22 nt, Homo sapiens
ugaaaugucuuuaggaggcuuc

SEQ ID NO: 79102 - RNA, 20 nt, Homo sapiens
ugaaggaggucauuuauacc

SEQ ID NO: 79103 - RNA, 22 nt, Homo sapiens
ugaaugguaaagaaaagcacug

SEQ ID NO: 79104 - RNA, 22 nt, Homo sapiens
ugacagaggucuuuuaauagcu

SEQ ID NO: 79105 - RNA, 22 nt, Homo sapiens
ugacaguaucuacagcuucuua

SEQ ID NO: 79106 - RNA, 22 nt, Homo sapiens
ugacucaagagccugacucauc

SEQ ID NO: 79107 - RNA, 22 nt, Homo sapiens
ugacucaguuguuagucuucau

SEQ ID NO: 79108 - RNA, 21 nt, Homo sapiens
ugagaacaacaggucaagcag

SEQ ID NO: 79109 - RNA, 22 nt, Homo sapiens
ugagacggagucuugcucuguc

SEQ ID NO: 79110 - RNA, 22 nt, Homo sapiens
ugagacugagucucgcucuugu

SEQ ID NO: 79111 - RNA, 22 nt, Homo sapiens
ugagacugaguuuugcucuugu

SEQ ID NO: 79112 - RNA, 22 nt, Homo sapiens
ugagaucacgccacugcacucc

SEQ ID NO: 79113 - RNA, 22 nt, Homo sapiens
ugagaucugauaggccuggguu

SEQ ID NO: 79114 - RNA, 22 nt, Homo sapiens
ugagaugaaagcagaaagacuu

SEQ ID NO: 79115 - RNA, 22 nt, Homo sapiens
ugagauguugcucugaaacaag

SEQ ID NO: 79116 - RNA, 22 nt, Homo sapiens
ugagcacaggugcgcgguuacu

SEQ ID NO: 79117 - RNA, 22 nt, Homo sapiens
ugagcugagaaaugcagcagcu

SEQ ID NO: 79118 - RNA, 21 nt, Homo sapiens
ugaggucaugaugcugcuucc

SEQ ID NO: 79119 - RNA, 22 nt, Homo sapiens
ugaguucuuccuaucucugccu

SEQ ID NO: 79120 - RNA, 22 nt, Homo sapiens
ugauggccuguucuccauaugu

SEQ ID NO: 79121 - RNA, 21 nt, Homo sapiens
ugcaagaaucaggaagcugcc

SEQ ID NO: 79122 - RNA, 17 nt, Homo sapiens
ugcagcacacugauggg

SEQ ID NO: 79123 - RNA, 22 nt, Homo sapiens
ugcaucaggcugcuuauuacaa

SEQ ID NO: 79124 - RNA, 22 nt, Homo sapiens
augacagugagugagcucucac

SEQ ID NO: 79125 - RNA, 22 nt, Homo sapiens
augagaaugaagccuggcgugu

SEQ ID NO: 79126 - RNA, 22 nt, Homo sapiens
augaggaagucaggcccagggg

SEQ ID NO: 79127 - RNA, 22 nt, Homo sapiens
augagguaguagaaagucaggu

SEQ ID NO: 79128 - RNA, 22 nt, Homo sapiens
augcaauucuagauugauagua

SEQ ID NO: 79129 - RNA, 19 nt, Homo sapiens
augcugguguugcucaaac

SEQ ID NO: 79130 - RNA, 22 nt, Homo sapiens
auggaacauaacuauuugggga

SEQ ID NO: 79131 - RNA, 22 nt, Homo sapiens
auggaacauuauagauguaaaa

SEQ ID NO: 79132 - RNA, 22 nt, Homo sapiens
auggaucuuucugcuuuugaau

SEQ ID NO: 79133 - RNA, 22 nt, Homo sapiens
auggccugaugcaccuguccca

SEQ ID NO: 79134 - RNA, 22 nt, Homo sapiens
augucacugcacuccugccugg

SEQ ID NO: 79135 - RNA, 22 nt, Homo sapiens
augucuggcagaagacuucuca

SEQ ID NO: 79136 - RNA, 22 nt, Homo sapiens
auucaagggauuucaggaggcu

SEQ ID NO: 79137 - RNA, 22 nt, Homo sapiens
auucacuguggcuuucucugau

SEQ ID NO: 79138 - RNA, 22 nt, Homo sapiens
auucccuuagcugccucagccu

SEQ ID NO: 79139 - RNA, 22 nt, Homo sapiens
auugcaacaguguugagaggug

SEQ ID NO: 79140 - RNA, 22 nt, Homo sapiens
auugcccaggcuggagugcagu

SEQ ID NO: 79141 - RNA, 22 nt, Homo sapiens
caaagugcuggaauuggccggg

SEQ ID NO: 79142 - RNA, 22 nt, Homo sapiens
caaagugcuggccgggcgcagu

SEQ ID NO: 79143 - RNA, 22 nt, Homo sapiens
caaagugcugggacuggccggg

SEQ ID NO: 79144 - RNA, 22 nt, Homo sapiens
caaggcacagccccuacuuccu

SEQ ID NO: 79145 - RNA, 22 nt, Homo sapiens
caaugguacuagauaucuucag

SEQ ID NO: 79146 - RNA, 22 nt, Homo sapiens
cacaggaagaggcacggucccu

SEQ ID NO: 79147 - RNA, 23 nt, Homo sapiens
cacagggugaacaccccuaaucc

SEQ ID NO: 79148 - RNA, 19 nt, Homo sapiens
caccagugcaugcuacuau

SEQ ID NO: 79149 - RNA, 22 nt, Homo sapiens
caccuugugauccacccgccuu

SEQ ID NO: 79150 - RNA, 22 nt, Homo sapiens
cacugcaguaaauugcgucggu

SEQ ID NO: 79151 - RNA, 17 nt, Homo sapiens
cacugggugcaagagga

SEQ ID NO: 79152 - RNA, 21 nt, Homo sapiens
cacuggguucaggcuugugga

SEQ ID NO: 79153 - RNA, 22 nt, Homo sapiens
cagacaugucuuguggccgugg

SEQ ID NO: 79154 - RNA, 22 nt, Homo sapiens
cagagguaagcaagucagcauu

SEQ ID NO: 79155 - RNA, 22 nt, Homo sapiens
cagcaucauucaucugggguaa

SEQ ID NO: 79156 - RNA, 22 nt, Homo sapiens
cagggcaugugggucuauuggc

SEQ ID NO: 79157 - RNA, 22 nt, Homo sapiens
cagggcauuggcugguaccugg

SEQ ID NO: 79158 - RNA, 20 nt, Homo sapiens
cagugcacuuucccacuggu

SEQ ID NO: 79159 - RNA, 22 nt, Homo sapiens
cagugguuuucaacccugguug

SEQ ID NO: 79160 - RNA, 22 nt, Homo sapiens
cagugucugcauuuggaacuca

SEQ ID NO: 79161 - RNA, 22 nt, Homo sapiens
caucagcaauguaugaggguuc

SEQ ID NO: 79162 - RNA, 22 nt, Homo sapiens
caucccauucgaggggcacagc

SEQ ID NO: 79163 - RNA, 22 nt, Homo sapiens
cauggcccuggguccauaggaa

SEQ ID NO: 79164 - RNA, 22 nt, Homo sapiens
caugugcaugcuuucuuaugug

SEQ ID NO: 79165 - RNA, 22 nt, Homo sapiens
cauuuugguuaaauagguagcu

SEQ ID NO: 79166 - RNA, 22 nt, Homo sapiens
ccacagucuaugcaacaagguc

SEQ ID NO: 79167 - RNA, 22 nt, Homo sapiens
ccagcaccauuuauuaaauagg

SEQ ID NO: 79168 - RNA, 22 nt, Homo sapiens
ccagcaccauuuguugaauagg

SEQ ID NO: 79169 - RNA, 20 nt, Homo sapiens
ccagcaucauuagauucugg

SEQ ID NO: 79170 - RNA, 22 nt, Homo sapiens
cccagagacagaaugauaaacu

SEQ ID NO: 79171 - RNA, 22 nt, Homo sapiens
ccucaguguuuaucauuauuuu

SEQ ID NO: 79172 - RNA, 22 nt, Homo sapiens
ccucauggagaacaucugcuag

SEQ ID NO: 79173 - RNA, 22 nt, Homo sapiens
ccucauggagaaccucugcuag

SEQ ID NO: 79174 - RNA, 22 nt, Homo sapiens
ccucauugcuaucccaggcuga

SEQ ID NO: 79175 - RNA, 22 nt, Homo sapiens
ccuggaagaaaggugcuaaaua

SEQ ID NO: 79176 - RNA, 22 nt, Homo sapiens
ccuggguuacaggugugagcca

SEQ ID NO: 79177 - RNA, 22 nt, Homo sapiens
ccuuuguggggcgguggguaau

SEQ ID NO: 79178 - RNA, 16 nt, Homo sapiens
cuaaaaugucuacuug

SEQ ID NO: 79179 - RNA, 22 nt, Homo sapiens
cuaaagucacgauuugugggua

SEQ ID NO: 79180 - RNA, 18 nt, Homo sapiens
cuaagacacuuggcagag

SEQ ID NO: 79181 - RNA, 22 nt, Homo sapiens
cuagcagcauaagaaucaccaa

SEQ ID NO: 79182 - RNA, 22 nt, Homo sapiens
cuagcagcaugagaauggacca

SEQ ID NO: 79183 - RNA, 22 nt, Homo sapiens
cuagccuggagugcaguggugc

SEQ ID NO: 79184 - RNA, 22 nt, Homo sapiens
cucagggugguggacucuaaua

SEQ ID NO: 79185 - RNA, 22 nt, Homo sapiens
cucagugucuggcacacagaaa

SEQ ID NO: 79186 - RNA, 22 nt, Homo sapiens
cuccacugagcaggugggaggc

SEQ ID NO: 79187 - RNA, 22 nt, Homo sapiens
cuccuggugauuggagugugaa

SEQ ID NO: 79188 - RNA, 22 nt, Homo sapiens
cucucugagccccagacaccuu

SEQ ID NO: 79189 - RNA, 17 nt, Homo sapiens
cucucugguuuaaagca

SEQ ID NO: 79190 - RNA, 22 nt, Homo sapiens
cucucuguuugucuguuauugg

SEQ ID NO: 79191 - RNA, 22 nt, Homo sapiens
cucuuggguagauuuugcagag

SEQ ID NO: 79192 - RNA, 22 nt, Homo sapiens
cugaggcacggcgaccuuaagu

SEQ ID NO: 79193 - RNA, 20 nt, Homo sapiens
cugaggugggagaaucgcuu

SEQ ID NO: 79194 - RNA, 22 nt, Homo sapiens
cuggagucugacugacacaagg

SEQ ID NO: 79195 - RNA, 22 nt, Homo sapiens
cuggcacagugucagaaacaca

SEQ ID NO: 79196 - RNA, 22 nt, Homo sapiens
cuggcucugagguguuuagggc

SEQ ID NO: 79197 - RNA, 21 nt, Homo sapiens
cugguccccuuuauguaugug

SEQ ID NO: 79198 - RNA, 22 nt, Homo sapiens
cugucuagagggcacaugaugc

SEQ ID NO: 79199 - RNA, 22 nt, Homo sapiens
cugugaucuuuuuucauguggu

SEQ ID NO: 79200 - RNA, 22 nt, Homo sapiens
cugugcacaucuggcggcccga

SEQ ID NO: 79201 - RNA, 22 nt, Homo sapiens
aaaugcaccacucuggugcagg

SEQ ID NO: 79202 - RNA, 22 nt, Homo sapiens
aacaggguggugccugguccau

SEQ ID NO: 79203 - RNA, 22 nt, Homo sapiens
aacaggguguuugcaguuucuu

SEQ ID NO: 79204 - RNA, 22 nt, Homo sapiens
aacagugcuucauucacacauu

SEQ ID NO: 79205 - RNA, 22 nt, Homo sapiens
aagcagauguguugaaaguacu

SEQ ID NO: 79206 - RNA, 22 nt, Homo sapiens
aaggaguaucuguuuucucacc

SEQ ID NO: 79207 - RNA, 22 nt, Homo sapiens
aagggaaugcuuccaguuugug

SEQ ID NO: 79208 - RNA, 22 nt, Homo sapiens
aagugcuguccuaccuuuggga

SEQ ID NO: 79209 - RNA, 22 nt, Homo sapiens
aaugcacuccagccugggcgac

SEQ ID NO: 79210 - RNA, 22 nt, Homo sapiens
acacuggaguuaaaggugauuu

SEQ ID NO: 79211 - RNA, 18 nt, Homo sapiens
acagugcuggcaugagau

SEQ ID NO: 79212 - RNA, 22 nt, Homo sapiens
acauggcuuaugaauuuggaga

SEQ ID NO: 79213 - RNA, 22 nt, Homo sapiens
accaccacucccgcauucuaaa

SEQ ID NO: 79214 - RNA, 22 nt, Homo sapiens
acccagaguuccuugucuuuca

SEQ ID NO: 79215 - RNA, 22 nt, Homo sapiens
acccuggauucguggccuugaa

SEQ ID NO: 79216 - RNA, 18 nt, Homo sapiens
acccuucagcacugggcc

SEQ ID NO: 79217 - RNA, 22 nt, Homo sapiens
accucagcccggggaaguugag

SEQ ID NO: 79218 - RNA, 23 nt, Homo sapiens
accugugguuauuuuacucuucc

SEQ ID NO: 79219 - RNA, 20 nt, Homo sapiens
acuaaaucucauuuuaugca

SEQ ID NO: 79220 - RNA, 21 nt, Homo sapiens
acugcacuccaaccucaacag

SEQ ID NO: 79221 - RNA, 22 nt, Homo sapiens
acugcacuccaaccuuggugac

SEQ ID NO: 79222 - RNA, 22 nt, Homo sapiens
acugcacuccagacucugucuc

SEQ ID NO: 79223 - RNA, 22 nt, Homo sapiens
acugcacuccagcccaggugac

SEQ ID NO: 79224 - RNA, 22 nt, Homo sapiens
acugcacuccagccucccgucu

SEQ ID NO: 79225 - RNA, 22 nt, Homo sapiens
acugcacuccagccuccugaca

SEQ ID NO: 79226 - RNA, 22 nt, Homo sapiens
acugcacuccagccucggggac

SEQ ID NO: 79227 - RNA, 22 nt, Homo sapiens
acugcacuccagccucggugac

SEQ ID NO: 79228 - RNA, 22 nt, Homo sapiens
acugcacuccagccugcugaca

SEQ ID NO: 79229 - RNA, 22 nt, Homo sapiens
acugcacuccagccugcuggca

SEQ ID NO: 79230 - RNA, 22 nt, Homo sapiens
acugcacuccagccugcugggu

SEQ ID NO: 79231 - RNA, 22 nt, Homo sapiens
acugcacuccagccugugcgua

SEQ ID NO: 79232 - RNA, 22 nt, Homo sapiens
acugcacuccagccuguugaca

SEQ ID NO: 79233 - RNA, 22 nt, Homo sapiens
acugcacuccagccuugauggc

SEQ ID NO: 79234 - RNA, 22 nt, Homo sapiens
acugcacuccagccuuggagac

SEQ ID NO: 79235 - RNA, 22 nt, Homo sapiens
acugcacuccagcuugggugac

SEQ ID NO: 79236 - RNA, 20 nt, Homo sapiens
acugcacuccagucucuggg

SEQ ID NO: 79237 - RNA, 18 nt, Homo sapiens
acugcacuccauccuagg

SEQ ID NO: 79238 - RNA, 22 nt, Homo sapiens
acugcacucuagcauggguaau

SEQ ID NO: 79239 - RNA, 22 nt, Homo sapiens
acugcacucuagccccugcgac

SEQ ID NO: 79240 - RNA, 22 nt, Homo sapiens
acugcacugucaaccuccuggg

SEQ ID NO: 79241 - RNA, 22 nt, Homo sapiens
acugcacuucagccuguugaca

SEQ ID NO: 79242 - RNA, 22 nt, Homo sapiens
acugcacuucagccuuggcuac

SEQ ID NO: 79243 - RNA, 22 nt, Homo sapiens
agagaugaagauggggcucccg

SEQ ID NO: 79244 - RNA, 22 nt, Homo sapiens
agaugauguuuacugagcauca

SEQ ID NO: 79245 - RNA, 23 nt, Homo sapiens
agcaaaugcucuagcacuccaac

SEQ ID NO: 79246 - RNA, 22 nt, Homo sapiens
agcaccauuuauugaaaagaca

SEQ ID NO: 79247 - RNA, 22 nt, Homo sapiens
agcagguguccacaauguuugc

SEQ ID NO: 79248 - RNA, 22 nt, Homo sapiens
agcagguguggcuuauccugaa

SEQ ID NO: 79249 - RNA, 22 nt, Homo sapiens
agcaguagaauuccugcaucac

SEQ ID NO: 79250 - RNA, 22 nt, Homo sapiens
agcaucacaugggcugcuuggg

SEQ ID NO: 79251 - RNA, 22 nt, Homo sapiens
agcuggcuguagcugcaagucu

SEQ ID NO: 79252 - RNA, 20 nt, Homo sapiens
agcuggguguguuggugcau

SEQ ID NO: 79253 - RNA, 22 nt, Homo sapiens
agcugguuuauuucuauauccu

SEQ ID NO: 79254 - RNA, 22 nt, Homo sapiens
aggaccccucaucagcaccagu

SEQ ID NO: 79255 - RNA, 22 nt, Homo sapiens
aggagaauugguucuucuugau

SEQ ID NO: 79256 - RNA, 22 nt, Homo sapiens
agucagugucuguaaggagaac

SEQ ID NO: 79257 - RNA, 22 nt, Homo sapiens
ugacucagauagguguguauuc

SEQ ID NO: 79258 - RNA, 22 nt, Homo sapiens
ugacucuagagcugccuguggc

SEQ ID NO: 79259 - RNA, 22 nt, Homo sapiens
ugagacacugaauccggccuga

SEQ ID NO: 79260 - RNA, 22 nt, Homo sapiens
ugagacgaagucuugcucuguu

SEQ ID NO: 79261 - RNA, 22 nt, Homo sapiens
ugagacugagucucccucuguc

SEQ ID NO: 79262 - RNA, 22 nt, Homo sapiens
ugagacugagucuugcucuugu

SEQ ID NO: 79263 - RNA, 22 nt, Homo sapiens
ugagacugaguuuccaucuugu

SEQ ID NO: 79264 - RNA, 22 nt, Homo sapiens
ugagacugaguuucucucuugu

SEQ ID NO: 79265 - RNA, 22 nt, Homo sapiens
ugagacugaguuuugcucguug

SEQ ID NO: 79266 - RNA, 22 nt, Homo sapiens
ugagauaauuuacuuguugagg

SEQ ID NO: 79267 - RNA, 19 nt, Homo sapiens
ugagauccacugaagauuc

SEQ ID NO: 79268 - RNA, 23 nt, Homo sapiens
ugagaucuacagaucucagaucu

SEQ ID NO: 79269 - RNA, 22 nt, Homo sapiens
ugagaucuuuuguggcugagaa

SEQ ID NO: 79270 - RNA, 22 nt, Homo sapiens
ugagaugaagcuagaagaaugg

SEQ ID NO: 79271 - RNA, 22 nt, Homo sapiens
ugagaugagagaaugcuugccu

SEQ ID NO: 79272 - RNA, 22 nt, Homo sapiens
ugagaugagucucgcucuguca

SEQ ID NO: 79273 - RNA, 22 nt, Homo sapiens
ugagaugauuuaauggagccca

SEQ ID NO: 79274 - RNA, 22 nt, Homo sapiens
ugagauguuuguuucagugccu

SEQ ID NO: 79275 - RNA, 22 nt, Homo sapiens
ugagauucucugauuguagguc

SEQ ID NO: 79276 - RNA, 22 nt, Homo sapiens
ugagcagaguuguuucuccuga

SEQ ID NO: 79277 - RNA, 22 nt, Homo sapiens
ugagcugguacuaauauuauca

SEQ ID NO: 79278 - RNA, 22 nt, Homo sapiens
ugaggucauucaugugggcgca

SEQ ID NO: 79279 - RNA, 22 nt, Homo sapiens
ugaguagaagugaagauagugg

SEQ ID NO: 79280 - RNA, 22 nt, Homo sapiens
ugauaugcuuugaacucucugg

SEQ ID NO: 79281 - RNA, 22 nt, Homo sapiens
ugaucuguguaacauaggaguc

SEQ ID NO: 79282 - RNA, 22 nt, Homo sapiens
ugcaaauguuaggugucauuau

SEQ ID NO: 79283 - RNA, 22 nt, Homo sapiens
ugcaagcacacccagggauugu

SEQ ID NO: 79284 - RNA, 20 nt, Homo sapiens
ugcaaguugccuuuggaggc

SEQ ID NO: 79285 - RNA, 22 nt, Homo sapiens
ugcagcauguaggcacguuauu

SEQ ID NO: 79286 - RNA, 22 nt, Homo sapiens
ugcuggugauucagauucaaau

SEQ ID NO: 79287 - RNA, 17 nt, Homo sapiens
ugcuuagagagccucag

SEQ ID NO: 79288 - RNA, 22 nt, Homo sapiens
uggaagacaggcuguauuuuaa

SEQ ID NO: 79289 - RNA, 22 nt, Homo sapiens
uggaaguuaaauuaguugauga

SEQ ID NO: 79290 - RNA, 21 nt, Homo sapiens
uggaaucuauuauuccaguuu

SEQ ID NO: 79291 - RNA, 21 nt, Homo sapiens
uggaccccuuccuugcaccau

SEQ ID NO: 79292 - RNA, 22 nt, Homo sapiens
uggaccccuucuccuauuaaaa

SEQ ID NO: 79293 - RNA, 22 nt, Homo sapiens
uggacuguaauuuuauaggcau

SEQ ID NO: 79294 - RNA, 22 nt, Homo sapiens
uggccuguaacgcugucucagc

SEQ ID NO: 79295 - RNA, 22 nt, Homo sapiens
uggcuguguccucucccaaauc

SEQ ID NO: 79296 - RNA, 20 nt, Homo sapiens
uggcuucuuaauugcaggca

SEQ ID NO: 79297 - RNA, 22 nt, Homo sapiens
ugggaucuuuccuauuagcgag

SEQ ID NO: 79298 - RNA, 22 nt, Homo sapiens
ugggucaguagcauguaugucu

SEQ ID NO: 79299 - RNA, 22 nt, Homo sapiens
uguaaaucugguuaauuggaua

SEQ ID NO: 79300 - RNA, 22 nt, Homo sapiens
ugucagggaggcucggccgcac

SEQ ID NO: 79301 - RNA, 22 nt, Homo sapiens
ugucaguuucuugagauggaac

SEQ ID NO: 79302 - RNA, 22 nt, Homo sapiens
ugucaugguagcaaggacgagg

SEQ ID NO: 79303 - RNA, 22 nt, Homo sapiens
ugucccugagccuggauuccug

SEQ ID NO: 79304 - RNA, 22 nt, Homo sapiens
uguccuggugaugcccaaauuc

SEQ ID NO: 79305 - RNA, 22 nt, Homo sapiens
gucuguuuggggaccuguggcc

SEQ ID NO: 79306 - RNA, 22 nt, Homo sapiens
gugaccauuugacauauccuug

SEQ ID NO: 79307 - RNA, 22 nt, Homo sapiens
gugagguacgugucaagaacca

SEQ ID NO: 79308 - RNA, 17 nt, Homo sapiens
gugagguauccucaaaa

SEQ ID NO: 79309 - RNA, 22 nt, Homo sapiens
gugaggugguacaauauuaacu

SEQ ID NO: 79310 - RNA, 22 nt, Homo sapiens
gugagguguuaaccaaccugug

SEQ ID NO: 79311 - RNA, 22 nt, Homo sapiens
gugcacuguagaacccuuuguu

SEQ ID NO: 79312 - RNA, 22 nt, Homo sapiens
guggagacaaaggcugagugag

SEQ ID NO: 79313 - RNA, 22 nt, Homo sapiens
guggagcuguguggccuugggc

SEQ ID NO: 79314 - RNA, 22 nt, Homo sapiens
guggugucuuuuuugauuagga

SEQ ID NO: 79315 - RNA, 18 nt, Homo sapiens
guguauggauggaggcca

SEQ ID NO: 79316 - RNA, 21 nt, Homo sapiens
gugugcuugagugaugggauu

SEQ ID NO: 79317 - RNA, 22 nt, Homo sapiens
guugcucaggcugaagugcagu

SEQ ID NO: 79318 - RNA, 22 nt, Homo sapiens
guuggcuguuucccccaaguga

SEQ ID NO: 79319 - RNA, 22 nt, Homo sapiens
guuuggauuuucuaauuucugu

SEQ ID NO: 79320 - RNA, 22 nt, Homo sapiens
guuuggcucuuguuucugucaa

SEQ ID NO: 79321 - RNA, 22 nt, Homo sapiens
uaaacugcuugaaaugguguca

SEQ ID NO: 79322 - RNA, 22 nt, Homo sapiens
uaaagccagugauuaugucucu

SEQ ID NO: 79323 - RNA, 22 nt, Homo sapiens
uaaagugaggauggcaguaggu

SEQ ID NO: 79324 - RNA, 22 nt, Homo sapiens
uaacaggcaaggucacaccuug

SEQ ID NO: 79325 - RNA, 22 nt, Homo sapiens
uaacauuguugauuauacuaag

SEQ ID NO: 79326 - RNA, 22 nt, Homo sapiens
uaauagagucauuauuauuguu

SEQ ID NO: 79327 - RNA, 21 nt, Homo sapiens
uacaagcuguagcacaugcca

SEQ ID NO: 79328 - RNA, 18 nt, Homo sapiens
uacagaacuggaguagaa

SEQ ID NO: 79329 - RNA, 22 nt, Homo sapiens
uaccuaguaggugguuuuucag

SEQ ID NO: 79330 - RNA, 22 nt, Homo sapiens
uacugcacuccagccugccaac

SEQ ID NO: 79331 - RNA, 22 nt, Homo sapiens
uagaaagcaugaccuucagaua

SEQ ID NO: 79332 - RNA, 22 nt, Homo sapiens
uagagguaggucuucgagucuc

SEQ ID NO: 79333 - RNA, 22 nt, Homo sapiens
uagagguauguauaguauucuu

SEQ ID NO: 79334 - RNA, 22 nt, Homo sapiens
uagcagaauauaccucuuacuu

SEQ ID NO: 79335 - RNA, 22 nt, Homo sapiens
uagcagcauuuuuguagaguau

SEQ ID NO: 79336 - RNA, 22 nt, Homo sapiens
uagggcauguguggaguguaug

SEQ ID NO: 79337 - RNA, 22 nt, Homo sapiens
uaggggcacacuucgguuagca

SEQ ID NO: 79338 - RNA, 18 nt, Homo sapiens
uagugcuguucucaugau

SEQ ID NO: 79339 - RNA, 21 nt, Homo sapiens
uaucagagacauugagaggca

SEQ ID NO: 79340 - RNA, 22 nt, Homo sapiens
uaucagagcugucagccuaccu

SEQ ID NO: 79341 - RNA, 22 nt, Homo sapiens
uauggauuucauuagacuugag

SEQ ID NO: 79342 - RNA, 22 nt, Homo sapiens
uauggccccuacaugugcaaaa

SEQ ID NO: 79343 - RNA, 22 nt, Homo sapiens
uauugccugucuccaaaaauca

SEQ ID NO: 79344 - RNA, 22 nt, Homo sapiens
ucaaagugagcuccuucucacu

SEQ ID NO: 79345 - RNA, 22 nt, Homo sapiens
ucaaugcaaccuccaccucugg

SEQ ID NO: 79346 - RNA, 22 nt, Homo sapiens
ucaauguaucuccaagaauuga

SEQ ID NO: 79347 - RNA, 22 nt, Homo sapiens
ucacagugaguggaguggggug

SEQ ID NO: 79348 - RNA, 22 nt, Homo sapiens
ucacaguucagcauggcugagg

SEQ ID NO: 79349 - RNA, 22 nt, Homo sapiens
ucacauggauuaacucauuuau

SEQ ID NO: 79350 - RNA, 21 nt, Homo sapiens
uggaccccuuucuuacaccgu

SEQ ID NO: 79351 - RNA, 22 nt, Homo sapiens
uggagagucauuuauaguauuu

SEQ ID NO: 79352 - RNA, 22 nt, Homo sapiens
uggagagugauaaguaaaugga

SEQ ID NO: 79353 - RNA, 22 nt, Homo sapiens
uggagggcuagucauuucuuuu

SEQ ID NO: 79354 - RNA, 18 nt, Homo sapiens
uggauuggaaaaguuccu

SEQ ID NO: 79355 - RNA, 22 nt, Homo sapiens
uggcaaauagcaauaggagggu

SEQ ID NO: 79356 - RNA, 22 nt, Homo sapiens
uggccuguaacccucucauagg

SEQ ID NO: 79357 - RNA, 22 nt, Homo sapiens
uggcuguuuauuucacaugggu

SEQ ID NO: 79358 - RNA, 22 nt, Homo sapiens
uggcuguuuauuucacgugggu

SEQ ID NO: 79359 - RNA, 22 nt, Homo sapiens
ugggaaauguagccuagcugug

SEQ ID NO: 79360 - RNA, 22 nt, Homo sapiens
ugggaccccuacucuuuccaca

SEQ ID NO: 79361 - RNA, 22 nt, Homo sapiens
aaagaagucagccuguccuuug

SEQ ID NO: 79362 - RNA, 22 nt, Homo sapiens
aaagaguucagguagauuucaa

SEQ ID NO: 79363 - RNA, 22 nt, Homo sapiens
aaagugcugagaguucuaacuu

SEQ ID NO: 79364 - RNA, 22 nt, Homo sapiens
aaaguggugggauuccaggcau

SEQ ID NO: 79365 - RNA, 22 nt, Homo sapiens
aaaugcagauucugcuuagguu

SEQ ID NO: 79366 - RNA, 22 nt, Homo sapiens
aacugcacauauuuguaugggu

SEQ ID NO: 79367 - RNA, 22 nt, Homo sapiens
aagagguagaagcuugccuucu

SEQ ID NO: 79368 - RNA, 22 nt, Homo sapiens
aagagguaggaaauggucauuu

SEQ ID NO: 79369 - RNA, 23 nt, Homo sapiens
aagagguaugacuaugaagugga

SEQ ID NO: 79370 - RNA, 22 nt, Homo sapiens
aagagguuuaacugacucacag

SEQ ID NO: 79371 - RNA, 22 nt, Homo sapiens
aagcaggugugggaggaaaugg

SEQ ID NO: 79372 - RNA, 22 nt, Homo sapiens
aagugguucuaugaguuugcaa

SEQ ID NO: 79373 - RNA, 19 nt, Homo sapiens
aagugguuuaaacuuguau

SEQ ID NO: 79374 - RNA, 22 nt, Homo sapiens
aagugucagaguugcuaaugac

SEQ ID NO: 79375 - RNA, 22 nt, Homo sapiens
aauagugcugcaaaaacauacg

SEQ ID NO: 79376 - RNA, 22 nt, Homo sapiens
aaucacaguguucuugugaggg

SEQ ID NO: 79377 - RNA, 22 nt, Homo sapiens
aaucagauuccagugguuggaa

SEQ ID NO: 79378 - RNA, 17 nt, Homo sapiens
aaucagauuucugagga

SEQ ID NO: 79379 - RNA, 22 nt, Homo sapiens
acacaugugaaaaaaauguuac

SEQ ID NO: 79380 - RNA, 22 nt, Homo sapiens
acaccaugucuguuucugguuu

SEQ ID NO: 79381 - RNA, 20 nt, Homo sapiens
acacuggaguaucaaggccc

SEQ ID NO: 79382 - RNA, 20 nt, Homo sapiens
acagcacugguuucaagcaa

SEQ ID NO: 79383 - RNA, 22 nt, Homo sapiens
accauugcacuccagccugggc

SEQ ID NO: 79384 - RNA, 22 nt, Homo sapiens
acccuggaguaguaggaaucug

SEQ ID NO: 79385 - RNA, 22 nt, Homo sapiens
accugcacagccgaacauagac

SEQ ID NO: 79386 - RNA, 19 nt, Homo sapiens
acugcacuccaaccuccug

SEQ ID NO: 79387 - RNA, 22 nt, Homo sapiens
acugcacuccacccuuggcagc

SEQ ID NO: 79388 - RNA, 22 nt, Homo sapiens
acugcacuccagccucaugaca

SEQ ID NO: 79389 - RNA, 22 nt, Homo sapiens
acugcacuccagccuccugggu

SEQ ID NO: 79390 - RNA, 22 nt, Homo sapiens
acugcacuccagccucgugaca

SEQ ID NO: 79391 - RNA, 22 nt, Homo sapiens
acugcacuccagccucguggac

SEQ ID NO: 79392 - RNA, 22 nt, Homo sapiens
acugcacuccagccugccgaca

SEQ ID NO: 79393 - RNA, 22 nt, Homo sapiens
acugcacuccagccugcuggau

SEQ ID NO: 79394 - RNA, 22 nt, Homo sapiens
acugcacuccagccuggaccac

SEQ ID NO: 79395 - RNA, 22 nt, Homo sapiens
acugcacuccagccuucaggac

SEQ ID NO: 79396 - RNA, 22 nt, Homo sapiens
acugcacuccagccuuggccac

SEQ ID NO: 79397 - RNA, 22 nt, Homo sapiens
acugcacuccagccuugugaca

SEQ ID NO: 79398 - RNA, 22 nt, Homo sapiens
acugcacuccagccuuugcgau

SEQ ID NO: 79399 - RNA, 22 nt, Homo sapiens
acugcacuccagcuccagggug

SEQ ID NO: 79400 - RNA, 22 nt, Homo sapiens
acugcacuccagcuuuggugac

SEQ ID NO: 79401 - RNA, 22 nt, Homo sapiens
acugcacuccaguuccgggcaa

SEQ ID NO: 79402 - RNA, 22 nt, Homo sapiens
acugcacuccggccucgugaca

SEQ ID NO: 79403 - RNA, 22 nt, Homo sapiens
acugcacuccuccuugggugac

SEQ ID NO: 79404 - RNA, 22 nt, Homo sapiens
acugcacucuagccuuggcaac

SEQ ID NO: 79405 - RNA, 22 nt, Homo sapiens
acugcacuucaaccucauugac

SEQ ID NO: 79406 - RNA, 20 nt, Homo sapiens
acugcacuucagccugcugg

SEQ ID NO: 79407 - RNA, 22 nt, Homo sapiens
acugcacuucagccuugggaaa

SEQ ID NO: 79408 - RNA, 22 nt, Homo sapiens
agaguacaggcaaguuagucau

SEQ ID NO: 79409 - RNA, 22 nt, Homo sapiens
agaguauacaugugagugagau

SEQ ID NO: 79410 - RNA, 22 nt, Homo sapiens
agaguauagcaacuuaguaaaa

SEQ ID NO: 79411 - RNA, 22 nt, Homo sapiens
agaugguauuauagguuucugu

SEQ ID NO: 79412 - RNA, 22 nt, Homo sapiens
agcagcaauuuuguaugguuua

SEQ ID NO: 79413 - RNA, 22 nt, Homo sapiens
agcagcaugcaaauggacuaau

SEQ ID NO: 79414 - RNA, 21 nt, Homo sapiens
agcagcuuugguugaagcaga

SEQ ID NO: 79415 - RNA, 22 nt, Homo sapiens
agcuggauuguuuaccuggggc

SEQ ID NO: 79416 - RNA, 22 nt, Homo sapiens
agcuggcuguggagaaaccccu

SEQ ID NO: 79417 - RNA, 22 nt, Homo sapiens
aggcagcuguuauauacugagu

SEQ ID NO: 79418 - RNA, 22 nt, Homo sapiens
aggcaggugaaagauaguuuua

SEQ ID NO: 79419 - RNA, 22 nt, Homo sapiens
aggcaguuucagugagagguga

SEQ ID NO: 79420 - RNA, 22 nt, Homo sapiens
aggcuagaaucuuccaucuugg

SEQ ID NO: 79421 - RNA, 22 nt, Homo sapiens
aggcuagacuuugagaauuuuu

SEQ ID NO: 79422 - RNA, 22 nt, Homo sapiens
aggcuuuuggagaacacugcac

SEQ ID NO: 79423 - RNA, 22 nt, Homo sapiens
agguccacuuacuacuccuguu

SEQ ID NO: 79424 - RNA, 22 nt, Homo sapiens
aggucccauguccucccugacc

SEQ ID NO: 79425 - RNA, 22 nt, Homo sapiens
aggugacugguuuaucuggcag

SEQ ID NO: 79426 - RNA, 22 nt, Homo sapiens
agucagugcauaagaaugaagu

SEQ ID NO: 79427 - RNA, 22 nt, Homo sapiens
agucugguguucucacacuagu

SEQ ID NO: 79428 - RNA, 22 nt, Homo sapiens
agugaauuguucaacaggagga

SEQ ID NO: 79429 - RNA, 22 nt, Homo sapiens
auaaaguguuuaguauaggcaa

SEQ ID NO: 79430 - RNA, 22 nt, Homo sapiens
auaagugagugauucaguguua

SEQ ID NO: 79431 - RNA, 22 nt, Homo sapiens
auagugcugcaaaaaacauacg

SEQ ID NO: 79432 - RNA, 22 nt, Homo sapiens
auagugcugcaacaaauauacg

SEQ ID NO: 79433 - RNA, 22 nt, Homo sapiens
auauucaagugaggauggcuaa

SEQ ID NO: 79434 - RNA, 22 nt, Homo sapiens
aucaagccaaagaaaguccuug

SEQ ID NO: 79435 - RNA, 22 nt, Homo sapiens
aucacagagucacgggcaacuu

SEQ ID NO: 79436 - RNA, 22 nt, Homo sapiens
aucagcacugaucauacagcuu

SEQ ID NO: 79437 - RNA, 22 nt, Homo sapiens
auccccugcacggggugucauu

SEQ ID NO: 79438 - RNA, 22 nt, Homo sapiens
aucuagagacauaguaaagaau

SEQ ID NO: 79439 - RNA, 22 nt, Homo sapiens
aucuguguuuaaggucccagaa

SEQ ID NO: 79440 - RNA, 22 nt, Homo sapiens
augaaagugauaaaugucucua

SEQ ID NO: 79441 - RNA, 22 nt, Homo sapiens
augaaaucuuuccugugaggau

SEQ ID NO: 79442 - RNA, 22 nt, Homo sapiens
augaaaugcauguuaaguccgu

SEQ ID NO: 79443 - RNA, 22 nt, Homo sapiens
augagcagaugcuccugccucu

SEQ ID NO: 79444 - RNA, 22 nt, Homo sapiens
augaucacaccacugcacucca

SEQ ID NO: 79445 - RNA, 22 nt, Homo sapiens
augcaaaucuuaaguaugugug

SEQ ID NO: 79446 - RNA, 22 nt, Homo sapiens
augcacaguccagcccaugugg

SEQ ID NO: 79447 - RNA, 22 nt, Homo sapiens
augcacuguauaggaucuugcg

SEQ ID NO: 79448 - RNA, 22 nt, Homo sapiens
augcacuguuuucuugaugaga

SEQ ID NO: 79449 - RNA, 22 nt, Homo sapiens
augcauauuuuaccuagaagag

SEQ ID NO: 79450 - RNA, 22 nt, Homo sapiens
augcauggcagagucaggguac

SEQ ID NO: 79451 - RNA, 22 nt, Homo sapiens
auggaaaugaagggcuggcccu

SEQ ID NO: 79452 - RNA, 22 nt, Homo sapiens
auggcagcugacacuuccgucu

SEQ ID NO: 79453 - RNA, 22 nt, Homo sapiens
auggcccaguuugcuaucccua

SEQ ID NO: 79454 - RNA, 22 nt, Homo sapiens
auggcugugagaucgacuuauu

SEQ ID NO: 79455 - RNA, 22 nt, Homo sapiens
auggcuguuccugggaguucua

SEQ ID NO: 79456 - RNA, 22 nt, Homo sapiens
auggcuguuucugcaaugucua

SEQ ID NO: 79457 - RNA, 22 nt, Homo sapiens
augggugaguaugaguugacuu

SEQ ID NO: 79458 - RNA, 22 nt, Homo sapiens
augucaacauagacaguagagu

SEQ ID NO: 79459 - RNA, 22 nt, Homo sapiens
augucaaggugggugauaguuu

SEQ ID NO: 79460 - RNA, 22 nt, Homo sapiens
auguccauggaaucuguagcaa

SEQ ID NO: 79461 - RNA, 22 nt, Homo sapiens
augucugguagccaccuggagg

SEQ ID NO: 79462 - RNA, 22 nt, Homo sapiens
augugacugauguaaucagaca

SEQ ID NO: 79463 - RNA, 22 nt, Homo sapiens
auguuagcaucaauauucauca

SEQ ID NO: 79464 - RNA, 22 nt, Homo sapiens
auuugguuauucaguuguucag

SEQ ID NO: 79465 - RNA, 22 nt, Homo sapiens
caaagcuauagcaccagaggga

SEQ ID NO: 79466 - RNA, 22 nt, Homo sapiens
caaaggcuguuauaggccagga

SEQ ID NO: 79467 - RNA, 22 nt, Homo sapiens
caagugaauaguugcucucaga

SEQ ID NO: 79468 - RNA, 22 nt, Homo sapiens
caagugcuuucuuggggauuua

SEQ ID NO: 79469 - RNA, 22 nt, Homo sapiens
cacugggugagauccauguuua

SEQ ID NO: 79470 - RNA, 22 nt, Homo sapiens
cacuggguuagaacaugcuccu

SEQ ID NO: 79471 - RNA, 22 nt, Homo sapiens
cacuuugguucaccugaguuuc

SEQ ID NO: 79472 - RNA, 22 nt, Homo sapiens
cagccgggugagguggcuuguu

SEQ ID NO: 79473 - RNA, 22 nt, Homo sapiens
caggugcauuggcugacaccug

SEQ ID NO: 79474 - RNA, 22 nt, Homo sapiens
cagugauaggugguuguuggca

SEQ ID NO: 79475 - RNA, 22 nt, Homo sapiens
caucagagugagauauaagauc

SEQ ID NO: 79476 - RNA, 22 nt, Homo sapiens
caucccugucgucaagucucug

SEQ ID NO: 79477 - RNA, 19 nt, Homo sapiens
cauugcacuccacccuggg

SEQ ID NO: 79478 - RNA, 20 nt, Homo sapiens
cauugcccuccagccugggc

SEQ ID NO: 79479 - RNA, 22 nt, Homo sapiens
cauuuugcaguuucugucucca

SEQ ID NO: 79480 - RNA, 22 nt, Homo sapiens
ccagaguuucugauucagcagg

SEQ ID NO: 79481 - RNA, 22 nt, Homo sapiens
ccagguuucuagaauaauuccu

SEQ ID NO: 79482 - RNA, 22 nt, Homo sapiens
ccaguauuuuauugaggguuuu

SEQ ID NO: 79483 - RNA, 22 nt, Homo sapiens
ccaguuuucaagauaaugguuu

SEQ ID NO: 79484 - RNA, 22 nt, Homo sapiens
ccaucacaggccucagugggaa

SEQ ID NO: 79485 - RNA, 23 nt, Homo sapiens
ccauugcacuccagccucaguga

SEQ ID NO: 79486 - RNA, 21 nt, Homo sapiens
cccagguucucugaggguaga

SEQ ID NO: 79487 - RNA, 17 nt, Homo sapiens
cccuaguagcugggacu

SEQ ID NO: 79488 - RNA, 22 nt, Homo sapiens
ccuugucacugaguggaaugaa

SEQ ID NO: 79489 - RNA, 22 nt, Homo sapiens
cuaacuaugucucaggaugucc

SEQ ID NO: 79490 - RNA, 22 nt, Homo sapiens
cucaaguaauccucccgccuug

SEQ ID NO: 79491 - RNA, 22 nt, Homo sapiens
cucagcuacuugggaagcugag

SEQ ID NO: 79492 - RNA, 19 nt, Homo sapiens
cucauggagaaggagaaua

SEQ ID NO: 79493 - RNA, 22 nt, Homo sapiens
cucauugcaaucuccaccuccc

SEQ ID NO: 79494 - RNA, 22 nt, Homo sapiens
cucccagagccaguuauaggcu

SEQ ID NO: 79495 - RNA, 22 nt, Homo sapiens
cugacuaguuuuaaugcagauu

SEQ ID NO: 79496 - RNA, 22 nt, Homo sapiens
cugagaucugaaccaggagugu

SEQ ID NO: 79497 - RNA, 22 nt, Homo sapiens
cugaggucugaauccagguauc

SEQ ID NO: 79498 - RNA, 22 nt, Homo sapiens
cugaggugggagaaucacauaa

SEQ ID NO: 79499 - RNA, 22 nt, Homo sapiens
cugaggugggaggauuggcuug

SEQ ID NO: 79500 - RNA, 22 nt, Homo sapiens
cugaucuggaggugucugggga

SEQ ID NO: 79501 - RNA, 22 nt, Homo sapiens
cuggaagcacaacgcauuuauu

SEQ ID NO: 79502 - RNA, 22 nt, Homo sapiens
cuggaggccugaacauaaaugg

SEQ ID NO: 79503 - RNA, 22 nt, Homo sapiens
cuggauauuaacauugaugaaa

SEQ ID NO: 79504 - RNA, 22 nt, Homo sapiens
cuggcaucuaaauacuugaugu

SEQ ID NO: 79505 - RNA, 22 nt, Homo sapiens
cuucaucugguuugugaacuuu

SEQ ID NO: 79506 - RNA, 22 nt, Homo sapiens
aagagaugaagguccugacugu

SEQ ID NO: 79507 - RNA, 22 nt, Homo sapiens
aagagcucucuguagcauguga

SEQ ID NO: 79508 - RNA, 22 nt, Homo sapiens
aagagguaauaacaaagcuucu

SEQ ID NO: 79509 - RNA, 22 nt, Homo sapiens
aagagguagcagucacaaaaga

SEQ ID NO: 79510 - RNA, 22 nt, Homo sapiens
aagcugcauuuucuagaugcuu

SEQ ID NO: 79511 - RNA, 22 nt, Homo sapiens
aaggaguagaggaauagcaaug

SEQ ID NO: 79512 - RNA, 22 nt, Homo sapiens
aaguauuaagacuaagaggcuu

SEQ ID NO: 79513 - RNA, 22 nt, Homo sapiens
aagugaguaauacgucaguugu

SEQ ID NO: 79514 - RNA, 22 nt, Homo sapiens
aagugcaaaucuguggcugaaa

SEQ ID NO: 79515 - RNA, 22 nt, Homo sapiens
aagugccauguggaugggcccu

SEQ ID NO: 79516 - RNA, 22 nt, Homo sapiens
aagugcuguaugggagccuagg

SEQ ID NO: 79517 - RNA, 22 nt, Homo sapiens
aagugcuuaggauagugugugg

SEQ ID NO: 79518 - RNA, 22 nt, Homo sapiens
aauaaagcagcuuuuugggacu

SEQ ID NO: 79519 - RNA, 22 nt, Homo sapiens
aaucacacuugauguugagcaa

SEQ ID NO: 79520 - RNA, 22 nt, Homo sapiens
aaucauggaguauuuguccuug

SEQ ID NO: 79521 - RNA, 22 nt, Homo sapiens
aaucgcuuuugguaggcaagga

SEQ ID NO: 79522 - RNA, 22 nt, Homo sapiens
aaucucagagauaucugugucc

SEQ ID NO: 79523 - RNA, 22 nt, Homo sapiens
aaucugucaguuuuguguuaau

SEQ ID NO: 79524 - RNA, 22 nt, Homo sapiens
aauggcucuuccuggaguugug

SEQ ID NO: 79525 - RNA, 22 nt, Homo sapiens
acaccauugcauuccagccugg

SEQ ID NO: 79526 - RNA, 22 nt, Homo sapiens
acaguggugcgaucucggcuca

SEQ ID NO: 79527 - RNA, 22 nt, Homo sapiens
acugcacuccaaccuguugggc

SEQ ID NO: 79528 - RNA, 20 nt, Homo sapiens
acugcacuccaaccuuugug

SEQ ID NO: 79529 - RNA, 18 nt, Homo sapiens
acugcacuccaccuuggg

SEQ ID NO: 79530 - RNA, 22 nt, Homo sapiens
acugcacuccaccuugggcaac

SEQ ID NO: 79531 - RNA, 22 nt, Homo sapiens
acugcacuccagcccgggugac

SEQ ID NO: 79532 - RNA, 22 nt, Homo sapiens
acugcacuccagccuaggcgac

SEQ ID NO: 79533 - RNA, 22 nt, Homo sapiens
acugcacuccagccucgcaaca

SEQ ID NO: 79534 - RNA, 22 nt, Homo sapiens
acugcacuccagccugcccaac

SEQ ID NO: 79535 - RNA, 22 nt, Homo sapiens
acugcacuccagccuggacgaa

SEQ ID NO: 79536 - RNA, 22 nt, Homo sapiens
acugcacuccagccuuagugac

SEQ ID NO: 79537 - RNA, 22 nt, Homo sapiens
acugcacuccagcuuuggguga

SEQ ID NO: 79538 - RNA, 20 nt, Homo sapiens
acugcacuccaggcugccca

SEQ ID NO: 79539 - RNA, 22 nt, Homo sapiens
acugcacuccaucuuagguggc

SEQ ID NO: 79540 - RNA, 22 nt, Homo sapiens
acugcacuccggccuggcaaca

SEQ ID NO: 79541 - RNA, 22 nt, Homo sapiens
acugcacugcagccuggccaac

SEQ ID NO: 79542 - RNA, 22 nt, Homo sapiens
acugcacuguccuagaguccuc

SEQ ID NO: 79543 - RNA, 22 nt, Homo sapiens
acugcacuucagccuuggggac

SEQ ID NO: 79544 - RNA, 22 nt, Homo sapiens
agaacuguccauucagcaugaa

SEQ ID NO: 79545 - RNA, 22 nt, Homo sapiens
agagaucaauaugaaggaaaug

SEQ ID NO: 79546 - RNA, 22 nt, Homo sapiens
agagauccucauuuuauagaca

SEQ ID NO: 79547 - RNA, 22 nt, Homo sapiens
cuggccagagacauucauuaaa

SEQ ID NO: 79548 - RNA, 22 nt, Homo sapiens
cuguccugcagagucagaauga

SEQ ID NO: 79549 - RNA, 22 nt, Homo sapiens
cugucucagccucuccaguagc

SEQ ID NO: 79550 - RNA, 22 nt, Homo sapiens
cugucuggaggccugcaaauaa

SEQ ID NO: 79551 - RNA, 22 nt, Homo sapiens
cugucuguuucaaaagugguua

SEQ ID NO: 79552 - RNA, 22 nt, Homo sapiens
cugugccaagcuugcgaugugc

SEQ ID NO: 79553 - RNA, 22 nt, Homo sapiens
cugugguguaacucuuggggcg

SEQ ID NO: 79554 - RNA, 19 nt, Homo sapiens
cuuaggugaccaguuccca

SEQ ID NO: 79555 - RNA, 22 nt, Homo sapiens
cuugccuuugucuucaaaggcu

SEQ ID NO: 79556 - RNA, 22 nt, Homo sapiens
cuuugugcccuucugcccauca

SEQ ID NO: 79557 - RNA, 22 nt, Homo sapiens
cuuuuugcaaauacaacucuga

SEQ ID NO: 79558 - RNA, 22 nt, Homo sapiens
gaaacugcauuucuaacaagcu

SEQ ID NO: 79559 - RNA, 22 nt, Homo sapiens
gaaagugcugcaaggccaugca

SEQ ID NO: 79560 - RNA, 20 nt, Homo sapiens
gacauagagacucucaaaaa

SEQ ID NO: 79561 - RNA, 22 nt, Homo sapiens
gacucuguagacaaucacaucu

SEQ ID NO: 79562 - RNA, 22 nt, Homo sapiens
gacuggccauugauacagaggu

SEQ ID NO: 79563 - RNA, 22 nt, Homo sapiens
gagaacagaagcauuccuaauu

SEQ ID NO: 79564 - RNA, 20 nt, Homo sapiens
gagaccugagauucacucaa

SEQ ID NO: 79565 - RNA, 22 nt, Homo sapiens
gagacggagucucgcucugucg

SEQ ID NO: 79566 - RNA, 22 nt, Homo sapiens
gagacggagucuugcucuguug

SEQ ID NO: 79567 - RNA, 22 nt, Homo sapiens
gagacugagucuugcucugucg

SEQ ID NO: 79568 - RNA, 21 nt, Homo sapiens
gagaggauucgccagccucuu

SEQ ID NO: 79569 - RNA, 22 nt, Homo sapiens
gagauguuuguuucacugucac

SEQ ID NO: 79570 - RNA, 22 nt, Homo sapiens
gaggcagucugacccuuagcag

SEQ ID NO: 79571 - RNA, 22 nt, Homo sapiens
gagugcugagcccacuuccuug

SEQ ID NO: 79572 - RNA, 22 nt, Homo sapiens
gaucucaguggauacugugaug

SEQ ID NO: 79573 - RNA, 22 nt, Homo sapiens
gaucugucuuuccuuauagucu

SEQ ID NO: 79574 - RNA, 22 nt, Homo sapiens
gaucugugugauuggaugcauu

SEQ ID NO: 79575 - RNA, 22 nt, Homo sapiens
gaucuguguuuguaugcauaag

SEQ ID NO: 79576 - RNA, 22 nt, Homo sapiens
gaugagguaguguaccuagucu

SEQ ID NO: 79577 - RNA, 22 nt, Homo sapiens
gauggaauuaaaaucagaauca

SEQ ID NO: 79578 - RNA, 22 nt, Homo sapiens
gcagugugauguuuuaaucuau

SEQ ID NO: 79579 - RNA, 16 nt, Homo sapiens
gcaguguguuuaauag

SEQ ID NO: 79580 - RNA, 22 nt, Homo sapiens
gcauguaguagauguugaauaa

SEQ ID NO: 79581 - RNA, 22 nt, Homo sapiens
gccaaaaugcugggauuacagg

SEQ ID NO: 79582 - RNA, 22 nt, Homo sapiens
gccccgggugaugcagccguca

SEQ ID NO: 79583 - RNA, 22 nt, Homo sapiens
gccuagagaaguaaauauuauc

SEQ ID NO: 79584 - RNA, 22 nt, Homo sapiens
gcugcacuuuaaggcauccccu

SEQ ID NO: 79585 - RNA, 22 nt, Homo sapiens
gcugcuguuauucaucagaacu

SEQ ID NO: 79586 - RNA, 22 nt, Homo sapiens
gcuggguucagagugggcugcg

SEQ ID NO: 79587 - RNA, 22 nt, Homo sapiens
gcuguugguaaaaaggacauga

SEQ ID NO: 79588 - RNA, 22 nt, Homo sapiens
ggacaaaguauuuucaaaugua

SEQ ID NO: 79589 - RNA, 22 nt, Homo sapiens
ggaguaggaaggaaauguuaaa

SEQ ID NO: 79590 - RNA, 22 nt, Homo sapiens
ggagucugauuuuuauguugcu

SEQ ID NO: 79591 - RNA, 21 nt, Homo sapiens
ggcaagaaacacaaucaagua

SEQ ID NO: 79592 - RNA, 23 nt, Homo sapiens
ggcaagaucucagcucacugcaa

SEQ ID NO: 79593 - RNA, 22 nt, Homo sapiens
ggcagcaugggugccuuuguga

SEQ ID NO: 79594 - RNA, 22 nt, Homo sapiens
ggcagcauugccuuugcaguga

SEQ ID NO: 79595 - RNA, 22 nt, Homo sapiens
ggcaguuuggcaguuucauaaa

SEQ ID NO: 79596 - RNA, 22 nt, Homo sapiens
ggcucguguuuucuguccaguu

SEQ ID NO: 79597 - RNA, 22 nt, Homo sapiens
gggaaugaagagaaccuuccca

SEQ ID NO: 79598 - RNA, 22 nt, Homo sapiens
ggguucccuucuggcucagggu

SEQ ID NO: 79599 - RNA, 19 nt, Homo sapiens
ggucagcaaagucuagcug

SEQ ID NO: 79600 - RNA, 22 nt, Homo sapiens
guaaucucagcuacuugggagu

SEQ ID NO: 79601 - RNA, 22 nt, Homo sapiens
guauggaagucaguuuguuggc

SEQ ID NO: 79602 - RNA, 22 nt, Homo sapiens
gucacuggcugucuuguaugau

SEQ ID NO: 79603 - RNA, 22 nt, Homo sapiens
gucagcaaagaggaauaguuug

SEQ ID NO: 79604 - RNA, 22 nt, Homo sapiens
gucauugcacuccagccuggac

SEQ ID NO: 79605 - RNA, 22 nt, Homo sapiens
gucuggcacagggaaaguacaa

SEQ ID NO: 79606 - RNA, 22 nt, Homo sapiens
agagauuauccuggcuucucug

SEQ ID NO: 79607 - RNA, 22 nt, Homo sapiens
agagcaauguuaucagucucug

SEQ ID NO: 79608 - RNA, 22 nt, Homo sapiens
agagcuaguauuuacggagcau

SEQ ID NO: 79609 - RNA, 22 nt, Homo sapiens
agagguagaagauaggcuacag

SEQ ID NO: 79610 - RNA, 22 nt, Homo sapiens
agagugcaauggcaccaucucg

SEQ ID NO: 79611 - RNA, 22 nt, Homo sapiens
agauggucuucauaaguuuuaa

SEQ ID NO: 79612 - RNA, 22 nt, Homo sapiens
agaugguuuuguucacagcucu

SEQ ID NO: 79613 - RNA, 22 nt, Homo sapiens
agcagcacaucccuuucuggcc

SEQ ID NO: 79614 - RNA, 22 nt, Homo sapiens
agcagcauggguauaaaucucc

SEQ ID NO: 79615 - RNA, 16 nt, Homo sapiens
agcagguguuagguga

SEQ ID NO: 79616 - RNA, 18 nt, Homo sapiens
agcaucacugaucauccu

SEQ ID NO: 79617 - RNA, 22 nt, Homo sapiens
agcugaguguuccaagagcgag

SEQ ID NO: 79618 - RNA, 22 nt, Homo sapiens
agcugcaaagggagagaugauu

SEQ ID NO: 79619 - RNA, 22 nt, Homo sapiens
agcuggucucaggugcccugcu

SEQ ID NO: 79620 - RNA, 22 nt, Homo sapiens
aggaagguaaacuaacuugccu

SEQ ID NO: 79621 - RNA, 21 nt, Homo sapiens
aggagcauucaugacgagguu

SEQ ID NO: 79622 - RNA, 20 nt, Homo sapiens
aggagcauuuacauuggcuc

SEQ ID NO: 79623 - RNA, 22 nt, Homo sapiens
aggcaacaugguaaaacccugu

SEQ ID NO: 79624 - RNA, 22 nt, Homo sapiens
aggcuguguggauaauauuggg

SEQ ID NO: 79625 - RNA, 22 nt, Homo sapiens
aggugaaugcucacauucuaau

SEQ ID NO: 79626 - RNA, 22 nt, Homo sapiens
agucaguguguauugauggcac

SEQ ID NO: 79627 - RNA, 22 nt, Homo sapiens
agugcauugagacuugugaguu

SEQ ID NO: 79628 - RNA, 22 nt, Homo sapiens
agugccaaaucgagggcucuga

SEQ ID NO: 79629 - RNA, 22 nt, Homo sapiens
aguuuugguugaguuacuagca

SEQ ID NO: 79630 - RNA, 22 nt, Homo sapiens
auaagauaguggaagugggauu

SEQ ID NO: 79631 - RNA, 20 nt, Homo sapiens
auagaagacuagugcagcag

SEQ ID NO: 79632 - RNA, 22 nt, Homo sapiens
auaggagcacgaacucuagugu

SEQ ID NO: 79633 - RNA, 22 nt, Homo sapiens
auaggagcagaaaccguauuuu

SEQ ID NO: 79634 - RNA, 22 nt, Homo sapiens
auagugcugcaagaaacauacg

SEQ ID NO: 79635 - RNA, 22 nt, Homo sapiens
auagugcugcaauaaacauacg

SEQ ID NO: 79636 - RNA, 22 nt, Homo sapiens
auagugcugcacuaaacauaca

SEQ ID NO: 79637 - RNA, 22 nt, Homo sapiens
auagugcugcauuaaacauacg

SEQ ID NO: 79638 - RNA, 22 nt, Homo sapiens
auagugcuguauuaaacauacg

SEQ ID NO: 79639 - RNA, 19 nt, Homo sapiens
auauaacauccaggagcag

SEQ ID NO: 79640 - RNA, 22 nt, Homo sapiens
auaucaaggccauuuucuaaau

SEQ ID NO: 79641 - RNA, 22 nt, Homo sapiens
aucaaagcagcauggcccaguc

SEQ ID NO: 79642 - RNA, 22 nt, Homo sapiens
aucagcagcaugaaaacaggcu

SEQ ID NO: 79643 - RNA, 23 nt, Homo sapiens
auccacauucuaguccuuuaugc

SEQ ID NO: 79644 - RNA, 22 nt, Homo sapiens
auccccuugcagugaccggggc

SEQ ID NO: 79645 - RNA, 22 nt, Homo sapiens
aucucaguucaggcuggccaca

SEQ ID NO: 79646 - RNA, 22 nt, Homo sapiens
augacugucagggcagucauug

SEQ ID NO: 79647 - RNA, 22 nt, Homo sapiens
augagagcuaacuguggguaca

SEQ ID NO: 79648 - RNA, 22 nt, Homo sapiens
augagaugaggaauggcccucc

SEQ ID NO: 79649 - RNA, 22 nt, Homo sapiens
augagcugauuuccuuaccaua

SEQ ID NO: 79650 - RNA, 22 nt, Homo sapiens
augagggagggguggugccgca

SEQ ID NO: 79651 - RNA, 22 nt, Homo sapiens
augcuggugcuagaaacuggaa

SEQ ID NO: 79652 - RNA, 22 nt, Homo sapiens
auggcacuaaugggaguuuacu

SEQ ID NO: 79653 - RNA, 22 nt, Homo sapiens
auggcccugggaaaggaggcau

SEQ ID NO: 79654 - RNA, 22 nt, Homo sapiens
auggcuucuucuaaaagugggg

SEQ ID NO: 79655 - RNA, 22 nt, Homo sapiens
auguaacaguauuuggagaugu

SEQ ID NO: 79656 - RNA, 22 nt, Homo sapiens
auguccaugagcacauguauca

SEQ ID NO: 79657 - RNA, 22 nt, Homo sapiens
augucuagagcaagagaugcug

SEQ ID NO: 79658 - RNA, 22 nt, Homo sapiens
auuaaguugugccugaaaacuu

SEQ ID NO: 79659 - RNA, 22 nt, Homo sapiens
auucaaggagucuucgucccaa

SEQ ID NO: 79660 - RNA, 22 nt, Homo sapiens
caaagugguuuauacaugauug

SEQ ID NO: 79661 - RNA, 22 nt, Homo sapiens
caaugcagcuuuuggagagaaa

SEQ ID NO: 79662 - RNA, 22 nt, Homo sapiens
cacacugucuucauuacuguag

SEQ ID NO: 79663 - RNA, 22 nt, Homo sapiens
ugccuaguagaaggugaacaug

SEQ ID NO: 79664 - RNA, 23 nt, Homo sapiens
ugcuauguaagcauuuauuaaau

SEQ ID NO: 79665 - RNA, 22 nt, Homo sapiens
ugcuggcguuacucuccaucag

SEQ ID NO: 79666 - RNA, 22 nt, Homo sapiens
uggaagauggaguuuuaucauu

SEQ ID NO: 79667 - RNA, 22 nt, Homo sapiens
uggaagccuagauucuuuucuu

SEQ ID NO: 79668 - RNA, 21 nt, Homo sapiens
uggaccccuuccagucaucau

SEQ ID NO: 79669 - RNA, 22 nt, Homo sapiens
uggagucuugcucuguugccca

SEQ ID NO: 79670 - RNA, 22 nt, Homo sapiens
uggaucuguucuauuuaucuga

SEQ ID NO: 79671 - RNA, 19 nt, Homo sapiens
uggcacauguauacauaug

SEQ ID NO: 79672 - RNA, 22 nt, Homo sapiens
uggcaugugugaagugcccagc

SEQ ID NO: 79673 - RNA, 22 nt, Homo sapiens
uggcuacagaaaguacuaguga

SEQ ID NO: 79674 - RNA, 23 nt, Homo sapiens
ugggucaguuuuucugacaucau

SEQ ID NO: 79675 - RNA, 20 nt, Homo sapiens
ugguccccaccaaaucucau

SEQ ID NO: 79676 - RNA, 22 nt, Homo sapiens
uggucuccuuuguacccugggc

SEQ ID NO: 79677 - RNA, 20 nt, Homo sapiens
uggugucuuggaaagagcuc

SEQ ID NO: 79678 - RNA, 22 nt, Homo sapiens
uguauagaucugauucaucucc

SEQ ID NO: 79679 - RNA, 22 nt, Homo sapiens
ugucaacauuuaucaaguuauu

SEQ ID NO: 79680 - RNA, 22 nt, Homo sapiens
ugucacccuuuauccauuuccu

SEQ ID NO: 79681 - RNA, 22 nt, Homo sapiens
ugucccaguuggguauugaauu

SEQ ID NO: 79682 - RNA, 22 nt, Homo sapiens
ugugaauggugcuuccuagaug

SEQ ID NO: 79683 - RNA, 22 nt, Homo sapiens
ugugaguguguacuaguuauca

SEQ ID NO: 79684 - RNA, 22 nt, Homo sapiens
ugugaucaaccugcagggcugg

SEQ ID NO: 79685 - RNA, 22 nt, Homo sapiens
ugugcacaauguacagguuagu

SEQ ID NO: 79686 - RNA, 22 nt, Homo sapiens
ugugccacuccagcucuagcuu

SEQ ID NO: 79687 - RNA, 22 nt, Homo sapiens
ugugccacugcacuccugccug

SEQ ID NO: 79688 - RNA, 22 nt, Homo sapiens
ugugccacugcacuccugggug

SEQ ID NO: 79689 - RNA, 22 nt, Homo sapiens
ugugccacugcacuucagccug

SEQ ID NO: 79690 - RNA, 22 nt, Homo sapiens
uguggcaaauggucaggaagaa

SEQ ID NO: 79691 - RNA, 18 nt, Homo sapiens
uguggcuguuuuccaaua

SEQ ID NO: 79692 - RNA, 22 nt, Homo sapiens
uguucuugaguugggaguacaa

SEQ ID NO: 79693 - RNA, 22 nt, Homo sapiens
uguugcacacacugaaauacac

SEQ ID NO: 79694 - RNA, 22 nt, Homo sapiens
uguugcaccugccuugcuuuag

SEQ ID NO: 79695 - RNA, 22 nt, Homo sapiens
uguugcacuccagccuggguga

SEQ ID NO: 79696 - RNA, 22 nt, Homo sapiens
uguugcacuccauccugggcga

SEQ ID NO: 79697 - RNA, 19 nt, Homo sapiens
uuaagugugauaucucagu

SEQ ID NO: 79698 - RNA, 22 nt, Homo sapiens
uuacacaguugguaggggcaga

SEQ ID NO: 79699 - RNA, 17 nt, Homo sapiens
uuacaggugcugagagu

SEQ ID NO: 79700 - RNA, 22 nt, Homo sapiens
uuacaguugugagccaccaugc

SEQ ID NO: 79701 - RNA, 22 nt, Homo sapiens
uuagcagcacaaaagcagacua

SEQ ID NO: 79702 - RNA, 22 nt, Homo sapiens
uuaggucaucgcuguccuucag

SEQ ID NO: 79703 - RNA, 22 nt, Homo sapiens
uucaaguaagaaagacaucagg

SEQ ID NO: 79704 - RNA, 22 nt, Homo sapiens
uucaaguagguaggaccacagg

SEQ ID NO: 79705 - RNA, 22 nt, Homo sapiens
uucacagugugaucuaugggca

SEQ ID NO: 79706 - RNA, 22 nt, Homo sapiens
uucacccugguuguagauggac

SEQ ID NO: 79707 - RNA, 23 nt, Homo sapiens
uucaccguguuggccaggcuggu

SEQ ID NO: 79708 - RNA, 22 nt, Homo sapiens
uucagcacaguguggaucauuc

SEQ ID NO: 79709 - RNA, 22 nt, Homo sapiens
uucaucagggguauuggccaau

SEQ ID NO: 79710 - RNA, 22 nt, Homo sapiens
uucauguaauauauuucaggcc

SEQ ID NO: 79711 - RNA, 22 nt, Homo sapiens
uuccagaugggaguucuauucu

SEQ ID NO: 79712 - RNA, 22 nt, Homo sapiens
uuccaguuauuauaccucuuaa

SEQ ID NO: 79713 - RNA, 22 nt, Homo sapiens
uuccuugguucagggaaggucc

SEQ ID NO: 79714 - RNA, 22 nt, Homo sapiens
uucuaaguaauuuugcaugccu

SEQ ID NO: 79715 - RNA, 22 nt, Homo sapiens
uucucauggugauggcaaaauc

SEQ ID NO: 79716 - RNA, 22 nt, Homo sapiens
uucuucaggcauucccagaagc

SEQ ID NO: 79717 - RNA, 22 nt, Homo sapiens
uugaaaguaaacaucacaaaga

SEQ ID NO: 79718 - RNA, 22 nt, Homo sapiens
uugaagacuauaugauucuuca

SEQ ID NO: 79719 - RNA, 22 nt, Homo sapiens
uugagacggaguuuugcucuug

SEQ ID NO: 79720 - RNA, 22 nt, Homo sapiens
uugagagaaaaggccaugccuu

SEQ ID NO: 79721 - RNA, 22 nt, Homo sapiens
uugagaugauggauaugcuaau

SEQ ID NO: 79722 - RNA, 22 nt, Homo sapiens
uugagauggagccucacucugc

SEQ ID NO: 79723 - RNA, 22 nt, Homo sapiens
uugagauggagcuucacucuug

SEQ ID NO: 79724 - RNA, 22 nt, Homo sapiens
uugagauggagucucacucugc

SEQ ID NO: 79725 - RNA, 22 nt, Homo sapiens
uugagauggagucucacugugu

SEQ ID NO: 79726 - RNA, 22 nt, Homo sapiens
uugagauggaguuucacucugu

SEQ ID NO: 79727 - RNA, 22 nt, Homo sapiens
uugagauggaguuucgcucuug

SEQ ID NO: 79728 - RNA, 22 nt, Homo sapiens
uugagauguauguauauaaugu

SEQ ID NO: 79729 - RNA, 22 nt, Homo sapiens
uugauaguccuguaucuauuuu

SEQ ID NO: 79730 - RNA, 22 nt, Homo sapiens
uugcacugagauuuugcuuaca

SEQ ID NO: 79731 - RNA, 22 nt, Homo sapiens
uugcacuguaauuuauuuaugu

SEQ ID NO: 79732 - RNA, 22 nt, Homo sapiens
uugcauguacguacagagagag

SEQ ID NO: 79733 - RNA, 22 nt, Homo sapiens
uugcuggugguucgagcaacac

SEQ ID NO: 79734 - RNA, 22 nt, Homo sapiens
uuggaauuaagagauauuuucu

SEQ ID NO: 79735 - RNA, 22 nt, Homo sapiens
uuggcagucugaggcacagacu

SEQ ID NO: 79736 - RNA, 23 nt, Homo sapiens
uuggccuccuugugucuagggcu

SEQ ID NO: 79737 - RNA, 22 nt, Homo sapiens
uuggcucuggcugggcuccagc

SEQ ID NO: 79738 - RNA, 22 nt, Homo sapiens
uuggcuguguuuauaugcugga

SEQ ID NO: 79739 - RNA, 22 nt, Homo sapiens
uuggcuguguuucccuacaaau

SEQ ID NO: 79740 - RNA, 22 nt, Homo sapiens
uuggguccucugguccuugguu

SEQ ID NO: 79741 - RNA, 22 nt, Homo sapiens
uuguaaaguucuuaggaagcuc

SEQ ID NO: 79742 - RNA, 22 nt, Homo sapiens
uugucacccuacauaacaggga

SEQ ID NO: 79743 - RNA, 22 nt, Homo sapiens
uugugucaaauggcaauuagca

SEQ ID NO: 79744 - RNA, 22 nt, Homo sapiens
uuguucaggagguuggggaugc

SEQ ID NO: 79745 - RNA, 22 nt, Homo sapiens
uuucuacagggcuugccaggua

SEQ ID NO: 79746 - RNA, 22 nt, Homo sapiens
uuugacucacagccuggcugcc

SEQ ID NO: 79747 - RNA, 22 nt, Homo sapiens
uuugcaauagguuguggggagg

SEQ ID NO: 79748 - RNA, 22 nt, Homo sapiens
uuugcaucuuagaaaguucucc

SEQ ID NO: 79749 - RNA, 23 nt, Homo sapiens
uuuggcauuccagaaauuuucau

SEQ ID NO: 79750 - RNA, 18 nt, Homo sapiens
uuugugcuccacaaagga

SEQ ID NO: 79751 - RNA, 22 nt, Homo sapiens
uuugugcuccucucaguaugug

SEQ ID NO: 79752 - RNA, 22 nt, Homo sapiens
uuugugcuccugugagaaucua

SEQ ID NO: 79753 - RNA, 22 nt, Homo sapiens
uuuuuggaggagguuagaucau

SEQ ID NO: 79754 - RNA, 21 nt, Homo sapiens
uuuuugggcuuucauaguguu

SEQ ID NO: 79755 - RNA, 22 nt, Homo sapiens
aaaagcauucagagugcugggc

SEQ ID NO: 79756 - RNA, 22 nt, Homo sapiens
aaacugccuuccuuguaggugc

SEQ ID NO: 79757 - RNA, 22 nt, Homo sapiens
aaagucuguuuugucagagacu

SEQ ID NO: 79758 - RNA, 22 nt, Homo sapiens
aaagugauguccaggcuuucag

SEQ ID NO: 79759 - RNA, 22 nt, Homo sapiens
aaagugcaguauuugggcagaa

SEQ ID NO: 79760 - RNA, 22 nt, Homo sapiens
aaauugcuuuugaagacuuagu

SEQ ID NO: 79761 - RNA, 22 nt, Homo sapiens
ucacauguguaugagcuuugau

SEQ ID NO: 79762 - RNA, 22 nt, Homo sapiens
ucaccaccuuccaggaccacug

SEQ ID NO: 79763 - RNA, 22 nt, Homo sapiens
ucacuggagguuccugaaguuc

SEQ ID NO: 79764 - RNA, 22 nt, Homo sapiens
ucacugggagcauuugagccuu

SEQ ID NO: 79765 - RNA, 22 nt, Homo sapiens
ucagcaccauguaacaauugau

SEQ ID NO: 79766 - RNA, 20 nt, Homo sapiens
ucagcagucuggagcagagg

SEQ ID NO: 79767 - RNA, 23 nt, Homo sapiens
ucagugucuggauccugcucagu

SEQ ID NO: 79768 - RNA, 22 nt, Homo sapiens
ucagugucugugauggagaggu

SEQ ID NO: 79769 - RNA, 22 nt, Homo sapiens
ucaucuggcgaaugugaagagu

SEQ ID NO: 79770 - RNA, 22 nt, Homo sapiens
ucauggguuuugguccaagcaa

SEQ ID NO: 79771 - RNA, 22 nt, Homo sapiens
uccaagaugcuggcagcuacag

SEQ ID NO: 79772 - RNA, 19 nt, Homo sapiens
uccaccgcgugcaccucua

SEQ ID NO: 79773 - RNA, 22 nt, Homo sapiens
uccaguguuccucagucacccc

SEQ ID NO: 79774 - RNA, 22 nt, Homo sapiens
uccaguuuggaggcuugaugug

SEQ ID NO: 79775 - RNA, 22 nt, Homo sapiens
uccaguuuuguuaacauauggu

SEQ ID NO: 79776 - RNA, 22 nt, Homo sapiens
ucccaguuuuucugaauaguca

SEQ ID NO: 79777 - RNA, 22 nt, Homo sapiens
uccugagucagcauccguuugu

SEQ ID NO: 79778 - RNA, 22 nt, Homo sapiens
ucuaaaacuagauugugaugau

SEQ ID NO: 79779 - RNA, 22 nt, Homo sapiens
ucuaguaaugagaggcaggaga

SEQ ID NO: 79780 - RNA, 18 nt, Homo sapiens
ucucacagcaaucuguca

SEQ ID NO: 79781 - RNA, 22 nt, Homo sapiens
ucucaguggcacccccaacacc

SEQ ID NO: 79782 - RNA, 22 nt, Homo sapiens
ucucaguggugcuggcagggga

SEQ ID NO: 79783 - RNA, 20 nt, Homo sapiens
ucucauagagguagagaaua

SEQ ID NO: 79784 - RNA, 20 nt, Homo sapiens
ucucauggagguagagaaua

SEQ ID NO: 79785 - RNA, 22 nt, Homo sapiens
ucucauggagguagagaguaaa

SEQ ID NO: 79786 - RNA, 22 nt, Homo sapiens
ucucccauccguacacggauug

SEQ ID NO: 79787 - RNA, 21 nt, Homo sapiens
ucucucaaccaggaagugggc

SEQ ID NO: 79788 - RNA, 19 nt, Homo sapiens
ucucugguguuggagggga

SEQ ID NO: 79789 - RNA, 20 nt, Homo sapiens
ucuggccccuccaaaucuca

SEQ ID NO: 79790 - RNA, 22 nt, Homo sapiens
ucuggccccucccaaaucucau

SEQ ID NO: 79791 - RNA, 22 nt, Homo sapiens
ucuggccuagaacaauuaauua

SEQ ID NO: 79792 - RNA, 22 nt, Homo sapiens
ucuggcuugugaacugucuucu

SEQ ID NO: 79793 - RNA, 22 nt, Homo sapiens
ucuggguuuuuccauugccggu

SEQ ID NO: 79794 - RNA, 22 nt, Homo sapiens
ucugucuuugccuaaguuuguc

SEQ ID NO: 79795 - RNA, 22 nt, Homo sapiens
ucuguguuugguuggcaauuuc

SEQ ID NO: 79796 - RNA, 22 nt, Homo sapiens
ucuuagugcggcugcugcagcc

SEQ ID NO: 79797 - RNA, 22 nt, Homo sapiens
ucuuggguuguuggcuucuccu

SEQ ID NO: 79798 - RNA, 22 nt, Homo sapiens
ucuuggguuugccuugcugcug

SEQ ID NO: 79799 - RNA, 22 nt, Homo sapiens
ucuuuggaggcgaucuguuuga

SEQ ID NO: 79800 - RNA, 22 nt, Homo sapiens
ugaaggaguauggauaagucgu

SEQ ID NO: 79801 - RNA, 22 nt, Homo sapiens
ugaauggauccaauucuuagua

SEQ ID NO: 79802 - RNA, 22 nt, Homo sapiens
ugacagagaagcauugaguuca

SEQ ID NO: 79803 - RNA, 22 nt, Homo sapiens
ugacaguaaacagucuugauua

SEQ ID NO: 79804 - RNA, 22 nt, Homo sapiens
ugaccacagaaagugagggagc

SEQ ID NO: 79805 - RNA, 19 nt, Homo sapiens
ugaccagggacagaaacca

SEQ ID NO: 79806 - RNA, 22 nt, Homo sapiens
ugaccuguuugaaauugccaau

SEQ ID NO: 79807 - RNA, 22 nt, Homo sapiens
cuucggugaguagauggguuaa

SEQ ID NO: 79808 - RNA, 22 nt, Homo sapiens
cuugcagagucauucuaauuuc

SEQ ID NO: 79809 - RNA, 22 nt, Homo sapiens
cuuucucagugagacccgagau

SEQ ID NO: 79810 - RNA, 18 nt, Homo sapiens
cuuugcagcuuccagagg

SEQ ID NO: 79811 - RNA, 22 nt, Homo sapiens
cuuuggcacuuccuaagugcca

SEQ ID NO: 79812 - RNA, 22 nt, Homo sapiens
gaaaugucugagauguggcuca

SEQ ID NO: 79813 - RNA, 22 nt, Homo sapiens
gaacugggguuggguugcgaua

SEQ ID NO: 79814 - RNA, 22 nt, Homo sapiens
gagaaugagaggggaaggccac

SEQ ID NO: 79815 - RNA, 22 nt, Homo sapiens
gagccuguaggaggagaggugg

SEQ ID NO: 79816 - RNA, 22 nt, Homo sapiens
gagcuaguguaauauuuugggg

SEQ ID NO: 79817 - RNA, 22 nt, Homo sapiens
gaggcaaguggccaccgagucu

SEQ ID NO: 79818 - RNA, 22 nt, Homo sapiens
gaggcagucuguccauucucag

SEQ ID NO: 79819 - RNA, 22 nt, Homo sapiens
gagguaucauuauguugcccag

SEQ ID NO: 79820 - RNA, 22 nt, Homo sapiens
gaguuagguugucaaugucuua

SEQ ID NO: 79821 - RNA, 19 nt, Homo sapiens
gaucuguugaucaaugugu

SEQ ID NO: 79822 - RNA, 22 nt, Homo sapiens
gcaagauuguguggcugaagua

SEQ ID NO: 79823 - RNA, 22 nt, Homo sapiens
gcacccugucaaaauggaccaa

SEQ ID NO: 79824 - RNA, 22 nt, Homo sapiens
gcaucacagcuccugugcuggc

SEQ ID NO: 79825 - RNA, 22 nt, Homo sapiens
gcauggccuuuaaaugucacag

SEQ ID NO: 79826 - RNA, 22 nt, Homo sapiens
gcccugauacauucuucugccu

SEQ ID NO: 79827 - RNA, 22 nt, Homo sapiens
gcuggucugccguaguaggugc

SEQ ID NO: 79828 - RNA, 20 nt, Homo sapiens
gcugugcuuaauacacuuuc

SEQ ID NO: 79829 - RNA, 22 nt, Homo sapiens
ggaaguuaauacagauagagua

SEQ ID NO: 79830 - RNA, 22 nt, Homo sapiens
ggaauuaaggcaauugaaagcu

SEQ ID NO: 79831 - RNA, 22 nt, Homo sapiens
ggagauaauccagggagggacu

SEQ ID NO: 79832 - RNA, 22 nt, Homo sapiens
ggagaugauuaugaaucacuua

SEQ ID NO: 79833 - RNA, 22 nt, Homo sapiens
ggagucugacuuauaggaaccu

SEQ ID NO: 79834 - RNA, 22 nt, Homo sapiens
ggagucugauguucuaaggcag

SEQ ID NO: 79835 - RNA, 22 nt, Homo sapiens
ggaucacagagcuugggaaagg

SEQ ID NO: 79836 - RNA, 22 nt, Homo sapiens
ggcaacauggugaaacucuguc

SEQ ID NO: 79837 - RNA, 22 nt, Homo sapiens
ggcaccauuuuacuccuucccu

SEQ ID NO: 79838 - RNA, 22 nt, Homo sapiens
ggcaguguuauuauauuuuugg

SEQ ID NO: 79839 - RNA, 22 nt, Homo sapiens
ggcaguuuguuugugaggucca

SEQ ID NO: 79840 - RNA, 22 nt, Homo sapiens
ggccggguggccauggcugccc

SEQ ID NO: 79841 - RNA, 22 nt, Homo sapiens
gggaugaaguugauguagaaag

SEQ ID NO: 79842 - RNA, 22 nt, Homo sapiens
gggcaacauugaguacccugaa

SEQ ID NO: 79843 - RNA, 22 nt, Homo sapiens
ggugacugguuuaucuggcagu

SEQ ID NO: 79844 - RNA, 19 nt, Homo sapiens
ggugagaaauuaugggucu

SEQ ID NO: 79845 - RNA, 22 nt, Homo sapiens
guaaucucagcuacuugggagc

SEQ ID NO: 79846 - RNA, 22 nt, Homo sapiens
guaaucucagcuucuugggagg

SEQ ID NO: 79847 - RNA, 22 nt, Homo sapiens
guagaaaguuugcugucacaug

SEQ ID NO: 79848 - RNA, 21 nt, Homo sapiens
gucacuggggcuggauaauuc

SEQ ID NO: 79849 - RNA, 22 nt, Homo sapiens
gucaggcaccgauacaguuuuu

SEQ ID NO: 79850 - RNA, 22 nt, Homo sapiens
gucaguggauacugucucuguc

SEQ ID NO: 79851 - RNA, 22 nt, Homo sapiens
gucagugucuuugcagcucaga

SEQ ID NO: 79852 - RNA, 22 nt, Homo sapiens
gucaugggguacuacacauggg

SEQ ID NO: 79853 - RNA, 22 nt, Homo sapiens
gucccugcgauugugggauccu

SEQ ID NO: 79854 - RNA, 22 nt, Homo sapiens
gucuguuugauccagaucaaaa

SEQ ID NO: 79855 - RNA, 22 nt, Homo sapiens
uuggacuuuaagauagagaugu

SEQ ID NO: 79856 - RNA, 22 nt, Homo sapiens
uuggagagaaaggcaguuccug

SEQ ID NO: 79857 - RNA, 22 nt, Homo sapiens
uuggccagugucuuuuuuuccu

SEQ ID NO: 79858 - RNA, 22 nt, Homo sapiens
uuggucaggcuagaguguggug

SEQ ID NO: 79859 - RNA, 18 nt, Homo sapiens
uuucaagucuuaggugac

SEQ ID NO: 79860 - RNA, 21 nt, Homo sapiens
uuuccuggagcguauggcuuc

SEQ ID NO: 79861 - RNA, 18 nt, Homo sapiens
uuugacugguguccuuau

SEQ ID NO: 79862 - RNA, 22 nt, Homo sapiens
uuugauguccaccucagcccac

SEQ ID NO: 79863 - RNA, 22 nt, Homo sapiens
uuugcacuuuuguaauaugguu

SEQ ID NO: 79864 - RNA, 22 nt, Homo sapiens
uuugccuuugugauauggucua

SEQ ID NO: 79865 - RNA, 22 nt, Homo sapiens
uuuggcauuugaguuuguagga

SEQ ID NO: 79866 - RNA, 22 nt, Homo sapiens
uuuguaauccuauuccaaagga

SEQ ID NO: 79867 - RNA, 22 nt, Homo sapiens
uuuguacuucauacaauaacuc

SEQ ID NO: 79868 - RNA, 22 nt, Homo sapiens
uuugugaaugucauaagcucca

SEQ ID NO: 79869 - RNA, 22 nt, Homo sapiens
uuugugcaugaagagggggugc

SEQ ID NO: 79870 - RNA, 17 nt, Homo sapiens
uuuuggauuagaaaucc

SEQ ID NO: 79871 - RNA, 22 nt, Homo sapiens
uuuuggcuagaaauauaccucc

SEQ ID NO: 79872 - RNA, 22 nt, Homo sapiens
uuuuggcuuaaagagaauguau

SEQ ID NO: 79873 - RNA, 22 nt, Homo sapiens
uuuuggcuuuuccucagcaagc

SEQ ID NO: 79874 - RNA, 22 nt, Homo sapiens
uuuuuggauaaugguacaugua

SEQ ID NO: 79875 - RNA, 22 nt, Homo sapiens
ugucuggaaggguggccuccug

SEQ ID NO: 79876 - RNA, 22 nt, Homo sapiens
ugucuggaguccauagaagugu

SEQ ID NO: 79877 - RNA, 22 nt, Homo sapiens
ugucuuggagaauccuggguuu

SEQ ID NO: 79878 - RNA, 22 nt, Homo sapiens
ugugacagguauccuguguucu

SEQ ID NO: 79879 - RNA, 22 nt, Homo sapiens
ugugccacugcacucccgccug

SEQ ID NO: 79880 - RNA, 21 nt, Homo sapiens
uguggcaauggccucacagau

SEQ ID NO: 79881 - RNA, 22 nt, Homo sapiens
uguggcagugcuuuaugaaacc

SEQ ID NO: 79882 - RNA, 22 nt, Homo sapiens
uguggcauugaauaaccuugga

SEQ ID NO: 79883 - RNA, 22 nt, Homo sapiens
uguggcugguggcaccuuuucc

SEQ ID NO: 79884 - RNA, 19 nt, Homo sapiens
uguggucauccugggacga

SEQ ID NO: 79885 - RNA, 22 nt, Homo sapiens
uguguaauacucuaaugaugca

SEQ ID NO: 79886 - RNA, 22 nt, Homo sapiens
uguugcacuccagccugggcaa

SEQ ID NO: 79887 - RNA, 22 nt, Homo sapiens
uuaaaagcuaucuccaagguca

SEQ ID NO: 79888 - RNA, 22 nt, Homo sapiens
uuagcagcaugagaauggacua

SEQ ID NO: 79889 - RNA, 22 nt, Homo sapiens
uuauuugguuauuguaauuggg

SEQ ID NO: 79890 - RNA, 22 nt, Homo sapiens
uucacugugaacucauauucag

SEQ ID NO: 79891 - RNA, 22 nt, Homo sapiens
uucaguggagaggcugaguggu

SEQ ID NO: 79892 - RNA, 22 nt, Homo sapiens
uucccagugguuagcucugguc

SEQ ID NO: 79893 - RNA, 22 nt, Homo sapiens
uuccugagccuuguaucuagua

SEQ ID NO: 79894 - RNA, 22 nt, Homo sapiens
uuccugcacuugcuugccuaug

SEQ ID NO: 79895 - RNA, 21 nt, Homo sapiens
uucuaaguaaauguuggacau

SEQ ID NO: 79896 - RNA, 22 nt, Homo sapiens
uucuacagugacugcagccaua

SEQ ID NO: 79897 - RNA, 22 nt, Homo sapiens
uucuccugguggacccuaaacg

SEQ ID NO: 79898 - RNA, 22 nt, Homo sapiens
uucucuggucagaggggagguu

SEQ ID NO: 79899 - RNA, 22 nt, Homo sapiens
uucuugcugaauugugcccuuc

SEQ ID NO: 79900 - RNA, 22 nt, Homo sapiens
uugaauguacuuguucucacua

SEQ ID NO: 79901 - RNA, 22 nt, Homo sapiens
uugacuucagagcugauucaag

SEQ ID NO: 79902 - RNA, 22 nt, Homo sapiens
uugagacggagucuugcucuuu

SEQ ID NO: 79903 - RNA, 22 nt, Homo sapiens
uugagauaggagcuguuguucu

SEQ ID NO: 79904 - RNA, 22 nt, Homo sapiens
uugagauggagucucacucugu

SEQ ID NO: 79905 - RNA, 22 nt, Homo sapiens
uugagauggagucucacucuug

SEQ ID NO: 79906 - RNA, 22 nt, Homo sapiens
uugagauggagucucgcucuuu

SEQ ID NO: 79907 - RNA, 22 nt, Homo sapiens
uugagauggaguuucacucucg

SEQ ID NO: 79908 - RNA, 19 nt, Homo sapiens
uugagaugugaacucacac

SEQ ID NO: 79909 - RNA, 22 nt, Homo sapiens
uugagcccuggagguggaggcu

SEQ ID NO: 79910 - RNA, 18 nt, Homo sapiens
uugcaaauucuucccugu

SEQ ID NO: 79911 - RNA, 22 nt, Homo sapiens
uugcaacauuguaaguuuauau

SEQ ID NO: 79912 - RNA, 22 nt, Homo sapiens
uugcaacuuagaaaaaucauuu

SEQ ID NO: 79913 - RNA, 20 nt, Homo sapiens
uugcacagagaaggaggcag

SEQ ID NO: 79914 - RNA, 22 nt, Homo sapiens
uugcacagucuagcuccaccuu

SEQ ID NO: 79915 - RNA, 22 nt, Homo sapiens
uugcacaguguguacagcacca

SEQ ID NO: 79916 - RNA, 19 nt, Homo sapiens
uugcaguauccuauauguu

SEQ ID NO: 79917 - RNA, 22 nt, Homo sapiens
uugcugguuuucauaugagcag

SEQ ID NO: 79918 - RNA, 22 nt, Homo sapiens
aaagcugucaaggcaggaggcu

SEQ ID NO: 79919 - RNA, 22 nt, Homo sapiens
aaagugcaguauuugggcagga

SEQ ID NO: 79920 - RNA, 18 nt, Homo sapiens
aaaugcucuucuggaaua

SEQ ID NO: 79921 - RNA, 22 nt, Homo sapiens
aaauugcaaugcgaggcagagg

SEQ ID NO: 79922 - RNA, 22 nt, Homo sapiens
aagagguagucugucccuuagc

SEQ ID NO: 79923 - RNA, 22 nt, Homo sapiens
aaggagcuuaagugacuuguac

SEQ ID NO: 79924 - RNA, 22 nt, Homo sapiens
aaguacuguuuaaauugcagaa

SEQ ID NO: 79925 - RNA, 22 nt, Homo sapiens
aagugcuuuacacaugcaugau

SEQ ID NO: 79926 - RNA, 22 nt, Homo sapiens
aagugcuuuguacagggguuga

SEQ ID NO: 79927 - RNA, 21 nt, Homo sapiens
aauaaagcaaccuuaugccau

SEQ ID NO: 79928 - RNA, 22 nt, Homo sapiens
aauaaagccugucucuuuagag

SEQ ID NO: 79929 - RNA, 21 nt, Homo sapiens
aauacucuagguuaagagagc

SEQ ID NO: 79930 - RNA, 22 nt, Homo sapiens
aaugacagccagauucuucucu

SEQ ID NO: 79931 - RNA, 22 nt, Homo sapiens
aaugcacauauauuuccuuauu

SEQ ID NO: 79932 - RNA, 22 nt, Homo sapiens
aauggcaaauguuuucuguuga

SEQ ID NO: 79933 - RNA, 22 nt, Homo sapiens
aauuaguaaccuaauuccaucu

SEQ ID NO: 79934 - RNA, 22 nt, Homo sapiens
aauugcaauggacaaugcagca

SEQ ID NO: 79935 - RNA, 22 nt, Homo sapiens
acaugccucccugguccgcugu

SEQ ID NO: 79936 - RNA, 22 nt, Homo sapiens
accaucuagauuuguguaggua

SEQ ID NO: 79937 - RNA, 22 nt, Homo sapiens
accugggugcugaugggcuuua

SEQ ID NO: 79938 - RNA, 22 nt, Homo sapiens
accuggguguauguucaguuug

SEQ ID NO: 79939 - RNA, 22 nt, Homo sapiens
acugcacuccagccucggcaau

SEQ ID NO: 79940 - RNA, 22 nt, Homo sapiens
acugcacuccagccugagccug

SEQ ID NO: 79941 - RNA, 22 nt, Homo sapiens
acugcacuccagccugaugaaa

SEQ ID NO: 79942 - RNA, 22 nt, Homo sapiens
acugcacuccagccuggacgac

SEQ ID NO: 79943 - RNA, 22 nt, Homo sapiens
acugcacuccagccuggcggac

SEQ ID NO: 79944 - RNA, 22 nt, Homo sapiens
acugcacuccagccugugagac

SEQ ID NO: 79945 - RNA, 20 nt, Homo sapiens
acugcacuccagccuuccag

SEQ ID NO: 79946 - RNA, 22 nt, Homo sapiens
acugcacuccagccuucggaca

SEQ ID NO: 79947 - RNA, 22 nt, Homo sapiens
acugcacuccagccuucgugac

SEQ ID NO: 79948 - RNA, 22 nt, Homo sapiens
acugcacuccagccuugagagc

SEQ ID NO: 79949 - RNA, 22 nt, Homo sapiens
acugcacuccagccuugcgaca

SEQ ID NO: 79950 - RNA, 22 nt, Homo sapiens
acugcacuccagccuuggcaac

SEQ ID NO: 79951 - RNA, 22 nt, Homo sapiens
acugcacuccagccuuggcggc

SEQ ID NO: 79952 - RNA, 22 nt, Homo sapiens
acugcacuccaguuugggcagc

SEQ ID NO: 79953 - RNA, 22 nt, Homo sapiens
acugcacucccgcccgggugac

SEQ ID NO: 79954 - RNA, 18 nt, Homo sapiens
cuggaugucgaguguguu

SEQ ID NO: 79955 - RNA, 22 nt, Homo sapiens
cuggcccaguucugcguuuugc

SEQ ID NO: 79956 - RNA, 22 nt, Homo sapiens
cugggaugugacuguugccccc

SEQ ID NO: 79957 - RNA, 22 nt, Homo sapiens
cugguuuguaaaguuccugaga

SEQ ID NO: 79958 - RNA, 22 nt, Homo sapiens
cugucuaugagccaggaagcca

SEQ ID NO: 79959 - RNA, 22 nt, Homo sapiens
cugucuggaguccuucgugugc

SEQ ID NO: 79960 - RNA, 22 nt, Homo sapiens
cuucaaguguggccaccugacc

SEQ ID NO: 79961 - RNA, 22 nt, Homo sapiens
cuucacuuuguuaaacuccaau

SEQ ID NO: 79962 - RNA, 22 nt, Homo sapiens
cuugcacucagaagauucaguu

SEQ ID NO: 79963 - RNA, 22 nt, Homo sapiens
cuugcacuccacuguucuccug

SEQ ID NO: 79964 - RNA, 22 nt, Homo sapiens
cuuuuugcugcagcaauacugg

SEQ ID NO: 79965 - RNA, 22 nt, Homo sapiens
gaaagugcugcuugacugggau

SEQ ID NO: 79966 - RNA, 22 nt, Homo sapiens
gacacuggguguuuguuggcgu

SEQ ID NO: 79967 - RNA, 22 nt, Homo sapiens
gacucgagggcauaagagcuuu

SEQ ID NO: 79968 - RNA, 22 nt, Homo sapiens
gagaacagagauaauuuuacuu

SEQ ID NO: 79969 - RNA, 22 nt, Homo sapiens
gagaacaguguuguauuuuuuc

SEQ ID NO: 79970 - RNA, 22 nt, Homo sapiens
gagacugagucuugcucuguca

SEQ ID NO: 79971 - RNA, 22 nt, Homo sapiens
gagaugaagugucaauaaggau

SEQ ID NO: 79972 - RNA, 22 nt, Homo sapiens
gagaugugguucaaggguguuu

SEQ ID NO: 79973 - RNA, 22 nt, Homo sapiens
gagauguuuuguuaucaaagga

SEQ ID NO: 79974 - RNA, 22 nt, Homo sapiens
gagcugguccuuuaaggaugca

SEQ ID NO: 79975 - RNA, 22 nt, Homo sapiens
gaggaaguuuacaaagcaucug

SEQ ID NO: 79976 - RNA, 22 nt, Homo sapiens
gaguuuguaaacuauucacuaa

SEQ ID NO: 79977 - RNA, 22 nt, Homo sapiens
gaugagaucauaaguguggagc

SEQ ID NO: 79978 - RNA, 22 nt, Homo sapiens
gauugcaauuuaggugagagag

SEQ ID NO: 79979 - RNA, 20 nt, Homo sapiens
gcaacauggccagagugaau

SEQ ID NO: 79980 - RNA, 22 nt, Homo sapiens
gcacauuacaaguauuagcuca

SEQ ID NO: 79981 - RNA, 22 nt, Homo sapiens
gcaccaugguagaauaauggua

SEQ ID NO: 79982 - RNA, 22 nt, Homo sapiens
gcagagaaacaggucuaaggag

SEQ ID NO: 79983 - RNA, 22 nt, Homo sapiens
gcagcauuaccaagacauggca

SEQ ID NO: 79984 - RNA, 22 nt, Homo sapiens
gcccuuugugucuggcuggggu

SEQ ID NO: 79985 - RNA, 22 nt, Homo sapiens
gcugcuguuucucuuucagcau

SEQ ID NO: 79986 - RNA, 22 nt, Homo sapiens
gcuggaauuaacauagaugugc

SEQ ID NO: 79987 - RNA, 22 nt, Homo sapiens
gcuggcaagaugcugaugcaac

SEQ ID NO: 79988 - RNA, 22 nt, Homo sapiens
gcugucaugagcaacacaugaa

SEQ ID NO: 79989 - RNA, 22 nt, Homo sapiens
gcugucuggagucuguucaaug

SEQ ID NO: 79990 - RNA, 22 nt, Homo sapiens
gcuguguucucgaggcggggga

SEQ ID NO: 79991 - RNA, 22 nt, Homo sapiens
gcuugguccccacccaaaucgc

SEQ ID NO: 79992 - RNA, 22 nt, Homo sapiens
ggaauggaacaaagucuugaaa

SEQ ID NO: 79993 - RNA, 22 nt, Homo sapiens
ggaaugggauuugaagucuggc

SEQ ID NO: 79994 - RNA, 21 nt, Homo sapiens
ggaauuuagggaaugauuuag

SEQ ID NO: 79995 - RNA, 22 nt, Homo sapiens
ggagaguaauuagacugaaaga

SEQ ID NO: 79996 - RNA, 22 nt, Homo sapiens
ggagggugagaucaauuuggga

SEQ ID NO: 79997 - RNA, 16 nt, Homo sapiens
ggaggucaucugggaa

SEQ ID NO: 79998 - RNA, 22 nt, Homo sapiens
ggagucugaacuggacaaugac

SEQ ID NO: 79999 - RNA, 22 nt, Homo sapiens
ggcacuguugccggccugaauu

SEQ ID NO: 80000 - RNA, 22 nt, Homo sapiens
ggcaguuucucaggcaggggua

SEQ ID NO: 80001 - RNA, 22 nt, Homo sapiens
ggcaguuuguucuugcuccuuu

SEQ ID NO: 80002 - RNA, 22 nt, Homo sapiens
gggaugaagaagaauaguucgu

SEQ ID NO: 80003 - RNA, 22 nt, Homo sapiens
gggcaugauggugcacacaugu

SEQ ID NO: 80004 - RNA, 22 nt, Homo sapiens
ggggaguguggacaucacccug

SEQ ID NO: 80005 - RNA, 22 nt, Homo sapiens
gguaucuuggagagagaaguga

SEQ ID NO: 80006 - RNA, 22 nt, Homo sapiens
guaaucucaccuacuugggagg

SEQ ID NO: 80007 - RNA, 22 nt, Homo sapiens
guacaguaguaaaagugaauga

SEQ ID NO: 80008 - RNA, 22 nt, Homo sapiens
guacaguauaguaauaggauuu

SEQ ID NO: 80009 - RNA, 22 nt, Homo sapiens
guauccugaaguucucagcacu

SEQ ID NO: 80010 - RNA, 22 nt, Homo sapiens
gucagcaaaguucuccugcaga

SEQ ID NO: 80011 - RNA, 22 nt, Homo sapiens
gucuggagacuugggucaucaa

SEQ ID NO: 80012 - RNA, 22 nt, Homo sapiens
gucuggcaauggcagacuggca

SEQ ID NO: 80013 - RNA, 22 nt, Homo sapiens
gugaagugugaccucagcaucu

SEQ ID NO: 80014 - RNA, 22 nt, Homo sapiens
gugagaugaggucucacucugu

SEQ ID NO: 80015 - RNA, 22 nt, Homo sapiens
gugagaugguaucucauugugg

SEQ ID NO: 80016 - RNA, 22 nt, Homo sapiens
gugagaugugacuucugccucu

SEQ ID NO: 80017 - RNA, 20 nt, Homo sapiens
gugagguagaggguuaccug

SEQ ID NO: 80018 - RNA, 22 nt, Homo sapiens
gugccuucuagcuaugguuggc

SEQ ID NO: 80019 - RNA, 16 nt, Homo sapiens
gugcuguguuguuagg

SEQ ID NO: 80020 - RNA, 18 nt, Homo sapiens
guggagugucuuccugga

SEQ ID NO: 80021 - RNA, 22 nt, Homo sapiens
guggcuauucaccuuuaugaaa

SEQ ID NO: 80022 - RNA, 22 nt, Homo sapiens
guguggcaggugggggcucaga

SEQ ID NO: 80023 - RNA, 22 nt, Homo sapiens
guucaaggaauguuggcuucuc

SEQ ID NO: 80024 - RNA, 22 nt, Homo sapiens
guucucacuggacugugaaaau

SEQ ID NO: 80025 - RNA, 22 nt, Homo sapiens
guuugcagaucaugaagaaccc

SEQ ID NO: 80026 - RNA, 22 nt, Homo sapiens
uaacaccuuugauagcacuuuu

SEQ ID NO: 80027 - RNA, 22 nt, Homo sapiens
uaacagcucuacagcugcucuu

SEQ ID NO: 80028 - RNA, 22 nt, Homo sapiens
uaagguccuuaaauguguaacc

SEQ ID NO: 80029 - RNA, 22 nt, Homo sapiens
uaauugaaugcagacaccaggg

SEQ ID NO: 80030 - RNA, 22 nt, Homo sapiens
uaccacccuuuuuccagaagcc

SEQ ID NO: 80031 - RNA, 22 nt, Homo sapiens
uacugcacuccagccuugccaa

SEQ ID NO: 80032 - RNA, 22 nt, Homo sapiens
uagagguagagugacuucccca

SEQ ID NO: 80033 - RNA, 22 nt, Homo sapiens
uagagguagguguaugaacuag

SEQ ID NO: 80034 - RNA, 22 nt, Homo sapiens
uagaugauucacuuuacuucca

SEQ ID NO: 80035 - RNA, 22 nt, Homo sapiens
uagauuauccggcugggacaau

SEQ ID NO: 80036 - RNA, 22 nt, Homo sapiens
uagcagaauaacuugccagccu

SEQ ID NO: 80037 - RNA, 20 nt, Homo sapiens
uagcagcagacagagggagg

SEQ ID NO: 80038 - RNA, 22 nt, Homo sapiens
uagcagcaucucuggcuucuac

SEQ ID NO: 80039 - RNA, 22 nt, Homo sapiens
uagcuggaauuacuugcaccug

SEQ ID NO: 80040 - RNA, 22 nt, Homo sapiens
uaggagcacaaaccccauugug

SEQ ID NO: 80041 - RNA, 22 nt, Homo sapiens
uagggcauugaacugaauucuu

SEQ ID NO: 80042 - RNA, 22 nt, Homo sapiens
uagggcauuuagaggcuauuaa

SEQ ID NO: 80043 - RNA, 22 nt, Homo sapiens
uaguagcaccucucaugagcuu

SEQ ID NO: 80044 - RNA, 21 nt, Homo sapiens
uagugcugaggcaguauggga

SEQ ID NO: 80045 - RNA, 22 nt, Homo sapiens
uaucaagaugacaaacuuugcu

SEQ ID NO: 80046 - RNA, 22 nt, Homo sapiens
ugggaugaauacaaugggauca

SEQ ID NO: 80047 - RNA, 21 nt, Homo sapiens
uggucccuucagaucggauuu

SEQ ID NO: 80048 - RNA, 22 nt, Homo sapiens
uguaaaucuauuuuuaguguuu

SEQ ID NO: 80049 - RNA, 22 nt, Homo sapiens
ugucaaaugcagugauauuuga

SEQ ID NO: 80050 - RNA, 22 nt, Homo sapiens
ugucaagaaaucaaggugugag

SEQ ID NO: 80051 - RNA, 22 nt, Homo sapiens
ugucagcacaacucagguuccu

SEQ ID NO: 80052 - RNA, 22 nt, Homo sapiens
uguccuguaggaggcagaacaa

SEQ ID NO: 80053 - RNA, 16 nt, Homo sapiens
ugucuguuugggcaca

SEQ ID NO: 80054 - RNA, 22 nt, Homo sapiens
ugugaaacacgaaagucuaaaa

SEQ ID NO: 80055 - RNA, 22 nt, Homo sapiens
ugugaagauggacuaauauagu

SEQ ID NO: 80056 - RNA, 23 nt, Homo sapiens
ugugacacuuccgucaguucauu

SEQ ID NO: 80057 - RNA, 19 nt, Homo sapiens
ugugacugggccagccuag

SEQ ID NO: 80058 - RNA, 22 nt, Homo sapiens
ugugcacaugauauaucacaua

SEQ ID NO: 80059 - RNA, 23 nt, Homo sapiens
ugugcacauuuacauauauacac

SEQ ID NO: 80060 - RNA, 22 nt, Homo sapiens
ugugccaaucauagggcuuggu

SEQ ID NO: 80061 - RNA, 22 nt, Homo sapiens
uguggcauuuucagaaaggaug

SEQ ID NO: 80062 - RNA, 22 nt, Homo sapiens
ugugguagugcuuaccugcagu

SEQ ID NO: 80063 - RNA, 22 nt, Homo sapiens
uguugcacucuagccugggcaa

SEQ ID NO: 80064 - RNA, 22 nt, Homo sapiens
uuaauuguccauuauucuguuc

SEQ ID NO: 80065 - RNA, 22 nt, Homo sapiens
uuagcagcucuggugacaaggu

SEQ ID NO: 80066 - RNA, 23 nt, Homo sapiens
uucaacagguagacccucccugc

SEQ ID NO: 80067 - RNA, 22 nt, Homo sapiens
uucagggagaaggcaaacguug

SEQ ID NO: 80068 - RNA, 22 nt, Homo sapiens
uucaggguggagaguaugaggu

SEQ ID NO: 80069 - RNA, 22 nt, Homo sapiens
uucaucagggagaaauaauuuc

SEQ ID NO: 80070 - RNA, 22 nt, Homo sapiens
uucauguaaucaaggcagcuaa

SEQ ID NO: 80071 - RNA, 22 nt, Homo sapiens
uuccagagucaccuuucugucg

SEQ ID NO: 80072 - RNA, 22 nt, Homo sapiens
uuccaggugggcgugggccugg

SEQ ID NO: 80073 - RNA, 22 nt, Homo sapiens
uuccugagagggcugggugcag

SEQ ID NO: 80074 - RNA, 22 nt, Homo sapiens
uucucacaguacagggagcucu

SEQ ID NO: 80075 - RNA, 22 nt, Homo sapiens
uucucagcccccugacagucag

SEQ ID NO: 80076 - RNA, 22 nt, Homo sapiens
uucucugggacauaggucgggu

SEQ ID NO: 80077 - RNA, 22 nt, Homo sapiens
uucuggccccucccaaucucau

SEQ ID NO: 80078 - RNA, 22 nt, Homo sapiens
uucuguguuuaggucacggcua

SEQ ID NO: 80079 - RNA, 22 nt, Homo sapiens
uucuucaggccacaaaaauggu

SEQ ID NO: 80080 - RNA, 22 nt, Homo sapiens
uucuucaguuacaacaaggggg

SEQ ID NO: 80081 - RNA, 22 nt, Homo sapiens
uucuuugcuuggaagcggggga

SEQ ID NO: 80082 - RNA, 22 nt, Homo sapiens
uugagaucaugcuacugcacuc

SEQ ID NO: 80083 - RNA, 22 nt, Homo sapiens
uugagauggagucucacuccuu

SEQ ID NO: 80084 - RNA, 22 nt, Homo sapiens
uugagauggagucucgcucugu

SEQ ID NO: 80085 - RNA, 22 nt, Homo sapiens
uugagauggagucucguucugu

SEQ ID NO: 80086 - RNA, 22 nt, Homo sapiens
uugagauggaguuucgcucuuu

SEQ ID NO: 80087 - RNA, 22 nt, Homo sapiens
uugagauguaguuucacuccug

SEQ ID NO: 80088 - RNA, 22 nt, Homo sapiens
uugaucaaaucugagugagaau

SEQ ID NO: 80089 - RNA, 21 nt, Homo sapiens
uugcaaaugcugcugccugau

SEQ ID NO: 80090 - RNA, 22 nt, Homo sapiens
uugcacagugcuuucuuugccc

SEQ ID NO: 80091 - RNA, 22 nt, Homo sapiens
uugcacagugguuuagagccug

SEQ ID NO: 80092 - RNA, 18 nt, Homo sapiens
uugcacuccugccugggu

SEQ ID NO: 80093 - RNA, 22 nt, Homo sapiens
uugcuauguugcccagucugga

SEQ ID NO: 80094 - RNA, 20 nt, Homo sapiens
uugcugguguuagaggaggc

SEQ ID NO: 80095 - RNA, 22 nt, Homo sapiens
uuggauuguuucuagauugggg

SEQ ID NO: 80096 - RNA, 21 nt, Homo sapiens
uuggggaauggagagguuuuc

SEQ ID NO: 80097 - RNA, 22 nt, Homo sapiens
uuggggcacggccucuguugcc

SEQ ID NO: 80098 - RNA, 22 nt, Homo sapiens
uugugagggagcuaagaugagu

SEQ ID NO: 80099 - RNA, 22 nt, Homo sapiens
uugugcuuguaacuacauucag

SEQ ID NO: 80100 - RNA, 22 nt, Homo sapiens
uuuauggagagauauuuauggu

SEQ ID NO: 80101 - RNA, 18 nt, Homo sapiens
uuucaggguggacaugag

SEQ ID NO: 80102 - RNA, 22 nt, Homo sapiens
uuugacuuuuagaauaugaguu

SEQ ID NO: 80103 - RNA, 22 nt, Homo sapiens
uuugcacauauuugggcaaaag

SEQ ID NO: 80104 - RNA, 22 nt, Homo sapiens
uuuggcauuuaaauaugcaugg

SEQ ID NO: 80105 - RNA, 22 nt, Homo sapiens
uuugugcuccuaugagaaucua

SEQ ID NO: 80106 - RNA, 20 nt, Homo sapiens
uuuuggacuaaaggcauccc

SEQ ID NO: 80107 - RNA, 22 nt, Homo sapiens
uuuuggacuucaauuugacacu

SEQ ID NO: 80108 - RNA, 22 nt, Homo sapiens
uuuuggacuugcuccccugucc

SEQ ID NO: 80109 - RNA, 22 nt, Homo sapiens
uuuuggcucuugguaggucaga

SEQ ID NO: 80110 - RNA, 20 nt, Homo sapiens
uuuuggcuuaaagcagucug

SEQ ID NO: 80111 - RNA, 23 nt, Homo sapiens
aaagacuagucaggugcaguggu

SEQ ID NO: 80112 - RNA, 22 nt, Homo sapiens
aaaugcuucuauguggcauguu

SEQ ID NO: 80113 - RNA, 22 nt, Homo sapiens
aaaugguguuaguagaucuuua

SEQ ID NO: 80114 - RNA, 22 nt, Homo sapiens
aacagacugucacauaaaauug

SEQ ID NO: 80115 - RNA, 20 nt, Homo sapiens
aacagcacugucugaagcuu

SEQ ID NO: 80116 - RNA, 19 nt, Homo sapiens
aacuggugugagaugauau

SEQ ID NO: 80117 - RNA, 22 nt, Homo sapiens
aagcgguguugaauuuuguuga

SEQ ID NO: 80118 - RNA, 22 nt, Homo sapiens
aagcugugucuugucagcuacc

SEQ ID NO: 80119 - RNA, 22 nt, Homo sapiens
aaggcagugugcacauaacacu

SEQ ID NO: 80120 - RNA, 22 nt, Homo sapiens
aaguaaacauuuuguacaauaa

SEQ ID NO: 80121 - RNA, 23 nt, Homo sapiens
aagucauggaaucaaaugaggug

SEQ ID NO: 80122 - RNA, 19 nt, Homo sapiens
aagugaaugcuuuguucac

SEQ ID NO: 80123 - RNA, 22 nt, Homo sapiens
aagugcuucuuuccucgagaag

SEQ ID NO: 80124 - RNA, 21 nt, Homo sapiens
aauacucuagguuaagagagc

SEQ ID NO: 80125 - RNA, 21 nt, Homo sapiens
aaucacaguuguucugccuuc

SEQ ID NO: 80126 - RNA, 22 nt, Homo sapiens
aaugugccuacagugggcuguu

SEQ ID NO: 80127 - RNA, 22 nt, Homo sapiens
acacagugucuguguauuuaaa

SEQ ID NO: 80128 - RNA, 22 nt, Homo sapiens
ccaaaguauuuucacugauauc

SEQ ID NO: 80129 - RNA, 21 nt, Homo sapiens
cucaaaguacugauauuacag

SEQ ID NO: 80130 - RNA, 22 nt, Homo sapiens
cucagauacuugggagguugag

SEQ ID NO: 80131 - RNA, 22 nt, Homo sapiens
cucccauugcaaacaacagaag

SEQ ID NO: 80132 - RNA, 22 nt, Homo sapiens
cucucugagccccagacaccuu

SEQ ID NO: 80133 - RNA, 22 nt, Homo sapiens
cucugguuuuucuuccauuaag

SEQ ID NO: 80134 - RNA, 20 nt, Homo sapiens
cuuaucaguggcaaguauaa

SEQ ID NO: 80135 - RNA, 22 nt, Homo sapiens
cuuguggugcuuuuacgugggc

SEQ ID NO: 80136 - RNA, 22 nt, Homo sapiens
cuuucugaggagaauagagaac

SEQ ID NO: 80137 - RNA, 23 nt, Homo sapiens
cuuuguccccacccaaaucucau

SEQ ID NO: 80138 - RNA, 22 nt, Homo sapiens
cuuuuacacugguggugggaau

SEQ ID NO: 80139 - RNA, 22 nt, Homo sapiens
gaaccagcagacuuugacaggu

SEQ ID NO: 80140 - RNA, 22 nt, Homo sapiens
gaagaucacacuguagaucuau

SEQ ID NO: 80141 - RNA, 22 nt, Homo sapiens
gaagcgaggugauuagcagaca

SEQ ID NO: 80142 - RNA, 22 nt, Homo sapiens
gaaucacagauuaugaguaucu

SEQ ID NO: 80143 - RNA, 20 nt, Homo sapiens
gacauagagacucucaaaaa

SEQ ID NO: 80144 - RNA, 22 nt, Homo sapiens
gagauuaauacacaucaaaugc

SEQ ID NO: 80145 - RNA, 22 nt, Homo sapiens
gagcaucauggggccaaagcgc

SEQ ID NO: 80146 - RNA, 22 nt, Homo sapiens
gagcuggacuucuuaccuuuuc

SEQ ID NO: 80147 - RNA, 22 nt, Homo sapiens
gagcuuggguuaaaguugccuu

SEQ ID NO: 80148 - RNA, 22 nt, Homo sapiens
gaggcauuauucccaucuuaca

SEQ ID NO: 80149 - RNA, 22 nt, Homo sapiens
gagguugggaugagggauacag

SEQ ID NO: 80150 - RNA, 22 nt, Homo sapiens
gaguauauuugcacuguuaugu

SEQ ID NO: 80151 - RNA, 22 nt, Homo sapiens
gagugcaauggcaagaucuugg

SEQ ID NO: 80152 - RNA, 22 nt, Homo sapiens
gauaagagaugauuuugccaug

SEQ ID NO: 80153 - RNA, 22 nt, Homo sapiens
gcacugggccacauuuauuuuc

SEQ ID NO: 80154 - RNA, 22 nt, Homo sapiens
gccaagaugcugcccacagaca

SEQ ID NO: 80155 - RNA, 22 nt, Homo sapiens
gccaagauugguuuaauauucc

SEQ ID NO: 80156 - RNA, 19 nt, Homo sapiens
gcuuuguggggaaggagcc

SEQ ID NO: 80157 - RNA, 21 nt, Homo sapiens
ggauucaucccucaugaauuu

SEQ ID NO: 80158 - RNA, 22 nt, Homo sapiens
ggcuuggaggaaugugagggcu

SEQ ID NO: 80159 - RNA, 22 nt, Homo sapiens
gggcuagaauccgcgucucuug

SEQ ID NO: 80160 - RNA, 22 nt, Homo sapiens
guaugguuuauagggaaauugu

SEQ ID NO: 80161 - RNA, 22 nt, Homo sapiens
gucccagagauauugugucuuu

SEQ ID NO: 80162 - RNA, 22 nt, Homo sapiens
gucucugagaugucaacaccua

SEQ ID NO: 80163 - RNA, 22 nt, Homo sapiens
gucugcaugucauaugauagua

SEQ ID NO: 80164 - RNA, 22 nt, Homo sapiens
gugagaccaauguacuaccuuc

SEQ ID NO: 80165 - RNA, 19 nt, Homo sapiens
gugguauuaccuuuugauu

SEQ ID NO: 80166 - RNA, 22 nt, Homo sapiens
gugguuuuuuucugccuuauag

SEQ ID NO: 80167 - RNA, 22 nt, Homo sapiens
guucacacuugcaaccccagca

SEQ ID NO: 80168 - RNA, 22 nt, Homo sapiens
uaaagugcugagaugaggcugg

SEQ ID NO: 80169 - RNA, 22 nt, Homo sapiens
uaagacugccccagacagcaag

SEQ ID NO: 80170 - RNA, 22 nt, Homo sapiens
uaaggcaaguuuuuaguggaca

SEQ ID NO: 80171 - RNA, 22 nt, Homo sapiens
uaauacauucaaggugguaguu

SEQ ID NO: 80172 - RNA, 18 nt, Homo sapiens
uagaauauaggucauucu

SEQ ID NO: 80173 - RNA, 22 nt, Homo sapiens
uagauuaucauucauacaggga

SEQ ID NO: 80174 - RNA, 22 nt, Homo sapiens
uagcaucagauuccauauucua

SEQ ID NO: 80175 - RNA, 21 nt, Homo sapiens
uagcuacacugugauucaugg

SEQ ID NO: 80176 - RNA, 22 nt, Homo sapiens
uaucacagcauugucuauaaua

SEQ ID NO: 80177 - RNA, 22 nt, Homo sapiens
uaucagcagagucauacuucaa

SEQ ID NO: 80178 - RNA, 22 nt, Homo sapiens
uaugaaccuguuaucuagguuu

SEQ ID NO: 80179 - RNA, 22 nt, Homo sapiens
uauggcauuauuuugauagaca

SEQ ID NO: 80180 - RNA, 22 nt, Homo sapiens
uaugggcuuuguuuuguacuag

SEQ ID NO: 80181 - RNA, 18 nt, Homo sapiens
uauugcuugguuuggaga

SEQ ID NO: 80182 - RNA, 22 nt, Homo sapiens
ucaaacauccccaccagggacu

SEQ ID NO: 80183 - RNA, 20 nt, Homo sapiens
ucaaagacauggcugucaga

SEQ ID NO: 80184 - RNA, 22 nt, Homo sapiens
ucaccaguaauaaagagccugc

SEQ ID NO: 80185 - RNA, 22 nt, Homo sapiens
ucacccacacaggagacaggga

SEQ ID NO: 80186 - RNA, 22 nt, Homo sapiens
ucacuagggagaaacugaggcu

SEQ ID NO: 80187 - RNA, 20 nt, Homo sapiens
ucauacuguggaguaccagg

SEQ ID NO: 80188 - RNA, 22 nt, Homo sapiens
uccacaauggcugaacuagauu

SEQ ID NO: 80189 - RNA, 22 nt, Homo sapiens
uccauugucuagauguaacaca

SEQ ID NO: 80190 - RNA, 22 nt, Homo sapiens
uccauuuguagguagugagaca

SEQ ID NO: 80191 - RNA, 22 nt, Homo sapiens
uccuuggucaaaaagaaagugu

SEQ ID NO: 80192 - RNA, 22 nt, Homo sapiens
ucugugcuugucauaugcuuug

SEQ ID NO: 80193 - RNA, 22 nt, Homo sapiens
ucuuggguggauucauucuuuc

SEQ ID NO: 80194 - RNA, 22 nt, Homo sapiens
ucuuugauuaugcagauggguu

SEQ ID NO: 80195 - RNA, 22 nt, Homo sapiens
ugaauagugucacaauaaacau

SEQ ID NO: 80196 - RNA, 21 nt, Homo sapiens
ugaauauuuggguugugucca

SEQ ID NO: 80197 - RNA, 20 nt, Homo sapiens
ugagauccacgugaaguaug

SEQ ID NO: 80198 - RNA, 22 nt, Homo sapiens
ugagcauuguuuggacuuggau

SEQ ID NO: 80199 - RNA, 22 nt, Homo sapiens
ugaguuaguguggugcuuggaa

SEQ ID NO: 80200 - RNA, 23 nt, Homo sapiens
ugauaacagcauaugaagauucu

SEQ ID NO: 80201 - RNA, 22 nt, Homo sapiens
ugauaacauugggggaagcuga

SEQ ID NO: 80202 - RNA, 22 nt, Homo sapiens
ugcaagaugauuucaauugaua

SEQ ID NO: 80203 - RNA, 22 nt, Homo sapiens
uggaaucuagagaaaugcaaac

SEQ ID NO: 80204 - RNA, 22 nt, Homo sapiens
uggacagaaacauguuuucagu

SEQ ID NO: 80205 - RNA, 22 nt, Homo sapiens
uggcaacaucuggggacauguu

SEQ ID NO: 80206 - RNA, 21 nt, Homo sapiens
uggcaacauggauggauucug

SEQ ID NO: 80207 - RNA, 19 nt, Homo sapiens
uggcaaugucagcagagau

SEQ ID NO: 80208 - RNA, 22 nt, Homo sapiens
uggcggagacauggacuucaga

SEQ ID NO: 80209 - RNA, 22 nt, Homo sapiens
ugggcggagacgugcagccgcc

SEQ ID NO: 80210 - RNA, 22 nt, Homo sapiens
uggucaaaugccaaucuguagu

SEQ ID NO: 80211 - RNA, 22 nt, Homo sapiens
ugugcacuggaccuugucuucu

SEQ ID NO: 80212 - RNA, 22 nt, Homo sapiens
ugugccacuguucuguaaagug

SEQ ID NO: 80213 - RNA, 22 nt, Homo sapiens
uguguacaucucuacacacaug

SEQ ID NO: 80214 - RNA, 22 nt, Homo sapiens
uuaagagugggaguuggccaca

SEQ ID NO: 80215 - RNA, 22 nt, Homo sapiens
uuacaacugucuuacugguuau

SEQ ID NO: 80216 - RNA, 17 nt, Homo sapiens
uuaugagacuucuuagc

SEQ ID NO: 80217 - RNA, 22 nt, Homo sapiens
uuauuugguugcugacuuggaa

SEQ ID NO: 80218 - RNA, 22 nt, Homo sapiens
uucaauaugucauuggcaggca

SEQ ID NO: 80219 - RNA, 22 nt, Homo sapiens
uucaccaguuuugucacgaaug

SEQ ID NO: 80220 - RNA, 22 nt, Homo sapiens
uucaguagucuccauagaaccg

SEQ ID NO: 80221 - RNA, 18 nt, Homo sapiens
uucauauguugaaccaga

SEQ ID NO: 80222 - RNA, 22 nt, Homo sapiens
uuccaagugggaaacaaaaaug

SEQ ID NO: 80223 - RNA, 22 nt, Homo sapiens
uuccaauguuccguguugcagu

SEQ ID NO: 80224 - RNA, 22 nt, Homo sapiens
uucccagagaaaaggguuucuu

SEQ ID NO: 80225 - RNA, 22 nt, Homo sapiens
uucccuagaacacauggaggga

SEQ ID NO: 80226 - RNA, 22 nt, Homo sapiens
uucugugcugaaucaaagacug

SEQ ID NO: 80227 - RNA, 22 nt, Homo sapiens
uugaauagaaguguugaaagug

SEQ ID NO: 80228 - RNA, 22 nt, Homo sapiens
auguuaagauggaacaugggaa

SEQ ID NO: 80229 - RNA, 22 nt, Homo sapiens
auuggguuaaaggauaugaaca

SEQ ID NO: 80230 - RNA, 22 nt, Homo sapiens
auuguaauuuuagagaaagugg

SEQ ID NO: 80231 - RNA, 22 nt, Homo sapiens
auugugucuuguagagagauau

SEQ ID NO: 80232 - RNA, 22 nt, Homo sapiens
auuugacacugagagccucagu

SEQ ID NO: 80233 - RNA, 22 nt, Homo sapiens
caccacauuccauugaucaggc

SEQ ID NO: 80234 - RNA, 22 nt, Homo sapiens
caugauauugcagaauguuggu

SEQ ID NO: 80235 - RNA, 22 nt, Homo sapiens
aagucauggaggaguaugugag

SEQ ID NO: 80236 - RNA, 22 nt, Homo sapiens
aauaucacaguggguguacacc

SEQ ID NO: 80237 - RNA, 23 nt, Homo sapiens
aauaucacaguggguguacaccc

SEQ ID NO: 80238 - RNA, 22 nt, Homo sapiens
aauaugguuuuaugaagcaauu

SEQ ID NO: 80239 - RNA, 22 nt, Homo sapiens
aaucacuaugccaugaaguaca

SEQ ID NO: 80240 - RNA, 22 nt, Homo sapiens
aaucagcacacugugcuuucca

SEQ ID NO: 80241 - RNA, 22 nt, Homo sapiens
aaugguguuuccguuaagcuga

SEQ ID NO: 80242 - RNA, 22 nt, Homo sapiens
aauuaggcuagaauguuauuaa

SEQ ID NO: 80243 - RNA, 19 nt, Homo sapiens
acagauagaauguucuaca

SEQ ID NO: 80244 - RNA, 22 nt, Homo sapiens
acagucauagcagccuuuguua

SEQ ID NO: 80245 - RNA, 22 nt, Homo sapiens
acaucacuguuugauugauuga

SEQ ID NO: 80246 - RNA, 22 nt, Homo sapiens
accuggguguauguucaguuug

SEQ ID NO: 80247 - RNA, 21 nt, Homo sapiens
acugagagaucuggggcacau

SEQ ID NO: 80248 - RNA, 22 nt, Homo sapiens
acuuuguguuacccagcaagga

SEQ ID NO: 80249 - RNA, 20 nt, Homo sapiens
agagugcugucuguccugag

SEQ ID NO: 80250 - RNA, 22 nt, Homo sapiens
agauaugucugcuauuugcugu

SEQ ID NO: 80251 - RNA, 22 nt, Homo sapiens
agauauguuuaguuucaaaaug

SEQ ID NO: 80252 - RNA, 22 nt, Homo sapiens
agaugguguuggcugaguguau

SEQ ID NO: 80253 - RNA, 22 nt, Homo sapiens
agcuccuuucugcaggcagguc

SEQ ID NO: 80254 - RNA, 21 nt, Homo sapiens
agcuuguguguaucacagugu

SEQ ID NO: 80255 - RNA, 22 nt, Homo sapiens
aggaaugucaaugguaguuuaa

SEQ ID NO: 80256 - RNA, 23 nt, Homo sapiens
aggagcuuagaaguugccauugc

SEQ ID NO: 80257 - RNA, 22 nt, Homo sapiens
aggagcuuuggggaaaacagau

SEQ ID NO: 80258 - RNA, 22 nt, Homo sapiens
aggauaguaaugauagagaggc

SEQ ID NO: 80259 - RNA, 22 nt, Homo sapiens
agguuguugcaugcuccuuagg

SEQ ID NO: 80260 - RNA, 22 nt, Homo sapiens
agucaguggaguaaauguaauu

SEQ ID NO: 80261 - RNA, 22 nt, Homo sapiens
agugguuugaucacagcucacu

SEQ ID NO: 80262 - RNA, 22 nt, Homo sapiens
aguuggugauugauugggucug

SEQ ID NO: 80263 - RNA, 22 nt, Homo sapiens
auaaagcuauuccucucuuuuu

SEQ ID NO: 80264 - RNA, 22 nt, Homo sapiens
auaagagugggguguuagggau

SEQ ID NO: 80265 - RNA, 22 nt, Homo sapiens
auaagucaauggaacagauuaa

SEQ ID NO: 80266 - RNA, 22 nt, Homo sapiens
auaauguuuauccagaggaguu

SEQ ID NO: 80267 - RNA, 22 nt, Homo sapiens
auacagcuaaaauauuaaguua

SEQ ID NO: 80268 - RNA, 22 nt, Homo sapiens
aucauugugcaucuucauucca

SEQ ID NO: 80269 - RNA, 22 nt, Homo sapiens
uaggcaaaugcaagaguagaac

SEQ ID NO: 80270 - RNA, 22 nt, Homo sapiens
uauacuguuuucuauaguggcu

SEQ ID NO: 80271 - RNA, 21 nt, Homo sapiens
uaucacaguagaauaggaucu

SEQ ID NO: 80272 - RNA, 22 nt, Homo sapiens
uaugggauuucauuaagugucu

SEQ ID NO: 80273 - RNA, 22 nt, Homo sapiens
uauugauuuucaguguucagcu

SEQ ID NO: 80274 - RNA, 22 nt, Homo sapiens
uauuucaguugcguuucccgag

SEQ ID NO: 80275 - RNA, 22 nt, Homo sapiens
ucaacauugcugucaggcaucu

SEQ ID NO: 80276 - RNA, 21 nt, Homo sapiens
ucacaaugaacagcagcagaa

SEQ ID NO: 80277 - RNA, 22 nt, Homo sapiens
ucacagacugagccaaauagag

SEQ ID NO: 80278 - RNA, 23 nt, Homo sapiens
ucacaguuacuuuugcaucaacc

SEQ ID NO: 80279 - RNA, 22 nt, Homo sapiens
ucacaugaauugucuuguucca

SEQ ID NO: 80280 - RNA, 22 nt, Homo sapiens
ucaguagcaugaaaacagacua

SEQ ID NO: 80281 - RNA, 22 nt, Homo sapiens
uccuuggucauggaagagacag

SEQ ID NO: 80282 - RNA, 22 nt, Homo sapiens
ucuauggaguuugaaugagaaa

SEQ ID NO: 80283 - RNA, 22 nt, Homo sapiens
ucucaugaagauagagaauaga

SEQ ID NO: 80284 - RNA, 22 nt, Homo sapiens
ucucugguuuguggaaucuuag

SEQ ID NO: 80285 - RNA, 21 nt, Homo sapiens
ucuuggguugaauucucccag

SEQ ID NO: 80286 - RNA, 22 nt, Homo sapiens
ucuuggguuguuggcuucuccu

SEQ ID NO: 80287 - RNA, 22 nt, Homo sapiens
ucuuuguguaggucaaucuggc

SEQ ID NO: 80288 - RNA, 22 nt, Homo sapiens
ugaacagcuaucuugucagugu

SEQ ID NO: 80289 - RNA, 22 nt, Homo sapiens
ugaauauguuaaauaauguucu

SEQ ID NO: 80290 - RNA, 22 nt, Homo sapiens
ugaaugcaucuagaaauuuauu

SEQ ID NO: 80291 - RNA, 21 nt, Homo sapiens
ugacagaaaauugaguuugcu

SEQ ID NO: 80292 - RNA, 22 nt, Homo sapiens
ugacagcugaggcccagaguac

SEQ ID NO: 80293 - RNA, 21 nt, Homo sapiens
ugagauaauauguuucugaug

SEQ ID NO: 80294 - RNA, 22 nt, Homo sapiens
ugagauaaucaugugguuuuug

SEQ ID NO: 80295 - RNA, 23 nt, Homo sapiens
ugagccaugggacuccaagggag

SEQ ID NO: 80296 - RNA, 22 nt, Homo sapiens
ugagucauuuccuuaugcuacu

SEQ ID NO: 80297 - RNA, 21 nt, Homo sapiens
ugagugcugagugaggguuga

SEQ ID NO: 80298 - RNA, 22 nt, Homo sapiens
ugauaauguuaggcuuuauuca

SEQ ID NO: 80299 - RNA, 22 nt, Homo sapiens
ugcuguguugcuggcuuaaaga

SEQ ID NO: 80300 - RNA, 22 nt, Homo sapiens
uggaaaacaugcacauuggauu

SEQ ID NO: 80301 - RNA, 22 nt, Homo sapiens
uggaagauggaguuuuaucauu

SEQ ID NO: 80302 - RNA, 22 nt, Homo sapiens
uggaauuaauccuccugguuuc

SEQ ID NO: 80303 - RNA, 22 nt, Homo sapiens
uggauaguaauaaacauauagg

SEQ ID NO: 80304 - RNA, 22 nt, Homo sapiens
uggcuguuguuacuaacaguuc

SEQ ID NO: 80305 - RNA, 22 nt, Homo sapiens
ugggaagaugcugcuucuuccu

SEQ ID NO: 80306 - RNA, 20 nt, Homo sapiens
uggugguuuuaugugguuua

SEQ ID NO: 80307 - RNA, 20 nt, Homo sapiens
ugguguuugaacagugaaug

SEQ ID NO: 80308 - RNA, 23 nt, Homo sapiens
ugguuuguaagagauggacugga

SEQ ID NO: 80309 - RNA, 22 nt, Homo sapiens
ugucaauauguaauaacugaau

SEQ ID NO: 80310 - RNA, 22 nt, Homo sapiens
ugucucaguuucuguggguuag

SEQ ID NO: 80311 - RNA, 22 nt, Homo sapiens
uguugcacugguaauguacuga

SEQ ID NO: 80312 - RNA, 22 nt, Homo sapiens
uguuuguuugugauacgguaca

SEQ ID NO: 80313 - RNA, 22 nt, Homo sapiens
uuaaagcuggcguuacaguuug

SEQ ID NO: 80314 - RNA, 22 nt, Homo sapiens
uuaaggcauucuuugucuucau

SEQ ID NO: 80315 - RNA, 22 nt, Homo sapiens
uuacagauggcacacucaaggg

SEQ ID NO: 80316 - RNA, 22 nt, Homo sapiens
uucaauuaauauuauacucuca

SEQ ID NO: 80317 - RNA, 22 nt, Homo sapiens
uucagugagacgaaaacaacaa

SEQ ID NO: 80318 - RNA, 22 nt, Homo sapiens
uucccagagagggacuucuaau

SEQ ID NO: 80319 - RNA, 22 nt, Homo sapiens
uucccagagccugggagugagg

SEQ ID NO: 80320 - RNA, 22 nt, Homo sapiens
uugagauacauaauuaugaaug

SEQ ID NO: 80321 - RNA, 22 nt, Homo sapiens
uugagugaaugaaugauuaaau

SEQ ID NO: 80322 - RNA, 20 nt, Homo sapiens
uugauucccucuaaacucgc

SEQ ID NO: 80323 - RNA, 22 nt, Homo sapiens
uuggauggugauaugguuugga

SEQ ID NO: 80324 - RNA, 22 nt, Homo sapiens
uuggggcacggccucuguugcc

SEQ ID NO: 80325 - RNA, 22 nt, Homo sapiens
uugugccccuucucagucgggc

SEQ ID NO: 80326 - RNA, 20 nt, Homo sapiens
auaaauguauagguguacau

SEQ ID NO: 80327 - RNA, 22 nt, Homo sapiens
auaagaguaguacauaugagac

SEQ ID NO: 80328 - RNA, 22 nt, Homo sapiens
auacagacacagucagaggggu

SEQ ID NO: 80329 - RNA, 22 nt, Homo sapiens
auagacugaguggcuuaaacca

SEQ ID NO: 80330 - RNA, 19 nt, Homo sapiens
auauaacauccaggagcag

SEQ ID NO: 80331 - RNA, 22 nt, Homo sapiens
auaugcauguacccacacaggc

SEQ ID NO: 80332 - RNA, 22 nt, Homo sapiens
aucacagcccuccucuuggaug

SEQ ID NO: 80333 - RNA, 22 nt, Homo sapiens
aucgugucuggcccugaaugcu

SEQ ID NO: 80334 - RNA, 22 nt, Homo sapiens
aucuuugcugagaugcauggca

SEQ ID NO: 80335 - RNA, 22 nt, Homo sapiens
augacagcaucugugaaguugu

SEQ ID NO: 80336 - RNA, 22 nt, Homo sapiens
augacuggauaauggacacaca

SEQ ID NO: 80337 - RNA, 22 nt, Homo sapiens
augaguugaagcuacaagaggc

SEQ ID NO: 80338 - RNA, 22 nt, Homo sapiens
augauaucuuguuuuucaugca

SEQ ID NO: 80339 - RNA, 22 nt, Homo sapiens
augguuuuacugcaaaauggga

SEQ ID NO: 80340 - RNA, 21 nt, Homo sapiens
auguaacugggaaugugagag

SEQ ID NO: 80341 - RNA, 22 nt, Homo sapiens
auugaggcaggaggaccaucua

SEQ ID NO: 80342 - RNA, 22 nt, Homo sapiens
auuugucacuuaacagccauua

SEQ ID NO: 80343 - RNA, 22 nt, Homo sapiens
cacagugaacaauauccucugu

SEQ ID NO: 80344 - RNA, 22 nt, Homo sapiens
cagauacuccuggucucaggag

SEQ ID NO: 80345 - RNA, 22 nt, Homo sapiens
cagcugaugucgaaugcacucu

SEQ ID NO: 80346 - RNA, 22 nt, Homo sapiens
cagcuguuguuaugucugcagg

SEQ ID NO: 80347 - RNA, 22 nt, Homo sapiens
caucacaguacuaaucgucaua

SEQ ID NO: 80348 - RNA, 22 nt, Homo sapiens
caucagcaauguaugaggguuc

SEQ ID NO: 80349 - RNA, 22 nt, Homo sapiens
ccuaggcacugggguccagccc

SEQ ID NO: 80350 - RNA, 22 nt, Homo sapiens
cuaaggcaguagccugaauaau

SEQ ID NO: 80351 - RNA, 22 nt, Homo sapiens
cugagauaggacucugcuggcu

SEQ ID NO: 80352 - RNA, 22 nt, Homo sapiens
cugagguuaggaguuugagacc

SEQ ID NO: 80353 - RNA, 22 nt, Homo sapiens
cugagugcaagugauccuccca

SEQ ID NO: 80354 - RNA, 22 nt, Homo sapiens
cugcauuggguuaugcauuuuu

SEQ ID NO: 80355 - RNA, 22 nt, Homo sapiens
cuggagcauugguggauuuguu

SEQ ID NO: 80356 - RNA, 22 nt, Homo sapiens
cugugguugagcuuugccauga

SEQ ID NO: 80357 - RNA, 22 nt, Homo sapiens
cugugguuuaaggaauuuugac

SEQ ID NO: 80358 - RNA, 22 nt, Homo sapiens
cuuaggguacuuuggugcauca

SEQ ID NO: 80359 - RNA, 22 nt, Homo sapiens
cuuggguugauugauaaugcca

SEQ ID NO: 80360 - RNA, 22 nt, Homo sapiens
cuuugguuuacuuggugcuagu

SEQ ID NO: 80361 - RNA, 22 nt, Homo sapiens
cuuuguaugucaugacaacugu

SEQ ID NO: 80362 - RNA, 22 nt, Homo sapiens
cuuuuacacuguuggcaggauu

SEQ ID NO: 80363 - RNA, 22 nt, Homo sapiens
gaauucugucgcuuacuagaug

SEQ ID NO: 80364 - RNA, 22 nt, Homo sapiens
gacagacacaauugauccauga

SEQ ID NO: 80365 - RNA, 22 nt, Homo sapiens
gagacauguuugccaauaauuu

SEQ ID NO: 80366 - RNA, 22 nt, Homo sapiens
gagaugaugagauguucacagu

SEQ ID NO: 80367 - RNA, 22 nt, Homo sapiens
gagcuccuccccuuggcuuuca

SEQ ID NO: 80368 - RNA, 22 nt, Homo sapiens
gaugagaugagcauuugaauug

SEQ ID NO: 80369 - RNA, 22 nt, Homo sapiens
gauuagagaaauacugcugcua

SEQ ID NO: 80370 - RNA, 20 nt, Homo sapiens
gauuagagagaggcugugca

SEQ ID NO: 80371 - RNA, 22 nt, Homo sapiens
gcaaaaaguagugcugguuagg

SEQ ID NO: 80372 - RNA, 21 nt, Homo sapiens
gcaaacauccuuugaugccag

SEQ ID NO: 80373 - RNA, 20 nt, Homo sapiens
gcaaaguuuagcucccacua

SEQ ID NO: 80374 - RNA, 22 nt, Homo sapiens
gccaagauuuaauucaucaguu

SEQ ID NO: 80375 - RNA, 22 nt, Homo sapiens
gccuagggacaaaccguccgac

SEQ ID NO: 80376 - RNA, 22 nt, Homo sapiens
ggcagcauugccuuugcaguga

SEQ ID NO: 80377 - RNA, 22 nt, Homo sapiens
gggaaugaagagaaccuuccca

SEQ ID NO: 80378 - RNA, 22 nt, Homo sapiens
gggauuguaauacugaguuggu

SEQ ID NO: 80379 - RNA, 22 nt, Homo sapiens
gggcaacauugaguacccugaa

SEQ ID NO: 80380 - RNA, 19 nt, Homo sapiens
gucaaagucgguauucaaa

SEQ ID NO: 80381 - RNA, 22 nt, Homo sapiens
gugguagaaauguagaugcuag

SEQ ID NO: 80382 - RNA, 22 nt, Homo sapiens
gugguuuuacaaagagaaagau

SEQ ID NO: 80383 - RNA, 22 nt, Homo sapiens
gugguuuucaacuccaccugca

SEQ ID NO: 80384 - RNA, 22 nt, Homo sapiens
gugguuuuuaaaguaccugugg

SEQ ID NO: 80385 - RNA, 22 nt, Homo sapiens
guuggucucguauaaaucaagg

SEQ ID NO: 80386 - RNA, 22 nt, Homo sapiens
guuugcagaucaugaagaaccc

SEQ ID NO: 80387 - RNA, 22 nt, Homo sapiens
uaacaagagagucagucagucc

SEQ ID NO: 80388 - RNA, 22 nt, Homo sapiens
uaaggcaaaccuuggcugcagu

SEQ ID NO: 80389 - RNA, 22 nt, Homo sapiens
uaagugguguucauucuuuuga

SEQ ID NO: 80390 - RNA, 22 nt, Homo sapiens
uaaucacagagguuuggccuca

SEQ ID NO: 80391 - RNA, 22 nt, Homo sapiens
uaauucugacaacaguggcguu

SEQ ID NO: 80392 - RNA, 22 nt, Homo sapiens
uacaaguaauaagggaagaauu

SEQ ID NO: 80393 - RNA, 22 nt, Homo sapiens
uacaaguggguuugugcaggag

SEQ ID NO: 80394 - RNA, 21 nt, Homo sapiens
uagauaguugguucugaaucu

SEQ ID NO: 80395 - RNA, 19 nt, Homo sapiens
uagaugucuuugcauagau

SEQ ID NO: 80396 - RNA, 22 nt, Homo sapiens
uagcacaugucagguaauuugc

SEQ ID NO: 80397 - RNA, 22 nt, Homo sapiens
uaucaaggccacucauuuuaug

SEQ ID NO: 80398 - RNA, 22 nt, Homo sapiens
uaucacaguugcauauuuaagg

SEQ ID NO: 80399 - RNA, 20 nt, Homo sapiens
uaucacauggggagaaaccu

SEQ ID NO: 80400 - RNA, 22 nt, Homo sapiens
uauggauucuagcucaguaggu

SEQ ID NO: 80401 - RNA, 22 nt, Homo sapiens
ucaaugaaugaugguugguaug

SEQ ID NO: 80402 - RNA, 22 nt, Homo sapiens
ucaguagcauugcuuauacagu

SEQ ID NO: 80403 - RNA, 22 nt, Homo sapiens
ucaugaaguaguuaacugguug

SEQ ID NO: 80404 - RNA, 22 nt, Homo sapiens
uccauagacauuuuaagguagu

SEQ ID NO: 80405 - RNA, 22 nt, Homo sapiens
uccuuuguuacaguuggcucug

SEQ ID NO: 80406 - RNA, 22 nt, Homo sapiens
ucucacaccccucucauauacc

SEQ ID NO: 80407 - RNA, 22 nt, Homo sapiens
ucugcaagucuaaacuagccau

SEQ ID NO: 80408 - RNA, 22 nt, Homo sapiens
ucuguggucagaguccuuggcc

SEQ ID NO: 80409 - RNA, 22 nt, Homo sapiens
ucuuuguguucaggagccacgu

SEQ ID NO: 80410 - RNA, 22 nt, Homo sapiens
ugaacacagccugccucugcca

SEQ ID NO: 80411 - RNA, 22 nt, Homo sapiens
ugaagacucaauuauuaugaac

SEQ ID NO: 80412 - RNA, 22 nt, Homo sapiens
ugagaccugaucuugguacugc

SEQ ID NO: 80413 - RNA, 22 nt, Homo sapiens
ugagaccuuucauuucucagug

SEQ ID NO: 80414 - RNA, 22 nt, Homo sapiens
ugagagacaguuuguuaaaauu

SEQ ID NO: 80415 - RNA, 22 nt, Homo sapiens
ugagaggugaauggcaggcuca

SEQ ID NO: 80416 - RNA, 22 nt, Homo sapiens
ugaggcaaggcugaaugaaggc

SEQ ID NO: 80417 - RNA, 22 nt, Homo sapiens
ugagucauguaauaaugcugcu

SEQ ID NO: 80418 - RNA, 22 nt, Homo sapiens
ugauaucugaucauccuugaua

SEQ ID NO: 80419 - RNA, 22 nt, Homo sapiens
ugcugcacuuauggcucugagg

SEQ ID NO: 80420 - RNA, 20 nt, Homo sapiens
uggaaaguaagucaugauau

SEQ ID NO: 80421 - RNA, 22 nt, Homo sapiens
uggaaguuaaauuaguugauga

SEQ ID NO: 80422 - RNA, 18 nt, Homo sapiens
uggagauaagaagaacuu

SEQ ID NO: 80423 - RNA, 22 nt, Homo sapiens
uggagugcaauggugagaucuu

SEQ ID NO: 80424 - RNA, 22 nt, Homo sapiens
ugguuguuuuaaaugucgucug

SEQ ID NO: 80425 - RNA, 22 nt, Homo sapiens
ugucagaaucugagacgacaac

SEQ ID NO: 80426 - RNA, 19 nt, Homo sapiens
ugugaacaucacagagugu

SEQ ID NO: 80427 - RNA, 22 nt, Homo sapiens
aaaccacagugugcugcugggg

SEQ ID NO: 80428 - RNA, 22 nt, Homo sapiens
aaagugcuuccuuuuugagggu

SEQ ID NO: 80429 - RNA, 22 nt, Homo sapiens
ugugguuuuauaaacgugaccu

SEQ ID NO: 80430 - RNA, 22 nt, Homo sapiens
uuaaggcagugcaucuggaguu

SEQ ID NO: 80431 - RNA, 22 nt, Homo sapiens
uuaaggcagugucuaugccagu

SEQ ID NO: 80432 - RNA, 22 nt, Homo sapiens
uuaauagugacucauuuuccac

SEQ ID NO: 80433 - RNA, 22 nt, Homo sapiens
uuagaacuagaggaguuugagu

SEQ ID NO: 80434 - RNA, 22 nt, Homo sapiens
uuaguaguagcugcaugucagu

SEQ ID NO: 80435 - RNA, 22 nt, Homo sapiens
uuauauguuucuuagggacaga

SEQ ID NO: 80436 - RNA, 22 nt, Homo sapiens
uuauuacuccuauuuuguagau

SEQ ID NO: 80437 - RNA, 22 nt, Homo sapiens
uuauucauuaacagggaccaaa

SEQ ID NO: 80438 - RNA, 22 nt, Homo sapiens
uucacuguaaaaugaagagggu

SEQ ID NO: 80439 - RNA, 22 nt, Homo sapiens
uucauaguucuuuuagucauua

SEQ ID NO: 80440 - RNA, 22 nt, Homo sapiens
uucccauuguuggccagcaugu

SEQ ID NO: 80441 - RNA, 22 nt, Homo sapiens
uucucauggugauggcaaaauc

SEQ ID NO: 80442 - RNA, 22 nt, Homo sapiens
uugagauaggaacucacuaugc

SEQ ID NO: 80443 - RNA, 22 nt, Homo sapiens
uugcaaaguugccaaggaagga

SEQ ID NO: 80444 - RNA, 22 nt, Homo sapiens
uuggaugauaaagaagccuaag

SEQ ID NO: 80445 - RNA, 22 nt, Homo sapiens
uugggaauguccuaauaucucg

SEQ ID NO: 80446 - RNA, 22 nt, Homo sapiens
uugucuugcagcuuaggcauca

SEQ ID NO: 80447 - RNA, 22 nt, Homo sapiens
uuugacuagaguguuuuacaac

SEQ ID NO: 80448 - RNA, 22 nt, Homo sapiens
uuuggguuuuauguaacagcua

SEQ ID NO: 80449 - RNA, 22 nt, Homo sapiens
uuuggucuuuuauuuaaagcag

SEQ ID NO: 80450 - RNA, 22 nt, Homo sapiens
uuugugagguggauagauugca

SEQ ID NO: 80451 - RNA, 22 nt, Homo sapiens
uuuguguccccacccaaaucuc

SEQ ID NO: 80452 - RNA, 22 nt, Homo sapiens
aacagucaauugcugaugaccu

SEQ ID NO: 80453 - RNA, 22 nt, Homo sapiens
aagagcauuggauggggagauu

SEQ ID NO: 80454 - RNA, 22 nt, Homo sapiens
aaggcaacgugaguuguugauu

SEQ ID NO: 80455 - RNA, 22 nt, Homo sapiens
aaggcuguuguguaauaggauu

SEQ ID NO: 80456 - RNA, 22 nt, Homo sapiens
aaguaaacauugagagacaaga

SEQ ID NO: 80457 - RNA, 22 nt, Homo sapiens
aaguagcagaggcaagacuuga

SEQ ID NO: 80458 - RNA, 22 nt, Homo sapiens
aaugauauguuauguuuagguu

SEQ ID NO: 80459 - RNA, 22 nt, Homo sapiens
aauguguuuugaaaucaggaag

SEQ ID NO: 80460 - RNA, 22 nt, Homo sapiens
aauuacauggcaauugggaaau

SEQ ID NO: 80461 - RNA, 22 nt, Homo sapiens
aauugaaugauaugggacauuu

SEQ ID NO: 80462 - RNA, 23 nt, Homo sapiens
aauugcuuuugaggacuuaguug

SEQ ID NO: 80463 - RNA, 22 nt, Homo sapiens
acaguagcgcaaucucggcuca

SEQ ID NO: 80464 - RNA, 22 nt, Homo sapiens
accagucucagguaugucuuua

SEQ ID NO: 80465 - RNA, 22 nt, Homo sapiens
acugagacugagaauguuucuu

SEQ ID NO: 80466 - RNA, 22 nt, Homo sapiens
agagugcuuuauuagauguagc

SEQ ID NO: 80467 - RNA, 22 nt, Homo sapiens
agauacaucuaugugucugugu

SEQ ID NO: 80468 - RNA, 22 nt, Homo sapiens
agaucauaugcaguaaugaacu

SEQ ID NO: 80469 - RNA, 22 nt, Homo sapiens
agcaacauuguucauaauagcu

SEQ ID NO: 80470 - RNA, 19 nt, Homo sapiens
agcuguguugccugugaga

SEQ ID NO: 80471 - RNA, 22 nt, Homo sapiens
agguucccuuuuggccugggau

SEQ ID NO: 80472 - RNA, 21 nt, Homo sapiens
agucauaggaguacauaaugc

SEQ ID NO: 80473 - RNA, 22 nt, Homo sapiens
agugguuuuggaauggaauuca

SEQ ID NO: 80474 - RNA, 18 nt, Homo sapiens
aguuguuuuauccugccc

SEQ ID NO: 80475 - RNA, 22 nt, Homo sapiens
auaacauggaguuugucauuua

SEQ ID NO: 80476 - RNA, 22 nt, Homo sapiens
auaaguagaaugauggucaaaa

SEQ ID NO: 80477 - RNA, 22 nt, Homo sapiens
auaauguuugauugagcagaua

SEQ ID NO: 80478 - RNA, 22 nt, Homo sapiens
ugagauaaucaugugauuucau

SEQ ID NO: 80479 - RNA, 22 nt, Homo sapiens
ugagauuaaucuuuaaguaaga

SEQ ID NO: 80480 - RNA, 22 nt, Homo sapiens
ugagauuauauuucuuaacaga

SEQ ID NO: 80481 - RNA, 22 nt, Homo sapiens
ugagcacauuuacaucaguucc

SEQ ID NO: 80482 - RNA, 20 nt, Homo sapiens
ugagcuuguaaacacuguuu

SEQ ID NO: 80483 - RNA, 22 nt, Homo sapiens
ugagugaggcugggcagucccu

SEQ ID NO: 80484 - RNA, 22 nt, Homo sapiens
ugaguuccuugugugaccuugc

SEQ ID NO: 80485 - RNA, 22 nt, Homo sapiens
ugauauauugaaugaugaaaca

SEQ ID NO: 80486 - RNA, 22 nt, Homo sapiens
ugauuuccaugagaacaugccu

SEQ ID NO: 80487 - RNA, 22 nt, Homo sapiens
ugccaugaagagaggaagcagu

SEQ ID NO: 80488 - RNA, 22 nt, Homo sapiens
uggaaguuaaaugacucuuucu

SEQ ID NO: 80489 - RNA, 20 nt, Homo sapiens
uggaaucugaagaucucagu

SEQ ID NO: 80490 - RNA, 22 nt, Homo sapiens
uggacagacaagguuauagauc

SEQ ID NO: 80491 - RNA, 18 nt, Homo sapiens
ugggaagaaauucuucuc

SEQ ID NO: 80492 - RNA, 22 nt, Homo sapiens
ugggaagaagguuuacuugcca

SEQ ID NO: 80493 - RNA, 20 nt, Homo sapiens
ugguccccugagucuggcuu

SEQ ID NO: 80494 - RNA, 22 nt, Homo sapiens
ugugacagcacgguucaacugc

SEQ ID NO: 80495 - RNA, 22 nt, Homo sapiens
ugugaugaagaguccaagaaca

SEQ ID NO: 80496 - RNA, 22 nt, Homo sapiens
ugugguuuuaguaaaacuaugu

SEQ ID NO: 80497 - RNA, 22 nt, Homo sapiens
ugugguuuuucacauuuagaga

SEQ ID NO: 80498 - RNA, 22 nt, Homo sapiens
ugugguuuuuuucuccaauagg

SEQ ID NO: 80499 - RNA, 22 nt, Homo sapiens
ugugucacugaggguuagugua

SEQ ID NO: 80500 - RNA, 22 nt, Homo sapiens
uguuuguuugagauggagucuc

SEQ ID NO: 80501 - RNA, 22 nt, Homo sapiens
uguuuguuugauaugggauaaa

SEQ ID NO: 80502 - RNA, 22 nt, Homo sapiens
aaagaguucagguagauuucaa

SEQ ID NO: 80503 - RNA, 22 nt, Homo sapiens
aaagugguuuuucagacuuuga

SEQ ID NO: 80504 - RNA, 18 nt, Homo sapiens
aaauucugucccuucuuc

SEQ ID NO: 80505 - RNA, 22 nt, Homo sapiens
aacagauugcugagccccaccc

SEQ ID NO: 80506 - RNA, 20 nt, Homo sapiens
aagacacuguccccacugga

SEQ ID NO: 80507 - RNA, 22 nt, Homo sapiens
aagcuguguguaagcucucaca

SEQ ID NO: 80508 - RNA, 22 nt, Homo sapiens
aaggcaugcaaagaacauuuua

SEQ ID NO: 80509 - RNA, 22 nt, Homo sapiens
aauaagcauaguaccugauagg

SEQ ID NO: 80510 - RNA, 22 nt, Homo sapiens
aauggcacaagacaugaagaag

SEQ ID NO: 80511 - RNA, 22 nt, Homo sapiens
aaugugccuacuggagcuugca

SEQ ID NO: 80512 - RNA, 20 nt, Homo sapiens
agaagcauugcucucuucag

SEQ ID NO: 80513 - RNA, 22 nt, Homo sapiens
agacagcuggaguaucauagcu

SEQ ID NO: 80514 - RNA, 22 nt, Homo sapiens
agagaccuguaaaguucaggca

SEQ ID NO: 80515 - RNA, 22 nt, Homo sapiens
agagugcuaaggaaguaauuua

SEQ ID NO: 80516 - RNA, 20 nt, Homo sapiens
agagugcuggacugaggagc

SEQ ID NO: 80517 - RNA, 22 nt, Homo sapiens
agaucaauugcugauucgcucu

SEQ ID NO: 80518 - RNA, 22 nt, Homo sapiens
agcuccuuucugcagguagguu

SEQ ID NO: 80519 - RNA, 22 nt, Homo sapiens
agcugguauuuugucgaggacu

SEQ ID NO: 80520 - RNA, 22 nt, Homo sapiens
agcuuguggugaauacugcuag

SEQ ID NO: 80521 - RNA, 22 nt, Homo sapiens
aggcaacaugguaaaacccugu

SEQ ID NO: 80522 - RNA, 21 nt, Homo sapiens
aggucaugaagauguucuaau

SEQ ID NO: 80523 - RNA, 22 nt, Homo sapiens
aguaacaggauccaaagaaugu

SEQ ID NO: 80524 - RNA, 22 nt, Homo sapiens
agugccauggcugcuagauggc

SEQ ID NO: 80525 - RNA, 22 nt, Homo sapiens
agugguuuuaaguagagcauac

SEQ ID NO: 80526 - RNA, 22 nt, Homo sapiens
auaaagacacuuggcaugauuu

SEQ ID NO: 80527 - RNA, 22 nt, Homo sapiens
auaaaugcaaugguauuuuuga

SEQ ID NO: 80528 - RNA, 22 nt, Homo sapiens
auaagauaguggaagugggauu

SEQ ID NO: 80529 - RNA, 22 nt, Homo sapiens
auaaggcagcugcuaaaaggca

SEQ ID NO: 80530 - RNA, 22 nt, Homo sapiens
auaauaucagguugugaugaug

SEQ ID NO: 80531 - RNA, 22 nt, Homo sapiens
auaaucacacccagguuaaaug

SEQ ID NO: 80532 - RNA, 22 nt, Homo sapiens
auacuccugucucagcugagau

SEQ ID NO: 80533 - RNA, 22 nt, Homo sapiens
auauagcaaugaaagagaugaa

SEQ ID NO: 80534 - RNA, 22 nt, Homo sapiens
auaugcauacauguaugcagga

SEQ ID NO: 80535 - RNA, 21 nt, Homo sapiens
auauggaacuggugacguguu

SEQ ID NO: 80536 - RNA, 22 nt, Homo sapiens
aucacagauauggguuuaaauc

SEQ ID NO: 80537 - RNA, 22 nt, Homo sapiens
aucacagcuacuccucugucuu

SEQ ID NO: 80538 - RNA, 22 nt, Homo sapiens
auccuuuagacuguccaguuga

SEQ ID NO: 80539 - RNA, 22 nt, Homo sapiens
augaagauguugccuuuuuaau

SEQ ID NO: 80540 - RNA, 22 nt, Homo sapiens
augacagagauaugugaauuuu

SEQ ID NO: 80541 - RNA, 22 nt, Homo sapiens
augagauaaaccaucucuuaag

SEQ ID NO: 80542 - RNA, 22 nt, Homo sapiens
augcaagacaccgauuagcuuu

SEQ ID NO: 80543 - RNA, 22 nt, Homo sapiens
auggauuuugaacuugagaguu

SEQ ID NO: 80544 - RNA, 19 nt, Homo sapiens
uuucacacucgccuacuuc

SEQ ID NO: 80545 - RNA, 22 nt, Homo sapiens
uuucccuuacuuaaacuuacuc

SEQ ID NO: 80546 - RNA, 22 nt, Homo sapiens
uuugaagacuacugggagugaa

SEQ ID NO: 80547 - RNA, 22 nt, Homo sapiens
uuugaaguguggcacugaguuu

SEQ ID NO: 80548 - RNA, 22 nt, Homo sapiens
uuuggucuuuuguaaguuaucu

SEQ ID NO: 80549 - RNA, 22 nt, Homo sapiens
uuuuagcagccaugacaaagau

SEQ ID NO: 80550 - RNA, 22 nt, Homo sapiens
acauacacuagggauguggugu

SEQ ID NO: 80551 - RNA, 22 nt, Homo sapiens
acaugagacuggguuuguaggg

SEQ ID NO: 80552 - RNA, 22 nt, Homo sapiens
accugggugcugaugggcuuua

SEQ ID NO: 80553 - RNA, 22 nt, Homo sapiens
acuguauagauggaguugauuu

SEQ ID NO: 80554 - RNA, 22 nt, Homo sapiens
agaagugcuggguucaggcugg

SEQ ID NO: 80555 - RNA, 22 nt, Homo sapiens
agacacuguugaaaaggcccca

SEQ ID NO: 80556 - RNA, 21 nt, Homo sapiens
agagucaucucuaucuguacc

SEQ ID NO: 80557 - RNA, 22 nt, Homo sapiens
agagugcuauagauuagauuuc

SEQ ID NO: 80558 - RNA, 22 nt, Homo sapiens
agauauuuguuaggucugucag

SEQ ID NO: 80559 - RNA, 22 nt, Homo sapiens
agcugguaguuuucuaguguuu

SEQ ID NO: 80560 - RNA, 22 nt, Homo sapiens
agcuuguguuuuucuaaguauc

SEQ ID NO: 80561 - RNA, 22 nt, Homo sapiens
aggcuuuuggagaacacugcac

SEQ ID NO: 80562 - RNA, 22 nt, Homo sapiens
agucauaggagagauaucacug

SEQ ID NO: 80563 - RNA, 20 nt, Homo sapiens
agugguuuucaaauaugucu

SEQ ID NO: 80564 - RNA, 19 nt, Homo sapiens
auaaacuagaacugucccc

SEQ ID NO: 80565 - RNA, 22 nt, Homo sapiens
aucccagaaacucggguuucuc

SEQ ID NO: 80566 - RNA, 22 nt, Homo sapiens
augaauacugcugcaaugaaca

SEQ ID NO: 80567 - RNA, 22 nt, Homo sapiens
augagauaggaacaaacuuaca

SEQ ID NO: 80568 - RNA, 22 nt, Homo sapiens
augagauauguuaaaaguuaaa

SEQ ID NO: 80569 - RNA, 22 nt, Homo sapiens
augagauuguuugugugaaaua

SEQ ID NO: 80570 - RNA, 22 nt, Homo sapiens
augcaagaaauaucucuuuuuc

SEQ ID NO: 80571 - RNA, 22 nt, Homo sapiens
augggauaguaucaguggaaua

SEQ ID NO: 80572 - RNA, 22 nt, Homo sapiens
auguauggcagguuugggguuu

SEQ ID NO: 80573 - RNA, 22 nt, Homo sapiens
auuaagagcacauguucugggu

SEQ ID NO: 80574 - RNA, 22 nt, Homo sapiens
cagcuaguaauuuauugaagau

SEQ ID NO: 80575 - RNA, 22 nt, Homo sapiens
caggcaacauggcgaaacucug

SEQ ID NO: 80576 - RNA, 22 nt, Homo sapiens
caguagcaugccucagaaugag

SEQ ID NO: 80577 - RNA, 22 nt, Homo sapiens
ccuggguuacaggugugagcca

SEQ ID NO: 80578 - RNA, 22 nt, Homo sapiens
ccuuuguggggcgguggguaau

SEQ ID NO: 80579 - RNA, 20 nt, Homo sapiens
cuugaagacuaugcugcuga

SEQ ID NO: 80580 - RNA, 22 nt, Homo sapiens
cuuuuacacugcuggugggaau

SEQ ID NO: 80581 - RNA, 22 nt, Homo sapiens
cuuuuacacuguuagugggaau

SEQ ID NO: 80582 - RNA, 22 nt, Homo sapiens
gacauuaucagguuuguuuucu

SEQ ID NO: 80583 - RNA, 21 nt, Homo sapiens
gaccacagcagggaaugucag

SEQ ID NO: 80584 - RNA, 22 nt, Homo sapiens
gacuggagcuguaugugguuac

SEQ ID NO: 80585 - RNA, 22 nt, Homo sapiens
gagaacauacggcauuugguuu

SEQ ID NO: 80586 - RNA, 22 nt, Homo sapiens
gauugguugaaaguagaauacu

SEQ ID NO: 80587 - RNA, 22 nt, Homo sapiens
gccaaaaugcugggauuacagg

SEQ ID NO: 80588 - RNA, 22 nt, Homo sapiens
ggaaugcuaaaauaggaugcug

SEQ ID NO: 80589 - RNA, 22 nt, Homo sapiens
ggacaguagugcuuucuaucau

SEQ ID NO: 80590 - RNA, 22 nt, Homo sapiens
ggcaguuuguuugugaggucca

SEQ ID NO: 80591 - RNA, 22 nt, Homo sapiens
gggaaauguaaagucauaagau

SEQ ID NO: 80592 - RNA, 22 nt, Homo sapiens
gucaggaugauuuggggaggug

SEQ ID NO: 80593 - RNA, 22 nt, Homo sapiens
gucauaugcucggaaaauguua

SEQ ID NO: 80594 - RNA, 22 nt, Homo sapiens
gugaaauguguagaggaucugg

SEQ ID NO: 80595 - RNA, 22 nt, Homo sapiens
gugggagugucccguuuuucca

SEQ ID NO: 80596 - RNA, 22 nt, Homo sapiens
guuccuuguagaugcuggauau

SEQ ID NO: 80597 - RNA, 22 nt, Homo sapiens
guugaguuugaccugaacucug

SEQ ID NO: 80598 - RNA, 17 nt, Homo sapiens
guugaguuugagucaag

SEQ ID NO: 80599 - RNA, 22 nt, Homo sapiens
guuggugaccugaagagaguaa

SEQ ID NO: 80600 - RNA, 22 nt, Homo sapiens
uaaacacucacuucauagccau

SEQ ID NO: 80601 - RNA, 22 nt, Homo sapiens
uaacaacauucuaacugacggc

SEQ ID NO: 80602 - RNA, 22 nt, Homo sapiens
uaacuaaagagaagucaauguc

SEQ ID NO: 80603 - RNA, 23 nt, Homo sapiens
uaagacacuaacuuuaugcuuug

SEQ ID NO: 80604 - RNA, 22 nt, Homo sapiens
uaaggcaaucagucaugguguu

SEQ ID NO: 80605 - RNA, 22 nt, Homo sapiens
uaagugaauauggacaguuagc

SEQ ID NO: 80606 - RNA, 22 nt, Homo sapiens
uaauucuguauguaucagaguu

SEQ ID NO: 80607 - RNA, 19 nt, Homo sapiens
uacaggacugagcugaggu

SEQ ID NO: 80608 - RNA, 22 nt, Homo sapiens
uaggacacaggacauauguaga

SEQ ID NO: 80609 - RNA, 22 nt, Homo sapiens
auagcuguccuuacuagcuagg

SEQ ID NO: 80610 - RNA, 23 nt, Homo sapiens
auauaguagaugugcaguaacau

SEQ ID NO: 80611 - RNA, 22 nt, Homo sapiens
auaugucuguuuagucuguaau

SEQ ID NO: 80612 - RNA, 22 nt, Homo sapiens
aucacagaguuaaaacuuucuu

SEQ ID NO: 80613 - RNA, 22 nt, Homo sapiens
aucauaucaucugcaaacaaag

SEQ ID NO: 80614 - RNA, 22 nt, Homo sapiens
aucauugugugaguugauggga

SEQ ID NO: 80615 - RNA, 22 nt, Homo sapiens
auccuagguuagagaacaaaac

SEQ ID NO: 80616 - RNA, 22 nt, Homo sapiens
augauauguuuguagcuaucuc

SEQ ID NO: 80617 - RNA, 22 nt, Homo sapiens
augcacuuggcaggaugauucc

SEQ ID NO: 80618 - RNA, 22 nt, Homo sapiens
auggaacuggagaucauuaugu

SEQ ID NO: 80619 - RNA, 22 nt, Homo sapiens
auggaacuggagaugguuauau

SEQ ID NO: 80620 - RNA, 22 nt, Homo sapiens
auggagaugugcgaacugagua

SEQ ID NO: 80621 - RNA, 22 nt, Homo sapiens
augguugguuaaaucuguguau

SEQ ID NO: 80622 - RNA, 22 nt, Homo sapiens
augguuugugcuccuauaagaa

SEQ ID NO: 80623 - RNA, 22 nt, Homo sapiens
auguaauguuaaauugcuaauu

SEQ ID NO: 80624 - RNA, 22 nt, Homo sapiens
auuggucuauuaaaccuaaguu

SEQ ID NO: 80625 - RNA, 22 nt, Homo sapiens
auuggucuugaaaccagagaga

SEQ ID NO: 80626 - RNA, 22 nt, Homo sapiens
auugugauggucaaaggaaaua

SEQ ID NO: 80627 - RNA, 22 nt, Homo sapiens
cacagugaaugucaucauugcc

SEQ ID NO: 80628 - RNA, 22 nt, Homo sapiens
cagcuguguuauaaacuaccau

SEQ ID NO: 80629 - RNA, 20 nt, Homo sapiens
cagucauagacaucagaguc

SEQ ID NO: 80630 - RNA, 19 nt, Homo sapiens
caucacagagucuuccauu

SEQ ID NO: 80631 - RNA, 21 nt, Homo sapiens
cgauaacagcccuuucccaaa

SEQ ID NO: 80632 - RNA, 17 nt, Homo sapiens
cuaaggcaagagucugc

SEQ ID NO: 80633 - RNA, 22 nt, Homo sapiens
cucccagagccaguuauaggcu

SEQ ID NO: 80634 - RNA, 22 nt, Homo sapiens
cucuuuaguaagcaguugauga

SEQ ID NO: 80635 - RNA, 22 nt, Homo sapiens
cugaggguagaaggaucacuug

SEQ ID NO: 80636 - RNA, 22 nt, Homo sapiens
cugaggugggaguuuuucucau

SEQ ID NO: 80637 - RNA, 22 nt, Homo sapiens
cuucaaguaauucugauggcua

SEQ ID NO: 80638 - RNA, 22 nt, Homo sapiens
cuugagacauuguuuuccaagu

SEQ ID NO: 80639 - RNA, 22 nt, Homo sapiens
cuuuuacacuguuggugggaau

SEQ ID NO: 80640 - RNA, 22 nt, Homo sapiens
gaaucacaguuauuagagcagc

SEQ ID NO: 80641 - RNA, 22 nt, Homo sapiens
gaggcaauaugagggaggcuuc

SEQ ID NO: 80642 - RNA, 21 nt, Homo sapiens
gauaugacauggguaaaacca

SEQ ID NO: 80643 - RNA, 22 nt, Homo sapiens
gcagcagugcccuggauggaaa

SEQ ID NO: 80644 - RNA, 22 nt, Homo sapiens
gcccuuugugucuggcuggggu

SEQ ID NO: 80645 - RNA, 22 nt, Homo sapiens
gcuggguucagagugggcugcg

SEQ ID NO: 80646 - RNA, 22 nt, Homo sapiens
ggaauauaaaacuuuugacagg

SEQ ID NO: 80647 - RNA, 22 nt, Homo sapiens
ggacagaaaggguucaccaaac

SEQ ID NO: 80648 - RNA, 22 nt, Homo sapiens
ggagugcuguuguuacacaagg

SEQ ID NO: 80649 - RNA, 22 nt, Homo sapiens
gggagguuguauguaugcgggg

SEQ ID NO: 80650 - RNA, 22 nt, Homo sapiens
ggucaggagaaugguaacugag

SEQ ID NO: 80651 - RNA, 22 nt, Homo sapiens
gugauguguuucaacagcuccu

SEQ ID NO: 80652 - RNA, 22 nt, Homo sapiens
gugguuuuaauauucagucuag

SEQ ID NO: 80653 - RNA, 22 nt, Homo sapiens
gugguuuuaucccagaaauuaa

SEQ ID NO: 80654 - RNA, 22 nt, Homo sapiens
gugguuuuuagauuucuacagu

SEQ ID NO: 80655 - RNA, 22 nt, Homo sapiens
uacacagucaaaaauuuccagg

SEQ ID NO: 80656 - RNA, 23 nt, Homo sapiens
uacagcugcagaaucaggcuaag

SEQ ID NO: 80657 - RNA, 22 nt, Homo sapiens
uagaacauuccaggugauguug

SEQ ID NO: 80658 - RNA, 22 nt, Homo sapiens
uagcaaguguuuaagcacuuuu

SEQ ID NO: 80659 - RNA, 22 nt, Homo sapiens
uaggugaauguaguaagguguu

SEQ ID NO: 80660 - RNA, 22 nt, Homo sapiens
uauaacaaugcaagaauggccu

SEQ ID NO: 80661 - RNA, 23 nt, Homo sapiens
uauaugugucuaggagcuauggu

SEQ ID NO: 80662 - RNA, 22 nt, Homo sapiens
uaucagcacaguggguucaugg

SEQ ID NO: 80663 - RNA, 22 nt, Homo sapiens
uaucagcagcaggggcugcaga

SEQ ID NO: 80664 - RNA, 22 nt, Homo sapiens
uaucucuuuucauguguaaaug

SEQ ID NO: 80665 - RNA, 22 nt, Homo sapiens
uaucugcaucccauuuuuauca

SEQ ID NO: 80666 - RNA, 22 nt, Homo sapiens
uauggauuuuggaauauguggg

SEQ ID NO: 80667 - RNA, 22 nt, Homo sapiens
uauggguuucagagggugauag

SEQ ID NO: 80668 - RNA, 22 nt, Homo sapiens
uauuugauugacuuuagcagga

SEQ ID NO: 80669 - RNA, 22 nt, Homo sapiens
ucaaaguauucuucugagaacc

SEQ ID NO: 80670 - RNA, 22 nt, Homo sapiens
ucacagauaaauaaagaugauu

SEQ ID NO: 80671 - RNA, 22 nt, Homo sapiens
ucacaugaagauuuuaguauac

SEQ ID NO: 80672 - RNA, 21 nt, Homo sapiens
ucagaagcucccagggaggac

SEQ ID NO: 80673 - RNA, 22 nt, Homo sapiens
ucagaugaugucccuguucuaa

SEQ ID NO: 80674 - RNA, 22 nt, Homo sapiens
ucauguaauuuugugucuauga

SEQ ID NO: 80675 - RNA, 22 nt, Homo sapiens
ucucuugguugaacaguuugga

SEQ ID NO: 80676 - RNA, 22 nt, Homo sapiens
ucugaguggcagaaugagcuga

SEQ ID NO: 80677 - RNA, 22 nt, Homo sapiens
ucuugggugaguuugugaauaa

SEQ ID NO: 80678 - RNA, 22 nt, Homo sapiens
ucuuggguuugccuugcugcug

SEQ ID NO: 80679 - RNA, 22 nt, Homo sapiens
ucuuggguuuguccuucuccua

SEQ ID NO: 80680 - RNA, 22 nt, Homo sapiens
ucuuugauuuuguuacuaagac

SEQ ID NO: 80681 - RNA, 22 nt, Homo sapiens
ugaaauguugggugauggaauc

SEQ ID NO: 80682 - RNA, 22 nt, Homo sapiens
ugaauacagcacacccaugggu

SEQ ID NO: 80683 - RNA, 18 nt, Homo sapiens
ugaauacagcguugggaa

SEQ ID NO: 80684 - RNA, 22 nt, Homo sapiens
ugaauagagcugcaguggacau

SEQ ID NO: 80685 - RNA, 22 nt, Homo sapiens
uuaaaugcacauacuugagaaa

SEQ ID NO: 80686 - RNA, 18 nt, Homo sapiens
uuaaggcaggacuuuaag

SEQ ID NO: 80687 - RNA, 22 nt, Homo sapiens
uuacaaguggcaucucucugga

SEQ ID NO: 80688 - RNA, 22 nt, Homo sapiens
uuaggcuuuuuaaccaguuguu

SEQ ID NO: 80689 - RNA, 21 nt, Homo sapiens
uuauaguggcaugauuuauaa

SEQ ID NO: 80690 - RNA, 22 nt, Homo sapiens
uuauuagcacccuaccaugugg

SEQ ID NO: 80691 - RNA, 22 nt, Homo sapiens
uucacagagagaacucaaacca

SEQ ID NO: 80692 - RNA, 22 nt, Homo sapiens
uucauagaggacauuacuggag

SEQ ID NO: 80693 - RNA, 22 nt, Homo sapiens
uuccuacugcccauuaaaaugg

SEQ ID NO: 80694 - RNA, 22 nt, Homo sapiens
uugacaaggagccauugcaucu

SEQ ID NO: 80695 - RNA, 22 nt, Homo sapiens
uugcaagaaaugcagauucuca

SEQ ID NO: 80696 - RNA, 22 nt, Homo sapiens
uugccauggaguagaauugaag

SEQ ID NO: 80697 - RNA, 22 nt, Homo sapiens
uuggaauuuuaaaauaggcaac

SEQ ID NO: 80698 - RNA, 22 nt, Homo sapiens
uugguccucccaugcucaagag

SEQ ID NO: 80699 - RNA, 22 nt, Homo sapiens
uuguacaggaguguaagcuuca

SEQ ID NO: 80700 - RNA, 22 nt, Homo sapiens
uuuagcagcaaagagccaugcu

SEQ ID NO: 80701 - RNA, 22 nt, Homo sapiens
uuugagcuugacucagcuggag

SEQ ID NO: 80702 - RNA, 22 nt, Homo sapiens
uuugaguuugaggugcugauga

SEQ ID NO: 80703 - RNA, 22 nt, Homo sapiens
uuuggguuaguuuuccaaucuu

SEQ ID NO: 80704 - RNA, 18 nt, Homo sapiens
uuuugcuuaacugcgcca

SEQ ID NO: 80705 - RNA, 22 nt, Homo sapiens
uugacagaccuuggucauaucc

SEQ ID NO: 80706 - RNA, 22 nt, Homo sapiens
uugacuucagagcugauucaag

SEQ ID NO: 80707 - RNA, 22 nt, Homo sapiens
uugagauagggucuaccucugu

SEQ ID NO: 80708 - RNA, 22 nt, Homo sapiens
uugagcaaaacauuaauauuag

SEQ ID NO: 80709 - RNA, 22 nt, Homo sapiens
aaagcagcaggugguuuucaau

SEQ ID NO: 80710 - RNA, 22 nt, Homo sapiens
aacacuguuuccagucaugauc

SEQ ID NO: 80711 - RNA, 22 nt, Homo sapiens
aacauguuuagcagauaccugu

SEQ ID NO: 80712 - RNA, 22 nt, Homo sapiens
aacucacauucuuucuugguac

SEQ ID NO: 80713 - RNA, 22 nt, Homo sapiens
aagagguaggaaauggucauuu

SEQ ID NO: 80714 - RNA, 22 nt, Homo sapiens
aagccacuguaccugucucuua

SEQ ID NO: 80715 - RNA, 22 nt, Homo sapiens
aagcuccauuucugccaugaga

SEQ ID NO: 80716 - RNA, 22 nt, Homo sapiens
aagcuggauuucgcauccuguu

SEQ ID NO: 80717 - RNA, 22 nt, Homo sapiens
aaguacuguuuaaauugcagaa

SEQ ID NO: 80718 - RNA, 22 nt, Homo sapiens
aaugucaucuucaguuguacag

SEQ ID NO: 80719 - RNA, 22 nt, Homo sapiens
acacagugucuguguauuuaaa

SEQ ID NO: 80720 - RNA, 22 nt, Homo sapiens
accccauuugcacugagcccuu

SEQ ID NO: 80721 - RNA, 22 nt, Homo sapiens
acugcacuccaccuugggcaac

SEQ ID NO: 80722 - RNA, 22 nt, Homo sapiens
acugcacuccagccuuggcaac

SEQ ID NO: 80723 - RNA, 22 nt, Homo sapiens
acugcacuccggccuggcaaca

SEQ ID NO: 80724 - RNA, 22 nt, Homo sapiens
agaauguaacucuaugaaggca

SEQ ID NO: 80725 - RNA, 22 nt, Homo sapiens
agacacuguugaaaaggcccca

SEQ ID NO: 80726 - RNA, 22 nt, Homo sapiens
agagacauugcuccaacucacc

SEQ ID NO: 80727 - RNA, 22 nt, Homo sapiens
aggaagcuagcauuuguucagu

SEQ ID NO: 80728 - RNA, 22 nt, Homo sapiens
aggcaacaugguaaaacccugu

SEQ ID NO: 80729 - RNA, 20 nt, Homo sapiens
agguuauuauaauuagaaga

SEQ ID NO: 80730 - RNA, 21 nt, Homo sapiens
agucauaggaguacauaaugc

SEQ ID NO: 80731 - RNA, 22 nt, Homo sapiens
agugcacuccagccugggcaac

SEQ ID NO: 80732 - RNA, 22 nt, Homo sapiens
aguggaauuaagaaacugaauu

SEQ ID NO: 80733 - RNA, 22 nt, Homo sapiens
aguggcacaauuuugacucccc

SEQ ID NO: 80734 - RNA, 22 nt, Homo sapiens
auacaagcaguccaacuccaua

SEQ ID NO: 80735 - RNA, 22 nt, Homo sapiens
auacaugugcaggucagguuac

SEQ ID NO: 80736 - RNA, 22 nt, Homo sapiens
auacaugugccaugcuggugug

SEQ ID NO: 80737 - RNA, 22 nt, Homo sapiens
auacugucucuugcuccugccc

SEQ ID NO: 80738 - RNA, 22 nt, Homo sapiens
auauggcauucagaacuguaua

SEQ ID NO: 80739 - RNA, 21 nt, Homo sapiens
auaugugcuguggaagucagc

SEQ ID NO: 80740 - RNA, 22 nt, Homo sapiens
aucugugguuguaugcauauua

SEQ ID NO: 80741 - RNA, 22 nt, Homo sapiens
augacguugugggcucucaagc

SEQ ID NO: 80742 - RNA, 19 nt, Homo sapiens
augagaacagacuccauuu

SEQ ID NO: 80743 - RNA, 22 nt, Homo sapiens
augauauggucacccuuaugaa

SEQ ID NO: 80744 - RNA, 22 nt, Homo sapiens
augccaagaugagcacgcgucu

SEQ ID NO: 80745 - RNA, 22 nt, Homo sapiens
auggcaagaagagcaauuauuu

SEQ ID NO: 80746 - RNA, 21 nt, Homo sapiens
auguaaugaagaagccacugg

SEQ ID NO: 80747 - RNA, 22 nt, Homo sapiens
augucaaggugggugauaguuu

SEQ ID NO: 80748 - RNA, 22 nt, Homo sapiens
augucacagguccuagccaagu

SEQ ID NO: 80749 - RNA, 22 nt, Homo sapiens
auugcacuccauccugggcaau

SEQ ID NO: 80750 - RNA, 21 nt, Homo sapiens
caauggcacaaucucugcuca

SEQ ID NO: 80751 - RNA, 22 nt, Homo sapiens
cacaggccugucucuuucuaac

SEQ ID NO: 80752 - RNA, 22 nt, Homo sapiens
cacugcacuccagccuaagagg

SEQ ID NO: 80753 - RNA, 22 nt, Homo sapiens
cagagguauugcaaaagccuag

SEQ ID NO: 80754 - RNA, 22 nt, Homo sapiens
caugaaagugagaaacuccugg

SEQ ID NO: 80755 - RNA, 22 nt, Homo sapiens
caugccauugcucuccugggug

SEQ ID NO: 80756 - RNA, 22 nt, Homo sapiens
cauggagcuaggcuugaucccu

SEQ ID NO: 80757 - RNA, 22 nt, Homo sapiens
cauggcuuuauuuucagcuucu

SEQ ID NO: 80758 - RNA, 22 nt, Homo sapiens
caugggacugucuuggcuauac

SEQ ID NO: 80759 - RNA, 22 nt, Homo sapiens
ccaaguguuuucauuguuccau

SEQ ID NO: 80760 - RNA, 22 nt, Homo sapiens
cccugaagaaagccuaggacau

SEQ ID NO: 80761 - RNA, 22 nt, Homo sapiens
cgccugagcugaggaagcugca

SEQ ID NO: 80762 - RNA, 22 nt, Homo sapiens
cuacagcagcccaguccccgaa

SEQ ID NO: 80763 - RNA, 22 nt, Homo sapiens
cuauggcuguaaggauaguaac

SEQ ID NO: 80764 - RNA, 17 nt, Homo sapiens
cucacugagaacagcua

SEQ ID NO: 80765 - RNA, 22 nt, Homo sapiens
cucaguuuugccuuguuuaagg

SEQ ID NO: 80766 - RNA, 22 nt, Homo sapiens
cuccauagucuucgaagaauga

SEQ ID NO: 80767 - RNA, 22 nt, Homo sapiens
cugagacacucuuaucugcaua

SEQ ID NO: 80768 - RNA, 22 nt, Homo sapiens
cugagagaggagcuaaaacugc

SEQ ID NO: 80769 - RNA, 22 nt, Homo sapiens
cugaggguagaaggaucacuug

SEQ ID NO: 80770 - RNA, 22 nt, Homo sapiens
cuuuggcaaugucauuuucaau

SEQ ID NO: 80771 - RNA, 20 nt, Homo sapiens
cuuuuagcagcagcaagaga

SEQ ID NO: 80772 - RNA, 22 nt, Homo sapiens
gagagcaugugcuggcaucagu

SEQ ID NO: 80773 - RNA, 22 nt, Homo sapiens
gagaugguacacauacgauucu

SEQ ID NO: 80774 - RNA, 22 nt, Homo sapiens
gagguaugauugacauauaaaa

SEQ ID NO: 80775 - RNA, 23 nt, Homo sapiens
gaguacauuaaaagcccagacug

SEQ ID NO: 80776 - RNA, 22 nt, Homo sapiens
gcagcacauggcagaacauauu

SEQ ID NO: 80777 - RNA, 22 nt, Homo sapiens
gccaagauuuaauucaucaguu

SEQ ID NO: 80778 - RNA, 22 nt, Homo sapiens
gcucugguuacaaaggcaaauu

SEQ ID NO: 80779 - RNA, 22 nt, Homo sapiens
gcugguguucaggcccucaguc

SEQ ID NO: 80780 - RNA, 23 nt, Homo sapiens
ggauucaucuguuuguucgcugu

SEQ ID NO: 80781 - RNA, 21 nt, Homo sapiens
ggcaagagaauacaacauaaa

SEQ ID NO: 80782 - RNA, 22 nt, Homo sapiens
ggcaugaggccauaaaaguaag

SEQ ID NO: 80783 - RNA, 18 nt, Homo sapiens
gggaauauggggaguuga

SEQ ID NO: 80784 - RNA, 22 nt, Homo sapiens
guacacauacauauaugugugu

SEQ ID NO: 80785 - RNA, 22 nt, Homo sapiens
gucauuguguggacauggagaa

SEQ ID NO: 80786 - RNA, 22 nt, Homo sapiens
gugaggucagggcuguggacag

SEQ ID NO: 80787 - RNA, 22 nt, Homo sapiens
guggacguguguccccauggcu

SEQ ID NO: 80788 - RNA, 22 nt, Homo sapiens
guggaguaugaaaacugacuuu

SEQ ID NO: 80789 - RNA, 22 nt, Homo sapiens
guggcaagaugacuacucacug

SEQ ID NO: 80790 - RNA, 22 nt, Homo sapiens
guguauguuguccauggaugcg

SEQ ID NO: 80791 - RNA, 22 nt, Homo sapiens
uaacaguguauuuacuacuucc

SEQ ID NO: 80792 - RNA, 22 nt, Homo sapiens
uaaggcacuacuuuaggcuuuc

SEQ ID NO: 80793 - RNA, 22 nt, Homo sapiens
uaaggcucuuguuauuuugagg

SEQ ID NO: 80794 - RNA, 22 nt, Homo sapiens
uacaacacugguucgacaugug

SEQ ID NO: 80795 - RNA, 22 nt, Homo sapiens
uacagucauaaugccuagugac

SEQ ID NO: 80796 - RNA, 22 nt, Homo sapiens
uaguucguguuugaacuagauc

SEQ ID NO: 80797 - RNA, 22 nt, Homo sapiens
uaugagagcugguagguagaga

SEQ ID NO: 80798 - RNA, 20 nt, Homo sapiens
uauucacucuccagucuugc

SEQ ID NO: 80799 - RNA, 22 nt, Homo sapiens
ucaaggcacuagcugagcugca

SEQ ID NO: 80800 - RNA, 22 nt, Homo sapiens
ucacagacauugaggggaccuu

SEQ ID NO: 80801 - RNA, 22 nt, Homo sapiens
ucacagauaaauaaagaugauu

SEQ ID NO: 80802 - RNA, 22 nt, Homo sapiens
ucacagugaguggaguggggug

SEQ ID NO: 80803 - RNA, 22 nt, Homo sapiens
ucacagugcaggaucaguuaau

SEQ ID NO: 80804 - RNA, 22 nt, Homo sapiens
ucacauguguaaauugguguaa

SEQ ID NO: 80805 - RNA, 22 nt, Homo sapiens
ucagggacgcuugacacaagcc

SEQ ID NO: 80806 - RNA, 22 nt, Homo sapiens
ucaggguacuuguggccaaagu

SEQ ID NO: 80807 - RNA, 22 nt, Homo sapiens
ucagucauugauggaguagguc

SEQ ID NO: 80808 - RNA, 22 nt, Homo sapiens
ucagugcuguaccaucuaagga

SEQ ID NO: 80809 - RNA, 21 nt, Homo sapiens
ucagugcugugggcaaggugc

SEQ ID NO: 80810 - RNA, 22 nt, Homo sapiens
ucagugcuuuuuguugucauca

SEQ ID NO: 80811 - RNA, 22 nt, Homo sapiens
ucauaguacuuuguuuugaaaa

SEQ ID NO: 80812 - RNA, 22 nt, Homo sapiens
ucauaugucauaguaugaucuu

SEQ ID NO: 80813 - RNA, 22 nt, Homo sapiens
ucaugagacacacuggaaagga

SEQ ID NO: 80814 - RNA, 22 nt, Homo sapiens
ucauggcacugaugagaguuuc

SEQ ID NO: 80815 - RNA, 22 nt, Homo sapiens
ucaugggagcccccaucaugag

SEQ ID NO: 80816 - RNA, 22 nt, Homo sapiens
uccauaguugcacucuggagcc

SEQ ID NO: 80817 - RNA, 22 nt, Homo sapiens
uccuuuaguuaauaaagacaag

SEQ ID NO: 80818 - RNA, 20 nt, Homo sapiens
ucgcaccacuauacuccagc

SEQ ID NO: 80819 - RNA, 22 nt, Homo sapiens
ucugaguggcagaaugagcuga

SEQ ID NO: 80820 - RNA, 22 nt, Homo sapiens
ucuucagucauauuggccugga

SEQ ID NO: 80821 - RNA, 19 nt, Homo sapiens
ugaaugacaucuaaagucc

SEQ ID NO: 80822 - RNA, 22 nt, Homo sapiens
ugagagaugaacucugauaugu

SEQ ID NO: 80823 - RNA, 22 nt, Homo sapiens
ugagauaaucaugugauuucau

SEQ ID NO: 80824 - RNA, 22 nt, Homo sapiens
ugagaugacgacacaccucagu

SEQ ID NO: 80825 - RNA, 22 nt, Homo sapiens
ugagccaaguucacaccauugc

SEQ ID NO: 80826 - RNA, 20 nt, Homo sapiens
ugagccccuggacucaagcg

SEQ ID NO: 80827 - RNA, 22 nt, Homo sapiens
ugaggaaugaccccgugugguc

SEQ ID NO: 80828 - RNA, 22 nt, Homo sapiens
ugagguaaugcuguagcuguga

SEQ ID NO: 80829 - RNA, 22 nt, Homo sapiens
ugaggucauguucugucagguu

SEQ ID NO: 80830 - RNA, 22 nt, Homo sapiens
ugagguuggggucagggcuagc

SEQ ID NO: 80831 - RNA, 22 nt, Homo sapiens
ugagugugaggaagaauuagaa

SEQ ID NO: 80832 - RNA, 22 nt, Homo sapiens
ugauagugccuuuuauaucucu

SEQ ID NO: 80833 - RNA, 22 nt, Homo sapiens
ugaugacacugauuucuucaau

SEQ ID NO: 80834 - RNA, 22 nt, Homo sapiens
ugccaaggagucagucccuaga

SEQ ID NO: 80835 - RNA, 22 nt, Homo sapiens
ugccuucuguuaaacgaggaug

SEQ ID NO: 80836 - RNA, 21 nt, Homo sapiens
ugcuuacugaauguuaauuuc

SEQ ID NO: 80837 - RNA, 22 nt, Homo sapiens
uggcaagaagagcaugagacca

SEQ ID NO: 80838 - RNA, 22 nt, Homo sapiens
uggcaagugggaccuaguuaaa

SEQ ID NO: 80839 - RNA, 22 nt, Homo sapiens
uggcaguuucauaugguucaac

SEQ ID NO: 80840 - RNA, 22 nt, Homo sapiens
uggccuguaacccucucauagg

SEQ ID NO: 80841 - RNA, 20 nt, Homo sapiens
uggcuaaaugaaugauagca

SEQ ID NO: 80842 - RNA, 22 nt, Homo sapiens
uggcuuuuguuauuuggaagcu

SEQ ID NO: 80843 - RNA, 22 nt, Homo sapiens
ugguaaguuuaacaugcauccc

SEQ ID NO: 80844 - RNA, 22 nt, Homo sapiens
ugucauauagaauguucuauga

SEQ ID NO: 80845 - RNA, 18 nt, Homo sapiens
ugucccuuugcuguucau

SEQ ID NO: 80846 - RNA, 22 nt, Homo sapiens
ugugaacagaauuagucaccua

SEQ ID NO: 80847 - RNA, 22 nt, Homo sapiens
uuaacagucacuuagcucauuu

SEQ ID NO: 80848 - RNA, 22 nt, Homo sapiens
uuaaggcuuuaaguaaacacag

SEQ ID NO: 80849 - RNA, 22 nt, Homo sapiens
uuaaggcuuucccuauguaaaa

SEQ ID NO: 80850 - RNA, 22 nt, Homo sapiens
uuauacucgucugaaugauucu

SEQ ID NO: 80851 - RNA, 23 nt, Homo sapiens
uucaaauguucucugguugucag

SEQ ID NO: 80852 - RNA, 22 nt, Homo sapiens
uucacugugcuuaaauucugcu

SEQ ID NO: 80853 - RNA, 22 nt, Homo sapiens
uucaggcuuuuauuuacugaua

SEQ ID NO: 80854 - RNA, 22 nt, Homo sapiens
uucagggagaaggcaaacguug

SEQ ID NO: 80855 - RNA, 22 nt, Homo sapiens
uucauggugguacaaaagcaau

SEQ ID NO: 80856 - RNA, 22 nt, Homo sapiens
uugaaugaaauuggugugggga

SEQ ID NO: 80857 - RNA, 22 nt, Homo sapiens
uugagagagaacauuuguuaca

SEQ ID NO: 80858 - RNA, 22 nt, Homo sapiens
uugagcaaaacauuaauauuag

SEQ ID NO: 80859 - RNA, 22 nt, Homo sapiens
uugaggacugcuaagcauuuga

SEQ ID NO: 80860 - RNA, 22 nt, Homo sapiens
uugagggaggcagggcuugucu

SEQ ID NO: 80861 - RNA, 22 nt, Homo sapiens
uugagggaggccucaguuuaca

SEQ ID NO: 80862 - RNA, 22 nt, Homo sapiens
uugguuaucaucauuucagcaa

SEQ ID NO: 80863 - RNA, 22 nt, Homo sapiens
uugguuauccugucgguaauuc

SEQ ID NO: 80864 - RNA, 22 nt, Homo sapiens
uuuugggggugauucacacagu

SEQ ID NO: 80865 - RNA, 22 nt, Homo sapiens
uugagggagccuguuagucccg

SEQ ID NO: 80866 - RNA, 22 nt, Homo sapiens
uuggaauauaaccuguuucuaa

SEQ ID NO: 80867 - RNA, 16 nt, Homo sapiens
uuucuauguuuuacua

SEQ ID NO: 80868 - RNA, 19 nt, Homo sapiens
cucauggagaaggagaaua

SEQ ID NO: 80869 - RNA, 22 nt, Homo sapiens
cucugacagugguuagcacugu

SEQ ID NO: 80870 - RNA, 22 nt, Homo sapiens
cugagcaauauagugagaucuu

SEQ ID NO: 80871 - RNA, 22 nt, Homo sapiens
cugagguacugggggccaggau

SEQ ID NO: 80872 - RNA, 22 nt, Homo sapiens
cugagguauuuaggugaaagaa

SEQ ID NO: 80873 - RNA, 22 nt, Homo sapiens
cuggaaucuagaaaagguaagg

SEQ ID NO: 80874 - RNA, 22 nt, Homo sapiens
cuucuugcuguguccucacaug

SEQ ID NO: 80875 - RNA, 22 nt, Homo sapiens
gagagguaguuuuuuggucguc

SEQ ID NO: 80876 - RNA, 22 nt, Homo sapiens
gcacaguguuacuugauauauu

SEQ ID NO: 80877 - RNA, 17 nt, Homo sapiens
ggaaugaauuccagccc

SEQ ID NO: 80878 - RNA, 22 nt, Homo sapiens
ggccagaugaucuaugaaggaa

SEQ ID NO: 80879 - RNA, 22 nt, Homo sapiens
ggugagguaguaagguacaaua

SEQ ID NO: 80880 - RNA, 22 nt, Homo sapiens
guauggcacuauccucucugau

SEQ ID NO: 80881 - RNA, 21 nt, Homo sapiens
guauggcauugauuaguuacu

SEQ ID NO: 80882 - RNA, 22 nt, Homo sapiens
gugagaagaaaaauauggcugu

SEQ ID NO: 80883 - RNA, 22 nt, Homo sapiens
gugaggcuuuuccuguuagacu

SEQ ID NO: 80884 - RNA, 22 nt, Homo sapiens
guguaaguccugaguuuggaua

SEQ ID NO: 80885 - RNA, 22 nt, Homo sapiens
uaacaagagagucagucagucc

SEQ ID NO: 80886 - RNA, 22 nt, Homo sapiens
uaauagcaguguuacuaggacu

SEQ ID NO: 80887 - RNA, 22 nt, Homo sapiens
uacaagcaggaaaugguauaug

SEQ ID NO: 80888 - RNA, 22 nt, Homo sapiens
uagaaugaaacaagcugugccu

SEQ ID NO: 80889 - RNA, 22 nt, Homo sapiens
uagagguauuaacaguagaaga

SEQ ID NO: 80890 - RNA, 22 nt, Homo sapiens
uagcacaugucagguaauuugc

SEQ ID NO: 80891 - RNA, 21 nt, Homo sapiens
uaucacauuggugauuaaguu

SEQ ID NO: 80892 - RNA, 22 nt, Homo sapiens
uaucagcacaguggguucaugg

SEQ ID NO: 80893 - RNA, 21 nt, Homo sapiens
uauccacuugcaacagagaag

SEQ ID NO: 80894 - RNA, 22 nt, Homo sapiens
uaugaugcuguuuagaaucucu

SEQ ID NO: 80895 - RNA, 22 nt, Homo sapiens
uauggauuugccuauucuguau

SEQ ID NO: 80896 - RNA, 22 nt, Homo sapiens
uauggcuacuacgaauaaugcu

SEQ ID NO: 80897 - RNA, 22 nt, Homo sapiens
uauugcaauuggggaaacuggg

SEQ ID NO: 80898 - RNA, 22 nt, Homo sapiens
ucacagacugagccaaauagag

SEQ ID NO: 80899 - RNA, 22 nt, Homo sapiens
ucauauguaugugcaauuuugu

SEQ ID NO: 80900 - RNA, 22 nt, Homo sapiens
uccugagacucacaggcucccc

SEQ ID NO: 80901 - RNA, 22 nt, Homo sapiens
uccugagagcagacccucuaua

SEQ ID NO: 80902 - RNA, 21 nt, Homo sapiens
ucucauagaguuucacuuucu

SEQ ID NO: 80903 - RNA, 22 nt, Homo sapiens
ucucccauccaugaacuucugu

SEQ ID NO: 80904 - RNA, 17 nt, Homo sapiens
ucucccaucccuuucuc

SEQ ID NO: 80905 - RNA, 22 nt, Homo sapiens
ucuggagugugaaguggauaug

SEQ ID NO: 80906 - RNA, 22 nt, Homo sapiens
ugagaaugaugauugguaaacc

SEQ ID NO: 80907 - RNA, 22 nt, Homo sapiens
ugagaugagaaucaguucuaau

SEQ ID NO: 80908 - RNA, 22 nt, Homo sapiens
ugaggaauguguguuaaagaua

SEQ ID NO: 80909 - RNA, 22 nt, Homo sapiens
ugagguaaaacaaggauuggau

SEQ ID NO: 80910 - RNA, 22 nt, Homo sapiens
ugagguaauagauaauauuuuu

SEQ ID NO: 80911 - RNA, 22 nt, Homo sapiens
ugagguaggugaagaaugcacg

SEQ ID NO: 80912 - RNA, 20 nt, Homo sapiens
ugaggucaggaguuacagac

SEQ ID NO: 80913 - RNA, 22 nt, Homo sapiens
ugagguuauuuguucaagaagu

SEQ ID NO: 80914 - RNA, 22 nt, Homo sapiens
ugaguguccaccccuuucacag

SEQ ID NO: 80915 - RNA, 22 nt, Homo sapiens
ugauaauguuaggcuuuauuca

SEQ ID NO: 80916 - RNA, 22 nt, Homo sapiens
ugauggcauuuggaguugggac

SEQ ID NO: 80917 - RNA, 22 nt, Homo sapiens
ugcauggaagggagggaaagag

SEQ ID NO: 80918 - RNA, 22 nt, Homo sapiens
ugccaagaacauuuucuguuuu

SEQ ID NO: 80919 - RNA, 22 nt, Homo sapiens
ugccugagccagguuuuaggag

SEQ ID NO: 80920 - RNA, 22 nt, Homo sapiens
uggaaaauuaggggagguuaua

SEQ ID NO: 80921 - RNA, 22 nt, Homo sapiens
uggagacaaagauagaaaagca

SEQ ID NO: 80922 - RNA, 21 nt, Homo sapiens
uggauugagaaccccaggagg

SEQ ID NO: 80923 - RNA, 22 nt, Homo sapiens
uggcaaaugaaagaaagccagu

SEQ ID NO: 80924 - RNA, 22 nt, Homo sapiens
uggcaacaucuggggacauguu

SEQ ID NO: 80925 - RNA, 22 nt, Homo sapiens
uggcaguuucacauggcucaac

SEQ ID NO: 80926 - RNA, 22 nt, Homo sapiens
uggcaguuuuaugugguucaac

SEQ ID NO: 80927 - RNA, 22 nt, Homo sapiens
uggccuguaacgcugucucagc

SEQ ID NO: 80928 - RNA, 22 nt, Homo sapiens
uggcuaagaugcacacuucacu

SEQ ID NO: 80929 - RNA, 22 nt, Homo sapiens
ugggaauaugauacaggucuuu

SEQ ID NO: 80930 - RNA, 22 nt, Homo sapiens
ugugaacagcuccaaaugugga

SEQ ID NO: 80931 - RNA, 22 nt, Homo sapiens
uguguaaauaugauagaggaau

SEQ ID NO: 80932 - RNA, 22 nt, Homo sapiens
uguugcauuugucaaggucaag

SEQ ID NO: 80933 - RNA, 22 nt, Homo sapiens
uuaaggaaagcauuuaauucag

SEQ ID NO: 80934 - RNA, 22 nt, Homo sapiens
uuaaugaacuuuauuuuguaga

SEQ ID NO: 80935 - RNA, 22 nt, Homo sapiens
uuagcagugugagcacagacua

SEQ ID NO: 80936 - RNA, 22 nt, Homo sapiens
uuaguaguagugcuguaauuuu

SEQ ID NO: 80937 - RNA, 22 nt, Homo sapiens
aaaagugguguuguuucuaaau

SEQ ID NO: 80938 - RNA, 18 nt, Homo sapiens
aaacagugucucuuucug

SEQ ID NO: 80939 - RNA, 22 nt, Homo sapiens
aaagagaucuaugggcacuaug

SEQ ID NO: 80940 - RNA, 22 nt, Homo sapiens
aacagcacacccgcugcuucca

SEQ ID NO: 80941 - RNA, 20 nt, Homo sapiens
aagacacuguccccacugga

SEQ ID NO: 80942 - RNA, 22 nt, Homo sapiens
aagagguuguaccuaaaguguu

SEQ ID NO: 80943 - RNA, 23 nt, Homo sapiens
aaggacacugaacacuucccagc

SEQ ID NO: 80944 - RNA, 22 nt, Homo sapiens
aaguaauugagguuuuugcugu

SEQ ID NO: 80945 - RNA, 22 nt, Homo sapiens
aauugcacuacugcacucccac

SEQ ID NO: 80946 - RNA, 22 nt, Homo sapiens
acacaaugguaaguguuugugu

SEQ ID NO: 80947 - RNA, 22 nt, Homo sapiens
acacauacacauaugguguaua

SEQ ID NO: 80948 - RNA, 22 nt, Homo sapiens
acaguagcgcaaucucggcuca

SEQ ID NO: 80949 - RNA, 22 nt, Homo sapiens
acagugcugucugcuuuggcua

SEQ ID NO: 80950 - RNA, 22 nt, Homo sapiens
acaugagacuggguuuguaggg

SEQ ID NO: 80951 - RNA, 17 nt, Homo sapiens
accccuaccucagaagc

SEQ ID NO: 80952 - RNA, 22 nt, Homo sapiens
acuaugcuuuucuuagaauuaa

SEQ ID NO: 80953 - RNA, 22 nt, Homo sapiens
acugcacuccacccuuggcagc

SEQ ID NO: 80954 - RNA, 22 nt, Homo sapiens
acugcacucuagccuuggcaac

SEQ ID NO: 80955 - RNA, 22 nt, Homo sapiens
acugcacugcagccuggccaac

SEQ ID NO: 80956 - RNA, 22 nt, Homo sapiens
acuguacuccagccugggcaac

SEQ ID NO: 80957 - RNA, 22 nt, Homo sapiens
agaagaacauagggugacugaa

SEQ ID NO: 80958 - RNA, 19 nt, Homo sapiens
agagacucauuguagcauu

SEQ ID NO: 80959 - RNA, 22 nt, Homo sapiens
agaugauguuuacugagcauca

SEQ ID NO: 80960 - RNA, 22 nt, Homo sapiens
agcagauguuuagugagcgccu

SEQ ID NO: 80961 - RNA, 22 nt, Homo sapiens
agguauguauguaugggagaaa

SEQ ID NO: 80962 - RNA, 21 nt, Homo sapiens
aggucaugaagauguucuaau

SEQ ID NO: 80963 - RNA, 22 nt, Homo sapiens
agucaugggagagaugugaucg

SEQ ID NO: 80964 - RNA, 23 nt, Homo sapiens
agugccuaguauauaggaggcgc

SEQ ID NO: 80965 - RNA, 22 nt, Homo sapiens
aguguuuuucaugggauacuuu

SEQ ID NO: 80966 - RNA, 19 nt, Homo sapiens
auaguguaggaaaacagcu

SEQ ID NO: 80967 - RNA, 22 nt, Homo sapiens
auauucacagguaucagagauu

SEQ ID NO: 80968 - RNA, 22 nt, Homo sapiens
aucacagauauggguuuaaauc

SEQ ID NO: 80969 - RNA, 22 nt, Homo sapiens
aucacauggccagguaguaauc

SEQ ID NO: 80970 - RNA, 22 nt, Homo sapiens
auccucugagaucuaggcagag

SEQ ID NO: 80971 - RNA, 22 nt, Homo sapiens
augagauuguuuguacuccaca

SEQ ID NO: 80972 - RNA, 22 nt, Homo sapiens
augagcagaugcuccugccucu

SEQ ID NO: 80973 - RNA, 22 nt, Homo sapiens
augaggaagucaggcccagggg

SEQ ID NO: 80974 - RNA, 22 nt, Homo sapiens
augagggagggcaccugaccuu

SEQ ID NO: 80975 - RNA, 22 nt, Homo sapiens
auguaacugggacacaagccuc

SEQ ID NO: 80976 - RNA, 22 nt, Homo sapiens
augugacagugguuuuaagcgu

SEQ ID NO: 80977 - RNA, 22 nt, Homo sapiens
augugcauaugaagcacagaca

SEQ ID NO: 80978 - RNA, 22 nt, Homo sapiens
augugucaaaucuaggccaaag

SEQ ID NO: 80979 - RNA, 22 nt, Homo sapiens
auguugcuugaaggcauuuugu

SEQ ID NO: 80980 - RNA, 22 nt, Homo sapiens
auuauguuguauuuccuugcag

SEQ ID NO: 80981 - RNA, 22 nt, Homo sapiens
auuccacaguuaacacagaccg

SEQ ID NO: 80982 - RNA, 21 nt, Homo sapiens
auugcacuccagccugggcga

SEQ ID NO: 80983 - RNA, 22 nt, Homo sapiens
auugcacugcagccugggcaac

SEQ ID NO: 80984 - RNA, 22 nt, Homo sapiens
auugcacuggggguuagaauuu

SEQ ID NO: 80985 - RNA, 22 nt, Homo sapiens
caaagugcugaaagaggccagg

SEQ ID NO: 80986 - RNA, 22 nt, Homo sapiens
caaugcagcuuuuggagagaaa

SEQ ID NO: 80987 - RNA, 22 nt, Homo sapiens
caacacuguuuauuggauagcc

SEQ ID NO: 80988 - RNA, 22 nt, Homo sapiens
cacaguguuacugguaugaagu

SEQ ID NO: 80989 - RNA, 22 nt, Homo sapiens
cagugucugcauuuggaacuca

SEQ ID NO: 80990 - RNA, 22 nt, Homo sapiens
caucccauucgaggggcacagc

SEQ ID NO: 80991 - RNA, 22 nt, Homo sapiens
ccaaggcacugauucuguacuc

SEQ ID NO: 80992 - RNA, 22 nt, Homo sapiens
ccucccuuuguugcaagggaaa

SEQ ID NO: 80993 - RNA, 16 nt, Homo sapiens
cuaaaaugucuacuug

SEQ ID NO: 80994 - RNA, 23 nt, Homo sapiens
cuaaagucugucacugaggacuu

SEQ ID NO: 80995 - RNA, 17 nt, Homo sapiens
cuaaggcaagagucugc

SEQ ID NO: 80996 - RNA, 22 nt, Homo sapiens
cucauggaauacuucacagcca

SEQ ID NO: 80997 - RNA, 22 nt, Homo sapiens
cucauggauggucuggcagcca

SEQ ID NO: 80998 - RNA, 22 nt, Homo sapiens
cugacagaugacugccacugua

SEQ ID NO: 80999 - RNA, 21 nt, Homo sapiens
cugcauccauuucugagugau

SEQ ID NO: 81000 - RNA, 19 nt, Homo sapiens
cugcaugagacaguugguu

SEQ ID NO: 81001 - RNA, 22 nt, Homo sapiens
cuggcgagacagcuccaucacu

SEQ ID NO: 81002 - RNA, 22 nt, Homo sapiens
cuuccaaguggggcacgugcca

SEQ ID NO: 81003 - RNA, 22 nt, Homo sapiens
gaagaaguacaagacaaauuuu

SEQ ID NO: 81004 - RNA, 23 nt, Homo sapiens
gaaguaauaaauggauucuuaac

SEQ ID NO: 81005 - RNA, 18 nt, Homo sapiens
gacucaguuucuaaggca

SEQ ID NO: 81006 - RNA, 22 nt, Homo sapiens
gacuucaucauacuaugugugg

SEQ ID NO: 81007 - RNA, 22 nt, Homo sapiens
gagaaccauuuggagaaaaagu

SEQ ID NO: 81008 - RNA, 22 nt, Homo sapiens
gagguggugguggaggcauagc

SEQ ID NO: 81009 - RNA, 22 nt, Homo sapiens
gauuuguuggccugugagcuag

SEQ ID NO: 81010 - RNA, 22 nt, Homo sapiens
gcaagaauggaacaggagagcc

SEQ ID NO: 81011 - RNA, 22 nt, Homo sapiens
gcacaggguuacauucuaaggu

SEQ ID NO: 81012 - RNA, 22 nt, Homo sapiens
gcacaguggcucccgucuauaa

SEQ ID NO: 81013 - RNA, 20 nt, Homo sapiens
gcaguacuuuuaguucuaag

SEQ ID NO: 81014 - RNA, 22 nt, Homo sapiens
ggcaaagagacaugcaucgggg

SEQ ID NO: 81015 - RNA, 22 nt, Homo sapiens
ggcaaaugaagauggagaggcu

SEQ ID NO: 81016 - RNA, 22 nt, Homo sapiens
ggcauguuuaguagaauguggu

SEQ ID NO: 81017 - RNA, 22 nt, Homo sapiens
gggaaugaagagaaccuuccca

SEQ ID NO: 81018 - RNA, 22 nt, Homo sapiens
ggucauagagaauucaccagga

SEQ ID NO: 81019 - RNA, 22 nt, Homo sapiens
guauggcauuuguggauuggcc

SEQ ID NO: 81020 - RNA, 22 nt, Homo sapiens
gucacaguggccagugauguuc

SEQ ID NO: 81021 - RNA, 22 nt, Homo sapiens
gucaguuugguuaaucauucca

SEQ ID NO: 81022 - RNA, 22 nt, Homo sapiens
gugaaugaaugggugaauacau

SEQ ID NO: 81023 - RNA, 22 nt, Homo sapiens
guggcaaguguuccaagaggcg

SEQ ID NO: 81024 - RNA, 21 nt, Homo sapiens
uaaaacuguaacuuuguccug

SEQ ID NO: 81025 - RNA, 22 nt, Homo sapiens
uaaggcacccuucugaguagag

SEQ ID NO: 81026 - RNA, 22 nt, Homo sapiens
uaaggcacucuucugugugccu

SEQ ID NO: 81027 - RNA, 22 nt, Homo sapiens
uaaguacugucagaauuggacu

SEQ ID NO: 81028 - RNA, 22 nt, Homo sapiens
uaaguacuuuacagacauuauc

SEQ ID NO: 81029 - RNA, 22 nt, Homo sapiens
uaaguucauucaugaaacuuag

SEQ ID NO: 81030 - RNA, 22 nt, Homo sapiens
uacuguacugcaguucugcaaa

SEQ ID NO: 81031 - RNA, 22 nt, Homo sapiens
uagagguagguguaugaacuag

SEQ ID NO: 81032 - RNA, 22 nt, Homo sapiens
uagaguacucugguaaguucuu

SEQ ID NO: 81033 - RNA, 22 nt, Homo sapiens
uagcagcuuuauugagguaaau

SEQ ID NO: 81034 - RNA, 22 nt, Homo sapiens
uagugcuguaauucuaaugaaa

SEQ ID NO: 81035 - RNA, 19 nt, Homo sapiens
uaugcaacuuauagugcug

SEQ ID NO: 81036 - RNA, 22 nt, Homo sapiens
uauggauguuaagguucacagc

SEQ ID NO: 81037 - RNA, 22 nt, Homo sapiens
uauggcaaugcauaggaaggaa

SEQ ID NO: 81038 - RNA, 22 nt, Homo sapiens
ucaaggcacauuugacauuuuc

SEQ ID NO: 81039 - RNA, 20 nt, Homo sapiens
ucaaggcacgaauaaaaguu

SEQ ID NO: 81040 - RNA, 20 nt, Homo sapiens
ucaaggcaggaacuguacau

SEQ ID NO: 81041 - RNA, 22 nt, Homo sapiens
ucaaggcaguggccuuccuucu

SEQ ID NO: 81042 - RNA, 22 nt, Homo sapiens
ucacaguguuaaaccuuucuuu

SEQ ID NO: 81043 - RNA, 17 nt, Homo sapiens
ucacaguguuaggauga

SEQ ID NO: 81044 - RNA, 22 nt, Homo sapiens
ucacaugucagccguggggaag

SEQ ID NO: 81045 - RNA, 22 nt, Homo sapiens
ucacaugugacauauauauuug

SEQ ID NO: 81046 - RNA, 22 nt, Homo sapiens
ucacaugugcguuuuggcaugu

SEQ ID NO: 81047 - RNA, 20 nt, Homo sapiens
ucacugagugguccacagua

SEQ ID NO: 81048 - RNA, 22 nt, Homo sapiens
ucacugugugucucuguaucug

SEQ ID NO: 81049 - RNA, 22 nt, Homo sapiens
ucagaguagcugucugaggugc

SEQ ID NO: 81050 - RNA, 22 nt, Homo sapiens
ucagggacuuacaaaccagaag

SEQ ID NO: 81051 - RNA, 19 nt, Homo sapiens
ucagugcuauguaauguag

SEQ ID NO: 81052 - RNA, 22 nt, Homo sapiens
uccauuuguagguagugagaca

SEQ ID NO: 81053 - RNA, 19 nt, Homo sapiens
ucccaagaugcucauacau

SEQ ID NO: 81054 - RNA, 19 nt, Homo sapiens
ucucaguguuggucaggug

SEQ ID NO: 81055 - RNA, 22 nt, Homo sapiens
ucucaugaagauagagaauaga

SEQ ID NO: 81056 - RNA, 22 nt, Homo sapiens
ucucaugaagguggagaguagg

SEQ ID NO: 81057 - RNA, 22 nt, Homo sapiens
ucuggcaagauauccauugcuu

SEQ ID NO: 81058 - RNA, 22 nt, Homo sapiens
ugaauacagcacacccaugggu

SEQ ID NO: 81059 - RNA, 22 nt, Homo sapiens
ugagaugagggcugcacucaaa

SEQ ID NO: 81060 - RNA, 22 nt, Homo sapiens
ugaggucacuuguuuuaugcuu

SEQ ID NO: 81061 - RNA, 21 nt, Homo sapiens
ugaggucaugaugcugcuucc

SEQ ID NO: 81062 - RNA, 22 nt, Homo sapiens
ugaguagagaauucagcuaagg

SEQ ID NO: 81063 - RNA, 22 nt, Homo sapiens
ugaguuaauuuuuguaucaugu

SEQ ID NO: 81064 - RNA, 22 nt, Homo sapiens
ugauggcauuucauguuuguaa

SEQ ID NO: 81065 - RNA, 23 nt, Homo sapiens
ugauguccacuuagggucuaggu

SEQ ID NO: 81066 - RNA, 21 nt, Homo sapiens
uggaauuaauggagagguguu

SEQ ID NO: 81067 - RNA, 22 nt, Homo sapiens
uggacugagauuucagcugcca

SEQ ID NO: 81068 - RNA, 22 nt, Homo sapiens
uggagguagacauugggaagag

SEQ ID NO: 81069 - RNA, 22 nt, Homo sapiens
uggagguaggugauauguagca

SEQ ID NO: 81070 - RNA, 22 nt, Homo sapiens
uggauagauacuauccaggacu

SEQ ID NO: 81071 - RNA, 21 nt, Homo sapiens
uggcaacauggauggauucug

SEQ ID NO: 81072 - RNA, 22 nt, Homo sapiens
uggcauguaaugcagaaguugc

SEQ ID NO: 81073 - RNA, 22 nt, Homo sapiens
uggcuuuucauccugggacauu

SEQ ID NO: 81074 - RNA, 22 nt, Homo sapiens
uguaaugaucaaaucagaguaa

SEQ ID NO: 81075 - RNA, 22 nt, Homo sapiens
ugucauguggcuaacgauucau

SEQ ID NO: 81076 - RNA, 22 nt, Homo sapiens
ugugucuuuuaucacacaaugu

SEQ ID NO: 81077 - RNA, 22 nt, Homo sapiens
uguucuggagaguuuagucugg

SEQ ID NO: 81078 - RNA, 22 nt, Homo sapiens
uguuucuacugucucuguagua

SEQ ID NO: 81079 - RNA, 22 nt, Homo sapiens
uuaaggcuccuguuggcuuuua

SEQ ID NO: 81080 - RNA, 19 nt, Homo sapiens
uuaagguacuuagaugugu

SEQ ID NO: 81081 - RNA, 22 nt, Homo sapiens
uuaauuguaucuauagauguca

SEQ ID NO: 81082 - RNA, 22 nt, Homo sapiens
uuacagauggauggcagcuggc

SEQ ID NO: 81083 - RNA, 22 nt, Homo sapiens
uucauagaggacauuacuggag

SEQ ID NO: 81084 - RNA, 22 nt, Homo sapiens
uucauagucuaugcaaguaaga

SEQ ID NO: 81085 - RNA, 22 nt, Homo sapiens
uucauggauggaaaugauuuug

SEQ ID NO: 81086 - RNA, 22 nt, Homo sapiens
aaauucaucaaaugguuuguau

SEQ ID NO: 81087 - RNA, 22 nt, Homo sapiens
aacagaccuagauaguauaguc

SEQ ID NO: 81088 - RNA, 21 nt, Homo sapiens
aacagugcugaacagacaccu

SEQ ID NO: 81089 - RNA, 22 nt, Homo sapiens
aagaucaucauagagggcauga

SEQ ID NO: 81090 - RNA, 22 nt, Homo sapiens
aagcaggugugggaggaaaugg

SEQ ID NO: 81091 - RNA, 22 nt, Homo sapiens
aaggcucuuucaacguaaauua

SEQ ID NO: 81092 - RNA, 22 nt, Homo sapiens
aaguagcagaggcaagacuuga

SEQ ID NO: 81093 - RNA, 22 nt, Homo sapiens
aagucaugaagaggaaaggaca

SEQ ID NO: 81094 - RNA, 22 nt, Homo sapiens
aauucacuuguggcagauccuu

SEQ ID NO: 81095 - RNA, 23 nt, Homo sapiens
aauugcacauuccuugcuggcag

SEQ ID NO: 81096 - RNA, 22 nt, Homo sapiens
aauugcauugaauuuguagcuu

SEQ ID NO: 81097 - RNA, 22 nt, Homo sapiens
acacaugugaaaaaaauguuac

SEQ ID NO: 81098 - RNA, 22 nt, Homo sapiens
acacuugcuugcaauagccucc

SEQ ID NO: 81099 - RNA, 22 nt, Homo sapiens
acagcagugccccacucuacug

SEQ ID NO: 81100 - RNA, 22 nt, Homo sapiens
acagugcuucugauaugaugcc

SEQ ID NO: 81101 - RNA, 17 nt, Homo sapiens
acaugagacuggauucu

SEQ ID NO: 81102 - RNA, 22 nt, Homo sapiens
accauugcacuccagccugggc

SEQ ID NO: 81103 - RNA, 22 nt, Homo sapiens
acugcacuccagccuccugaca

SEQ ID NO: 81104 - RNA, 22 nt, Homo sapiens
acugcacuccagccucggcaau

SEQ ID NO: 81105 - RNA, 22 nt, Homo sapiens
agaaccauuagagggagauauu

SEQ ID NO: 81106 - RNA, 22 nt, Homo sapiens
agagguagaagauaggcuacag

SEQ ID NO: 81107 - RNA, 22 nt, Homo sapiens
agaugauguuucuggcacauga

SEQ ID NO: 81108 - RNA, 22 nt, Homo sapiens
agauucauccaaguuguugcau

SEQ ID NO: 81109 - RNA, 17 nt, Homo sapiens
agcauguguuugagauu

SEQ ID NO: 81110 - RNA, 21 nt, Homo sapiens
aggcaaaugaagcagccgcuc

SEQ ID NO: 81111 - RNA, 22 nt, Homo sapiens
aggugcugagcagagaauccug

SEQ ID NO: 81112 - RNA, 22 nt, Homo sapiens
agguuguguuugugauuagaua

SEQ ID NO: 81113 - RNA, 22 nt, Homo sapiens
agucaagugggguuagauaguu

SEQ ID NO: 81114 - RNA, 22 nt, Homo sapiens
auaaauucauuuaagcuccuua

SEQ ID NO: 81115 - RNA, 22 nt, Homo sapiens
auacauguucaagggcauauau

SEQ ID NO: 81116 - RNA, 22 nt, Homo sapiens
auacuguacugaaguacccauu

SEQ ID NO: 81117 - RNA, 22 nt, Homo sapiens
aucacagaguuaaaacuuucuu

SEQ ID NO: 81118 - RNA, 22 nt, Homo sapiens
aucauauccuagauauaacuuc

SEQ ID NO: 81119 - RNA, 22 nt, Homo sapiens
aucgcgccauuguacuccagcc

SEQ ID NO: 81120 - RNA, 22 nt, Homo sapiens
augaaugcuuuuggauguaucu

SEQ ID NO: 81121 - RNA, 22 nt, Homo sapiens
augagagcaacaccuucacuug

SEQ ID NO: 81122 - RNA, 22 nt, Homo sapiens
augagagugagagcagccccuu

SEQ ID NO: 81123 - RNA, 22 nt, Homo sapiens
augaggaaggagccuuugucug

SEQ ID NO: 81124 - RNA, 22 nt, Homo sapiens
augagguauccaagcccagaaa

SEQ ID NO: 81125 - RNA, 22 nt, Homo sapiens
augcagaucacauuuuucuguc

SEQ ID NO: 81126 - RNA, 22 nt, Homo sapiens
augccaagagacaaagggaauc

SEQ ID NO: 81127 - RNA, 22 nt, Homo sapiens
auggcaaaaaaugcaauuacuu

SEQ ID NO: 81128 - RNA, 22 nt, Homo sapiens
auggcacugaagcguauugaca

SEQ ID NO: 81129 - RNA, 22 nt, Homo sapiens
augguauggaaggucuggagga

SEQ ID NO: 81130 - RNA, 22 nt, Homo sapiens
auguaacaguauuuggagaugu

SEQ ID NO: 81131 - RNA, 22 nt, Homo sapiens
augugggaggacuuggcuguug

SEQ ID NO: 81132 - RNA, 22 nt, Homo sapiens
auguguucaucacagcacaauu

SEQ ID NO: 81133 - RNA, 22 nt, Homo sapiens
auuacacuuucuauucaaugag

SEQ ID NO: 81134 - RNA, 22 nt, Homo sapiens
auuccacuuccacuaguuucuc

SEQ ID NO: 81135 - RNA, 22 nt, Homo sapiens
auugcacuccagccuggcaaua

SEQ ID NO: 81136 - RNA, 22 nt, Homo sapiens
auugcacuccagccugggcaac

SEQ ID NO: 81137 - RNA, 22 nt, Homo sapiens
auugcacuccagucugggcaac

SEQ ID NO: 81138 - RNA, 22 nt, Homo sapiens
caaaggcuuccacugcauccuu

SEQ ID NO: 81139 - RNA, 22 nt, Homo sapiens
caaagugcugggaugggccagg

SEQ ID NO: 81140 - RNA, 22 nt, Homo sapiens
caagaucauuuaugcuaaaauu

SEQ ID NO: 81141 - RNA, 22 nt, Homo sapiens
cacuguggauggaacuauguga

SEQ ID NO: 81142 - RNA, 22 nt, Homo sapiens
cagugcaaccuccaucucucgg

SEQ ID NO: 81143 - RNA, 22 nt, Homo sapiens
cauagcacugcacuucagccug

SEQ ID NO: 81144 - RNA, 22 nt, Homo sapiens
ccaagccucaguuucccucugu

SEQ ID NO: 81145 - RNA, 21 nt, Homo sapiens
ccaugggacggaaugaauaca

SEQ ID NO: 81146 - RNA, 22 nt, Homo sapiens
cuacacaugcaggcucccugcc

SEQ ID NO: 81147 - RNA, 23 nt, Homo sapiens
cuacagugccugucucuuuggcc

SEQ ID NO: 81148 - RNA, 22 nt, Homo sapiens
cuauggcagccacggccuggag

SEQ ID NO: 81149 - RNA, 22 nt, Homo sapiens
cucacaguucuaaaggcaagaa

SEQ ID NO: 81150 - RNA, 22 nt, Homo sapiens
cugagagaugagaccucucacu

SEQ ID NO: 81151 - RNA, 22 nt, Homo sapiens
cugagcaaagaagugauaauga

SEQ ID NO: 81152 - RNA, 22 nt, Homo sapiens
cuggaaucuauggauaacaucg

SEQ ID NO: 81153 - RNA, 22 nt, Homo sapiens
cuuuguguaggugccucuggcu

SEQ ID NO: 81154 - RNA, 22 nt, Homo sapiens
gacugaggaagcgcucucuccu

SEQ ID NO: 81155 - RNA, 22 nt, Homo sapiens
gagguaugugggcagacauuua

SEQ ID NO: 81156 - RNA, 22 nt, Homo sapiens
gcagcacaugacuguauguaua

SEQ ID NO: 81157 - RNA, 22 nt, Homo sapiens
gccaagaucugaauaauuaaga

SEQ ID NO: 81158 - RNA, 22 nt, Homo sapiens
gccaagaugcugcccacagaca

SEQ ID NO: 81159 - RNA, 22 nt, Homo sapiens
gccaagauugguuuaauauucc

SEQ ID NO: 81160 - RNA, 20 nt, Homo sapiens
gccacaguuaagcuucugcc

SEQ ID NO: 81161 - RNA, 22 nt, Homo sapiens
ggagggugagaucaauuuggga

SEQ ID NO: 81162 - RNA, 20 nt, Homo sapiens
ggagguuguauaaguacauc

SEQ ID NO: 81163 - RNA, 22 nt, Homo sapiens
guauggcaugcaugagaauuuc

SEQ ID NO: 81164 - RNA, 22 nt, Homo sapiens
gucuggcaauggcagacuggca

SEQ ID NO: 81165 - RNA, 22 nt, Homo sapiens
gugaacaagcaaaggcaggagg

SEQ ID NO: 81166 - RNA, 22 nt, Homo sapiens
gugagacugaguuucgcucuug

SEQ ID NO: 81167 - RNA, 22 nt, Homo sapiens
uuauggauuuauauucuguagu

SEQ ID NO: 81168 - RNA, 22 nt, Homo sapiens
uuauggcaaugccccacuccua

SEQ ID NO: 81169 - RNA, 22 nt, Homo sapiens
uuauguguuuaauguuucugaa

SEQ ID NO: 81170 - RNA, 22 nt, Homo sapiens
uucaggcuccugugagaaucua

SEQ ID NO: 81171 - RNA, 22 nt, Homo sapiens
uucaguaguacauucccguguu

SEQ ID NO: 81172 - RNA, 18 nt, Homo sapiens
uucauaguagcaugauuu

SEQ ID NO: 81173 - RNA, 22 nt, Homo sapiens
uucauaguauuuuucuccaaau

SEQ ID NO: 81174 - RNA, 20 nt, Homo sapiens
uucaugggagcaaagaggcc

SEQ ID NO: 81175 - RNA, 22 nt, Homo sapiens
uuccacagggauuugcauugau

SEQ ID NO: 81176 - RNA, 22 nt, Homo sapiens
uuccuaguccugagucucugcg

SEQ ID NO: 81177 - RNA, 22 nt, Homo sapiens
uuccuuguuuauuuacaggagg

SEQ ID NO: 81178 - RNA, 23 nt, Homo sapiens
uucuaucaggcccaggagcccug

SEQ ID NO: 81179 - RNA, 22 nt, Homo sapiens
uugaaggaggugcucacucucg

SEQ ID NO: 81180 - RNA, 22 nt, Homo sapiens
uugagagaaaaggccaugccuu

SEQ ID NO: 81181 - RNA, 22 nt, Homo sapiens
aaaugcugcuuuggccucuucu

SEQ ID NO: 81182 - RNA, 22 nt, Homo sapiens
aacagugcuguuauaaauguac

SEQ ID NO: 81183 - RNA, 22 nt, Homo sapiens
aacuggccuggcgugcagaggg

SEQ ID NO: 81184 - RNA, 23 nt, Homo sapiens
aagagguaugacuaugaagugga

SEQ ID NO: 81185 - RNA, 22 nt, Homo sapiens
aagaucauucagggaaggcuga

SEQ ID NO: 81186 - RNA, 22 nt, Homo sapiens
aaggcaagguggauaaugaagc

SEQ ID NO: 81187 - RNA, 22 nt, Homo sapiens
aaguaauggaguuauuuuauga

SEQ ID NO: 81188 - RNA, 19 nt, Homo sapiens
aauaaugccagaugucugu

SEQ ID NO: 81189 - RNA, 22 nt, Homo sapiens
aaugacccugauuggcaaguug

SEQ ID NO: 81190 - RNA, 22 nt, Homo sapiens
aauucacuucuuuuaggcaggg

SEQ ID NO: 81191 - RNA, 22 nt, Homo sapiens
aauugguuaagauaagaucaua

SEQ ID NO: 81192 - RNA, 22 nt, Homo sapiens
acacaguguuuauugugguuag

SEQ ID NO: 81193 - RNA, 20 nt, Homo sapiens
acacugugcuaaggauuuuc

SEQ ID NO: 81194 - RNA, 22 nt, Homo sapiens
acaucacuguuugauugauuga

SEQ ID NO: 81195 - RNA, 22 nt, Homo sapiens
acugaauguaaacacggagugu

SEQ ID NO: 81196 - RNA, 22 nt, Homo sapiens
acugagccuuuaaaugacuuca

SEQ ID NO: 81197 - RNA, 18 nt, Homo sapiens
acugcacuccaccuuggg

SEQ ID NO: 81198 - RNA, 22 nt, Homo sapiens
acugcacuccagccugaugaaa

SEQ ID NO: 81199 - RNA, 22 nt, Homo sapiens
acugcacuccaguuugggcagc

SEQ ID NO: 81200 - RNA, 22 nt, Homo sapiens
acuguacucuacccugggcaac

SEQ ID NO: 81201 - RNA, 21 nt, Homo sapiens
acuuucuguggcaguccauuc

SEQ ID NO: 81202 - RNA, 22 nt, Homo sapiens
agagguaagcaguggcaagugc

SEQ ID NO: 81203 - RNA, 21 nt, Homo sapiens
agccaguguuccuuguggcuc

SEQ ID NO: 81204 - RNA, 20 nt, Homo sapiens
agccccauguaaaccacaug

SEQ ID NO: 81205 - RNA, 22 nt, Homo sapiens
agcuccaugauaguaugucugu

SEQ ID NO: 81206 - RNA, 22 nt, Homo sapiens
agcuccuacuguuacaucauug

SEQ ID NO: 81207 - RNA, 22 nt, Homo sapiens
agcugccagucuuguaaggccu

SEQ ID NO: 81208 - RNA, 22 nt, Homo sapiens
aggagguagggugugaaacagc

SEQ ID NO: 81209 - RNA, 22 nt, Homo sapiens
aggcaaaugccagcaaucacac

SEQ ID NO: 81210 - RNA, 22 nt, Homo sapiens
aguggaaucuguuauacuaacu

SEQ ID NO: 81211 - RNA, 22 nt, Homo sapiens
aguugcaagucuugaguaaaga

SEQ ID NO: 81212 - RNA, 22 nt, Homo sapiens
auaaagcaagucucuggccuca

SEQ ID NO: 81213 - RNA, 22 nt, Homo sapiens
auaacauccuuucuuaucguug

SEQ ID NO: 81214 - RNA, 22 nt, Homo sapiens
auagcagcaccccacuaccuca

SEQ ID NO: 81215 - RNA, 22 nt, Homo sapiens
auaucacucccaauaucgcagg

SEQ ID NO: 81216 - RNA, 22 nt, Homo sapiens
auaucagugucuuacuguuuuu

SEQ ID NO: 81217 - RNA, 22 nt, Homo sapiens
aucgcaccauugcacuccagca

SEQ ID NO: 81218 - RNA, 22 nt, Homo sapiens
augaagugcaugauaguugguu

SEQ ID NO: 81219 - RNA, 22 nt, Homo sapiens
augagaugaggaauggcccucc

SEQ ID NO: 81220 - RNA, 22 nt, Homo sapiens
augagggcggacgcccuggaga

SEQ ID NO: 81221 - RNA, 23 nt, Homo sapiens
augagguaucugagcccagaaau

SEQ ID NO: 81222 - RNA, 22 nt, Homo sapiens
augcagagucccagccccuagc

SEQ ID NO: 81223 - RNA, 22 nt, Homo sapiens
augucaacauagacaguagagu

SEQ ID NO: 81224 - RNA, 22 nt, Homo sapiens
augugcuuuuuaaacagaugcu

SEQ ID NO: 81225 - RNA, 22 nt, Homo sapiens
auuaaguaaugguuccaauaau

SEQ ID NO: 81226 - RNA, 22 nt, Homo sapiens
auugaacuguuggagagguuuu

SEQ ID NO: 81227 - RNA, 22 nt, Homo sapiens
auugcacuccacccugggcaac

SEQ ID NO: 81228 - RNA, 22 nt, Homo sapiens
auugcacuccagccugggcagc

SEQ ID NO: 81229 - RNA, 22 nt, Homo sapiens
auugcacuccagccuugugaca

SEQ ID NO: 81230 - RNA, 22 nt, Homo sapiens
caaaagugguucuuauccuuuu

SEQ ID NO: 81231 - RNA, 19 nt, Homo sapiens
caaaguguucuucuuugcc

SEQ ID NO: 81232 - RNA, 22 nt, Homo sapiens
gugagggaugugaaaaagguca

SEQ ID NO: 81233 - RNA, 22 nt, Homo sapiens
gugcaagagugacugcaguuuu

SEQ ID NO: 81234 - RNA, 22 nt, Homo sapiens
guggaauauaaagcaucgugua

SEQ ID NO: 81235 - RNA, 22 nt, Homo sapiens
guggaaucuagagaggcaguag

SEQ ID NO: 81236 - RNA, 22 nt, Homo sapiens
guggagcuguguggccuugggc

SEQ ID NO: 81237 - RNA, 22 nt, Homo sapiens
guguaugugagaaugcucaugu

SEQ ID NO: 81238 - RNA, 22 nt, Homo sapiens
guguccucgaguacacaucagg

SEQ ID NO: 81239 - RNA, 22 nt, Homo sapiens
guucagguauucuggaacagag

SEQ ID NO: 81240 - RNA, 18 nt, Homo sapiens
uaacagucucucaggauc

SEQ ID NO: 81241 - RNA, 22 nt, Homo sapiens
uaacaguguauuccuuuggaca

SEQ ID NO: 81242 - RNA, 22 nt, Homo sapiens
uaaggcacauaggccuggaaac

SEQ ID NO: 81243 - RNA, 22 nt, Homo sapiens
uaauugcaguucuguguuauau

SEQ ID NO: 81244 - RNA, 22 nt, Homo sapiens
uacguuaucagguaugcaagag

SEQ ID NO: 81245 - RNA, 22 nt, Homo sapiens
uagguaguugugggcuugaaug

SEQ ID NO: 81246 - RNA, 20 nt, Homo sapiens
uaugaaacaguguagagcaa

SEQ ID NO: 81247 - RNA, 22 nt, Homo sapiens
uauggcauuauuuugauagaca

SEQ ID NO: 81248 - RNA, 22 nt, Homo sapiens
uauggcauuguuggugaugaua

SEQ ID NO: 81249 - RNA, 22 nt, Homo sapiens
uauucacuguaucauugauggg

SEQ ID NO: 81250 - RNA, 23 nt, Homo sapiens
ucacaguggcugcuuaauuguga

SEQ ID NO: 81251 - RNA, 22 nt, Homo sapiens
ucauaguagucacuuaauaaau

SEQ ID NO: 81252 - RNA, 21 nt, Homo sapiens
ucauauguaucuuugugccuc

SEQ ID NO: 81253 - RNA, 23 nt, Homo sapiens
ucaugaggccauucaaauccauu

SEQ ID NO: 81254 - RNA, 22 nt, Homo sapiens
uccacaauggcugaacuagauu

SEQ ID NO: 81255 - RNA, 17 nt, Homo sapiens
ucccauguuucuucuac

SEQ ID NO: 81256 - RNA, 22 nt, Homo sapiens
ucgcaccauugcacuccagcca

SEQ ID NO: 81257 - RNA, 22 nt, Homo sapiens
ucucagugaauguggaaaaagc

SEQ ID NO: 81258 - RNA, 22 nt, Homo sapiens
ucucagugaauugguuuugucu

SEQ ID NO: 81259 - RNA, 22 nt, Homo sapiens
ucucagugugguaaaaguuuuu

SEQ ID NO: 81260 - RNA, 20 nt, Homo sapiens
ucucccaaacagcaggcccu

SEQ ID NO: 81261 - RNA, 22 nt, Homo sapiens
ucuggcaagagccgagggcagu

SEQ ID NO: 81262 - RNA, 22 nt, Homo sapiens
ucuggccuagaacaauuaauua

SEQ ID NO: 81263 - RNA, 22 nt, Homo sapiens
ugaaggacauaaggcagaguga

SEQ ID NO: 81264 - RNA, 22 nt, Homo sapiens
ugagaauauuuuccaugucuca

SEQ ID NO: 81265 - RNA, 22 nt, Homo sapiens
cacauguuuuagcauggcuguu

SEQ ID NO: 81266 - RNA, 22 nt, Homo sapiens
cacauugcaggaaaguucauua

SEQ ID NO: 81267 - RNA, 22 nt, Homo sapiens
cagcugaugucgaaugcacucu

SEQ ID NO: 81268 - RNA, 22 nt, Homo sapiens
cagucacagugacaggaugugg

SEQ ID NO: 81269 - RNA, 22 nt, Homo sapiens
cauagcacugagcucuacccuc

SEQ ID NO: 81270 - RNA, 18 nt, Homo sapiens
cauagcacuucagcacau

SEQ ID NO: 81271 - RNA, 21 nt, Homo sapiens
caucacauuacucaaaguccu

SEQ ID NO: 81272 - RNA, 22 nt, Homo sapiens
cauggcacugagcagguaugca

SEQ ID NO: 81273 - RNA, 22 nt, Homo sapiens
cauggcacuguaugaaaugugc

SEQ ID NO: 81274 - RNA, 22 nt, Homo sapiens
ccacaguggauuaaaguuacug

SEQ ID NO: 81275 - RNA, 22 nt, Homo sapiens
ccaucacacugugauuauuauc

SEQ ID NO: 81276 - RNA, 22 nt, Homo sapiens
ccaucacaggccucagugggaa

SEQ ID NO: 81277 - RNA, 22 nt, Homo sapiens
ccauggcaauggucagucuauu

SEQ ID NO: 81278 - RNA, 22 nt, Homo sapiens
ccuaggcacugggguccagccc

SEQ ID NO: 81279 - RNA, 22 nt, Homo sapiens
cuaaggaaggacugaaaggaca

SEQ ID NO: 81280 - RNA, 22 nt, Homo sapiens
cucacugucaacauguauuugg

SEQ ID NO: 81281 - RNA, 22 nt, Homo sapiens
uuccuucaugcuugaaggguau

SEQ ID NO: 81282 - RNA, 22 nt, Homo sapiens
uucuaugguuuuuaugguguua

SEQ ID NO: 81283 - RNA, 22 nt, Homo sapiens
uugaggaaugucauuuguguuu

SEQ ID NO: 81284 - RNA, 22 nt, Homo sapiens
uugugauggugcauacugagcu

SEQ ID NO: 81285 - RNA, 22 nt, Homo sapiens
uuucauggacgcaaugccuuuu

SEQ ID NO: 81286 - RNA, 22 nt, Homo sapiens
uuugguuauauauauacacucu

SEQ ID NO: 81287 - RNA, 22 nt, Homo sapiens
ugagagacaguuucgucggagg

SEQ ID NO: 81288 - RNA, 22 nt, Homo sapiens
ugagaugaugggauaagagggc

SEQ ID NO: 81289 - RNA, 18 nt, Homo sapiens
ugaggaaaggguuugcua

SEQ ID NO: 81290 - RNA, 22 nt, Homo sapiens
ugagguaacaaacuaugaguua

SEQ ID NO: 81291 - RNA, 22 nt, Homo sapiens
ugagguaagauguucauuuuuc

SEQ ID NO: 81292 - RNA, 22 nt, Homo sapiens
ugagugaggcugggcagucccu

SEQ ID NO: 81293 - RNA, 22 nt, Homo sapiens
ugauaugaaguuagcuggcugu

SEQ ID NO: 81294 - RNA, 22 nt, Homo sapiens
ugcaagaaacauauuccacaag

SEQ ID NO: 81295 - RNA, 21 nt, Homo sapiens
ugcauggagaacacugagggu

SEQ ID NO: 81296 - RNA, 19 nt, Homo sapiens
ugccaagaaagucagcuua

SEQ ID NO: 81297 - RNA, 22 nt, Homo sapiens
ugccaguauuuuacugaggauu

SEQ ID NO: 81298 - RNA, 22 nt, Homo sapiens
ugccugagcccagcccuguagu

SEQ ID NO: 81299 - RNA, 22 nt, Homo sapiens
uggaagacuuuagaggcuuaua

SEQ ID NO: 81300 - RNA, 22 nt, Homo sapiens
uggagguaggacgaagaacucu

SEQ ID NO: 81301 - RNA, 22 nt, Homo sapiens
uggcaaaugaagucagcuguac

SEQ ID NO: 81302 - RNA, 21 nt, Homo sapiens
uggcacuauucacaauagcaa

SEQ ID NO: 81303 - RNA, 22 nt, Homo sapiens
uggccagagggcaauuagcugu

SEQ ID NO: 81304 - RNA, 20 nt, Homo sapiens
ugguaauguaagagaggaga

SEQ ID NO: 81305 - RNA, 22 nt, Homo sapiens
ugucaugucuuuguguaucaau

SEQ ID NO: 81306 - RNA, 22 nt, Homo sapiens
ugucuaaagaauggcagacuca

SEQ ID NO: 81307 - RNA, 22 nt, Homo sapiens
uguggucaucacuugaagguaa

SEQ ID NO: 81308 - RNA, 22 nt, Homo sapiens
uguucuggagccgguucaaaug

SEQ ID NO: 81309 - RNA, 22 nt, Homo sapiens
uuaaggcuuguacuuguuuucu

SEQ ID NO: 81310 - RNA, 22 nt, Homo sapiens
uuacagcagugccccacuccca

SEQ ID NO: 81311 - RNA, 22 nt, Homo sapiens
uuaguaguaguuugcauuuacc

SEQ ID NO: 81312 - RNA, 18 nt, Homo sapiens
uuauacuccccaggcaau

SEQ ID NO: 81313 - RNA, 22 nt, Homo sapiens
uucaggguggagaguaugaggu

SEQ ID NO: 81314 - RNA, 18 nt, Homo sapiens
uucaguuuguaucugggg

SEQ ID NO: 81315 - RNA, 22 nt, Homo sapiens
uucauagucacauucgaugucu

SEQ ID NO: 81316 - RNA, 21 nt, Homo sapiens
uucaucagccagaaaucaagc

SEQ ID NO: 81317 - RNA, 22 nt, Homo sapiens
uucauggaugcauuugaggggu

SEQ ID NO: 81318 - RNA, 22 nt, Homo sapiens
uucccuuuuuucuaguagguag

SEQ ID NO: 81319 - RNA, 22 nt, Homo sapiens
uucuaaacaucuuacaaugcau

SEQ ID NO: 81320 - RNA, 22 nt, Homo sapiens
uugaggaguacugauuagguau

SEQ ID NO: 81321 - RNA, 22 nt, Homo sapiens
uugagggaagccagaggucugc

SEQ ID NO: 81322 - RNA, 22 nt, Homo sapiens
uuucauggaggauuugcuucuu

SEQ ID NO: 81323 - RNA, 22 nt, Homo sapiens
uuucugggggugcugauggaaa

SEQ ID NO: 81324 - RNA, 22 nt, Homo sapiens
uuuuaguggacaaagguauuua

SEQ ID NO: 81325 - RNA, 22 nt, Homo sapiens
gugcaagagugauugcaguuuu

SEQ ID NO: 81326 - RNA, 22 nt, Homo sapiens
uuggauauucaguuuuuccauc

SEQ ID NO: 81327 - RNA, 22 nt, Homo sapiens
uuggcaaagugucuggcauuua

SEQ ID NO: 81328 - RNA, 22 nt, Homo sapiens
uuggcagucugaggcacagacu

SEQ ID NO: 81329 - RNA, 22 nt, Homo sapiens
uuggcauugaguuucaaaucau

SEQ ID NO: 81330 - RNA, 22 nt, Homo sapiens
uuggccccucccaaauuucaug

SEQ ID NO: 81331 - RNA, 23 nt, Homo sapiens
uuggccuccuugugucuagggcu

SEQ ID NO: 81332 - RNA, 21 nt, Homo sapiens
uuggccuggaggccugaaugu

SEQ ID NO: 81333 - RNA, 22 nt, Homo sapiens
uuggcuucuggacuauugugca

SEQ ID NO: 81334 - RNA, 21 nt, Homo sapiens
uuggggaauggagagguuuuc

SEQ ID NO: 81335 - RNA, 22 nt, Homo sapiens
uugguaguuucugucuuuagau

SEQ ID NO: 81336 - RNA, 22 nt, Homo sapiens
uuggucagcucaauggagaggg

SEQ ID NO: 81337 - RNA, 22 nt, Homo sapiens
uuguaaacaucuguacauugcu

SEQ ID NO: 81338 - RNA, 22 nt, Homo sapiens
uuguaaucaacacaucauuggg

SEQ ID NO: 81339 - RNA, 22 nt, Homo sapiens
uuguaauguuaggguguccaug

SEQ ID NO: 81340 - RNA, 22 nt, Homo sapiens
uuguagaucuucaguugcuaca

SEQ ID NO: 81341 - RNA, 22 nt, Homo sapiens
uuguaguguuuauucugucaac

SEQ ID NO: 81342 - RNA, 22 nt, Homo sapiens
uuguauaguucuauguguuuug

SEQ ID NO: 81343 - RNA, 21 nt, Homo sapiens
uuguaugguugaacuugauac

SEQ ID NO: 81344 - RNA, 22 nt, Homo sapiens
uugucacugcacuccagucugg

SEQ ID NO: 81345 - RNA, 22 nt, Homo sapiens
uuguccccuuccaaaucucaug

SEQ ID NO: 81346 - RNA, 22 nt, Homo sapiens
uuguccuccacauuugaucagu

SEQ ID NO: 81347 - RNA, 22 nt, Homo sapiens
uuguccuggagguucuugcaag

SEQ ID NO: 81348 - RNA, 22 nt, Homo sapiens
uugucuugcagcuuaggcauca

SEQ ID NO: 81349 - RNA, 21 nt, Homo sapiens
uugugccaaacccuggaggga

SEQ ID NO: 81350 - RNA, 22 nt, Homo sapiens
uugugguuuucagcuuauauau

SEQ ID NO: 81351 - RNA, 22 nt, Homo sapiens
uuguguuuuuaguagggaaggg

SEQ ID NO: 81352 - RNA, 22 nt, Homo sapiens
uuuaaagcaugacgagaagaag

SEQ ID NO: 81353 - RNA, 22 nt, Homo sapiens
uuuaaagcuccaagcaugucug

SEQ ID NO: 81354 - RNA, 22 nt, Homo sapiens
uuuaaugcgucucugaguuuug

SEQ ID NO: 81355 - RNA, 22 nt, Homo sapiens
uuuaaugcugcccagucauggg

SEQ ID NO: 81356 - RNA, 22 nt, Homo sapiens
uuuagcaaugcuguggggaagu

SEQ ID NO: 81357 - RNA, 22 nt, Homo sapiens
uuuaggcaugcaguucuauuua

SEQ ID NO: 81358 - RNA, 22 nt, Homo sapiens
uuuagggcaggccuggugguga

SEQ ID NO: 81359 - RNA, 22 nt, Homo sapiens
uuuagguauuugguauagcagu

SEQ ID NO: 81360 - RNA, 22 nt, Homo sapiens
uuuauccagccucuagcaaggu

SEQ ID NO: 81361 - RNA, 22 nt, Homo sapiens
uuucacagagggcuucuuucua

SEQ ID NO: 81362 - RNA, 22 nt, Homo sapiens
uuucauggaggcauuuuagauu

SEQ ID NO: 81363 - RNA, 22 nt, Homo sapiens
uuuccacauggacuuaccuucg

SEQ ID NO: 81364 - RNA, 19 nt, Homo sapiens
uuuccaguaaucuuaugug

SEQ ID NO: 81365 - RNA, 22 nt, Homo sapiens
uuucccuuacuuaaacuuacuc

SEQ ID NO: 81366 - RNA, 22 nt, Homo sapiens
uuucccuuuagcuuagugauuu

SEQ ID NO: 81367 - RNA, 22 nt, Homo sapiens
uuucccuuugcuuugucagcca

SEQ ID NO: 81368 - RNA, 22 nt, Homo sapiens
uuuccuggagaaucuuaacaaa

SEQ ID NO: 81369 - RNA, 22 nt, Homo sapiens
uuucgguuaucuagcuuuauga

SEQ ID NO: 81370 - RNA, 22 nt, Homo sapiens
uuucuacagggcuugccaggua

SEQ ID NO: 81371 - RNA, 22 nt, Homo sapiens
uuugaagacuacugggagugaa

SEQ ID NO: 81372 - RNA, 22 nt, Homo sapiens
uuugagaaugcuaccagagaag

SEQ ID NO: 81373 - RNA, 22 nt, Homo sapiens
uuugagcaagaggugacauuau

SEQ ID NO: 81374 - RNA, 22 nt, Homo sapiens
uuugcacucaguaagugggagc

SEQ ID NO: 81375 - RNA, 22 nt, Homo sapiens
uuugcacuggagauucaauggg

SEQ ID NO: 81376 - RNA, 22 nt, Homo sapiens
uuugcacuugaaaacacucuca

SEQ ID NO: 81377 - RNA, 22 nt, Homo sapiens
uuugcacuuuaauauaauguga

SEQ ID NO: 81378 - RNA, 20 nt, Homo sapiens
uuugcagaaucuaagaagag

SEQ ID NO: 81379 - RNA, 22 nt, Homo sapiens
uuugcaucuuagaaaguucucc

SEQ ID NO: 81380 - RNA, 22 nt, Homo sapiens
uuugccuuugugauauggucua

SEQ ID NO: 81381 - RNA, 22 nt, Homo sapiens
uuugcugagucauuccaugcug

SEQ ID NO: 81382 - RNA, 22 nt, Homo sapiens
uuuggcaauuugacuguauagg

SEQ ID NO: 81383 - RNA, 22 nt, Homo sapiens
uuuggcauauuuuaagcugguu

SEQ ID NO: 81384 - RNA, 21 nt, Homo sapiens
uuuggcauuaugucaccagag

SEQ ID NO: 81385 - RNA, 21 nt, Homo sapiens
uuuggcuucucugcugcagcc

SEQ ID NO: 81386 - RNA, 22 nt, Homo sapiens
uuugggccucugauuucuuugg

SEQ ID NO: 81387 - RNA, 18 nt, Homo sapiens
uuugguccuuuauaaaca

SEQ ID NO: 81388 - RNA, 22 nt, Homo sapiens
uuugucacucuuggagguuguu

SEQ ID NO: 81389 - RNA, 22 nt, Homo sapiens
uuuguccugccaugguuuauuu

SEQ ID NO: 81390 - RNA, 22 nt, Homo sapiens
uuuugcaggcauuggaaguuua

SEQ ID NO: 81391 - RNA, 22 nt, Homo sapiens
uuuugcaguuacagagagugag

SEQ ID NO: 81392 - RNA, 22 nt, Homo sapiens
uuuugcauuggcugaggagugu

SEQ ID NO: 81393 - RNA, 22 nt, Homo sapiens
uuuuggcuagaaauauaccucc

SEQ ID NO: 81394 - RNA, 22 nt, Homo sapiens
uuuuggcucugucuguaucuuu

SEQ ID NO: 81395 - RNA, 22 nt, Homo sapiens
uuuuggcucuugguaggucaga

SEQ ID NO: 81396 - RNA, 22 nt, Homo sapiens
uuuuggcuuaaagagaauguau

SEQ ID NO: 81397 - RNA, 20 nt, Homo sapiens
uuuuggcuuaaagcagucug

SEQ ID NO: 81398 - RNA, 22 nt, Homo sapiens
uuuugguguacaauucuaugga

SEQ ID NO: 81399 - RNA, 22 nt, Homo sapiens
uuuugguguauuguauaaggua

SEQ ID NO: 81400 - RNA, 16 nt, Homo sapiens
uuuuugcagaaaugac

SEQ ID NO: 81401 - RNA, 22 nt, Homo sapiens
uuuuuggaggagguuagaucau

SEQ ID NO: 81402 - RNA, 22 nt, Homo sapiens
uuuuuugguaauugaacaauga

SEQ ID NO: 81403 - RNA, 22 nt, Homo sapiens
cucuggauauuccugucuaaaa

SEQ ID NO: 81404 - RNA, 22 nt, Homo sapiens
cucuuggguagauuuugcagag

SEQ ID NO: 81405 - RNA, 22 nt, Homo sapiens
cucuuuaguaagcaguugauga

SEQ ID NO: 81406 - RNA, 22 nt, Homo sapiens
cucuuugaugugaaccgugguu

SEQ ID NO: 81407 - RNA, 22 nt, Homo sapiens
cugaaagagcauuugaaugggu

SEQ ID NO: 81408 - RNA, 22 nt, Homo sapiens
cugaaucauugcauuaucaagg

SEQ ID NO: 81409 - RNA, 22 nt, Homo sapiens
cugagauaauuucuagguguca

SEQ ID NO: 81410 - RNA, 22 nt, Homo sapiens
cugagauaggacucugcuggcu

SEQ ID NO: 81411 - RNA, 22 nt, Homo sapiens
cugagauggagucucgcauugu

SEQ ID NO: 81412 - RNA, 22 nt, Homo sapiens
cugaggacaucagggaagcauc

SEQ ID NO: 81413 - RNA, 20 nt, Homo sapiens
cugagguacgaggguuaaau

SEQ ID NO: 81414 - RNA, 22 nt, Homo sapiens
cugagguacugggggccaggau

SEQ ID NO: 81415 - RNA, 20 nt, Homo sapiens
cugaggugggagaaucgcuu

SEQ ID NO: 81416 - RNA, 20 nt, Homo sapiens
cugcaaaugcugcugcugau

SEQ ID NO: 81417 - RNA, 20 nt, Homo sapiens
cugcuccccuacaaaucuca

SEQ ID NO: 81418 - RNA, 22 nt, Homo sapiens
cuggaaucuagaaaagguaagg

SEQ ID NO: 81419 - RNA, 22 nt, Homo sapiens
cuggaauguuccuaaagauuca

SEQ ID NO: 81420 - RNA, 22 nt, Homo sapiens
cuggaauucaaaaucugaauuu

SEQ ID NO: 81421 - RNA, 22 nt, Homo sapiens
cuggagaucuugacauugaagu

SEQ ID NO: 81422 - RNA, 22 nt, Homo sapiens
cuggagcaaaggugacucuugu

SEQ ID NO: 81423 - RNA, 22 nt, Homo sapiens
cuggagcauugguggauuuguu

SEQ ID NO: 81424 - RNA, 22 nt, Homo sapiens
cuggcaaaaagagggcaauaau

SEQ ID NO: 81425 - RNA, 22 nt, Homo sapiens
cuggcaaauaguagagccagga

SEQ ID NO: 81426 - RNA, 19 nt, Homo sapiens
cuggcaaaugcuuuggcca

SEQ ID NO: 81427 - RNA, 22 nt, Homo sapiens
cuggcaaauguuuucuguaaag

SEQ ID NO: 81428 - RNA, 22 nt, Homo sapiens
cuggcaagaggauaaaguccua

SEQ ID NO: 81429 - RNA, 22 nt, Homo sapiens
cuggcacccuugcuuaggaaga

SEQ ID NO: 81430 - RNA, 22 nt, Homo sapiens
aaaaugcugauauugggcccca

SEQ ID NO: 81431 - RNA, 20 nt, Homo sapiens
aaacucugucuucuuuauca

SEQ ID NO: 81432 - RNA, 22 nt, Homo sapiens
aaagcuaccagauucuguugga

SEQ ID NO: 81433 - RNA, 22 nt, Homo sapiens
aaaggcacugaucuuauccagu

SEQ ID NO: 81434 - RNA, 22 nt, Homo sapiens
aaagggcuuuguaaacuucaag

SEQ ID NO: 81435 - RNA, 22 nt, Homo sapiens
aaagguaguacuucuagaaggg

SEQ ID NO: 81436 - RNA, 22 nt, Homo sapiens
aaaguaauugcaguuuuugcaa

SEQ ID NO: 81437 - RNA, 22 nt, Homo sapiens
aaagugacuuagugccccauuu

SEQ ID NO: 81438 - RNA, 18 nt, Homo sapiens
aaagugaugucauucuuu

SEQ ID NO: 81439 - RNA, 22 nt, Homo sapiens
aaagugauguccaggcuuucag

SEQ ID NO: 81440 - RNA, 22 nt, Homo sapiens
aaaguucuguugauagugcuga

SEQ ID NO: 81441 - RNA, 22 nt, Homo sapiens
aaaugcacaaagauuuugcacu

SEQ ID NO: 81442 - RNA, 22 nt, Homo sapiens
aaaugcuuucuuggaccauuug

SEQ ID NO: 81443 - RNA, 22 nt, Homo sapiens
aaaugguguuaguagaucuuua

SEQ ID NO: 81444 - RNA, 22 nt, Homo sapiens
aaauucaucaaaugguuuguau

SEQ ID NO: 81445 - RNA, 22 nt, Homo sapiens
aaauugcaaugcgaggcagagg

SEQ ID NO: 81446 - RNA, 22 nt, Homo sapiens
aaauugcuuuugaagacuuagu

SEQ ID NO: 81447 - RNA, 22 nt, Homo sapiens
aaaagcauucagagugcugggc

SEQ ID NO: 81448 - RNA, 22 nt, Homo sapiens
aaaagugguguuguuucuaaau

SEQ ID NO: 81449 - RNA, 22 nt, Homo sapiens
aaacauugaccucauccuggca

SEQ ID NO: 81450 - RNA, 22 nt, Homo sapiens
aaacugcuuuccaugguggcug

SEQ ID NO: 81451 - RNA, 22 nt, Homo sapiens
aaagagaucuaugggcacuaug

SEQ ID NO: 81452 - RNA, 22 nt, Homo sapiens
aaagcuagagaagcugcuguca

SEQ ID NO: 81453 - RNA, 22 nt, Homo sapiens
aaagucacuggagaaggaauau

SEQ ID NO: 81454 - RNA, 22 nt, Homo sapiens
aaauaacugucagguucuggaa

SEQ ID NO: 81455 - RNA, 22 nt, Homo sapiens
aaauccauuuguucagcuaugc

SEQ ID NO: 81456 - RNA, 22 nt, Homo sapiens
aaaugcccuaaaauggagcauc

SEQ ID NO: 81457 - RNA, 20 nt, Homo sapiens
aaaugcuguaauguuuggga

SEQ ID NO: 81458 - RNA, 22 nt, Homo sapiens
aaaugcuguuccaggaccuauc

SEQ ID NO: 81459 - RNA, 22 nt, Homo sapiens
aaauucauuucagcucugggua

SEQ ID NO: 81460 - RNA, 22 nt, Homo sapiens
aaauuguccuauugguuuaagc

SEQ ID NO: 81461 - RNA, 22 nt, Homo sapiens
aacacuguuuccagucaugauc

SEQ ID NO: 81462 - RNA, 22 nt, Homo sapiens
aacagcauaguacccgugauaa

SEQ ID NO: 81463 - RNA, 22 nt, Homo sapiens
aacagugccugucauuuaguag

SEQ ID NO: 81464 - RNA, 22 nt, Homo sapiens
aacauagucaugggguaauguu

SEQ ID NO: 81465 - RNA, 22 nt, Homo sapiens
aaccuacauucuuaacuguugc

SEQ ID NO: 81466 - RNA, 22 nt, Homo sapiens
aacuacaucucuuugaggcagg

SEQ ID NO: 81467 - RNA, 22 nt, Homo sapiens
aacuggcacuacaucaagagcu

SEQ ID NO: 81468 - RNA, 22 nt, Homo sapiens
aacugguauuucccaugaauuu

SEQ ID NO: 81469 - RNA, 20 nt, Homo sapiens
aagacacuguccccacugga

SEQ ID NO: 81470 - RNA, 22 nt, Homo sapiens
aagagagcuaugugcauaauua

SEQ ID NO: 81471 - RNA, 22 nt, Homo sapiens
aagauaguaaacauuuucugcu

SEQ ID NO: 81472 - RNA, 22 nt, Homo sapiens
aagaugauguucuuuuucuuag

SEQ ID NO: 81473 - RNA, 22 nt, Homo sapiens
aagaugcagucauacuggagga

SEQ ID NO: 81474 - RNA, 22 nt, Homo sapiens
aagcagauguguugaaaguacu

SEQ ID NO: 81475 - RNA, 22 nt, Homo sapiens
aagcuggagugcaguggugcga

SEQ ID NO: 81476 - RNA, 22 nt, Homo sapiens
aagcuggauuuaguguggagca

SEQ ID NO: 81477 - RNA, 22 nt, Homo sapiens
aagcuggauuucgcauccuguu

SEQ ID NO: 81478 - RNA, 22 nt, Homo sapiens
aagcuggcauucauucguucuu

SEQ ID NO: 81479 - RNA, 22 nt, Homo sapiens
aagcuguguguaagcucucaca

SEQ ID NO: 81480 - RNA, 22 nt, Homo sapiens
aaggcucuuucaacguaaauua

SEQ ID NO: 81481 - RNA, 22 nt, Homo sapiens
aaguagcuggaugcaguggcac

SEQ ID NO: 81482 - RNA, 19 nt, Homo sapiens
aaguaguugugacagaugc

SEQ ID NO: 81483 - RNA, 22 nt, Homo sapiens
aaguauuaugaguccuuguuuu

SEQ ID NO: 81484 - RNA, 22 nt, Homo sapiens
aagugacuagacuaugaaaccu

SEQ ID NO: 81485 - RNA, 22 nt, Homo sapiens
aagugcacuguaagugcaggau

SEQ ID NO: 81486 - RNA, 22 nt, Homo sapiens
aagugccauguggaugggcccu

SEQ ID NO: 81487 - RNA, 22 nt, Homo sapiens
aagugcuuacagggaacaugau

SEQ ID NO: 81488 - RNA, 22 nt, Homo sapiens
aaguggcauugaggaaaaaaau

SEQ ID NO: 81489 - RNA, 19 nt, Homo sapiens
aagugguuuaaacuuguau

SEQ ID NO: 81490 - RNA, 22 nt, Homo sapiens
aagugucagaguugcuaaugac

SEQ ID NO: 81491 - RNA, 21 nt, Homo sapiens
aauaaagcaaccuuaugccau

SEQ ID NO: 81492 - RNA, 22 nt, Homo sapiens
aauaaagcauggcuacuccaua

SEQ ID NO: 81493 - RNA, 22 nt, Homo sapiens
aauaaagcugaauccuuccuga

SEQ ID NO: 81494 - RNA, 22 nt, Homo sapiens
aauaaaguaggaggugaggaaa

SEQ ID NO: 81495 - RNA, 22 nt, Homo sapiens
aauaaguugagaugaggucaua

SEQ ID NO: 81496 - RNA, 22 nt, Homo sapiens
aauacugaaaguauuuucaaau

SEQ ID NO: 81497 - RNA, 22 nt, Homo sapiens
aauaucacaguuggguguacac

SEQ ID NO: 81498 - RNA, 22 nt, Homo sapiens
aaucacauugaaucugcuaccu

SEQ ID NO: 81499 - RNA, 22 nt, Homo sapiens
aaucacuuuggcaccaaccuaa

SEQ ID NO: 81500 - RNA, 22 nt, Homo sapiens
aaucagauuccagugguuggaa

SEQ ID NO: 81501 - RNA, 17 nt, Homo sapiens
aaucagauuucugagga

SEQ ID NO: 81502 - RNA, 22 nt, Homo sapiens
aaucagcacacugugcuuucca

SEQ ID NO: 81503 - RNA, 22 nt, Homo sapiens
aaucugucuagacaaggagucu

SEQ ID NO: 81504 - RNA, 22 nt, Homo sapiens
aaugacagccagauucuucucu

SEQ ID NO: 81505 - RNA, 22 nt, Homo sapiens
aaugacuaagaugguacauuuu

SEQ ID NO: 81506 - RNA, 22 nt, Homo sapiens
aaugauauguuauguuuagguu

SEQ ID NO: 81507 - RNA, 18 nt, Homo sapiens
aaugggacuacaaagcca

SEQ ID NO: 81508 - RNA, 22 nt, Homo sapiens
aauuacuucuacaccaaccuaa

SEQ ID NO: 81509 - RNA, 22 nt, Homo sapiens
aauugcauaaaauucaacucug

SEQ ID NO: 81510 - RNA, 22 nt, Homo sapiens
aauugcauaugcaguagaucua

SEQ ID NO: 81511 - RNA, 22 nt, Homo sapiens
acacagucaaauccacuuggcu

SEQ ID NO: 81512 - RNA, 22 nt, Homo sapiens
acacucuaguguucuuaaucag

SEQ ID NO: 81513 - RNA, 20 nt, Homo sapiens
acacugugcuaaggauuuuc

SEQ ID NO: 81514 - RNA, 22 nt, Homo sapiens
acacuguuuuguggagaaugua

SEQ ID NO: 81515 - RNA, 19 nt, Homo sapiens
acagcugguuuugguuucu

SEQ ID NO: 81516 - RNA, 22 nt, Homo sapiens
acagguacacagaauauccaga

SEQ ID NO: 81517 - RNA, 22 nt, Homo sapiens
acaguacaugauaaauaaggua

SEQ ID NO: 81518 - RNA, 20 nt, Homo sapiens
acaguagaagggauuucaaa

SEQ ID NO: 81519 - RNA, 22 nt, Homo sapiens
acagugacagaaagcugauuau

SEQ ID NO: 81520 - RNA, 22 nt, Homo sapiens
acaguguagugacugccaacuu

SEQ ID NO: 81521 - RNA, 22 nt, Homo sapiens
acagugucaugucguguucccc

SEQ ID NO: 81522 - RNA, 22 nt, Homo sapiens
acaucacuguuugauugauuga

SEQ ID NO: 81523 - RNA, 22 nt, Homo sapiens
acaucauugggggcuacaggug

SEQ ID NO: 81524 - RNA, 22 nt, Homo sapiens
acaugcauggcaugcauuguac

SEQ ID NO: 81525 - RNA, 23 nt, Homo sapiens
acauguauagacuuuuuuuccuu

SEQ ID NO: 81526 - RNA, 22 nt, Homo sapiens
acauguauauaaugcauagcga

SEQ ID NO: 81527 - RNA, 22 nt, Homo sapiens
acauugcagauguguuuaaugu

SEQ ID NO: 81528 - RNA, 22 nt, Homo sapiens
accaccacucccgcauucuaaa

SEQ ID NO: 81529 - RNA, 22 nt, Homo sapiens
accauugcacuucagccuaggc

SEQ ID NO: 81530 - RNA, 22 nt, Homo sapiens
acccaguguucagacuaccugu

SEQ ID NO: 81531 - RNA, 22 nt, Homo sapiens
acccaguguugggcagaacugu

SEQ ID NO: 81532 - RNA, 21 nt, Homo sapiens
acccccacaccuccuuaguuc

SEQ ID NO: 81533 - RNA, 22 nt, Homo sapiens
acccgugcugaauauguaggug

SEQ ID NO: 81534 - RNA, 22 nt, Homo sapiens
ugcuuugguagaaaucuuuggu

SEQ ID NO: 81535 - RNA, 22 nt, Homo sapiens
uggaaaauuaggggagguuaua

SEQ ID NO: 81536 - RNA, 22 nt, Homo sapiens
uggaacaccaggcuggcguggc

SEQ ID NO: 81537 - RNA, 22 nt, Homo sapiens
uggaagacucuagucucuugag

SEQ ID NO: 81538 - RNA, 22 nt, Homo sapiens
uggaagugaacaaccaaggcag

SEQ ID NO: 81539 - RNA, 22 nt, Homo sapiens
uggaaguuaaauuaguugauga

SEQ ID NO: 81540 - RNA, 19 nt, Homo sapiens
uggaauggauuuaaaugug

SEQ ID NO: 81541 - RNA, 22 nt, Homo sapiens
uggaaugguaucuuguuggggu

SEQ ID NO: 81542 - RNA, 22 nt, Homo sapiens
uggagggcuagucauuucuuuu

SEQ ID NO: 81543 - RNA, 22 nt, Homo sapiens
uggagguagagaugggaucucc

SEQ ID NO: 81544 - RNA, 22 nt, Homo sapiens
uggagguaggacgaagaacucu

SEQ ID NO: 81545 - RNA, 22 nt, Homo sapiens
uggagguagggccuaggaaucu

SEQ ID NO: 81546 - RNA, 22 nt, Homo sapiens
uggagugaaaacacacuaaucu

SEQ ID NO: 81547 - RNA, 22 nt, Homo sapiens
uggaguguaaauuaguucagcc

SEQ ID NO: 81548 - RNA, 22 nt, Homo sapiens
uggaguguagcggcaccuauua

SEQ ID NO: 81549 - RNA, 22 nt, Homo sapiens
uggaguguguugcagaugaagg

SEQ ID NO: 81550 - RNA, 22 nt, Homo sapiens
uggaguguuggggcaggaucuc

SEQ ID NO: 81551 - RNA, 22 nt, Homo sapiens
uggauagugauaagguagauga

SEQ ID NO: 81552 - RNA, 22 nt, Homo sapiens
uggauaguuuacugaagagugg

SEQ ID NO: 81553 - RNA, 22 nt, Homo sapiens
uggauauguuuauuacccugaa

SEQ ID NO: 81554 - RNA, 22 nt, Homo sapiens
uggauggucagaggguuucugu

SEQ ID NO: 81555 - RNA, 22 nt, Homo sapiens
uggauguaauugauucauguug

SEQ ID NO: 81556 - RNA, 22 nt, Homo sapiens
uggauuuuaauuauucugucau

SEQ ID NO: 81557 - RNA, 22 nt, Homo sapiens
uggcaagaagagcaugagacca

SEQ ID NO: 81558 - RNA, 22 nt, Homo sapiens
uggcaagagggaugcaagguuu

SEQ ID NO: 81559 - RNA, 22 nt, Homo sapiens
uggcaagaucacaauuacuuuu

SEQ ID NO: 81560 - RNA, 22 nt, Homo sapiens
uggcacuggagauacauuaaua

SEQ ID NO: 81561 - RNA, 19 nt, Homo sapiens
uggcacuugacguccggau

SEQ ID NO: 81562 - RNA, 22 nt, Homo sapiens
uggcagcugcuucaugggaugc

SEQ ID NO: 81563 - RNA, 22 nt, Homo sapiens
uggcagugggagauauuuuauu

SEQ ID NO: 81564 - RNA, 22 nt, Homo sapiens
uggcaguuuacaaaugccauga

SEQ ID NO: 81565 - RNA, 22 nt, Homo sapiens
uggcaugauauauauucguuug

SEQ ID NO: 81566 - RNA, 22 nt, Homo sapiens
uggcauguagucugggaccugg

SEQ ID NO: 81567 - RNA, 22 nt, Homo sapiens
uggcauguauuuuguguauuaa

SEQ ID NO: 81568 - RNA, 22 nt, Homo sapiens
uggcuacugacugaugauuaua

SEQ ID NO: 81569 - RNA, 21 nt, Homo sapiens
uggcuauuucuguggcauaca

SEQ ID NO: 81570 - RNA, 21 nt, Homo sapiens
uggcuuauuugaaucuggcuu

SEQ ID NO: 81571 - RNA, 22 nt, Homo sapiens
ugggaacaugaagguuaaagag

SEQ ID NO: 81572 - RNA, 18 nt, Homo sapiens
ugggaagaaauucuucuc

SEQ ID NO: 81573 - RNA, 22 nt, Homo sapiens
ugggaauaugauacaggucuuu

SEQ ID NO: 81574 - RNA, 22 nt, Homo sapiens
ugggagacuacauuuuuaacaa

SEQ ID NO: 81575 - RNA, 22 nt, Homo sapiens
ugggcaaaugcuuuuuagucaa

SEQ ID NO: 81576 - RNA, 22 nt, Homo sapiens
ugggccgcugcaggaugguccc

SEQ ID NO: 81577 - RNA, 22 nt, Homo sapiens
uggggcaaugaacauuuuugca

SEQ ID NO: 81578 - RNA, 22 nt, Homo sapiens
ugggguaggccugguuaugugc

SEQ ID NO: 81579 - RNA, 22 nt, Homo sapiens
gaugauguugaauguucucacc

SEQ ID NO: 81580 - RNA, 22 nt, Homo sapiens
gaugauguuugauaaauaauaa

SEQ ID NO: 81581 - RNA, 22 nt, Homo sapiens
gaugcaaauuaagcuugggaca

SEQ ID NO: 81582 - RNA, 22 nt, Homo sapiens
gaugccuuuuuguccucaguua

SEQ ID NO: 81583 - RNA, 22 nt, Homo sapiens
gauggcacuguagcaacacaaa

SEQ ID NO: 81584 - RNA, 22 nt, Homo sapiens
gauguagaaagagugggcugga

SEQ ID NO: 81585 - RNA, 22 nt, Homo sapiens
gauuuuuggggaagccucuuau

SEQ ID NO: 81586 - RNA, 21 nt, Homo sapiens
gcaaaguggcuaccuugcucc

SEQ ID NO: 81587 - RNA, 22 nt, Homo sapiens
gcaaaucuuauguccucacauu

SEQ ID NO: 81588 - RNA, 22 nt, Homo sapiens
gcaauacugacagcauuaguuu

SEQ ID NO: 81589 - RNA, 22 nt, Homo sapiens
gcacagaugaggagaggucuca

SEQ ID NO: 81590 - RNA, 22 nt, Homo sapiens
gcacaguguuacuugauauauu

SEQ ID NO: 81591 - RNA, 22 nt, Homo sapiens
gcaggauuggagccucucugaa

SEQ ID NO: 81592 - RNA, 20 nt, Homo sapiens
gcaguacuuuuaguucuaag

SEQ ID NO: 81593 - RNA, 22 nt, Homo sapiens
gcaguauuguugaaauguccau

SEQ ID NO: 81594 - RNA, 22 nt, Homo sapiens
gcaguguuggggccggaggcug

SEQ ID NO: 81595 - RNA, 22 nt, Homo sapiens
gcauauuuuaaaguguaaccug

SEQ ID NO: 81596 - RNA, 22 nt, Homo sapiens
gcaucacagcuccugugcuggc

SEQ ID NO: 81597 - RNA, 22 nt, Homo sapiens
gcauggauguugauggcugcug

SEQ ID NO: 81598 - RNA, 22 nt, Homo sapiens
gccaagaagugucuaagcagga

SEQ ID NO: 81599 - RNA, 22 nt, Homo sapiens
gccucaguuguggccagggauu

SEQ ID NO: 81600 - RNA, 23 nt, Homo sapiens
gcuaggagagaugaaacacaggu

SEQ ID NO: 81601 - RNA, 22 nt, Homo sapiens
gcugagaucucuugccugaacu

SEQ ID NO: 81602 - RNA, 22 nt, Homo sapiens
gcuggauguuucaauacaaaua

SEQ ID NO: 81603 - RNA, 22 nt, Homo sapiens
gcuggcuuucuccugaucucag

SEQ ID NO: 81604 - RNA, 22 nt, Homo sapiens
gcuggguugccagguuacuuaa

SEQ ID NO: 81605 - RNA, 22 nt, Homo sapiens
gcuggugacuuuaaguugaagc

SEQ ID NO: 81606 - RNA, 18 nt, Homo sapiens
gcuguugucagagcacau

SEQ ID NO: 81607 - RNA, 22 nt, Homo sapiens
gcuuuggauaaaugucaguuua

SEQ ID NO: 81608 - RNA, 22 nt, Homo sapiens
gcuuuguuaaaacacagccaca

SEQ ID NO: 81609 - RNA, 22 nt, Homo sapiens
uuaaaguauaguuccucugguu

SEQ ID NO: 81610 - RNA, 22 nt, Homo sapiens
uuaacagcacaugcugucccuu

SEQ ID NO: 81611 - RNA, 22 nt, Homo sapiens
uuaagccacucaagagauagag

SEQ ID NO: 81612 - RNA, 22 nt, Homo sapiens
uuaaggccccgcccauucaggc

SEQ ID NO: 81613 - RNA, 22 nt, Homo sapiens
uuaagggaggagcuucaagaug

SEQ ID NO: 81614 - RNA, 22 nt, Homo sapiens
uuaagugaauuaucuaacaugu

SEQ ID NO: 81615 - RNA, 22 nt, Homo sapiens
uuaauaccgucacauggcugaa

SEQ ID NO: 81616 - RNA, 22 nt, Homo sapiens
uuaaucacagugucuuccuuca

SEQ ID NO: 81617 - RNA, 21 nt, Homo sapiens
uuaaugcuaugcagaaaaucu

SEQ ID NO: 81618 - RNA, 22 nt, Homo sapiens
uuacagcugcuccccaucacuc

SEQ ID NO: 81619 - RNA, 22 nt, Homo sapiens
uuacaggacuaagcagcuuugc

SEQ ID NO: 81620 - RNA, 17 nt, Homo sapiens
uuacaggugcugagagu

SEQ ID NO: 81621 - RNA, 22 nt, Homo sapiens
uuacagugguugcuauugugaa

SEQ ID NO: 81622 - RNA, 22 nt, Homo sapiens
uuacaguucugguggagaggua

SEQ ID NO: 81623 - RNA, 19 nt, Homo sapiens
uuacauccauugcauuuca

SEQ ID NO: 81624 - RNA, 22 nt, Homo sapiens
uuacauguggugugaagaagag

SEQ ID NO: 81625 - RNA, 22 nt, Homo sapiens
uuaccugagaaggugacauuug

SEQ ID NO: 81626 - RNA, 20 nt, Homo sapiens
uuacuauguaguauuggcuc

SEQ ID NO: 81627 - RNA, 22 nt, Homo sapiens
uuagauuauugagcauccacug

SEQ ID NO: 81628 - RNA, 22 nt, Homo sapiens
uuagauuauugguguuuugcaa

SEQ ID NO: 81629 - RNA, 22 nt, Homo sapiens
uuagcaauugauucucauaagc

SEQ ID NO: 81630 - RNA, 22 nt, Homo sapiens
uuaggcucuuuaucaguuaacu

SEQ ID NO: 81631 - RNA, 18 nt, Homo sapiens
uuagguaggucuuugugu

SEQ ID NO: 81632 - RNA, 22 nt, Homo sapiens
uuauaaacaugaagauuugggg

SEQ ID NO: 81633 - RNA, 22 nt, Homo sapiens
uuauagacacguuguaacaaac

SEQ ID NO: 81634 - RNA, 21 nt, Homo sapiens
uuauaguggcaugauuuauaa

SEQ ID NO: 81635 - RNA, 22 nt, Homo sapiens
uuaugguuuuucugugagaugg

SEQ ID NO: 81636 - RNA, 22 nt, Homo sapiens
uuaugucacuguucagucuccc

SEQ ID NO: 81637 - RNA, 20 nt, Homo sapiens
uuaugucguuucuugcuuau

SEQ ID NO: 81638 - RNA, 22 nt, Homo sapiens
uucaaaaccucugcuuaagccc

SEQ ID NO: 81639 - RNA, 22 nt, Homo sapiens
uucaaaggauagauuaagauca

SEQ ID NO: 81640 - RNA, 23 nt, Homo sapiens
uucaaaggaugcuuuauggaauu

SEQ ID NO: 81641 - RNA, 22 nt, Homo sapiens
uucaaaucuucguuuugccaua

SEQ ID NO: 81642 - RNA, 22 nt, Homo sapiens
uucaagucaacaagcacuugag

SEQ ID NO: 81643 - RNA, 22 nt, Homo sapiens
uucacaauuaaaugugguuauu

SEQ ID NO: 81644 - RNA, 22 nt, Homo sapiens
uucacagccgcaccccaucacu

SEQ ID NO: 81645 - RNA, 22 nt, Homo sapiens
uucacagucacccuucuccaug

SEQ ID NO: 81646 - RNA, 22 nt, Homo sapiens
uucacgguguucacgggggucc

SEQ ID NO: 81647 - RNA, 22 nt, Homo sapiens
uucacugcauuucagccugggc

SEQ ID NO: 81648 - RNA, 22 nt, Homo sapiens
uucacuguagcuuggauguuua

SEQ ID NO: 81649 - RNA, 22 nt, Homo sapiens
uucagacugggugaagagggua

SEQ ID NO: 81650 - RNA, 22 nt, Homo sapiens
uucagcuaccugggaugcugaa

SEQ ID NO: 81651 - RNA, 22 nt, Homo sapiens
uucaguccauuuccuuggucac

SEQ ID NO: 81652 - RNA, 22 nt, Homo sapiens
uucauaguuuauacugauauuu

SEQ ID NO: 81653 - RNA, 22 nt, Homo sapiens
uucaucacagucuccgaugccc

SEQ ID NO: 81654 - RNA, 22 nt, Homo sapiens
uucaucagggagaaauaauuuc

SEQ ID NO: 81655 - RNA, 21 nt, Homo sapiens
uucaucuggccguauuccagg

SEQ ID NO: 81656 - RNA, 22 nt, Homo sapiens
uuuagguaauauuaaguagcug

SEQ ID NO: 81657 - RNA, 22 nt, Homo sapiens
uuuagguagucaaagguuaguc

SEQ ID NO: 81658 - RNA, 23 nt, Homo sapiens
uuuauacguugucauuuaucagg

SEQ ID NO: 81659 - RNA, 23 nt, Homo sapiens
uuucacagaaggauuguagggcc

SEQ ID NO: 81660 - RNA, 22 nt, Homo sapiens
uuucacaguguucucccccaga

SEQ ID NO: 81661 - RNA, 17 nt, Homo sapiens
uuucagaguggaagugu

SEQ ID NO: 81662 - RNA, 22 nt, Homo sapiens
uuucauggaauauagucauuuu

SEQ ID NO: 81663 - RNA, 18 nt, Homo sapiens
uuucauugagugugauau

SEQ ID NO: 81664 - RNA, 22 nt, Homo sapiens
uuuccagguggccaacauuuua

SEQ ID NO: 81665 - RNA, 22 nt, Homo sapiens
uuuccuguaggaaggaaauaga

SEQ ID NO: 81666 - RNA, 22 nt, Homo sapiens
uuuccuguagggggcaaggccu

SEQ ID NO: 81667 - RNA, 22 nt, Homo sapiens
uuucugcuugagagaauugcug

SEQ ID NO: 81668 - RNA, 23 nt, Homo sapiens
uuucuugggcaugcuaugucagu

SEQ ID NO: 81669 - RNA, 22 nt, Homo sapiens
uuugacaaugugugcuuguauu

SEQ ID NO: 81670 - RNA, 22 nt, Homo sapiens
uuugacuagaguguuuuacaac

SEQ ID NO: 81671 - RNA, 22 nt, Homo sapiens
uuugagcauguaguuuaacccu

SEQ ID NO: 81672 - RNA, 22 nt, Homo sapiens
uuugcacuuuuguaauaugguu

SEQ ID NO: 81673 - RNA, 22 nt, Homo sapiens
uuugcagagacuuguuaggaau

SEQ ID NO: 81674 - RNA, 22 nt, Homo sapiens
uuugcuucacuguuuggcaaaa

SEQ ID NO: 81675 - RNA, 22 nt, Homo sapiens
uuuggacuucuagccuccagag

SEQ ID NO: 81676 - RNA, 22 nt, Homo sapiens
uuuggcagaugacccucaaguu

SEQ ID NO: 81677 - RNA, 22 nt, Homo sapiens
uuuggcaugggcuauuugcuuu

SEQ ID NO: 81678 - RNA, 22 nt, Homo sapiens
uuuggcuguuucuggacuaaga

SEQ ID NO: 81679 - RNA, 22 nt, Homo sapiens
uuuggucuuuuguaaguuaucu

SEQ ID NO: 81680 - RNA, 22 nt, Homo sapiens
uuuguacuaugguuuuucacua

SEQ ID NO: 81681 - RNA, 22 nt, Homo sapiens
uuugugcugcaauuaauuuccc

SEQ ID NO: 81682 - RNA, 22 nt, Homo sapiens
uuuguucaccucaaggauggga

SEQ ID NO: 81683 - RNA, 22 nt, Homo sapiens
uuuuaacagccaggggacggcc

SEQ ID NO: 81684 - RNA, 22 nt, Homo sapiens
uuuuagcagccaugacaaagau

SEQ ID NO: 81685 - RNA, 22 nt, Homo sapiens
uuuucaguggccauaguggaga

SEQ ID NO: 81686 - RNA, 22 nt, Homo sapiens
uuuucaguuuuccagguagccg

SEQ ID NO: 81687 - RNA, 23 nt, Homo sapiens
uuuugcaauaagucacuggaaua

SEQ ID NO: 81688 - RNA, 19 nt, Homo sapiens
uuuugcucuuuauaccuau

SEQ ID NO: 81689 - RNA, 22 nt, Homo sapiens
uuuugcuugugaauagccacau

SEQ ID NO: 81690 - RNA, 20 nt, Homo sapiens
uuuuggacuaaaggcauccc

SEQ ID NO: 81691 - RNA, 22 nt, Homo sapiens
uuuuggacuucaauuugacacu

SEQ ID NO: 81692 - RNA, 22 nt, Homo sapiens
uuuuggacuugcuccccugucc

SEQ ID NO: 81693 - RNA, 22 nt, Homo sapiens
uuuuggcacuuugucugauucu

SEQ ID NO: 81694 - RNA, 22 nt, Homo sapiens
uuuuggugguuaugugucaaug

SEQ ID NO: 81695 - RNA, 18 nt, Homo sapiens
uuuuugaggcacagggga

SEQ ID NO: 81696 - RNA, 23 nt, Homo sapiens
uuuuuguguuucauggaaauagg

SEQ ID NO: 81697 - RNA, 22 nt, Homo sapiens
uuuuuugcuguaugcaaacauc

SEQ ID NO: 81698 - RNA, 20 nt, Homo sapiens
agcugcagauauaaauccgc

SEQ ID NO: 81699 - RNA, 20 nt, Homo sapiens
agcuggguguguuggugcau

SEQ ID NO: 81700 - RNA, 22 nt, Homo sapiens
agcugguaugaaaaucucccca

SEQ ID NO: 81701 - RNA, 22 nt, Homo sapiens
agcuguuuuugugggcauguga

SEQ ID NO: 81702 - RNA, 22 nt, Homo sapiens
agcuucacaaugcagagggcag

SEQ ID NO: 81703 - RNA, 22 nt, Homo sapiens
agcuuguuuucccauaacuaga

SEQ ID NO: 81704 - RNA, 22 nt, Homo sapiens
aggaaauguuggucccauuucu

SEQ ID NO: 81705 - RNA, 22 nt, Homo sapiens
aggaagugucuucuuuuaggca

SEQ ID NO: 81706 - RNA, 23 nt, Homo sapiens
aggaauggaaaaccaaguaucau

SEQ ID NO: 81707 - RNA, 22 nt, Homo sapiens
aggacacugagcaugggagguu

SEQ ID NO: 81708 - RNA, 22 nt, Homo sapiens
aggacacugauagucuuuggca

SEQ ID NO: 81709 - RNA, 22 nt, Homo sapiens
aggaccccucaucagcaccagu

SEQ ID NO: 81710 - RNA, 22 nt, Homo sapiens
aggaggauugcuuucaucuuuu

SEQ ID NO: 81711 - RNA, 22 nt, Homo sapiens
aggagguaggaauugugcuagg

SEQ ID NO: 81712 - RNA, 22 nt, Homo sapiens
aggauacugguaugggcugaau

SEQ ID NO: 81713 - RNA, 21 nt, Homo sapiens
aggauaguagauuaaauauuu

SEQ ID NO: 81714 - RNA, 22 nt, Homo sapiens
aggaucauugacuauuauaagg

SEQ ID NO: 81715 - RNA, 22 nt, Homo sapiens
aggcaagaaugcuuguuucacc

SEQ ID NO: 81716 - RNA, 22 nt, Homo sapiens
aggcaagcaucuugcucccuuc

SEQ ID NO: 81717 - RNA, 21 nt, Homo sapiens
aggcaagguguuauuauugaa

SEQ ID NO: 81718 - RNA, 22 nt, Homo sapiens
aggcaagugggagacagcauuu

SEQ ID NO: 81719 - RNA, 22 nt, Homo sapiens
aggcaaguugcucaaaugcaaa

SEQ ID NO: 81720 - RNA, 22 nt, Homo sapiens
aaucccuuuguccagucucuuu

SEQ ID NO: 81721 - RNA, 22 nt, Homo sapiens
aauccuguagauucuaauuccu

SEQ ID NO: 81722 - RNA, 22 nt, Homo sapiens
aaucugguguguggccgggcac

SEQ ID NO: 81723 - RNA, 22 nt, Homo sapiens
aaucugucaguuuuguguuaau

SEQ ID NO: 81724 - RNA, 22 nt, Homo sapiens
aaucugucuuuuguuauugagg

SEQ ID NO: 81725 - RNA, 22 nt, Homo sapiens
aaugcacauauauuuccuuauu

SEQ ID NO: 81726 - RNA, 22 nt, Homo sapiens
aaugcacuccagccugggcgac

SEQ ID NO: 81727 - RNA, 22 nt, Homo sapiens
aaugcuaucuggaacauuguug

SEQ ID NO: 81728 - RNA, 22 nt, Homo sapiens
aauggcacaagacaugaagaag

SEQ ID NO: 81729 - RNA, 22 nt, Homo sapiens
aauggcaucuacguuaaauguc

SEQ ID NO: 81730 - RNA, 22 nt, Homo sapiens
aaugugcacuuggagccuugcu

SEQ ID NO: 81731 - RNA, 22 nt, Homo sapiens
aauguguuuugaaaucaggaag

SEQ ID NO: 81732 - RNA, 22 nt, Homo sapiens
aauugcaauggacaaugcagca

SEQ ID NO: 81733 - RNA, 22 nt, Homo sapiens
aauugcaucuguucuuugccag

SEQ ID NO: 81734 - RNA, 22 nt, Homo sapiens
acaaaguaggcagugggcugga

SEQ ID NO: 81735 - RNA, 22 nt, Homo sapiens
acaauguauauuuuacuguagg

SEQ ID NO: 81736 - RNA, 23 nt, Homo sapiens
acacaguaaacuaaaagcuagcu

SEQ ID NO: 81737 - RNA, 22 nt, Homo sapiens
acacauuagcaagugcuguuau

SEQ ID NO: 81738 - RNA, 22 nt, Homo sapiens
acaccaguacuuuauacaagca

SEQ ID NO: 81739 - RNA, 22 nt, Homo sapiens
acacuacuggguauauguguuu

SEQ ID NO: 81740 - RNA, 22 nt, Homo sapiens
acacuggaggagagcuguugcu

SEQ ID NO: 81741 - RNA, 22 nt, Homo sapiens
acacuuucuagacaagggaaua

SEQ ID NO: 81742 - RNA, 20 nt, Homo sapiens
acagcauagccuuuuaaagc

SEQ ID NO: 81743 - RNA, 19 nt, Homo sapiens
acaguaccuggcaugaggu

SEQ ID NO: 81744 - RNA, 22 nt, Homo sapiens
acaguacucugcucuuuugauu

SEQ ID NO: 81745 - RNA, 19 nt, Homo sapiens
acaguauugugcacagguu

SEQ ID NO: 81746 - RNA, 22 nt, Homo sapiens
acagugcuucugauaugaugcc

SEQ ID NO: 81747 - RNA, 19 nt, Homo sapiens
acagugcuuugucagaagc

SEQ ID NO: 81748 - RNA, 19 nt, Homo sapiens
acagugucucuauaaugau

SEQ ID NO: 81749 - RNA, 22 nt, Homo sapiens
acagugucugacacguaggaag

SEQ ID NO: 81750 - RNA, 18 nt, Homo sapiens
acagugucuuacaccugu

SEQ ID NO: 81751 - RNA, 22 nt, Homo sapiens
acauaaagaagcaggacauugu

SEQ ID NO: 81752 - RNA, 22 nt, Homo sapiens
acaucccuuucccacccuucac

SEQ ID NO: 81753 - RNA, 22 nt, Homo sapiens
acaugcauccaugugaagagac

SEQ ID NO: 81754 - RNA, 19 nt, Homo sapiens
acauggauuuugugcaaac

SEQ ID NO: 81755 - RNA, 21 nt, Homo sapiens
acauguacacauguaugcaca

SEQ ID NO: 81756 - RNA, 22 nt, Homo sapiens
acauucagcuguuguuucaaug

SEQ ID NO: 81757 - RNA, 18 nt, Homo sapiens
acauucagcuugaagaua

SEQ ID NO: 81758 - RNA, 22 nt, Homo sapiens
accaguuuuuuauacaucuucu

SEQ ID NO: 81759 - RNA, 22 nt, Homo sapiens
accccugagaucgaaucaugcu

SEQ ID NO: 81760 - RNA, 22 nt, Homo sapiens
acccggagagcaggcgagaagg

SEQ ID NO: 81761 - RNA, 21 nt, Homo sapiens
acccucuaguuuucaacaggc

SEQ ID NO: 81762 - RNA, 22 nt, Homo sapiens
acccuggagagugcuguaguaa

SEQ ID NO: 81763 - RNA, 22 nt, Homo sapiens
acccuggaggucuacagugcag

SEQ ID NO: 81764 - RNA, 22 nt, Homo sapiens
acccuggaguaguaggaaucug

SEQ ID NO: 81765 - RNA, 22 nt, Homo sapiens
acccuguaggugcuggcagaga

SEQ ID NO: 81766 - RNA, 19 nt, Homo sapiens
acccuguccccaccuuuac

SEQ ID NO: 81767 - RNA, 22 nt, Homo sapiens
accugagacuaggcauuuuaua

SEQ ID NO: 81768 - RNA, 22 nt, Homo sapiens
accugagauuacaggugcuggc

SEQ ID NO: 81769 - RNA, 22 nt, Homo sapiens
accuggcacuuagcaaaucuga

SEQ ID NO: 81770 - RNA, 23 nt, Homo sapiens
accuucauucauucagcugaagu

SEQ ID NO: 81771 - RNA, 18 nt, Homo sapiens
accuucauuccuuugccu

SEQ ID NO: 81772 - RNA, 22 nt, Homo sapiens
acggcaguguggugcggucagg

SEQ ID NO: 81773 - RNA, 22 nt, Homo sapiens
acuacaugugaugucaguauau

SEQ ID NO: 81774 - RNA, 22 nt, Homo sapiens
acuauacuguaacuguauucag

SEQ ID NO: 81775 - RNA, 22 nt, Homo sapiens
acuaugagacgaaugcaucagu

SEQ ID NO: 81776 - RNA, 22 nt, Homo sapiens
acucacagcaaccuccgccucc

SEQ ID NO: 81777 - RNA, 19 nt, Homo sapiens
acugcacuccaaccuccug

SEQ ID NO: 81778 - RNA, 22 nt, Homo sapiens
acugcacuccagacucugucuc

SEQ ID NO: 81779 - RNA, 22 nt, Homo sapiens
acugcacuccagcccaggugac

SEQ ID NO: 81780 - RNA, 22 nt, Homo sapiens
acugcacuccagccucggugac

SEQ ID NO: 81781 - RNA, 22 nt, Homo sapiens
acugcacuccagccucgugaca

SEQ ID NO: 81782 - RNA, 23 nt, Homo sapiens
uugcaaagccugaaacucuucag

SEQ ID NO: 81783 - RNA, 18 nt, Homo sapiens
uugcaaauucuucccugu

SEQ ID NO: 81784 - RNA, 22 nt, Homo sapiens
uugcaagauguuaacauuggag

SEQ ID NO: 81785 - RNA, 22 nt, Homo sapiens
uugcaagauguucaugggcugu

SEQ ID NO: 81786 - RNA, 22 nt, Homo sapiens
uugcacaauccugugagugagu

SEQ ID NO: 81787 - RNA, 22 nt, Homo sapiens
uugcacuuccgccugggugaca

SEQ ID NO: 81788 - RNA, 22 nt, Homo sapiens
uugcaggcaugagccaccgugc

SEQ ID NO: 81789 - RNA, 22 nt, Homo sapiens
uugcaguaguaacuccuuaccu

SEQ ID NO: 81790 - RNA, 22 nt, Homo sapiens
uugcagugugacgacuauauuu

SEQ ID NO: 81791 - RNA, 19 nt, Homo sapiens
uugcauauguugaaccagg

SEQ ID NO: 81792 - RNA, 22 nt, Homo sapiens
uugcaucagcuccugauguacu

SEQ ID NO: 81793 - RNA, 22 nt, Homo sapiens
uugcauuagugugguacauuug

SEQ ID NO: 81794 - RNA, 22 nt, Homo sapiens
uugccuuuguuggaaacaagug

SEQ ID NO: 81795 - RNA, 22 nt, Homo sapiens
uugcugguuuucauaugagcag

SEQ ID NO: 81796 - RNA, 22 nt, Homo sapiens
uugcuucauucaacauugaggg

SEQ ID NO: 81797 - RNA, 22 nt, Homo sapiens
uuggaaagagguguuuaugacu

SEQ ID NO: 81798 - RNA, 22 nt, Homo sapiens
uuggaaaugguaaaggguuaau

SEQ ID NO: 81799 - RNA, 22 nt, Homo sapiens
uuggaaauguguuugcauucag

SEQ ID NO: 81800 - RNA, 22 nt, Homo sapiens
uuggaaggcugaauggccucuc

SEQ ID NO: 81801 - RNA, 22 nt, Homo sapiens
uuggaauuaagagauauuuucu

SEQ ID NO: 81802 - RNA, 22 nt, Homo sapiens
uuggagugugcucauaacugcu

SEQ ID NO: 81803 - RNA, 22 nt, Homo sapiens
uuggaugauaaagaagccuaag

SEQ ID NO: 81804 - RNA, 22 nt, Homo sapiens
uuggcaauucagauucuuuuau

SEQ ID NO: 81805 - RNA, 22 nt, Homo sapiens
uuggcagugcccgaugcugggg

SEQ ID NO: 81806 - RNA, 22 nt, Homo sapiens
uuggcauuguggauggaaucau

SEQ ID NO: 81807 - RNA, 20 nt, Homo sapiens
uuggcauuuagacaagaguu

SEQ ID NO: 81808 - RNA, 22 nt, Homo sapiens
uuggccccuccaaaucucaugu

SEQ ID NO: 81809 - RNA, 22 nt, Homo sapiens
uugggaauguccuaauaucucg

SEQ ID NO: 81810 - RNA, 22 nt, Homo sapiens
uugggagugucucuggacugca

SEQ ID NO: 81811 - RNA, 22 nt, Homo sapiens
uugggccacuuuaguuuccuua

SEQ ID NO: 81812 - RNA, 22 nt, Homo sapiens
uugggcuugagggugcccaguc

SEQ ID NO: 81813 - RNA, 22 nt, Homo sapiens
uuggucagcuagauuauucccu

SEQ ID NO: 81814 - RNA, 22 nt, Homo sapiens
uugguucaguuuaacgaguaau

SEQ ID NO: 81815 - RNA, 22 nt, Homo sapiens
uugguucucuuagccaucuuaa

SEQ ID NO: 81816 - RNA, 22 nt, Homo sapiens
uuguaaagucugucucagucag

SEQ ID NO: 81817 - RNA, 22 nt, Homo sapiens
uuguaaaguucuuaggaagcuc

SEQ ID NO: 81818 - RNA, 22 nt, Homo sapiens
uuguaugucuucauuugaaaaa

SEQ ID NO: 81819 - RNA, 22 nt, Homo sapiens
uugucacuauaaauaagcauuu

SEQ ID NO: 81820 - RNA, 19 nt, Homo sapiens
uugucuuagaguugucauu

SEQ ID NO: 81821 - RNA, 22 nt, Homo sapiens
uugugagggagcuaagaugagu

SEQ ID NO: 81822 - RNA, 22 nt, Homo sapiens
uugugcuuguaacuacauucag

SEQ ID NO: 81823 - RNA, 22 nt, Homo sapiens
uugugguuuuaucuaccuuugg

SEQ ID NO: 81824 - RNA, 22 nt, Homo sapiens
uuguguacuacaguaugccaca

SEQ ID NO: 81825 - RNA, 22 nt, Homo sapiens
uuguguuugaugcugacacgca

SEQ ID NO: 81826 - RNA, 22 nt, Homo sapiens
uuguucccuucuggcuuuuaug

SEQ ID NO: 81827 - RNA, 22 nt, Homo sapiens
uuuaaagcacggaguuuguggc

SEQ ID NO: 81828 - RNA, 20 nt, Homo sapiens
uuuaagacaugcugaauuga

SEQ ID NO: 81829 - RNA, 22 nt, Homo sapiens
uuuaauacugcaucuuuacucu

SEQ ID NO: 81830 - RNA, 22 nt, Homo sapiens
uuuaaugcaucccaaaauguag

SEQ ID NO: 81831 - RNA, 22 nt, Homo sapiens
uuuagcacugugauugacaaaa

SEQ ID NO: 81832 - RNA, 22 nt, Homo sapiens
uuuagggcagggacaguucuuc

SEQ ID NO: 81833 - RNA, 22 nt, Homo sapiens
uuuauugcucuaaaguugccau

SEQ ID NO: 81834 - RNA, 22 nt, Homo sapiens
uuucaagugcugucuuagcugu

SEQ ID NO: 81835 - RNA, 19 nt, Homo sapiens
uuucacacucgccuacuuc

SEQ ID NO: 81836 - RNA, 22 nt, Homo sapiens
uuucagcguggggugcugaaga

SEQ ID NO: 81837 - RNA, 22 nt, Homo sapiens
uuucaguguggcaggcauagcu

SEQ ID NO: 81838 - RNA, 22 nt, Homo sapiens
uuucauccggcuguguauuaug

SEQ ID NO: 81839 - RNA, 22 nt, Homo sapiens
uuuccauguuggugaaaugagg

SEQ ID NO: 81840 - RNA, 22 nt, Homo sapiens
uuucccugaaggcucugaaguc

SEQ ID NO: 81841 - RNA, 16 nt, Homo sapiens
uuucccuuugguguuu

SEQ ID NO: 81842 - RNA, 21 nt, Homo sapiens
uuuccuggagcguauggcuuc

SEQ ID NO: 81843 - RNA, 21 nt, Homo sapiens
uuucugggggagcauggcagg

SEQ ID NO: 81844 - RNA, 22 nt, Homo sapiens
uuucugggggugcugauggaaa

SEQ ID NO: 81845 - RNA, 22 nt, Homo sapiens
uuucugugguccucuugaaggu

SEQ ID NO: 81846 - RNA, 22 nt, Homo sapiens
uuucuuggagcucuuagggucg

SEQ ID NO: 81847 - RNA, 22 nt, Homo sapiens
uuucuugguuguauuuagacuu

SEQ ID NO: 81848 - RNA, 22 nt, Homo sapiens
uuugacuuuuagaauaugaguu

SEQ ID NO: 81849 - RNA, 22 nt, Homo sapiens
uuugagcaggcuaaucaauaua

SEQ ID NO: 81850 - RNA, 22 nt, Homo sapiens
uuugaggaaaggcauaaguagg

SEQ ID NO: 81851 - RNA, 22 nt, Homo sapiens
uuugcaguguaguuggccagca

SEQ ID NO: 81852 - RNA, 22 nt, Homo sapiens
uuugcaguuuauuccuggggcu

SEQ ID NO: 81853 - RNA, 19 nt, Homo sapiens
uuugcauagugagaauaua

SEQ ID NO: 81854 - RNA, 22 nt, Homo sapiens
uuugcaucuuuugcuuccugga

SEQ ID NO: 81855 - RNA, 23 nt, Homo sapiens
uuugccacuuauuagcugggagg

SEQ ID NO: 81856 - RNA, 22 nt, Homo sapiens
uuugcuauagugaauagugcug

SEQ ID NO: 81857 - RNA, 22 nt, Homo sapiens
uuugcuuaguaaauguagaaaa

SEQ ID NO: 81858 - RNA, 22 nt, Homo sapiens
uuugcuugaggucuagcuaccc

SEQ ID NO: 81859 - RNA, 22 nt, Homo sapiens
uuuggcaaagaucaacauguua

SEQ ID NO: 81860 - RNA, 22 nt, Homo sapiens
uuuggcacuauagguaaauuug

SEQ ID NO: 81861 - RNA, 20 nt, Homo sapiens
uuuggcacugagugguauaa

SEQ ID NO: 81862 - RNA, 22 nt, Homo sapiens
uuuggcaguuauuuacucagug

SEQ ID NO: 81863 - RNA, 22 nt, Homo sapiens
uuuggcauuaagaugcuguauc

SEQ ID NO: 81864 - RNA, 22 nt, Homo sapiens
uuuggcauuagauaauugugua

SEQ ID NO: 81865 - RNA, 22 nt, Homo sapiens
uuuggcauuuuacuacucaaau

SEQ ID NO: 81866 - RNA, 22 nt, Homo sapiens
uuuggcuuaagauugacugcaa

SEQ ID NO: 81867 - RNA, 22 nt, Homo sapiens
uuuggcuuuugugauacguaau

SEQ ID NO: 81868 - RNA, 22 nt, Homo sapiens
uuugggaaugaguuuaucauuu

SEQ ID NO: 81869 - RNA, 22 nt, Homo sapiens
uuuggucagcugcgggucagcu

SEQ ID NO: 81870 - RNA, 22 nt, Homo sapiens
uuugguugcauucacauauuuc

SEQ ID NO: 81871 - RNA, 22 nt, Homo sapiens
uuuguaagaugcauagauugca

SEQ ID NO: 81872 - RNA, 22 nt, Homo sapiens
uuuguaauccuauuccaaagga

SEQ ID NO: 81873 - RNA, 23 nt, Homo sapiens
uuuguacuaugucaguuuagaua

SEQ ID NO: 81874 - RNA, 21 nt, Homo sapiens
uuuguaguagcaugauuuaua

SEQ ID NO: 81875 - RNA, 23 nt, Homo sapiens
uuugugacacucuccaucuccag

SEQ ID NO: 81876 - RNA, 22 nt, Homo sapiens
uuugugacucauggucuagugc

SEQ ID NO: 81877 - RNA, 22 nt, Homo sapiens
uuugugugugauuauaaaaggu

SEQ ID NO: 81878 - RNA, 22 nt, Homo sapiens
uuuugcaaauuccaguggccau

SEQ ID NO: 81879 - RNA, 22 nt, Homo sapiens
uuuugcaauauguuccugaaua

SEQ ID NO: 81880 - RNA, 22 nt, Homo sapiens
uuuugcucuugguaaugaaaga

SEQ ID NO: 81881 - RNA, 22 nt, Homo sapiens
uuuugguaaugaacuuaggaag

SEQ ID NO: 81882 - RNA, 22 nt, Homo sapiens
uuuuucacuuaaguuaggcuca

SEQ ID NO: 81883 - RNA, 22 nt, Homo sapiens
uuuuugaguaaauauaaauugu

SEQ ID NO: 81884 - RNA, 22 nt, Homo sapiens
uuuuugauuaauggguagacca

SEQ ID NO: 81885 - RNA, 22 nt, Homo sapiens
aucagaaucucuagugggacca

SEQ ID NO: 81886 - RNA, 22 nt, Homo sapiens
aucagcagcaugaaaacaggcu

SEQ ID NO: 81887 - RNA, 22 nt, Homo sapiens
aucagugcauaguauuuaauga

SEQ ID NO: 81888 - RNA, 22 nt, Homo sapiens
aucaucaugcacuacagccugg

SEQ ID NO: 81889 - RNA, 22 nt, Homo sapiens
auccacaugcaguuggaaacag

SEQ ID NO: 81890 - RNA, 22 nt, Homo sapiens
auccaguguuuucuuuugucac

SEQ ID NO: 81891 - RNA, 22 nt, Homo sapiens
aucccugugacgagcaucccua

SEQ ID NO: 81892 - RNA, 22 nt, Homo sapiens
auccucugagagaguuucauaa

SEQ ID NO: 81893 - RNA, 22 nt, Homo sapiens
aucgcgccauuguacuccagcc

SEQ ID NO: 81894 - RNA, 22 nt, Homo sapiens
aucugacuuuuaauuugaaaac

SEQ ID NO: 81895 - RNA, 19 nt, Homo sapiens
aucuggaguuccuggggcu

SEQ ID NO: 81896 - RNA, 22 nt, Homo sapiens
aucuggcuccuuuugacaaugc

SEQ ID NO: 81897 - RNA, 22 nt, Homo sapiens
aucuggcuucuuuuaguccaca

SEQ ID NO: 81898 - RNA, 22 nt, Homo sapiens
aucuuguguugaauggugcaga

SEQ ID NO: 81899 - RNA, 22 nt, Homo sapiens
aucuuugauuguagguacaaug

SEQ ID NO: 81900 - RNA, 22 nt, Homo sapiens
aucuuuggucaucacagcuaga

SEQ ID NO: 81901 - RNA, 22 nt, Homo sapiens
aucuuuggugaguucuuugguc

SEQ ID NO: 81902 - RNA, 22 nt, Homo sapiens
augaaacuggcuaauuuuugua

SEQ ID NO: 81903 - RNA, 22 nt, Homo sapiens
augaaaugcauguuaaguccgu

SEQ ID NO: 81904 - RNA, 22 nt, Homo sapiens
augaagauguugccuuuuuaau

SEQ ID NO: 81905 - RNA, 22 nt, Homo sapiens
augaauacugcugcaaugaaca

SEQ ID NO: 81906 - RNA, 23 nt, Homo sapiens
augaauguaaggaguguaagaaa

SEQ ID NO: 81907 - RNA, 22 nt, Homo sapiens
augaaugucuuauuuugagaaa

SEQ ID NO: 81908 - RNA, 22 nt, Homo sapiens
augacacugcagagauguccca

SEQ ID NO: 81909 - RNA, 22 nt, Homo sapiens
augagauacuacaaaugaguuu

SEQ ID NO: 81910 - RNA, 22 nt, Homo sapiens
augagaugaauaccgacgaugu

SEQ ID NO: 81911 - RNA, 21 nt, Homo sapiens
augagauguuagacuuuagac

SEQ ID NO: 81912 - RNA, 22 nt, Homo sapiens
augagcagaagagauacacugu

SEQ ID NO: 81913 - RNA, 22 nt, Homo sapiens
augagcuguuuggaagacacuu

SEQ ID NO: 81914 - RNA, 22 nt, Homo sapiens
augaggugaggucaguaaggua

SEQ ID NO: 81915 - RNA, 22 nt, Homo sapiens
augaucauggaaguuuuccugu

SEQ ID NO: 81916 - RNA, 22 nt, Homo sapiens
augcaaaucuuaaguaugugug

SEQ ID NO: 81917 - RNA, 22 nt, Homo sapiens
augcacuguuguuauuggauaa

SEQ ID NO: 81918 - RNA, 22 nt, Homo sapiens
augcacuguuuucuugaugaga

SEQ ID NO: 81919 - RNA, 22 nt, Homo sapiens
augcagcugaggguaguggagc

SEQ ID NO: 81920 - RNA, 22 nt, Homo sapiens
augccaguguccagaguggguu

SEQ ID NO: 81921 - RNA, 22 nt, Homo sapiens
augcuggugcuagaaacuggaa

SEQ ID NO: 81922 - RNA, 22 nt, Homo sapiens
augcuuguguuggggcagugga

SEQ ID NO: 81923 - RNA, 22 nt, Homo sapiens
auggaaaugaagggcuggcccu

SEQ ID NO: 81924 - RNA, 22 nt, Homo sapiens
auggaauggcacuuugaagauu

SEQ ID NO: 81925 - RNA, 22 nt, Homo sapiens
auggagaugaacuuggguaaag

SEQ ID NO: 81926 - RNA, 22 nt, Homo sapiens
auggcaaaaaaugcaauuacuu

SEQ ID NO: 81927 - RNA, 22 nt, Homo sapiens
auggcaaaauguuccuaguggu

SEQ ID NO: 81928 - RNA, 22 nt, Homo sapiens
auggcaauaugaugcacuguuu

SEQ ID NO: 81929 - RNA, 22 nt, Homo sapiens
auggcacugccuggcuucaugg

SEQ ID NO: 81930 - RNA, 22 nt, Homo sapiens
auggcagugagucucuaguauu

SEQ ID NO: 81931 - RNA, 22 nt, Homo sapiens
auggcaguuucacucugggauu

SEQ ID NO: 81932 - RNA, 22 nt, Homo sapiens
auggcauggugaagucuuugga

SEQ ID NO: 81933 - RNA, 22 nt, Homo sapiens
auggcauggugcaggguuuaag

SEQ ID NO: 81934 - RNA, 22 nt, Homo sapiens
auggcccaguuugcuaucccua

SEQ ID NO: 81935 - RNA, 22 nt, Homo sapiens
auggcccugaguucaauauauu

SEQ ID NO: 81936 - RNA, 22 nt, Homo sapiens
auggccuuuacaauuugguaug

SEQ ID NO: 81937 - RNA, 22 nt, Homo sapiens
auggcucuggauagaaugcagg

SEQ ID NO: 81938 - RNA, 22 nt, Homo sapiens
auggcuucuucuaaaagugggg

SEQ ID NO: 81939 - RNA, 22 nt, Homo sapiens
augguaucauuacuguuuuauu

SEQ ID NO: 81940 - RNA, 21 nt, Homo sapiens
auggugagaaaguagugucaa

SEQ ID NO: 81941 - RNA, 22 nt, Homo sapiens
augguugguuaaaucuguguau

SEQ ID NO: 81942 - RNA, 22 nt, Homo sapiens
auguaguaugaagaagaugcuu

SEQ ID NO: 81943 - RNA, 22 nt, Homo sapiens
auguaguauuaaugagagauaa

SEQ ID NO: 81944 - RNA, 20 nt, Homo sapiens
augucagaguguggguacgg

SEQ ID NO: 81945 - RNA, 22 nt, Homo sapiens
augugaacaucauagaaugcac

SEQ ID NO: 81946 - RNA, 22 nt, Homo sapiens
augugacugauggagaauaugu

SEQ ID NO: 81947 - RNA, 22 nt, Homo sapiens
augugacugauguaaucagaca

SEQ ID NO: 81948 - RNA, 22 nt, Homo sapiens
augugacuugugaaaaguucag

SEQ ID NO: 81949 - RNA, 22 nt, Homo sapiens
augugcacaacgugcagguuug

SEQ ID NO: 81950 - RNA, 22 nt, Homo sapiens
augugcacaugcuuacauguga

SEQ ID NO: 81951 - RNA, 22 nt, Homo sapiens
augugcacauucugguaaauau

SEQ ID NO: 81952 - RNA, 22 nt, Homo sapiens
auguggaaauguauaugugucu

SEQ ID NO: 81953 - RNA, 22 nt, Homo sapiens
auguguauuaccucgauuguga

SEQ ID NO: 81954 - RNA, 22 nt, Homo sapiens
auuaagugaaugaaguuguucc

SEQ ID NO: 81955 - RNA, 22 nt, Homo sapiens
auuaagugcuugccagugcugg

SEQ ID NO: 81956 - RNA, 22 nt, Homo sapiens
auuaaguuaggauuuugagaua

SEQ ID NO: 81957 - RNA, 22 nt, Homo sapiens
auuaaguugugccugaaaacuu

SEQ ID NO: 81958 - RNA, 22 nt, Homo sapiens
auuacuuugcaccaaccuaaua

SEQ ID NO: 81959 - RNA, 20 nt, Homo sapiens
auuagacuugccuuauccuu

SEQ ID NO: 81960 - RNA, 22 nt, Homo sapiens
auuagguuggugcaaaaguaau

SEQ ID NO: 81961 - RNA, 22 nt, Homo sapiens
auuauaugucaucacagacacc

SEQ ID NO: 81962 - RNA, 22 nt, Homo sapiens
auucaaagugcauguucccacu

SEQ ID NO: 81963 - RNA, 22 nt, Homo sapiens
auucaagggauuucaggaggcu

SEQ ID NO: 81964 - RNA, 22 nt, Homo sapiens
auucaccauggcuaccaagggu

SEQ ID NO: 81965 - RNA, 22 nt, Homo sapiens
auucacuguggcuuucucugau

SEQ ID NO: 81966 - RNA, 22 nt, Homo sapiens
auuccacaguuaacacagaccg

SEQ ID NO: 81967 - RNA, 22 nt, Homo sapiens
auuccacuuauaugagguaucu

SEQ ID NO: 81968 - RNA, 23 nt, Homo sapiens
auuccaguggcaauuggagaaac

SEQ ID NO: 81969 - RNA, 22 nt, Homo sapiens
auuccaguggguuuacauccca

SEQ ID NO: 81970 - RNA, 22 nt, Homo sapiens
auuccauuuguguggaauggcu

SEQ ID NO: 81971 - RNA, 22 nt, Homo sapiens
auuccauuuguuaucacacccg

SEQ ID NO: 81972 - RNA, 22 nt, Homo sapiens
ccucauggagaaccucugcuag

SEQ ID NO: 81973 - RNA, 21 nt, Homo sapiens
ccucuuugagggaagaaaggg

SEQ ID NO: 81974 - RNA, 22 nt, Homo sapiens
ccucuuuguugagacuucacca

SEQ ID NO: 81975 - RNA, 22 nt, Homo sapiens
ccuggaagaaaggugcuaaaua

SEQ ID NO: 81976 - RNA, 22 nt, Homo sapiens
ccuggaucauugucauucccaa

SEQ ID NO: 81977 - RNA, 22 nt, Homo sapiens
ccuucauucauuaauuuagccc

SEQ ID NO: 81978 - RNA, 22 nt, Homo sapiens
ccuucauugcaucuuuaagaga

SEQ ID NO: 81979 - RNA, 19 nt, Homo sapiens
ccuugguuagguauauucc

SEQ ID NO: 81980 - RNA, 22 nt, Homo sapiens
ccuuuuugaguugccagaguuc

SEQ ID NO: 81981 - RNA, 22 nt, Homo sapiens
cgaguagcacaaugugugugau

SEQ ID NO: 81982 - RNA, 22 nt, Homo sapiens
cuaaagucacgauuugugggua

SEQ ID NO: 81983 - RNA, 22 nt, Homo sapiens
cuacucuggagagugacaauca

SEQ ID NO: 81984 - RNA, 22 nt, Homo sapiens
cuagcacauaguuauucacuca

SEQ ID NO: 81985 - RNA, 22 nt, Homo sapiens
cuagcagacaggcugggagcag

SEQ ID NO: 81986 - RNA, 22 nt, Homo sapiens
cuagccuggagugcaguggugc

SEQ ID NO: 81987 - RNA, 22 nt, Homo sapiens
cuaguaaugucugucuuaugga

SEQ ID NO: 81988 - RNA, 18 nt, Homo sapiens
cuaguguuucuugaauca

SEQ ID NO: 81989 - RNA, 22 nt, Homo sapiens
cuauggugauagaaaucagaau

SEQ ID NO: 81990 - RNA, 22 nt, Homo sapiens
cuauguaccuggaacuguauua

SEQ ID NO: 81991 - RNA, 22 nt, Homo sapiens
cuauuagguuggugcaaaaguc

SEQ ID NO: 81992 - RNA, 22 nt, Homo sapiens
cuauucacaggcaauauguaca

SEQ ID NO: 81993 - RNA, 22 nt, Homo sapiens
cuauuugguuggugaaaaaagu

SEQ ID NO: 81994 - RNA, 22 nt, Homo sapiens
cucaaagugcuaagauuaggcu

SEQ ID NO: 81995 - RNA, 22 nt, Homo sapiens
cucaaaguguggucuguggguu

SEQ ID NO: 81996 - RNA, 22 nt, Homo sapiens
cucaauuuggaauugucaguaa

SEQ ID NO: 81997 - RNA, 18 nt, Homo sapiens
cucacaguaacuuuuaag

SEQ ID NO: 81998 - RNA, 22 nt, Homo sapiens
cucacagucagaagggacuugc

SEQ ID NO: 81999 - RNA, 22 nt, Homo sapiens
cucacagugacacgaaccccca

SEQ ID NO: 82000 - RNA, 20 nt, Homo sapiens
cucaccagguguaggcugag

SEQ ID NO: 82001 - RNA, 22 nt, Homo sapiens
cucaccuugugauccacccacc

SEQ ID NO: 82002 - RNA, 22 nt, Homo sapiens
cucaggcacucugauuccagug

SEQ ID NO: 82003 - RNA, 22 nt, Homo sapiens
cucagugguugauuuauuuauc

SEQ ID NO: 82004 - RNA, 22 nt, Homo sapiens
cucagugucuggcacacagaaa

SEQ ID NO: 82005 - RNA, 22 nt, Homo sapiens
cucaguguucccauucuaccuu

SEQ ID NO: 82006 - RNA, 22 nt, Homo sapiens
cucaguguuucagcugcucaga

SEQ ID NO: 82007 - RNA, 22 nt, Homo sapiens
cucauuaguuguuuuaagauga

SEQ ID NO: 82008 - RNA, 22 nt, Homo sapiens
cucauugcaaucuccaccuccc

SEQ ID NO: 82009 - RNA, 22 nt, Homo sapiens
cuccacugagcaggugggaggc

SEQ ID NO: 82010 - RNA, 22 nt, Homo sapiens
cuccccuuuaguuucuuaauaa

SEQ ID NO: 82011 - RNA, 22 nt, Homo sapiens
cucuuagauuagccauccuaau

SEQ ID NO: 82012 - RNA, 22 nt, Homo sapiens
cucuuugaggugagcugcccau

SEQ ID NO: 82013 - RNA, 19 nt, Homo sapiens
cucuuuggugucucuucuu

SEQ ID NO: 82014 - RNA, 22 nt, Homo sapiens
cugaaaguuauucaggggcaag

SEQ ID NO: 82015 - RNA, 20 nt, Homo sapiens
cugaaugucaaggcagaggu

SEQ ID NO: 82016 - RNA, 22 nt, Homo sapiens
cugaauguucuggauggaagag

SEQ ID NO: 82017 - RNA, 22 nt, Homo sapiens
cugacauuguugaucacagcca

SEQ ID NO: 82018 - RNA, 22 nt, Homo sapiens
cugagaagaaacagguaaggac

SEQ ID NO: 82019 - RNA, 22 nt, Homo sapiens
cugagauacacuaauagucucu

SEQ ID NO: 82020 - RNA, 22 nt, Homo sapiens
cugaggauauucagccucugug

SEQ ID NO: 82021 - RNA, 22 nt, Homo sapiens
cugaggguagaaggaucacuug

SEQ ID NO: 82022 - RNA, 18 nt, Homo sapiens
cugagucauuccuggguc

SEQ ID NO: 82023 - RNA, 22 nt, Homo sapiens
cugcacugagacccucuuugcu

SEQ ID NO: 82024 - RNA, 22 nt, Homo sapiens
cugcuggucuuuaaggucuagg

SEQ ID NO: 82025 - RNA, 22 nt, Homo sapiens
cuggaaugugagccccaaaaag

SEQ ID NO: 82026 - RNA, 22 nt, Homo sapiens
cuggagauuaaccaauugccau

SEQ ID NO: 82027 - RNA, 22 nt, Homo sapiens
cuggauauguugcaacauuucc

SEQ ID NO: 82028 - RNA, 18 nt, Homo sapiens
cuggaugucgaguguguu

SEQ ID NO: 82029 - RNA, 22 nt, Homo sapiens
cuggcaauaggcagugucccaa

SEQ ID NO: 82030 - RNA, 22 nt, Homo sapiens
cuggcacagugucagaaacaca

SEQ ID NO: 82031 - RNA, 22 nt, Homo sapiens
cuggccagagacauucauuaaa

SEQ ID NO: 82032 - RNA, 22 nt, Homo sapiens
cuggcugagugguaaguagagg

SEQ ID NO: 82033 - RNA, 22 nt, Homo sapiens
cugggauggaggagaauuagag

SEQ ID NO: 82034 - RNA, 22 nt, Homo sapiens
cuggugagaugucuuuccucuu

SEQ ID NO: 82035 - RNA, 22 nt, Homo sapiens
cugucuguuucaaaagugguua

SEQ ID NO: 82036 - RNA, 22 nt, Homo sapiens
cugugaagaaagucauugguag

SEQ ID NO: 82037 - RNA, 22 nt, Homo sapiens
cugugcacaucuggcggcccga

SEQ ID NO: 82038 - RNA, 22 nt, Homo sapiens
cuucaaguguggccaccugacc

SEQ ID NO: 82039 - RNA, 21 nt, Homo sapiens
cuucuuggggcagggcagggu

SEQ ID NO: 82040 - RNA, 22 nt, Homo sapiens
cuugacacugcaguuuuccugg

SEQ ID NO: 82041 - RNA, 22 nt, Homo sapiens
cuugcacuugaaauuccaguuu

SEQ ID NO: 82042 - RNA, 22 nt, Homo sapiens
cuuggcacugcucacccuccuu

SEQ ID NO: 82043 - RNA, 22 nt, Homo sapiens
cuugucuugcacacgguugcca

SEQ ID NO: 82044 - RNA, 22 nt, Homo sapiens
cuuguucuccuaagaugaaugc

SEQ ID NO: 82045 - RNA, 22 nt, Homo sapiens
cuuuggcaaugucauuuucaau

SEQ ID NO: 82046 - RNA, 22 nt, Homo sapiens
cuuuggcacuuccuaagugcca

SEQ ID NO: 82047 - RNA, 22 nt, Homo sapiens
cuuuggugagggauaaauuuca

SEQ ID NO: 82048 - RNA, 22 nt, Homo sapiens
cuuuuacacuguuggcaggauu

SEQ ID NO: 82049 - RNA, 22 nt, Homo sapiens
cuuuuggugugaagaagcucuu

SEQ ID NO: 82050 - RNA, 22 nt, Homo sapiens
cuuuuugcaaauacaacucuga

SEQ ID NO: 82051 - RNA, 22 nt, Homo sapiens
cuuuuugcugcagcaauacugg

SEQ ID NO: 82052 - RNA, 20 nt, Homo sapiens
cuuuuugcugugcugggagc

SEQ ID NO: 82053 - RNA, 22 nt, Homo sapiens
cuuuuugguagagcaggugugc

SEQ ID NO: 82054 - RNA, 21 nt, Homo sapiens
gaaauacugccuuaggagcug

SEQ ID NO: 82055 - RNA, 22 nt, Homo sapiens
gaacacaucuuugguuagagga

SEQ ID NO: 82056 - RNA, 22 nt, Homo sapiens
gaacugggguuggguugcgaua

SEQ ID NO: 82057 - RNA, 22 nt, Homo sapiens
gaacuuguguugcuucacaugu

SEQ ID NO: 82058 - RNA, 22 nt, Homo sapiens
gaagauguugcuuaccuuggag

SEQ ID NO: 82059 - RNA, 22 nt, Homo sapiens
gaaguaguaaaauuuauugcag

SEQ ID NO: 82060 - RNA, 17 nt, Homo sapiens
gaaguguuucuucauga

SEQ ID NO: 82061 - RNA, 22 nt, Homo sapiens
gaaucacugugguaucccaugc

SEQ ID NO: 82062 - RNA, 22 nt, Homo sapiens
gaaucauuguuucuaaguuugu

SEQ ID NO: 82063 - RNA, 22 nt, Homo sapiens
gaaucccuugcauuaucccuuu

SEQ ID NO: 82064 - RNA, 22 nt, Homo sapiens
gacagacacaauugauccauga

SEQ ID NO: 82065 - RNA, 22 nt, Homo sapiens
gacaguuucucaggcuuccuua

SEQ ID NO: 82066 - RNA, 22 nt, Homo sapiens
gaccaaagaggcaggcauuaga

SEQ ID NO: 82067 - RNA, 21 nt, Homo sapiens
gaccacagcagggaaugucag

SEQ ID NO: 82068 - RNA, 22 nt, Homo sapiens
gacuggccuauaauggcgaauu

SEQ ID NO: 82069 - RNA, 22 nt, Homo sapiens
gacuuagagauguuguauuugg

SEQ ID NO: 82070 - RNA, 22 nt, Homo sapiens
gagaacuaaugauguacuaggc

SEQ ID NO: 82071 - RNA, 22 nt, Homo sapiens
gagaaugagaggggaaggccac

SEQ ID NO: 82072 - RNA, 22 nt, Homo sapiens
gagacagugucagccauugaaa

SEQ ID NO: 82073 - RNA, 22 nt, Homo sapiens
gagacggagucacgcccuguca

SEQ ID NO: 82074 - RNA, 22 nt, Homo sapiens
gagacggagucucgcucuguca

SEQ ID NO: 82075 - RNA, 22 nt, Homo sapiens
gagauaaauaggucacaguucu

SEQ ID NO: 82076 - RNA, 22 nt, Homo sapiens
gagauaggauucacuuucaugu

SEQ ID NO: 82077 - RNA, 23 nt, Homo sapiens
gagaucauucuggaauuagagug

SEQ ID NO: 82078 - RNA, 22 nt, Homo sapiens
gagaucuauuccucacccuucu

SEQ ID NO: 82079 - RNA, 22 nt, Homo sapiens
gagauuaauacacaucaaaugc

SEQ ID NO: 82080 - RNA, 22 nt, Homo sapiens
gagauuuucagcuugacuggga

SEQ ID NO: 82081 - RNA, 22 nt, Homo sapiens
gagcuccuccccuuggcuuuca

SEQ ID NO: 82082 - RNA, 22 nt, Homo sapiens
gagguaugugggcagacauuua

SEQ ID NO: 82083 - RNA, 22 nt, Homo sapiens
gagguguagucaugccaagauc

SEQ ID NO: 82084 - RNA, 22 nt, Homo sapiens
gagguuauuggggugcuugugu

SEQ ID NO: 82085 - RNA, 22 nt, Homo sapiens
gaguagaacugguuaucuaaua

SEQ ID NO: 82086 - RNA, 23 nt, Homo sapiens
gagugcaaugacaugaucucgga

SEQ ID NO: 82087 - RNA, 22 nt, Homo sapiens
gagugcaauggugccaucucgg

SEQ ID NO: 82088 - RNA, 22 nt, Homo sapiens
gaguucaaaucucagcucuguu

SEQ ID NO: 82089 - RNA, 22 nt, Homo sapiens
gauaaaucuuggcuagucuaag

SEQ ID NO: 82090 - RNA, 22 nt, Homo sapiens
gauauguugaguagaguuuuug

SEQ ID NO: 82091 - RNA, 22 nt, Homo sapiens
gauauguuucuucaauaccuag

SEQ ID NO: 82092 - RNA, 22 nt, Homo sapiens
gaucaauuggcugaagacacgu

SEQ ID NO: 82093 - RNA, 22 nt, Homo sapiens
gaugcaguaagaaugcauagcg

SEQ ID NO: 82094 - RNA, 22 nt, Homo sapiens
gauggaauuaaaaucagaauca

SEQ ID NO: 82095 - RNA, 22 nt, Homo sapiens
gcaaaauugagaagggaauaua

SEQ ID NO: 82096 - RNA, 22 nt, Homo sapiens
gcaaaguguuuuccaacuuggu

SEQ ID NO: 82097 - RNA, 20 nt, Homo sapiens
gcaaauggaucccacaagcc

SEQ ID NO: 82098 - RNA, 22 nt, Homo sapiens
gcaagaaucugggaguaaaauu

SEQ ID NO: 82099 - RNA, 22 nt, Homo sapiens
gcaagagguaucuuauuuuccc

SEQ ID NO: 82100 - RNA, 22 nt, Homo sapiens
gcacaggguuacauucuaaggu

SEQ ID NO: 82101 - RNA, 22 nt, Homo sapiens
gcaccacugcacucucagcuug

SEQ ID NO: 82102 - RNA, 22 nt, Homo sapiens
gcacgugcacccacaugcacgu

SEQ ID NO: 82103 - RNA, 17 nt, Homo sapiens
gcacuggcguaucccac

SEQ ID NO: 82104 - RNA, 22 nt, Homo sapiens
gcacugggccacauuuauuuuc

SEQ ID NO: 82105 - RNA, 22 nt, Homo sapiens
gcagcacauggcagaacauauu

SEQ ID NO: 82106 - RNA, 22 nt, Homo sapiens
gcaguacacuguugguaggaau

SEQ ID NO: 82107 - RNA, 22 nt, Homo sapiens
gcaguagugcgaucucagcuca

SEQ ID NO: 82108 - RNA, 22 nt, Homo sapiens
gcaguagugugaucuuggcuca

SEQ ID NO: 82109 - RNA, 19 nt, Homo sapiens
gcaguauugaaggccaguc

SEQ ID NO: 82110 - RNA, 22 nt, Homo sapiens
gcagugacaugugccaguuuau

SEQ ID NO: 82111 - RNA, 20 nt, Homo sapiens
gcaguguucacuguauuccu

SEQ ID NO: 82112 - RNA, 22 nt, Homo sapiens
gcaguguucugggcaggaagaa

SEQ ID NO: 82113 - RNA, 22 nt, Homo sapiens
gcaucacagggagacaggccuc

SEQ ID NO: 82114 - RNA, 22 nt, Homo sapiens
gcaugcacaugugaaaaaauga

SEQ ID NO: 82115 - RNA, 20 nt, Homo sapiens
gccacaguuaagcuucugcc

SEQ ID NO: 82116 - RNA, 22 nt, Homo sapiens
gccauugcacuacagccuaggc

SEQ ID NO: 82117 - RNA, 22 nt, Homo sapiens
gccccgggugaugcagccguca

SEQ ID NO: 82118 - RNA, 22 nt, Homo sapiens
gccugagaggauaugauccccu

SEQ ID NO: 82119 - RNA, 22 nt, Homo sapiens
gcuaaaucuguaaaaugaggag

SEQ ID NO: 82120 - RNA, 22 nt, Homo sapiens
gcucguuuuugccucugguugc

SEQ ID NO: 82121 - RNA, 22 nt, Homo sapiens
gcugauggugcaguucuagccu

SEQ ID NO: 82122 - RNA, 22 nt, Homo sapiens
gcugcuguggcagauuggauuc

SEQ ID NO: 82123 - RNA, 22 nt, Homo sapiens
gcuggcaagaugcugaugcaac

SEQ ID NO: 82124 - RNA, 22 nt, Homo sapiens
gcugguguucaggcccucaguc

SEQ ID NO: 82125 - RNA, 22 nt, Homo sapiens
gcuugguccccacccaaaucgc

SEQ ID NO: 82126 - RNA, 21 nt, Homo sapiens
gcuuuuucggaagucuuuggc

SEQ ID NO: 82127 - RNA, 18 nt, Homo sapiens
ggaagauuggcuaugugc

SEQ ID NO: 82128 - RNA, 21 nt, Homo sapiens
ggaauguugccagcagccaga

SEQ ID NO: 82129 - RNA, 22 nt, Homo sapiens
ggacaucauuaccauggaccca

SEQ ID NO: 82130 - RNA, 22 nt, Homo sapiens
ggacuaggagcuaggaagaucu

SEQ ID NO: 82131 - RNA, 22 nt, Homo sapiens
ggagaugauuaugaaucacuua

SEQ ID NO: 82132 - RNA, 23 nt, Homo sapiens
ggauggaaaguuuugagggccac

SEQ ID NO: 82133 - RNA, 20 nt, Homo sapiens
ggcaagacccaaagugugug

SEQ ID NO: 82134 - RNA, 22 nt, Homo sapiens
ggcaaggaggggcacuuucacu

SEQ ID NO: 82135 - RNA, 22 nt, Homo sapiens
ggcaaggauguuuuucuggcaa

SEQ ID NO: 82136 - RNA, 22 nt, Homo sapiens
ggcaaguauguuuuaggaugcu

SEQ ID NO: 82137 - RNA, 22 nt, Homo sapiens
ggcagaucauuggccucaguuu

SEQ ID NO: 82138 - RNA, 22 nt, Homo sapiens
ggcagcgugcacuuucgccacu

SEQ ID NO: 82139 - RNA, 22 nt, Homo sapiens
ggcagcucaggccccgcgcuga

SEQ ID NO: 82140 - RNA, 22 nt, Homo sapiens
ggcaugaugcgcacgccuguag

SEQ ID NO: 82141 - RNA, 22 nt, Homo sapiens
ggcaugauggcugaggcuucug

SEQ ID NO: 82142 - RNA, 22 nt, Homo sapiens
ggcauguuuaguagaauguggu

SEQ ID NO: 82143 - RNA, 22 nt, Homo sapiens
ggcauugaguggguaggaguca

SEQ ID NO: 82144 - RNA, 22 nt, Homo sapiens
ggccagaugcaguggcucacac

SEQ ID NO: 82145 - RNA, 22 nt, Homo sapiens
ggccggguggccauggcugccc

SEQ ID NO: 82146 - RNA, 22 nt, Homo sapiens
ggccuguaggguauugguaggg

SEQ ID NO: 82147 - RNA, 22 nt, Homo sapiens
ggcuagagaauagugccacuaa

SEQ ID NO: 82148 - RNA, 22 nt, Homo sapiens
ggcuagagagcucagggauaug

SEQ ID NO: 82149 - RNA, 22 nt, Homo sapiens
ggcucguguuuucuguccaguu

SEQ ID NO: 82150 - RNA, 22 nt, Homo sapiens
ggcuuuggucacacaggggcaa

SEQ ID NO: 82151 - RNA, 22 nt, Homo sapiens
gggaauggaagacauuaugaug

SEQ ID NO: 82152 - RNA, 22 nt, Homo sapiens
ggguucccuucuggcucagggu

SEQ ID NO: 82153 - RNA, 22 nt, Homo sapiens
gguaacaguggggcuaugcuua

SEQ ID NO: 82154 - RNA, 22 nt, Homo sapiens
gguagacucuguaagugaucau

SEQ ID NO: 82155 - RNA, 22 nt, Homo sapiens
gguauguuuagaccauuuacau

SEQ ID NO: 82156 - RNA, 22 nt, Homo sapiens
ggucaggagaaugguaacugag

SEQ ID NO: 82157 - RNA, 22 nt, Homo sapiens
ggugaggaaaguugaguuucua

SEQ ID NO: 82158 - RNA, 22 nt, Homo sapiens
ggugcagcacaccaacauggca

SEQ ID NO: 82159 - RNA, 22 nt, Homo sapiens
guaagugguagagcugggcuau

SEQ ID NO: 82160 - RNA, 22 nt, Homo sapiens
guaaucucagcuacuugggagc

SEQ ID NO: 82161 - RNA, 19 nt, Homo sapiens
guaaucucaguacuuuggu

SEQ ID NO: 82162 - RNA, 22 nt, Homo sapiens
guacugagagacaguuacuguu

SEQ ID NO: 82163 - RNA, 22 nt, Homo sapiens
guagaggaauggcuccaccaua

SEQ ID NO: 82164 - RNA, 22 nt, Homo sapiens
guagcagcuacuaaguugcugu

SEQ ID NO: 82165 - RNA, 22 nt, Homo sapiens
guagcagucacauagcagauug

SEQ ID NO: 82166 - RNA, 23 nt, Homo sapiens
guaguuugaugcaauccacuugu

SEQ ID NO: 82167 - RNA, 22 nt, Homo sapiens
guaucauugccuaaugcucuca

SEQ ID NO: 82168 - RNA, 22 nt, Homo sapiens
guauuugauuauagcaugcuua

SEQ ID NO: 82169 - RNA, 22 nt, Homo sapiens
guauuuguugcagcagcacuau

SEQ ID NO: 82170 - RNA, 22 nt, Homo sapiens
gucacugagaagguuaguuugu

SEQ ID NO: 82171 - RNA, 22 nt, Homo sapiens
gucagcaaagaggaauaguuug

SEQ ID NO: 82172 - RNA, 22 nt, Homo sapiens
gucauccaggcuggagugaagc

SEQ ID NO: 82173 - RNA, 22 nt, Homo sapiens
gucucacaggcaugaugccagc

SEQ ID NO: 82174 - RNA, 22 nt, Homo sapiens
gucucuuguuaucauuucugag

SEQ ID NO: 82175 - RNA, 22 nt, Homo sapiens
gucuggagacuugggucaucaa

SEQ ID NO: 82176 - RNA, 22 nt, Homo sapiens
gucugugguuccuaugucaccu

SEQ ID NO: 82177 - RNA, 22 nt, Homo sapiens
gucuuugaugucuaugugcuuc

SEQ ID NO: 82178 - RNA, 22 nt, Homo sapiens
acccugcuaaacagcccccugc

SEQ ID NO: 82179 - RNA, 22 nt, Homo sapiens
accuggguguauguucaguuug

SEQ ID NO: 82180 - RNA, 22 nt, Homo sapiens
acugcacuccaaccuguugggc

SEQ ID NO: 82181 - RNA, 20 nt, Homo sapiens
acugcacuccaaccuuugug

SEQ ID NO: 82182 - RNA, 22 nt, Homo sapiens
acugcacuccagcccgggugac

SEQ ID NO: 82183 - RNA, 22 nt, Homo sapiens
acugcacuccagccuggacgac

SEQ ID NO: 82184 - RNA, 22 nt, Homo sapiens
acugcacuccagccuuggcaac

SEQ ID NO: 82185 - RNA, 22 nt, Homo sapiens
acugcacuccagccuuggcggc

SEQ ID NO: 82186 - RNA, 22 nt, Homo sapiens
acugcacuccagcuugggugac

SEQ ID NO: 82187 - RNA, 22 nt, Homo sapiens
acugcacuccagcuuuggugac

SEQ ID NO: 82188 - RNA, 22 nt, Homo sapiens
acugcacuccaguuugggcagc

SEQ ID NO: 82189 - RNA, 22 nt, Homo sapiens
ugucacaguuuguacuuuauag

SEQ ID NO: 82190 - RNA, 22 nt, Homo sapiens
ugucagcacaacucagguuccu

SEQ ID NO: 82191 - RNA, 22 nt, Homo sapiens
ugucaggagcaaugauaaauuu

SEQ ID NO: 82192 - RNA, 22 nt, Homo sapiens
ugucaggaggguccagagaaaa

SEQ ID NO: 82193 - RNA, 22 nt, Homo sapiens
ugucaggaugcuccuuuuggcu

SEQ ID NO: 82194 - RNA, 22 nt, Homo sapiens
ugucaguggucuggaugcagcc

SEQ ID NO: 82195 - RNA, 20 nt, Homo sapiens
ugucauuaagcacugugcca

SEQ ID NO: 82196 - RNA, 22 nt, Homo sapiens
uguccuguaggaggcagaacaa

SEQ ID NO: 82197 - RNA, 22 nt, Homo sapiens
ugucuggaguccauagaagugu

SEQ ID NO: 82198 - RNA, 16 nt, Homo sapiens
ugucuguuugggcaca

SEQ ID NO: 82199 - RNA, 22 nt, Homo sapiens
ugucuuugguucaggcaaggag

SEQ ID NO: 82200 - RNA, 22 nt, Homo sapiens
ugucuuuguuaguuguccuagu

SEQ ID NO: 82201 - RNA, 22 nt, Homo sapiens
ugugaacagcuccaaaugugga

SEQ ID NO: 82202 - RNA, 22 nt, Homo sapiens
ugugcacauugugcagguugau

SEQ ID NO: 82203 - RNA, 22 nt, Homo sapiens
ugugcaguuuugagugaauuuc

SEQ ID NO: 82204 - RNA, 22 nt, Homo sapiens
ugugcaugacagcauacaaacg

SEQ ID NO: 82205 - RNA, 22 nt, Homo sapiens
ugugccacuccagcucuagcuu

SEQ ID NO: 82206 - RNA, 22 nt, Homo sapiens
ugugccacuccaggaggcuguu

SEQ ID NO: 82207 - RNA, 22 nt, Homo sapiens
ugugccacugcacucccgccug

SEQ ID NO: 82208 - RNA, 22 nt, Homo sapiens
uguggaaauaaaagaaagguua

SEQ ID NO: 82209 - RNA, 22 nt, Homo sapiens
uguggaaauggugcuacgaaca

SEQ ID NO: 82210 - RNA, 22 nt, Homo sapiens
uguggaaauuguuguauuuaau

SEQ ID NO: 82211 - RNA, 22 nt, Homo sapiens
uguggcuuuuucuuggcugagg

SEQ ID NO: 82212 - RNA, 22 nt, Homo sapiens
ugugggaggugcuaauguaaau

SEQ ID NO: 82213 - RNA, 23 nt, Homo sapiens
ugugguauuauuccauuuauagg

SEQ ID NO: 82214 - RNA, 22 nt, Homo sapiens
ugugguuuuaguaaaacuaugu

SEQ ID NO: 82215 - RNA, 22 nt, Homo sapiens
ugugguuuuucacauuuagaga

SEQ ID NO: 82216 - RNA, 22 nt, Homo sapiens
uguguaauaccuuugacuauau

SEQ ID NO: 82217 - RNA, 22 nt, Homo sapiens
ugugucuuguuuauagcuuucu

SEQ ID NO: 82218 - RNA, 22 nt, Homo sapiens
uguuacagcagaauugaaagag

SEQ ID NO: 82219 - RNA, 22 nt, Homo sapiens
uguuacagcagcacaaaaugga

SEQ ID NO: 82220 - RNA, 22 nt, Homo sapiens
uguuagguuggugcaaaaguga

SEQ ID NO: 82221 - RNA, 22 nt, Homo sapiens
uguucacaguguuucuuugaga

SEQ ID NO: 82222 - RNA, 22 nt, Homo sapiens
uguucuggagccgguucaaaug

SEQ ID NO: 82223 - RNA, 22 nt, Homo sapiens
uguugcauuugucaaggucaag

SEQ ID NO: 82224 - RNA, 22 nt, Homo sapiens
uguuggacuuacuuggcagauu

SEQ ID NO: 82225 - RNA, 22 nt, Homo sapiens
uguuuaguuaagacauagaauu

SEQ ID NO: 82226 - RNA, 22 nt, Homo sapiens
uguuucuacugucucuguagua

SEQ ID NO: 82227 - RNA, 22 nt, Homo sapiens
uguuuguuugugauacgguaca

SEQ ID NO: 82228 - RNA, 22 nt, Homo sapiens
uuaaaagcuaucuccaagguca

SEQ ID NO: 82229 - RNA, 22 nt, Homo sapiens
uuaaaugucuguagaugugcug

SEQ ID NO: 82230 - RNA, 22 nt, Homo sapiens
uuaagaagugauuuuccucauu

SEQ ID NO: 82231 - RNA, 23 nt, Homo sapiens
uuaagcaacggcugcuuuucaga

SEQ ID NO: 82232 - RNA, 22 nt, Homo sapiens
uuaagcaguggauuagaauuuu

SEQ ID NO: 82233 - RNA, 22 nt, Homo sapiens
uuaaggcauucuuugucuucau

SEQ ID NO: 82234 - RNA, 22 nt, Homo sapiens
uuaaggcuuguacuuguuuucu

SEQ ID NO: 82235 - RNA, 22 nt, Homo sapiens
uuaaggcuuucccuauguaaaa

SEQ ID NO: 82236 - RNA, 22 nt, Homo sapiens
uuaaggguuuuagaauuuucca

SEQ ID NO: 82237 - RNA, 21 nt, Homo sapiens
uuaagugcuuuguaugcacua

SEQ ID NO: 82238 - RNA, 22 nt, Homo sapiens
uuaagugguagguggugcccaa

SEQ ID NO: 82239 - RNA, 19 nt, Homo sapiens
uuaagugugauaucucagu

SEQ ID NO: 82240 - RNA, 22 nt, Homo sapiens
uuaauagugacucauuuuccac

SEQ ID NO: 82241 - RNA, 22 nt, Homo sapiens
uuaaucacagcugaacucaaac

SEQ ID NO: 82242 - RNA, 22 nt, Homo sapiens
uuaaucugucuaugauuuuggu

SEQ ID NO: 82243 - RNA, 22 nt, Homo sapiens
uuaaugcuuuugggauauuucu

SEQ ID NO: 82244 - RNA, 22 nt, Homo sapiens
uuaauguaucuaucacaucaca

SEQ ID NO: 82245 - RNA, 22 nt, Homo sapiens
uuacagauggcacacucaaggg

SEQ ID NO: 82246 - RNA, 22 nt, Homo sapiens
uuacaguaugaguaagaguucu

SEQ ID NO: 82247 - RNA, 22 nt, Homo sapiens
uuacagucaaguuacauuucuc

SEQ ID NO: 82248 - RNA, 20 nt, Homo sapiens
uuacagugggaccuuccuga

SEQ ID NO: 82249 - RNA, 17 nt, Homo sapiens
uuagagguagacucauu

SEQ ID NO: 82250 - RNA, 18 nt, Homo sapiens
uuagagugcauuacuuug

SEQ ID NO: 82251 - RNA, 22 nt, Homo sapiens
uuagcacaucuuucuauguaag

SEQ ID NO: 82252 - RNA, 22 nt, Homo sapiens
uuaggcaguuuauugauuuuca

SEQ ID NO: 82253 - RNA, 22 nt, Homo sapiens
uuaggcuuuucagacacuucau

SEQ ID NO: 82254 - RNA, 22 nt, Homo sapiens
uuagguacuuuggagagauuca

SEQ ID NO: 82255 - RNA, 22 nt, Homo sapiens
uuagugaaugggugugauuugu

SEQ ID NO: 82256 - RNA, 22 nt, Homo sapiens
uuagugcuuacgaugagcuaag

SEQ ID NO: 82257 - RNA, 22 nt, Homo sapiens
uuauauguuuguacuuaggccu

SEQ ID NO: 82258 - RNA, 22 nt, Homo sapiens
uuaugaaguagguuaagagcag

SEQ ID NO: 82259 - RNA, 22 nt, Homo sapiens
uuaugcaucuuccacacucauu

SEQ ID NO: 82260 - RNA, 22 nt, Homo sapiens
uuauguccuuuaacuucaucac

SEQ ID NO: 82261 - RNA, 22 nt, Homo sapiens
uuauuagagauauuugguuagg

SEQ ID NO: 82262 - RNA, 22 nt, Homo sapiens
uuauucagcaccugcuguguuc

SEQ ID NO: 82263 - RNA, 22 nt, Homo sapiens
uuauucauuaacagggaccaaa

SEQ ID NO: 82264 - RNA, 22 nt, Homo sapiens
uuauugcacuccagccugggua

SEQ ID NO: 82265 - RNA, 22 nt, Homo sapiens
uuauugcuccagaggcugauuu

SEQ ID NO: 82266 - RNA, 22 nt, Homo sapiens
uuauugcuuuugugcaggugag

SEQ ID NO: 82267 - RNA, 22 nt, Homo sapiens
uucaaaguuggaggacaaacug

SEQ ID NO: 82268 - RNA, 22 nt, Homo sapiens
uucaauacuguugauccuuaug

SEQ ID NO: 82269 - RNA, 22 nt, Homo sapiens
uucacagaaaaaggcgaugagg

SEQ ID NO: 82270 - RNA, 22 nt, Homo sapiens
uucacaugacagggugaagcau

SEQ ID NO: 82271 - RNA, 22 nt, Homo sapiens
uucacaugguugccuuuugauc

SEQ ID NO: 82272 - RNA, 22 nt, Homo sapiens
uucacugagccagacuaagaca

SEQ ID NO: 82273 - RNA, 22 nt, Homo sapiens
uucacuggagcccaggaguugg

SEQ ID NO: 82274 - RNA, 22 nt, Homo sapiens
uucagaguggacagaaauuaag

SEQ ID NO: 82275 - RNA, 22 nt, Homo sapiens
uucagcaaugacagccuauaua

SEQ ID NO: 82276 - RNA, 22 nt, Homo sapiens
uucagcacaguguggaucauuc

SEQ ID NO: 82277 - RNA, 22 nt, Homo sapiens
uucagcuacuugggaggcugaa

SEQ ID NO: 82278 - RNA, 22 nt, Homo sapiens
uucaggcaccauugucauugau

SEQ ID NO: 82279 - RNA, 22 nt, Homo sapiens
uucaggcuuuuauuuacugaua

SEQ ID NO: 82280 - RNA, 22 nt, Homo sapiens
uucagggacuuuagacaagaga

SEQ ID NO: 82281 - RNA, 22 nt, Homo sapiens
uucagggcauuggaguuucuga

SEQ ID NO: 82282 - RNA, 22 nt, Homo sapiens
gauagugaaccaagggguaauu

SEQ ID NO: 82283 - RNA, 22 nt, Homo sapiens
gauauguacagcucucuaggau

SEQ ID NO: 82284 - RNA, 22 nt, Homo sapiens
gaucacaguuccucacgggcau

SEQ ID NO: 82285 - RNA, 22 nt, Homo sapiens
gaucugucuuuccuuauagucu

SEQ ID NO: 82286 - RNA, 22 nt, Homo sapiens
gauggcucugcaggugagggua

SEQ ID NO: 82287 - RNA, 22 nt, Homo sapiens
gauguuguuuagccuuugaugu

SEQ ID NO: 82288 - RNA, 22 nt, Homo sapiens
gauuucaucuuuagaggaagga

SEQ ID NO: 82289 - RNA, 22 nt, Homo sapiens
gauuugguguucuggcucaaga

SEQ ID NO: 82290 - RNA, 22 nt, Homo sapiens
gcaaaguguuuuuaggaagucu

SEQ ID NO: 82291 - RNA, 20 nt, Homo sapiens
gcaacauggccagagugaau

SEQ ID NO: 82292 - RNA, 22 nt, Homo sapiens
gcaaggacucccugggucauuc

SEQ ID NO: 82293 - RNA, 22 nt, Homo sapiens
gcacaguaggugguaggacuuu

SEQ ID NO: 82294 - RNA, 22 nt, Homo sapiens
gcacauggccccaucgugccga

SEQ ID NO: 82295 - RNA, 22 nt, Homo sapiens
gcaccauugacaagaaauaggu

SEQ ID NO: 82296 - RNA, 22 nt, Homo sapiens
gcacugagagaagccccaagua

SEQ ID NO: 82297 - RNA, 19 nt, Homo sapiens
gcagagaugugguagcuug

SEQ ID NO: 82298 - RNA, 23 nt, Homo sapiens
gcagcaaugucacagggguccgg

SEQ ID NO: 82299 - RNA, 20 nt, Homo sapiens
gcagcaccauauuucuaaga

SEQ ID NO: 82300 - RNA, 22 nt, Homo sapiens
gcagcagugugggcugaaccua

SEQ ID NO: 82301 - RNA, 22 nt, Homo sapiens
gcagcauuaccaagacauggca

SEQ ID NO: 82302 - RNA, 22 nt, Homo sapiens
gcaggcaugacauuucacucuu

SEQ ID NO: 82303 - RNA, 22 nt, Homo sapiens
gcagucacagggagauggugac

SEQ ID NO: 82304 - RNA, 22 nt, Homo sapiens
gcauaaagcuaauaagacgaag

SEQ ID NO: 82305 - RNA, 22 nt, Homo sapiens
gccaagauuuaauucaucaguu

SEQ ID NO: 82306 - RNA, 22 nt, Homo sapiens
ucacugcacuucaggcuuucuc

SEQ ID NO: 82307 - RNA, 22 nt, Homo sapiens
ucacugcgaccuccaccuccug

SEQ ID NO: 82308 - RNA, 22 nt, Homo sapiens
ucacugcgaccucugccucccg

SEQ ID NO: 82309 - RNA, 20 nt, Homo sapiens
ucacuggagcucauuugauu

SEQ ID NO: 82310 - RNA, 22 nt, Homo sapiens
ucacuguugaugggcaugcagg

SEQ ID NO: 82311 - RNA, 22 nt, Homo sapiens
ucacuuggccgcagccuucucu

SEQ ID NO: 82312 - RNA, 22 nt, Homo sapiens
ucagaguaguuccuggcagaaa

SEQ ID NO: 82313 - RNA, 22 nt, Homo sapiens
ucagagugcagggaguagcagc

SEQ ID NO: 82314 - RNA, 22 nt, Homo sapiens
ucagaugaucugguaagaacuu

SEQ ID NO: 82315 - RNA, 22 nt, Homo sapiens
ucagcaaugaccuaagcaaaua

SEQ ID NO: 82316 - RNA, 22 nt, Homo sapiens
ucagcagugugaaaacaaacua

SEQ ID NO: 82317 - RNA, 21 nt, Homo sapiens
ucagcucaucacugccuggag

SEQ ID NO: 82318 - RNA, 20 nt, Homo sapiens
ucaggcuccgcauuaacuua

SEQ ID NO: 82319 - RNA, 23 nt, Homo sapiens
ucagguaggccuagaguauucuu

SEQ ID NO: 82320 - RNA, 18 nt, Homo sapiens
ucagucacugccuggcuu

SEQ ID NO: 82321 - RNA, 22 nt, Homo sapiens
ucagugauugguuauuuuaggc

SEQ ID NO: 82322 - RNA, 22 nt, Homo sapiens
ucagugccauugccauaugagu

SEQ ID NO: 82323 - RNA, 22 nt, Homo sapiens
ucagugucaucuggguuguuug

SEQ ID NO: 82324 - RNA, 22 nt, Homo sapiens
ucagugucugugauggagaggu

SEQ ID NO: 82325 - RNA, 22 nt, Homo sapiens
ucagugucugugcaccgcugga

SEQ ID NO: 82326 - RNA, 22 nt, Homo sapiens
ucaguuaaugcugccugcugga

SEQ ID NO: 82327 - RNA, 23 nt, Homo sapiens
ucaucacagcauuuccugguauu

SEQ ID NO: 82328 - RNA, 22 nt, Homo sapiens
ucauccauacaguuagcaaagg

SEQ ID NO: 82329 - RNA, 22 nt, Homo sapiens
ucaucuggcgaaugugaagagu

SEQ ID NO: 82330 - RNA, 22 nt, Homo sapiens
ucaugcaaugagucaggaggca

SEQ ID NO: 82331 - RNA, 22 nt, Homo sapiens
ucaugcaaugcaaggggaaauu

SEQ ID NO: 82332 - RNA, 23 nt, Homo sapiens
ucauguauucccuguaaugggua

SEQ ID NO: 82333 - RNA, 22 nt, Homo sapiens
ucaugucuuguuguauuuauuu

SEQ ID NO: 82334 - RNA, 22 nt, Homo sapiens
uccacagugguggaauuguuca

SEQ ID NO: 82335 - RNA, 22 nt, Homo sapiens
uccacagugguugaacuaguuu

SEQ ID NO: 82336 - RNA, 22 nt, Homo sapiens
uccagguuuggcuuuauaacuu

SEQ ID NO: 82337 - RNA, 22 nt, Homo sapiens
uccagguuuugugaguuuaaau

SEQ ID NO: 82338 - RNA, 22 nt, Homo sapiens
uccaguagaauuuuauucaaca

SEQ ID NO: 82339 - RNA, 22 nt, Homo sapiens
uccagugcauucagacacuugg

SEQ ID NO: 82340 - RNA, 22 nt, Homo sapiens
uccaguuuggaggcuugaugug

SEQ ID NO: 82341 - RNA, 22 nt, Homo sapiens
uccaguuuucuuuccuagggcu

SEQ ID NO: 82342 - RNA, 20 nt, Homo sapiens
uccaguuuuggagacauucu

SEQ ID NO: 82343 - RNA, 22 nt, Homo sapiens
uccaugagaauaguuaggcucu

SEQ ID NO: 82344 - RNA, 19 nt, Homo sapiens
uccaugagcccacagugau

SEQ ID NO: 82345 - RNA, 22 nt, Homo sapiens
uccauugucuagauguaacaca

SEQ ID NO: 82346 - RNA, 22 nt, Homo sapiens
uccccgagcccaggcugugacu

SEQ ID NO: 82347 - RNA, 23 nt, Homo sapiens
uccccgggagcaccagcuuguug

SEQ ID NO: 82348 - RNA, 22 nt, Homo sapiens
uccccuuuguaagauggaaacg

SEQ ID NO: 82349 - RNA, 22 nt, Homo sapiens
ucccugaaaaauuggcuuaaca

SEQ ID NO: 82350 - RNA, 22 nt, Homo sapiens
ucccugaaucucagguucugua

SEQ ID NO: 82351 - RNA, 19 nt, Homo sapiens
ucccugagucuuagcuuga

SEQ ID NO: 82352 - RNA, 22 nt, Homo sapiens
ucccuguagugccuagaucaga

SEQ ID NO: 82353 - RNA, 22 nt, Homo sapiens
uccuucauuugucaacucuagu

SEQ ID NO: 82354 - RNA, 22 nt, Homo sapiens
uccuuuaguuaauaaagacaag

SEQ ID NO: 82355 - RNA, 22 nt, Homo sapiens
ucgcgccauucuccugccucag

SEQ ID NO: 82356 - RNA, 22 nt, Homo sapiens
ucgcugggaagacugaaguguc

SEQ ID NO: 82357 - RNA, 22 nt, Homo sapiens
ucggcucagugcaagcucugcc

SEQ ID NO: 82358 - RNA, 22 nt, Homo sapiens
ucuaagaauucauuuauaagcc

SEQ ID NO: 82359 - RNA, 22 nt, Homo sapiens
ucuaaguaguagcuggucagaa

SEQ ID NO: 82360 - RNA, 15 nt, Homo sapiens
ucuaguuuugaagac

SEQ ID NO: 82361 - RNA, 22 nt, Homo sapiens
ucucaaccuccacacuacaaua

SEQ ID NO: 82362 - RNA, 22 nt, Homo sapiens
ucucaagaugguagaugggaau

SEQ ID NO: 82363 - RNA, 22 nt, Homo sapiens
ucucacagaguugaacuuucuu

SEQ ID NO: 82364 - RNA, 18 nt, Homo sapiens
ucucacagcaaucuguca

SEQ ID NO: 82365 - RNA, 22 nt, Homo sapiens
ucucaguggcacccccaacacc

SEQ ID NO: 82366 - RNA, 22 nt, Homo sapiens
ucucaguggugcuggcagggga

SEQ ID NO: 82367 - RNA, 22 nt, Homo sapiens
ucucauagaggcagagaguaaa

SEQ ID NO: 82368 - RNA, 22 nt, Homo sapiens
ucucauggcucacccugcauag

SEQ ID NO: 82369 - RNA, 23 nt, Homo sapiens
ucucauuccuugaaaauaaugac

SEQ ID NO: 82370 - RNA, 22 nt, Homo sapiens
ucugagaucaugucugugcugu

SEQ ID NO: 82371 - RNA, 22 nt, Homo sapiens
ucugagcaauaaacaacauauu

SEQ ID NO: 82372 - RNA, 22 nt, Homo sapiens
ucuggccuacaaguaauuuuau

SEQ ID NO: 82373 - RNA, 22 nt, Homo sapiens
ucuggccuacaucauuuuuccg

SEQ ID NO: 82374 - RNA, 22 nt, Homo sapiens
ucuggccuagaacaauuaauua

SEQ ID NO: 82375 - RNA, 18 nt, Homo sapiens
ucuggcuucuuuguucca

SEQ ID NO: 82376 - RNA, 22 nt, Homo sapiens
ucuguaguuaacagcuucagcu

SEQ ID NO: 82377 - RNA, 22 nt, Homo sapiens
ucugucaaaucuuauguuguag

SEQ ID NO: 82378 - RNA, 22 nt, Homo sapiens
ucugugaaugaacacuugaaaa

SEQ ID NO: 82379 - RNA, 22 nt, Homo sapiens
ucuguugguucuuugaggagga

SEQ ID NO: 82380 - RNA, 22 nt, Homo sapiens
ucuucuagcggaacccucuugu

SEQ ID NO: 82381 - RNA, 22 nt, Homo sapiens
ucuugcaguucccaaauucaca

SEQ ID NO: 82382 - RNA, 22 nt, Homo sapiens
ucuugcauuuuuaaauagugcu

SEQ ID NO: 82383 - RNA, 22 nt, Homo sapiens
ucuuggacuuuugugagaaauc

SEQ ID NO: 82384 - RNA, 21 nt, Homo sapiens
ucuugguauguauuuaggagg

SEQ ID NO: 82385 - RNA, 22 nt, Homo sapiens
ucuugguuuauugauggagagg

SEQ ID NO: 82386 - RNA, 23 nt, Homo sapiens
ucuuguacuuugagugagcaugg

SEQ ID NO: 82387 - RNA, 15 nt, Homo sapiens
ucuuuaguuuuucuu

SEQ ID NO: 82388 - RNA, 22 nt, Homo sapiens
ucuuugagugcccugagucccu

SEQ ID NO: 82389 - RNA, 22 nt, Homo sapiens
ucuuugauuuuguuacuaagac

SEQ ID NO: 82390 - RNA, 22 nt, Homo sapiens
ucuuugguaauggaugucugau

SEQ ID NO: 82391 - RNA, 19 nt, Homo sapiens
ucuuugguacgugcuuuga

SEQ ID NO: 82392 - RNA, 22 nt, Homo sapiens
ucuuugguucugugcagccuau

SEQ ID NO: 82393 - RNA, 22 nt, Homo sapiens
ucuuuguguaggucaaucuggc

SEQ ID NO: 82394 - RNA, 22 nt, Homo sapiens
ucuuuguguucaggagccacgu

SEQ ID NO: 82395 - RNA, 22 nt, Homo sapiens
ugaaacugcagugggcuuggca

SEQ ID NO: 82396 - RNA, 22 nt, Homo sapiens
ugaaauuuuuuauucguuggcu

SEQ ID NO: 82397 - RNA, 22 nt, Homo sapiens
ugaagggcauuguuuugccaaa

SEQ ID NO: 82398 - RNA, 22 nt, Homo sapiens
ugaaguaggcauaaguuaagcu

SEQ ID NO: 82399 - RNA, 22 nt, Homo sapiens
ugaauagacagucacugccucc

SEQ ID NO: 82400 - RNA, 22 nt, Homo sapiens
gccauugcacuccagccuaggc

SEQ ID NO: 82401 - RNA, 22 nt, Homo sapiens
gccauugcacucuagccuaggu

SEQ ID NO: 82402 - RNA, 22 nt, Homo sapiens
gccccaguacaggcuccuuaga

SEQ ID NO: 82403 - RNA, 22 nt, Homo sapiens
gcgcagugggcugugccaucca

SEQ ID NO: 82404 - RNA, 22 nt, Homo sapiens
gcuaguguuugccagcguagcc

SEQ ID NO: 82405 - RNA, 19 nt, Homo sapiens
gcucaccuugcugcuccag

SEQ ID NO: 82406 - RNA, 22 nt, Homo sapiens
gcugauguuggccucugggcuu

SEQ ID NO: 82407 - RNA, 22 nt, Homo sapiens
gcuggguucagagugggcugcg

SEQ ID NO: 82408 - RNA, 22 nt, Homo sapiens
gcugguguagagugcagaaagg

SEQ ID NO: 82409 - RNA, 19 nt, Homo sapiens
gcugguuguccacucucuc

SEQ ID NO: 82410 - RNA, 22 nt, Homo sapiens
gcuguauugacuuuguaucaua

SEQ ID NO: 82411 - RNA, 22 nt, Homo sapiens
gcuguauuguugaaggaaaugu

SEQ ID NO: 82412 - RNA, 22 nt, Homo sapiens
gcuguugguaaaaaggacauga

SEQ ID NO: 82413 - RNA, 22 nt, Homo sapiens
gcuucauggaggcugggcgcag

SEQ ID NO: 82414 - RNA, 22 nt, Homo sapiens
gcuuguguuugcuccccagaau

SEQ ID NO: 82415 - RNA, 22 nt, Homo sapiens
ggaaauguuggugucaugaguu

SEQ ID NO: 82416 - RNA, 22 nt, Homo sapiens
ggaaauguuuagcauccacuuu

SEQ ID NO: 82417 - RNA, 18 nt, Homo sapiens
ggaagccuauuuaguaac

SEQ ID NO: 82418 - RNA, 17 nt, Homo sapiens
ggaagccuuugguuuaa

SEQ ID NO: 82419 - RNA, 22 nt, Homo sapiens
ggaagguaauuggcuaaugaga

SEQ ID NO: 82420 - RNA, 22 nt, Homo sapiens
ggaagguaauugucagcucaua

SEQ ID NO: 82421 - RNA, 21 nt, Homo sapiens
ggaauuuagggaaugauuuag

SEQ ID NO: 82422 - RNA, 20 nt, Homo sapiens
ggagguguugauuuuucuuu

SEQ ID NO: 82423 - RNA, 22 nt, Homo sapiens
ggagugucagaaacaguguccu

SEQ ID NO: 82424 - RNA, 22 nt, Homo sapiens
ggagugugauucaguauaauau

SEQ ID NO: 82425 - RNA, 22 nt, Homo sapiens
ggaucgauuccaaauguagauc

SEQ ID NO: 82426 - RNA, 22 nt, Homo sapiens
ggcaagaaccacaauuacuuuu

SEQ ID NO: 82427 - RNA, 22 nt, Homo sapiens
ggcaaggugaugaaugucuaca

SEQ ID NO: 82428 - RNA, 22 nt, Homo sapiens
ggcacgguggcucacaccugua

SEQ ID NO: 82429 - RNA, 22 nt, Homo sapiens
ggcagaauugcugaggaugcua

SEQ ID NO: 82430 - RNA, 22 nt, Homo sapiens
ggcagcaugggugccuuuguga

SEQ ID NO: 82431 - RNA, 23 nt, Homo sapiens
ggcagguuggucuaggucuauuc

SEQ ID NO: 82432 - RNA, 22 nt, Homo sapiens
ggccagaugcgguggcucacac

SEQ ID NO: 82433 - RNA, 22 nt, Homo sapiens
gggaaaaugucuauugaaugaa

SEQ ID NO: 82434 - RNA, 22 nt, Homo sapiens
gggaguguguaggacccagugu

SEQ ID NO: 82435 - RNA, 21 nt, Homo sapiens
gggcaaaucuuuauccuaagc

SEQ ID NO: 82436 - RNA, 22 nt, Homo sapiens
gggcagaugucuggacaccuca

SEQ ID NO: 82437 - RNA, 16 nt, Homo sapiens
gggcaugugaagccua

SEQ ID NO: 82438 - RNA, 22 nt, Homo sapiens
gggcaugugugugcacacacau

SEQ ID NO: 82439 - RNA, 22 nt, Homo sapiens
gggggagugugguacccagcau

SEQ ID NO: 82440 - RNA, 22 nt, Homo sapiens
gguaggcacuggugggaagaga

SEQ ID NO: 82441 - RNA, 22 nt, Homo sapiens
ggucaguguuaucaccgaagga

SEQ ID NO: 82442 - RNA, 22 nt, Homo sapiens
ggugaguggugcuuaaguucag

SEQ ID NO: 82443 - RNA, 22 nt, Homo sapiens
guaaaguaaagcacaucaaggu

SEQ ID NO: 82444 - RNA, 18 nt, Homo sapiens
guaaauguaucuauugcc

SEQ ID NO: 82445 - RNA, 22 nt, Homo sapiens
guaaauguccccugugauauug

SEQ ID NO: 82446 - RNA, 22 nt, Homo sapiens
guaagacuuauuuucuuuauca

SEQ ID NO: 82447 - RNA, 22 nt, Homo sapiens
guaaucucagcuacucgggaga

SEQ ID NO: 82448 - RNA, 22 nt, Homo sapiens
guaaucucagcuacuugggagu

SEQ ID NO: 82449 - RNA, 22 nt, Homo sapiens
guacacaacaugcagguuuguu

SEQ ID NO: 82450 - RNA, 22 nt, Homo sapiens
guacaguucucuuuguugucag

SEQ ID NO: 82451 - RNA, 22 nt, Homo sapiens
guauacacccugugauauuauu

SEQ ID NO: 82452 - RNA, 22 nt, Homo sapiens
guaucaucauguuggccaggcu

SEQ ID NO: 82453 - RNA, 22 nt, Homo sapiens
guaucccuugcuaucugaaucu

SEQ ID NO: 82454 - RNA, 22 nt, Homo sapiens
guauuuuguuagggugugguau

SEQ ID NO: 82455 - RNA, 22 nt, Homo sapiens
gucacugacaagagagaagaac

SEQ ID NO: 82456 - RNA, 22 nt, Homo sapiens
gucacugagauugguauuaaug

SEQ ID NO: 82457 - RNA, 22 nt, Homo sapiens
gucaggcaccgauacaguuuuu

SEQ ID NO: 82458 - RNA, 22 nt, Homo sapiens
gucagugucuuugcagcucaga

SEQ ID NO: 82459 - RNA, 22 nt, Homo sapiens
gucauggacaaggugugagcca

SEQ ID NO: 82460 - RNA, 21 nt, Homo sapiens
guccaaaacaguguccaaugc

SEQ ID NO: 82461 - RNA, 22 nt, Homo sapiens
guccaguacucuuuccugaaaa

SEQ ID NO: 82462 - RNA, 22 nt, Homo sapiens
gucccaguggaaccuccaagcu

SEQ ID NO: 82463 - RNA, 22 nt, Homo sapiens
gucuaugagucccugaauuuaa

SEQ ID NO: 82464 - RNA, 22 nt, Homo sapiens
gucuggcaauggcagacuggca

SEQ ID NO: 82465 - RNA, 21 nt, Homo sapiens
gucugguguuuuaaugaggac

SEQ ID NO: 82466 - RNA, 20 nt, Homo sapiens
gucugucuccgaguagaauu

SEQ ID NO: 82467 - RNA, 22 nt, Homo sapiens
gucugucuuuugucuuugaaau

SEQ ID NO: 82468 - RNA, 22 nt, Homo sapiens
gugaaaagaugagcaccauaca

SEQ ID NO: 82469 - RNA, 22 nt, Homo sapiens
gugaaagauuaaaccagugugu

SEQ ID NO: 82470 - RNA, 22 nt, Homo sapiens
gugacauuauuucagcuacaug

SEQ ID NO: 82471 - RNA, 22 nt, Homo sapiens
gugacugcauauaaguguaugu

SEQ ID NO: 82472 - RNA, 22 nt, Homo sapiens
gugagaggaggcagcuuuuaca

SEQ ID NO: 82473 - RNA, 22 nt, Homo sapiens
gugagauaucuagacuagggaa

SEQ ID NO: 82474 - RNA, 22 nt, Homo sapiens
gugagaugguaucucauugugg

SEQ ID NO: 82475 - RNA, 22 nt, Homo sapiens
gugagcauaacaacagaguuua

SEQ ID NO: 82476 - RNA, 22 nt, Homo sapiens
gugagguaauuagcucccuuag

SEQ ID NO: 82477 - RNA, 22 nt, Homo sapiens
gugaggucagggcuguggacag

SEQ ID NO: 82478 - RNA, 22 nt, Homo sapiens
gugaggucguagucauaggcaa

SEQ ID NO: 82479 - RNA, 22 nt, Homo sapiens
gugauauguuaggaucuaaguc

SEQ ID NO: 82480 - RNA, 22 nt, Homo sapiens
gugaucuucauggaaggugaaa

SEQ ID NO: 82481 - RNA, 22 nt, Homo sapiens
gugcaaaucucugaguaucuuu

SEQ ID NO: 82482 - RNA, 22 nt, Homo sapiens
gugcaaauguuauugagguuuu

SEQ ID NO: 82483 - RNA, 22 nt, Homo sapiens
gugcaaauuccagcucaacucc

SEQ ID NO: 82484 - RNA, 22 nt, Homo sapiens
gugcaacaucccuccauaauuu

SEQ ID NO: 82485 - RNA, 22 nt, Homo sapiens
gugcaagagugauugcaguuuu

SEQ ID NO: 82486 - RNA, 22 nt, Homo sapiens
gugcacaacaugcaguuuuguu

SEQ ID NO: 82487 - RNA, 22 nt, Homo sapiens
gugcacaacguguagguuuguu

SEQ ID NO: 82488 - RNA, 22 nt, Homo sapiens
gugcgggaggcgcgccuaggug

SEQ ID NO: 82489 - RNA, 22 nt, Homo sapiens
guggaaucuagagaggcaguag

SEQ ID NO: 82490 - RNA, 22 nt, Homo sapiens
guggacaugaauuuuggaggca

SEQ ID NO: 82491 - RNA, 22 nt, Homo sapiens
guggagacaaaggcugagugag

SEQ ID NO: 82492 - RNA, 22 nt, Homo sapiens
acccucaagggacugacagaau

SEQ ID NO: 82493 - RNA, 22 nt, Homo sapiens
acccugaagccaugaguggaac

SEQ ID NO: 82494 - RNA, 22 nt, Homo sapiens
acccugucauccacauggugcu

SEQ ID NO: 82495 - RNA, 22 nt, Homo sapiens
accgaguguucucccgcagcgg

SEQ ID NO: 82496 - RNA, 22 nt, Homo sapiens
accuucauuguugccaugucca

SEQ ID NO: 82497 - RNA, 20 nt, Homo sapiens
acuaaaucucauuuuaugca

SEQ ID NO: 82498 - RNA, 22 nt, Homo sapiens
acuacugucagacugccacuga

SEQ ID NO: 82499 - RNA, 22 nt, Homo sapiens
acucagagugggccccuagaua

SEQ ID NO: 82500 - RNA, 23 nt, Homo sapiens
acugagcaauguuuacauacuug

SEQ ID NO: 82501 - RNA, 19 nt, Homo sapiens
acugagcuaccugggggca

SEQ ID NO: 82502 - RNA, 22 nt, Homo sapiens
acugagucauugggugcccaga

SEQ ID NO: 82503 - RNA, 20 nt, Homo sapiens
acugauauguuccuguucuc

SEQ ID NO: 82504 - RNA, 22 nt, Homo sapiens
acugcacuccagccucccgucu

SEQ ID NO: 82505 - RNA, 22 nt, Homo sapiens
acugcacuccagccuccugggu

SEQ ID NO: 82506 - RNA, 22 nt, Homo sapiens
acugcacuccagccucggcaau

SEQ ID NO: 82507 - RNA, 22 nt, Homo sapiens
acugcacuccagccucggggac

SEQ ID NO: 82508 - RNA, 22 nt, Homo sapiens
acugcacuccagccugugagac

SEQ ID NO: 82509 - RNA, 22 nt, Homo sapiens
acugcacuccagccugugcgua

SEQ ID NO: 82510 - RNA, 20 nt, Homo sapiens
acugcacuccagccuuccag

SEQ ID NO: 82511 - RNA, 22 nt, Homo sapiens
acugcacuccagccuucggaca

SEQ ID NO: 82512 - RNA, 22 nt, Homo sapiens
acugcacuccagccuugauggc

SEQ ID NO: 82513 - RNA, 22 nt, Homo sapiens
acugcacuccagccuugugaca

SEQ ID NO: 82514 - RNA, 22 nt, Homo sapiens
acugcacuccagccuuugcgau

SEQ ID NO: 82515 - RNA, 22 nt, Homo sapiens
acugcacuccagcuccagggug

SEQ ID NO: 82516 - RNA, 20 nt, Homo sapiens
acugcacuccaggcugccca

SEQ ID NO: 82517 - RNA, 22 nt, Homo sapiens
acugcacuccaguuccgggcaa

SEQ ID NO: 82518 - RNA, 18 nt, Homo sapiens
acugcacuccauccuagg

SEQ ID NO: 82519 - RNA, 22 nt, Homo sapiens
acugcacucccgcccgggugac

SEQ ID NO: 82520 - RNA, 22 nt, Homo sapiens
acugcacuccggccuggcaaca

SEQ ID NO: 82521 - RNA, 22 nt, Homo sapiens
acugcacuccuccuugggugac

SEQ ID NO: 82522 - RNA, 22 nt, Homo sapiens
acugcacucuagccccugcgac

SEQ ID NO: 82523 - RNA, 22 nt, Homo sapiens
acugcacuucaaccucauugac

SEQ ID NO: 82524 - RNA, 22 nt, Homo sapiens
acugcacuucagccuuggcuac

SEQ ID NO: 82525 - RNA, 22 nt, Homo sapiens
acugcacuucagccuuggggac

SEQ ID NO: 82526 - RNA, 22 nt, Homo sapiens
acuggacuuaaugaugaauugu

SEQ ID NO: 82527 - RNA, 18 nt, Homo sapiens
acuggauguaaagggucc

SEQ ID NO: 82528 - RNA, 22 nt, Homo sapiens
acuggauguuagggauuuuauu

SEQ ID NO: 82529 - RNA, 22 nt, Homo sapiens
acuggcauagggcgggcacagu

SEQ ID NO: 82530 - RNA, 22 nt, Homo sapiens
acuugacacuuauauuacucac

SEQ ID NO: 82531 - RNA, 21 nt, Homo sapiens
acuuucuguggcaguccauuc

SEQ ID NO: 82532 - RNA, 22 nt, Homo sapiens
acuuuuguuauacagugugaua

SEQ ID NO: 82533 - RNA, 22 nt, Homo sapiens
acuuuuugaugaggucguuugu

SEQ ID NO: 82534 - RNA, 22 nt, Homo sapiens
agaaacauucucuugccuccuu

SEQ ID NO: 82535 - RNA, 22 nt, Homo sapiens
agaaugugaccuuauuuggaga

SEQ ID NO: 82536 - RNA, 22 nt, Homo sapiens
agacaagauggcuugagguuca

SEQ ID NO: 82537 - RNA, 21 nt, Homo sapiens
agacacuuggaagguuuuaga

SEQ ID NO: 82538 - RNA, 20 nt, Homo sapiens
agacagcugcagcccacauc

SEQ ID NO: 82539 - RNA, 22 nt, Homo sapiens
agacuagagggaaaugaguugg

SEQ ID NO: 82540 - RNA, 22 nt, Homo sapiens
agagaacugauuggaguugggc

SEQ ID NO: 82541 - RNA, 22 nt, Homo sapiens
agagaucauuuuguuucaaauc

SEQ ID NO: 82542 - RNA, 18 nt, Homo sapiens
agagcuaugaacauaugc

SEQ ID NO: 82543 - RNA, 22 nt, Homo sapiens
agagguagaagauaggcuacag

SEQ ID NO: 82544 - RNA, 22 nt, Homo sapiens
agagguaugccugggcuggagc

SEQ ID NO: 82545 - RNA, 22 nt, Homo sapiens
agagguuuugcacugguucuuu

SEQ ID NO: 82546 - RNA, 22 nt, Homo sapiens
agaguaguaggaugaauggacu

SEQ ID NO: 82547 - RNA, 19 nt, Homo sapiens
agaguauuguuacuucucu

SEQ ID NO: 82548 - RNA, 22 nt, Homo sapiens
agagugcaauggcaccaucucg

SEQ ID NO: 82549 - RNA, 22 nt, Homo sapiens
agaucacagucuuugguuuuag

SEQ ID NO: 82550 - RNA, 22 nt, Homo sapiens
agaugcauuuuuauuggaauac

SEQ ID NO: 82551 - RNA, 22 nt, Homo sapiens
agaugccucauguucuagguuc

SEQ ID NO: 82552 - RNA, 22 nt, Homo sapiens
agauggugauaaaugugguacc

SEQ ID NO: 82553 - RNA, 22 nt, Homo sapiens
agaugguguuuucucaccagau

SEQ ID NO: 82554 - RNA, 22 nt, Homo sapiens
agcacagccuuguguuuucuug

SEQ ID NO: 82555 - RNA, 22 nt, Homo sapiens
agcacagugguuaaguuucuua

SEQ ID NO: 82556 - RNA, 22 nt, Homo sapiens
agcaccaauaaucagaguucuu

SEQ ID NO: 82557 - RNA, 22 nt, Homo sapiens
agcaccauugcacuccagccug

SEQ ID NO: 82558 - RNA, 22 nt, Homo sapiens
agcagcacaucccuuucuggcc

SEQ ID NO: 82559 - RNA, 22 nt, Homo sapiens
agcagcaugcaaauggacuaau

SEQ ID NO: 82560 - RNA, 20 nt, Homo sapiens
agcagccacagauuccucag

SEQ ID NO: 82561 - RNA, 17 nt, Homo sapiens
agcagcccauaucccca

SEQ ID NO: 82562 - RNA, 16 nt, Homo sapiens
agccaccauuuacuug

SEQ ID NO: 82563 - RNA, 22 nt, Homo sapiens
agcccuuagauggcuccuucca

SEQ ID NO: 82564 - RNA, 22 nt, Homo sapiens
agcggcuguuccccuggucuau

SEQ ID NO: 82565 - RNA, 22 nt, Homo sapiens
agcucuuguuaguauuagcagu

SEQ ID NO: 82566 - RNA, 22 nt, Homo sapiens
aggcacgguggcucacaccugu

SEQ ID NO: 82567 - RNA, 22 nt, Homo sapiens
aggcacggugucucaugccugu

SEQ ID NO: 82568 - RNA, 22 nt, Homo sapiens
aggcaggugaaagauaguuuua

SEQ ID NO: 82569 - RNA, 22 nt, Homo sapiens
aggcaugauuguauuuugcucu

SEQ ID NO: 82570 - RNA, 22 nt, Homo sapiens
aggcauguggcucuguucugac

SEQ ID NO: 82571 - RNA, 23 nt, Homo sapiens
aggccaguuuuuccugcuugcug

SEQ ID NO: 82572 - RNA, 22 nt, Homo sapiens
aggcuuauuaagauucccuuau

SEQ ID NO: 82573 - RNA, 22 nt, Homo sapiens
agggcaguguuaggacugucug

SEQ ID NO: 82574 - RNA, 22 nt, Homo sapiens
agggcuuaucuguguagaguuc

SEQ ID NO: 82575 - RNA, 22 nt, Homo sapiens
aggugcuugaaucuaugagcuc

SEQ ID NO: 82576 - RNA, 22 nt, Homo sapiens
aggugguauuucaaaguggcag

SEQ ID NO: 82577 - RNA, 22 nt, Homo sapiens
agguuaucccgcauuauuuggu

SEQ ID NO: 82578 - RNA, 22 nt, Homo sapiens
agucaagugggguuagauaguu

SEQ ID NO: 82579 - RNA, 22 nt, Homo sapiens
agucagugucuguaaggagaac

SEQ ID NO: 82580 - RNA, 22 nt, Homo sapiens
agucgguguuacugacagaaug

SEQ ID NO: 82581 - RNA, 23 nt, Homo sapiens
agucuguguuuacaggcucucug

SEQ ID NO: 82582 - RNA, 22 nt, Homo sapiens
agugaauuguucaacaggagga

SEQ ID NO: 82583 - RNA, 22 nt, Homo sapiens
agugacaugggaucaaaucuga

SEQ ID NO: 82584 - RNA, 22 nt, Homo sapiens
agugcaguggcauggucauaac

SEQ ID NO: 82585 - RNA, 22 nt, Homo sapiens
agugcaguggcucaaaaugccu

SEQ ID NO: 82586 - RNA, 22 nt, Homo sapiens
agugccacugcacucuagccug

SEQ ID NO: 82587 - RNA, 23 nt, Homo sapiens
aguggucuccugggcccagcugu

SEQ ID NO: 82588 - RNA, 22 nt, Homo sapiens
aguguuuuuaucaugaaagggu

SEQ ID NO: 82589 - RNA, 22 nt, Homo sapiens
aguguuuuucaugggauacuuu

SEQ ID NO: 82590 - RNA, 22 nt, Homo sapiens
aguuggugauugauugggucug

SEQ ID NO: 82591 - RNA, 22 nt, Homo sapiens
auaaagguaagcacuauccuga

SEQ ID NO: 82592 - RNA, 22 nt, Homo sapiens
auaaauaguaguugugguggcc

SEQ ID NO: 82593 - RNA, 22 nt, Homo sapiens
auaaaugcaaugguauuuuuga

SEQ ID NO: 82594 - RNA, 22 nt, Homo sapiens
auaagaagugaaccagacgucu

SEQ ID NO: 82595 - RNA, 22 nt, Homo sapiens
auaagaguaguacauaugagac

SEQ ID NO: 82596 - RNA, 22 nt, Homo sapiens
auaaggcuaguguaggagccag

SEQ ID NO: 82597 - RNA, 22 nt, Homo sapiens
auaaguauuuggacuuuacugu

SEQ ID NO: 82598 - RNA, 22 nt, Homo sapiens
auacacuggagcaaaccuggag

SEQ ID NO: 82599 - RNA, 22 nt, Homo sapiens
auacaguugccauuucuugugc

SEQ ID NO: 82600 - RNA, 22 nt, Homo sapiens
auacaugugugagcgaagaugu

SEQ ID NO: 82601 - RNA, 22 nt, Homo sapiens
auacauguucaagggcauauau

SEQ ID NO: 82602 - RNA, 22 nt, Homo sapiens
auacuguuucugaacuuugauu

SEQ ID NO: 82603 - RNA, 22 nt, Homo sapiens
auacuguuuuacaucauugccu

SEQ ID NO: 82604 - RNA, 22 nt, Homo sapiens
auagcaaugccccaauccuugg

SEQ ID NO: 82605 - RNA, 22 nt, Homo sapiens
auagcacaguguguguacacca

SEQ ID NO: 82606 - RNA, 22 nt, Homo sapiens
auagcacuuaccacaggcugca

SEQ ID NO: 82607 - RNA, 22 nt, Homo sapiens
auauaccuaggcuacaugguuu

SEQ ID NO: 82608 - RNA, 22 nt, Homo sapiens
auaucacagguguuuaccugau

SEQ ID NO: 82609 - RNA, 22 nt, Homo sapiens
auauguauuuuaacguguaagg

SEQ ID NO: 82610 - RNA, 21 nt, Homo sapiens
auaugugcuguggaagucagc

SEQ ID NO: 82611 - RNA, 22 nt, Homo sapiens
auauucaagugaggauggcuaa

SEQ ID NO: 82612 - RNA, 22 nt, Homo sapiens
auauugacuuucucuuagauca

SEQ ID NO: 82613 - RNA, 22 nt, Homo sapiens
auauugguuaaauauuauguga

SEQ ID NO: 82614 - RNA, 20 nt, Homo sapiens
aucaaagacuuagaggggga

SEQ ID NO: 82615 - RNA, 22 nt, Homo sapiens
aucaaagugaauuaaugagaau

SEQ ID NO: 82616 - RNA, 22 nt, Homo sapiens
aucaagcuggcauauguaguuc

SEQ ID NO: 82617 - RNA, 22 nt, Homo sapiens
aucaaguaaucugaguaagagu

SEQ ID NO: 82618 - RNA, 22 nt, Homo sapiens
aucacagguacuauggcugaca

SEQ ID NO: 82619 - RNA, 22 nt, Homo sapiens
aucacagugaaaacagucaauu

SEQ ID NO: 82620 - RNA, 22 nt, Homo sapiens
aucacauggccagguaguaauc

SEQ ID NO: 82621 - RNA, 22 nt, Homo sapiens
aucaccuggaguagcccguccc

SEQ ID NO: 82622 - RNA, 21 nt, Homo sapiens
aucagagacccaggcuuccuc

SEQ ID NO: 82623 - RNA, 22 nt, Homo sapiens
auccacagugucaauguuguga

SEQ ID NO: 82624 - RNA, 22 nt, Homo sapiens
auccacauucauggaccagucc

SEQ ID NO: 82625 - RNA, 22 nt, Homo sapiens
aucccgagacuuugcugaaguu

SEQ ID NO: 82626 - RNA, 22 nt, Homo sapiens
aucccuugacguggagucucug

SEQ ID NO: 82627 - RNA, 22 nt, Homo sapiens
auccuacaguccauucuuugug

SEQ ID NO: 82628 - RNA, 22 nt, Homo sapiens
aucgugucuggcccugaaugcu

SEQ ID NO: 82629 - RNA, 22 nt, Homo sapiens
aucucugagauguucugauuuu

SEQ ID NO: 82630 - RNA, 22 nt, Homo sapiens
aucugcaaagcugggcugagac

SEQ ID NO: 82631 - RNA, 22 nt, Homo sapiens
aucuguagauucagcacaagcu

SEQ ID NO: 82632 - RNA, 22 nt, Homo sapiens
aucuugcauuugcuaaaaugca

SEQ ID NO: 82633 - RNA, 22 nt, Homo sapiens
aucuugggugggaacugagaau

SEQ ID NO: 82634 - RNA, 22 nt, Homo sapiens
aucuuuggcgggaauaucacag

SEQ ID NO: 82635 - RNA, 22 nt, Homo sapiens
augaaaacaugauuugccuguu

SEQ ID NO: 82636 - RNA, 22 nt, Homo sapiens
uucauguaauauuucacagcuu

SEQ ID NO: 82637 - RNA, 22 nt, Homo sapiens
uucauugcugcuuaucuccaga

SEQ ID NO: 82638 - RNA, 22 nt, Homo sapiens
uuccacaaugguugaacuagcu

SEQ ID NO: 82639 - RNA, 22 nt, Homo sapiens
uuccacaaugguugaacuaguu

SEQ ID NO: 82640 - RNA, 22 nt, Homo sapiens
uuccacuuuuuccuugugcucc

SEQ ID NO: 82641 - RNA, 22 nt, Homo sapiens
uuccaguaauagcacagcauug

SEQ ID NO: 82642 - RNA, 22 nt, Homo sapiens
uucccuagaacacauggaggga

SEQ ID NO: 82643 - RNA, 22 nt, Homo sapiens
uucccucagaaacacacagccc

SEQ ID NO: 82644 - RNA, 22 nt, Homo sapiens
uucccuuugaaacuaaacuugc

SEQ ID NO: 82645 - RNA, 19 nt, Homo sapiens
uuccugagaacaagggcuu

SEQ ID NO: 82646 - RNA, 22 nt, Homo sapiens
uuccuguagcgauuuuaguaau

SEQ ID NO: 82647 - RNA, 22 nt, Homo sapiens
uuccugugacccccaagcccac

SEQ ID NO: 82648 - RNA, 22 nt, Homo sapiens
uucuaaacaucuuacaaugcau

SEQ ID NO: 82649 - RNA, 21 nt, Homo sapiens
uucuaaguaaauguuggacau

SEQ ID NO: 82650 - RNA, 22 nt, Homo sapiens
uucucuggucagaggggagguu

SEQ ID NO: 82651 - RNA, 22 nt, Homo sapiens
uucugagguuauauucucucaa

SEQ ID NO: 82652 - RNA, 22 nt, Homo sapiens
uucugcuugaucuaguguguug

SEQ ID NO: 82653 - RNA, 22 nt, Homo sapiens
uucugguuaauacuugcaaaaa

SEQ ID NO: 82654 - RNA, 22 nt, Homo sapiens
uucuuagucauguaauagucca

SEQ ID NO: 82655 - RNA, 22 nt, Homo sapiens
uucuuugcaugaucucaaaguc

SEQ ID NO: 82656 - RNA, 22 nt, Homo sapiens
uucuuuggaaacaguacuaauu

SEQ ID NO: 82657 - RNA, 22 nt, Homo sapiens
uucuuugguacaagggccgacc

SEQ ID NO: 82658 - RNA, 22 nt, Homo sapiens
uugaaagaaaggagacugaguu

SEQ ID NO: 82659 - RNA, 22 nt, Homo sapiens
uugaaagacagaggggcaaguu

SEQ ID NO: 82660 - RNA, 22 nt, Homo sapiens
uugaaagacaucaccuacugcu

SEQ ID NO: 82661 - RNA, 22 nt, Homo sapiens
uugaagacuaccuaccauacuu

SEQ ID NO: 82662 - RNA, 22 nt, Homo sapiens
uugaaugaaaugaugucauuug

SEQ ID NO: 82663 - RNA, 17 nt, Homo sapiens
uugaaugcauuacuugg

SEQ ID NO: 82664 - RNA, 22 nt, Homo sapiens
uugaauguaugcuggguuuacu

SEQ ID NO: 82665 - RNA, 23 nt, Homo sapiens
uugaauguuuccccucccaaauu

SEQ ID NO: 82666 - RNA, 22 nt, Homo sapiens
uugacuuuuaggaggaaaauga

SEQ ID NO: 82667 - RNA, 22 nt, Homo sapiens
uugagauagaauaggaauggga

SEQ ID NO: 82668 - RNA, 22 nt, Homo sapiens
uugagauggagucucgcugugu

SEQ ID NO: 82669 - RNA, 22 nt, Homo sapiens
uugagauggagucuuguucuuu

SEQ ID NO: 82670 - RNA, 22 nt, Homo sapiens
uugagauuuuccucaaauauuu

SEQ ID NO: 82671 - RNA, 22 nt, Homo sapiens
uugagcacauguguuaaggggu

SEQ ID NO: 82672 - RNA, 22 nt, Homo sapiens
uugaggaaugucauuuguguuu

SEQ ID NO: 82673 - RNA, 22 nt, Homo sapiens
uugagguauaaagguagguugu

SEQ ID NO: 82674 - RNA, 20 nt, Homo sapiens
uugaggugugaggggcagag

SEQ ID NO: 82675 - RNA, 22 nt, Homo sapiens
uugaucuggagagaggcccgug

SEQ ID NO: 82676 - RNA, 22 nt, Homo sapiens
uugcaaaguugccaaggaagga

SEQ ID NO: 82677 - RNA, 21 nt, Homo sapiens
uugcaaaugcugcugccugau

SEQ ID NO: 82678 - RNA, 20 nt, Homo sapiens
uugcacagagaaggaggcag

SEQ ID NO: 82679 - RNA, 22 nt, Homo sapiens
uugcacauguugaaccagcaaa

SEQ ID NO: 82680 - RNA, 22 nt, Homo sapiens
uugcacuccagccuggaugaca

SEQ ID NO: 82681 - RNA, 19 nt, Homo sapiens
augaacucaucauuucuca

SEQ ID NO: 82682 - RNA, 22 nt, Homo sapiens
augaaugcagcacuguuuuucu

SEQ ID NO: 82683 - RNA, 22 nt, Homo sapiens
augagagcaacaccuucacuug

SEQ ID NO: 82684 - RNA, 22 nt, Homo sapiens
augagaugauaggcguucuaac

SEQ ID NO: 82685 - RNA, 22 nt, Homo sapiens
augagcagaugcuccugccucu

SEQ ID NO: 82686 - RNA, 22 nt, Homo sapiens
augaggaagucaggcccagggg

SEQ ID NO: 82687 - RNA, 22 nt, Homo sapiens
augagggagggguggugccgca

SEQ ID NO: 82688 - RNA, 22 nt, Homo sapiens
augauacuggcuucauagaaug

SEQ ID NO: 82689 - RNA, 22 nt, Homo sapiens
augauccagugaguuucaguuc

SEQ ID NO: 82690 - RNA, 22 nt, Homo sapiens
augauucugaucuagagcuugg

SEQ ID NO: 82691 - RNA, 22 nt, Homo sapiens
augcaacugcacuccagccugg

SEQ ID NO: 82692 - RNA, 22 nt, Homo sapiens
augcauauuuuaccuagaagag

SEQ ID NO: 82693 - RNA, 19 nt, Homo sapiens
augccacagugaggucaga

SEQ ID NO: 82694 - RNA, 22 nt, Homo sapiens
augcuacauucuacaauuaggc

SEQ ID NO: 82695 - RNA, 22 nt, Homo sapiens
augcuggugguucacaugcgca

SEQ ID NO: 82696 - RNA, 19 nt, Homo sapiens
augcugguguugcucaaac

SEQ ID NO: 82697 - RNA, 22 nt, Homo sapiens
augcuuguugcagccugagccu

SEQ ID NO: 82698 - RNA, 22 nt, Homo sapiens
auggaaacauaagaguauagau

SEQ ID NO: 82699 - RNA, 22 nt, Homo sapiens
auggaacauaacuauuugggga

SEQ ID NO: 82700 - RNA, 22 nt, Homo sapiens
auggaauguaaguuauguuugc

SEQ ID NO: 82701 - RNA, 22 nt, Homo sapiens
auggacauuaaagcgauguaga

SEQ ID NO: 82702 - RNA, 22 nt, Homo sapiens
auggagagaauuauucucucag

SEQ ID NO: 82703 - RNA, 22 nt, Homo sapiens
auggauuuugaacuugagaguu

SEQ ID NO: 82704 - RNA, 22 nt, Homo sapiens
auggcaaugcgaugaugacuga

SEQ ID NO: 82705 - RNA, 22 nt, Homo sapiens
guacaugcauacaugcacaucu

SEQ ID NO: 82706 - RNA, 22 nt, Homo sapiens
guaguuuaucagaaagaauagg

SEQ ID NO: 82707 - RNA, 22 nt, Homo sapiens
guauaguaguacaaaaguuuuu

SEQ ID NO: 82708 - RNA, 22 nt, Homo sapiens
guaucaugaaguuucuucauuu

SEQ ID NO: 82709 - RNA, 22 nt, Homo sapiens
gucaacauauuaauuauguucu

SEQ ID NO: 82710 - RNA, 22 nt, Homo sapiens
gucaaggaauuuauccauuucu

SEQ ID NO: 82711 - RNA, 22 nt, Homo sapiens
gucaagugaagcagugggagua

SEQ ID NO: 82712 - RNA, 22 nt, Homo sapiens
gucaaguguuuucaaggcuucc

SEQ ID NO: 82713 - RNA, 22 nt, Homo sapiens
gucacauugaugcccauggugg

SEQ ID NO: 82714 - RNA, 22 nt, Homo sapiens
gucacugagcaauagaaaguuu

SEQ ID NO: 82715 - RNA, 22 nt, Homo sapiens
gucacugccugaggcugaugca

SEQ ID NO: 82716 - RNA, 22 nt, Homo sapiens
gucagugucuuaacagagauua

SEQ ID NO: 82717 - RNA, 22 nt, Homo sapiens
gucagugugauaucugcagggg

SEQ ID NO: 82718 - RNA, 22 nt, Homo sapiens
gucaguuucacucagcuggaac

SEQ ID NO: 82719 - RNA, 22 nt, Homo sapiens
gucauauaggguuuaccuguau

SEQ ID NO: 82720 - RNA, 21 nt, Homo sapiens
gucauaugucucugauuagug

SEQ ID NO: 82721 - RNA, 22 nt, Homo sapiens
gucauguuuaacuucuugagga

SEQ ID NO: 82722 - RNA, 22 nt, Homo sapiens
gucauugcacuccagccuggac

SEQ ID NO: 82723 - RNA, 22 nt, Homo sapiens
guccaaauccaugggauguaca

SEQ ID NO: 82724 - RNA, 22 nt, Homo sapiens
gucccugcgauugugggauccu

SEQ ID NO: 82725 - RNA, 22 nt, Homo sapiens
gucucugguugcuuuuguacca

SEQ ID NO: 82726 - RNA, 22 nt, Homo sapiens
gucuuugagauaggguuauuuu

SEQ ID NO: 82727 - RNA, 17 nt, Homo sapiens
gucuuugguugaguuua

SEQ ID NO: 82728 - RNA, 22 nt, Homo sapiens
gugaaagacagcauuaauggcu

SEQ ID NO: 82729 - RNA, 22 nt, Homo sapiens
gugaaagacauauaugguuuga

SEQ ID NO: 82730 - RNA, 22 nt, Homo sapiens
gugaagugugaccucagcaucu

SEQ ID NO: 82731 - RNA, 22 nt, Homo sapiens
gugacacagcaagacuccgucu

SEQ ID NO: 82732 - RNA, 22 nt, Homo sapiens
gugaccauuugacauauccuug

SEQ ID NO: 82733 - RNA, 22 nt, Homo sapiens
gugagauacuagagauauagug

SEQ ID NO: 82734 - RNA, 22 nt, Homo sapiens
gugagaugugacuucugccucu

SEQ ID NO: 82735 - RNA, 22 nt, Homo sapiens
gugagcuccucuucugcugcag

SEQ ID NO: 82736 - RNA, 22 nt, Homo sapiens
gugaggaaggaaaccugcuagc

SEQ ID NO: 82737 - RNA, 22 nt, Homo sapiens
ugggguaggcuguauacucugu

SEQ ID NO: 82738 - RNA, 22 nt, Homo sapiens
ugguaucuaagaugcacguugu

SEQ ID NO: 82739 - RNA, 22 nt, Homo sapiens
ugguauguaugauuaacaugga

SEQ ID NO: 82740 - RNA, 22 nt, Homo sapiens
ugguaugucuuucuuccuguag

SEQ ID NO: 82741 - RNA, 22 nt, Homo sapiens
ugguauguguucuaaaauuaug

SEQ ID NO: 82742 - RNA, 21 nt, Homo sapiens
uggucaguuuucucacuagga

SEQ ID NO: 82743 - RNA, 21 nt, Homo sapiens
uggucccauaagauuauaaug

SEQ ID NO: 82744 - RNA, 22 nt, Homo sapiens
ugguccucugcuuccagaauuc

SEQ ID NO: 82745 - RNA, 22 nt, Homo sapiens
uggugagaaaugagaugcuuuu

SEQ ID NO: 82746 - RNA, 15 nt, Homo sapiens
uggugguguugagac

SEQ ID NO: 82747 - RNA, 20 nt, Homo sapiens
uggugucuuggaaagagcuc

SEQ ID NO: 82748 - RNA, 22 nt, Homo sapiens
ugguuguuuuaaaugucgucug

SEQ ID NO: 82749 - RNA, 22 nt, Homo sapiens
uguaagcauuauauaauuguug

SEQ ID NO: 82750 - RNA, 22 nt, Homo sapiens
uguaauguuucaucauuauuaa

SEQ ID NO: 82751 - RNA, 22 nt, Homo sapiens
uguacaaauuucugugguggug

SEQ ID NO: 82752 - RNA, 22 nt, Homo sapiens
uguacuucaagauuaugguuua

SEQ ID NO: 82753 - RNA, 22 nt, Homo sapiens
uguagauauucuuucaguuuuu

SEQ ID NO: 82754 - RNA, 22 nt, Homo sapiens
uguagggagagggaguugcacc

SEQ ID NO: 82755 - RNA, 22 nt, Homo sapiens
uguagguagggucuguuuuuga

SEQ ID NO: 82756 - RNA, 22 nt, Homo sapiens
uguauacauguguguucacgca

SEQ ID NO: 82757 - RNA, 22 nt, Homo sapiens
uguauacugucuaauauguugu

SEQ ID NO: 82758 - RNA, 22 nt, Homo sapiens
uguauguaaagacaggauaaca

SEQ ID NO: 82759 - RNA, 22 nt, Homo sapiens
uguauguugggucaaaguacau

SEQ ID NO: 82760 - RNA, 22 nt, Homo sapiens
ugucaaauucuggguuaaaaca

SEQ ID NO: 82761 - RNA, 18 nt, Homo sapiens
ugucacuggauaaugguc

SEQ ID NO: 82762 - RNA, 22 nt, Homo sapiens
ugucagaaucuagaggcugcua

SEQ ID NO: 82763 - RNA, 22 nt, Homo sapiens
ugucaggaguuuuagaaucuua

SEQ ID NO: 82764 - RNA, 22 nt, Homo sapiens
ugucaguggacugugaaaggca

SEQ ID NO: 82765 - RNA, 22 nt, Homo sapiens
ugucaguuuuaacuagggaaua

SEQ ID NO: 82766 - RNA, 22 nt, Homo sapiens
ugucauacaguaacaugguugg

SEQ ID NO: 82767 - RNA, 22 nt, Homo sapiens
ugucaucauuccaucagggcuu

SEQ ID NO: 82768 - RNA, 22 nt, Homo sapiens
ugucauggugcucugggcccug

SEQ ID NO: 82769 - RNA, 19 nt, Homo sapiens
ugucccagccauagaggca

SEQ ID NO: 82770 - RNA, 18 nt, Homo sapiens
ugucuuagagcuugaccc

SEQ ID NO: 82771 - RNA, 22 nt, Homo sapiens
ugugaacauuuuguauauauua

SEQ ID NO: 82772 - RNA, 22 nt, Homo sapiens
ugugacuaguggugaaugacgc

SEQ ID NO: 82773 - RNA, 22 nt, Homo sapiens
ugugauuauuuaaauaggacag

SEQ ID NO: 82774 - RNA, 18 nt, Homo sapiens
ugugcaauauuaaccacc

SEQ ID NO: 82775 - RNA, 22 nt, Homo sapiens
ugugcaauucgauggagcucau

SEQ ID NO: 82776 - RNA, 22 nt, Homo sapiens
ugugccacuccaaccuggguga

SEQ ID NO: 82777 - RNA, 22 nt, Homo sapiens
ugugccacugcacucugggcaa

SEQ ID NO: 82778 - RNA, 22 nt, Homo sapiens
uguggcaaauggucaggaagaa

SEQ ID NO: 82779 - RNA, 22 nt, Homo sapiens
uguggcauuuucagaaaggaug

SEQ ID NO: 82780 - RNA, 22 nt, Homo sapiens
uguguuuuuauguaaaauggaa

SEQ ID NO: 82781 - RNA, 22 nt, Homo sapiens
uguuaagaugucaauuuuccac

SEQ ID NO: 82782 - RNA, 22 nt, Homo sapiens
uguuauuuuguguuagggcaca

SEQ ID NO: 82783 - RNA, 22 nt, Homo sapiens
uguuuguuugauaugggauaaa

SEQ ID NO: 82784 - RNA, 21 nt, Homo sapiens
uguuuuugcuguguaucucuc

SEQ ID NO: 82785 - RNA, 22 nt, Homo sapiens
augacugagacuaacuuacuuu

SEQ ID NO: 82786 - RNA, 22 nt, Homo sapiens
augacuuuucugaaaaccacca

SEQ ID NO: 82787 - RNA, 22 nt, Homo sapiens
augagaacauaucaagugauug

SEQ ID NO: 82788 - RNA, 22 nt, Homo sapiens
augagaaucauuucagcuugua

SEQ ID NO: 82789 - RNA, 22 nt, Homo sapiens
augagauaaaccaucucuuaag

SEQ ID NO: 82790 - RNA, 22 nt, Homo sapiens
augagaugaggaauggcccucc

SEQ ID NO: 82791 - RNA, 22 nt, Homo sapiens
augagauucuuagagaagucug

SEQ ID NO: 82792 - RNA, 22 nt, Homo sapiens
augagauuguuuguacuccaca

SEQ ID NO: 82793 - RNA, 22 nt, Homo sapiens
augaguaugagaauacauuaag

SEQ ID NO: 82794 - RNA, 22 nt, Homo sapiens
augauguccacagggguguuca

SEQ ID NO: 82795 - RNA, 22 nt, Homo sapiens
augcacaguccagcccaugugg

SEQ ID NO: 82796 - RNA, 22 nt, Homo sapiens
augcacuguauaggaucuugcg

SEQ ID NO: 82797 - RNA, 22 nt, Homo sapiens
augcagagaaaucuaaaauaug

SEQ ID NO: 82798 - RNA, 22 nt, Homo sapiens
augcagaucacauuuuucuguc

SEQ ID NO: 82799 - RNA, 22 nt, Homo sapiens
augcauagcaucugcaaauguu

SEQ ID NO: 82800 - RNA, 22 nt, Homo sapiens
augccacagaaauaaccaaaau

SEQ ID NO: 82801 - RNA, 22 nt, Homo sapiens
augccacugcauaagguuuuca

SEQ ID NO: 82802 - RNA, 22 nt, Homo sapiens
augcuacugaccccuacuuaca

SEQ ID NO: 82803 - RNA, 22 nt, Homo sapiens
augcuguuuuguagcucccucu

SEQ ID NO: 82804 - RNA, 22 nt, Homo sapiens
auggaagaaaguuggguucuug

SEQ ID NO: 82805 - RNA, 22 nt, Homo sapiens
auggaaggagaauggucuuuga

SEQ ID NO: 82806 - RNA, 22 nt, Homo sapiens
auggaaggagaggaaugaauga

SEQ ID NO: 82807 - RNA, 22 nt, Homo sapiens
auggaaucauccuccugggagc

SEQ ID NO: 82808 - RNA, 21 nt, Homo sapiens
auggacaugguuaggcuuugu

SEQ ID NO: 82809 - RNA, 22 nt, Homo sapiens
auggagguguggggagugaguu

SEQ ID NO: 82810 - RNA, 22 nt, Homo sapiens
auggaguuuacuuaguguaaua

SEQ ID NO: 82811 - RNA, 22 nt, Homo sapiens
auggaucauauucuugaggagg

SEQ ID NO: 82812 - RNA, 22 nt, Homo sapiens
auggauuuguaguacaugguug

SEQ ID NO: 82813 - RNA, 22 nt, Homo sapiens
auggauuuuaggauacaguuga

SEQ ID NO: 82814 - RNA, 22 nt, Homo sapiens
auggcacuaaugggaguuuacu

SEQ ID NO: 82815 - RNA, 22 nt, Homo sapiens
auggcacugaagcguauugaca

SEQ ID NO: 82816 - RNA, 18 nt, Homo sapiens
auggcagaacaauuuaca

SEQ ID NO: 82817 - RNA, 22 nt, Homo sapiens
auggcagcugguuuuacccuag

SEQ ID NO: 82818 - RNA, 22 nt, Homo sapiens
auggcaguguaugauuauauua

SEQ ID NO: 82819 - RNA, 22 nt, Homo sapiens
auggcauugaagaguugucccu

SEQ ID NO: 82820 - RNA, 22 nt, Homo sapiens
auggcccccuguuugugaacau

SEQ ID NO: 82821 - RNA, 22 nt, Homo sapiens
auggccgggugcgguggcucac

SEQ ID NO: 82822 - RNA, 22 nt, Homo sapiens
auggccugaugcaccuguccca

SEQ ID NO: 82823 - RNA, 22 nt, Homo sapiens
auggccuuucuggcacauuucc

SEQ ID NO: 82824 - RNA, 22 nt, Homo sapiens
auggcugugagaucgacuuauu

SEQ ID NO: 82825 - RNA, 22 nt, Homo sapiens
auggcuuuuuaaaucauguugu

SEQ ID NO: 82826 - RNA, 22 nt, Homo sapiens
augggagugugguuagagaccu

SEQ ID NO: 82827 - RNA, 22 nt, Homo sapiens
augguauuuugugauaccuugu

SEQ ID NO: 82828 - RNA, 22 nt, Homo sapiens
auggucccuguuccaugcuccu

SEQ ID NO: 82829 - RNA, 22 nt, Homo sapiens
auguaauguuaaauugcuaauu

SEQ ID NO: 82830 - RNA, 22 nt, Homo sapiens
auguagugugauuuucacuaga

SEQ ID NO: 82831 - RNA, 22 nt, Homo sapiens
auguccaugagcacauguauca

SEQ ID NO: 82832 - RNA, 22 nt, Homo sapiens
augucuagagcaagagaugcug

SEQ ID NO: 82833 - RNA, 22 nt, Homo sapiens
augucuggcagaagacuucuca

SEQ ID NO: 82834 - RNA, 22 nt, Homo sapiens
augucugguagccaccuggagg

SEQ ID NO: 82835 - RNA, 21 nt, Homo sapiens
augugcacuaugucauuuaau

SEQ ID NO: 82836 - RNA, 22 nt, Homo sapiens
augugcaugcuguucugccaga

SEQ ID NO: 82837 - RNA, 22 nt, Homo sapiens
auguggcacuugacuuucucgc

SEQ ID NO: 82838 - RNA, 22 nt, Homo sapiens
auguggcauuucucauucauuu

SEQ ID NO: 82839 - RNA, 22 nt, Homo sapiens
auuagguauuuguccuaaauau

SEQ ID NO: 82840 - RNA, 22 nt, Homo sapiens
auuagguuagugcaaaaguaau

SEQ ID NO: 82841 - RNA, 22 nt, Homo sapiens
auuagguuguugcaaaaguaau

SEQ ID NO: 82842 - RNA, 22 nt, Homo sapiens
auuauaguguauacuugaaauu

SEQ ID NO: 82843 - RNA, 22 nt, Homo sapiens
auuauauguguaugugcauacc

SEQ ID NO: 82844 - RNA, 22 nt, Homo sapiens
auucacagggggagaaggguau

SEQ ID NO: 82845 - RNA, 22 nt, Homo sapiens
auucacuguggguccuuuggau

SEQ ID NO: 82846 - RNA, 20 nt, Homo sapiens
auuccacuuauaugaggucc

SEQ ID NO: 82847 - RNA, 22 nt, Homo sapiens
auucccuuggucaacggaugca

SEQ ID NO: 82848 - RNA, 22 nt, Homo sapiens
auugaacacagaguagcuuucc

SEQ ID NO: 82849 - RNA, 22 nt, Homo sapiens
ugaagugaaugguaaguaugcc

SEQ ID NO: 82850 - RNA, 22 nt, Homo sapiens
ugaauacuucguucaaagauaa

SEQ ID NO: 82851 - RNA, 22 nt, Homo sapiens
ugaaucaugcugcuauaaagac

SEQ ID NO: 82852 - RNA, 20 nt, Homo sapiens
ugaauguaauuacagaugua

SEQ ID NO: 82853 - RNA, 22 nt, Homo sapiens
ugacaagcucccucugcaccuu

SEQ ID NO: 82854 - RNA, 22 nt, Homo sapiens
ugacacagcaagauggaaccau

SEQ ID NO: 82855 - RNA, 22 nt, Homo sapiens
ugacacuugcccuuagaaacau

SEQ ID NO: 82856 - RNA, 23 nt, Homo sapiens
ugacagugcuugaaauugcucuu

SEQ ID NO: 82857 - RNA, 20 nt, Homo sapiens
ugacaguuaagggauagaag

SEQ ID NO: 82858 - RNA, 22 nt, Homo sapiens
ugacaugaugagcaauaauggc

SEQ ID NO: 82859 - RNA, 22 nt, Homo sapiens
ugacauguauuagcucagugcu

SEQ ID NO: 82860 - RNA, 22 nt, Homo sapiens
ugacggaggcauuggaagcuug

SEQ ID NO: 82861 - RNA, 22 nt, Homo sapiens
ugacuagacuugcaagguugca

SEQ ID NO: 82862 - RNA, 22 nt, Homo sapiens
ugacuggaacuuuagugagucu

SEQ ID NO: 82863 - RNA, 23 nt, Homo sapiens
ugacuuaggccucaacuaugacu

SEQ ID NO: 82864 - RNA, 22 nt, Homo sapiens
ugacuucauuugguaauugggu

SEQ ID NO: 82865 - RNA, 22 nt, Homo sapiens
ugacuucauuuuuggccaugag

SEQ ID NO: 82866 - RNA, 22 nt, Homo sapiens
ugagaacagcagcuugggacac

SEQ ID NO: 82867 - RNA, 16 nt, Homo sapiens
ugagaacaugcagcau

SEQ ID NO: 82868 - RNA, 22 nt, Homo sapiens
ugagaacucaugaaucuuucca

SEQ ID NO: 82869 - RNA, 22 nt, Homo sapiens
ugagaagcauaccagugucugu

SEQ ID NO: 82870 - RNA, 22 nt, Homo sapiens
ugagacggagucuugcuaaguu

SEQ ID NO: 82871 - RNA, 22 nt, Homo sapiens
ugagacggaguuucacucuugu

SEQ ID NO: 82872 - RNA, 22 nt, Homo sapiens
ugagacugagucuugcucuugu

SEQ ID NO: 82873 - RNA, 22 nt, Homo sapiens
ugagacugaguuucacuuuugu

SEQ ID NO: 82874 - RNA, 22 nt, Homo sapiens
ugagacugaguuuugccuuugu

SEQ ID NO: 82875 - RNA, 22 nt, Homo sapiens
ugagacugaguuuugcucguug

SEQ ID NO: 82876 - RNA, 19 nt, Homo sapiens
ugagagcacaacugaacaa

SEQ ID NO: 82877 - RNA, 21 nt, Homo sapiens
ugagaguaguguauuauucuc

SEQ ID NO: 82878 - RNA, 22 nt, Homo sapiens
ugagaucgagucucgcucuguc

SEQ ID NO: 82879 - RNA, 22 nt, Homo sapiens
ugagaucuucgcucuucacaga

SEQ ID NO: 82880 - RNA, 22 nt, Homo sapiens
ugagaucuuugcuguccucacc

SEQ ID NO: 82881 - RNA, 22 nt, Homo sapiens
ugagaugaacuugauuguuuua

SEQ ID NO: 82882 - RNA, 19 nt, Homo sapiens
ugagaugaagacagggguu

SEQ ID NO: 82883 - RNA, 22 nt, Homo sapiens
ugagaugacgacacaccucagu

SEQ ID NO: 82884 - RNA, 22 nt, Homo sapiens
ugagaugauagauauguuaauu

SEQ ID NO: 82885 - RNA, 22 nt, Homo sapiens
ugagaugauuuaauggagccca

SEQ ID NO: 82886 - RNA, 22 nt, Homo sapiens
ugagaugcuccucuugcaaagc

SEQ ID NO: 82887 - RNA, 22 nt, Homo sapiens
ugagauggaguuucacuuuugu

SEQ ID NO: 82888 - RNA, 21 nt, Homo sapiens
ugagaugugaccagggcauca

SEQ ID NO: 82889 - RNA, 22 nt, Homo sapiens
ugagauguuccaaugacuauua

SEQ ID NO: 82890 - RNA, 21 nt, Homo sapiens
ugagauuauauuaacauggua

SEQ ID NO: 82891 - RNA, 22 nt, Homo sapiens
ugagauuauauuucuuaacaga

SEQ ID NO: 82892 - RNA, 22 nt, Homo sapiens
ugagauucucugauuguagguc

SEQ ID NO: 82893 - RNA, 22 nt, Homo sapiens
ugagcagugagugugcugcagg

SEQ ID NO: 82894 - RNA, 22 nt, Homo sapiens
ugagcagugaguguggugcagg

SEQ ID NO: 82895 - RNA, 22 nt, Homo sapiens
ugagcuaggaucacaccugcau

SEQ ID NO: 82896 - RNA, 22 nt, Homo sapiens
ugaggacugagaggcacugugg

SEQ ID NO: 82897 - RNA, 22 nt, Homo sapiens
ugaggagugaacuauuucugau

SEQ ID NO: 82898 - RNA, 22 nt, Homo sapiens
ugaggagugagaaauugguuuc

SEQ ID NO: 82899 - RNA, 22 nt, Homo sapiens
ugaggaguguauuucauucgcu

SEQ ID NO: 82900 - RNA, 22 nt, Homo sapiens
ugagggaugcguacccuaugcc

SEQ ID NO: 82901 - RNA, 22 nt, Homo sapiens
ugagguaugacuuauuauucuu

SEQ ID NO: 82902 - RNA, 22 nt, Homo sapiens
ugaggucuuuauuuagugcuca

SEQ ID NO: 82903 - RNA, 22 nt, Homo sapiens
ugaguagaacuagucuagagcu

SEQ ID NO: 82904 - RNA, 22 nt, Homo sapiens
ugaguagauccaagacuguccu

SEQ ID NO: 82905 - RNA, 22 nt, Homo sapiens
ugaguauguuuaaugugacaau

SEQ ID NO: 82906 - RNA, 22 nt, Homo sapiens
ugagucagucucacucugcugc

SEQ ID NO: 82907 - RNA, 22 nt, Homo sapiens
ugagugaaagaagcacuaagga

SEQ ID NO: 82908 - RNA, 21 nt, Homo sapiens
ugagugcugagugaggguuga

SEQ ID NO: 82909 - RNA, 22 nt, Homo sapiens
ugaguuaguguggugcuuggaa

SEQ ID NO: 82910 - RNA, 22 nt, Homo sapiens
ugaguucuuccuaucucugccu

SEQ ID NO: 82911 - RNA, 22 nt, Homo sapiens
ugauaagaaauuguucauguag

SEQ ID NO: 82912 - RNA, 22 nt, Homo sapiens
ugauacugugcauuagaggcua

SEQ ID NO: 82913 - RNA, 22 nt, Homo sapiens
ugauaugucccucgacaucagg

SEQ ID NO: 82914 - RNA, 22 nt, Homo sapiens
ugauauguuagaaucuugcaag

SEQ ID NO: 82915 - RNA, 22 nt, Homo sapiens
ugaucaaagugcuggaauuaca

SEQ ID NO: 82916 - RNA, 22 nt, Homo sapiens
ugaucuuuuuaauguccauggg

SEQ ID NO: 82917 - RNA, 22 nt, Homo sapiens
ugauguguuuuguaguucaacu

SEQ ID NO: 82918 - RNA, 22 nt, Homo sapiens
ugauguugacuguaggcagaga

SEQ ID NO: 82919 - RNA, 20 nt, Homo sapiens
ugauuaguccacuuggcucu

SEQ ID NO: 82920 - RNA, 22 nt, Homo sapiens
ugcaaacuuccuugggcagcau

SEQ ID NO: 82921 - RNA, 22 nt, Homo sapiens
ugcaaauuauugggccccaacu

SEQ ID NO: 82922 - RNA, 19 nt, Homo sapiens
ugcaaauucuaaaaacuga

SEQ ID NO: 82923 - RNA, 22 nt, Homo sapiens
ugcaagaaacauauuccacaag

SEQ ID NO: 82924 - RNA, 22 nt, Homo sapiens
ugcaagaugauuucaauugaua

SEQ ID NO: 82925 - RNA, 22 nt, Homo sapiens
ugcaaguaauuccagcuacuga

SEQ ID NO: 82926 - RNA, 22 nt, Homo sapiens
ugcacacucuguaugagaaucu

SEQ ID NO: 82927 - RNA, 22 nt, Homo sapiens
ugcagcucaaauuccuaacaag

SEQ ID NO: 82928 - RNA, 22 nt, Homo sapiens
ugcaguaggcccagcgggaggc

SEQ ID NO: 82929 - RNA, 22 nt, Homo sapiens
ugcagugucaauaauaauuagu

SEQ ID NO: 82930 - RNA, 23 nt, Homo sapiens
ugcauaguacccaauacuuuauc

SEQ ID NO: 82931 - RNA, 22 nt, Homo sapiens
ugccaacaugccuggcuguuuu

SEQ ID NO: 82932 - RNA, 20 nt, Homo sapiens
ugccaagaaaugaggguauu

SEQ ID NO: 82933 - RNA, 22 nt, Homo sapiens
ugccuaggcuggagugcagugg

SEQ ID NO: 82934 - RNA, 22 nt, Homo sapiens
ugcgccauugcauuccagccug

SEQ ID NO: 82935 - RNA, 22 nt, Homo sapiens
ugcuaucauugauuagugaugu

SEQ ID NO: 82936 - RNA, 18 nt, Homo sapiens
ugcuaugagauuauuuua

SEQ ID NO: 82937 - RNA, 22 nt, Homo sapiens
ugcugguaguuuaugacuaauu

SEQ ID NO: 82938 - RNA, 22 nt, Homo sapiens
ugcugguauuuggaccagccug

SEQ ID NO: 82939 - RNA, 22 nt, Homo sapiens
ugcuggugucaucaaggcuuug

SEQ ID NO: 82940 - RNA, 22 nt, Homo sapiens
ugcuguuguuugaugaaguaau

SEQ ID NO: 82941 - RNA, 21 nt, Homo sapiens
uagauacuguauuaaaccuag

SEQ ID NO: 82942 - RNA, 22 nt, Homo sapiens
uagauucauuuuagcaaaaguu

SEQ ID NO: 82943 - RNA, 21 nt, Homo sapiens
uagcaaauugcuauuaaggca

SEQ ID NO: 82944 - RNA, 22 nt, Homo sapiens
uagcacagggaauugguucucu

SEQ ID NO: 82945 - RNA, 22 nt, Homo sapiens
uagcacaucccuaaaaugcugu

SEQ ID NO: 82946 - RNA, 22 nt, Homo sapiens
uagcacaugucagguaauuugc

SEQ ID NO: 82947 - RNA, 20 nt, Homo sapiens
uagcagcagacagagggagg

SEQ ID NO: 82948 - RNA, 19 nt, Homo sapiens
uagcagcaugauuuauaau

SEQ ID NO: 82949 - RNA, 22 nt, Homo sapiens
uagcaggaaaggggucagaucu

SEQ ID NO: 82950 - RNA, 22 nt, Homo sapiens
uagcugcugcuaggcuaaggau

SEQ ID NO: 82951 - RNA, 22 nt, Homo sapiens
uaggacaaugguacagcagaaa

SEQ ID NO: 82952 - RNA, 20 nt, Homo sapiens
uaggagcaaugagaguagaa

SEQ ID NO: 82953 - RNA, 22 nt, Homo sapiens
uaggcaaaugcaagaguagaac

SEQ ID NO: 82954 - RNA, 22 nt, Homo sapiens
uaggcaaguugcccaaucucuc

SEQ ID NO: 82955 - RNA, 22 nt, Homo sapiens
uagggaguuuuggggugcagaa

SEQ ID NO: 82956 - RNA, 22 nt, Homo sapiens
uagguaguugugggcuugaaug

SEQ ID NO: 82957 - RNA, 22 nt, Homo sapiens
uagguaucuuuauagcaguagc

SEQ ID NO: 82958 - RNA, 20 nt, Homo sapiens
uagguuuucacagaauugcc

SEQ ID NO: 82959 - RNA, 22 nt, Homo sapiens
uaguaguuuuguguauaauaau

SEQ ID NO: 82960 - RNA, 22 nt, Homo sapiens
uagucaaaucugaaggaaauuu

SEQ ID NO: 82961 - RNA, 22 nt, Homo sapiens
uagugcacuacuugugggaaug

SEQ ID NO: 82962 - RNA, 22 nt, Homo sapiens
uauacuguuuucuauaguggcu

SEQ ID NO: 82963 - RNA, 22 nt, Homo sapiens
uauagcauuuugauccuguaga

SEQ ID NO: 82964 - RNA, 22 nt, Homo sapiens
uauaugcucugggauccugaaa

SEQ ID NO: 82965 - RNA, 22 nt, Homo sapiens
uauauguucuugcacuggaaag

SEQ ID NO: 82966 - RNA, 22 nt, Homo sapiens
uaucaagaugacaaacuuugcu

SEQ ID NO: 82967 - RNA, 19 nt, Homo sapiens
uaucaaguaugcacuguac

SEQ ID NO: 82968 - RNA, 22 nt, Homo sapiens
uaucaaguuggaagagaaguaa

SEQ ID NO: 82969 - RNA, 22 nt, Homo sapiens
uaucacagaggguauccuagag

SEQ ID NO: 82970 - RNA, 22 nt, Homo sapiens
uaucacagcaaggacccauuau

SEQ ID NO: 82971 - RNA, 20 nt, Homo sapiens
uaucacaggucagaaacccu

SEQ ID NO: 82972 - RNA, 22 nt, Homo sapiens
uaucacaggucaggaaccuugu

SEQ ID NO: 82973 - RNA, 22 nt, Homo sapiens
uaucacaguaaaucugggugca

SEQ ID NO: 82974 - RNA, 22 nt, Homo sapiens
uaucacaguagaacucuuucca

SEQ ID NO: 82975 - RNA, 21 nt, Homo sapiens
uaucacaguagaauaggaucu

SEQ ID NO: 82976 - RNA, 22 nt, Homo sapiens
uaucacaguaucuagcacagug

SEQ ID NO: 82977 - RNA, 20 nt, Homo sapiens
uaucacaguucaggaacucu

SEQ ID NO: 82978 - RNA, 22 nt, Homo sapiens
uaucacaguugcauauuuaagg

SEQ ID NO: 82979 - RNA, 22 nt, Homo sapiens
uaucaccacccugggaaacaua

SEQ ID NO: 82980 - RNA, 22 nt, Homo sapiens
uaucacuuugauaguuuaaaug

SEQ ID NO: 82981 - RNA, 22 nt, Homo sapiens
uaucaugucuguguguaccuag

SEQ ID NO: 82982 - RNA, 22 nt, Homo sapiens
uaucccaauguaauaucacaaa

SEQ ID NO: 82983 - RNA, 22 nt, Homo sapiens
uaucccuuagagcggggugguu

SEQ ID NO: 82984 - RNA, 22 nt, Homo sapiens
uaucugguuauugcugcugauu

SEQ ID NO: 82985 - RNA, 22 nt, Homo sapiens
uaugaaagcuacuucucacaau

SEQ ID NO: 82986 - RNA, 22 nt, Homo sapiens
uaugaaucuggcuacuccaggg

SEQ ID NO: 82987 - RNA, 22 nt, Homo sapiens
uaugacuuuugaauacagaugg

SEQ ID NO: 82988 - RNA, 19 nt, Homo sapiens
uaugagcuaugacaugcau

SEQ ID NO: 82989 - RNA, 22 nt, Homo sapiens
uaugaugcugagguuuggagug

SEQ ID NO: 82990 - RNA, 22 nt, Homo sapiens
uauggcugcuuucacacuacaa

SEQ ID NO: 82991 - RNA, 22 nt, Homo sapiens
uauggcuucuauaaggaagcuu

SEQ ID NO: 82992 - RNA, 22 nt, Homo sapiens
uaugucuggaguuacugagcug

SEQ ID NO: 82993 - RNA, 22 nt, Homo sapiens
uaugucuuuugcuugcaaauag

SEQ ID NO: 82994 - RNA, 22 nt, Homo sapiens
uauuacacuuuagugucuucca

SEQ ID NO: 82995 - RNA, 22 nt, Homo sapiens
uauugacuugagaagggauuag

SEQ ID NO: 82996 - RNA, 22 nt, Homo sapiens
uauugacuugaugagggagggu

SEQ ID NO: 82997 - RNA, 22 nt, Homo sapiens
uauugauuaauugugauuaggc

SEQ ID NO: 82998 - RNA, 22 nt, Homo sapiens
uauugcaacagaagaaagaguc

SEQ ID NO: 82999 - RNA, 22 nt, Homo sapiens
uauuugguagcuauuuugcagu

SEQ ID NO: 83000 - RNA, 22 nt, Homo sapiens
ucaaacugcuugaggccauuua

SEQ ID NO: 83001 - RNA, 22 nt, Homo sapiens
ucaaaguauucuucugagaacc

SEQ ID NO: 83002 - RNA, 22 nt, Homo sapiens
ucaaagugagcuccuucucacu

SEQ ID NO: 83003 - RNA, 22 nt, Homo sapiens
ucaaaugcuguauuguaguaau

SEQ ID NO: 83004 - RNA, 22 nt, Homo sapiens
ucaaauguucccuguacuggcc

SEQ ID NO: 83005 - RNA, 22 nt, Homo sapiens
ucaacagugggcacuguaaaug

SEQ ID NO: 83006 - RNA, 18 nt, Homo sapiens
ucaagcaauugucaugcc

SEQ ID NO: 83007 - RNA, 22 nt, Homo sapiens
ucacacugaaacuaggguguga

SEQ ID NO: 83008 - RNA, 18 nt, Homo sapiens
ucacagguaauuaggauu

SEQ ID NO: 83009 - RNA, 22 nt, Homo sapiens
ucacaguaaauccagaagaaau

SEQ ID NO: 83010 - RNA, 22 nt, Homo sapiens
ucacaguagggaacugacaaag

SEQ ID NO: 83011 - RNA, 22 nt, Homo sapiens
ucacauuaagcuguuauuucuu

SEQ ID NO: 83012 - RNA, 16 nt, Homo sapiens
ucaccccuagagaucc

SEQ ID NO: 83013 - RNA, 22 nt, Homo sapiens
ucacugaaacuguccuggguua

SEQ ID NO: 83014 - RNA, 20 nt, Homo sapiens
ucacugagugguccacagua

SEQ ID NO: 83015 - RNA, 22 nt, Homo sapiens
ucacugcacucuccgccuugcg

SEQ ID NO: 83016 - RNA, 22 nt, Homo sapiens
ucacugugagaguuuauccugu

SEQ ID NO: 83017 - RNA, 22 nt, Homo sapiens
ucagaacugauacuagaacuuu

SEQ ID NO: 83018 - RNA, 22 nt, Homo sapiens
ucagcaaugcugcacucuacug

SEQ ID NO: 83019 - RNA, 22 nt, Homo sapiens
ucaggcuuuucccagagugaug

SEQ ID NO: 83020 - RNA, 21 nt, Homo sapiens
ucaggcuuuuugagugccaau

SEQ ID NO: 83021 - RNA, 21 nt, Homo sapiens
ucagggaccugcuguacugau

SEQ ID NO: 83022 - RNA, 22 nt, Homo sapiens
ucaggugcagagaagaaauggg

SEQ ID NO: 83023 - RNA, 20 nt, Homo sapiens
ucagugauugguuuaguuau

SEQ ID NO: 83024 - RNA, 22 nt, Homo sapiens
ucagugggcuauguaauuaacu

SEQ ID NO: 83025 - RNA, 22 nt, Homo sapiens
ucaguguuuggaaucucaauuu

SEQ ID NO: 83026 - RNA, 22 nt, Homo sapiens
ucauguaauuuugugucuauga

SEQ ID NO: 83027 - RNA, 22 nt, Homo sapiens
ucauugcaaucucugccucccg

SEQ ID NO: 83028 - RNA, 22 nt, Homo sapiens
uccaauguaaucaucauugaau

SEQ ID NO: 83029 - RNA, 22 nt, Homo sapiens
uccacagugguugaacuaguaa

SEQ ID NO: 83030 - RNA, 22 nt, Homo sapiens
uccacguggucuaucuguccuu

SEQ ID NO: 83031 - RNA, 22 nt, Homo sapiens
uccagaguggugaugcuggggc

SEQ ID NO: 83032 - RNA, 22 nt, Homo sapiens
uccagugugcaggcaaguuuga

SEQ ID NO: 83033 - RNA, 22 nt, Homo sapiens
uccaguguuccucagucacccc

SEQ ID NO: 83034 - RNA, 18 nt, Homo sapiens
uccaguuuucccagcauc

SEQ ID NO: 83035 - RNA, 22 nt, Homo sapiens
acugcacuccagccugagccug

SEQ ID NO: 83036 - RNA, 22 nt, Homo sapiens
acugcacuccagccugcuggau

SEQ ID NO: 83037 - RNA, 22 nt, Homo sapiens
acugcacuccagccugcuggca

SEQ ID NO: 83038 - RNA, 22 nt, Homo sapiens
acugcacuccagccugcugggu

SEQ ID NO: 83039 - RNA, 22 nt, Homo sapiens
acugcacuccagccuggacgaa

SEQ ID NO: 83040 - RNA, 22 nt, Homo sapiens
acugcacuccagccuguugaca

SEQ ID NO: 83041 - RNA, 22 nt, Homo sapiens
acugcacuccagccuugagagc

SEQ ID NO: 83042 - RNA, 22 nt, Homo sapiens
acugcacuccagccuugcgaca

SEQ ID NO: 83043 - RNA, 22 nt, Homo sapiens
acugcacuccagccuuggagac

SEQ ID NO: 83044 - RNA, 22 nt, Homo sapiens
acugcacuccagccuuggccac

SEQ ID NO: 83045 - RNA, 22 nt, Homo sapiens
acugcacuccagcuuuggguga

SEQ ID NO: 83046 - RNA, 20 nt, Homo sapiens
acugcacuccagucucuggg

SEQ ID NO: 83047 - RNA, 19 nt, Homo sapiens
acugcacuccuccuugggu

SEQ ID NO: 83048 - RNA, 22 nt, Homo sapiens
acugcacuucagccuugugaca

SEQ ID NO: 83049 - RNA, 22 nt, Homo sapiens
acuggcuguuaggaauuaccuc

SEQ ID NO: 83050 - RNA, 22 nt, Homo sapiens
acuucauucucuggaucagaau

SEQ ID NO: 83051 - RNA, 22 nt, Homo sapiens
acuuggcaaaguuuuaaacagc

SEQ ID NO: 83052 - RNA, 20 nt, Homo sapiens
acuuuuugaugaggucguuu

SEQ ID NO: 83053 - RNA, 22 nt, Homo sapiens
agaauguauauucuguaguugu

SEQ ID NO: 83054 - RNA, 22 nt, Homo sapiens
agacaguauuggcaaagugugu

SEQ ID NO: 83055 - RNA, 22 nt, Homo sapiens
agagaacugauucagggaaaau

SEQ ID NO: 83056 - RNA, 22 nt, Homo sapiens
agagauaaagauuuuaauuuug

SEQ ID NO: 83057 - RNA, 22 nt, Homo sapiens
agagaugaagauggggcucccg

SEQ ID NO: 83058 - RNA, 22 nt, Homo sapiens
agagaugauuaacauuuuggua

SEQ ID NO: 83059 - RNA, 22 nt, Homo sapiens
agagguauacauuugagagcca

SEQ ID NO: 83060 - RNA, 20 nt, Homo sapiens
agagugcugucuguccugag

SEQ ID NO: 83061 - RNA, 22 nt, Homo sapiens
agauauguuauugauguuaaug

SEQ ID NO: 83062 - RNA, 22 nt, Homo sapiens
agaucacucagguuucucccug

SEQ ID NO: 83063 - RNA, 18 nt, Homo sapiens
agaugcaugcucacuaca

SEQ ID NO: 83064 - RNA, 22 nt, Homo sapiens
agaugcauugguggcauauuca

SEQ ID NO: 83065 - RNA, 23 nt, Homo sapiens
agcaaaugcucuagcacuccaac

SEQ ID NO: 83066 - RNA, 22 nt, Homo sapiens
guggcaaguguuccaagaggcg

SEQ ID NO: 83067 - RNA, 22 nt, Homo sapiens
guggcagaaaagagaagcaaug

SEQ ID NO: 83068 - RNA, 22 nt, Homo sapiens
guggcauuucccaaaguauucu

SEQ ID NO: 83069 - RNA, 22 nt, Homo sapiens
gugggguagcaggcuccuaucu

SEQ ID NO: 83070 - RNA, 22 nt, Homo sapiens
gugggguaggcaauuccuagug

SEQ ID NO: 83071 - RNA, 22 nt, Homo sapiens
gugguaggaaagugcaaaugua

SEQ ID NO: 83072 - RNA, 22 nt, Homo sapiens
gugguguuugagcugccaggga

SEQ ID NO: 83073 - RNA, 22 nt, Homo sapiens
gugguucuaaaccuuuuuuggu

SEQ ID NO: 83074 - RNA, 22 nt, Homo sapiens
gugguuuucaacuccaccugca

SEQ ID NO: 83075 - RNA, 22 nt, Homo sapiens
guguaauacacacauauaugca

SEQ ID NO: 83076 - RNA, 22 nt, Homo sapiens
gugucacagcuuccaucucggu

SEQ ID NO: 83077 - RNA, 22 nt, Homo sapiens
guguccucgaguacacaucagg

SEQ ID NO: 83078 - RNA, 22 nt, Homo sapiens
gugugacuagucaugccugaau

SEQ ID NO: 83079 - RNA, 22 nt, Homo sapiens
gugugcacaaucuggcaugugc

SEQ ID NO: 83080 - RNA, 22 nt, Homo sapiens
guguggcaggugggggcucaga

SEQ ID NO: 83081 - RNA, 22 nt, Homo sapiens
gugugguaggauugguuacuca

SEQ ID NO: 83082 - RNA, 22 nt, Homo sapiens
guguucaaauucugacagagag

SEQ ID NO: 83083 - RNA, 22 nt, Homo sapiens
guuagaugaagaccaagggcaa

SEQ ID NO: 83084 - RNA, 22 nt, Homo sapiens
guucacaguucagccuguaaca

SEQ ID NO: 83085 - RNA, 20 nt, Homo sapiens
guucauguaauuaguucagg

SEQ ID NO: 83086 - RNA, 22 nt, Homo sapiens
guuccuuguagaugcuggauau

SEQ ID NO: 83087 - RNA, 22 nt, Homo sapiens
guugcaaaguaauugugguuuu

SEQ ID NO: 83088 - RNA, 22 nt, Homo sapiens
guugcaugucugggaggccagc

SEQ ID NO: 83089 - RNA, 22 nt, Homo sapiens
guuggaguuaagcaguaaugaa

SEQ ID NO: 83090 - RNA, 22 nt, Homo sapiens
guuugugguuaaagccuuucau

SEQ ID NO: 83091 - RNA, 15 nt, Homo sapiens
guuuuuggauacaau

SEQ ID NO: 83092 - RNA, 22 nt, Homo sapiens
guuuuuggggucacuauuaccg

SEQ ID NO: 83093 - RNA, 22 nt, Homo sapiens
uaaaccuagcauuuugcauaug

SEQ ID NO: 83094 - RNA, 22 nt, Homo sapiens
uaaaugcucuuuaaaagugcuu

SEQ ID NO: 83095 - RNA, 22 nt, Homo sapiens
uaacaagagagucagucagucc

SEQ ID NO: 83096 - RNA, 22 nt, Homo sapiens
uaacaccuugcucugucaauaa

SEQ ID NO: 83097 - RNA, 22 nt, Homo sapiens
uaacaguauauuuaccaaaccu

SEQ ID NO: 83098 - RNA, 22 nt, Homo sapiens
uaacaguguauuuacuacuucc

SEQ ID NO: 83099 - RNA, 22 nt, Homo sapiens
uaacauucacaugcugcaaaaa

SEQ ID NO: 83100 - RNA, 22 nt, Homo sapiens
uaacuacuucugcuucagagua

SEQ ID NO: 83101 - RNA, 22 nt, Homo sapiens
uaacucugccuagugacauggu

SEQ ID NO: 83102 - RNA, 22 nt, Homo sapiens
uaacugcaaccuccgccucccg

SEQ ID NO: 83103 - RNA, 22 nt, Homo sapiens
uaagacucuggacucuaauguu

SEQ ID NO: 83104 - RNA, 22 nt, Homo sapiens
uaagcuagcauagggguaaauu

SEQ ID NO: 83105 - RNA, 22 nt, Homo sapiens
uaaggauuuuggugauuacacu

SEQ ID NO: 83106 - RNA, 22 nt, Homo sapiens
uaaggcaaguuuuuaguggaca

SEQ ID NO: 83107 - RNA, 20 nt, Homo sapiens
uaaggcacugugcuuuuagg

SEQ ID NO: 83108 - RNA, 22 nt, Homo sapiens
uaaggcucuuguuauuuugagg

SEQ ID NO: 83109 - RNA, 22 nt, Homo sapiens
uaagguccuuaaauguguaacc

SEQ ID NO: 83110 - RNA, 22 nt, Homo sapiens
uaaguaguuuucuuggaggcga

SEQ ID NO: 83111 - RNA, 22 nt, Homo sapiens
uaaguauuaggccccaggcugg

SEQ ID NO: 83112 - RNA, 22 nt, Homo sapiens
uaagugaauuugacagguaaug

SEQ ID NO: 83113 - RNA, 22 nt, Homo sapiens
uaagugcaacauaaguguuaaa

SEQ ID NO: 83114 - RNA, 22 nt, Homo sapiens
uaagugcuugacuuugauguuu

SEQ ID NO: 83115 - RNA, 20 nt, Homo sapiens
uaagugcuugagacuucuga

SEQ ID NO: 83116 - RNA, 22 nt, Homo sapiens
uaaguuagugugagaauuuugc

SEQ ID NO: 83117 - RNA, 22 nt, Homo sapiens
uaauagagucauuauuauuguu

SEQ ID NO: 83118 - RNA, 22 nt, Homo sapiens
uaauccuagcacuuuggaagac

SEQ ID NO: 83119 - RNA, 22 nt, Homo sapiens
uaaucucagcuacucaggaggc

SEQ ID NO: 83120 - RNA, 22 nt, Homo sapiens
uacaaaguaacaguuccuguau

SEQ ID NO: 83121 - RNA, 22 nt, Homo sapiens
uacaagcaggaaaugguauaug

SEQ ID NO: 83122 - RNA, 22 nt, Homo sapiens
uacaagcuaaaauggaagauca

SEQ ID NO: 83123 - RNA, 22 nt, Homo sapiens
uacaaguauuuuuauuagugcc

SEQ ID NO: 83124 - RNA, 22 nt, Homo sapiens
uacacagucaaaaauuuccagg

SEQ ID NO: 83125 - RNA, 22 nt, Homo sapiens
uacaccauuugauucuuuaagc

SEQ ID NO: 83126 - RNA, 23 nt, Homo sapiens
uacagcugcagaaucaggcuaag

SEQ ID NO: 83127 - RNA, 22 nt, Homo sapiens
uacagucauaaugccuagugac

SEQ ID NO: 83128 - RNA, 22 nt, Homo sapiens
uacagucuggaggccuguguug

SEQ ID NO: 83129 - RNA, 22 nt, Homo sapiens
uacagugcuugguaucuaguaa

SEQ ID NO: 83130 - RNA, 22 nt, Homo sapiens
uacaguggcaugucaggugcuu

SEQ ID NO: 83131 - RNA, 19 nt, Homo sapiens
uacauaguauuuaguggca

SEQ ID NO: 83132 - RNA, 22 nt, Homo sapiens
uacauguauccauuguuuuugg

SEQ ID NO: 83133 - RNA, 22 nt, Homo sapiens
uacccuuauguaaucauuauac

SEQ ID NO: 83134 - RNA, 22 nt, Homo sapiens
uacuacuuucugacaucuuuaa

SEQ ID NO: 83135 - RNA, 22 nt, Homo sapiens
uacucuuuagcuccuuaaggaa

SEQ ID NO: 83136 - RNA, 22 nt, Homo sapiens
uacugcagucagacuccugggc

SEQ ID NO: 83137 - RNA, 22 nt, Homo sapiens
uacugcuuaagggcaugggccc

SEQ ID NO: 83138 - RNA, 22 nt, Homo sapiens
uacuggccuugaacucuggugu

SEQ ID NO: 83139 - RNA, 22 nt, Homo sapiens
uagaaguaggcuacgugucugg

SEQ ID NO: 83140 - RNA, 23 nt, Homo sapiens
uagaauguuuuuccauguuucuu

SEQ ID NO: 83141 - RNA, 22 nt, Homo sapiens
uagagcacagugauuagaccua

SEQ ID NO: 83142 - RNA, 22 nt, Homo sapiens
uagagguagguguaugaacuag

SEQ ID NO: 83143 - RNA, 22 nt, Homo sapiens
uagaucuuuaaaaggugcuaga

SEQ ID NO: 83144 - RNA, 22 nt, Homo sapiens
uagauucaucuguuccuuuuga

SEQ ID NO: 83145 - RNA, 22 nt, Homo sapiens
uagcaaaucaauggaauugaag

SEQ ID NO: 83146 - RNA, 22 nt, Homo sapiens
uagcaccaaacauauacucagu

SEQ ID NO: 83147 - RNA, 22 nt, Homo sapiens
uagcacccucuccuaguccugc

SEQ ID NO: 83148 - RNA, 22 nt, Homo sapiens
uagcucagcccagcuaagcuca

SEQ ID NO: 83149 - RNA, 22 nt, Homo sapiens
uaggcaauggagauagaggaug

SEQ ID NO: 83150 - RNA, 22 nt, Homo sapiens
uaggcacuguguuuguaggagu

SEQ ID NO: 83151 - RNA, 22 nt, Homo sapiens
uagggcuuuccggccugucaga

SEQ ID NO: 83152 - RNA, 22 nt, Homo sapiens
uaggguaguaauaguuguuuca

SEQ ID NO: 83153 - RNA, 22 nt, Homo sapiens
uaguaaacauuuuucuaucauu

SEQ ID NO: 83154 - RNA, 22 nt, Homo sapiens
uaguaacacauugaacgaucgc

SEQ ID NO: 83155 - RNA, 22 nt, Homo sapiens
uaguaucacauggucuuaauua

SEQ ID NO: 83156 - RNA, 20 nt, Homo sapiens
uaguggaaaucagguccucu

SEQ ID NO: 83157 - RNA, 20 nt, Homo sapiens
uaguggcaugcaccuguagc

SEQ ID NO: 83158 - RNA, 17 nt, Homo sapiens
uagcucuauuucuagcc

SEQ ID NO: 83159 - RNA, 22 nt, Homo sapiens
uagcuggaguuuuuguuauagg

SEQ ID NO: 83160 - RNA, 22 nt, Homo sapiens
uaggaaguacaucucagaaucu

SEQ ID NO: 83161 - RNA, 22 nt, Homo sapiens
uagguucucaggaaugagcuuc

SEQ ID NO: 83162 - RNA, 22 nt, Homo sapiens
uaguaaacaccucagguaauuc

SEQ ID NO: 83163 - RNA, 22 nt, Homo sapiens
uagucacacacucaacuuuuca

SEQ ID NO: 83164 - RNA, 22 nt, Homo sapiens
uauaaaguaauuucuaggggcu

SEQ ID NO: 83165 - RNA, 22 nt, Homo sapiens
uauaaccauuucuucucucuuc

SEQ ID NO: 83166 - RNA, 22 nt, Homo sapiens
uauaugcaacauaguguaugug

SEQ ID NO: 83167 - RNA, 22 nt, Homo sapiens
uaucaacaggguggccagugua

SEQ ID NO: 83168 - RNA, 22 nt, Homo sapiens
uaucacagauucuccaggguuu

SEQ ID NO: 83169 - RNA, 22 nt, Homo sapiens
uaucacaggucaggaaucuugc

SEQ ID NO: 83170 - RNA, 22 nt, Homo sapiens
uaucacagguggacugcacacc

SEQ ID NO: 83171 - RNA, 22 nt, Homo sapiens
uaucaccauguccguuuuaaaa

SEQ ID NO: 83172 - RNA, 22 nt, Homo sapiens
uaucagcacaguggguucaugg

SEQ ID NO: 83173 - RNA, 22 nt, Homo sapiens
uaucaucauguuuuugcugugu

SEQ ID NO: 83174 - RNA, 22 nt, Homo sapiens
uaucugcaucccauuuuuauca

SEQ ID NO: 83175 - RNA, 22 nt, Homo sapiens
uaucuuggaguuugacaaccaa

SEQ ID NO: 83176 - RNA, 20 nt, Homo sapiens
uaugaaacaguguagagcaa

SEQ ID NO: 83177 - RNA, 22 nt, Homo sapiens
uaugagcaaaaugaggguuagu

SEQ ID NO: 83178 - RNA, 22 nt, Homo sapiens
uaugcaugucucuguacacgug

SEQ ID NO: 83179 - RNA, 22 nt, Homo sapiens
uaugccucuucauaaaguauga

SEQ ID NO: 83180 - RNA, 22 nt, Homo sapiens
uaugccuuuugguucaagcaac

SEQ ID NO: 83181 - RNA, 22 nt, Homo sapiens
uauggcccuuaaguauugguug

SEQ ID NO: 83182 - RNA, 22 nt, Homo sapiens
uauggguguuauugcaugggag

SEQ ID NO: 83183 - RNA, 22 nt, Homo sapiens
uauggucuuugagaggugacug

SEQ ID NO: 83184 - RNA, 21 nt, Homo sapiens
uaugguuucuaauucugcagg

SEQ ID NO: 83185 - RNA, 19 nt, Homo sapiens
uauguaguuuucucaauau

SEQ ID NO: 83186 - RNA, 22 nt, Homo sapiens
uaugugcacaugcccuggugac

SEQ ID NO: 83187 - RNA, 22 nt, Homo sapiens
uauuagguuggugcaacaguaa

SEQ ID NO: 83188 - RNA, 22 nt, Homo sapiens
uauuaguuuucuguggauuaca

SEQ ID NO: 83189 - RNA, 22 nt, Homo sapiens
uauuauagugauaggucuacug

SEQ ID NO: 83190 - RNA, 20 nt, Homo sapiens
uauucacucuccagucuugc

SEQ ID NO: 83191 - RNA, 22 nt, Homo sapiens
uauugcaaauggugaucccagg

SEQ ID NO: 83192 - RNA, 22 nt, Homo sapiens
uauugccugucuccaaaaauca

SEQ ID NO: 83193 - RNA, 22 nt, Homo sapiens
uauuguccaauaggauguuccu

SEQ ID NO: 83194 - RNA, 22 nt, Homo sapiens
uauuuggauagucuggaaaaaa

SEQ ID NO: 83195 - RNA, 22 nt, Homo sapiens
uauuugguuauaugaguaaguu

SEQ ID NO: 83196 - RNA, 22 nt, Homo sapiens
ucaaagugacaaaguugcagca

SEQ ID NO: 83197 - RNA, 18 nt, Homo sapiens
ucaaauacuuugggcagu

SEQ ID NO: 83198 - RNA, 22 nt, Homo sapiens
ucaaaugauucuccugccucag

SEQ ID NO: 83199 - RNA, 22 nt, Homo sapiens
ucaaggacuacauggggugaaa

SEQ ID NO: 83200 - RNA, 22 nt, Homo sapiens
ucaaggcacuagcugagcugca

SEQ ID NO: 83201 - RNA, 22 nt, Homo sapiens
ucaaguaauacucccaucuugg

SEQ ID NO: 83202 - RNA, 22 nt, Homo sapiens
ucaauguaucuccaagaauuga

SEQ ID NO: 83203 - RNA, 22 nt, Homo sapiens
ucacaauucucaauuugugaaa

SEQ ID NO: 83204 - RNA, 19 nt, Homo sapiens
ucacacuguggcuucuuua

SEQ ID NO: 83205 - RNA, 22 nt, Homo sapiens
ucacaguaacuuuguugcuuuu

SEQ ID NO: 83206 - RNA, 22 nt, Homo sapiens
ucacagucggugacuucuugcu

SEQ ID NO: 83207 - RNA, 23 nt, Homo sapiens
ucacaguuacuuuugcaucaacc

SEQ ID NO: 83208 - RNA, 22 nt, Homo sapiens
ucacaucucagguuucuugaca

SEQ ID NO: 83209 - RNA, 22 nt, Homo sapiens
ucacaugaagauuuuaguauac

SEQ ID NO: 83210 - RNA, 22 nt, Homo sapiens
ucacauggaaaaguccaguaaa

SEQ ID NO: 83211 - RNA, 22 nt, Homo sapiens
ucacauggcagagaagaagcuc

SEQ ID NO: 83212 - RNA, 22 nt, Homo sapiens
ucacauuguguagccugcucac

SEQ ID NO: 83213 - RNA, 22 nt, Homo sapiens
ucacauuguuauguaaauguuu

SEQ ID NO: 83214 - RNA, 22 nt, Homo sapiens
ucaccuggagccuucacauucu

SEQ ID NO: 83215 - RNA, 22 nt, Homo sapiens
ucacugagcacaggagaugugc

SEQ ID NO: 83216 - RNA, 21 nt, Homo sapiens
ucacugagcaucaugguuuca

SEQ ID NO: 83217 - RNA, 22 nt, Homo sapiens
ucacugcacuagguaaugccac

SEQ ID NO: 83218 - RNA, 22 nt, Homo sapiens
ucacugcgaccuccgccucccg

SEQ ID NO: 83219 - RNA, 22 nt, Homo sapiens
ucacuggacagaaauaaaggug

SEQ ID NO: 83220 - RNA, 22 nt, Homo sapiens
ucacuggaggagaggaagugga

SEQ ID NO: 83221 - RNA, 20 nt, Homo sapiens
ucacuggguucuugaagucu

SEQ ID NO: 83222 - RNA, 22 nt, Homo sapiens
ucacuuugacggccaacuucua

SEQ ID NO: 83223 - RNA, 22 nt, Homo sapiens
ucagaugaugucccuguucuaa

SEQ ID NO: 83224 - RNA, 22 nt, Homo sapiens
ucagaugauucuguuguugugu

SEQ ID NO: 83225 - RNA, 22 nt, Homo sapiens
ucagaugcauccauaccccacu

SEQ ID NO: 83226 - RNA, 20 nt, Homo sapiens
ucagcagucuggagcagagg

SEQ ID NO: 83227 - RNA, 22 nt, Homo sapiens
ucaggcacucagcuuagagucu

SEQ ID NO: 83228 - RNA, 22 nt, Homo sapiens
ucagggacuuacaaaccagaag

SEQ ID NO: 83229 - RNA, 22 nt, Homo sapiens
ucagguauuucuuuuagcugug

SEQ ID NO: 83230 - RNA, 22 nt, Homo sapiens
ucaggugcaguggcucaugcuu

SEQ ID NO: 83231 - RNA, 22 nt, Homo sapiens
ucaguaaaugcuguucucuuuu

SEQ ID NO: 83232 - RNA, 22 nt, Homo sapiens
ucagugacugcugcuuguauac

SEQ ID NO: 83233 - RNA, 19 nt, Homo sapiens
ucagugcuauguaauguag

SEQ ID NO: 83234 - RNA, 22 nt, Homo sapiens
ucagugcuuggcacagagagcu

SEQ ID NO: 83235 - RNA, 22 nt, Homo sapiens
ucauacuguccaauucuagugg

SEQ ID NO: 83236 - RNA, 20 nt, Homo sapiens
ucauagcuuuuuccacuuua

SEQ ID NO: 83237 - RNA, 22 nt, Homo sapiens
ucauagucuaagguucuuuugc

SEQ ID NO: 83238 - RNA, 22 nt, Homo sapiens
ucauauguaugugcaauuuugu

SEQ ID NO: 83239 - RNA, 22 nt, Homo sapiens
ucauaugucauaguaugaucuu

SEQ ID NO: 83240 - RNA, 21 nt, Homo sapiens
ucaucaagcuguagacaugau

SEQ ID NO: 83241 - RNA, 22 nt, Homo sapiens
ucaucagguaugucagcggagu

SEQ ID NO: 83242 - RNA, 22 nt, Homo sapiens
ucauggguuuugguccaagcaa

SEQ ID NO: 83243 - RNA, 22 nt, Homo sapiens
ucaugugagcacagagcaagau

SEQ ID NO: 83244 - RNA, 19 nt, Homo sapiens
uccacagugguugaacuag

SEQ ID NO: 83245 - RNA, 19 nt, Homo sapiens
uccaccgcgugcaccucua

SEQ ID NO: 83246 - RNA, 22 nt, Homo sapiens
uccaguguuucuuccacuauuu

SEQ ID NO: 83247 - RNA, 22 nt, Homo sapiens
uccaguuuuguuaacauauggu

SEQ ID NO: 83248 - RNA, 22 nt, Homo sapiens
ucccagugcuaugcaaaagccu

SEQ ID NO: 83249 - RNA, 22 nt, Homo sapiens
ucccaguggucuugaaacaggg

SEQ ID NO: 83250 - RNA, 22 nt, Homo sapiens
uccccaguaggcaauuaacacc

SEQ ID NO: 83251 - RNA, 22 nt, Homo sapiens
uccccgaggcuggagugcagug

SEQ ID NO: 83252 - RNA, 22 nt, Homo sapiens
uucaguggguggaugaauauga

SEQ ID NO: 83253 - RNA, 22 nt, Homo sapiens
uucaguucugcacugaucuuag

SEQ ID NO: 83254 - RNA, 22 nt, Homo sapiens
uucaguucugcucugaucuuag

SEQ ID NO: 83255 - RNA, 18 nt, Homo sapiens
uucauaguagcaugauuu

SEQ ID NO: 83256 - RNA, 22 nt, Homo sapiens
uucauagucacauucgaugucu

SEQ ID NO: 83257 - RNA, 22 nt, Homo sapiens
uucauagugaaaaauucaaagu

SEQ ID NO: 83258 - RNA, 22 nt, Homo sapiens
uucauaguucuuuuagucauua

SEQ ID NO: 83259 - RNA, 22 nt, Homo sapiens
uucaucagggguauuggccaau

SEQ ID NO: 83260 - RNA, 22 nt, Homo sapiens
uuccaauguuccguguugcagu

SEQ ID NO: 83261 - RNA, 22 nt, Homo sapiens
uuccacagggauuugcauugau

SEQ ID NO: 83262 - RNA, 22 nt, Homo sapiens
uuccacgugaaguauucuaaag

SEQ ID NO: 83263 - RNA, 21 nt, Homo sapiens
uuccagugagccuagaugccu

SEQ ID NO: 83264 - RNA, 22 nt, Homo sapiens
uuccaguguguucauccucaga

SEQ ID NO: 83265 - RNA, 22 nt, Homo sapiens
uucccguacugguguugccuau

SEQ ID NO: 83266 - RNA, 22 nt, Homo sapiens
uucccguugcugugcuccugcc

SEQ ID NO: 83267 - RNA, 23 nt, Homo sapiens
uucccuuagaagaaggggagaaa

SEQ ID NO: 83268 - RNA, 22 nt, Homo sapiens
uucccuuucuuaaagaguuagg

SEQ ID NO: 83269 - RNA, 22 nt, Homo sapiens
uuccuacugugcaaaguugcaa

SEQ ID NO: 83270 - RNA, 22 nt, Homo sapiens
uuccugagagggcugggugcag

SEQ ID NO: 83271 - RNA, 22 nt, Homo sapiens
uuccuugguucagggaaggucc

SEQ ID NO: 83272 - RNA, 22 nt, Homo sapiens
uuccuugugacuaguagugacc

SEQ ID NO: 83273 - RNA, 22 nt, Homo sapiens
uucuaaguaauuuugcaugccu

SEQ ID NO: 83274 - RNA, 22 nt, Homo sapiens
uucuagagagaagacuuaagcu

SEQ ID NO: 83275 - RNA, 20 nt, Homo sapiens
uucuauggugaugaguccug

SEQ ID NO: 83276 - RNA, 22 nt, Homo sapiens
uucuaugguuuaauaguuuggg

SEQ ID NO: 83277 - RNA, 22 nt, Homo sapiens
uucucacaguacagggagcucu

SEQ ID NO: 83278 - RNA, 22 nt, Homo sapiens
uucucaguuccuacuuugguga

SEQ ID NO: 83279 - RNA, 22 nt, Homo sapiens
uucucaguucgguggcagugcu

SEQ ID NO: 83280 - RNA, 22 nt, Homo sapiens
uucuccugguggacccuaaacg

SEQ ID NO: 83281 - RNA, 19 nt, Homo sapiens
uucucugguuguacuaccc

SEQ ID NO: 83282 - RNA, 22 nt, Homo sapiens
uucugacuggugugagauggua

SEQ ID NO: 83283 - RNA, 20 nt, Homo sapiens
uucuugaguuaacaaguuac

SEQ ID NO: 83284 - RNA, 22 nt, Homo sapiens
uucuugcacuuaacugacauuc

SEQ ID NO: 83285 - RNA, 18 nt, Homo sapiens
uucuuguguugauauuuu

SEQ ID NO: 83286 - RNA, 22 nt, Homo sapiens
uucuuuaguucacuugcuccag

SEQ ID NO: 83287 - RNA, 22 nt, Homo sapiens
uucuuuggauaaaguuuuaugc

SEQ ID NO: 83288 - RNA, 22 nt, Homo sapiens
uugaaagaugaacuggauugga

SEQ ID NO: 83289 - RNA, 22 nt, Homo sapiens
uugaaagcuaucucaaaucgcu

SEQ ID NO: 83290 - RNA, 22 nt, Homo sapiens
uugaaaucuuccacagcccaag

SEQ ID NO: 83291 - RNA, 22 nt, Homo sapiens
uugaaguguguauacauugugg

SEQ ID NO: 83292 - RNA, 22 nt, Homo sapiens
uugacagaccuuggucauaucc

SEQ ID NO: 83293 - RNA, 21 nt, Homo sapiens
uugagaagaauuagcucuucc

SEQ ID NO: 83294 - RNA, 22 nt, Homo sapiens
uugagacggagucucacucugu

SEQ ID NO: 83295 - RNA, 22 nt, Homo sapiens
uugagagaaaaggccaugccuu

SEQ ID NO: 83296 - RNA, 22 nt, Homo sapiens
uugagauggagucucacugugu

SEQ ID NO: 83297 - RNA, 22 nt, Homo sapiens
uugagauggagucucgcacugu

SEQ ID NO: 83298 - RNA, 22 nt, Homo sapiens
uugagauguaagauguuaauau

SEQ ID NO: 83299 - RNA, 22 nt, Homo sapiens
uugagauguaguuucacuccug

SEQ ID NO: 83300 - RNA, 22 nt, Homo sapiens
uugagcaaugucacugaggcuu

SEQ ID NO: 83301 - RNA, 22 nt, Homo sapiens
uugagccaaggauugucuuucc

SEQ ID NO: 83302 - RNA, 22 nt, Homo sapiens
uugaggcuuuugaccucaugug

SEQ ID NO: 83303 - RNA, 22 nt, Homo sapiens
uugagggaggcagggcuugucu

SEQ ID NO: 83304 - RNA, 22 nt, Homo sapiens
uugauaugguauaagauuucau

SEQ ID NO: 83305 - RNA, 22 nt, Homo sapiens
uugauauguggaauauuuaucu

SEQ ID NO: 83306 - RNA, 22 nt, Homo sapiens
uugauauuaaguacugaagugg

SEQ ID NO: 83307 - RNA, 22 nt, Homo sapiens
uugauguugaggacauaaaccu

SEQ ID NO: 83308 - RNA, 22 nt, Homo sapiens
uugcaaagaccucuucacuucc

SEQ ID NO: 83309 - RNA, 22 nt, Homo sapiens
uugcaacauuguaaguuuauau

SEQ ID NO: 83310 - RNA, 22 nt, Homo sapiens
uugcacauggcaggugcucaau

SEQ ID NO: 83311 - RNA, 22 nt, Homo sapiens
uugcacauggcuggggaggccu

SEQ ID NO: 83312 - RNA, 22 nt, Homo sapiens
uugcacuccggccuggguaaca

SEQ ID NO: 83313 - RNA, 22 nt, Homo sapiens
uugcacugagauuuugcuuaca

SEQ ID NO: 83314 - RNA, 22 nt, Homo sapiens
uugcacuugcugaggagugauu

SEQ ID NO: 83315 - RNA, 22 nt, Homo sapiens
uugcagagaaauuucugguuua

SEQ ID NO: 83316 - RNA, 22 nt, Homo sapiens
uugcagagccccacacugggcu

SEQ ID NO: 83317 - RNA, 22 nt, Homo sapiens
uugcagcaacauggaugaaacu

SEQ ID NO: 83318 - RNA, 22 nt, Homo sapiens
uugcagcauucugguuccuggu

SEQ ID NO: 83319 - RNA, 22 nt, Homo sapiens
uugccuaggcuggagugcagug

SEQ ID NO: 83320 - RNA, 22 nt, Homo sapiens
uugccuaggcuggaguucagug

SEQ ID NO: 83321 - RNA, 22 nt, Homo sapiens
uugccuaggcuggauugcagug

SEQ ID NO: 83322 - RNA, 22 nt, Homo sapiens
uugcuauguugcccagucugga

SEQ ID NO: 83323 - RNA, 22 nt, Homo sapiens
uuggaaauauguuaagugucau

SEQ ID NO: 83324 - RNA, 22 nt, Homo sapiens
uuggaacacauguuuuucuacc

SEQ ID NO: 83325 - RNA, 22 nt, Homo sapiens
uuggaagguaaucaaaaguucu

SEQ ID NO: 83326 - RNA, 22 nt, Homo sapiens
uuggaauauaaccuguuucuaa

SEQ ID NO: 83327 - RNA, 22 nt, Homo sapiens
uuggaaugcacacugagccugc

SEQ ID NO: 83328 - RNA, 22 nt, Homo sapiens
uuggaauguacucuagccuaug

SEQ ID NO: 83329 - RNA, 19 nt, Homo sapiens
uuggaauuuuagaguuuga

SEQ ID NO: 83330 - RNA, 22 nt, Homo sapiens
uuggacagaugguuacauuuuu

SEQ ID NO: 83331 - RNA, 22 nt, Homo sapiens
uuggauggucuuuauauaguau

SEQ ID NO: 83332 - RNA, 22 nt, Homo sapiens
uuggcaaagaggaaugccacuu

SEQ ID NO: 83333 - RNA, 22 nt, Homo sapiens
uuggcacgugguggggcucgga

SEQ ID NO: 83334 - RNA, 19 nt, Homo sapiens
uuggcagaguugcccccua

SEQ ID NO: 83335 - RNA, 22 nt, Homo sapiens
uuggcagugguucugacggacc

SEQ ID NO: 83336 - RNA, 22 nt, Homo sapiens
uuggccccuuucauccacagcu

SEQ ID NO: 83337 - RNA, 22 nt, Homo sapiens
uugguaggcuggccucucucag

SEQ ID NO: 83338 - RNA, 22 nt, Homo sapiens
uuggucaggagccucccucuuu

SEQ ID NO: 83339 - RNA, 20 nt, Homo sapiens
uuggugaccuacagaugugg

SEQ ID NO: 83340 - RNA, 22 nt, Homo sapiens
uugguuccauuuuaccagcucu

SEQ ID NO: 83341 - RNA, 22 nt, Homo sapiens
uuguaaaguucucucccgaaaa

SEQ ID NO: 83342 - RNA, 22 nt, Homo sapiens
uuguacuuuuaguagagacggg

SEQ ID NO: 83343 - RNA, 22 nt, Homo sapiens
uuguaguagcauuauuuauaau

SEQ ID NO: 83344 - RNA, 22 nt, Homo sapiens
uugucaacaugaaacuguguuu

SEQ ID NO: 83345 - RNA, 22 nt, Homo sapiens
aacaccaucccuuugaugcuuu

SEQ ID NO: 83346 - RNA, 22 nt, Homo sapiens
aacacuaucugccuuacaggga

SEQ ID NO: 83347 - RNA, 20 nt, Homo sapiens
aacagcacugucugaagcuu

SEQ ID NO: 83348 - RNA, 22 nt, Homo sapiens
aacagucaauugcugaugaccu

SEQ ID NO: 83349 - RNA, 22 nt, Homo sapiens
aacaucaaccaugaggguugga

SEQ ID NO: 83350 - RNA, 22 nt, Homo sapiens
aacccugacacaagcagaauuu

SEQ ID NO: 83351 - RNA, 22 nt, Homo sapiens
aacucugucuccuucaaguuca

SEQ ID NO: 83352 - RNA, 22 nt, Homo sapiens
aagagaugaagguccugacugu

SEQ ID NO: 83353 - RNA, 22 nt, Homo sapiens
aagagugucuuugugcuggccc

SEQ ID NO: 83354 - RNA, 22 nt, Homo sapiens
aagaugcagucauacuggagua

SEQ ID NO: 83355 - RNA, 22 nt, Homo sapiens
aagcacccagccucacgccugc

SEQ ID NO: 83356 - RNA, 22 nt, Homo sapiens
aagcaugguuuccaggggucac

SEQ ID NO: 83357 - RNA, 22 nt, Homo sapiens
aagccagugugacaggaaacuu

SEQ ID NO: 83358 - RNA, 22 nt, Homo sapiens
aagcucuuguugaaucuuguca

SEQ ID NO: 83359 - RNA, 22 nt, Homo sapiens
aaggaacuggaauauuuugaac

SEQ ID NO: 83360 - RNA, 22 nt, Homo sapiens
aaggaagcuagcaggaauuggu

SEQ ID NO: 83361 - RNA, 22 nt, Homo sapiens
aaggaaguaauuugguuuauag

SEQ ID NO: 83362 - RNA, 22 nt, Homo sapiens
aaggcaagauacugguugcuga

SEQ ID NO: 83363 - RNA, 22 nt, Homo sapiens
aaggcagugugcacauaacacu

SEQ ID NO: 83364 - RNA, 22 nt, Homo sapiens
aagggaaugcuuccaguuugug

SEQ ID NO: 83365 - RNA, 18 nt, Homo sapiens
aaggugcuucuguucuga

SEQ ID NO: 83366 - RNA, 22 nt, Homo sapiens
aaguaguuaggaacauucucuc

SEQ ID NO: 83367 - RNA, 22 nt, Homo sapiens
aagucaaggagagaagcuucag

SEQ ID NO: 83368 - RNA, 22 nt, Homo sapiens
aagugaaugaugugaaguguaa

SEQ ID NO: 83369 - RNA, 22 nt, Homo sapiens
aagugcuguccuaccuuuggga

SEQ ID NO: 83370 - RNA, 22 nt, Homo sapiens
aauaaagcagcuuuuugggacu

SEQ ID NO: 83371 - RNA, 21 nt, Homo sapiens
aauacucuagguuaagagagc

SEQ ID NO: 83372 - RNA, 22 nt, Homo sapiens
aauauagcuauguacaugucca

SEQ ID NO: 83373 - RNA, 22 nt, Homo sapiens
aauaucacaggguguacacuca

SEQ ID NO: 83374 - RNA, 22 nt, Homo sapiens
aaucacacuugauguugagcaa

SEQ ID NO: 83375 - RNA, 21 nt, Homo sapiens
aaucacaguuguucugccuuc

SEQ ID NO: 83376 - RNA, 22 nt, Homo sapiens
aaucacuaugccaugaaguaca

SEQ ID NO: 83377 - RNA, 22 nt, Homo sapiens
aaucagagcccucugagcuuca

SEQ ID NO: 83378 - RNA, 22 nt, Homo sapiens
uggaucaugcgaggccuccccu

SEQ ID NO: 83379 - RNA, 22 nt, Homo sapiens
uggauggagaggcuugugaugc

SEQ ID NO: 83380 - RNA, 18 nt, Homo sapiens
uggauuguacuguguucu

SEQ ID NO: 83381 - RNA, 22 nt, Homo sapiens
uggcaaaaaaccgcaguugccu

SEQ ID NO: 83382 - RNA, 22 nt, Homo sapiens
uggcaaauagcaauaggagggu

SEQ ID NO: 83383 - RNA, 22 nt, Homo sapiens
uggcaaaugaaagaaagccagu

SEQ ID NO: 83384 - RNA, 22 nt, Homo sapiens
uggcaaauuccaaaguuaauuc

SEQ ID NO: 83385 - RNA, 22 nt, Homo sapiens
uggcaagaaccacaguuacuuu

SEQ ID NO: 83386 - RNA, 22 nt, Homo sapiens
uggcaagaacugcaauugcuuu

SEQ ID NO: 83387 - RNA, 22 nt, Homo sapiens
uggcaggugcacuggcuuugaa

SEQ ID NO: 83388 - RNA, 22 nt, Homo sapiens
uggcaguuucacauggcucaac

SEQ ID NO: 83389 - RNA, 22 nt, Homo sapiens
uggcaguuucauaugguucaac

SEQ ID NO: 83390 - RNA, 22 nt, Homo sapiens
uggcaguuuugauguggagaga

SEQ ID NO: 83391 - RNA, 22 nt, Homo sapiens
uggcaucuguucuacacauaaa

SEQ ID NO: 83392 - RNA, 22 nt, Homo sapiens
uggcauggaguggauggcccca

SEQ ID NO: 83393 - RNA, 22 nt, Homo sapiens
uggcaugggguaguagcgcugg

SEQ ID NO: 83394 - RNA, 22 nt, Homo sapiens
uggcucuguuuguuaacuagac

SEQ ID NO: 83395 - RNA, 20 nt, Homo sapiens
uggcuucuuaauugcaggca

SEQ ID NO: 83396 - RNA, 20 nt, Homo sapiens
ugggaacaugugguauaugg

SEQ ID NO: 83397 - RNA, 22 nt, Homo sapiens
ugggaagaagguuuacuugcca

SEQ ID NO: 83398 - RNA, 22 nt, Homo sapiens
ugggaagauucuguguuuuucc

SEQ ID NO: 83399 - RNA, 22 nt, Homo sapiens
ugggaagcugcauuuuaacaag

SEQ ID NO: 83400 - RNA, 22 nt, Homo sapiens
ugggagugugcacaauuucagc

SEQ ID NO: 83401 - RNA, 22 nt, Homo sapiens
ugggaugaauacaaugggauca

SEQ ID NO: 83402 - RNA, 21 nt, Homo sapiens
ugggccccuuccuuacaucau

SEQ ID NO: 83403 - RNA, 22 nt, Homo sapiens
uggggucguaggugcccgccag

SEQ ID NO: 83404 - RNA, 22 nt, Homo sapiens
uggguaggcccucauuggacag

SEQ ID NO: 83405 - RNA, 23 nt, Homo sapiens
ugggucaguuuuucugacaucau

SEQ ID NO: 83406 - RNA, 22 nt, Homo sapiens
uggguccccuacucuuuccaca

SEQ ID NO: 83407 - RNA, 22 nt, Homo sapiens
ugggugugaccgcucaaggggg

SEQ ID NO: 83408 - RNA, 22 nt, Homo sapiens
ugguauguauacuagcgacacu

SEQ ID NO: 83409 - RNA, 22 nt, Homo sapiens
uggucauggggcagcugacacu

SEQ ID NO: 83410 - RNA, 22 nt, Homo sapiens
uggucuccuuuguacccugggc

SEQ ID NO: 83411 - RNA, 22 nt, Homo sapiens
uggucuuuucaacaaaugguau

SEQ ID NO: 83412 - RNA, 22 nt, Homo sapiens
uggugagaaaagaugucuuugu

SEQ ID NO: 83413 - RNA, 22 nt, Homo sapiens
uggugcuugaugaggguggagc

SEQ ID NO: 83414 - RNA, 22 nt, Homo sapiens
ugguggcuuuucguagguucac

SEQ ID NO: 83415 - RNA, 20 nt, Homo sapiens
ugguguuugaacagugaaug

SEQ ID NO: 83416 - RNA, 21 nt, Homo sapiens
ugguucaguucguuacgugug

SEQ ID NO: 83417 - RNA, 22 nt, Homo sapiens
ugguuccauauuaauuuuagga

SEQ ID NO: 83418 - RNA, 16 nt, Homo sapiens
uguaaauguuuugcau

SEQ ID NO: 83419 - RNA, 22 nt, Homo sapiens
uguaacacacacuguuuacucc

SEQ ID NO: 83420 - RNA, 22 nt, Homo sapiens
uguauguugauguuauauucug

SEQ ID NO: 83421 - RNA, 22 nt, Homo sapiens
ugucacagagauuuugguaugu

SEQ ID NO: 83422 - RNA, 23 nt, Homo sapiens
ugucaucaagaugaggucacacu

SEQ ID NO: 83423 - RNA, 19 nt, Homo sapiens
ugucaucaucuuuucuugc

SEQ ID NO: 83424 - RNA, 22 nt, Homo sapiens
ugucaucauuggaaucugccuc

SEQ ID NO: 83425 - RNA, 22 nt, Homo sapiens
ugucauucaggaaauucuaagu

SEQ ID NO: 83426 - RNA, 22 nt, Homo sapiens
ugucucggagaucucucaaagu

SEQ ID NO: 83427 - RNA, 22 nt, Homo sapiens
ugucuguuugcgaaauugcuuc

SEQ ID NO: 83428 - RNA, 21 nt, Homo sapiens
ugucuuggagccagacgccag

SEQ ID NO: 83429 - RNA, 22 nt, Homo sapiens
ugugaacaaaauuuguugcaua

SEQ ID NO: 83430 - RNA, 22 nt, Homo sapiens
ugugaacacagaggcuauggca

SEQ ID NO: 83431 - RNA, 23 nt, Homo sapiens
ugugacacuuccgucaguucauu

SEQ ID NO: 83432 - RNA, 22 nt, Homo sapiens
ugugacaguguuacauuucaug

SEQ ID NO: 83433 - RNA, 18 nt, Homo sapiens
ugugacauugagcauguc

SEQ ID NO: 83434 - RNA, 19 nt, Homo sapiens
ugugacugggccagccuag

SEQ ID NO: 83435 - RNA, 21 nt, Homo sapiens
ugugacuguugcauuugucgu

SEQ ID NO: 83436 - RNA, 22 nt, Homo sapiens
ugugagcuauggaguuguagag

SEQ ID NO: 83437 - RNA, 22 nt, Homo sapiens
ugugaugguuuggaagcuucuu

SEQ ID NO: 83438 - RNA, 20 nt, Homo sapiens
ugugauuauuuaguugcaug

SEQ ID NO: 83439 - RNA, 23 nt, Homo sapiens
ugugcacauuuacauauauacac

SEQ ID NO: 83440 - RNA, 22 nt, Homo sapiens
ugugcaccucuucacacaggga

SEQ ID NO: 83441 - RNA, 22 nt, Homo sapiens
ugugccacugcacuccugccug

SEQ ID NO: 83442 - RNA, 22 nt, Homo sapiens
ugugccacugcacuccugggug

SEQ ID NO: 83443 - RNA, 22 nt, Homo sapiens
ugugcuauguuauucacauggg

SEQ ID NO: 83444 - RNA, 22 nt, Homo sapiens
uguggcagugcuuuaugaaacc

SEQ ID NO: 83445 - RNA, 18 nt, Homo sapiens
uguggcuguuuuccaaua

SEQ ID NO: 83446 - RNA, 22 nt, Homo sapiens
uguggcuuuguaaccauggguc

SEQ ID NO: 83447 - RNA, 22 nt, Homo sapiens
ugugguuuuuuucuccaauagg

SEQ ID NO: 83448 - RNA, 22 nt, Homo sapiens
uguguagagaaauauuacuuau

SEQ ID NO: 83449 - RNA, 22 nt, Homo sapiens
ugugucuuuuaucacacaaugu

SEQ ID NO: 83450 - RNA, 22 nt, Homo sapiens
uguuuguuugagauggagucuc

SEQ ID NO: 83451 - RNA, 22 nt, Homo sapiens
uuaaaugcauagaauguguagu

SEQ ID NO: 83452 - RNA, 22 nt, Homo sapiens
uuaacaguuaauucuuuggcaa

SEQ ID NO: 83453 - RNA, 22 nt, Homo sapiens
uuaagcaaagguaacaugagaa

SEQ ID NO: 83454 - RNA, 22 nt, Homo sapiens
uuaagccaggugugguggcaca

SEQ ID NO: 83455 - RNA, 22 nt, Homo sapiens
uuaaggcagugcaucuggaguu

SEQ ID NO: 83456 - RNA, 21 nt, Homo sapiens
uuaaguaauuacccaacucuc

SEQ ID NO: 83457 - RNA, 22 nt, Homo sapiens
uuaagucacacuagacaacuga

SEQ ID NO: 83458 - RNA, 22 nt, Homo sapiens
uuaagugcucaguuacucaguu

SEQ ID NO: 83459 - RNA, 22 nt, Homo sapiens
uuaccuugcacugagucugaaa

SEQ ID NO: 83460 - RNA, 22 nt, Homo sapiens
uuacuguauagaaucaucuuga

SEQ ID NO: 83461 - RNA, 22 nt, Homo sapiens
uuacuugagaugaguuggacaa

SEQ ID NO: 83462 - RNA, 18 nt, Homo sapiens
uuagaugguuuuaaaacu

SEQ ID NO: 83463 - RNA, 22 nt, Homo sapiens
uuagauguuugacugggccuua

SEQ ID NO: 83464 - RNA, 22 nt, Homo sapiens
uuagcacuaauucguuggggca

SEQ ID NO: 83465 - RNA, 22 nt, Homo sapiens
uuagggaggcucaggacaagag

SEQ ID NO: 83466 - RNA, 22 nt, Homo sapiens
uuaggugguacacagccccagu

SEQ ID NO: 83467 - RNA, 22 nt, Homo sapiens
uuaguggaugcugaauaaagaa

SEQ ID NO: 83468 - RNA, 18 nt, Homo sapiens
uuauaugcauguguagga

SEQ ID NO: 83469 - RNA, 22 nt, Homo sapiens
uuaucaaacccuaggagguggu

SEQ ID NO: 83470 - RNA, 21 nt, Homo sapiens
uuaucccagugucucugcagg

SEQ ID NO: 83471 - RNA, 22 nt, Homo sapiens
ugagacggagucucgcuguguc

SEQ ID NO: 83472 - RNA, 22 nt, Homo sapiens
ugagacggagucuugcccuguc

SEQ ID NO: 83473 - RNA, 22 nt, Homo sapiens
ugagacggagucuugcucuguc

SEQ ID NO: 83474 - RNA, 22 nt, Homo sapiens
ugagacggaguuuugcucuugu

SEQ ID NO: 83475 - RNA, 22 nt, Homo sapiens
ugagacugagucucccucuguc

SEQ ID NO: 83476 - RNA, 22 nt, Homo sapiens
ugagacugagucuugcucuauu

SEQ ID NO: 83477 - RNA, 22 nt, Homo sapiens
ugagagcuuugaugcacuguuu

SEQ ID NO: 83478 - RNA, 22 nt, Homo sapiens
ugagaguagggguugggauugg

SEQ ID NO: 83479 - RNA, 22 nt, Homo sapiens
ugagaucacuaagagguaaugg

SEQ ID NO: 83480 - RNA, 22 nt, Homo sapiens
ugagaucgaguaucgcugucac

SEQ ID NO: 83481 - RNA, 19 nt, Homo sapiens
ugagaucuuuacuggguuu

SEQ ID NO: 83482 - RNA, 22 nt, Homo sapiens
ugagaugaagcuagaagaaugg

SEQ ID NO: 83483 - RNA, 22 nt, Homo sapiens
ugagaugaagucuugcucuguu

SEQ ID NO: 83484 - RNA, 22 nt, Homo sapiens
ugagaugagaaucaguucuaau

SEQ ID NO: 83485 - RNA, 22 nt, Homo sapiens
ugagaugagagaaugcuugccu

SEQ ID NO: 83486 - RNA, 22 nt, Homo sapiens
ugagaugagggaagccuaggca

SEQ ID NO: 83487 - RNA, 22 nt, Homo sapiens
ugagaugaguugcgcucugucg

SEQ ID NO: 83488 - RNA, 22 nt, Homo sapiens
ugagaugaucaaaguauaggcu

SEQ ID NO: 83489 - RNA, 22 nt, Homo sapiens
ugagaugaugggauaagagggc

SEQ ID NO: 83490 - RNA, 22 nt, Homo sapiens
ugagaugcauauucuggcuccu

SEQ ID NO: 83491 - RNA, 22 nt, Homo sapiens
ugagaugcuuguaaauucauuu

SEQ ID NO: 83492 - RNA, 22 nt, Homo sapiens
ugagauggagucuugucgccua

SEQ ID NO: 83493 - RNA, 22 nt, Homo sapiens
ugagauggaguuucgcccuugu

SEQ ID NO: 83494 - RNA, 22 nt, Homo sapiens
ugagauggaguuucgcucuugu

SEQ ID NO: 83495 - RNA, 22 nt, Homo sapiens
ugagauggaguuucgcuuuugu

SEQ ID NO: 83496 - RNA, 22 nt, Homo sapiens
ugagauggcugaauucagaaua

SEQ ID NO: 83497 - RNA, 22 nt, Homo sapiens
ugagaugguaaauuuuuguugu

SEQ ID NO: 83498 - RNA, 22 nt, Homo sapiens
ugagauguugcucugaaacaag

SEQ ID NO: 83499 - RNA, 22 nt, Homo sapiens
ugagauuaucguaauguaucuc

SEQ ID NO: 83500 - RNA, 22 nt, Homo sapiens
ugagauuaucuguacauaggag

SEQ ID NO: 83501 - RNA, 22 nt, Homo sapiens
ugagcaaaauuuuggacauaga

SEQ ID NO: 83502 - RNA, 22 nt, Homo sapiens
ugagcucagcuuucuuuuucac

SEQ ID NO: 83503 - RNA, 20 nt, Homo sapiens
ugagcucaugacauuuuucu

SEQ ID NO: 83504 - RNA, 22 nt, Homo sapiens
ugaggaucucuaggaauuuauc

SEQ ID NO: 83505 - RNA, 22 nt, Homo sapiens
ugaggcaaggcugaaugaaggc

SEQ ID NO: 83506 - RNA, 22 nt, Homo sapiens
ugagguaucauugcccaggcug

SEQ ID NO: 83507 - RNA, 22 nt, Homo sapiens
ugagguaugugaugucuuuuag

SEQ ID NO: 83508 - RNA, 19 nt, Homo sapiens
ugagguauuuguugggaga

SEQ ID NO: 83509 - RNA, 22 nt, Homo sapiens
ugagguuauuuguucaagaagu

SEQ ID NO: 83510 - RNA, 22 nt, Homo sapiens
ugagucaauucuaacaauggca

SEQ ID NO: 83511 - RNA, 22 nt, Homo sapiens
ugagugaggcugggcagucccu

SEQ ID NO: 83512 - RNA, 22 nt, Homo sapiens
ugagugagguucuacucuguga

SEQ ID NO: 83513 - RNA, 22 nt, Homo sapiens
ugaguuaggagaguguggcucu

SEQ ID NO: 83514 - RNA, 22 nt, Homo sapiens
ugaguucuuuguagauucugug

SEQ ID NO: 83515 - RNA, 22 nt, Homo sapiens
ugaguuuaucuaaagaccuggg

SEQ ID NO: 83516 - RNA, 22 nt, Homo sapiens
ugauacuggcuucauagaauga

SEQ ID NO: 83517 - RNA, 22 nt, Homo sapiens
ugauauauugaaugaugaaaca

SEQ ID NO: 83518 - RNA, 22 nt, Homo sapiens
ugauaugugaguauaugguuau

SEQ ID NO: 83519 - RNA, 21 nt, Homo sapiens
ugaucacaugaaaaccaugca

SEQ ID NO: 83520 - RNA, 22 nt, Homo sapiens
ugaucuguguaacauaggaguc

SEQ ID NO: 83521 - RNA, 22 nt, Homo sapiens
ugaugacccugcaguucucaag

SEQ ID NO: 83522 - RNA, 22 nt, Homo sapiens
ugauggcauuucauguuuguaa

SEQ ID NO: 83523 - RNA, 22 nt, Homo sapiens
ugauuggagaacaaacugcaua

SEQ ID NO: 83524 - RNA, 22 nt, Homo sapiens
ugauugucucuccugccccauc

SEQ ID NO: 83525 - RNA, 22 nt, Homo sapiens
ugcaaauguuaggugucauuau

SEQ ID NO: 83526 - RNA, 22 nt, Homo sapiens
ugcaaguaauuggcgaggaguu

SEQ ID NO: 83527 - RNA, 22 nt, Homo sapiens
ugcaaugugaaauaagcacauc

SEQ ID NO: 83528 - RNA, 22 nt, Homo sapiens
ugcacaguccagugcccacuga

SEQ ID NO: 83529 - RNA, 17 nt, Homo sapiens
ugcagcacacugauggg

SEQ ID NO: 83530 - RNA, 22 nt, Homo sapiens
ugcagcauguaggcacguuauu

SEQ ID NO: 83531 - RNA, 22 nt, Homo sapiens
ugcagcauugcacuccagccug

SEQ ID NO: 83532 - RNA, 21 nt, Homo sapiens
ugcagccauucagcccuaugc

SEQ ID NO: 83533 - RNA, 18 nt, Homo sapiens
ugcagcuuugugauuggc

SEQ ID NO: 83534 - RNA, 22 nt, Homo sapiens
ugcagguacuugacaacuuggg

SEQ ID NO: 83535 - RNA, 22 nt, Homo sapiens
ugcaguacuuugaaauauacug

SEQ ID NO: 83536 - RNA, 22 nt, Homo sapiens
ugcagugugauuuucuggcuga

SEQ ID NO: 83537 - RNA, 22 nt, Homo sapiens
ugcaguuuaggaacugguaaca

SEQ ID NO: 83538 - RNA, 22 nt, Homo sapiens
ugcauauguauacaugugccau

SEQ ID NO: 83539 - RNA, 22 nt, Homo sapiens
ugcauauucgaguuauuuuggg

SEQ ID NO: 83540 - RNA, 22 nt, Homo sapiens
ugcauccauucuagacucaucu

SEQ ID NO: 83541 - RNA, 19 nt, Homo sapiens
ugccaagaaagucagcuua

SEQ ID NO: 83542 - RNA, 22 nt, Homo sapiens
ugccaaggagucagucccuaga

SEQ ID NO: 83543 - RNA, 22 nt, Homo sapiens
ugccagagacguagggaauauu

SEQ ID NO: 83544 - RNA, 21 nt, Homo sapiens
ugcccaguggcuuggggucag

SEQ ID NO: 83545 - RNA, 22 nt, Homo sapiens
ugccuacagaaggggcucagca

SEQ ID NO: 83546 - RNA, 22 nt, Homo sapiens
ugccuaguggaaggagagcaaa

SEQ ID NO: 83547 - RNA, 23 nt, Homo sapiens
ugcuauguaagcauuuauuaaau

SEQ ID NO: 83548 - RNA, 22 nt, Homo sapiens
ugcuaugucuucucucacagag

SEQ ID NO: 83549 - RNA, 21 nt, Homo sapiens
ugcuauguuguccaggcuggc

SEQ ID NO: 83550 - RNA, 23 nt, Homo sapiens
ugcuccccucauggaugaauaaa

SEQ ID NO: 83551 - RNA, 22 nt, Homo sapiens
ugcugcaaucucggcacuuugg

SEQ ID NO: 83552 - RNA, 22 nt, Homo sapiens
ugcugguauuauguuauccaga

SEQ ID NO: 83553 - RNA, 23 nt, Homo sapiens
uggaacugaauuucuuagcauuu

SEQ ID NO: 83554 - RNA, 20 nt, Homo sapiens
uggaaggcaucugcauuauu

SEQ ID NO: 83555 - RNA, 22 nt, Homo sapiens
uggaagucaugcugcaagaaca

SEQ ID NO: 83556 - RNA, 22 nt, Homo sapiens
uggaauggagagagggugcacg

SEQ ID NO: 83557 - RNA, 22 nt, Homo sapiens
uggaccccugcucgggagcccu

SEQ ID NO: 83558 - RNA, 22 nt, Homo sapiens
uggagguagacauugggaagag

SEQ ID NO: 83559 - RNA, 22 nt, Homo sapiens
uggagguaggugauauguagca

SEQ ID NO: 83560 - RNA, 20 nt, Homo sapiens
uggagugaagguucuggacc

SEQ ID NO: 83561 - RNA, 22 nt, Homo sapiens
uggaguguagaagccagccucc

SEQ ID NO: 83562 - RNA, 22 nt, Homo sapiens
uggaguguguuaacuuuacaag

SEQ ID NO: 83563 - RNA, 22 nt, Homo sapiens
cuggcagugcuuguuauccugg

SEQ ID NO: 83564 - RNA, 22 nt, Homo sapiens
cugggguaggacuggcuuuuga

SEQ ID NO: 83565 - RNA, 22 nt, Homo sapiens
cugguuguucuggaugggcagg

SEQ ID NO: 83566 - RNA, 22 nt, Homo sapiens
cuguccugcagagucagaauga

SEQ ID NO: 83567 - RNA, 22 nt, Homo sapiens
cugucucagccucuccaguagc

SEQ ID NO: 83568 - RNA, 22 nt, Homo sapiens
cugucuggaguccuucgugugc

SEQ ID NO: 83569 - RNA, 22 nt, Homo sapiens
cugugacugcagggcauauuug

SEQ ID NO: 83570 - RNA, 22 nt, Homo sapiens
cugugauuauauaguuaaggua

SEQ ID NO: 83571 - RNA, 22 nt, Homo sapiens
cugugguuacguucuuugugcu

SEQ ID NO: 83572 - RNA, 18 nt, Homo sapiens
cuuaacauugggaugaua

SEQ ID NO: 83573 - RNA, 22 nt, Homo sapiens
cuuagguuaugauaaauuuagu

SEQ ID NO: 83574 - RNA, 22 nt, Homo sapiens
cuucaguucuguaaggacagca

SEQ ID NO: 83575 - RNA, 22 nt, Homo sapiens
cuucucagugcucaucuuauuu

SEQ ID NO: 83576 - RNA, 22 nt, Homo sapiens
cuugacacugguuuucugaaua

SEQ ID NO: 83577 - RNA, 22 nt, Homo sapiens
cuugagacauuguuuuccaagu

SEQ ID NO: 83578 - RNA, 22 nt, Homo sapiens
cuugcauuuuggagaaugcuga

SEQ ID NO: 83579 - RNA, 22 nt, Homo sapiens
cuuggcuucuuuauguggcuau

SEQ ID NO: 83580 - RNA, 22 nt, Homo sapiens
cuuggcuugguaucaaauaacc

SEQ ID NO: 83581 - RNA, 20 nt, Homo sapiens
cuuggcuuucuugguguuaa

SEQ ID NO: 83582 - RNA, 22 nt, Homo sapiens
cuugguuacauuuuccuagaaa

SEQ ID NO: 83583 - RNA, 19 nt, Homo sapiens
cuuguacucggcgcaguug

SEQ ID NO: 83584 - RNA, 22 nt, Homo sapiens
cuuuagcaauugauuaugccau

SEQ ID NO: 83585 - RNA, 22 nt, Homo sapiens
cuuucucagugagacccgagau

SEQ ID NO: 83586 - RNA, 22 nt, Homo sapiens
cuuucugaggagaauagagaac

SEQ ID NO: 83587 - RNA, 22 nt, Homo sapiens
cuuuggcauuagccuguauaga

SEQ ID NO: 83588 - RNA, 22 nt, Homo sapiens
cuuuggguauucucccuugggg

SEQ ID NO: 83589 - RNA, 23 nt, Homo sapiens
cuuuggucucugguugacuucag

SEQ ID NO: 83590 - RNA, 20 nt, Homo sapiens
cuuuggugagucaacuccuu

SEQ ID NO: 83591 - RNA, 22 nt, Homo sapiens
cuuugguuaauaggauauggca

SEQ ID NO: 83592 - RNA, 22 nt, Homo sapiens
cuuuuggcuuaagauugucuug

SEQ ID NO: 83593 - RNA, 22 nt, Homo sapiens
cuuuuggugguucugaugcagg

SEQ ID NO: 83594 - RNA, 22 nt, Homo sapiens
cuuuugugauuccucaguuacu

SEQ ID NO: 83595 - RNA, 22 nt, Homo sapiens
cuuuugugauucuucaguuacu

SEQ ID NO: 83596 - RNA, 21 nt, Homo sapiens
cuuuuuacucguucauaugca

SEQ ID NO: 83597 - RNA, 22 nt, Homo sapiens
gaaagguaggaacagggugcag

SEQ ID NO: 83598 - RNA, 23 nt, Homo sapiens
gaaauguaagugaugccccacag

SEQ ID NO: 83599 - RNA, 22 nt, Homo sapiens
gaagaaguacaagacaaauuuu

SEQ ID NO: 83600 - RNA, 22 nt, Homo sapiens
gaaguaggugcuguuauuaucu

SEQ ID NO: 83601 - RNA, 17 nt, Homo sapiens
gaaguguuucagcagcu

SEQ ID NO: 83602 - RNA, 22 nt, Homo sapiens
gaauaaacuagagaggacugag

SEQ ID NO: 83603 - RNA, 22 nt, Homo sapiens
gaauucugucgcuuacuagaug

SEQ ID NO: 83604 - RNA, 22 nt, Homo sapiens
gacaucauuaugagauuuaaac

SEQ ID NO: 83605 - RNA, 20 nt, Homo sapiens
gacauguugguuugcugcac

SEQ ID NO: 83606 - RNA, 22 nt, Homo sapiens
gacuagggaaaauuauuuuguu

SEQ ID NO: 83607 - RNA, 22 nt, Homo sapiens
gacucuguagacaaucacaucu

SEQ ID NO: 83608 - RNA, 20 nt, Homo sapiens
gacuucagaagcuucagagu

SEQ ID NO: 83609 - RNA, 22 nt, Homo sapiens
gagaacauacggcauuugguuu

SEQ ID NO: 83610 - RNA, 22 nt, Homo sapiens
gagaaccauuuggagaaaaagu

SEQ ID NO: 83611 - RNA, 22 nt, Homo sapiens
gagacggagucucgcucugucg

SEQ ID NO: 83612 - RNA, 22 nt, Homo sapiens
gagacggagucuugcucuguug

SEQ ID NO: 83613 - RNA, 22 nt, Homo sapiens
gagagugaaguuugcuaccugu

SEQ ID NO: 83614 - RNA, 22 nt, Homo sapiens
gagauauucugguuuacuaaau

SEQ ID NO: 83615 - RNA, 22 nt, Homo sapiens
gagaucaguuaaugaagugagc

SEQ ID NO: 83616 - RNA, 22 nt, Homo sapiens
gagaugaaaucuugcucuguca

SEQ ID NO: 83617 - RNA, 22 nt, Homo sapiens
gagaugaaguuaaggaucuuua

SEQ ID NO: 83618 - RNA, 22 nt, Homo sapiens
gagauguuuguuucacugucac

SEQ ID NO: 83619 - RNA, 22 nt, Homo sapiens
gagcacccuuuguugauugcaa

SEQ ID NO: 83620 - RNA, 22 nt, Homo sapiens
gagcacugaauacugugguggu

SEQ ID NO: 83621 - RNA, 22 nt, Homo sapiens
gagccuguaggaggagaggugg

SEQ ID NO: 83622 - RNA, 22 nt, Homo sapiens
gagcucaccuuaccucuggagc

SEQ ID NO: 83623 - RNA, 22 nt, Homo sapiens
gaggacauuaugcuaaguggaa

SEQ ID NO: 83624 - RNA, 22 nt, Homo sapiens
gaggagauauucugcuggaugg

SEQ ID NO: 83625 - RNA, 22 nt, Homo sapiens
gaggcaagaguaguuaaguuag

SEQ ID NO: 83626 - RNA, 22 nt, Homo sapiens
gagguagugagcagcugaacua

SEQ ID NO: 83627 - RNA, 17 nt, Homo sapiens
gagguaguuuacuuuca

SEQ ID NO: 83628 - RNA, 21 nt, Homo sapiens
gagugcaaauaaagagagggc

SEQ ID NO: 83629 - RNA, 22 nt, Homo sapiens
gagugcuguuagcccuggguuu

SEQ ID NO: 83630 - RNA, 22 nt, Homo sapiens
gaguuuguacuaauuuguugua

SEQ ID NO: 83631 - RNA, 22 nt, Homo sapiens
uaguguuuuucauuggcagagg

SEQ ID NO: 83632 - RNA, 22 nt, Homo sapiens
uaguuuaucuucuggauggaca

SEQ ID NO: 83633 - RNA, 22 nt, Homo sapiens
uauacugucuuuguaugccuag

SEQ ID NO: 83634 - RNA, 22 nt, Homo sapiens
uauagcacugagaauguaauuc

SEQ ID NO: 83635 - RNA, 22 nt, Homo sapiens
uauagcagugugagaacagacu

SEQ ID NO: 83636 - RNA, 22 nt, Homo sapiens
uauaucacaugcacucauuuuc

SEQ ID NO: 83637 - RNA, 22 nt, Homo sapiens
uauaugcacucagguguaugug

SEQ ID NO: 83638 - RNA, 22 nt, Homo sapiens
uauaugcauugugggguacuga

SEQ ID NO: 83639 - RNA, 22 nt, Homo sapiens
uaucaaggccacucauuuuaug

SEQ ID NO: 83640 - RNA, 23 nt, Homo sapiens
uaucacacuuucucugugccaca

SEQ ID NO: 83641 - RNA, 22 nt, Homo sapiens
uaucacagauauuaugggccaa

SEQ ID NO: 83642 - RNA, 22 nt, Homo sapiens
uaucacagcauugucuauaaua

SEQ ID NO: 83643 - RNA, 22 nt, Homo sapiens
uaucacagcgggguguacaccc

SEQ ID NO: 83644 - RNA, 22 nt, Homo sapiens
uaucacagugcuggaguauucc

SEQ ID NO: 83645 - RNA, 22 nt, Homo sapiens
uaucaccuugcaguggaugcua

SEQ ID NO: 83646 - RNA, 22 nt, Homo sapiens
uaucauagacaaucaguuauug

SEQ ID NO: 83647 - RNA, 23 nt, Homo sapiens
uaucccuugccuuaugaugugag

SEQ ID NO: 83648 - RNA, 22 nt, Homo sapiens
uaucuacauguagguauguaug

SEQ ID NO: 83649 - RNA, 22 nt, Homo sapiens
uaucucagaugagacuuguaac

SEQ ID NO: 83650 - RNA, 20 nt, Homo sapiens
uaucucaguuuguccuaaac

SEQ ID NO: 83651 - RNA, 21 nt, Homo sapiens
uaucucaguuuuccuuugugg

SEQ ID NO: 83652 - RNA, 20 nt, Homo sapiens
uaugacaaagccuagugagu

SEQ ID NO: 83653 - RNA, 23 nt, Homo sapiens
uaugacagaggaagggggagcug

SEQ ID NO: 83654 - RNA, 22 nt, Homo sapiens
uaugaugcuguuuagaaucucu

SEQ ID NO: 83655 - RNA, 22 nt, Homo sapiens
uauggauuucauuagacuugag

SEQ ID NO: 83656 - RNA, 22 nt, Homo sapiens
uauggcuaugggaacugggagu

SEQ ID NO: 83657 - RNA, 22 nt, Homo sapiens
uauggcuuuguucaacagccuc

SEQ ID NO: 83658 - RNA, 19 nt, Homo sapiens
uaugggauuuuuagggugu

SEQ ID NO: 83659 - RNA, 20 nt, Homo sapiens
uaugguuuuagguauagcau

SEQ ID NO: 83660 - RNA, 22 nt, Homo sapiens
uauuagguuggugcaaaaguaa

SEQ ID NO: 83661 - RNA, 22 nt, Homo sapiens
uauuagguuggugcaaaaguua

SEQ ID NO: 83662 - RNA, 22 nt, Homo sapiens
uauuagugccuaagucuuaggg

SEQ ID NO: 83663 - RNA, 22 nt, Homo sapiens
uauuagugucuuuugguuagaa

SEQ ID NO: 83664 - RNA, 22 nt, Homo sapiens
uauuaguuguaugauucccaag

SEQ ID NO: 83665 - RNA, 22 nt, Homo sapiens
uauuaugcacuuuauaaaaauu

SEQ ID NO: 83666 - RNA, 22 nt, Homo sapiens
uauucacaggugugggacaaag

SEQ ID NO: 83667 - RNA, 22 nt, Homo sapiens
uauuccacacuguuggugggau

SEQ ID NO: 83668 - RNA, 22 nt, Homo sapiens
uauuccacuauuaguccagaug

SEQ ID NO: 83669 - RNA, 22 nt, Homo sapiens
uauugacuuuuuuguuaggagg

SEQ ID NO: 83670 - RNA, 22 nt, Homo sapiens
uauugcaauuggcagagugcua

SEQ ID NO: 83671 - RNA, 22 nt, Homo sapiens
uauugcaauuggggaaacuggg

SEQ ID NO: 83672 - RNA, 22 nt, Homo sapiens
uauugcuuuacucucuuauccu

SEQ ID NO: 83673 - RNA, 22 nt, Homo sapiens
uauuguuaaagauguuaaugau

SEQ ID NO: 83674 - RNA, 22 nt, Homo sapiens
uauuugauugacuuuagcagga

SEQ ID NO: 83675 - RNA, 22 nt, Homo sapiens
uauuuggugaaugaaugcaugu

SEQ ID NO: 83676 - RNA, 20 nt, Homo sapiens
uauuugguuauuuccauggu

SEQ ID NO: 83677 - RNA, 22 nt, Homo sapiens
uauuugguuggugcaaaaguaa

SEQ ID NO: 83678 - RNA, 22 nt, Homo sapiens
uauuuguccccuccaaaaguca

SEQ ID NO: 83679 - RNA, 22 nt, Homo sapiens
ucaaaaccucagagaguagagc

SEQ ID NO: 83680 - RNA, 22 nt, Homo sapiens
ucaaacauccccaccagggacu

SEQ ID NO: 83681 - RNA, 20 nt, Homo sapiens
ucaaagacauggcugucaga

SEQ ID NO: 83682 - RNA, 22 nt, Homo sapiens
ucaacauugcugucaggcaucu

SEQ ID NO: 83683 - RNA, 22 nt, Homo sapiens
ucaagcaauucgccugucucag

SEQ ID NO: 83684 - RNA, 23 nt, Homo sapiens
ucaagugaugguggccacaaggg

SEQ ID NO: 83685 - RNA, 22 nt, Homo sapiens
ucacaaagcuuggccugcuucu

SEQ ID NO: 83686 - RNA, 18 nt, Homo sapiens
ucacaaccacagugcugu

SEQ ID NO: 83687 - RNA, 22 nt, Homo sapiens
ucacaccauucuucuacuucag

SEQ ID NO: 83688 - RNA, 22 nt, Homo sapiens
ucacacugcaucuguuggaauu

SEQ ID NO: 83689 - RNA, 22 nt, Homo sapiens
ucacacugucuugguuacucuu

SEQ ID NO: 83690 - RNA, 22 nt, Homo sapiens
ucacagaggagaagaccuuuaa

SEQ ID NO: 83691 - RNA, 18 nt, Homo sapiens
ucacagguaaaguugaca

SEQ ID NO: 83692 - RNA, 17 nt, Homo sapiens
ucacaguguuaggauga

SEQ ID NO: 83693 - RNA, 22 nt, Homo sapiens
ucacaguugauugaaacacagc

SEQ ID NO: 83694 - RNA, 22 nt, Homo sapiens
ucacauggggaagggacuagcu

SEQ ID NO: 83695 - RNA, 22 nt, Homo sapiens
ucacaugggugcaauauaauca

SEQ ID NO: 83696 - RNA, 22 nt, Homo sapiens
ucacauuguacaaacagguaag

SEQ ID NO: 83697 - RNA, 22 nt, Homo sapiens
ucacauuguauauguaccuauc

SEQ ID NO: 83698 - RNA, 22 nt, Homo sapiens
ucaccaccuuccaggaccacug

SEQ ID NO: 83699 - RNA, 22 nt, Homo sapiens
ucaccuggggcacagcugaaga

SEQ ID NO: 83700 - RNA, 18 nt, Homo sapiens
ucacggggagcagcagcc

SEQ ID NO: 83701 - RNA, 23 nt, Homo sapiens
ucacuagaguccuggaguuugag

SEQ ID NO: 83702 - RNA, 20 nt, Homo sapiens
ucacuauggagcucuuucuu

SEQ ID NO: 83703 - RNA, 22 nt, Homo sapiens
ucacugagcuagaucacuugac

SEQ ID NO: 83704 - RNA, 22 nt, Homo sapiens
ucacugaggucugagcuuuaug

SEQ ID NO: 83705 - RNA, 22 nt, Homo sapiens
ucacugcacuccagccuuuaug

SEQ ID NO: 83706 - RNA, 22 nt, Homo sapiens
ugacagaggucuuuuaauagcu

SEQ ID NO: 83707 - RNA, 22 nt, Homo sapiens
ugacaggucuaauuuacugaca

SEQ ID NO: 83708 - RNA, 18 nt, Homo sapiens
ugacaucauuuagaaagg

SEQ ID NO: 83709 - RNA, 22 nt, Homo sapiens
ugacauggagggugcggcugca

SEQ ID NO: 83710 - RNA, 22 nt, Homo sapiens
ugacuaggaaauuagaacuuuu

SEQ ID NO: 83711 - RNA, 22 nt, Homo sapiens
ugacugaguaguauuccacuau

SEQ ID NO: 83712 - RNA, 22 nt, Homo sapiens
ugacuggaaacaguguuauuug

SEQ ID NO: 83713 - RNA, 22 nt, Homo sapiens
ugacuggagaccucaguagggu

SEQ ID NO: 83714 - RNA, 22 nt, Homo sapiens
ugacuggagucuugcucugucg

SEQ ID NO: 83715 - RNA, 22 nt, Homo sapiens
ugacuucagacugaaaugauuc

SEQ ID NO: 83716 - RNA, 23 nt, Homo sapiens
ugacuuguccagugauaguucgu

SEQ ID NO: 83717 - RNA, 17 nt, Homo sapiens
ugagaacaugugguauu

SEQ ID NO: 83718 - RNA, 22 nt, Homo sapiens
ugagaagacaucagcuuucgga

SEQ ID NO: 83719 - RNA, 22 nt, Homo sapiens
ugagaagugauauagaaguuaa

SEQ ID NO: 83720 - RNA, 22 nt, Homo sapiens
ugagacaugugaauauuuguac

SEQ ID NO: 83721 - RNA, 22 nt, Homo sapiens
ugagacggagucucgcucucua

SEQ ID NO: 83722 - RNA, 22 nt, Homo sapiens
ugagacggagucucgcucuguu

SEQ ID NO: 83723 - RNA, 22 nt, Homo sapiens
auggcaauguaagucagaaaaa

SEQ ID NO: 83724 - RNA, 22 nt, Homo sapiens
auggcacuacugggaaugucuu

SEQ ID NO: 83725 - RNA, 22 nt, Homo sapiens
auggcaguuucagcuauaguuu

SEQ ID NO: 83726 - RNA, 22 nt, Homo sapiens
auggcucuguuccaugugucuu

SEQ ID NO: 83727 - RNA, 22 nt, Homo sapiens
auggcucuguuuuuuaugcucu

SEQ ID NO: 83728 - RNA, 22 nt, Homo sapiens
augggauaguaucaguggaaua

SEQ ID NO: 83729 - RNA, 22 nt, Homo sapiens
augguuugugcuccuauaagaa

SEQ ID NO: 83730 - RNA, 21 nt, Homo sapiens
augucauggaugacuaauuca

SEQ ID NO: 83731 - RNA, 22 nt, Homo sapiens
augugaacugaauuaauucaca

SEQ ID NO: 83732 - RNA, 22 nt, Homo sapiens
augugacagugguuuuaagcgu

SEQ ID NO: 83733 - RNA, 22 nt, Homo sapiens
augugacuggaucauggggacg

SEQ ID NO: 83734 - RNA, 22 nt, Homo sapiens
augugacuuuuuccugugccuu

SEQ ID NO: 83735 - RNA, 22 nt, Homo sapiens
augugcauaugaagcacagaca

SEQ ID NO: 83736 - RNA, 19 nt, Homo sapiens
augugguuagcaugacugc

SEQ ID NO: 83737 - RNA, 22 nt, Homo sapiens
augugugaaucccagaaccugu

SEQ ID NO: 83738 - RNA, 22 nt, Homo sapiens
auguguucaucacagcacaauu

SEQ ID NO: 83739 - RNA, 22 nt, Homo sapiens
auguuauguuaaugauaaugga

SEQ ID NO: 83740 - RNA, 18 nt, Homo sapiens
auguuauguuuguagaag

SEQ ID NO: 83741 - RNA, 22 nt, Homo sapiens
auuaagugcuugcagaagucca

SEQ ID NO: 83742 - RNA, 22 nt, Homo sapiens
auuacacuuucuauucaaugag

SEQ ID NO: 83743 - RNA, 22 nt, Homo sapiens
auuacaugucuauccaugaaca

SEQ ID NO: 83744 - RNA, 22 nt, Homo sapiens
auucaacuaauuauugaagaug

SEQ ID NO: 83745 - RNA, 22 nt, Homo sapiens
auuccacagccgauaccaugac

SEQ ID NO: 83746 - RNA, 22 nt, Homo sapiens
auuccagguggcgccauucaca

SEQ ID NO: 83747 - RNA, 22 nt, Homo sapiens
auugagcaaggucuccuaguau

SEQ ID NO: 83748 - RNA, 21 nt, Homo sapiens
auugagcacaugaaacauggc

SEQ ID NO: 83749 - RNA, 22 nt, Homo sapiens
auugcacaccagucugggcaaa

SEQ ID NO: 83750 - RNA, 22 nt, Homo sapiens
auugcacuccagccuuggggau

SEQ ID NO: 83751 - RNA, 22 nt, Homo sapiens
auugcacucuagccugggugac

SEQ ID NO: 83752 - RNA, 22 nt, Homo sapiens
auugcacugcagccugggcaac

SEQ ID NO: 83753 - RNA, 22 nt, Homo sapiens
auugcaguuucaacuccagggc

SEQ ID NO: 83754 - RNA, 22 nt, Homo sapiens
auugcauugugaucuucccaga

SEQ ID NO: 83755 - RNA, 22 nt, Homo sapiens
auugccucaauuccaagacugc

SEQ ID NO: 83756 - RNA, 22 nt, Homo sapiens
auugcuuuuacugggagcuuug

SEQ ID NO: 83757 - RNA, 22 nt, Homo sapiens
auuggacagcauuucuagacuu

SEQ ID NO: 83758 - RNA, 22 nt, Homo sapiens
auuggcaagauagcauaugagg

SEQ ID NO: 83759 - RNA, 22 nt, Homo sapiens
auuggcuuuauacauaagaaua

SEQ ID NO: 83760 - RNA, 22 nt, Homo sapiens
auuggggaaugguggcuuuagu

SEQ ID NO: 83761 - RNA, 22 nt, Homo sapiens
auuguaauuuuagagaaagugg

SEQ ID NO: 83762 - RNA, 22 nt, Homo sapiens
auuguacuccagccugggcugc

SEQ ID NO: 83763 - RNA, 22 nt, Homo sapiens
auuguacuccagccuguggagc

SEQ ID NO: 83764 - RNA, 22 nt, Homo sapiens
auuguucuuguguccuuuuccu

SEQ ID NO: 83765 - RNA, 22 nt, Homo sapiens
auuuggcaacguagggaggcau

SEQ ID NO: 83766 - RNA, 22 nt, Homo sapiens
auuugggaaugugcauuauacu

SEQ ID NO: 83767 - RNA, 22 nt, Homo sapiens
auuuugcauugcuguaaaggaa

SEQ ID NO: 83768 - RNA, 22 nt, Homo sapiens
auuuugguuacauaguugagcu

SEQ ID NO: 83769 - RNA, 22 nt, Homo sapiens
caaaggauucauuuccaggagu

SEQ ID NO: 83770 - RNA, 22 nt, Homo sapiens
caaaggcuguuauaggccagga

SEQ ID NO: 83771 - RNA, 22 nt, Homo sapiens
caaagugcuggccgggcgcagu

SEQ ID NO: 83772 - RNA, 19 nt, Homo sapiens
caaaguguucuucuuugcc

SEQ ID NO: 83773 - RNA, 22 nt, Homo sapiens
caaauacuuucauguugucuug

SEQ ID NO: 83774 - RNA, 22 nt, Homo sapiens
caacugguuuuauacaguuuag

SEQ ID NO: 83775 - RNA, 22 nt, Homo sapiens
caagagagcugaugguuuuaaa

SEQ ID NO: 83776 - RNA, 22 nt, Homo sapiens
caaggcacagccccuacuuccu

SEQ ID NO: 83777 - RNA, 22 nt, Homo sapiens
caagugaauaguugcucucaga

SEQ ID NO: 83778 - RNA, 22 nt, Homo sapiens
caagugcuuucuuggggauuua

SEQ ID NO: 83779 - RNA, 22 nt, Homo sapiens
caaguguuggcuuguauacaaa

SEQ ID NO: 83780 - RNA, 22 nt, Homo sapiens
caaugguuuuuuaguauaagua

SEQ ID NO: 83781 - RNA, 22 nt, Homo sapiens
cacagcgacuuccgccuaccgg

SEQ ID NO: 83782 - RNA, 22 nt, Homo sapiens
cacagcuagucaaugguagaca

SEQ ID NO: 83783 - RNA, 22 nt, Homo sapiens
cacaggaagaggcacggucccu

SEQ ID NO: 83784 - RNA, 22 nt, Homo sapiens
cacagucugggcuuguuuguac

SEQ ID NO: 83785 - RNA, 22 nt, Homo sapiens
cacauguuuuagcauggcuguu

SEQ ID NO: 83786 - RNA, 22 nt, Homo sapiens
caccagguggcugaggccauga

SEQ ID NO: 83787 - RNA, 22 nt, Homo sapiens
cacccaguaagcaugaggcccu

SEQ ID NO: 83788 - RNA, 22 nt, Homo sapiens
cacccgugacgcugucugaaau

SEQ ID NO: 83789 - RNA, 22 nt, Homo sapiens
cacccgugcucccuccagcugc

SEQ ID NO: 83790 - RNA, 18 nt, Homo sapiens
cacugagcccuucacucu

SEQ ID NO: 83791 - RNA, 22 nt, Homo sapiens
cacugcaguaaauugcgucggu

SEQ ID NO: 83792 - RNA, 22 nt, Homo sapiens
cacugcauuacucaugagcaug

SEQ ID NO: 83793 - RNA, 22 nt, Homo sapiens
cacugcgaccuccaccucccgg

SEQ ID NO: 83794 - RNA, 22 nt, Homo sapiens
cacugcgaccucugccuaccgg

SEQ ID NO: 83795 - RNA, 22 nt, Homo sapiens
cagaaguauugguaugcucugu

SEQ ID NO: 83796 - RNA, 22 nt, Homo sapiens
cagagcaaugcuuuugcuuuga

SEQ ID NO: 83797 - RNA, 22 nt, Homo sapiens
cagcaagucucuaagaguucau

SEQ ID NO: 83798 - RNA, 22 nt, Homo sapiens
cagcucauugcagucucgaccu

SEQ ID NO: 83799 - RNA, 22 nt, Homo sapiens
cagcugguggcaagaagacaga

SEQ ID NO: 83800 - RNA, 22 nt, Homo sapiens
caggcaaggugaaguguacugg

SEQ ID NO: 83801 - RNA, 22 nt, Homo sapiens
caggcagucuggggguguaucc

SEQ ID NO: 83802 - RNA, 22 nt, Homo sapiens
caggcagugggagacaaaacug

SEQ ID NO: 83803 - RNA, 22 nt, Homo sapiens
caguaguagccccuuagaugga

SEQ ID NO: 83804 - RNA, 20 nt, Homo sapiens
cagugcacuuucccacuggu

SEQ ID NO: 83805 - RNA, 22 nt, Homo sapiens
cagugcauagaugugccacauu

SEQ ID NO: 83806 - RNA, 23 nt, Homo sapiens
cagugcaugacuguauaugcaaa

SEQ ID NO: 83807 - RNA, 22 nt, Homo sapiens
caguuacuuuugcaccaaccua

SEQ ID NO: 83808 - RNA, 22 nt, Homo sapiens
caguuguuuuaugacauaagau

SEQ ID NO: 83809 - RNA, 22 nt, Homo sapiens
cauacaugugcuugucuuaugc

SEQ ID NO: 83810 - RNA, 22 nt, Homo sapiens
cauagcacugagcucuacccuc

SEQ ID NO: 83811 - RNA, 22 nt, Homo sapiens
caucaaaguggagggaaggacc

SEQ ID NO: 83812 - RNA, 22 nt, Homo sapiens
caucacacuuggauguaagaca

SEQ ID NO: 83813 - RNA, 22 nt, Homo sapiens
caucacaguacuaaucgucaua

SEQ ID NO: 83814 - RNA, 23 nt, Homo sapiens
caucacauagaggaaagaggaca

SEQ ID NO: 83815 - RNA, 22 nt, Homo sapiens
caucacaucugcaugguaagua

SEQ ID NO: 83816 - RNA, 22 nt, Homo sapiens
caucacuuuuccuuuuacagau

SEQ ID NO: 83817 - RNA, 22 nt, Homo sapiens
caucagcaauguaugaggguuc

SEQ ID NO: 83818 - RNA, 22 nt, Homo sapiens
caucccugucgucaagucucug

SEQ ID NO: 83819 - RNA, 22 nt, Homo sapiens
caugaaagugagaaacuccugg

SEQ ID NO: 83820 - RNA, 22 nt, Homo sapiens
caugccacuguggacaaagaca

SEQ ID NO: 83821 - RNA, 22 nt, Homo sapiens
cauggcacagagaauguguucu

SEQ ID NO: 83822 - RNA, 22 nt, Homo sapiens
cauggcacugagcagguaugca

SEQ ID NO: 83823 - RNA, 22 nt, Homo sapiens
cauggcaucuguguggccucca

SEQ ID NO: 83824 - RNA, 22 nt, Homo sapiens
cauggcccuggguccauaggaa

SEQ ID NO: 83825 - RNA, 22 nt, Homo sapiens
cauggcucuuguuuacucccag

SEQ ID NO: 83826 - RNA, 23 nt, Homo sapiens
cauggcuguuaacacuguuugag

SEQ ID NO: 83827 - RNA, 22 nt, Homo sapiens
cauggucaccuuccaaguuauu

SEQ ID NO: 83828 - RNA, 22 nt, Homo sapiens
cauguauagauuccauaguggu

SEQ ID NO: 83829 - RNA, 19 nt, Homo sapiens
caugugcacuacuggcuuc

SEQ ID NO: 83830 - RNA, 22 nt, Homo sapiens
cauuccacuggauaaacaaggu

SEQ ID NO: 83831 - RNA, 22 nt, Homo sapiens
cauugcaacuucugccucccag

SEQ ID NO: 83832 - RNA, 20 nt, Homo sapiens
cauugcacuccagccugcug

SEQ ID NO: 83833 - RNA, 22 nt, Homo sapiens
cauugcccuccagccugggcaa

SEQ ID NO: 83834 - RNA, 22 nt, Homo sapiens
cauuuuacuuuccagacgugga

SEQ ID NO: 83835 - RNA, 22 nt, Homo sapiens
ccaaaguauuuucacugauauc

SEQ ID NO: 83836 - RNA, 22 nt, Homo sapiens
ccaagccucaguuucccucugu

SEQ ID NO: 83837 - RNA, 20 nt, Homo sapiens
ccagcaucauuagauucugg

SEQ ID NO: 83838 - RNA, 22 nt, Homo sapiens
ccagugcauggaucccaggggg

SEQ ID NO: 83839 - RNA, 22 nt, Homo sapiens
ccaguguauuuuugggaccugc

SEQ ID NO: 83840 - RNA, 20 nt, Homo sapiens
ccaguguuauuuauguucua

SEQ ID NO: 83841 - RNA, 22 nt, Homo sapiens
ccaguuuucaagauaaugguuu

SEQ ID NO: 83842 - RNA, 22 nt, Homo sapiens
ccaguuuuucauuuauacuagu

SEQ ID NO: 83843 - RNA, 22 nt, Homo sapiens
cccacaguggccucauauccuu

SEQ ID NO: 83844 - RNA, 21 nt, Homo sapiens
cccagguucucugaggguaga

SEQ ID NO: 83845 - RNA, 22 nt, Homo sapiens
cccagugaagagaaccuuacga

SEQ ID NO: 83846 - RNA, 22 nt, Homo sapiens
cccagugugaacuuggcauuuu

SEQ ID NO: 83847 - RNA, 20 nt, Homo sapiens
ccccaguuuuucuauuagcu

SEQ ID NO: 83848 - RNA, 22 nt, Homo sapiens
ccccggguggauguacauguga

SEQ ID NO: 83849 - RNA, 22 nt, Homo sapiens
ccccggguucugucugcccuug

SEQ ID NO: 83850 - RNA, 23 nt, Homo sapiens
cccucagaagugcagggagagaa

SEQ ID NO: 83851 - RNA, 22 nt, Homo sapiens
cccuucauucaaggguugugag

SEQ ID NO: 83852 - RNA, 22 nt, Homo sapiens
ccucauugcuaucccaggcuga

SEQ ID NO: 83853 - RNA, 22 nt, Homo sapiens
ccugagaucauacuguuaguaa

SEQ ID NO: 83854 - RNA, 22 nt, Homo sapiens
ccuggcaagagacugaagauag

SEQ ID NO: 83855 - RNA, 22 nt, Homo sapiens
ccuugguggccacaagacauug

SEQ ID NO: 83856 - RNA, 22 nt, Homo sapiens
ccuuuuuguaguggaaguagga

SEQ ID NO: 83857 - RNA, 22 nt, Homo sapiens
cgcuggugaucuagacccccaa

SEQ ID NO: 83858 - RNA, 22 nt, Homo sapiens
cuacacaugcaggcucccugcc

SEQ ID NO: 83859 - RNA, 22 nt, Homo sapiens
cuacagaguaucuaaagaggua

SEQ ID NO: 83860 - RNA, 23 nt, Homo sapiens
cuacagugccugucucuuuggcc

SEQ ID NO: 83861 - RNA, 22 nt, Homo sapiens
cuagaauguauaaaaccaagcu

SEQ ID NO: 83862 - RNA, 22 nt, Homo sapiens
cuagacuagacccaaauugaag

SEQ ID NO: 83863 - RNA, 22 nt, Homo sapiens
cuaggaaguauguguuauugcu

SEQ ID NO: 83864 - RNA, 22 nt, Homo sapiens
cuaugcuuucugggcccugggu

SEQ ID NO: 83865 - RNA, 22 nt, Homo sapiens
cuauuugcauucagaggcaugu

SEQ ID NO: 83866 - RNA, 19 nt, Homo sapiens
cucaaagugguauuuggag

SEQ ID NO: 83867 - RNA, 22 nt, Homo sapiens
cucaaguacaugggauuacagg

SEQ ID NO: 83868 - RNA, 22 nt, Homo sapiens
cucacagucucucccuaauuuu

SEQ ID NO: 83869 - RNA, 22 nt, Homo sapiens
cucacugcauuucaguuuuguu

SEQ ID NO: 83870 - RNA, 22 nt, Homo sapiens
cucagugucuggggccccaggg

SEQ ID NO: 83871 - RNA, 22 nt, Homo sapiens
cucaguguuaaggccaccucug

SEQ ID NO: 83872 - RNA, 22 nt, Homo sapiens
cucaugcugucuucugggguaa

SEQ ID NO: 83873 - RNA, 22 nt, Homo sapiens
cuccauuuaucugaaauuuuau

SEQ ID NO: 83874 - RNA, 23 nt, Homo sapiens
cucccugaacaugacacaccaga

SEQ ID NO: 83875 - RNA, 22 nt, Homo sapiens
cucucugagccccagacaccuu

SEQ ID NO: 83876 - RNA, 22 nt, Homo sapiens
cucugagccugagguuccuacu

SEQ ID NO: 83877 - RNA, 22 nt, Homo sapiens
cucugagguuauucguaauauu

SEQ ID NO: 83878 - RNA, 22 nt, Homo sapiens
cucuuuggaugccuuaggguua

SEQ ID NO: 83879 - RNA, 22 nt, Homo sapiens
cugaagugcuugccacauaaaa

SEQ ID NO: 83880 - RNA, 22 nt, Homo sapiens
cugaauguccaggcagagguuu

SEQ ID NO: 83881 - RNA, 22 nt, Homo sapiens
cugagacacucuuaucugcaua

SEQ ID NO: 83882 - RNA, 22 nt, Homo sapiens
cugagcaucauggcagaaucuu

SEQ ID NO: 83883 - RNA, 22 nt, Homo sapiens
cugaggaaguucuuuaacaguu

SEQ ID NO: 83884 - RNA, 22 nt, Homo sapiens
cugaggugggagaaucacauaa

SEQ ID NO: 83885 - RNA, 22 nt, Homo sapiens
cugaggugggaggauuacuuga

SEQ ID NO: 83886 - RNA, 22 nt, Homo sapiens
cugaggugggaggauuggcuug

SEQ ID NO: 83887 - RNA, 21 nt, Homo sapiens
cugaucacaggugagcugccu

SEQ ID NO: 83888 - RNA, 21 nt, Homo sapiens
cugcaaaugcugcugccugau

SEQ ID NO: 83889 - RNA, 19 nt, Homo sapiens
cugcaagguaauaggucag

SEQ ID NO: 83890 - RNA, 22 nt, Homo sapiens
cugcagguaggggcagcuuugg

SEQ ID NO: 83891 - RNA, 22 nt, Homo sapiens
cuggaaugcagcuuuaggggcu

SEQ ID NO: 83892 - RNA, 22 nt, Homo sapiens
cuggcaagagugaaccagcugu

SEQ ID NO: 83893 - RNA, 22 nt, Homo sapiens
cuggcagucugccucuucacug

SEQ ID NO: 83894 - RNA, 22 nt, Homo sapiens
cuggcaguguuucuugugggcu

SEQ ID NO: 83895 - RNA, 22 nt, Homo sapiens
cugggaugugacuguugccccc

SEQ ID NO: 83896 - RNA, 22 nt, Homo sapiens
cugggcaaugcggcuggauaga

SEQ ID NO: 83897 - RNA, 22 nt, Homo sapiens
cuggucaugggggcacccucug

SEQ ID NO: 83898 - RNA, 22 nt, Homo sapiens
cuggugauugguuucauucagu

SEQ ID NO: 83899 - RNA, 22 nt, Homo sapiens
cuguagcuuuuauaugcuuagc

SEQ ID NO: 83900 - RNA, 22 nt, Homo sapiens
cuguaguuagcagaugaugaau

SEQ ID NO: 83901 - RNA, 22 nt, Homo sapiens
cugucuggaggccugcaaauaa

SEQ ID NO: 83902 - RNA, 22 nt, Homo sapiens
cugugaacaugggagaaauggc

SEQ ID NO: 83903 - RNA, 23 nt, Homo sapiens
cuguggugaggcccuagaaucug

SEQ ID NO: 83904 - RNA, 17 nt, Homo sapiens
cuucaaauaauuucccc

SEQ ID NO: 83905 - RNA, 22 nt, Homo sapiens
cuucacuggagucccuggauuc

SEQ ID NO: 83906 - RNA, 22 nt, Homo sapiens
cuucacuuuguuaaacuccaau

SEQ ID NO: 83907 - RNA, 22 nt, Homo sapiens
cuucuugcuguguccucacaug

SEQ ID NO: 83908 - RNA, 22 nt, Homo sapiens
cuugacaucugucaguuccuca

SEQ ID NO: 83909 - RNA, 22 nt, Homo sapiens
cuugcacucagaagauucaguu

SEQ ID NO: 83910 - RNA, 19 nt, Homo sapiens
cuugccccauucauccucu

SEQ ID NO: 83911 - RNA, 22 nt, Homo sapiens
cuugccuaaucugcaugauuuu

SEQ ID NO: 83912 - RNA, 22 nt, Homo sapiens
cuuggacaccucaugcccaccu

SEQ ID NO: 83913 - RNA, 22 nt, Homo sapiens
cuuggcuccgacuccccuccaa

SEQ ID NO: 83914 - RNA, 21 nt, Homo sapiens
cuugucuugcuuagaauagac

SEQ ID NO: 83915 - RNA, 22 nt, Homo sapiens
cuugugauugcacggcugccug

SEQ ID NO: 83916 - RNA, 22 nt, Homo sapiens
cuuuacacauccuaaccagugu

SEQ ID NO: 83917 - RNA, 22 nt, Homo sapiens
cuuuaugagguuggauggaucu

SEQ ID NO: 83918 - RNA, 22 nt, Homo sapiens
cuuuccauuguuggagcauaaa

SEQ ID NO: 83919 - RNA, 21 nt, Homo sapiens
cuuugcacugcuccucagcuc

SEQ ID NO: 83920 - RNA, 18 nt, Homo sapiens
cuuugcagcuuccagagg

SEQ ID NO: 83921 - RNA, 20 nt, Homo sapiens
cuuuggcaaugagaacaggg

SEQ ID NO: 83922 - RNA, 22 nt, Homo sapiens
cuuuggugauagauaccccaua

SEQ ID NO: 83923 - RNA, 22 nt, Homo sapiens
cuuugguggagucuuuagguuc

SEQ ID NO: 83924 - RNA, 21 nt, Homo sapiens
cuuuugcacuccagccugggu

SEQ ID NO: 83925 - RNA, 22 nt, Homo sapiens
cuuuuggcuuagaauugucuug

SEQ ID NO: 83926 - RNA, 22 nt, Homo sapiens
cuuuugugauucuucaguugcu

SEQ ID NO: 83927 - RNA, 22 nt, Homo sapiens
gaaagauuuccugagcuagaaa

SEQ ID NO: 83928 - RNA, 22 nt, Homo sapiens
gaaagauuuuaacugggagacu

SEQ ID NO: 83929 - RNA, 22 nt, Homo sapiens
gaaaguaauuaacgauuguugc

SEQ ID NO: 83930 - RNA, 22 nt, Homo sapiens
gaaauguauuaaugaguugaaa

SEQ ID NO: 83931 - RNA, 23 nt, Homo sapiens
gaaaugucuuagugaaauugcuu

SEQ ID NO: 83932 - RNA, 22 nt, Homo sapiens
gaacccuggaggcggagguugc

SEQ ID NO: 83933 - RNA, 18 nt, Homo sapiens
gaagaaguaggcauggca

SEQ ID NO: 83934 - RNA, 22 nt, Homo sapiens
gaauacuguccaagagugaugg

SEQ ID NO: 83935 - RNA, 22 nt, Homo sapiens
gaaucacagauuaugaguaucu

SEQ ID NO: 83936 - RNA, 22 nt, Homo sapiens
gaaugcaugaggggaucagaug

SEQ ID NO: 83937 - RNA, 22 nt, Homo sapiens
gaauggaacugacuauagcuga

SEQ ID NO: 83938 - RNA, 22 nt, Homo sapiens
gaauguuuacuuuguuuaauac

SEQ ID NO: 83939 - RNA, 22 nt, Homo sapiens
gacaagagaacacugcuauauu

SEQ ID NO: 83940 - RNA, 22 nt, Homo sapiens
gacacuggguguuuguuggcgu

SEQ ID NO: 83941 - RNA, 22 nt, Homo sapiens
gacaguuuggugaggaagacga

SEQ ID NO: 83942 - RNA, 22 nt, Homo sapiens
gacauguuucucucuguuuacu

SEQ ID NO: 83943 - RNA, 22 nt, Homo sapiens
gaccuggugguccacccgccuu

SEQ ID NO: 83944 - RNA, 22 nt, Homo sapiens
gacuggagcuguaugugguuac

SEQ ID NO: 83945 - RNA, 22 nt, Homo sapiens
gacuuagaauuuuugccugcua

SEQ ID NO: 83946 - RNA, 22 nt, Homo sapiens
gagaacaguguuguauuuuuuc

SEQ ID NO: 83947 - RNA, 22 nt, Homo sapiens
gagaacuaaugguuugauaagg

SEQ ID NO: 83948 - RNA, 22 nt, Homo sapiens
gagaaguaaauuuauuugcaaa

SEQ ID NO: 83949 - RNA, 22 nt, Homo sapiens
gagaaugagauuaugguuacau

SEQ ID NO: 83950 - RNA, 22 nt, Homo sapiens
gagacugagucuugcucuguca

SEQ ID NO: 83951 - RNA, 22 nt, Homo sapiens
gagaggucguauaugauuucug

SEQ ID NO: 83952 - RNA, 22 nt, Homo sapiens
gagauauuauuucccuuucaca

SEQ ID NO: 83953 - RNA, 22 nt, Homo sapiens
gagccauggagaaaacagcuau

SEQ ID NO: 83954 - RNA, 22 nt, Homo sapiens
gagcugaaguuuccauuuguac

SEQ ID NO: 83955 - RNA, 22 nt, Homo sapiens
gagcugaauugcugccauuugc

SEQ ID NO: 83956 - RNA, 22 nt, Homo sapiens
gaggaaguagcuacugucuuuc

SEQ ID NO: 83957 - RNA, 22 nt, Homo sapiens
gaggaaguuuacaaagcaucug

SEQ ID NO: 83958 - RNA, 22 nt, Homo sapiens
gaggaucucuugagcccagaag

SEQ ID NO: 83959 - RNA, 22 nt, Homo sapiens
gaggcaaguggccaccgagucu

SEQ ID NO: 83960 - RNA, 22 nt, Homo sapiens
gagguaucauuauguugcccag

SEQ ID NO: 83961 - RNA, 22 nt, Homo sapiens
gaggugguagguucacagcagc

SEQ ID NO: 83962 - RNA, 22 nt, Homo sapiens
gagguugggaugagggauacag

SEQ ID NO: 83963 - RNA, 22 nt, Homo sapiens
gaguaaauguccuagcuucuug

SEQ ID NO: 83964 - RNA, 22 nt, Homo sapiens
gaguauuuuacaucguguaauu

SEQ ID NO: 83965 - RNA, 22 nt, Homo sapiens
gagugcaauggcaccgucucgg

SEQ ID NO: 83966 - RNA, 22 nt, Homo sapiens
gagugcaauggcagaucuccgc

SEQ ID NO: 83967 - RNA, 22 nt, Homo sapiens
gagugcaauggcgcgaucucgg

SEQ ID NO: 83968 - RNA, 22 nt, Homo sapiens
gagugcaauggugcuaucucgg

SEQ ID NO: 83969 - RNA, 22 nt, Homo sapiens
gauaaauccagauucugaugua

SEQ ID NO: 83970 - RNA, 22 nt, Homo sapiens
gauauguaaaaauuauaucuga

SEQ ID NO: 83971 - RNA, 22 nt, Homo sapiens
gauauguucugagaaaugcauu

SEQ ID NO: 83972 - RNA, 22 nt, Homo sapiens
gaucacauggccauuucuagcu

SEQ ID NO: 83973 - RNA, 22 nt, Homo sapiens
gaugacagugaguaaccccaac

SEQ ID NO: 83974 - RNA, 22 nt, Homo sapiens
gaugauauuugagucauuagaa

SEQ ID NO: 83975 - RNA, 22 nt, Homo sapiens
uugcacuccauccuggguugac

SEQ ID NO: 83976 - RNA, 22 nt, Homo sapiens
uugcacucuagccugggugaca

SEQ ID NO: 83977 - RNA, 22 nt, Homo sapiens
uugcaugguuuuuaucugaaau

SEQ ID NO: 83978 - RNA, 22 nt, Homo sapiens
uugcccuuuagguaacuauaua

SEQ ID NO: 83979 - RNA, 22 nt, Homo sapiens
uugcuagagaugagggaugugu

SEQ ID NO: 83980 - RNA, 22 nt, Homo sapiens
uugcucaccugagaagaauaga

SEQ ID NO: 83981 - RNA, 22 nt, Homo sapiens
uugcuggugguucgagcaacac

SEQ ID NO: 83982 - RNA, 22 nt, Homo sapiens
uuggaaacgucaccuuuuccuu

SEQ ID NO: 83983 - RNA, 22 nt, Homo sapiens
uuggaagacaaugcugauucuc

SEQ ID NO: 83984 - RNA, 22 nt, Homo sapiens
uuggaagauuacuuaguuuucu

SEQ ID NO: 83985 - RNA, 22 nt, Homo sapiens
uuggaaggcuccuaaugaaugg

SEQ ID NO: 83986 - RNA, 22 nt, Homo sapiens
uuggaauguauggcaucuugcg

SEQ ID NO: 83987 - RNA, 22 nt, Homo sapiens
uuggaauuuuacuucuguaaga

SEQ ID NO: 83988 - RNA, 22 nt, Homo sapiens
uuggacugagaguuccaccauu

SEQ ID NO: 83989 - RNA, 22 nt, Homo sapiens
uuggacugggauggccgaggcu

SEQ ID NO: 83990 - RNA, 22 nt, Homo sapiens
uuggacuuuaagauagagaugu

SEQ ID NO: 83991 - RNA, 22 nt, Homo sapiens
uuggagagaaaggcaguuccug

SEQ ID NO: 83992 - RNA, 22 nt, Homo sapiens
uuggcaaauagguuuuauugca

SEQ ID NO: 83993 - RNA, 22 nt, Homo sapiens
uuggcaaaugucacaaaucagg

SEQ ID NO: 83994 - RNA, 21 nt, Homo sapiens
uuggcacucuucucuccuuau

SEQ ID NO: 83995 - RNA, 22 nt, Homo sapiens
uuggcaguaucuacuacagcua

SEQ ID NO: 83996 - RNA, 22 nt, Homo sapiens
uuggcauagaggcucucaagcu

SEQ ID NO: 83997 - RNA, 22 nt, Homo sapiens
uuggcauuuauucuaaggucaa

SEQ ID NO: 83998 - RNA, 22 nt, Homo sapiens
uugggcuuuuagguccuuaaca

SEQ ID NO: 83999 - RNA, 22 nt, Homo sapiens
uuggucaggcuaaucucgaacg

SEQ ID NO: 84000 - RNA, 22 nt, Homo sapiens
uuggucaggcuagaguguggug

SEQ ID NO: 84001 - RNA, 23 nt, Homo sapiens
uuggucucccaaaguguugagau

SEQ ID NO: 84002 - RNA, 20 nt, Homo sapiens
uuggugaccuguuugguauu

SEQ ID NO: 84003 - RNA, 22 nt, Homo sapiens
uuguaauggagcaaacagguug

SEQ ID NO: 84004 - RNA, 22 nt, Homo sapiens
uuguaauguuaccaaauggugu

SEQ ID NO: 84005 - RNA, 22 nt, Homo sapiens
uuguauacucuauuuuagcagu

SEQ ID NO: 84006 - RNA, 22 nt, Homo sapiens
uugucauuuucagaguguuacg

SEQ ID NO: 84007 - RNA, 22 nt, Homo sapiens
uuguccccacccaaaugucauc

SEQ ID NO: 84008 - RNA, 22 nt, Homo sapiens
uuguccccaucugcugccagaa

SEQ ID NO: 84009 - RNA, 22 nt, Homo sapiens
uugugacacagcugggccuaua

SEQ ID NO: 84010 - RNA, 22 nt, Homo sapiens
uugugcaugaugcauacauggu

SEQ ID NO: 84011 - RNA, 20 nt, Homo sapiens
uugugcauugggccauuggg

SEQ ID NO: 84012 - RNA, 22 nt, Homo sapiens
uugugcuucaucaccuagcaga

SEQ ID NO: 84013 - RNA, 22 nt, Homo sapiens
uugugcuuuugagcugagauga

SEQ ID NO: 84014 - RNA, 18 nt, Homo sapiens
uuguggccccuacaaauu

SEQ ID NO: 84015 - RNA, 22 nt, Homo sapiens
uugugguugacuaaauuuguaa

SEQ ID NO: 84016 - RNA, 22 nt, Homo sapiens
uuguuaagaugcagauucugga

SEQ ID NO: 84017 - RNA, 22 nt, Homo sapiens
uuguugcacugcuuuccuggcc

SEQ ID NO: 84018 - RNA, 22 nt, Homo sapiens
uuuaaagcuaaaauauguuuau

SEQ ID NO: 84019 - RNA, 22 nt, Homo sapiens
uuuaacauuggaugagaucguc

SEQ ID NO: 84020 - RNA, 23 nt, Homo sapiens
uuuaagcuucauguccuaacauc

SEQ ID NO: 84021 - RNA, 22 nt, Homo sapiens
uuuaaggcaugccuguacaugc

SEQ ID NO: 84022 - RNA, 21 nt, Homo sapiens
uuuacuguggacccauugcuu

SEQ ID NO: 84023 - RNA, 22 nt, Homo sapiens
uuuagcaauucauuuugugucu

SEQ ID NO: 84024 - RNA, 22 nt, Homo sapiens
uuuaggcaauauauucaugucu

SEQ ID NO: 84025 - RNA, 23 nt, Homo sapiens
ggaaacauccagucuuucaccau

SEQ ID NO: 84026 - RNA, 22 nt, Homo sapiens
ggaaagauguaauauuaucuaa

SEQ ID NO: 84027 - RNA, 22 nt, Homo sapiens
ggaaagcuagguguggguguac

SEQ ID NO: 84028 - RNA, 22 nt, Homo sapiens
ggaaaguaacccauucucuuac

SEQ ID NO: 84029 - RNA, 22 nt, Homo sapiens
ggaaauguaaacaauggggcua

SEQ ID NO: 84030 - RNA, 19 nt, Homo sapiens
ggaaaugucuauuaagauc

SEQ ID NO: 84031 - RNA, 23 nt, Homo sapiens
ggaaauguuuaagggguugggag

SEQ ID NO: 84032 - RNA, 20 nt, Homo sapiens
ggaagagugacacaagguau

SEQ ID NO: 84033 - RNA, 22 nt, Homo sapiens
ggaaggucaaagggaaagcaga

SEQ ID NO: 84034 - RNA, 22 nt, Homo sapiens
ggaagugugaguaggauuugga

SEQ ID NO: 84035 - RNA, 19 nt, Homo sapiens
ggaaugcaccaguccuugc

SEQ ID NO: 84036 - RNA, 22 nt, Homo sapiens
ggaaugggauuugaagucuggc

SEQ ID NO: 84037 - RNA, 22 nt, Homo sapiens
ggacaaaguauuuucaaaugua

SEQ ID NO: 84038 - RNA, 22 nt, Homo sapiens
ggagggugagaucaauuuggga

SEQ ID NO: 84039 - RNA, 22 nt, Homo sapiens
ggaguaggcuguccggcaccca

SEQ ID NO: 84040 - RNA, 22 nt, Homo sapiens
ggagucugaacuggacaaugac

SEQ ID NO: 84041 - RNA, 22 nt, Homo sapiens
ggaguguaauggcgccaucuca

SEQ ID NO: 84042 - RNA, 23 nt, Homo sapiens
ggaguguauuggcacgaucucag

SEQ ID NO: 84043 - RNA, 22 nt, Homo sapiens
ggauugcuuaagaaguuucauu

SEQ ID NO: 84044 - RNA, 22 nt, Homo sapiens
ggcaaauucuuguaugccuacu

SEQ ID NO: 84045 - RNA, 22 nt, Homo sapiens
ggcaagaaaaugcaauuacugu

SEQ ID NO: 84046 - RNA, 22 nt, Homo sapiens
ggcaagaacuucacucacuuuu

SEQ ID NO: 84047 - RNA, 22 nt, Homo sapiens
ggcaagaagagaguuuaaacau

SEQ ID NO: 84048 - RNA, 21 nt, Homo sapiens
ggcaagagaauacaacauaaa

SEQ ID NO: 84049 - RNA, 22 nt, Homo sapiens
ggcaaggauuagauucuccccu

SEQ ID NO: 84050 - RNA, 22 nt, Homo sapiens
ggcaaugaggcggaccagcagg

SEQ ID NO: 84051 - RNA, 22 nt, Homo sapiens
ggcacaauugcagcaauaaaca

SEQ ID NO: 84052 - RNA, 22 nt, Homo sapiens
ggcacuguugccggccugaauu

SEQ ID NO: 84053 - RNA, 22 nt, Homo sapiens
ggcagagucuugcaucuuuaga

SEQ ID NO: 84054 - RNA, 17 nt, Homo sapiens
ggcaggauccaggaucc

SEQ ID NO: 84055 - RNA, 22 nt, Homo sapiens
ggcaguuuguucuugcuccuuu

SEQ ID NO: 84056 - RNA, 22 nt, Homo sapiens
ggcaugauguauuugagguuug

SEQ ID NO: 84057 - RNA, 22 nt, Homo sapiens
ggcaugguggugugugccuaua

SEQ ID NO: 84058 - RNA, 22 nt, Homo sapiens
ggcauguugauagguagaugua

SEQ ID NO: 84059 - RNA, 22 nt, Homo sapiens
gggaaauguaaagucauaagau

SEQ ID NO: 84060 - RNA, 22 nt, Homo sapiens
gggagcacaagaaauguuucau

SEQ ID NO: 84061 - RNA, 22 nt, Homo sapiens
gggagguaggaguuauuauuuu

SEQ ID NO: 84062 - RNA, 22 nt, Homo sapiens
gggagguagguauuagcuuuuc

SEQ ID NO: 84063 - RNA, 22 nt, Homo sapiens
gggagugucuaaccuguuaaca

SEQ ID NO: 84064 - RNA, 22 nt, Homo sapiens
gggagugugcacacaugguaua

SEQ ID NO: 84065 - RNA, 22 nt, Homo sapiens
gggauguuuuauacugagccug

SEQ ID NO: 84066 - RNA, 22 nt, Homo sapiens
gggauuauugugauuucauguu

SEQ ID NO: 84067 - RNA, 22 nt, Homo sapiens
ggggaguguggacaucacccug

SEQ ID NO: 84068 - RNA, 22 nt, Homo sapiens
gggguaggcuacacugaguucc

SEQ ID NO: 84069 - RNA, 19 nt, Homo sapiens
ggucacagggguuacaagg

SEQ ID NO: 84070 - RNA, 19 nt, Homo sapiens
ggucauggagguuguguga

SEQ ID NO: 84071 - RNA, 22 nt, Homo sapiens
ggucccccuccacucucgcaaa

SEQ ID NO: 84072 - RNA, 22 nt, Homo sapiens
ggucugguguugaaauucuuca

SEQ ID NO: 84073 - RNA, 22 nt, Homo sapiens
ggugaauuguaccccauaggau

SEQ ID NO: 84074 - RNA, 22 nt, Homo sapiens
ggugacugguuuaucuggcagu

SEQ ID NO: 84075 - RNA, 22 nt, Homo sapiens
ggugagcacagaaugcccugag

SEQ ID NO: 84076 - RNA, 23 nt, Homo sapiens
ggugaggaguacagagucuucau

SEQ ID NO: 84077 - RNA, 22 nt, Homo sapiens
gguggugguauuucagaaaaug

SEQ ID NO: 84078 - RNA, 22 nt, Homo sapiens
gguguguaaauuacuuaucucu

SEQ ID NO: 84079 - RNA, 22 nt, Homo sapiens
guaaacuuccccucaugaauga

SEQ ID NO: 84080 - RNA, 22 nt, Homo sapiens
guaaagacacaugcacacguau

SEQ ID NO: 84081 - RNA, 22 nt, Homo sapiens
guaaaucucuguuuucauggac

SEQ ID NO: 84082 - RNA, 22 nt, Homo sapiens
guaacuggccuucaauuucuuc

SEQ ID NO: 84083 - RNA, 22 nt, Homo sapiens
guaaucucagcuacuugggagg

SEQ ID NO: 84084 - RNA, 22 nt, Homo sapiens
guaaucucagcuucuugggagg

SEQ ID NO: 84085 - RNA, 22 nt, Homo sapiens
guaaucuguaguaaagcaccau

SEQ ID NO: 84086 - RNA, 22 nt, Homo sapiens
guacacauacauauaugugugu

SEQ ID NO: 84087 - RNA, 22 nt, Homo sapiens
cacagcacaggcaugaguguca

SEQ ID NO: 84088 - RNA, 22 nt, Homo sapiens
cacaggucauccuggaucaagg

SEQ ID NO: 84089 - RNA, 22 nt, Homo sapiens
cacagucuugcaauauugagau

SEQ ID NO: 84090 - RNA, 22 nt, Homo sapiens
cacuggguuagaacaugcuccu

SEQ ID NO: 84091 - RNA, 22 nt, Homo sapiens
cacuggucucauggcaugagag

SEQ ID NO: 84092 - RNA, 18 nt, Homo sapiens
cacuuggcuuugccccuc

SEQ ID NO: 84093 - RNA, 22 nt, Homo sapiens
cagacagugucccgagucccug

SEQ ID NO: 84094 - RNA, 22 nt, Homo sapiens
cagcaaaucauccuauuugagc

SEQ ID NO: 84095 - RNA, 22 nt, Homo sapiens
cagcacauagcaguugcucagu

SEQ ID NO: 84096 - RNA, 22 nt, Homo sapiens
cagcgaggucugcgucacauug

SEQ ID NO: 84097 - RNA, 22 nt, Homo sapiens
cagcuaaauuguuaaauccaag

SEQ ID NO: 84098 - RNA, 22 nt, Homo sapiens
caggcaacauggcgaaacucug

SEQ ID NO: 84099 - RNA, 22 nt, Homo sapiens
caggcacgcuugggagacacac

SEQ ID NO: 84100 - RNA, 22 nt, Homo sapiens
caggcagucuggcucccaagug

SEQ ID NO: 84101 - RNA, 22 nt, Homo sapiens
cagggcauuggcugguaccugg

SEQ ID NO: 84102 - RNA, 22 nt, Homo sapiens
caggguccccuaccuuuugaug

SEQ ID NO: 84103 - RNA, 22 nt, Homo sapiens
cagucacagugacaggaugugg

SEQ ID NO: 84104 - RNA, 22 nt, Homo sapiens
cauaaagauggaggaggccagg

SEQ ID NO: 84105 - RNA, 19 nt, Homo sapiens
caucacagagucuuccauu

SEQ ID NO: 84106 - RNA, 22 nt, Homo sapiens
caucagauugagaucaucuaag

SEQ ID NO: 84107 - RNA, 22 nt, Homo sapiens
caucgcacuccagccugggcaa

SEQ ID NO: 84108 - RNA, 22 nt, Homo sapiens
caugaaagacugaggaauugga

SEQ ID NO: 84109 - RNA, 22 nt, Homo sapiens
caugcacugagagggucucggc

SEQ ID NO: 84110 - RNA, 19 nt, Homo sapiens
cauggcuuauaauuuuaau

SEQ ID NO: 84111 - RNA, 22 nt, Homo sapiens
cauuaagcuacuuagaaggugc

SEQ ID NO: 84112 - RNA, 22 nt, Homo sapiens
cauuacacuccagccuggguga

SEQ ID NO: 84113 - RNA, 22 nt, Homo sapiens
cauuguccuccuggggcuauuu

SEQ ID NO: 84114 - RNA, 22 nt, Homo sapiens
cauuugguggcuacagaguaac

SEQ ID NO: 84115 - RNA, 22 nt, Homo sapiens
cauuuugcaguuucugucucca

SEQ ID NO: 84116 - RNA, 22 nt, Homo sapiens
ccacaguggauuaaaguuacug

SEQ ID NO: 84117 - RNA, 22 nt, Homo sapiens
ccacccuuccauucuuccucuu

SEQ ID NO: 84118 - RNA, 22 nt, Homo sapiens
ccaccgggucccagcucugcuc

SEQ ID NO: 84119 - RNA, 22 nt, Homo sapiens
ccacugggcaguuuauuaucag

SEQ ID NO: 84120 - RNA, 22 nt, Homo sapiens
ccacugggcuagguguuuugga

SEQ ID NO: 84121 - RNA, 22 nt, Homo sapiens
ccaguauugaacacaaugaaag

SEQ ID NO: 84122 - RNA, 23 nt, Homo sapiens
ccaguauuuauguaaggaagugu

SEQ ID NO: 84123 - RNA, 22 nt, Homo sapiens
ccaguauuuuauugaggguuuu

SEQ ID NO: 84124 - RNA, 22 nt, Homo sapiens
ccaucacacugugauuauuauc

SEQ ID NO: 84125 - RNA, 20 nt, Homo sapiens
ccaucaguccucucuuguuc

SEQ ID NO: 84126 - RNA, 22 nt, Homo sapiens
ccauuucacucuuccugaagga

SEQ ID NO: 84127 - RNA, 22 nt, Homo sapiens
ccccaguguguaaaggccuugc

SEQ ID NO: 84128 - RNA, 22 nt, Homo sapiens
cccugagcagccugaguuuccc

SEQ ID NO: 84129 - RNA, 19 nt, Homo sapiens
cccuggcacauggaaaaug

SEQ ID NO: 84130 - RNA, 22 nt, Homo sapiens
ccucaguguuuaucauuauuuu

SEQ ID NO: 84131 - RNA, 22 nt, Homo sapiens
ccuggguuacaggugugagcca

SEQ ID NO: 84132 - RNA, 22 nt, Homo sapiens
ccuuggcacuuugccacagugc

SEQ ID NO: 84133 - RNA, 22 nt, Homo sapiens
cgccgggggaugggcaccagcg

SEQ ID NO: 84134 - RNA, 16 nt, Homo sapiens
cuaaaaugucuacuug

SEQ ID NO: 84135 - RNA, 22 nt, Homo sapiens
cuaaagauagugacaugauuug

SEQ ID NO: 84136 - RNA, 22 nt, Homo sapiens
cuacaguuauguuuuaaaugug

SEQ ID NO: 84137 - RNA, 22 nt, Homo sapiens
cuagcagaacaauacaauucgg

SEQ ID NO: 84138 - RNA, 22 nt, Homo sapiens
cuagcagacaugggcugaacca

SEQ ID NO: 84139 - RNA, 22 nt, Homo sapiens
cuauauacugccugcugauuag

SEQ ID NO: 84140 - RNA, 22 nt, Homo sapiens
cuauucacaauagccaagauuu

SEQ ID NO: 84141 - RNA, 22 nt, Homo sapiens
cucaaguaauccucccgccuug

SEQ ID NO: 84142 - RNA, 18 nt, Homo sapiens
cucacacccuaaucagga

SEQ ID NO: 84143 - RNA, 22 nt, Homo sapiens
cucacugugguguccuuaggua

SEQ ID NO: 84144 - RNA, 22 nt, Homo sapiens
cucaguuuugccuuguuuaagg

SEQ ID NO: 84145 - RNA, 22 nt, Homo sapiens
cucauugcaaucucugccuccc

SEQ ID NO: 84146 - RNA, 22 nt, Homo sapiens
cuccauuuaguccuuuuagaag

SEQ ID NO: 84147 - RNA, 22 nt, Homo sapiens
cucccacccucauuuuuaggca

SEQ ID NO: 84148 - RNA, 22 nt, Homo sapiens
cucccagagccaguuauaggcu

SEQ ID NO: 84149 - RNA, 22 nt, Homo sapiens
cucccuuugcugaauguuuuuc

SEQ ID NO: 84150 - RNA, 22 nt, Homo sapiens
cucucaagaugcugggauuaca

SEQ ID NO: 84151 - RNA, 22 nt, Homo sapiens
cucucugagccauggcugcccu

SEQ ID NO: 84152 - RNA, 21 nt, Homo sapiens
cucucugcuuaugaauaguga

SEQ ID NO: 84153 - RNA, 22 nt, Homo sapiens
uugccuaggcuggagugcagua

SEQ ID NO: 84154 - RNA, 20 nt, Homo sapiens
uugcugguguuagaggaggc

SEQ ID NO: 84155 - RNA, 22 nt, Homo sapiens
uugcuuuguuacugcaguuucc

SEQ ID NO: 84156 - RNA, 22 nt, Homo sapiens
uuggaaaaauccaccuugaucu

SEQ ID NO: 84157 - RNA, 23 nt, Homo sapiens
uuggaaugagaccuaagaguuuu

SEQ ID NO: 84158 - RNA, 22 nt, Homo sapiens
uuggaaugcaacagaaggauaa

SEQ ID NO: 84159 - RNA, 22 nt, Homo sapiens
uuggagcacuggggcacugaca

SEQ ID NO: 84160 - RNA, 22 nt, Homo sapiens
ugagacugagucucgcucuauu

SEQ ID NO: 84161 - RNA, 22 nt, Homo sapiens
ugagacugaguuuccaucuugu

SEQ ID NO: 84162 - RNA, 22 nt, Homo sapiens
ugagacugaguuucgcucuugu

SEQ ID NO: 84163 - RNA, 22 nt, Homo sapiens
ugagacugaguuuugcucuugu

SEQ ID NO: 84164 - RNA, 22 nt, Homo sapiens
ugagagaugauaaaauguuugu

SEQ ID NO: 84165 - RNA, 22 nt, Homo sapiens
ugagagcuuuuuugccugguga

SEQ ID NO: 84166 - RNA, 22 nt, Homo sapiens
ugagauaggaucuugcucuguu

SEQ ID NO: 84167 - RNA, 22 nt, Homo sapiens
ugagauagggucucacucuguc

SEQ ID NO: 84168 - RNA, 18 nt, Homo sapiens
ugagaucagcaucaaggg

SEQ ID NO: 84169 - RNA, 22 nt, Homo sapiens
ugagauccugagaguugggacu

SEQ ID NO: 84170 - RNA, 22 nt, Homo sapiens
ugagaucgaguuucgcucuugu

SEQ ID NO: 84171 - RNA, 22 nt, Homo sapiens
ugagaugaagucucacucuguc

SEQ ID NO: 84172 - RNA, 22 nt, Homo sapiens
ugagaugagggcugcacucaaa

SEQ ID NO: 84173 - RNA, 22 nt, Homo sapiens
ugagaugaggucucgcucuguc

SEQ ID NO: 84174 - RNA, 22 nt, Homo sapiens
ugagaugagucucgcucuguca

SEQ ID NO: 84175 - RNA, 21 nt, Homo sapiens
ugagaugauccugcaugcaug

SEQ ID NO: 84176 - RNA, 22 nt, Homo sapiens
ugagauguguccagaucuaguu

SEQ ID NO: 84177 - RNA, 22 nt, Homo sapiens
ugagauuaucuugaucuugaaa

SEQ ID NO: 84178 - RNA, 22 nt, Homo sapiens
ugagcacauuuacaucaguucc

SEQ ID NO: 84179 - RNA, 22 nt, Homo sapiens
ugagcagagaagugcccugcgc

SEQ ID NO: 84180 - RNA, 22 nt, Homo sapiens
ugagcugagaaaugcagcagcu

SEQ ID NO: 84181 - RNA, 22 nt, Homo sapiens
ugaggcuaggauaggcugauuc

SEQ ID NO: 84182 - RNA, 22 nt, Homo sapiens
ugaguagaaauaaacgcaaacu

SEQ ID NO: 84183 - RNA, 21 nt, Homo sapiens
ugaguagcuagaacuaggggc

SEQ ID NO: 84184 - RNA, 23 nt, Homo sapiens
ugaguaggcaguuuuccccucac

SEQ ID NO: 84185 - RNA, 23 nt, Homo sapiens
ugaguaggugguuuuccccucac

SEQ ID NO: 84186 - RNA, 22 nt, Homo sapiens
ugagugaacgcugagaccaaau

SEQ ID NO: 84187 - RNA, 22 nt, Homo sapiens
ugaguguccaaguaaggugaaa

SEQ ID NO: 84188 - RNA, 22 nt, Homo sapiens
ugauaggucagaugauauugaa

SEQ ID NO: 84189 - RNA, 22 nt, Homo sapiens
ugauagugccuuuuauaucucu

SEQ ID NO: 84190 - RNA, 22 nt, Homo sapiens
ugauaugaaagggaaauaagug

SEQ ID NO: 84191 - RNA, 22 nt, Homo sapiens
ugauauguaugugaccuagaaa

SEQ ID NO: 84192 - RNA, 22 nt, Homo sapiens
ugaucacagcuugacuaaagga

SEQ ID NO: 84193 - RNA, 22 nt, Homo sapiens
ugaucuguccaccucagcuucc

SEQ ID NO: 84194 - RNA, 22 nt, Homo sapiens
ugauggcauuuggaguugggac

SEQ ID NO: 84195 - RNA, 22 nt, Homo sapiens
ugauggccuguucuccauaugu

SEQ ID NO: 84196 - RNA, 22 nt, Homo sapiens
ugauuuccaugagaacaugccu

SEQ ID NO: 84197 - RNA, 22 nt, Homo sapiens
ugcaaagucgaaacugcaguuu

SEQ ID NO: 84198 - RNA, 22 nt, Homo sapiens
ugcaaaugcugcuauuucucuu

SEQ ID NO: 84199 - RNA, 22 nt, Homo sapiens
ugcaaaugucaaggguuagugu

SEQ ID NO: 84200 - RNA, 22 nt, Homo sapiens
ugcaaauguuaguaacaccacu

SEQ ID NO: 84201 - RNA, 22 nt, Homo sapiens
ugcaauauccucuacuauaggu

SEQ ID NO: 84202 - RNA, 22 nt, Homo sapiens
ugcaaucaucgcuguuggccac

SEQ ID NO: 84203 - RNA, 22 nt, Homo sapiens
ugcaccacugcaccccagucug

SEQ ID NO: 84204 - RNA, 22 nt, Homo sapiens
ugcaccacugcuagccugggua

SEQ ID NO: 84205 - RNA, 18 nt, Homo sapiens
ugcaccaguuuacacuuc

SEQ ID NO: 84206 - RNA, 20 nt, Homo sapiens
ugcagcacgggcccuuucca

SEQ ID NO: 84207 - RNA, 22 nt, Homo sapiens
ugcagcacuguucacaauagcc

SEQ ID NO: 84208 - RNA, 18 nt, Homo sapiens
ugcagcaucaguacccag

SEQ ID NO: 84209 - RNA, 22 nt, Homo sapiens
ugcaggguccauugucccaagu

SEQ ID NO: 84210 - RNA, 22 nt, Homo sapiens
ugcauacacaagcauacaugua

SEQ ID NO: 84211 - RNA, 22 nt, Homo sapiens
ugcauauguucaaaguauucug

SEQ ID NO: 84212 - RNA, 22 nt, Homo sapiens
ugcaucaggcugcuuauuacaa

SEQ ID NO: 84213 - RNA, 22 nt, Homo sapiens
ugcauuagucuguucucacacu

SEQ ID NO: 84214 - RNA, 22 nt, Homo sapiens
ugccaagaacauuuucuguuuu

SEQ ID NO: 84215 - RNA, 20 nt, Homo sapiens
ugccaagaugacuauagcuc

SEQ ID NO: 84216 - RNA, 22 nt, Homo sapiens
ugccaagauuucaggaauuaag

SEQ ID NO: 84217 - RNA, 22 nt, Homo sapiens
ugccaggaugaggucaauguuu

SEQ ID NO: 84218 - RNA, 22 nt, Homo sapiens
ugccaguauuuuauuaagaauu

SEQ ID NO: 84219 - RNA, 19 nt, Homo sapiens
ugccauguagcacaugguc

SEQ ID NO: 84220 - RNA, 22 nt, Homo sapiens
ugccuacuuugcaucugucagg

SEQ ID NO: 84221 - RNA, 22 nt, Homo sapiens
ugccuaggcccaguccucagaa

SEQ ID NO: 84222 - RNA, 22 nt, Homo sapiens
ugccuaggcuggaaugcagugg

SEQ ID NO: 84223 - RNA, 22 nt, Homo sapiens
ugccuaguagaaggugaacaug

SEQ ID NO: 84224 - RNA, 22 nt, Homo sapiens
ugccugcugucuaauauauucu

SEQ ID NO: 84225 - RNA, 22 nt, Homo sapiens
ugcgccauugcacuccagccug

SEQ ID NO: 84226 - RNA, 22 nt, Homo sapiens
ugcuagagaaauauauuugggg

SEQ ID NO: 84227 - RNA, 22 nt, Homo sapiens
ugcuaugucagccaggcugguc

SEQ ID NO: 84228 - RNA, 21 nt, Homo sapiens
ugcuuuggucauacuucuucc

SEQ ID NO: 84229 - RNA, 22 nt, Homo sapiens
uggaaauaaaauagaguuugcc

SEQ ID NO: 84230 - RNA, 19 nt, Homo sapiens
uggaacugauucaguucug

SEQ ID NO: 84231 - RNA, 22 nt, Homo sapiens
uggaagacacauaccugauaac

SEQ ID NO: 84232 - RNA, 22 nt, Homo sapiens
uggaagcauagcagcgugugug

SEQ ID NO: 84233 - RNA, 22 nt, Homo sapiens
uggaaguaaucaugagguagca

SEQ ID NO: 84234 - RNA, 22 nt, Homo sapiens
uggaagugucugugcccagcuc

SEQ ID NO: 84235 - RNA, 21 nt, Homo sapiens
uggaaugaauggccaacaugg

SEQ ID NO: 84236 - RNA, 22 nt, Homo sapiens
uggaaugucuuuuccccaaagc

SEQ ID NO: 84237 - RNA, 22 nt, Homo sapiens
uggaauuaauuaaaauauacug

SEQ ID NO: 84238 - RNA, 22 nt, Homo sapiens
uggacaugaagggcacaggagg

SEQ ID NO: 84239 - RNA, 22 nt, Homo sapiens
uggacauguacauauguguaug

SEQ ID NO: 84240 - RNA, 22 nt, Homo sapiens
uggagacaaagauagaaaagca

SEQ ID NO: 84241 - RNA, 22 nt, Homo sapiens
uggagagucauuuauaguauuu

SEQ ID NO: 84242 - RNA, 19 nt, Homo sapiens
uggagauauccccuucaca

SEQ ID NO: 84243 - RNA, 23 nt, Homo sapiens
uggaggacaagcauggauaguga

SEQ ID NO: 84244 - RNA, 22 nt, Homo sapiens
uggaggacugcagaacugaggc

SEQ ID NO: 84245 - RNA, 20 nt, Homo sapiens
uggaggucaucugucacuac

SEQ ID NO: 84246 - RNA, 22 nt, Homo sapiens
uggaguaggccuaagaaugaca

SEQ ID NO: 84247 - RNA, 22 nt, Homo sapiens
uggagucuugcucuguugccca

SEQ ID NO: 84248 - RNA, 22 nt, Homo sapiens
uggagugcaauggcaccaucuu

SEQ ID NO: 84249 - RNA, 22 nt, Homo sapiens
uggagugucaguuuccagaguu

SEQ ID NO: 84250 - RNA, 16 nt, Homo sapiens
uggaguguuuguuaga

SEQ ID NO: 84251 - RNA, 22 nt, Homo sapiens
uggauaguucuucuacuagagu

SEQ ID NO: 84252 - RNA, 22 nt, Homo sapiens
uggaucauucuuucuugcaggg

SEQ ID NO: 84253 - RNA, 21 nt, Homo sapiens
uggauugagaaccccaggagg

SEQ ID NO: 84254 - RNA, 22 nt, Homo sapiens
uuauuacuccuauuuuguagau

SEQ ID NO: 84255 - RNA, 22 nt, Homo sapiens
uuauugcuaaaucaugaccaca

SEQ ID NO: 84256 - RNA, 22 nt, Homo sapiens
uuauuguccaaguuucccuuug

SEQ ID NO: 84257 - RNA, 22 nt, Homo sapiens
uucaaaguaaaaauguguucac

SEQ ID NO: 84258 - RNA, 22 nt, Homo sapiens
uucaacagugauggccuuugua

SEQ ID NO: 84259 - RNA, 22 nt, Homo sapiens
uucaauuaauauuauacucuca

SEQ ID NO: 84260 - RNA, 22 nt, Homo sapiens
uucacacugggccuacucugug

SEQ ID NO: 84261 - RNA, 20 nt, Homo sapiens
uucacaggcagcuucuuucu

SEQ ID NO: 84262 - RNA, 22 nt, Homo sapiens
uucacaguacucccuggaauua

SEQ ID NO: 84263 - RNA, 22 nt, Homo sapiens
uucacagugugaucuaugggca

SEQ ID NO: 84264 - RNA, 22 nt, Homo sapiens
uucaccuggguuggccaucauu

SEQ ID NO: 84265 - RNA, 22 nt, Homo sapiens
uucacugcacuccagccugggu

SEQ ID NO: 84266 - RNA, 22 nt, Homo sapiens
uucacugcaugaaaaggacagc

SEQ ID NO: 84267 - RNA, 22 nt, Homo sapiens
uucacuguagccucagccucuu

SEQ ID NO: 84268 - RNA, 22 nt, Homo sapiens
uucaguaguaaguuggaacucu

SEQ ID NO: 84269 - RNA, 22 nt, Homo sapiens
uucaucuggcaauucagagauu

SEQ ID NO: 84270 - RNA, 22 nt, Homo sapiens
uucauguaauuccauaagguaa

SEQ ID NO: 84271 - RNA, 22 nt, Homo sapiens
uucauugaaugauuuuuagaag

SEQ ID NO: 84272 - RNA, 22 nt, Homo sapiens
uuccaguggaguaaauggacaa

SEQ ID NO: 84273 - RNA, 22 nt, Homo sapiens
uuccaguguuugacucaccuuu

SEQ ID NO: 84274 - RNA, 22 nt, Homo sapiens
uuccaugagaugcaucaaagcu

SEQ ID NO: 84275 - RNA, 22 nt, Homo sapiens
uuccauuuguucggugucgcca

SEQ ID NO: 84276 - RNA, 22 nt, Homo sapiens
uucccuuugugcauaggauuug

SEQ ID NO: 84277 - RNA, 22 nt, Homo sapiens
uuccugaggccuccccagaagc

SEQ ID NO: 84278 - RNA, 20 nt, Homo sapiens
uuccuuaggcauuggaagaa

SEQ ID NO: 84279 - RNA, 22 nt, Homo sapiens
uucucagugcuaucuuuuaugc

SEQ ID NO: 84280 - RNA, 17 nt, Homo sapiens
uucucaguucugaucuc

SEQ ID NO: 84281 - RNA, 22 nt, Homo sapiens
uucucuguggauugggugagag

SEQ ID NO: 84282 - RNA, 22 nt, Homo sapiens
uucugcacaucgaucacaagau

SEQ ID NO: 84283 - RNA, 22 nt, Homo sapiens
uucugugcuuguggaugaagug

SEQ ID NO: 84284 - RNA, 22 nt, Homo sapiens
uucuguguuuaggucacggcua

SEQ ID NO: 84285 - RNA, 22 nt, Homo sapiens
uucuucaguuacaacaaggggg

SEQ ID NO: 84286 - RNA, 22 nt, Homo sapiens
uucuuccagccuugaggggccc

SEQ ID NO: 84287 - RNA, 22 nt, Homo sapiens
uugaagacuauaugauucuuca

SEQ ID NO: 84288 - RNA, 22 nt, Homo sapiens
uugaagguaggaugugcuauca

SEQ ID NO: 84289 - RNA, 22 nt, Homo sapiens
uugaaugucuauuaaguuguuu

SEQ ID NO: 84290 - RNA, 22 nt, Homo sapiens
uugacuuuuauucacucugcua

SEQ ID NO: 84291 - RNA, 22 nt, Homo sapiens
uugagaaucuuucgaauguucu

SEQ ID NO: 84292 - RNA, 22 nt, Homo sapiens
uugagacgaagucucacucuug

SEQ ID NO: 84293 - RNA, 22 nt, Homo sapiens
uugagauggagucucacgcauu

SEQ ID NO: 84294 - RNA, 22 nt, Homo sapiens
uugagauggagucucacuccuu

SEQ ID NO: 84295 - RNA, 22 nt, Homo sapiens
uugagauggagucucgcucugu

SEQ ID NO: 84296 - RNA, 22 nt, Homo sapiens
uugagauggagucucguucugu

SEQ ID NO: 84297 - RNA, 22 nt, Homo sapiens
uugagauggagucuuguucucu

SEQ ID NO: 84298 - RNA, 22 nt, Homo sapiens
uugagauggaguuucaauauug

SEQ ID NO: 84299 - RNA, 22 nt, Homo sapiens
uugagauggaguuucgcucuuu

SEQ ID NO: 84300 - RNA, 22 nt, Homo sapiens
uugagcuaguugcaccagcagg

SEQ ID NO: 84301 - RNA, 22 nt, Homo sapiens
uugaggaaugugauuucaaaua

SEQ ID NO: 84302 - RNA, 22 nt, Homo sapiens
uugaggacugagacagaccaag

SEQ ID NO: 84303 - RNA, 22 nt, Homo sapiens
uugaggacugguugaaagcuuu

SEQ ID NO: 84304 - RNA, 22 nt, Homo sapiens
uugaggcaaugaggagaagcug

SEQ ID NO: 84305 - RNA, 22 nt, Homo sapiens
uugaggguggcauauauugauu

SEQ ID NO: 84306 - RNA, 22 nt, Homo sapiens
uugaguagaaguaugucaguau

SEQ ID NO: 84307 - RNA, 22 nt, Homo sapiens
uugaguagugugaugcaugucu

SEQ ID NO: 84308 - RNA, 22 nt, Homo sapiens
uugaguauuggacugguaucuu

SEQ ID NO: 84309 - RNA, 22 nt, Homo sapiens
uugaguuugaguauucuaaagc

SEQ ID NO: 84310 - RNA, 22 nt, Homo sapiens
uugauaguuuuaaaauuaaucu

SEQ ID NO: 84311 - RNA, 22 nt, Homo sapiens
uugaucaauagaauacaacaga

SEQ ID NO: 84312 - RNA, 22 nt, Homo sapiens
uugaucugugucccugcccaau

SEQ ID NO: 84313 - RNA, 22 nt, Homo sapiens
uugaucuguguuagaagcuaag

SEQ ID NO: 84314 - RNA, 22 nt, Homo sapiens
auaucccuguauaagugaaugu

SEQ ID NO: 84315 - RNA, 22 nt, Homo sapiens
auaugcauacccucaccaacua

SEQ ID NO: 84316 - RNA, 20 nt, Homo sapiens
auaugcauguguuuucacuu

SEQ ID NO: 84317 - RNA, 22 nt, Homo sapiens
auauguaguuucagaaguggaa

SEQ ID NO: 84318 - RNA, 22 nt, Homo sapiens
auauuggacugugcuaguuaga

SEQ ID NO: 84319 - RNA, 22 nt, Homo sapiens
aucaaaguuucccagaaguugu

SEQ ID NO: 84320 - RNA, 22 nt, Homo sapiens
aucaaaugcuggcagagugccu

SEQ ID NO: 84321 - RNA, 22 nt, Homo sapiens
aucaagcuacacccuuuggaaa

SEQ ID NO: 84322 - RNA, 22 nt, Homo sapiens
aucacacuguuauuuuaguuaa

SEQ ID NO: 84323 - RNA, 22 nt, Homo sapiens
aucacaguuaagaggugaugaa

SEQ ID NO: 84324 - RNA, 22 nt, Homo sapiens
aucacauuuauaguggcacgca

SEQ ID NO: 84325 - RNA, 22 nt, Homo sapiens
aucaccauguguacauuagacc

SEQ ID NO: 84326 - RNA, 22 nt, Homo sapiens
aucagaaucucuugagaguguu

SEQ ID NO: 84327 - RNA, 22 nt, Homo sapiens
aucagugagugguuagugaaug

SEQ ID NO: 84328 - RNA, 22 nt, Homo sapiens
auccaucagacggcaggcguug

SEQ ID NO: 84329 - RNA, 22 nt, Homo sapiens
aucccuuccuagcacuuggugu

SEQ ID NO: 84330 - RNA, 22 nt, Homo sapiens
aucucagcaacuaaagauccuu

SEQ ID NO: 84331 - RNA, 22 nt, Homo sapiens
aucucaguuaaugacccuaugc

SEQ ID NO: 84332 - RNA, 20 nt, Homo sapiens
aucucugggcaaaggaaaau

SEQ ID NO: 84333 - RNA, 22 nt, Homo sapiens
aucugguguauuggugcugggu

SEQ ID NO: 84334 - RNA, 22 nt, Homo sapiens
aucuucucuugaagggugggga

SEQ ID NO: 84335 - RNA, 22 nt, Homo sapiens
aucuuguccugagguuuuauug

SEQ ID NO: 84336 - RNA, 22 nt, Homo sapiens
aucuuuggauacuugauauagu

SEQ ID NO: 84337 - RNA, 22 nt, Homo sapiens
augaaaagcauaaacgcugaag

SEQ ID NO: 84338 - RNA, 22 nt, Homo sapiens
augaaaguguguggaaacuuga

SEQ ID NO: 84339 - RNA, 22 nt, Homo sapiens
augaaaucuuuggcagaucuua

SEQ ID NO: 84340 - RNA, 22 nt, Homo sapiens
augaaauguaugagucuggguu

SEQ ID NO: 84341 - RNA, 22 nt, Homo sapiens
augaacucaucaucuagguuuu

SEQ ID NO: 84342 - RNA, 22 nt, Homo sapiens
augacaaugaaucccuguuuca

SEQ ID NO: 84343 - RNA, 22 nt, Homo sapiens
augacaguaugacuccaaaagu

SEQ ID NO: 84344 - RNA, 21 nt, Homo sapiens
gugaggaguuacuggcuuuga

SEQ ID NO: 84345 - RNA, 22 nt, Homo sapiens
gugaggcugguccugccuccca

SEQ ID NO: 84346 - RNA, 22 nt, Homo sapiens
gugaggcuuuuccuguuagacu

SEQ ID NO: 84347 - RNA, 22 nt, Homo sapiens
gugagggagcuggaauauuuau

SEQ ID NO: 84348 - RNA, 22 nt, Homo sapiens
gugagggaugugaaaaagguca

SEQ ID NO: 84349 - RNA, 22 nt, Homo sapiens
gugaugcaguacguagaggaga

SEQ ID NO: 84350 - RNA, 22 nt, Homo sapiens
gugauuuaguagaugcuaguua

SEQ ID NO: 84351 - RNA, 22 nt, Homo sapiens
gugcaaugucaggagaugcagc

SEQ ID NO: 84352 - RNA, 22 nt, Homo sapiens
gugcacaacgugcaaguuuguu

SEQ ID NO: 84353 - RNA, 22 nt, Homo sapiens
gugcacuguagaacccuuuguu

SEQ ID NO: 84354 - RNA, 22 nt, Homo sapiens
gugcauacucuggagacauugu

SEQ ID NO: 84355 - RNA, 18 nt, Homo sapiens
gugcauagccauggcagc

SEQ ID NO: 84356 - RNA, 22 nt, Homo sapiens
gugccacaguguuaagggauuc

SEQ ID NO: 84357 - RNA, 22 nt, Homo sapiens
guggaaaacauaugcuuguuga

SEQ ID NO: 84358 - RNA, 22 nt, Homo sapiens
guggaaaauuauugcuguuuuu

SEQ ID NO: 84359 - RNA, 22 nt, Homo sapiens
guggaaagaacacaaaauuagg

SEQ ID NO: 84360 - RNA, 18 nt, Homo sapiens
guggagugucuuccugga

SEQ ID NO: 84361 - RNA, 22 nt, Homo sapiens
guggcaaagaugccuucuccaa

SEQ ID NO: 84362 - RNA, 22 nt, Homo sapiens
guggcacgaugaucugggcuca

SEQ ID NO: 84363 - RNA, 22 nt, Homo sapiens
guggcagcacauauagguuguu

SEQ ID NO: 84364 - RNA, 22 nt, Homo sapiens
guggcaguuuuaaauaugaaaa

SEQ ID NO: 84365 - RNA, 20 nt, Homo sapiens
gugggcaaauccuuuccucu

SEQ ID NO: 84366 - RNA, 22 nt, Homo sapiens
guggguaaaucucuggggcucu

SEQ ID NO: 84367 - RNA, 22 nt, Homo sapiens
gugguuguuggaguggcaauuu

SEQ ID NO: 84368 - RNA, 22 nt, Homo sapiens
gugguuuuaauauucagucuag

SEQ ID NO: 84369 - RNA, 22 nt, Homo sapiens
gugguuuuuuucugccuuauag

SEQ ID NO: 84370 - RNA, 22 nt, Homo sapiens
gugucacuguauaauauuuauu

SEQ ID NO: 84371 - RNA, 22 nt, Homo sapiens
gugucacugugaggauauugua

SEQ ID NO: 84372 - RNA, 22 nt, Homo sapiens
gugugcaacuuucauuaauauu

SEQ ID NO: 84373 - RNA, 22 nt, Homo sapiens
guguguaaauggcagugagcuc

SEQ ID NO: 84374 - RNA, 22 nt, Homo sapiens
guguuauggagccaaacuacua

SEQ ID NO: 84375 - RNA, 22 nt, Homo sapiens
guguucaaacccaggucugucu

SEQ ID NO: 84376 - RNA, 22 nt, Homo sapiens
guuauguaucuugauugggugg

SEQ ID NO: 84377 - RNA, 22 nt, Homo sapiens
guuauuguccauuuauuuagca

SEQ ID NO: 84378 - RNA, 21 nt, Homo sapiens
guucaagugauccuccugucu

SEQ ID NO: 84379 - RNA, 22 nt, Homo sapiens
guucaaguuuucucuugugggu

SEQ ID NO: 84380 - RNA, 20 nt, Homo sapiens
guucacaggcuuccuuucag

SEQ ID NO: 84381 - RNA, 22 nt, Homo sapiens
guugaacaauagauucauauca

SEQ ID NO: 84382 - RNA, 22 nt, Homo sapiens
guugcugagucccaucaccaga

SEQ ID NO: 84383 - RNA, 22 nt, Homo sapiens
guuggcuuuuuaaggaaauugc

SEQ ID NO: 84384 - RNA, 22 nt, Homo sapiens
guuggucaaugugauuaggcca

SEQ ID NO: 84385 - RNA, 22 nt, Homo sapiens
guuggugaccugaagagaguaa

SEQ ID NO: 84386 - RNA, 22 nt, Homo sapiens
guuuaggaaugagaauauuuag

SEQ ID NO: 84387 - RNA, 22 nt, Homo sapiens
uaaaagucaucacaacuggagu

SEQ ID NO: 84388 - RNA, 22 nt, Homo sapiens
uaaacacucacuucauagccau

SEQ ID NO: 84389 - RNA, 22 nt, Homo sapiens
uaaaccacguuuacauuugaga

SEQ ID NO: 84390 - RNA, 22 nt, Homo sapiens
uaaagcacaaguaaagaauacu

SEQ ID NO: 84391 - RNA, 22 nt, Homo sapiens
uaaagcacuuuuuucugcaugg

SEQ ID NO: 84392 - RNA, 22 nt, Homo sapiens
uaaagcauguaauuagguuaga

SEQ ID NO: 84393 - RNA, 22 nt, Homo sapiens
uaaaguuauugccccucaguua

SEQ ID NO: 84394 - RNA, 22 nt, Homo sapiens
uaaauugcauaaguacaaauga

SEQ ID NO: 84395 - RNA, 18 nt, Homo sapiens
uaaauugcuucaccugag

SEQ ID NO: 84396 - RNA, 22 nt, Homo sapiens
uaacaacauucuaacugacggc

SEQ ID NO: 84397 - RNA, 21 nt, Homo sapiens
uaagacugccaguagggcugu

SEQ ID NO: 84398 - RNA, 22 nt, Homo sapiens
uaagacuuuuugggaauauaga

SEQ ID NO: 84399 - RNA, 22 nt, Homo sapiens
uaagagagcuccaucuuuuccu

SEQ ID NO: 84400 - RNA, 22 nt, Homo sapiens
uaagagcuaggauuuuaaauca

SEQ ID NO: 84401 - RNA, 22 nt, Homo sapiens
uaagaugaaggcucaccuagaa

SEQ ID NO: 84402 - RNA, 22 nt, Homo sapiens
uaaggaacucugauaucuggaa

SEQ ID NO: 84403 - RNA, 22 nt, Homo sapiens
uaaggaaggcugugugcuuuua

SEQ ID NO: 84404 - RNA, 22 nt, Homo sapiens
uaaguaguauaagguuuuuuga

SEQ ID NO: 84405 - RNA, 22 nt, Homo sapiens
uaaguaguccugauuuaaccuu

SEQ ID NO: 84406 - RNA, 22 nt, Homo sapiens
uaagugaauauggacaguuagc

SEQ ID NO: 84407 - RNA, 23 nt, Homo sapiens
uaaguucaucucuaauaggugga

SEQ ID NO: 84408 - RNA, 22 nt, Homo sapiens
uaaguucauucaugaaacuuag

SEQ ID NO: 84409 - RNA, 22 nt, Homo sapiens
uaauacucuucucauuuuacag

SEQ ID NO: 84410 - RNA, 22 nt, Homo sapiens
uaauauguauacagacagauac

SEQ ID NO: 84411 - RNA, 22 nt, Homo sapiens
uaaucacagagguuuggccuca

SEQ ID NO: 84412 - RNA, 22 nt, Homo sapiens
uaaugcucauuagcaggccaau

SEQ ID NO: 84413 - RNA, 22 nt, Homo sapiens
uaauucacauaaagcacuuaga

SEQ ID NO: 84414 - RNA, 22 nt, Homo sapiens
uaauucuguauguaucagaguu

SEQ ID NO: 84415 - RNA, 22 nt, Homo sapiens
uacaaagugggaaacgaagguu

SEQ ID NO: 84416 - RNA, 22 nt, Homo sapiens
uacaccugaguuugugguuuuc

SEQ ID NO: 84417 - RNA, 22 nt, Homo sapiens
uacaggaaugucagguugcugu

SEQ ID NO: 84418 - RNA, 22 nt, Homo sapiens
uacagucacauuccugaccaua

SEQ ID NO: 84419 - RNA, 22 nt, Homo sapiens
uacagucuagaggagaaucagg

SEQ ID NO: 84420 - RNA, 22 nt, Homo sapiens
uacaguguuuugguauuccaca

SEQ ID NO: 84421 - RNA, 22 nt, Homo sapiens
uacaugcaugggcaugugugca

SEQ ID NO: 84422 - RNA, 22 nt, Homo sapiens
uacauguauacaggguuuacuu

SEQ ID NO: 84423 - RNA, 22 nt, Homo sapiens
uacauguauguguuuauggcug

SEQ ID NO: 84424 - RNA, 22 nt, Homo sapiens
uaccacaggcuggguaaucuau

SEQ ID NO: 84425 - RNA, 22 nt, Homo sapiens
uaccagcauuucucuuuaagua

SEQ ID NO: 84426 - RNA, 22 nt, Homo sapiens
uacuagaaccuuauucagagug

SEQ ID NO: 84427 - RNA, 22 nt, Homo sapiens
uacucaauugcagucaccuggc

SEQ ID NO: 84428 - RNA, 22 nt, Homo sapiens
uacugcugucagugccaaguag

SEQ ID NO: 84429 - RNA, 22 nt, Homo sapiens
uacugguuuuauauauuucucc

SEQ ID NO: 84430 - RNA, 22 nt, Homo sapiens
uacugguuuuggugggcaggug

SEQ ID NO: 84431 - RNA, 22 nt, Homo sapiens
uacuuuguagagugugagaauu

SEQ ID NO: 84432 - RNA, 22 nt, Homo sapiens
uacuuuguuauagcagcaggaa

SEQ ID NO: 84433 - RNA, 22 nt, Homo sapiens
uagaauguaacuuccaugucau

SEQ ID NO: 84434 - RNA, 22 nt, Homo sapiens
uagagccauugcagauguuuga

SEQ ID NO: 84435 - RNA, 22 nt, Homo sapiens
uagaggaaugaauuuggccaga

SEQ ID NO: 84436 - RNA, 22 nt, Homo sapiens
uagagguaggucuucgagucuc

SEQ ID NO: 84437 - RNA, 22 nt, Homo sapiens
ucccagugaaaccccaccuuca

SEQ ID NO: 84438 - RNA, 22 nt, Homo sapiens
ucccaguuuuucugaauaguca

SEQ ID NO: 84439 - RNA, 19 nt, Homo sapiens
uccccaguuuuccguucag

SEQ ID NO: 84440 - RNA, 19 nt, Homo sapiens
uccccgggucuagugcagc

SEQ ID NO: 84441 - RNA, 22 nt, Homo sapiens
uccccugagucaccugcuucuc

SEQ ID NO: 84442 - RNA, 20 nt, Homo sapiens
ucccucaaacuuuuccacug

SEQ ID NO: 84443 - RNA, 18 nt, Homo sapiens
ucccucagaauuauagaa

SEQ ID NO: 84444 - RNA, 22 nt, Homo sapiens
ucccugaaagcugagauuggaa

SEQ ID NO: 84445 - RNA, 22 nt, Homo sapiens
ucccuuaaugaugaacaaugag

SEQ ID NO: 84446 - RNA, 22 nt, Homo sapiens
ucccuugagccuggcuucucac

SEQ ID NO: 84447 - RNA, 22 nt, Homo sapiens
uccugcauucauccugguguug

SEQ ID NO: 84448 - RNA, 22 nt, Homo sapiens
uccuucaugcaucaauguaucc

SEQ ID NO: 84449 - RNA, 22 nt, Homo sapiens
uccuuggucauggaagagacag

SEQ ID NO: 84450 - RNA, 22 nt, Homo sapiens
uccuuuggcuaacuuucuaagu

SEQ ID NO: 84451 - RNA, 22 nt, Homo sapiens
uccuuugguuauaggcaccucu

SEQ ID NO: 84452 - RNA, 22 nt, Homo sapiens
ucgcugggaaccagagguaaag

SEQ ID NO: 84453 - RNA, 22 nt, Homo sapiens
ucuauggauaaaaugcccucau

SEQ ID NO: 84454 - RNA, 22 nt, Homo sapiens
ucucaguguuaucuaucugccu

SEQ ID NO: 84455 - RNA, 22 nt, Homo sapiens
ucucauugauucuggggugaug

SEQ ID NO: 84456 - RNA, 22 nt, Homo sapiens
ucucugacacugaccccaaaaa

SEQ ID NO: 84457 - RNA, 22 nt, Homo sapiens
ucucugagaccacuccaaacuc

SEQ ID NO: 84458 - RNA, 22 nt, Homo sapiens
ucucugauuaaacaagauagug

SEQ ID NO: 84459 - RNA, 22 nt, Homo sapiens
ucucuugguugaacaguuugga

SEQ ID NO: 84460 - RNA, 22 nt, Homo sapiens
ucugagcaugcaucuugccugg

SEQ ID NO: 84461 - RNA, 22 nt, Homo sapiens
ucugccuacugagcacacagug

SEQ ID NO: 84462 - RNA, 22 nt, Homo sapiens
ucuggccuccuaugagaaucga

SEQ ID NO: 84463 - RNA, 21 nt, Homo sapiens
ucuggcuuucauuccccuucu

SEQ ID NO: 84464 - RNA, 22 nt, Homo sapiens
ucuguacugccaaguuucuuua

SEQ ID NO: 84465 - RNA, 22 nt, Homo sapiens
ucugucuuugccuaaguuuguc

SEQ ID NO: 84466 - RNA, 22 nt, Homo sapiens
ucugugcauuacacuuuucuca

SEQ ID NO: 84467 - RNA, 22 nt, Homo sapiens
ucugugcauuguaacaacuaaa

SEQ ID NO: 84468 - RNA, 22 nt, Homo sapiens
ucuuagguaagaaauuuuaaca

SEQ ID NO: 84469 - RNA, 22 nt, Homo sapiens
ucuuggcauggcugaagauucc

SEQ ID NO: 84470 - RNA, 22 nt, Homo sapiens
ucuuggguuguuggcuucuccu

SEQ ID NO: 84471 - RNA, 22 nt, Homo sapiens
ucuuggguuugccuugcugcug

SEQ ID NO: 84472 - RNA, 22 nt, Homo sapiens
ucuuuaguaauuucuguaaggc

SEQ ID NO: 84473 - RNA, 19 nt, Homo sapiens
ucuuuagucacauuuuuau

SEQ ID NO: 84474 - RNA, 20 nt, Homo sapiens
ucuuucgguuaccaggcagu

SEQ ID NO: 84475 - RNA, 22 nt, Homo sapiens
ucuuugccuaacccaaggucau

SEQ ID NO: 84476 - RNA, 19 nt, Homo sapiens
ucuuugcuuuucuaagagg

SEQ ID NO: 84477 - RNA, 22 nt, Homo sapiens
ucuuuggagacaaccccagucu

SEQ ID NO: 84478 - RNA, 22 nt, Homo sapiens
ucuuuggguguauuucacagcc

SEQ ID NO: 84479 - RNA, 22 nt, Homo sapiens
ucuuugguaugugcaugugcuu

SEQ ID NO: 84480 - RNA, 22 nt, Homo sapiens
ucuuuuugagucaguuucggua

SEQ ID NO: 84481 - RNA, 20 nt, Homo sapiens
ucuuuuuguggccccagagu

SEQ ID NO: 84482 - RNA, 22 nt, Homo sapiens
ugaaaaguuguugaaggcuuca

SEQ ID NO: 84483 - RNA, 22 nt, Homo sapiens
ugaaacacacauugcccuuuau

SEQ ID NO: 84484 - RNA, 22 nt, Homo sapiens
ugaaacacaccuccucuccauc

SEQ ID NO: 84485 - RNA, 18 nt, Homo sapiens
ugaaacacauuuuuuccu

SEQ ID NO: 84486 - RNA, 22 nt, Homo sapiens
ugaaagacugaaagcuuuucuu

SEQ ID NO: 84487 - RNA, 22 nt, Homo sapiens
ugaaaugauuauaugguguuug

SEQ ID NO: 84488 - RNA, 22 nt, Homo sapiens
ugaaaugguuaugugaggagau

SEQ ID NO: 84489 - RNA, 22 nt, Homo sapiens
ugaaauguugggugauggaauc

SEQ ID NO: 84490 - RNA, 22 nt, Homo sapiens
ugaaauuauucuuaccaaggug

SEQ ID NO: 84491 - RNA, 22 nt, Homo sapiens
ugaacacaucuccugguaccug

SEQ ID NO: 84492 - RNA, 22 nt, Homo sapiens
ugaaggcaggagggagaaaagu

SEQ ID NO: 84493 - RNA, 21 nt, Homo sapiens
ugaaguagcauaggaugucaa

SEQ ID NO: 84494 - RNA, 22 nt, Homo sapiens
ugaagugaagacucacagaagg

SEQ ID NO: 84495 - RNA, 22 nt, Homo sapiens
ucacugggagcauuugagccuu

SEQ ID NO: 84496 - RNA, 22 nt, Homo sapiens
ucagaacugaacaaaccagucu

SEQ ID NO: 84497 - RNA, 19 nt, Homo sapiens
ucagaugcauuagggguua

SEQ ID NO: 84498 - RNA, 22 nt, Homo sapiens
ucagauguuugagaaguauacu

SEQ ID NO: 84499 - RNA, 22 nt, Homo sapiens
ucaggcaugcagcaaugcagug

SEQ ID NO: 84500 - RNA, 22 nt, Homo sapiens
ucagggacgcuugacacaagcc

SEQ ID NO: 84501 - RNA, 22 nt, Homo sapiens
ucaggucauuccaggagggcca

SEQ ID NO: 84502 - RNA, 19 nt, Homo sapiens
ucaguagugcacauaagcc

SEQ ID NO: 84503 - RNA, 22 nt, Homo sapiens
ucagugacuggguauuaaauca

SEQ ID NO: 84504 - RNA, 22 nt, Homo sapiens
ucagugauugcuuucauggaaa

SEQ ID NO: 84505 - RNA, 17 nt, Homo sapiens
ucagugcauuuaagaga

SEQ ID NO: 84506 - RNA, 22 nt, Homo sapiens
ucagugccucaguuuuuaaaga

SEQ ID NO: 84507 - RNA, 22 nt, Homo sapiens
ucagugcuguaccaucuaagga

SEQ ID NO: 84508 - RNA, 22 nt, Homo sapiens
ucagugucugcauucuuauugu

SEQ ID NO: 84509 - RNA, 23 nt, Homo sapiens
ucagugucuggauccugcucagu

SEQ ID NO: 84510 - RNA, 22 nt, Homo sapiens
ucauaaaguuguuuuaauggga

SEQ ID NO: 84511 - RNA, 22 nt, Homo sapiens
ucauacuguugugaaacaaaac

SEQ ID NO: 84512 - RNA, 22 nt, Homo sapiens
ucaucaggaaacuuaugcagug

SEQ ID NO: 84513 - RNA, 22 nt, Homo sapiens
ucaucaggcucauucaagcuga

SEQ ID NO: 84514 - RNA, 21 nt, Homo sapiens
ucaucagucaaagacaauggu

SEQ ID NO: 84515 - RNA, 22 nt, Homo sapiens
ucaucagugcuugcaaauuauu

SEQ ID NO: 84516 - RNA, 22 nt, Homo sapiens
ucaugagacacacuggaaagga

SEQ ID NO: 84517 - RNA, 22 nt, Homo sapiens
ucaugguuuuauaacccucuug

SEQ ID NO: 84518 - RNA, 22 nt, Homo sapiens
ucauguauuaucauuagugggu

SEQ ID NO: 84519 - RNA, 22 nt, Homo sapiens
ucaugugaggauaacaauagug

SEQ ID NO: 84520 - RNA, 22 nt, Homo sapiens
ucauuagagaucuuggggaaaa

SEQ ID NO: 84521 - RNA, 22 nt, Homo sapiens
cuagagagaagcugugugaccu

SEQ ID NO: 84522 - RNA, 22 nt, Homo sapiens
cuaugcuucuuaaauuaguuau

SEQ ID NO: 84523 - RNA, 22 nt, Homo sapiens
cuaugguuucuccauaucauca

SEQ ID NO: 84524 - RNA, 22 nt, Homo sapiens
cuauuagguuggugcaaaagua

SEQ ID NO: 84525 - RNA, 18 nt, Homo sapiens
cucaaccucaugcagggc

SEQ ID NO: 84526 - RNA, 22 nt, Homo sapiens
cucacaguucuaaaggcaagaa

SEQ ID NO: 84527 - RNA, 22 nt, Homo sapiens
cucaccuugugauccuccugcc

SEQ ID NO: 84528 - RNA, 22 nt, Homo sapiens
cucacugggaccacucugaagu

SEQ ID NO: 84529 - RNA, 22 nt, Homo sapiens
cucacugucaacauguauuugg

SEQ ID NO: 84530 - RNA, 22 nt, Homo sapiens
cucaguagaaaauacauggacu

SEQ ID NO: 84531 - RNA, 22 nt, Homo sapiens
cuccaguacagagagguuccuc

SEQ ID NO: 84532 - RNA, 22 nt, Homo sapiens
cuccagugcaaagucaugauca

SEQ ID NO: 84533 - RNA, 23 nt, Homo sapiens
cuccaugagccguccagggccug

SEQ ID NO: 84534 - RNA, 22 nt, Homo sapiens
cuccauguggcuaacuuuuaaa

SEQ ID NO: 84535 - RNA, 22 nt, Homo sapiens
cucccagugacccaggaacagg

SEQ ID NO: 84536 - RNA, 20 nt, Homo sapiens
cucccugacaaauguggaaa

SEQ ID NO: 84537 - RNA, 22 nt, Homo sapiens
cuccuggugauuggagugugaa

SEQ ID NO: 84538 - RNA, 22 nt, Homo sapiens
cuccuugauuagaguauagagu

SEQ ID NO: 84539 - RNA, 22 nt, Homo sapiens
cucgcuccauuucggugaucaa

SEQ ID NO: 84540 - RNA, 17 nt, Homo sapiens
cucucugguuuaaagca

SEQ ID NO: 84541 - RNA, 22 nt, Homo sapiens
cucucuguuugucuguuauugg

SEQ ID NO: 84542 - RNA, 22 nt, Homo sapiens
cucugacagugguuagcacugu

SEQ ID NO: 84543 - RNA, 22 nt, Homo sapiens
cucugauggagauauacaagga

SEQ ID NO: 84544 - RNA, 22 nt, Homo sapiens
cucuuugcuucuggcaucauug

SEQ ID NO: 84545 - RNA, 22 nt, Homo sapiens
cucuuuuguuuagcugagaggg

SEQ ID NO: 84546 - RNA, 22 nt, Homo sapiens
cugaaaagcaucugcauagcug

SEQ ID NO: 84547 - RNA, 22 nt, Homo sapiens
cugaaagagcauguaacacagu

SEQ ID NO: 84548 - RNA, 22 nt, Homo sapiens
cugaaggcagguagaauagaga

SEQ ID NO: 84549 - RNA, 22 nt, Homo sapiens
cugaaucauugguuaugaguac

SEQ ID NO: 84550 - RNA, 22 nt, Homo sapiens
cugacagaugacugccacugua

SEQ ID NO: 84551 - RNA, 22 nt, Homo sapiens
cugacuuuagaacccaaaaagu

SEQ ID NO: 84552 - RNA, 22 nt, Homo sapiens
cugagaauguaaaugaagcuuu

SEQ ID NO: 84553 - RNA, 22 nt, Homo sapiens
cugagauuuuuagauccuggcg

SEQ ID NO: 84554 - RNA, 18 nt, Homo sapiens
cugagcacugcuuuauga

SEQ ID NO: 84555 - RNA, 22 nt, Homo sapiens
cugagcccauucuggggagaag

SEQ ID NO: 84556 - RNA, 22 nt, Homo sapiens
cugaggugggaguuuuucucau

SEQ ID NO: 84557 - RNA, 22 nt, Homo sapiens
cugagguuaggaguuugagacc

SEQ ID NO: 84558 - RNA, 20 nt, Homo sapiens
cugagguugggguccuuccc

SEQ ID NO: 84559 - RNA, 22 nt, Homo sapiens
cugcaaauacuugugggauuuu

SEQ ID NO: 84560 - RNA, 19 nt, Homo sapiens
cugcacugagaaaaggagg

SEQ ID NO: 84561 - RNA, 18 nt, Homo sapiens
cuggaaggcuacuacagu

SEQ ID NO: 84562 - RNA, 22 nt, Homo sapiens
cuggagucugacugacacaagg

SEQ ID NO: 84563 - RNA, 22 nt, Homo sapiens
cuggcaucuaaauacuugaugu

SEQ ID NO: 84564 - RNA, 22 nt, Homo sapiens
cuggcccaguucugcguuuugc

SEQ ID NO: 84565 - RNA, 22 nt, Homo sapiens
cuggucaagagcaaaggccagg

SEQ ID NO: 84566 - RNA, 22 nt, Homo sapiens
cugucuagagggcacaugaugc

SEQ ID NO: 84567 - RNA, 22 nt, Homo sapiens
cugucucagugaauugguuuua

SEQ ID NO: 84568 - RNA, 22 nt, Homo sapiens
cugugcaugcgcggagcugaaa

SEQ ID NO: 84569 - RNA, 22 nt, Homo sapiens
cugugcauguaugcgugaguuc

SEQ ID NO: 84570 - RNA, 19 nt, Homo sapiens
cugugcauuucuguggaag

SEQ ID NO: 84571 - RNA, 22 nt, Homo sapiens
cugugcuugagagaugacacag

SEQ ID NO: 84572 - RNA, 22 nt, Homo sapiens
cugugguguaacucuuggggcg

SEQ ID NO: 84573 - RNA, 22 nt, Homo sapiens
cuguuugguaaggaugccucag

SEQ ID NO: 84574 - RNA, 22 nt, Homo sapiens
cuuaaggccagauaauuucuau

SEQ ID NO: 84575 - RNA, 22 nt, Homo sapiens
cuucaagucuuuggauaauuag

SEQ ID NO: 84576 - RNA, 22 nt, Homo sapiens
cuucaugagacuuuuggaaggc

SEQ ID NO: 84577 - RNA, 18 nt, Homo sapiens
cuucauugcuguuuugcu

SEQ ID NO: 84578 - RNA, 22 nt, Homo sapiens
cuuccauaguuacacccaggga

SEQ ID NO: 84579 - RNA, 22 nt, Homo sapiens
cuugaauguaaauaauguacag

SEQ ID NO: 84580 - RNA, 20 nt, Homo sapiens
cuugccuagcccuuugccuc

SEQ ID NO: 84581 - RNA, 22 nt, Homo sapiens
cuugccuuugucuucaaaggcu

SEQ ID NO: 84582 - RNA, 22 nt, Homo sapiens
cuuggcacgugauagguguuga

SEQ ID NO: 84583 - RNA, 22 nt, Homo sapiens
cuuggcacucuguggaguuagg

SEQ ID NO: 84584 - RNA, 22 nt, Homo sapiens
cuuggcuuguuguccccugcuc

SEQ ID NO: 84585 - RNA, 22 nt, Homo sapiens
cuugggcagugugcauguguau

SEQ ID NO: 84586 - RNA, 18 nt, Homo sapiens
cuugucaaaucuuuccuc

SEQ ID NO: 84587 - RNA, 22 nt, Homo sapiens
cuuguguuacauauuuaagaga

SEQ ID NO: 84588 - RNA, 22 nt, Homo sapiens
cuuuacaguuggacucacgagg

SEQ ID NO: 84589 - RNA, 22 nt, Homo sapiens
cuuuggucaauugcugcgggga

SEQ ID NO: 84590 - RNA, 18 nt, Homo sapiens
cuuugguccccgcacccu

SEQ ID NO: 84591 - RNA, 22 nt, Homo sapiens
cuuugguguauuuucagagacc

SEQ ID NO: 84592 - RNA, 23 nt, Homo sapiens
cuuuugcaaugugaucuugccac

SEQ ID NO: 84593 - RNA, 22 nt, Homo sapiens
cuuuuguggaucuucuguugcu

SEQ ID NO: 84594 - RNA, 22 nt, Homo sapiens
gaaaauccauccccagggagua

SEQ ID NO: 84595 - RNA, 22 nt, Homo sapiens
gaaacugcauuucuaacaagcu

SEQ ID NO: 84596 - RNA, 22 nt, Homo sapiens
gaaaugcucagggguuuuccag

SEQ ID NO: 84597 - RNA, 22 nt, Homo sapiens
gaacuggcuuagugaaacuucc

SEQ ID NO: 84598 - RNA, 22 nt, Homo sapiens
gagaaugaacagacugccucuu

SEQ ID NO: 84599 - RNA, 22 nt, Homo sapiens
gagacugagucuugcucugucg

SEQ ID NO: 84600 - RNA, 22 nt, Homo sapiens
gagauacuugguuucuguuucu

SEQ ID NO: 84601 - RNA, 21 nt, Homo sapiens
gagauagguaccgaagcuuag

SEQ ID NO: 84602 - RNA, 22 nt, Homo sapiens
gagauauuuagaaauguguucu

SEQ ID NO: 84603 - RNA, 22 nt, Homo sapiens
gagaucauugugggccaagcug

SEQ ID NO: 84604 - RNA, 22 nt, Homo sapiens
gagaugaagugucaauaaggau

SEQ ID NO: 84605 - RNA, 22 nt, Homo sapiens
gagauggagucuuuuucuguca

SEQ ID NO: 84606 - RNA, 22 nt, Homo sapiens
gagauggaguuucacuucgcuc

SEQ ID NO: 84607 - RNA, 22 nt, Homo sapiens
gagauucaucuagguccagaga

SEQ ID NO: 84608 - RNA, 22 nt, Homo sapiens
gagcuagguuuugaauccagac

SEQ ID NO: 84609 - RNA, 22 nt, Homo sapiens
gaggcaguguguccguucucgg

SEQ ID NO: 84610 - RNA, 22 nt, Homo sapiens
gagguuuuagugagucccacug

SEQ ID NO: 84611 - RNA, 22 nt, Homo sapiens
gaguaaaugucacuguugcugu

SEQ ID NO: 84612 - RNA, 23 nt, Homo sapiens
gaguacauuaaaagcccagacug

SEQ ID NO: 84613 - RNA, 19 nt, Homo sapiens
gauaucuagggggagguuc

SEQ ID NO: 84614 - RNA, 22 nt, Homo sapiens
gauauguuguuggauucgguua

SEQ ID NO: 84615 - RNA, 17 nt, Homo sapiens
gaucacagucgucuccu

SEQ ID NO: 84616 - RNA, 22 nt, Homo sapiens
gaugagcuaaguucucacagca

SEQ ID NO: 84617 - RNA, 22 nt, Homo sapiens
gaugagguaggccugcuuugaa

SEQ ID NO: 84618 - RNA, 22 nt, Homo sapiens
gauggaguaauguaaucuugag

SEQ ID NO: 84619 - RNA, 22 nt, Homo sapiens
gauggcaucugagaguguuaga

SEQ ID NO: 84620 - RNA, 22 nt, Homo sapiens
gaugguuuucaccugcaugcuu

SEQ ID NO: 84621 - RNA, 22 nt, Homo sapiens
gauuugagagaggguguuuaua

SEQ ID NO: 84622 - RNA, 22 nt, Homo sapiens
gcaaaaaguagugcugguuagg

SEQ ID NO: 84623 - RNA, 21 nt, Homo sapiens
gcaaacauccuuugaugccag

SEQ ID NO: 84624 - RNA, 22 nt, Homo sapiens
gcaagacaugucuaagguuuaa

SEQ ID NO: 84625 - RNA, 22 nt, Homo sapiens
gcaaggaugagugcccaugaga

SEQ ID NO: 84626 - RNA, 22 nt, Homo sapiens
gcacaaugccugacgaguccug

SEQ ID NO: 84627 - RNA, 22 nt, Homo sapiens
gcacauggccacuaggaauaaa

SEQ ID NO: 84628 - RNA, 22 nt, Homo sapiens
gcaccccuuaccgggcuggguu

SEQ ID NO: 84629 - RNA, 22 nt, Homo sapiens
gcacccugucaaaauggaccaa

SEQ ID NO: 84630 - RNA, 22 nt, Homo sapiens
gcagcaucaaaucacacaagau

SEQ ID NO: 84631 - RNA, 22 nt, Homo sapiens
gcagugcaguggcgcgaucucg

SEQ ID NO: 84632 - RNA, 20 nt, Homo sapiens
gcauaugucuuuauagcaga

SEQ ID NO: 84633 - RNA, 22 nt, Homo sapiens
gcauauguuuggguguguauau

SEQ ID NO: 84634 - RNA, 22 nt, Homo sapiens
gcauggagaaggggacugauuc

SEQ ID NO: 84635 - RNA, 22 nt, Homo sapiens
gcauggaguggaaauucuuggg

SEQ ID NO: 84636 - RNA, 22 nt, Homo sapiens
gcauggccuuuaaaugucacag

SEQ ID NO: 84637 - RNA, 22 nt, Homo sapiens
gccauugcacuccagccuagcg

SEQ ID NO: 84638 - RNA, 22 nt, Homo sapiens
gccauugcacuccagccuaggu

SEQ ID NO: 84639 - RNA, 22 nt, Homo sapiens
gccuagggacaaaccguccgac

SEQ ID NO: 84640 - RNA, 19 nt, Homo sapiens
gcggcacuggagacacagc

SEQ ID NO: 84641 - RNA, 22 nt, Homo sapiens
gcgguuuuaagugaguuucuua

SEQ ID NO: 84642 - RNA, 22 nt, Homo sapiens
gcucuuuugggguaauucugag

SEQ ID NO: 84643 - RNA, 22 nt, Homo sapiens
gcugcacuuuaaggcauccccu

SEQ ID NO: 84644 - RNA, 22 nt, Homo sapiens
gcugcuuuugaugacaaaaaca

SEQ ID NO: 84645 - RNA, 22 nt, Homo sapiens
gcuguguugugcccagcaucau

SEQ ID NO: 84646 - RNA, 22 nt, Homo sapiens
ggaagccugcacucgggcaggg

SEQ ID NO: 84647 - RNA, 22 nt, Homo sapiens
ggaagccuggaaaaaauuguga

SEQ ID NO: 84648 - RNA, 22 nt, Homo sapiens
ggaaguauaaacuuaguggagu

SEQ ID NO: 84649 - RNA, 22 nt, Homo sapiens
ggacaagagacugggacacuga

SEQ ID NO: 84650 - RNA, 22 nt, Homo sapiens
ggacagugaaugccacuccucc

SEQ ID NO: 84651 - RNA, 22 nt, Homo sapiens
ggagguagguuugugauuugua

SEQ ID NO: 84652 - RNA, 23 nt, Homo sapiens
ggaguguaaugacucgaucucgg

SEQ ID NO: 84653 - RNA, 22 nt, Homo sapiens
ggaguguaguggcuccaucucg

SEQ ID NO: 84654 - RNA, 22 nt, Homo sapiens
ggagugugauuguucucuguua

SEQ ID NO: 84655 - RNA, 22 nt, Homo sapiens
ggaguguguaggagaaagguaa

SEQ ID NO: 84656 - RNA, 22 nt, Homo sapiens
ggaguuuaagucuugugcaucu

SEQ ID NO: 84657 - RNA, 22 nt, Homo sapiens
ggauauguagggcauaucuaca

SEQ ID NO: 84658 - RNA, 22 nt, Homo sapiens
ggcaaaugaagauggagaggcu

SEQ ID NO: 84659 - RNA, 22 nt, Homo sapiens
ggcaacauggugaaacucuguc

SEQ ID NO: 84660 - RNA, 22 nt, Homo sapiens
ggcaagaggagauucugcuccc

SEQ ID NO: 84661 - RNA, 22 nt, Homo sapiens
ggcaagugggagggaguguuuc

SEQ ID NO: 84662 - RNA, 22 nt, Homo sapiens
ggcaagugucagcagcaacacc

SEQ ID NO: 84663 - RNA, 22 nt, Homo sapiens
ggcacaaugucagcucacugca

SEQ ID NO: 84664 - RNA, 23 nt, Homo sapiens
ggcacggaauucaaagaggcauu

SEQ ID NO: 84665 - RNA, 22 nt, Homo sapiens
ggcagcacaauuuucugaugga

SEQ ID NO: 84666 - RNA, 22 nt, Homo sapiens
ggcagcuguguccuucguaagg

SEQ ID NO: 84667 - RNA, 22 nt, Homo sapiens
ggcagguaaggagugggagccu

SEQ ID NO: 84668 - RNA, 22 nt, Homo sapiens
ggcaguguaauaauuuauuaau

SEQ ID NO: 84669 - RNA, 22 nt, Homo sapiens
ggcaguguauuacuuaggguuc

SEQ ID NO: 84670 - RNA, 22 nt, Homo sapiens
ggcaguguggcugcauauagca

SEQ ID NO: 84671 - RNA, 22 nt, Homo sapiens
ggcaguguuauuauauuuuugg

SEQ ID NO: 84672 - RNA, 22 nt, Homo sapiens
gggaagaaggagugguuuacuc

SEQ ID NO: 84673 - RNA, 22 nt, Homo sapiens
gggaagauauaggcugggcacc

SEQ ID NO: 84674 - RNA, 20 nt, Homo sapiens
gggaugugagguacacucuu

SEQ ID NO: 84675 - RNA, 22 nt, Homo sapiens
gggcauguggacuuguauguuu

SEQ ID NO: 84676 - RNA, 22 nt, Homo sapiens
ggugagaaaaacauagucucag

SEQ ID NO: 84677 - RNA, 22 nt, Homo sapiens
ggugaucauugucucuaguaug

SEQ ID NO: 84678 - RNA, 22 nt, Homo sapiens
gguggcaaaucugaguggcgcu

SEQ ID NO: 84679 - RNA, 22 nt, Homo sapiens
guaacagucucaacaguggucu

SEQ ID NO: 84680 - RNA, 22 nt, Homo sapiens
guaagagaauggguuacuuucc

SEQ ID NO: 84681 - RNA, 22 nt, Homo sapiens
guaaggcuguuaucuucacguc

SEQ ID NO: 84682 - RNA, 22 nt, Homo sapiens
guaauaacuguggaaaaagguu

SEQ ID NO: 84683 - RNA, 22 nt, Homo sapiens
guaaucucaccuacuugggagg

SEQ ID NO: 84684 - RNA, 22 nt, Homo sapiens
guaaucucagcuacucgggagg

SEQ ID NO: 84685 - RNA, 22 nt, Homo sapiens
guaaugaacuugaaagccuguu

SEQ ID NO: 84686 - RNA, 22 nt, Homo sapiens
guacaggcagcaaacaccauaa

SEQ ID NO: 84687 - RNA, 22 nt, Homo sapiens
guagaagcacagggccuguauu

SEQ ID NO: 84688 - RNA, 22 nt, Homo sapiens
guagcagaauaucagauaauuu

SEQ ID NO: 84689 - RNA, 22 nt, Homo sapiens
guauccugaaguucucagcacu

SEQ ID NO: 84690 - RNA, 22 nt, Homo sapiens
guaugacacaggaagcuuaacc

SEQ ID NO: 84691 - RNA, 22 nt, Homo sapiens
gucacuggcugucuuguaugau

SEQ ID NO: 84692 - RNA, 21 nt, Homo sapiens
gucacuggggcuggauaauuc

SEQ ID NO: 84693 - RNA, 22 nt, Homo sapiens
gucagcaaaguucuccugcaga

SEQ ID NO: 84694 - RNA, 18 nt, Homo sapiens
uaauaacugugaccuuga

SEQ ID NO: 84695 - RNA, 22 nt, Homo sapiens
uaaugugaauagugcuguaaug

SEQ ID NO: 84696 - RNA, 16 nt, Homo sapiens
uacaauguagaaaaca

SEQ ID NO: 84697 - RNA, 22 nt, Homo sapiens
uacagaguauccauuugaguuc

SEQ ID NO: 84698 - RNA, 22 nt, Homo sapiens
uacauuggcuagguuuggaggc

SEQ ID NO: 84699 - RNA, 22 nt, Homo sapiens
uaccucaguucaauaacagaua

SEQ ID NO: 84700 - RNA, 22 nt, Homo sapiens
uacuacuuucucuucugggaaa

SEQ ID NO: 84701 - RNA, 22 nt, Homo sapiens
uacugcuuaaaagucaauuacu

SEQ ID NO: 84702 - RNA, 20 nt, Homo sapiens
uagagagauauggggguucc

SEQ ID NO: 84703 - RNA, 22 nt, Homo sapiens
uagagauaucaauuucauggug

SEQ ID NO: 84704 - RNA, 22 nt, Homo sapiens
uagagcacauuaucauuuccaa

SEQ ID NO: 84705 - RNA, 22 nt, Homo sapiens
uagauuaucucaccacucgagu

SEQ ID NO: 84706 - RNA, 19 nt, Homo sapiens
uagcacagggucccagacu

SEQ ID NO: 84707 - RNA, 17 nt, Homo sapiens
uagcacagugccuggua

SEQ ID NO: 84708 - RNA, 22 nt, Homo sapiens
uagcaccaggguugacugaccu

SEQ ID NO: 84709 - RNA, 22 nt, Homo sapiens
uagcaccucuuuggccuuucgu

SEQ ID NO: 84710 - RNA, 23 nt, Homo sapiens
uagcacuuuuuacauauggacau

SEQ ID NO: 84711 - RNA, 22 nt, Homo sapiens
uagcagcaaagcaggaucugcu

SEQ ID NO: 84712 - RNA, 22 nt, Homo sapiens
uagcagcaccccacucuacugg

SEQ ID NO: 84713 - RNA, 22 nt, Homo sapiens
uagcagcauuuuuguagaguau

SEQ ID NO: 84714 - RNA, 22 nt, Homo sapiens
uagcaguauggagcgaggccca

SEQ ID NO: 84715 - RNA, 22 nt, Homo sapiens
uagcauaauuuguagaaaauca

SEQ ID NO: 84716 - RNA, 21 nt, Homo sapiens
uagcucagugguguugccaua

SEQ ID NO: 84717 - RNA, 18 nt, Homo sapiens
uagcucuuguugguccau

SEQ ID NO: 84718 - RNA, 22 nt, Homo sapiens
gucuuugcauguauguucauga

SEQ ID NO: 84719 - RNA, 22 nt, Homo sapiens
gucuuugcuuuuaaccagaggu

SEQ ID NO: 84720 - RNA, 22 nt, Homo sapiens
gucuuuggaaagacaaaguuca

SEQ ID NO: 84721 - RNA, 22 nt, Homo sapiens
gugaaaugaaacgcuaugucuu

SEQ ID NO: 84722 - RNA, 22 nt, Homo sapiens
gugaacaagcaaaggcaggagg

SEQ ID NO: 84723 - RNA, 22 nt, Homo sapiens
gugaacuguuugaggaagagaa

SEQ ID NO: 84724 - RNA, 22 nt, Homo sapiens
gugacauuuuuacugaugagag

SEQ ID NO: 84725 - RNA, 22 nt, Homo sapiens
gugagaagaaaaauauggcugu

SEQ ID NO: 84726 - RNA, 22 nt, Homo sapiens
gugagaugaggucucacucugu

SEQ ID NO: 84727 - RNA, 22 nt, Homo sapiens
gugaggcacugcugcuuuccag

SEQ ID NO: 84728 - RNA, 22 nt, Homo sapiens
gugaugguaguuuguauuucug

SEQ ID NO: 84729 - RNA, 22 nt, Homo sapiens
gugauguguuuguucuaucucu

SEQ ID NO: 84730 - RNA, 18 nt, Homo sapiens
gugcaaugaauagcagag

SEQ ID NO: 84731 - RNA, 22 nt, Homo sapiens
gugcacaacaugcagguuuguu

SEQ ID NO: 84732 - RNA, 22 nt, Homo sapiens
gugcacaacgugcagguuuguu

SEQ ID NO: 84733 - RNA, 22 nt, Homo sapiens
gugcagugugauccuuccguau

SEQ ID NO: 84734 - RNA, 22 nt, Homo sapiens
gugcaguguuugcauggaauca

SEQ ID NO: 84735 - RNA, 22 nt, Homo sapiens
guggaaaaguaguugcgguuuu

SEQ ID NO: 84736 - RNA, 22 nt, Homo sapiens
guggaagcacaggccuccugga

SEQ ID NO: 84737 - RNA, 22 nt, Homo sapiens
guggagcuguguggccuugggc

SEQ ID NO: 84738 - RNA, 22 nt, Homo sapiens
guggaggagaaagaagcauuuc

SEQ ID NO: 84739 - RNA, 22 nt, Homo sapiens
guggaucacuugaggucaagag

SEQ ID NO: 84740 - RNA, 22 nt, Homo sapiens
guggcaagaauguacaaaaggu

SEQ ID NO: 84741 - RNA, 22 nt, Homo sapiens
guggcacaauuaaguagcuauu

SEQ ID NO: 84742 - RNA, 22 nt, Homo sapiens
guggcagagucagagggaaaug

SEQ ID NO: 84743 - RNA, 22 nt, Homo sapiens
guggcagugugaggauccugcu

SEQ ID NO: 84744 - RNA, 22 nt, Homo sapiens
gugggauggagagaagguauga

SEQ ID NO: 84745 - RNA, 22 nt, Homo sapiens
gugggguaggguaggacucaac

SEQ ID NO: 84746 - RNA, 22 nt, Homo sapiens
guggguaaaucucuguuugagg

SEQ ID NO: 84747 - RNA, 22 nt, Homo sapiens
guggugucuuuuuugauuagga

SEQ ID NO: 84748 - RNA, 22 nt, Homo sapiens
gugguuuuaucccagaaauuaa

SEQ ID NO: 84749 - RNA, 22 nt, Homo sapiens
gugguuuuuaaaguaccugugg

SEQ ID NO: 84750 - RNA, 22 nt, Homo sapiens
guguaaaacaauuagaggauuu

SEQ ID NO: 84751 - RNA, 20 nt, Homo sapiens
guguaagagcaagcuuccua

SEQ ID NO: 84752 - RNA, 22 nt, Homo sapiens
guguauacauagaauuguguau

SEQ ID NO: 84753 - RNA, 22 nt, Homo sapiens
gugucccagugugcauacaggu

SEQ ID NO: 84754 - RNA, 22 nt, Homo sapiens
gugugacugcucuauuagggcg

SEQ ID NO: 84755 - RNA, 19 nt, Homo sapiens
gugugcauaucacagagca

SEQ ID NO: 84756 - RNA, 22 nt, Homo sapiens
guguucaaagcugauugagauu

SEQ ID NO: 84757 - RNA, 22 nt, Homo sapiens
guuaaagacauccacauaggag

SEQ ID NO: 84758 - RNA, 23 nt, Homo sapiens
guuaagugaauguguacucuauu

SEQ ID NO: 84759 - RNA, 22 nt, Homo sapiens
guucagcaggggcuucaauggu

SEQ ID NO: 84760 - RNA, 22 nt, Homo sapiens
guucagguauucuggaacagag

SEQ ID NO: 84761 - RNA, 22 nt, Homo sapiens
guugggcccauagacugccagu

SEQ ID NO: 84762 - RNA, 22 nt, Homo sapiens
guuuguaacucuagugacuaga

SEQ ID NO: 84763 - RNA, 22 nt, Homo sapiens
uaaacugcuugaggguaaguac

SEQ ID NO: 84764 - RNA, 22 nt, Homo sapiens
uaaacugucuugcaguuacaug

SEQ ID NO: 84765 - RNA, 22 nt, Homo sapiens
uaaagcuuagauccaugguggc

SEQ ID NO: 84766 - RNA, 22 nt, Homo sapiens
uaaaugcuuaauugaaugugga

SEQ ID NO: 84767 - RNA, 22 nt, Homo sapiens
uaacaguggucugugguaucug

SEQ ID NO: 84768 - RNA, 22 nt, Homo sapiens
uaacccagugucugugaugggu

SEQ ID NO: 84769 - RNA, 22 nt, Homo sapiens
uaaggaaccagaaguggguagc

SEQ ID NO: 84770 - RNA, 22 nt, Homo sapiens
uaaggcaaucagucaugguguu

SEQ ID NO: 84771 - RNA, 22 nt, Homo sapiens
uaagggcaugcugcaugagagu

SEQ ID NO: 84772 - RNA, 22 nt, Homo sapiens
uaaguaguguugagacaaguuu

SEQ ID NO: 84773 - RNA, 15 nt, Homo sapiens
uaaguaguuggcugu

SEQ ID NO: 84774 - RNA, 22 nt, Homo sapiens
uaaguaguuucuggauauucuc

SEQ ID NO: 84775 - RNA, 22 nt, Homo sapiens
uaagugcaugauuacaugcaua

SEQ ID NO: 84776 - RNA, 22 nt, Homo sapiens
uaagugguguucauucuuuuga

SEQ ID NO: 84777 - RNA, 22 nt, Homo sapiens
uaauaauguuaggcuuacucaa

SEQ ID NO: 84778 - RNA, 22 nt, Homo sapiens
uaauacuagugaauagcaggau

SEQ ID NO: 84779 - RNA, 22 nt, Homo sapiens
uaauaguguuaaugcuagagcu

SEQ ID NO: 84780 - RNA, 22 nt, Homo sapiens
uacaaaucuagguuuguuacug

SEQ ID NO: 84781 - RNA, 22 nt, Homo sapiens
uacaacacugguucgacaugug

SEQ ID NO: 84782 - RNA, 22 nt, Homo sapiens
uacacaugugaguucuuuucua

SEQ ID NO: 84783 - RNA, 22 nt, Homo sapiens
uacaccaauuuaaucaaaagca

SEQ ID NO: 84784 - RNA, 22 nt, Homo sapiens
uacagccacauaauguaugauu

SEQ ID NO: 84785 - RNA, 19 nt, Homo sapiens
uacaggacugagcugaggu

SEQ ID NO: 84786 - RNA, 22 nt, Homo sapiens
uacaguaauguuaaucuuugug

SEQ ID NO: 84787 - RNA, 22 nt, Homo sapiens
uacaguggugugaucucagcuc

SEQ ID NO: 84788 - RNA, 22 nt, Homo sapiens
uacauacuguaugguucuguuu

SEQ ID NO: 84789 - RNA, 22 nt, Homo sapiens
uacauacuucacagacuuuaaa

SEQ ID NO: 84790 - RNA, 22 nt, Homo sapiens
uacauccauccugcugggcagu

SEQ ID NO: 84791 - RNA, 22 nt, Homo sapiens
uaccaaaguuucggccucuguu

SEQ ID NO: 84792 - RNA, 22 nt, Homo sapiens
uaccacugccgagaaaacagau

SEQ ID NO: 84793 - RNA, 22 nt, Homo sapiens
uaccaugaagguggagagagaa

SEQ ID NO: 84794 - RNA, 22 nt, Homo sapiens
uaccugagacaacuuugaggaa

SEQ ID NO: 84795 - RNA, 22 nt, Homo sapiens
uacugcacuccaaccugagaga

SEQ ID NO: 84796 - RNA, 22 nt, Homo sapiens
uagaaugaaacaagcugugccu

SEQ ID NO: 84797 - RNA, 22 nt, Homo sapiens
uagagaucuuauauuuuaugac

SEQ ID NO: 84798 - RNA, 22 nt, Homo sapiens
uagagcuugacacuuuccaugg

SEQ ID NO: 84799 - RNA, 22 nt, Homo sapiens
uagaggaaggauuggaaacgca

SEQ ID NO: 84800 - RNA, 22 nt, Homo sapiens
uagagugcugucaaagacuugu

SEQ ID NO: 84801 - RNA, 22 nt, Homo sapiens
uagaucauauucagugcuuacu

SEQ ID NO: 84802 - RNA, 22 nt, Homo sapiens
uagcaaguguuuaagcacuuuu

SEQ ID NO: 84803 - RNA, 22 nt, Homo sapiens
uagcacagugucauucuaggua

SEQ ID NO: 84804 - RNA, 22 nt, Homo sapiens
uagcacaguucacccucgauuu

SEQ ID NO: 84805 - RNA, 22 nt, Homo sapiens
uagcaccacaaucaagauacag

SEQ ID NO: 84806 - RNA, 22 nt, Homo sapiens
uagcacuauguuaucacauacu

SEQ ID NO: 84807 - RNA, 22 nt, Homo sapiens
uagcagcagugguguauuuaga

SEQ ID NO: 84808 - RNA, 22 nt, Homo sapiens
uagcagcauaaauggacuaaga

SEQ ID NO: 84809 - RNA, 22 nt, Homo sapiens
uagcagcaucucuggcuucuac

SEQ ID NO: 84810 - RNA, 21 nt, Homo sapiens
uagcauacauuuugcaucuua

SEQ ID NO: 84811 - RNA, 22 nt, Homo sapiens
ucccuuagccaaauccccagcc

SEQ ID NO: 84812 - RNA, 22 nt, Homo sapiens
ucccuuucuggaguuucccaag

SEQ ID NO: 84813 - RNA, 18 nt, Homo sapiens
ucccuuuguagaugaccc

SEQ ID NO: 84814 - RNA, 22 nt, Homo sapiens
uccugagagcagacccucuaua

SEQ ID NO: 84815 - RNA, 20 nt, Homo sapiens
uccugagauucccaguucuc

SEQ ID NO: 84816 - RNA, 22 nt, Homo sapiens
uccuuuggucaguauucuuuug

SEQ ID NO: 84817 - RNA, 22 nt, Homo sapiens
uccuuugguggagucuuuaggg

SEQ ID NO: 84818 - RNA, 19 nt, Homo sapiens
ucgcgccauucuccugccu

SEQ ID NO: 84819 - RNA, 22 nt, Homo sapiens
ucguucuugucaguuuauaaag

SEQ ID NO: 84820 - RNA, 22 nt, Homo sapiens
ucuaaaguacuacuacuguugg

SEQ ID NO: 84821 - RNA, 17 nt, Homo sapiens
ucuaauaauaugcauuu

SEQ ID NO: 84822 - RNA, 22 nt, Homo sapiens
ucuauguuuuugcuaguagugu

SEQ ID NO: 84823 - RNA, 22 nt, Homo sapiens
ucucaaccucccaaguagcugg

SEQ ID NO: 84824 - RNA, 22 nt, Homo sapiens
ucucaaguggucgcaguuagau

SEQ ID NO: 84825 - RNA, 22 nt, Homo sapiens
ucucacauuucacagggauggg

SEQ ID NO: 84826 - RNA, 19 nt, Homo sapiens
ucucaguguuggucaggug

SEQ ID NO: 84827 - RNA, 22 nt, Homo sapiens
ucuccauugaaauggacauaau

SEQ ID NO: 84828 - RNA, 22 nt, Homo sapiens
ucuccauuguccagaugaggaa

SEQ ID NO: 84829 - RNA, 20 nt, Homo sapiens
ucucccaaacagcaggcccu

SEQ ID NO: 84830 - RNA, 22 nt, Homo sapiens
ucucugagaaaaguuucuccca

SEQ ID NO: 84831 - RNA, 22 nt, Homo sapiens
ucugacacagugauuaguaaau

SEQ ID NO: 84832 - RNA, 22 nt, Homo sapiens
ucugagaugagacuuugaauuu

SEQ ID NO: 84833 - RNA, 22 nt, Homo sapiens
ucuggcaagagccgagggcagu

SEQ ID NO: 84834 - RNA, 22 nt, Homo sapiens
ucuggcacugaugugggaugcu

SEQ ID NO: 84835 - RNA, 22 nt, Homo sapiens
ucuggcauuuucucugcuugca

SEQ ID NO: 84836 - RNA, 22 nt, Homo sapiens
ucuggcuccacacuuuauuaac

SEQ ID NO: 84837 - RNA, 19 nt, Homo sapiens
ucugucacuggggguauuc

SEQ ID NO: 84838 - RNA, 22 nt, Homo sapiens
ucuuaguuuagauuagcaauuc

SEQ ID NO: 84839 - RNA, 17 nt, Homo sapiens
ucuucuguuacuguggc

SEQ ID NO: 84840 - RNA, 22 nt, Homo sapiens
ucuuggcaaagaauuuuuggcu

SEQ ID NO: 84841 - RNA, 20 nt, Homo sapiens
ucuugggaauguagccuagg

SEQ ID NO: 84842 - RNA, 22 nt, Homo sapiens
ucuuuagugacaguugugcaag

SEQ ID NO: 84843 - RNA, 22 nt, Homo sapiens
ucuuuaguuaagggacauuuua

SEQ ID NO: 84844 - RNA, 22 nt, Homo sapiens
ucuuugaguguauacuuagauu

SEQ ID NO: 84845 - RNA, 22 nt, Homo sapiens
ucuuuggaggcgaucuguuuga

SEQ ID NO: 84846 - RNA, 22 nt, Homo sapiens
ucuuuggguagauauguagcug

SEQ ID NO: 84847 - RNA, 22 nt, Homo sapiens
ucuuuggucuacuuucauaugu

SEQ ID NO: 84848 - RNA, 22 nt, Homo sapiens
ucuuugguucuguuuauguaau

SEQ ID NO: 84849 - RNA, 22 nt, Homo sapiens
ucuuuuggguauggagccauca

SEQ ID NO: 84850 - RNA, 22 nt, Homo sapiens
ucuuuugguuucuagaggccgc

SEQ ID NO: 84851 - RNA, 22 nt, Homo sapiens
ugaaacacacagagaagggaga

SEQ ID NO: 84852 - RNA, 22 nt, Homo sapiens
ugaaaugaucaguuugguuacu

SEQ ID NO: 84853 - RNA, 22 nt, Homo sapiens
ugaacacagccugccucugcca

SEQ ID NO: 84854 - RNA, 20 nt, Homo sapiens
ugaacugguuacuuucuguc

SEQ ID NO: 84855 - RNA, 22 nt, Homo sapiens
ugaagugaagcaguaguguggg

SEQ ID NO: 84856 - RNA, 22 nt, Homo sapiens
ugaauacugugcaaaggauuug

SEQ ID NO: 84857 - RNA, 22 nt, Homo sapiens
ugaauauuugcuacucacucuu

SEQ ID NO: 84858 - RNA, 22 nt, Homo sapiens
ugaaucauuucuugucuucagu

SEQ ID NO: 84859 - RNA, 22 nt, Homo sapiens
ugaaugcaucuagaaauuuauu

SEQ ID NO: 84860 - RNA, 21 nt, Homo sapiens
ugaaugcuuuaaauauuagaa

SEQ ID NO: 84861 - RNA, 22 nt, Homo sapiens
ugaauggauccaauucuuagua

SEQ ID NO: 84862 - RNA, 22 nt, Homo sapiens
ugaaugugauggguuucaugug

SEQ ID NO: 84863 - RNA, 22 nt, Homo sapiens
ugaauucuguccaaaauaacug

SEQ ID NO: 84864 - RNA, 22 nt, Homo sapiens
ugacagcaucaggauuggagag

SEQ ID NO: 84865 - RNA, 22 nt, Homo sapiens
ugacaggagauuaugugauguu

SEQ ID NO: 84866 - RNA, 22 nt, Homo sapiens
ugacaguaucuacagcuucuua

SEQ ID NO: 84867 - RNA, 22 nt, Homo sapiens
ugacauggagagagaagccuuu

SEQ ID NO: 84868 - RNA, 22 nt, Homo sapiens
ugacauggugcucuuucaggca

SEQ ID NO: 84869 - RNA, 22 nt, Homo sapiens
ugacuagagcaauuggaaacaa

SEQ ID NO: 84870 - RNA, 22 nt, Homo sapiens
ugacuugaaguuaccauaugca

SEQ ID NO: 84871 - RNA, 22 nt, Homo sapiens
ugagaacaugcacuugagguug

SEQ ID NO: 84872 - RNA, 16 nt, Homo sapiens
ugagaacaugugacau

SEQ ID NO: 84873 - RNA, 19 nt, Homo sapiens
ugagaacaugugguauuug

SEQ ID NO: 84874 - RNA, 18 nt, Homo sapiens
ugagaacauguguacaca

SEQ ID NO: 84875 - RNA, 22 nt, Homo sapiens
ugagaacugccuguauuuaucu

SEQ ID NO: 84876 - RNA, 22 nt, Homo sapiens
ugagaacuuauggugauuuuuu

SEQ ID NO: 84877 - RNA, 22 nt, Homo sapiens
ugagaagaugaacuccuugguc

SEQ ID NO: 84878 - RNA, 22 nt, Homo sapiens
ugagacauauuauacugcuuuu

SEQ ID NO: 84879 - RNA, 22 nt, Homo sapiens
ugagacggagucucgcucuguc

SEQ ID NO: 84880 - RNA, 22 nt, Homo sapiens
ugagacggagucuggcacuguc

SEQ ID NO: 84881 - RNA, 22 nt, Homo sapiens
ugagacggaguuauuuauaaua

SEQ ID NO: 84882 - RNA, 22 nt, Homo sapiens
ugagacggaguuucgcucuugu

SEQ ID NO: 84883 - RNA, 22 nt, Homo sapiens
ugagacugagucucgcucuugu

SEQ ID NO: 84884 - RNA, 22 nt, Homo sapiens
ugagacugaguuucucucuugu

SEQ ID NO: 84885 - RNA, 22 nt, Homo sapiens
ugagaggugaauggcaggcuca

SEQ ID NO: 84886 - RNA, 22 nt, Homo sapiens
ugagauagaaaacauaggagaa

SEQ ID NO: 84887 - RNA, 22 nt, Homo sapiens
ugagaucaacugagucagagca

SEQ ID NO: 84888 - RNA, 22 nt, Homo sapiens
ugagaucaaggugggcccuggg

SEQ ID NO: 84889 - RNA, 22 nt, Homo sapiens
ugagaugaaagcagaaagacuu

SEQ ID NO: 84890 - RNA, 22 nt, Homo sapiens
ugagaugaagugauguaaaaca

SEQ ID NO: 84891 - RNA, 22 nt, Homo sapiens
ugagaugaggucucacucuguu

SEQ ID NO: 84892 - RNA, 22 nt, Homo sapiens
ugagaugaguucucgcucuguc

SEQ ID NO: 84893 - RNA, 22 nt, Homo sapiens
ugagaugaguugcuggcucuga

SEQ ID NO: 84894 - RNA, 22 nt, Homo sapiens
ugagaugauaucuuauuguaau

SEQ ID NO: 84895 - RNA, 22 nt, Homo sapiens
ugagauggcuuuauugcugaau

SEQ ID NO: 84896 - RNA, 21 nt, Homo sapiens
ugagauuaaguuguuuagaag

SEQ ID NO: 84897 - RNA, 23 nt, Homo sapiens
ugagauuauaaucuuuuacuucu

SEQ ID NO: 84898 - RNA, 22 nt, Homo sapiens
ugagauuguaucugcaaugugu

SEQ ID NO: 84899 - RNA, 19 nt, Homo sapiens
ugagauuguaugaggagau

SEQ ID NO: 84900 - RNA, 22 nt, Homo sapiens
ugagcaacauuucaaaacucca

SEQ ID NO: 84901 - RNA, 22 nt, Homo sapiens
ugagcaagaaauagaaacagau

SEQ ID NO: 84902 - RNA, 22 nt, Homo sapiens
ugagcacuguacuuuaucaggu

SEQ ID NO: 84903 - RNA, 22 nt, Homo sapiens
ugagccaugguuagcuucucau

SEQ ID NO: 84904 - RNA, 22 nt, Homo sapiens
ugagcuaggauccugucacugu

SEQ ID NO: 84905 - RNA, 22 nt, Homo sapiens
aaaaggcuagcuaguaacagaa

SEQ ID NO: 84906 - RNA, 22 nt, Homo sapiens
aaacuugucuaauuauaagcau

SEQ ID NO: 84907 - RNA, 22 nt, Homo sapiens
aaagaagucagccuguccuuug

SEQ ID NO: 84908 - RNA, 22 nt, Homo sapiens
aaaggauucuaauggaaaugcu

SEQ ID NO: 84909 - RNA, 22 nt, Homo sapiens
aaaggcacacacuccuuguuau

SEQ ID NO: 84910 - RNA, 22 nt, Homo sapiens
aaaggcuucggaucagaaggua

SEQ ID NO: 84911 - RNA, 22 nt, Homo sapiens
aaagggcuugaauacucuuuuu

SEQ ID NO: 84912 - RNA, 22 nt, Homo sapiens
aaaguaguagcaguuucugcca

SEQ ID NO: 84913 - RNA, 22 nt, Homo sapiens
aaagucuguuuugucagagacu

SEQ ID NO: 84914 - RNA, 22 nt, Homo sapiens
aaagugcaguacuucguauauu

SEQ ID NO: 84915 - RNA, 22 nt, Homo sapiens
aaagugccugacucauaguuag

SEQ ID NO: 84916 - RNA, 22 nt, Homo sapiens
aaagugcuuccuuuuugagggu

SEQ ID NO: 84917 - RNA, 22 nt, Homo sapiens
aaauaguagcugaaugagggaa

SEQ ID NO: 84918 - RNA, 22 nt, Homo sapiens
aaaugacuuuuuaugcagagua

SEQ ID NO: 84919 - RNA, 23 nt, Homo sapiens
aaauuugccuauuauuccuaugg

SEQ ID NO: 84920 - RNA, 22 nt, Homo sapiens
aacagacugucacauaaaauug

SEQ ID NO: 84921 - RNA, 22 nt, Homo sapiens
aacuggcauagccagacuucuc

SEQ ID NO: 84922 - RNA, 22 nt, Homo sapiens
aacuugcacuugauugagagcu

SEQ ID NO: 84923 - RNA, 22 nt, Homo sapiens
aagaccuaugcaggaagaaaug

SEQ ID NO: 84924 - RNA, 22 nt, Homo sapiens
aagagcauuauuuaguaauuuc

SEQ ID NO: 84925 - RNA, 22 nt, Homo sapiens
aagaggcuguaggauaaugccu

SEQ ID NO: 84926 - RNA, 22 nt, Homo sapiens
aagagguuuaacugacucacag

SEQ ID NO: 84927 - RNA, 22 nt, Homo sapiens
aagaugauguuguguuuucacu

SEQ ID NO: 84928 - RNA, 22 nt, Homo sapiens
aagcacaauuucaccuucuugu

SEQ ID NO: 84929 - RNA, 22 nt, Homo sapiens
aagcacccuuugucuggacaug

SEQ ID NO: 84930 - RNA, 21 nt, Homo sapiens
aagcaugguguaucuuuccau

SEQ ID NO: 84931 - RNA, 22 nt, Homo sapiens
aagcugccuugugaaggcauuc

SEQ ID NO: 84932 - RNA, 22 nt, Homo sapiens
aagcuggagugcaguggugcaa

SEQ ID NO: 84933 - RNA, 22 nt, Homo sapiens
aagcuggcuuucauugagugcu

SEQ ID NO: 84934 - RNA, 22 nt, Homo sapiens
aagcugugucuugucagcuacc

SEQ ID NO: 84935 - RNA, 22 nt, Homo sapiens
aagcuuucaacuguuugccauu

SEQ ID NO: 84936 - RNA, 22 nt, Homo sapiens
aaggagcuuaagugacuuguac

SEQ ID NO: 84937 - RNA, 22 nt, Homo sapiens
aaggcaagaaugcgugcuuuca

SEQ ID NO: 84938 - RNA, 22 nt, Homo sapiens
aaggcaagagaaaauuucgagu

SEQ ID NO: 84939 - RNA, 22 nt, Homo sapiens
aagguggugucagagagcuuau

SEQ ID NO: 84940 - RNA, 22 nt, Homo sapiens
aagguucuugcuugcaugacug

SEQ ID NO: 84941 - RNA, 22 nt, Homo sapiens
aaguaauggaguuauuuuauga

SEQ ID NO: 84942 - RNA, 22 nt, Homo sapiens
aagugaguaauacgucaguugu

SEQ ID NO: 84943 - RNA, 22 nt, Homo sapiens
aagugcugggauuggccgggca

SEQ ID NO: 84944 - RNA, 22 nt, Homo sapiens
aagugucuuaccgggagggagu

SEQ ID NO: 84945 - RNA, 22 nt, Homo sapiens
aauaagaaguggaagggaccgg

SEQ ID NO: 84946 - RNA, 22 nt, Homo sapiens
aauacugugauaucgagcgauu

SEQ ID NO: 84947 - RNA, 22 nt, Homo sapiens
aauagcauugaaucuaccaauu

SEQ ID NO: 84948 - RNA, 22 nt, Homo sapiens
aauaucacaguggguguacacc

SEQ ID NO: 84949 - RNA, 22 nt, Homo sapiens
aauauguccuugaaauggugcu

SEQ ID NO: 84950 - RNA, 22 nt, Homo sapiens
aauauugucaaaauggauucca

SEQ ID NO: 84951 - RNA, 22 nt, Homo sapiens
aaucaacauuguuuuaagucaa

SEQ ID NO: 84952 - RNA, 22 nt, Homo sapiens
aaucugggguuguuuggggagu

SEQ ID NO: 84953 - RNA, 22 nt, Homo sapiens
aaucuguagaaggugcacauuc

SEQ ID NO: 84954 - RNA, 22 nt, Homo sapiens
aaugccuagugugugacaggug

SEQ ID NO: 84955 - RNA, 22 nt, Homo sapiens
aauggcacuuuauaaauguuaa

SEQ ID NO: 84956 - RNA, 22 nt, Homo sapiens
aauggcauuugccagggcaaag

SEQ ID NO: 84957 - RNA, 22 nt, Homo sapiens
aaugggacugacgccucccaga

SEQ ID NO: 84958 - RNA, 22 nt, Homo sapiens
aaugguguuuccguuaagcuga

SEQ ID NO: 84959 - RNA, 22 nt, Homo sapiens
aauuaguugaaagucugcuuuu

SEQ ID NO: 84960 - RNA, 22 nt, Homo sapiens
acaauggaauggaguggaaagu

SEQ ID NO: 84961 - RNA, 22 nt, Homo sapiens
acacaguaaauauguauugaau

SEQ ID NO: 84962 - RNA, 22 nt, Homo sapiens
acacaguauaugacaaugcuuu

SEQ ID NO: 84963 - RNA, 22 nt, Homo sapiens
acacaugugaaaaaaauguuac

SEQ ID NO: 84964 - RNA, 22 nt, Homo sapiens
acaccauugcauuccagccugg

SEQ ID NO: 84965 - RNA, 20 nt, Homo sapiens
acacuggaguaucaaggccc

SEQ ID NO: 84966 - RNA, 20 nt, Homo sapiens
acacuggcuuugagauuuag

SEQ ID NO: 84967 - RNA, 22 nt, Homo sapiens
acacuggguaacauaucuguua

SEQ ID NO: 84968 - RNA, 20 nt, Homo sapiens
acagcacugguuucaagcaa

SEQ ID NO: 84969 - RNA, 22 nt, Homo sapiens
acaggguuauuguaauaaugua

SEQ ID NO: 84970 - RNA, 22 nt, Homo sapiens
acaguacuuuuggauuugugaa

SEQ ID NO: 84971 - RNA, 22 nt, Homo sapiens
acaguagaaaacaauggauuug

SEQ ID NO: 84972 - RNA, 22 nt, Homo sapiens
acagucacaauuuguaccuuuu

SEQ ID NO: 84973 - RNA, 22 nt, Homo sapiens
acagucuggagaaugggugcuc

SEQ ID NO: 84974 - RNA, 22 nt, Homo sapiens
acagugcuuggcacacaguaau

SEQ ID NO: 84975 - RNA, 23 nt, Homo sapiens
acaguggugugaucuuggcucag

SEQ ID NO: 84976 - RNA, 22 nt, Homo sapiens
acaguguacaauagccuuuuaa

SEQ ID NO: 84977 - RNA, 18 nt, Homo sapiens
acagugucauggcucaau

SEQ ID NO: 84978 - RNA, 22 nt, Homo sapiens
acaugcauauguuggaagaaag

SEQ ID NO: 84979 - RNA, 22 nt, Homo sapiens
acauggcacugcgggcuucuug

SEQ ID NO: 84980 - RNA, 22 nt, Homo sapiens
acccaguguucaacauucacau

SEQ ID NO: 84981 - RNA, 22 nt, Homo sapiens
acccgugcucacugccucugcc

SEQ ID NO: 84982 - RNA, 22 nt, Homo sapiens
acccucagaccaguuucccugg

SEQ ID NO: 84983 - RNA, 22 nt, Homo sapiens
ugagcugagauuaagcugcugc

SEQ ID NO: 84984 - RNA, 22 nt, Homo sapiens
ugaggaacuagcuacccuaaua

SEQ ID NO: 84985 - RNA, 17 nt, Homo sapiens
ugagggaugccugguuc

SEQ ID NO: 84986 - RNA, 22 nt, Homo sapiens
ugagguauuuuguuaugcagcc

SEQ ID NO: 84987 - RNA, 22 nt, Homo sapiens
ugaggugcagcaauccucaugu

SEQ ID NO: 84988 - RNA, 22 nt, Homo sapiens
ugagguguuaacuuuacuuuua

SEQ ID NO: 84989 - RNA, 23 nt, Homo sapiens
ugagguguuaagcagacuugucu

SEQ ID NO: 84990 - RNA, 22 nt, Homo sapiens
ugagguguuauccagaguucuu

SEQ ID NO: 84991 - RNA, 22 nt, Homo sapiens
ugaguagaagugaagauagugg

SEQ ID NO: 84992 - RNA, 22 nt, Homo sapiens
ugaguaggauugguauuucuuc

SEQ ID NO: 84993 - RNA, 23 nt, Homo sapiens
ugaguagguccacguaugugagu

SEQ ID NO: 84994 - RNA, 22 nt, Homo sapiens
ugaguauguaggaugugucuua

SEQ ID NO: 84995 - RNA, 22 nt, Homo sapiens
ugagucaauggaggcucagagc

SEQ ID NO: 84996 - RNA, 22 nt, Homo sapiens
ugagugugacuuagcagaagga

SEQ ID NO: 84997 - RNA, 22 nt, Homo sapiens
ugaguuaaucucuacgauagaa

SEQ ID NO: 84998 - RNA, 22 nt, Homo sapiens
ugaguucaugcuuguaguucua

SEQ ID NO: 84999 - RNA, 22 nt, Homo sapiens
ugauaugcuuugaacucucugg

SEQ ID NO: 85000 - RNA, 22 nt, Homo sapiens
ugaucucagcucacugguugaa

SEQ ID NO: 85001 - RNA, 22 nt, Homo sapiens
ugaucucauuagcaccuuuagc

SEQ ID NO: 85002 - RNA, 22 nt, Homo sapiens
ugaugguaguucagucaaugua

SEQ ID NO: 85003 - RNA, 18 nt, Homo sapiens
ugauugacuuauuuaggu

SEQ ID NO: 85004 - RNA, 19 nt, Homo sapiens
ugcaaagucuuuuccuauu

SEQ ID NO: 85005 - RNA, 22 nt, Homo sapiens
ugcaaauguuauuuugguuucu

SEQ ID NO: 85006 - RNA, 22 nt, Homo sapiens
ugcaagaaucagccuaucauua

SEQ ID NO: 85007 - RNA, 18 nt, Homo sapiens
ugcaauggagaugcagcc

SEQ ID NO: 85008 - RNA, 22 nt, Homo sapiens
ugcagugcaugacuguguuaug

SEQ ID NO: 85009 - RNA, 22 nt, Homo sapiens
ugcaguguucuuuagaggaaau

SEQ ID NO: 85010 - RNA, 22 nt, Homo sapiens
ugcauaauuccuugcaccagaa

SEQ ID NO: 85011 - RNA, 22 nt, Homo sapiens
ugcauaugcagcauuuaugauu

SEQ ID NO: 85012 - RNA, 22 nt, Homo sapiens
ugcauauucaaggcaggccauu

SEQ ID NO: 85013 - RNA, 22 nt, Homo sapiens
ugcauauucuaggauuuuguau

SEQ ID NO: 85014 - RNA, 21 nt, Homo sapiens
ugcauggagaacacugagggu

SEQ ID NO: 85015 - RNA, 22 nt, Homo sapiens
ugcauguucuuacucauacaug

SEQ ID NO: 85016 - RNA, 22 nt, Homo sapiens
ugccagaugcuggugugagggg

SEQ ID NO: 85017 - RNA, 22 nt, Homo sapiens
ugccauugcacuccagccuggg

SEQ ID NO: 85018 - RNA, 22 nt, Homo sapiens
ugcguaggcuagagugcagugg

SEQ ID NO: 85019 - RNA, 18 nt, Homo sapiens
ugcuccccugggugagca

SEQ ID NO: 85020 - RNA, 23 nt, Homo sapiens
ugcugagaccuagauccuaaaga

SEQ ID NO: 85021 - RNA, 20 nt, Homo sapiens
ugcugcacuuaagcaugggc

SEQ ID NO: 85022 - RNA, 21 nt, Homo sapiens
ugcuuacugaauguuaauuuc

SEQ ID NO: 85023 - RNA, 22 nt, Homo sapiens
ugcuuagucuugcuuuagcuau

SEQ ID NO: 85024 - RNA, 20 nt, Homo sapiens
uggaaaguaagucaugauau

SEQ ID NO: 85025 - RNA, 22 nt, Homo sapiens
uggaaaguaguucuaaucuaag

SEQ ID NO: 85026 - RNA, 22 nt, Homo sapiens
uggaacugauauugauggaaaa

SEQ ID NO: 85027 - RNA, 22 nt, Homo sapiens
uggaagcaugcaaucugugggg

SEQ ID NO: 85028 - RNA, 22 nt, Homo sapiens
uggaagccuagauucuuuucuu

SEQ ID NO: 85029 - RNA, 20 nt, Homo sapiens
uggaagccuggugcuaucuu

SEQ ID NO: 85030 - RNA, 22 nt, Homo sapiens
uggaaugggauuggaaauuuug

SEQ ID NO: 85031 - RNA, 22 nt, Homo sapiens
uggaaugguuggugugauuuua

SEQ ID NO: 85032 - RNA, 22 nt, Homo sapiens
uggacaagugcccuccaccuca

SEQ ID NO: 85033 - RNA, 21 nt, Homo sapiens
uggaccccuacuucucaccau

SEQ ID NO: 85034 - RNA, 18 nt, Homo sapiens
uggagauaagaagaacuu

SEQ ID NO: 85035 - RNA, 22 nt, Homo sapiens
uggagucgugcccuugcauuua

SEQ ID NO: 85036 - RNA, 22 nt, Homo sapiens
uggaguguaauuagccaucagu

SEQ ID NO: 85037 - RNA, 22 nt, Homo sapiens
uggauaguaauaaacauauagg

SEQ ID NO: 85038 - RNA, 19 nt, Homo sapiens
uggaugacugucugggucu

SEQ ID NO: 85039 - RNA, 22 nt, Homo sapiens
uggauggugauuggaucaugga

SEQ ID NO: 85040 - RNA, 22 nt, Homo sapiens
uggcaacaucuggggacauguu

SEQ ID NO: 85041 - RNA, 22 nt, Homo sapiens
uggcaagaccccaucucuacaa

SEQ ID NO: 85042 - RNA, 22 nt, Homo sapiens
uggcaagagcaaaauguacagu

SEQ ID NO: 85043 - RNA, 22 nt, Homo sapiens
uggcagauagaaaugugguuaa

SEQ ID NO: 85044 - RNA, 22 nt, Homo sapiens
uggcagaugagccgcgcuccaa

SEQ ID NO: 85045 - RNA, 22 nt, Homo sapiens
uggcaguuuuaugugguucaac

SEQ ID NO: 85046 - RNA, 22 nt, Homo sapiens
uggcauauaauauagaagacua

SEQ ID NO: 85047 - RNA, 22 nt, Homo sapiens
uggcaugcauuguggguaauua

SEQ ID NO: 85048 - RNA, 22 nt, Homo sapiens
uggcauggaaagcuuuucauac

SEQ ID NO: 85049 - RNA, 22 nt, Homo sapiens
uggcauguaaugcagaaguugc

SEQ ID NO: 85050 - RNA, 22 nt, Homo sapiens
uggcauguuggguguugacucc

SEQ ID NO: 85051 - RNA, 20 nt, Homo sapiens
uggcauguugguaugcaccc

SEQ ID NO: 85052 - RNA, 23 nt, Homo sapiens
uggcauuuuaguuagcuucagug

SEQ ID NO: 85053 - RNA, 23 nt, Homo sapiens
uggcauuuuuggcaaugccuucu

SEQ ID NO: 85054 - RNA, 22 nt, Homo sapiens
uggcgagaugcucgugugcaga

SEQ ID NO: 85055 - RNA, 22 nt, Homo sapiens
uggcuguuuauuucacgugggu

SEQ ID NO: 85056 - RNA, 22 nt, Homo sapiens
uggcuuuuguuauuuggaagcu

SEQ ID NO: 85057 - RNA, 22 nt, Homo sapiens
ugggagcauugcauuagaagcc

SEQ ID NO: 85058 - RNA, 22 nt, Homo sapiens
ugggauccaugugguuuaagca

SEQ ID NO: 85059 - RNA, 22 nt, Homo sapiens
ugggcggagacgugcagccgcc

SEQ ID NO: 85060 - RNA, 22 nt, Homo sapiens
ugggguagaauagaauugauau

SEQ ID NO: 85061 - RNA, 22 nt, Homo sapiens
uggguaggaccagaaaugcacu

SEQ ID NO: 85062 - RNA, 21 nt, Homo sapiens
uggguaguuuucaaggccccg

SEQ ID NO: 85063 - RNA, 19 nt, Homo sapiens
uggucaguucugggagcug

SEQ ID NO: 85064 - RNA, 22 nt, Homo sapiens
uggucaugaggugaggcuucuc

SEQ ID NO: 85065 - RNA, 22 nt, Homo sapiens
uggucauggaaauagaaugcac

SEQ ID NO: 85066 - RNA, 20 nt, Homo sapiens
ugguccccaccaaaucucau

SEQ ID NO: 85067 - RNA, 22 nt, Homo sapiens
uggucuggagagucccgcccag

SEQ ID NO: 85068 - RNA, 22 nt, Homo sapiens
uggucuucuggccuccagaacc

SEQ ID NO: 85069 - RNA, 20 nt, Homo sapiens
uggugguuuuaugugguuua

SEQ ID NO: 85070 - RNA, 22 nt, Homo sapiens
uguaaaucugguuaauuggaua

SEQ ID NO: 85071 - RNA, 22 nt, Homo sapiens
uguaacaguaguuacuauucuu

SEQ ID NO: 85072 - RNA, 22 nt, Homo sapiens
uguaagcauugggcaugcaguc

SEQ ID NO: 85073 - RNA, 22 nt, Homo sapiens
uguaauuuaaaugauccuugga

SEQ ID NO: 85074 - RNA, 22 nt, Homo sapiens
uguauacauauguauguuuugu

SEQ ID NO: 85075 - RNA, 22 nt, Homo sapiens
uguaugcuuuugagagauauuu

SEQ ID NO: 85076 - RNA, 22 nt, Homo sapiens
ugucaagaaaucaaggugugag

SEQ ID NO: 85077 - RNA, 23 nt, Homo sapiens
uuguccccuccaaagcucauguu

SEQ ID NO: 85078 - RNA, 19 nt, Homo sapiens
uuguccccucuaaaucuca

SEQ ID NO: 85079 - RNA, 22 nt, Homo sapiens
uugugaagaugugaagcaagca

SEQ ID NO: 85080 - RNA, 22 nt, Homo sapiens
uugugaucauugucaaauagug

SEQ ID NO: 85081 - RNA, 22 nt, Homo sapiens
uugugaucuucagaaaguggcu

SEQ ID NO: 85082 - RNA, 22 nt, Homo sapiens
uugugcacauguacccuagaac

SEQ ID NO: 85083 - RNA, 22 nt, Homo sapiens
uugugcuuuuuaaauagcuucc

SEQ ID NO: 85084 - RNA, 19 nt, Homo sapiens
uugugggaggacagagggg

SEQ ID NO: 85085 - RNA, 22 nt, Homo sapiens
uugugguuuuuaaaacuaggug

SEQ ID NO: 85086 - RNA, 22 nt, Homo sapiens
uuguuauguaucucaagauaaa

SEQ ID NO: 85087 - RNA, 22 nt, Homo sapiens
uuuaagccaggugcaguggcuc

SEQ ID NO: 85088 - RNA, 17 nt, Homo sapiens
uuuaaugcuaggacucu

SEQ ID NO: 85089 - RNA, 22 nt, Homo sapiens
uuuacugucuucagucccucug

SEQ ID NO: 85090 - RNA, 21 nt, Homo sapiens
uuuagguagcuuuucugggag

SEQ ID NO: 85091 - RNA, 22 nt, Homo sapiens
uuuauagucaggaacuugagga

SEQ ID NO: 85092 - RNA, 22 nt, Homo sapiens
uuuauucggcuaggagcuucgg

SEQ ID NO: 85093 - RNA, 21 nt, Homo sapiens
uuucacugugaguuuuucugu

SEQ ID NO: 85094 - RNA, 22 nt, Homo sapiens
uuucagguauuuaagggccguu

SEQ ID NO: 85095 - RNA, 22 nt, Homo sapiens
uuucauagccuuugucgucuga

SEQ ID NO: 85096 - RNA, 23 nt, Homo sapiens
uuucauggggauuuacucauucc

SEQ ID NO: 85097 - RNA, 22 nt, Homo sapiens
uuucauguuuuucugugaggca

SEQ ID NO: 85098 - RNA, 22 nt, Homo sapiens
uuucugagaccaaaacuuguaa

SEQ ID NO: 85099 - RNA, 22 nt, Homo sapiens
uuucugguuaauuucuaagagc

SEQ ID NO: 85100 - RNA, 19 nt, Homo sapiens
uuugaauauaaugcagcua

SEQ ID NO: 85101 - RNA, 22 nt, Homo sapiens
uuugaauggaaguuuugugaaa

SEQ ID NO: 85102 - RNA, 20 nt, Homo sapiens
uuugaauguaaagcauguca

SEQ ID NO: 85103 - RNA, 22 nt, Homo sapiens
uuugaauguaaugagcaggaag

SEQ ID NO: 85104 - RNA, 22 nt, Homo sapiens
uuugacuaccaggaauguucuu

SEQ ID NO: 85105 - RNA, 21 nt, Homo sapiens
uuugaucauuaaaagugaauc

SEQ ID NO: 85106 - RNA, 22 nt, Homo sapiens
uuugcauaauaagauuagggug

SEQ ID NO: 85107 - RNA, 22 nt, Homo sapiens
uuugcaugcuccuuaugagaau

SEQ ID NO: 85108 - RNA, 22 nt, Homo sapiens
uuugcugagucugacuucaugg

SEQ ID NO: 85109 - RNA, 22 nt, Homo sapiens
uuugcuuaaaguccuuguggga

SEQ ID NO: 85110 - RNA, 22 nt, Homo sapiens
uuuggaagaugccacuguauca

SEQ ID NO: 85111 - RNA, 22 nt, Homo sapiens
uuuggaaugugcacucagauug

SEQ ID NO: 85112 - RNA, 22 nt, Homo sapiens
uuuggcacuguaaauuucucuu

SEQ ID NO: 85113 - RNA, 22 nt, Homo sapiens
uuuggcagaaaacuaaaaggua

SEQ ID NO: 85114 - RNA, 22 nt, Homo sapiens
uuuggcauuagagagacuugca

SEQ ID NO: 85115 - RNA, 22 nt, Homo sapiens
uuuggcauuugaguuuguagga

SEQ ID NO: 85116 - RNA, 22 nt, Homo sapiens
uuuggcuuugagaagcagugga

SEQ ID NO: 85117 - RNA, 22 nt, Homo sapiens
uuuggcuuuuguaauaacugcc

SEQ ID NO: 85118 - RNA, 22 nt, Homo sapiens
uuugggaaaugaaguugguaga

SEQ ID NO: 85119 - RNA, 22 nt, Homo sapiens
uuuggucacugccgccgccagc

SEQ ID NO: 85120 - RNA, 22 nt, Homo sapiens
uuugguugucacaacuggggga

SEQ ID NO: 85121 - RNA, 22 nt, Homo sapiens
uuugguuuuuguuaucacucau

SEQ ID NO: 85122 - RNA, 22 nt, Homo sapiens
uuuguagcucacucugagcuga

SEQ ID NO: 85123 - RNA, 22 nt, Homo sapiens
uuugucauagcagcaggaaugg

SEQ ID NO: 85124 - RNA, 22 nt, Homo sapiens
uuugucuccuaagacucugugg

SEQ ID NO: 85125 - RNA, 22 nt, Homo sapiens
uuugugacuugcuucucagaau

SEQ ID NO: 85126 - RNA, 22 nt, Homo sapiens
uuugugcuaaugcuagauuacu

SEQ ID NO: 85127 - RNA, 22 nt, Homo sapiens
uuuguucuucguuccugagcca

SEQ ID NO: 85128 - RNA, 22 nt, Homo sapiens
uuuuacacuucgguugugugca

SEQ ID NO: 85129 - RNA, 22 nt, Homo sapiens
uuuuacagaggagguugcugau

SEQ ID NO: 85130 - RNA, 22 nt, Homo sapiens
uuuugcacuguuuuaucugaca

SEQ ID NO: 85131 - RNA, 18 nt, Homo sapiens
uuuugcuuaacugcgcca

SEQ ID NO: 85132 - RNA, 22 nt, Homo sapiens
uuuugcuuuuccucggucccac

SEQ ID NO: 85133 - RNA, 19 nt, Homo sapiens
uuuuggaaaugugaacagc

SEQ ID NO: 85134 - RNA, 22 nt, Homo sapiens
uuuuggcuuuuccucagcaagc

SEQ ID NO: 85135 - RNA, 22 nt, Homo sapiens
uuuuuauggccaauccucagaa

SEQ ID NO: 85136 - RNA, 22 nt, Homo sapiens
uuuuugaguagcuggagagcag

SEQ ID NO: 85137 - RNA, 22 nt, Homo sapiens
uuuuuggauaaugguacaugua

SEQ ID NO: 85138 - RNA, 18 nt, Homo sapiens
aaacagugucucuuucug

SEQ ID NO: 85139 - RNA, 22 nt, Homo sapiens
aaacugaucugaaggccaggcu

SEQ ID NO: 85140 - RNA, 22 nt, Homo sapiens
aaacugccuuccuuguaggugc

SEQ ID NO: 85141 - RNA, 22 nt, Homo sapiens
aaacugucuggaugcuugugga

SEQ ID NO: 85142 - RNA, 22 nt, Homo sapiens
aaagcacugaauaaauuugcuu

SEQ ID NO: 85143 - RNA, 22 nt, Homo sapiens
agcacgauggggucacgaugag

SEQ ID NO: 85144 - RNA, 22 nt, Homo sapiens
agcagagcaguggauuuuguga

SEQ ID NO: 85145 - RNA, 22 nt, Homo sapiens
agcagcgacacccuguggugag

SEQ ID NO: 85146 - RNA, 22 nt, Homo sapiens
agcagcuuugaucugaaugauu

SEQ ID NO: 85147 - RNA, 22 nt, Homo sapiens
agcagcuuugcauggccugugg

SEQ ID NO: 85148 - RNA, 22 nt, Homo sapiens
agcaucaugcaguugcuauuca

SEQ ID NO: 85149 - RNA, 20 nt, Homo sapiens
agcaucauugcaauuuguca

SEQ ID NO: 85150 - RNA, 22 nt, Homo sapiens
agccaagacucuguuccccuug

SEQ ID NO: 85151 - RNA, 19 nt, Homo sapiens
agccaguuuucccagcacc

SEQ ID NO: 85152 - RNA, 22 nt, Homo sapiens
agcgccacugcacuccagccug

SEQ ID NO: 85153 - RNA, 22 nt, Homo sapiens
agcuggcuguagcugcaagucu

SEQ ID NO: 85154 - RNA, 22 nt, Homo sapiens
agcugguauuuguuagggaguu

SEQ ID NO: 85155 - RNA, 22 nt, Homo sapiens
agcuggucuacguguguaugag

SEQ ID NO: 85156 - RNA, 22 nt, Homo sapiens
aggaagcuagcauuuguucagu

SEQ ID NO: 85157 - RNA, 22 nt, Homo sapiens
aggaauuuaauguaugauaaua

SEQ ID NO: 85158 - RNA, 18 nt, Homo sapiens
aggagcauagugcuauga

SEQ ID NO: 85159 - RNA, 21 nt, Homo sapiens
aggagcauucaugacgagguu

SEQ ID NO: 85160 - RNA, 22 nt, Homo sapiens
aggauaguaaugauagagaggc

SEQ ID NO: 85161 - RNA, 16 nt, Homo sapiens
aggcaagaauugaggu

SEQ ID NO: 85162 - RNA, 22 nt, Homo sapiens
aggcaagugauagcugcguaau

SEQ ID NO: 85163 - RNA, 22 nt, Homo sapiens
aggcagaugagguccucagcug

SEQ ID NO: 85164 - RNA, 22 nt, Homo sapiens
aggcuaagaugacuccaccccc

SEQ ID NO: 85165 - RNA, 22 nt, Homo sapiens
aggcuagacuuugagaauuuuu

SEQ ID NO: 85166 - RNA, 22 nt, Homo sapiens
aggcugguauuuacaaaagcuc

SEQ ID NO: 85167 - RNA, 22 nt, Homo sapiens
agggagcaaaguggucuuucuc

SEQ ID NO: 85168 - RNA, 21 nt, Homo sapiens
aggucaguaagaaugcagcac

SEQ ID NO: 85169 - RNA, 22 nt, Homo sapiens
aggucccauguccucccugacc

SEQ ID NO: 85170 - RNA, 22 nt, Homo sapiens
agguguuguugaggagauuuca

SEQ ID NO: 85171 - RNA, 21 nt, Homo sapiens
agguuguguuuccucuuacuu

SEQ ID NO: 85172 - RNA, 22 nt, Homo sapiens
aguaacaggauccaaagaaugu

SEQ ID NO: 85173 - RNA, 22 nt, Homo sapiens
aguacacuguugaacagaagug

SEQ ID NO: 85174 - RNA, 22 nt, Homo sapiens
agucaaaugcuuauguauaaag

SEQ ID NO: 85175 - RNA, 22 nt, Homo sapiens
agugacuagaauaugaauuuua

SEQ ID NO: 85176 - RNA, 22 nt, Homo sapiens
agugauggagccaggauuuaau

SEQ ID NO: 85177 - RNA, 22 nt, Homo sapiens
agugcaguggugccaucauaac

SEQ ID NO: 85178 - RNA, 22 nt, Homo sapiens
agugcagugguuaggagccagg

SEQ ID NO: 85179 - RNA, 22 nt, Homo sapiens
agugcaguugucacgugccuuc

SEQ ID NO: 85180 - RNA, 22 nt, Homo sapiens
agugcauuuguucugugucagg

SEQ ID NO: 85181 - RNA, 22 nt, Homo sapiens
aguggguguuccauuggauaaa

SEQ ID NO: 85182 - RNA, 22 nt, Homo sapiens
agugguuugaucacagcucacu

SEQ ID NO: 85183 - RNA, 22 nt, Homo sapiens
aguuggcacugagcugugauug

SEQ ID NO: 85184 - RNA, 22 nt, Homo sapiens
auaaaagcaggucuaggucagg

SEQ ID NO: 85185 - RNA, 22 nt, Homo sapiens
auaaacagcuuauccucuauuc

SEQ ID NO: 85186 - RNA, 22 nt, Homo sapiens
auaaaccuacauuuucacuucu

SEQ ID NO: 85187 - RNA, 19 nt, Homo sapiens
auaaacuagaacugucccc

SEQ ID NO: 85188 - RNA, 17 nt, Homo sapiens
auaaacucaucauuuuu

SEQ ID NO: 85189 - RNA, 18 nt, Homo sapiens
auaaacucaucauuuuua

SEQ ID NO: 85190 - RNA, 22 nt, Homo sapiens
auaaagacacuuggcaugauuu

SEQ ID NO: 85191 - RNA, 22 nt, Homo sapiens
auaaaugcuuccagucauuaaa

SEQ ID NO: 85192 - RNA, 22 nt, Homo sapiens
auaacauggaguuugucauuua

SEQ ID NO: 85193 - RNA, 22 nt, Homo sapiens
auaacucuguuuuuuucaugca

SEQ ID NO: 85194 - RNA, 22 nt, Homo sapiens
auaaggcugguauagacauuca

SEQ ID NO: 85195 - RNA, 22 nt, Homo sapiens
auaagguuagcucugagaaagu

SEQ ID NO: 85196 - RNA, 22 nt, Homo sapiens
auacacauuccugggccucacc

SEQ ID NO: 85197 - RNA, 22 nt, Homo sapiens
auagaucauugucauuuuagau

SEQ ID NO: 85198 - RNA, 22 nt, Homo sapiens
auagcauaucccacaugucaga

SEQ ID NO: 85199 - RNA, 22 nt, Homo sapiens
auagcaucauuucuugaaaaga

SEQ ID NO: 85200 - RNA, 22 nt, Homo sapiens
auagggcacgagaugugagccu

SEQ ID NO: 85201 - RNA, 22 nt, Homo sapiens
auagugaacuuugugagaacaa

SEQ ID NO: 85202 - RNA, 19 nt, Homo sapiens
auauaacauccaggagcag

SEQ ID NO: 85203 - RNA, 22 nt, Homo sapiens
auauagcaaugaaagagaugaa

SEQ ID NO: 85204 - RNA, 23 nt, Homo sapiens
auauaguagaugugcaguaacau

SEQ ID NO: 85205 - RNA, 22 nt, Homo sapiens
auaucaacaugguaggguuggu

SEQ ID NO: 85206 - RNA, 22 nt, Homo sapiens
auugaguaaaugaaaauugccu

SEQ ID NO: 85207 - RNA, 22 nt, Homo sapiens
auugaguaacaauuuuguucaa

SEQ ID NO: 85208 - RNA, 22 nt, Homo sapiens
auugcaaagcguagacucuaaa

SEQ ID NO: 85209 - RNA, 22 nt, Homo sapiens
auugcacuccacccugggcaac

SEQ ID NO: 85210 - RNA, 23 nt, Homo sapiens
auugcacuccagccuaccugggc

SEQ ID NO: 85211 - RNA, 22 nt, Homo sapiens
auugcacuccagccuggcaaua

SEQ ID NO: 85212 - RNA, 21 nt, Homo sapiens
auugcacuccagccugggcga

SEQ ID NO: 85213 - RNA, 22 nt, Homo sapiens
auugcacuccagccugggcuag

SEQ ID NO: 85214 - RNA, 22 nt, Homo sapiens
auugcacuccagccugggugac

SEQ ID NO: 85215 - RNA, 22 nt, Homo sapiens
auugcacuccagccuugggcaa

SEQ ID NO: 85216 - RNA, 22 nt, Homo sapiens
auugcacuccagccuugugaca

SEQ ID NO: 85217 - RNA, 22 nt, Homo sapiens
auugcagcccacccugggugau

SEQ ID NO: 85218 - RNA, 19 nt, Homo sapiens
auugcaguguaaaacuauu

SEQ ID NO: 85219 - RNA, 22 nt, Homo sapiens
auugcccaggcuggagugcagu

SEQ ID NO: 85220 - RNA, 22 nt, Homo sapiens
auugcugagacauugcuaaucu

SEQ ID NO: 85221 - RNA, 22 nt, Homo sapiens
auuggucuugaaaccagagaga

SEQ ID NO: 85222 - RNA, 22 nt, Homo sapiens
auuggugaccugcggcaguaug

SEQ ID NO: 85223 - RNA, 22 nt, Homo sapiens
auuguacugccccccuguugcu

SEQ ID NO: 85224 - RNA, 22 nt, Homo sapiens
auuuggcaguauaaugcuuugg

SEQ ID NO: 85225 - RNA, 21 nt, Homo sapiens
auuuuugcagagcugguagug

SEQ ID NO: 85226 - RNA, 22 nt, Homo sapiens
auuuuuggauauagggaaggau

SEQ ID NO: 85227 - RNA, 22 nt, Homo sapiens
caaagcacuuggcuuggaagau

SEQ ID NO: 85228 - RNA, 22 nt, Homo sapiens
caaagcuauagcaccagaggga

SEQ ID NO: 85229 - RNA, 22 nt, Homo sapiens
caaaguaauuacgguuuuggcc

SEQ ID NO: 85230 - RNA, 22 nt, Homo sapiens
caaagucuucaguugauucuga

SEQ ID NO: 85231 - RNA, 22 nt, Homo sapiens
caaauugcuuguggaggauaau

SEQ ID NO: 85232 - RNA, 22 nt, Homo sapiens
caagaggcuguguauaaagcca

SEQ ID NO: 85233 - RNA, 19 nt, Homo sapiens
caauacuucuuggcauaca

SEQ ID NO: 85234 - RNA, 22 nt, Homo sapiens
uaggaaugaacgauuuauuggu

SEQ ID NO: 85235 - RNA, 22 nt, Homo sapiens
uaggcuuuucugggaugugggc

SEQ ID NO: 85236 - RNA, 22 nt, Homo sapiens
uaggggcacacuucgguuagca

SEQ ID NO: 85237 - RNA, 22 nt, Homo sapiens
uagguaucuugguauaucagga

SEQ ID NO: 85238 - RNA, 22 nt, Homo sapiens
uaggucuuuuaugaaauauauu

SEQ ID NO: 85239 - RNA, 22 nt, Homo sapiens
uagguucuccacagguucucca

SEQ ID NO: 85240 - RNA, 22 nt, Homo sapiens
uaguaggacaggauuucaguua

SEQ ID NO: 85241 - RNA, 22 nt, Homo sapiens
uagugcaguggcuccaucucag

SEQ ID NO: 85242 - RNA, 22 nt, Homo sapiens
uauacaugugggcaucaggaga

SEQ ID NO: 85243 - RNA, 22 nt, Homo sapiens
uauagcacugcaauauuucccu

SEQ ID NO: 85244 - RNA, 22 nt, Homo sapiens
uauaguuuuuccugggaggaaa

SEQ ID NO: 85245 - RNA, 22 nt, Homo sapiens
uauaucuagagcggaccaggcu

SEQ ID NO: 85246 - RNA, 23 nt, Homo sapiens
uauaugugucuaggagcuauggu

SEQ ID NO: 85247 - RNA, 22 nt, Homo sapiens
uaucacacgccuugcuucauuu

SEQ ID NO: 85248 - RNA, 22 nt, Homo sapiens
uaucacacuggaagaaguuaag

SEQ ID NO: 85249 - RNA, 22 nt, Homo sapiens
uaucacacuguuggauuugauu

SEQ ID NO: 85250 - RNA, 19 nt, Homo sapiens
uaucacuucccuggaaaca

SEQ ID NO: 85251 - RNA, 22 nt, Homo sapiens
uaucauaguuuggacuuucauu

SEQ ID NO: 85252 - RNA, 22 nt, Homo sapiens
uaucaucauuggcaggugagaa

SEQ ID NO: 85253 - RNA, 22 nt, Homo sapiens
uaucucagaguguacaagauua

SEQ ID NO: 85254 - RNA, 22 nt, Homo sapiens
uaugaccuuguccccucucgcc

SEQ ID NO: 85255 - RNA, 22 nt, Homo sapiens
uaugacuuuggaaaaauuacuu

SEQ ID NO: 85256 - RNA, 19 nt, Homo sapiens
uaugcuauuuauuagaagu

SEQ ID NO: 85257 - RNA, 22 nt, Homo sapiens
uauggcauuauuuugauagaca

SEQ ID NO: 85258 - RNA, 22 nt, Homo sapiens
uauggcauuguuggugaugaua

SEQ ID NO: 85259 - RNA, 22 nt, Homo sapiens
uauggccccuacaugugcaaaa

SEQ ID NO: 85260 - RNA, 22 nt, Homo sapiens
uauguuaucaaaaagcuaagga

SEQ ID NO: 85261 - RNA, 22 nt, Homo sapiens
uauuacuugucugugucucaau

SEQ ID NO: 85262 - RNA, 22 nt, Homo sapiens
uauuagguuggggcaaaaguaa

SEQ ID NO: 85263 - RNA, 22 nt, Homo sapiens
uauuauuguccuucuauaccca

SEQ ID NO: 85264 - RNA, 22 nt, Homo sapiens
uauuccacucuguuggagguaa

SEQ ID NO: 85265 - RNA, 22 nt, Homo sapiens
uauugacauuacagugggucuu

SEQ ID NO: 85266 - RNA, 22 nt, Homo sapiens
uauugauuuucaguguucagcu

SEQ ID NO: 85267 - RNA, 22 nt, Homo sapiens
uauugcacuccagccuuggcaa

SEQ ID NO: 85268 - RNA, 22 nt, Homo sapiens
uauugcuggcacauaguagguc

SEQ ID NO: 85269 - RNA, 22 nt, Homo sapiens
uauugcuugaggaaaugguaau

SEQ ID NO: 85270 - RNA, 22 nt, Homo sapiens
uauugucaccaucccuguuuua

SEQ ID NO: 85271 - RNA, 22 nt, Homo sapiens
uauugucacuaaaggaagcugg

SEQ ID NO: 85272 - RNA, 22 nt, Homo sapiens
uauuguuuuucccaggagucua

SEQ ID NO: 85273 - RNA, 22 nt, Homo sapiens
uauuugguuacuugaauagcua

SEQ ID NO: 85274 - RNA, 22 nt, Homo sapiens
ucaaagacacacaaggagaagg

SEQ ID NO: 85275 - RNA, 22 nt, Homo sapiens
ucaaagucuucucaaguaacau

SEQ ID NO: 85276 - RNA, 22 nt, Homo sapiens
ucaaagugcuauggcucagguu

SEQ ID NO: 85277 - RNA, 22 nt, Homo sapiens
ucaaaugauucacccaccuuug

SEQ ID NO: 85278 - RNA, 22 nt, Homo sapiens
ucaaaugcacguagagaaaaua

SEQ ID NO: 85279 - RNA, 22 nt, Homo sapiens
ucaaauguuuguuuaaggcuua

SEQ ID NO: 85280 - RNA, 22 nt, Homo sapiens
ucaacagugauggaaaguuaua

SEQ ID NO: 85281 - RNA, 21 nt, Homo sapiens
ucaacccuugcgucaccaagc

SEQ ID NO: 85282 - RNA, 22 nt, Homo sapiens
ucaaggcaguggccuuccuucu

SEQ ID NO: 85283 - RNA, 22 nt, Homo sapiens
ucacaauucacuacaggcuuga

SEQ ID NO: 85284 - RNA, 21 nt, Homo sapiens
ucacagccuaggaccugaaga

SEQ ID NO: 85285 - RNA, 22 nt, Homo sapiens
ucacagcuaaaaugaaaguagu

SEQ ID NO: 85286 - RNA, 22 nt, Homo sapiens
ucacaguagcaaauguuagaaa

SEQ ID NO: 85287 - RNA, 22 nt, Homo sapiens
ucacaguauucaugaacaugga

SEQ ID NO: 85288 - RNA, 23 nt, Homo sapiens
ucacaguggcugcuuaauuguga

SEQ ID NO: 85289 - RNA, 22 nt, Homo sapiens
ucacaguucagcauggcugagg

SEQ ID NO: 85290 - RNA, 22 nt, Homo sapiens
ucacaugaauugucuuguucca

SEQ ID NO: 85291 - RNA, 22 nt, Homo sapiens
ucacaugugacauauauauuug

SEQ ID NO: 85292 - RNA, 22 nt, Homo sapiens
ucacauguguaugagcuuugau

SEQ ID NO: 85293 - RNA, 22 nt, Homo sapiens
ucacauucaauuguaauccccg

SEQ ID NO: 85294 - RNA, 20 nt, Homo sapiens
ucacccugacaucugcccag

SEQ ID NO: 85295 - RNA, 22 nt, Homo sapiens
ucaccggcagacguggccugau

SEQ ID NO: 85296 - RNA, 22 nt, Homo sapiens
ucacgugguucauaaggcagaa

SEQ ID NO: 85297 - RNA, 22 nt, Homo sapiens
ucacugaaaccacugccuccug

SEQ ID NO: 85298 - RNA, 22 nt, Homo sapiens
ucacugaaaccgccuccaccuc

SEQ ID NO: 85299 - RNA, 22 nt, Homo sapiens
ucacugagaaugauguuucuga

SEQ ID NO: 85300 - RNA, 22 nt, Homo sapiens
ucacugcgaccuccaccucccg

SEQ ID NO: 85301 - RNA, 22 nt, Homo sapiens
ucacugggagaccaaagccauc

SEQ ID NO: 85302 - RNA, 22 nt, Homo sapiens
ucauucuuucuguggaggggcu

SEQ ID NO: 85303 - RNA, 22 nt, Homo sapiens
ucauugcacuccagccugggug

SEQ ID NO: 85304 - RNA, 22 nt, Homo sapiens
ucauuggauggaaugcucugua

SEQ ID NO: 85305 - RNA, 22 nt, Homo sapiens
uccacaauggcugaacuagauu

SEQ ID NO: 85306 - RNA, 22 nt, Homo sapiens
uccacaguaaggacccugccuu

SEQ ID NO: 85307 - RNA, 18 nt, Homo sapiens
uccacgugcuuuccagau

SEQ ID NO: 85308 - RNA, 21 nt, Homo sapiens
uccagcuuugagaguuguggu

SEQ ID NO: 85309 - RNA, 22 nt, Homo sapiens
uccaguguuauaauaugcgucu

SEQ ID NO: 85310 - RNA, 22 nt, Homo sapiens
uccaugaggcuacaguaaucuc

SEQ ID NO: 85311 - RNA, 22 nt, Homo sapiens
uccaugaguccauuagaaaaaa

SEQ ID NO: 85312 - RNA, 22 nt, Homo sapiens
uccaugugaaaaggucgugaua

SEQ ID NO: 85313 - RNA, 19 nt, Homo sapiens
ucccaagaugcucauacau

SEQ ID NO: 85314 - RNA, 22 nt, Homo sapiens
ucccagaaacgcauauguucau

SEQ ID NO: 85315 - RNA, 22 nt, Homo sapiens
ucccaguguguagcuugucucu

SEQ ID NO: 85316 - RNA, 22 nt, Homo sapiens
uccccugagaacuugcuagaaa

SEQ ID NO: 85317 - RNA, 22 nt, Homo sapiens
ucccugaaaauuagcauuuuaa

SEQ ID NO: 85318 - RNA, 22 nt, Homo sapiens
ucccugaacacauguugagaag

SEQ ID NO: 85319 - RNA, 22 nt, Homo sapiens
ucccugaagcugcagcaacaca

SEQ ID NO: 85320 - RNA, 22 nt, Homo sapiens
ucccuguguuccuuuugaauug

SEQ ID NO: 85321 - RNA, 19 nt, Homo sapiens
ucccuuuguauggacauac

SEQ ID NO: 85322 - RNA, 22 nt, Homo sapiens
uccuacaugcaguacauucaaa

SEQ ID NO: 85323 - RNA, 22 nt, Homo sapiens
uccugagaauagaguugcaugu

SEQ ID NO: 85324 - RNA, 22 nt, Homo sapiens
uccugagacucacaggcucccc

SEQ ID NO: 85325 - RNA, 22 nt, Homo sapiens
uccugagacugaggagcuuugg

SEQ ID NO: 85326 - RNA, 21 nt, Homo sapiens
uccugagagaggaguaacucu

SEQ ID NO: 85327 - RNA, 22 nt, Homo sapiens
uccuggcuccacuguuuauucc

SEQ ID NO: 85328 - RNA, 22 nt, Homo sapiens
uccuugguugauccugugcaga

SEQ ID NO: 85329 - RNA, 22 nt, Homo sapiens
ucgguauuuuagaauugagacu

SEQ ID NO: 85330 - RNA, 22 nt, Homo sapiens
ucuacccugugagggacacagu

SEQ ID NO: 85331 - RNA, 22 nt, Homo sapiens
ucuagccuaugaagcuugucca

SEQ ID NO: 85332 - RNA, 22 nt, Homo sapiens
ucuauggaguuugaaugagaaa

SEQ ID NO: 85333 - RNA, 22 nt, Homo sapiens
ucucaaguaacugggacaauaa

SEQ ID NO: 85334 - RNA, 22 nt, Homo sapiens
ucucaauuugauuacauucaua

SEQ ID NO: 85335 - RNA, 22 nt, Homo sapiens
ucucagugaaauaaauuauuuu

SEQ ID NO: 85336 - RNA, 22 nt, Homo sapiens
ucucagugaauugguuuugucu

SEQ ID NO: 85337 - RNA, 20 nt, Homo sapiens
ucucauagagguagagaaua

SEQ ID NO: 85338 - RNA, 21 nt, Homo sapiens
ucucauagaguuucacuuucu

SEQ ID NO: 85339 - RNA, 22 nt, Homo sapiens
ucucaugaagauagagaauaga

SEQ ID NO: 85340 - RNA, 21 nt, Homo sapiens
ucucauuacugaugagccaga

SEQ ID NO: 85341 - RNA, 21 nt, Homo sapiens
ucucucaaccaggaagugggc

SEQ ID NO: 85342 - RNA, 22 nt, Homo sapiens
ucucuuggcggaaguugcagug

SEQ ID NO: 85343 - RNA, 22 nt, Homo sapiens
ucucuuggugacuuaaaauguu

SEQ ID NO: 85344 - RNA, 22 nt, Homo sapiens
ucugacucuggagucucagguu

SEQ ID NO: 85345 - RNA, 22 nt, Homo sapiens
ucugagguuaaauuuuauaguu

SEQ ID NO: 85346 - RNA, 21 nt, Homo sapiens
ucugagucauucaguggccug

SEQ ID NO: 85347 - RNA, 23 nt, Homo sapiens
ucugcggguguggacccuagugc

SEQ ID NO: 85348 - RNA, 23 nt, Homo sapiens
ucuggaucauucguagugccagc

SEQ ID NO: 85349 - RNA, 22 nt, Homo sapiens
ucuggauuuuugaggcaauaua

SEQ ID NO: 85350 - RNA, 22 nt, Homo sapiens
ucuggcaagauauccauugcuu

SEQ ID NO: 85351 - RNA, 22 nt, Homo sapiens
ucuggcuccaaagucuauuuuu

SEQ ID NO: 85352 - RNA, 22 nt, Homo sapiens
ucuggcuuauuucacuuagcau

SEQ ID NO: 85353 - RNA, 22 nt, Homo sapiens
ucugugcauggcagaggaauga

SEQ ID NO: 85354 - RNA, 22 nt, Homo sapiens
ucuuggccaugaauggcaaggc

SEQ ID NO: 85355 - RNA, 22 nt, Homo sapiens
ucuugggugaguuugugaauaa

SEQ ID NO: 85356 - RNA, 22 nt, Homo sapiens
ucuugguuuauugugguaugaa

SEQ ID NO: 85357 - RNA, 17 nt, Homo sapiens
ucuugugguucuugaau

SEQ ID NO: 85358 - RNA, 22 nt, Homo sapiens
ucuuucacuuagcaugauguuu

SEQ ID NO: 85359 - RNA, 19 nt, Homo sapiens
ucuuugaggcaucgcccuc

SEQ ID NO: 85360 - RNA, 22 nt, Homo sapiens
ucuuugauguucugaaagaugg

SEQ ID NO: 85361 - RNA, 22 nt, Homo sapiens
ucuuuggauggaaauuggaguc

SEQ ID NO: 85362 - RNA, 21 nt, Homo sapiens
ucuuuggucaccaguuuucau

SEQ ID NO: 85363 - RNA, 22 nt, Homo sapiens
ucuuugguuguuuagggugcau

SEQ ID NO: 85364 - RNA, 22 nt, Homo sapiens
ucuuugguuucugucucuguaa

SEQ ID NO: 85365 - RNA, 22 nt, Homo sapiens
ucuuugucuacauccuguuaaa

SEQ ID NO: 85366 - RNA, 20 nt, Homo sapiens
ugaaacacauggacuggggu

SEQ ID NO: 85367 - RNA, 22 nt, Homo sapiens
ugaaaucuaaaauguuccaaga

SEQ ID NO: 85368 - RNA, 22 nt, Homo sapiens
ugaaguagguucucguaucgcc

SEQ ID NO: 85369 - RNA, 21 nt, Homo sapiens
ugaauauuuggguugugucca

SEQ ID NO: 85370 - RNA, 22 nt, Homo sapiens
ugaauguuguugguugagauau

SEQ ID NO: 85371 - RNA, 22 nt, Homo sapiens
ugacaagauauggucuuaucaa

SEQ ID NO: 85372 - RNA, 22 nt, Homo sapiens
ugacacagugggggauccuuuu

SEQ ID NO: 85373 - RNA, 22 nt, Homo sapiens
ugacagagaagcauugaguuca

SEQ ID NO: 85374 - RNA, 22 nt, Homo sapiens
ugacaguuuccagggcugucuc

SEQ ID NO: 85375 - RNA, 18 nt, Homo sapiens
ugacaguuucuuuauauu

SEQ ID NO: 85376 - RNA, 22 nt, Homo sapiens
ugacaugaagaaaaacagauuu

SEQ ID NO: 85377 - RNA, 22 nt, Homo sapiens
ugacauggaagauguucaugau

SEQ ID NO: 85378 - RNA, 22 nt, Homo sapiens
ugacauggaaguagguauacau

SEQ ID NO: 85379 - RNA, 22 nt, Homo sapiens
ugacauggagguggaggaagau

SEQ ID NO: 85380 - RNA, 22 nt, Homo sapiens
ugacauuacagucacuugcugu

SEQ ID NO: 85381 - RNA, 22 nt, Homo sapiens
ugaccuguuugaaauugccaau

SEQ ID NO: 85382 - RNA, 22 nt, Homo sapiens
ugacuaaggaaggauuaugugc

SEQ ID NO: 85383 - RNA, 22 nt, Homo sapiens
ugacuaggggcccuggcuucuu

SEQ ID NO: 85384 - RNA, 22 nt, Homo sapiens
ugacuauugauuuagacgugcu

SEQ ID NO: 85385 - RNA, 23 nt, Homo sapiens
ugacuggagacuguugauccuuu

SEQ ID NO: 85386 - RNA, 22 nt, Homo sapiens
ugacugguguuuaaugagucaa

SEQ ID NO: 85387 - RNA, 22 nt, Homo sapiens
ugacuugaucauuacacauucu

SEQ ID NO: 85388 - RNA, 20 nt, Homo sapiens
ugagaacauguggcauuugg

SEQ ID NO: 85389 - RNA, 22 nt, Homo sapiens
ugagaacggauacuaagggcug

SEQ ID NO: 85390 - RNA, 22 nt, Homo sapiens
ugagaacuuugucuuuuacucu

SEQ ID NO: 85391 - RNA, 22 nt, Homo sapiens
ugagaagacaucuuugcuuugu

SEQ ID NO: 85392 - RNA, 22 nt, Homo sapiens
ugagaagugacgcagcaggguu

SEQ ID NO: 85393 - RNA, 22 nt, Homo sapiens
ugagaauauuugaagauguuag

SEQ ID NO: 85394 - RNA, 22 nt, Homo sapiens
ugagaaugaugauuuccaguuu

SEQ ID NO: 85395 - RNA, 22 nt, Homo sapiens
ugagacaaucucaucucaguga

SEQ ID NO: 85396 - RNA, 22 nt, Homo sapiens
ugagacaugugaacuguaguuc

SEQ ID NO: 85397 - RNA, 22 nt, Homo sapiens
ugagacggagucucacucuguu

SEQ ID NO: 85398 - RNA, 21 nt, Homo sapiens
uggauuguacacccuaucauu

SEQ ID NO: 85399 - RNA, 22 nt, Homo sapiens
uggauuguuucucuugguauga

SEQ ID NO: 85400 - RNA, 22 nt, Homo sapiens
uggcaaaauggaauauguuggg

SEQ ID NO: 85401 - RNA, 21 nt, Homo sapiens
uggcaacauggauggauucug

SEQ ID NO: 85402 - RNA, 22 nt, Homo sapiens
uggcaagaacgaaauguagggu

SEQ ID NO: 85403 - RNA, 22 nt, Homo sapiens
uggcaagagaacaacaucucuc

SEQ ID NO: 85404 - RNA, 22 nt, Homo sapiens
uggcaagauuguuccgguuugg

SEQ ID NO: 85405 - RNA, 18 nt, Homo sapiens
uggcaagugccauacggu

SEQ ID NO: 85406 - RNA, 19 nt, Homo sapiens
uggcaaugucagcagagau

SEQ ID NO: 85407 - RNA, 20 nt, Homo sapiens
uggcaccugacagauagcca

SEQ ID NO: 85408 - RNA, 22 nt, Homo sapiens
uggcagaugggugagcuggaga

SEQ ID NO: 85409 - RNA, 22 nt, Homo sapiens
uggcagauggugacaccauuag

SEQ ID NO: 85410 - RNA, 22 nt, Homo sapiens
uggcagcgugaauguggcugaa

SEQ ID NO: 85411 - RNA, 22 nt, Homo sapiens
uggcaguuuacagcuuuaggag

SEQ ID NO: 85412 - RNA, 22 nt, Homo sapiens
uggcaguuuuugccuucaauac

SEQ ID NO: 85413 - RNA, 20 nt, Homo sapiens
uggcaugaaauuuuccaagc

SEQ ID NO: 85414 - RNA, 22 nt, Homo sapiens
uggcaugaagaccccauccuuu

SEQ ID NO: 85415 - RNA, 22 nt, Homo sapiens
uggcaugauguguucauugaaa

SEQ ID NO: 85416 - RNA, 22 nt, Homo sapiens
uggcaugucagguuucuggguu

SEQ ID NO: 85417 - RNA, 22 nt, Homo sapiens
uggcauguguuugaaugaguau

SEQ ID NO: 85418 - RNA, 22 nt, Homo sapiens
uggcauuuucucuguucuuaga

SEQ ID NO: 85419 - RNA, 22 nt, Homo sapiens
uggcauuuuguuuuagaauuag

SEQ ID NO: 85420 - RNA, 22 nt, Homo sapiens
uggccaagagcacagauauugg

SEQ ID NO: 85421 - RNA, 23 nt, Homo sapiens
uggccaagauaaucucaguuuuc

SEQ ID NO: 85422 - RNA, 19 nt, Homo sapiens
uggcuagaggccaggcguu

SEQ ID NO: 85423 - RNA, 22 nt, Homo sapiens
uggcuuuuauuauguugaggua

SEQ ID NO: 85424 - RNA, 22 nt, Homo sapiens
ugggaagagggagcgauuuugg

SEQ ID NO: 85425 - RNA, 22 nt, Homo sapiens
ugggaugaugcuugagaauauc

SEQ ID NO: 85426 - RNA, 22 nt, Homo sapiens
uggggcuuuuucuuguauucuc

SEQ ID NO: 85427 - RNA, 22 nt, Homo sapiens
uggguagagcacugggggcgag

SEQ ID NO: 85428 - RNA, 22 nt, Homo sapiens
ugguaaaaugucauuuaccaga

SEQ ID NO: 85429 - RNA, 22 nt, Homo sapiens
ugguaagaucugugagccaggc

SEQ ID NO: 85430 - RNA, 20 nt, Homo sapiens
ugguaauguaagagaggaga

SEQ ID NO: 85431 - RNA, 17 nt, Homo sapiens
ugguagguuuuucuggc

SEQ ID NO: 85432 - RNA, 22 nt, Homo sapiens
uggucaguugugccucaauucc

SEQ ID NO: 85433 - RNA, 21 nt, Homo sapiens
uggucccauaagauuacaaug

SEQ ID NO: 85434 - RNA, 22 nt, Homo sapiens
uggucccaugaacuuuagguca

SEQ ID NO: 85435 - RNA, 22 nt, Homo sapiens
uggugagaaacuagauauuuuu

SEQ ID NO: 85436 - RNA, 22 nt, Homo sapiens
uguaaacauguauguguuuaug

SEQ ID NO: 85437 - RNA, 22 nt, Homo sapiens
uguaaacucaguauguuuuacu

SEQ ID NO: 85438 - RNA, 20 nt, Homo sapiens
uguaacaaucuggauguugc

SEQ ID NO: 85439 - RNA, 22 nt, Homo sapiens
ugucaacauuuaucaaguuauu

SEQ ID NO: 85440 - RNA, 22 nt, Homo sapiens
ugucaucauuugagagaagaaa

SEQ ID NO: 85441 - RNA, 22 nt, Homo sapiens
ugucaugagucuccuccaucuu

SEQ ID NO: 85442 - RNA, 22 nt, Homo sapiens
ugucauggucacaggcauuuca

SEQ ID NO: 85443 - RNA, 22 nt, Homo sapiens
ugucuaaagaauggcagacuca

SEQ ID NO: 85444 - RNA, 22 nt, Homo sapiens
ugucuagaaaagccugccuucu

SEQ ID NO: 85445 - RNA, 22 nt, Homo sapiens
ugucucccuucccauuaggaag

SEQ ID NO: 85446 - RNA, 22 nt, Homo sapiens
ugucuggaaggguggccuccug

SEQ ID NO: 85447 - RNA, 19 nt, Homo sapiens
ugugaagaaaugcugcaag

SEQ ID NO: 85448 - RNA, 22 nt, Homo sapiens
ugugaauggugcugcaaugaac

SEQ ID NO: 85449 - RNA, 22 nt, Homo sapiens
ugugaauggugcuuccuagaug

SEQ ID NO: 85450 - RNA, 22 nt, Homo sapiens
ugugacacugaauggcagaacu

SEQ ID NO: 85451 - RNA, 22 nt, Homo sapiens
ugugacagcacagcaucucuuu

SEQ ID NO: 85452 - RNA, 19 nt, Homo sapiens
ugugacugguugucucgcu

SEQ ID NO: 85453 - RNA, 22 nt, Homo sapiens
ugugcacaugauauaucacaua

SEQ ID NO: 85454 - RNA, 22 nt, Homo sapiens
ugugccacugcacucuggccug

SEQ ID NO: 85455 - RNA, 22 nt, Homo sapiens
ugugccacugcacuucagccug

SEQ ID NO: 85456 - RNA, 22 nt, Homo sapiens
ugugccacuguucuguaaagug

SEQ ID NO: 85457 - RNA, 22 nt, Homo sapiens
uguggccccuagcuacuagaga

SEQ ID NO: 85458 - RNA, 22 nt, Homo sapiens
ugugguagugcuuaccugcagu

SEQ ID NO: 85459 - RNA, 22 nt, Homo sapiens
uguguaaauauauacacacgug

SEQ ID NO: 85460 - RNA, 22 nt, Homo sapiens
uguguaauacucuaaugaugca

SEQ ID NO: 85461 - RNA, 22 nt, Homo sapiens
uguguacaucucuacacacaug

SEQ ID NO: 85462 - RNA, 22 nt, Homo sapiens
uguuaacauggucucagucugu

SEQ ID NO: 85463 - RNA, 22 nt, Homo sapiens
uguucuggagaggcaggccaca

SEQ ID NO: 85464 - RNA, 22 nt, Homo sapiens
uguuugcuguguggaguagcag

SEQ ID NO: 85465 - RNA, 22 nt, Homo sapiens
uguuugcuguuuucuccaauga

SEQ ID NO: 85466 - RNA, 22 nt, Homo sapiens
uuaaaaguauaggccuggcaua

SEQ ID NO: 85467 - RNA, 22 nt, Homo sapiens
uuaaauacagcaugguguuucu

SEQ ID NO: 85468 - RNA, 20 nt, Homo sapiens
uuaaaucuagugcagacuca

SEQ ID NO: 85469 - RNA, 22 nt, Homo sapiens
uuaaaugcacauacuugagaaa

SEQ ID NO: 85470 - RNA, 22 nt, Homo sapiens
uuaagcugaauuuaagcuucgg

SEQ ID NO: 85471 - RNA, 22 nt, Homo sapiens
uuaaggaguagugucugguauu

SEQ ID NO: 85472 - RNA, 22 nt, Homo sapiens
uuaaugaacuuuauuuuguaga

SEQ ID NO: 85473 - RNA, 22 nt, Homo sapiens
uuacaacugucuuacugguuau

SEQ ID NO: 85474 - RNA, 21 nt, Homo sapiens
uuacaauggcuccuugaaggu

SEQ ID NO: 85475 - RNA, 22 nt, Homo sapiens
uuacagguggagaaguaaggcu

SEQ ID NO: 85476 - RNA, 22 nt, Homo sapiens
uuacaugucuugguaagguuag

SEQ ID NO: 85477 - RNA, 22 nt, Homo sapiens
uuacauugcuucaaauucagug

SEQ ID NO: 85478 - RNA, 22 nt, Homo sapiens
uuacuauguuucaaagugucuc

SEQ ID NO: 85479 - RNA, 22 nt, Homo sapiens
uuagauguuuagaagugggcca

SEQ ID NO: 85480 - RNA, 22 nt, Homo sapiens
uuagcacugagaauggcuugcu

SEQ ID NO: 85481 - RNA, 22 nt, Homo sapiens
uuagcacugucuacucuggauu

SEQ ID NO: 85482 - RNA, 22 nt, Homo sapiens
uuagcaugucuacuaauuugcu

SEQ ID NO: 85483 - RNA, 22 nt, Homo sapiens
uuagggcaggcaugagagaacu

SEQ ID NO: 85484 - RNA, 23 nt, Homo sapiens
uuaguaaacucaaugacaccaca

SEQ ID NO: 85485 - RNA, 22 nt, Homo sapiens
uuaguaucauccuucugcauuc

SEQ ID NO: 85486 - RNA, 22 nt, Homo sapiens
uuaguuuaucagugguuucuga

SEQ ID NO: 85487 - RNA, 22 nt, Homo sapiens
uuauaacagagacuccugugcu

SEQ ID NO: 85488 - RNA, 22 nt, Homo sapiens
uuauauguuacucccucuagca

SEQ ID NO: 85489 - RNA, 22 nt, Homo sapiens
uuaugcuuauugguguacggua

SEQ ID NO: 85490 - RNA, 22 nt, Homo sapiens
uuaugcuugugugaauuuuccc

SEQ ID NO: 85491 - RNA, 22 nt, Homo sapiens
uuaugguuuuuagcagaguaau

SEQ ID NO: 85492 - RNA, 17 nt, Homo sapiens
uuaugagacuucuuagc

SEQ ID NO: 85493 - RNA, 22 nt, Homo sapiens
uuauggcuauugaugacaauug

SEQ ID NO: 85494 - RNA, 22 nt, Homo sapiens
uuaugucauuuuuggauguuaa

SEQ ID NO: 85495 - RNA, 22 nt, Homo sapiens
uuauguguuuaauguuucugaa

SEQ ID NO: 85496 - RNA, 22 nt, Homo sapiens
uuauucauuaauugcuaagguu

SEQ ID NO: 85497 - RNA, 17 nt, Homo sapiens
uuauugcuauaagcuga

SEQ ID NO: 85498 - RNA, 22 nt, Homo sapiens
uucaaaucuuuggcucccacua

SEQ ID NO: 85499 - RNA, 22 nt, Homo sapiens
uucaagcugggcaaauaagggg

SEQ ID NO: 85500 - RNA, 22 nt, Homo sapiens
uucaaggacuaaggauuuuugg

SEQ ID NO: 85501 - RNA, 20 nt, Homo sapiens
uucaagugauucucaugccu

SEQ ID NO: 85502 - RNA, 22 nt, Homo sapiens
uucacacuagccacucugguag

SEQ ID NO: 85503 - RNA, 22 nt, Homo sapiens
uucacaguguuucucacgguua

SEQ ID NO: 85504 - RNA, 22 nt, Homo sapiens
uucaccagggaagucucaacuc

SEQ ID NO: 85505 - RNA, 22 nt, Homo sapiens
uucaccaguuuugucacgaaug

SEQ ID NO: 85506 - RNA, 21 nt, Homo sapiens
uucaccauggcuccacacucu

SEQ ID NO: 85507 - RNA, 22 nt, Homo sapiens
uucaccuggaguucaggauaag

SEQ ID NO: 85508 - RNA, 22 nt, Homo sapiens
uucacugcacuccagccugagc

SEQ ID NO: 85509 - RNA, 21 nt, Homo sapiens
uucacuggucuauuucccuuu

SEQ ID NO: 85510 - RNA, 22 nt, Homo sapiens
uucacugugaacucauauucag

SEQ ID NO: 85511 - RNA, 22 nt, Homo sapiens
uucacuguuaagcaguuaaacu

SEQ ID NO: 85512 - RNA, 20 nt, Homo sapiens
uucagcaaaggaaugggagu

SEQ ID NO: 85513 - RNA, 22 nt, Homo sapiens
uucagcaggccaggcccugacu

SEQ ID NO: 85514 - RNA, 22 nt, Homo sapiens
uucagcaguggccaguggaaau

SEQ ID NO: 85515 - RNA, 22 nt, Homo sapiens
uucaggcaccauggucauugau

SEQ ID NO: 85516 - RNA, 22 nt, Homo sapiens
uucaguagucaaaagauaaggg

SEQ ID NO: 85517 - RNA, 22 nt, Homo sapiens
uucaguagucuccauagaaccg

SEQ ID NO: 85518 - RNA, 22 nt, Homo sapiens
uucagugucauuaacacaguag

SEQ ID NO: 85519 - RNA, 22 nt, Homo sapiens
uucauaguaacaguaacuaugg

SEQ ID NO: 85520 - RNA, 21 nt, Homo sapiens
uucaucagccagaaaucaagc

SEQ ID NO: 85521 - RNA, 22 nt, Homo sapiens
uucauccccuccaaaucucaug

SEQ ID NO: 85522 - RNA, 22 nt, Homo sapiens
uucaugucuuggcuguuagagu

SEQ ID NO: 85523 - RNA, 22 nt, Homo sapiens
uuccaagugggaaacaaaaaug

SEQ ID NO: 85524 - RNA, 22 nt, Homo sapiens
uuccacaauggcugaacuaguu

SEQ ID NO: 85525 - RNA, 22 nt, Homo sapiens
uuccacaaugguugaacuaauu

SEQ ID NO: 85526 - RNA, 23 nt, Homo sapiens
uuccaccauugacuaguuacaua

SEQ ID NO: 85527 - RNA, 22 nt, Homo sapiens
uuccaguggacuacuucauccu

SEQ ID NO: 85528 - RNA, 22 nt, Homo sapiens
uuccagugggacgagaugugga

SEQ ID NO: 85529 - RNA, 22 nt, Homo sapiens
uucccaguggaacauguaguca

SEQ ID NO: 85530 - RNA, 22 nt, Homo sapiens
uuccuacugcccauuaaaaugg

SEQ ID NO: 85531 - RNA, 22 nt, Homo sapiens
uuccugagaucagaauucaaau

SEQ ID NO: 85532 - RNA, 22 nt, Homo sapiens
uuccugcacuugcuugccuaug

SEQ ID NO: 85533 - RNA, 22 nt, Homo sapiens
uuccugucuuccaagagagauu

SEQ ID NO: 85534 - RNA, 21 nt, Homo sapiens
uucuauggucagaauucaaua

SEQ ID NO: 85535 - RNA, 22 nt, Homo sapiens
uucuauugguaauauuuucugu

SEQ ID NO: 85536 - RNA, 22 nt, Homo sapiens
uucucaaggagccuucguaacu

SEQ ID NO: 85537 - RNA, 21 nt, Homo sapiens
uucucaggguguguccuaccc

SEQ ID NO: 85538 - RNA, 22 nt, Homo sapiens
uucucugggacauaggucgggu

SEQ ID NO: 85539 - RNA, 22 nt, Homo sapiens
uucuuaguggcaccacuuuuuu

SEQ ID NO: 85540 - RNA, 22 nt, Homo sapiens
uucuugcuguauccucacaugg

SEQ ID NO: 85541 - RNA, 21 nt, Homo sapiens
uucuuugcucaguguuagagu

SEQ ID NO: 85542 - RNA, 23 nt, Homo sapiens
uugaaaagucaguagccucugau

SEQ ID NO: 85543 - RNA, 22 nt, Homo sapiens
uugaaagcuaucagagauucca

SEQ ID NO: 85544 - RNA, 22 nt, Homo sapiens
uugaaguagaaagacgaaauuu

SEQ ID NO: 85545 - RNA, 22 nt, Homo sapiens
uugaauguacuuguucucacua

SEQ ID NO: 85546 - RNA, 22 nt, Homo sapiens
uugacauugcuguaguguccag

SEQ ID NO: 85547 - RNA, 21 nt, Homo sapiens
uugagacggagucucacucug

SEQ ID NO: 85548 - RNA, 22 nt, Homo sapiens
uugagacggagucuugcucuuu

SEQ ID NO: 85549 - RNA, 22 nt, Homo sapiens
uugagacggaguuuugcucuug

SEQ ID NO: 85550 - RNA, 22 nt, Homo sapiens
uugagagcugaugaaagauaaa

SEQ ID NO: 85551 - RNA, 22 nt, Homo sapiens
uugagauaggaacucacuaugc

SEQ ID NO: 85552 - RNA, 22 nt, Homo sapiens
uugagauggagucucgcucuuu

SEQ ID NO: 85553 - RNA, 22 nt, Homo sapiens
uugagauggaguuucgcucuug

SEQ ID NO: 85554 - RNA, 22 nt, Homo sapiens
uugagauggugccacuguacuc

SEQ ID NO: 85555 - RNA, 22 nt, Homo sapiens
uugagcaacauagugagacugu

SEQ ID NO: 85556 - RNA, 22 nt, Homo sapiens
uugagcaaugaacgauucaggg

SEQ ID NO: 85557 - RNA, 22 nt, Homo sapiens
uugagcacaggaguuugagacc

SEQ ID NO: 85558 - RNA, 22 nt, Homo sapiens
uugagcuauguacagaugcugu

SEQ ID NO: 85559 - RNA, 22 nt, Homo sapiens
uugaggaagugguuccccagag

SEQ ID NO: 85560 - RNA, 22 nt, Homo sapiens
uugagguauuuugucaacugua

SEQ ID NO: 85561 - RNA, 22 nt, Homo sapiens
uugaguuuaucuaaagaccugg

SEQ ID NO: 85562 - RNA, 22 nt, Homo sapiens
uugauaauguuaacuuugguca

SEQ ID NO: 85563 - RNA, 22 nt, Homo sapiens
uugauuagauccaguugauuga

SEQ ID NO: 85564 - RNA, 22 nt, Homo sapiens
uugcaaaucucuuguguuuggu

SEQ ID NO: 85565 - RNA, 22 nt, Homo sapiens
uugcaagaaaucagagccuucc

SEQ ID NO: 85566 - RNA, 22 nt, Homo sapiens
uugcacagugcuuucuuugccc

SEQ ID NO: 85567 - RNA, 22 nt, Homo sapiens
uugcacuccagccugggugaca

SEQ ID NO: 85568 - RNA, 22 nt, Homo sapiens
uugcacucugaagaccuacugu

SEQ ID NO: 85569 - RNA, 22 nt, Homo sapiens
uugcacuguaauuuauuuaugu

SEQ ID NO: 85570 - RNA, 22 nt, Homo sapiens
uugcagugguuucacuggcaaa

SEQ ID NO: 85571 - RNA, 22 nt, Homo sapiens
uugcauagacaauauuaaucuu

SEQ ID NO: 85572 - RNA, 23 nt, Homo sapiens
uugcauagacauccucauagauu

SEQ ID NO: 85573 - RNA, 22 nt, Homo sapiens
uugcauagaggugaguauagua

SEQ ID NO: 85574 - RNA, 22 nt, Homo sapiens
uugcauauguugaaccaagcgu

SEQ ID NO: 85575 - RNA, 19 nt, Homo sapiens
uugcauauguugaaccagc

SEQ ID NO: 85576 - RNA, 22 nt, Homo sapiens
uugcaugcacaguucucaauag

SEQ ID NO: 85577 - RNA, 22 nt, Homo sapiens
aaagcacuggagucaucaucua

SEQ ID NO: 85578 - RNA, 22 nt, Homo sapiens
aaagcuacaggaccugcucauu

SEQ ID NO: 85579 - RNA, 22 nt, Homo sapiens
aaagggcuguuucuugacuugg

SEQ ID NO: 85580 - RNA, 19 nt, Homo sapiens
aaagguaguaaccucugau

SEQ ID NO: 85581 - RNA, 22 nt, Homo sapiens
aaagucuagaggaucaugugug

SEQ ID NO: 85582 - RNA, 22 nt, Homo sapiens
aaaucccuugcucucucagacc

SEQ ID NO: 85583 - RNA, 22 nt, Homo sapiens
aaaugcaugaggugggaagaaa

SEQ ID NO: 85584 - RNA, 22 nt, Homo sapiens
aaaugcuucuauguggcauguu

SEQ ID NO: 85585 - RNA, 22 nt, Homo sapiens
aaaugucauggaguguuucccc

SEQ ID NO: 85586 - RNA, 22 nt, Homo sapiens
aaauucaugucaccucuaggua

SEQ ID NO: 85587 - RNA, 22 nt, Homo sapiens
aacacuggcugcucgaguucuc

SEQ ID NO: 85588 - RNA, 22 nt, Homo sapiens
aacaggguguuugcaguuucuu

SEQ ID NO: 85589 - RNA, 22 nt, Homo sapiens
aacagucuccaguuguauccau

SEQ ID NO: 85590 - RNA, 22 nt, Homo sapiens
aacagugcauuccuguccauau

SEQ ID NO: 85591 - RNA, 22 nt, Homo sapiens
aacugcacauauuuguaugggu

SEQ ID NO: 85592 - RNA, 22 nt, Homo sapiens
aacugcuguuuggguacuggug

SEQ ID NO: 85593 - RNA, 22 nt, Homo sapiens
aacuggcauguuuuaaggcuua

SEQ ID NO: 85594 - RNA, 20 nt, Homo sapiens
aagagcucaccagaauaucu

SEQ ID NO: 85595 - RNA, 22 nt, Homo sapiens
aagagugcucgugggacucagc

SEQ ID NO: 85596 - RNA, 20 nt, Homo sapiens
aagcauggguuuuaggguca

SEQ ID NO: 85597 - RNA, 22 nt, Homo sapiens
aagcuggcauucaugagauuac

SEQ ID NO: 85598 - RNA, 22 nt, Homo sapiens
aagcuguauuguguugcuauaa

SEQ ID NO: 85599 - RNA, 22 nt, Homo sapiens
aaggcaagaaaauggauucucc

SEQ ID NO: 85600 - RNA, 22 nt, Homo sapiens
aaggcaagaagagaaccaucgg

SEQ ID NO: 85601 - RNA, 22 nt, Homo sapiens
aaggcuagagaagaagggcauc

SEQ ID NO: 85602 - RNA, 22 nt, Homo sapiens
aaguaaacauuuuguacaauaa

SEQ ID NO: 85603 - RNA, 22 nt, Homo sapiens
aaguacuguuuaaauugcagaa

SEQ ID NO: 85604 - RNA, 22 nt, Homo sapiens
aaguagcagaggcaagacuuga

SEQ ID NO: 85605 - RNA, 18 nt, Homo sapiens
aaguauagagagcccuua

SEQ ID NO: 85606 - RNA, 22 nt, Homo sapiens
aaguaucaggaauaguuauugg

SEQ ID NO: 85607 - RNA, 20 nt, Homo sapiens
aagugaguguuaaacugaac

SEQ ID NO: 85608 - RNA, 20 nt, Homo sapiens
aagugcaucguugugucugc

SEQ ID NO: 85609 - RNA, 22 nt, Homo sapiens
aagugcucuugaaacugucuua

SEQ ID NO: 85610 - RNA, 22 nt, Homo sapiens
aagugcuguaugggagccuagg

SEQ ID NO: 85611 - RNA, 22 nt, Homo sapiens
aagugcuuuacacaugcaugau

SEQ ID NO: 85612 - RNA, 22 nt, Homo sapiens
aagugguucuaugaguuugcaa

SEQ ID NO: 85613 - RNA, 22 nt, Homo sapiens
aauaagcugagagaauucuaca

SEQ ID NO: 85614 - RNA, 22 nt, Homo sapiens
aauaaugucacaggggguuagc

SEQ ID NO: 85615 - RNA, 22 nt, Homo sapiens
aauacagcacacagaugggucu

SEQ ID NO: 85616 - RNA, 22 nt, Homo sapiens
aauacucaguccuggugaggcu

SEQ ID NO: 85617 - RNA, 22 nt, Homo sapiens
aauacuuccaaaucuagucauu

SEQ ID NO: 85618 - RNA, 22 nt, Homo sapiens
aauaucuguguauagauggggg

SEQ ID NO: 85619 - RNA, 22 nt, Homo sapiens
aaucacagccagcuuccgcuau

SEQ ID NO: 85620 - RNA, 22 nt, Homo sapiens
aaucacaggucuuggcugcaug

SEQ ID NO: 85621 - RNA, 22 nt, Homo sapiens
aaucacaguguucuugugaggg

SEQ ID NO: 85622 - RNA, 22 nt, Homo sapiens
aaucacaguuaguaagggagaa

SEQ ID NO: 85623 - RNA, 23 nt, Homo sapiens
aaucugucuuuguuauagggguc

SEQ ID NO: 85624 - RNA, 22 nt, Homo sapiens
aaugacagugcuaaagaacccu

SEQ ID NO: 85625 - RNA, 22 nt, Homo sapiens
aaugauacuguguacaagggca

SEQ ID NO: 85626 - RNA, 22 nt, Homo sapiens
aauggcaagagccacagaggcg

SEQ ID NO: 85627 - RNA, 22 nt, Homo sapiens
aauggcacacaccuggucuaac

SEQ ID NO: 85628 - RNA, 22 nt, Homo sapiens
aauggcuucuuauugugguuca

SEQ ID NO: 85629 - RNA, 22 nt, Homo sapiens
aauggcuuucagcuuuucccca

SEQ ID NO: 85630 - RNA, 22 nt, Homo sapiens
aaugucaugaguccaaccagaa

SEQ ID NO: 85631 - RNA, 22 nt, Homo sapiens
aauuaguaaccuaauuccaucu

SEQ ID NO: 85632 - RNA, 22 nt, Homo sapiens
aauugaaugauaugggacauuu

SEQ ID NO: 85633 - RNA, 22 nt, Homo sapiens
aauugcaccaucuagaucaaga

SEQ ID NO: 85634 - RNA, 22 nt, Homo sapiens
aauugugcuuguaggccaggca

SEQ ID NO: 85635 - RNA, 21 nt, Homo sapiens
acaaagcuggagggagacugc

SEQ ID NO: 85636 - RNA, 22 nt, Homo sapiens
acaaaguauggaauguuggugu

SEQ ID NO: 85637 - RNA, 22 nt, Homo sapiens
acacaguaagcacaguguagau

SEQ ID NO: 85638 - RNA, 22 nt, Homo sapiens
acaccaucuccuuauuucucuu

SEQ ID NO: 85639 - RNA, 22 nt, Homo sapiens
acacuggaguuaaaggugauuu

SEQ ID NO: 85640 - RNA, 22 nt, Homo sapiens
acacuuucuggagcugcacaua

SEQ ID NO: 85641 - RNA, 22 nt, Homo sapiens
acagccauuccagccaaauacu

SEQ ID NO: 85642 - RNA, 21 nt, Homo sapiens
acaguacuugagaucuuuuga

SEQ ID NO: 85643 - RNA, 17 nt, Homo sapiens
acagugcuuugcuuucc

SEQ ID NO: 85644 - RNA, 22 nt, Homo sapiens
acaguggugcgaucucggcuca

SEQ ID NO: 85645 - RNA, 17 nt, Homo sapiens
acagugucuaugaaaug

SEQ ID NO: 85646 - RNA, 22 nt, Homo sapiens
acauaguagacacugaaaauau

SEQ ID NO: 85647 - RNA, 22 nt, Homo sapiens
acauaugaguacaugugccaug

SEQ ID NO: 85648 - RNA, 22 nt, Homo sapiens
acaugccucccugguccgcugu

SEQ ID NO: 85649 - RNA, 22 nt, Homo sapiens
acauguaauugauuuuguguua

SEQ ID NO: 85650 - RNA, 22 nt, Homo sapiens
accacaggguaaaguuagauau

SEQ ID NO: 85651 - RNA, 17 nt, Homo sapiens
accagugcaugugcuuu

SEQ ID NO: 85652 - RNA, 22 nt, Homo sapiens
accaugcaguccaauaugcaca

SEQ ID NO: 85653 - RNA, 22 nt, Homo sapiens
accauugcacuccagcccaggc

SEQ ID NO: 85654 - RNA, 22 nt, Homo sapiens
acccuggauucguggccuugaa

SEQ ID NO: 85655 - RNA, 22 nt, Homo sapiens
acccugucagcuggccugggca

SEQ ID NO: 85656 - RNA, 22 nt, Homo sapiens
accugcacagccgaacauagac

SEQ ID NO: 85657 - RNA, 22 nt, Homo sapiens
accugggugcugaugggcuuua

SEQ ID NO: 85658 - RNA, 22 nt, Homo sapiens
acgcagcacauucacagcuaug

SEQ ID NO: 85659 - RNA, 22 nt, Homo sapiens
acugagaucuuuaaauaaauaa

SEQ ID NO: 85660 - RNA, 22 nt, Homo sapiens
acugaguguugauuuagauuaa

SEQ ID NO: 85661 - RNA, 21 nt, Homo sapiens
acugcacuccaaccucaacag

SEQ ID NO: 85662 - RNA, 22 nt, Homo sapiens
acugcacuccaaccuuggugac

SEQ ID NO: 85663 - RNA, 22 nt, Homo sapiens
acugcacuccacccuuggcagc

SEQ ID NO: 85664 - RNA, 18 nt, Homo sapiens
acugcacuccaccuuggg

SEQ ID NO: 85665 - RNA, 22 nt, Homo sapiens
acugcacuccaccuugggcaac

SEQ ID NO: 85666 - RNA, 22 nt, Homo sapiens
acugcacuccagccuaggcgac

SEQ ID NO: 85667 - RNA, 22 nt, Homo sapiens
acugcacuccagccucaugaca

SEQ ID NO: 85668 - RNA, 22 nt, Homo sapiens
acugcacuccagccuccugaca

SEQ ID NO: 85669 - RNA, 22 nt, Homo sapiens
acugcacuccagccucgcaaca

SEQ ID NO: 85670 - RNA, 22 nt, Homo sapiens
acugcacuccagccucguggac

SEQ ID NO: 85671 - RNA, 22 nt, Homo sapiens
acugcacuccagccugaugaaa

SEQ ID NO: 85672 - RNA, 22 nt, Homo sapiens
acugcacuccagccugcccaac

SEQ ID NO: 85673 - RNA, 22 nt, Homo sapiens
acugcacuccagccugccgaca

SEQ ID NO: 85674 - RNA, 22 nt, Homo sapiens
acugcacuccagccugcugaca

SEQ ID NO: 85675 - RNA, 22 nt, Homo sapiens
acugcacuccagccuggaccac

SEQ ID NO: 85676 - RNA, 22 nt, Homo sapiens
acugcacuccagccuggcggac

SEQ ID NO: 85677 - RNA, 22 nt, Homo sapiens
acugcacuccagccuuagugac

SEQ ID NO: 85678 - RNA, 22 nt, Homo sapiens
acugcacuccagccuucaggac

SEQ ID NO: 85679 - RNA, 22 nt, Homo sapiens
acugcacuccagccuucgugac

SEQ ID NO: 85680 - RNA, 22 nt, Homo sapiens
acugcacuccaucuuagguggc

SEQ ID NO: 85681 - RNA, 22 nt, Homo sapiens
acugcacugcagccuggccaac

SEQ ID NO: 85682 - RNA, 22 nt, Homo sapiens
acugcacugucaaccuccuggg

SEQ ID NO: 85683 - RNA, 22 nt, Homo sapiens
acugcacuguccuagaguccuc

SEQ ID NO: 85684 - RNA, 22 nt, Homo sapiens
acugcacuuauccuccaauguu

SEQ ID NO: 85685 - RNA, 22 nt, Homo sapiens
acugcacuucagccuguugaca

SEQ ID NO: 85686 - RNA, 22 nt, Homo sapiens
acugcacuucagccuugggaaa

SEQ ID NO: 85687 - RNA, 22 nt, Homo sapiens
acuggcuuaaggaugggccacu

SEQ ID NO: 85688 - RNA, 22 nt, Homo sapiens
acugguuguuuaacugaauuga

SEQ ID NO: 85689 - RNA, 17 nt, Homo sapiens
acuuuuugaggaggcau

SEQ ID NO: 85690 - RNA, 22 nt, Homo sapiens
acuuuuugauggggagaacauu

SEQ ID NO: 85691 - RNA, 22 nt, Homo sapiens
acuuuuugcaaccauuuggacc

SEQ ID NO: 85692 - RNA, 21 nt, Homo sapiens
agaaaaucuuaugggaaacau

SEQ ID NO: 85693 - RNA, 22 nt, Homo sapiens
agaaacacagguggaauugcuu

SEQ ID NO: 85694 - RNA, 22 nt, Homo sapiens
agaaauguuuauucaaacccgu

SEQ ID NO: 85695 - RNA, 22 nt, Homo sapiens
agaacccuuugaaauguguuug

SEQ ID NO: 85696 - RNA, 20 nt, Homo sapiens
agacuagggagcagaaagcc

SEQ ID NO: 85697 - RNA, 22 nt, Homo sapiens
agagaucaauaugaaggaaaug

SEQ ID NO: 85698 - RNA, 22 nt, Homo sapiens
agagguauuggaaggaguguca

SEQ ID NO: 85699 - RNA, 22 nt, Homo sapiens
agagugcaaagguuggggcugg

SEQ ID NO: 85700 - RNA, 20 nt, Homo sapiens
agagugcuggacugaggagc

SEQ ID NO: 85701 - RNA, 22 nt, Homo sapiens
agauggauuuuguagccccagc

SEQ ID NO: 85702 - RNA, 22 nt, Homo sapiens
agauggguuuucacauguuggc

SEQ ID NO: 85703 - RNA, 22 nt, Homo sapiens
agauguuguucaucugauuguu

SEQ ID NO: 85704 - RNA, 22 nt, Homo sapiens
agauucauccaaguuguugcau

SEQ ID NO: 85705 - RNA, 22 nt, Homo sapiens
agcagauguuuagugagcgccu

SEQ ID NO: 85706 - RNA, 22 nt, Homo sapiens
agcagcaccaaacagacuaaga

SEQ ID NO: 85707 - RNA, 22 nt, Homo sapiens
agcaguacauaaaaagcauccu

SEQ ID NO: 85708 - RNA, 23 nt, Homo sapiens
agccugguuucccugcuucuccc

SEQ ID NO: 85709 - RNA, 22 nt, Homo sapiens
agcuaguguucaccagagguca

SEQ ID NO: 85710 - RNA, 22 nt, Homo sapiens
agcugcacgugguaaauguaaa

SEQ ID NO: 85711 - RNA, 22 nt, Homo sapiens
agcugccagucuuguaaggccu

SEQ ID NO: 85712 - RNA, 22 nt, Homo sapiens
agcuggaauuuaagguagauag

SEQ ID NO: 85713 - RNA, 22 nt, Homo sapiens
agcuggauuguuuaccuggggc

SEQ ID NO: 85714 - RNA, 23 nt, Homo sapiens
agcugguacuagaggcuugcgcc

SEQ ID NO: 85715 - RNA, 22 nt, Homo sapiens
agcugguaguuuucuaguguuu

SEQ ID NO: 85716 - RNA, 22 nt, Homo sapiens
agcugguauuuugucgaggacu

SEQ ID NO: 85717 - RNA, 22 nt, Homo sapiens
agcuggucuuggggaagaguag

SEQ ID NO: 85718 - RNA, 22 nt, Homo sapiens
agcuugugcuguaugaagggcc

SEQ ID NO: 85719 - RNA, 21 nt, Homo sapiens
agcuuguguguaucacagugu

SEQ ID NO: 85720 - RNA, 22 nt, Homo sapiens
agcuuguuuuccugcaacuaga

SEQ ID NO: 85721 - RNA, 22 nt, Homo sapiens
aggaagugugcaauuaauuucu

SEQ ID NO: 85722 - RNA, 21 nt, Homo sapiens
aggagcauuguugugguggag

SEQ ID NO: 85723 - RNA, 22 nt, Homo sapiens
aggagguagaacauugccauuu

SEQ ID NO: 85724 - RNA, 22 nt, Homo sapiens
aggagguagggugugaaacagc

SEQ ID NO: 85725 - RNA, 22 nt, Homo sapiens
aggagguagucugucccuuagc

SEQ ID NO: 85726 - RNA, 22 nt, Homo sapiens
aggaguguguauuaaugaaauu

SEQ ID NO: 85727 - RNA, 21 nt, Homo sapiens
aggcaagacuuuuagguuugu

SEQ ID NO: 85728 - RNA, 22 nt, Homo sapiens
aggcaugaaauacaugcauuga

SEQ ID NO: 85729 - RNA, 22 nt, Homo sapiens
aggccaguuuuuggagggaaac

SEQ ID NO: 85730 - RNA, 22 nt, Homo sapiens
agggcaagacuuguuaagaaca

SEQ ID NO: 85731 - RNA, 22 nt, Homo sapiens
agggcuuguuuaacuaucauua

SEQ ID NO: 85732 - RNA, 22 nt, Homo sapiens
agggcuuuugagcugagauggu

SEQ ID NO: 85733 - RNA, 22 nt, Homo sapiens
agguaaguauguuauuacuuuu

SEQ ID NO: 85734 - RNA, 22 nt, Homo sapiens
agguagaguguuuuguucuucu

SEQ ID NO: 85735 - RNA, 22 nt, Homo sapiens
agguagucuuuuccuauuguca

SEQ ID NO: 85736 - RNA, 22 nt, Homo sapiens
agguccacuuacuacuccuguu

SEQ ID NO: 85737 - RNA, 22 nt, Homo sapiens
aggugcugagcagagaauccug

SEQ ID NO: 85738 - RNA, 21 nt, Homo sapiens
aggugucuuggguucccuggc

SEQ ID NO: 85739 - RNA, 22 nt, Homo sapiens
aguaagauggcaacucuccaca

SEQ ID NO: 85740 - RNA, 22 nt, Homo sapiens
agucaacaucaugaaguggaaa

SEQ ID NO: 85741 - RNA, 19 nt, Homo sapiens
agucaugugaggacccuug

SEQ ID NO: 85742 - RNA, 22 nt, Homo sapiens
aguccagguuuuguaauggcaa

SEQ ID NO: 85743 - RNA, 22 nt, Homo sapiens
agugcaauaaggauguagaacu

SEQ ID NO: 85744 - RNA, 22 nt, Homo sapiens
agugcaauggcgugaucuuggc

SEQ ID NO: 85745 - RNA, 22 nt, Homo sapiens
agugcaguggcacaaucuuggc

SEQ ID NO: 85746 - RNA, 22 nt, Homo sapiens
aguggcaaugugauguccugaa

SEQ ID NO: 85747 - RNA, 20 nt, Homo sapiens
agugguuuucaaauaugucu

SEQ ID NO: 85748 - RNA, 22 nt, Homo sapiens
aguguuuuuaacaagaaagggu

SEQ ID NO: 85749 - RNA, 22 nt, Homo sapiens
aguucaauggguuuucacucau

SEQ ID NO: 85750 - RNA, 18 nt, Homo sapiens
aguuguuuuauccugccc

SEQ ID NO: 85751 - RNA, 22 nt, Homo sapiens
aguuuugguugaguuacuagca

SEQ ID NO: 85752 - RNA, 22 nt, Homo sapiens
auaaaugcuuagaucuguauau

SEQ ID NO: 85753 - RNA, 20 nt, Homo sapiens
auaaauguauagguguacau

SEQ ID NO: 85754 - RNA, 22 nt, Homo sapiens
auaaggcuaaggacuugaguua

SEQ ID NO: 85755 - RNA, 22 nt, Homo sapiens
auaauaccugccacauuugaau

SEQ ID NO: 85756 - RNA, 22 nt, Homo sapiens
auacagcuaaaauauuaaguua

SEQ ID NO: 85757 - RNA, 22 nt, Homo sapiens
auacuaugagauaauaaagacu

SEQ ID NO: 85758 - RNA, 20 nt, Homo sapiens
auagaagacuagugcagcag

SEQ ID NO: 85759 - RNA, 22 nt, Homo sapiens
auauagcucuggcuggaugacu

SEQ ID NO: 85760 - RNA, 22 nt, Homo sapiens
auauaugcacacgugugcauau

SEQ ID NO: 85761 - RNA, 22 nt, Homo sapiens
auaucacaaacaagucuguacu

SEQ ID NO: 85762 - RNA, 22 nt, Homo sapiens
auaugcacgugcauacacacuu

SEQ ID NO: 85763 - RNA, 22 nt, Homo sapiens
auaugcacuauacacacguaua

SEQ ID NO: 85764 - RNA, 22 nt, Homo sapiens
auaugcauguacccacacaggc

SEQ ID NO: 85765 - RNA, 22 nt, Homo sapiens
auaugcuuauuagcaagaaaua

SEQ ID NO: 85766 - RNA, 22 nt, Homo sapiens
auaugguuuuuggaagcauauc

SEQ ID NO: 85767 - RNA, 17 nt, Homo sapiens
auaugucugcuggggga

SEQ ID NO: 85768 - RNA, 22 nt, Homo sapiens
auauguucucauucauaugugg

SEQ ID NO: 85769 - RNA, 22 nt, Homo sapiens
auauuacagagaggaccuggga

SEQ ID NO: 85770 - RNA, 21 nt, Homo sapiens
auauuacuguuagaggacugc

SEQ ID NO: 85771 - RNA, 22 nt, Homo sapiens
auauucacuauaugcagaacca

SEQ ID NO: 85772 - RNA, 22 nt, Homo sapiens
auauugcuccuaauaccacggu

SEQ ID NO: 85773 - RNA, 22 nt, Homo sapiens
auauugcuuagugaugaagucu

SEQ ID NO: 85774 - RNA, 22 nt, Homo sapiens
aucaaaguaucucaauauggua

SEQ ID NO: 85775 - RNA, 22 nt, Homo sapiens
aucaaagugaaauauuaguuau

SEQ ID NO: 85776 - RNA, 22 nt, Homo sapiens
aucaaauugucauuuuaaggau

SEQ ID NO: 85777 - RNA, 22 nt, Homo sapiens
aucaaguacuguacugaaagug

SEQ ID NO: 85778 - RNA, 22 nt, Homo sapiens
aucacacucaccuucuguccuu

SEQ ID NO: 85779 - RNA, 22 nt, Homo sapiens
aucacagauauggguuuaaauc

SEQ ID NO: 85780 - RNA, 22 nt, Homo sapiens
aucacaguuauaacauccuuuu

SEQ ID NO: 85781 - RNA, 22 nt, Homo sapiens
aucaccuggaggugaucacuug

SEQ ID NO: 85782 - RNA, 22 nt, Homo sapiens
aucacuaugcaggugucucggg

SEQ ID NO: 85783 - RNA, 22 nt, Homo sapiens
aucacuuugcucuccagugugg

SEQ ID NO: 85784 - RNA, 19 nt, Homo sapiens
aucagcacaagugugcuuu

SEQ ID NO: 85785 - RNA, 22 nt, Homo sapiens
aucagcauucccaaaugaugug

SEQ ID NO: 85786 - RNA, 22 nt, Homo sapiens
aucaggcacacauuggaguuug

SEQ ID NO: 85787 - RNA, 22 nt, Homo sapiens
aucauguaguaagacacauuua

SEQ ID NO: 85788 - RNA, 22 nt, Homo sapiens
aucauguuuauguguaggauau

SEQ ID NO: 85789 - RNA, 22 nt, Homo sapiens
auccccugcacggggugucauu

SEQ ID NO: 85790 - RNA, 22 nt, Homo sapiens
aucucagagaaaauuacuaaga

SEQ ID NO: 85791 - RNA, 22 nt, Homo sapiens
aucuccaggugccagcugcgcc

SEQ ID NO: 85792 - RNA, 22 nt, Homo sapiens
aucugcacaucuguguuuuugu

SEQ ID NO: 85793 - RNA, 22 nt, Homo sapiens
aucugcauucccauguuuauug

SEQ ID NO: 85794 - RNA, 22 nt, Homo sapiens
aucugugaaugaaguuauuuug

SEQ ID NO: 85795 - RNA, 22 nt, Homo sapiens
aucuuuggugcaugauacuuug

SEQ ID NO: 85796 - RNA, 22 nt, Homo sapiens
augaacagagccuugagaaccu

SEQ ID NO: 85797 - RNA, 18 nt, Homo sapiens
augaacucaucaguucuu

SEQ ID NO: 85798 - RNA, 22 nt, Homo sapiens
augacaagagccuucuuuccuu

SEQ ID NO: 85799 - RNA, 22 nt, Homo sapiens
augacaguguggauuauuguaa

SEQ ID NO: 85800 - RNA, 22 nt, Homo sapiens
augacuauugcacuuuccuggu

SEQ ID NO: 85801 - RNA, 17 nt, Homo sapiens
augacuucuucagugug

SEQ ID NO: 85802 - RNA, 22 nt, Homo sapiens
augagaugcaagauuagauggg

SEQ ID NO: 85803 - RNA, 22 nt, Homo sapiens
augagcaucaccagaaucaaua

SEQ ID NO: 85804 - RNA, 22 nt, Homo sapiens
augaggaaggagccuuugucug

SEQ ID NO: 85805 - RNA, 22 nt, Homo sapiens
augaggcuauaauuuuuaugua

SEQ ID NO: 85806 - RNA, 22 nt, Homo sapiens
augaguauguucuguauuuuca

SEQ ID NO: 85807 - RNA, 15 nt, Homo sapiens
augaguuuuauggag

SEQ ID NO: 85808 - RNA, 22 nt, Homo sapiens
augauaaguuauuagaagaaga

SEQ ID NO: 85809 - RNA, 22 nt, Homo sapiens
augauaucuuguuuuucaugca

SEQ ID NO: 85810 - RNA, 22 nt, Homo sapiens
augauaugagaaaggaucaaca

SEQ ID NO: 85811 - RNA, 22 nt, Homo sapiens
augaucaucugaaagcuuuuac

SEQ ID NO: 85812 - RNA, 20 nt, Homo sapiens
augcaaacccugcuuugugg

SEQ ID NO: 85813 - RNA, 22 nt, Homo sapiens
augcaagcacacaagaggaaau

SEQ ID NO: 85814 - RNA, 22 nt, Homo sapiens
augcacuuggcaggaugauucc

SEQ ID NO: 85815 - RNA, 22 nt, Homo sapiens
augcauaugucuuuauaguggc

SEQ ID NO: 85816 - RNA, 22 nt, Homo sapiens
augccagggagaauuguucaag

SEQ ID NO: 85817 - RNA, 22 nt, Homo sapiens
augccucugacaauuggauucu

SEQ ID NO: 85818 - RNA, 22 nt, Homo sapiens
augcuacuggauuuguauaaau

SEQ ID NO: 85819 - RNA, 22 nt, Homo sapiens
augcuaucauucaggauuuguu

SEQ ID NO: 85820 - RNA, 22 nt, Homo sapiens
augcuguuuugaauucucuaga

SEQ ID NO: 85821 - RNA, 22 nt, Homo sapiens
auggacagaaaaaaauagaugu

SEQ ID NO: 85822 - RNA, 22 nt, Homo sapiens
auggacuuuuuguucagugucu

SEQ ID NO: 85823 - RNA, 22 nt, Homo sapiens
auggauagucucacucacauac

SEQ ID NO: 85824 - RNA, 22 nt, Homo sapiens
auggcacucaaucaaguugaga

SEQ ID NO: 85825 - RNA, 22 nt, Homo sapiens
auggcacuguguauuuuucugu

SEQ ID NO: 85826 - RNA, 22 nt, Homo sapiens
auggcagcccucuuuauccaug

SEQ ID NO: 85827 - RNA, 22 nt, Homo sapiens
auggcagcugacacuuccgucu

SEQ ID NO: 85828 - RNA, 22 nt, Homo sapiens
auggcagugucuagggguguuu

SEQ ID NO: 85829 - RNA, 22 nt, Homo sapiens
auggcaguuuauucuaaaucaa

SEQ ID NO: 85830 - RNA, 22 nt, Homo sapiens
auggcaguuuggucucugugcu

SEQ ID NO: 85831 - RNA, 22 nt, Homo sapiens
auggcccuguguggagcugcug

SEQ ID NO: 85832 - RNA, 22 nt, Homo sapiens
auggcucaguguguaucuauca

SEQ ID NO: 85833 - RNA, 22 nt, Homo sapiens
auggcucuuauuauuuugaggu

SEQ ID NO: 85834 - RNA, 22 nt, Homo sapiens
auggcuucuuacucuucugcau

SEQ ID NO: 85835 - RNA, 21 nt, Homo sapiens
augggguagaagagaaggcuu

SEQ ID NO: 85836 - RNA, 22 nt, Homo sapiens
augggugaguaugaguugacuu

SEQ ID NO: 85837 - RNA, 22 nt, Homo sapiens
augguaguagaugugugguuuu

SEQ ID NO: 85838 - RNA, 22 nt, Homo sapiens
augguauuuaacagucuuucua

SEQ ID NO: 85839 - RNA, 22 nt, Homo sapiens
augguuuuacugcaaaauggga

SEQ ID NO: 85840 - RNA, 22 nt, Homo sapiens
auguaaacauuuggucuaaauu

SEQ ID NO: 85841 - RNA, 22 nt, Homo sapiens
auguaguagcagaaaauauuuu

SEQ ID NO: 85842 - RNA, 22 nt, Homo sapiens
auguccuggacccagacaaagc

SEQ ID NO: 85843 - RNA, 22 nt, Homo sapiens
augugggaggacuuggcuguug

SEQ ID NO: 85844 - RNA, 22 nt, Homo sapiens
augugucaaaucuaggccaaag

SEQ ID NO: 85845 - RNA, 22 nt, Homo sapiens
auguuauguucuucucuguaua

SEQ ID NO: 85846 - RNA, 22 nt, Homo sapiens
auguugcuugaaggcauuuugu

SEQ ID NO: 85847 - RNA, 22 nt, Homo sapiens
auuaacaucuagaguuuuggug

SEQ ID NO: 85848 - RNA, 22 nt, Homo sapiens
auuaaguaaugguuccaauaau

SEQ ID NO: 85849 - RNA, 22 nt, Homo sapiens
auuagaugguuauaggugugag

SEQ ID NO: 85850 - RNA, 22 nt, Homo sapiens
auuagguuggugcaaaacuuuc

SEQ ID NO: 85851 - RNA, 22 nt, Homo sapiens
auuaucacaguuuugcauaugg

SEQ ID NO: 85852 - RNA, 22 nt, Homo sapiens
auucacagcuuuaaaaggcgug

SEQ ID NO: 85853 - RNA, 22 nt, Homo sapiens
auucaucagggauauugguuga

SEQ ID NO: 85854 - RNA, 22 nt, Homo sapiens
auuccacuuccacuaguuucuc

SEQ ID NO: 85855 - RNA, 21 nt, Homo sapiens
auuccacuuuuccuucaggga

SEQ ID NO: 85856 - RNA, 22 nt, Homo sapiens
auuccauaguacagugaugagu

SEQ ID NO: 85857 - RNA, 22 nt, Homo sapiens
auucccuuagcugccucagccu

SEQ ID NO: 85858 - RNA, 22 nt, Homo sapiens
auuccuuaggcccuuugguuag

SEQ ID NO: 85859 - RNA, 22 nt, Homo sapiens
auucuauaguccuaggauuggg

SEQ ID NO: 85860 - RNA, 23 nt, Homo sapiens
auugaacacuuucauaugugagg

SEQ ID NO: 85861 - RNA, 22 nt, Homo sapiens
auugaacaugccauauguacca

SEQ ID NO: 85862 - RNA, 22 nt, Homo sapiens
auugaggcauguaccaaugguc

SEQ ID NO: 85863 - RNA, 19 nt, Homo sapiens
auugauuaaguuugcuguc

SEQ ID NO: 85864 - RNA, 22 nt, Homo sapiens
auugcacuccagcccugcugac

SEQ ID NO: 85865 - RNA, 22 nt, Homo sapiens
auugcacuccagccuaggcaac

SEQ ID NO: 85866 - RNA, 22 nt, Homo sapiens
auugcacuccagccugggcaac

SEQ ID NO: 85867 - RNA, 22 nt, Homo sapiens
auugcacuccagccugggcgac

SEQ ID NO: 85868 - RNA, 22 nt, Homo sapiens
auugcacuccagccugggugag

SEQ ID NO: 85869 - RNA, 22 nt, Homo sapiens
auugcacuccagcuuaggcgac

SEQ ID NO: 85870 - RNA, 22 nt, Homo sapiens
auugcacuccagucugggcaac

SEQ ID NO: 85871 - RNA, 22 nt, Homo sapiens
auugcacuccggccugggugac

SEQ ID NO: 85872 - RNA, 22 nt, Homo sapiens
auugcacucuagccuuggcgac

SEQ ID NO: 85873 - RNA, 22 nt, Homo sapiens
auugcagauucgcuuuguguug

SEQ ID NO: 85874 - RNA, 23 nt, Homo sapiens
auugcagucuugaacuccugggc

SEQ ID NO: 85875 - RNA, 22 nt, Homo sapiens
auugcaugucauguuuagugua

SEQ ID NO: 85876 - RNA, 22 nt, Homo sapiens
auugcauuuucagguuggucug

SEQ ID NO: 85877 - RNA, 22 nt, Homo sapiens
auugcuuacuaaucaucuucag

SEQ ID NO: 85878 - RNA, 22 nt, Homo sapiens
auuggauagucuuuaucuguug

SEQ ID NO: 85879 - RNA, 22 nt, Homo sapiens
auuggcaauggcaaagcagagu

SEQ ID NO: 85880 - RNA, 22 nt, Homo sapiens
auuguacuccagccugggcuaa

SEQ ID NO: 85881 - RNA, 22 nt, Homo sapiens
auuguacuuauugccagaauuu

SEQ ID NO: 85882 - RNA, 22 nt, Homo sapiens
auugucacuuaaaagugcaugu

SEQ ID NO: 85883 - RNA, 22 nt, Homo sapiens
auugucauuuauaacuguguag

SEQ ID NO: 85884 - RNA, 22 nt, Homo sapiens
auuucacuucgcaugguguccg

SEQ ID NO: 85885 - RNA, 22 nt, Homo sapiens
auuuccuguaggggcuugcgaa

SEQ ID NO: 85886 - RNA, 22 nt, Homo sapiens
auuuggcagugaagggaucaca

SEQ ID NO: 85887 - RNA, 20 nt, Homo sapiens
auuuggcauaguuuaagcaa

SEQ ID NO: 85888 - RNA, 21 nt, Homo sapiens
auuugguggcugugugacacu

SEQ ID NO: 85889 - RNA, 22 nt, Homo sapiens
auuugguguuguuuggagccua

SEQ ID NO: 85890 - RNA, 22 nt, Homo sapiens
auuuuugguugguaggcuauua

SEQ ID NO: 85891 - RNA, 22 nt, Homo sapiens
auuuuugguuucaccugcacgc

SEQ ID NO: 85892 - RNA, 22 nt, Homo sapiens
caaagugcugggaugggccagg

SEQ ID NO: 85893 - RNA, 22 nt, Homo sapiens
caaauccucaccucaucaugaa

SEQ ID NO: 85894 - RNA, 22 nt, Homo sapiens
caauggcacuauuggaaaaggu

SEQ ID NO: 85895 - RNA, 22 nt, Homo sapiens
cacaaaguagauuagucuucca

SEQ ID NO: 85896 - RNA, 22 nt, Homo sapiens
cacaggccugucucuuucuaac

SEQ ID NO: 85897 - RNA, 22 nt, Homo sapiens
cacagugaacaauauccucugu

SEQ ID NO: 85898 - RNA, 22 nt, Homo sapiens
cacagugaacugguggguuuuu

SEQ ID NO: 85899 - RNA, 22 nt, Homo sapiens
caccacagccauuauugucccc

SEQ ID NO: 85900 - RNA, 22 nt, Homo sapiens
caccgagguuggagugcagugg

SEQ ID NO: 85901 - RNA, 22 nt, Homo sapiens
cacugcauccuccaccuccugg

SEQ ID NO: 85902 - RNA, 22 nt, Homo sapiens
cacugcauucuccaccucccag

SEQ ID NO: 85903 - RNA, 22 nt, Homo sapiens
cagagaacugaguuauuuucuu

SEQ ID NO: 85904 - RNA, 22 nt, Homo sapiens
cagaguuaguagccuuugacaa

SEQ ID NO: 85905 - RNA, 22 nt, Homo sapiens
cagaugcaugaccugggcuugg

SEQ ID NO: 85906 - RNA, 22 nt, Homo sapiens
cagccgggugagguggcuuguu

SEQ ID NO: 85907 - RNA, 22 nt, Homo sapiens
cagccggguggcuccuagggua

SEQ ID NO: 85908 - RNA, 23 nt, Homo sapiens
cagcucauuuggguccccuuguc

SEQ ID NO: 85909 - RNA, 22 nt, Homo sapiens
cagcuguuguugggguauagga

SEQ ID NO: 85910 - RNA, 22 nt, Homo sapiens
caguacaauguugauuagaagu

SEQ ID NO: 85911 - RNA, 22 nt, Homo sapiens
cagugauaggugguuguuggca

SEQ ID NO: 85912 - RNA, 22 nt, Homo sapiens
cagugcuuuaucaaguccucca

SEQ ID NO: 85913 - RNA, 23 nt, Homo sapiens
cagugguguuagagaaaucuuuu

SEQ ID NO: 85914 - RNA, 22 nt, Homo sapiens
caguguaugcuucuauuuuugg

SEQ ID NO: 85915 - RNA, 22 nt, Homo sapiens
cagugucugcauuuggaacuca

SEQ ID NO: 85916 - RNA, 22 nt, Homo sapiens
cauauucacuuuacagagcugu

SEQ ID NO: 85917 - RNA, 22 nt, Homo sapiens
caucacagcaaguagggagugg

SEQ ID NO: 85918 - RNA, 21 nt, Homo sapiens
caucacauuacucaaaguccu

SEQ ID NO: 85919 - RNA, 22 nt, Homo sapiens
cauggcccugggcugggcgaac

SEQ ID NO: 85920 - RNA, 22 nt, Homo sapiens
caugguacugccacagaagagu

SEQ ID NO: 85921 - RNA, 22 nt, Homo sapiens
caugugcaugagcacauacgug

SEQ ID NO: 85922 - RNA, 22 nt, Homo sapiens
caugugcaugcuuucuuaugug

SEQ ID NO: 85923 - RNA, 20 nt, Homo sapiens
cauuacacuccaaccugggu

SEQ ID NO: 85924 - RNA, 22 nt, Homo sapiens
cauuacacuuguaagguuuuuc

SEQ ID NO: 85925 - RNA, 22 nt, Homo sapiens
cauugcaauccagccugggcaa

SEQ ID NO: 85926 - RNA, 20 nt, Homo sapiens
cauugcccuccagccugggc

SEQ ID NO: 85927 - RNA, 22 nt, Homo sapiens
cauuugcacugagacucagcuu

SEQ ID NO: 85928 - RNA, 22 nt, Homo sapiens
ccaaaucucauguugaaaugug

SEQ ID NO: 85929 - RNA, 22 nt, Homo sapiens
ccaaggaauacccucccuuuuu

SEQ ID NO: 85930 - RNA, 22 nt, Homo sapiens
ccacaaccuccauauccugggu

SEQ ID NO: 85931 - RNA, 23 nt, Homo sapiens
ccacacuguuuagaauggcauca

SEQ ID NO: 85932 - RNA, 22 nt, Homo sapiens
ccacccuggagaauuugagguc

SEQ ID NO: 85933 - RNA, 22 nt, Homo sapiens
ccagaguugccucagguuucug

SEQ ID NO: 85934 - RNA, 22 nt, Homo sapiens
ccagcaccauuuauuaaauagg

SEQ ID NO: 85935 - RNA, 22 nt, Homo sapiens
ccagcaccauuuguugaauagg

SEQ ID NO: 85936 - RNA, 22 nt, Homo sapiens
ccaggguuccacgccuggcugu

SEQ ID NO: 85937 - RNA, 22 nt, Homo sapiens
ccaggguugagacccacugacu

SEQ ID NO: 85938 - RNA, 22 nt, Homo sapiens
ccaggguugcuuuagauucuga

SEQ ID NO: 85939 - RNA, 22 nt, Homo sapiens
ccagugaacugcaagguuuuuc

SEQ ID NO: 85940 - RNA, 22 nt, Homo sapiens
ccagugucugacagacacggcg

SEQ ID NO: 85941 - RNA, 22 nt, Homo sapiens
ccaguuuucucacuguugcagu

SEQ ID NO: 85942 - RNA, 19 nt, Homo sapiens
ccauggcaaugaucugaug

SEQ ID NO: 85943 - RNA, 21 nt, Homo sapiens
ccauggcaaugguaaacugac

SEQ ID NO: 85944 - RNA, 18 nt, Homo sapiens
ccauucaacagauuuguc

SEQ ID NO: 85945 - RNA, 22 nt, Homo sapiens
cccagaguucuuaaauacugag

SEQ ID NO: 85946 - RNA, 22 nt, Homo sapiens
ccccugaaacucacucauuauc

SEQ ID NO: 85947 - RNA, 17 nt, Homo sapiens
ccccugagcgaugcagu

SEQ ID NO: 85948 - RNA, 17 nt, Homo sapiens
cccuaguagcugggacu

SEQ ID NO: 85949 - RNA, 22 nt, Homo sapiens
cccugagaaaacuuuguccuua

SEQ ID NO: 85950 - RNA, 22 nt, Homo sapiens
cccugagagcagggucuuucuc

SEQ ID NO: 85951 - RNA, 22 nt, Homo sapiens
cccugagaugcuguuaaucugu

SEQ ID NO: 85952 - RNA, 22 nt, Homo sapiens
ccugguguuuugauggucgggu

SEQ ID NO: 85953 - RNA, 22 nt, Homo sapiens
ccugucuugauuaaauuacuua

SEQ ID NO: 85954 - RNA, 22 nt, Homo sapiens
ccuucuuuuguaaggcugaaua

SEQ ID NO: 85955 - RNA, 22 nt, Homo sapiens
ccuugcacuucccaggugaggc

SEQ ID NO: 85956 - RNA, 22 nt, Homo sapiens
cggcaguggguaagccaagcuu

SEQ ID NO: 85957 - RNA, 22 nt, Homo sapiens
cuaaaacuuucugagugcagca

SEQ ID NO: 85958 - RNA, 22 nt, Homo sapiens
cuaaaguauugagugguaaaga

SEQ ID NO: 85959 - RNA, 22 nt, Homo sapiens
cuaaaguucuucugagagaaca

SEQ ID NO: 85960 - RNA, 22 nt, Homo sapiens
cuaagauugucuuaguguguug

SEQ ID NO: 85961 - RNA, 22 nt, Homo sapiens
cuaaggaaggacugaaaggaca

SEQ ID NO: 85962 - RNA, 22 nt, Homo sapiens
gaacuguaaagaaauucuaagg

SEQ ID NO: 85963 - RNA, 22 nt, Homo sapiens
gaagacauuugcugcacguccu

SEQ ID NO: 85964 - RNA, 22 nt, Homo sapiens
gaagauaucuaguaccauuguc

SEQ ID NO: 85965 - RNA, 19 nt, Homo sapiens
gaaguguuguccuccagua

SEQ ID NO: 85966 - RNA, 19 nt, Homo sapiens
gaaguguuuguucuccaug

SEQ ID NO: 85967 - RNA, 22 nt, Homo sapiens
gaaucauuggguugauucaaga

SEQ ID NO: 85968 - RNA, 21 nt, Homo sapiens
gaauggcaccauuagcauaua

SEQ ID NO: 85969 - RNA, 17 nt, Homo sapiens
gacauaggaaaaggaga

SEQ ID NO: 85970 - RNA, 21 nt, Homo sapiens
gacauggcgauacuccgucuc

SEQ ID NO: 85971 - RNA, 22 nt, Homo sapiens
gacauguuuacaguguugagag

SEQ ID NO: 85972 - RNA, 22 nt, Homo sapiens
gacauguuuucauguauuugga

SEQ ID NO: 85973 - RNA, 22 nt, Homo sapiens
gacuauguuaccuuacacauca

SEQ ID NO: 85974 - RNA, 22 nt, Homo sapiens
gacuggccauugauacagaggu

SEQ ID NO: 85975 - RNA, 22 nt, Homo sapiens
gacuucaucauacuaugugugg

SEQ ID NO: 85976 - RNA, 22 nt, Homo sapiens
gagaacagagauaauuuuacuu

SEQ ID NO: 85977 - RNA, 22 nt, Homo sapiens
gagaacugagauaagugauauu

SEQ ID NO: 85978 - RNA, 22 nt, Homo sapiens
gagaacugagugugcuggcgga

SEQ ID NO: 85979 - RNA, 22 nt, Homo sapiens
gagaacuggcgugaacugcacg

SEQ ID NO: 85980 - RNA, 22 nt, Homo sapiens
gucagguaccugaaagcagcca

SEQ ID NO: 85981 - RNA, 22 nt, Homo sapiens
gucaucaggacgggucaucugc

SEQ ID NO: 85982 - RNA, 22 nt, Homo sapiens
gucauggaggaugaauggccaa

SEQ ID NO: 85983 - RNA, 22 nt, Homo sapiens
guccaguguuggagguuuuacc

SEQ ID NO: 85984 - RNA, 22 nt, Homo sapiens
gucucacagcuagcugcuuuau

SEQ ID NO: 85985 - RNA, 22 nt, Homo sapiens
gucucugagaugucaacaccua

SEQ ID NO: 85986 - RNA, 22 nt, Homo sapiens
gucucuugguuuagagcauuua

SEQ ID NO: 85987 - RNA, 22 nt, Homo sapiens
gucuggcuccuucuacuacaug

SEQ ID NO: 85988 - RNA, 22 nt, Homo sapiens
gucugguugacagcauguggcc

SEQ ID NO: 85989 - RNA, 21 nt, Homo sapiens
gucuuacagccagaugccucu

SEQ ID NO: 85990 - RNA, 22 nt, Homo sapiens
gucuuuggaaaaaaugucuguu

SEQ ID NO: 85991 - RNA, 22 nt, Homo sapiens
gugaaagcaucugacugugcca

SEQ ID NO: 85992 - RNA, 22 nt, Homo sapiens
gugaauugagagaacuguguua

SEQ ID NO: 85993 - RNA, 22 nt, Homo sapiens
gugacacuggagcuggcacaau

SEQ ID NO: 85994 - RNA, 22 nt, Homo sapiens
gugacugcauccauccaggcuu

SEQ ID NO: 85995 - RNA, 22 nt, Homo sapiens
gugagaacugcuggggccacag

SEQ ID NO: 85996 - RNA, 22 nt, Homo sapiens
gugagauggagucuugcuuugu

SEQ ID NO: 85997 - RNA, 22 nt, Homo sapiens
gugagcauucaaggaaggagcu

SEQ ID NO: 85998 - RNA, 22 nt, Homo sapiens
gugagccaugauuuuaccacug

SEQ ID NO: 85999 - RNA, 22 nt, Homo sapiens
gugagguaagaguugcuuugcu

SEQ ID NO: 86000 - RNA, 21 nt, Homo sapiens
gugaggucauugggcuuucug

SEQ ID NO: 86001 - RNA, 22 nt, Homo sapiens
gugaucuuucaggcuugaccau

SEQ ID NO: 86002 - RNA, 22 nt, Homo sapiens
gugcaagagugacugcaguuuu

SEQ ID NO: 86003 - RNA, 22 nt, Homo sapiens
gugcacaaugugcagguuuguu

SEQ ID NO: 86004 - RNA, 23 nt, Homo sapiens
gugcaguggcgagauuucggcuc

SEQ ID NO: 86005 - RNA, 22 nt, Homo sapiens
gugcauacgucuuuauaguagc

SEQ ID NO: 86006 - RNA, 22 nt, Homo sapiens
gugcauaugcaugugcaugcac

SEQ ID NO: 86007 - RNA, 22 nt, Homo sapiens
guggaaaucucugugugacuua

SEQ ID NO: 86008 - RNA, 21 nt, Homo sapiens
guggaaauggaauuuacuaau

SEQ ID NO: 86009 - RNA, 22 nt, Homo sapiens
guggaagaccagacuuuccaac

SEQ ID NO: 86010 - RNA, 17 nt, Homo sapiens
guggaaugucaugucaa

SEQ ID NO: 86011 - RNA, 22 nt, Homo sapiens
guggcaaacucagcaugcccca

SEQ ID NO: 86012 - RNA, 22 nt, Homo sapiens
guggcagaacagguaggguucu

SEQ ID NO: 86013 - RNA, 22 nt, Homo sapiens
guggcuagaaugaagguagcug

SEQ ID NO: 86014 - RNA, 22 nt, Homo sapiens
gugggaagcuggaacucccucc

SEQ ID NO: 86015 - RNA, 22 nt, Homo sapiens
gugggagugucccguuuuucca

SEQ ID NO: 86016 - RNA, 22 nt, Homo sapiens
gugggaugcaaguaaaauuguc

SEQ ID NO: 86017 - RNA, 22 nt, Homo sapiens
guggguaaaucucuguucgagg

SEQ ID NO: 86018 - RNA, 22 nt, Homo sapiens
gugguaguagaauuucggaaau

SEQ ID NO: 86019 - RNA, 22 nt, Homo sapiens
guggucagaaaucucaguggca

SEQ ID NO: 86020 - RNA, 22 nt, Homo sapiens
gugguuuuacaaagagaaagau

SEQ ID NO: 86021 - RNA, 22 nt, Homo sapiens
gugguuuuuagauuucuacagu

SEQ ID NO: 86022 - RNA, 22 nt, Homo sapiens
guguaaaucaaucuguugucuu

SEQ ID NO: 86023 - RNA, 22 nt, Homo sapiens
guguaauaaucguggacuaugu

SEQ ID NO: 86024 - RNA, 22 nt, Homo sapiens
guguauauccuauuaguucugu

SEQ ID NO: 86025 - RNA, 18 nt, Homo sapiens
gugucugguuaugggagu

SEQ ID NO: 86026 - RNA, 22 nt, Homo sapiens
gugugguauuauaacuagguau

SEQ ID NO: 86027 - RNA, 22 nt, Homo sapiens
guucaagcaauucugcugccuc

SEQ ID NO: 86028 - RNA, 22 nt, Homo sapiens
guucuggagauaaagccaaggu

SEQ ID NO: 86029 - RNA, 22 nt, Homo sapiens
guugcucaggcugaagugcagu

SEQ ID NO: 86030 - RNA, 22 nt, Homo sapiens
guuuggcuuucucucuauccug

SEQ ID NO: 86031 - RNA, 22 nt, Homo sapiens
uaaacugcuugaaaugguguca

SEQ ID NO: 86032 - RNA, 22 nt, Homo sapiens
uaaagccuagaacuuucagccc

SEQ ID NO: 86033 - RNA, 22 nt, Homo sapiens
uaacacagagcuccuaaucccu

SEQ ID NO: 86034 - RNA, 22 nt, Homo sapiens
uaacacccuucuccagguacau

SEQ ID NO: 86035 - RNA, 22 nt, Homo sapiens
uaacaggcaaggucacaccuug

SEQ ID NO: 86036 - RNA, 22 nt, Homo sapiens
uaacaguauaugugguaucuau

SEQ ID NO: 86037 - RNA, 22 nt, Homo sapiens
uaacauugucuugcuuaguuuu

SEQ ID NO: 86038 - RNA, 22 nt, Homo sapiens
uaacauuguugauuauacuaag

SEQ ID NO: 86039 - RNA, 22 nt, Homo sapiens
uaacuaguggaauuugauuuca

SEQ ID NO: 86040 - RNA, 18 nt, Homo sapiens
uaacuggugugagauggu

SEQ ID NO: 86041 - RNA, 22 nt, Homo sapiens
uaacuucaucauaagucaagaa

SEQ ID NO: 86042 - RNA, 22 nt, Homo sapiens
uaaggcaaaccuuggcugcagu

SEQ ID NO: 86043 - RNA, 22 nt, Homo sapiens
uaaggcauuuuuuugaguugca

SEQ ID NO: 86044 - RNA, 22 nt, Homo sapiens
uaaguaauugcagcaauuugcc

SEQ ID NO: 86045 - RNA, 22 nt, Homo sapiens
uaaguagugugcauguauguau

SEQ ID NO: 86046 - RNA, 22 nt, Homo sapiens
uaaguauuuuaauuccuggcau

SEQ ID NO: 86047 - RNA, 22 nt, Homo sapiens
uaagugcuguguuguuaccuaa

SEQ ID NO: 86048 - RNA, 20 nt, Homo sapiens
uaagugcuugaugaaugaac

SEQ ID NO: 86049 - RNA, 20 nt, Homo sapiens
uaagugcuuuauauugauua

SEQ ID NO: 86050 - RNA, 22 nt, Homo sapiens
acugcacuccggccucgugaca

SEQ ID NO: 86051 - RNA, 22 nt, Homo sapiens
acugcacucuagcauggguaau

SEQ ID NO: 86052 - RNA, 22 nt, Homo sapiens
acugcacucuagccuuggcaac

SEQ ID NO: 86053 - RNA, 22 nt, Homo sapiens
acugcacucuagcuugggugac

SEQ ID NO: 86054 - RNA, 20 nt, Homo sapiens
acugcacuucagccugcugg

SEQ ID NO: 86055 - RNA, 22 nt, Homo sapiens
acuggcaauggcagaaauaguu

SEQ ID NO: 86056 - RNA, 22 nt, Homo sapiens
acuggcuuuugagaaaaacacu

SEQ ID NO: 86057 - RNA, 20 nt, Homo sapiens
acugggcuaccgaaguaagg

SEQ ID NO: 86058 - RNA, 22 nt, Homo sapiens
acuguauagauggaguugauuu

SEQ ID NO: 86059 - RNA, 22 nt, Homo sapiens
agaagaacauagggugacugaa

SEQ ID NO: 86060 - RNA, 22 nt, Homo sapiens
agaauguaacucuaugaaggca

SEQ ID NO: 86061 - RNA, 22 nt, Homo sapiens
agaauguuuuagaccaauacaa

SEQ ID NO: 86062 - RNA, 22 nt, Homo sapiens
agacagcuggaguaucauagcu

SEQ ID NO: 86063 - RNA, 22 nt, Homo sapiens
agacagcugguagcacuuccug

SEQ ID NO: 86064 - RNA, 19 nt, Homo sapiens
agacuggcccaggcgggug

SEQ ID NO: 86065 - RNA, 22 nt, Homo sapiens
agagaacugauuggaugugggc

SEQ ID NO: 86066 - RNA, 22 nt, Homo sapiens
agagauaauuagguuaaaugag

SEQ ID NO: 86067 - RNA, 22 nt, Homo sapiens
agagguuuuggggcugagagcu

SEQ ID NO: 86068 - RNA, 22 nt, Homo sapiens
agaguaguuuauuaugcuaagg

SEQ ID NO: 86069 - RNA, 22 nt, Homo sapiens
agaguauagcaacuuaguaaaa

SEQ ID NO: 86070 - RNA, 23 nt, Homo sapiens
agagugcaauggugccaucucgg

SEQ ID NO: 86071 - RNA, 22 nt, Homo sapiens
agagugcuuuauuagauguagc

SEQ ID NO: 86072 - RNA, 22 nt, Homo sapiens
agaugauguuucuggcacauga

SEQ ID NO: 86073 - RNA, 22 nt, Homo sapiens
agaugccuaugaagagaaauua

SEQ ID NO: 86074 - RNA, 22 nt, Homo sapiens
agaugguuuuguucacagcucu

SEQ ID NO: 86075 - RNA, 22 nt, Homo sapiens
agcacacuggguggcuuaaaca

SEQ ID NO: 86076 - RNA, 22 nt, Homo sapiens
agcacagugaaugguuuacuca

SEQ ID NO: 86077 - RNA, 22 nt, Homo sapiens
agcacauuaguaucuaagaaca

SEQ ID NO: 86078 - RNA, 22 nt, Homo sapiens
agcaccauuguacuccagccug

SEQ ID NO: 86079 - RNA, 22 nt, Homo sapiens
agcacgaaaccaaauucuguga

SEQ ID NO: 86080 - RNA, 22 nt, Homo sapiens
agcagcuuugcauggccuguga

SEQ ID NO: 86081 - RNA, 22 nt, Homo sapiens
agcaggacaauaugggaucagg

SEQ ID NO: 86082 - RNA, 22 nt, Homo sapiens
agcaucacaugggcugcuuggg

SEQ ID NO: 86083 - RNA, 18 nt, Homo sapiens
agcaucacugaucauccu

SEQ ID NO: 86084 - RNA, 22 nt, Homo sapiens
agcugaguguuccaagagcgag

SEQ ID NO: 86085 - RNA, 22 nt, Homo sapiens
agcugcacugguauaggagaaa

SEQ ID NO: 86086 - RNA, 22 nt, Homo sapiens
agcuggacuugauaaaugaaua

SEQ ID NO: 86087 - RNA, 22 nt, Homo sapiens
agcuggcuguggagaaaccccu

SEQ ID NO: 86088 - RNA, 22 nt, Homo sapiens
agcugguauuuugucaaggaua

SEQ ID NO: 86089 - RNA, 20 nt, Homo sapiens
agcuguuguuaugagguuua

SEQ ID NO: 86090 - RNA, 22 nt, Homo sapiens
agcuucauuguuaugaauguca

SEQ ID NO: 86091 - RNA, 22 nt, Homo sapiens
agcuugugauuuagagugagag

SEQ ID NO: 86092 - RNA, 22 nt, Homo sapiens
aggaacuguaacuaugucucug

SEQ ID NO: 86093 - RNA, 22 nt, Homo sapiens
aggaagguaaacuaacuugccu

SEQ ID NO: 86094 - RNA, 20 nt, Homo sapiens
aggagcauuuacauuggcuc

SEQ ID NO: 86095 - RNA, 22 nt, Homo sapiens
aggcaacaugguaaaacccugu

SEQ ID NO: 86096 - RNA, 22 nt, Homo sapiens
aggcaagagugacuacgugaaa

SEQ ID NO: 86097 - RNA, 21 nt, Homo sapiens
aggcaagauuacuuacgagca

SEQ ID NO: 86098 - RNA, 22 nt, Homo sapiens
aggcacacaacccuggaccuga

SEQ ID NO: 86099 - RNA, 20 nt, Homo sapiens
aggcauguugguuugcgugu

SEQ ID NO: 86100 - RNA, 22 nt, Homo sapiens
aggcuguguggauaauauuggg

SEQ ID NO: 86101 - RNA, 22 nt, Homo sapiens
agguagguugagaugggcauca

SEQ ID NO: 86102 - RNA, 22 nt, Homo sapiens
aggugguguuggguuccagccc

SEQ ID NO: 86103 - RNA, 22 nt, Homo sapiens
aguaaauuucugugcuuucaua

SEQ ID NO: 86104 - RNA, 22 nt, Homo sapiens
aguaacauuucuaguagagagu

SEQ ID NO: 86105 - RNA, 22 nt, Homo sapiens
aguacacuguuaaaaagaagug

SEQ ID NO: 86106 - RNA, 20 nt, Homo sapiens
aguauucacuuuuuucaugg

SEQ ID NO: 86107 - RNA, 22 nt, Homo sapiens
agucacagccuuuuacuuuaga

SEQ ID NO: 86108 - RNA, 22 nt, Homo sapiens
agucacagguucuugggauuag

SEQ ID NO: 86109 - RNA, 22 nt, Homo sapiens
agucacagugaccuugucugac

SEQ ID NO: 86110 - RNA, 22 nt, Homo sapiens
agucagugcauaagaaugaagu

SEQ ID NO: 86111 - RNA, 22 nt, Homo sapiens
agucaguggaguaaauguaauu

SEQ ID NO: 86112 - RNA, 22 nt, Homo sapiens
agucugguguucucacacuagu

SEQ ID NO: 86113 - RNA, 22 nt, Homo sapiens
agugagcugcagucuggggucc

SEQ ID NO: 86114 - RNA, 19 nt, Homo sapiens
agugcaauugccuuugugc

SEQ ID NO: 86115 - RNA, 22 nt, Homo sapiens
agugggccccuagaggugaggu

SEQ ID NO: 86116 - RNA, 19 nt, Homo sapiens
agugucauggucauuauuu

SEQ ID NO: 86117 - RNA, 22 nt, Homo sapiens
aguguuuuuacaagcacucugg

SEQ ID NO: 86118 - RNA, 22 nt, Homo sapiens
aguucaaaucgagccuggccau

SEQ ID NO: 86119 - RNA, 22 nt, Homo sapiens
auaaaguucugcuggcauauau

SEQ ID NO: 86120 - RNA, 22 nt, Homo sapiens
auaagugagugauucaguguua

SEQ ID NO: 86121 - RNA, 22 nt, Homo sapiens
auaaucaugucugaaaccuuug

SEQ ID NO: 86122 - RNA, 22 nt, Homo sapiens
auacaaggaaugaagagauuug

SEQ ID NO: 86123 - RNA, 22 nt, Homo sapiens
auacagguauacaaugcauaau

SEQ ID NO: 86124 - RNA, 21 nt, Homo sapiens
auacuugagacuggguaauuu

SEQ ID NO: 86125 - RNA, 21 nt, Homo sapiens
auagcacaucagauuuuauua

SEQ ID NO: 86126 - RNA, 22 nt, Homo sapiens
auagcacauggcauccucucuu

SEQ ID NO: 86127 - RNA, 22 nt, Homo sapiens
auagguuuucacuguagauucu

SEQ ID NO: 86128 - RNA, 22 nt, Homo sapiens
auauaugcuaagugcuaauaaa

SEQ ID NO: 86129 - RNA, 22 nt, Homo sapiens
auaugcaaauccauagagacag

SEQ ID NO: 86130 - RNA, 22 nt, Homo sapiens
auaugcacaguggaguacuauu

SEQ ID NO: 86131 - RNA, 22 nt, Homo sapiens
auaugcauacauguaugcagga

SEQ ID NO: 86132 - RNA, 22 nt, Homo sapiens
auaugguguuugcuauucagcu

SEQ ID NO: 86133 - RNA, 22 nt, Homo sapiens
auauucacagguaucagagauu

SEQ ID NO: 86134 - RNA, 22 nt, Homo sapiens
aucaaagcagcauggcccaguc

SEQ ID NO: 86135 - RNA, 22 nt, Homo sapiens
aucaaaguaggcauauguuuuu

SEQ ID NO: 86136 - RNA, 22 nt, Homo sapiens
aucaagcugcuuguuugaaucu

SEQ ID NO: 86137 - RNA, 22 nt, Homo sapiens
aucacaguggcucacaagagcc

SEQ ID NO: 86138 - RNA, 19 nt, Homo sapiens
aucaccauuauuuggaaca

SEQ ID NO: 86139 - RNA, 22 nt, Homo sapiens
aucacuguaaguuuacacuuug

SEQ ID NO: 86140 - RNA, 23 nt, Homo sapiens
aucacuguuaacaauuucuuccu

SEQ ID NO: 86141 - RNA, 22 nt, Homo sapiens
aucacuuucuauuucugugcca

SEQ ID NO: 86142 - RNA, 22 nt, Homo sapiens
auucuugcuugaacuuggugca

SEQ ID NO: 86143 - RNA, 22 nt, Homo sapiens
auugaauuugguuugcuaagaa

SEQ ID NO: 86144 - RNA, 22 nt, Homo sapiens
auugacacugauuuuucuuuaa

SEQ ID NO: 86145 - RNA, 22 nt, Homo sapiens
auugagacaaauuuguaugcag

SEQ ID NO: 86146 - RNA, 22 nt, Homo sapiens
auugcacacagaaucaggguaa

SEQ ID NO: 86147 - RNA, 22 nt, Homo sapiens
auugcacaucugcacuacagcc

SEQ ID NO: 86148 - RNA, 22 nt, Homo sapiens
auugcacuccagccugggcagc

SEQ ID NO: 86149 - RNA, 22 nt, Homo sapiens
auugcacuccagccugggggac

SEQ ID NO: 86150 - RNA, 22 nt, Homo sapiens
auugcacuccagccuugacaca

SEQ ID NO: 86151 - RNA, 22 nt, Homo sapiens
auugcacuccauccugggcaau

SEQ ID NO: 86152 - RNA, 22 nt, Homo sapiens
auugcagaaaugacagagcgcc

SEQ ID NO: 86153 - RNA, 22 nt, Homo sapiens
auugcaguuagaacagaagucu

SEQ ID NO: 86154 - RNA, 22 nt, Homo sapiens
auugcucuuagaaauauuucuu

SEQ ID NO: 86155 - RNA, 22 nt, Homo sapiens
auugcuuaagucccuguauuag

SEQ ID NO: 86156 - RNA, 22 nt, Homo sapiens
auugcuuacccuguauuagauc

SEQ ID NO: 86157 - RNA, 22 nt, Homo sapiens
auugcuucugauuuuaaaugag

SEQ ID NO: 86158 - RNA, 22 nt, Homo sapiens
auuggcuuuugaaagucugcga

SEQ ID NO: 86159 - RNA, 22 nt, Homo sapiens
auuggguuaaaggauaugaaca

SEQ ID NO: 86160 - RNA, 21 nt, Homo sapiens
auuguauguaaaccaaaugag

SEQ ID NO: 86161 - RNA, 22 nt, Homo sapiens
auugucacccgggcaguaagca

SEQ ID NO: 86162 - RNA, 22 nt, Homo sapiens
auugucauuuucugagaaguaa

SEQ ID NO: 86163 - RNA, 19 nt, Homo sapiens
auuuccuggagcuggucuc

SEQ ID NO: 86164 - RNA, 22 nt, Homo sapiens
auuuggcaauuuugaagaugcc

SEQ ID NO: 86165 - RNA, 22 nt, Homo sapiens
auuuggcauagaguaucauucu

SEQ ID NO: 86166 - RNA, 21 nt, Homo sapiens
auuugguguuagaaauaaauu

SEQ ID NO: 86167 - RNA, 22 nt, Homo sapiens
auuuuugguugucagcacuagg

SEQ ID NO: 86168 - RNA, 22 nt, Homo sapiens
caaaagugguucuuauccuuuu

SEQ ID NO: 86169 - RNA, 22 nt, Homo sapiens
caaaggcuucugaaacugcaga

SEQ ID NO: 86170 - RNA, 22 nt, Homo sapiens
caaagugguuuauacaugauug

SEQ ID NO: 86171 - RNA, 22 nt, Homo sapiens
caacaguaaagcauuuuuaagu

SEQ ID NO: 86172 - RNA, 22 nt, Homo sapiens
caaggaauucucaauagaguua

SEQ ID NO: 86173 - RNA, 22 nt, Homo sapiens
caaggugcugagacaggagccc

SEQ ID NO: 86174 - RNA, 22 nt, Homo sapiens
caauugcacucuuagguguaca

SEQ ID NO: 86175 - RNA, 22 nt, Homo sapiens
cacaccuacuagggccgugggc

SEQ ID NO: 86176 - RNA, 22 nt, Homo sapiens
cacauguuugcuacauuuuucu

SEQ ID NO: 86177 - RNA, 22 nt, Homo sapiens
cacauugcaggaaaguucauua

SEQ ID NO: 86178 - RNA, 22 nt, Homo sapiens
caccacauuccauugaucaggc

SEQ ID NO: 86179 - RNA, 19 nt, Homo sapiens
caccagugcaugcuacuau

SEQ ID NO: 86180 - RNA, 22 nt, Homo sapiens
cacccagucaucuuggguuuuu

SEQ ID NO: 86181 - RNA, 22 nt, Homo sapiens
caccccuaccugagucaggagu

SEQ ID NO: 86182 - RNA, 19 nt, Homo sapiens
caccgccugcccccugcug

SEQ ID NO: 86183 - RNA, 22 nt, Homo sapiens
cacugcacuccagucugacgac

SEQ ID NO: 86184 - RNA, 22 nt, Homo sapiens
cacugcaguggaagauuaagaa

SEQ ID NO: 86185 - RNA, 22 nt, Homo sapiens
cacugcgacguccgccucccgg

SEQ ID NO: 86186 - RNA, 23 nt, Homo sapiens
cacugggcagcagguguucccag

SEQ ID NO: 86187 - RNA, 22 nt, Homo sapiens
cacugggugagauccauguuua

SEQ ID NO: 86188 - RNA, 17 nt, Homo sapiens
cacugggugcaagagga

SEQ ID NO: 86189 - RNA, 21 nt, Homo sapiens
cacuggguucaggcuugugga

SEQ ID NO: 86190 - RNA, 22 nt, Homo sapiens
cagagaaugucuuuuuuaacca

SEQ ID NO: 86191 - RNA, 22 nt, Homo sapiens
cagagagcuugcccuuguauau

SEQ ID NO: 86192 - RNA, 22 nt, Homo sapiens
cagagcacuaaagguaaaaggc

SEQ ID NO: 86193 - RNA, 22 nt, Homo sapiens
cagagugcauguuuagaugagu

SEQ ID NO: 86194 - RNA, 22 nt, Homo sapiens
cagauguaguauuuuagugaaa

SEQ ID NO: 86195 - RNA, 22 nt, Homo sapiens
cagcaucauucaucugggguaa

SEQ ID NO: 86196 - RNA, 22 nt, Homo sapiens
cagcuggugggagcuggguucc

SEQ ID NO: 86197 - RNA, 23 nt, Homo sapiens
cagcuucauugaacauaacuccu

SEQ ID NO: 86198 - RNA, 22 nt, Homo sapiens
caggaccucuugccuggaagcc

SEQ ID NO: 86199 - RNA, 22 nt, Homo sapiens
caggcuuuuccacacauggguu

SEQ ID NO: 86200 - RNA, 20 nt, Homo sapiens
cagggcaaugaggagguaaa

SEQ ID NO: 86201 - RNA, 22 nt, Homo sapiens
cagugacacugaaaaguucggg

SEQ ID NO: 86202 - RNA, 22 nt, Homo sapiens
cagugcaaccuccaucucucgg

SEQ ID NO: 86203 - RNA, 22 nt, Homo sapiens
cagugcauaggaucuaaaauuu

SEQ ID NO: 86204 - RNA, 22 nt, Homo sapiens
cagugcaugacuguauauuauc

SEQ ID NO: 86205 - RNA, 22 nt, Homo sapiens
cagugcuuguuauuguucuauu

SEQ ID NO: 86206 - RNA, 22 nt, Homo sapiens
cagugguuuucaacccugguug

SEQ ID NO: 86207 - RNA, 22 nt, Homo sapiens
caguguuuuuaacaggugcccg

SEQ ID NO: 86208 - RNA, 22 nt, Homo sapiens
caguuacuugacacaaccaauu

SEQ ID NO: 86209 - RNA, 21 nt, Homo sapiens
caucaaauugucauggugggu

SEQ ID NO: 86210 - RNA, 23 nt, Homo sapiens
caucacagagccuuccuugacuc

SEQ ID NO: 86211 - RNA, 22 nt, Homo sapiens
caucccugaaccccagaaaucu

SEQ ID NO: 86212 - RNA, 22 nt, Homo sapiens
caucgcacuccagcuugggcaa

SEQ ID NO: 86213 - RNA, 22 nt, Homo sapiens
caugauauugcagaauguuggu

SEQ ID NO: 86214 - RNA, 22 nt, Homo sapiens
caugccacugcacgccauccug

SEQ ID NO: 86215 - RNA, 22 nt, Homo sapiens
caugccacugcacuccaaccug

SEQ ID NO: 86216 - RNA, 22 nt, Homo sapiens
cauggguuuucucaaguaguca

SEQ ID NO: 86217 - RNA, 22 nt, Homo sapiens
caugucuuuuaaacauucaacu

SEQ ID NO: 86218 - RNA, 22 nt, Homo sapiens
cauugcuaaaagucauauauaa

SEQ ID NO: 86219 - RNA, 22 nt, Homo sapiens
ccacacugucuuggugggaaac

SEQ ID NO: 86220 - RNA, 22 nt, Homo sapiens
ccacagucuaugcaacaagguc

SEQ ID NO: 86221 - RNA, 22 nt, Homo sapiens
ccacaguugaaauuuugacugu

SEQ ID NO: 86222 - RNA, 22 nt, Homo sapiens
ccagguuucuagaauaauuccu

SEQ ID NO: 86223 - RNA, 22 nt, Homo sapiens
ccagugauggcugccucauuug

SEQ ID NO: 86224 - RNA, 18 nt, Homo sapiens
ccagugcaaggaaagccc

SEQ ID NO: 86225 - RNA, 21 nt, Homo sapiens
ccagugguuggaaacuauggg

SEQ ID NO: 86226 - RNA, 22 nt, Homo sapiens
ccaugaacuagaauagaacaug

SEQ ID NO: 86227 - RNA, 22 nt, Homo sapiens
ccauggcaauggucagucuauu

SEQ ID NO: 86228 - RNA, 18 nt, Homo sapiens
cccagugacuuauggccu

SEQ ID NO: 86229 - RNA, 22 nt, Homo sapiens
cccaguuuugcuucucaugagg

SEQ ID NO: 86230 - RNA, 22 nt, Homo sapiens
ccccagguuucaauaaagccca

SEQ ID NO: 86231 - RNA, 22 nt, Homo sapiens
ccccagugguugcaacagcaga

SEQ ID NO: 86232 - RNA, 22 nt, Homo sapiens
ccccauguucucucugcagcuc

SEQ ID NO: 86233 - RNA, 22 nt, Homo sapiens
cccucgagaaaccaucugcuga

SEQ ID NO: 86234 - RNA, 22 nt, Homo sapiens
cccugagaugugaauuucagag

SEQ ID NO: 86235 - RNA, 22 nt, Homo sapiens
agauggauuuuguagccccagc

SEQ ID NO: 86236 - RNA, 22 nt, Homo sapiens
agcugguucuuugccuuguaga

SEQ ID NO: 86237 - RNA, 22 nt, Homo sapiens
aggagcacaauggucaugugga

SEQ ID NO: 86238 - RNA, 22 nt, Homo sapiens
agguagcauagcgggaauauca

SEQ ID NO: 86239 - RNA, 22 nt, Homo sapiens
uuggaagcaugguuauugacgu

SEQ ID NO: 86240 - RNA, 22 nt, Homo sapiens
uugucuugcagcuuaggcauca

SEQ ID NO: 86241 - RNA, 22 nt, Homo sapiens
aaagcaucacuuuuccuacuuu

SEQ ID NO: 86242 - RNA, 22 nt, Homo sapiens
aaguaauugagguuuuugcugu

SEQ ID NO: 86243 - RNA, 18 nt, Homo sapiens
aaguauagagagcccuua

SEQ ID NO: 86244 - RNA, 22 nt, Homo sapiens
aagugcuuacagggaacaugau

SEQ ID NO: 86245 - RNA, 19 nt, Homo sapiens
aauaaugccagaugucugu

SEQ ID NO: 86246 - RNA, 22 nt, Homo sapiens
aaucacauugaaucugcuaccu

SEQ ID NO: 86247 - RNA, 22 nt, Homo sapiens
acaguagugggcuacagaauca

SEQ ID NO: 86248 - RNA, 22 nt, Homo sapiens
acauaguagacacugaaaauau

SEQ ID NO: 86249 - RNA, 22 nt, Homo sapiens
acccugucaaaacggaccaauc

SEQ ID NO: 86250 - RNA, 22 nt, Homo sapiens
acccugucagcuggccugggca

SEQ ID NO: 86251 - RNA, 22 nt, Homo sapiens
acccugucauccacauggugcu

SEQ ID NO: 86252 - RNA, 19 nt, Homo sapiens
acccuguccccaccuuuac

SEQ ID NO: 86253 - RNA, 22 nt, Homo sapiens
acucugucuaguuguaaaauuu

SEQ ID NO: 86254 - RNA, 18 nt, Homo sapiens
acugcacuccaccuuggg

SEQ ID NO: 86255 - RNA, 22 nt, Homo sapiens
acugcacuccagcccgggugac

SEQ ID NO: 86256 - RNA, 22 nt, Homo sapiens
acugcacuccagccugcccaac

SEQ ID NO: 86257 - RNA, 22 nt, Homo sapiens
acugcacuccagccugcugaca

SEQ ID NO: 86258 - RNA, 22 nt, Homo sapiens
acugcacuccagccuggaccac

SEQ ID NO: 86259 - RNA, 22 nt, Homo sapiens
acugcacuccagccuggacgaa

SEQ ID NO: 86260 - RNA, 18 nt, Homo sapiens
acugcacuccauccuagg

SEQ ID NO: 86261 - RNA, 22 nt, Homo sapiens
acugcacuccggccuggcaaca

SEQ ID NO: 86262 - RNA, 22 nt, Homo sapiens
acugcacucuagcauggguaau

SEQ ID NO: 86263 - RNA, 22 nt, Homo sapiens
acugcacucuagcuugggugac

SEQ ID NO: 86264 - RNA, 22 nt, Homo sapiens
acugcacugcagccuggccaac

SEQ ID NO: 86265 - RNA, 22 nt, Homo sapiens
acuguacuacagccugggugac

SEQ ID NO: 86266 - RNA, 22 nt, Homo sapiens
agauauguuauugauguuaaug

SEQ ID NO: 86267 - RNA, 22 nt, Homo sapiens
agcaacauuguucauaauagcu

SEQ ID NO: 86268 - RNA, 22 nt, Homo sapiens
agcaauaugacauugcuacauc

SEQ ID NO: 86269 - RNA, 22 nt, Homo sapiens
agcauuacaugguacagagaag

SEQ ID NO: 86270 - RNA, 22 nt, Homo sapiens
agcugguuuaauaugcugucug

SEQ ID NO: 86271 - RNA, 21 nt, Homo sapiens
agcugguuucuucuuacuccu

SEQ ID NO: 86272 - RNA, 22 nt, Homo sapiens
aggagguaggaauugugcuagg

SEQ ID NO: 86273 - RNA, 22 nt, Homo sapiens
aggcauggagacuaaaauuaua

SEQ ID NO: 86274 - RNA, 22 nt, Homo sapiens
auaugugacuucaugcaaggcu

SEQ ID NO: 86275 - RNA, 22 nt, Homo sapiens
aucccuuucugauacuuucccu

SEQ ID NO: 86276 - RNA, 22 nt, Homo sapiens
augaggcuauaauuuuuaugua

SEQ ID NO: 86277 - RNA, 22 nt, Homo sapiens
augaucacaccacugcacucca

SEQ ID NO: 86278 - RNA, 22 nt, Homo sapiens
augcacaguccagcccaugugg

SEQ ID NO: 86279 - RNA, 22 nt, Homo sapiens
augcagguguuuugcacugagu

SEQ ID NO: 86280 - RNA, 22 nt, Homo sapiens
augugcacaugcuuacauguga

SEQ ID NO: 86281 - RNA, 22 nt, Homo sapiens
auguggugguagccaggacagg

SEQ ID NO: 86282 - RNA, 21 nt, Homo sapiens
auuaaugcucugguuagaggc

SEQ ID NO: 86283 - RNA, 22 nt, Homo sapiens
auugaauuugguuugcuaagaa

SEQ ID NO: 86284 - RNA, 22 nt, Homo sapiens
auugcacaccagucugggcaaa

SEQ ID NO: 86285 - RNA, 22 nt, Homo sapiens
caagaucauuuaugcuaaaauu

SEQ ID NO: 86286 - RNA, 20 nt, Homo sapiens
cagagcaaagcaguccuggc

SEQ ID NO: 86287 - RNA, 22 nt, Homo sapiens
cagcccuacacagacugacuca

SEQ ID NO: 86288 - RNA, 22 nt, Homo sapiens
cagcuggugcugcaccaguggg

SEQ ID NO: 86289 - RNA, 22 nt, Homo sapiens
cagcugguggcaagaagacaga

SEQ ID NO: 86290 - RNA, 22 nt, Homo sapiens
cagguaguguguagcacagcag

SEQ ID NO: 86291 - RNA, 21 nt, Homo sapiens
cauaaugcuacuuauuuuaug

SEQ ID NO: 86292 - RNA, 22 nt, Homo sapiens
caugcagcacacaugucugugc

SEQ ID NO: 86293 - RNA, 22 nt, Homo sapiens
ccaguguucuggaaggcugagu

SEQ ID NO: 86294 - RNA, 22 nt, Homo sapiens
ccccuguaucucagcgucuuca

SEQ ID NO: 86295 - RNA, 22 nt, Homo sapiens
cugaaagagcauguaacacagu

SEQ ID NO: 86296 - RNA, 22 nt, Homo sapiens
cugacacuucaaaacugccaau

SEQ ID NO: 86297 - RNA, 22 nt, Homo sapiens
cugagcaauauagugagaucuu

SEQ ID NO: 86298 - RNA, 22 nt, Homo sapiens
cugaggugggaggauuggcuug

SEQ ID NO: 86299 - RNA, 22 nt, Homo sapiens
cugucacuggggcacauguccc

SEQ ID NO: 86300 - RNA, 22 nt, Homo sapiens
cuguccugcagagucagaauga

SEQ ID NO: 86301 - RNA, 18 nt, Homo sapiens
cuucauugcuguuuugcu

SEQ ID NO: 86302 - RNA, 22 nt, Homo sapiens
gacugaggaagcgcucucuccu

SEQ ID NO: 86303 - RNA, 22 nt, Homo sapiens
gacuggguuaguuugaaagacu

SEQ ID NO: 86304 - RNA, 22 nt, Homo sapiens
gagcaaugauugagccacugua

SEQ ID NO: 86305 - RNA, 23 nt, Homo sapiens
gaguggagacucauugauuuccu

SEQ ID NO: 86306 - RNA, 18 nt, Homo sapiens
gaguggugcuucccuugu

SEQ ID NO: 86307 - RNA, 22 nt, Homo sapiens
gaguucaaaucucagcucuguu

SEQ ID NO: 86308 - RNA, 22 nt, Homo sapiens
ggagaucacucuuuguagcgug

SEQ ID NO: 86309 - RNA, 22 nt, Homo sapiens
guauugcuugagcccaggaguu

SEQ ID NO: 86310 - RNA, 22 nt, Homo sapiens
gugaaagacagcauuaauggcu

SEQ ID NO: 86311 - RNA, 22 nt, Homo sapiens
gugauugucuaaucaagauaca

SEQ ID NO: 86312 - RNA, 22 nt, Homo sapiens
guggaucacuugaggucaagag

SEQ ID NO: 86313 - RNA, 22 nt, Homo sapiens
guuauggaguauaugugaacug

SEQ ID NO: 86314 - RNA, 22 nt, Homo sapiens
uaaugcuugguuguuuggaaaa

SEQ ID NO: 86315 - RNA, 22 nt, Homo sapiens
uagagagcuguuugaaagcagg

SEQ ID NO: 86316 - RNA, 22 nt, Homo sapiens
uagcagcauuuuuguagaguau

SEQ ID NO: 86317 - RNA, 22 nt, Homo sapiens
uaggacacucucuccaccagua

SEQ ID NO: 86318 - RNA, 22 nt, Homo sapiens
uauaaugcacauucccaaaucu

SEQ ID NO: 86319 - RNA, 22 nt, Homo sapiens
uauagcacaucuguguguacau

SEQ ID NO: 86320 - RNA, 22 nt, Homo sapiens
uauuuggauagucuggaaaaaa

SEQ ID NO: 86321 - RNA, 22 nt, Homo sapiens
ucagaauguaacuuuaguugga

SEQ ID NO: 86322 - RNA, 23 nt, Homo sapiens
ucagugaaggaacaacuaaauag

SEQ ID NO: 86323 - RNA, 17 nt, Homo sapiens
ucuaauaauaugcauuu

SEQ ID NO: 86324 - RNA, 22 nt, Homo sapiens
ucugucuugugguuugagugcc

SEQ ID NO: 86325 - RNA, 22 nt, Homo sapiens
ugaaacugcagugggcuuggca

SEQ ID NO: 86326 - RNA, 22 nt, Homo sapiens
ugaauguuguugguugagauau

SEQ ID NO: 86327 - RNA, 22 nt, Homo sapiens
ugaauuguuucauucuuuacau

SEQ ID NO: 86328 - RNA, 22 nt, Homo sapiens
ugacagcaucaggauuggagag

SEQ ID NO: 86329 - RNA, 22 nt, Homo sapiens
ugacaguguccuccuccugaga

SEQ ID NO: 86330 - RNA, 22 nt, Homo sapiens
ugacagugugagacuuugucuc

SEQ ID NO: 86331 - RNA, 22 nt, Homo sapiens
ugacaucaccaccuccgucauc

SEQ ID NO: 86332 - RNA, 22 nt, Homo sapiens
ugagaggugaauggcaggcuca

SEQ ID NO: 86333 - RNA, 22 nt, Homo sapiens
ugagauaaugcaugugaagauc

SEQ ID NO: 86334 - RNA, 22 nt, Homo sapiens
ugagguagaggugaacuugacc

SEQ ID NO: 86335 - RNA, 22 nt, Homo sapiens
ugaguauguuuaaugugacaau

SEQ ID NO: 86336 - RNA, 22 nt, Homo sapiens
ugaugacauugucacagucuga

SEQ ID NO: 86337 - RNA, 22 nt, Homo sapiens
ugccugauacccucugucucuc

SEQ ID NO: 86338 - RNA, 20 nt, Homo sapiens
uggaaucugaagaucucagu

SEQ ID NO: 86339 - RNA, 22 nt, Homo sapiens
ugguggcuuuucguagguucac

SEQ ID NO: 86340 - RNA, 22 nt, Homo sapiens
ugucagaaucugagacgacaac

SEQ ID NO: 86341 - RNA, 22 nt, Homo sapiens
ugucaggaguuuuagaaucuua

SEQ ID NO: 86342 - RNA, 22 nt, Homo sapiens
ugucuuggacuugaaucucauu

SEQ ID NO: 86343 - RNA, 22 nt, Homo sapiens
uguggcugguggcaccuuuucc

SEQ ID NO: 86344 - RNA, 22 nt, Homo sapiens
ugugggugguaaaauacaauga

SEQ ID NO: 86345 - RNA, 22 nt, Homo sapiens
uuacuguagugucauaucguau

SEQ ID NO: 86346 - RNA, 22 nt, Homo sapiens
uuagcacauuuccagcacaugg

SEQ ID NO: 86347 - RNA, 22 nt, Homo sapiens
uucccuuucuuaaagaguuagg

SEQ ID NO: 86348 - RNA, 22 nt, Homo sapiens
uugacaguggcuuaaauugguu

SEQ ID NO: 86349 - RNA, 22 nt, Homo sapiens
uugagauuuuccucaaauauuu

SEQ ID NO: 86350 - RNA, 22 nt, Homo sapiens
uugagcccuggagguggaggcu

SEQ ID NO: 86351 - RNA, 22 nt, Homo sapiens
uugcacagugcuuucuuugccc

SEQ ID NO: 86352 - RNA, 22 nt, Homo sapiens
uugcacagugguuuagagccug

SEQ ID NO: 86353 - RNA, 22 nt, Homo sapiens
uugcacaguguguacagcacca

SEQ ID NO: 86354 - RNA, 22 nt, Homo sapiens
uugcacucuagccugggugaca

SEQ ID NO: 86355 - RNA, 22 nt, Homo sapiens
uuggaagcacauuguuuaauua

SEQ ID NO: 86356 - RNA, 22 nt, Homo sapiens
uuggaauuaagagauauuuucu

SEQ ID NO: 86357 - RNA, 22 nt, Homo sapiens
uugguccucccaugcucaagag

SEQ ID NO: 86358 - RNA, 22 nt, Homo sapiens
uuugacuuuuagaauaugaguu

SEQ ID NO: 86359 - RNA, 21 nt, Homo sapiens
aagaaagcuggacuugccgcu

SEQ ID NO: 86360 - RNA, 22 nt, Homo sapiens
aagagagcuaugugcauaauua

SEQ ID NO: 86361 - RNA, 23 nt, Homo sapiens
aaggacacugaacacuucccagc

SEQ ID NO: 86362 - RNA, 22 nt, Homo sapiens
aagugguuuuuacaaagacaga

SEQ ID NO: 86363 - RNA, 22 nt, Homo sapiens
aauaugguuuuaugaagcaauu

SEQ ID NO: 86364 - RNA, 22 nt, Homo sapiens
aauggcagaugaaauugucauu

SEQ ID NO: 86365 - RNA, 22 nt, Homo sapiens
aaugugcacuauuagggugaua

SEQ ID NO: 86366 - RNA, 22 nt, Homo sapiens
acagaacugggcuugcuuuugg

SEQ ID NO: 86367 - RNA, 18 nt, Homo sapiens
acagugucuuacaccugu

SEQ ID NO: 86368 - RNA, 22 nt, Homo sapiens
acaucacuguuugauugauuga

SEQ ID NO: 86369 - RNA, 17 nt, Homo sapiens
accccuaccucagaagc

SEQ ID NO: 86370 - RNA, 22 nt, Homo sapiens
acccugucaaaauggaccaauc

SEQ ID NO: 86371 - RNA, 22 nt, Homo sapiens
accugugguuacagucugucuc

SEQ ID NO: 86372 - RNA, 22 nt, Homo sapiens
acugcacuccagccucgcaaca

SEQ ID NO: 86373 - RNA, 22 nt, Homo sapiens
acugcacuccagccucggggac

SEQ ID NO: 86374 - RNA, 22 nt, Homo sapiens
acugcacuccagccucguggac

SEQ ID NO: 86375 - RNA, 22 nt, Homo sapiens
acugcacuccagccugagccug

SEQ ID NO: 86376 - RNA, 22 nt, Homo sapiens
acugcacuccagccuggacgac

SEQ ID NO: 86377 - RNA, 22 nt, Homo sapiens
acugcacuccagcuuuggguga

SEQ ID NO: 86378 - RNA, 22 nt, Homo sapiens
acugcacucuagccuuggcaac

SEQ ID NO: 86379 - RNA, 22 nt, Homo sapiens
acugcacuguccuagaguccuc

SEQ ID NO: 86380 - RNA, 19 nt, Homo sapiens
acuguacuccagucugggc

SEQ ID NO: 86381 - RNA, 22 nt, Homo sapiens
agaauaauguccccccaaggga

SEQ ID NO: 86382 - RNA, 22 nt, Homo sapiens
agagauaaagauuuuaauuuug

SEQ ID NO: 86383 - RNA, 22 nt, Homo sapiens
agagauaauuagguuaaaugag

SEQ ID NO: 86384 - RNA, 22 nt, Homo sapiens
agaguaguaggaugaauggacu

SEQ ID NO: 86385 - RNA, 22 nt, Homo sapiens
agcuggcuguagcugcaagucu

SEQ ID NO: 86386 - RNA, 22 nt, Homo sapiens
agcugguccugugacuugcuuc

SEQ ID NO: 86387 - RNA, 22 nt, Homo sapiens
agcuggucuuggggaagaguag

SEQ ID NO: 86388 - RNA, 22 nt, Homo sapiens
aggcaagaaugcuuguuucacc

SEQ ID NO: 86389 - RNA, 22 nt, Homo sapiens
aggcaugguggcacauacaugu

SEQ ID NO: 86390 - RNA, 22 nt, Homo sapiens
aguauguagugcaaucagucag

SEQ ID NO: 86391 - RNA, 22 nt, Homo sapiens
auaauagcugaucauuuagaag

SEQ ID NO: 86392 - RNA, 22 nt, Homo sapiens
auaguagagagggcaaaaugcu

SEQ ID NO: 86393 - RNA, 22 nt, Homo sapiens
auagugaacuuugugagaacaa

SEQ ID NO: 86394 - RNA, 22 nt, Homo sapiens
aucacuuucuauuucugugcca

SEQ ID NO: 86395 - RNA, 22 nt, Homo sapiens
aucgcaccauugcacuccagca

SEQ ID NO: 86396 - RNA, 22 nt, Homo sapiens
augagcaaagagaugagacccu

SEQ ID NO: 86397 - RNA, 22 nt, Homo sapiens
auggaaggagaggaaugaauga

SEQ ID NO: 86398 - RNA, 22 nt, Homo sapiens
auggagaugaauaucaucuguu

SEQ ID NO: 86399 - RNA, 17 nt, Homo sapiens
augugaauguucaaaua

SEQ ID NO: 86400 - RNA, 22 nt, Homo sapiens
auucccuuagcugccucagccu

SEQ ID NO: 86401 - RNA, 22 nt, Homo sapiens
auugcacuccagccugggugac

SEQ ID NO: 86402 - RNA, 22 nt, Homo sapiens
auuggguuaaaggauaugaaca

SEQ ID NO: 86403 - RNA, 22 nt, Homo sapiens
auuucacuucgcaugguguccg

SEQ ID NO: 86404 - RNA, 22 nt, Homo sapiens
cacaguagaauagagcacuagg

SEQ ID NO: 86405 - RNA, 22 nt, Homo sapiens
cagagguaagcaagucagcauu

SEQ ID NO: 86406 - RNA, 22 nt, Homo sapiens
cauggcccugggcugggcgaac

SEQ ID NO: 86407 - RNA, 22 nt, Homo sapiens
cauugcagauccuucaaaugac

SEQ ID NO: 86408 - RNA, 22 nt, Homo sapiens
ccugcauaguucaccgcugaua

SEQ ID NO: 86409 - RNA, 22 nt, Homo sapiens
cgaggaguaucuuugugguguu

SEQ ID NO: 86410 - RNA, 22 nt, Homo sapiens
cuaauccugugguagcacucaa

SEQ ID NO: 86411 - RNA, 22 nt, Homo sapiens
cucacugugguguccuuaggua

SEQ ID NO: 86412 - RNA, 22 nt, Homo sapiens
cugaaagagcauuugaaugggu

SEQ ID NO: 86413 - RNA, 22 nt, Homo sapiens
cuuggauuauaauggaauauuu

SEQ ID NO: 86414 - RNA, 21 nt, Homo sapiens
ugucuuggagccagacgccag

SEQ ID NO: 86415 - RNA, 22 nt, Homo sapiens
uuacaguagaugaggguauaau

SEQ ID NO: 86416 - RNA, 19 nt, Homo sapiens
uuauacuguauuguuuagg

SEQ ID NO: 86417 - RNA, 22 nt, Homo sapiens
uucccucagaaacacacagccc

SEQ ID NO: 86418 - RNA, 20 nt, Homo sapiens
uucccucagccuugagggua

SEQ ID NO: 86419 - RNA, 22 nt, Homo sapiens
uucccuuugaaacuaaacuugc

SEQ ID NO: 86420 - RNA, 22 nt, Homo sapiens
uugaaagacagaggggcaaguu

SEQ ID NO: 86421 - RNA, 21 nt, Homo sapiens
uugacagugacagguaaaguu

SEQ ID NO: 86422 - RNA, 22 nt, Homo sapiens
uugaggugaagggcagagcagc

SEQ ID NO: 86423 - RNA, 20 nt, Homo sapiens
uugcacagagaaggaggcag

SEQ ID NO: 86424 - RNA, 22 nt, Homo sapiens
uugcacuccagcucuaggugac

SEQ ID NO: 86425 - RNA, 22 nt, Homo sapiens
uuggaaaguuguuguaguuauu

SEQ ID NO: 86426 - RNA, 22 nt, Homo sapiens
uuggaauuuuacuucuguaaga

SEQ ID NO: 86427 - RNA, 22 nt, Homo sapiens
uugugaauggugccacaauaaa

SEQ ID NO: 86428 - RNA, 22 nt, Homo sapiens
uugugauugagugauccuuguu

SEQ ID NO: 86429 - RNA, 22 nt, Homo sapiens
uuuaaaguuagaaggaaagggc

SEQ ID NO: 86430 - RNA, 22 nt, Homo sapiens
uuugaauggaaguuuugugaaa

SEQ ID NO: 86431 - RNA, 22 nt, Homo sapiens
aagcaaacaucagcuugguuaa

SEQ ID NO: 86432 - RNA, 22 nt, Homo sapiens
aagcuggauuucgcauccuguu

SEQ ID NO: 86433 - RNA, 22 nt, Homo sapiens
aagcugguguguauuauucacu

SEQ ID NO: 86434 - RNA, 22 nt, Homo sapiens
aagcugguuuuauaucugugag

SEQ ID NO: 86435 - RNA, 22 nt, Homo sapiens
aaguaauggaguuauuuuauga

SEQ ID NO: 86436 - RNA, 22 nt, Homo sapiens
acaggugaaguauuacacuaag

SEQ ID NO: 86437 - RNA, 22 nt, Homo sapiens
acccugucacucccaucaauuu

SEQ ID NO: 86438 - RNA, 23 nt, Homo sapiens
accugugguuauuuuacucuucc

SEQ ID NO: 86439 - RNA, 22 nt, Homo sapiens
acugcacuccagcccaggugac

SEQ ID NO: 86440 - RNA, 22 nt, Homo sapiens
acugcacuccagccuaggcgac

SEQ ID NO: 86441 - RNA, 22 nt, Homo sapiens
acugcacuccagccuccugaca

SEQ ID NO: 86442 - RNA, 22 nt, Homo sapiens
acugcacuccagccuugcgaca

SEQ ID NO: 86443 - RNA, 22 nt, Homo sapiens
acugcacuccagccuuggcaac

SEQ ID NO: 86444 - RNA, 22 nt, Homo sapiens
acugcacuccagcuccagggug

SEQ ID NO: 86445 - RNA, 22 nt, Homo sapiens
acugcacuccagcuugggugac

SEQ ID NO: 86446 - RNA, 22 nt, Homo sapiens
acugcacucccgcccgggugac

SEQ ID NO: 86447 - RNA, 22 nt, Homo sapiens
acugcacuccuccuugggugac

SEQ ID NO: 86448 - RNA, 20 nt, Homo sapiens
acugcauuuaguccucagga

SEQ ID NO: 86449 - RNA, 22 nt, Homo sapiens
acuguacuccauccugggugac

SEQ ID NO: 86450 - RNA, 22 nt, Homo sapiens
agacccuguauguguuuaguuu

SEQ ID NO: 86451 - RNA, 22 nt, Homo sapiens
agaguauacaugugagugagau

SEQ ID NO: 86452 - RNA, 22 nt, Homo sapiens
agcagcauuccaaaaaucugcu

SEQ ID NO: 86453 - RNA, 22 nt, Homo sapiens
agcaucacguagacuuuaccau

SEQ ID NO: 86454 - RNA, 21 nt, Homo sapiens
agccugugggucauaguugcc

SEQ ID NO: 86455 - RNA, 22 nt, Homo sapiens
auaaaugccuguuguuuuaagc

SEQ ID NO: 86456 - RNA, 22 nt, Homo sapiens
auaaaugcuuagaucuguauau

SEQ ID NO: 86457 - RNA, 22 nt, Homo sapiens
auaaugcuggaacuagagggca

SEQ ID NO: 86458 - RNA, 22 nt, Homo sapiens
aucacuuugcucuccagugugg

SEQ ID NO: 86459 - RNA, 22 nt, Homo sapiens
aucagaaucucuagaggacugu

SEQ ID NO: 86460 - RNA, 22 nt, Homo sapiens
auggagaugugcgaacugagua

SEQ ID NO: 86461 - RNA, 21 nt, Homo sapiens
auugcacaauauacccaugua

SEQ ID NO: 86462 - RNA, 18 nt, Homo sapiens
auugcacaccagccuggg

SEQ ID NO: 86463 - RNA, 22 nt, Homo sapiens
auugcacuccggccugggugac

SEQ ID NO: 86464 - RNA, 22 nt, Homo sapiens
cagauaguuguagauaugcagc

SEQ ID NO: 86465 - RNA, 22 nt, Homo sapiens
cagcaaaucauccuauuugagc

SEQ ID NO: 86466 - RNA, 23 nt, Homo sapiens
cagcuggugauuuuaaguugaag

SEQ ID NO: 86467 - RNA, 18 nt, Homo sapiens
cagugcaauacaggagag

SEQ ID NO: 86468 - RNA, 22 nt, Homo sapiens
caucacuuuuccuuuuacagau

SEQ ID NO: 86469 - RNA, 22 nt, Homo sapiens
cauugcacucuagucuggguga

SEQ ID NO: 86470 - RNA, 22 nt, Homo sapiens
ccagaauucucauuggaaggaa

SEQ ID NO: 86471 - RNA, 22 nt, Homo sapiens
ccaggguugagacccacugacu

SEQ ID NO: 86472 - RNA, 22 nt, Homo sapiens
cucacugucaacauguauuugg

SEQ ID NO: 86473 - RNA, 22 nt, Homo sapiens
cuggaaagaaacccuuaauucu

SEQ ID NO: 86474 - RNA, 22 nt, Homo sapiens
cugggauggaggagaauuagag

SEQ ID NO: 86475 - RNA, 22 nt, Homo sapiens
cuguaacagaauaaauuuguuu

SEQ ID NO: 86476 - RNA, 23 nt, Homo sapiens
cuguacacauauacaucuaagua

SEQ ID NO: 86477 - RNA, 21 nt, Homo sapiens
cuucuuggggcagggcagggu

SEQ ID NO: 86478 - RNA, 22 nt, Homo sapiens
gaaguaauaaauggauucuuaa

SEQ ID NO: 86479 - RNA, 22 nt, Homo sapiens
gacagugagaugucaugugaaa

SEQ ID NO: 86480 - RNA, 22 nt, Homo sapiens
gagaaguaaauuuauuugcaaa

SEQ ID NO: 86481 - RNA, 22 nt, Homo sapiens
gagcaaugagcugccugcugag

SEQ ID NO: 86482 - RNA, 22 nt, Homo sapiens
gagcugguccuuuaaggaugca

SEQ ID NO: 86483 - RNA, 22 nt, Homo sapiens
gagguggugguggaggcauagc

SEQ ID NO: 86484 - RNA, 22 nt, Homo sapiens
ggaaagacaccuuacuauguua

SEQ ID NO: 86485 - RNA, 22 nt, Homo sapiens
ggaucacugugaaccgugucag

SEQ ID NO: 86486 - RNA, 22 nt, Homo sapiens
ggguucaaaucuuggcucuuac

SEQ ID NO: 86487 - RNA, 22 nt, Homo sapiens
guaacuggccuucaauuucuuc

SEQ ID NO: 86488 - RNA, 22 nt, Homo sapiens
guaacugguuuucuucccucuc

SEQ ID NO: 86489 - RNA, 22 nt, Homo sapiens
gugaaauauuuaacguccaggu

SEQ ID NO: 86490 - RNA, 22 nt, Homo sapiens
gugacagaguaagacccuguau

SEQ ID NO: 86491 - RNA, 22 nt, Homo sapiens
gugagcauaacaacagaguuua

SEQ ID NO: 86492 - RNA, 22 nt, Homo sapiens
gugagcauucaaggaaggagcu

SEQ ID NO: 86493 - RNA, 22 nt, Homo sapiens
gugauuguuaaacugccucucu

SEQ ID NO: 86494 - RNA, 18 nt, Homo sapiens
guggagugucuuccugga

SEQ ID NO: 86495 - RNA, 22 nt, Homo sapiens
gugggaugaucgcuugagccca

SEQ ID NO: 86496 - RNA, 22 nt, Homo sapiens
gugucacugugaggauauugua

SEQ ID NO: 86497 - RNA, 22 nt, Homo sapiens
uaauuggaucucaaaaaagugu

SEQ ID NO: 86498 - RNA, 22 nt, Homo sapiens
uacaggacuucucagaguuauu

SEQ ID NO: 86499 - RNA, 22 nt, Homo sapiens
uagcugguauuaggaguugugu

SEQ ID NO: 86500 - RNA, 22 nt, Homo sapiens
uagugacauugcugggaaugcu

SEQ ID NO: 86501 - RNA, 22 nt, Homo sapiens
uaugcagacauuguuccaacca

SEQ ID NO: 86502 - RNA, 22 nt, Homo sapiens
ucacagauaaauaaagaugauu

SEQ ID NO: 86503 - RNA, 22 nt, Homo sapiens
ucacucagaccuggugauaugc

SEQ ID NO: 86504 - RNA, 22 nt, Homo sapiens
ucagugaacgaggaggagggug

SEQ ID NO: 86505 - RNA, 22 nt, Homo sapiens
ugaaagacacagaaguugccca

SEQ ID NO: 86506 - RNA, 22 nt, Homo sapiens
ugaaggacauucuaugguagau

SEQ ID NO: 86507 - RNA, 22 nt, Homo sapiens
ugaauguuugcagcuuauacca

SEQ ID NO: 86508 - RNA, 22 nt, Homo sapiens
ugacaagugauuaaggcauauu

SEQ ID NO: 86509 - RNA, 20 nt, Homo sapiens
ugacaucagcaauguaauaa

SEQ ID NO: 86510 - RNA, 22 nt, Homo sapiens
ugagauuaaucuuuaaguaaga

SEQ ID NO: 86511 - RNA, 22 nt, Homo sapiens
ugagcauuguguuugacuguga

SEQ ID NO: 86512 - RNA, 20 nt, Homo sapiens
ugagcucaauuguugcaagu

SEQ ID NO: 86513 - RNA, 22 nt, Homo sapiens
ugaggacugagaggcacugugg

SEQ ID NO: 86514 - RNA, 22 nt, Homo sapiens
ugaguauguuuagaaguaaagg

SEQ ID NO: 86515 - RNA, 20 nt, Homo sapiens
uggaaugcagccuccuucug

SEQ ID NO: 86516 - RNA, 22 nt, Homo sapiens
uggaauuuagguugauaguaua

SEQ ID NO: 86517 - RNA, 22 nt, Homo sapiens
uggagggcuagucauuucuuuu

SEQ ID NO: 86518 - RNA, 22 nt, Homo sapiens
uggauauguuuauuacccugaa

SEQ ID NO: 86519 - RNA, 22 nt, Homo sapiens
ugggaacugaggugaaaagaca

SEQ ID NO: 86520 - RNA, 22 nt, Homo sapiens
ugggaugaugaaaaggcuuucu

SEQ ID NO: 86521 - RNA, 22 nt, Homo sapiens
ugggugugaccgcucaaggggg

SEQ ID NO: 86522 - RNA, 22 nt, Homo sapiens
uguaacaggaggaaaaugugaa

SEQ ID NO: 86523 - RNA, 22 nt, Homo sapiens
ugucaggaggguccagagaaaa

SEQ ID NO: 86524 - RNA, 22 nt, Homo sapiens
ugucuuggaugaggauuaacag

SEQ ID NO: 86525 - RNA, 17 nt, Homo sapiens
ugugauugaagucaucc

SEQ ID NO: 86526 - RNA, 22 nt, Homo sapiens
ugugauugauuaaugugugcua

SEQ ID NO: 86527 - RNA, 22 nt, Homo sapiens
uguuaagauguguuuuguggcu

SEQ ID NO: 86528 - RNA, 17 nt, Homo sapiens
uuacaggugcugagagu

SEQ ID NO: 86529 - RNA, 22 nt, Homo sapiens
uuacuagaacauuuagggaacu

SEQ ID NO: 86530 - RNA, 21 nt, Homo sapiens
uuaggcagugucagaggugag

SEQ ID NO: 86531 - RNA, 22 nt, Homo sapiens
uucaagaauuaaaguggcuuuu

SEQ ID NO: 86532 - RNA, 22 nt, Homo sapiens
uucccugaaguguuacucuaga

SEQ ID NO: 86533 - RNA, 22 nt, Homo sapiens
uucccuuugugcauaggauuug

SEQ ID NO: 86534 - RNA, 18 nt, Homo sapiens
uucuuguguugauauuuu

SEQ ID NO: 86535 - RNA, 22 nt, Homo sapiens
uugaaagacaucaccuacugcu

SEQ ID NO: 86536 - RNA, 22 nt, Homo sapiens
uugaaagaugaacuggauugga

SEQ ID NO: 86537 - RNA, 22 nt, Homo sapiens
uugaagguaggaugugcuauca

SEQ ID NO: 86538 - RNA, 22 nt, Homo sapiens
uugacuuuuaggaggaaaauga

SEQ ID NO: 86539 - RNA, 22 nt, Homo sapiens
uugcacuccagccugggugaca

SEQ ID NO: 86540 - RNA, 22 nt, Homo sapiens
uugcacuccauccuggguugac

SEQ ID NO: 86541 - RNA, 22 nt, Homo sapiens
uugggacccuguccuguaacaa

SEQ ID NO: 86542 - RNA, 22 nt, Homo sapiens
uuucccuuacuuaaacuuacuc

SEQ ID NO: 86543 - RNA, 22 nt, Homo sapiens
uuucccuuugcuuugucagcca

SEQ ID NO: 86544 - RNA, 22 nt, Homo sapiens
cuugugauugcacggcugccug

SEQ ID NO: 86545 - RNA, 22 nt, Homo sapiens
gaaucaauugaucuaugugucu

SEQ ID NO: 86546 - RNA, 22 nt, Homo sapiens
gagaacagagauaauuuuacuu

SEQ ID NO: 86547 - RNA, 20 nt, Homo sapiens
gagcugguguacugccgggc

SEQ ID NO: 86548 - RNA, 22 nt, Homo sapiens
gaucacuuugaugccaggaacu

SEQ ID NO: 86549 - RNA, 22 nt, Homo sapiens
gcugcuuuugaugacaaaaaca

SEQ ID NO: 86550 - RNA, 22 nt, Homo sapiens
ggaaagaucagcuaaauguaag

SEQ ID NO: 86551 - RNA, 22 nt, Homo sapiens
ggaagaauauuaggggauuucg

SEQ ID NO: 86552 - RNA, 22 nt, Homo sapiens
ggacaagagacugggacacuga

SEQ ID NO: 86553 - RNA, 22 nt, Homo sapiens
ggcuagagaauagugccacuaa

SEQ ID NO: 86554 - RNA, 22 nt, Homo sapiens
gugaaagacauauaugguuuga

SEQ ID NO: 86555 - RNA, 22 nt, Homo sapiens
gugagguguuaaccaaccugug

SEQ ID NO: 86556 - RNA, 22 nt, Homo sapiens
gugauugugaaaacauuaagaa

SEQ ID NO: 86557 - RNA, 22 nt, Homo sapiens
gugcacgucuuaggaggucacg

SEQ ID NO: 86558 - RNA, 22 nt, Homo sapiens
guggaucacuugagguuagaag

SEQ ID NO: 86559 - RNA, 22 nt, Homo sapiens
guggcuagaaugaagguagcug

SEQ ID NO: 86560 - RNA, 22 nt, Homo sapiens
uaauagcucggauaaacaugau

SEQ ID NO: 86561 - RNA, 22 nt, Homo sapiens
uacccuguaaucugaaacauga

SEQ ID NO: 86562 - RNA, 22 nt, Homo sapiens
uagauaauuagaggguuuuaag

SEQ ID NO: 86563 - RNA, 22 nt, Homo sapiens
uagauaguuaugauuugaugau

SEQ ID NO: 86564 - RNA, 22 nt, Homo sapiens
uagcagcagugguguauuuaga

SEQ ID NO: 86565 - RNA, 19 nt, Homo sapiens
uagcagcaugauuuauaau

SEQ ID NO: 86566 - RNA, 22 nt, Homo sapiens
uagcugguucuccaggagcuag

SEQ ID NO: 86567 - RNA, 20 nt, Homo sapiens
uauuacagaguaauggugga

SEQ ID NO: 86568 - RNA, 22 nt, Homo sapiens
ucaaggacuacauggggugaaa

SEQ ID NO: 86569 - RNA, 22 nt, Homo sapiens
ucaggcaugcagcaaugcagug

SEQ ID NO: 86570 - RNA, 22 nt, Homo sapiens
ucauuagagaucuuggggaaaa

SEQ ID NO: 86571 - RNA, 22 nt, Homo sapiens
ucccuugagccuggcuucucac

SEQ ID NO: 86572 - RNA, 22 nt, Homo sapiens
ucccuuucuggaguuucccaag

SEQ ID NO: 86573 - RNA, 22 nt, Homo sapiens
uccugagaauagaguugcaugu

SEQ ID NO: 86574 - RNA, 22 nt, Homo sapiens
ugacagugaacagguuaccacu

SEQ ID NO: 86575 - RNA, 17 nt, Homo sapiens
ugagcuaugauccuguc

SEQ ID NO: 86576 - RNA, 22 nt, Homo sapiens
ugaggaacuagcuacccuaaua

SEQ ID NO: 86577 - RNA, 22 nt, Homo sapiens
ugagguaggugaagaaugcacg

SEQ ID NO: 86578 - RNA, 22 nt, Homo sapiens
ugaguaugaguucaggaaaggc

SEQ ID NO: 86579 - RNA, 22 nt, Homo sapiens
ugaguauguaggaugugucuua

SEQ ID NO: 86580 - RNA, 22 nt, Homo sapiens
ugauaauguuaggcuuuauuca

SEQ ID NO: 86581 - RNA, 22 nt, Homo sapiens
ugauaggucuguuuugaaaagg

SEQ ID NO: 86582 - RNA, 22 nt, Homo sapiens
ugcaagacacuguccugggcau

SEQ ID NO: 86583 - RNA, 22 nt, Homo sapiens
ugcacuguggucugagagacag

SEQ ID NO: 86584 - RNA, 22 nt, Homo sapiens
uggagagucauuuauaguauuu

SEQ ID NO: 86585 - RNA, 20 nt, Homo sapiens
uggaggucaucugucacuac

SEQ ID NO: 86586 - RNA, 22 nt, Homo sapiens
ugggaaugaaauuacauagcuu

SEQ ID NO: 86587 - RNA, 22 nt, Homo sapiens
aaaugcuuucuuggaccauuug

SEQ ID NO: 86588 - RNA, 22 nt, Homo sapiens
aagcugguguugcugcucuguu

SEQ ID NO: 86589 - RNA, 22 nt, Homo sapiens
aaugggacugacgccucccaga

SEQ ID NO: 86590 - RNA, 22 nt, Homo sapiens
aauuaguuggcugccuaugauu

SEQ ID NO: 86591 - RNA, 22 nt, Homo sapiens
acccugucaaaauagaccaauc

SEQ ID NO: 86592 - RNA, 22 nt, Homo sapiens
acugcacuccaaccuuggugac

SEQ ID NO: 86593 - RNA, 22 nt, Homo sapiens
acugcacuccacccuuggcagc

SEQ ID NO: 86594 - RNA, 22 nt, Homo sapiens
acugcacuccagccucggcaau

SEQ ID NO: 86595 - RNA, 22 nt, Homo sapiens
acugcacuccagccucggugac

SEQ ID NO: 86596 - RNA, 22 nt, Homo sapiens
acugcacuccagccugccgaca

SEQ ID NO: 86597 - RNA, 22 nt, Homo sapiens
acuguacuccagccugggugac

SEQ ID NO: 86598 - RNA, 22 nt, Homo sapiens
agaucauaugcaguaaugaacu

SEQ ID NO: 86599 - RNA, 22 nt, Homo sapiens
aguggaguguaaagcgucuuuu

SEQ ID NO: 86600 - RNA, 22 nt, Homo sapiens
aguucaaaucgagccuggccau

SEQ ID NO: 86601 - RNA, 22 nt, Homo sapiens
auaaagcaagucucuggccuca

SEQ ID NO: 86602 - RNA, 22 nt, Homo sapiens
auacugguuuuugucaugugga

SEQ ID NO: 86603 - RNA, 21 nt, Homo sapiens
auagcacaucagauuuuauua

SEQ ID NO: 86604 - RNA, 22 nt, Homo sapiens
auagcagaagaagggacaauuc

SEQ ID NO: 86605 - RNA, 22 nt, Homo sapiens
augaauuuucugauguugggua

SEQ ID NO: 86606 - RNA, 22 nt, Homo sapiens
augagcugauuuccuuaccaua

SEQ ID NO: 86607 - RNA, 22 nt, Homo sapiens
auggcagagucagaaagucagg

SEQ ID NO: 86608 - RNA, 22 nt, Homo sapiens
augucuuucauagagacccaga

SEQ ID NO: 86609 - RNA, 22 nt, Homo sapiens
auugcacuccagccugggugag

SEQ ID NO: 86610 - RNA, 22 nt, Homo sapiens
auugcacucuagccugggugac

SEQ ID NO: 86611 - RNA, 22 nt, Homo sapiens
cacugcacuccagucccgucuc

SEQ ID NO: 86612 - RNA, 22 nt, Homo sapiens
cacugcacuccagucuggcgac

SEQ ID NO: 86613 - RNA, 22 nt, Homo sapiens
cacugcacucuucuucugggca

SEQ ID NO: 86614 - RNA, 22 nt, Homo sapiens
cagcuggugggagcuggguucc

SEQ ID NO: 86615 - RNA, 22 nt, Homo sapiens
cagcugguguuacaaaccagag

SEQ ID NO: 86616 - RNA, 22 nt, Homo sapiens
cauaaugcuaagagcugccccu

SEQ ID NO: 86617 - RNA, 22 nt, Homo sapiens
caucacuuugccuccgucucua

SEQ ID NO: 86618 - RNA, 22 nt, Homo sapiens
ccacuguuuaaauggcugagga

SEQ ID NO: 86619 - RNA, 22 nt, Homo sapiens
cucacggcccugcgcacuggca

SEQ ID NO: 86620 - RNA, 22 nt, Homo sapiens
cugacaucuucaagugaggaga

SEQ ID NO: 86621 - RNA, 21 nt, Homo sapiens
cugcauccauuucugagugau

SEQ ID NO: 86622 - RNA, 22 nt, Homo sapiens
cugucucagccucuccaguagc

SEQ ID NO: 86623 - RNA, 22 nt, Homo sapiens
cugucucagugaauugguuuua

SEQ ID NO: 86624 - RNA, 23 nt, Homo sapiens
gaaguaauaaauggauucuuaac

SEQ ID NO: 86625 - RNA, 22 nt, Homo sapiens
gaaucauuguuucuaaguuugu

SEQ ID NO: 86626 - RNA, 22 nt, Homo sapiens
gacccuguugggguuuagggcu

SEQ ID NO: 86627 - RNA, 22 nt, Homo sapiens
gaggugguagguucacagcagc

SEQ ID NO: 86628 - RNA, 22 nt, Homo sapiens
gaguucaauuuccagcuguucu

SEQ ID NO: 86629 - RNA, 22 nt, Homo sapiens
gaugagcuaaguucucacagca

SEQ ID NO: 86630 - RNA, 22 nt, Homo sapiens
gcacauuacaaguauuagcuca

SEQ ID NO: 86631 - RNA, 22 nt, Homo sapiens
ggaaagacuauuguaaaggaug

SEQ ID NO: 86632 - RNA, 22 nt, Homo sapiens
ggaaguuaauacagauagagua

SEQ ID NO: 86633 - RNA, 21 nt, Homo sapiens
ggaauuuagggaaugauuuag

SEQ ID NO: 86634 - RNA, 22 nt, Homo sapiens
ggaucacagccagcucccagaa

SEQ ID NO: 86635 - RNA, 22 nt, Homo sapiens
ggaucacuugagaccaggaguu

SEQ ID NO: 86636 - RNA, 22 nt, Homo sapiens
ggcaaggauguuuuucuggcaa

SEQ ID NO: 86637 - RNA, 22 nt, Homo sapiens
gguggugguauuucagaaaaug

SEQ ID NO: 86638 - RNA, 22 nt, Homo sapiens
guauagcacauaauacuugaug

SEQ ID NO: 86639 - RNA, 22 nt, Homo sapiens
guauggaauuugugaccuuaua

SEQ ID NO: 86640 - RNA, 22 nt, Homo sapiens
guaugugacuggaacaguagga

SEQ ID NO: 86641 - RNA, 22 nt, Homo sapiens
gucacugugaggaggggccagg

SEQ ID NO: 86642 - RNA, 22 nt, Homo sapiens
gucaggaccucgguggcauucu

SEQ ID NO: 86643 - RNA, 22 nt, Homo sapiens
gucauggaggaugaauggccaa

SEQ ID NO: 86644 - RNA, 22 nt, Homo sapiens
gugaaagauuaaaccagugugu

SEQ ID NO: 86645 - RNA, 22 nt, Homo sapiens
gugaaaugaaucuggaaauauu

SEQ ID NO: 86646 - RNA, 21 nt, Homo sapiens
gugcacaguaguguuuaauag

SEQ ID NO: 86647 - RNA, 22 nt, Homo sapiens
guggcaugaaagcaucugugau

SEQ ID NO: 86648 - RNA, 22 nt, Homo sapiens
gugggaagcuggaacucccucc

SEQ ID NO: 86649 - RNA, 22 nt, Homo sapiens
gugggauggaaaugggcuucag

SEQ ID NO: 86650 - RNA, 22 nt, Homo sapiens
gugucacuguauaauauuuauu

SEQ ID NO: 86651 - RNA, 22 nt, Homo sapiens
uaauaauguuaggcuuacucaa

SEQ ID NO: 86652 - RNA, 19 nt, Homo sapiens
uacugcacuccagucuggg

SEQ ID NO: 86653 - RNA, 22 nt, Homo sapiens
uagauaguaaagccauuagcuu

SEQ ID NO: 86654 - RNA, 22 nt, Homo sapiens
uaggacacagaccuggauggaa

SEQ ID NO: 86655 - RNA, 22 nt, Homo sapiens
uaggacacagauggagaaaagc

SEQ ID NO: 86656 - RNA, 22 nt, Homo sapiens
uaggacacaggacauauguaga

SEQ ID NO: 86657 - RNA, 22 nt, Homo sapiens
uaggcacacaucuacuacaaau

SEQ ID NO: 86658 - RNA, 22 nt, Homo sapiens
uauugcacuuuuccauaggagu

SEQ ID NO: 86659 - RNA, 22 nt, Homo sapiens
ucaaggacucagagagggauua

SEQ ID NO: 86660 - RNA, 22 nt, Homo sapiens
ucacuggaggagaggaagugga

SEQ ID NO: 86661 - RNA, 22 nt, Homo sapiens
ucagacacugagcaaacgacua

SEQ ID NO: 86662 - RNA, 22 nt, Homo sapiens
ucugucuuugucaggaccagag

SEQ ID NO: 86663 - RNA, 20 nt, Homo sapiens
ucuugggaauguagccuagg

SEQ ID NO: 86664 - RNA, 22 nt, Homo sapiens
ugaaacacacauugcccuuuau

SEQ ID NO: 86665 - RNA, 22 nt, Homo sapiens
ugaaagacugaaagcuuuucuu

SEQ ID NO: 86666 - RNA, 22 nt, Homo sapiens
ugaaagacugaagaauaggcau

SEQ ID NO: 86667 - RNA, 22 nt, Homo sapiens
ugaauucuguccaaaauaacug

SEQ ID NO: 86668 - RNA, 18 nt, Homo sapiens
ugacaucauuuagaaagg

SEQ ID NO: 86669 - RNA, 22 nt, Homo sapiens
ugagaauauuugaagauguuag

SEQ ID NO: 86670 - RNA, 22 nt, Homo sapiens
ugagaggugauaaagcaagggu

SEQ ID NO: 86671 - RNA, 22 nt, Homo sapiens
ugagcuaugaucccaccucugu

SEQ ID NO: 86672 - RNA, 22 nt, Homo sapiens
ugcacaguccagugcccacuga

SEQ ID NO: 86673 - RNA, 22 nt, Homo sapiens
ugcaucacaguacuccagccug

SEQ ID NO: 86674 - RNA, 22 nt, Homo sapiens
uggaaaauuaggggagguuaua

SEQ ID NO: 86675 - RNA, 22 nt, Homo sapiens
uggagugagaacuucaaugaug

SEQ ID NO: 86676 - RNA, 22 nt, Homo sapiens
uggcauguaaugcagaaguugc

SEQ ID NO: 86677 - RNA, 22 nt, Homo sapiens
ugggaugaaaauagcuucuucc

SEQ ID NO: 86678 - RNA, 22 nt, Homo sapiens
ugucaggagcaaugauaaauuu

SEQ ID NO: 86679 - RNA, 22 nt, Homo sapiens
ugucaggaugcuccuuuuggcu

SEQ ID NO: 86680 - RNA, 18 nt, Homo sapiens
ugucccuuugcuguucau

SEQ ID NO: 86681 - RNA, 22 nt, Homo sapiens
ugucuuggagaauccuggguuu

SEQ ID NO: 86682 - RNA, 22 nt, Homo sapiens
ugugacagcacgguucaacugc

SEQ ID NO: 86683 - RNA, 22 nt, Homo sapiens
ugugauugauauauuuacagaa

SEQ ID NO: 86684 - RNA, 22 nt, Homo sapiens
ugugauuggccuggcguggguc

SEQ ID NO: 86685 - RNA, 18 nt, Homo sapiens
uguggcuguuuuccaaua

SEQ ID NO: 86686 - RNA, 22 nt, Homo sapiens
uuacaguauugcaaggacuagg

SEQ ID NO: 86687 - RNA, 22 nt, Homo sapiens
uuagggaggcucaggacaagag

SEQ ID NO: 86688 - RNA, 23 nt, Homo sapiens
uucaacagguagacccucccugc

SEQ ID NO: 86689 - RNA, 22 nt, Homo sapiens
uucccugaaauauucacuuuca

SEQ ID NO: 86690 - RNA, 22 nt, Homo sapiens
uucucuaguuacuuuaauggag

SEQ ID NO: 86691 - RNA, 22 nt, Homo sapiens
uugaaagaaaggagacugaguu

SEQ ID NO: 86692 - RNA, 22 nt, Homo sapiens
uugacaguugggcagggaaguu

SEQ ID NO: 86693 - RNA, 22 nt, Homo sapiens
uugaggugaauuugcaggaugc

SEQ ID NO: 86694 - RNA, 22 nt, Homo sapiens
uugaguuugaguauucuaaagc

SEQ ID NO: 86695 - RNA, 22 nt, Homo sapiens
uugcacagucuagcuccaccuu

SEQ ID NO: 86696 - RNA, 22 nt, Homo sapiens
ucagguaucuuuauagcgaugc

SEQ ID NO: 86697 - RNA, 22 nt, Homo sapiens
ucauggggugcuuugcuagauu

SEQ ID NO: 86698 - RNA, 22 nt, Homo sapiens
ucucaaguggucgcaguuagau

SEQ ID NO: 86699 - RNA, 23 nt, Homo sapiens
ucugauguuauaaaauucuuugg

SEQ ID NO: 86700 - RNA, 22 nt, Homo sapiens
ucuuugauuuuguuacuaagac

SEQ ID NO: 86701 - RNA, 22 nt, Homo sapiens
ugaagugggaaaugaguauuaa

SEQ ID NO: 86702 - RNA, 23 nt, Homo sapiens
ugaauguaucgaaugugggaaag

SEQ ID NO: 86703 - RNA, 18 nt, Homo sapiens
ugauaucaaugauagcca

SEQ ID NO: 86704 - RNA, 22 nt, Homo sapiens
ugauggcauuuggaguugggac

SEQ ID NO: 86705 - RNA, 22 nt, Homo sapiens
ugcauauguucaaaguauucug

SEQ ID NO: 86706 - RNA, 22 nt, Homo sapiens
ugcauccauucuagacucaucu

SEQ ID NO: 86707 - RNA, 22 nt, Homo sapiens
ugccaguguugccuuucacuag

SEQ ID NO: 86708 - RNA, 22 nt, Homo sapiens
ugcugcuguuaucauuuuacca

SEQ ID NO: 86709 - RNA, 22 nt, Homo sapiens
uggaguaggccuaagaaugaca

SEQ ID NO: 86710 - RNA, 19 nt, Homo sapiens
uggagucaucaugcugcua

SEQ ID NO: 86711 - RNA, 22 nt, Homo sapiens
ugucaagaugguuugauguugu

SEQ ID NO: 86712 - RNA, 22 nt, Homo sapiens
ugugaguguguacuaguuauca

SEQ ID NO: 86713 - RNA, 22 nt, Homo sapiens
uguguauaucacugcaugagug

SEQ ID NO: 86714 - RNA, 22 nt, Homo sapiens
uuaaggcauucuuugucuucau

SEQ ID NO: 86715 - RNA, 22 nt, Homo sapiens
uuaauguaucuaucacaucaca

SEQ ID NO: 86716 - RNA, 21 nt, Homo sapiens
uuauccagcacuguuucggac

SEQ ID NO: 86717 - RNA, 22 nt, Homo sapiens
uucuacuccucauggcagguug

SEQ ID NO: 86718 - RNA, 17 nt, Homo sapiens
uucucaguucugaucuc

SEQ ID NO: 86719 - RNA, 22 nt, Homo sapiens
uucugagguuauauucucucaa

SEQ ID NO: 86720 - RNA, 19 nt, Homo sapiens
uucugguguuuuaagccaa

SEQ ID NO: 86721 - RNA, 22 nt, Homo sapiens
uucuuccagccuugaggggccc

SEQ ID NO: 86722 - RNA, 22 nt, Homo sapiens
uugaagguagaaguucucaauu

SEQ ID NO: 86723 - RNA, 22 nt, Homo sapiens
aacaucaaccaugaggguugga

SEQ ID NO: 86724 - RNA, 22 nt, Homo sapiens
aacugcuguuuggguacuggug

SEQ ID NO: 86725 - RNA, 22 nt, Homo sapiens
aagagguuuaacugacucacag

SEQ ID NO: 86726 - RNA, 22 nt, Homo sapiens
aaguaauggaguuauuuuauga

SEQ ID NO: 86727 - RNA, 22 nt, Homo sapiens
aaguauguaucaagucauacuu

SEQ ID NO: 86728 - RNA, 22 nt, Homo sapiens
aaucagcacacugugcuuucca

SEQ ID NO: 86729 - RNA, 22 nt, Homo sapiens
aauggcauugguccuuuuggau

SEQ ID NO: 86730 - RNA, 22 nt, Homo sapiens
aauuaggcuagaauguuauuaa

SEQ ID NO: 86731 - RNA, 22 nt, Homo sapiens
aauuaguaaccuaauuccaucu

SEQ ID NO: 86732 - RNA, 22 nt, Homo sapiens
agacuguaaugcauaauuuacu

SEQ ID NO: 86733 - RNA, 22 nt, Homo sapiens
agcagcaucgggaaguuggcca

SEQ ID NO: 86734 - RNA, 19 nt, Homo sapiens
aggcauugugcucaucugu

SEQ ID NO: 86735 - RNA, 22 nt, Homo sapiens
aguauguagugcaaucagucag

SEQ ID NO: 86736 - RNA, 22 nt, Homo sapiens
aguucaaugcucuuucuacuau

SEQ ID NO: 86737 - RNA, 22 nt, Homo sapiens
auagcagaauuuggucaagucu

SEQ ID NO: 86738 - RNA, 22 nt, Homo sapiens
acaagcacaaauuuaauccugu

SEQ ID NO: 86739 - RNA, 22 nt, Homo sapiens
accuguagcagacuuaauauuu

SEQ ID NO: 86740 - RNA, 22 nt, Homo sapiens
acuggaguuuguucaagaaaua

SEQ ID NO: 86741 - RNA, 22 nt, Homo sapiens
agacaucauuugauggugggag

SEQ ID NO: 86742 - RNA, 22 nt, Homo sapiens
agagugcuuuauuagauguagc

SEQ ID NO: 86743 - RNA, 22 nt, Homo sapiens
agguaaguauguuauuacuuuu

SEQ ID NO: 86744 - RNA, 22 nt, Homo sapiens
agguacuugagauucugaacug

SEQ ID NO: 86745 - RNA, 21 nt, Homo sapiens
aggugucuuggguucccuggc

SEQ ID NO: 86746 - RNA, 22 nt, Homo sapiens
agucacagccuuuuacuuuaga

SEQ ID NO: 86747 - RNA, 22 nt, Homo sapiens
agucagugucuguaaggagaac

SEQ ID NO: 86748 - RNA, 22 nt, Homo sapiens
aguccagguuuuguaauggcaa

SEQ ID NO: 86749 - RNA, 22 nt, Homo sapiens
auaauaucagguugugaugaug

SEQ ID NO: 86750 - RNA, 22 nt, Homo sapiens
auauguauuuuaacguguaagg

SEQ ID NO: 86751 - RNA, 22 nt, Homo sapiens
aucaggcacacauuggaguuug

SEQ ID NO: 86752 - RNA, 22 nt, Homo sapiens
aucagucuguuggaauaucgcu

SEQ ID NO: 86753 - RNA, 22 nt, Homo sapiens
aucagugagugguuagugaaug

SEQ ID NO: 86754 - RNA, 22 nt, Homo sapiens
aucauugugcaucuucauucca

SEQ ID NO: 86755 - RNA, 22 nt, Homo sapiens
augaagagaaaguggaucuugg

SEQ ID NO: 86756 - RNA, 22 nt, Homo sapiens
augaggagguaugauuuucuga

SEQ ID NO: 86757 - RNA, 22 nt, Homo sapiens
augaggcuauaauuuuuaugua

SEQ ID NO: 86758 - RNA, 22 nt, Homo sapiens
augauacugaguugaguucuca

SEQ ID NO: 86759 - RNA, 22 nt, Homo sapiens
augaucauggaaguuuuccugu

SEQ ID NO: 86760 - RNA, 22 nt, Homo sapiens
augcuacuggauuuguauaaau

SEQ ID NO: 86761 - RNA, 22 nt, Homo sapiens
auggcacuaaugggaguuuacu

SEQ ID NO: 86762 - RNA, 22 nt, Homo sapiens
auggcaguuucacucugggauu

SEQ ID NO: 86763 - RNA, 22 nt, Homo sapiens
auggcaucgucaccuuuucagu

SEQ ID NO: 86764 - RNA, 22 nt, Homo sapiens
auggcauuuuuagggcugggug

SEQ ID NO: 86765 - RNA, 22 nt, Homo sapiens
auggcuuuaagagugucugaau

SEQ ID NO: 86766 - RNA, 22 nt, Homo sapiens
auguauacauagauacgugugu

SEQ ID NO: 86767 - RNA, 22 nt, Homo sapiens
auuagguuagugcaaaaguaau

SEQ ID NO: 86768 - RNA, 22 nt, Homo sapiens
auucaccauggaccaggggccu

SEQ ID NO: 86769 - RNA, 22 nt, Homo sapiens
caagagagcugaugguuuuaaa

SEQ ID NO: 86770 - RNA, 22 nt, Homo sapiens
cagguacuucugggcugagcag

SEQ ID NO: 86771 - RNA, 22 nt, Homo sapiens
cagucacagugacaggaugugg

SEQ ID NO: 86772 - RNA, 22 nt, Homo sapiens
cauaaagauggaggaggccagg

SEQ ID NO: 86773 - RNA, 22 nt, Homo sapiens
caucagauugagaucaucuaag

SEQ ID NO: 86774 - RNA, 22 nt, Homo sapiens
ccuaggcacugggguccagccc

SEQ ID NO: 86775 - RNA, 20 nt, Homo sapiens
cuaaucaucccagaagaaau

SEQ ID NO: 86776 - RNA, 22 nt, Homo sapiens
cuguuugauuaagugguggaaa

SEQ ID NO: 86777 - RNA, 22 nt, Homo sapiens
cuuccaaguggggcacgugcca

SEQ ID NO: 86778 - RNA, 22 nt, Homo sapiens
gaaguaguaaaauuuauugcag

SEQ ID NO: 86779 - RNA, 22 nt, Homo sapiens
gagaacauuuaagccacucagg

SEQ ID NO: 86780 - RNA, 22 nt, Homo sapiens
gagcuagggucaugcuacugca

SEQ ID NO: 86781 - RNA, 22 nt, Homo sapiens
gaggagauauucugcuggaugg

SEQ ID NO: 86782 - RNA, 22 nt, Homo sapiens
gaguuagguugucaaugucuua

SEQ ID NO: 86783 - RNA, 22 nt, Homo sapiens
gauaugaguagucgcauugaug

SEQ ID NO: 86784 - RNA, 22 nt, Homo sapiens
gcauggagaaggggacugauuc

SEQ ID NO: 86785 - RNA, 22 nt, Homo sapiens
gcuaggagauccacugcucucu

SEQ ID NO: 86786 - RNA, 22 nt, Homo sapiens
ggacaucauuaccauggaccca

SEQ ID NO: 86787 - RNA, 22 nt, Homo sapiens
ggauggcauuucuuuagcuuuu

SEQ ID NO: 86788 - RNA, 22 nt, Homo sapiens
gggcauugugggcagagggcag

SEQ ID NO: 86789 - RNA, 22 nt, Homo sapiens
gucauugagucagggaguaucu

SEQ ID NO: 86790 - RNA, 22 nt, Homo sapiens
gugacuggacucugaagaaaau

SEQ ID NO: 86791 - RNA, 22 nt, Homo sapiens
guuacugucuuccugauugcuu

SEQ ID NO: 86792 - RNA, 22 nt, Homo sapiens
guucuggagauaaagccaaggu

SEQ ID NO: 86793 - RNA, 22 nt, Homo sapiens
uaagacuguuggcaauuuuugc

SEQ ID NO: 86794 - RNA, 22 nt, Homo sapiens
uaaguaguguugagacaaguuu

SEQ ID NO: 86795 - RNA, 22 nt, Homo sapiens
uaaguaguuucuggauauucuc

SEQ ID NO: 86796 - RNA, 22 nt, Homo sapiens
uaauauguuuugaaaucaggaa

SEQ ID NO: 86797 - RNA, 22 nt, Homo sapiens
uagacccauuguucagagagug

SEQ ID NO: 86798 - RNA, 22 nt, Homo sapiens
uagcagcaccccacucuacugg

SEQ ID NO: 86799 - RNA, 20 nt, Homo sapiens
uagcagcagacagagggagg

SEQ ID NO: 86800 - RNA, 22 nt, Homo sapiens
uagcagcagugguguauuuaga

SEQ ID NO: 86801 - RNA, 22 nt, Homo sapiens
uagcagcaucucuggcuucuac

SEQ ID NO: 86802 - RNA, 19 nt, Homo sapiens
uagcagcaugauuuauaau

SEQ ID NO: 86803 - RNA, 22 nt, Homo sapiens
uagcagcauuuuuguagaguau

SEQ ID NO: 86804 - RNA, 22 nt, Homo sapiens
uagcugcugcuaggcuaaggau

SEQ ID NO: 86805 - RNA, 22 nt, Homo sapiens
uagggcuuuaguuugcuugugu

SEQ ID NO: 86806 - RNA, 22 nt, Homo sapiens
uaguuauggaguaauuuuaagc

SEQ ID NO: 86807 - RNA, 22 nt, Homo sapiens
uaucacaguagaacucuuucca

SEQ ID NO: 86808 - RNA, 22 nt, Homo sapiens
uauggcauuauuuugauagaca

SEQ ID NO: 86809 - RNA, 22 nt, Homo sapiens
uauggcauuguuggugaugaua

SEQ ID NO: 86810 - RNA, 22 nt, Homo sapiens
uauggcuuuuauuauguuguag

SEQ ID NO: 86811 - RNA, 17 nt, Homo sapiens
uauguaguacuuauaaa

SEQ ID NO: 86812 - RNA, 22 nt, Homo sapiens
uugaaguguguauacauugugg

SEQ ID NO: 86813 - RNA, 22 nt, Homo sapiens
uugaauagacagccagcuuuaa

SEQ ID NO: 86814 - RNA, 22 nt, Homo sapiens
uugacuucagagcugauucaag

SEQ ID NO: 86815 - RNA, 22 nt, Homo sapiens
uugagggaaacauucacaucau

SEQ ID NO: 86816 - RNA, 22 nt, Homo sapiens
uugauaguuuuaaaauuaaucu

SEQ ID NO: 86817 - RNA, 22 nt, Homo sapiens
uugauguugaggacauaaaccu

SEQ ID NO: 86818 - RNA, 18 nt, Homo sapiens
uugcaucauuuuguuguu

SEQ ID NO: 86819 - RNA, 22 nt, Homo sapiens
uuucccauuguucugcucugug

SEQ ID NO: 86820 - RNA, 22 nt, Homo sapiens
uuugacuuuuagaauaugaguu

SEQ ID NO: 86821 - RNA, 22 nt, Homo sapiens
uuuggaagaugccacuguauca

SEQ ID NO: 86822 - RNA, 22 nt, Homo sapiens
uuuguagcucacucugagcuga

SEQ ID NO: 86823 - RNA, 20 nt, Homo sapiens
uuuugcacuccuacuaaggu

SEQ ID NO: 86824 - RNA, 18 nt, Homo sapiens
uuuuugaggcacagggga

SEQ ID NO: 86825 - RNA, 22 nt, Homo sapiens
uuuuugagguauaguguggcua

SEQ ID NO: 86826 - RNA, 22 nt, Homo sapiens
cuuguucuccuaagaugaaugc

SEQ ID NO: 86827 - RNA, 22 nt, Homo sapiens
gaagguaguuuauagauguggu

SEQ ID NO: 86828 - RNA, 22 nt, Homo sapiens
gaaucacagauuaugaguaucu

SEQ ID NO: 86829 - RNA, 22 nt, Homo sapiens
gagcaucauucaacaaaagucu

SEQ ID NO: 86830 - RNA, 22 nt, Homo sapiens
gaggcacucuguacaaaucugc

SEQ ID NO: 86831 - RNA, 22 nt, Homo sapiens
gaguaacauugacaacuucaug

SEQ ID NO: 86832 - RNA, 21 nt, Homo sapiens
gauaucuuuauucccaagagc

SEQ ID NO: 86833 - RNA, 22 nt, Homo sapiens
gauggcaugugcugccaccaag

SEQ ID NO: 86834 - RNA, 22 nt, Homo sapiens
gauggcauuucuggaucugaca

SEQ ID NO: 86835 - RNA, 22 nt, Homo sapiens
gcacauggccccaucgugccga

SEQ ID NO: 86836 - RNA, 22 nt, Homo sapiens
gcaugacaaugauugcucuuca

SEQ ID NO: 86837 - RNA, 22 nt, Homo sapiens
gcaugcacaugugaaaaaauga

SEQ ID NO: 86838 - RNA, 22 nt, Homo sapiens
gcugcuguuuaguuucuccugg

SEQ ID NO: 86839 - RNA, 22 nt, Homo sapiens
gcuuuguuaaaacacagccaca

SEQ ID NO: 86840 - RNA, 22 nt, Homo sapiens
ggcacuguggcucaagccugua

SEQ ID NO: 86841 - RNA, 22 nt, Homo sapiens
ggcagcauugccuuugcaguga

SEQ ID NO: 86842 - RNA, 22 nt, Homo sapiens
ggcuuggaggaaugugagggcu

SEQ ID NO: 86843 - RNA, 22 nt, Homo sapiens
gggguauguaagugagugagug

SEQ ID NO: 86844 - RNA, 22 nt, Homo sapiens
ggucauagagaauucaccagga

SEQ ID NO: 86845 - RNA, 22 nt, Homo sapiens
ggugcagcacaccaacauggca

SEQ ID NO: 86846 - RNA, 22 nt, Homo sapiens
gucacuguuuccuauuauauuu

SEQ ID NO: 86847 - RNA, 22 nt, Homo sapiens
gucagauaauuugcauccaucu

SEQ ID NO: 86848 - RNA, 22 nt, Homo sapiens
gucaguggagaaaaggacaugu

SEQ ID NO: 86849 - RNA, 22 nt, Homo sapiens
gucauugaaguggaaucaucca

SEQ ID NO: 86850 - RNA, 22 nt, Homo sapiens
gucauugucaauugacaauugu

SEQ ID NO: 86851 - RNA, 22 nt, Homo sapiens
gucuuugagauaggguuauuuu

SEQ ID NO: 86852 - RNA, 22 nt, Homo sapiens
gugggcaagucacuucaguucu

SEQ ID NO: 86853 - RNA, 22 nt, Homo sapiens
uaagguguagacuggucacaag

SEQ ID NO: 86854 - RNA, 22 nt, Homo sapiens
uacguuaucagguaugcaagag

SEQ ID NO: 86855 - RNA, 22 nt, Homo sapiens
uacuagaggaauugcuauaacu

SEQ ID NO: 86856 - RNA, 22 nt, Homo sapiens
uagcagcaaagcaggaucugcu

SEQ ID NO: 86857 - RNA, 22 nt, Homo sapiens
uagcagcauaaauggacuaaga

SEQ ID NO: 86858 - RNA, 22 nt, Homo sapiens
uagcaucaauucauguuaugau

SEQ ID NO: 86859 - RNA, 22 nt, Homo sapiens
uagcaucagauuccauauucua

SEQ ID NO: 86860 - RNA, 22 nt, Homo sapiens
uagcugcuguauguacacggau

SEQ ID NO: 86861 - RNA, 22 nt, Homo sapiens
uaggcacugagaauaugaggau

SEQ ID NO: 86862 - RNA, 22 nt, Homo sapiens
uaggcacuguguuuguaggagu

SEQ ID NO: 86863 - RNA, 22 nt, Homo sapiens
uaguaucacauggucuuaauua

SEQ ID NO: 86864 - RNA, 22 nt, Homo sapiens
uaucaucauguuuuugcugugu

SEQ ID NO: 86865 - RNA, 22 nt, Homo sapiens
uaucucuuuucauguguaaaug

SEQ ID NO: 86866 - RNA, 22 nt, Homo sapiens
uauugauuaauugugauuaggc

SEQ ID NO: 86867 - RNA, 22 nt, Homo sapiens
ucacaauucacuacaggcuuga

SEQ ID NO: 86868 - RNA, 22 nt, Homo sapiens
ucacaguucagcauggcugagg

SEQ ID NO: 86869 - RNA, 22 nt, Homo sapiens
ucacaugugcguuuuggcaugu

SEQ ID NO: 86870 - RNA, 22 nt, Homo sapiens
ucagaucaguuccacaagaacu

SEQ ID NO: 86871 - RNA, 22 nt, Homo sapiens
aaagcacuggagucaucaucua

SEQ ID NO: 86872 - RNA, 22 nt, Homo sapiens
aaaguacucaguucaguuccgu

SEQ ID NO: 86873 - RNA, 19 nt, Homo sapiens
aaaguacucugaugccucu

SEQ ID NO: 86874 - RNA, 22 nt, Homo sapiens
aaauugcacaaguggugauuug

SEQ ID NO: 86875 - RNA, 22 nt, Homo sapiens
aagaccuaugcaggaagaaaug

SEQ ID NO: 86876 - RNA, 22 nt, Homo sapiens
aagcaugguuuccaggggucac

SEQ ID NO: 86877 - RNA, 22 nt, Homo sapiens
aaggaacuggaauauuuugaac

SEQ ID NO: 86878 - RNA, 22 nt, Homo sapiens
aauacucuauaagggaagcugu

SEQ ID NO: 86879 - RNA, 22 nt, Homo sapiens
aauggcaucuacguuaaauguc

SEQ ID NO: 86880 - RNA, 22 nt, Homo sapiens
aauggcaucuagaguggugaau

SEQ ID NO: 86881 - RNA, 22 nt, Homo sapiens
aauggcauuugccagggcaaag

SEQ ID NO: 86882 - RNA, 22 nt, Homo sapiens
acaucauugggggcuacaggug

SEQ ID NO: 86883 - RNA, 22 nt, Homo sapiens
agaauguauauucuguaguugu

SEQ ID NO: 86884 - RNA, 22 nt, Homo sapiens
agcaucauguuuucgagguuca

SEQ ID NO: 86885 - RNA, 21 nt, Homo sapiens
agccaguguuccuuguggcuc

SEQ ID NO: 86886 - RNA, 22 nt, Homo sapiens
agcuugugauuuagagugagag

SEQ ID NO: 86887 - RNA, 22 nt, Homo sapiens
agggaauguaaguuuuaugaga

SEQ ID NO: 86888 - RNA, 22 nt, Homo sapiens
agggcuuuugagcugagauggu

SEQ ID NO: 86889 - RNA, 22 nt, Homo sapiens
agguauauuggacagauguaaa

SEQ ID NO: 86890 - RNA, 22 nt, Homo sapiens
aguagcauuggggggcauccuc

SEQ ID NO: 86891 - RNA, 20 nt, Homo sapiens
aguauucacuuuuuucaugg

SEQ ID NO: 86892 - RNA, 22 nt, Homo sapiens
agucgguguuacugacagaaug

SEQ ID NO: 86893 - RNA, 22 nt, Homo sapiens
auaaggcugguauagacauuca

SEQ ID NO: 86894 - RNA, 22 nt, Homo sapiens
auacuguauaggauuguagccu

SEQ ID NO: 86895 - RNA, 22 nt, Homo sapiens
auagaguuagaaagaaauguuu

SEQ ID NO: 86896 - RNA, 22 nt, Homo sapiens
auagugaacuuugugagaacaa

SEQ ID NO: 86897 - RNA, 22 nt, Homo sapiens
aucacuuugcucuccagugugg

SEQ ID NO: 86898 - RNA, 22 nt, Homo sapiens
augauagucuugagaagcauuu

SEQ ID NO: 86899 - RNA, 22 nt, Homo sapiens
augcaagacaccgauuagcuuu

SEQ ID NO: 86900 - RNA, 18 nt, Homo sapiens
augcauauuuuaaguugu

SEQ ID NO: 86901 - RNA, 22 nt, Homo sapiens
augcuacauucuacaauuaggc

SEQ ID NO: 86902 - RNA, 22 nt, Homo sapiens
augcuacugauaagcaaucauu

SEQ ID NO: 86903 - RNA, 22 nt, Homo sapiens
auggcagugucuagggguguuu

SEQ ID NO: 86904 - RNA, 22 nt, Homo sapiens
auggcuagauuguaugguaguu

SEQ ID NO: 86905 - RNA, 22 nt, Homo sapiens
augggugaguaugaguugacuu

SEQ ID NO: 86906 - RNA, 20 nt, Homo sapiens
augucaggaagggagucagg

SEQ ID NO: 86907 - RNA, 18 nt, Homo sapiens
auguuauguuuguagaag

SEQ ID NO: 86908 - RNA, 22 nt, Homo sapiens
auuagguuggugcaaaaguaau

SEQ ID NO: 86909 - RNA, 22 nt, Homo sapiens
auuagguuguugcaaaaguaau

SEQ ID NO: 86910 - RNA, 22 nt, Homo sapiens
auuaucacaguuuugcauaugg

SEQ ID NO: 86911 - RNA, 22 nt, Homo sapiens
cagcugcuuuggaaaauauuuu

SEQ ID NO: 86912 - RNA, 20 nt, Homo sapiens
cagucaugaagaacugugag

SEQ ID NO: 86913 - RNA, 22 nt, Homo sapiens
caucauugcacccuauagagaa

SEQ ID NO: 86914 - RNA, 22 nt, Homo sapiens
caucgcacuccagccugggcaa

SEQ ID NO: 86915 - RNA, 22 nt, Homo sapiens
caugaaagacugaggaauugga

SEQ ID NO: 86916 - RNA, 22 nt, Homo sapiens
cauggcauuugcagaguugaaa

SEQ ID NO: 86917 - RNA, 22 nt, Homo sapiens
cucaaguacaugggauuacagg

SEQ ID NO: 86918 - RNA, 22 nt, Homo sapiens
cucagggugguggacucuaaua

SEQ ID NO: 86919 - RNA, 22 nt, Homo sapiens
cucugguuaaggcugaacuaua

SEQ ID NO: 86920 - RNA, 22 nt, Homo sapiens
cucugguucugcagugcacccu

SEQ ID NO: 86921 - RNA, 21 nt, Homo sapiens
cucugguuugcauuggauuau

SEQ ID NO: 86922 - RNA, 22 nt, Homo sapiens
cugcuaagagaaugagacuuag

SEQ ID NO: 86923 - RNA, 22 nt, Homo sapiens
cuggcaucuaaauacuugaugu

SEQ ID NO: 86924 - RNA, 22 nt, Homo sapiens
cuguaaggcacuaagcauaugu

SEQ ID NO: 86925 - RNA, 22 nt, Homo sapiens
cugugcaaacaagugaaccccu

SEQ ID NO: 86926 - RNA, 22 nt, Homo sapiens
cuguuauguucuagagggugca

SEQ ID NO: 86927 - RNA, 18 nt, Homo sapiens
cuucauugcuguuuugcu

SEQ ID NO: 86928 - RNA, 22 nt, Homo sapiens
cuuccagcuggguucagucagu

SEQ ID NO: 86929 - RNA, 22 nt, Homo sapiens
cuuccauaguauuuuuacaaaa

SEQ ID NO: 86930 - RNA, 19 nt, Homo sapiens
cuuguacucggcgcaguug

SEQ ID NO: 86931 - RNA, 22 nt, Homo sapiens
aagaggcuguaggauaaugccu

SEQ ID NO: 86932 - RNA, 22 nt, Homo sapiens
aaggucauugugguuuuugcca

SEQ ID NO: 86933 - RNA, 22 nt, Homo sapiens
aauacugaaaguauuuucaaau

SEQ ID NO: 86934 - RNA, 19 nt, Homo sapiens
aauauugacaguggugucu

SEQ ID NO: 86935 - RNA, 22 nt, Homo sapiens
aauugcucuccuccaaggucuu

SEQ ID NO: 86936 - RNA, 17 nt, Homo sapiens
acuuuuugaggaggcau

SEQ ID NO: 86937 - RNA, 20 nt, Homo sapiens
agaagcauugcucucuucag

SEQ ID NO: 86938 - RNA, 22 nt, Homo sapiens
agagacauugcuccaacucacc

SEQ ID NO: 86939 - RNA, 20 nt, Homo sapiens
agagugcuggacugaggagc

SEQ ID NO: 86940 - RNA, 23 nt, Homo sapiens
agauggcauuucaguucuuuagg

SEQ ID NO: 86941 - RNA, 19 nt, Homo sapiens
agcaucauuauuguuuugg

SEQ ID NO: 86942 - RNA, 22 nt, Homo sapiens
agccucauucuacauguuaaug

SEQ ID NO: 86943 - RNA, 21 nt, Homo sapiens
aggagcauucaugacgagguu

SEQ ID NO: 86944 - RNA, 22 nt, Homo sapiens
agucacagguucuugggauuag

SEQ ID NO: 86945 - RNA, 22 nt, Homo sapiens
agucauuguugagaugguguca

SEQ ID NO: 86946 - RNA, 22 nt, Homo sapiens
auaaguagaaugauggucaaaa

SEQ ID NO: 86947 - RNA, 22 nt, Homo sapiens
auacaagcaguccaacuccaua

SEQ ID NO: 86948 - RNA, 22 nt, Homo sapiens
auagcaaugccccacuccuugg

SEQ ID NO: 86949 - RNA, 22 nt, Homo sapiens
aucaagccaaagaaaguccuug

SEQ ID NO: 86950 - RNA, 22 nt, Homo sapiens
aucaccauguguacauuagacc

SEQ ID NO: 86951 - RNA, 19 nt, Homo sapiens
aucaccauuauuuggaaca

SEQ ID NO: 86952 - RNA, 22 nt, Homo sapiens
aucugcauucccauguuuauug

SEQ ID NO: 86953 - RNA, 20 nt, Homo sapiens
augagguguaugacacugaa

SEQ ID NO: 86954 - RNA, 22 nt, Homo sapiens
auggcacuccagccugggcaac

SEQ ID NO: 86955 - RNA, 22 nt, Homo sapiens
auggcacuguguccugggguca

SEQ ID NO: 86956 - RNA, 22 nt, Homo sapiens
auggcuuuuccugucuugcaug

SEQ ID NO: 86957 - RNA, 22 nt, Homo sapiens
auguugcuugaaggcauuuugu

SEQ ID NO: 86958 - RNA, 22 nt, Homo sapiens
auuaaguugugccugaaaacuu

SEQ ID NO: 86959 - RNA, 22 nt, Homo sapiens
auucaccauggcuaccaagggu

SEQ ID NO: 86960 - RNA, 22 nt, Homo sapiens
auugcauaaacacauuucuuau

SEQ ID NO: 86961 - RNA, 22 nt, Homo sapiens
cacagucugggcuuguuuguac

SEQ ID NO: 86962 - RNA, 22 nt, Homo sapiens
caguagcaugccucagaaugag

SEQ ID NO: 86963 - RNA, 22 nt, Homo sapiens
cauggcaucuguguggccucca

SEQ ID NO: 86964 - RNA, 22 nt, Homo sapiens
ccaaaguauuuucacugauauc

SEQ ID NO: 86965 - RNA, 22 nt, Homo sapiens
cuaagcaccuuaguggggaauc

SEQ ID NO: 86966 - RNA, 22 nt, Homo sapiens
cuacugacacuacugcaaucau

SEQ ID NO: 86967 - RNA, 22 nt, Homo sapiens
cucuuuuguuuagcugagaggg

SEQ ID NO: 86968 - RNA, 22 nt, Homo sapiens
cugacugaggaucaguucauca

SEQ ID NO: 86969 - RNA, 20 nt, Homo sapiens
cugauacagccugagcucuc

SEQ ID NO: 86970 - RNA, 22 nt, Homo sapiens
cuucaccaguuuggcagucuca

SEQ ID NO: 86971 - RNA, 20 nt, Homo sapiens
cuugaagacuaugcugcuga

SEQ ID NO: 86972 - RNA, 22 nt, Homo sapiens
gaaucauuguuucuaaguuugu

SEQ ID NO: 86973 - RNA, 18 nt, Homo sapiens
gacuuggaguuuacagug

SEQ ID NO: 86974 - RNA, 22 nt, Homo sapiens
gagacucuuagauuggaaaucu

SEQ ID NO: 86975 - RNA, 22 nt, Homo sapiens
gagcaucaguggccucaucuca

SEQ ID NO: 86976 - RNA, 22 nt, Homo sapiens
gaggcauugaaauauugcuuau

SEQ ID NO: 86977 - RNA, 22 nt, Homo sapiens
gauagcauucaauuaucuguug

SEQ ID NO: 86978 - RNA, 22 nt, Homo sapiens
gauauugacuuauucuauguuu

SEQ ID NO: 86979 - RNA, 20 nt, Homo sapiens
gaucaguuuggaguaagugc

SEQ ID NO: 86980 - RNA, 22 nt, Homo sapiens
gauggcaucugagaguguuaga

SEQ ID NO: 86981 - RNA, 22 nt, Homo sapiens
gauggcauuucuggaucugccc

SEQ ID NO: 86982 - RNA, 22 nt, Homo sapiens
gcaucacagggagacaggccuc

SEQ ID NO: 86983 - RNA, 22 nt, Homo sapiens
gcuaggagaucugcugcucucu

SEQ ID NO: 86984 - RNA, 22 nt, Homo sapiens
gcucaugggcagugugauuguu

SEQ ID NO: 86985 - RNA, 22 nt, Homo sapiens
gcuucauggaggcugggcgcag

SEQ ID NO: 86986 - RNA, 22 nt, Homo sapiens
ggacauuaacugcaagauagau

SEQ ID NO: 86987 - RNA, 22 nt, Homo sapiens
ggcagacuguggaguucuuucu

SEQ ID NO: 86988 - RNA, 22 nt, Homo sapiens
guaacguaaugucaaaaucuau

SEQ ID NO: 86989 - RNA, 22 nt, Homo sapiens
gucucuuguuaucauuucugag

SEQ ID NO: 86990 - RNA, 22 nt, Homo sapiens
gugaaagacauauaugguuuga

SEQ ID NO: 86991 - RNA, 22 nt, Homo sapiens
gugaguggacgugaccaauaaa

SEQ ID NO: 86992 - RNA, 22 nt, Homo sapiens
gugcacaugguagguauugagu

SEQ ID NO: 86993 - RNA, 22 nt, Homo sapiens
guguuugauugcaaauaaucua

SEQ ID NO: 86994 - RNA, 22 nt, Homo sapiens
uaaguauuaugugcugcauuuu

SEQ ID NO: 86995 - RNA, 22 nt, Homo sapiens
uagaagcacuaucccuccuagu

SEQ ID NO: 86996 - RNA, 22 nt, Homo sapiens
uaucacagguggacugcacacc

SEQ ID NO: 86997 - RNA, 22 nt, Homo sapiens
uaucauugccucaaucuguauu

SEQ ID NO: 86998 - RNA, 22 nt, Homo sapiens
uaugacuuuugaauacagaugg

SEQ ID NO: 86999 - RNA, 19 nt, Homo sapiens
uaugcuauuuauuagaagu

SEQ ID NO: 87000 - RNA, 22 nt, Homo sapiens
ucaaggcacauuugacauuuuc

SEQ ID NO: 87001 - RNA, 18 nt, Homo sapiens
ucacagguaaaguugaca

SEQ ID NO: 87002 - RNA, 22 nt, Homo sapiens
gcaagagguaucuuauuuuccc

SEQ ID NO: 87003 - RNA, 19 nt, Homo sapiens
gcaucauuaguugcuuuuc

SEQ ID NO: 87004 - RNA, 22 nt, Homo sapiens
gccaagaagugucuaagcagga

SEQ ID NO: 87005 - RNA, 22 nt, Homo sapiens
ggcaaauucuuguaugccuacu

SEQ ID NO: 87006 - RNA, 22 nt, Homo sapiens
ggcaguguauuacuuaggguuc

SEQ ID NO: 87007 - RNA, 22 nt, Homo sapiens
guagcaucauuugcaauuucau

SEQ ID NO: 87008 - RNA, 22 nt, Homo sapiens
gucaccauugagucauuuccuc

SEQ ID NO: 87009 - RNA, 22 nt, Homo sapiens
gucaucaggacgggucaucugc

SEQ ID NO: 87010 - RNA, 22 nt, Homo sapiens
gugaaagacagcauuaauggcu

SEQ ID NO: 87011 - RNA, 22 nt, Homo sapiens
gugacugggaguggugaagaua

SEQ ID NO: 87012 - RNA, 22 nt, Homo sapiens
gugauguguuucaacagcuccu

SEQ ID NO: 87013 - RNA, 22 nt, Homo sapiens
gugggguaggguaggacucaac

SEQ ID NO: 87014 - RNA, 22 nt, Homo sapiens
uaacaggcuacucuugcauugc

SEQ ID NO: 87015 - RNA, 22 nt, Homo sapiens
uaacuacuucugcuucagagua

SEQ ID NO: 87016 - RNA, 22 nt, Homo sapiens
uaagagagcuccaucuuuuccu

SEQ ID NO: 87017 - RNA, 22 nt, Homo sapiens
uaagcuaauguguuuucucuua

SEQ ID NO: 87018 - RNA, 22 nt, Homo sapiens
uaauaguguuaaugcuagagcu

SEQ ID NO: 87019 - RNA, 22 nt, Homo sapiens
uagcaagaugaauuugugcaaa

SEQ ID NO: 87020 - RNA, 22 nt, Homo sapiens
uauggauuuucagauucuuauc

SEQ ID NO: 87021 - RNA, 22 nt, Homo sapiens
uauggcauguauguguggcgca

SEQ ID NO: 87022 - RNA, 22 nt, Homo sapiens
uauggcauuuuguaagggcuug

SEQ ID NO: 87023 - RNA, 22 nt, Homo sapiens
uauggucuuugagaggugacug

SEQ ID NO: 87024 - RNA, 22 nt, Homo sapiens
ucacaaguguauagacaugucc

SEQ ID NO: 87025 - RNA, 21 nt, Homo sapiens
ucaucagucaaagacaauggu

SEQ ID NO: 87026 - RNA, 22 nt, Homo sapiens
ucaugucuuguuguauuuauuu

SEQ ID NO: 87027 - RNA, 22 nt, Homo sapiens
uccauuuguucagcuucaggaa

SEQ ID NO: 87028 - RNA, 22 nt, Homo sapiens
ucucuguuugucuguuacuggu

SEQ ID NO: 87029 - RNA, 22 nt, Homo sapiens
ucugguuccugcauucauucaa

SEQ ID NO: 87030 - RNA, 22 nt, Homo sapiens
ucuguguugaugcucauuaauu

SEQ ID NO: 87031 - RNA, 22 nt, Homo sapiens
ugaaguaauguuuuauucuauu

SEQ ID NO: 87032 - RNA, 22 nt, Homo sapiens
ugacuggagaccucaguagggu

SEQ ID NO: 87033 - RNA, 20 nt, Homo sapiens
ugauauuuucugagcaggaa

SEQ ID NO: 87034 - RNA, 22 nt, Homo sapiens
ugauggcacagugaguuccagg

SEQ ID NO: 87035 - RNA, 22 nt, Homo sapiens
ugcaagaaucagccuaucauua

SEQ ID NO: 87036 - RNA, 22 nt, Homo sapiens
ugcaagaggagacuguacucag

SEQ ID NO: 87037 - RNA, 22 nt, Homo sapiens
ugcugcuguuguuguuacuagc

SEQ ID NO: 87038 - RNA, 22 nt, Homo sapiens
uggaggacugcagaacugaggc

SEQ ID NO: 87039 - RNA, 22 nt, Homo sapiens
uggcaauaauucagugugggcu

SEQ ID NO: 87040 - RNA, 22 nt, Homo sapiens
uggcaguuuugauguggagaga

SEQ ID NO: 87041 - RNA, 22 nt, Homo sapiens
uggcucauuucuaaacccagcu

SEQ ID NO: 87042 - RNA, 22 nt, Homo sapiens
uggcuuuuauuauguugaggua

SEQ ID NO: 87043 - RNA, 22 nt, Homo sapiens
ugggaucagcugggcucucugu

SEQ ID NO: 87044 - RNA, 22 nt, Homo sapiens
ugggugaguaucuauuauucag

SEQ ID NO: 87045 - RNA, 22 nt, Homo sapiens
ugucuagaaaagccugccuucu

SEQ ID NO: 87046 - RNA, 22 nt, Homo sapiens
ugucuguuugcgaaauugcuuc

SEQ ID NO: 87047 - RNA, 22 nt, Homo sapiens
uguuugcuguuuucuccaauga

SEQ ID NO: 87048 - RNA, 22 nt, Homo sapiens
uuaauuguaucuauagauguca

SEQ ID NO: 87049 - RNA, 19 nt, Homo sapiens
uuacacaaccuaguggggc

SEQ ID NO: 87050 - RNA, 22 nt, Homo sapiens
uuagguauuuuguuaugucagc

SEQ ID NO: 87051 - RNA, 22 nt, Homo sapiens
uuaguaguugugauagguaccu

SEQ ID NO: 87052 - RNA, 22 nt, Homo sapiens
uuaucauagugcaguuuucuga

SEQ ID NO: 87053 - RNA, 22 nt, Homo sapiens
uuaugcaucuuccacacucauu

SEQ ID NO: 87054 - RNA, 22 nt, Homo sapiens
uuaugucuuugagcaaugcugu

SEQ ID NO: 87055 - RNA, 22 nt, Homo sapiens
uucacaguacucccuggaauua

SEQ ID NO: 87056 - RNA, 22 nt, Homo sapiens
uucacugugaacucauauucag

SEQ ID NO: 87057 - RNA, 22 nt, Homo sapiens
uucaucaggaauauugaccugu

SEQ ID NO: 87058 - RNA, 22 nt, Homo sapiens
uucauugaaugauuuuuagaag

SEQ ID NO: 87059 - RNA, 22 nt, Homo sapiens
uucucagcccccugacagucag

SEQ ID NO: 87060 - RNA, 22 nt, Homo sapiens
uugaaggaggugcucacucucg

SEQ ID NO: 87061 - RNA, 22 nt, Homo sapiens
uugaagugaagaacaauaucac

SEQ ID NO: 87062 - RNA, 22 nt, Homo sapiens
uugaauagugacuuugauucug

SEQ ID NO: 87063 - RNA, 22 nt, Homo sapiens
uugacugggccagacagagauc

SEQ ID NO: 87064 - RNA, 23 nt, Homo sapiens
uugaggcauguaccaucaauauc

SEQ ID NO: 87065 - RNA, 22 nt, Homo sapiens
uugauacuagagucuuucugac

SEQ ID NO: 87066 - RNA, 22 nt, Homo sapiens
uugauauucugagaagcugaag

SEQ ID NO: 87067 - RNA, 22 nt, Homo sapiens
uugggccacuuuaguuuccuua

SEQ ID NO: 87068 - RNA, 22 nt, Homo sapiens
uugugcuuuuuaaauagcuucc

SEQ ID NO: 87069 - RNA, 22 nt, Homo sapiens
uuugacucacagccuggcugcc

SEQ ID NO: 87070 - RNA, 22 nt, Homo sapiens
uuugugcuccucucaguaugug

SEQ ID NO: 87071 - RNA, 23 nt, Homo sapiens
uuuugcaauaagucacuggaaua

SEQ ID NO: 87072 - RNA, 22 nt, Homo sapiens
uuuuugaguagcuggagagcag

SEQ ID NO: 87073 - RNA, 22 nt, Homo sapiens
auaguagagagggcaaaaugcu

SEQ ID NO: 87074 - RNA, 22 nt, Homo sapiens
aucaccuuucccuuucugaauc

SEQ ID NO: 87075 - RNA, 22 nt, Homo sapiens
auccacagugucaauguuguga

SEQ ID NO: 87076 - RNA, 22 nt, Homo sapiens
augcacaguccagcccaugugg

SEQ ID NO: 87077 - RNA, 22 nt, Homo sapiens
augccacugcacuccaaccugg

SEQ ID NO: 87078 - RNA, 22 nt, Homo sapiens
augccaguguccagaguggguu

SEQ ID NO: 87079 - RNA, 22 nt, Homo sapiens
auggaggaggaagcugaaacaa

SEQ ID NO: 87080 - RNA, 22 nt, Homo sapiens
auggcacugccuggcuucaugg

SEQ ID NO: 87081 - RNA, 22 nt, Homo sapiens
auggcacuuuggacugcuagau

SEQ ID NO: 87082 - RNA, 22 nt, Homo sapiens
augggagugugguuagagaccu

SEQ ID NO: 87083 - RNA, 22 nt, Homo sapiens
auguaauugagguuuuugccau

SEQ ID NO: 87084 - RNA, 22 nt, Homo sapiens
auguguauuaccucgauuguga

SEQ ID NO: 87085 - RNA, 22 nt, Homo sapiens
auguuauguuaaugauaaugga

SEQ ID NO: 87086 - RNA, 22 nt, Homo sapiens
auugucacuuaaaagugcaugu

SEQ ID NO: 87087 - RNA, 22 nt, Homo sapiens
auuguguuugaaugaggcucca

SEQ ID NO: 87088 - RNA, 19 nt, Homo sapiens
auuugaucaucaggcacag

SEQ ID NO: 87089 - RNA, 22 nt, Homo sapiens
caaugguuuuuuaguauaagua

SEQ ID NO: 87090 - RNA, 23 nt, Homo sapiens
cagcucauuuggguccccuuguc

SEQ ID NO: 87091 - RNA, 22 nt, Homo sapiens
caggcaaggugaaguguacugg

SEQ ID NO: 87092 - RNA, 19 nt, Homo sapiens
caguaucauugcacauagu

SEQ ID NO: 87093 - RNA, 22 nt, Homo sapiens
caucagcaauguaugaggguuc

SEQ ID NO: 87094 - RNA, 21 nt, Homo sapiens
cauccccugccauuguggucu

SEQ ID NO: 87095 - RNA, 22 nt, Homo sapiens
cauggcauuucaagauuuacca

SEQ ID NO: 87096 - RNA, 22 nt, Homo sapiens
cauuaagcuacuuagaaggugc

SEQ ID NO: 87097 - RNA, 22 nt, Homo sapiens
cauuccacauguaggacaauuu

SEQ ID NO: 87098 - RNA, 22 nt, Homo sapiens
ccaagccucaguuucccucugu

SEQ ID NO: 87099 - RNA, 18 nt, Homo sapiens
ccagugcaaggaaagccc

SEQ ID NO: 87100 - RNA, 22 nt, Homo sapiens
cuaagugaacugucacugagaa

SEQ ID NO: 87101 - RNA, 22 nt, Homo sapiens
cugauacucuccuuuuagagag

SEQ ID NO: 87102 - RNA, 22 nt, Homo sapiens
cugauaguucucuuuagaguuu

SEQ ID NO: 87103 - RNA, 22 nt, Homo sapiens
cuguuugaggguuugcuuucag

SEQ ID NO: 87104 - RNA, 22 nt, Homo sapiens
cuucugauugaaaauggaguag

SEQ ID NO: 87105 - RNA, 22 nt, Homo sapiens
cuuucugaggagaauagagaac

SEQ ID NO: 87106 - RNA, 22 nt, Homo sapiens
gaaucauuggguugauucaaga

SEQ ID NO: 87107 - RNA, 22 nt, Homo sapiens
gacuacaacuucuauuauucag

SEQ ID NO: 87108 - RNA, 22 nt, Homo sapiens
gagcacugaauacugugguggu

SEQ ID NO: 87109 - RNA, 22 nt, Homo sapiens
gaugaggcuagagacaugugua

SEQ ID NO: 87110 - RNA, 22 nt, Homo sapiens
aaagaagucagccuguccuuug

SEQ ID NO: 87111 - RNA, 22 nt, Homo sapiens
aacaccauucucuguaacaaga

SEQ ID NO: 87112 - RNA, 21 nt, Homo sapiens
aagcacauugaguguguguga

SEQ ID NO: 87113 - RNA, 22 nt, Homo sapiens
aaggcacugaacuuaaauucug

SEQ ID NO: 87114 - RNA, 22 nt, Homo sapiens
aagucaaggagagaagcuucag

SEQ ID NO: 87115 - RNA, 22 nt, Homo sapiens
aagugauguuauugggugacuc

SEQ ID NO: 87116 - RNA, 22 nt, Homo sapiens
aaguuaauguuuaagacuccua

SEQ ID NO: 87117 - RNA, 20 nt, Homo sapiens
aauggcauguuggacaacug

SEQ ID NO: 87118 - RNA, 22 nt, Homo sapiens
aauggcucugauguuguuguga

SEQ ID NO: 87119 - RNA, 18 nt, Homo sapiens
aauggcucuggguucuaa

SEQ ID NO: 87120 - RNA, 22 nt, Homo sapiens
aauucacuucuuuuaggcaggg

SEQ ID NO: 87121 - RNA, 22 nt, Homo sapiens
uauugcugaugcugaagggaag

SEQ ID NO: 87122 - RNA, 18 nt, Homo sapiens
ucaauguggauguucuuu

SEQ ID NO: 87123 - RNA, 22 nt, Homo sapiens
ucaccuggagacaugaagacug

SEQ ID NO: 87124 - RNA, 19 nt, Homo sapiens
ucagaucagcccaagggau

SEQ ID NO: 87125 - RNA, 22 nt, Homo sapiens
ucagaucauauucuucgcugcu

SEQ ID NO: 87126 - RNA, 22 nt, Homo sapiens
ucagcagugugaaaacaaacua

SEQ ID NO: 87127 - RNA, 22 nt, Homo sapiens
ucaguagcauugcuuauacagu

SEQ ID NO: 87128 - RNA, 22 nt, Homo sapiens
ucaucagugcuugcaaauuauu

SEQ ID NO: 87129 - RNA, 19 nt, Homo sapiens
uccuugauugcaccacugc

SEQ ID NO: 87130 - RNA, 22 nt, Homo sapiens
ucugacucuggagucucagguu

SEQ ID NO: 87131 - RNA, 22 nt, Homo sapiens
ucuguguuugaucaagauugua

SEQ ID NO: 87132 - RNA, 22 nt, Homo sapiens
ugaauagagcugcaguggacau

SEQ ID NO: 87133 - RNA, 22 nt, Homo sapiens
ugacucagauagguguguauuc

SEQ ID NO: 87134 - RNA, 22 nt, Homo sapiens
ugagcuaagugccaauauuaau

SEQ ID NO: 87135 - RNA, 22 nt, Homo sapiens
ugagggaugccugguuuguuuu

SEQ ID NO: 87136 - RNA, 22 nt, Homo sapiens
ugauauuuuugauccuuaaguu

SEQ ID NO: 87137 - RNA, 22 nt, Homo sapiens
ugauuuguccauguggcacgug

SEQ ID NO: 87138 - RNA, 21 nt, Homo sapiens
ugcaagaaucaggaagcugcc

SEQ ID NO: 87139 - RNA, 22 nt, Homo sapiens
ugccaguguuuuguugaagauu

SEQ ID NO: 87140 - RNA, 21 nt, Homo sapiens
uggaaugaauggccaacaugg

SEQ ID NO: 87141 - RNA, 22 nt, Homo sapiens
uggacagaaacauguuuucagu

SEQ ID NO: 87142 - RNA, 22 nt, Homo sapiens
uggcacuggagauacauuaaua

SEQ ID NO: 87143 - RNA, 22 nt, Homo sapiens
uggcagacaaauuugagcauau

SEQ ID NO: 87144 - RNA, 22 nt, Homo sapiens
uggcuuuucauccugggacauu

SEQ ID NO: 87145 - RNA, 22 nt, Homo sapiens
ugggaacugaggugaaaagaca

SEQ ID NO: 87146 - RNA, 22 nt, Homo sapiens
uguugcaccugccuugcuuuag

SEQ ID NO: 87147 - RNA, 19 nt, Homo sapiens
uuaaguaguuagagggucu

SEQ ID NO: 87148 - RNA, 22 nt, Homo sapiens
uuaaucacagcugaacucaaac

SEQ ID NO: 87149 - RNA, 22 nt, Homo sapiens
uuaguaguuugauaggaauagc

SEQ ID NO: 87150 - RNA, 22 nt, Homo sapiens
uucacaaugccuuguugauggu

SEQ ID NO: 87151 - RNA, 22 nt, Homo sapiens
uucacagagagaacucaaacca

SEQ ID NO: 87152 - RNA, 22 nt, Homo sapiens
uucacagaguuauuuuuaugcu

SEQ ID NO: 87153 - RNA, 21 nt, Homo sapiens
uucaccauggcuccacacucu

SEQ ID NO: 87154 - RNA, 22 nt, Homo sapiens
uucaccuggaguucaggauaag

SEQ ID NO: 87155 - RNA, 21 nt, Homo sapiens
uucuaaguaaauguuggacau

SEQ ID NO: 87156 - RNA, 22 nt, Homo sapiens
uucuaaguaagucuguggggaa

SEQ ID NO: 87157 - RNA, 21 nt, Homo sapiens
uucuacuccggcguuguuuuu

SEQ ID NO: 87158 - RNA, 22 nt, Homo sapiens
uucucuaguuacuuuaauggag

SEQ ID NO: 87159 - RNA, 22 nt, Homo sapiens
uucugugguuucauuuaccugu

SEQ ID NO: 87160 - RNA, 22 nt, Homo sapiens
uugaauagaagguuuuuuguuc

SEQ ID NO: 87161 - RNA, 22 nt, Homo sapiens
uugaaugaaaugaugucauuug

SEQ ID NO: 87162 - RNA, 22 nt, Homo sapiens
uuggacucccuccccagcuuca

SEQ ID NO: 87163 - RNA, 22 nt, Homo sapiens
uuggcagucugaggcacagacu

SEQ ID NO: 87164 - RNA, 23 nt, Homo sapiens
uuggcaucugggacacaagcuga

SEQ ID NO: 87165 - RNA, 22 nt, Homo sapiens
uugucacuauaaauaagcauuu

SEQ ID NO: 87166 - RNA, 22 nt, Homo sapiens
uugugucaaauggcaauuagca

SEQ ID NO: 87167 - RNA, 23 nt, Homo sapiens
uuuaagcuucauguccuaacauc

SEQ ID NO: 87168 - RNA, 22 nt, Homo sapiens
uuuccacauggacuuaccuucg

SEQ ID NO: 87169 - RNA, 22 nt, Homo sapiens
uuugaauguaaugagcaggaag

SEQ ID NO: 87170 - RNA, 22 nt, Homo sapiens
uuugagaucuuuagaaucaggc

SEQ ID NO: 87171 - RNA, 22 nt, Homo sapiens
uuugauguugagacuauaaagc

SEQ ID NO: 87172 - RNA, 22 nt, Homo sapiens
uuugauguugauacuaccuuca

SEQ ID NO: 87173 - RNA, 22 nt, Homo sapiens
uuuggcauauuuuaagcugguu

SEQ ID NO: 87174 - RNA, 22 nt, Homo sapiens
uuuggcauuaagaugcuguauc

SEQ ID NO: 87175 - RNA, 22 nt, Homo sapiens
uuuugcucuugguaaugaaaga

SEQ ID NO: 87176 - RNA, 22 nt, Homo sapiens
uuuuugagaauuggugaaacac

SEQ ID NO: 87177 - RNA, 22 nt, Homo sapiens
uuuuugaguaaauauaaauugu

SEQ ID NO: 87178 - RNA, 22 nt, Homo sapiens
ucagcaucacgugggcucccgu

SEQ ID NO: 87179 - RNA, 22 nt, Homo sapiens
ucauugcauguuaauuaaacag

SEQ ID NO: 87180 - RNA, 19 nt, Homo sapiens
ucccaauguuuccaggcag

SEQ ID NO: 87181 - RNA, 22 nt, Homo sapiens
uccuucaugcaucaauguaucc

SEQ ID NO: 87182 - RNA, 22 nt, Homo sapiens
ucucaguguuaucuaucugccu

SEQ ID NO: 87183 - RNA, 22 nt, Homo sapiens
ugacagaggucuuuuaauagcu

SEQ ID NO: 87184 - RNA, 22 nt, Homo sapiens
ugacucaguuguuagucuucau

SEQ ID NO: 87185 - RNA, 22 nt, Homo sapiens
ugaggacugagaggcacugugg

SEQ ID NO: 87186 - RNA, 22 nt, Homo sapiens
ugaguauguuuagaaguaaagg

SEQ ID NO: 87187 - RNA, 22 nt, Homo sapiens
ugauaugucccucgacaucagg

SEQ ID NO: 87188 - RNA, 20 nt, Homo sapiens
ugauauuucuggaaguggag

SEQ ID NO: 87189 - RNA, 17 nt, Homo sapiens
ugauauuuucccagaua

SEQ ID NO: 87190 - RNA, 22 nt, Homo sapiens
ugauggcaauggcauucauuuu

SEQ ID NO: 87191 - RNA, 22 nt, Homo sapiens
ugauggcauuucauguuuguaa

SEQ ID NO: 87192 - RNA, 20 nt, Homo sapiens
ugccagugugucaauuuaua

SEQ ID NO: 87193 - RNA, 22 nt, Homo sapiens
uggcagcugcuucaugggaugc

SEQ ID NO: 87194 - RNA, 22 nt, Homo sapiens
uuaauacucuucuaaguagucc

SEQ ID NO: 87195 - RNA, 22 nt, Homo sapiens
uuauccagcgcuguuuuggaga

SEQ ID NO: 87196 - RNA, 22 nt, Homo sapiens
uuauggauuuauauucuguagu

SEQ ID NO: 87197 - RNA, 22 nt, Homo sapiens
uucaccuugcccacagcagucu

SEQ ID NO: 87198 - RNA, 23 nt, Homo sapiens
uucaguauugaaugauggcgcug

SEQ ID NO: 87199 - RNA, 22 nt, Homo sapiens
uucucaguuccuacuuugguga

SEQ ID NO: 87200 - RNA, 22 nt, Homo sapiens
uucuuagucauguaauagucca

SEQ ID NO: 87201 - RNA, 22 nt, Homo sapiens
uugagauacauaauuaugaaug

SEQ ID NO: 87202 - RNA, 22 nt, Homo sapiens
uugagauguauguauauaaugu

SEQ ID NO: 87203 - RNA, 21 nt, Homo sapiens
uugagcuuuuaguacagacag

SEQ ID NO: 87204 - RNA, 22 nt, Homo sapiens
uugaggacugguugaaagcuuu

SEQ ID NO: 87205 - RNA, 22 nt, Homo sapiens
uugaguuugaguauucuaaagc

SEQ ID NO: 87206 - RNA, 22 nt, Homo sapiens
uugcauauucucugaggcagga

SEQ ID NO: 87207 - RNA, 22 nt, Homo sapiens
uuggcaacauagugagaccccc

SEQ ID NO: 87208 - RNA, 22 nt, Homo sapiens
uuggcagugguucugacggacc

SEQ ID NO: 87209 - RNA, 22 nt, Homo sapiens
uuggcauagaggcucucaagcu

SEQ ID NO: 87210 - RNA, 21 nt, Homo sapiens
uuggggaauggagagguuuuc

SEQ ID NO: 87211 - RNA, 22 nt, Homo sapiens
uugucaaacucauucuccaucc

SEQ ID NO: 87212 - RNA, 22 nt, Homo sapiens
uuguccucuccaaaucucaugu

SEQ ID NO: 87213 - RNA, 22 nt, Homo sapiens
uuguuauguuggucaguaaugu

SEQ ID NO: 87214 - RNA, 22 nt, Homo sapiens
uuucacuagccagcccuuuauu

SEQ ID NO: 87215 - RNA, 22 nt, Homo sapiens
uuucaguagagacacgguuuug

SEQ ID NO: 87216 - RNA, 23 nt, Homo sapiens
uuucaguaguuguauccuguugc

SEQ ID NO: 87217 - RNA, 22 nt, Homo sapiens
uuugaggaaaggcauaaguagg

SEQ ID NO: 87218 - RNA, 22 nt, Homo sapiens
uuuugggggugauucacacagu

SEQ ID NO: 87219 - RNA, 22 nt, Homo sapiens
uuuuucacuuaaguuaggcuca

SEQ ID NO: 87220 - RNA, 22 nt, Homo sapiens
uuuuuugcuguaugcaaacauc

SEQ ID NO: 87221 - RNA, 22 nt, Homo sapiens
aaaagugguguuguuucuaaau

SEQ ID NO: 87222 - RNA, 22 nt, Homo sapiens
aaacugaucugaaggccaggcu

SEQ ID NO: 87223 - RNA, 22 nt, Homo sapiens
aaaggcacugugacuuuauagg

SEQ ID NO: 87224 - RNA, 22 nt, Homo sapiens
aaagggcuuuguaaacuucaag

SEQ ID NO: 87225 - RNA, 22 nt, Homo sapiens
aaaguaguagcaguuucugcca

SEQ ID NO: 87226 - RNA, 22 nt, Homo sapiens
aaagucuguuacagcuauuucu

SEQ ID NO: 87227 - RNA, 22 nt, Homo sapiens
aaagugaauguaucccguaagu

SEQ ID NO: 87228 - RNA, 22 nt, Homo sapiens
aaagugcaguauuugggcagaa

SEQ ID NO: 87229 - RNA, 22 nt, Homo sapiens
aaagugcaguauuugggcagga

SEQ ID NO: 87230 - RNA, 22 nt, Homo sapiens
aaaugcacagaaaggaugugga

SEQ ID NO: 87231 - RNA, 22 nt, Homo sapiens
aaaugcaugaggugggaagaaa

SEQ ID NO: 87232 - RNA, 22 nt, Homo sapiens
aacaccuugcagggauuaugac

SEQ ID NO: 87233 - RNA, 21 nt, Homo sapiens
aagaaagcuggacuugccgcu

SEQ ID NO: 87234 - RNA, 22 nt, Homo sapiens
aaggaguguggugaucuugggc

SEQ ID NO: 87235 - RNA, 21 nt, Homo sapiens
aagguuuuuagugcuugacuu

SEQ ID NO: 87236 - RNA, 22 nt, Homo sapiens
aaguaaacauuuuguacaauaa

SEQ ID NO: 87237 - RNA, 22 nt, Homo sapiens
aagucaaggagagaagcuucag

SEQ ID NO: 87238 - RNA, 22 nt, Homo sapiens
aagugcaaauucccaggcucug

SEQ ID NO: 87239 - RNA, 22 nt, Homo sapiens
aagugcuuuacacaugcaugau

SEQ ID NO: 87240 - RNA, 22 nt, Homo sapiens
aagugcuuuuuagauaugguuu

SEQ ID NO: 87241 - RNA, 22 nt, Homo sapiens
aaguggaauguuuguggcacaa

SEQ ID NO: 87242 - RNA, 22 nt, Homo sapiens
aauaaguugagaugaggucaua

SEQ ID NO: 87243 - RNA, 22 nt, Homo sapiens
aauacagcacacagaugggucu

SEQ ID NO: 87244 - RNA, 22 nt, Homo sapiens
aaugacacugagcaucuuucau

SEQ ID NO: 87245 - RNA, 22 nt, Homo sapiens
aaugacuaagaugguacauuuu

SEQ ID NO: 87246 - RNA, 22 nt, Homo sapiens
aaugaucaauguuugaggugau

SEQ ID NO: 87247 - RNA, 22 nt, Homo sapiens
aaugccaucagagaaaacucuu

SEQ ID NO: 87248 - RNA, 22 nt, Homo sapiens
aauggcacaagacaugaagaag

SEQ ID NO: 87249 - RNA, 22 nt, Homo sapiens
aauggcacuuuauaaauguuaa

SEQ ID NO: 87250 - RNA, 22 nt, Homo sapiens
aaugugcacuuggagccuugcu

SEQ ID NO: 87251 - RNA, 22 nt, Homo sapiens
aauguguuuugaaaucaggaag

SEQ ID NO: 87252 - RNA, 22 nt, Homo sapiens
aauucacuucuuuuaggcaggg

SEQ ID NO: 87253 - RNA, 22 nt, Homo sapiens
aauugcauaugcaguagaucua

SEQ ID NO: 87254 - RNA, 22 nt, Homo sapiens
aauugcauugaauuuguagcuu

SEQ ID NO: 87255 - RNA, 22 nt, Homo sapiens
acaaagugccuccuuuuagagu

SEQ ID NO: 87256 - RNA, 20 nt, Homo sapiens
acaaaugcauucugugacau

SEQ ID NO: 87257 - RNA, 22 nt, Homo sapiens
acaccaguacuuuauacaagca

SEQ ID NO: 87258 - RNA, 22 nt, Homo sapiens
acacuguacuuauguuuugcag

SEQ ID NO: 87259 - RNA, 22 nt, Homo sapiens
acagugcugucugcuuuggcua

SEQ ID NO: 87260 - RNA, 22 nt, Homo sapiens
acagugcuguuguguuuucacg

SEQ ID NO: 87261 - RNA, 22 nt, Homo sapiens
acagugcuuggcacacaguaau

SEQ ID NO: 87262 - RNA, 19 nt, Homo sapiens
acagugcuuugucagaagc

SEQ ID NO: 87263 - RNA, 22 nt, Homo sapiens
acagugcuuuuguuccucuccu

SEQ ID NO: 87264 - RNA, 22 nt, Homo sapiens
acaucacuguuugauugauuga

SEQ ID NO: 87265 - RNA, 17 nt, Homo sapiens
acaugagacuggauucu

SEQ ID NO: 87266 - RNA, 22 nt, Homo sapiens
acauguaauugauuuuguguua

SEQ ID NO: 87267 - RNA, 22 nt, Homo sapiens
acccaguagucauucaggagca

SEQ ID NO: 87268 - RNA, 22 nt, Homo sapiens
acccgcccagguguggccggga

SEQ ID NO: 87269 - RNA, 22 nt, Homo sapiens
acccuuaagcacuaguucagcu

SEQ ID NO: 87270 - RNA, 22 nt, Homo sapiens
accuucauuguugccaugucca

SEQ ID NO: 87271 - RNA, 22 nt, Homo sapiens
acucacagcaaccuccgccucc

SEQ ID NO: 87272 - RNA, 22 nt, Homo sapiens
acugaucaauguuaaggcuuau

SEQ ID NO: 87273 - RNA, 20 nt, Homo sapiens
acugggcuaccgaaguaagg

SEQ ID NO: 87274 - RNA, 22 nt, Homo sapiens
acuuuguuauggcaacccuaag

SEQ ID NO: 87275 - RNA, 22 nt, Homo sapiens
agaauaauguccccccaaggga

SEQ ID NO: 87276 - RNA, 22 nt, Homo sapiens
agaauucugucauguuuauauu

SEQ ID NO: 87277 - RNA, 22 nt, Homo sapiens
agacuagagcagagcccucucu

SEQ ID NO: 87278 - RNA, 22 nt, Homo sapiens
agaggucuuaucaaacaugcuu

SEQ ID NO: 87279 - RNA, 22 nt, Homo sapiens
agagugaagcuuuuuauauucu

SEQ ID NO: 87280 - RNA, 22 nt, Homo sapiens
agauauuuguuaggucugucag

SEQ ID NO: 87281 - RNA, 22 nt, Homo sapiens
agaugguguuuucucaccagau

SEQ ID NO: 87282 - RNA, 22 nt, Homo sapiens
agcaccacaauuuccugccuaa

SEQ ID NO: 87283 - RNA, 23 nt, Homo sapiens
agcuagagaggcuggggauacag

SEQ ID NO: 87284 - RNA, 22 nt, Homo sapiens
agcugccagucuuguaaggccu

SEQ ID NO: 87285 - RNA, 20 nt, Homo sapiens
agcuugguuuggaugaucac

SEQ ID NO: 87286 - RNA, 22 nt, Homo sapiens
aggaagacugaaauugcuguuc

SEQ ID NO: 87287 - RNA, 22 nt, Homo sapiens
aggacacugauagucuuuggca

SEQ ID NO: 87288 - RNA, 22 nt, Homo sapiens
aggagcacuggccuuggaguca

SEQ ID NO: 87289 - RNA, 21 nt, Homo sapiens
aggagcauucaugacgagguu

SEQ ID NO: 87290 - RNA, 22 nt, Homo sapiens
aggaucauugacuauuauaagg

SEQ ID NO: 87291 - RNA, 22 nt, Homo sapiens
aggcaagagugacuacgugaaa

SEQ ID NO: 87292 - RNA, 22 nt, Homo sapiens
aggcagaugagguccucagcug

SEQ ID NO: 87293 - RNA, 22 nt, Homo sapiens
aggcauggagacuaaaauuaua

SEQ ID NO: 87294 - RNA, 22 nt, Homo sapiens
agggcuuguuuaacuaucauua

SEQ ID NO: 87295 - RNA, 20 nt, Homo sapiens
agguaguuauacaaaugugu

SEQ ID NO: 87296 - RNA, 21 nt, Homo sapiens
aggucaugaagauguucuaau

SEQ ID NO: 87297 - RNA, 22 nt, Homo sapiens
aggugguuuugaugagcaggua

SEQ ID NO: 87298 - RNA, 22 nt, Homo sapiens
aguaaacuucagaguucuuccu

SEQ ID NO: 87299 - RNA, 22 nt, Homo sapiens
aguaagucucaagguaggguag

SEQ ID NO: 87300 - RNA, 22 nt, Homo sapiens
aguaucacaguggguguauacc

SEQ ID NO: 87301 - RNA, 22 nt, Homo sapiens
agucacagugaccuugucugac

SEQ ID NO: 87302 - RNA, 17 nt, Homo sapiens
agucaguaguuuguauu

SEQ ID NO: 87303 - RNA, 22 nt, Homo sapiens
aguccauuugaugaugauucca

SEQ ID NO: 87304 - RNA, 22 nt, Homo sapiens
agugcacuccagccugggcaac

SEQ ID NO: 87305 - RNA, 22 nt, Homo sapiens
agugcaguggugccaucauaac

SEQ ID NO: 87306 - RNA, 22 nt, Homo sapiens
agugccacugcacucuagccug

SEQ ID NO: 87307 - RNA, 22 nt, Homo sapiens
aguggaguguaaagcgucuuuu

SEQ ID NO: 87308 - RNA, 22 nt, Homo sapiens
aguggcuuuuuaguggcagaug

SEQ ID NO: 87309 - RNA, 22 nt, Homo sapiens
agugggccccuagaggugaggu

SEQ ID NO: 87310 - RNA, 19 nt, Homo sapiens
agugggcuagaaaucaggg

SEQ ID NO: 87311 - RNA, 22 nt, Homo sapiens
auaaauucauuuaagcuccuua

SEQ ID NO: 87312 - RNA, 22 nt, Homo sapiens
auaacaggaaauacagggcuuu

SEQ ID NO: 87313 - RNA, 22 nt, Homo sapiens
auaacauggaguuugucauuua

SEQ ID NO: 87314 - RNA, 22 nt, Homo sapiens
auacuguacugaaguacccauu

SEQ ID NO: 87315 - RNA, 22 nt, Homo sapiens
auagcagcaccccacuaccuca

SEQ ID NO: 87316 - RNA, 22 nt, Homo sapiens
auagcucuugcuuacccacugu

SEQ ID NO: 87317 - RNA, 22 nt, Homo sapiens
auagguuuucacuguagauucu

SEQ ID NO: 87318 - RNA, 19 nt, Homo sapiens
auaguguaggaaaacagcu

SEQ ID NO: 87319 - RNA, 22 nt, Homo sapiens
auauagcaaugaaagagaugaa

SEQ ID NO: 87320 - RNA, 22 nt, Homo sapiens
auaucccuguauaagugaaugu

SEQ ID NO: 87321 - RNA, 17 nt, Homo sapiens
auaugaauuuuggagau

SEQ ID NO: 87322 - RNA, 22 nt, Homo sapiens
auaugcauguacccacacaggc

SEQ ID NO: 87323 - RNA, 22 nt, Homo sapiens
auaugcuuauuagcaagaaaua

SEQ ID NO: 87324 - RNA, 22 nt, Homo sapiens
auauuggccuaaaauucucuuu

SEQ ID NO: 87325 - RNA, 22 nt, Homo sapiens
aucaaguaaucugaguaagagu

SEQ ID NO: 87326 - RNA, 22 nt, Homo sapiens
aucaaguacuguacugaaagug

SEQ ID NO: 87327 - RNA, 22 nt, Homo sapiens
aucaaguaguuauacguaaagg

SEQ ID NO: 87328 - RNA, 22 nt, Homo sapiens
aucacagauauggguuuaaauc

SEQ ID NO: 87329 - RNA, 22 nt, Homo sapiens
aucacaguuuuaccauuuggua

SEQ ID NO: 87330 - RNA, 22 nt, Homo sapiens
aucagauguuuguauaggagua

SEQ ID NO: 87331 - RNA, 22 nt, Homo sapiens
aucauccugucaggagcuguga

SEQ ID NO: 87332 - RNA, 22 nt, Homo sapiens
aucauugugugaguugauggga

SEQ ID NO: 87333 - RNA, 22 nt, Homo sapiens
auccacaugcaguuggaaacag

SEQ ID NO: 87334 - RNA, 22 nt, Homo sapiens
aucccagaaacucggguuucuc

SEQ ID NO: 87335 - RNA, 22 nt, Homo sapiens
aucccgagacuuugcugaaguu

SEQ ID NO: 87336 - RNA, 21 nt, Homo sapiens
auccuucuuuuucaaccugug

SEQ ID NO: 87337 - RNA, 22 nt, Homo sapiens
aucgcaccauugcacuccagca

SEQ ID NO: 87338 - RNA, 22 nt, Homo sapiens
aucucaguuaaugacccuaugc

SEQ ID NO: 87339 - RNA, 22 nt, Homo sapiens
aucugcauuagggugaagaccu

SEQ ID NO: 87340 - RNA, 22 nt, Homo sapiens
aucugguguuuccuucacauug

SEQ ID NO: 87341 - RNA, 22 nt, Homo sapiens
aucuuuggcgggaauaucacag

SEQ ID NO: 87342 - RNA, 22 nt, Homo sapiens
augaaaacaugauuugccuguu

SEQ ID NO: 87343 - RNA, 22 nt, Homo sapiens
augaacacuccaauuguacucc

SEQ ID NO: 87344 - RNA, 22 nt, Homo sapiens
augacacugcagagauguccca

SEQ ID NO: 87345 - RNA, 22 nt, Homo sapiens
augacuggaacagcaauuuaca

SEQ ID NO: 87346 - RNA, 22 nt, Homo sapiens
augagauucuuagagaagucug

SEQ ID NO: 87347 - RNA, 22 nt, Homo sapiens
augagcucauaaagagugauuu

SEQ ID NO: 87348 - RNA, 22 nt, Homo sapiens
augagcuguuuggaagacacuu

SEQ ID NO: 87349 - RNA, 22 nt, Homo sapiens
augaggcuauaauuuuuaugua

SEQ ID NO: 87350 - RNA, 22 nt, Homo sapiens
augaggugaggucaguaaggua

SEQ ID NO: 87351 - RNA, 22 nt, Homo sapiens
augcaaacaucauagaguguac

SEQ ID NO: 87352 - RNA, 19 nt, Homo sapiens
augcacgugaaaugcauuu

SEQ ID NO: 87353 - RNA, 22 nt, Homo sapiens
augccacagaaauaaccaaaau

SEQ ID NO: 87354 - RNA, 19 nt, Homo sapiens
augcugguguugcucaaac

SEQ ID NO: 87355 - RNA, 19 nt, Homo sapiens
auggauacauuuucugcua

SEQ ID NO: 87356 - RNA, 22 nt, Homo sapiens
auggauaugcuuccaacugccu

SEQ ID NO: 87357 - RNA, 22 nt, Homo sapiens
auggauguucuagggaugugau

SEQ ID NO: 87358 - RNA, 22 nt, Homo sapiens
auggcaguguaugauuauauua

SEQ ID NO: 87359 - RNA, 22 nt, Homo sapiens
auggcaguuuauucuaaaucaa

SEQ ID NO: 87360 - RNA, 22 nt, Homo sapiens
auggccugaugcaccuguccca

SEQ ID NO: 87361 - RNA, 22 nt, Homo sapiens
auggcuuuaagagugucugaau

SEQ ID NO: 87362 - RNA, 22 nt, Homo sapiens
auggcuuuugaccugguaggau

SEQ ID NO: 87363 - RNA, 22 nt, Homo sapiens
auggcuuuugcccuaaauggau

SEQ ID NO: 87364 - RNA, 22 nt, Homo sapiens
augggcaaauguuggaaauucc

SEQ ID NO: 87365 - RNA, 22 nt, Homo sapiens
augguaguagaugugugguuuu

SEQ ID NO: 87366 - RNA, 22 nt, Homo sapiens
augucacagguccuagccaagu

SEQ ID NO: 87367 - RNA, 22 nt, Homo sapiens
augucauagaagccugugaacc

SEQ ID NO: 87368 - RNA, 22 nt, Homo sapiens
auguccaugagcacauguauca

SEQ ID NO: 87369 - RNA, 22 nt, Homo sapiens
augugcaaauuuccaaacucuu

SEQ ID NO: 87370 - RNA, 22 nt, Homo sapiens
augugcuuaaaaaugcagagaa

SEQ ID NO: 87371 - RNA, 22 nt, Homo sapiens
augugggaggacuuggcuguug

SEQ ID NO: 87372 - RNA, 22 nt, Homo sapiens
auguuuagagagggugucaaau

SEQ ID NO: 87373 - RNA, 22 nt, Homo sapiens
auuaaggaguggguucauggug

SEQ ID NO: 87374 - RNA, 22 nt, Homo sapiens
auuaaguugugccugaaaacuu

SEQ ID NO: 87375 - RNA, 22 nt, Homo sapiens
auuaauguaauuaguaaaguug

SEQ ID NO: 87376 - RNA, 22 nt, Homo sapiens
auuagguuaggcaaacuucugu

SEQ ID NO: 87377 - RNA, 22 nt, Homo sapiens
uccuuggugacauuucuugucu

SEQ ID NO: 87378 - RNA, 22 nt, Homo sapiens
uccuuugguggagucuuuaggg

SEQ ID NO: 87379 - RNA, 22 nt, Homo sapiens
ucgcgccauucuccugccucag

SEQ ID NO: 87380 - RNA, 22 nt, Homo sapiens
ucucaaccucccaaguagcugg

SEQ ID NO: 87381 - RNA, 18 nt, Homo sapiens
ucucacagcaaucuguca

SEQ ID NO: 87382 - RNA, 22 nt, Homo sapiens
ucucaguggcuuccucacuuuu

SEQ ID NO: 87383 - RNA, 22 nt, Homo sapiens
ucucaguguuaucuaucugccu

SEQ ID NO: 87384 - RNA, 20 nt, Homo sapiens
ucucauagagguagagaaua

SEQ ID NO: 87385 - RNA, 22 nt, Homo sapiens
ucucaugaagguggagaguagg

SEQ ID NO: 87386 - RNA, 20 nt, Homo sapiens
ucucccaaacagcaggcccu

SEQ ID NO: 87387 - RNA, 22 nt, Homo sapiens
ucucccauccguacacggauug

SEQ ID NO: 87388 - RNA, 22 nt, Homo sapiens
ucucuguuuauuuuugguguau

SEQ ID NO: 87389 - RNA, 22 nt, Homo sapiens
ucugagcaauagauguggauau

SEQ ID NO: 87390 - RNA, 22 nt, Homo sapiens
ucugagguaggugcauggauac

SEQ ID NO: 87391 - RNA, 22 nt, Homo sapiens
ucuguacugccaaguuucuuua

SEQ ID NO: 87392 - RNA, 22 nt, Homo sapiens
ucugucuugugguuugagugcc

SEQ ID NO: 87393 - RNA, 22 nt, Homo sapiens
ucugugcuugucauaugcuuug

SEQ ID NO: 87394 - RNA, 22 nt, Homo sapiens
ucuuaguuuagauuagcaauuc

SEQ ID NO: 87395 - RNA, 22 nt, Homo sapiens
ucuugcuuuugcagagcuucuc

SEQ ID NO: 87396 - RNA, 22 nt, Homo sapiens
ucuuugguucuguuuauguaau

SEQ ID NO: 87397 - RNA, 22 nt, Homo sapiens
ucuuugguuguuuagggugcau

SEQ ID NO: 87398 - RNA, 22 nt, Homo sapiens
ugaaacacacagagaagggaga

SEQ ID NO: 87399 - RNA, 22 nt, Homo sapiens
ugaaagacugaagaauaggcau

SEQ ID NO: 87400 - RNA, 22 nt, Homo sapiens
ugaaaucauguaguuauugcaa

SEQ ID NO: 87401 - RNA, 22 nt, Homo sapiens
ugaaaugccuugagauuuugac

SEQ ID NO: 87402 - RNA, 22 nt, Homo sapiens
uaagugaaggaaguguguuuac

SEQ ID NO: 87403 - RNA, 22 nt, Homo sapiens
uaagugaauauggacaguuagc

SEQ ID NO: 87404 - RNA, 22 nt, Homo sapiens
uaagugaauuugacagguaaug

SEQ ID NO: 87405 - RNA, 22 nt, Homo sapiens
uaaugcauguaaugggcugaua

SEQ ID NO: 87406 - RNA, 22 nt, Homo sapiens
uaaugcuugguuguuuggaaaa

SEQ ID NO: 87407 - RNA, 21 nt, Homo sapiens
uaauggcaugaucucggcuca

SEQ ID NO: 87408 - RNA, 22 nt, Homo sapiens
uaaugugaauagugcuguaaug

SEQ ID NO: 87409 - RNA, 22 nt, Homo sapiens
uaauucacauaaagcacuuaga

SEQ ID NO: 87410 - RNA, 22 nt, Homo sapiens
uacaaguauuuuuauuagugcc

SEQ ID NO: 87411 - RNA, 22 nt, Homo sapiens
uacaccaauuuaaucaaaagca

SEQ ID NO: 87412 - RNA, 22 nt, Homo sapiens
uacaggcagguguucccugguu

SEQ ID NO: 87413 - RNA, 22 nt, Homo sapiens
uacaguguuuugguauuccaca

SEQ ID NO: 87414 - RNA, 22 nt, Homo sapiens
uacuagaggaaaacuugaagac

SEQ ID NO: 87415 - RNA, 22 nt, Homo sapiens
uacugcuuaagggcaugggccc

SEQ ID NO: 87416 - RNA, 22 nt, Homo sapiens
uacuggccuugaacucuggugu

SEQ ID NO: 87417 - RNA, 22 nt, Homo sapiens
uagaagcacuaucccuccuagu

SEQ ID NO: 87418 - RNA, 22 nt, Homo sapiens
uagcacagugucauucuaggua

SEQ ID NO: 87419 - RNA, 22 nt, Homo sapiens
uagcacugucuugcaccugugc

SEQ ID NO: 87420 - RNA, 20 nt, Homo sapiens
uagcagcagacagagggagg

SEQ ID NO: 87421 - RNA, 22 nt, Homo sapiens
uagcagcauuuuuguagaguau

SEQ ID NO: 87422 - RNA, 22 nt, Homo sapiens
uaggacauugcccuuguggaga

SEQ ID NO: 87423 - RNA, 20 nt, Homo sapiens
uaggagcaaugagaguagaa

SEQ ID NO: 87424 - RNA, 22 nt, Homo sapiens
uaggcaaaugcaagaguagaac

SEQ ID NO: 87425 - RNA, 22 nt, Homo sapiens
uagguuaucucaaguguaauuu

SEQ ID NO: 87426 - RNA, 23 nt, Homo sapiens
uagguuauuugguaaauauaugu

SEQ ID NO: 87427 - RNA, 22 nt, Homo sapiens
uagugcaguggcuccaucucag

SEQ ID NO: 87428 - RNA, 22 nt, Homo sapiens
uaguuauggaguaauuuuaagc

SEQ ID NO: 87429 - RNA, 22 nt, Homo sapiens
uauacugucuuuguaugccuag

SEQ ID NO: 87430 - RNA, 22 nt, Homo sapiens
uauaugauugguagacccugca

SEQ ID NO: 87431 - RNA, 22 nt, Homo sapiens
uauaugcaacauaguguaugug

SEQ ID NO: 87432 - RNA, 22 nt, Homo sapiens
uauaugcucugggauccugaaa

SEQ ID NO: 87433 - RNA, 22 nt, Homo sapiens
uauauguuuucauaaggcuaga

SEQ ID NO: 87434 - RNA, 22 nt, Homo sapiens
uaucaaguuggaagagaaguaa

SEQ ID NO: 87435 - RNA, 22 nt, Homo sapiens
uaucauagacaaucaguuauug

SEQ ID NO: 87436 - RNA, 20 nt, Homo sapiens
uaucuacuugcaaaugccau

SEQ ID NO: 87437 - RNA, 22 nt, Homo sapiens
uaugaaacucuaagauucacau

SEQ ID NO: 87438 - RNA, 19 nt, Homo sapiens
uaugagcuaugacaugcau

SEQ ID NO: 87439 - RNA, 19 nt, Homo sapiens
uaugcuagagagggaagcu

SEQ ID NO: 87440 - RNA, 19 nt, Homo sapiens
uaugcuauuuauuagaagu

SEQ ID NO: 87441 - RNA, 22 nt, Homo sapiens
uauggucuuugagaggugacug

SEQ ID NO: 87442 - RNA, 20 nt, Homo sapiens
uaugguuuuagguauagcau

SEQ ID NO: 87443 - RNA, 22 nt, Homo sapiens
uaugguuuuggaauccugcaga

SEQ ID NO: 87444 - RNA, 22 nt, Homo sapiens
uauuacugucaauaucacagaa

SEQ ID NO: 87445 - RNA, 22 nt, Homo sapiens
uauuaguuuucuguggauuaca

SEQ ID NO: 87446 - RNA, 22 nt, Homo sapiens
uauucacaggugugggacaaag

SEQ ID NO: 87447 - RNA, 22 nt, Homo sapiens
uauugcaauuggggaaacuggg

SEQ ID NO: 87448 - RNA, 22 nt, Homo sapiens
uauuggcucuguuucucugaag

SEQ ID NO: 87449 - RNA, 22 nt, Homo sapiens
ucaaaugauucacccaccuuug

SEQ ID NO: 87450 - RNA, 17 nt, Homo sapiens
ucaaaugcucccaguga

SEQ ID NO: 87451 - RNA, 21 nt, Homo sapiens
ucaacccuugcgucaccaagc

SEQ ID NO: 87452 - RNA, 21 nt, Homo sapiens
ucaaggaguauacguaugcca

SEQ ID NO: 87453 - RNA, 22 nt, Homo sapiens
ucaaguaguaacuaacugugac

SEQ ID NO: 87454 - RNA, 22 nt, Homo sapiens
ucacaagugagaggaauuagau

SEQ ID NO: 87455 - RNA, 22 nt, Homo sapiens
ucacaauggagacucgggcgga

SEQ ID NO: 87456 - RNA, 22 nt, Homo sapiens
ucacaauggcugaacuaauuua

SEQ ID NO: 87457 - RNA, 22 nt, Homo sapiens
ucacagucaaaguaaucauaga

SEQ ID NO: 87458 - RNA, 22 nt, Homo sapiens
ucacauguguaaauugguguaa

SEQ ID NO: 87459 - RNA, 22 nt, Homo sapiens
ucacucagaccuggugauaugc

SEQ ID NO: 87460 - RNA, 20 nt, Homo sapiens
ucacugaguaucuacgauua

SEQ ID NO: 87461 - RNA, 21 nt, Homo sapiens
ucagaagcucccagggaggac

SEQ ID NO: 87462 - RNA, 22 nt, Homo sapiens
ucagauguuuuguuuaucugcu

SEQ ID NO: 87463 - RNA, 22 nt, Homo sapiens
ucaggcacuaguaagaaaaagg

SEQ ID NO: 87464 - RNA, 20 nt, Homo sapiens
ucagguagggcuucaacauu

SEQ ID NO: 87465 - RNA, 22 nt, Homo sapiens
ucagugucugugauggagaggu

SEQ ID NO: 87466 - RNA, 22 nt, Homo sapiens
ucagugucugugcaccgcugga

SEQ ID NO: 87467 - RNA, 21 nt, Homo sapiens
ucaugccacugcacuuuagcc

SEQ ID NO: 87468 - RNA, 19 nt, Homo sapiens
ucauggcuuuuucagcugu

SEQ ID NO: 87469 - RNA, 22 nt, Homo sapiens
ucauggggugagcuacaggcac

SEQ ID NO: 87470 - RNA, 22 nt, Homo sapiens
ucauucauucauccagcuugag

SEQ ID NO: 87471 - RNA, 22 nt, Homo sapiens
ucauucauucuucaguggguac

SEQ ID NO: 87472 - RNA, 22 nt, Homo sapiens
uccagguacucagggggcugag

SEQ ID NO: 87473 - RNA, 22 nt, Homo sapiens
uccaguacaggucucucauuuc

SEQ ID NO: 87474 - RNA, 22 nt, Homo sapiens
uccaguuuggaggcuugaugug

SEQ ID NO: 87475 - RNA, 22 nt, Homo sapiens
ucccaguuuuucugaauaguca

SEQ ID NO: 87476 - RNA, 22 nt, Homo sapiens
ucccgaggacaucugggggcaa

SEQ ID NO: 87477 - RNA, 20 nt, Homo sapiens
ucccucaaacuuuuccacug

SEQ ID NO: 87478 - RNA, 22 nt, Homo sapiens
ucccugacagggucugagcuuu

SEQ ID NO: 87479 - RNA, 22 nt, Homo sapiens
uccuguaaucccagcuaccaga

SEQ ID NO: 87480 - RNA, 22 nt, Homo sapiens
uccuucaugcaucaauguaucc

SEQ ID NO: 87481 - RNA, 22 nt, Homo sapiens
gagguguagagauauaccugaa

SEQ ID NO: 87482 - RNA, 22 nt, Homo sapiens
gaguagaacugguuaucuaaua

SEQ ID NO: 87483 - RNA, 22 nt, Homo sapiens
gauaaagauagcaauagggaca

SEQ ID NO: 87484 - RNA, 22 nt, Homo sapiens
gauaauucuagcagauacaggc

SEQ ID NO: 87485 - RNA, 22 nt, Homo sapiens
gaucacuuugaugccaggaacu

SEQ ID NO: 87486 - RNA, 22 nt, Homo sapiens
gaucagauggcuguuggugugu

SEQ ID NO: 87487 - RNA, 22 nt, Homo sapiens
gauguaggugcauuugcacgug

SEQ ID NO: 87488 - RNA, 22 nt, Homo sapiens
gcaaaauugagaagggaauaua

SEQ ID NO: 87489 - RNA, 21 nt, Homo sapiens
gcaaacauccuuugaugccag

SEQ ID NO: 87490 - RNA, 21 nt, Homo sapiens
gcaaaggaauugccuaagcuu

SEQ ID NO: 87491 - RNA, 22 nt, Homo sapiens
gcacaaugccugacgaguccug

SEQ ID NO: 87492 - RNA, 22 nt, Homo sapiens
gcagugacaugugccaguuuau

SEQ ID NO: 87493 - RNA, 22 nt, Homo sapiens
gcagugaugugaucauagcuca

SEQ ID NO: 87494 - RNA, 22 nt, Homo sapiens
gcaguguucaaaucaugcccau

SEQ ID NO: 87495 - RNA, 20 nt, Homo sapiens
gcaugagucuuuauaguaga

SEQ ID NO: 87496 - RNA, 22 nt, Homo sapiens
gccauagucauagauggcaggg

SEQ ID NO: 87497 - RNA, 22 nt, Homo sapiens
gccccgggugaugcagccguca

SEQ ID NO: 87498 - RNA, 22 nt, Homo sapiens
gcugagcuaugccauauaugcc

SEQ ID NO: 87499 - RNA, 22 nt, Homo sapiens
gcugagguucaagaagguuaaa

SEQ ID NO: 87500 - RNA, 22 nt, Homo sapiens
gcuuuggcauguagauguaugg

SEQ ID NO: 87501 - RNA, 18 nt, Homo sapiens
ggaaaacuuuucuaagua

SEQ ID NO: 87502 - RNA, 23 nt, Homo sapiens
ggaaacauccagucuuucaccau

SEQ ID NO: 87503 - RNA, 22 nt, Homo sapiens
ggaaagaucagcuaaauguaag

SEQ ID NO: 87504 - RNA, 22 nt, Homo sapiens
ggaaauguuggugucaugaguu

SEQ ID NO: 87505 - RNA, 22 nt, Homo sapiens
ggaagacuuagaguagcaucag

SEQ ID NO: 87506 - RNA, 20 nt, Homo sapiens
ggaagagugacacaagguau

SEQ ID NO: 87507 - RNA, 22 nt, Homo sapiens
ggaaucugaaccaugggaaugg

SEQ ID NO: 87508 - RNA, 22 nt, Homo sapiens
ggacaagagacugggacacuga

SEQ ID NO: 87509 - RNA, 22 nt, Homo sapiens
ggagagcuaggcagagguuugu

SEQ ID NO: 87510 - RNA, 22 nt, Homo sapiens
ggagaucuuuaggaguuggacu

SEQ ID NO: 87511 - RNA, 22 nt, Homo sapiens
ggagaugauuaugaaucacuua

SEQ ID NO: 87512 - RNA, 22 nt, Homo sapiens
ggaggcuaguaaaaagguagaa

SEQ ID NO: 87513 - RNA, 22 nt, Homo sapiens
ggagucugacuuauaggaaccu

SEQ ID NO: 87514 - RNA, 22 nt, Homo sapiens
ggauacauuuuuccuccucuuc

SEQ ID NO: 87515 - RNA, 23 nt, Homo sapiens
ggauggaaaguuuugagggccac

SEQ ID NO: 87516 - RNA, 22 nt, Homo sapiens
ggcaaaauggccagugggucac

SEQ ID NO: 87517 - RNA, 22 nt, Homo sapiens
ggcaacaauuccuacuucuuuu

SEQ ID NO: 87518 - RNA, 22 nt, Homo sapiens
ggcacgguggcucacgccugua

SEQ ID NO: 87519 - RNA, 19 nt, Homo sapiens
ggcucagucaacugacugu

SEQ ID NO: 87520 - RNA, 22 nt, Homo sapiens
ggcugguuuucaguuacugagu

SEQ ID NO: 87521 - RNA, 22 nt, Homo sapiens
gggaagauauaggcugggcacc

SEQ ID NO: 87522 - RNA, 22 nt, Homo sapiens
gggaggucauuguaaggucuua

SEQ ID NO: 87523 - RNA, 22 nt, Homo sapiens
gggauguaugauauauguuggu

SEQ ID NO: 87524 - RNA, 22 nt, Homo sapiens
gggcauaucacuugaggucagg

SEQ ID NO: 87525 - RNA, 22 nt, Homo sapiens
gggugguuuuauuaucagugac

SEQ ID NO: 87526 - RNA, 22 nt, Homo sapiens
gguaggcacuggugggaagaga

SEQ ID NO: 87527 - RNA, 22 nt, Homo sapiens
gguauguagcaaaagaggugcu

SEQ ID NO: 87528 - RNA, 22 nt, Homo sapiens
ggucauggauaagauccagaag

SEQ ID NO: 87529 - RNA, 22 nt, Homo sapiens
gguggugguauuucagaaaaug

SEQ ID NO: 87530 - RNA, 22 nt, Homo sapiens
ggugucaguuggccccuacugg

SEQ ID NO: 87531 - RNA, 20 nt, Homo sapiens
guaaacucucagcauagaug

SEQ ID NO: 87532 - RNA, 22 nt, Homo sapiens
guaacuggccuucaauuucuuc

SEQ ID NO: 87533 - RNA, 23 nt, Homo sapiens
guaauacuagucauaguagcagg

SEQ ID NO: 87534 - RNA, 22 nt, Homo sapiens
guaaucucaccuacuugggagg

SEQ ID NO: 87535 - RNA, 22 nt, Homo sapiens
guaaucucagcuacuugggagu

SEQ ID NO: 87536 - RNA, 22 nt, Homo sapiens
guaaucucagcuucuugggagg

SEQ ID NO: 87537 - RNA, 16 nt, Homo sapiens
guacacaguaaguaug

SEQ ID NO: 87538 - RNA, 22 nt, Homo sapiens
guagaaagcauuucagauuugc

SEQ ID NO: 87539 - RNA, 22 nt, Homo sapiens
guagaaaguuugcugucacaug

SEQ ID NO: 87540 - RNA, 22 nt, Homo sapiens
guagaagcacaggugaguuggu

SEQ ID NO: 87541 - RNA, 22 nt, Homo sapiens
gucaaguaaauguuaugguuau

SEQ ID NO: 87542 - RNA, 22 nt, Homo sapiens
gucacagcuggcauugucugca

SEQ ID NO: 87543 - RNA, 22 nt, Homo sapiens
gucacugagcaauagaaaguuu

SEQ ID NO: 87544 - RNA, 18 nt, Homo sapiens
gucauagaaugaugguuc

SEQ ID NO: 87545 - RNA, 22 nt, Homo sapiens
gucaugcaggguucgccagccc

SEQ ID NO: 87546 - RNA, 22 nt, Homo sapiens
gucccagagauauugugucuuu

SEQ ID NO: 87547 - RNA, 22 nt, Homo sapiens
gucucacagcuagcugcuuuau

SEQ ID NO: 87548 - RNA, 22 nt, Homo sapiens
gucucagugcgaaucucaaaga

SEQ ID NO: 87549 - RNA, 22 nt, Homo sapiens
gucucccaaccccugugcccag

SEQ ID NO: 87550 - RNA, 22 nt, Homo sapiens
gucugguuggaguaguuuucag

SEQ ID NO: 87551 - RNA, 22 nt, Homo sapiens
gucuuccagccuccaucuuucu

SEQ ID NO: 87552 - RNA, 19 nt, Homo sapiens
gugagcacagacaauacaa

SEQ ID NO: 87553 - RNA, 22 nt, Homo sapiens
gugagcuccucuucugcugcag

SEQ ID NO: 87554 - RNA, 22 nt, Homo sapiens
gugaggaaggaaaccugcuagc

SEQ ID NO: 87555 - RNA, 18 nt, Homo sapiens
gugcaaugaauagcagag

SEQ ID NO: 87556 - RNA, 22 nt, Homo sapiens
gugcacaacgugcaggcuuguu

SEQ ID NO: 87557 - RNA, 22 nt, Homo sapiens
gugcacaaugugcagguuuguu

SEQ ID NO: 87558 - RNA, 23 nt, Homo sapiens
gugcaugagucuuuauaguagca

SEQ ID NO: 87559 - RNA, 22 nt, Homo sapiens
gugcaugucugugacgacccug

SEQ ID NO: 87560 - RNA, 22 nt, Homo sapiens
gugccuuuucugagcaaugagc

SEQ ID NO: 87561 - RNA, 22 nt, Homo sapiens
guggaucacuugagguuagaag

SEQ ID NO: 87562 - RNA, 22 nt, Homo sapiens
guggcuuuaaguacgauugagg

SEQ ID NO: 87563 - RNA, 22 nt, Homo sapiens
auuauauguguaugugcauacc

SEQ ID NO: 87564 - RNA, 22 nt, Homo sapiens
auucaaagugcauguucccacu

SEQ ID NO: 87565 - RNA, 22 nt, Homo sapiens
auucauagugcuaagguguauc

SEQ ID NO: 87566 - RNA, 20 nt, Homo sapiens
auugaagacuccggggcaga

SEQ ID NO: 87567 - RNA, 22 nt, Homo sapiens
auugcaguuagaacagaagucu

SEQ ID NO: 87568 - RNA, 22 nt, Homo sapiens
auuuggcaguauaaugcuuugg

SEQ ID NO: 87569 - RNA, 20 nt, Homo sapiens
auuuggcauaguuuaagcaa

SEQ ID NO: 87570 - RNA, 22 nt, Homo sapiens
caacacagugaaacccgucucu

SEQ ID NO: 87571 - RNA, 22 nt, Homo sapiens
caagugaauaguugcucucaga

SEQ ID NO: 87572 - RNA, 23 nt, Homo sapiens
cacagggugaacaccccuaaucc

SEQ ID NO: 87573 - RNA, 22 nt, Homo sapiens
cacaguguucauagccaucagg

SEQ ID NO: 87574 - RNA, 22 nt, Homo sapiens
cacugcacuccagucugacgac

SEQ ID NO: 87575 - RNA, 22 nt, Homo sapiens
cagaaguauugguaugcucugu

SEQ ID NO: 87576 - RNA, 20 nt, Homo sapiens
cagagcaaagcaguccuggc

SEQ ID NO: 87577 - RNA, 22 nt, Homo sapiens
cagcaagucucuaagaguucau

SEQ ID NO: 87578 - RNA, 22 nt, Homo sapiens
cagccgggugagguggcuuguu

SEQ ID NO: 87579 - RNA, 22 nt, Homo sapiens
caggcagucuggcucccaagug

SEQ ID NO: 87580 - RNA, 22 nt, Homo sapiens
cagguaguauuugguuacauaa

SEQ ID NO: 87581 - RNA, 23 nt, Homo sapiens
cagguaguucuuuauaguagugu

SEQ ID NO: 87582 - RNA, 22 nt, Homo sapiens
cagugguuuucaacccugguug

SEQ ID NO: 87583 - RNA, 22 nt, Homo sapiens
caguuacuuuugcaccaaccua

SEQ ID NO: 87584 - RNA, 22 nt, Homo sapiens
caguuguuuuaugacauaagau

SEQ ID NO: 87585 - RNA, 21 nt, Homo sapiens
cauaaugcuacuuauuuuaug

SEQ ID NO: 87586 - RNA, 22 nt, Homo sapiens
cauaguacuugcauaguacuau

SEQ ID NO: 87587 - RNA, 22 nt, Homo sapiens
caucacagcaaguagggagugg

SEQ ID NO: 87588 - RNA, 22 nt, Homo sapiens
cauuaguugaagugcagggaga

SEQ ID NO: 87589 - RNA, 22 nt, Homo sapiens
cauuuuacuuuccagacgugga

SEQ ID NO: 87590 - RNA, 22 nt, Homo sapiens
cauuuugguuaaauagguagcu

SEQ ID NO: 87591 - RNA, 22 nt, Homo sapiens
ccaaggcacugauucuguacuc

SEQ ID NO: 87592 - RNA, 23 nt, Homo sapiens
ccacacuguuuagaauggcauca

SEQ ID NO: 87593 - RNA, 22 nt, Homo sapiens
ccacccuuccauucuuccucuu

SEQ ID NO: 87594 - RNA, 22 nt, Homo sapiens
ccagaguggagccuuugcgagg

SEQ ID NO: 87595 - RNA, 22 nt, Homo sapiens
ccagaguugccucagguuucug

SEQ ID NO: 87596 - RNA, 22 nt, Homo sapiens
ccagcaccauuuauuaaauagg

SEQ ID NO: 87597 - RNA, 22 nt, Homo sapiens
ccagugauuguauggugaaggu

SEQ ID NO: 87598 - RNA, 18 nt, Homo sapiens
ccauucaacagauuuguc

SEQ ID NO: 87599 - RNA, 22 nt, Homo sapiens
cccacaguggccucauauccuu

SEQ ID NO: 87600 - RNA, 22 nt, Homo sapiens
cccagugguuacauaaggagua

SEQ ID NO: 87601 - RNA, 17 nt, Homo sapiens
ccccugagcgaugcagu

SEQ ID NO: 87602 - RNA, 22 nt, Homo sapiens
cccuagaucucagcgccuucau

SEQ ID NO: 87603 - RNA, 22 nt, Homo sapiens
cccuucauucaaggguugugag

SEQ ID NO: 87604 - RNA, 21 nt, Homo sapiens
ccugaagaagugaccucugag

SEQ ID NO: 87605 - RNA, 22 nt, Homo sapiens
ccuuggcacuuugccacagugc

SEQ ID NO: 87606 - RNA, 19 nt, Homo sapiens
ccuuugguuuccaugacau

SEQ ID NO: 87607 - RNA, 22 nt, Homo sapiens
cuagcagacaggcugggagcag

SEQ ID NO: 87608 - RNA, 21 nt, Homo sapiens
cuaucucaguguuuacauuug

SEQ ID NO: 87609 - RNA, 22 nt, Homo sapiens
cuauucacaggcaauauguaca

SEQ ID NO: 87610 - RNA, 22 nt, Homo sapiens
cucaaguacaugggauuacagg

SEQ ID NO: 87611 - RNA, 18 nt, Homo sapiens
cucacacccuaaucagga

SEQ ID NO: 87612 - RNA, 22 nt, Homo sapiens
cucagugucuggggccccaggg

SEQ ID NO: 87613 - RNA, 22 nt, Homo sapiens
cucauggaauacuucacagcca

SEQ ID NO: 87614 - RNA, 22 nt, Homo sapiens
cucgcuccauuucggugaucaa

SEQ ID NO: 87615 - RNA, 22 nt, Homo sapiens
cucugacagugguuagcacugu

SEQ ID NO: 87616 - RNA, 22 nt, Homo sapiens
cucugguuaaggcugaacuaua

SEQ ID NO: 87617 - RNA, 22 nt, Homo sapiens
cucugguuuuucuuccauuaag

SEQ ID NO: 87618 - RNA, 22 nt, Homo sapiens
cucuuuggaugccuuaggguua

SEQ ID NO: 87619 - RNA, 22 nt, Homo sapiens
cugaagugcuugccacauaaaa

SEQ ID NO: 87620 - RNA, 22 nt, Homo sapiens
cugaauguucuggauggaagag

SEQ ID NO: 87621 - RNA, 22 nt, Homo sapiens
cugacaucuucaagugaggaga

SEQ ID NO: 87622 - RNA, 22 nt, Homo sapiens
cugagcaaaaugaagacacgau

SEQ ID NO: 87623 - RNA, 20 nt, Homo sapiens
cugauacagccugagcucuc

SEQ ID NO: 87624 - RNA, 22 nt, Homo sapiens
cugauacugaaagcuguugguu

SEQ ID NO: 87625 - RNA, 22 nt, Homo sapiens
cugauuuguccccagccucaug

SEQ ID NO: 87626 - RNA, 22 nt, Homo sapiens
cugcaagaugcauaggaauuuu

SEQ ID NO: 87627 - RNA, 19 nt, Homo sapiens
cugcacugagaaaaggagg

SEQ ID NO: 87628 - RNA, 20 nt, Homo sapiens
cugcuccccuacaaaucuca

SEQ ID NO: 87629 - RNA, 22 nt, Homo sapiens
cuggaggccugaacauaaaugg

SEQ ID NO: 87630 - RNA, 22 nt, Homo sapiens
cuggauggugagauaaagaaaa

SEQ ID NO: 87631 - RNA, 22 nt, Homo sapiens
cuggucaugggggcacccucug

SEQ ID NO: 87632 - RNA, 22 nt, Homo sapiens
cugguuuguaaaguuccugaga

SEQ ID NO: 87633 - RNA, 22 nt, Homo sapiens
cuguaagcauuauaaagagaua

SEQ ID NO: 87634 - RNA, 22 nt, Homo sapiens
cuguaguuagcagaugaugaau

SEQ ID NO: 87635 - RNA, 22 nt, Homo sapiens
cugucucagugaauugguuuua

SEQ ID NO: 87636 - RNA, 22 nt, Homo sapiens
cugugaacaugggagaaauggc

SEQ ID NO: 87637 - RNA, 22 nt, Homo sapiens
cuguugguuaaauuccaugcag

SEQ ID NO: 87638 - RNA, 19 nt, Homo sapiens
cuuaggugaccaguuccca

SEQ ID NO: 87639 - RNA, 22 nt, Homo sapiens
cuuccagcuggguucagucagu

SEQ ID NO: 87640 - RNA, 22 nt, Homo sapiens
cuucucagugcucaucuuauuu

SEQ ID NO: 87641 - RNA, 22 nt, Homo sapiens
cuuggcauugccccuggaauuu

SEQ ID NO: 87642 - RNA, 22 nt, Homo sapiens
cuugggauauguguuacucugu

SEQ ID NO: 87643 - RNA, 22 nt, Homo sapiens
cuugugauugcacggcugccug

SEQ ID NO: 87644 - RNA, 22 nt, Homo sapiens
cuuugcaaaacauugagaccuc

SEQ ID NO: 87645 - RNA, 22 nt, Homo sapiens
cuuugcuaauccaacccucauc

SEQ ID NO: 87646 - RNA, 22 nt, Homo sapiens
cuuuggcacuuccuaagugcca

SEQ ID NO: 87647 - RNA, 22 nt, Homo sapiens
uucugugguugaaaggagagau

SEQ ID NO: 87648 - RNA, 22 nt, Homo sapiens
uucuugguguaguaguugaaaa

SEQ ID NO: 87649 - RNA, 18 nt, Homo sapiens
uucuuguguugauauuuu

SEQ ID NO: 87650 - RNA, 21 nt, Homo sapiens
uucuuugcucaguguuagagu

SEQ ID NO: 87651 - RNA, 22 nt, Homo sapiens
uugaaggaacgcuguucccuug

SEQ ID NO: 87652 - RNA, 22 nt, Homo sapiens
uugaauagaagguuuuuuguuc

SEQ ID NO: 87653 - RNA, 18 nt, Homo sapiens
uugaauaguguccaaucu

SEQ ID NO: 87654 - RNA, 22 nt, Homo sapiens
uugaaugaaaugaugucauuug

SEQ ID NO: 87655 - RNA, 22 nt, Homo sapiens
uugagauggaaucucgcuuugu

SEQ ID NO: 87656 - RNA, 22 nt, Homo sapiens
uugagauggauagacauagcau

SEQ ID NO: 87657 - RNA, 22 nt, Homo sapiens
uugagauguaagauguuaauau

SEQ ID NO: 87658 - RNA, 22 nt, Homo sapiens
uugagauguggcaguuuaugag

SEQ ID NO: 87659 - RNA, 22 nt, Homo sapiens
uugagauguggguuggugacuu

SEQ ID NO: 87660 - RNA, 22 nt, Homo sapiens
uugagcaaaacauuaauauuag

SEQ ID NO: 87661 - RNA, 20 nt, Homo sapiens
uugaggugugaggggcagag

SEQ ID NO: 87662 - RNA, 22 nt, Homo sapiens
uugauaguuuuaaaauuaaucu

SEQ ID NO: 87663 - RNA, 22 nt, Homo sapiens
uugauaugaauggcuguuugug

SEQ ID NO: 87664 - RNA, 22 nt, Homo sapiens
uugauauguggaauauuuaucu

SEQ ID NO: 87665 - RNA, 22 nt, Homo sapiens
uugauugacaugucucuguuca

SEQ ID NO: 87666 - RNA, 22 nt, Homo sapiens
uugcaaagaccucuucacuucc

SEQ ID NO: 87667 - RNA, 22 nt, Homo sapiens
uugcaacuuagaaaaaucauuu

SEQ ID NO: 87668 - RNA, 22 nt, Homo sapiens
uugcacaauggaauuuaucuuu

SEQ ID NO: 87669 - RNA, 22 nt, Homo sapiens
uugccuuuguuggaaacaagug

SEQ ID NO: 87670 - RNA, 22 nt, Homo sapiens
uugcuacuuggauguacaugug

SEQ ID NO: 87671 - RNA, 22 nt, Homo sapiens
uugcucaggcuagaguucagcu

SEQ ID NO: 87672 - RNA, 22 nt, Homo sapiens
uugcuccccaggaaaggaagca

SEQ ID NO: 87673 - RNA, 22 nt, Homo sapiens
uuggaaacauuuaugguaacag

SEQ ID NO: 87674 - RNA, 22 nt, Homo sapiens
uuggaagacaaugcugauucuc

SEQ ID NO: 87675 - RNA, 22 nt, Homo sapiens
uuggaagauuacuuaguuuucu

SEQ ID NO: 87676 - RNA, 22 nt, Homo sapiens
uuggagagugauauucagaugc

SEQ ID NO: 87677 - RNA, 22 nt, Homo sapiens
uuggauaguuuaugaaaaaugg

SEQ ID NO: 87678 - RNA, 22 nt, Homo sapiens
uuggcaaagaggaaugccacuu

SEQ ID NO: 87679 - RNA, 21 nt, Homo sapiens
uuggcacucuucucuccuuau

SEQ ID NO: 87680 - RNA, 22 nt, Homo sapiens
uuggcagaauguuagaaacuua

SEQ ID NO: 87681 - RNA, 20 nt, Homo sapiens
uuggcagagucuuuagggua

SEQ ID NO: 87682 - RNA, 22 nt, Homo sapiens
uuggcagaguuaauuuguugag

SEQ ID NO: 87683 - RNA, 22 nt, Homo sapiens
uuggcagucugaggcacagacu

SEQ ID NO: 87684 - RNA, 22 nt, Homo sapiens
uuggucacugacauguuugaaa

SEQ ID NO: 87685 - RNA, 22 nt, Homo sapiens
uuguacuucagacaugccaaag

SEQ ID NO: 87686 - RNA, 22 nt, Homo sapiens
uugucacuauaaauaagcauuu

SEQ ID NO: 87687 - RNA, 22 nt, Homo sapiens
uugucacucuuccuaggguagg

SEQ ID NO: 87688 - RNA, 22 nt, Homo sapiens
uugucucacuggaguuuaguaa

SEQ ID NO: 87689 - RNA, 22 nt, Homo sapiens
uugugaaaaaccucucguggaa

SEQ ID NO: 87690 - RNA, 22 nt, Homo sapiens
uugugauugagugauccuuguu

SEQ ID NO: 87691 - RNA, 22 nt, Homo sapiens
uugugcuuuugagcugagauga

SEQ ID NO: 87692 - RNA, 22 nt, Homo sapiens
uugugggaggugauuagaucau

SEQ ID NO: 87693 - RNA, 22 nt, Homo sapiens
uuuaaguguuuguuccugaaaa

SEQ ID NO: 87694 - RNA, 22 nt, Homo sapiens
uuuaaugcaucccaaaauguag

SEQ ID NO: 87695 - RNA, 22 nt, Homo sapiens
uuuaauguuacaguauugguau

SEQ ID NO: 87696 - RNA, 22 nt, Homo sapiens
uuuaucaggccuuuggaaaaau

SEQ ID NO: 87697 - RNA, 22 nt, Homo sapiens
uuucauguuuuucugugaggca

SEQ ID NO: 87698 - RNA, 22 nt, Homo sapiens
uuuccaagaugcuuacuuucuc

SEQ ID NO: 87699 - RNA, 22 nt, Homo sapiens
uuuccacauggacuuaccuucg

SEQ ID NO: 87700 - RNA, 22 nt, Homo sapiens
uuucccuuuagcuuagugauuu

SEQ ID NO: 87701 - RNA, 22 nt, Homo sapiens
uuucugugguccucuugaaggu

SEQ ID NO: 87702 - RNA, 22 nt, Homo sapiens
uuugaauggaaguuuugugaaa

SEQ ID NO: 87703 - RNA, 22 nt, Homo sapiens
uuugcacuugaaaacacucuca

SEQ ID NO: 87704 - RNA, 22 nt, Homo sapiens
uuugcaguguaguuggccagca

SEQ ID NO: 87705 - RNA, 22 nt, Homo sapiens
uuugcagugucagcuucugugu

SEQ ID NO: 87706 - RNA, 22 nt, Homo sapiens
uuugcauaauaagauuagggug

SEQ ID NO: 87707 - RNA, 22 nt, Homo sapiens
uuugcaucuuagaaaguucucc

SEQ ID NO: 87708 - RNA, 22 nt, Homo sapiens
uuugcaugcuccuuaugagaau

SEQ ID NO: 87709 - RNA, 22 nt, Homo sapiens
uuugccaauauuuuauugagga

SEQ ID NO: 87710 - RNA, 22 nt, Homo sapiens
uuugccuuugugauauggucua

SEQ ID NO: 87711 - RNA, 22 nt, Homo sapiens
uuugcuuaguaaauguagaaaa

SEQ ID NO: 87712 - RNA, 22 nt, Homo sapiens
uuuggcaacguuggaucccuca

SEQ ID NO: 87713 - RNA, 23 nt, Homo sapiens
uuuggcauuccagaaauuuucau

SEQ ID NO: 87714 - RNA, 21 nt, Homo sapiens
uuuguccaccuguguucacca

SEQ ID NO: 87715 - RNA, 22 nt, Homo sapiens
uuugugaggugauggauauguc

SEQ ID NO: 87716 - RNA, 22 nt, Homo sapiens
uuugugagguggauagauugca

SEQ ID NO: 87717 - RNA, 22 nt, Homo sapiens
uuuuacagaggagguugcugau

SEQ ID NO: 87718 - RNA, 22 nt, Homo sapiens
uuuugcaaauuccaguggccau

SEQ ID NO: 87719 - RNA, 22 nt, Homo sapiens
uuuugcaguuacagagagugag

SEQ ID NO: 87720 - RNA, 22 nt, Homo sapiens
uuuugcuccuggcaaacucaua

SEQ ID NO: 87721 - RNA, 22 nt, Homo sapiens
cuuuugugauuccucaguuacu

SEQ ID NO: 87722 - RNA, 22 nt, Homo sapiens
cuuuugugauucuucaguuacu

SEQ ID NO: 87723 - RNA, 22 nt, Homo sapiens
gaaagcugguauagauacauua

SEQ ID NO: 87724 - RNA, 22 nt, Homo sapiens
gaacuguuucuggugaaagagu

SEQ ID NO: 87725 - RNA, 22 nt, Homo sapiens
gaacuuguguugcuucacaugu

SEQ ID NO: 87726 - RNA, 22 nt, Homo sapiens
gaacuuucuacauuaccucuuu

SEQ ID NO: 87727 - RNA, 22 nt, Homo sapiens
gaagugcuuuuggacuaacagu

SEQ ID NO: 87728 - RNA, 22 nt, Homo sapiens
gacaguuuggugaggaagacga

SEQ ID NO: 87729 - RNA, 21 nt, Homo sapiens
gaccacagcagggaaugucag

SEQ ID NO: 87730 - RNA, 22 nt, Homo sapiens
gaccacauuccacacaggcuuu

SEQ ID NO: 87731 - RNA, 22 nt, Homo sapiens
gagaacauuaauaguuaauuuu

SEQ ID NO: 87732 - RNA, 22 nt, Homo sapiens
gagagucacagugaauguggca

SEQ ID NO: 87733 - RNA, 22 nt, Homo sapiens
gagauggagacuuggccuuaaa

SEQ ID NO: 87734 - RNA, 22 nt, Homo sapiens
gagauggugugcuguuggaagu

SEQ ID NO: 87735 - RNA, 22 nt, Homo sapiens
gagcaaaaguauguauugguua

SEQ ID NO: 87736 - RNA, 22 nt, Homo sapiens
gagcacugauuuauuuuugucu

SEQ ID NO: 87737 - RNA, 22 nt, Homo sapiens
gagcagacaugaggaccgcugg

SEQ ID NO: 87738 - RNA, 22 nt, Homo sapiens
gagcaucaguggccucaucuca

SEQ ID NO: 87739 - RNA, 22 nt, Homo sapiens
gagccuguaggaggagaggugg

SEQ ID NO: 87740 - RNA, 22 nt, Homo sapiens
gagcuccuccccuuggcuuuca

SEQ ID NO: 87741 - RNA, 22 nt, Homo sapiens
gagcugaaguuuccauuuguac

SEQ ID NO: 87742 - RNA, 22 nt, Homo sapiens
gaggcaaugugcccggcccaca

SEQ ID NO: 87743 - RNA, 22 nt, Homo sapiens
gaggucaggacauuuuugcuuu

SEQ ID NO: 87744 - RNA, 22 nt, Homo sapiens
gaggucauguggcaggcagcca

SEQ ID NO: 87745 - RNA, 22 nt, Homo sapiens
gaucuguuguuuggaaguauca

SEQ ID NO: 87746 - RNA, 22 nt, Homo sapiens
gaugacagcugacucccuugcu

SEQ ID NO: 87747 - RNA, 22 nt, Homo sapiens
gcaaaaaguagugcugguuagg

SEQ ID NO: 87748 - RNA, 22 nt, Homo sapiens
gcacaguguuacuugauauauu

SEQ ID NO: 87749 - RNA, 22 nt, Homo sapiens
gcacugggccacauuuauuuuc

SEQ ID NO: 87750 - RNA, 19 nt, Homo sapiens
gcagagaugugguagcuug

SEQ ID NO: 87751 - RNA, 22 nt, Homo sapiens
gcagaguauagagggcugggcc

SEQ ID NO: 87752 - RNA, 22 nt, Homo sapiens
gcagaucucuucauuucucuua

SEQ ID NO: 87753 - RNA, 22 nt, Homo sapiens
gcaggcaugacauuucacucuu

SEQ ID NO: 87754 - RNA, 22 nt, Homo sapiens
gcaguguucugggcaggaagaa

SEQ ID NO: 87755 - RNA, 22 nt, Homo sapiens
gcaugcacaugugaaaaaauga

SEQ ID NO: 87756 - RNA, 22 nt, Homo sapiens
gccccugagacuugccucgggc

SEQ ID NO: 87757 - RNA, 22 nt, Homo sapiens
gccuagauccaaauauggugca

SEQ ID NO: 87758 - RNA, 22 nt, Homo sapiens
gccuguagaagaguagaugacc

SEQ ID NO: 87759 - RNA, 22 nt, Homo sapiens
gcucugguuacaaaggcaaauu

SEQ ID NO: 87760 - RNA, 22 nt, Homo sapiens
gcugcacuuuaaggcauccccu

SEQ ID NO: 87761 - RNA, 22 nt, Homo sapiens
gcuguaguugaggauuuuaaga

SEQ ID NO: 87762 - RNA, 22 nt, Homo sapiens
ggaagguaauugucagcucaua

SEQ ID NO: 87763 - RNA, 22 nt, Homo sapiens
ggaaugcagugagcauuagaua

SEQ ID NO: 87764 - RNA, 22 nt, Homo sapiens
ggagucugauguucuaaggcag

SEQ ID NO: 87765 - RNA, 23 nt, Homo sapiens
ggaguguaaauuauuucaaccau

SEQ ID NO: 87766 - RNA, 22 nt, Homo sapiens
ggcaagaacuucacucacuuuu

SEQ ID NO: 87767 - RNA, 22 nt, Homo sapiens
ggcaguguuauuauauuuuugg

SEQ ID NO: 87768 - RNA, 22 nt, Homo sapiens
ggcaugauggcugaggcuucug

SEQ ID NO: 87769 - RNA, 22 nt, Homo sapiens
ggcuagagacaaguugcugaga

SEQ ID NO: 87770 - RNA, 22 nt, Homo sapiens
gggagguuguauguaugcgggg

SEQ ID NO: 87771 - RNA, 22 nt, Homo sapiens
gggaugaagcccuaggguuggu

SEQ ID NO: 87772 - RNA, 22 nt, Homo sapiens
ggguaggcaagcggaugucaga

SEQ ID NO: 87773 - RNA, 22 nt, Homo sapiens
gguaaacauaagagagcugacu

SEQ ID NO: 87774 - RNA, 22 nt, Homo sapiens
ggucacccugaugcuggugguc

SEQ ID NO: 87775 - RNA, 22 nt, Homo sapiens
ggugagguaguaagguacaaua

SEQ ID NO: 87776 - RNA, 22 nt, Homo sapiens
guaaggaguaguguaacagugc

SEQ ID NO: 87777 - RNA, 22 nt, Homo sapiens
guaagucucaugagaucugaug

SEQ ID NO: 87778 - RNA, 22 nt, Homo sapiens
guaaucucagcuacucgggaga

SEQ ID NO: 87779 - RNA, 22 nt, Homo sapiens
guaaucucagcuacuugggagc

SEQ ID NO: 87780 - RNA, 19 nt, Homo sapiens
guaaucucaguacuuuggu

SEQ ID NO: 87781 - RNA, 22 nt, Homo sapiens
guacaagugcaguuucguuaca

SEQ ID NO: 87782 - RNA, 22 nt, Homo sapiens
guacagugcucacaaugagagc

SEQ ID NO: 87783 - RNA, 22 nt, Homo sapiens
guagcagcuacuaaguugcugu

SEQ ID NO: 87784 - RNA, 22 nt, Homo sapiens
guaucucaguucucgugauuag

SEQ ID NO: 87785 - RNA, 22 nt, Homo sapiens
guauuuuguuagggugugguau

SEQ ID NO: 87786 - RNA, 22 nt, Homo sapiens
gucacagcacuuuuaguaagug

SEQ ID NO: 87787 - RNA, 20 nt, Homo sapiens
gucacuggcccagggcuugu

SEQ ID NO: 87788 - RNA, 22 nt, Homo sapiens
gucagcaaaguucuccugcaga

SEQ ID NO: 87789 - RNA, 22 nt, Homo sapiens
gucagcaucaccaugucuauga

SEQ ID NO: 87790 - RNA, 20 nt, Homo sapiens
guccauuugcugccauugcu

SEQ ID NO: 87791 - RNA, 22 nt, Homo sapiens
uuuagguauuugguauagcagu

SEQ ID NO: 87792 - RNA, 22 nt, Homo sapiens
uuuauggcaugcucccucucaa

SEQ ID NO: 87793 - RNA, 19 nt, Homo sapiens
uuucaauguaaggauggag

SEQ ID NO: 87794 - RNA, 22 nt, Homo sapiens
uuucaguagagacacgguuuug

SEQ ID NO: 87795 - RNA, 18 nt, Homo sapiens
uuucauugagugugauau

SEQ ID NO: 87796 - RNA, 21 nt, Homo sapiens
uuuccuggagcguauggcuuc

SEQ ID NO: 87797 - RNA, 22 nt, Homo sapiens
uuucuacagggcuugccaggua

SEQ ID NO: 87798 - RNA, 22 nt, Homo sapiens
uuucuauguugaccagucuaga

SEQ ID NO: 87799 - RNA, 22 nt, Homo sapiens
uuugacucacagccuggcugcc

SEQ ID NO: 87800 - RNA, 22 nt, Homo sapiens
uuugaggaaaggcauaaguagg

SEQ ID NO: 87801 - RNA, 22 nt, Homo sapiens
uuugcaagaugaaaaaguucua

SEQ ID NO: 87802 - RNA, 22 nt, Homo sapiens
uuugcuucacuguuuggcaaaa

SEQ ID NO: 87803 - RNA, 22 nt, Homo sapiens
uuugcuuguguaaaaaucugga

SEQ ID NO: 87804 - RNA, 22 nt, Homo sapiens
uuuggaaugaaacagcagagcc

SEQ ID NO: 87805 - RNA, 22 nt, Homo sapiens
uuuggcaaagaucaacauguua

SEQ ID NO: 87806 - RNA, 22 nt, Homo sapiens
uuuggcaauuugacuguauagg

SEQ ID NO: 87807 - RNA, 22 nt, Homo sapiens
uuuggcacuguaaauuucucuu

SEQ ID NO: 87808 - RNA, 22 nt, Homo sapiens
uuuggcauuagagagacuugca

SEQ ID NO: 87809 - RNA, 22 nt, Homo sapiens
uuuguagcuacaaagugagaug

SEQ ID NO: 87810 - RNA, 22 nt, Homo sapiens
uuuguagcucacucugagcuga

SEQ ID NO: 87811 - RNA, 21 nt, Homo sapiens
uuugugguuacugugugagcu

SEQ ID NO: 87812 - RNA, 16 nt, Homo sapiens
uuugugugugacgaga

SEQ ID NO: 87813 - RNA, 22 nt, Homo sapiens
uuuugcucuugguaaugaaaga

SEQ ID NO: 87814 - RNA, 22 nt, Homo sapiens
uuuuggacuugcuccccugucc

SEQ ID NO: 87815 - RNA, 22 nt, Homo sapiens
uuuuggcacuuugucugauucu

SEQ ID NO: 87816 - RNA, 22 nt, Homo sapiens
uuuuggcuuaaagagaauguau

SEQ ID NO: 87817 - RNA, 22 nt, Homo sapiens
uuuugguguacaauucuaugga

SEQ ID NO: 87818 - RNA, 22 nt, Homo sapiens
uuuugguguauuguauaaggua

SEQ ID NO: 87819 - RNA, 22 nt, Homo sapiens
uuuuuauggccaauccucagaa

SEQ ID NO: 87820 - RNA, 22 nt, Homo sapiens
uuuuugaguaaauauaaauugu

SEQ ID NO: 87821 - RNA, 22 nt, Homo sapiens
ugucaacauuuaucaaguuauu

SEQ ID NO: 87822 - RNA, 22 nt, Homo sapiens
ugucaagaugguuugauguugu

SEQ ID NO: 87823 - RNA, 22 nt, Homo sapiens
ugucaccauuuguaggugagga

SEQ ID NO: 87824 - RNA, 22 nt, Homo sapiens
ugucaugaacucacauucuggg

SEQ ID NO: 87825 - RNA, 22 nt, Homo sapiens
ugucaugucuuuguguaucaau

SEQ ID NO: 87826 - RNA, 18 nt, Homo sapiens
ugucccuuugcuguucau

SEQ ID NO: 87827 - RNA, 22 nt, Homo sapiens
uguccuagagggaugucacccc

SEQ ID NO: 87828 - RNA, 22 nt, Homo sapiens
ugucuuggaugaggauuaacag

SEQ ID NO: 87829 - RNA, 22 nt, Homo sapiens
ugucuuuguuaguuguccuagu

SEQ ID NO: 87830 - RNA, 19 nt, Homo sapiens
ugugaacaucacagagugu

SEQ ID NO: 87831 - RNA, 22 nt, Homo sapiens
ugugacagcacagcaucucuuu

SEQ ID NO: 87832 - RNA, 22 nt, Homo sapiens
ugugacagcacgguucaacugc

SEQ ID NO: 87833 - RNA, 22 nt, Homo sapiens
ugugacaguguuacauuucaug

SEQ ID NO: 87834 - RNA, 22 nt, Homo sapiens
ugugacaguuaguuugguguua

SEQ ID NO: 87835 - RNA, 20 nt, Homo sapiens
ugugauuauuuaguugcaug

SEQ ID NO: 87836 - RNA, 17 nt, Homo sapiens
ugugauugaagucaucc

SEQ ID NO: 87837 - RNA, 22 nt, Homo sapiens
ugugauugauauauuuacagaa

SEQ ID NO: 87838 - RNA, 22 nt, Homo sapiens
ugugccacugcacucccgccug

SEQ ID NO: 87839 - RNA, 22 nt, Homo sapiens
ugugccacugcacuccugccug

SEQ ID NO: 87840 - RNA, 22 nt, Homo sapiens
ugugcuaauacauacagugcua

SEQ ID NO: 87841 - RNA, 22 nt, Homo sapiens
ugugcuauguuauucacauggg

SEQ ID NO: 87842 - RNA, 22 nt, Homo sapiens
uguggcuuuacagcaugguuca

SEQ ID NO: 87843 - RNA, 22 nt, Homo sapiens
uguggcuuuuucuuggcugagg

SEQ ID NO: 87844 - RNA, 22 nt, Homo sapiens
uguguacugcagaguauucugu

SEQ ID NO: 87845 - RNA, 22 nt, Homo sapiens
ugugucacugcacuccagccug

SEQ ID NO: 87846 - RNA, 22 nt, Homo sapiens
ugugucuuuuaucacacaaugu

SEQ ID NO: 87847 - RNA, 22 nt, Homo sapiens
uguuugcuguguggaguagcag

SEQ ID NO: 87848 - RNA, 22 nt, Homo sapiens
augaaaagcauaaacgcugaag

SEQ ID NO: 87849 - RNA, 22 nt, Homo sapiens
augaacucaucauuuuuauggc

SEQ ID NO: 87850 - RNA, 22 nt, Homo sapiens
augaagcuagcugauugcugau

SEQ ID NO: 87851 - RNA, 18 nt, Homo sapiens
augaagucaucacuuuua

SEQ ID NO: 87852 - RNA, 22 nt, Homo sapiens
augaagugcaugauaguugguu

SEQ ID NO: 87853 - RNA, 22 nt, Homo sapiens
augacaagaguguucagggaga

SEQ ID NO: 87854 - RNA, 22 nt, Homo sapiens
augacaguguggauuauuguaa

SEQ ID NO: 87855 - RNA, 22 nt, Homo sapiens
augagaauguaaguuaaugaaa

SEQ ID NO: 87856 - RNA, 17 nt, Homo sapiens
augagcucaucauuuuu

SEQ ID NO: 87857 - RNA, 22 nt, Homo sapiens
augagcugauuuccuuaccaua

SEQ ID NO: 87858 - RNA, 22 nt, Homo sapiens
augaggugaguaaauaaaugaa

SEQ ID NO: 87859 - RNA, 22 nt, Homo sapiens
augaggugcagaggaaaugagu

SEQ ID NO: 87860 - RNA, 20 nt, Homo sapiens
augagguguaugacacugaa

SEQ ID NO: 87861 - RNA, 19 nt, Homo sapiens
augagucugcaagaaccag

SEQ ID NO: 87862 - RNA, 22 nt, Homo sapiens
augauggagguagauuguccau

SEQ ID NO: 87863 - RNA, 22 nt, Homo sapiens
augauucugaucuagagcuugg

SEQ ID NO: 87864 - RNA, 22 nt, Homo sapiens
augcaaacaucugaagagacau

SEQ ID NO: 87865 - RNA, 22 nt, Homo sapiens
augcagaucacauuuuucuguc

SEQ ID NO: 87866 - RNA, 22 nt, Homo sapiens
augcauagugggaugcucugug

SEQ ID NO: 87867 - RNA, 22 nt, Homo sapiens
augcauauuccugggccucacu

SEQ ID NO: 87868 - RNA, 19 nt, Homo sapiens
augccacagugaggucaga

SEQ ID NO: 87869 - RNA, 22 nt, Homo sapiens
auggaguguaauauugagagcu

SEQ ID NO: 87870 - RNA, 22 nt, Homo sapiens
auggaguguucugaauccuuug

SEQ ID NO: 87871 - RNA, 22 nt, Homo sapiens
auggcaauguaagucagaaaaa

SEQ ID NO: 87872 - RNA, 22 nt, Homo sapiens
auggcaccauguuaugauaaua

SEQ ID NO: 87873 - RNA, 22 nt, Homo sapiens
auggcuauuccauaggcagagc

SEQ ID NO: 87874 - RNA, 22 nt, Homo sapiens
auggcuuugggcugcucugccc

SEQ ID NO: 87875 - RNA, 21 nt, Homo sapiens
auggugagaaaguagugucaa

SEQ ID NO: 87876 - RNA, 22 nt, Homo sapiens
augguuuauuuguaagcagagu

SEQ ID NO: 87877 - RNA, 22 nt, Homo sapiens
auguaagugugcucaaauguua

SEQ ID NO: 87878 - RNA, 22 nt, Homo sapiens
auguaguaugaagaagaugcuu

SEQ ID NO: 87879 - RNA, 22 nt, Homo sapiens
augucaacauagacaguagagu

SEQ ID NO: 87880 - RNA, 22 nt, Homo sapiens
augugcaugcuguucugccaga

SEQ ID NO: 87881 - RNA, 22 nt, Homo sapiens
auucaucagggauauuggucug

SEQ ID NO: 87882 - RNA, 18 nt, Homo sapiens
auucuacaggccuuuuga

SEQ ID NO: 87883 - RNA, 22 nt, Homo sapiens
auucuugcuugaacuuggugca

SEQ ID NO: 87884 - RNA, 22 nt, Homo sapiens
auugaguaaaugaaaauugccu

SEQ ID NO: 87885 - RNA, 18 nt, Homo sapiens
auugcacuccugccuggg

SEQ ID NO: 87886 - RNA, 22 nt, Homo sapiens
auugcuuuuacugggagcuuug

SEQ ID NO: 87887 - RNA, 22 nt, Homo sapiens
auuggucuauuaaaccuaaguu

SEQ ID NO: 87888 - RNA, 22 nt, Homo sapiens
auuguaguacauuuggugguca

SEQ ID NO: 87889 - RNA, 22 nt, Homo sapiens
auuguuccccggucauuuuugu

SEQ ID NO: 87890 - RNA, 22 nt, Homo sapiens
auuuggcaauuuugaagaugcc

SEQ ID NO: 87891 - RNA, 22 nt, Homo sapiens
auuuggcauagaguaucauucu

SEQ ID NO: 87892 - RNA, 22 nt, Homo sapiens
auuugucacuauguggcuaaua

SEQ ID NO: 87893 - RNA, 22 nt, Homo sapiens
auuuugguuacauaguugagcu

SEQ ID NO: 87894 - RNA, 22 nt, Homo sapiens
caaaagugauugcgguuuuugc

SEQ ID NO: 87895 - RNA, 22 nt, Homo sapiens
caaaagugguucuuauccuuuu

SEQ ID NO: 87896 - RNA, 22 nt, Homo sapiens
caaaccuguaggggccaagagg

SEQ ID NO: 87897 - RNA, 22 nt, Homo sapiens
caaagcacuuggcuuggaagau

SEQ ID NO: 87898 - RNA, 22 nt, Homo sapiens
caaagucuucaguugauucuga

SEQ ID NO: 87899 - RNA, 22 nt, Homo sapiens
caaagucuucucauuaugucuu

SEQ ID NO: 87900 - RNA, 19 nt, Homo sapiens
caaaguguucuucuuugcc

SEQ ID NO: 87901 - RNA, 21 nt, Homo sapiens
caauggcacaaucucugcuca

SEQ ID NO: 87902 - RNA, 22 nt, Homo sapiens
cacagagugagacccugucucu

SEQ ID NO: 87903 - RNA, 22 nt, Homo sapiens
cacccaguaagcaugaggcccu

SEQ ID NO: 87904 - RNA, 22 nt, Homo sapiens
cagagguauugcaaaagccuag

SEQ ID NO: 87905 - RNA, 22 nt, Homo sapiens
cagcaaaucauccuauuugagc

SEQ ID NO: 87906 - RNA, 22 nt, Homo sapiens
cagguacaugcaugugugugca

SEQ ID NO: 87907 - RNA, 22 nt, Homo sapiens
cagguaggccaauguuuuccaa

SEQ ID NO: 87908 - RNA, 22 nt, Homo sapiens
cagguaguguguagcacagcag

SEQ ID NO: 87909 - RNA, 19 nt, Homo sapiens
caguaucauugcacauagu

SEQ ID NO: 87910 - RNA, 22 nt, Homo sapiens
caucacuuuuccuuuuacagau

SEQ ID NO: 87911 - RNA, 22 nt, Homo sapiens
caugauauugcagaauguuggu

SEQ ID NO: 87912 - RNA, 22 nt, Homo sapiens
caugccauugcucuccugggug

SEQ ID NO: 87913 - RNA, 23 nt, Homo sapiens
cauggcuguuaacacuguuugag

SEQ ID NO: 87914 - RNA, 19 nt, Homo sapiens
cauggcuuauaauuuuaau

SEQ ID NO: 87915 - RNA, 22 nt, Homo sapiens
cauggcuuuaagcaacaccaag

SEQ ID NO: 87916 - RNA, 22 nt, Homo sapiens
cauuuugcaguuucugucucca

SEQ ID NO: 87917 - RNA, 18 nt, Homo sapiens
ccagugcaaggaaagccc

SEQ ID NO: 87918 - RNA, 22 nt, Homo sapiens
ccccaguguguaaaggccuugc

SEQ ID NO: 87919 - RNA, 21 nt, Homo sapiens
ccucuuugagggaagaaaggg

SEQ ID NO: 87920 - RNA, 22 nt, Homo sapiens
ccugagacuugagggggcuucu

SEQ ID NO: 87921 - RNA, 22 nt, Homo sapiens
ccugagaucauacuguuaguaa

SEQ ID NO: 87922 - RNA, 22 nt, Homo sapiens
ccugagguagaguuuauauuga

SEQ ID NO: 87923 - RNA, 22 nt, Homo sapiens
ccugucuugaagagauccuccu

SEQ ID NO: 87924 - RNA, 22 nt, Homo sapiens
ccuugcacuucccaagugaggc

SEQ ID NO: 87925 - RNA, 22 nt, Homo sapiens
ccuugcacuucccaggugaggc

SEQ ID NO: 87926 - RNA, 22 nt, Homo sapiens
ccuugguaauguguuuuauucu

SEQ ID NO: 87927 - RNA, 22 nt, Homo sapiens
cggcaguggguaagccaagcuu

SEQ ID NO: 87928 - RNA, 23 nt, Homo sapiens
cuaaagucugucacugaggacuu

SEQ ID NO: 87929 - RNA, 21 nt, Homo sapiens
cuaaucucacccuuuucuggg

SEQ ID NO: 87930 - RNA, 22 nt, Homo sapiens
cuagaagguaagagcuggaugc

SEQ ID NO: 87931 - RNA, 22 nt, Homo sapiens
cuagcagaacaauacaauucgg

SEQ ID NO: 87932 - RNA, 22 nt, Homo sapiens
cuagcccagugcuccuggauca

SEQ ID NO: 87933 - RNA, 22 nt, Homo sapiens
cucaaguagugguuuucauuga

SEQ ID NO: 87934 - RNA, 18 nt, Homo sapiens
cucacaguaacuuuuaag

SEQ ID NO: 87935 - RNA, 22 nt, Homo sapiens
cucacagucagaagggacuugc

SEQ ID NO: 87936 - RNA, 22 nt, Homo sapiens
cucauggauggucuggcagcca

SEQ ID NO: 87937 - RNA, 22 nt, Homo sapiens
cucccagugacccaggaacagg

SEQ ID NO: 87938 - RNA, 20 nt, Homo sapiens
cucugguugugaauugucuu

SEQ ID NO: 87939 - RNA, 19 nt, Homo sapiens
cucuuuggugucucuucuu

SEQ ID NO: 87940 - RNA, 22 nt, Homo sapiens
cugaaucauugguuaugaguac

SEQ ID NO: 87941 - RNA, 22 nt, Homo sapiens
cugagauuaagauauugggagu

SEQ ID NO: 87942 - RNA, 22 nt, Homo sapiens
cugagcccauucuggggagaag

SEQ ID NO: 87943 - RNA, 20 nt, Homo sapiens
cugagguugggguccuuccc

SEQ ID NO: 87944 - RNA, 22 nt, Homo sapiens
cugauacucuccuuuuagagag

SEQ ID NO: 87945 - RNA, 22 nt, Homo sapiens
cugaugaaguauuuguucugga

SEQ ID NO: 87946 - RNA, 22 nt, Homo sapiens
cugauguagguggucugugauc

SEQ ID NO: 87947 - RNA, 22 nt, Homo sapiens
cugcaguaaccacuguaggugu

SEQ ID NO: 87948 - RNA, 18 nt, Homo sapiens
cugccagugugcucuccg

SEQ ID NO: 87949 - RNA, 22 nt, Homo sapiens
cuggaaacaucuuaggaaugca

SEQ ID NO: 87950 - RNA, 22 nt, Homo sapiens
cuggaauguuccuaaagauuca

SEQ ID NO: 87951 - RNA, 22 nt, Homo sapiens
cuggcugagugguaaguagagg

SEQ ID NO: 87952 - RNA, 22 nt, Homo sapiens
cuguaugugagaaauaauaagu

SEQ ID NO: 87953 - RNA, 22 nt, Homo sapiens
cugugcaaacaagugaaccccu

SEQ ID NO: 87954 - RNA, 22 nt, Homo sapiens
cuguucaaauuguuugugaagu

SEQ ID NO: 87955 - RNA, 22 nt, Homo sapiens
cuucaaaguuggcuaggagaca

SEQ ID NO: 87956 - RNA, 22 nt, Homo sapiens
cuuguggugcuuuuacgugggc

SEQ ID NO: 87957 - RNA, 21 nt, Homo sapiens
cuuuaugcuguguuagaaaag

SEQ ID NO: 87958 - RNA, 23 nt, Homo sapiens
cuuuggucucugguugacuucag

SEQ ID NO: 87959 - RNA, 22 nt, Homo sapiens
cuuugguugugcucuccacuuu

SEQ ID NO: 87960 - RNA, 22 nt, Homo sapiens
cuuuguguaggugccucuggcu

SEQ ID NO: 87961 - RNA, 22 nt, Homo sapiens
cuuuuggcuuagaauugucuug

SEQ ID NO: 87962 - RNA, 21 nt, Homo sapiens
cuuuuuacucguucauaugca

SEQ ID NO: 87963 - RNA, 22 nt, Homo sapiens
gaagaaguacaagacaaauuuu

SEQ ID NO: 87964 - RNA, 18 nt, Homo sapiens
gaagaaguaggcauggca

SEQ ID NO: 87965 - RNA, 22 nt, Homo sapiens
gaagauguugcuuaccuuggag

SEQ ID NO: 87966 - RNA, 22 nt, Homo sapiens
gaaguaauaaauggauucuuaa

SEQ ID NO: 87967 - RNA, 22 nt, Homo sapiens
gaaguaggugcuguuauuaucu

SEQ ID NO: 87968 - RNA, 19 nt, Homo sapiens
gaaguguuuguucuccaug

SEQ ID NO: 87969 - RNA, 22 nt, Homo sapiens
gaaucauuguuucuaaguuugu

SEQ ID NO: 87970 - RNA, 22 nt, Homo sapiens
gacacagugaagucucuacuug

SEQ ID NO: 87971 - RNA, 22 nt, Homo sapiens
gacagugagaugucaugugaaa

SEQ ID NO: 87972 - RNA, 20 nt, Homo sapiens
gacauaggcugguaucuggc

SEQ ID NO: 87973 - RNA, 22 nt, Homo sapiens
gaccaaagaggcaggcauuaga

SEQ ID NO: 87974 - RNA, 22 nt, Homo sapiens
gacucuguagacaaucacaucu

SEQ ID NO: 87975 - RNA, 22 nt, Homo sapiens
gacugaggaagcgcucucuccu

SEQ ID NO: 87976 - RNA, 21 nt, Homo sapiens
gagaaucuuuucagggcaaac

SEQ ID NO: 87977 - RNA, 22 nt, Homo sapiens
gagcugaauugcugccauuugc

SEQ ID NO: 87978 - RNA, 22 nt, Homo sapiens
gaggcggugugaugucacaugc

SEQ ID NO: 87979 - RNA, 22 nt, Homo sapiens
gagguaaguggauuaugagguc

SEQ ID NO: 87980 - RNA, 22 nt, Homo sapiens
gagguggauacauuaaauaaug

SEQ ID NO: 87981 - RNA, 22 nt, Homo sapiens
gaguauuuuacaucguguaauu

SEQ ID NO: 87982 - RNA, 22 nt, Homo sapiens
uaccacaggcuggguaaucuau

SEQ ID NO: 87983 - RNA, 22 nt, Homo sapiens
uacuacagccugagcgacugag

SEQ ID NO: 87984 - RNA, 22 nt, Homo sapiens
uacucaguaagugcuggcugcu

SEQ ID NO: 87985 - RNA, 22 nt, Homo sapiens
uacucaguagucuguugcuguc

SEQ ID NO: 87986 - RNA, 22 nt, Homo sapiens
uacugcugucagugccaaguag

SEQ ID NO: 87987 - RNA, 22 nt, Homo sapiens
uacugcuuaaaagucaauuacu

SEQ ID NO: 87988 - RNA, 22 nt, Homo sapiens
uagaaaguagggaagguaggau

SEQ ID NO: 87989 - RNA, 21 nt, Homo sapiens
uagagcaacacacgcccucuc

SEQ ID NO: 87990 - RNA, 22 nt, Homo sapiens
uagagcaaugacucuggaaacc

SEQ ID NO: 87991 - RNA, 22 nt, Homo sapiens
uagagguagguguaugaacuag

SEQ ID NO: 87992 - RNA, 22 nt, Homo sapiens
uagauaauuagaggguuuuaag

SEQ ID NO: 87993 - RNA, 20 nt, Homo sapiens
uagaugcauuuagauucauu

SEQ ID NO: 87994 - RNA, 23 nt, Homo sapiens
uagcaacaguuggaggugaggua

SEQ ID NO: 87995 - RNA, 22 nt, Homo sapiens
uagcagcauaaauggacuaaga

SEQ ID NO: 87996 - RNA, 22 nt, Homo sapiens
uagcaguaagaaacugacauug

SEQ ID NO: 87997 - RNA, 22 nt, Homo sapiens
uagcucagcccagcuaagcuca

SEQ ID NO: 87998 - RNA, 22 nt, Homo sapiens
uagcuggaauuacuugcaccug

SEQ ID NO: 87999 - RNA, 22 nt, Homo sapiens
uagguaucuuuauagcaguagc

SEQ ID NO: 88000 - RNA, 22 nt, Homo sapiens
uaggucuuuuaugaaauauauu

SEQ ID NO: 88001 - RNA, 22 nt, Homo sapiens
uaguaaacaccucagguaauuc

SEQ ID NO: 88002 - RNA, 22 nt, Homo sapiens
uaguaaacagcucugccacaau

SEQ ID NO: 88003 - RNA, 22 nt, Homo sapiens
uaguaaacauaguucuuuugcu

SEQ ID NO: 88004 - RNA, 22 nt, Homo sapiens
uaguaguuuuguguauaauaau

SEQ ID NO: 88005 - RNA, 22 nt, Homo sapiens
uagugaaugucacuggcuguug

SEQ ID NO: 88006 - RNA, 22 nt, Homo sapiens
uauaucuguccauggcccugcu

SEQ ID NO: 88007 - RNA, 21 nt, Homo sapiens
uauaugacuuacuauugccuc

SEQ ID NO: 88008 - RNA, 22 nt, Homo sapiens
uaucaucauuggcaggugagaa

SEQ ID NO: 88009 - RNA, 22 nt, Homo sapiens
uaucucagaugagacuuguaac

SEQ ID NO: 88010 - RNA, 21 nt, Homo sapiens
uaucucaguuuuccuuugugg

SEQ ID NO: 88011 - RNA, 22 nt, Homo sapiens
uaucucuuuucauguguaaaug

SEQ ID NO: 88012 - RNA, 22 nt, Homo sapiens
uaugucauggguaaagugcccu

SEQ ID NO: 88013 - RNA, 22 nt, Homo sapiens
uauuauuguccuucuauaccca

SEQ ID NO: 88014 - RNA, 22 nt, Homo sapiens
uauuccuuuugcauuuccacau

SEQ ID NO: 88015 - RNA, 22 nt, Homo sapiens
ugacaucaccaccuccgucauc

SEQ ID NO: 88016 - RNA, 22 nt, Homo sapiens
ugacauggagguggaggaagau

SEQ ID NO: 88017 - RNA, 23 nt, Homo sapiens
ugacauguaauucaguccagcag

SEQ ID NO: 88018 - RNA, 22 nt, Homo sapiens
ugacauguauaucuuacgcuau

SEQ ID NO: 88019 - RNA, 22 nt, Homo sapiens
ugacauguugcauuauauuucc

SEQ ID NO: 88020 - RNA, 21 nt, Homo sapiens
ugacauguugguguucugcac

SEQ ID NO: 88021 - RNA, 22 nt, Homo sapiens
ugacggaggcauuggaagcuug

SEQ ID NO: 88022 - RNA, 22 nt, Homo sapiens
ugagagacagacauuaucuuau

SEQ ID NO: 88023 - RNA, 22 nt, Homo sapiens
ugagagacaguuuguuaaaauu

SEQ ID NO: 88024 - RNA, 22 nt, Homo sapiens
ugagaggugaauggcaggcuca

SEQ ID NO: 88025 - RNA, 20 nt, Homo sapiens
ugagaucaggauuaaggcua

SEQ ID NO: 88026 - RNA, 22 nt, Homo sapiens
ugagaucaugccacugcacuuc

SEQ ID NO: 88027 - RNA, 22 nt, Homo sapiens
ugagauggguucugguccccug

SEQ ID NO: 88028 - RNA, 22 nt, Homo sapiens
ugagaugguaaauuuuuguugu

SEQ ID NO: 88029 - RNA, 22 nt, Homo sapiens
ugagauuaucuugaucuugaaa

SEQ ID NO: 88030 - RNA, 19 nt, Homo sapiens
ugagauuguaugaggagau

SEQ ID NO: 88031 - RNA, 22 nt, Homo sapiens
ugagcagaaagcugcaaggucg

SEQ ID NO: 88032 - RNA, 22 nt, Homo sapiens
ugagcagaaguuuugauuggcg

SEQ ID NO: 88033 - RNA, 17 nt, Homo sapiens
ugagcuaagauuacccc

SEQ ID NO: 88034 - RNA, 20 nt, Homo sapiens
ugagcuauauauguccuuga

SEQ ID NO: 88035 - RNA, 22 nt, Homo sapiens
ugagcucagcuaguugaggugu

SEQ ID NO: 88036 - RNA, 22 nt, Homo sapiens
ugagcugagaaaugcagcagcu

SEQ ID NO: 88037 - RNA, 22 nt, Homo sapiens
ugaggaaugaccccgugugguc

SEQ ID NO: 88038 - RNA, 22 nt, Homo sapiens
ugaggauaguguugaaggcagg

SEQ ID NO: 88039 - RNA, 22 nt, Homo sapiens
ugaggcaagauacugauuucau

SEQ ID NO: 88040 - RNA, 22 nt, Homo sapiens
ugaggcuagucagaucagauga

SEQ ID NO: 88041 - RNA, 20 nt, Homo sapiens
ugaggucaggaguuacagac

SEQ ID NO: 88042 - RNA, 22 nt, Homo sapiens
ugagguuggguaauuuaugaag

SEQ ID NO: 88043 - RNA, 22 nt, Homo sapiens
ugaguagagaauucagcuaagg

SEQ ID NO: 88044 - RNA, 22 nt, Homo sapiens
ugagucgagauugcgccacugu

SEQ ID NO: 88045 - RNA, 22 nt, Homo sapiens
ugagugagguucuacucuguga

SEQ ID NO: 88046 - RNA, 23 nt, Homo sapiens
uuaguaaacucaaugacaccaca

SEQ ID NO: 88047 - RNA, 22 nt, Homo sapiens
uuaugccagugauuauaagggc

SEQ ID NO: 88048 - RNA, 22 nt, Homo sapiens
uuauuagguuagugcaaaaguu

SEQ ID NO: 88049 - RNA, 22 nt, Homo sapiens
uucaagaauuaaaguggcuuuu

SEQ ID NO: 88050 - RNA, 22 nt, Homo sapiens
uucaaggacuaaggauuuuugg

SEQ ID NO: 88051 - RNA, 22 nt, Homo sapiens
uucaaguaagaaagacaucagg

SEQ ID NO: 88052 - RNA, 22 nt, Homo sapiens
uucaaguagguaggaccacagg

SEQ ID NO: 88053 - RNA, 22 nt, Homo sapiens
uucaauaugucauuggcaggca

SEQ ID NO: 88054 - RNA, 22 nt, Homo sapiens
uucaauuaauauuauacucuca

SEQ ID NO: 88055 - RNA, 22 nt, Homo sapiens
uucacagccgcaccccaucacu

SEQ ID NO: 88056 - RNA, 22 nt, Homo sapiens
uucagcaaugacagccuauaua

SEQ ID NO: 88057 - RNA, 22 nt, Homo sapiens
uucaggcuccugugagaaucua

SEQ ID NO: 88058 - RNA, 22 nt, Homo sapiens
uucagggacuuuagacaagaga

SEQ ID NO: 88059 - RNA, 22 nt, Homo sapiens
uucaucaguuauauuggccuga

SEQ ID NO: 88060 - RNA, 22 nt, Homo sapiens
uucaugucuuggcuguuagagu

SEQ ID NO: 88061 - RNA, 22 nt, Homo sapiens
uuccacaauggcugaacuaguu

SEQ ID NO: 88062 - RNA, 23 nt, Homo sapiens
uuccaccauugacuaguuacaua

SEQ ID NO: 88063 - RNA, 22 nt, Homo sapiens
uucccaguggaacauguaguca

SEQ ID NO: 88064 - RNA, 22 nt, Homo sapiens
uucccaguuggggaaagcgacc

SEQ ID NO: 88065 - RNA, 22 nt, Homo sapiens
uucccgggguggaaugcaguga

SEQ ID NO: 88066 - RNA, 22 nt, Homo sapiens
uucccucagaaacacacagccc

SEQ ID NO: 88067 - RNA, 19 nt, Homo sapiens
uuccugagaacaagggcuu

SEQ ID NO: 88068 - RNA, 22 nt, Homo sapiens
uuccugucuuccaagagagauu

SEQ ID NO: 88069 - RNA, 21 nt, Homo sapiens
uucuauggucagaauucaaua

SEQ ID NO: 88070 - RNA, 22 nt, Homo sapiens
uucucaguuccuacuuugguga

SEQ ID NO: 88071 - RNA, 22 nt, Homo sapiens
uucucaguucgguggcagugcu

SEQ ID NO: 88072 - RNA, 22 nt, Homo sapiens
uucuggcuaugggauacuaaau

SEQ ID NO: 88073 - RNA, 22 nt, Homo sapiens
uucuggcucaggucaacacuuc

SEQ ID NO: 88074 - RNA, 22 nt, Homo sapiens
uucuggcucgauucucugaccg

SEQ ID NO: 88075 - RNA, 22 nt, Homo sapiens
auaugguuuuuggaagcauauc

SEQ ID NO: 88076 - RNA, 22 nt, Homo sapiens
auauuacuggccauaucgcagg

SEQ ID NO: 88077 - RNA, 22 nt, Homo sapiens
aucacauggccagguaguaauc

SEQ ID NO: 88078 - RNA, 22 nt, Homo sapiens
aucagaaucucuugagaguguu

SEQ ID NO: 88079 - RNA, 22 nt, Homo sapiens
aucagauggcuaaaacagaaga

SEQ ID NO: 88080 - RNA, 22 nt, Homo sapiens
aucagugcauaguauuuaauga

SEQ ID NO: 88081 - RNA, 22 nt, Homo sapiens
aucagugcauguuuguugagcu

SEQ ID NO: 88082 - RNA, 22 nt, Homo sapiens
aucaucaugcacuacagccugg

SEQ ID NO: 88083 - RNA, 22 nt, Homo sapiens
auccugagacuuugcugaaguu

SEQ ID NO: 88084 - RNA, 22 nt, Homo sapiens
aucucugagauguucugauuuu

SEQ ID NO: 88085 - RNA, 22 nt, Homo sapiens
aucuuguguugaauggugcaga

SEQ ID NO: 88086 - RNA, 22 nt, Homo sapiens
aucuuuggauacuugauauagu

SEQ ID NO: 88087 - RNA, 22 nt, Homo sapiens
aucuuuggucaucacagcuaga

SEQ ID NO: 88088 - RNA, 22 nt, Homo sapiens
augaaaucuuuccugugaggau

SEQ ID NO: 88089 - RNA, 22 nt, Homo sapiens
augaaaugcauguuaaguccgu

SEQ ID NO: 88090 - RNA, 23 nt, Homo sapiens
augaacucaucauuuuuuauggc

SEQ ID NO: 88091 - RNA, 23 nt, Homo sapiens
augacacuguccuugaccauuuc

SEQ ID NO: 88092 - RNA, 22 nt, Homo sapiens
augacagugagugagcucucac

SEQ ID NO: 88093 - RNA, 22 nt, Homo sapiens
augaccaaugggcagagcuaga

SEQ ID NO: 88094 - RNA, 22 nt, Homo sapiens
augagaacauaucaagugauug

SEQ ID NO: 88095 - RNA, 22 nt, Homo sapiens
augagauaaaccaucucuuaag

SEQ ID NO: 88096 - RNA, 22 nt, Homo sapiens
augagcagaagagauacacugu

SEQ ID NO: 88097 - RNA, 22 nt, Homo sapiens
augagcuauggagacagggcca

SEQ ID NO: 88098 - RNA, 22 nt, Homo sapiens
augaggaaggagccuuugucug

SEQ ID NO: 88099 - RNA, 21 nt, Homo sapiens
augagguguacuguggugaaa

SEQ ID NO: 88100 - RNA, 22 nt, Homo sapiens
augauggaggccgugauggacg

SEQ ID NO: 88101 - RNA, 22 nt, Homo sapiens
augcaaacagcuaucuggcugg

SEQ ID NO: 88102 - RNA, 22 nt, Homo sapiens
augcaaaucuuaaguaugugug

SEQ ID NO: 88103 - RNA, 22 nt, Homo sapiens
augcacauggcuaacuuuuuuc

SEQ ID NO: 88104 - RNA, 22 nt, Homo sapiens
augcauaugucuuuauaguggc

SEQ ID NO: 88105 - RNA, 22 nt, Homo sapiens
auggagguguggggagugaguu

SEQ ID NO: 88106 - RNA, 22 nt, Homo sapiens
auggagugagaauggagguucc

SEQ ID NO: 88107 - RNA, 22 nt, Homo sapiens
auggauuuuggggccagaggca

SEQ ID NO: 88108 - RNA, 22 nt, Homo sapiens
auggcacuuuggacugcuagau

SEQ ID NO: 88109 - RNA, 22 nt, Homo sapiens
auggcagugagucucuaguauu

SEQ ID NO: 88110 - RNA, 22 nt, Homo sapiens
auggcccugaguucaauauauu

SEQ ID NO: 88111 - RNA, 22 nt, Homo sapiens
auggcugagugauuucaaacag

SEQ ID NO: 88112 - RNA, 22 nt, Homo sapiens
auggcuuuguguucagagcuga

SEQ ID NO: 88113 - RNA, 22 nt, Homo sapiens
auggcuuuuauuguguugaggu

SEQ ID NO: 88114 - RNA, 22 nt, Homo sapiens
auggcuuuuuucuugggcacuc

SEQ ID NO: 88115 - RNA, 20 nt, Homo sapiens
auguaauguaugauauguac

SEQ ID NO: 88116 - RNA, 22 nt, Homo sapiens
auguaauguuaaauugcuaauu

SEQ ID NO: 88117 - RNA, 22 nt, Homo sapiens
auguauacaugcaggucacagg

SEQ ID NO: 88118 - RNA, 22 nt, Homo sapiens
augucauagauaaggaagugga

SEQ ID NO: 88119 - RNA, 22 nt, Homo sapiens
augugcuuauagguguauguuu

SEQ ID NO: 88120 - RNA, 22 nt, Homo sapiens
auguguauuaccucgauuguga

SEQ ID NO: 88121 - RNA, 22 nt, Homo sapiens
auuaaguaaugguuccaauaau

SEQ ID NO: 88122 - RNA, 22 nt, Homo sapiens
auuaagugcuugcagaagucca

SEQ ID NO: 88123 - RNA, 22 nt, Homo sapiens
auuagguuggugcaaaacuuuc

SEQ ID NO: 88124 - RNA, 22 nt, Homo sapiens
auuauuaguuguugaaugaagu

SEQ ID NO: 88125 - RNA, 22 nt, Homo sapiens
auuccuuaggcccuuugguuag

SEQ ID NO: 88126 - RNA, 22 nt, Homo sapiens
auugaacuuuugucacugacau

SEQ ID NO: 88127 - RNA, 22 nt, Homo sapiens
auugaauuugguuugcuaagaa

SEQ ID NO: 88128 - RNA, 22 nt, Homo sapiens
auugacuugauauauagcugau

SEQ ID NO: 88129 - RNA, 22 nt, Homo sapiens
auugcaaagcguagacucuaaa

SEQ ID NO: 88130 - RNA, 22 nt, Homo sapiens
auugcauaaacacauuucuuau

SEQ ID NO: 88131 - RNA, 22 nt, Homo sapiens
auugcuauuauuugaccauugu

SEQ ID NO: 88132 - RNA, 22 nt, Homo sapiens
auugcuucugauuuuaaaugag

SEQ ID NO: 88133 - RNA, 22 nt, Homo sapiens
auuggcuuuauacauaagaaua

SEQ ID NO: 88134 - RNA, 22 nt, Homo sapiens
auuggucuugaaaccagagaga

SEQ ID NO: 88135 - RNA, 22 nt, Homo sapiens
auuguacucuagccucugggca

SEQ ID NO: 88136 - RNA, 22 nt, Homo sapiens
auuguguuugaaugaggcucca

SEQ ID NO: 88137 - RNA, 22 nt, Homo sapiens
auuuggcagugaagggaucaca

SEQ ID NO: 88138 - RNA, 22 nt, Homo sapiens
auuuggguuuuacaucaggcua

SEQ ID NO: 88139 - RNA, 21 nt, Homo sapiens
auuugguguuagaaauaaauu

SEQ ID NO: 88140 - RNA, 22 nt, Homo sapiens
caaauugcuugucuguagugga

SEQ ID NO: 88141 - RNA, 22 nt, Homo sapiens
caacugcucacuccuggguuca

SEQ ID NO: 88142 - RNA, 22 nt, Homo sapiens
caaugcauuauucucccacuuc

SEQ ID NO: 88143 - RNA, 22 nt, Homo sapiens
caauggcaaugaaauagugaga

SEQ ID NO: 88144 - RNA, 22 nt, Homo sapiens
caaugguuuuuuaguauaagua

SEQ ID NO: 88145 - RNA, 22 nt, Homo sapiens
cacagcuagucaaugguagaca

SEQ ID NO: 88146 - RNA, 22 nt, Homo sapiens
cacagugaaugucaucauugcc

SEQ ID NO: 88147 - RNA, 22 nt, Homo sapiens
cacaguguuacugguaugaagu

SEQ ID NO: 88148 - RNA, 19 nt, Homo sapiens
caccgccugcccccugcug

SEQ ID NO: 88149 - RNA, 22 nt, Homo sapiens
cacugcacuccaguuuggauga

SEQ ID NO: 88150 - RNA, 22 nt, Homo sapiens
cacugcauuacucaugagcaug

SEQ ID NO: 88151 - RNA, 22 nt, Homo sapiens
cacuggcacuguguuuagaugg

SEQ ID NO: 88152 - RNA, 23 nt, Homo sapiens
cacugggcagcagguguucccag

SEQ ID NO: 88153 - RNA, 22 nt, Homo sapiens
cacuggguuagaacaugcuccu

SEQ ID NO: 88154 - RNA, 22 nt, Homo sapiens
cagagguaagcaagucagcauu

SEQ ID NO: 88155 - RNA, 22 nt, Homo sapiens
cagaugguggucccacagccca

SEQ ID NO: 88156 - RNA, 22 nt, Homo sapiens
cagauguaguauuuuagugaaa

SEQ ID NO: 88157 - RNA, 23 nt, Homo sapiens
cagcucauuuggguccccuuguc

SEQ ID NO: 88158 - RNA, 22 nt, Homo sapiens
cagguaagaugcuuucucuuau

SEQ ID NO: 88159 - RNA, 22 nt, Homo sapiens
cagguagucaacgggucuugga

SEQ ID NO: 88160 - RNA, 21 nt, Homo sapiens
cagguagugucugaagccaga

SEQ ID NO: 88161 - RNA, 19 nt, Homo sapiens
cagguagugugcugacaug

SEQ ID NO: 88162 - RNA, 22 nt, Homo sapiens
cagugucugcauuuggaacuca

SEQ ID NO: 88163 - RNA, 18 nt, Homo sapiens
cauagcacuucagcacau

SEQ ID NO: 88164 - RNA, 22 nt, Homo sapiens
caucacaucugcaugguaagua

SEQ ID NO: 88165 - RNA, 22 nt, Homo sapiens
caugcacugagagggucucggc

SEQ ID NO: 88166 - RNA, 22 nt, Homo sapiens
caugcacugaguccaccucugg

SEQ ID NO: 88167 - RNA, 22 nt, Homo sapiens
caugcagcacacaugucugugc

SEQ ID NO: 88168 - RNA, 22 nt, Homo sapiens
caugccacuguggacaaagaca

SEQ ID NO: 88169 - RNA, 22 nt, Homo sapiens
caugggcacugacuugcauucg

SEQ ID NO: 88170 - RNA, 22 nt, Homo sapiens
cauugcaguuuuugguguaucu

SEQ ID NO: 88171 - RNA, 19 nt, Homo sapiens
ccacaaugguugaacuaga

SEQ ID NO: 88172 - RNA, 22 nt, Homo sapiens
ccacccuuccacacccugggua

SEQ ID NO: 88173 - RNA, 21 nt, Homo sapiens
ccaguguaaugauagcaggca

SEQ ID NO: 88174 - RNA, 19 nt, Homo sapiens
ccauggcaaugaucugaug

SEQ ID NO: 88175 - RNA, 22 nt, Homo sapiens
ccauggcaauggucagucuauu

SEQ ID NO: 88176 - RNA, 21 nt, Homo sapiens
ugacauguugguuugcugcac

SEQ ID NO: 88177 - RNA, 22 nt, Homo sapiens
ugacuaggggcccuggcuucuu

SEQ ID NO: 88178 - RNA, 22 nt, Homo sapiens
ugacucaguuguuagucuucau

SEQ ID NO: 88179 - RNA, 22 nt, Homo sapiens
ugacuccagagacugugcuguc

SEQ ID NO: 88180 - RNA, 22 nt, Homo sapiens
ugacugugcagcuccaucaggg

SEQ ID NO: 88181 - RNA, 22 nt, Homo sapiens
ugagacacugaauccggccuga

SEQ ID NO: 88182 - RNA, 22 nt, Homo sapiens
ugagauaguacuuuuuuaaagg

SEQ ID NO: 88183 - RNA, 22 nt, Homo sapiens
ugagauauauauauuugagaca

SEQ ID NO: 88184 - RNA, 22 nt, Homo sapiens
ugagaucaaggugggcccuggg

SEQ ID NO: 88185 - RNA, 19 nt, Homo sapiens
ugagaugaagacagggguu

SEQ ID NO: 88186 - RNA, 22 nt, Homo sapiens
ugagaugagggaagccuaggca

SEQ ID NO: 88187 - RNA, 22 nt, Homo sapiens
ugagauggcugaauucagaaua

SEQ ID NO: 88188 - RNA, 22 nt, Homo sapiens
ugagauggcuuuauugcugaau

SEQ ID NO: 88189 - RNA, 22 nt, Homo sapiens
ugagauggguaauuaaauggug

SEQ ID NO: 88190 - RNA, 22 nt, Homo sapiens
ugagauguuuguuucagugccu

SEQ ID NO: 88191 - RNA, 22 nt, Homo sapiens
ugagauuguaucugcaaugugu

SEQ ID NO: 88192 - RNA, 22 nt, Homo sapiens
ugagcaagaaauagaaacagau

SEQ ID NO: 88193 - RNA, 22 nt, Homo sapiens
ugagcaagaucuuuauaauuag

SEQ ID NO: 88194 - RNA, 22 nt, Homo sapiens
ugagcacagagccugggguggc

SEQ ID NO: 88195 - RNA, 22 nt, Homo sapiens
ugagcacaggugcgcgguuacu

SEQ ID NO: 88196 - RNA, 22 nt, Homo sapiens
ugagcagaguuguuucuccuga

SEQ ID NO: 88197 - RNA, 22 nt, Homo sapiens
ugagcucaguauuucauaaaca

SEQ ID NO: 88198 - RNA, 22 nt, Homo sapiens
ugagcucaugcauucuugagga

SEQ ID NO: 88199 - RNA, 20 nt, Homo sapiens
ugagcuuguaaacacuguuu

SEQ ID NO: 88200 - RNA, 22 nt, Homo sapiens
ugaggcaaggcugaaugaaggc

SEQ ID NO: 88201 - RNA, 22 nt, Homo sapiens
ugagguagaggugaacuugacc

SEQ ID NO: 88202 - RNA, 22 nt, Homo sapiens
ugagguugucagugucauucuu

SEQ ID NO: 88203 - RNA, 22 nt, Homo sapiens
ugaguacuacuaguuacugcua

SEQ ID NO: 88204 - RNA, 22 nt, Homo sapiens
ugaguagcuaauguuuacugag

SEQ ID NO: 88205 - RNA, 23 nt, Homo sapiens
ugaguaggcaguuuuccccucac

SEQ ID NO: 88206 - RNA, 22 nt, Homo sapiens
ugaguauguuuagaaguaaagg

SEQ ID NO: 88207 - RNA, 22 nt, Homo sapiens
ugagucaugcuggagucauggc

SEQ ID NO: 88208 - RNA, 22 nt, Homo sapiens
ugagugccuggagggcagggac

SEQ ID NO: 88209 - RNA, 22 nt, Homo sapiens
ugaguggagacuguguguagag

SEQ ID NO: 88210 - RNA, 20 nt, Homo sapiens
ugaugcaaaucuuuaaaagu

SEQ ID NO: 88211 - RNA, 18 nt, Homo sapiens
ugauugacuuauuuaggu

SEQ ID NO: 88212 - RNA, 22 nt, Homo sapiens
ugauuuguccauguggcacgug

SEQ ID NO: 88213 - RNA, 22 nt, Homo sapiens
ugauuugucucucagcccuacu

SEQ ID NO: 88214 - RNA, 22 nt, Homo sapiens
ugauuugucugcaggaauagug

SEQ ID NO: 88215 - RNA, 22 nt, Homo sapiens
ugauuuguuuagugccaaguuu

SEQ ID NO: 88216 - RNA, 22 nt, Homo sapiens
ugcaagaaucuuucaggcuagc

SEQ ID NO: 88217 - RNA, 22 nt, Homo sapiens
ugcaagauaggcaguuugcacu

SEQ ID NO: 88218 - RNA, 22 nt, Homo sapiens
ugcaauauccucuacuauaggu

SEQ ID NO: 88219 - RNA, 23 nt, Homo sapiens
ugcagcacacugaugggucuuga

SEQ ID NO: 88220 - RNA, 22 nt, Homo sapiens
ugcagcacaguagguuugcaau

SEQ ID NO: 88221 - RNA, 20 nt, Homo sapiens
ugcagcacgggcccuuucca

SEQ ID NO: 88222 - RNA, 20 nt, Homo sapiens
ugcagcacugggaaugcagu

SEQ ID NO: 88223 - RNA, 22 nt, Homo sapiens
ugcaggauguucaguaauuucc

SEQ ID NO: 88224 - RNA, 22 nt, Homo sapiens
ugcauaauuccuugcaccagaa

SEQ ID NO: 88225 - RNA, 18 nt, Homo sapiens
ugcauacuaucugauuuu

SEQ ID NO: 88226 - RNA, 22 nt, Homo sapiens
ugcauagcauauauuguagagu

SEQ ID NO: 88227 - RNA, 22 nt, Homo sapiens
ugcauguucuuacucauacaug

SEQ ID NO: 88228 - RNA, 22 nt, Homo sapiens
ugccaacaugccuggcuguuuu

SEQ ID NO: 88229 - RNA, 22 nt, Homo sapiens
ugccaaggagucagucccuaga

SEQ ID NO: 88230 - RNA, 22 nt, Homo sapiens
ugccagaugcaguguucaacaa

SEQ ID NO: 88231 - RNA, 22 nt, Homo sapiens
ugccagaugugcccucuccacc

SEQ ID NO: 88232 - RNA, 22 nt, Homo sapiens
ugcccguaauuccagcacuuug

SEQ ID NO: 88233 - RNA, 22 nt, Homo sapiens
ugccuuuguucuggaaugggaa

SEQ ID NO: 88234 - RNA, 23 nt, Homo sapiens
ugcuccccucauggaugaauaaa

SEQ ID NO: 88235 - RNA, 22 nt, Homo sapiens
ugcuuugguagaaaucuuuggu

SEQ ID NO: 88236 - RNA, 22 nt, Homo sapiens
uggaaaacaugcacauuggauu

SEQ ID NO: 88237 - RNA, 22 nt, Homo sapiens
uggaaguaaucaugagguagca

SEQ ID NO: 88238 - RNA, 22 nt, Homo sapiens
uggaaguuaaauuaguugauga

SEQ ID NO: 88239 - RNA, 22 nt, Homo sapiens
uggagcccuaguuccucauaac

SEQ ID NO: 88240 - RNA, 22 nt, Homo sapiens
uggagguagggccuaggaaucu

SEQ ID NO: 88241 - RNA, 22 nt, Homo sapiens
uggagguaggugauauguagca

SEQ ID NO: 88242 - RNA, 21 nt, Homo sapiens
uggagugaagaguuuauugac

SEQ ID NO: 88243 - RNA, 22 nt, Homo sapiens
uggauagaacuaagugcuuaga

SEQ ID NO: 88244 - RNA, 18 nt, Homo sapiens
uggauaguuguuggcaga

SEQ ID NO: 88245 - RNA, 22 nt, Homo sapiens
uggcaagaagagcaugagacca

SEQ ID NO: 88246 - RNA, 22 nt, Homo sapiens
uggcagcgugaaagacuuuuuc

SEQ ID NO: 88247 - RNA, 22 nt, Homo sapiens
uggcaggugcacuggcuuugaa

SEQ ID NO: 88248 - RNA, 23 nt, Homo sapiens
uggcauuuuaguuagcuucagug

SEQ ID NO: 88249 - RNA, 22 nt, Homo sapiens
uggcauuuuguuuuagaauuag

SEQ ID NO: 88250 - RNA, 23 nt, Homo sapiens
uggcauuuuuggcaaugccuucu

SEQ ID NO: 88251 - RNA, 22 nt, Homo sapiens
uggccagugucggaggccagga

SEQ ID NO: 88252 - RNA, 19 nt, Homo sapiens
uggcuagagcagauauccu

SEQ ID NO: 88253 - RNA, 22 nt, Homo sapiens
uggcuguuguuacuaacaguuc

SEQ ID NO: 88254 - RNA, 20 nt, Homo sapiens
ugggaacaugugguauaugg

SEQ ID NO: 88255 - RNA, 22 nt, Homo sapiens
ugggaucagcugggcucucugu

SEQ ID NO: 88256 - RNA, 22 nt, Homo sapiens
ugggguaggcuguauacucugu

SEQ ID NO: 88257 - RNA, 22 nt, Homo sapiens
uggguaaaucucuguucagggc

SEQ ID NO: 88258 - RNA, 22 nt, Homo sapiens
uggguagauaucauaguugccc

SEQ ID NO: 88259 - RNA, 20 nt, Homo sapiens
ugguccccaccaaaucucau

SEQ ID NO: 88260 - RNA, 22 nt, Homo sapiens
uggugagaaaagaugucuuugu

SEQ ID NO: 88261 - RNA, 23 nt, Homo sapiens
ugguuuguaagagauggacugga

SEQ ID NO: 88262 - RNA, 22 nt, Homo sapiens
uguacaaauuucugugguggug

SEQ ID NO: 88263 - RNA, 22 nt, Homo sapiens
uguagacagcacguaguugagu

SEQ ID NO: 88264 - RNA, 22 nt, Homo sapiens
uguaugguuauuuguggauggu

SEQ ID NO: 88265 - RNA, 22 nt, Homo sapiens
ugucaauauguaauaacugaau

SEQ ID NO: 88266 - RNA, 22 nt, Homo sapiens
ugucacugugcagucaugcauu

SEQ ID NO: 88267 - RNA, 22 nt, Homo sapiens
ugucagcacaacucagguuccu

SEQ ID NO: 88268 - RNA, 22 nt, Homo sapiens
ugucaguggacugugaaaggca

SEQ ID NO: 88269 - RNA, 19 nt, Homo sapiens
ugucccagccauagaggca

SEQ ID NO: 88270 - RNA, 22 nt, Homo sapiens
ugucucaguucccuucucugga

SEQ ID NO: 88271 - RNA, 21 nt, Homo sapiens
ugucuuggagccagacgccag

SEQ ID NO: 88272 - RNA, 22 nt, Homo sapiens
ugugaaaucagauagccuuuuu

SEQ ID NO: 88273 - RNA, 20 nt, Homo sapiens
ugugaacuguagauagucuu

SEQ ID NO: 88274 - RNA, 22 nt, Homo sapiens
ugugccuucuaagaaggagucu

SEQ ID NO: 88275 - RNA, 22 nt, Homo sapiens
uguggcucuucuguucuccacu

SEQ ID NO: 88276 - RNA, 22 nt, Homo sapiens
ugugggugguaaaauacaauga

SEQ ID NO: 88277 - RNA, 18 nt, Homo sapiens
aaacagugucucuuucug

SEQ ID NO: 88278 - RNA, 22 nt, Homo sapiens
aaacauugaccucauccuggca

SEQ ID NO: 88279 - RNA, 22 nt, Homo sapiens
aaagcagcaggugguuuucaau

SEQ ID NO: 88280 - RNA, 22 nt, Homo sapiens
aaagggcacugugcuuuggcaa

SEQ ID NO: 88281 - RNA, 20 nt, Homo sapiens
aaaguaggcuaauaccaaaa

SEQ ID NO: 88282 - RNA, 22 nt, Homo sapiens
aaaugcagucuuuguucugggc

SEQ ID NO: 88283 - RNA, 22 nt, Homo sapiens
aaauggcuuuuugggcaaggug

SEQ ID NO: 88284 - RNA, 22 nt, Homo sapiens
aaaugucauggaguguuucccc

SEQ ID NO: 88285 - RNA, 22 nt, Homo sapiens
aaauucaucaaaugguuuguau

SEQ ID NO: 88286 - RNA, 22 nt, Homo sapiens
aaauucauuucagcucugggua

SEQ ID NO: 88287 - RNA, 18 nt, Homo sapiens
aaauucugucccuucuuc

SEQ ID NO: 88288 - RNA, 22 nt, Homo sapiens
aaauugcauugagcugcuuauu

SEQ ID NO: 88289 - RNA, 22 nt, Homo sapiens
aacaggguguuugcaguuucuu

SEQ ID NO: 88290 - RNA, 22 nt, Homo sapiens
aacucugucuccuucaaguuca

SEQ ID NO: 88291 - RNA, 22 nt, Homo sapiens
aagacuguaauccaucuugagu

SEQ ID NO: 88292 - RNA, 22 nt, Homo sapiens
aagagguagaagcuugccuucu

SEQ ID NO: 88293 - RNA, 22 nt, Homo sapiens
aagcaacacaucugccccgguu

SEQ ID NO: 88294 - RNA, 22 nt, Homo sapiens
aagcacaauuucaccuucuugu

SEQ ID NO: 88295 - RNA, 21 nt, Homo sapiens
aagcaugguguaucuuuccau

SEQ ID NO: 88296 - RNA, 22 nt, Homo sapiens
aagcuacauuuuauuuauguca

SEQ ID NO: 88297 - RNA, 22 nt, Homo sapiens
aaggcauggugacuauuuaggc

SEQ ID NO: 88298 - RNA, 22 nt, Homo sapiens
aaguaauggaguuauuuuauga

SEQ ID NO: 88299 - RNA, 22 nt, Homo sapiens
aaguaauugagguuuuugcugu

SEQ ID NO: 88300 - RNA, 21 nt, Homo sapiens
ggauucaucccucaugaauuu

SEQ ID NO: 88301 - RNA, 22 nt, Homo sapiens
ggcaacaaagacauuucaacau

SEQ ID NO: 88302 - RNA, 22 nt, Homo sapiens
ggcagcacaauuuucugaugga

SEQ ID NO: 88303 - RNA, 22 nt, Homo sapiens
ggcaguuuguuugugaggucca

SEQ ID NO: 88304 - RNA, 22 nt, Homo sapiens
ggcaugaugcgcacgccuguag

SEQ ID NO: 88305 - RNA, 22 nt, Homo sapiens
ggcauguaauuauucaaagugg

SEQ ID NO: 88306 - RNA, 22 nt, Homo sapiens
ggcuauagauaugugaacacuu

SEQ ID NO: 88307 - RNA, 22 nt, Homo sapiens
gggcaugaugucuuaugccuau

SEQ ID NO: 88308 - RNA, 22 nt, Homo sapiens
gggguauguaagugagugagug

SEQ ID NO: 88309 - RNA, 22 nt, Homo sapiens
ggguucaaaucuuggcucuuac

SEQ ID NO: 88310 - RNA, 22 nt, Homo sapiens
ggguucccuucuggcucagggu

SEQ ID NO: 88311 - RNA, 22 nt, Homo sapiens
gguaacaguggggcuaugcuua

SEQ ID NO: 88312 - RNA, 22 nt, Homo sapiens
gguagacaucgugcucugugau

SEQ ID NO: 88313 - RNA, 22 nt, Homo sapiens
gguauuauuugccuuuuacuga

SEQ ID NO: 88314 - RNA, 22 nt, Homo sapiens
ggucugguguugaaauucuuca

SEQ ID NO: 88315 - RNA, 19 nt, Homo sapiens
ggugagaaauuaugggucu

SEQ ID NO: 88316 - RNA, 22 nt, Homo sapiens
ggugagguaggaaaaguuagga

SEQ ID NO: 88317 - RNA, 22 nt, Homo sapiens
gguggcuuuuugugauggcuga

SEQ ID NO: 88318 - RNA, 22 nt, Homo sapiens
guaaaguaaagcacaucaaggu

SEQ ID NO: 88319 - RNA, 22 nt, Homo sapiens
guaagugauagaauuaggauuc

SEQ ID NO: 88320 - RNA, 22 nt, Homo sapiens
guaauacuggacaggguaucag

SEQ ID NO: 88321 - RNA, 22 nt, Homo sapiens
guaaucucagcuacuugggagg

SEQ ID NO: 88322 - RNA, 22 nt, Homo sapiens
guauacaguugacccuugaacc

SEQ ID NO: 88323 - RNA, 19 nt, Homo sapiens
gucaaagucgguauucaaa

SEQ ID NO: 88324 - RNA, 22 nt, Homo sapiens
gucacugugaggaggggccagg

SEQ ID NO: 88325 - RNA, 22 nt, Homo sapiens
gucagcaaagaggaauaguuug

SEQ ID NO: 88326 - RNA, 22 nt, Homo sapiens
gucagugucuuugcagcucaga

SEQ ID NO: 88327 - RNA, 22 nt, Homo sapiens
gucauccaggcuggagugaagc

SEQ ID NO: 88328 - RNA, 22 nt, Homo sapiens
guccugaagaccuuccucugga

SEQ ID NO: 88329 - RNA, 22 nt, Homo sapiens
gucucauugcaguuagaccugu

SEQ ID NO: 88330 - RNA, 22 nt, Homo sapiens
gucugguuuuuuauauccucac

SEQ ID NO: 88331 - RNA, 22 nt, Homo sapiens
gucuguuuggggaccuguggcc

SEQ ID NO: 88332 - RNA, 17 nt, Homo sapiens
gucuuugguugaguuua

SEQ ID NO: 88333 - RNA, 22 nt, Homo sapiens
gugaaauguguagaggaucugg

SEQ ID NO: 88334 - RNA, 22 nt, Homo sapiens
gugacgucauuguuccuggcuc

SEQ ID NO: 88335 - RNA, 22 nt, Homo sapiens
gugacugcauccauccaggcuu

SEQ ID NO: 88336 - RNA, 22 nt, Homo sapiens
gugagaugaggucucacucugu

SEQ ID NO: 88337 - RNA, 22 nt, Homo sapiens
gugagccaugauuuuaccacug

SEQ ID NO: 88338 - RNA, 17 nt, Homo sapiens
gugagguggguaguauc

SEQ ID NO: 88339 - RNA, 22 nt, Homo sapiens
gugaggugguacaauauuaacu

SEQ ID NO: 88340 - RNA, 22 nt, Homo sapiens
gugauagaucugggauucagaa

SEQ ID NO: 88341 - RNA, 22 nt, Homo sapiens
gugcaaacuccaggucucuuca

SEQ ID NO: 88342 - RNA, 22 nt, Homo sapiens
gugcacaacaugcaguuuuguu

SEQ ID NO: 88343 - RNA, 22 nt, Homo sapiens
gugcacaacgugcaaguuuguu

SEQ ID NO: 88344 - RNA, 22 nt, Homo sapiens
gugcacuguagaacccuuuguu

SEQ ID NO: 88345 - RNA, 22 nt, Homo sapiens
gugcuuguauuuaaaucaugug

SEQ ID NO: 88346 - RNA, 22 nt, Homo sapiens
guggaagaccagacuuuccaac

SEQ ID NO: 88347 - RNA, 22 nt, Homo sapiens
guggagcuguguggccuugggc

SEQ ID NO: 88348 - RNA, 18 nt, Homo sapiens
guggagugucuuccugga

SEQ ID NO: 88349 - RNA, 22 nt, Homo sapiens
guggcuuuauuuagaagcaggg

SEQ ID NO: 88350 - RNA, 22 nt, Homo sapiens
gugggauauaaucaguccugua

SEQ ID NO: 88351 - RNA, 21 nt, Homo sapiens
gugucacagacaugacagaug

SEQ ID NO: 88352 - RNA, 22 nt, Homo sapiens
gugucucagcccagaccuauuu

SEQ ID NO: 88353 - RNA, 22 nt, Homo sapiens
guguuugguugauagagccacu

SEQ ID NO: 88354 - RNA, 22 nt, Homo sapiens
guuauguuaaauuguuguaugc

SEQ ID NO: 88355 - RNA, 22 nt, Homo sapiens
guuauuguccauuuauuuagca

SEQ ID NO: 88356 - RNA, 22 nt, Homo sapiens
guucaagugauucuacugccuc

SEQ ID NO: 88357 - RNA, 22 nt, Homo sapiens
guugcaaaguaauugugguuuu

SEQ ID NO: 88358 - RNA, 22 nt, Homo sapiens
guugcucaggcugaagugcagu

SEQ ID NO: 88359 - RNA, 22 nt, Homo sapiens
guuugcauagugcugggagggg

SEQ ID NO: 88360 - RNA, 22 nt, Homo sapiens
guuuggauauuaggcaagagua

SEQ ID NO: 88361 - RNA, 22 nt, Homo sapiens
guuuugguuauauggaucaguu

SEQ ID NO: 88362 - RNA, 22 nt, Homo sapiens
uaaagccagugauuaugucucu

SEQ ID NO: 88363 - RNA, 22 nt, Homo sapiens
uaaagccauugucaaguuugua

SEQ ID NO: 88364 - RNA, 22 nt, Homo sapiens
uaaagcgaggucuccuacaaga

SEQ ID NO: 88365 - RNA, 22 nt, Homo sapiens
uaaagugaggauggcaguaggu

SEQ ID NO: 88366 - RNA, 22 nt, Homo sapiens
uaacaccuuugauagcacuuuu

SEQ ID NO: 88367 - RNA, 22 nt, Homo sapiens
uaacauugcuggacuaccugcu

SEQ ID NO: 88368 - RNA, 22 nt, Homo sapiens
uaacugucucaggccaugggcg

SEQ ID NO: 88369 - RNA, 22 nt, Homo sapiens
uaaggaguagaauaguaaggca

SEQ ID NO: 88370 - RNA, 22 nt, Homo sapiens
uaaggcacccuucugaguagag

SEQ ID NO: 88371 - RNA, 22 nt, Homo sapiens
uaaggcuuugcuggacucaguc

SEQ ID NO: 88372 - RNA, 23 nt, Homo sapiens
uaagucacacagauuaauuuauu

SEQ ID NO: 88373 - RNA, 22 nt, Homo sapiens
uaagugaauuucacuacugagu

SEQ ID NO: 88374 - RNA, 20 nt, Homo sapiens
uaagugcuugaugaaugaac

SEQ ID NO: 88375 - RNA, 22 nt, Homo sapiens
uaaguuguagaacguuuucuua

SEQ ID NO: 88376 - RNA, 20 nt, Homo sapiens
uaaguuguauuugucaugaa

SEQ ID NO: 88377 - RNA, 18 nt, Homo sapiens
uaauaacugugaccuuga

SEQ ID NO: 88378 - RNA, 22 nt, Homo sapiens
uaauacauucaaggugguaguu

SEQ ID NO: 88379 - RNA, 22 nt, Homo sapiens
uaauagcucggauaaacaugau

SEQ ID NO: 88380 - RNA, 22 nt, Homo sapiens
uaauaguuucagaaguuguuuu

SEQ ID NO: 88381 - RNA, 22 nt, Homo sapiens
uaaucucagcuacucaggaggc

SEQ ID NO: 88382 - RNA, 22 nt, Homo sapiens
uaaugcauacagaagguguuuu

SEQ ID NO: 88383 - RNA, 22 nt, Homo sapiens
uaaugcaucagugguaguucuu

SEQ ID NO: 88384 - RNA, 22 nt, Homo sapiens
uaaugcaucaugguuggcaaac

SEQ ID NO: 88385 - RNA, 22 nt, Homo sapiens
uacaaagcuuucugcaaaucau

SEQ ID NO: 88386 - RNA, 22 nt, Homo sapiens
uacaaguggguuugugcaggag

SEQ ID NO: 88387 - RNA, 22 nt, Homo sapiens
uacacagucaaaaauuuccagg

SEQ ID NO: 88388 - RNA, 22 nt, Homo sapiens
uacaggcaccuggcuaauuuuu

SEQ ID NO: 88389 - RNA, 22 nt, Homo sapiens
uacagucuagaggagaaucagg

SEQ ID NO: 88390 - RNA, 22 nt, Homo sapiens
uacagugcuuuuugguggagaa

SEQ ID NO: 88391 - RNA, 22 nt, Homo sapiens
uacaguggaaguuaaccccauu

SEQ ID NO: 88392 - RNA, 22 nt, Homo sapiens
uacaguggugugaucucagcuc

SEQ ID NO: 88393 - RNA, 22 nt, Homo sapiens
uaccucaguucaauaacagaua

SEQ ID NO: 88394 - RNA, 22 nt, Homo sapiens
uaccugagacaacuuugaggaa

SEQ ID NO: 88395 - RNA, 22 nt, Homo sapiens
uaccugagcccucugcugaguu

SEQ ID NO: 88396 - RNA, 22 nt, Homo sapiens
uagauuauuccuuugaauggcc

SEQ ID NO: 88397 - RNA, 22 nt, Homo sapiens
uagcaacauucagcucagguac

SEQ ID NO: 88398 - RNA, 22 nt, Homo sapiens
uagcaagaugaauuugugcaaa

SEQ ID NO: 88399 - RNA, 22 nt, Homo sapiens
uagcacagggaauugguucucu

SEQ ID NO: 88400 - RNA, 22 nt, Homo sapiens
uagcagaauaacuugccagccu

SEQ ID NO: 88401 - RNA, 18 nt, Homo sapiens
aaaaagugcucaggccua

SEQ ID NO: 88402 - RNA, 22 nt, Homo sapiens
aaagagcugagaccugguggag

SEQ ID NO: 88403 - RNA, 22 nt, Homo sapiens
aaaggcacugaucuuauccagu

SEQ ID NO: 88404 - RNA, 20 nt, Homo sapiens
aaaggcugugagaacgagau

SEQ ID NO: 88405 - RNA, 22 nt, Homo sapiens
aaagggcuguuucuugacuugg

SEQ ID NO: 88406 - RNA, 22 nt, Homo sapiens
aaagugcaguacuucguauauu

SEQ ID NO: 88407 - RNA, 22 nt, Homo sapiens
aaauaacugucagguucuggaa

SEQ ID NO: 88408 - RNA, 22 nt, Homo sapiens
aaaugcacaaagauuuugcacu

SEQ ID NO: 88409 - RNA, 22 nt, Homo sapiens
aaaugcaccacucuggugcagg

SEQ ID NO: 88410 - RNA, 22 nt, Homo sapiens
aaaugcauaucaagauugcccu

SEQ ID NO: 88411 - RNA, 22 nt, Homo sapiens
aaaugcaucauuaggugauuuu

SEQ ID NO: 88412 - RNA, 22 nt, Homo sapiens
aaaugcauugagggaaaaggca

SEQ ID NO: 88413 - RNA, 22 nt, Homo sapiens
aaaugcuuucuuggaccauuug

SEQ ID NO: 88414 - RNA, 22 nt, Homo sapiens
aacagcuaguaccaauccacua

SEQ ID NO: 88415 - RNA, 22 nt, Homo sapiens
aacaggcuccuaggggugcacc

SEQ ID NO: 88416 - RNA, 22 nt, Homo sapiens
aacaggguggugccugguccau

SEQ ID NO: 88417 - RNA, 22 nt, Homo sapiens
aaccugaagaaaauauuugcug

SEQ ID NO: 88418 - RNA, 19 nt, Homo sapiens
aacuggugugagaugguau

SEQ ID NO: 88419 - RNA, 21 nt, Homo sapiens
aacuggugugagaugguaugu

SEQ ID NO: 88420 - RNA, 22 nt, Homo sapiens
aagagcauuauuuaguaauuuc

SEQ ID NO: 88421 - RNA, 22 nt, Homo sapiens
aagagccgcaagggugaagggu

SEQ ID NO: 88422 - RNA, 18 nt, Homo sapiens
aagagcucagcacagguu

SEQ ID NO: 88423 - RNA, 22 nt, Homo sapiens
aagaggcuguaggauaaugccu

SEQ ID NO: 88424 - RNA, 22 nt, Homo sapiens
aagagguuguaccuaaaguguu

SEQ ID NO: 88425 - RNA, 22 nt, Homo sapiens
aagauaguaaacauuuucugcu

SEQ ID NO: 88426 - RNA, 22 nt, Homo sapiens
aagaugauguucuuuuucuuag

SEQ ID NO: 88427 - RNA, 22 nt, Homo sapiens
aagcaggugugggaggaaaugg

SEQ ID NO: 88428 - RNA, 23 nt, Homo sapiens
aaggacacugaacacuucccagc

SEQ ID NO: 88429 - RNA, 22 nt, Homo sapiens
aaggagugugauucuucaguuu

SEQ ID NO: 88430 - RNA, 22 nt, Homo sapiens
aaggcagugugcacauaacacu

SEQ ID NO: 88431 - RNA, 22 nt, Homo sapiens
aaggcaugcaaagaacauuuua

SEQ ID NO: 88432 - RNA, 22 nt, Homo sapiens
aagggagcugcauaaucuugug

SEQ ID NO: 88433 - RNA, 22 nt, Homo sapiens
aaggugcuguaagcauccaugu

SEQ ID NO: 88434 - RNA, 17 nt, Homo sapiens
aaggugcuucgaccucc

SEQ ID NO: 88435 - RNA, 22 nt, Homo sapiens
aagugcacuguaagugcaggau

SEQ ID NO: 88436 - RNA, 20 nt, Homo sapiens
aagugcaucguugugucugc

SEQ ID NO: 88437 - RNA, 22 nt, Homo sapiens
aagugcuucagaagacaauauu

SEQ ID NO: 88438 - RNA, 22 nt, Homo sapiens
aauaugguuuuaugaagcaauu

SEQ ID NO: 88439 - RNA, 22 nt, Homo sapiens
aaucacuaugccaugaaguaca

SEQ ID NO: 88440 - RNA, 17 nt, Homo sapiens
aaucagauuucugagga

SEQ ID NO: 88441 - RNA, 22 nt, Homo sapiens
aaucucaacacuuugggaggcu

SEQ ID NO: 88442 - RNA, 22 nt, Homo sapiens
aaugcuguguuauuucaugacc

SEQ ID NO: 88443 - RNA, 22 nt, Homo sapiens
aauggccuuuuucauuauacug

SEQ ID NO: 88444 - RNA, 22 nt, Homo sapiens
aauggcuauuucaugugguagg

SEQ ID NO: 88445 - RNA, 22 nt, Homo sapiens
aaugugcacuauuagggugaua

SEQ ID NO: 88446 - RNA, 22 nt, Homo sapiens
aauucuguauuguuuagggacu

SEQ ID NO: 88447 - RNA, 22 nt, Homo sapiens
aauugaaucaugugggcagacu

SEQ ID NO: 88448 - RNA, 22 nt, Homo sapiens
aauugcacuaagcauaguccag

SEQ ID NO: 88449 - RNA, 22 nt, Homo sapiens
aauugguuaagauaagaucaua

SEQ ID NO: 88450 - RNA, 22 nt, Homo sapiens
acaaaguauggaauguuggugu

SEQ ID NO: 88451 - RNA, 22 nt, Homo sapiens
acaagcacaaaugcauagaugg

SEQ ID NO: 88452 - RNA, 22 nt, Homo sapiens
acacaaugguaaguguuugugu

SEQ ID NO: 88453 - RNA, 22 nt, Homo sapiens
acacacgugcauguaugcguau

SEQ ID NO: 88454 - RNA, 22 nt, Homo sapiens
acacagugucuguguauuuaaa

SEQ ID NO: 88455 - RNA, 22 nt, Homo sapiens
acacugucugaugaaaguaguu

SEQ ID NO: 88456 - RNA, 22 nt, Homo sapiens
acacuguugacauuuuguagug

SEQ ID NO: 88457 - RNA, 22 nt, Homo sapiens
acagauagcacuaagggaucug

SEQ ID NO: 88458 - RNA, 20 nt, Homo sapiens
acagcauagccuuuuaaagc

SEQ ID NO: 88459 - RNA, 22 nt, Homo sapiens
acaguacuguuguuugcugcca

SEQ ID NO: 88460 - RNA, 23 nt, Homo sapiens
acagucuaguuugaagucaggua

SEQ ID NO: 88461 - RNA, 22 nt, Homo sapiens
acagugacagaaagcugauuau

SEQ ID NO: 88462 - RNA, 18 nt, Homo sapiens
acagugcuggcaugagau

SEQ ID NO: 88463 - RNA, 22 nt, Homo sapiens
acagugcuguggucaugggucu

SEQ ID NO: 88464 - RNA, 22 nt, Homo sapiens
acaguggugcgaucucggcuca

SEQ ID NO: 88465 - RNA, 22 nt, Homo sapiens
accagucucagguaugucuuua

SEQ ID NO: 88466 - RNA, 22 nt, Homo sapiens
acccaguaacauaugggaggga

SEQ ID NO: 88467 - RNA, 22 nt, Homo sapiens
acuccauuucauuuuagcucuu

SEQ ID NO: 88468 - RNA, 22 nt, Homo sapiens
acugcacuccagccugugagac

SEQ ID NO: 88469 - RNA, 22 nt, Homo sapiens
acugcacuucagccuugggaaa

SEQ ID NO: 88470 - RNA, 22 nt, Homo sapiens
acuggcuuuugagaaaaacacu

SEQ ID NO: 88471 - RNA, 22 nt, Homo sapiens
acuuuguguuacccagcaagga

SEQ ID NO: 88472 - RNA, 22 nt, Homo sapiens
acuuuuguuauacagugugaua

SEQ ID NO: 88473 - RNA, 22 nt, Homo sapiens
agaaagcgcuucccuuugcugg

SEQ ID NO: 88474 - RNA, 22 nt, Homo sapiens
agacagcuggaguaucauagcu

SEQ ID NO: 88475 - RNA, 20 nt, Homo sapiens
agacuagggagcagaaagcc

SEQ ID NO: 88476 - RNA, 22 nt, Homo sapiens
agagauaauuagguuaaaugag

SEQ ID NO: 88477 - RNA, 18 nt, Homo sapiens
agagcuaugaacauaugc

SEQ ID NO: 88478 - RNA, 22 nt, Homo sapiens
agaguauagcaacuuaguaaaa

SEQ ID NO: 88479 - RNA, 23 nt, Homo sapiens
agaugcauucuuguaggauauau

SEQ ID NO: 88480 - RNA, 22 nt, Homo sapiens
agauucauccaaguuguugcau

SEQ ID NO: 88481 - RNA, 22 nt, Homo sapiens
agcaacauugagacugcaguug

SEQ ID NO: 88482 - RNA, 22 nt, Homo sapiens
agcaccaccguugcucuauccc

SEQ ID NO: 88483 - RNA, 22 nt, Homo sapiens
agcagcacaucccuuucuggcc

SEQ ID NO: 88484 - RNA, 22 nt, Homo sapiens
agcagguguggcuuauccugaa

SEQ ID NO: 88485 - RNA, 21 nt, Homo sapiens
agccugugggucauaguugcc

SEQ ID NO: 88486 - RNA, 23 nt, Homo sapiens
agccuguugccuaggcagcucau

SEQ ID NO: 88487 - RNA, 22 nt, Homo sapiens
agcugauuuuaaguccuugucc

SEQ ID NO: 88488 - RNA, 22 nt, Homo sapiens
agcugcaauguuuaguauaaua

SEQ ID NO: 88489 - RNA, 22 nt, Homo sapiens
agcuuguauuuguagccuguug

SEQ ID NO: 88490 - RNA, 22 nt, Homo sapiens
agcuuguuuuauagaaagucaa

SEQ ID NO: 88491 - RNA, 22 nt, Homo sapiens
aggaaauguuggucccauuucu

SEQ ID NO: 88492 - RNA, 22 nt, Homo sapiens
aggaauggaaacuuuugauggu

SEQ ID NO: 88493 - RNA, 22 nt, Homo sapiens
aggaccaugguauugcuuuggg

SEQ ID NO: 88494 - RNA, 22 nt, Homo sapiens
aggagcacaauggucaugugga

SEQ ID NO: 88495 - RNA, 20 nt, Homo sapiens
aggagcauuuacauuggcuc

SEQ ID NO: 88496 - RNA, 22 nt, Homo sapiens
aggcaaaugccagcaaucacac

SEQ ID NO: 88497 - RNA, 22 nt, Homo sapiens
aggccaguuuuuggagggaaac

SEQ ID NO: 88498 - RNA, 22 nt, Homo sapiens
aggcuuuauuacagggucucag

SEQ ID NO: 88499 - RNA, 22 nt, Homo sapiens
agggguauuauguaaaucugac

SEQ ID NO: 88500 - RNA, 22 nt, Homo sapiens
aggugguauuucaaaguggcag

SEQ ID NO: 88501 - RNA, 22 nt, Homo sapiens
aggugguuuuaggcagagacau

SEQ ID NO: 88502 - RNA, 22 nt, Homo sapiens
ugaagcuuguuucuguaccuuu

SEQ ID NO: 88503 - RNA, 22 nt, Homo sapiens
ugaaggacauaaggcagaguga

SEQ ID NO: 88504 - RNA, 22 nt, Homo sapiens
ugaaguaggcauaaguuaagcu

SEQ ID NO: 88505 - RNA, 22 nt, Homo sapiens
ugaauagacacuaaagacugua

SEQ ID NO: 88506 - RNA, 22 nt, Homo sapiens
ugaaucauuucuugucuucagu

SEQ ID NO: 88507 - RNA, 21 nt, Homo sapiens
ugaaugcuuuaaauauuagaa

SEQ ID NO: 88508 - RNA, 22 nt, Homo sapiens
ugaauugucucucacuggguuc

SEQ ID NO: 88509 - RNA, 19 nt, Homo sapiens
ugacacuguuggugggagg

SEQ ID NO: 88510 - RNA, 22 nt, Homo sapiens
ugacaggagauuaugugauguu

SEQ ID NO: 88511 - RNA, 23 nt, Homo sapiens
ugacagucucccgauggcuaggc

SEQ ID NO: 88512 - RNA, 20 nt, Homo sapiens
ugacaguuaagggauagaag

SEQ ID NO: 88513 - RNA, 20 nt, Homo sapiens
ugacaucagcaauguaauaa

SEQ ID NO: 88514 - RNA, 18 nt, Homo sapiens
ugacaucauuuagaaagg

SEQ ID NO: 88515 - RNA, 22 nt, Homo sapiens
ugacauuacagucacuugcugu

SEQ ID NO: 88516 - RNA, 22 nt, Homo sapiens
ugagaaugacugggcaugcugc

SEQ ID NO: 88517 - RNA, 22 nt, Homo sapiens
ugagagacaguuucgucggagg

SEQ ID NO: 88518 - RNA, 22 nt, Homo sapiens
ugagagacauuuguuguagagu

SEQ ID NO: 88519 - RNA, 22 nt, Homo sapiens
ugagaucacgccacugcacucc

SEQ ID NO: 88520 - RNA, 22 nt, Homo sapiens
ugagaugaucaaaguauaggcu

SEQ ID NO: 88521 - RNA, 22 nt, Homo sapiens
ugagauggaucuuggauuugaa

SEQ ID NO: 88522 - RNA, 22 nt, Homo sapiens
ugagaugugugcauucaacuca

SEQ ID NO: 88523 - RNA, 22 nt, Homo sapiens
ugagauguuccaaugacuauua

SEQ ID NO: 88524 - RNA, 23 nt, Homo sapiens
ugagauuacccagaaagaguaua

SEQ ID NO: 88525 - RNA, 23 nt, Homo sapiens
ugagauuauaaucuuuuacuucu

SEQ ID NO: 88526 - RNA, 22 nt, Homo sapiens
ugagauuauauuucuuaacaga

SEQ ID NO: 88527 - RNA, 22 nt, Homo sapiens
ugagcacauuuacaucaguucc

SEQ ID NO: 88528 - RNA, 22 nt, Homo sapiens
ugagcagagaucacggcauugu

SEQ ID NO: 88529 - RNA, 22 nt, Homo sapiens
ugagcagagggagaaguaaauu

SEQ ID NO: 88530 - RNA, 18 nt, Homo sapiens
ugaggaaaggguuugcua

SEQ ID NO: 88531 - RNA, 22 nt, Homo sapiens
ugaggcuaggauaggcugauuc

SEQ ID NO: 88532 - RNA, 22 nt, Homo sapiens
ugagguaugugaugucuuuuag

SEQ ID NO: 88533 - RNA, 22 nt, Homo sapiens
ugaggucuuuauuuagugcuca

SEQ ID NO: 88534 - RNA, 23 nt, Homo sapiens
ugagguguuaagcagacuugucu

SEQ ID NO: 88535 - RNA, 22 nt, Homo sapiens
ugaguaucuugaugaauuugaa

SEQ ID NO: 88536 - RNA, 22 nt, Homo sapiens
ugaguauguuuaaugugacaau

SEQ ID NO: 88537 - RNA, 22 nt, Homo sapiens
ugagugaggcugggcagucccu

SEQ ID NO: 88538 - RNA, 22 nt, Homo sapiens
ugauaagugagauagcaaguga

SEQ ID NO: 88539 - RNA, 22 nt, Homo sapiens
ugauaugaaguucaaaccaggu

SEQ ID NO: 88540 - RNA, 22 nt, Homo sapiens
ugauauguagguggcaagcaua

SEQ ID NO: 88541 - RNA, 22 nt, Homo sapiens
ugaugacauugucacagucuga

SEQ ID NO: 88542 - RNA, 22 nt, Homo sapiens
ugaugcuacuaccugggcugaa

SEQ ID NO: 88543 - RNA, 23 nt, Homo sapiens
ugauguccacuuagggucuaggu

SEQ ID NO: 88544 - RNA, 22 nt, Homo sapiens
ugauuuguuucaggaguuuucu

SEQ ID NO: 88545 - RNA, 18 nt, Homo sapiens
ugcaaacauguguguguu

SEQ ID NO: 88546 - RNA, 22 nt, Homo sapiens
ugcaaacuuccuugggcagcau

SEQ ID NO: 88547 - RNA, 17 nt, Homo sapiens
ugcagcacacugauggg

SEQ ID NO: 88548 - RNA, 22 nt, Homo sapiens
ugcagcacugaacuucugggcu

SEQ ID NO: 88549 - RNA, 22 nt, Homo sapiens
ugcagcacuguucacaauagcc

SEQ ID NO: 88550 - RNA, 22 nt, Homo sapiens
ugcaguuuaggaacugguaaca

SEQ ID NO: 88551 - RNA, 22 nt, Homo sapiens
ugcauacacaagcauacaugua

SEQ ID NO: 88552 - RNA, 22 nt, Homo sapiens
ugcaucacaguacuccagccug

SEQ ID NO: 88553 - RNA, 20 nt, Homo sapiens
ugcauguccucacuuacuug

SEQ ID NO: 88554 - RNA, 21 nt, Homo sapiens
ugcauugucuugaguuuaaau

SEQ ID NO: 88555 - RNA, 22 nt, Homo sapiens
ugccuaggcccaguccucagaa

SEQ ID NO: 88556 - RNA, 22 nt, Homo sapiens
ugccuggagagcuccuacauau

SEQ ID NO: 88557 - RNA, 21 nt, Homo sapiens
ugccuuuguaguaggugucuu

SEQ ID NO: 88558 - RNA, 18 nt, Homo sapiens
ugcuccccugggugagca

SEQ ID NO: 88559 - RNA, 22 nt, Homo sapiens
uggaagguaaguuuugagcauu

SEQ ID NO: 88560 - RNA, 21 nt, Homo sapiens
uggaauuaauggagagguguu

SEQ ID NO: 88561 - RNA, 22 nt, Homo sapiens
uggagcccuaaacuucuaauau

SEQ ID NO: 88562 - RNA, 22 nt, Homo sapiens
uggagguaggacgaagaacucu

SEQ ID NO: 88563 - RNA, 22 nt, Homo sapiens
uggauagauacuauccaggacu

SEQ ID NO: 88564 - RNA, 22 nt, Homo sapiens
uggauaguaaagucagauuccc

SEQ ID NO: 88565 - RNA, 22 nt, Homo sapiens
uggcauggaguggauggcccca

SEQ ID NO: 88566 - RNA, 20 nt, Homo sapiens
uggcuaaaugaaugauagca

SEQ ID NO: 88567 - RNA, 20 nt, Homo sapiens
uggcucuuugcugcuaaagu

SEQ ID NO: 88568 - RNA, 22 nt, Homo sapiens
uggcuuuguaagguuucauuuu

SEQ ID NO: 88569 - RNA, 22 nt, Homo sapiens
uggcuuuuguuauuuggaagcu

SEQ ID NO: 88570 - RNA, 20 nt, Homo sapiens
ugggaaauguccaggacaua

SEQ ID NO: 88571 - RNA, 22 nt, Homo sapiens
uggucaguugaguccuugccaa

SEQ ID NO: 88572 - RNA, 22 nt, Homo sapiens
uggucuccuuuguacccugggc

SEQ ID NO: 88573 - RNA, 22 nt, Homo sapiens
ugguguccugucucugcgcuug

SEQ ID NO: 88574 - RNA, 22 nt, Homo sapiens
uguaaugaucaaaucagaguaa

SEQ ID NO: 88575 - RNA, 22 nt, Homo sapiens
uguacuucaagauuaugguuua

SEQ ID NO: 88576 - RNA, 22 nt, Homo sapiens
uguaugucugcucuuuggaacu

SEQ ID NO: 88577 - RNA, 22 nt, Homo sapiens
gugggauaauuuuuggugcugu

SEQ ID NO: 88578 - RNA, 22 nt, Homo sapiens
gugucacuguauaauauuuauu

SEQ ID NO: 88579 - RNA, 22 nt, Homo sapiens
gugucacuguugagaaguccac

SEQ ID NO: 88580 - RNA, 22 nt, Homo sapiens
gugucccagugugcauacaggu

SEQ ID NO: 88581 - RNA, 22 nt, Homo sapiens
guguuaaucucaaguacucuca

SEQ ID NO: 88582 - RNA, 22 nt, Homo sapiens
guuaaagacauccacauaggag

SEQ ID NO: 88583 - RNA, 22 nt, Homo sapiens
guuaagaaguguaacuuaaguu

SEQ ID NO: 88584 - RNA, 17 nt, Homo sapiens
guucccaguggcauuug

SEQ ID NO: 88585 - RNA, 17 nt, Homo sapiens
guugaguuugagucaag

SEQ ID NO: 88586 - RNA, 22 nt, Homo sapiens
guuggugaccugaagagaguaa

SEQ ID NO: 88587 - RNA, 22 nt, Homo sapiens
guuuggcucuuguuucugucaa

SEQ ID NO: 88588 - RNA, 22 nt, Homo sapiens
uaaacugucuugcaguuacaug

SEQ ID NO: 88589 - RNA, 21 nt, Homo sapiens
uaaagcuuagcuauaguggcu

SEQ ID NO: 88590 - RNA, 22 nt, Homo sapiens
uaaaguguuuguuauuaaaggu

SEQ ID NO: 88591 - RNA, 22 nt, Homo sapiens
uaacaggcuacucuugcauugc

SEQ ID NO: 88592 - RNA, 22 nt, Homo sapiens
uaacaguggucugugguaucug

SEQ ID NO: 88593 - RNA, 22 nt, Homo sapiens
uaacauucacaugcugcaaaaa

SEQ ID NO: 88594 - RNA, 22 nt, Homo sapiens
uaacccuuacaacuacacucgu

SEQ ID NO: 88595 - RNA, 22 nt, Homo sapiens
uaacucugccuagugacauggu

SEQ ID NO: 88596 - RNA, 22 nt, Homo sapiens
uaaggcauuuuuuugaguugca

SEQ ID NO: 88597 - RNA, 22 nt, Homo sapiens
uaagucuuuuuggaguuuauaa

SEQ ID NO: 88598 - RNA, 22 nt, Homo sapiens
cuuuguguggacauuucaggca

SEQ ID NO: 88599 - RNA, 22 nt, Homo sapiens
cuuugugugggccaagggcugg

SEQ ID NO: 88600 - RNA, 22 nt, Homo sapiens
cuuuuacacugcuggugggaau

SEQ ID NO: 88601 - RNA, 22 nt, Homo sapiens
cuuuuacacuguuagugggaau

SEQ ID NO: 88602 - RNA, 22 nt, Homo sapiens
cuuuuggcuuaagauugucuug

SEQ ID NO: 88603 - RNA, 22 nt, Homo sapiens
gaaaauccauccccagggagua

SEQ ID NO: 88604 - RNA, 22 nt, Homo sapiens
gaaucaauugaucuaugugucu

SEQ ID NO: 88605 - RNA, 22 nt, Homo sapiens
gaaucacagauuaugaguaucu

SEQ ID NO: 88606 - RNA, 22 nt, Homo sapiens
gacaaguuugauuuauuccaag

SEQ ID NO: 88607 - RNA, 22 nt, Homo sapiens
gacagguuuucuguuucugaaa

SEQ ID NO: 88608 - RNA, 18 nt, Homo sapiens
gacucaguuucuaaggca

SEQ ID NO: 88609 - RNA, 18 nt, Homo sapiens
gacuuggaguuuacagug

SEQ ID NO: 88610 - RNA, 20 nt, Homo sapiens
gagaccugagauucacucaa

SEQ ID NO: 88611 - RNA, 22 nt, Homo sapiens
gagauggaguuucacuucgcuc

SEQ ID NO: 88612 - RNA, 22 nt, Homo sapiens
gagcaacaguggcagugguggg

SEQ ID NO: 88613 - RNA, 22 nt, Homo sapiens
gagcuaguguaauauuuugggg

SEQ ID NO: 88614 - RNA, 22 nt, Homo sapiens
gaggcaauaugagggaggcuuc

SEQ ID NO: 88615 - RNA, 22 nt, Homo sapiens
gaggucuuacauuuuaauauuu

SEQ ID NO: 88616 - RNA, 17 nt, Homo sapiens
uuuuggauuagaaaucc

SEQ ID NO: 88617 - RNA, 22 nt, Homo sapiens
uuuuuggauaaugguacaugua

SEQ ID NO: 88618 - RNA, 23 nt, Homo sapiens
uuuuuguguuucauggaaauagg

SEQ ID NO: 88619 - RNA, 22 nt, Homo sapiens
uguuuuggaguggacuuugcau

SEQ ID NO: 88620 - RNA, 22 nt, Homo sapiens
uuaaaguaauugaaauggccuu

SEQ ID NO: 88621 - RNA, 22 nt, Homo sapiens
uuaaaguguuugcagacaggug

SEQ ID NO: 88622 - RNA, 22 nt, Homo sapiens
uuaaaguguuuucaaaauguca

SEQ ID NO: 88623 - RNA, 22 nt, Homo sapiens
uuaacagugaccccugguggcc

SEQ ID NO: 88624 - RNA, 22 nt, Homo sapiens
uuaaggaaggagucuuaaaugg

SEQ ID NO: 88625 - RNA, 22 nt, Homo sapiens
uuaaggcuuguacuuguuuucu

SEQ ID NO: 88626 - RNA, 22 nt, Homo sapiens
uuaagguaugugggcauuuugu

SEQ ID NO: 88627 - RNA, 22 nt, Homo sapiens
uuaauccugccuuauuucagua

SEQ ID NO: 88628 - RNA, 22 nt, Homo sapiens
uuaaucuguucucuguauucua

SEQ ID NO: 88629 - RNA, 22 nt, Homo sapiens
uuaauuguccaaguucaucucu

SEQ ID NO: 88630 - RNA, 22 nt, Homo sapiens
uuacaaguggcaucucucugga

SEQ ID NO: 88631 - RNA, 22 nt, Homo sapiens
uuacaccuguaauccagcacuu

SEQ ID NO: 88632 - RNA, 20 nt, Homo sapiens
uuacagugggaccuuccuga

SEQ ID NO: 88633 - RNA, 22 nt, Homo sapiens
uuacaucaucacauuaguuugc

SEQ ID NO: 88634 - RNA, 22 nt, Homo sapiens
uuacaugucuugguaagguuag

SEQ ID NO: 88635 - RNA, 22 nt, Homo sapiens
uuacauguuguggguuguggcc

SEQ ID NO: 88636 - RNA, 22 nt, Homo sapiens
uuacugcauaauuccugggaag

SEQ ID NO: 88637 - RNA, 22 nt, Homo sapiens
uuagauguuuagaagugggcca

SEQ ID NO: 88638 - RNA, 22 nt, Homo sapiens
uuagccggguguguuggcgggc

SEQ ID NO: 88639 - RNA, 22 nt, Homo sapiens
uuaggcaaugcucucaaauuug

SEQ ID NO: 88640 - RNA, 22 nt, Homo sapiens
uuaggcaguuuauugauuuuca

SEQ ID NO: 88641 - RNA, 22 nt, Homo sapiens
uuaucucagugaacugagugga

SEQ ID NO: 88642 - RNA, 22 nt, Homo sapiens
uuauguguuuaauguuucugaa

SEQ ID NO: 88643 - RNA, 22 nt, Homo sapiens
uucaaaggauagauuaagauca

SEQ ID NO: 88644 - RNA, 22 nt, Homo sapiens
uucacaauuaaaugugguuauu

SEQ ID NO: 88645 - RNA, 22 nt, Homo sapiens
uucagguaguuuaacuguucca

SEQ ID NO: 88646 - RNA, 22 nt, Homo sapiens
uucaguagucaaaagauaaggg

SEQ ID NO: 88647 - RNA, 22 nt, Homo sapiens
uucauaguaacaguaacuaugg

SEQ ID NO: 88648 - RNA, 22 nt, Homo sapiens
uucauaguuuauacugauauuu

SEQ ID NO: 88649 - RNA, 21 nt, Homo sapiens
uucaucagccagaaaucaagc

SEQ ID NO: 88650 - RNA, 22 nt, Homo sapiens
uucauguaauauauuucaggcc

SEQ ID NO: 88651 - RNA, 22 nt, Homo sapiens
uucauguaaucaaggcagcuaa

SEQ ID NO: 88652 - RNA, 22 nt, Homo sapiens
uuccacaaugguugaacuagcu

SEQ ID NO: 88653 - RNA, 22 nt, Homo sapiens
uuccacaaugguugaacuaguu

SEQ ID NO: 88654 - RNA, 22 nt, Homo sapiens
uuccagaugggaguucuauucu

SEQ ID NO: 88655 - RNA, 20 nt, Homo sapiens
uuccagcacauuagggaagc

SEQ ID NO: 88656 - RNA, 22 nt, Homo sapiens
uuccagugggacgagaugugga

SEQ ID NO: 88657 - RNA, 22 nt, Homo sapiens
uuccaguugugagcuauccggg

SEQ ID NO: 88658 - RNA, 22 nt, Homo sapiens
uuccaguuuuauggguauagag

SEQ ID NO: 88659 - RNA, 22 nt, Homo sapiens
uucccaguaaacucuaucccuc

SEQ ID NO: 88660 - RNA, 22 nt, Homo sapiens
uucccagugccaggcacuggga

SEQ ID NO: 88661 - RNA, 22 nt, Homo sapiens
uucccagugguuagcucugguc

SEQ ID NO: 88662 - RNA, 22 nt, Homo sapiens
uuccugagaucagaauucaaau

SEQ ID NO: 88663 - RNA, 22 nt, Homo sapiens
uucuaaguaauuuugcaugccu

SEQ ID NO: 88664 - RNA, 20 nt, Homo sapiens
uucuaguacuucuguuucca

SEQ ID NO: 88665 - RNA, 22 nt, Homo sapiens
uucuauugguaauauuuucugu

SEQ ID NO: 88666 - RNA, 22 nt, Homo sapiens
uucucacaguacagggagcucu

SEQ ID NO: 88667 - RNA, 22 nt, Homo sapiens
uucucagugaaguuuagaacau

SEQ ID NO: 88668 - RNA, 22 nt, Homo sapiens
uucugauggaguaguccacaga

SEQ ID NO: 88669 - RNA, 22 nt, Homo sapiens
uucugcuagucugucagaucuu

SEQ ID NO: 88670 - RNA, 22 nt, Homo sapiens
uucuggaaaucagcagagggug

SEQ ID NO: 88671 - RNA, 22 nt, Homo sapiens
uucuggccuccauuuuucuccu

SEQ ID NO: 88672 - RNA, 22 nt, Homo sapiens
uucuguguuuaggucacggcua

SEQ ID NO: 88673 - RNA, 21 nt, Homo sapiens
uucuucaggcagaaggauuau

SEQ ID NO: 88674 - RNA, 22 nt, Homo sapiens
uucuucaggccacaaaaauggu

SEQ ID NO: 88675 - RNA, 19 nt, Homo sapiens
uucuuuguugugggggcug

SEQ ID NO: 88676 - RNA, 22 nt, Homo sapiens
uugaauagugacuuugauucug

SEQ ID NO: 88677 - RNA, 22 nt, Homo sapiens
uugacaaggagccauugcaucu

SEQ ID NO: 88678 - RNA, 22 nt, Homo sapiens
uugaccucaucacuucccaaag

SEQ ID NO: 88679 - RNA, 22 nt, Homo sapiens
uugagacugaacauuuguguac

SEQ ID NO: 88680 - RNA, 22 nt, Homo sapiens
uugagauggugccacuguacuc

SEQ ID NO: 88681 - RNA, 22 nt, Homo sapiens
uugagcccuggagguggaggcu

SEQ ID NO: 88682 - RNA, 22 nt, Homo sapiens
uugaggcaaugaggagaagcug

SEQ ID NO: 88683 - RNA, 22 nt, Homo sapiens
uugaggcuuuugaccucaugug

SEQ ID NO: 88684 - RNA, 22 nt, Homo sapiens
uugaggguggcauauauugauu

SEQ ID NO: 88685 - RNA, 22 nt, Homo sapiens
uugagguagcuuugauggaggu

SEQ ID NO: 88686 - RNA, 22 nt, Homo sapiens
uugauguccaucucuagguaaa

SEQ ID NO: 88687 - RNA, 22 nt, Homo sapiens
uugauuagauccaguugauuga

SEQ ID NO: 88688 - RNA, 22 nt, Homo sapiens
uugcaaacaucuuguuucacau

SEQ ID NO: 88689 - RNA, 22 nt, Homo sapiens
uugcacaguguguacagcacca

SEQ ID NO: 88690 - RNA, 22 nt, Homo sapiens
uugcacucugaagaccuacugu

SEQ ID NO: 88691 - RNA, 22 nt, Homo sapiens
uugcaggcaugagccaccgugc

SEQ ID NO: 88692 - RNA, 22 nt, Homo sapiens
augugggaggaauguguuucca

SEQ ID NO: 88693 - RNA, 22 nt, Homo sapiens
auguguucaucacagcacaauu

SEQ ID NO: 88694 - RNA, 21 nt, Homo sapiens
auuaaugcucugguuagaggc

SEQ ID NO: 88695 - RNA, 22 nt, Homo sapiens
auuccauuuguuaucacacccg

SEQ ID NO: 88696 - RNA, 22 nt, Homo sapiens
auugaacuuacuaucuaaacua

SEQ ID NO: 88697 - RNA, 22 nt, Homo sapiens
auugcaauuaguccauagaguu

SEQ ID NO: 88698 - RNA, 19 nt, Homo sapiens
auugcaguguaaaacuauu

SEQ ID NO: 88699 - RNA, 22 nt, Homo sapiens
auuucuacuccuguguccagaa

SEQ ID NO: 88700 - RNA, 22 nt, Homo sapiens
auuuggcaacguagggaggcau

SEQ ID NO: 88701 - RNA, 22 nt, Homo sapiens
caaaggcuuccacugcauccuu

SEQ ID NO: 88702 - RNA, 22 nt, Homo sapiens
caaagucuauucuacccuuacc

SEQ ID NO: 88703 - RNA, 22 nt, Homo sapiens
caacucuguaggauccaggugg

SEQ ID NO: 88704 - RNA, 22 nt, Homo sapiens
caaggugcugagacaggagccc

SEQ ID NO: 88705 - RNA, 21 nt, Homo sapiens
caagugaugcuucugcuuuaa

SEQ ID NO: 88706 - RNA, 22 nt, Homo sapiens
cacaaaguagauuagucuucca

SEQ ID NO: 88707 - RNA, 22 nt, Homo sapiens
cacaaugucugguaggccacuu

SEQ ID NO: 88708 - RNA, 22 nt, Homo sapiens
cacagugaacaauauccucugu

SEQ ID NO: 88709 - RNA, 22 nt, Homo sapiens
cacagugaacugguggguuuuu

SEQ ID NO: 88710 - RNA, 22 nt, Homo sapiens
cacugggccaucacuuaauauu

SEQ ID NO: 88711 - RNA, 22 nt, Homo sapiens
cagagcaaugcuuuugcuuuga

SEQ ID NO: 88712 - RNA, 22 nt, Homo sapiens
cagagugcauguuuagaugagu

SEQ ID NO: 88713 - RNA, 22 nt, Homo sapiens
cagccggguggcuccuagggua

SEQ ID NO: 88714 - RNA, 22 nt, Homo sapiens
cagcugaugucgaaugcacucu

SEQ ID NO: 88715 - RNA, 22 nt, Homo sapiens
cagguacauuuuaaagggcuca

SEQ ID NO: 88716 - RNA, 22 nt, Homo sapiens
caggugcauuggcugacaccug

SEQ ID NO: 88717 - RNA, 20 nt, Homo sapiens
cagucauagacaucagaguc

SEQ ID NO: 88718 - RNA, 20 nt, Homo sapiens
cagugcacuuucccacuggu

SEQ ID NO: 88719 - RNA, 22 nt, Homo sapiens
cagugcauagaugugccacauu

SEQ ID NO: 88720 - RNA, 22 nt, Homo sapiens
caguuacuugacacaaccaauu

SEQ ID NO: 88721 - RNA, 22 nt, Homo sapiens
cauacagcuaguaaguguaaga

SEQ ID NO: 88722 - RNA, 23 nt, Homo sapiens
caucacagagccuuccuugacuc

SEQ ID NO: 88723 - RNA, 22 nt, Homo sapiens
caucacuuugccuccgucucua

SEQ ID NO: 88724 - RNA, 22 nt, Homo sapiens
cauggauuuuuuugaauggcag

SEQ ID NO: 88725 - RNA, 22 nt, Homo sapiens
cauggcacagagaauguguucu

SEQ ID NO: 88726 - RNA, 22 nt, Homo sapiens
cauggcauuugcagaguugaaa

SEQ ID NO: 88727 - RNA, 22 nt, Homo sapiens
cauggcuuuauuuucagcuucu

SEQ ID NO: 88728 - RNA, 22 nt, Homo sapiens
cauggcuuuuauaacaagaaau

SEQ ID NO: 88729 - RNA, 22 nt, Homo sapiens
caugggacugucuuggcuauac

SEQ ID NO: 88730 - RNA, 22 nt, Homo sapiens
caugucuuuuauucugugugau

SEQ ID NO: 88731 - RNA, 20 nt, Homo sapiens
cauuccacuuuccugucagu

SEQ ID NO: 88732 - RNA, 22 nt, Homo sapiens
cauugcacacauuuaccuaugu

SEQ ID NO: 88733 - RNA, 23 nt, Homo sapiens
ccacaaugguugaacuagauuac

SEQ ID NO: 88734 - RNA, 22 nt, Homo sapiens
ccacaguggauuaaaguuacug

SEQ ID NO: 88735 - RNA, 22 nt, Homo sapiens
ccacuguuuaaauggcugagga

SEQ ID NO: 88736 - RNA, 22 nt, Homo sapiens
ccagcaccauuuguugaauagg

SEQ ID NO: 88737 - RNA, 22 nt, Homo sapiens
ccagugcugugcaguguaugag

SEQ ID NO: 88738 - RNA, 22 nt, Homo sapiens
ccaguucaaugauauggaaacu

SEQ ID NO: 88739 - RNA, 22 nt, Homo sapiens
cccagaguucuuaaauacugag

SEQ ID NO: 88740 - RNA, 22 nt, Homo sapiens
ccccagguuucaauaaagccca

SEQ ID NO: 88741 - RNA, 22 nt, Homo sapiens
cccugagcagccugaguuuccc

SEQ ID NO: 88742 - RNA, 22 nt, Homo sapiens
ccucaguguuuaucauuauuuu

SEQ ID NO: 88743 - RNA, 22 nt, Homo sapiens
ccugcauaguucaccgcugaua

SEQ ID NO: 88744 - RNA, 22 nt, Homo sapiens
cgaggaguaucuuugugguguu

SEQ ID NO: 88745 - RNA, 22 nt, Homo sapiens
cgccugagcugaggaagcugca

SEQ ID NO: 88746 - RNA, 22 nt, Homo sapiens
cuaaagugcuuaaaaucucauu

SEQ ID NO: 88747 - RNA, 22 nt, Homo sapiens
cuacaguguauuuauggagggu

SEQ ID NO: 88748 - RNA, 22 nt, Homo sapiens
cuagaguagaguuuccuuagga

SEQ ID NO: 88749 - RNA, 22 nt, Homo sapiens
cuagauuauccaacuuauuagc

SEQ ID NO: 88750 - RNA, 22 nt, Homo sapiens
cuagcuccauauaaagcaggau

SEQ ID NO: 88751 - RNA, 22 nt, Homo sapiens
cuagugcaauccuuugauggua

SEQ ID NO: 88752 - RNA, 22 nt, Homo sapiens
cucacugucaacauguauuugg

SEQ ID NO: 88753 - RNA, 22 nt, Homo sapiens
cucagugaagggcaagaggcaa

SEQ ID NO: 88754 - RNA, 22 nt, Homo sapiens
cucaguguuucagcugcucaga

SEQ ID NO: 88755 - RNA, 19 nt, Homo sapiens
cucauggagaaggagaaua

SEQ ID NO: 88756 - RNA, 22 nt, Homo sapiens
cucauugcaaucucugccuccc

SEQ ID NO: 88757 - RNA, 22 nt, Homo sapiens
cuccaggugucauccaccuccu

SEQ ID NO: 88758 - RNA, 22 nt, Homo sapiens
cucugguucugcagugcacccu

SEQ ID NO: 88759 - RNA, 22 nt, Homo sapiens
cucugguuucgcaggaaauaga

SEQ ID NO: 88760 - RNA, 22 nt, Homo sapiens
gucucccagccuacauauuucu

SEQ ID NO: 88761 - RNA, 22 nt, Homo sapiens
gucugcaugucauaugauagua

SEQ ID NO: 88762 - RNA, 22 nt, Homo sapiens
gucugguuccugggagauuucu

SEQ ID NO: 88763 - RNA, 22 nt, Homo sapiens
gucugguugacagcauguggcc

SEQ ID NO: 88764 - RNA, 22 nt, Homo sapiens
gucuuuggaaagacaaaguuca

SEQ ID NO: 88765 - RNA, 22 nt, Homo sapiens
gugaaaagaugagcaccauaca

SEQ ID NO: 88766 - RNA, 17 nt, Homo sapiens
gugaaaucaucauuuuu

SEQ ID NO: 88767 - RNA, 22 nt, Homo sapiens
gugaccagaugggcaggggugu

SEQ ID NO: 88768 - RNA, 22 nt, Homo sapiens
gugagaccaauguacuaccuuc

SEQ ID NO: 88769 - RNA, 22 nt, Homo sapiens
gugaggucagggcuguggacag

SEQ ID NO: 88770 - RNA, 22 nt, Homo sapiens
gugauugucuaaucaagauaca

SEQ ID NO: 88771 - RNA, 22 nt, Homo sapiens
gugauugugaaaacauuaagaa

SEQ ID NO: 88772 - RNA, 22 nt, Homo sapiens
gugauuguuaaacugccucucu

SEQ ID NO: 88773 - RNA, 22 nt, Homo sapiens
gugcaaguguaauacagcuagg

SEQ ID NO: 88774 - RNA, 22 nt, Homo sapiens
gugcacaacaugcagguuuguu

SEQ ID NO: 88775 - RNA, 22 nt, Homo sapiens
gugcacaacgugcagguuaguu

SEQ ID NO: 88776 - RNA, 22 nt, Homo sapiens
gugcacaacgugcagguuuguu

SEQ ID NO: 88777 - RNA, 21 nt, Homo sapiens
gugcagaugccacagucacuc

SEQ ID NO: 88778 - RNA, 19 nt, Homo sapiens
gugcauaguuauuaaagag

SEQ ID NO: 88779 - RNA, 22 nt, Homo sapiens
gugccuucuagcuaugguuggc

SEQ ID NO: 88780 - RNA, 22 nt, Homo sapiens
guggacggagguugcagugagc

SEQ ID NO: 88781 - RNA, 22 nt, Homo sapiens
guggaggacuggauaaagaaaa

SEQ ID NO: 88782 - RNA, 22 nt, Homo sapiens
guggaggagaaagaagcauuuc

SEQ ID NO: 88783 - RNA, 22 nt, Homo sapiens
guggcagagucagagggaaaug

SEQ ID NO: 88784 - RNA, 22 nt, Homo sapiens
guggcuaaagauuuggaaucug

SEQ ID NO: 88785 - RNA, 22 nt, Homo sapiens
gugguuguuggaguggcaauuu

SEQ ID NO: 88786 - RNA, 22 nt, Homo sapiens
guguaaaacaauuagaggauuu

SEQ ID NO: 88787 - RNA, 22 nt, Homo sapiens
guguaaguccugaguuuggaua

SEQ ID NO: 88788 - RNA, 22 nt, Homo sapiens
guguaugguaggaugacggagu

SEQ ID NO: 88789 - RNA, 22 nt, Homo sapiens
gugucacugugaggauauugua

SEQ ID NO: 88790 - RNA, 22 nt, Homo sapiens
aguaaauuucugugcuuucaua

SEQ ID NO: 88791 - RNA, 22 nt, Homo sapiens
aguacacuguugaacagaagug

SEQ ID NO: 88792 - RNA, 22 nt, Homo sapiens
agucugguguucucacacuagu

SEQ ID NO: 88793 - RNA, 22 nt, Homo sapiens
agugacuagaauaugaauuuua

SEQ ID NO: 88794 - RNA, 22 nt, Homo sapiens
agugcacucuuuccucucuuac

SEQ ID NO: 88795 - RNA, 22 nt, Homo sapiens
aguuggccccuacugggaggug

SEQ ID NO: 88796 - RNA, 22 nt, Homo sapiens
auaaaagcaggucuaggucagg

SEQ ID NO: 88797 - RNA, 22 nt, Homo sapiens
auaaacagcuuauccucuauuc

SEQ ID NO: 88798 - RNA, 22 nt, Homo sapiens
auaacagcauuauugcauacgu

SEQ ID NO: 88799 - RNA, 22 nt, Homo sapiens
auaacucuguuuuuuucaugca

SEQ ID NO: 88800 - RNA, 22 nt, Homo sapiens
auaaggaguaucauauuaaaac

SEQ ID NO: 88801 - RNA, 22 nt, Homo sapiens
auaagugcuuguugaauaauag

SEQ ID NO: 88802 - RNA, 22 nt, Homo sapiens
auacaagcaguccaacuccaua

SEQ ID NO: 88803 - RNA, 22 nt, Homo sapiens
auacaaguuauuugaacugcgg

SEQ ID NO: 88804 - RNA, 22 nt, Homo sapiens
auagcagacauuucaaggcagg

SEQ ID NO: 88805 - RNA, 22 nt, Homo sapiens
auagguagcauagcaggaauau

SEQ ID NO: 88806 - RNA, 22 nt, Homo sapiens
auaguagagagggcaaaaugcu

SEQ ID NO: 88807 - RNA, 22 nt, Homo sapiens
auauguaguuucagaaguggaa

SEQ ID NO: 88808 - RNA, 22 nt, Homo sapiens
auauuacuggcuauaucgcaag

SEQ ID NO: 88809 - RNA, 22 nt, Homo sapiens
auauuagcacuaaugucacgau

SEQ ID NO: 88810 - RNA, 22 nt, Homo sapiens
aucaaagugaauuaaugagaau

SEQ ID NO: 88811 - RNA, 22 nt, Homo sapiens
aucacaauuguacguaggagcc

SEQ ID NO: 88812 - RNA, 22 nt, Homo sapiens
aucacacuguuauuuuaguuaa

SEQ ID NO: 88813 - RNA, 22 nt, Homo sapiens
aucacaggcaaaauuccuucuc

SEQ ID NO: 88814 - RNA, 22 nt, Homo sapiens
aucacauuuauaguggcacgca

SEQ ID NO: 88815 - RNA, 22 nt, Homo sapiens
aucacuuucuauuucugugcca

SEQ ID NO: 88816 - RNA, 22 nt, Homo sapiens
aucacuuugcucuccagugugg

SEQ ID NO: 88817 - RNA, 20 nt, Homo sapiens
aucagagccggugaaagggc

SEQ ID NO: 88818 - RNA, 22 nt, Homo sapiens
aucauguaguaagacacauuua

SEQ ID NO: 88819 - RNA, 22 nt, Homo sapiens
auccauguggauaaauguguau

SEQ ID NO: 88820 - RNA, 22 nt, Homo sapiens
aucgcgccauuguacuccagcc

SEQ ID NO: 88821 - RNA, 22 nt, Homo sapiens
aucucagagaaaauuacuaaga

SEQ ID NO: 88822 - RNA, 22 nt, Homo sapiens
aucuuuaguggcuguuuucaga

SEQ ID NO: 88823 - RNA, 22 nt, Homo sapiens
augaaauugcuaucgcaguacu

SEQ ID NO: 88824 - RNA, 22 nt, Homo sapiens
augacagagauaugugaauuuu

SEQ ID NO: 88825 - RNA, 22 nt, Homo sapiens
augacagcaucugugaaguugu

SEQ ID NO: 88826 - RNA, 22 nt, Homo sapiens
augacuggauaauggacacaca

SEQ ID NO: 88827 - RNA, 22 nt, Homo sapiens
augacuuuucugaaaaccacca

SEQ ID NO: 88828 - RNA, 22 nt, Homo sapiens
augagauauuuuauaagaucau

SEQ ID NO: 88829 - RNA, 22 nt, Homo sapiens
augagggagggguggugccgca

SEQ ID NO: 88830 - RNA, 22 nt, Homo sapiens
augagguguuuauuguauccug

SEQ ID NO: 88831 - RNA, 22 nt, Homo sapiens
augauguccacagggguguuca

SEQ ID NO: 88832 - RNA, 20 nt, Homo sapiens
augcaaacccugcuuugugg

SEQ ID NO: 88833 - RNA, 22 nt, Homo sapiens
augcacuuggcaggaugauucc

SEQ ID NO: 88834 - RNA, 22 nt, Homo sapiens
auggaaacauaagaguauagau

SEQ ID NO: 88835 - RNA, 21 nt, Homo sapiens
auggaaagacugccucuucaa

SEQ ID NO: 88836 - RNA, 19 nt, Homo sapiens
auggaacugcuggagccac

SEQ ID NO: 88837 - RNA, 22 nt, Homo sapiens
auggaaucauccuccugggagc

SEQ ID NO: 88838 - RNA, 22 nt, Homo sapiens
auggacuuuuuguucagugucu

SEQ ID NO: 88839 - RNA, 22 nt, Homo sapiens
auggagagaauuauucucucag

SEQ ID NO: 88840 - RNA, 22 nt, Homo sapiens
auggaggccuacagaauuuugg

SEQ ID NO: 88841 - RNA, 22 nt, Homo sapiens
auggaucauauucuugaggagg

SEQ ID NO: 88842 - RNA, 22 nt, Homo sapiens
auggcaaugcgaugaugacuga

SEQ ID NO: 88843 - RNA, 22 nt, Homo sapiens
auggcagaaucaagccgacagc

SEQ ID NO: 88844 - RNA, 22 nt, Homo sapiens
auggccuuguauaccuggcaaa

SEQ ID NO: 88845 - RNA, 22 nt, Homo sapiens
auggcuuucaggacguggcgag

SEQ ID NO: 88846 - RNA, 22 nt, Homo sapiens
auggcuuuggucucccagugau

SEQ ID NO: 88847 - RNA, 22 nt, Homo sapiens
auggcuuuucacagaggguucu

SEQ ID NO: 88848 - RNA, 22 nt, Homo sapiens
auggcuuuuccugucuugcaug

SEQ ID NO: 88849 - RNA, 22 nt, Homo sapiens
auggcuuuuuaaaucauguugu

SEQ ID NO: 88850 - RNA, 22 nt, Homo sapiens
augguuugugcuccuauaagaa

SEQ ID NO: 88851 - RNA, 17 nt, Homo sapiens
augugaauguucaaaua

SEQ ID NO: 88852 - RNA, 22 nt, Homo sapiens
augugcaacugcuggaacaguc

SEQ ID NO: 88853 - RNA, 23 nt, Homo sapiens
auuaagguuacuacaguaugagg

SEQ ID NO: 88854 - RNA, 22 nt, Homo sapiens
auucaaggagucuucgucccaa

SEQ ID NO: 88855 - RNA, 22 nt, Homo sapiens
ucacagauaaauaaagaugauu

SEQ ID NO: 88856 - RNA, 20 nt, Homo sapiens
ucacagucacacauaauccu

SEQ ID NO: 88857 - RNA, 22 nt, Homo sapiens
ucacagugaguggaguggggug

SEQ ID NO: 88858 - RNA, 18 nt, Homo sapiens
ucacggggagcagcagcc

SEQ ID NO: 88859 - RNA, 22 nt, Homo sapiens
ucacuauugacaacagugugga

SEQ ID NO: 88860 - RNA, 22 nt, Homo sapiens
ucacugagcacaggagaugugc

SEQ ID NO: 88861 - RNA, 22 nt, Homo sapiens
ucacuuugacggccaacuucua

SEQ ID NO: 88862 - RNA, 22 nt, Homo sapiens
ucagcaaugaccuaagcaaaua

SEQ ID NO: 88863 - RNA, 20 nt, Homo sapiens
ucagcagucuggagcagagg

SEQ ID NO: 88864 - RNA, 22 nt, Homo sapiens
ucaguggagcuacaauucuggg

SEQ ID NO: 88865 - RNA, 22 nt, Homo sapiens
ucaguggauuuaaccugaauca

SEQ ID NO: 88866 - RNA, 18 nt, Homo sapiens
ucauagaucaugacagug

SEQ ID NO: 88867 - RNA, 22 nt, Homo sapiens
ucauaguagucacuuaauaaau

SEQ ID NO: 88868 - RNA, 22 nt, Homo sapiens
ucaugacacagcauacugacuu

SEQ ID NO: 88869 - RNA, 22 nt, Homo sapiens
ucauggcuuuuauuauguugag

SEQ ID NO: 88870 - RNA, 19 nt, Homo sapiens
uccacagugguugaacuag

SEQ ID NO: 88871 - RNA, 22 nt, Homo sapiens
uccacagugguugaacuaguaa

SEQ ID NO: 88872 - RNA, 22 nt, Homo sapiens
ucccacugucuucucgugcucg

SEQ ID NO: 88873 - RNA, 22 nt, Homo sapiens
ucccaguauucauuuacagaag

SEQ ID NO: 88874 - RNA, 22 nt, Homo sapiens
ucccagugaaaccccaccuuca

SEQ ID NO: 88875 - RNA, 22 nt, Homo sapiens
ucccaguggucuugaaacaggg

SEQ ID NO: 88876 - RNA, 22 nt, Homo sapiens
ucccaguguguagcuugucucu

SEQ ID NO: 88877 - RNA, 22 nt, Homo sapiens
uccugagacucacaggcucccc

SEQ ID NO: 88878 - RNA, 22 nt, Homo sapiens
uccuucauuugucaacucuagu

SEQ ID NO: 88879 - RNA, 22 nt, Homo sapiens
uccuuugguuauaggcaccucu

SEQ ID NO: 88880 - RNA, 19 nt, Homo sapiens
ucgcgccauucuccugccu

SEQ ID NO: 88881 - RNA, 22 nt, Homo sapiens
ucguucuugucaguuuauaaag

SEQ ID NO: 88882 - RNA, 22 nt, Homo sapiens
ucucaaccuccacacuacaaua

SEQ ID NO: 88883 - RNA, 22 nt, Homo sapiens
uugcaugcuccuuaugagaauc

SEQ ID NO: 88884 - RNA, 22 nt, Homo sapiens
uugccgggugcaguggcucaug

SEQ ID NO: 88885 - RNA, 22 nt, Homo sapiens
uuggaaaaauccaccuugaucu

SEQ ID NO: 88886 - RNA, 22 nt, Homo sapiens
uuggaaacgucaccuuuuccuu

SEQ ID NO: 88887 - RNA, 22 nt, Homo sapiens
uuggaugauaaagaagccuaag

SEQ ID NO: 88888 - RNA, 22 nt, Homo sapiens
uuggcaagcuguuaauuauaaa

SEQ ID NO: 88889 - RNA, 22 nt, Homo sapiens
uugggauaaucacaaaguaaaa

SEQ ID NO: 88890 - RNA, 22 nt, Homo sapiens
uugguaaucccuagugucuaga

SEQ ID NO: 88891 - RNA, 21 nt, Homo sapiens
uuggucuucucugugauucuu

SEQ ID NO: 88892 - RNA, 22 nt, Homo sapiens
uuguaaaguucucucccgaaaa

SEQ ID NO: 88893 - RNA, 22 nt, Homo sapiens
uuguauccaucuuucaggcaac

SEQ ID NO: 88894 - RNA, 22 nt, Homo sapiens
uugucauuuucagaguguuacg

SEQ ID NO: 88895 - RNA, 22 nt, Homo sapiens
uugucuugcagcuuaggcauca

SEQ ID NO: 88896 - RNA, 22 nt, Homo sapiens
uugugcuugauuugccuagcug

SEQ ID NO: 88897 - RNA, 22 nt, Homo sapiens
uuguuauguuggucaguaaugu

SEQ ID NO: 88898 - RNA, 22 nt, Homo sapiens
uuuaaaguuagaaggaaagggc

SEQ ID NO: 88899 - RNA, 22 nt, Homo sapiens
uuuaaugcgucucugaguuuug

SEQ ID NO: 88900 - RNA, 23 nt, Homo sapiens
uuucacagaaggauuguagggcc

SEQ ID NO: 88901 - RNA, 17 nt, Homo sapiens
uuucagaguggaagugu

SEQ ID NO: 88902 - RNA, 20 nt, Homo sapiens
uuucaguacuuucuacuggc

SEQ ID NO: 88903 - RNA, 22 nt, Homo sapiens
uuucauggagaaucuucuuacu

SEQ ID NO: 88904 - RNA, 22 nt, Homo sapiens
uuugaaccauuugaagaaugau

SEQ ID NO: 88905 - RNA, 22 nt, Homo sapiens
uuugaguaggcuuauauuuugg

SEQ ID NO: 88906 - RNA, 22 nt, Homo sapiens
uuugcaguuuauuccuggggcu

SEQ ID NO: 88907 - RNA, 22 nt, Homo sapiens
uuugccaauauuuuacugagga

SEQ ID NO: 88908 - RNA, 22 nt, Homo sapiens
uuuggucuuuuguaaguuaucu

SEQ ID NO: 88909 - RNA, 22 nt, Homo sapiens
uuugucuccuaagacucugugg

SEQ ID NO: 88910 - RNA, 22 nt, Homo sapiens
uuugugaaugucauaagcucca

SEQ ID NO: 88911 - RNA, 22 nt, Homo sapiens
uuugugauugcacacucaagau

SEQ ID NO: 88912 - RNA, 23 nt, Homo sapiens
uuugugcuaauuuaugggcucuu

SEQ ID NO: 88913 - RNA, 22 nt, Homo sapiens
uuuguguggccuuggccuggca

SEQ ID NO: 88914 - RNA, 22 nt, Homo sapiens
uuugugugugauuauaaaaggu

SEQ ID NO: 88915 - RNA, 22 nt, Homo sapiens
uuuuacacuguugguuggaaug

SEQ ID NO: 88916 - RNA, 20 nt, Homo sapiens
uuuuagcacuuguuauggug

SEQ ID NO: 88917 - RNA, 20 nt, Homo sapiens
uuuuagcuuuuauugaaagc

SEQ ID NO: 88918 - RNA, 22 nt, Homo sapiens
uuuucaguuuuccagguagccg

SEQ ID NO: 88919 - RNA, 22 nt, Homo sapiens
uuuugcucuucggaagagcuug

SEQ ID NO: 88920 - RNA, 20 nt, Homo sapiens
uuuuggacuaaaggcauccc

SEQ ID NO: 88921 - RNA, 22 nt, Homo sapiens
uuuuggacuucaauuugacacu

SEQ ID NO: 88922 - RNA, 22 nt, Homo sapiens
uuuuuggaggagguuagaucau

SEQ ID NO: 88923 - RNA, 22 nt, Homo sapiens
ugauaacauugggggaagcuga

SEQ ID NO: 88924 - RNA, 22 nt, Homo sapiens
ugauauauugaaugaugaaaca

SEQ ID NO: 88925 - RNA, 22 nt, Homo sapiens
ugaugacacugauuucuucaau

SEQ ID NO: 88926 - RNA, 22 nt, Homo sapiens
ugcaccaucuugcuucuguggu

SEQ ID NO: 88927 - RNA, 22 nt, Homo sapiens
ugcagagaaacauuuuguauuu

SEQ ID NO: 88928 - RNA, 22 nt, Homo sapiens
ugcagagucuguccugccugcc

SEQ ID NO: 88929 - RNA, 22 nt, Homo sapiens
ugcagugcaugacuguguuaug

SEQ ID NO: 88930 - RNA, 22 nt, Homo sapiens
ugcauauuuuauaaagauggaa

SEQ ID NO: 88931 - RNA, 22 nt, Homo sapiens
ugccagagacguagggaauauu

SEQ ID NO: 88932 - RNA, 22 nt, Homo sapiens
ugccuaggcuggagugcagugg

SEQ ID NO: 88933 - RNA, 22 nt, Homo sapiens
ugccuaggcuggaguguagugg

SEQ ID NO: 88934 - RNA, 22 nt, Homo sapiens
ugccuaguagaaggugaacaug

SEQ ID NO: 88935 - RNA, 22 nt, Homo sapiens
ugccuaguggaaggagagcaaa

SEQ ID NO: 88936 - RNA, 22 nt, Homo sapiens
ugcuauagcuauaucaucuccu

SEQ ID NO: 88937 - RNA, 20 nt, Homo sapiens
ugcugcacuuaagcaugggc

SEQ ID NO: 88938 - RNA, 21 nt, Homo sapiens
ugcugcacuucuuuugcugug

SEQ ID NO: 88939 - RNA, 22 nt, Homo sapiens
ugcugguauuauguuauccaga

SEQ ID NO: 88940 - RNA, 22 nt, Homo sapiens
ugcugguuuucaucaucagugg

SEQ ID NO: 88941 - RNA, 20 nt, Homo sapiens
uggaaggcaucugcauuauu

SEQ ID NO: 88942 - RNA, 22 nt, Homo sapiens
uggaauacaugucgcugagcug

SEQ ID NO: 88943 - RNA, 22 nt, Homo sapiens
uggaaucaucaacgaaugaaau

SEQ ID NO: 88944 - RNA, 20 nt, Homo sapiens
uggaaucuaggcggagguuu

SEQ ID NO: 88945 - RNA, 21 nt, Homo sapiens
uggaaucuauagaggcaguag

SEQ ID NO: 88946 - RNA, 18 nt, Homo sapiens
uggaauguuuggguuaau

SEQ ID NO: 88947 - RNA, 22 nt, Homo sapiens
uggaucauucuuucuugcaggg

SEQ ID NO: 88948 - RNA, 22 nt, Homo sapiens
uugcaucagcaggcauaauugg

SEQ ID NO: 88949 - RNA, 22 nt, Homo sapiens
uugccuaggcuggaguguggug

SEQ ID NO: 88950 - RNA, 22 nt, Homo sapiens
uuggaagcacauuguuuaauua

SEQ ID NO: 88951 - RNA, 22 nt, Homo sapiens
uuggaagcaugguuauugacgu

SEQ ID NO: 88952 - RNA, 22 nt, Homo sapiens
uuggaaggcuccuaaugaaugg

SEQ ID NO: 88953 - RNA, 23 nt, Homo sapiens
uuggaaugagaccuaagaguuuu

SEQ ID NO: 88954 - RNA, 22 nt, Homo sapiens
uuggaaugcacacugagccugc

SEQ ID NO: 88955 - RNA, 22 nt, Homo sapiens
uuggaccacuugauuucugguc

SEQ ID NO: 88956 - RNA, 22 nt, Homo sapiens
uuggauuauaaacugagauuug

SEQ ID NO: 88957 - RNA, 19 nt, Homo sapiens
uuggcagaguugcccccua

SEQ ID NO: 88958 - RNA, 22 nt, Homo sapiens
uuggcaguaucuacuacagcua

SEQ ID NO: 88959 - RNA, 22 nt, Homo sapiens
uuggccuccuggucauauccag

SEQ ID NO: 88960 - RNA, 23 nt, Homo sapiens
uuggccuccuugugucuagggcu

SEQ ID NO: 88961 - RNA, 22 nt, Homo sapiens
uuggcucuggcugggcuccagc

SEQ ID NO: 88962 - RNA, 22 nt, Homo sapiens
uuggcuuaguugaccacagucu

SEQ ID NO: 88963 - RNA, 22 nt, Homo sapiens
uuggcuuuuaugcagcuuaggu

SEQ ID NO: 88964 - RNA, 22 nt, Homo sapiens
uugggacccuguccuguaacaa

SEQ ID NO: 88965 - RNA, 22 nt, Homo sapiens
uugguaagguggaugaugaaua

SEQ ID NO: 88966 - RNA, 22 nt, Homo sapiens
uuguacuagucauauuuugaaa

SEQ ID NO: 88967 - RNA, 22 nt, Homo sapiens
uuguauguuucugugcacauga

SEQ ID NO: 88968 - RNA, 18 nt, Homo sapiens
uugugccugagaaggugg

SEQ ID NO: 88969 - RNA, 19 nt, Homo sapiens
uugugggaggacagagggg

SEQ ID NO: 88970 - RNA, 22 nt, Homo sapiens
uuguguuuuuaguagggaaggg

SEQ ID NO: 88971 - RNA, 22 nt, Homo sapiens
uuguucccuucuggcuuuuaug

SEQ ID NO: 88972 - RNA, 22 nt, Homo sapiens
uuguuuuggagaugagcuaaaa

SEQ ID NO: 88973 - RNA, 22 nt, Homo sapiens
uuuaaagcaugacgagaagaag

SEQ ID NO: 88974 - RNA, 23 nt, Homo sapiens
uuuaagcuucauguccuaacauc

SEQ ID NO: 88975 - RNA, 22 nt, Homo sapiens
uuuaaugcacuaggugguguuc

SEQ ID NO: 88976 - RNA, 22 nt, Homo sapiens
uuuaggcaugcaguucuauuua

SEQ ID NO: 88977 - RNA, 22 nt, Homo sapiens
uuuagguaauauuaaguagcug

SEQ ID NO: 88978 - RNA, 22 nt, Homo sapiens
aaaagucuguagugaaagguga

SEQ ID NO: 88979 - RNA, 22 nt, Homo sapiens
aaacucuguagcagagacagau

SEQ ID NO: 88980 - RNA, 20 nt, Homo sapiens
aaacucugucuucuuuauca

SEQ ID NO: 88981 - RNA, 22 nt, Homo sapiens
aaacuugucuaauuauaagcau

SEQ ID NO: 88982 - RNA, 22 nt, Homo sapiens
aaaggcacacacuccuuguuau

SEQ ID NO: 88983 - RNA, 22 nt, Homo sapiens
aaaggcuucggaucagaaggua

SEQ ID NO: 88984 - RNA, 22 nt, Homo sapiens
aaagugcugagacagacuggga

SEQ ID NO: 88985 - RNA, 22 nt, Homo sapiens
aaaguucuguugauagugcuga

SEQ ID NO: 88986 - RNA, 22 nt, Homo sapiens
aaaugcaugaauaagcucgugu

SEQ ID NO: 88987 - RNA, 22 nt, Homo sapiens
aaaugcauggacagcuggucuu

SEQ ID NO: 88988 - RNA, 22 nt, Homo sapiens
aaaugcccuaaaauggagcauc

SEQ ID NO: 88989 - RNA, 20 nt, Homo sapiens
aaaugcuguaauguuuggga

SEQ ID NO: 88990 - RNA, 22 nt, Homo sapiens
aaauugcuuuugaagacuuagu

SEQ ID NO: 88991 - RNA, 22 nt, Homo sapiens
aacacuguuuccagucaugauc

SEQ ID NO: 88992 - RNA, 22 nt, Homo sapiens
aacagaauccucuuuuccuggg

SEQ ID NO: 88993 - RNA, 22 nt, Homo sapiens
aacagacugucacauaaaauug

SEQ ID NO: 88994 - RNA, 22 nt, Homo sapiens
aacagugcauucagggauauau

SEQ ID NO: 88995 - RNA, 22 nt, Homo sapiens
aacaguguuuuggguuuucugg

SEQ ID NO: 88996 - RNA, 22 nt, Homo sapiens
aacuacaucucuuugaggcagg

SEQ ID NO: 88997 - RNA, 22 nt, Homo sapiens
aacugcuguuuggguacuggug

SEQ ID NO: 88998 - RNA, 22 nt, Homo sapiens
aacugguauuucccaugaauuu

SEQ ID NO: 88999 - RNA, 20 nt, Homo sapiens
aagcagacauuuggaugaaa

SEQ ID NO: 89000 - RNA, 22 nt, Homo sapiens
aaggagcagagagcccuguuuc

SEQ ID NO: 89001 - RNA, 22 nt, Homo sapiens
aaggcaugcaguacguuucuau

SEQ ID NO: 89002 - RNA, 22 nt, Homo sapiens
aaggcaugcugaguccuaaaag

SEQ ID NO: 89003 - RNA, 22 nt, Homo sapiens
aagguucuugcuugcaugacug

SEQ ID NO: 89004 - RNA, 19 nt, Homo sapiens
aagugaaugcuuuguucac

SEQ ID NO: 89005 - RNA, 22 nt, Homo sapiens
aagugaauguuugguagcagug

SEQ ID NO: 89006 - RNA, 22 nt, Homo sapiens
aagugaguaauacgucaguugu

SEQ ID NO: 89007 - RNA, 22 nt, Homo sapiens
aagugagugacaaaaacugggc

SEQ ID NO: 89008 - RNA, 20 nt, Homo sapiens
aagugaguguuaaacugaac

SEQ ID NO: 89009 - RNA, 22 nt, Homo sapiens
aagugccauguggaugggcccu

SEQ ID NO: 89010 - RNA, 22 nt, Homo sapiens
aagugcuuacagggaacaugau

SEQ ID NO: 89011 - RNA, 22 nt, Homo sapiens
aagugcuuuguacagggguuga

SEQ ID NO: 89012 - RNA, 22 nt, Homo sapiens
aauaaaguaggaggugaggaaa

SEQ ID NO: 89013 - RNA, 22 nt, Homo sapiens
aaucacaguuaguaagggagaa

SEQ ID NO: 89014 - RNA, 22 nt, Homo sapiens
aaucacauugaaucugcuaccu

SEQ ID NO: 89015 - RNA, 22 nt, Homo sapiens
aaucagagcccucugagcuuca

SEQ ID NO: 89016 - RNA, 22 nt, Homo sapiens
aaucagcacacugugcuuucca

SEQ ID NO: 89017 - RNA, 22 nt, Homo sapiens
aaucugucuuuuguuauugagg

SEQ ID NO: 89018 - RNA, 22 nt, Homo sapiens
aaugacagccagauucuucucu

SEQ ID NO: 89019 - RNA, 22 nt, Homo sapiens
aaugauauguuauguuuagguu

SEQ ID NO: 89020 - RNA, 22 nt, Homo sapiens
aaugccuagugugugacaggug

SEQ ID NO: 89021 - RNA, 22 nt, Homo sapiens
aauggcaucuagaguggugaau

SEQ ID NO: 89022 - RNA, 22 nt, Homo sapiens
aauggcauuugccagggcaaag

SEQ ID NO: 89023 - RNA, 22 nt, Homo sapiens
aaugucaugaguccaaccagaa

SEQ ID NO: 89024 - RNA, 22 nt, Homo sapiens
aauugaaugcagaugccaggga

SEQ ID NO: 89025 - RNA, 22 nt, Homo sapiens
ucucaauuugauuacauucaua

SEQ ID NO: 89026 - RNA, 22 nt, Homo sapiens
ucucagcacaaacaaaauugcu

SEQ ID NO: 89027 - RNA, 22 nt, Homo sapiens
ucucagugaaauaaauuauuuu

SEQ ID NO: 89028 - RNA, 22 nt, Homo sapiens
ucucagugaauguggaaaaagc

SEQ ID NO: 89029 - RNA, 22 nt, Homo sapiens
ucucaguggugcuggcagggga

SEQ ID NO: 89030 - RNA, 20 nt, Homo sapiens
ucucauggagggaaagagca

SEQ ID NO: 89031 - RNA, 22 nt, Homo sapiens
ucucauggagguagagaguaaa

SEQ ID NO: 89032 - RNA, 22 nt, Homo sapiens
ucuccggguggcggcgaaggga

SEQ ID NO: 89033 - RNA, 22 nt, Homo sapiens
ucucugagaaaaguuucuccca

SEQ ID NO: 89034 - RNA, 22 nt, Homo sapiens
ucugagaucaugucugugcugu

SEQ ID NO: 89035 - RNA, 22 nt, Homo sapiens
ucuggccuccuaugagaaucga

SEQ ID NO: 89036 - RNA, 21 nt, Homo sapiens
ucuggcuuucauuccccuucu

SEQ ID NO: 89037 - RNA, 22 nt, Homo sapiens
ucugguguuauucauguaguuu

SEQ ID NO: 89038 - RNA, 22 nt, Homo sapiens
ucugugaaaucauuuccuguaa

SEQ ID NO: 89039 - RNA, 22 nt, Homo sapiens
ucugugcauggcagaggaauga

SEQ ID NO: 89040 - RNA, 19 nt, Homo sapiens
ucugugcuugucccccugu

SEQ ID NO: 89041 - RNA, 21 nt, Homo sapiens
ucuguguugaucucacuggga

SEQ ID NO: 89042 - RNA, 22 nt, Homo sapiens
ucuguguugaugcucauuaauu

SEQ ID NO: 89043 - RNA, 22 nt, Homo sapiens
ucuguuguuguuuuaagagaca

SEQ ID NO: 89044 - RNA, 22 nt, Homo sapiens
ucuuagguaagaaauuuuaaca

SEQ ID NO: 89045 - RNA, 21 nt, Homo sapiens
ucuugguauguauuuaggagg

SEQ ID NO: 89046 - RNA, 22 nt, Homo sapiens
ucuuugauaagauccagaagaa

SEQ ID NO: 89047 - RNA, 22 nt, Homo sapiens
ucuuugauuaugcagauggguu

SEQ ID NO: 89048 - RNA, 22 nt, Homo sapiens
ucuuuggagacaaccccagucu

SEQ ID NO: 89049 - RNA, 22 nt, Homo sapiens
ucuuugguagaagcuauuuuau

SEQ ID NO: 89050 - RNA, 21 nt, Homo sapiens
ucuuuggucaccaguuuucau

SEQ ID NO: 89051 - RNA, 22 nt, Homo sapiens
ucuuuggucuacuuucauaugu

SEQ ID NO: 89052 - RNA, 22 nt, Homo sapiens
ucuuuggugaauggucauccag

SEQ ID NO: 89053 - RNA, 22 nt, Homo sapiens
ucuuugguuagguuuaguugau

SEQ ID NO: 89054 - RNA, 22 nt, Homo sapiens
ucuuugguucugugcagccuau

SEQ ID NO: 89055 - RNA, 22 nt, Homo sapiens
ucuuugguugcacugcaggugu

SEQ ID NO: 89056 - RNA, 22 nt, Homo sapiens
ugaaacacacauugcccuuuau

SEQ ID NO: 89057 - RNA, 22 nt, Homo sapiens
ugaaacacaccuccucuccauc

SEQ ID NO: 89058 - RNA, 22 nt, Homo sapiens
ugaaacauacacucugaugggg

SEQ ID NO: 89059 - RNA, 22 nt, Homo sapiens
ugaaaguuauauugugaaauuc

SEQ ID NO: 89060 - RNA, 22 nt, Homo sapiens
ugaaauacuuuggcucuuuguu

SEQ ID NO: 89061 - RNA, 22 nt, Homo sapiens
ugaaauggugcggucugcagca

SEQ ID NO: 89062 - RNA, 22 nt, Homo sapiens
ugaaauuauucuuaccaaggug

SEQ ID NO: 89063 - RNA, 22 nt, Homo sapiens
ugaacagucaucucucuuguau

SEQ ID NO: 89064 - RNA, 22 nt, Homo sapiens
ugaagugaaugguaaguaugcc

SEQ ID NO: 89065 - RNA, 22 nt, Homo sapiens
ugaaugcauggggccaagaagg

SEQ ID NO: 89066 - RNA, 22 nt, Homo sapiens
ugaauguaagaugucugcuggu

SEQ ID NO: 89067 - RNA, 22 nt, Homo sapiens
ugaauuguuucauucuuuacau

SEQ ID NO: 89068 - RNA, 22 nt, Homo sapiens
ugacagaggucuuuuaauagcu

SEQ ID NO: 89069 - RNA, 22 nt, Homo sapiens
ugacagcugaagauguugaacc

SEQ ID NO: 89070 - RNA, 22 nt, Homo sapiens
ugacauggugcucuuucaggca

SEQ ID NO: 89071 - RNA, 22 nt, Homo sapiens
ugacauguccaggugguccugu

SEQ ID NO: 89072 - RNA, 22 nt, Homo sapiens
ugacuauaggauaacaugcauu

SEQ ID NO: 89073 - RNA, 22 nt, Homo sapiens
ugagaucuuggaggcuuuguga

SEQ ID NO: 89074 - RNA, 19 nt, Homo sapiens
ugagaucuuuacuggguuu

SEQ ID NO: 89075 - RNA, 22 nt, Homo sapiens
ugagaugagaaucaguucuaau

SEQ ID NO: 89076 - RNA, 22 nt, Homo sapiens
ugagauggagucuugucgccua

SEQ ID NO: 89077 - RNA, 22 nt, Homo sapiens
ugagauguguccagaucuaguu

SEQ ID NO: 89078 - RNA, 21 nt, Homo sapiens
ugagauuaaguuguuuagaag

SEQ ID NO: 89079 - RNA, 22 nt, Homo sapiens
ugagauuaaucuuuaaguaaga

SEQ ID NO: 89080 - RNA, 22 nt, Homo sapiens
ugagcacagcgugugggagagc

SEQ ID NO: 89081 - RNA, 22 nt, Homo sapiens
ugagcagagaagugcccugcgc

SEQ ID NO: 89082 - RNA, 22 nt, Homo sapiens
ugagcuaagugccaauauuaau

SEQ ID NO: 89083 - RNA, 17 nt, Homo sapiens
ugagcuaugauccuguc

SEQ ID NO: 89084 - RNA, 20 nt, Homo sapiens
ugagcucaauuguugcaagu

SEQ ID NO: 89085 - RNA, 22 nt, Homo sapiens
ugagguaacagaagcgagcauu

SEQ ID NO: 89086 - RNA, 22 nt, Homo sapiens
ugaggucacuuguuuuaugcuu

SEQ ID NO: 89087 - RNA, 22 nt, Homo sapiens
ugaggucauguucugucagguu

SEQ ID NO: 89088 - RNA, 22 nt, Homo sapiens
ugaggugagggguuaggugcua

SEQ ID NO: 89089 - RNA, 22 nt, Homo sapiens
ugagguguauugggggaaauuc

SEQ ID NO: 89090 - RNA, 22 nt, Homo sapiens
ugagguguuauccagaguucuu

SEQ ID NO: 89091 - RNA, 22 nt, Homo sapiens
ugagguuauuuguucaagaagu

SEQ ID NO: 89092 - RNA, 22 nt, Homo sapiens
ugagguugaaggacauuuuuau

SEQ ID NO: 89093 - RNA, 22 nt, Homo sapiens
ugagguuggggucagggcuagc

SEQ ID NO: 89094 - RNA, 22 nt, Homo sapiens
ugagguugguauuacugucucu

SEQ ID NO: 89095 - RNA, 22 nt, Homo sapiens
ugagguuguccacuauaaucca

SEQ ID NO: 89096 - RNA, 22 nt, Homo sapiens
ugaguagaacaucaagucauac

SEQ ID NO: 89097 - RNA, 23 nt, Homo sapiens
ugaguaggugguuuuccccucac

SEQ ID NO: 89098 - RNA, 22 nt, Homo sapiens
ugaguaugaguucaggaaaggc

SEQ ID NO: 89099 - RNA, 22 nt, Homo sapiens
ugagucagucucacucugcugc

SEQ ID NO: 89100 - RNA, 22 nt, Homo sapiens
uggauggagaggcuugugaugc

SEQ ID NO: 89101 - RNA, 21 nt, Homo sapiens
uggcaaaaugggcaguggguu

SEQ ID NO: 89102 - RNA, 22 nt, Homo sapiens
uggcaagaacgaaauguagggu

SEQ ID NO: 89103 - RNA, 22 nt, Homo sapiens
uggcagcgugaauguggcugaa

SEQ ID NO: 89104 - RNA, 22 nt, Homo sapiens
uggcaguuuugauguggagaga

SEQ ID NO: 89105 - RNA, 22 nt, Homo sapiens
uggcauauaauauagaagacua

SEQ ID NO: 89106 - RNA, 22 nt, Homo sapiens
uggcauuuucucuguucuuaga

SEQ ID NO: 89107 - RNA, 22 nt, Homo sapiens
ugggcaagagagcaugacccug

SEQ ID NO: 89108 - RNA, 22 nt, Homo sapiens
ugggcaagugacuuggcuucuc

SEQ ID NO: 89109 - RNA, 22 nt, Homo sapiens
ugggcuagaugcuuugggguca

SEQ ID NO: 89110 - RNA, 22 nt, Homo sapiens
uggguccccuacucuuuccaca

SEQ ID NO: 89111 - RNA, 22 nt, Homo sapiens
ugguaaaaugucauuuaccaga

SEQ ID NO: 89112 - RNA, 22 nt, Homo sapiens
ugguaagaucagaacuggaguc

SEQ ID NO: 89113 - RNA, 22 nt, Homo sapiens
ugguauuuaauauaugagaguu

SEQ ID NO: 89114 - RNA, 21 nt, Homo sapiens
uggucaguuuucucacuagga

SEQ ID NO: 89115 - RNA, 22 nt, Homo sapiens
ugguggcuuuucguagguucac

SEQ ID NO: 89116 - RNA, 22 nt, Homo sapiens
uguaagcauugggcaugcaguc

SEQ ID NO: 89117 - RNA, 22 nt, Homo sapiens
uguaauguuugguagguuaggu

SEQ ID NO: 89118 - RNA, 22 nt, Homo sapiens
uguagacaccaaagacagcaua

SEQ ID NO: 89119 - RNA, 22 nt, Homo sapiens
uguagcaaauaaaagucuggau

SEQ ID NO: 89120 - RNA, 22 nt, Homo sapiens
uguauacugucuaauauguugu

SEQ ID NO: 89121 - RNA, 22 nt, Homo sapiens
uguauguugauguuauauucug

SEQ ID NO: 89122 - RNA, 22 nt, Homo sapiens
uguauguuguaagacuuagacc

SEQ ID NO: 89123 - RNA, 22 nt, Homo sapiens
ugucaaagagacaucugcacuc

SEQ ID NO: 89124 - RNA, 22 nt, Homo sapiens
ugucacagagauuuugguaugu

SEQ ID NO: 89125 - RNA, 22 nt, Homo sapiens
ugucagaaucugagacgacaac

SEQ ID NO: 89126 - RNA, 23 nt, Homo sapiens
ugucaucaagaugaggucacacu

SEQ ID NO: 89127 - RNA, 22 nt, Homo sapiens
ugucauuguggugcagauauaa

SEQ ID NO: 89128 - RNA, 22 nt, Homo sapiens
ugucuuggagaauccuggguuu

SEQ ID NO: 89129 - RNA, 22 nt, Homo sapiens
ugugaaacauggauagaacugg

SEQ ID NO: 89130 - RNA, 22 nt, Homo sapiens
ugugacagguauccuguguucu

SEQ ID NO: 89131 - RNA, 22 nt, Homo sapiens
ugugauugauuaaugugugcua

SEQ ID NO: 89132 - RNA, 22 nt, Homo sapiens
ugugauuggccuggcguggguc

SEQ ID NO: 89133 - RNA, 22 nt, Homo sapiens
ugugcacuggaccuugucuucu

SEQ ID NO: 89134 - RNA, 22 nt, Homo sapiens
ugugccacuccaggaggcuguu

SEQ ID NO: 89135 - RNA, 22 nt, Homo sapiens
uguggaaauggugcuacgaaca

SEQ ID NO: 89136 - RNA, 22 nt, Homo sapiens
uguguaaauagcuacggaucug

SEQ ID NO: 89137 - RNA, 22 nt, Homo sapiens
ugugucacugcacuccagcgug

SEQ ID NO: 89138 - RNA, 22 nt, Homo sapiens
ugugucuccugaaaauucacau

SEQ ID NO: 89139 - RNA, 22 nt, Homo sapiens
uguuuguuugagauggagucuc

SEQ ID NO: 89140 - RNA, 22 nt, Homo sapiens
uguuuuguuagcacucugggaa

SEQ ID NO: 89141 - RNA, 22 nt, Homo sapiens
uuaaacucaucacccagguagu

SEQ ID NO: 89142 - RNA, 22 nt, Homo sapiens
uuaaagugaucauaaggauagu

SEQ ID NO: 89143 - RNA, 22 nt, Homo sapiens
uuaacagucacuuagcucauuu

SEQ ID NO: 89144 - RNA, 22 nt, Homo sapiens
uuaagagugggaguuggccaca

SEQ ID NO: 89145 - RNA, 22 nt, Homo sapiens
uuaaguguaaguggugugggac

SEQ ID NO: 89146 - RNA, 22 nt, Homo sapiens
uuaaugacaucauaggugaagu

SEQ ID NO: 89147 - RNA, 22 nt, Homo sapiens
uuaauguaauugauugauugac

SEQ ID NO: 89148 - RNA, 21 nt, Homo sapiens
uuacaauggcuccuugaaggu

SEQ ID NO: 89149 - RNA, 22 nt, Homo sapiens
uuacacaguaggucccuaguaa

SEQ ID NO: 89150 - RNA, 22 nt, Homo sapiens
uuacagucaaguuacauuucuc

SEQ ID NO: 89151 - RNA, 22 nt, Homo sapiens
uuacuugagaugaguuggacaa

SEQ ID NO: 89152 - RNA, 18 nt, Homo sapiens
uuagaugguuuuaaaacu

SEQ ID NO: 89153 - RNA, 21 nt, Homo sapiens
uuagcauccauguucaucaac

SEQ ID NO: 89154 - RNA, 22 nt, Homo sapiens
uuagggaguaaucuaaaaaugg

SEQ ID NO: 89155 - RNA, 22 nt, Homo sapiens
uuauagacacguuguaacaaac

SEQ ID NO: 89156 - RNA, 22 nt, Homo sapiens
uuauauguuagacauggugggu

SEQ ID NO: 89157 - RNA, 22 nt, Homo sapiens
uuauauguuucuuagggacaga

SEQ ID NO: 89158 - RNA, 22 nt, Homo sapiens
uuaugacauugacaguuuuuag

SEQ ID NO: 89159 - RNA, 22 nt, Homo sapiens
uuauuacuccuauuuuguagau

SEQ ID NO: 89160 - RNA, 23 nt, Homo sapiens
uucaaaggaugcuuuauggaauu

SEQ ID NO: 89161 - RNA, 22 nt, Homo sapiens
uucaaaggauuuagauuagcua

SEQ ID NO: 89162 - RNA, 23 nt, Homo sapiens
uucaaauguucucugguugucag

SEQ ID NO: 89163 - RNA, 22 nt, Homo sapiens
uucaaguaguucucaugccuca

SEQ ID NO: 89164 - RNA, 22 nt, Homo sapiens
uucacaaugccuuguugauggu

SEQ ID NO: 89165 - RNA, 22 nt, Homo sapiens
uucacagagagaacucaaacca

SEQ ID NO: 89166 - RNA, 22 nt, Homo sapiens
uucagcuacuuggaaacagcaa

SEQ ID NO: 89167 - RNA, 22 nt, Homo sapiens
uucaguagucuccauagaaccg

SEQ ID NO: 89168 - RNA, 22 nt, Homo sapiens
uucauagucuaauuuuuuccac

SEQ ID NO: 89169 - RNA, 22 nt, Homo sapiens
uucauagucuaugcaaguaaga

SEQ ID NO: 89170 - RNA, 22 nt, Homo sapiens
uucauagugaaaaauucaaagu

SEQ ID NO: 89171 - RNA, 22 nt, Homo sapiens
uucauaguguuuccuuccagug

SEQ ID NO: 89172 - RNA, 22 nt, Homo sapiens
uucauaguucuuuuagucauua

SEQ ID NO: 89173 - RNA, 23 nt, Homo sapiens
uucaucagggauauuggccugaa

SEQ ID NO: 89174 - RNA, 22 nt, Homo sapiens
uucauggaauauugaccauuuu

SEQ ID NO: 89175 - RNA, 22 nt, Homo sapiens
uucauguaauuccauaagguaa

SEQ ID NO: 89176 - RNA, 22 nt, Homo sapiens
uucauguagucaucauccugcu

SEQ ID NO: 89177 - RNA, 22 nt, Homo sapiens
uuccauguaguugaacgguuuu

SEQ ID NO: 89178 - RNA, 22 nt, Homo sapiens
uucccagucaaacgaaggacuu

SEQ ID NO: 89179 - RNA, 22 nt, Homo sapiens
uucccugugggcuggugcucca

SEQ ID NO: 89180 - RNA, 22 nt, Homo sapiens
uucucaauggcaacuuguugcu

SEQ ID NO: 89181 - RNA, 22 nt, Homo sapiens
uucucugggacauaggucgggu

SEQ ID NO: 89182 - RNA, 19 nt, Homo sapiens
uucucugguuguacuaccc

SEQ ID NO: 89183 - RNA, 23 nt, Homo sapiens
uucugccacugaaaaugccucag

SEQ ID NO: 89184 - RNA, 22 nt, Homo sapiens
uucugguuaauacuugcaaaaa

SEQ ID NO: 89185 - RNA, 22 nt, Homo sapiens
uucugugcuuguggaugaagug

SEQ ID NO: 89186 - RNA, 22 nt, Homo sapiens
uucuuccagccuugaggggccc

SEQ ID NO: 89187 - RNA, 22 nt, Homo sapiens
uucuucugguuaugaaauuuga

SEQ ID NO: 89188 - RNA, 22 nt, Homo sapiens
uucuuugcaugaucucaaaguc

SEQ ID NO: 89189 - RNA, 22 nt, Homo sapiens
uugaaggaggugcucacucucg

SEQ ID NO: 89190 - RNA, 18 nt, Homo sapiens
uugaaugcgucccagaga

SEQ ID NO: 89191 - RNA, 22 nt, Homo sapiens
uugacagaccuuggucauaucc

SEQ ID NO: 89192 - RNA, 22 nt, Homo sapiens
uugaccuggagaguacuuugac

SEQ ID NO: 89193 - RNA, 22 nt, Homo sapiens
uugagguaguacuuauuauugg

SEQ ID NO: 89194 - RNA, 22 nt, Homo sapiens
uugaggugaagggcagagcagc

SEQ ID NO: 89195 - RNA, 22 nt, Homo sapiens
uugaggugggaggaucacuuga

SEQ ID NO: 89196 - RNA, 22 nt, Homo sapiens
uugaguaguaagugguucaccg

SEQ ID NO: 89197 - RNA, 22 nt, Homo sapiens
uugagugaaugaaugauuaaau

SEQ ID NO: 89198 - RNA, 22 nt, Homo sapiens
uugcagagccccugcaaggguc

SEQ ID NO: 89199 - RNA, 22 nt, Homo sapiens
uugcauaagugcauucugugau

SEQ ID NO: 89200 - RNA, 21 nt, Homo sapiens
agaaaaucuuaugggaaacau

SEQ ID NO: 89201 - RNA, 22 nt, Homo sapiens
agaagugcuggguucaggcugg

SEQ ID NO: 89202 - RNA, 22 nt, Homo sapiens
agaauguauauucuguaguugu

SEQ ID NO: 89203 - RNA, 22 nt, Homo sapiens
agagauaguuuccaacucauac

SEQ ID NO: 89204 - RNA, 20 nt, Homo sapiens
agagcaaagccgcaccccua

SEQ ID NO: 89205 - RNA, 22 nt, Homo sapiens
agaucauaugcaguaaugaacu

SEQ ID NO: 89206 - RNA, 22 nt, Homo sapiens
agcaaaucuaugaauguauauu

SEQ ID NO: 89207 - RNA, 22 nt, Homo sapiens
agcacagccuuguguuuucuug

SEQ ID NO: 89208 - RNA, 17 nt, Homo sapiens
agcaccacacucucuug

SEQ ID NO: 89209 - RNA, 20 nt, Homo sapiens
agcagccacagauuccucag

SEQ ID NO: 89210 - RNA, 22 nt, Homo sapiens
agcagguguccacaauguuugc

SEQ ID NO: 89211 - RNA, 16 nt, Homo sapiens
agcagguguuagguga

SEQ ID NO: 89212 - RNA, 22 nt, Homo sapiens
agccuguguugaauuauagaaa

SEQ ID NO: 89213 - RNA, 22 nt, Homo sapiens
agcuaaaucucauguugaauug

SEQ ID NO: 89214 - RNA, 22 nt, Homo sapiens
agcucuuguuaguauuagcagu

SEQ ID NO: 89215 - RNA, 22 nt, Homo sapiens
agcuggcuguggagaaaccccu

SEQ ID NO: 89216 - RNA, 22 nt, Homo sapiens
agcuuguagugauuugugguaa

SEQ ID NO: 89217 - RNA, 22 nt, Homo sapiens
aggacacugagcaugggagguu

SEQ ID NO: 89218 - RNA, 19 nt, Homo sapiens
aggacuaaagacuagaagu

SEQ ID NO: 89219 - RNA, 22 nt, Homo sapiens
aggagaauugguucuucuugau

SEQ ID NO: 89220 - RNA, 18 nt, Homo sapiens
aggagcauagugcuauga

SEQ ID NO: 89221 - RNA, 21 nt, Homo sapiens
aggagcauuguugugguggag

SEQ ID NO: 89222 - RNA, 22 nt, Homo sapiens
aggagguugguaccaucuguuu

SEQ ID NO: 89223 - RNA, 22 nt, Homo sapiens
aggaguguguauuaaugaaauu

SEQ ID NO: 89224 - RNA, 22 nt, Homo sapiens
aggcaagaaugcuuguuucacc

SEQ ID NO: 89225 - RNA, 22 nt, Homo sapiens
aggcaggugaaagauaguuuua

SEQ ID NO: 89226 - RNA, 22 nt, Homo sapiens
agggagcaaaguggucuuucuc

SEQ ID NO: 89227 - RNA, 22 nt, Homo sapiens
agggcaagacuuguuaagaaca

SEQ ID NO: 89228 - RNA, 20 nt, Homo sapiens
agguucaaaucccaaucaug

SEQ ID NO: 89229 - RNA, 22 nt, Homo sapiens
agguucccuuuuggccugggau

SEQ ID NO: 89230 - RNA, 22 nt, Homo sapiens
agucaaaugcuuauguauaaag

SEQ ID NO: 89231 - RNA, 17 nt, Homo sapiens
agugagaucauggcuua

SEQ ID NO: 89232 - RNA, 22 nt, Homo sapiens
agugauggagccaggauuuaau

SEQ ID NO: 89233 - RNA, 22 nt, Homo sapiens
agugauuuuaacuuccagcaau

SEQ ID NO: 89234 - RNA, 22 nt, Homo sapiens
agugcaauggcgugaucuuggc

SEQ ID NO: 89235 - RNA, 22 nt, Homo sapiens
agugcaguugucacgugccuuc

SEQ ID NO: 89236 - RNA, 22 nt, Homo sapiens
aguucaauggguuuucacucau

SEQ ID NO: 89237 - RNA, 22 nt, Homo sapiens
auaaagcaaauaggacuauugc

SEQ ID NO: 89238 - RNA, 22 nt, Homo sapiens
auaaagccaugagcuugagaug

SEQ ID NO: 89239 - RNA, 22 nt, Homo sapiens
auaagaugaaggaagccauauc

SEQ ID NO: 89240 - RNA, 22 nt, Homo sapiens
auaauagcugaucauuuagaag

SEQ ID NO: 89241 - RNA, 22 nt, Homo sapiens
auacagugaauaucuggggcag

SEQ ID NO: 89242 - RNA, 22 nt, Homo sapiens
auacaguguauguauaguacau

SEQ ID NO: 89243 - RNA, 22 nt, Homo sapiens
auacauguuucauguuggugug

SEQ ID NO: 89244 - RNA, 20 nt, Homo sapiens
auagaagacuagugcagcag

SEQ ID NO: 89245 - RNA, 22 nt, Homo sapiens
auagaauguuugcgccagguga

SEQ ID NO: 89246 - RNA, 22 nt, Homo sapiens
auagcagcaccucacucuacug

SEQ ID NO: 89247 - RNA, 22 nt, Homo sapiens
auagcagcauauguaauguuga

SEQ ID NO: 89248 - RNA, 22 nt, Homo sapiens
auagugcugcaauaaacacacg

SEQ ID NO: 89249 - RNA, 22 nt, Homo sapiens
auaucacagguguuuaccugau

SEQ ID NO: 89250 - RNA, 22 nt, Homo sapiens
auaugcauacauguaugcagga

SEQ ID NO: 89251 - RNA, 22 nt, Homo sapiens
auauguucucauucauaugugg

SEQ ID NO: 89252 - RNA, 22 nt, Homo sapiens
aucaaaguuucccagaaguugu

SEQ ID NO: 89253 - RNA, 22 nt, Homo sapiens
aucacagaacuuugagcagaga

SEQ ID NO: 89254 - RNA, 22 nt, Homo sapiens
aucacagcccuccucuuggaug

SEQ ID NO: 89255 - RNA, 19 nt, Homo sapiens
aucaccauuauuuggaaca

SEQ ID NO: 89256 - RNA, 22 nt, Homo sapiens
aucacugggauggaacugcuga

SEQ ID NO: 89257 - RNA, 22 nt, Homo sapiens
aucagaaucucuagaggacugu

SEQ ID NO: 89258 - RNA, 22 nt, Homo sapiens
aucagagccugugugcccugaa

SEQ ID NO: 89259 - RNA, 22 nt, Homo sapiens
aucagugagugguuagugaaug

SEQ ID NO: 89260 - RNA, 22 nt, Homo sapiens
aucauccagccccagaagggag

SEQ ID NO: 89261 - RNA, 22 nt, Homo sapiens
aucaugcacaugcauagguaug

SEQ ID NO: 89262 - RNA, 22 nt, Homo sapiens
auccaucagacggcaggcguug

SEQ ID NO: 89263 - RNA, 22 nt, Homo sapiens
aucccaguucagccucugacac

SEQ ID NO: 89264 - RNA, 22 nt, Homo sapiens
auccugaagcuuuacugaauuc

SEQ ID NO: 89265 - RNA, 22 nt, Homo sapiens
aucucauuccuucugggcugau

SEQ ID NO: 89266 - RNA, 22 nt, Homo sapiens
aucuuuggugaguucuuugguc

SEQ ID NO: 89267 - RNA, 22 nt, Homo sapiens
aucuuuggugcaugauacuuug

SEQ ID NO: 89268 - RNA, 18 nt, Homo sapiens
gaguggugcuucccuugu

SEQ ID NO: 89269 - RNA, 22 nt, Homo sapiens
gaguucaaaucucagcucuguu

SEQ ID NO: 89270 - RNA, 22 nt, Homo sapiens
gauaaaguauuggguacuaugc

SEQ ID NO: 89271 - RNA, 22 nt, Homo sapiens
gaugccuuuuuguccucaguua

SEQ ID NO: 89272 - RNA, 22 nt, Homo sapiens
gauuggccaaacuaaagaacug

SEQ ID NO: 89273 - RNA, 21 nt, Homo sapiens
gcaaguacuaucaucauuauc

SEQ ID NO: 89274 - RNA, 22 nt, Homo sapiens
gcacaguggcucccgucuauaa

SEQ ID NO: 89275 - RNA, 22 nt, Homo sapiens
gcagagaaacaggucuaaggag

SEQ ID NO: 89276 - RNA, 22 nt, Homo sapiens
gcagaucuucgcgguaaguguu

SEQ ID NO: 89277 - RNA, 22 nt, Homo sapiens
gcaguguuggggccggaggcug

SEQ ID NO: 89278 - RNA, 22 nt, Homo sapiens
gcaugcacuguauuuaaguauc

SEQ ID NO: 89279 - RNA, 20 nt, Homo sapiens
gccacaguuaagcuucugcc

SEQ ID NO: 89280 - RNA, 22 nt, Homo sapiens
gcugguauuacaggcaugagcc

SEQ ID NO: 89281 - RNA, 22 nt, Homo sapiens
gcugugguuuaguagaaagaag

SEQ ID NO: 89282 - RNA, 22 nt, Homo sapiens
gcuuugguucaaccaggcaauu

SEQ ID NO: 89283 - RNA, 21 nt, Homo sapiens
gcuuuuucggaagucuuuggc

SEQ ID NO: 89284 - RNA, 22 nt, Homo sapiens
ggaauggaacaaagucuugaaa

SEQ ID NO: 89285 - RNA, 22 nt, Homo sapiens
ggagugcuguuguuacacaagg

SEQ ID NO: 89286 - RNA, 22 nt, Homo sapiens
ggaucacugugaaccgugucag

SEQ ID NO: 89287 - RNA, 22 nt, Homo sapiens
ggcaagaaaaugcaauuacugu

SEQ ID NO: 89288 - RNA, 21 nt, Homo sapiens
ggcaagaaacacaaucaagua

SEQ ID NO: 89289 - RNA, 22 nt, Homo sapiens
ggcaagauagauaucaguguca

SEQ ID NO: 89290 - RNA, 22 nt, Homo sapiens
ggcaaggauguuuuucuggcaa

SEQ ID NO: 89291 - RNA, 22 nt, Homo sapiens
ggcacgguggcucacaccugua

SEQ ID NO: 89292 - RNA, 17 nt, Homo sapiens
ggcaggauccaggaucc

SEQ ID NO: 89293 - RNA, 22 nt, Homo sapiens
ggcaguuucucaggcaggggua

SEQ ID NO: 89294 - RNA, 21 nt, Homo sapiens
ggcaugaauggaaaagugaga

SEQ ID NO: 89295 - RNA, 22 nt, Homo sapiens
ggcaugcauuguacuaguaugc

SEQ ID NO: 89296 - RNA, 22 nt, Homo sapiens
ggcaugguggugugugccuaua

SEQ ID NO: 89297 - RNA, 22 nt, Homo sapiens
ggcucaguuuccuccgucugcu

SEQ ID NO: 89298 - RNA, 22 nt, Homo sapiens
gggaaauguaaagucauaagau

SEQ ID NO: 89299 - RNA, 22 nt, Homo sapiens
gggaggucauuguucaaugcug

SEQ ID NO: 89300 - RNA, 22 nt, Homo sapiens
gggauguuuuauacugagccug

SEQ ID NO: 89301 - RNA, 22 nt, Homo sapiens
gggccagaugcauuuguuauuu

SEQ ID NO: 89302 - RNA, 22 nt, Homo sapiens
gggguaggcuacacugaguucc

SEQ ID NO: 89303 - RNA, 17 nt, Homo sapiens
gggucaccuugcaggua

SEQ ID NO: 89304 - RNA, 19 nt, Homo sapiens
ggucacagggguuacaagg

SEQ ID NO: 89305 - RNA, 22 nt, Homo sapiens
gguggucuuccccuggaguucg

SEQ ID NO: 89306 - RNA, 22 nt, Homo sapiens
guaaaucucuguuuucauggac

SEQ ID NO: 89307 - RNA, 22 nt, Homo sapiens
guaacucugucacuuacuaguu

SEQ ID NO: 89308 - RNA, 22 nt, Homo sapiens
guaaguagcuuuagauauaaau

SEQ ID NO: 89309 - RNA, 22 nt, Homo sapiens
guaauaacuguggaaaaagguu

SEQ ID NO: 89310 - RNA, 22 nt, Homo sapiens
guaaucucagcuacucaggagg

SEQ ID NO: 89311 - RNA, 22 nt, Homo sapiens
guaaucucagcuacucgggagg

SEQ ID NO: 89312 - RNA, 22 nt, Homo sapiens
guacaguggguguagggaccag

SEQ ID NO: 89313 - RNA, 22 nt, Homo sapiens
guauacacccugugauauuauu

SEQ ID NO: 89314 - RNA, 22 nt, Homo sapiens
gucaaagucuauuggcuaauuc

SEQ ID NO: 89315 - RNA, 22 nt, Homo sapiens
gucacggaauguaaguggaagu

SEQ ID NO: 89316 - RNA, 22 nt, Homo sapiens
gucagaugcagauuccaguucu

SEQ ID NO: 89317 - RNA, 22 nt, Homo sapiens
gucauggacaguuugcuaauug

SEQ ID NO: 89318 - RNA, 22 nt, Homo sapiens
gucccugcgauugugggauccu

SEQ ID NO: 89319 - RNA, 22 nt, Homo sapiens
gucucccagccuacaucuuucu

SEQ ID NO: 89320 - RNA, 22 nt, Homo sapiens
gucuggcuuaucucacuuacca

SEQ ID NO: 89321 - RNA, 22 nt, Homo sapiens
gucuggguuuguuuguacuugc

SEQ ID NO: 89322 - RNA, 22 nt, Homo sapiens
gucugugguuccuaugucaccu

SEQ ID NO: 89323 - RNA, 22 nt, Homo sapiens
gucuugaaggcugaguaccugu

SEQ ID NO: 89324 - RNA, 22 nt, Homo sapiens
gucuuugcuuuuaaccagaggu

SEQ ID NO: 89325 - RNA, 22 nt, Homo sapiens
gucuuuggaaaaaaugucuguu

SEQ ID NO: 89326 - RNA, 22 nt, Homo sapiens
gugaaguuuuugugaggccuaa

SEQ ID NO: 89327 - RNA, 22 nt, Homo sapiens
gugacaguggagacuuacuuca

SEQ ID NO: 89328 - RNA, 22 nt, Homo sapiens
gugagcagagaucgcgugauug

SEQ ID NO: 89329 - RNA, 21 nt, Homo sapiens
gugaggucauugggcuuucug

SEQ ID NO: 89330 - RNA, 22 nt, Homo sapiens
gugaggucguagucauaggcaa

SEQ ID NO: 89331 - RNA, 22 nt, Homo sapiens
gugcacaacguguagguuuguu

SEQ ID NO: 89332 - RNA, 22 nt, Homo sapiens
gugcauguccacuaguccauau

SEQ ID NO: 89333 - RNA, 22 nt, Homo sapiens
gugcaugucuaugcgagucuaa

SEQ ID NO: 89334 - RNA, 22 nt, Homo sapiens
gugcuuguguuaauauguagcu

SEQ ID NO: 89335 - RNA, 22 nt, Homo sapiens
guggaucacuugaggucaagag

SEQ ID NO: 89336 - RNA, 22 nt, Homo sapiens
guggcagaacagguaggguucu

SEQ ID NO: 89337 - RNA, 22 nt, Homo sapiens
gugggaugaucacaguucacug

SEQ ID NO: 89338 - RNA, 22 nt, Homo sapiens
gugggcucguucguguuagaca

SEQ ID NO: 89339 - RNA, 22 nt, Homo sapiens
gugguucuagaauugaguaucc

SEQ ID NO: 89340 - RNA, 22 nt, Homo sapiens
guguaugguuguuguagagaga

SEQ ID NO: 89341 - RNA, 22 nt, Homo sapiens
gugucuccuguggagcuaugua

SEQ ID NO: 89342 - RNA, 21 nt, Homo sapiens
gugugcuugagugaugggauu

SEQ ID NO: 89343 - RNA, 22 nt, Homo sapiens
guuaaugcuggaauaaguuaag

SEQ ID NO: 89344 - RNA, 22 nt, Homo sapiens
guuaugcagcaauugauaaucu

SEQ ID NO: 89345 - RNA, 22 nt, Homo sapiens
guucaagcaauucugcugccuc

SEQ ID NO: 89346 - RNA, 22 nt, Homo sapiens
guugcuuauuccuguaauccca

SEQ ID NO: 89347 - RNA, 17 nt, Homo sapiens
guuuggguacuggguaa

SEQ ID NO: 89348 - RNA, 22 nt, Homo sapiens
uaaaagucaucacaacuggagu

SEQ ID NO: 89349 - RNA, 17 nt, Homo sapiens
uaaagccagucaaguca

SEQ ID NO: 89350 - RNA, 22 nt, Homo sapiens
uaaagcuuagauccaugguggc

SEQ ID NO: 89351 - RNA, 22 nt, Homo sapiens
uaaagcuuggauuuaggcuaau

SEQ ID NO: 89352 - RNA, 22 nt, Homo sapiens
uaacaacauucuaacugacggc

SEQ ID NO: 89353 - RNA, 22 nt, Homo sapiens
uaacugucucccuugguccuga

SEQ ID NO: 89354 - RNA, 22 nt, Homo sapiens
uaaguaguguugagacaaguuu

SEQ ID NO: 89355 - RNA, 22 nt, Homo sapiens
uaagugaauguuggcuacugaa

SEQ ID NO: 89356 - RNA, 20 nt, Homo sapiens
uaagugcauaggauauuucu

SEQ ID NO: 89357 - RNA, 21 nt, Homo sapiens
uaauaaugucucagacaccua

SEQ ID NO: 89358 - RNA, 22 nt, Homo sapiens
uaauagcaguguuacuaggacu

SEQ ID NO: 89359 - RNA, 22 nt, Homo sapiens
uaauccuagcacuuuggaagac

SEQ ID NO: 89360 - RNA, 22 nt, Homo sapiens
uaaugcucauuagcaggccaau

SEQ ID NO: 89361 - RNA, 22 nt, Homo sapiens
uaauucugacaacaguggcguu

SEQ ID NO: 89362 - RNA, 22 nt, Homo sapiens
uaauucuguauguaucagaguu

SEQ ID NO: 89363 - RNA, 22 nt, Homo sapiens
uacaagcacaggcagcaggcug

SEQ ID NO: 89364 - RNA, 22 nt, Homo sapiens
uacagaguauccauuugaguuc

SEQ ID NO: 89365 - RNA, 22 nt, Homo sapiens
uacaguaauguuaaucuuugug

SEQ ID NO: 89366 - RNA, 22 nt, Homo sapiens
uacaguagaaugucuuucaaaa

SEQ ID NO: 89367 - RNA, 22 nt, Homo sapiens
uacagugcuugguaucuaguaa

SEQ ID NO: 89368 - RNA, 22 nt, Homo sapiens
uacauugcacuuuauuagauac

SEQ ID NO: 89369 - RNA, 22 nt, Homo sapiens
ucaaagucuucucaaguaacau

SEQ ID NO: 89370 - RNA, 22 nt, Homo sapiens
ucaaguagugacucgaguuauu

SEQ ID NO: 89371 - RNA, 22 nt, Homo sapiens
ucaaugcaugugacaaagagua

SEQ ID NO: 89372 - RNA, 22 nt, Homo sapiens
ucaauguaucuccaagaauuga

SEQ ID NO: 89373 - RNA, 21 nt, Homo sapiens
ucacaaugaacagcagcagaa

SEQ ID NO: 89374 - RNA, 22 nt, Homo sapiens
ucacagcuaaaaugaaaguagu

SEQ ID NO: 89375 - RNA, 22 nt, Homo sapiens
ucacagucggugacuucuugcu

SEQ ID NO: 89376 - RNA, 23 nt, Homo sapiens
ucacaguggcugcuuaauuguga

SEQ ID NO: 89377 - RNA, 22 nt, Homo sapiens
ucacaguucagcauggcugagg

SEQ ID NO: 89378 - RNA, 20 nt, Homo sapiens
ucacccugacaucugcccag

SEQ ID NO: 89379 - RNA, 22 nt, Homo sapiens
ucacugaggucugagcuuuaug

SEQ ID NO: 89380 - RNA, 20 nt, Homo sapiens
ucacugagugguccacagua

SEQ ID NO: 89381 - RNA, 22 nt, Homo sapiens
ucacugcgcuucagccugggug

SEQ ID NO: 89382 - RNA, 20 nt, Homo sapiens
ucacuggguucuugaagucu

SEQ ID NO: 89383 - RNA, 22 nt, Homo sapiens
ucaggcuuuucccagagugaug

SEQ ID NO: 89384 - RNA, 23 nt, Homo sapiens
ucaguacuccacuuucaauagug

SEQ ID NO: 89385 - RNA, 22 nt, Homo sapiens
ucaguguugauggcugcugacu

SEQ ID NO: 89386 - RNA, 22 nt, Homo sapiens
ucauacaggccaccagggaagu

SEQ ID NO: 89387 - RNA, 22 nt, Homo sapiens
ucaucagguaugucagcggagu

SEQ ID NO: 89388 - RNA, 22 nt, Homo sapiens
ucaucucaguuucuugccguac

SEQ ID NO: 89389 - RNA, 22 nt, Homo sapiens
ucauguaauuuugugucuauga

SEQ ID NO: 89390 - RNA, 22 nt, Homo sapiens
uccacaguaaggacccugccuu

SEQ ID NO: 89391 - RNA, 22 nt, Homo sapiens
uccacaguggugaggugcagca

SEQ ID NO: 89392 - RNA, 22 nt, Homo sapiens
uccagugugcaggcaaguuuga

SEQ ID NO: 89393 - RNA, 22 nt, Homo sapiens
ucccuugguaauucuguuccuu

SEQ ID NO: 89394 - RNA, 19 nt, Homo sapiens
ucccuuuguauggacauac

SEQ ID NO: 89395 - RNA, 22 nt, Homo sapiens
uccucaguggauuggauggugc

SEQ ID NO: 89396 - RNA, 22 nt, Homo sapiens
ucgcugggaagacugaaguguc

SEQ ID NO: 89397 - RNA, 22 nt, Homo sapiens
ucgugccacugcacuccagccu

SEQ ID NO: 89398 - RNA, 22 nt, Homo sapiens
ucuaaguaguagcuggucagaa

SEQ ID NO: 89399 - RNA, 19 nt, Homo sapiens
ucucaguguuggucaggug

SEQ ID NO: 89400 - RNA, 22 nt, Homo sapiens
ucucaugaagauagagaauaga

SEQ ID NO: 89401 - RNA, 23 nt, Homo sapiens
ucucauuccuugaaaauaaugac

SEQ ID NO: 89402 - RNA, 22 nt, Homo sapiens
ucucugagaccacuccaaacuc

SEQ ID NO: 89403 - RNA, 22 nt, Homo sapiens
ucugagaugagacuuugaauuu

SEQ ID NO: 89404 - RNA, 22 nt, Homo sapiens
ucuggcuuugugaguugccaga

SEQ ID NO: 89405 - RNA, 22 nt, Homo sapiens
ucugucuuguccucacccuaga

SEQ ID NO: 89406 - RNA, 22 nt, Homo sapiens
ucugugaaugaacacuugaaaa

SEQ ID NO: 89407 - RNA, 22 nt, Homo sapiens
ucugugcugagaguugaaaguu

SEQ ID NO: 89408 - RNA, 22 nt, Homo sapiens
ucugugguuguugcauggaaug

SEQ ID NO: 89409 - RNA, 22 nt, Homo sapiens
ucuugaacuucauaggucuaga

SEQ ID NO: 89410 - RNA, 20 nt, Homo sapiens
ucuugggaauguagccuagg

SEQ ID NO: 89411 - RNA, 22 nt, Homo sapiens
ucuuuagguguuauaguucaag

SEQ ID NO: 89412 - RNA, 22 nt, Homo sapiens
ucuuugaguuauugugcagacu

SEQ ID NO: 89413 - RNA, 22 nt, Homo sapiens
ucuuugguaauggaugucugau

SEQ ID NO: 89414 - RNA, 19 nt, Homo sapiens
ucuuugguacgugcuuuga

SEQ ID NO: 89415 - RNA, 22 nt, Homo sapiens
ucuuugguaggaguaggaggcc

SEQ ID NO: 89416 - RNA, 22 nt, Homo sapiens
ucuuugguaugugcaugugcuu

SEQ ID NO: 89417 - RNA, 22 nt, Homo sapiens
ucuuugguauugugaauagugu

SEQ ID NO: 89418 - RNA, 22 nt, Homo sapiens
ucuuuggucagaaagauuacac

SEQ ID NO: 89419 - RNA, 22 nt, Homo sapiens
ucuuugguuucugucucuguaa

SEQ ID NO: 89420 - RNA, 22 nt, Homo sapiens
ucuuuguuagaacccucuccuu

SEQ ID NO: 89421 - RNA, 20 nt, Homo sapiens
ugaaacacauggacuggggu

SEQ ID NO: 89422 - RNA, 18 nt, Homo sapiens
ugaaacacauuuuuuccu

SEQ ID NO: 89423 - RNA, 22 nt, Homo sapiens
ugaaauacuuaauuucuccaug

SEQ ID NO: 89424 - RNA, 22 nt, Homo sapiens
ugaaaugaucaguuugguuacu

SEQ ID NO: 89425 - RNA, 21 nt, Homo sapiens
ugaaaugcaugugcacauuaa

SEQ ID NO: 89426 - RNA, 22 nt, Homo sapiens
ugaacagcuaucuugucagugu

SEQ ID NO: 89427 - RNA, 22 nt, Homo sapiens
ugaagggcauuguuuugccaaa

SEQ ID NO: 89428 - RNA, 22 nt, Homo sapiens
ugaagugaagcaguaguguggg

SEQ ID NO: 89429 - RNA, 22 nt, Homo sapiens
ugaauauguuaaauaauguucu

SEQ ID NO: 89430 - RNA, 22 nt, Homo sapiens
ugaauguacacgcguacuuguu

SEQ ID NO: 89431 - RNA, 22 nt, Homo sapiens
ugacaagagaccccuccgcagg

SEQ ID NO: 89432 - RNA, 22 nt, Homo sapiens
ugacaagauauggucuuaucaa

SEQ ID NO: 89433 - RNA, 22 nt, Homo sapiens
ugacagcugaggcccagaguac

SEQ ID NO: 89434 - RNA, 22 nt, Homo sapiens
ugacagcuguugaggcauuuau

SEQ ID NO: 89435 - RNA, 22 nt, Homo sapiens
ugacaggucuaauuuacugaca

SEQ ID NO: 89436 - RNA, 22 nt, Homo sapiens
ugacagguuggaauuaugggag

SEQ ID NO: 89437 - RNA, 22 nt, Homo sapiens
ugacagucaccaggacccacag

SEQ ID NO: 89438 - RNA, 22 nt, Homo sapiens
ugauaagaaauuguucauguag

SEQ ID NO: 89439 - RNA, 22 nt, Homo sapiens
ugauaugaaagggaaauaagug

SEQ ID NO: 89440 - RNA, 22 nt, Homo sapiens
ugauauuuuugauccuuaaguu

SEQ ID NO: 89441 - RNA, 22 nt, Homo sapiens
ugauccagugcucaguuggagu

SEQ ID NO: 89442 - RNA, 22 nt, Homo sapiens
ugaucuuuuuaauguccauggg

SEQ ID NO: 89443 - RNA, 22 nt, Homo sapiens
ugauggcauuucauguuuguaa

SEQ ID NO: 89444 - RNA, 20 nt, Homo sapiens
ugauguccaggcagagguuu

SEQ ID NO: 89445 - RNA, 22 nt, Homo sapiens
ugauuuccaugagaacaugccu

SEQ ID NO: 89446 - RNA, 19 nt, Homo sapiens
ugcaaauucuaaaaacuga

SEQ ID NO: 89447 - RNA, 22 nt, Homo sapiens
ugcaaguaauuccagcuacuga

SEQ ID NO: 89448 - RNA, 20 nt, Homo sapiens
ugcaaguugccuuuggaggc

SEQ ID NO: 89449 - RNA, 17 nt, Homo sapiens
ugcaauuuaagcuagau

SEQ ID NO: 89450 - RNA, 22 nt, Homo sapiens
ugcagaaucccuucagauccga

SEQ ID NO: 89451 - RNA, 22 nt, Homo sapiens
ugcauagaauguucuguaaaua

SEQ ID NO: 89452 - RNA, 22 nt, Homo sapiens
ugcauagcaaaauaggauuaga

SEQ ID NO: 89453 - RNA, 22 nt, Homo sapiens
ugcaugcaucuuuuauaguagc

SEQ ID NO: 89454 - RNA, 22 nt, Homo sapiens
ugcauuguggaucuaaaugcau

SEQ ID NO: 89455 - RNA, 22 nt, Homo sapiens
ugccauagcaaugguaagcuga

SEQ ID NO: 89456 - RNA, 19 nt, Homo sapiens
ugccauguagcacaugguc

SEQ ID NO: 89457 - RNA, 22 nt, Homo sapiens
ugcccuguaucccacuguuuca

SEQ ID NO: 89458 - RNA, 22 nt, Homo sapiens
ugccuaggcuggaaugcagugg

SEQ ID NO: 89459 - RNA, 22 nt, Homo sapiens
ugcuacccuucgucucucuggu

SEQ ID NO: 89460 - RNA, 22 nt, Homo sapiens
ugcuaugucuucucucacagag

SEQ ID NO: 89461 - RNA, 21 nt, Homo sapiens
ugcuuuggucauacuucuucc

SEQ ID NO: 89462 - RNA, 22 nt, Homo sapiens
uggaaaauuaggggagguuaua

SEQ ID NO: 89463 - RNA, 22 nt, Homo sapiens
uggaagucauugagguguguua

SEQ ID NO: 89464 - RNA, 20 nt, Homo sapiens
uggaaucugaagaucucagu

SEQ ID NO: 89465 - RNA, 22 nt, Homo sapiens
uggaauuaauuaaaauauacug

SEQ ID NO: 89466 - RNA, 22 nt, Homo sapiens
uggacaagugcccuccaccuca

SEQ ID NO: 89467 - RNA, 22 nt, Homo sapiens
uggagucuugcucuguugccca

SEQ ID NO: 89468 - RNA, 22 nt, Homo sapiens
uggcaaaaaucacaaguaccuu

SEQ ID NO: 89469 - RNA, 22 nt, Homo sapiens
uggcaagaucacaauuacuuuu

SEQ ID NO: 89470 - RNA, 22 nt, Homo sapiens
uggcaugucguuuuucauagga

SEQ ID NO: 89471 - RNA, 22 nt, Homo sapiens
uggcauuuugugugaauuagaa

SEQ ID NO: 89472 - RNA, 22 nt, Homo sapiens
uggccaguguuuuuccugggcu

SEQ ID NO: 89473 - RNA, 22 nt, Homo sapiens
uggcuagaccugcauaacagcu

SEQ ID NO: 89474 - RNA, 22 nt, Homo sapiens
uggcuagauauccagaguucug

SEQ ID NO: 89475 - RNA, 22 nt, Homo sapiens
uggcuuucuggggcuucuguuc

SEQ ID NO: 89476 - RNA, 22 nt, Homo sapiens
uggcuuuucauccugggacauu

SEQ ID NO: 89477 - RNA, 22 nt, Homo sapiens
uggcuuuuccuugaaucugccu

SEQ ID NO: 89478 - RNA, 22 nt, Homo sapiens
ugggaaauguagccuagcugug

SEQ ID NO: 89479 - RNA, 22 nt, Homo sapiens
ugggaaugaaauuacauagcuu

SEQ ID NO: 89480 - RNA, 22 nt, Homo sapiens
ugggaucauucaaugacgaaau

SEQ ID NO: 89481 - RNA, 22 nt, Homo sapiens
ugguaagaggcccugaguuugu

SEQ ID NO: 89482 - RNA, 22 nt, Homo sapiens
ugguacuucaugcucacagaua

SEQ ID NO: 89483 - RNA, 22 nt, Homo sapiens
ugguauguaugauuaacaugga

SEQ ID NO: 89484 - RNA, 22 nt, Homo sapiens
ugguaugucuagauggggaagu

SEQ ID NO: 89485 - RNA, 20 nt, Homo sapiens
uggucaccuucaggagguuc

SEQ ID NO: 89486 - RNA, 22 nt, Homo sapiens
ugguccucugcuuccagaauuc

SEQ ID NO: 89487 - RNA, 22 nt, Homo sapiens
uguaacaggaggaaaaugugaa

SEQ ID NO: 89488 - RNA, 22 nt, Homo sapiens
uguaacaguaguuacuauucuu

SEQ ID NO: 89489 - RNA, 23 nt, Homo sapiens
uguauacacccugugcaucuggg

SEQ ID NO: 89490 - RNA, 22 nt, Homo sapiens
uguaugagagugaaagcauuuc

SEQ ID NO: 89491 - RNA, 22 nt, Homo sapiens
ugucauucaggaaauucuaagu

SEQ ID NO: 89492 - RNA, 22 nt, Homo sapiens
ugucuacugaugauguaguuaa

SEQ ID NO: 89493 - RNA, 21 nt, Homo sapiens
ugucugagagaggagaucuac

SEQ ID NO: 89494 - RNA, 22 nt, Homo sapiens
ugucuuggacuugaaucucauu

SEQ ID NO: 89495 - RNA, 18 nt, Homo sapiens
ugugacauugagcauguc

SEQ ID NO: 89496 - RNA, 22 nt, Homo sapiens
ugugccacugcacucuggccug

SEQ ID NO: 89497 - RNA, 22 nt, Homo sapiens
ugugcuugaaauucaguuuuga

SEQ ID NO: 89498 - RNA, 22 nt, Homo sapiens
uguguaaauaugauagaggaau

SEQ ID NO: 89499 - RNA, 22 nt, Homo sapiens
uguguaauacucuaaugaugca

SEQ ID NO: 89500 - RNA, 22 nt, Homo sapiens
uguucuugagccuuuagaccua

SEQ ID NO: 89501 - RNA, 22 nt, Homo sapiens
uguuugguggucucuucacaug

SEQ ID NO: 89502 - RNA, 22 nt, Homo sapiens
uuaaagcuggcguuacaguuug

SEQ ID NO: 89503 - RNA, 22 nt, Homo sapiens
uuaagacaccaaucauuggauu

SEQ ID NO: 89504 - RNA, 22 nt, Homo sapiens
uuaauacucuucuaaguagucc

SEQ ID NO: 89505 - RNA, 22 nt, Homo sapiens
uuaaucugucuaugauuuuggu

SEQ ID NO: 89506 - RNA, 23 nt, Homo sapiens
uuacaguggcaugaucucugcuc

SEQ ID NO: 89507 - RNA, 22 nt, Homo sapiens
uuacuguagugucauaucguau

SEQ ID NO: 89508 - RNA, 22 nt, Homo sapiens
uuaggcuuuauugaaaacaaua

SEQ ID NO: 89509 - RNA, 22 nt, Homo sapiens
aaguacuguuuaaauugcagaa

SEQ ID NO: 89510 - RNA, 19 nt, Homo sapiens
aaguacuugucuuuugaag

SEQ ID NO: 89511 - RNA, 22 nt, Homo sapiens
aaguauagcuaugauaaacauu

SEQ ID NO: 89512 - RNA, 22 nt, Homo sapiens
aaguauuaagacuaagaggcuu

SEQ ID NO: 89513 - RNA, 22 nt, Homo sapiens
aagucaugaagaggaaaggaca

SEQ ID NO: 89514 - RNA, 22 nt, Homo sapiens
aagugcauguauuaguguaguc

SEQ ID NO: 89515 - RNA, 22 nt, Homo sapiens
aagugcuuccuuucagaggguu

SEQ ID NO: 89516 - RNA, 22 nt, Homo sapiens
aagugucuuaccgggagggagu

SEQ ID NO: 89517 - RNA, 22 nt, Homo sapiens
aauaaagcaggguccuugcacu

SEQ ID NO: 89518 - RNA, 22 nt, Homo sapiens
aauaaagucugaagugugcuua

SEQ ID NO: 89519 - RNA, 22 nt, Homo sapiens
aauacugugauaucgagcgauu

SEQ ID NO: 89520 - RNA, 22 nt, Homo sapiens
aauauagcuauguacaugucca

SEQ ID NO: 89521 - RNA, 22 nt, Homo sapiens
aaucucagagauaucugugucc

SEQ ID NO: 89522 - RNA, 22 nt, Homo sapiens
aaugcaucuagaaaggugaauu

SEQ ID NO: 89523 - RNA, 22 nt, Homo sapiens
aaugccacugugccugccaagg

SEQ ID NO: 89524 - RNA, 22 nt, Homo sapiens
aauggcacaagaguaaacuguu

SEQ ID NO: 89525 - RNA, 22 nt, Homo sapiens
aauggcuuuuaauauccauaau

SEQ ID NO: 89526 - RNA, 22 nt, Homo sapiens
aaugucaucuucaguuguacag

SEQ ID NO: 89527 - RNA, 22 nt, Homo sapiens
aauucugugagauggugcagau

SEQ ID NO: 89528 - RNA, 22 nt, Homo sapiens
aauugaaugauaugggacauuu

SEQ ID NO: 89529 - RNA, 23 nt, Homo sapiens
aauugcacauuccuugcuggcag

SEQ ID NO: 89530 - RNA, 22 nt, Homo sapiens
aauugcaccaucuagaucaaga

SEQ ID NO: 89531 - RNA, 22 nt, Homo sapiens
acacaguguuuauugugguuag

SEQ ID NO: 89532 - RNA, 22 nt, Homo sapiens
acaccuguggucccaguaacuu

SEQ ID NO: 89533 - RNA, 22 nt, Homo sapiens
acagaccuauuucaaucauuua

SEQ ID NO: 89534 - RNA, 22 nt, Homo sapiens
acagcacugccaagugacccau

SEQ ID NO: 89535 - RNA, 20 nt, Homo sapiens
acagcacugguuucaagcaa

SEQ ID NO: 89536 - RNA, 22 nt, Homo sapiens
acaggagugggauuugaguccu

SEQ ID NO: 89537 - RNA, 22 nt, Homo sapiens
acaggugaaguauuacacuaag

SEQ ID NO: 89538 - RNA, 22 nt, Homo sapiens
acagucacaauuuguaccuuuu

SEQ ID NO: 89539 - RNA, 18 nt, Homo sapiens
acagugcugucacugcuu

SEQ ID NO: 89540 - RNA, 22 nt, Homo sapiens
acagugcuucugauaugaugcc

SEQ ID NO: 89541 - RNA, 18 nt, Homo sapiens
acagugucuuacaccugu

SEQ ID NO: 89542 - RNA, 21 nt, Homo sapiens
acaucagaguugugaagguag

SEQ ID NO: 89543 - RNA, 22 nt, Homo sapiens
acaugacauugggguggggaua

SEQ ID NO: 89544 - RNA, 22 nt, Homo sapiens
acauggcacugcgggcuucuug

SEQ ID NO: 89545 - RNA, 22 nt, Homo sapiens
acccaguagccagauguagcug

SEQ ID NO: 89546 - RNA, 22 nt, Homo sapiens
acccaguguucagacuaccugu

SEQ ID NO: 89547 - RNA, 22 nt, Homo sapiens
acuggcaauggcagaaauaguu

SEQ ID NO: 89548 - RNA, 22 nt, Homo sapiens
acuggcuuaaggaugggccacu

SEQ ID NO: 89549 - RNA, 22 nt, Homo sapiens
acuguguguuugucuagcacag

SEQ ID NO: 89550 - RNA, 22 nt, Homo sapiens
acuuggcaaaguuuuaaacagc

SEQ ID NO: 89551 - RNA, 21 nt, Homo sapiens
acuuucuguggcaguccauuc

SEQ ID NO: 89552 - RNA, 22 nt, Homo sapiens
agacaagauggcuugagguuca

SEQ ID NO: 89553 - RNA, 20 nt, Homo sapiens
agacaguguggagauuccuu

SEQ ID NO: 89554 - RNA, 20 nt, Homo sapiens
agagaucaguaauucaucaa

SEQ ID NO: 89555 - RNA, 22 nt, Homo sapiens
agagcaaugacaugcuaugugg

SEQ ID NO: 89556 - RNA, 22 nt, Homo sapiens
agagcaauguuaucagucucug

SEQ ID NO: 89557 - RNA, 22 nt, Homo sapiens
agagcuaguauuuacggagcau

SEQ ID NO: 89558 - RNA, 22 nt, Homo sapiens
agagcuguguuuuaacuuuuua

SEQ ID NO: 89559 - RNA, 22 nt, Homo sapiens
agagguaagaauaguaguugga

SEQ ID NO: 89560 - RNA, 22 nt, Homo sapiens
agagguaagcaguggcaagugc

SEQ ID NO: 89561 - RNA, 22 nt, Homo sapiens
agagugcaaagguuggggcugg

SEQ ID NO: 89562 - RNA, 22 nt, Homo sapiens
agcaacauuuuugaccuuucuu

SEQ ID NO: 89563 - RNA, 22 nt, Homo sapiens
agcaagauuguucccauuuucu

SEQ ID NO: 89564 - RNA, 22 nt, Homo sapiens
agcagcaccaaacagacuaaga

SEQ ID NO: 89565 - RNA, 22 nt, Homo sapiens
agcagcauauuuuuauaaugua

SEQ ID NO: 89566 - RNA, 22 nt, Homo sapiens
agccaguauuuccacagagugg

SEQ ID NO: 89567 - RNA, 21 nt, Homo sapiens
agccaguguuccuuguggcuc

SEQ ID NO: 89568 - RNA, 22 nt, Homo sapiens
agccgguguccacgaagaagag

SEQ ID NO: 89569 - RNA, 22 nt, Homo sapiens
agcgccacugcacuccagccug

SEQ ID NO: 89570 - RNA, 22 nt, Homo sapiens
agcuggauguauguuaagugaa

SEQ ID NO: 89571 - RNA, 22 nt, Homo sapiens
agcuguuguuuuaagauacuaa

SEQ ID NO: 89572 - RNA, 22 nt, Homo sapiens
aggaaaucuuagcugaggggau

SEQ ID NO: 89573 - RNA, 22 nt, Homo sapiens
aggacacugauguaugcugugg

SEQ ID NO: 89574 - RNA, 22 nt, Homo sapiens
aggaccauuguguagcagacau

SEQ ID NO: 89575 - RNA, 22 nt, Homo sapiens
aggagguagaacauugccauuu

SEQ ID NO: 89576 - RNA, 22 nt, Homo sapiens
aggagguaggaauugugcuagg

SEQ ID NO: 89577 - RNA, 16 nt, Homo sapiens
aggcaagaauugaggu

SEQ ID NO: 89578 - RNA, 21 nt, Homo sapiens
aggcaagacuuuuagguuugu

SEQ ID NO: 89579 - RNA, 21 nt, Homo sapiens
aggcaagauuacuuacgagca

SEQ ID NO: 89580 - RNA, 22 nt, Homo sapiens
aggcacggugucucaugccugu

SEQ ID NO: 89581 - RNA, 22 nt, Homo sapiens
aggcaguuucagugagagguga

SEQ ID NO: 89582 - RNA, 22 nt, Homo sapiens
aggcaugaguucagaggguaug

SEQ ID NO: 89583 - RNA, 22 nt, Homo sapiens
aggcaugguggcacauacaugu

SEQ ID NO: 89584 - RNA, 22 nt, Homo sapiens
agguauauuggacagauguaaa

SEQ ID NO: 89585 - RNA, 22 nt, Homo sapiens
aggugcuugaaucuaugagcuc

SEQ ID NO: 89586 - RNA, 22 nt, Homo sapiens
agguguuguugaggagauuuca

SEQ ID NO: 89587 - RNA, 22 nt, Homo sapiens
agguuaugauuauagagcgagg

SEQ ID NO: 89588 - RNA, 23 nt, Homo sapiens
agguuaugauuauagagcgagga

SEQ ID NO: 89589 - RNA, 22 nt, Homo sapiens
agguuaugauuguagagcgagg

SEQ ID NO: 89590 - RNA, 22 nt, Homo sapiens
agguuuucagccccagccuagg

SEQ ID NO: 89591 - RNA, 22 nt, Homo sapiens
aguaaagcaucagcuagaugug

SEQ ID NO: 89592 - RNA, 22 nt, Homo sapiens
aguaagauggcaacucuccaca

SEQ ID NO: 89593 - RNA, 22 nt, Homo sapiens
aguauguagugcaaucagucag

SEQ ID NO: 89594 - RNA, 22 nt, Homo sapiens
agucacggugguuugcacuugu

SEQ ID NO: 89595 - RNA, 22 nt, Homo sapiens
agucagucuguccugugcugag

SEQ ID NO: 89596 - RNA, 22 nt, Homo sapiens
aguccagguuuuguaauggcaa

SEQ ID NO: 89597 - RNA, 21 nt, Homo sapiens
agugagucauuuggaaagcaa

SEQ ID NO: 89598 - RNA, 22 nt, Homo sapiens
agugcaaagccgagguuucuug

SEQ ID NO: 89599 - RNA, 22 nt, Homo sapiens
agugcacugcccgcuuccuguc

SEQ ID NO: 89600 - RNA, 22 nt, Homo sapiens
auaaagcaagucucuggccuca

SEQ ID NO: 89601 - RNA, 22 nt, Homo sapiens
auaaaugcuuccagucauuaaa

SEQ ID NO: 89602 - RNA, 22 nt, Homo sapiens
auacacgguaggcacauauuua

SEQ ID NO: 89603 - RNA, 19 nt, Homo sapiens
auacacguguauacauaca

SEQ ID NO: 89604 - RNA, 22 nt, Homo sapiens
auacagugaauacuuacagugu

SEQ ID NO: 89605 - RNA, 22 nt, Homo sapiens
auacaguguucugggaagaagu

SEQ ID NO: 89606 - RNA, 22 nt, Homo sapiens
auacaguugccauuucuugugc

SEQ ID NO: 89607 - RNA, 22 nt, Homo sapiens
auacaugugugagcgaagaugu

SEQ ID NO: 89608 - RNA, 22 nt, Homo sapiens
auacuguauaggauuguagccu

SEQ ID NO: 89609 - RNA, 22 nt, Homo sapiens
auaucacaaacaagucuguacu

SEQ ID NO: 89610 - RNA, 22 nt, Homo sapiens
ugugucuugaauuuuguaugua

SEQ ID NO: 89611 - RNA, 22 nt, Homo sapiens
ugugucuugagagucucgagaa

SEQ ID NO: 89612 - RNA, 22 nt, Homo sapiens
ugugucuuguuuuuucccaggc

SEQ ID NO: 89613 - RNA, 22 nt, Homo sapiens
uguucuugaguugggaguacaa

SEQ ID NO: 89614 - RNA, 18 nt, Homo sapiens
uguuugguucugcgccuc

SEQ ID NO: 89615 - RNA, 22 nt, Homo sapiens
uuaaaagcuaucuccaagguca

SEQ ID NO: 89616 - RNA, 22 nt, Homo sapiens
uuaaaaguauaggccuggcaua

SEQ ID NO: 89617 - RNA, 22 nt, Homo sapiens
uuaagaagugauuuuccucauu

SEQ ID NO: 89618 - RNA, 22 nt, Homo sapiens
uuaagucacacuagacaacuga

SEQ ID NO: 89619 - RNA, 19 nt, Homo sapiens
uuaagugugauaucucagu

SEQ ID NO: 89620 - RNA, 22 nt, Homo sapiens
uuaauagugacucauuuuccac

SEQ ID NO: 89621 - RNA, 21 nt, Homo sapiens
uuaaugcuaugcagaaaaucu

SEQ ID NO: 89622 - RNA, 22 nt, Homo sapiens
uuaauucugucugcccucaucc

SEQ ID NO: 89623 - RNA, 22 nt, Homo sapiens
uuaauuguaucuauagauguca

SEQ ID NO: 89624 - RNA, 22 nt, Homo sapiens
uuaauuguccauuauucuguuc

SEQ ID NO: 89625 - RNA, 22 nt, Homo sapiens
uuacagauggcacacucaaggg

SEQ ID NO: 89626 - RNA, 22 nt, Homo sapiens
uuacaggacuaagcagcuuugc

SEQ ID NO: 89627 - RNA, 22 nt, Homo sapiens
uuacagucuuaggcagugcuuu

SEQ ID NO: 89628 - RNA, 22 nt, Homo sapiens
uuacauugcuucaaauucagug

SEQ ID NO: 89629 - RNA, 22 nt, Homo sapiens
uuaccagucugauuccuguuag

SEQ ID NO: 89630 - RNA, 22 nt, Homo sapiens
uuacugcucuuuugucaugagu

SEQ ID NO: 89631 - RNA, 22 nt, Homo sapiens
uuacuguauagaaucaucuuga

SEQ ID NO: 89632 - RNA, 22 nt, Homo sapiens
uuaggcaggauaguuacauauu

SEQ ID NO: 89633 - RNA, 21 nt, Homo sapiens
uuaggcagugucagaggugag

SEQ ID NO: 89634 - RNA, 22 nt, Homo sapiens
uuauauguuacucccucuagca

SEQ ID NO: 89635 - RNA, 17 nt, Homo sapiens
uuaugagacuucuuagc

SEQ ID NO: 89636 - RNA, 22 nt, Homo sapiens
uuauuagguuaaccuauagcua

SEQ ID NO: 89637 - RNA, 22 nt, Homo sapiens
uuauuagguugguggaaaagua

SEQ ID NO: 89638 - RNA, 22 nt, Homo sapiens
uucaaaguaaagggauggagac

SEQ ID NO: 89639 - RNA, 22 nt, Homo sapiens
uucaaaguuggaggacaaacug

SEQ ID NO: 89640 - RNA, 22 nt, Homo sapiens
uucaagucaauuuuugaaugac

SEQ ID NO: 89641 - RNA, 22 nt, Homo sapiens
uucaagugaacaaaaugaggag

SEQ ID NO: 89642 - RNA, 21 nt, Homo sapiens
uucacaagggaaguagggggc

SEQ ID NO: 89643 - RNA, 22 nt, Homo sapiens
uucacaguacucccuggaauua

SEQ ID NO: 89644 - RNA, 22 nt, Homo sapiens
uucacaguguguacaccagggg

SEQ ID NO: 89645 - RNA, 22 nt, Homo sapiens
uucagaugcacacuguagucua

SEQ ID NO: 89646 - RNA, 22 nt, Homo sapiens
uucaguaaauguucuuacuaua

SEQ ID NO: 89647 - RNA, 22 nt, Homo sapiens
uucaguggagaggcugaguggu

SEQ ID NO: 89648 - RNA, 22 nt, Homo sapiens
uucagugucauuaacacaguag

SEQ ID NO: 89649 - RNA, 22 nt, Homo sapiens
uucaucagggagaaauaauuuc

SEQ ID NO: 89650 - RNA, 22 nt, Homo sapiens
uucauguaauauuucacagcuu

SEQ ID NO: 89651 - RNA, 22 nt, Homo sapiens
uuccacagggauuugcauugau

SEQ ID NO: 89652 - RNA, 22 nt, Homo sapiens
uucccugaaguguuacucuaga

SEQ ID NO: 89653 - RNA, 22 nt, Homo sapiens
uucccugagcaucuguugagcc

SEQ ID NO: 89654 - RNA, 22 nt, Homo sapiens
uuccuacugcccauuaaaaugg

SEQ ID NO: 89655 - RNA, 22 nt, Homo sapiens
uuccugagccuuguaucuagua

SEQ ID NO: 89656 - RNA, 22 nt, Homo sapiens
uucuauguuugaaaaugccaaa

SEQ ID NO: 89657 - RNA, 22 nt, Homo sapiens
uucucauggugauggcaaaauc

SEQ ID NO: 89658 - RNA, 22 nt, Homo sapiens
uucuggcuuuuaaagaaauguu

SEQ ID NO: 89659 - RNA, 22 nt, Homo sapiens
uucugugcugaaucaaagacug

SEQ ID NO: 89660 - RNA, 22 nt, Homo sapiens
uucuuuggaaacaguacuaauu

SEQ ID NO: 89661 - RNA, 22 nt, Homo sapiens
uucuuuggauaaaguuuuaugc

SEQ ID NO: 89662 - RNA, 22 nt, Homo sapiens
uucuuugguacaagggccgacc

SEQ ID NO: 89663 - RNA, 22 nt, Homo sapiens
uugaaagaaaggagacugaguu

SEQ ID NO: 89664 - RNA, 22 nt, Homo sapiens
uugaaagcuaucagagauucca

SEQ ID NO: 89665 - RNA, 22 nt, Homo sapiens
uugaagacuauaugauucuuca

SEQ ID NO: 89666 - RNA, 22 nt, Homo sapiens
uugaaguagaaagacgaaauuu

SEQ ID NO: 89667 - RNA, 22 nt, Homo sapiens
uugaauagaaguguugaaagug

SEQ ID NO: 89668 - RNA, 22 nt, Homo sapiens
uugaauaggcucaugcuuauca

SEQ ID NO: 89669 - RNA, 22 nt, Homo sapiens
uugacaguugggcagggaaguu

SEQ ID NO: 89670 - RNA, 22 nt, Homo sapiens
uugacauaguuucugaaauaga

SEQ ID NO: 89671 - RNA, 22 nt, Homo sapiens
uugacugggccagacagagauc

SEQ ID NO: 89672 - RNA, 22 nt, Homo sapiens
uugacuuuuaggaggaaaauga

SEQ ID NO: 89673 - RNA, 22 nt, Homo sapiens
uugagcucuuccagccuggagc

SEQ ID NO: 89674 - RNA, 23 nt, Homo sapiens
uugaggcauguaccaucaauauc

SEQ ID NO: 89675 - RNA, 22 nt, Homo sapiens
uugagggaggcagggcuugucu

SEQ ID NO: 89676 - RNA, 22 nt, Homo sapiens
uugauacuagagucuuucugac

SEQ ID NO: 89677 - RNA, 22 nt, Homo sapiens
uugauagaucagggauuugauu

SEQ ID NO: 89678 - RNA, 22 nt, Homo sapiens
uugcaacauuguaaguuuauau

SEQ ID NO: 89679 - RNA, 22 nt, Homo sapiens
uugcagugguuucacuggcaaa

SEQ ID NO: 89680 - RNA, 22 nt, Homo sapiens
uugcaugguggaacuuggagcu

SEQ ID NO: 89681 - RNA, 22 nt, Homo sapiens
uugcaugguuuuuaucugaaau

SEQ ID NO: 89682 - RNA, 22 nt, Homo sapiens
uuggaaacaccuggugagguua

SEQ ID NO: 89683 - RNA, 22 nt, Homo sapiens
uuggaaaccucugcagguguuu

SEQ ID NO: 89684 - RNA, 22 nt, Homo sapiens
uuggaaauauguuaagugucau

SEQ ID NO: 89685 - RNA, 22 nt, Homo sapiens
uuggaacacauguuuuucuacc

SEQ ID NO: 89686 - RNA, 22 nt, Homo sapiens
uuggaaguguguauguauagcu

SEQ ID NO: 89687 - RNA, 22 nt, Homo sapiens
uuggauauucaguuuuuccauc

SEQ ID NO: 89688 - RNA, 22 nt, Homo sapiens
uuggcaaguuucugucagcaaa

SEQ ID NO: 89689 - RNA, 22 nt, Homo sapiens
uuggcagaaaaggucggggguu

SEQ ID NO: 89690 - RNA, 22 nt, Homo sapiens
uuggccccuuucauccacagcu

SEQ ID NO: 89691 - RNA, 22 nt, Homo sapiens
uuggccuuuucaaugccucuuu

SEQ ID NO: 89692 - RNA, 23 nt, Homo sapiens
uugggcaaaucacuaacgucucc

SEQ ID NO: 89693 - RNA, 22 nt, Homo sapiens
uugguaaaaugaccacagacau

SEQ ID NO: 89694 - RNA, 23 nt, Homo sapiens
uuggucucccaaaguguugagau

SEQ ID NO: 89695 - RNA, 22 nt, Homo sapiens
uugguucucuuuauaugcugga

SEQ ID NO: 89696 - RNA, 22 nt, Homo sapiens
uuguagcuuuuuaaugugcugc

SEQ ID NO: 89697 - RNA, 22 nt, Homo sapiens
uuguauugucuugaugaguuga

SEQ ID NO: 89698 - RNA, 22 nt, Homo sapiens
uugucaaacucauucuccaucc

SEQ ID NO: 89699 - RNA, 22 nt, Homo sapiens
uugucacugcacuccagucugg

SEQ ID NO: 89700 - RNA, 22 nt, Homo sapiens
uugugaaaucuaggcagagguu

SEQ ID NO: 89701 - RNA, 22 nt, Homo sapiens
uugugcuucaucaccuagcaga

SEQ ID NO: 89702 - RNA, 17 nt, Homo sapiens
uuuaaugcuaggacucu

SEQ ID NO: 89703 - RNA, 22 nt, Homo sapiens
uuuaaugcugcccagucauggg

SEQ ID NO: 89704 - RNA, 18 nt, Homo sapiens
uuuacaguagaaggacuu

SEQ ID NO: 89705 - RNA, 22 nt, Homo sapiens
uuuagcaaagcaauuuacacca

SEQ ID NO: 89706 - RNA, 22 nt, Homo sapiens
uuuaggcaauauauucaugucu

SEQ ID NO: 89707 - RNA, 22 nt, Homo sapiens
uuuauagucaggaacuugagga

SEQ ID NO: 89708 - RNA, 22 nt, Homo sapiens
uuuaugucuguacaucgggcgg

SEQ ID NO: 89709 - RNA, 19 nt, Homo sapiens
uuucacacucgccuacuuc

SEQ ID NO: 89710 - RNA, 21 nt, Homo sapiens
uuucacugugaguuuuucugu

SEQ ID NO: 89711 - RNA, 21 nt, Homo sapiens
cccagguucucugaggguaga

SEQ ID NO: 89712 - RNA, 22 nt, Homo sapiens
cccaguguguuguggauauuua

SEQ ID NO: 89713 - RNA, 22 nt, Homo sapiens
ccuggaucauugucauucccaa

SEQ ID NO: 89714 - RNA, 22 nt, Homo sapiens
ccuucuuuuguaaggcugaaua

SEQ ID NO: 89715 - RNA, 22 nt, Homo sapiens
cuaaaacuuucugagugcagca

SEQ ID NO: 89716 - RNA, 19 nt, Homo sapiens
cuaaguccccuugauuaga

SEQ ID NO: 89717 - RNA, 18 nt, Homo sapiens
cuaauacuauucaacaag

SEQ ID NO: 89718 - RNA, 22 nt, Homo sapiens
cuacagcacugagcugugugca

SEQ ID NO: 89719 - RNA, 21 nt, Homo sapiens
cuacccuguauuagagaaaga

SEQ ID NO: 89720 - RNA, 22 nt, Homo sapiens
cuaccuggguggcucaugacuu

SEQ ID NO: 89721 - RNA, 22 nt, Homo sapiens
cuagccuggagugcaguggugc

SEQ ID NO: 89722 - RNA, 22 nt, Homo sapiens
cuagucacaggaguugaaggau

SEQ ID NO: 89723 - RNA, 22 nt, Homo sapiens
cuaugcuucuuaaauuaguuau

SEQ ID NO: 89724 - RNA, 22 nt, Homo sapiens
cucaaguaauccucccgccuug

SEQ ID NO: 89725 - RNA, 22 nt, Homo sapiens
cucacaguucuaaaggcaagaa

SEQ ID NO: 89726 - RNA, 22 nt, Homo sapiens
cucaccuugugauccuccugcc

SEQ ID NO: 89727 - RNA, 22 nt, Homo sapiens
cucacugugguguccuuaggua

SEQ ID NO: 89728 - RNA, 22 nt, Homo sapiens
cucaguagaaaauacauggacu

SEQ ID NO: 89729 - RNA, 22 nt, Homo sapiens
cucagugucuggcacacagaaa

SEQ ID NO: 89730 - RNA, 22 nt, Homo sapiens
cucucaguugucuaauuaguuu

SEQ ID NO: 89731 - RNA, 22 nt, Homo sapiens
cucucugagccccagacaccuu

SEQ ID NO: 89732 - RNA, 15 nt, Homo sapiens
cucugguuuuucuuc

SEQ ID NO: 89733 - RNA, 22 nt, Homo sapiens
cugagaguugaugaaauauggu

SEQ ID NO: 89734 - RNA, 22 nt, Homo sapiens
cugagcacugagauccucuagc

SEQ ID NO: 89735 - RNA, 22 nt, Homo sapiens
cugaggcacggcgaccuuaagu

SEQ ID NO: 89736 - RNA, 22 nt, Homo sapiens
cugagguuguucuucucagugg

SEQ ID NO: 89737 - RNA, 22 nt, Homo sapiens
cugaguauaacugaccuuauga

SEQ ID NO: 89738 - RNA, 22 nt, Homo sapiens
cuggcagucugccucuucacug

SEQ ID NO: 89739 - RNA, 21 nt, Homo sapiens
cugguguuagcacuucuuccc

SEQ ID NO: 89740 - RNA, 22 nt, Homo sapiens
cuguaauguaaugagacuacau

SEQ ID NO: 89741 - RNA, 22 nt, Homo sapiens
cugucacaguuuuggaggccag

SEQ ID NO: 89742 - RNA, 22 nt, Homo sapiens
cugucaucauuucuaugugcca

SEQ ID NO: 89743 - RNA, 22 nt, Homo sapiens
cugugguugagcuuugccauga

SEQ ID NO: 89744 - RNA, 22 nt, Homo sapiens
cuucaccaguuuggcagucuca

SEQ ID NO: 89745 - RNA, 18 nt, Homo sapiens
cuucauugcuguuuugcu

SEQ ID NO: 89746 - RNA, 22 nt, Homo sapiens
cuucuugagggccugcugggaa

SEQ ID NO: 89747 - RNA, 22 nt, Homo sapiens
cuugaacaaagagauuccauua

SEQ ID NO: 89748 - RNA, 23 nt, Homo sapiens
cuugagacaaaugcgugugugca

SEQ ID NO: 89749 - RNA, 22 nt, Homo sapiens
cuuggcacugcucacccuccuu

SEQ ID NO: 89750 - RNA, 22 nt, Homo sapiens
cuuuacaguuggacucacgagg

SEQ ID NO: 89751 - RNA, 22 nt, Homo sapiens
cuuugcacaucucugcuuuccc

SEQ ID NO: 89752 - RNA, 20 nt, Homo sapiens
cuuuggcaaugagaacaggg

SEQ ID NO: 89753 - RNA, 22 nt, Homo sapiens
cuuuggcauuagccuguauaga

SEQ ID NO: 89754 - RNA, 20 nt, Homo sapiens
cuuuggugagucaacuccuu

SEQ ID NO: 89755 - RNA, 22 nt, Homo sapiens
cuuugguguauuuucagagacc

SEQ ID NO: 89756 - RNA, 22 nt, Homo sapiens
cuuuuacacuguuggugggaau

SEQ ID NO: 89757 - RNA, 22 nt, Homo sapiens
cuuuugcugggucagcgguggu

SEQ ID NO: 89758 - RNA, 22 nt, Homo sapiens
cuuuugugauucuucaguugcu

SEQ ID NO: 89759 - RNA, 22 nt, Homo sapiens
gaacccuggaggcggagguugc

SEQ ID NO: 89760 - RNA, 22 nt, Homo sapiens
gaagauucaaccaaaccagaac

SEQ ID NO: 89761 - RNA, 22 nt, Homo sapiens
gaaggugcuuggugaaugcauu

SEQ ID NO: 89762 - RNA, 23 nt, Homo sapiens
gaaguaauaaauggauucuuaac

SEQ ID NO: 89763 - RNA, 22 nt, Homo sapiens
gaaucacaguuauuagagcagc

SEQ ID NO: 89764 - RNA, 22 nt, Homo sapiens
gaaucacugugguaucccaugc

SEQ ID NO: 89765 - RNA, 22 nt, Homo sapiens
gaaucauuggguugauucaaga

SEQ ID NO: 89766 - RNA, 22 nt, Homo sapiens
gaaugcaugaggggaucagaug

SEQ ID NO: 89767 - RNA, 22 nt, Homo sapiens
gaauucugucgcuuacuagaug

SEQ ID NO: 89768 - RNA, 22 nt, Homo sapiens
gacagugugauacuuagucuca

SEQ ID NO: 89769 - RNA, 22 nt, Homo sapiens
gacaguguggcgauuccucaag

SEQ ID NO: 89770 - RNA, 22 nt, Homo sapiens
gacucagucuuggauuuuuaau

SEQ ID NO: 89771 - RNA, 22 nt, Homo sapiens
gacuggagcuguaugugguuac

SEQ ID NO: 89772 - RNA, 16 nt, Homo sapiens
gacugggcugaggaau

SEQ ID NO: 89773 - RNA, 22 nt, Homo sapiens
gagaaugagaggggaaggccac

SEQ ID NO: 89774 - RNA, 22 nt, Homo sapiens
gagagcuaggccacuggggcuu

SEQ ID NO: 89775 - RNA, 22 nt, Homo sapiens
gagauaaauaggucacaguucu

SEQ ID NO: 89776 - RNA, 22 nt, Homo sapiens
gagauucaucuagguccagaga

SEQ ID NO: 89777 - RNA, 22 nt, Homo sapiens
gagauucuucaauauuuauucu

SEQ ID NO: 89778 - RNA, 22 nt, Homo sapiens
gagcacugaauacugugguggu

SEQ ID NO: 89779 - RNA, 22 nt, Homo sapiens
gagcuagcauuuagacaucugg

SEQ ID NO: 89780 - RNA, 22 nt, Homo sapiens
gagcuguugguuugaaagaauu

SEQ ID NO: 89781 - RNA, 22 nt, Homo sapiens
gaggcaagaguaguuaaguuag

SEQ ID NO: 89782 - RNA, 22 nt, Homo sapiens
gaggcauuauucccaucuuaca

SEQ ID NO: 89783 - RNA, 22 nt, Homo sapiens
gaggcauugaaauauugcuuau

SEQ ID NO: 89784 - RNA, 22 nt, Homo sapiens
gagguauggauaucuggagagg

SEQ ID NO: 89785 - RNA, 22 nt, Homo sapiens
gagguuuuagugagucccacug

SEQ ID NO: 89786 - RNA, 23 nt, Homo sapiens
gaguggagacucauugauuuccu

SEQ ID NO: 89787 - RNA, 22 nt, Homo sapiens
gauagguucuaagcagguguug

SEQ ID NO: 89788 - RNA, 22 nt, Homo sapiens
gaucugugugauuggaugcauu

SEQ ID NO: 89789 - RNA, 22 nt, Homo sapiens
gaugacagugaguaaccccaac

SEQ ID NO: 89790 - RNA, 22 nt, Homo sapiens
gaugcaguaagaaugcauagcg

SEQ ID NO: 89791 - RNA, 22 nt, Homo sapiens
gauuugagagaggguguuuaua

SEQ ID NO: 89792 - RNA, 22 nt, Homo sapiens
gcacagaugaggagaggucuca

SEQ ID NO: 89793 - RNA, 22 nt, Homo sapiens
gcacaggguuacauucuaaggu

SEQ ID NO: 89794 - RNA, 22 nt, Homo sapiens
gcacugagagaagccccaagua

SEQ ID NO: 89795 - RNA, 22 nt, Homo sapiens
gcagaauugguuucuucuaagg

SEQ ID NO: 89796 - RNA, 22 nt, Homo sapiens
gcagcacauggcagaacauauu

SEQ ID NO: 89797 - RNA, 22 nt, Homo sapiens
gcaguguugugauccaggucuu

SEQ ID NO: 89798 - RNA, 22 nt, Homo sapiens
gcauaaagcuaauaagacgaag

SEQ ID NO: 89799 - RNA, 22 nt, Homo sapiens
gcaugcauuuuccuaacuagaa

SEQ ID NO: 89800 - RNA, 22 nt, Homo sapiens
gcccugagauucuuggauucug

SEQ ID NO: 89801 - RNA, 22 nt, Homo sapiens
gccucaguuguggccagggauu

SEQ ID NO: 89802 - RNA, 22 nt, Homo sapiens
gcugauggugcaguucuagccu

SEQ ID NO: 89803 - RNA, 22 nt, Homo sapiens
gcugcuuuugaugacaaaaaca

SEQ ID NO: 89804 - RNA, 22 nt, Homo sapiens
ggaauguuaaggcgcuguuggu

SEQ ID NO: 89805 - RNA, 22 nt, Homo sapiens
ggacaagaucuuccaccauuca

SEQ ID NO: 89806 - RNA, 22 nt, Homo sapiens
ggagaucuuugaaguguugugc

SEQ ID NO: 89807 - RNA, 22 nt, Homo sapiens
ggagguagguuugugauuugua

SEQ ID NO: 89808 - RNA, 20 nt, Homo sapiens
ggagguuguauaaguacauc

SEQ ID NO: 89809 - RNA, 22 nt, Homo sapiens
ggagugucagaaacaguguccu

SEQ ID NO: 89810 - RNA, 22 nt, Homo sapiens
ggaucacuugagaccaggaguu

SEQ ID NO: 89811 - RNA, 22 nt, Homo sapiens
ggaucauaugauagcucaauuu

SEQ ID NO: 89812 - RNA, 22 nt, Homo sapiens
uagcagaauauaccucuuacuu

SEQ ID NO: 89813 - RNA, 22 nt, Homo sapiens
uagcagcaaagcaggaucugcu

SEQ ID NO: 89814 - RNA, 22 nt, Homo sapiens
uagcagcaccccacucuacugg

SEQ ID NO: 89815 - RNA, 22 nt, Homo sapiens
uagcagcaucucuggcuucuac

SEQ ID NO: 89816 - RNA, 19 nt, Homo sapiens
uagcagcaugauuuauaau

SEQ ID NO: 89817 - RNA, 22 nt, Homo sapiens
uagcaguauaugagagcuauug

SEQ ID NO: 89818 - RNA, 21 nt, Homo sapiens
uagcauacauuuugcaucuua

SEQ ID NO: 89819 - RNA, 21 nt, Homo sapiens
uagcucagugguguugccaua

SEQ ID NO: 89820 - RNA, 22 nt, Homo sapiens
uagcuggaguuuuuguuauagg

SEQ ID NO: 89821 - RNA, 22 nt, Homo sapiens
uaggaaguacaucucagaaucu

SEQ ID NO: 89822 - RNA, 22 nt, Homo sapiens
uagggcuuuaguuugcuugugu

SEQ ID NO: 89823 - RNA, 22 nt, Homo sapiens
uaguaaacauuuuucuaucauu

SEQ ID NO: 89824 - RNA, 22 nt, Homo sapiens
uagucaaaucugaaggaaauuu

SEQ ID NO: 89825 - RNA, 22 nt, Homo sapiens
uagucccauaugauuuagugaa

SEQ ID NO: 89826 - RNA, 22 nt, Homo sapiens
uaucauaguuuggacuuucauu

SEQ ID NO: 89827 - RNA, 21 nt, Homo sapiens
uaucauggugaaacccugucu

SEQ ID NO: 89828 - RNA, 22 nt, Homo sapiens
uaucucagagaaucagauuuac

SEQ ID NO: 89829 - RNA, 22 nt, Homo sapiens
uaugaauuuuauccaggauaua

SEQ ID NO: 89830 - RNA, 20 nt, Homo sapiens
uaugacaaagccuagugagu

SEQ ID NO: 89831 - RNA, 22 nt, Homo sapiens
uaugacuuuggaaaaauuacuu

SEQ ID NO: 89832 - RNA, 22 nt, Homo sapiens
uaugccuuucucacuaagcuua

SEQ ID NO: 89833 - RNA, 22 nt, Homo sapiens
uauggcuuuguuaacauuuucu

SEQ ID NO: 89834 - RNA, 22 nt, Homo sapiens
uaugguuuuaagguuaaggacu

SEQ ID NO: 89835 - RNA, 22 nt, Homo sapiens
uauuguuuuucccaggagucua

SEQ ID NO: 89836 - RNA, 22 nt, Homo sapiens
uauuugguuauaugaguaaguu

SEQ ID NO: 89837 - RNA, 22 nt, Homo sapiens
uauuugguuggugcaaaaguaa

SEQ ID NO: 89838 - RNA, 22 nt, Homo sapiens
ucaaacauccccaccagggacu

SEQ ID NO: 89839 - RNA, 22 nt, Homo sapiens
ucaaagugagcuccuucucacu

SEQ ID NO: 89840 - RNA, 22 nt, Homo sapiens
ucaacaggucaauugcauagaa

SEQ ID NO: 89841 - RNA, 22 nt, Homo sapiens
ucaacauugcugucaggcaucu

SEQ ID NO: 89842 - RNA, 22 nt, Homo sapiens
ucaacugcuugagaucacaaau

SEQ ID NO: 89843 - RNA, 22 nt, Homo sapiens
ucacaaagcuuggccugcuucu

SEQ ID NO: 89844 - RNA, 22 nt, Homo sapiens
ucacaauucucaauuugugaaa

SEQ ID NO: 89845 - RNA, 22 nt, Homo sapiens
ucacacucucaccaacauuugg

SEQ ID NO: 89846 - RNA, 21 nt, Homo sapiens
ucacagccuaggaccugaaga

SEQ ID NO: 89847 - RNA, 22 nt, Homo sapiens
ucacaguaucaugggggacaga

SEQ ID NO: 89848 - RNA, 22 nt, Homo sapiens
ucacagugcaggaucaguuaau

SEQ ID NO: 89849 - RNA, 22 nt, Homo sapiens
ucacaguguuaaaccuuucuuu

SEQ ID NO: 89850 - RNA, 17 nt, Homo sapiens
ucacaguguuaggauga

SEQ ID NO: 89851 - RNA, 22 nt, Homo sapiens
ucacaguugauugaaacacagc

SEQ ID NO: 89852 - RNA, 22 nt, Homo sapiens
ucacauucaauuguaauccccg

SEQ ID NO: 89853 - RNA, 22 nt, Homo sapiens
ucacccuguguuuugcguuugc

SEQ ID NO: 89854 - RNA, 22 nt, Homo sapiens
ucaccuuacuugcuucugaacu

SEQ ID NO: 89855 - RNA, 22 nt, Homo sapiens
ucacugcgaccucugccucccg

SEQ ID NO: 89856 - RNA, 22 nt, Homo sapiens
ucacuguggaacucaaaaagcu

SEQ ID NO: 89857 - RNA, 22 nt, Homo sapiens
ucagaauguaacuuuaguugga

SEQ ID NO: 89858 - RNA, 22 nt, Homo sapiens
ucagaugaucugguaagaacuu

SEQ ID NO: 89859 - RNA, 21 nt, Homo sapiens
ucagcucaucacugccuggag

SEQ ID NO: 89860 - RNA, 22 nt, Homo sapiens
ucaggcaugcagcaaugcagug

SEQ ID NO: 89861 - RNA, 22 nt, Homo sapiens
ucagguauuuuaucacaugaag

SEQ ID NO: 89862 - RNA, 22 nt, Homo sapiens
ucaguaaucuuagcugugcaga

SEQ ID NO: 89863 - RNA, 22 nt, Homo sapiens
ucagugacuggguauuaaauca

SEQ ID NO: 89864 - RNA, 22 nt, Homo sapiens
ucagugucugcauucuuauugu

SEQ ID NO: 89865 - RNA, 22 nt, Homo sapiens
ucauagaucaaguaauaagaca

SEQ ID NO: 89866 - RNA, 19 nt, Homo sapiens
ucauagucuaagaugagaa

SEQ ID NO: 89867 - RNA, 23 nt, Homo sapiens
ucaugaggccauucaaauccauu

SEQ ID NO: 89868 - RNA, 22 nt, Homo sapiens
uccacagugguggaauuguuca

SEQ ID NO: 89869 - RNA, 22 nt, Homo sapiens
uccacagugguugaacuaguuu

SEQ ID NO: 89870 - RNA, 22 nt, Homo sapiens
uccagaguggugaugcuggggc

SEQ ID NO: 89871 - RNA, 22 nt, Homo sapiens
uccagugcauucagacacuugg

SEQ ID NO: 89872 - RNA, 18 nt, Homo sapiens
uccaguuuucccagcauc

SEQ ID NO: 89873 - RNA, 20 nt, Homo sapiens
ucccaguaggagaaggaagg

SEQ ID NO: 89874 - RNA, 22 nt, Homo sapiens
ucccagugcuaugcaaaagccu

SEQ ID NO: 89875 - RNA, 22 nt, Homo sapiens
ucccugagcaaaguuuucugua

SEQ ID NO: 89876 - RNA, 22 nt, Homo sapiens
ucccuuaaugaugaacaaugag

SEQ ID NO: 89877 - RNA, 23 nt, Homo sapiens
uccuugguuggcgcccuaugugu

SEQ ID NO: 89878 - RNA, 22 nt, Homo sapiens
ucgcaccauugcacuccagcca

SEQ ID NO: 89879 - RNA, 20 nt, Homo sapiens
ucuaccuguagguaauuggu

SEQ ID NO: 89880 - RNA, 21 nt, Homo sapiens
ucucauagaguuucacuuucu

SEQ ID NO: 89881 - RNA, 20 nt, Homo sapiens
ucucauggagguagagaaua

SEQ ID NO: 89882 - RNA, 22 nt, Homo sapiens
ucucauggagucaggagcagaa

SEQ ID NO: 89883 - RNA, 22 nt, Homo sapiens
ucucugaaacucuugacauccu

SEQ ID NO: 89884 - RNA, 22 nt, Homo sapiens
ucucugauuaaacaagauagug

SEQ ID NO: 89885 - RNA, 22 nt, Homo sapiens
ucucuuggugacuuaaaauguu

SEQ ID NO: 89886 - RNA, 22 nt, Homo sapiens
ucugucuuugucaggaccagag

SEQ ID NO: 89887 - RNA, 22 nt, Homo sapiens
ucuguggucagaguccuuggcc

SEQ ID NO: 89888 - RNA, 22 nt, Homo sapiens
ucuuauuuggggaaaggguccu

SEQ ID NO: 89889 - RNA, 22 nt, Homo sapiens
ucuucaugcuugaaauaauagc

SEQ ID NO: 89890 - RNA, 20 nt, Homo sapiens
ucuugaacuuagucaacagg

SEQ ID NO: 89891 - RNA, 22 nt, Homo sapiens
ucuugcuuguuguucccuucau

SEQ ID NO: 89892 - RNA, 22 nt, Homo sapiens
ucuuggcaaagaauuuuuggcu

SEQ ID NO: 89893 - RNA, 22 nt, Homo sapiens
ucuugguaaugucacauuuccu

SEQ ID NO: 89894 - RNA, 22 nt, Homo sapiens
ucuuuagugacaguugugcaag

SEQ ID NO: 89895 - RNA, 22 nt, Homo sapiens
ucuuuaguuaagggacauuuua

SEQ ID NO: 89896 - RNA, 22 nt, Homo sapiens
ucuuugguauuuguggggaauu

SEQ ID NO: 89897 - RNA, 22 nt, Homo sapiens
ucuuuggucaucaugggaagca

SEQ ID NO: 89898 - RNA, 22 nt, Homo sapiens
ucuuugucuacauccuguuaaa

SEQ ID NO: 89899 - RNA, 22 nt, Homo sapiens
ucuuuguuuucugauccugaag

SEQ ID NO: 89900 - RNA, 22 nt, Homo sapiens
ugaaaugauuauaugguguuug

SEQ ID NO: 89901 - RNA, 22 nt, Homo sapiens
ugaaauuuuuuauucguuggcu

SEQ ID NO: 89902 - RNA, 22 nt, Homo sapiens
ugaacuguaagguauaggugau

SEQ ID NO: 89903 - RNA, 22 nt, Homo sapiens
ugaauguuugcagcuuauacca

SEQ ID NO: 89904 - RNA, 22 nt, Homo sapiens
ugaauucuguccaaaauaacug

SEQ ID NO: 89905 - RNA, 22 nt, Homo sapiens
ugaauuguuuacgagaugugag

SEQ ID NO: 89906 - RNA, 22 nt, Homo sapiens
ugacaagaaagcgucuucuuuu

SEQ ID NO: 89907 - RNA, 22 nt, Homo sapiens
ugacaagaacuuuccauaguaa

SEQ ID NO: 89908 - RNA, 22 nt, Homo sapiens
ugacaaguaaacagucagcacc

SEQ ID NO: 89909 - RNA, 22 nt, Homo sapiens
ugacaagugauuaaggcauauu

SEQ ID NO: 89910 - RNA, 22 nt, Homo sapiens
ugacagagaagcauugaguuca

SEQ ID NO: 89911 - RNA, 22 nt, Homo sapiens
ugacagagcaggacuucaucuc

SEQ ID NO: 89912 - RNA, 22 nt, Homo sapiens
ugacagugugagauccugucuc

SEQ ID NO: 89913 - RNA, 22 nt, Homo sapiens
acacagucaaauccacuuggcu

SEQ ID NO: 89914 - RNA, 22 nt, Homo sapiens
acacaugcuccacuguggccuc

SEQ ID NO: 89915 - RNA, 22 nt, Homo sapiens
acacugucaugucucacaggca

SEQ ID NO: 89916 - RNA, 22 nt, Homo sapiens
acacuguuuuaguuauuauagc

SEQ ID NO: 89917 - RNA, 22 nt, Homo sapiens
acagagcaaugagcuacggucu

SEQ ID NO: 89918 - RNA, 19 nt, Homo sapiens
acagcugguuuugguuucu

SEQ ID NO: 89919 - RNA, 22 nt, Homo sapiens
acaggguuauuguaauaaugua

SEQ ID NO: 89920 - RNA, 22 nt, Homo sapiens
acagucuggagaaugggugcuc

SEQ ID NO: 89921 - RNA, 22 nt, Homo sapiens
acagugcuuucaauguucagua

SEQ ID NO: 89922 - RNA, 17 nt, Homo sapiens
acagugcuuugcuuucc

SEQ ID NO: 89923 - RNA, 22 nt, Homo sapiens
acaguguagugacugccaacuu

SEQ ID NO: 89924 - RNA, 17 nt, Homo sapiens
acagugucuaugaaaug

SEQ ID NO: 89925 - RNA, 22 nt, Homo sapiens
acaucccaugccuggguacucc

SEQ ID NO: 89926 - RNA, 22 nt, Homo sapiens
acaugagacuggguuuguaggg

SEQ ID NO: 89927 - RNA, 22 nt, Homo sapiens
acaugccucccugguccgcugu

SEQ ID NO: 89928 - RNA, 22 nt, Homo sapiens
acauucagcuguuguuucaaug

SEQ ID NO: 89929 - RNA, 18 nt, Homo sapiens
acauucagcuugaagaua

SEQ ID NO: 89930 - RNA, 22 nt, Homo sapiens
accacagugcuuccugcucacg

SEQ ID NO: 89931 - RNA, 21 nt, Homo sapiens
acccccacaccuccuuaguuc

SEQ ID NO: 89932 - RNA, 22 nt, Homo sapiens
acccugucacucccaucaauuu

SEQ ID NO: 89933 - RNA, 23 nt, Homo sapiens
accugauguuucuguggggagcc

SEQ ID NO: 89934 - RNA, 23 nt, Homo sapiens
accuucauucauucagcugaagu

SEQ ID NO: 89935 - RNA, 18 nt, Homo sapiens
accuucauuccuuugccu

SEQ ID NO: 89936 - RNA, 22 nt, Homo sapiens
accuugcacugagccgagauug

SEQ ID NO: 89937 - RNA, 22 nt, Homo sapiens
acuccauuuggacucugggagg

SEQ ID NO: 89938 - RNA, 22 nt, Homo sapiens
acucuguauaaacauugcugua

SEQ ID NO: 89939 - RNA, 22 nt, Homo sapiens
acugagaucuuuaaauaaauaa

SEQ ID NO: 89940 - RNA, 22 nt, Homo sapiens
acugagccuuuaaaugacuuca

SEQ ID NO: 89941 - RNA, 22 nt, Homo sapiens
acugagucauugggugcccaga

SEQ ID NO: 89942 - RNA, 22 nt, Homo sapiens
acugcacuccagccuuggagac

SEQ ID NO: 89943 - RNA, 19 nt, Homo sapiens
acuuuggugauuagaggga

SEQ ID NO: 89944 - RNA, 22 nt, Homo sapiens
acuuugguuaucauacuuucag

SEQ ID NO: 89945 - RNA, 22 nt, Homo sapiens
acuuugguuuauagaauuuagg

SEQ ID NO: 89946 - RNA, 22 nt, Homo sapiens
acuuuuugauggggagaacauu

SEQ ID NO: 89947 - RNA, 22 nt, Homo sapiens
gugucaugagggggacaggaag

SEQ ID NO: 89948 - RNA, 22 nt, Homo sapiens
guuauguuauguuauguuaugu

SEQ ID NO: 89949 - RNA, 22 nt, Homo sapiens
guuauuaguugauauuaaguuc

SEQ ID NO: 89950 - RNA, 22 nt, Homo sapiens
guucaaggaauguuggcuucuc

SEQ ID NO: 89951 - RNA, 22 nt, Homo sapiens
guucaagugauagcugggauua

SEQ ID NO: 89952 - RNA, 22 nt, Homo sapiens
guucaaguuuucucuugugggu

SEQ ID NO: 89953 - RNA, 22 nt, Homo sapiens
guucaguaguucauucauuuau

SEQ ID NO: 89954 - RNA, 22 nt, Homo sapiens
guucccaguugaaaugauuagu

SEQ ID NO: 89955 - RNA, 22 nt, Homo sapiens
guucuauguugggaguucacua

SEQ ID NO: 89956 - RNA, 22 nt, Homo sapiens
guuuacagucgacuugggaaua

SEQ ID NO: 89957 - RNA, 22 nt, Homo sapiens
guuuggcuuucucucuauccug

SEQ ID NO: 89958 - RNA, 22 nt, Homo sapiens
uaaagaugcugggaaggcuagg

SEQ ID NO: 89959 - RNA, 22 nt, Homo sapiens
uaaauacguccauuugugguau

SEQ ID NO: 89960 - RNA, 22 nt, Homo sapiens
uaacaccuugcucugucaauaa

SEQ ID NO: 89961 - RNA, 22 nt, Homo sapiens
uaacccuuaguaucuguggguu

SEQ ID NO: 89962 - RNA, 22 nt, Homo sapiens
uaagagcuaggauuuuaaauca

SEQ ID NO: 89963 - RNA, 22 nt, Homo sapiens
uaagguccuuaaauguguaacc

SEQ ID NO: 89964 - RNA, 22 nt, Homo sapiens
uaaguagaggaaucauuuugug

SEQ ID NO: 89965 - RNA, 22 nt, Homo sapiens
uaagucacuccagguuaaagug

SEQ ID NO: 89966 - RNA, 22 nt, Homo sapiens
uaauaguuggcacuggagaaag

SEQ ID NO: 89967 - RNA, 22 nt, Homo sapiens
uaaucucagcugagcugagauu

SEQ ID NO: 89968 - RNA, 16 nt, Homo sapiens
uacaauguagaaaaca

SEQ ID NO: 89969 - RNA, 22 nt, Homo sapiens
uacaggauagacaauuuauuaa

SEQ ID NO: 89970 - RNA, 22 nt, Homo sapiens
uacaggugcucuacagacagga

SEQ ID NO: 89971 - RNA, 22 nt, Homo sapiens
uacagucacauuccugaccaua

SEQ ID NO: 89972 - RNA, 22 nt, Homo sapiens
uacagugcauagaggcaugaua

SEQ ID NO: 89973 - RNA, 22 nt, Homo sapiens
uacaguggcaugucaggugcuu

SEQ ID NO: 89974 - RNA, 22 nt, Homo sapiens
uacagugggcacuggcgcccug

SEQ ID NO: 89975 - RNA, 22 nt, Homo sapiens
uacauagucuucuuuugguuau

SEQ ID NO: 89976 - RNA, 22 nt, Homo sapiens
uaccaaaguuucggccucuguu

SEQ ID NO: 89977 - RNA, 22 nt, Homo sapiens
uaccaguaaugguucuagagga

SEQ ID NO: 89978 - RNA, 22 nt, Homo sapiens
uaccaugaagguggagagagaa

SEQ ID NO: 89979 - RNA, 22 nt, Homo sapiens
uacucaguagacacucauaugu

SEQ ID NO: 89980 - RNA, 22 nt, Homo sapiens
uacucuuuagcuccuuaaggaa

SEQ ID NO: 89981 - RNA, 22 nt, Homo sapiens
uacugcacuccagccugggaga

SEQ ID NO: 89982 - RNA, 22 nt, Homo sapiens
uagaaagcaugaccuucagaua

SEQ ID NO: 89983 - RNA, 22 nt, Homo sapiens
uagauuaucccugauuugucca

SEQ ID NO: 89984 - RNA, 22 nt, Homo sapiens
uagcagcagugguguauuuaga

SEQ ID NO: 89985 - RNA, 21 nt, Homo sapiens
uagcuacacugugauucaugg

SEQ ID NO: 89986 - RNA, 18 nt, Homo sapiens
uagcucuuguugguccau

SEQ ID NO: 89987 - RNA, 22 nt, Homo sapiens
uagcugagacuacaguaggugc

SEQ ID NO: 89988 - RNA, 22 nt, Homo sapiens
uaggcaguuuuccuuucacagu

SEQ ID NO: 89989 - RNA, 22 nt, Homo sapiens
uagggcuuuccggccugucaga

SEQ ID NO: 89990 - RNA, 22 nt, Homo sapiens
uaggucuuuuagcauaggagcu

SEQ ID NO: 89991 - RNA, 22 nt, Homo sapiens
uaguaccauucccaaaccaacu

SEQ ID NO: 89992 - RNA, 22 nt, Homo sapiens
uaguauguuuauagcauugagu

SEQ ID NO: 89993 - RNA, 23 nt, Homo sapiens
uauaacuuuuaauuuacuggccu

SEQ ID NO: 89994 - RNA, 22 nt, Homo sapiens
uauacaguaggcacucaguggc

SEQ ID NO: 89995 - RNA, 22 nt, Homo sapiens
uauaugcacucagguguaugug

SEQ ID NO: 89996 - RNA, 22 nt, Homo sapiens
uauaugucugagacugggggau

SEQ ID NO: 89997 - RNA, 22 nt, Homo sapiens
uaucacagcauugucuauaaua

SEQ ID NO: 89998 - RNA, 20 nt, Homo sapiens
uaucacauggggagaaaccu

SEQ ID NO: 89999 - RNA, 21 nt, Homo sapiens
uaucacauuggugauuaaguu

SEQ ID NO: 90000 - RNA, 22 nt, Homo sapiens
uaucagaguuacacugaagacu

SEQ ID NO: 90001 - RNA, 22 nt, Homo sapiens
uaucucagaguguacaagauua

SEQ ID NO: 90002 - RNA, 22 nt, Homo sapiens
uaucucaguguacaggaugaua

SEQ ID NO: 90003 - RNA, 22 nt, Homo sapiens
uaucucauccuccuugauccca

SEQ ID NO: 90004 - RNA, 23 nt, Homo sapiens
uaugacagaggaagggggagcug

SEQ ID NO: 90005 - RNA, 22 nt, Homo sapiens
uaugcuuguuuauuuaagaaac

SEQ ID NO: 90006 - RNA, 21 nt, Homo sapiens
uaugguuucuaauucugcagg

SEQ ID NO: 90007 - RNA, 22 nt, Homo sapiens
uaugucaugggguuuuugagau

SEQ ID NO: 90008 - RNA, 22 nt, Homo sapiens
uauuacacuuuagugucuucca

SEQ ID NO: 90009 - RNA, 22 nt, Homo sapiens
uauuccauuugugaaaggaagu

SEQ ID NO: 90010 - RNA, 22 nt, Homo sapiens
uauugcaacagaagaaagaguc

SEQ ID NO: 90011 - RNA, 22 nt, Homo sapiens
uauugcucaugcauuuaauuuc

SEQ ID NO: 90012 - RNA, 22 nt, Homo sapiens
uauuguuaaagauguuaaugau

SEQ ID NO: 90013 - RNA, 22 nt, Homo sapiens
uauuucaguugugcagguaguu

SEQ ID NO: 90014 - RNA, 22 nt, Homo sapiens
ucaacagugggcacuguaaaug

SEQ ID NO: 90015 - RNA, 22 nt, Homo sapiens
ucaaggcacauuugacauuuuc

SEQ ID NO: 90016 - RNA, 22 nt, Homo sapiens
ucaaggcacuagcugagcugca

SEQ ID NO: 90017 - RNA, 22 nt, Homo sapiens
ucacaauguaaaugaggguugg

SEQ ID NO: 90018 - RNA, 22 nt, Homo sapiens
ucacagaggagaagaccuuuaa

SEQ ID NO: 90019 - RNA, 21 nt, Homo sapiens
cucugguuugcauuggauuau

SEQ ID NO: 90020 - RNA, 19 nt, Homo sapiens
cugaaacacagagagggcu

SEQ ID NO: 90021 - RNA, 22 nt, Homo sapiens
cugaaucauugcauuaucaagg

SEQ ID NO: 90022 - RNA, 22 nt, Homo sapiens
cugagacuggugauuuaugaag

SEQ ID NO: 90023 - RNA, 22 nt, Homo sapiens
cugagauaggacucugcuggcu

SEQ ID NO: 90024 - RNA, 22 nt, Homo sapiens
cugagaucguggggcugcuguc

SEQ ID NO: 90025 - RNA, 18 nt, Homo sapiens
cugagcacugcuuuauga

SEQ ID NO: 90026 - RNA, 22 nt, Homo sapiens
cugagcucauuucuuuugcuac

SEQ ID NO: 90027 - RNA, 22 nt, Homo sapiens
cugaggacaucagggaagcauc

SEQ ID NO: 90028 - RNA, 22 nt, Homo sapiens
cugagguacccacuucaucuca

SEQ ID NO: 90029 - RNA, 22 nt, Homo sapiens
cugagguuaggaguuugagacc

SEQ ID NO: 90030 - RNA, 22 nt, Homo sapiens
cugcaagaaucguaguauuuga

SEQ ID NO: 90031 - RNA, 19 nt, Homo sapiens
cugcaugagacaguugguu

SEQ ID NO: 90032 - RNA, 20 nt, Homo sapiens
cuggaucaucaguaaaguua

SEQ ID NO: 90033 - RNA, 22 nt, Homo sapiens
cuggcgagacagcuccaucacu

SEQ ID NO: 90034 - RNA, 22 nt, Homo sapiens
cugggaucaguucuagucagaa

SEQ ID NO: 90035 - RNA, 21 nt, Homo sapiens
cugguccccuuuauguaugug

SEQ ID NO: 90036 - RNA, 22 nt, Homo sapiens
cugucucagccucuccaguagc

SEQ ID NO: 90037 - RNA, 22 nt, Homo sapiens
cugugguauuauuagaaauauc

SEQ ID NO: 90038 - RNA, 22 nt, Homo sapiens
cuuacagucuaucagccacaac

SEQ ID NO: 90039 - RNA, 22 nt, Homo sapiens
cuucacggugccuacuuguguc

SEQ ID NO: 90040 - RNA, 22 nt, Homo sapiens
cuucuguuaguucugauaacuu

SEQ ID NO: 90041 - RNA, 21 nt, Homo sapiens
cuucuuggggcagggcagggu

SEQ ID NO: 90042 - RNA, 22 nt, Homo sapiens
cuugagcuugagauccuuucug

SEQ ID NO: 90043 - RNA, 22 nt, Homo sapiens
cuugccuuugucuucaaaggcu

SEQ ID NO: 90044 - RNA, 22 nt, Homo sapiens
cuugggccccacccaaaucuua

SEQ ID NO: 90045 - RNA, 22 nt, Homo sapiens
cuuuggcaaugucauuuucaau

SEQ ID NO: 90046 - RNA, 22 nt, Homo sapiens
cuuugguggagucuuuagguuc

SEQ ID NO: 90047 - RNA, 22 nt, Homo sapiens
cuuugguuaauaggauauggca

SEQ ID NO: 90048 - RNA, 22 nt, Homo sapiens
cuuuuacacugguggugggaau

SEQ ID NO: 90049 - RNA, 22 nt, Homo sapiens
cuuuuacacuguuggcaggauu

SEQ ID NO: 90050 - RNA, 23 nt, Homo sapiens
cuuuugcaaugugaucuugccac

SEQ ID NO: 90051 - RNA, 22 nt, Homo sapiens
uuucagagucaucugcccaagu

SEQ ID NO: 90052 - RNA, 22 nt, Homo sapiens
uuucauagccuucuaaugaguu

SEQ ID NO: 90053 - RNA, 23 nt, Homo sapiens
uuucauggggauuuacucauucc

SEQ ID NO: 90054 - RNA, 19 nt, Homo sapiens
uuucauguuuuuggugaga

SEQ ID NO: 90055 - RNA, 22 nt, Homo sapiens
uuucccagugguacaguuuaua

SEQ ID NO: 90056 - RNA, 22 nt, Homo sapiens
uuucuacagugaacgauuucua

SEQ ID NO: 90057 - RNA, 16 nt, Homo sapiens
uuucuauguuuuacua

SEQ ID NO: 90058 - RNA, 22 nt, Homo sapiens
uuugaauguaaugagcaggaag

SEQ ID NO: 90059 - RNA, 22 nt, Homo sapiens
uuugccaaucagaggcaucuug

SEQ ID NO: 90060 - RNA, 22 nt, Homo sapiens
uuugcuauagugaauagugcug

SEQ ID NO: 90061 - RNA, 22 nt, Homo sapiens
uuuggcaugggcuauuugcuuu

SEQ ID NO: 90062 - RNA, 22 nt, Homo sapiens
uuugucaauaacuaccaacagg

SEQ ID NO: 90063 - RNA, 22 nt, Homo sapiens
uuuguucuucguuccugagcca

SEQ ID NO: 90064 - RNA, 22 nt, Homo sapiens
uuuuagcaaagagacugguggc

SEQ ID NO: 90065 - RNA, 22 nt, Homo sapiens
uuuuauguuuguucccugccaa

SEQ ID NO: 90066 - RNA, 20 nt, Homo sapiens
uuuugaacuuggcaaccugu

SEQ ID NO: 90067 - RNA, 23 nt, Homo sapiens
uuuugcaauaagucacuggaaua

SEQ ID NO: 90068 - RNA, 19 nt, Homo sapiens
uuuuggaaaugugaacagc

SEQ ID NO: 90069 - RNA, 22 nt, Homo sapiens
uuuuggucuccaguuucugcug

SEQ ID NO: 90070 - RNA, 22 nt, Homo sapiens
uuuuguacgccuguguccauca

SEQ ID NO: 90071 - RNA, 22 nt, Homo sapiens
uuuuuugcuguaugcaaacauc

SEQ ID NO: 90072 - RNA, 18 nt, Homo sapiens
aaaaagugcucaggccua

SEQ ID NO: 90073 - RNA, 22 nt, Homo sapiens
aaaagagcugagagguauucuu

SEQ ID NO: 90074 - RNA, 22 nt, Homo sapiens
aaaaguucuuugagccuugaca

SEQ ID NO: 90075 - RNA, 22 nt, Homo sapiens
aaaaugcugauauugggcccca

SEQ ID NO: 90076 - RNA, 22 nt, Homo sapiens
aaaccacagugugcugcugggg

SEQ ID NO: 90077 - RNA, 15 nt, Homo sapiens
aaacccugucucaag

SEQ ID NO: 90078 - RNA, 22 nt, Homo sapiens
aaacugucuucugacaguuucc

SEQ ID NO: 90079 - RNA, 22 nt, Homo sapiens
aaacuugucuaauuauaagcau

SEQ ID NO: 90080 - RNA, 22 nt, Homo sapiens
aaagaagucagccuguccuuug

SEQ ID NO: 90081 - RNA, 22 nt, Homo sapiens
aaagagcugagaccugguggag

SEQ ID NO: 90082 - RNA, 22 nt, Homo sapiens
aaagcaucacuuuuccuacuuu

SEQ ID NO: 90083 - RNA, 22 nt, Homo sapiens
aaaggauucuaauggaaaugcu

SEQ ID NO: 90084 - RNA, 20 nt, Homo sapiens
aaaggcugugagaacgagau

SEQ ID NO: 90085 - RNA, 22 nt, Homo sapiens
aaagucacuggagaaggaauau

SEQ ID NO: 90086 - RNA, 22 nt, Homo sapiens
aaagucuguuuugucagagacu

SEQ ID NO: 90087 - RNA, 22 nt, Homo sapiens
aaagugauguccaggcuuucag

SEQ ID NO: 90088 - RNA, 22 nt, Homo sapiens
aaagugauuguaguuuuugcca

SEQ ID NO: 90089 - RNA, 22 nt, Homo sapiens
aaagugcaguacuucguauauu

SEQ ID NO: 90090 - RNA, 22 nt, Homo sapiens
aaagugcaguauuugggcagga

SEQ ID NO: 90091 - RNA, 22 nt, Homo sapiens
aaagugccugacucauaguuag

SEQ ID NO: 90092 - RNA, 22 nt, Homo sapiens
aaagugcugagacagacuggga

SEQ ID NO: 90093 - RNA, 22 nt, Homo sapiens
aaagugcugagucuaggcgggg

SEQ ID NO: 90094 - RNA, 22 nt, Homo sapiens
aaagugcuuccuuuuugagggu

SEQ ID NO: 90095 - RNA, 22 nt, Homo sapiens
aaagugcuucucuuuggugggu

SEQ ID NO: 90096 - RNA, 19 nt, Homo sapiens
aaaguguuuuaaagaggau

SEQ ID NO: 90097 - RNA, 22 nt, Homo sapiens
aaaguucugcguuagggcuaaa

SEQ ID NO: 90098 - RNA, 22 nt, Homo sapiens
aaaguucuugcugaaggauuau

SEQ ID NO: 90099 - RNA, 22 nt, Homo sapiens
aaauccauuuguucagcuaugc

SEQ ID NO: 90100 - RNA, 22 nt, Homo sapiens
aaaucccuugcucucucagacc

SEQ ID NO: 90101 - RNA, 22 nt, Homo sapiens
aaaugcacagaaaggaugugga

SEQ ID NO: 90102 - RNA, 21 nt, Homo sapiens
aaaugcacauuacugcuggug

SEQ ID NO: 90103 - RNA, 22 nt, Homo sapiens
aaaugcagauuccuaggcccca

SEQ ID NO: 90104 - RNA, 22 nt, Homo sapiens
aaaugcaguugguggggauaug

SEQ ID NO: 90105 - RNA, 22 nt, Homo sapiens
aaaugcaucauuaggugauuuu

SEQ ID NO: 90106 - RNA, 22 nt, Homo sapiens
aaaugcauugagggaaaaggca

SEQ ID NO: 90107 - RNA, 23 nt, Homo sapiens
aaaugcucucaggugccaguaga

SEQ ID NO: 90108 - RNA, 22 nt, Homo sapiens
aaaugcucuguggguaguaaug

SEQ ID NO: 90109 - RNA, 22 nt, Homo sapiens
aaaugcugucugugagccucau

SEQ ID NO: 90110 - RNA, 22 nt, Homo sapiens
aaaugcuuucuuggaccauuug

SEQ ID NO: 90111 - RNA, 22 nt, Homo sapiens
aaauggcacaguaagggcauuu

SEQ ID NO: 90112 - RNA, 22 nt, Homo sapiens
aaauggcuuugaggguaggaca

SEQ ID NO: 90113 - RNA, 22 nt, Homo sapiens
aaauggcuuuuugggcaaggug

SEQ ID NO: 90114 - RNA, 22 nt, Homo sapiens
aaaugguguuaguagaucuuua

SEQ ID NO: 90115 - RNA, 21 nt, Homo sapiens
aaaugugcuuuaguacccuca

SEQ ID NO: 90116 - RNA, 22 nt, Homo sapiens
aaauucaucaaaugguuuguau

SEQ ID NO: 90117 - RNA, 22 nt, Homo sapiens
aaauucauuucagcucugggua

SEQ ID NO: 90118 - RNA, 18 nt, Homo sapiens
aaauucugucccuucuuc

SEQ ID NO: 90119 - RNA, 22 nt, Homo sapiens
aaauugcacaaguggugauuug

SEQ ID NO: 90120 - RNA, 22 nt, Homo sapiens
aaauugcuuuugaagacuuagu

SEQ ID NO: 90121 - RNA, 23 nt, Homo sapiens
aaauuugccuauuauuccuaugg

SEQ ID NO: 90122 - RNA, 22 nt, Homo sapiens
aacagcuaguaccaauccacua

SEQ ID NO: 90123 - RNA, 22 nt, Homo sapiens
aacagucuccaguuguauccau

SEQ ID NO: 90124 - RNA, 22 nt, Homo sapiens
aacaguguuuuggguuuucugg

SEQ ID NO: 90125 - RNA, 22 nt, Homo sapiens
aacaucaaccaugaggguugga

SEQ ID NO: 90126 - RNA, 22 nt, Homo sapiens
aacccugacacaagcagaauuu

SEQ ID NO: 90127 - RNA, 22 nt, Homo sapiens
aacccugagucaugagucuaga

SEQ ID NO: 90128 - RNA, 22 nt, Homo sapiens
aaccuauaguauugaaaucaag

SEQ ID NO: 90129 - RNA, 15 nt, Homo sapiens
aaccuggaggagcuu

SEQ ID NO: 90130 - RNA, 22 nt, Homo sapiens
aaccuguaaccauaugaucagu

SEQ ID NO: 90131 - RNA, 22 nt, Homo sapiens
aacuaugucaaauaaaaugagg

SEQ ID NO: 90132 - RNA, 22 nt, Homo sapiens
aacucacauucuuucuugguac

SEQ ID NO: 90133 - RNA, 22 nt, Homo sapiens
aacugcacauauuuguaugggu

SEQ ID NO: 90134 - RNA, 22 nt, Homo sapiens
aacuggcauagccagacuucuc

SEQ ID NO: 90135 - RNA, 22 nt, Homo sapiens
aacuggcauaugaacuuguucu

SEQ ID NO: 90136 - RNA, 22 nt, Homo sapiens
aacuggccugagaugaaaagug

SEQ ID NO: 90137 - RNA, 22 nt, Homo sapiens
aacugggcaagcauuacauggu

SEQ ID NO: 90138 - RNA, 22 nt, Homo sapiens
aacugguauuucccaugaauuu

SEQ ID NO: 90139 - RNA, 19 nt, Homo sapiens
aacuggugugagaugguau

SEQ ID NO: 90140 - RNA, 20 nt, Homo sapiens
aagacacuguccccacugga

SEQ ID NO: 90141 - RNA, 22 nt, Homo sapiens
aagagaugaagguccugacugu

SEQ ID NO: 90142 - RNA, 22 nt, Homo sapiens
aagagcauuggauggggagauu

SEQ ID NO: 90143 - RNA, 22 nt, Homo sapiens
aagagcucauccauaguuguca

SEQ ID NO: 90144 - RNA, 22 nt, Homo sapiens
aagagguaauaacaaagcuucu

SEQ ID NO: 90145 - RNA, 22 nt, Homo sapiens
aagagguagaagcuugccuucu

SEQ ID NO: 90146 - RNA, 22 nt, Homo sapiens
aagagguagcagucacaaaaga

SEQ ID NO: 90147 - RNA, 22 nt, Homo sapiens
aagagguaggaaauggucauuu

SEQ ID NO: 90148 - RNA, 23 nt, Homo sapiens
aagagguaugacuaugaagugga

SEQ ID NO: 90149 - RNA, 22 nt, Homo sapiens
aagaguuaguaaaauuuccucu

SEQ ID NO: 90150 - RNA, 22 nt, Homo sapiens
aagaucaucauagagggcauga

SEQ ID NO: 90151 - RNA, 22 nt, Homo sapiens
aagaugcagucauacuggagga

SEQ ID NO: 90152 - RNA, 20 nt, Homo sapiens
aagcaagcauuugcaaucau

SEQ ID NO: 90153 - RNA, 22 nt, Homo sapiens
aagcaccaauaggagauuuguc

SEQ ID NO: 90154 - RNA, 22 nt, Homo sapiens
aagcagacauguucauuuugaa

SEQ ID NO: 90155 - RNA, 20 nt, Homo sapiens
aagcagacauuuggaugaaa

SEQ ID NO: 90156 - RNA, 22 nt, Homo sapiens
aagcaggugucugugucuguaa

SEQ ID NO: 90157 - RNA, 22 nt, Homo sapiens
aagcaucacauaauggaucaug

SEQ ID NO: 90158 - RNA, 22 nt, Homo sapiens
aagcaucauuuggaauuugaga

SEQ ID NO: 90159 - RNA, 20 nt, Homo sapiens
aagcauggguuuuaggguca

SEQ ID NO: 90160 - RNA, 22 nt, Homo sapiens
aagcuagugagacagugguacu

SEQ ID NO: 90161 - RNA, 22 nt, Homo sapiens
aagcuaguguuccagugaacag

SEQ ID NO: 90162 - RNA, 22 nt, Homo sapiens
aagcucuuguugaaucuuguca

SEQ ID NO: 90163 - RNA, 20 nt, Homo sapiens
aagcugaguguuuuuuuaau

SEQ ID NO: 90164 - RNA, 22 nt, Homo sapiens
aagcugccuugugaaggcauuc

SEQ ID NO: 90165 - RNA, 22 nt, Homo sapiens
aagcugguguguauuauucacu

SEQ ID NO: 90166 - RNA, 22 nt, Homo sapiens
aagcugguuuuauaucugugag

SEQ ID NO: 90167 - RNA, 22 nt, Homo sapiens
aagcuguugguggaucuaccau

SEQ ID NO: 90168 - RNA, 22 nt, Homo sapiens
aagcuuucaacuguuugccauu

SEQ ID NO: 90169 - RNA, 22 nt, Homo sapiens
aaggaacuggaauauuuugaac

SEQ ID NO: 90170 - RNA, 22 nt, Homo sapiens
aaggaaguaauuugguuuauag

SEQ ID NO: 90171 - RNA, 22 nt, Homo sapiens
aaggaauucaaauuuucucugg

SEQ ID NO: 90172 - RNA, 22 nt, Homo sapiens
aaggaguagaauagaugcaccu

SEQ ID NO: 90173 - RNA, 22 nt, Homo sapiens
aaggaguauugaaugaccaagu

SEQ ID NO: 90174 - RNA, 22 nt, Homo sapiens
aaggagugugauucuucaguuu

SEQ ID NO: 90175 - RNA, 22 nt, Homo sapiens
aaggauuguaacaccaagguua

SEQ ID NO: 90176 - RNA, 22 nt, Homo sapiens
aaggcaagaagagaaccaucgg

SEQ ID NO: 90177 - RNA, 22 nt, Homo sapiens
aaggcaagagaaaauuucgagu

SEQ ID NO: 90178 - RNA, 22 nt, Homo sapiens
aaggcaagauacugguugcuga

SEQ ID NO: 90179 - RNA, 22 nt, Homo sapiens
aaggcagucacuaaauagugag

SEQ ID NO: 90180 - RNA, 22 nt, Homo sapiens
aaggcaguggcagaagauguca

SEQ ID NO: 90181 - RNA, 22 nt, Homo sapiens
aaggcaugcaaagaacauuuua

SEQ ID NO: 90182 - RNA, 22 nt, Homo sapiens
aaggcaugcugaguccuaaaag

SEQ ID NO: 90183 - RNA, 22 nt, Homo sapiens
aaggcauggugacuauuuaggc

SEQ ID NO: 90184 - RNA, 22 nt, Homo sapiens
aaggcgguguggauccuacagc

SEQ ID NO: 90185 - RNA, 22 nt, Homo sapiens
aaggcuagagaagaagggcauc

SEQ ID NO: 90186 - RNA, 22 nt, Homo sapiens
aaggcucuuucaacguaaauua

SEQ ID NO: 90187 - RNA, 22 nt, Homo sapiens
aaggcuguuguguaauaggauu

SEQ ID NO: 90188 - RNA, 22 nt, Homo sapiens
aagggaauguuguggcugguug

SEQ ID NO: 90189 - RNA, 22 nt, Homo sapiens
aagguacuggaaagaggaaugg

SEQ ID NO: 90190 - RNA, 22 nt, Homo sapiens
aagguauuuuugucuauaucuu

SEQ ID NO: 90191 - RNA, 22 nt, Homo sapiens
aaggucauugugguuuuugcca

SEQ ID NO: 90192 - RNA, 22 nt, Homo sapiens
aaggugcuguaagcauccaugu

SEQ ID NO: 90193 - RNA, 21 nt, Homo sapiens
aaggugguggugauugagaug

SEQ ID NO: 90194 - RNA, 22 nt, Homo sapiens
aaggugguuuucucuuggaguc

SEQ ID NO: 90195 - RNA, 22 nt, Homo sapiens
aagguucuugcuugcaugacug

SEQ ID NO: 90196 - RNA, 22 nt, Homo sapiens
aaguaaauauccgguaguccca

SEQ ID NO: 90197 - RNA, 19 nt, Homo sapiens
aaguacuugucuuuugaag

SEQ ID NO: 90198 - RNA, 22 nt, Homo sapiens
aaguagcuggaugcaguggcac

SEQ ID NO: 90199 - RNA, 22 nt, Homo sapiens
aaguaguuaggaacauucucuc

SEQ ID NO: 90200 - RNA, 22 nt, Homo sapiens
aaguaucaggaauaguuauugg

SEQ ID NO: 90201 - RNA, 22 nt, Homo sapiens
aaguauuaagacuaagaggcuu

SEQ ID NO: 90202 - RNA, 22 nt, Homo sapiens
aaguauuagcuaauugugcuua

SEQ ID NO: 90203 - RNA, 22 nt, Homo sapiens
aagucaaggagagaggcgucag

SEQ ID NO: 90204 - RNA, 22 nt, Homo sapiens
aagucaguuugggagaagcuau

SEQ ID NO: 90205 - RNA, 22 nt, Homo sapiens
aagucauggagaagguggaggu

SEQ ID NO: 90206 - RNA, 19 nt, Homo sapiens
aagugaaugcuuuguucac

SEQ ID NO: 90207 - RNA, 22 nt, Homo sapiens
aagugaccuaacaaugaaggcc

SEQ ID NO: 90208 - RNA, 22 nt, Homo sapiens
aagugagaugcaguggaguucc

SEQ ID NO: 90209 - RNA, 20 nt, Homo sapiens
aagugaguguuaaacugaac

SEQ ID NO: 90210 - RNA, 22 nt, Homo sapiens
aagugcaaauucccaggcucug

SEQ ID NO: 90211 - RNA, 22 nt, Homo sapiens
aagugcacuguaagugcaggau

SEQ ID NO: 90212 - RNA, 20 nt, Homo sapiens
aagugcaucguugugucugc

SEQ ID NO: 90213 - RNA, 22 nt, Homo sapiens
aagugcauguauuaguguaguc

SEQ ID NO: 90214 - RNA, 22 nt, Homo sapiens
aagugcucuugaaacugccuua

SEQ ID NO: 90215 - RNA, 22 nt, Homo sapiens
aagugcucuugaaacugucuua

SEQ ID NO: 90216 - RNA, 22 nt, Homo sapiens
aagugcugggauuggccgggca

SEQ ID NO: 90217 - RNA, 22 nt, Homo sapiens
aagugcuguccuaccuuuggga

SEQ ID NO: 90218 - RNA, 22 nt, Homo sapiens
aagugcuuccuuucagaggguu

SEQ ID NO: 90219 - RNA, 22 nt, Homo sapiens
aagugcuuuguacagggguuga

SEQ ID NO: 90220 - RNA, 19 nt, Homo sapiens
aagugguuuaaacuuguau

SEQ ID NO: 90221 - RNA, 23 nt, Homo sapiens
aagugguuuugaacccggacccu

SEQ ID NO: 90222 - RNA, 22 nt, Homo sapiens
aagugguuuuuacaaagacaga

SEQ ID NO: 90223 - RNA, 23 nt, Homo sapiens
aaguucaugcucaucuguuacac

SEQ ID NO: 90224 - RNA, 22 nt, Homo sapiens
aaguugcuuuagguaagucaau

SEQ ID NO: 90225 - RNA, 22 nt, Homo sapiens
aauaaagcaggguccuugcacu

SEQ ID NO: 90226 - RNA, 22 nt, Homo sapiens
aauaaagccugucucuuuagag

SEQ ID NO: 90227 - RNA, 22 nt, Homo sapiens
aauaagcugagagaauucuaca

SEQ ID NO: 90228 - RNA, 22 nt, Homo sapiens
aauaaguugagaugaggucaua

SEQ ID NO: 90229 - RNA, 22 nt, Homo sapiens
aauacagcacacagaugggucu

SEQ ID NO: 90230 - RNA, 22 nt, Homo sapiens
aauacucaguccuggugaggcu

SEQ ID NO: 90231 - RNA, 21 nt, Homo sapiens
aauacucuagguuaagagagc

SEQ ID NO: 90232 - RNA, 22 nt, Homo sapiens
aauacuggcacugaagaccaug

SEQ ID NO: 90233 - RNA, 22 nt, Homo sapiens
aauagcacugcuaugguuugaa

SEQ ID NO: 90234 - RNA, 22 nt, Homo sapiens
aauagcacuguagauggaggaa

SEQ ID NO: 90235 - RNA, 22 nt, Homo sapiens
acccgggaggcaggagucauag

SEQ ID NO: 90236 - RNA, 22 nt, Homo sapiens
acccuggaggucuacagugcag

SEQ ID NO: 90237 - RNA, 22 nt, Homo sapiens
acccugucagcuggccugggca

SEQ ID NO: 90238 - RNA, 22 nt, Homo sapiens
acccuguugucagaauguggau

SEQ ID NO: 90239 - RNA, 22 nt, Homo sapiens
acccuuuagguuggaugaggau

SEQ ID NO: 90240 - RNA, 22 nt, Homo sapiens
accgaguuagccaggauggucu

SEQ ID NO: 90241 - RNA, 22 nt, Homo sapiens
accugagacuaggcauuuuaua

SEQ ID NO: 90242 - RNA, 22 nt, Homo sapiens
accugagauuacaggugcuggc

SEQ ID NO: 90243 - RNA, 19 nt, Homo sapiens
accuguagaaaguacaaca

SEQ ID NO: 90244 - RNA, 22 nt, Homo sapiens
accuguauaacaagugggaaau

SEQ ID NO: 90245 - RNA, 22 nt, Homo sapiens
accugugguuacagucugucuc

SEQ ID NO: 90246 - RNA, 18 nt, Homo sapiens
accuucauuccuuugccu

SEQ ID NO: 90247 - RNA, 22 nt, Homo sapiens
accuucauuguugccaugucca

SEQ ID NO: 90248 - RNA, 22 nt, Homo sapiens
acgcagcacauucacagcuaug

SEQ ID NO: 90249 - RNA, 22 nt, Homo sapiens
acgugcaugcacacacaugcgc

SEQ ID NO: 90250 - RNA, 22 nt, Homo sapiens
acuacaugugaugucaguauau

SEQ ID NO: 90251 - RNA, 22 nt, Homo sapiens
acuagagaugcauuuguaguuu

SEQ ID NO: 90252 - RNA, 22 nt, Homo sapiens
acuagaugauuauguuccauug

SEQ ID NO: 90253 - RNA, 22 nt, Homo sapiens
acucagagaacauucccagucu

SEQ ID NO: 90254 - RNA, 22 nt, Homo sapiens
acucagagauuagcacauguuu

SEQ ID NO: 90255 - RNA, 22 nt, Homo sapiens
acucauugcucauaccuuaucu

SEQ ID NO: 90256 - RNA, 22 nt, Homo sapiens
acucuguugucuggccuuccug

SEQ ID NO: 90257 - RNA, 22 nt, Homo sapiens
acugaauguaaacacggagugu

SEQ ID NO: 90258 - RNA, 22 nt, Homo sapiens
acugagacugagaauguuucuu

SEQ ID NO: 90259 - RNA, 22 nt, Homo sapiens
acugagaucuuuaaauaaauaa

SEQ ID NO: 90260 - RNA, 22 nt, Homo sapiens
acugagccuuuaaaugacuuca

SEQ ID NO: 90261 - RNA, 22 nt, Homo sapiens
acugaguguugauuuagauuaa

SEQ ID NO: 90262 - RNA, 20 nt, Homo sapiens
acugauauguuccuguucuc

SEQ ID NO: 90263 - RNA, 22 nt, Homo sapiens
acugcaauuacuguuguaccaa

SEQ ID NO: 90264 - RNA, 22 nt, Homo sapiens
acugcacuccaaccuguugggc

SEQ ID NO: 90265 - RNA, 20 nt, Homo sapiens
acugcacuccaaccuuugug

SEQ ID NO: 90266 - RNA, 22 nt, Homo sapiens
acugcacuccagcccaggugac

SEQ ID NO: 90267 - RNA, 22 nt, Homo sapiens
acugcacuccagccuccugggu

SEQ ID NO: 90268 - RNA, 22 nt, Homo sapiens
acugcacuccagccucggugac

SEQ ID NO: 90269 - RNA, 22 nt, Homo sapiens
acugcacuccagccucguggac

SEQ ID NO: 90270 - RNA, 22 nt, Homo sapiens
acugcacuccagccugagccug

SEQ ID NO: 90271 - RNA, 22 nt, Homo sapiens
acugcacuccagccugcuggau

SEQ ID NO: 90272 - RNA, 22 nt, Homo sapiens
acugcacuccagccugcuggca

SEQ ID NO: 90273 - RNA, 22 nt, Homo sapiens
acugcacuccagccuggacgac

SEQ ID NO: 90274 - RNA, 22 nt, Homo sapiens
acugcacuccagccuuagugac

SEQ ID NO: 90275 - RNA, 22 nt, Homo sapiens
acugcacuccagccuugagagc

SEQ ID NO: 90276 - RNA, 22 nt, Homo sapiens
acugcacuccagccuuggcaac

SEQ ID NO: 90277 - RNA, 22 nt, Homo sapiens
acugcacuccagccuuggccac

SEQ ID NO: 90278 - RNA, 22 nt, Homo sapiens
acugcacuccagccuugugaca

SEQ ID NO: 90279 - RNA, 22 nt, Homo sapiens
acugcacuccaguuccgggcaa

SEQ ID NO: 90280 - RNA, 22 nt, Homo sapiens
acugcacuccaguuugggcagc

SEQ ID NO: 90281 - RNA, 22 nt, Homo sapiens
acugcacuccggccucgugaca

SEQ ID NO: 90282 - RNA, 19 nt, Homo sapiens
acugcacuccuccuugggu

SEQ ID NO: 90283 - RNA, 22 nt, Homo sapiens
acugcacuucagccuugugaca

SEQ ID NO: 90284 - RNA, 22 nt, Homo sapiens
acugcauuugucugucucaauu

SEQ ID NO: 90285 - RNA, 22 nt, Homo sapiens
acuggacuuaaugaugaauugu

SEQ ID NO: 90286 - RNA, 22 nt, Homo sapiens
acuggauguuagggauuuuauu

SEQ ID NO: 90287 - RNA, 20 nt, Homo sapiens
acuggcacugguaggugugg

SEQ ID NO: 90288 - RNA, 22 nt, Homo sapiens
acuggcauagggcgggcacagu

SEQ ID NO: 90289 - RNA, 22 nt, Homo sapiens
acuggcuuaaggaugggccacu

SEQ ID NO: 90290 - RNA, 22 nt, Homo sapiens
acugggauauuauugguaauau

SEQ ID NO: 90291 - RNA, 19 nt, Homo sapiens
acuguacuccagucugggc

SEQ ID NO: 90292 - RNA, 22 nt, Homo sapiens
acugugcuguuuuaauuauuga

SEQ ID NO: 90293 - RNA, 22 nt, Homo sapiens
acuuauuguggcugacccaaac

SEQ ID NO: 90294 - RNA, 22 nt, Homo sapiens
acuuugcuuaucccaggcacug

SEQ ID NO: 90295 - RNA, 22 nt, Homo sapiens
acuuugguuaucauacuuucag

SEQ ID NO: 90296 - RNA, 22 nt, Homo sapiens
acuuuguuauggcaacccuaag

SEQ ID NO: 90297 - RNA, 22 nt, Homo sapiens
agaaacauucucuugccuccuu

SEQ ID NO: 90298 - RNA, 22 nt, Homo sapiens
agaaagugcuucccuuugguga

SEQ ID NO: 90299 - RNA, 22 nt, Homo sapiens
agaacuguccauucagcaugaa

SEQ ID NO: 90300 - RNA, 20 nt, Homo sapiens
agaagcauugcucucuucag

SEQ ID NO: 90301 - RNA, 19 nt, Homo sapiens
agaagugcauggucuagag

SEQ ID NO: 90302 - RNA, 22 nt, Homo sapiens
agaagugcuggguucaggcugg

SEQ ID NO: 90303 - RNA, 22 nt, Homo sapiens
agaauacugucuauucauggua

SEQ ID NO: 90304 - RNA, 19 nt, Homo sapiens
agaaucuaaauuauuucug

SEQ ID NO: 90305 - RNA, 22 nt, Homo sapiens
agaauguauauucuguaguugu

SEQ ID NO: 90306 - RNA, 22 nt, Homo sapiens
agaaugucagcuggauucagcu

SEQ ID NO: 90307 - RNA, 22 nt, Homo sapiens
agacacuguugaaaaggcccca

SEQ ID NO: 90308 - RNA, 21 nt, Homo sapiens
agacacuuggaagguuuuaga

SEQ ID NO: 90309 - RNA, 22 nt, Homo sapiens
agacagcuggaguaucauagcu

SEQ ID NO: 90310 - RNA, 22 nt, Homo sapiens
agacagcugggaaauggagugu

SEQ ID NO: 90311 - RNA, 20 nt, Homo sapiens
agacuagggagcagaaagcc

SEQ ID NO: 90312 - RNA, 22 nt, Homo sapiens
agacucauuuccauagucagcu

SEQ ID NO: 90313 - RNA, 22 nt, Homo sapiens
agagaacugauuggaguugggc

SEQ ID NO: 90314 - RNA, 22 nt, Homo sapiens
agagaacugauuggaugugggc

SEQ ID NO: 90315 - RNA, 22 nt, Homo sapiens
agagaacuguuuacacguuaau

SEQ ID NO: 90316 - RNA, 19 nt, Homo sapiens
agagacucauuguagcauu

SEQ ID NO: 90317 - RNA, 22 nt, Homo sapiens
agagagcuuuaacuacccauuu

SEQ ID NO: 90318 - RNA, 22 nt, Homo sapiens
agagaucaauaugaaggaaaug

SEQ ID NO: 90319 - RNA, 22 nt, Homo sapiens
agagaugaagauggggcucccg

SEQ ID NO: 90320 - RNA, 22 nt, Homo sapiens
agagcaaugggugaauauuaaa

SEQ ID NO: 90321 - RNA, 22 nt, Homo sapiens
agagccacacucuccuaacuca

SEQ ID NO: 90322 - RNA, 22 nt, Homo sapiens
agagccacauuaaauaugggaa

SEQ ID NO: 90323 - RNA, 22 nt, Homo sapiens
agagguaugccugggcuggagc

SEQ ID NO: 90324 - RNA, 22 nt, Homo sapiens
agaggucuuaucaaacaugcuu

SEQ ID NO: 90325 - RNA, 22 nt, Homo sapiens
agagguuuaacuggcuuauggu

SEQ ID NO: 90326 - RNA, 22 nt, Homo sapiens
aggcagcuguuauauacugagu

SEQ ID NO: 90327 - RNA, 22 nt, Homo sapiens
aggcaugugugcagacugucug

SEQ ID NO: 90328 - RNA, 19 nt, Homo sapiens
aggcauugugcucaucugu

SEQ ID NO: 90329 - RNA, 22 nt, Homo sapiens
aggcuagaaucuuccaucuugg

SEQ ID NO: 90330 - RNA, 22 nt, Homo sapiens
aggcuagacuuugagaauuuuu

SEQ ID NO: 90331 - RNA, 22 nt, Homo sapiens
aggcuuauuaagauucccuuau

SEQ ID NO: 90332 - RNA, 22 nt, Homo sapiens
aggcuuguuuuacuaacuggua

SEQ ID NO: 90333 - RNA, 22 nt, Homo sapiens
aggcuuuuggagguggcuuucu

SEQ ID NO: 90334 - RNA, 22 nt, Homo sapiens
agggaauguaaguuuuaugaga

SEQ ID NO: 90335 - RNA, 22 nt, Homo sapiens
agggcaagacuuguuaagaaca

SEQ ID NO: 90336 - RNA, 22 nt, Homo sapiens
agggcaguguuaggacugucug

SEQ ID NO: 90337 - RNA, 22 nt, Homo sapiens
agggcauuguacaaaucaucau

SEQ ID NO: 90338 - RNA, 22 nt, Homo sapiens
aggguuuuuauuuauguggcau

SEQ ID NO: 90339 - RNA, 22 nt, Homo sapiens
agguaaacauggggacugcuac

SEQ ID NO: 90340 - RNA, 22 nt, Homo sapiens
agguaagucucuaauuaugaau

SEQ ID NO: 90341 - RNA, 22 nt, Homo sapiens
agguaauuuucccagagggaaa

SEQ ID NO: 90342 - RNA, 21 nt, Homo sapiens
agguaguuuuccuuuuggagu

SEQ ID NO: 90343 - RNA, 22 nt, Homo sapiens
agguauguaugucuguacagcg

SEQ ID NO: 90344 - RNA, 22 nt, Homo sapiens
agguauuuucaacuuagaaugg

SEQ ID NO: 90345 - RNA, 22 nt, Homo sapiens
agguccauugguauuauagcau

SEQ ID NO: 90346 - RNA, 22 nt, Homo sapiens
aggugcuugaaucuaugagcuc

SEQ ID NO: 90347 - RNA, 22 nt, Homo sapiens
agguuaugauuauagagcgagg

SEQ ID NO: 90348 - RNA, 20 nt, Homo sapiens
agguucaaaucccaaucaug

SEQ ID NO: 90349 - RNA, 21 nt, Homo sapiens
agguuguguuuccucuuacuu

SEQ ID NO: 90350 - RNA, 22 nt, Homo sapiens
agguuguugcaugcuccuuagg

SEQ ID NO: 90351 - RNA, 22 nt, Homo sapiens
aguaaacuucagaguucuuccu

SEQ ID NO: 90352 - RNA, 22 nt, Homo sapiens
aguaaagcaucagcuagaugug

SEQ ID NO: 90353 - RNA, 22 nt, Homo sapiens
aguaaagccagaccuguuaauu

SEQ ID NO: 90354 - RNA, 22 nt, Homo sapiens
aguaaaucacuaauggcuuccg

SEQ ID NO: 90355 - RNA, 22 nt, Homo sapiens
aguacaucuggcuggauagaua

SEQ ID NO: 90356 - RNA, 22 nt, Homo sapiens
aguacugucugguuaccugaca

SEQ ID NO: 90357 - RNA, 22 nt, Homo sapiens
aguagcaauggcucugagcuau

SEQ ID NO: 90358 - RNA, 22 nt, Homo sapiens
aguagguguugguagagguuuc

SEQ ID NO: 90359 - RNA, 22 nt, Homo sapiens
aguaucacaggcaaaacagaau

SEQ ID NO: 90360 - RNA, 22 nt, Homo sapiens
aguaucaucuuguuggccaggc

SEQ ID NO: 90361 - RNA, 22 nt, Homo sapiens
aguauugcuaauaagagauuug

SEQ ID NO: 90362 - RNA, 22 nt, Homo sapiens
agucaagaaucucagcaucuuu

SEQ ID NO: 90363 - RNA, 22 nt, Homo sapiens
agucacagugaccuugucugac

SEQ ID NO: 90364 - RNA, 22 nt, Homo sapiens
agucacaugcauuuucuucaau

SEQ ID NO: 90365 - RNA, 22 nt, Homo sapiens
agucagugucuguaaggagaac

SEQ ID NO: 90366 - RNA, 20 nt, Homo sapiens
agucaguuuauuuucucucu

SEQ ID NO: 90367 - RNA, 22 nt, Homo sapiens
agucauuguugagaugguguca

SEQ ID NO: 90368 - RNA, 22 nt, Homo sapiens
agucgguguuacugacagaaug

SEQ ID NO: 90369 - RNA, 22 nt, Homo sapiens
agucugguguucucacacuagu

SEQ ID NO: 90370 - RNA, 19 nt, Homo sapiens
agugagccaagauccuacc

SEQ ID NO: 90371 - RNA, 22 nt, Homo sapiens
agugagcuggagaaaagaaacu

SEQ ID NO: 90372 - RNA, 22 nt, Homo sapiens
agugagcuguuuuuacuuucug

SEQ ID NO: 90373 - RNA, 22 nt, Homo sapiens
agugauggagccaggauuuaau

SEQ ID NO: 90374 - RNA, 19 nt, Homo sapiens
agugcaauugccuuugugc

SEQ ID NO: 90375 - RNA, 22 nt, Homo sapiens
agugcacuccagccugggcaac

SEQ ID NO: 90376 - RNA, 22 nt, Homo sapiens
agugccuacuauguagaugcug

SEQ ID NO: 90377 - RNA, 22 nt, Homo sapiens
agugccuauugauggaaagaua

SEQ ID NO: 90378 - RNA, 22 nt, Homo sapiens
aguggaguguaaagcgucuuuu

SEQ ID NO: 90379 - RNA, 22 nt, Homo sapiens
aguggcacaauuuugacucccc

SEQ ID NO: 90380 - RNA, 22 nt, Homo sapiens
agugguguugccuguugaccua

SEQ ID NO: 90381 - RNA, 22 nt, Homo sapiens
aguguuuuuaacaagaaagggu

SEQ ID NO: 90382 - RNA, 22 nt, Homo sapiens
aguucaaaucgagccuggccau

SEQ ID NO: 90383 - RNA, 22 nt, Homo sapiens
aguucaaugcucuuucuacuau

SEQ ID NO: 90384 - RNA, 22 nt, Homo sapiens
aguucaauggguuuucacucau

SEQ ID NO: 90385 - RNA, 18 nt, Homo sapiens
aguuguuuuauccugccc

SEQ ID NO: 90386 - RNA, 22 nt, Homo sapiens
auaaacagcuuauccucuauuc

SEQ ID NO: 90387 - RNA, 18 nt, Homo sapiens
auaaacucaucauuuuua

SEQ ID NO: 90388 - RNA, 23 nt, Homo sapiens
auaaacugucaaaagccagcccu

SEQ ID NO: 90389 - RNA, 22 nt, Homo sapiens
auaaagcaagucucuggccuca

SEQ ID NO: 90390 - RNA, 22 nt, Homo sapiens
auaaagccaugagcuugagaug

SEQ ID NO: 90391 - RNA, 22 nt, Homo sapiens
auaaagcuauuccucucuuuuu

SEQ ID NO: 90392 - RNA, 22 nt, Homo sapiens
auaaagguaagcacuauccuga

SEQ ID NO: 90393 - RNA, 22 nt, Homo sapiens
auaaagguaauaauaguugcau

SEQ ID NO: 90394 - RNA, 22 nt, Homo sapiens
auaacagcauuauugcauacgu

SEQ ID NO: 90395 - RNA, 22 nt, Homo sapiens
auaacagcugcaaggcaaaagc

SEQ ID NO: 90396 - RNA, 22 nt, Homo sapiens
auaacauccuuucuuaucguug

SEQ ID NO: 90397 - RNA, 22 nt, Homo sapiens
auaagaagugaaccagacgucu

SEQ ID NO: 90398 - RNA, 22 nt, Homo sapiens
auaagaugaaggaagccauauc

SEQ ID NO: 90399 - RNA, 22 nt, Homo sapiens
auaaggcuaaggacuugaguua

SEQ ID NO: 90400 - RNA, 22 nt, Homo sapiens
auaaguagaaugauggucaaaa

SEQ ID NO: 90401 - RNA, 22 nt, Homo sapiens
auaagucaauggaacagauuaa

SEQ ID NO: 90402 - RNA, 22 nt, Homo sapiens
auacaaguuauuugaacugcgg

SEQ ID NO: 90403 - RNA, 22 nt, Homo sapiens
auacacauuccugggccucacc

SEQ ID NO: 90404 - RNA, 22 nt, Homo sapiens
auacacgugccauguugguaug

SEQ ID NO: 90405 - RNA, 19 nt, Homo sapiens
auacacguguauacauaca

SEQ ID NO: 90406 - RNA, 22 nt, Homo sapiens
auacacguguauauguguaucu

SEQ ID NO: 90407 - RNA, 22 nt, Homo sapiens
auacacuggagcaaaccuggag

SEQ ID NO: 90408 - RNA, 22 nt, Homo sapiens
auacagacacagucagaggggu

SEQ ID NO: 90409 - RNA, 22 nt, Homo sapiens
auacagcuaaaauauuaaguua

SEQ ID NO: 90410 - RNA, 22 nt, Homo sapiens
auacagguauacaaugcauaau

SEQ ID NO: 90411 - RNA, 22 nt, Homo sapiens
auacaguauggagggcccagcu

SEQ ID NO: 90412 - RNA, 22 nt, Homo sapiens
auacagucuguuagauuuccuc

SEQ ID NO: 90413 - RNA, 22 nt, Homo sapiens
auacagugaauacuuacagugu

SEQ ID NO: 90414 - RNA, 22 nt, Homo sapiens
auacaguugccauuucuugugc

SEQ ID NO: 90415 - RNA, 22 nt, Homo sapiens
auacaugugccauguugguuug

SEQ ID NO: 90416 - RNA, 22 nt, Homo sapiens
auacaugugugagcgaagaugu

SEQ ID NO: 90417 - RNA, 22 nt, Homo sapiens
auccaguguuuucuuuugucac

SEQ ID NO: 90418 - RNA, 22 nt, Homo sapiens
auccauguggauaaauguguau

SEQ ID NO: 90419 - RNA, 22 nt, Homo sapiens
aucccaguaaaaauggcuucua

SEQ ID NO: 90420 - RNA, 22 nt, Homo sapiens
aucccaguucagccucugacac

SEQ ID NO: 90421 - RNA, 22 nt, Homo sapiens
aucccuagaaaaaucagcacau

SEQ ID NO: 90422 - RNA, 22 nt, Homo sapiens
aucccugagaacuuuuaauguu

SEQ ID NO: 90423 - RNA, 22 nt, Homo sapiens
aucccuguaacuagcagccccu

SEQ ID NO: 90424 - RNA, 22 nt, Homo sapiens
aucccugugacgagcaucccua

SEQ ID NO: 90425 - RNA, 22 nt, Homo sapiens
auccuacaguccauucuuugug

SEQ ID NO: 90426 - RNA, 22 nt, Homo sapiens
auccugaagcuuuacugaauuc

SEQ ID NO: 90427 - RNA, 22 nt, Homo sapiens
auccugagacuuugcugaaguu

SEQ ID NO: 90428 - RNA, 22 nt, Homo sapiens
auccuguaggcuaguagacagu

SEQ ID NO: 90429 - RNA, 22 nt, Homo sapiens
aucgcgccauuguacuccagcc

SEQ ID NO: 90430 - RNA, 22 nt, Homo sapiens
aucuaaucaucgcaaccuucaa

SEQ ID NO: 90431 - RNA, 21 nt, Homo sapiens
aucucacuugaauguaaaagc

SEQ ID NO: 90432 - RNA, 16 nt, Homo sapiens
aucucagaccugcuga

SEQ ID NO: 90433 - RNA, 22 nt, Homo sapiens
aucucugagauguucugauuuu

SEQ ID NO: 90434 - RNA, 22 nt, Homo sapiens
aucucuugccagucagaauggu

SEQ ID NO: 90435 - RNA, 22 nt, Homo sapiens
aucugacuuuuaauuugaaaac

SEQ ID NO: 90436 - RNA, 22 nt, Homo sapiens
aucugcaaagcugggcugagac

SEQ ID NO: 90437 - RNA, 22 nt, Homo sapiens
aucugcaaauaaugaagauugg

SEQ ID NO: 90438 - RNA, 22 nt, Homo sapiens
aucugcauuagggugaagaccu

SEQ ID NO: 90439 - RNA, 22 nt, Homo sapiens
aucugcauucccauguuuauug

SEQ ID NO: 90440 - RNA, 22 nt, Homo sapiens
aucugcuccuggugaggguuuc

SEQ ID NO: 90441 - RNA, 22 nt, Homo sapiens
aucugggguuggcaaaguuugg

SEQ ID NO: 90442 - RNA, 22 nt, Homo sapiens
aucugguauuacugcaacugua

SEQ ID NO: 90443 - RNA, 22 nt, Homo sapiens
aucugguguccucgugggaguc

SEQ ID NO: 90444 - RNA, 22 nt, Homo sapiens
aucugguguuuuucucccucgu

SEQ ID NO: 90445 - RNA, 22 nt, Homo sapiens
aucuguguuuaaggucccagaa

SEQ ID NO: 90446 - RNA, 22 nt, Homo sapiens
aucuucucuugaagggugggga

SEQ ID NO: 90447 - RNA, 22 nt, Homo sapiens
aucuugcauuugcuaaaaugca

SEQ ID NO: 90448 - RNA, 22 nt, Homo sapiens
aucuugggugggaacugagaau

SEQ ID NO: 90449 - RNA, 22 nt, Homo sapiens
aucuuugauugaagggacccug

SEQ ID NO: 90450 - RNA, 22 nt, Homo sapiens
aucuuuggcgggaauaucacag

SEQ ID NO: 90451 - RNA, 22 nt, Homo sapiens
aucuuuggugaguucuuugguc

SEQ ID NO: 90452 - RNA, 22 nt, Homo sapiens
augaaauguaugagucuggguu

SEQ ID NO: 90453 - RNA, 21 nt, Homo sapiens
augaacucaucauuuuuuaug

SEQ ID NO: 90454 - RNA, 17 nt, Homo sapiens
augaacucaucguucuu

SEQ ID NO: 90455 - RNA, 19 nt, Homo sapiens
augaacucauucuuuuuau

SEQ ID NO: 90456 - RNA, 22 nt, Homo sapiens
augaagauguugccuuuuuaau

SEQ ID NO: 90457 - RNA, 22 nt, Homo sapiens
augaagcuagcugauugcugau

SEQ ID NO: 90458 - RNA, 18 nt, Homo sapiens
augaagucaucacuuuua

SEQ ID NO: 90459 - RNA, 22 nt, Homo sapiens
augaaguuagcucauuucuuuu

SEQ ID NO: 90460 - RNA, 22 nt, Homo sapiens
augaauccauuccugccacaga

SEQ ID NO: 90461 - RNA, 23 nt, Homo sapiens
augaauguaaagaaugugggaag

SEQ ID NO: 90462 - RNA, 20 nt, Homo sapiens
augaauguccuugauggcau

SEQ ID NO: 90463 - RNA, 22 nt, Homo sapiens
augaauuuucugauguugggua

SEQ ID NO: 90464 - RNA, 22 nt, Homo sapiens
augacaagaguguucagggaga

SEQ ID NO: 90465 - RNA, 22 nt, Homo sapiens
augacagcaucugugaaguugu

SEQ ID NO: 90466 - RNA, 22 nt, Homo sapiens
augacaguguggauuauuguaa

SEQ ID NO: 90467 - RNA, 22 nt, Homo sapiens
augacauuccacagccguagag

SEQ ID NO: 90468 - RNA, 19 nt, Homo sapiens
augacauuuggggguggac

SEQ ID NO: 90469 - RNA, 22 nt, Homo sapiens
augaccuuggggaaccaugucu

SEQ ID NO: 90470 - RNA, 22 nt, Homo sapiens
augacuagaggagggauggcca

SEQ ID NO: 90471 - RNA, 22 nt, Homo sapiens
augacuauugcacuuuccuggu

SEQ ID NO: 90472 - RNA, 22 nt, Homo sapiens
augacugagacuaacuuacuuu

SEQ ID NO: 90473 - RNA, 22 nt, Homo sapiens
augacugucagggcagucauug

SEQ ID NO: 90474 - RNA, 19 nt, Homo sapiens
augagaacagacuccauuu

SEQ ID NO: 90475 - RNA, 22 nt, Homo sapiens
augagaacauaucaagugauug

SEQ ID NO: 90476 - RNA, 22 nt, Homo sapiens
augagaaucauuucagcuugua

SEQ ID NO: 90477 - RNA, 22 nt, Homo sapiens
augagaaugauucuguuauggu

SEQ ID NO: 90478 - RNA, 22 nt, Homo sapiens
augagacuagaagagaauaaua

SEQ ID NO: 90479 - RNA, 22 nt, Homo sapiens
augagagcaacaccuucacuug

SEQ ID NO: 90480 - RNA, 22 nt, Homo sapiens
augagagcuaacuguggguaca

SEQ ID NO: 90481 - RNA, 22 nt, Homo sapiens
augagauaggaacaaacuuaca

SEQ ID NO: 90482 - RNA, 16 nt, Homo sapiens
augagauccugucuca

SEQ ID NO: 90483 - RNA, 22 nt, Homo sapiens
augagaugaauaccgacgaugu

SEQ ID NO: 90484 - RNA, 22 nt, Homo sapiens
augagaugauaggcguucuaac

SEQ ID NO: 90485 - RNA, 21 nt, Homo sapiens
augagauguuagacuuuagac

SEQ ID NO: 90486 - RNA, 22 nt, Homo sapiens
augagcucauaaagagugauuu

SEQ ID NO: 90487 - RNA, 22 nt, Homo sapiens
augagcuguuuggaagacacuu

SEQ ID NO: 90488 - RNA, 22 nt, Homo sapiens
augaggcaggaaaggcguaucu

SEQ ID NO: 90489 - RNA, 22 nt, Homo sapiens
augagggagggcaccugaccuu

SEQ ID NO: 90490 - RNA, 22 nt, Homo sapiens
augagggcggacgcccuggaga

SEQ ID NO: 90491 - RNA, 22 nt, Homo sapiens
augagguaguagaaagucaggu

SEQ ID NO: 90492 - RNA, 22 nt, Homo sapiens
augagguauccaagcccagaaa

SEQ ID NO: 90493 - RNA, 22 nt, Homo sapiens
augagguccuagccaacuuuuu

SEQ ID NO: 90494 - RNA, 22 nt, Homo sapiens
augaggugcagaggaaaugagu

SEQ ID NO: 90495 - RNA, 22 nt, Homo sapiens
augaggugggagaaucacuuga

SEQ ID NO: 90496 - RNA, 21 nt, Homo sapiens
augagguguacuguggugaaa

SEQ ID NO: 90497 - RNA, 22 nt, Homo sapiens
augaguaugagaauacauuaag

SEQ ID NO: 90498 - RNA, 22 nt, Homo sapiens
augagucacuuauuauuggggu

SEQ ID NO: 90499 - RNA, 15 nt, Homo sapiens
augaguuuuauggag

SEQ ID NO: 90500 - RNA, 22 nt, Homo sapiens
augauaaguuauuagaagaaga

SEQ ID NO: 90501 - RNA, 22 nt, Homo sapiens
augauaugagaaaggaucaaca

SEQ ID NO: 90502 - RNA, 22 nt, Homo sapiens
augauauguuuguagcuaucuc

SEQ ID NO: 90503 - RNA, 22 nt, Homo sapiens
augaucacugugccuccuguga

SEQ ID NO: 90504 - RNA, 22 nt, Homo sapiens
augaucacuguggaaauucagc

SEQ ID NO: 90505 - RNA, 22 nt, Homo sapiens
augaucauggaaguuuuccugu

SEQ ID NO: 90506 - RNA, 22 nt, Homo sapiens
augauccagugaguuucaguuc

SEQ ID NO: 90507 - RNA, 22 nt, Homo sapiens
augaucuguagaacuaguccuu

SEQ ID NO: 90508 - RNA, 22 nt, Homo sapiens
ucccuguagugccuagaucaga

SEQ ID NO: 90509 - RNA, 16 nt, Homo sapiens
ucccugugacaugugc

SEQ ID NO: 90510 - RNA, 22 nt, Homo sapiens
ucccuguuguuucauaauuuua

SEQ ID NO: 90511 - RNA, 22 nt, Homo sapiens
ucccuugguaauucuguuccuu

SEQ ID NO: 90512 - RNA, 19 nt, Homo sapiens
ucccuuuguagguaaccug

SEQ ID NO: 90513 - RNA, 22 nt, Homo sapiens
uccucaguggauuggauggugc

SEQ ID NO: 90514 - RNA, 22 nt, Homo sapiens
uccucugaacuccagacccaua

SEQ ID NO: 90515 - RNA, 22 nt, Homo sapiens
uccugagacucacaggcucccc

SEQ ID NO: 90516 - RNA, 21 nt, Homo sapiens
uccugagagaggaguaacucu

SEQ ID NO: 90517 - RNA, 22 nt, Homo sapiens
uccugagucagcauccguuugu

SEQ ID NO: 90518 - RNA, 22 nt, Homo sapiens
uccugcauucauccugguguug

SEQ ID NO: 90519 - RNA, 22 nt, Homo sapiens
uccuugaaacaggaagaauuca

SEQ ID NO: 90520 - RNA, 22 nt, Homo sapiens
uccuugagccucccagacucag

SEQ ID NO: 90521 - RNA, 22 nt, Homo sapiens
uccuuggugacauuucuugucu

SEQ ID NO: 90522 - RNA, 22 nt, Homo sapiens
uccuuuggucaguauucuuuug

SEQ ID NO: 90523 - RNA, 22 nt, Homo sapiens
ucgagcaauugucaugucucag

SEQ ID NO: 90524 - RNA, 22 nt, Homo sapiens
ucgcagcacgagcaugcaaggu

SEQ ID NO: 90525 - RNA, 22 nt, Homo sapiens
ucgcagcucacuggagccucga

SEQ ID NO: 90526 - RNA, 22 nt, Homo sapiens
ucgcauggucuccaggcagcuc

SEQ ID NO: 90527 - RNA, 22 nt, Homo sapiens
ucgcgccauucuccugccucag

SEQ ID NO: 90528 - RNA, 22 nt, Homo sapiens
ucgugccacugcacuccagccu

SEQ ID NO: 90529 - RNA, 22 nt, Homo sapiens
ucuaagacuaagggcuagcuuc

SEQ ID NO: 90530 - RNA, 22 nt, Homo sapiens
ucuaaguaguagcuggucagaa

SEQ ID NO: 90531 - RNA, 22 nt, Homo sapiens
ucuaaugcucugagaacagugc

SEQ ID NO: 90532 - RNA, 22 nt, Homo sapiens
ucuaauguaaccugcaaauauu

SEQ ID NO: 90533 - RNA, 22 nt, Homo sapiens
ucuagaugaaguauaaaguagu

SEQ ID NO: 90534 - RNA, 22 nt, Homo sapiens
ucuagcacuuacuggcugugug

SEQ ID NO: 90535 - RNA, 22 nt, Homo sapiens
ucuauugguaggggcugaggca

SEQ ID NO: 90536 - RNA, 22 nt, Homo sapiens
ucuauugguugaaauugcuuuu

SEQ ID NO: 90537 - RNA, 22 nt, Homo sapiens
ucuauuugggguaccuguggua

SEQ ID NO: 90538 - RNA, 22 nt, Homo sapiens
ucucaaccucccaaguagcugg

SEQ ID NO: 90539 - RNA, 22 nt, Homo sapiens
ucucaagaugguagaugggaau

SEQ ID NO: 90540 - RNA, 22 nt, Homo sapiens
ucucacagaguugaacuuucuu

SEQ ID NO: 90541 - RNA, 22 nt, Homo sapiens
ucucacagaguugaauguuucu

SEQ ID NO: 90542 - RNA, 22 nt, Homo sapiens
ucucacauuucacagggauggg

SEQ ID NO: 90543 - RNA, 22 nt, Homo sapiens
ucucagcacagucagggcgccu

SEQ ID NO: 90544 - RNA, 22 nt, Homo sapiens
ucucagugaauguggaaaaagc

SEQ ID NO: 90545 - RNA, 22 nt, Homo sapiens
ucucagugacugcugggucccc

SEQ ID NO: 90546 - RNA, 22 nt, Homo sapiens
ucucaguggcuuccucacuuuu

SEQ ID NO: 90547 - RNA, 19 nt, Homo sapiens
ucucaguguuggucaggug

SEQ ID NO: 90548 - RNA, 22 nt, Homo sapiens
ucucaguuuucaagcugucgau

SEQ ID NO: 90549 - RNA, 20 nt, Homo sapiens
ucucauagagguagagaaua

SEQ ID NO: 90550 - RNA, 20 nt, Homo sapiens
ucucauggagggaaagagca

SEQ ID NO: 90551 - RNA, 22 nt, Homo sapiens
ucucauugauucuggggugaug

SEQ ID NO: 90552 - RNA, 22 nt, Homo sapiens
ucucauuggucugagucaccug

SEQ ID NO: 90553 - RNA, 21 nt, Homo sapiens
ucucauugugguuuuaauugg

SEQ ID NO: 90554 - RNA, 22 nt, Homo sapiens
ucuccauugaaauggacauaau

SEQ ID NO: 90555 - RNA, 22 nt, Homo sapiens
ucucugaaacucuugacauccu

SEQ ID NO: 90556 - RNA, 22 nt, Homo sapiens
ucucugagaaaaguuucuccca

SEQ ID NO: 90557 - RNA, 22 nt, Homo sapiens
ucucugauuaaacaagauagug

SEQ ID NO: 90558 - RNA, 22 nt, Homo sapiens
ucucugauuauugcauuucauu

SEQ ID NO: 90559 - RNA, 22 nt, Homo sapiens
ucucuggauaucuacuuauguu

SEQ ID NO: 90560 - RNA, 22 nt, Homo sapiens
ucugacagugagagaaaucuga

SEQ ID NO: 90561 - RNA, 22 nt, Homo sapiens
ucugacucuggagucucagguu

SEQ ID NO: 90562 - RNA, 22 nt, Homo sapiens
ucugagaucaugucugugcugu

SEQ ID NO: 90563 - RNA, 22 nt, Homo sapiens
ucugagcaugcaucuugccugg

SEQ ID NO: 90564 - RNA, 21 nt, Homo sapiens
ucugagucauucaguggccug

SEQ ID NO: 90565 - RNA, 22 nt, Homo sapiens
ucugcauauucuagggcaccaa

SEQ ID NO: 90566 - RNA, 22 nt, Homo sapiens
ucugccacugucauugugugau

SEQ ID NO: 90567 - RNA, 22 nt, Homo sapiens
ucugccuacugagcacacagug

SEQ ID NO: 90568 - RNA, 22 nt, Homo sapiens
ucuggcacucagaggccuugcu

SEQ ID NO: 90569 - RNA, 20 nt, Homo sapiens
ucuggccccucuaaaucuca

SEQ ID NO: 90570 - RNA, 22 nt, Homo sapiens
ucuggccuacaaguaauuuuau

SEQ ID NO: 90571 - RNA, 22 nt, Homo sapiens
ucuggccuacaucauuuuuccg

SEQ ID NO: 90572 - RNA, 22 nt, Homo sapiens
ucuggcuccaaagucuauuuuu

SEQ ID NO: 90573 - RNA, 22 nt, Homo sapiens
ucuggcuccacacuuuauuaac

SEQ ID NO: 90574 - RNA, 22 nt, Homo sapiens
ucuggcuuucuuuacuuaaugu

SEQ ID NO: 90575 - RNA, 22 nt, Homo sapiens
ucuggguuuuguaccgugcucg

SEQ ID NO: 90576 - RNA, 22 nt, Homo sapiens
ucugguggugaugagagacagu

SEQ ID NO: 90577 - RNA, 22 nt, Homo sapiens
ucuggugugcucuggacuugca

SEQ ID NO: 90578 - RNA, 22 nt, Homo sapiens
ucugucaaaucuuauguuguag

SEQ ID NO: 90579 - RNA, 22 nt, Homo sapiens
ucugugaaugaacacuugaaaa

SEQ ID NO: 90580 - RNA, 22 nt, Homo sapiens
ucugugcauuacacuuuucuca

SEQ ID NO: 90581 - RNA, 22 nt, Homo sapiens
ucugugcauuguaggauguuua

SEQ ID NO: 90582 - RNA, 22 nt, Homo sapiens
ucugugguaagaaacgcauguc

SEQ ID NO: 90583 - RNA, 22 nt, Homo sapiens
ucugugguucaaaccagcaacu

SEQ ID NO: 90584 - RNA, 22 nt, Homo sapiens
ucugugguuguugcauggaaug

SEQ ID NO: 90585 - RNA, 22 nt, Homo sapiens
ucuguguugaucacacugggag

SEQ ID NO: 90586 - RNA, 22 nt, Homo sapiens
ucuguuguuguuuuaagagaca

SEQ ID NO: 90587 - RNA, 22 nt, Homo sapiens
ucuuagguaagaaauuuuaaca

SEQ ID NO: 90588 - RNA, 22 nt, Homo sapiens
ucuuaggugaugauugauguga

SEQ ID NO: 90589 - RNA, 22 nt, Homo sapiens
ucuuaggugggccaucacccca

SEQ ID NO: 90590 - RNA, 22 nt, Homo sapiens
ucuuaguuggaaugggauaagg

SEQ ID NO: 90591 - RNA, 22 nt, Homo sapiens
ucuuaguuuagauuagcaauuc

SEQ ID NO: 90592 - RNA, 22 nt, Homo sapiens
ucuuaguuugggguggggauag

SEQ ID NO: 90593 - RNA, 22 nt, Homo sapiens
ucuuauuuggggaaaggguccu

SEQ ID NO: 90594 - RNA, 20 nt, Homo sapiens
ucuugaacuuagucaacagg

SEQ ID NO: 90595 - RNA, 22 nt, Homo sapiens
ucuugcaccuacaugcuuuguc

SEQ ID NO: 90596 - RNA, 22 nt, Homo sapiens
ucuugcaguucccaaauucaca

SEQ ID NO: 90597 - RNA, 22 nt, Homo sapiens
ucuugcuuguuguucccuucau

SEQ ID NO: 90598 - RNA, 22 nt, Homo sapiens
ucuugcuuuugcagagcuucuc

SEQ ID NO: 90599 - RNA, 22 nt, Homo sapiens
ugagaacagcagcuugggacac

SEQ ID NO: 90600 - RNA, 22 nt, Homo sapiens
ugagaacauggagaacccccca

SEQ ID NO: 90601 - RNA, 22 nt, Homo sapiens
ugagaaccucugugugcccacu

SEQ ID NO: 90602 - RNA, 22 nt, Homo sapiens
ugagaacuagagaacaagguga

SEQ ID NO: 90603 - RNA, 22 nt, Homo sapiens
ugagaacugccuguauuuaucu

SEQ ID NO: 90604 - RNA, 22 nt, Homo sapiens
ugagaacugguagcacuuguga

SEQ ID NO: 90605 - RNA, 22 nt, Homo sapiens
ugagaagaugaacuccuugguc

SEQ ID NO: 90606 - RNA, 22 nt, Homo sapiens
ugagacauacuuacaggggaug

SEQ ID NO: 90607 - RNA, 22 nt, Homo sapiens
ugagacaugugaauauuuguac

SEQ ID NO: 90608 - RNA, 22 nt, Homo sapiens
ugagacggagucucgcucuguu

SEQ ID NO: 90609 - RNA, 22 nt, Homo sapiens
ugagacggagucuugcucuguc

SEQ ID NO: 90610 - RNA, 22 nt, Homo sapiens
ugagacggaguuucacucuugu

SEQ ID NO: 90611 - RNA, 22 nt, Homo sapiens
ugagacugagucucccucuguc

SEQ ID NO: 90612 - RNA, 22 nt, Homo sapiens
ugagacugagucucgcucuugu

SEQ ID NO: 90613 - RNA, 22 nt, Homo sapiens
ugagacugaguuuccaucuugu

SEQ ID NO: 90614 - RNA, 22 nt, Homo sapiens
ugagacugaguuuugccuuugu

SEQ ID NO: 90615 - RNA, 22 nt, Homo sapiens
ugagacugaguuuugcucguug

SEQ ID NO: 90616 - RNA, 22 nt, Homo sapiens
ugagacuguuuuggggaacuuc

SEQ ID NO: 90617 - RNA, 22 nt, Homo sapiens
ugagagaugaacucugauaugu

SEQ ID NO: 90618 - RNA, 22 nt, Homo sapiens
ugagagaugauaaaauguuugu

SEQ ID NO: 90619 - RNA, 19 nt, Homo sapiens
ugagagcacaacugaacaa

SEQ ID NO: 90620 - RNA, 22 nt, Homo sapiens
ugagagcugcauucuugaaagc

SEQ ID NO: 90621 - RNA, 22 nt, Homo sapiens
ugagaggugaauggcaggcuca

SEQ ID NO: 90622 - RNA, 22 nt, Homo sapiens
ugagaguagggguugggauugg

SEQ ID NO: 90623 - RNA, 22 nt, Homo sapiens
ugagauaaucaugugauuucau

SEQ ID NO: 90624 - RNA, 22 nt, Homo sapiens
ugagauaaucaugugguuuuug

SEQ ID NO: 90625 - RNA, 22 nt, Homo sapiens
ugagauagaaaacauaggagaa

SEQ ID NO: 90626 - RNA, 22 nt, Homo sapiens
ugagaucaacugagucagagca

SEQ ID NO: 90627 - RNA, 22 nt, Homo sapiens
ugagaucacgccacugcacucc

SEQ ID NO: 90628 - RNA, 22 nt, Homo sapiens
ugagaucagaaggauuucucug

SEQ ID NO: 90629 - RNA, 20 nt, Homo sapiens
ugagaucaggauuaaggcua

SEQ ID NO: 90630 - RNA, 22 nt, Homo sapiens
ugagaucauguguggaccccag

SEQ ID NO: 90631 - RNA, 22 nt, Homo sapiens
ugagaucgaguuucgcucuugu

SEQ ID NO: 90632 - RNA, 22 nt, Homo sapiens
ugagaucguugcgugagcgugu

SEQ ID NO: 90633 - RNA, 22 nt, Homo sapiens
ugagaucugauaggccuggguu

SEQ ID NO: 90634 - RNA, 22 nt, Homo sapiens
ugagaucugucuuuauaguauu

SEQ ID NO: 90635 - RNA, 22 nt, Homo sapiens
ugagaucuuaccuuccugccuu

SEQ ID NO: 90636 - RNA, 22 nt, Homo sapiens
ugagaucuuaucagaaauggug

SEQ ID NO: 90637 - RNA, 22 nt, Homo sapiens
ugagaugaaagcagaaagacuu

SEQ ID NO: 90638 - RNA, 22 nt, Homo sapiens
ugagaugaacuugauuguuuua

SEQ ID NO: 90639 - RNA, 22 nt, Homo sapiens
ugagaugagggcugcacucaaa

SEQ ID NO: 90640 - RNA, 22 nt, Homo sapiens
ugagaugaggucucgcucuguc

SEQ ID NO: 90641 - RNA, 22 nt, Homo sapiens
ugagaugagucucgcucuguca

SEQ ID NO: 90642 - RNA, 22 nt, Homo sapiens
ugagaugaguugcgcucugucg

SEQ ID NO: 90643 - RNA, 21 nt, Homo sapiens
ugagaugauccugcaugcaug

SEQ ID NO: 90644 - RNA, 21 nt, Homo sapiens
ugagaugcaaucaccagggag

SEQ ID NO: 90645 - RNA, 22 nt, Homo sapiens
ugagaugcauauucuggcuccu

SEQ ID NO: 90646 - RNA, 22 nt, Homo sapiens
ugagauggaguuucacuuuugu

SEQ ID NO: 90647 - RNA, 22 nt, Homo sapiens
ugagauggcuuuauugcugaau

SEQ ID NO: 90648 - RNA, 22 nt, Homo sapiens
ugagauggguucugguccccug

SEQ ID NO: 90649 - RNA, 22 nt, Homo sapiens
ugagauguagauauggauuaga

SEQ ID NO: 90650 - RNA, 22 nt, Homo sapiens
ugagaugugaagaucacaugaa

SEQ ID NO: 90651 - RNA, 21 nt, Homo sapiens
ugagaugugaccagggcauca

SEQ ID NO: 90652 - RNA, 22 nt, Homo sapiens
ugagaugugaucaccugaaggg

SEQ ID NO: 90653 - RNA, 22 nt, Homo sapiens
ugagauguuuguuucagugccu

SEQ ID NO: 90654 - RNA, 21 nt, Homo sapiens
ugagauuaaguuguuuagaag

SEQ ID NO: 90655 - RNA, 23 nt, Homo sapiens
ugagauuacccagaaagaguaua

SEQ ID NO: 90656 - RNA, 22 nt, Homo sapiens
ugagauuaucguaauguaucuc

SEQ ID NO: 90657 - RNA, 22 nt, Homo sapiens
ugagauuaucuguacauaggag

SEQ ID NO: 90658 - RNA, 22 nt, Homo sapiens
ugagauuguuagaucaaauggu

SEQ ID NO: 90659 - RNA, 22 nt, Homo sapiens
ugagcaagaaauagaaacagau

SEQ ID NO: 90660 - RNA, 22 nt, Homo sapiens
ugagcaagaucuuuauaauuag

SEQ ID NO: 90661 - RNA, 22 nt, Homo sapiens
ugagcaauaaaguuacacaguu

SEQ ID NO: 90662 - RNA, 22 nt, Homo sapiens
ugagcauauugugauaccuaaa

SEQ ID NO: 90663 - RNA, 22 nt, Homo sapiens
ugagcgaugggaggaagugaua

SEQ ID NO: 90664 - RNA, 22 nt, Homo sapiens
ugagcugagacaauaaguuuuu

SEQ ID NO: 90665 - RNA, 22 nt, Homo sapiens
ugagcugagaucacacuacugu

SEQ ID NO: 90666 - RNA, 22 nt, Homo sapiens
ugagcugguacuaauauuauca

SEQ ID NO: 90667 - RNA, 22 nt, Homo sapiens
ugaggaauguguguuaaagaua

SEQ ID NO: 90668 - RNA, 22 nt, Homo sapiens
ugaggaguauguucuguagacc

SEQ ID NO: 90669 - RNA, 22 nt, Homo sapiens
ugaggaucucuaggaauuuauc

SEQ ID NO: 90670 - RNA, 22 nt, Homo sapiens
ugaggcaagauacugauuucau

SEQ ID NO: 90671 - RNA, 22 nt, Homo sapiens
ugaggcaggagaacggcuugaa

SEQ ID NO: 90672 - RNA, 22 nt, Homo sapiens
ugaggcuagucagaucagauga

SEQ ID NO: 90673 - RNA, 22 nt, Homo sapiens
ugagggaugcguacccuaugcc

SEQ ID NO: 90674 - RNA, 22 nt, Homo sapiens
ugagguaaaacaaggauuggau

SEQ ID NO: 90675 - RNA, 22 nt, Homo sapiens
ugagguagguaccauuaucacu

SEQ ID NO: 90676 - RNA, 22 nt, Homo sapiens
ugagguaggugaagaaugcacg

SEQ ID NO: 90677 - RNA, 22 nt, Homo sapiens
ugagguaucauugcccaggcug

SEQ ID NO: 90678 - RNA, 20 nt, Homo sapiens
ugaggucugagaaagaauga

SEQ ID NO: 90679 - RNA, 22 nt, Homo sapiens
ugaggugaaguaauauucuaag

SEQ ID NO: 90680 - RNA, 22 nt, Homo sapiens
ugaggugagggguuaggugcua

SEQ ID NO: 90681 - RNA, 22 nt, Homo sapiens
ugaggugaggguaucaaaugcu

SEQ ID NO: 90682 - RNA, 22 nt, Homo sapiens
ugagguguuauccagaguucuu

SEQ ID NO: 90683 - RNA, 22 nt, Homo sapiens
ugagguuggggucagggcuagc

SEQ ID NO: 90684 - RNA, 22 nt, Homo sapiens
ugagguuguccacuauaaucca

SEQ ID NO: 90685 - RNA, 22 nt, Homo sapiens
ugaguagaacuccuggagaugu

SEQ ID NO: 90686 - RNA, 22 nt, Homo sapiens
ugaguagaagugaagauagugg

SEQ ID NO: 90687 - RNA, 22 nt, Homo sapiens
ugaguagagaauucagcuaagg

SEQ ID NO: 90688 - RNA, 23 nt, Homo sapiens
ugaguagguccacguaugugagu

SEQ ID NO: 90689 - RNA, 22 nt, Homo sapiens
ugaguagugccacaauaagcau

SEQ ID NO: 90690 - RNA, 22 nt, Homo sapiens
ugccuaguguguugagaguuuu

SEQ ID NO: 90691 - RNA, 20 nt, Homo sapiens
ugccugacacucuuugcuuc

SEQ ID NO: 90692 - RNA, 22 nt, Homo sapiens
ugccugagcccagcccuguagu

SEQ ID NO: 90693 - RNA, 22 nt, Homo sapiens
ugccugauacccucugucucuc

SEQ ID NO: 90694 - RNA, 22 nt, Homo sapiens
ugcgauuauuaugucacuuccu

SEQ ID NO: 90695 - RNA, 22 nt, Homo sapiens
ugcgccauugaacuccaggcug

SEQ ID NO: 90696 - RNA, 22 nt, Homo sapiens
ugcgguagugcaaucauggcuc

SEQ ID NO: 90697 - RNA, 22 nt, Homo sapiens
ugcguucauuuggccaguggcg

SEQ ID NO: 90698 - RNA, 22 nt, Homo sapiens
ugcuagagaaauauauuugggg

SEQ ID NO: 90699 - RNA, 22 nt, Homo sapiens
ugcuagaugaaguuugaguuuu

SEQ ID NO: 90700 - RNA, 22 nt, Homo sapiens
ugcuauagcuauaucaucuccu

SEQ ID NO: 90701 - RNA, 23 nt, Homo sapiens
ugcuauguaagcauuuauuaaau

SEQ ID NO: 90702 - RNA, 22 nt, Homo sapiens
ugcuauguccccacccaaaucu

SEQ ID NO: 90703 - RNA, 23 nt, Homo sapiens
ugcuccccucauggaugaauaaa

SEQ ID NO: 90704 - RNA, 22 nt, Homo sapiens
ugcugaguguuaccggacaccg

SEQ ID NO: 90705 - RNA, 22 nt, Homo sapiens
ugcugcaaacaugagaggaagu

SEQ ID NO: 90706 - RNA, 20 nt, Homo sapiens
ugcugcacuuaagcaugggc

SEQ ID NO: 90707 - RNA, 19 nt, Homo sapiens
ugcugcauugugaccuugc

SEQ ID NO: 90708 - RNA, 22 nt, Homo sapiens
ugcugguauuauguuauccaga

SEQ ID NO: 90709 - RNA, 17 nt, Homo sapiens
ugcuuagagagccucag

SEQ ID NO: 90710 - RNA, 22 nt, Homo sapiens
ugcuuguguucagguaaccuuu

SEQ ID NO: 90711 - RNA, 22 nt, Homo sapiens
ugcuuuguuauauggggauucu

SEQ ID NO: 90712 - RNA, 22 nt, Homo sapiens
ugcuuuguugaaaaucauuugg

SEQ ID NO: 90713 - RNA, 22 nt, Homo sapiens
uggaaaguaguucuaaucuaag

SEQ ID NO: 90714 - RNA, 19 nt, Homo sapiens
uggaacauaaaaguugguu

SEQ ID NO: 90715 - RNA, 22 nt, Homo sapiens
uggaagacucaagguggugaau

SEQ ID NO: 90716 - RNA, 20 nt, Homo sapiens
uggaaggcaucugcauuauu

SEQ ID NO: 90717 - RNA, 22 nt, Homo sapiens
uggaagucauugagguguguua

SEQ ID NO: 90718 - RNA, 22 nt, Homo sapiens
uggaaucaucaacgaaugaaau

SEQ ID NO: 90719 - RNA, 22 nt, Homo sapiens
uggaaucuagagaaaugcaaac

SEQ ID NO: 90720 - RNA, 21 nt, Homo sapiens
uggaaugaauggccaacaugg

SEQ ID NO: 90721 - RNA, 22 nt, Homo sapiens
uggaauguagcguugacacgag

SEQ ID NO: 90722 - RNA, 22 nt, Homo sapiens
uggaaugucuauguuuuugauu

SEQ ID NO: 90723 - RNA, 22 nt, Homo sapiens
uggaauguggacucuuaugggg

SEQ ID NO: 90724 - RNA, 22 nt, Homo sapiens
uggaauguuuaucaaaacagua

SEQ ID NO: 90725 - RNA, 22 nt, Homo sapiens
uggaauuaauccuccugguuuc

SEQ ID NO: 90726 - RNA, 21 nt, Homo sapiens
uggaauuaauggagagguguu

SEQ ID NO: 90727 - RNA, 22 nt, Homo sapiens
uggacaagugcccuccaccuca

SEQ ID NO: 90728 - RNA, 22 nt, Homo sapiens
uggacacugguggauauggaau

SEQ ID NO: 90729 - RNA, 22 nt, Homo sapiens
uggacagacaagguuauagauc

SEQ ID NO: 90730 - RNA, 21 nt, Homo sapiens
uggaccccuacuucucaccau

SEQ ID NO: 90731 - RNA, 19 nt, Homo sapiens
uggaccccuuccuuacacc

SEQ ID NO: 90732 - RNA, 21 nt, Homo sapiens
uggaccccuuucuuacaccgu

SEQ ID NO: 90733 - RNA, 22 nt, Homo sapiens
uggacugagauuucagcugcca

SEQ ID NO: 90734 - RNA, 22 nt, Homo sapiens
uggacuuuaauaaaagggaaau

SEQ ID NO: 90735 - RNA, 22 nt, Homo sapiens
uggagagcaaaaucaauccaaa

SEQ ID NO: 90736 - RNA, 22 nt, Homo sapiens
uggagagcaaagaauuuguuag

SEQ ID NO: 90737 - RNA, 22 nt, Homo sapiens
uggagagugagggccuccuuaa

SEQ ID NO: 90738 - RNA, 19 nt, Homo sapiens
uggagauauccccuucaca

SEQ ID NO: 90739 - RNA, 22 nt, Homo sapiens
uggagcaaaguugaggccaagc

SEQ ID NO: 90740 - RNA, 22 nt, Homo sapiens
uggagcccuaaacuucuaauau

SEQ ID NO: 90741 - RNA, 23 nt, Homo sapiens
uggaggacaagcauggauaguga

SEQ ID NO: 90742 - RNA, 22 nt, Homo sapiens
uggagguaggugauauguagca

SEQ ID NO: 90743 - RNA, 20 nt, Homo sapiens
uggaggucaucugucacuac

SEQ ID NO: 90744 - RNA, 22 nt, Homo sapiens
uggaguaggccuaagaaugaca

SEQ ID NO: 90745 - RNA, 19 nt, Homo sapiens
uggagucaucaugcugcua

SEQ ID NO: 90746 - RNA, 22 nt, Homo sapiens
uggagugcaauggugagaucuu

SEQ ID NO: 90747 - RNA, 22 nt, Homo sapiens
uggaguguaaauuaguucagcc

SEQ ID NO: 90748 - RNA, 22 nt, Homo sapiens
uggaguguguugcagaugaagg

SEQ ID NO: 90749 - RNA, 22 nt, Homo sapiens
uggaguguuggggcaggaucuc

SEQ ID NO: 90750 - RNA, 16 nt, Homo sapiens
uggaguguuuguuaga

SEQ ID NO: 90751 - RNA, 22 nt, Homo sapiens
uggauaguuuacugaagagugg

SEQ ID NO: 90752 - RNA, 22 nt, Homo sapiens
uggauauguuuauuacccugaa

SEQ ID NO: 90753 - RNA, 21 nt, Homo sapiens
uggaugccuaggcagaaguuu

SEQ ID NO: 90754 - RNA, 22 nt, Homo sapiens
uggauggugauuggaucaugga

SEQ ID NO: 90755 - RNA, 22 nt, Homo sapiens
uggauugaaagcuuuaauauug

SEQ ID NO: 90756 - RNA, 22 nt, Homo sapiens
uggauuguuucucuugguauga

SEQ ID NO: 90757 - RNA, 22 nt, Homo sapiens
uggauuuuaauuauucugucau

SEQ ID NO: 90758 - RNA, 21 nt, Homo sapiens
uggcaaaaugggcaguggguu

SEQ ID NO: 90759 - RNA, 22 nt, Homo sapiens
uggcaaaugaaagaaagccagu

SEQ ID NO: 90760 - RNA, 22 nt, Homo sapiens
uggcaaaugaagucagcuguac

SEQ ID NO: 90761 - RNA, 22 nt, Homo sapiens
uggcaagaacaacaauuacuuu

SEQ ID NO: 90762 - RNA, 22 nt, Homo sapiens
uggcaagaacgaaauguagggu

SEQ ID NO: 90763 - RNA, 22 nt, Homo sapiens
uggcaagaaggauuuauuccuu

SEQ ID NO: 90764 - RNA, 23 nt, Homo sapiens
uggcaagaauucuuaccgugugg

SEQ ID NO: 90765 - RNA, 22 nt, Homo sapiens
uggcaagagauaugugucuaua

SEQ ID NO: 90766 - RNA, 22 nt, Homo sapiens
uggcaagagcugcauucaucug

SEQ ID NO: 90767 - RNA, 22 nt, Homo sapiens
uggcaagcaggacuaaagcacc

SEQ ID NO: 90768 - RNA, 18 nt, Homo sapiens
uggcaaguuuaguagcac

SEQ ID NO: 90769 - RNA, 22 nt, Homo sapiens
uggcaauaauucagugugggcu

SEQ ID NO: 90770 - RNA, 22 nt, Homo sapiens
uggcaauauccacaauuacuuu

SEQ ID NO: 90771 - RNA, 19 nt, Homo sapiens
uggcaaugucagcagagau

SEQ ID NO: 90772 - RNA, 22 nt, Homo sapiens
uggcacaaugacccuugugggc

SEQ ID NO: 90773 - RNA, 22 nt, Homo sapiens
uggcaccauccaggugucucua

SEQ ID NO: 90774 - RNA, 21 nt, Homo sapiens
uggcacuauucacaauagcaa

SEQ ID NO: 90775 - RNA, 22 nt, Homo sapiens
uggcacuggagauacauuaaua

SEQ ID NO: 90776 - RNA, 22 nt, Homo sapiens
uggcagacaaauuugagcauau

SEQ ID NO: 90777 - RNA, 22 nt, Homo sapiens
uggcagaugagccgcgcuccaa

SEQ ID NO: 90778 - RNA, 22 nt, Homo sapiens
uggcaguuuacaaaugccauga

SEQ ID NO: 90779 - RNA, 22 nt, Homo sapiens
uggcaguuuuugccuucaauac

SEQ ID NO: 90780 - RNA, 22 nt, Homo sapiens
uggcaugaaguguguuuuaucu

SEQ ID NO: 90781 - RNA, 22 nt, Homo sapiens
uggcaugauccuagauucaaca

SEQ ID NO: 90782 - RNA, 22 nt, Homo sapiens
ugucauguagaaauuguccauu

SEQ ID NO: 90783 - RNA, 22 nt, Homo sapiens
ugucaugucaacuauggaauuu

SEQ ID NO: 90784 - RNA, 22 nt, Homo sapiens
ugucauguggcuaacgauucau

SEQ ID NO: 90785 - RNA, 22 nt, Homo sapiens
ugucauuggacuucuuucaugg

SEQ ID NO: 90786 - RNA, 21 nt, Homo sapiens
uguccagcuuuuggaauauaa

SEQ ID NO: 90787 - RNA, 22 nt, Homo sapiens
uguccauuuuuaugcuuauggu

SEQ ID NO: 90788 - RNA, 20 nt, Homo sapiens
ugucccaaccccauggguuc

SEQ ID NO: 90789 - RNA, 22 nt, Homo sapiens
ugucccguuuucgaggcugcag

SEQ ID NO: 90790 - RNA, 22 nt, Homo sapiens
ugucccugagccuggauuccug

SEQ ID NO: 90791 - RNA, 19 nt, Homo sapiens
uguccuagaggaguucaca

SEQ ID NO: 90792 - RNA, 22 nt, Homo sapiens
uguccuagagggaugucacccc

SEQ ID NO: 90793 - RNA, 22 nt, Homo sapiens
uguccuggugaugcccaaauuc

SEQ ID NO: 90794 - RNA, 21 nt, Homo sapiens
ugucuagaccucauccuacag

SEQ ID NO: 90795 - RNA, 22 nt, Homo sapiens
ugucuaguuuugaaguauagca

SEQ ID NO: 90796 - RNA, 18 nt, Homo sapiens
ugucuuagagcuugaccc

SEQ ID NO: 90797 - RNA, 22 nt, Homo sapiens
ugucuuguagacugaaggcuuc

SEQ ID NO: 90798 - RNA, 22 nt, Homo sapiens
ugucuuugguucaggcaaggag

SEQ ID NO: 90799 - RNA, 22 nt, Homo sapiens
ugugaaacauggauagaacugg

SEQ ID NO: 90800 - RNA, 22 nt, Homo sapiens
ugugaaccucuggccaagauga

SEQ ID NO: 90801 - RNA, 22 nt, Homo sapiens
ugugaagaaagucauugguagc

SEQ ID NO: 90802 - RNA, 22 nt, Homo sapiens
ugugaagauggacuaauauagu

SEQ ID NO: 90803 - RNA, 22 nt, Homo sapiens
ugugaagauguuucuuaauuga

SEQ ID NO: 90804 - RNA, 22 nt, Homo sapiens
ugugaaugaagaaugcuaaccu

SEQ ID NO: 90805 - RNA, 22 nt, Homo sapiens
ugugaaugauggagugucgaau

SEQ ID NO: 90806 - RNA, 22 nt, Homo sapiens
ugugaauguaaccuuauuugga

SEQ ID NO: 90807 - RNA, 23 nt, Homo sapiens
ugugacacuuccgucaguucauu

SEQ ID NO: 90808 - RNA, 22 nt, Homo sapiens
ugugacagguagguaauuuuug

SEQ ID NO: 90809 - RNA, 17 nt, Homo sapiens
ugugacccugggcuacc

SEQ ID NO: 90810 - RNA, 19 nt, Homo sapiens
ugugacugguugucucgcu

SEQ ID NO: 90811 - RNA, 21 nt, Homo sapiens
ugugacuguugcauuugucgu

SEQ ID NO: 90812 - RNA, 22 nt, Homo sapiens
ugugagaucucagaauugaacu

SEQ ID NO: 90813 - RNA, 22 nt, Homo sapiens
ugugagcuauggaguuguagag

SEQ ID NO: 90814 - RNA, 22 nt, Homo sapiens
ugugaguguguacuaguuauca

SEQ ID NO: 90815 - RNA, 22 nt, Homo sapiens
ugugaucaugcuccaggcgaga

SEQ ID NO: 90816 - RNA, 22 nt, Homo sapiens
ugugaugaaggcauagggaugu

SEQ ID NO: 90817 - RNA, 22 nt, Homo sapiens
ugugauggaguuucauggacug

SEQ ID NO: 90818 - RNA, 22 nt, Homo sapiens
ugugaugguuuggaagcuucuu

SEQ ID NO: 90819 - RNA, 22 nt, Homo sapiens
ugugauugauauauuuacagaa

SEQ ID NO: 90820 - RNA, 18 nt, Homo sapiens
ugugcaauauuaaccacc

SEQ ID NO: 90821 - RNA, 22 nt, Homo sapiens
ugugcacaacaugcagguuugu

SEQ ID NO: 90822 - RNA, 22 nt, Homo sapiens
ugugcacaaugugcagguuuga

SEQ ID NO: 90823 - RNA, 22 nt, Homo sapiens
ugugcacauaacauuuuuuuag

SEQ ID NO: 90824 - RNA, 22 nt, Homo sapiens
ugugcaguuuugagugaauuuc

SEQ ID NO: 90825 - RNA, 22 nt, Homo sapiens
ugugcauauaaguguguauaua

SEQ ID NO: 90826 - RNA, 22 nt, Homo sapiens
ugugcauaugucuuuauaguag

SEQ ID NO: 90827 - RNA, 22 nt, Homo sapiens
ugugccacugcacuccugggug

SEQ ID NO: 90828 - RNA, 22 nt, Homo sapiens
ugugccacugcacuucagccug

SEQ ID NO: 90829 - RNA, 22 nt, Homo sapiens
ugugccuacugauagagccaag

SEQ ID NO: 90830 - RNA, 22 nt, Homo sapiens
ugugcucaucucagucaacugu

SEQ ID NO: 90831 - RNA, 22 nt, Homo sapiens
uguggaaauaaaagaaagguua

SEQ ID NO: 90832 - RNA, 22 nt, Homo sapiens
uguggaaauuguuguauuuaau

SEQ ID NO: 90833 - RNA, 22 nt, Homo sapiens
uguggcauugaauaaccuugga

SEQ ID NO: 90834 - RNA, 18 nt, Homo sapiens
uguggcuguuuuccaaua

SEQ ID NO: 90835 - RNA, 22 nt, Homo sapiens
ugugggugguaaaauacaauga

SEQ ID NO: 90836 - RNA, 22 nt, Homo sapiens
ugugguuuuaguaaaacuaugu

SEQ ID NO: 90837 - RNA, 22 nt, Homo sapiens
ugugguuuuauaaacgugaccu

SEQ ID NO: 90838 - RNA, 22 nt, Homo sapiens
ugugguuuuuuucuccaauagg

SEQ ID NO: 90839 - RNA, 22 nt, Homo sapiens
uguguaaauauauacacacgug

SEQ ID NO: 90840 - RNA, 22 nt, Homo sapiens
uguguaauacucuaaugaugca

SEQ ID NO: 90841 - RNA, 22 nt, Homo sapiens
uguguacugcagaguauucugu

SEQ ID NO: 90842 - RNA, 22 nt, Homo sapiens
ugugucacugcacuccagcgug

SEQ ID NO: 90843 - RNA, 21 nt, Homo sapiens
uguuaacaugcagauuacugg

SEQ ID NO: 90844 - RNA, 22 nt, Homo sapiens
uguuaacauuuuagagugggaa

SEQ ID NO: 90845 - RNA, 22 nt, Homo sapiens
uguuaugaagaugccugguaca

SEQ ID NO: 90846 - RNA, 22 nt, Homo sapiens
uguuauuuuguguuagggcaca

SEQ ID NO: 90847 - RNA, 22 nt, Homo sapiens
uguugcacacacugaaauacac

SEQ ID NO: 90848 - RNA, 20 nt, Homo sapiens
uguugcacucuagccugggu

SEQ ID NO: 90849 - RNA, 22 nt, Homo sapiens
uguuugcuguguggaguagcag

SEQ ID NO: 90850 - RNA, 22 nt, Homo sapiens
uguuuguuugugauacgguaca

SEQ ID NO: 90851 - RNA, 22 nt, Homo sapiens
uguuuugguugucccuggccag

SEQ ID NO: 90852 - RNA, 22 nt, Homo sapiens
uguuuuguuagcacucugggaa

SEQ ID NO: 90853 - RNA, 22 nt, Homo sapiens
uuaaaccugucuucucacuaau

SEQ ID NO: 90854 - RNA, 22 nt, Homo sapiens
uuaaaggcaugguuagacaugg

SEQ ID NO: 90855 - RNA, 22 nt, Homo sapiens
uuaaaguauaguuccucugguu

SEQ ID NO: 90856 - RNA, 22 nt, Homo sapiens
uuaaaguguuuucaaaauguca

SEQ ID NO: 90857 - RNA, 22 nt, Homo sapiens
uuaaauacagcaugguguuucu

SEQ ID NO: 90858 - RNA, 20 nt, Homo sapiens
uuaaaucuagugcagacuca

SEQ ID NO: 90859 - RNA, 22 nt, Homo sapiens
uuaacagcacuacguggggauc

SEQ ID NO: 90860 - RNA, 22 nt, Homo sapiens
uuaacagucacuuagcucauuu

SEQ ID NO: 90861 - RNA, 22 nt, Homo sapiens
uuaagagugggaguuggccaca

SEQ ID NO: 90862 - RNA, 22 nt, Homo sapiens
uuaagaucagugcaaacuggag

SEQ ID NO: 90863 - RNA, 22 nt, Homo sapiens
uuaagcaaagguaacaugagaa

SEQ ID NO: 90864 - RNA, 22 nt, Homo sapiens
uuaagggaggagcuucaagaug

SEQ ID NO: 90865 - RNA, 19 nt, Homo sapiens
uuaagguacuuagaugugu

SEQ ID NO: 90866 - RNA, 22 nt, Homo sapiens
uuaaggugaaguucucagaugc

SEQ ID NO: 90867 - RNA, 22 nt, Homo sapiens
uuaaguagaugaaugugaaugu

SEQ ID NO: 90868 - RNA, 22 nt, Homo sapiens
uuaauacugcuuaacuuuagga

SEQ ID NO: 90869 - RNA, 22 nt, Homo sapiens
uuaauagcaaagaguuuagacu

SEQ ID NO: 90870 - RNA, 22 nt, Homo sapiens
uuaauccugccuuauuucagua

SEQ ID NO: 90871 - RNA, 21 nt, Homo sapiens
uuaaugcuaugcagaaaaucu

SEQ ID NO: 90872 - RNA, 22 nt, Homo sapiens
uuaaugcuuggggaguaguucu

SEQ ID NO: 90873 - RNA, 19 nt, Homo sapiens
aaccgggagugcacauguu

SEQ ID NO: 90874 - RNA, 22 nt, Homo sapiens
aacuccauuuuagacccuagau

SEQ ID NO: 90875 - RNA, 22 nt, Homo sapiens
aacugccucugacauaggcagg

SEQ ID NO: 90876 - RNA, 22 nt, Homo sapiens
aacuggcacuacaucaagagcu

SEQ ID NO: 90877 - RNA, 22 nt, Homo sapiens
aacuggcauauucugguugcgg

SEQ ID NO: 90878 - RNA, 22 nt, Homo sapiens
aacugguauugaauuuaggaag

SEQ ID NO: 90879 - RNA, 21 nt, Homo sapiens
aacuggugugagaugguaugu

SEQ ID NO: 90880 - RNA, 21 nt, Homo sapiens
aagaaagcuggacuugccgcu

SEQ ID NO: 90881 - RNA, 22 nt, Homo sapiens
aagagagccagcugguauauuu

SEQ ID NO: 90882 - RNA, 22 nt, Homo sapiens
aagagguagucugucccuuagc

SEQ ID NO: 90883 - RNA, 22 nt, Homo sapiens
aagauaguaaacauuuucugcu

SEQ ID NO: 90884 - RNA, 22 nt, Homo sapiens
aagauauguuaguuauaaacuc

SEQ ID NO: 90885 - RNA, 22 nt, Homo sapiens
aagaugcagaagcccagauguu

SEQ ID NO: 90886 - RNA, 22 nt, Homo sapiens
aagaugcagucauacuggagua

SEQ ID NO: 90887 - RNA, 22 nt, Homo sapiens
aagcaacacaucugccccgguu

SEQ ID NO: 90888 - RNA, 21 nt, Homo sapiens
aagcacauugaguguguguga

SEQ ID NO: 90889 - RNA, 22 nt, Homo sapiens
aagcacccagccucacgccugc

SEQ ID NO: 90890 - RNA, 22 nt, Homo sapiens
aagcacccuuugucuggacaug

SEQ ID NO: 90891 - RNA, 21 nt, Homo sapiens
aagcaugguguaucuuuccau

SEQ ID NO: 90892 - RNA, 22 nt, Homo sapiens
aagccagugugacaggaaacuu

SEQ ID NO: 90893 - RNA, 22 nt, Homo sapiens
aagcucauugagaucuauggcu

SEQ ID NO: 90894 - RNA, 22 nt, Homo sapiens
aagcuccauuucugccaugaga

SEQ ID NO: 90895 - RNA, 22 nt, Homo sapiens
aagcugcauuuucuagaugcuu

SEQ ID NO: 90896 - RNA, 22 nt, Homo sapiens
aagcuggagugcaguggugcaa

SEQ ID NO: 90897 - RNA, 22 nt, Homo sapiens
aagcuggauuuaguguggagca

SEQ ID NO: 90898 - RNA, 22 nt, Homo sapiens
aagcuggcauucauucguucuu

SEQ ID NO: 90899 - RNA, 22 nt, Homo sapiens
aagcuggcuuucauugagugcu

SEQ ID NO: 90900 - RNA, 22 nt, Homo sapiens
aagcuguugguggauguaccau

SEQ ID NO: 90901 - RNA, 22 nt, Homo sapiens
aaggaauacuggugguugcuau

SEQ ID NO: 90902 - RNA, 22 nt, Homo sapiens
aaggaguguggugaucuugggc

SEQ ID NO: 90903 - RNA, 22 nt, Homo sapiens
aaggcaacgugaguuguugauu

SEQ ID NO: 90904 - RNA, 22 nt, Homo sapiens
aaggcaauuuguugugaggauu

SEQ ID NO: 90905 - RNA, 22 nt, Homo sapiens
aaggcacugaacuuaaauucug

SEQ ID NO: 90906 - RNA, 22 nt, Homo sapiens
aaggcagugugcacauaacacu

SEQ ID NO: 90907 - RNA, 22 nt, Homo sapiens
aaggcauucucaaacuaguucu

SEQ ID NO: 90908 - RNA, 22 nt, Homo sapiens
aaggcuguucauuuagcacagu

SEQ ID NO: 90909 - RNA, 22 nt, Homo sapiens
aagggaauguuguagcugguuu

SEQ ID NO: 90910 - RNA, 22 nt, Homo sapiens
aagggaauguugugguugguuu

SEQ ID NO: 90911 - RNA, 22 nt, Homo sapiens
aagguauuucuaugggaauaga

SEQ ID NO: 90912 - RNA, 22 nt, Homo sapiens
aaguaaacauugagagacaaga

SEQ ID NO: 90913 - RNA, 22 nt, Homo sapiens
aaguaaacauuuuguacaauaa

SEQ ID NO: 90914 - RNA, 22 nt, Homo sapiens
aaguaauggaguuauuuuauga

SEQ ID NO: 90915 - RNA, 22 nt, Homo sapiens
aaguaauugagguuuuugcugu

SEQ ID NO: 90916 - RNA, 22 nt, Homo sapiens
aaguagcagaggcaagacuuga

SEQ ID NO: 90917 - RNA, 23 nt, Homo sapiens
aagucauggaaucaaaugaggug

SEQ ID NO: 90918 - RNA, 22 nt, Homo sapiens
aagugacauugugcccauuuga

SEQ ID NO: 90919 - RNA, 22 nt, Homo sapiens
aagugacuagacuaugaaaccu

SEQ ID NO: 90920 - RNA, 22 nt, Homo sapiens
aagugagugacaaaaacugggc

SEQ ID NO: 90921 - RNA, 22 nt, Homo sapiens
aagugcaaaucuguggcugaaa

SEQ ID NO: 90922 - RNA, 22 nt, Homo sapiens
aagugcuggccuacucaaucga

SEQ ID NO: 90923 - RNA, 22 nt, Homo sapiens
aagugcuguaugggagccuagg

SEQ ID NO: 90924 - RNA, 22 nt, Homo sapiens
aagugcuuacagggaacaugau

SEQ ID NO: 90925 - RNA, 20 nt, Homo sapiens
aagugcuuccuuuuagaggg

SEQ ID NO: 90926 - RNA, 22 nt, Homo sapiens
aagugcuuuacacaugcaugau

SEQ ID NO: 90927 - RNA, 22 nt, Homo sapiens
aagugcuuuuuagauaugguuu

SEQ ID NO: 90928 - RNA, 17 nt, Homo sapiens
aaguggcuuguucacca

SEQ ID NO: 90929 - RNA, 22 nt, Homo sapiens
aagugguguuugggagcuggac

SEQ ID NO: 90930 - RNA, 22 nt, Homo sapiens
aaguguaugaaacaguccaugg

SEQ ID NO: 90931 - RNA, 22 nt, Homo sapiens
aagugucagaguugcuaaugac

SEQ ID NO: 90932 - RNA, 22 nt, Homo sapiens
aagugucuuaccgggagggagu

SEQ ID NO: 90933 - RNA, 19 nt, Homo sapiens
aauaaugccagaugucugu

SEQ ID NO: 90934 - RNA, 22 nt, Homo sapiens
aauacucuauaagggaagcugu

SEQ ID NO: 90935 - RNA, 22 nt, Homo sapiens
aauacuuccaaaucuagucauu

SEQ ID NO: 90936 - RNA, 22 nt, Homo sapiens
aauaucacaggguguacacuca

SEQ ID NO: 90937 - RNA, 22 nt, Homo sapiens
aaucacagccagcuuccgcuau

SEQ ID NO: 90938 - RNA, 22 nt, Homo sapiens
aaucacaggucuuggcugcaug

SEQ ID NO: 90939 - RNA, 22 nt, Homo sapiens
aaucacaguguucuugugaggg

SEQ ID NO: 90940 - RNA, 21 nt, Homo sapiens
aaucacugucuguuuccccuu

SEQ ID NO: 90941 - RNA, 22 nt, Homo sapiens
aaucacuuugcuacaaggcagu

SEQ ID NO: 90942 - RNA, 22 nt, Homo sapiens
aaucacuuuggcaccaaccuaa

SEQ ID NO: 90943 - RNA, 17 nt, Homo sapiens
aaucagauuucugagga

SEQ ID NO: 90944 - RNA, 22 nt, Homo sapiens
aauccauuugccgucuauccau

SEQ ID NO: 90945 - RNA, 22 nt, Homo sapiens
aaucccauuucucuguguuuuu

SEQ ID NO: 90946 - RNA, 22 nt, Homo sapiens
aauccuguagauucuaauuccu

SEQ ID NO: 90947 - RNA, 22 nt, Homo sapiens
aaucugauguuaucagcuuaag

SEQ ID NO: 90948 - RNA, 22 nt, Homo sapiens
aaucugggguuguuuggggagu

SEQ ID NO: 90949 - RNA, 22 nt, Homo sapiens
aaucugucuuuuguuauugagg

SEQ ID NO: 90950 - RNA, 17 nt, Homo sapiens
aaugagacauuucugcu

SEQ ID NO: 90951 - RNA, 22 nt, Homo sapiens
aaugcacauaaaauccuccagg

SEQ ID NO: 90952 - RNA, 22 nt, Homo sapiens
aaugcacauauauuuccuuauu

SEQ ID NO: 90953 - RNA, 22 nt, Homo sapiens
aaugcauaauuuguaugaggua

SEQ ID NO: 90954 - RNA, 22 nt, Homo sapiens
aaugccacugugccugccaagg

SEQ ID NO: 90955 - RNA, 22 nt, Homo sapiens
aaugcuaucuggaacauuguug

SEQ ID NO: 90956 - RNA, 22 nt, Homo sapiens
aaugcuguucuuugcuuaaguu

SEQ ID NO: 90957 - RNA, 22 nt, Homo sapiens
aauggagcugaguggccuuggg

SEQ ID NO: 90958 - RNA, 22 nt, Homo sapiens
aauggcacaagacaugaagaag

SEQ ID NO: 90959 - RNA, 22 nt, Homo sapiens
aauggcacacaccuggucuaac

SEQ ID NO: 90960 - RNA, 22 nt, Homo sapiens
aauggcacaccuagcccuaacc

SEQ ID NO: 90961 - RNA, 22 nt, Homo sapiens
aauggcaucuagaguggugaau

SEQ ID NO: 90962 - RNA, 22 nt, Homo sapiens
aauggcauuugccagggcaaag

SEQ ID NO: 90963 - RNA, 16 nt, Homo sapiens
ucaccccuagagaucc

SEQ ID NO: 90964 - RNA, 22 nt, Homo sapiens
ucaccguguaucauuucauccg

SEQ ID NO: 90965 - RNA, 22 nt, Homo sapiens
ucaccuguagcuaagaccuaau

SEQ ID NO: 90966 - RNA, 21 nt, Homo sapiens
ucaccuguagcugcauguucu

SEQ ID NO: 90967 - RNA, 21 nt, Homo sapiens
ucaccuguugcgaugaagcug

SEQ ID NO: 90968 - RNA, 18 nt, Homo sapiens
ucaccuugaugcuggguc

SEQ ID NO: 90969 - RNA, 18 nt, Homo sapiens
ucacggggagcagcagcc

SEQ ID NO: 90970 - RNA, 21 nt, Homo sapiens
ucacuaguaaaaggugaacug

SEQ ID NO: 90971 - RNA, 20 nt, Homo sapiens
ucacuauggagcucuuucuu

SEQ ID NO: 90972 - RNA, 22 nt, Homo sapiens
ucacuauugacaacagugugga

SEQ ID NO: 90973 - RNA, 22 nt, Homo sapiens
ucacugaaaccuccaccucucg

SEQ ID NO: 90974 - RNA, 22 nt, Homo sapiens
ucacugagcacaggagaugugc

SEQ ID NO: 90975 - RNA, 21 nt, Homo sapiens
ucacugagcaucaugguuuca

SEQ ID NO: 90976 - RNA, 20 nt, Homo sapiens
ucacugagugguccacagua

SEQ ID NO: 90977 - RNA, 19 nt, Homo sapiens
ucacuggacagcacacuca

SEQ ID NO: 90978 - RNA, 22 nt, Homo sapiens
ucacuggagguuccugaaguuc

SEQ ID NO: 90979 - RNA, 22 nt, Homo sapiens
ucacugggagaccaaagccauc

SEQ ID NO: 90980 - RNA, 22 nt, Homo sapiens
ucacuguggaacucaaaaagcu

SEQ ID NO: 90981 - RNA, 22 nt, Homo sapiens
agagcacuguggguccaaauau

SEQ ID NO: 90982 - RNA, 22 nt, Homo sapiens
agagcuaguauuuacggagcau

SEQ ID NO: 90983 - RNA, 22 nt, Homo sapiens
agagcuguguuuuaacuuuuua

SEQ ID NO: 90984 - RNA, 21 nt, Homo sapiens
agaggacugaccacagcccua

SEQ ID NO: 90985 - RNA, 22 nt, Homo sapiens
agaggaguacuacuccaagucu

SEQ ID NO: 90986 - RNA, 22 nt, Homo sapiens
agagguaagaauaguaguugga

SEQ ID NO: 90987 - RNA, 22 nt, Homo sapiens
agagguagaagauaggcuacag

SEQ ID NO: 90988 - RNA, 22 nt, Homo sapiens
agagguuuuggggcugagagcu

SEQ ID NO: 90989 - RNA, 22 nt, Homo sapiens
agaguacugacguuugcaaauu

SEQ ID NO: 90990 - RNA, 15 nt, Homo sapiens
agaguagagacgccc

SEQ ID NO: 90991 - RNA, 22 nt, Homo sapiens
agaguaguaggaugaauggacu

SEQ ID NO: 90992 - RNA, 22 nt, Homo sapiens
agaguauacaugugagugagau

SEQ ID NO: 90993 - RNA, 22 nt, Homo sapiens
agagucacaugaggcccuucau

SEQ ID NO: 90994 - RNA, 23 nt, Homo sapiens
agagugcaauggugccaucucgg

SEQ ID NO: 90995 - RNA, 22 nt, Homo sapiens
agagugcuauagauuagauuuc

SEQ ID NO: 90996 - RNA, 22 nt, Homo sapiens
agauacauuggauaaugguggg

SEQ ID NO: 90997 - RNA, 22 nt, Homo sapiens
agauaugucugcuauuugcugu

SEQ ID NO: 90998 - RNA, 22 nt, Homo sapiens
agauauuuguuaggucugucag

SEQ ID NO: 90999 - RNA, 22 nt, Homo sapiens
agaucaauugcugauucgcucu

SEQ ID NO: 91000 - RNA, 22 nt, Homo sapiens
agaucauaugcaguaaugaacu

SEQ ID NO: 91001 - RNA, 22 nt, Homo sapiens
agaugauguuucuggcacauga

SEQ ID NO: 91002 - RNA, 20 nt, Homo sapiens
agaugcaugcacauaaacac

SEQ ID NO: 91003 - RNA, 23 nt, Homo sapiens
agaugcauucuuguaggauauau

SEQ ID NO: 91004 - RNA, 22 nt, Homo sapiens
agaugccuaugaagagaaauua

SEQ ID NO: 91005 - RNA, 22 nt, Homo sapiens
agaugcuguuaucaacuguagc

SEQ ID NO: 91006 - RNA, 22 nt, Homo sapiens
agaugguauuauagguuucugu

SEQ ID NO: 91007 - RNA, 22 nt, Homo sapiens
agauggucuucauaaguuuuaa

SEQ ID NO: 91008 - RNA, 22 nt, Homo sapiens
agauggugauaaaugugguacc

SEQ ID NO: 91009 - RNA, 22 nt, Homo sapiens
agauggugugcuaggaaaugua

SEQ ID NO: 91010 - RNA, 22 nt, Homo sapiens
agauguuguucaucugauuguu

SEQ ID NO: 91011 - RNA, 22 nt, Homo sapiens
agauucauccaaguuguugcau

SEQ ID NO: 91012 - RNA, 22 nt, Homo sapiens
agcaacauagugagacccccau

SEQ ID NO: 91013 - RNA, 22 nt, Homo sapiens
agcaacauugagacugcaguug

SEQ ID NO: 91014 - RNA, 22 nt, Homo sapiens
agcaacauuguucauaauagcu

SEQ ID NO: 91015 - RNA, 22 nt, Homo sapiens
agcaacauuuuugaccuuucuu

SEQ ID NO: 91016 - RNA, 22 nt, Homo sapiens
agcaaccagaggagaugaggcu

SEQ ID NO: 91017 - RNA, 22 nt, Homo sapiens
agcaagauccagucgcacagga

SEQ ID NO: 91018 - RNA, 22 nt, Homo sapiens
agcaagaugaaguugagcuagg

SEQ ID NO: 91019 - RNA, 22 nt, Homo sapiens
agcaauaugacauugcuacauc

SEQ ID NO: 91020 - RNA, 22 nt, Homo sapiens
agcaccacaauuuccugccuaa

SEQ ID NO: 91021 - RNA, 22 nt, Homo sapiens
agcaccagaaucugaguuauuc

SEQ ID NO: 91022 - RNA, 22 nt, Homo sapiens
agcaccauugcacuccagccug

SEQ ID NO: 91023 - RNA, 23 nt, Homo sapiens
agcaccuuuccuccacuaucugc

SEQ ID NO: 91024 - RNA, 19 nt, Homo sapiens
agcagaacaaauguguggg

SEQ ID NO: 91025 - RNA, 22 nt, Homo sapiens
agcagagcauauucauucgggg

SEQ ID NO: 91026 - RNA, 22 nt, Homo sapiens
agcagcacaucccuuucuggcc

SEQ ID NO: 91027 - RNA, 22 nt, Homo sapiens
agcagcauggguauaaaucucc

SEQ ID NO: 91028 - RNA, 22 nt, Homo sapiens
agcagcauuaguggaaucuugu

SEQ ID NO: 91029 - RNA, 22 nt, Homo sapiens
agcagcuuugcauggccuguga

SEQ ID NO: 91030 - RNA, 22 nt, Homo sapiens
agcagguguggcuuauccugaa

SEQ ID NO: 91031 - RNA, 16 nt, Homo sapiens
agcagguguuagguga

SEQ ID NO: 91032 - RNA, 22 nt, Homo sapiens
agcagugugaaaauggacuaau

SEQ ID NO: 91033 - RNA, 22 nt, Homo sapiens
agcaucacacacuacagggaaa

SEQ ID NO: 91034 - RNA, 18 nt, Homo sapiens
agcaucacugaucauccu

SEQ ID NO: 91035 - RNA, 20 nt, Homo sapiens
agcaucagugguaguguugc

SEQ ID NO: 91036 - RNA, 22 nt, Homo sapiens
agcaucauaccaaucugguccu

SEQ ID NO: 91037 - RNA, 22 nt, Homo sapiens
agcaucauuugauguucccgag

SEQ ID NO: 91038 - RNA, 22 nt, Homo sapiens
agcaugacauauuguagagaaa

SEQ ID NO: 91039 - RNA, 17 nt, Homo sapiens
agcauguguuugagauu

SEQ ID NO: 91040 - RNA, 22 nt, Homo sapiens
agcauuacaugguacagagaag

SEQ ID NO: 91041 - RNA, 20 nt, Homo sapiens
agcauugguuagaacaguag

SEQ ID NO: 91042 - RNA, 22 nt, Homo sapiens
agccaagacucuguuccccuug

SEQ ID NO: 91043 - RNA, 22 nt, Homo sapiens
agccaguauuuccacagagugg

SEQ ID NO: 91044 - RNA, 19 nt, Homo sapiens
agccaguuuucccagcacc

SEQ ID NO: 91045 - RNA, 22 nt, Homo sapiens
agccauacaacguaugcaugua

SEQ ID NO: 91046 - RNA, 22 nt, Homo sapiens
agcccauguggcugaggcuucu

SEQ ID NO: 91047 - RNA, 22 nt, Homo sapiens
agccccauuuguugaaaagacg

SEQ ID NO: 91048 - RNA, 22 nt, Homo sapiens
agcccuuagauggcuccuucca

SEQ ID NO: 91049 - RNA, 22 nt, Homo sapiens
agccgguguccacgaagaagag

SEQ ID NO: 91050 - RNA, 21 nt, Homo sapiens
agcuaaauuggaaauuucugu

SEQ ID NO: 91051 - RNA, 22 nt, Homo sapiens
agcuacaucuugcucugggaug

SEQ ID NO: 91052 - RNA, 22 nt, Homo sapiens
agcuauauugaggaugccauuc

SEQ ID NO: 91053 - RNA, 22 nt, Homo sapiens
agcuccuuucugcagguagguu

SEQ ID NO: 91054 - RNA, 22 nt, Homo sapiens
agcucuuguuaguauuagcagu

SEQ ID NO: 91055 - RNA, 22 nt, Homo sapiens
agcugauggucuuguaugaugu

SEQ ID NO: 91056 - RNA, 22 nt, Homo sapiens
agcugcacgugguaaauguaaa

SEQ ID NO: 91057 - RNA, 22 nt, Homo sapiens
agcugcacugguauaggagaaa

SEQ ID NO: 91058 - RNA, 20 nt, Homo sapiens
agcugcagauauaaauccgc

SEQ ID NO: 91059 - RNA, 22 nt, Homo sapiens
agcugcauuuacuuuugcacaa

SEQ ID NO: 91060 - RNA, 22 nt, Homo sapiens
agcugccagucuuguaaggccu

SEQ ID NO: 91061 - RNA, 17 nt, Homo sapiens
agcuggaauuacgggag

SEQ ID NO: 91062 - RNA, 22 nt, Homo sapiens
agcuggauguauguuaagugaa

SEQ ID NO: 91063 - RNA, 22 nt, Homo sapiens
agcugguauuuugucgaggacu

SEQ ID NO: 91064 - RNA, 22 nt, Homo sapiens
agcuggucugauacuuaccucc

SEQ ID NO: 91065 - RNA, 22 nt, Homo sapiens
gccuaguguuaauguguguuca

SEQ ID NO: 91066 - RNA, 22 nt, Homo sapiens
gccucaguuguggccagggauu

SEQ ID NO: 91067 - RNA, 22 nt, Homo sapiens
gccugagaggauaugauccccu

SEQ ID NO: 91068 - RNA, 22 nt, Homo sapiens
gccuguagaagaguagaugacc

SEQ ID NO: 91069 - RNA, 22 nt, Homo sapiens
gcgcagugggcugugccaucca

SEQ ID NO: 91070 - RNA, 22 nt, Homo sapiens
gcgugguguuagaaugagaagu

SEQ ID NO: 91071 - RNA, 20 nt, Homo sapiens
gcuaaggcacgggaauuacu

SEQ ID NO: 91072 - RNA, 22 nt, Homo sapiens
gcuaaggcaggagcauugcuug

SEQ ID NO: 91073 - RNA, 22 nt, Homo sapiens
gcuacugucuaucugugcuucu

SEQ ID NO: 91074 - RNA, 22 nt, Homo sapiens
gcuagcacauugucaccucuca

SEQ ID NO: 91075 - RNA, 22 nt, Homo sapiens
gcuaggagauccacugcucucu

SEQ ID NO: 91076 - RNA, 22 nt, Homo sapiens
gcuaggagaucugcugcucucu

SEQ ID NO: 91077 - RNA, 22 nt, Homo sapiens
gcuaugguuuuuagcuccauca

SEQ ID NO: 91078 - RNA, 22 nt, Homo sapiens
gcuaugucuguugcucuugggc

SEQ ID NO: 91079 - RNA, 22 nt, Homo sapiens
gcucaaguaauggcaguuuugc

SEQ ID NO: 91080 - RNA, 19 nt, Homo sapiens
gcucaccuugcugcuccag

SEQ ID NO: 91081 - RNA, 22 nt, Homo sapiens
gcucaugagacaagcaggagua

SEQ ID NO: 91082 - RNA, 22 nt, Homo sapiens
gcucaugggcagugugauuguu

SEQ ID NO: 91083 - RNA, 22 nt, Homo sapiens
gcucguuuuugccucugguugc

SEQ ID NO: 91084 - RNA, 22 nt, Homo sapiens
gcucugguuacaaaggcaaauu

SEQ ID NO: 91085 - RNA, 22 nt, Homo sapiens
gcugagguucaagaagguuaaa

SEQ ID NO: 91086 - RNA, 22 nt, Homo sapiens
gcugauggugcaguucuagccu

SEQ ID NO: 91087 - RNA, 17 nt, Homo sapiens
gcugauguuugcauuuu

SEQ ID NO: 91088 - RNA, 17 nt, Homo sapiens
gcugcauucauguagaa

SEQ ID NO: 91089 - RNA, 22 nt, Homo sapiens
gcugcuguggcagauuggauuc

SEQ ID NO: 91090 - RNA, 22 nt, Homo sapiens
gcugcuguuuaguuucuccugg

SEQ ID NO: 91091 - RNA, 22 nt, Homo sapiens
gcuggauguuucaauacaaaua

SEQ ID NO: 91092 - RNA, 22 nt, Homo sapiens
gcugguauuacaggcaugagcc

SEQ ID NO: 91093 - RNA, 22 nt, Homo sapiens
gcuggugaaggcugaaaagugg

SEQ ID NO: 91094 - RNA, 22 nt, Homo sapiens
gcugguguagagugcagaaagg

SEQ ID NO: 91095 - RNA, 22 nt, Homo sapiens
gcugguguucaggcccucaguc

SEQ ID NO: 91096 - RNA, 22 nt, Homo sapiens
gcuguauugacuuuguaucaua

SEQ ID NO: 91097 - RNA, 22 nt, Homo sapiens
gcuguauuguugaaggaaaugu

SEQ ID NO: 91098 - RNA, 22 nt, Homo sapiens
gcugucaugagcaacacaugaa

SEQ ID NO: 91099 - RNA, 22 nt, Homo sapiens
gcugucuggagucuguucaaug

SEQ ID NO: 91100 - RNA, 22 nt, Homo sapiens
gcuuguguuuacuguaguuacu

SEQ ID NO: 91101 - RNA, 22 nt, Homo sapiens
gcuuguguuugcuccccagaau

SEQ ID NO: 91102 - RNA, 22 nt, Homo sapiens
gcuuugcaauggcauugaccau

SEQ ID NO: 91103 - RNA, 22 nt, Homo sapiens
gcuuuggauaaaugucaguuua

SEQ ID NO: 91104 - RNA, 23 nt, Homo sapiens
ggaaacauccagucuuucaccau

SEQ ID NO: 91105 - RNA, 22 nt, Homo sapiens
ggaaagacaccuuacuauguua

SEQ ID NO: 91106 - RNA, 22 nt, Homo sapiens
ggaaauguuuagcauccacuuu

SEQ ID NO: 91107 - RNA, 22 nt, Homo sapiens
ggaagccuggaaaaaauuguga

SEQ ID NO: 91108 - RNA, 22 nt, Homo sapiens
ggaaguauaaacuuaguggagu

SEQ ID NO: 91109 - RNA, 22 nt, Homo sapiens
ggaagugcuguguggaagucug

SEQ ID NO: 91110 - RNA, 22 nt, Homo sapiens
ggaauauaaaaagccccagaau

SEQ ID NO: 91111 - RNA, 23 nt, Homo sapiens
ggaaugaaaccugguuaugauau

SEQ ID NO: 91112 - RNA, 22 nt, Homo sapiens
ggaaugcagugagcauuagaua

SEQ ID NO: 91113 - RNA, 22 nt, Homo sapiens
ggaauguuaaagacuacacuga

SEQ ID NO: 91114 - RNA, 22 nt, Homo sapiens
ggaauguuaaggcgcuguuggu

SEQ ID NO: 91115 - RNA, 22 nt, Homo sapiens
ggacacaucaugugaccaaggu

SEQ ID NO: 91116 - RNA, 22 nt, Homo sapiens
ggacauguauauauaugugugu

SEQ ID NO: 91117 - RNA, 20 nt, Homo sapiens
ggagagugacauaauucugg

SEQ ID NO: 91118 - RNA, 22 nt, Homo sapiens
ggagauaauccagggagggacu

SEQ ID NO: 91119 - RNA, 22 nt, Homo sapiens
ggagaucuuguuaaaguacaga

SEQ ID NO: 91120 - RNA, 22 nt, Homo sapiens
ggagaucuuuguuaucuuuuga

SEQ ID NO: 91121 - RNA, 22 nt, Homo sapiens
ggagaugugccugcucugcucu

SEQ ID NO: 91122 - RNA, 22 nt, Homo sapiens
ggagauuauuaguguuucaugc

SEQ ID NO: 91123 - RNA, 22 nt, Homo sapiens
ggagcaaugccucauucucacu

SEQ ID NO: 91124 - RNA, 22 nt, Homo sapiens
ggagguagguuugugauuugua

SEQ ID NO: 91125 - RNA, 22 nt, Homo sapiens
ggagguagucuuucccuuauca

SEQ ID NO: 91126 - RNA, 16 nt, Homo sapiens
ggaggucaucugggaa

SEQ ID NO: 91127 - RNA, 20 nt, Homo sapiens
ggagguguuggauuucuagu

SEQ ID NO: 91128 - RNA, 22 nt, Homo sapiens
ggagucugacuuauaggaaccu

SEQ ID NO: 91129 - RNA, 22 nt, Homo sapiens
ggagucugauguucuaaggcag

SEQ ID NO: 91130 - RNA, 22 nt, Homo sapiens
ggagucugauuuuuauguugcu

SEQ ID NO: 91131 - RNA, 22 nt, Homo sapiens
ggagugucagaaacaguguccu

SEQ ID NO: 91132 - RNA, 22 nt, Homo sapiens
ggagugugauuguucucuguua

SEQ ID NO: 91133 - RNA, 22 nt, Homo sapiens
ggauaacagccaggucaaacaa

SEQ ID NO: 91134 - RNA, 22 nt, Homo sapiens
ggauggcauuucuuuagcuuuu

SEQ ID NO: 91135 - RNA, 22 nt, Homo sapiens
ggaugugugcacgcgcacaugc

SEQ ID NO: 91136 - RNA, 22 nt, Homo sapiens
ggauuuguuggcauuagugaug

SEQ ID NO: 91137 - RNA, 22 nt, Homo sapiens
ggcaaaauauugucugguauag

SEQ ID NO: 91138 - RNA, 22 nt, Homo sapiens
ggcaaagagacaugcaucgggg

SEQ ID NO: 91139 - RNA, 22 nt, Homo sapiens
ggcaaagaugaccauuacuuuu

SEQ ID NO: 91140 - RNA, 22 nt, Homo sapiens
ggcaacauggugaaacucuguc

SEQ ID NO: 91141 - RNA, 22 nt, Homo sapiens
ggcaagaaaaugcaauuacugu

SEQ ID NO: 91142 - RNA, 22 nt, Homo sapiens
ggcaagaaccucaauuaccuuu

SEQ ID NO: 91143 - RNA, 22 nt, Homo sapiens
ggcaagaacuucacucacuuuu

SEQ ID NO: 91144 - RNA, 22 nt, Homo sapiens
ggcaagaagaacuauaacuuuu

SEQ ID NO: 91145 - RNA, 17 nt, Homo sapiens
ggcaagaaguggaacuc

SEQ ID NO: 91146 - RNA, 21 nt, Homo sapiens
ggcaagagaauacaacauaaa

SEQ ID NO: 91147 - RNA, 22 nt, Homo sapiens
ggcaaggauguuuuucuggcaa

SEQ ID NO: 91148 - RNA, 22 nt, Homo sapiens
ggcaaggauuagauucuccccu

SEQ ID NO: 91149 - RNA, 22 nt, Homo sapiens
ggcaaggugcuacagacaguga

SEQ ID NO: 91150 - RNA, 22 nt, Homo sapiens
ggcaaguugcuauucuuuaaug

SEQ ID NO: 91151 - RNA, 22 nt, Homo sapiens
ggcaauauauucugaauucagu

SEQ ID NO: 91152 - RNA, 22 nt, Homo sapiens
ggcaccacagacgccaggcgug

SEQ ID NO: 91153 - RNA, 22 nt, Homo sapiens
uaugucacagguuuuggugaaa

SEQ ID NO: 91154 - RNA, 22 nt, Homo sapiens
uaugucaugggguuuuugagau

SEQ ID NO: 91155 - RNA, 22 nt, Homo sapiens
uaugucauggguaaagugcccu

SEQ ID NO: 91156 - RNA, 22 nt, Homo sapiens
uaugucuucuuuagagaaaugu

SEQ ID NO: 91157 - RNA, 22 nt, Homo sapiens
uaugucuuuugcuugcaaauag

SEQ ID NO: 91158 - RNA, 22 nt, Homo sapiens
uaugugcaaauuaauugcuaga

SEQ ID NO: 91159 - RNA, 22 nt, Homo sapiens
uauuacagaccauaucgccggg

SEQ ID NO: 91160 - RNA, 20 nt, Homo sapiens
uauuacagaguaauggugga

SEQ ID NO: 91161 - RNA, 22 nt, Homo sapiens
uauuacugucaauaucacagaa

SEQ ID NO: 91162 - RNA, 22 nt, Homo sapiens
uauuacuguuauuccuaucaaa

SEQ ID NO: 91163 - RNA, 22 nt, Homo sapiens
uauuagugccuaagucuuaggg

SEQ ID NO: 91164 - RNA, 22 nt, Homo sapiens
uauuagugucuuuugguuagaa

SEQ ID NO: 91165 - RNA, 22 nt, Homo sapiens
uauuauagugauaggucuacug

SEQ ID NO: 91166 - RNA, 22 nt, Homo sapiens
uauuccacacuguuggugggau

SEQ ID NO: 91167 - RNA, 22 nt, Homo sapiens
uauuccacuauuaguccagaug

SEQ ID NO: 91168 - RNA, 22 nt, Homo sapiens
uauuccacuggcacugcauuug

SEQ ID NO: 91169 - RNA, 22 nt, Homo sapiens
uauuccucuuuguugagguuau

SEQ ID NO: 91170 - RNA, 22 nt, Homo sapiens
uauugacuuuuuuguuaggagg

SEQ ID NO: 91171 - RNA, 22 nt, Homo sapiens
uauugcaauuggcagagugcua

SEQ ID NO: 91172 - RNA, 23 nt, Homo sapiens
uauugcacuaugguaacccuuuu

SEQ ID NO: 91173 - RNA, 22 nt, Homo sapiens
uauugcagaaugugaguuggca

SEQ ID NO: 91174 - RNA, 22 nt, Homo sapiens
uauugcagugagauccaucugg

SEQ ID NO: 91175 - RNA, 22 nt, Homo sapiens
uauugcauauuauucuaguggc

SEQ ID NO: 91176 - RNA, 22 nt, Homo sapiens
uauugccucagugacuuugggg

SEQ ID NO: 91177 - RNA, 22 nt, Homo sapiens
uauugccuugccuacuuuucca

SEQ ID NO: 91178 - RNA, 22 nt, Homo sapiens
uauugcuuaugaugcugaauua

SEQ ID NO: 91179 - RNA, 18 nt, Homo sapiens
uauugcuugguuuggaga

SEQ ID NO: 91180 - RNA, 22 nt, Homo sapiens
uauugcuuuacucucuuauccu

SEQ ID NO: 91181 - RNA, 22 nt, Homo sapiens
uauuguccaauaggauguuccu

SEQ ID NO: 91182 - RNA, 22 nt, Homo sapiens
uauuguccacuuugcacugugu

SEQ ID NO: 91183 - RNA, 22 nt, Homo sapiens
uauuugcacucccaucauggug

SEQ ID NO: 91184 - RNA, 22 nt, Homo sapiens
uauuugguuacuugaauagcua

SEQ ID NO: 91185 - RNA, 22 nt, Homo sapiens
uauuuguccccuccaaaaguca

SEQ ID NO: 91186 - RNA, 22 nt, Homo sapiens
ucaaacacuccauaucgcgauu

SEQ ID NO: 91187 - RNA, 22 nt, Homo sapiens
ucaaacugucagguugaccaga

SEQ ID NO: 91188 - RNA, 22 nt, Homo sapiens
ucaaagacacacaaggagaagg

SEQ ID NO: 91189 - RNA, 22 nt, Homo sapiens
ucaaaguaaagccucaggaugg

SEQ ID NO: 91190 - RNA, 22 nt, Homo sapiens
ucaaagucuucucaaguaacau

SEQ ID NO: 91191 - RNA, 18 nt, Homo sapiens
ucaaauacuuugggcagu

SEQ ID NO: 91192 - RNA, 22 nt, Homo sapiens
ucaaaugcacguagagaaaaua

SEQ ID NO: 91193 - RNA, 17 nt, Homo sapiens
ucaaaugcucccaguga

SEQ ID NO: 91194 - RNA, 22 nt, Homo sapiens
ucaaaugcucuuugcagagagg

SEQ ID NO: 91195 - RNA, 22 nt, Homo sapiens
ucaaaugcuguauuguaguaau

SEQ ID NO: 91196 - RNA, 22 nt, Homo sapiens
ucaaauuccaagucuagguagg

SEQ ID NO: 91197 - RNA, 22 nt, Homo sapiens
ucaacauugcugucaggcaucu

SEQ ID NO: 91198 - RNA, 22 nt, Homo sapiens
ucaagaccucacauagaggaga

SEQ ID NO: 91199 - RNA, 19 nt, Homo sapiens
ucaagcuauucuccugccu

SEQ ID NO: 91200 - RNA, 22 nt, Homo sapiens
ucaaggacucagagagggauua

SEQ ID NO: 91201 - RNA, 22 nt, Homo sapiens
ucaaggcaguggccuuccuucu

SEQ ID NO: 91202 - RNA, 22 nt, Homo sapiens
ucaaguagugacucgaguuauu

SEQ ID NO: 91203 - RNA, 22 nt, Homo sapiens
ucaagugcauugauucaguauu

SEQ ID NO: 91204 - RNA, 22 nt, Homo sapiens
ucaaugaaugaugguugguaug

SEQ ID NO: 91205 - RNA, 22 nt, Homo sapiens
ucaaugcaaccuccaccucugg

SEQ ID NO: 91206 - RNA, 22 nt, Homo sapiens
ucaaugggcuacacauugagug

SEQ ID NO: 91207 - RNA, 18 nt, Homo sapiens
ucaauguggauguucuuu

SEQ ID NO: 91208 - RNA, 22 nt, Homo sapiens
ucacaauggcugaacuaauuua

SEQ ID NO: 91209 - RNA, 22 nt, Homo sapiens
ucacacgugaacucaucacaga

SEQ ID NO: 91210 - RNA, 22 nt, Homo sapiens
ucacagaggagaagaccuuuaa

SEQ ID NO: 91211 - RNA, 22 nt, Homo sapiens
ucacagauaaauaaagaugauu

SEQ ID NO: 91212 - RNA, 22 nt, Homo sapiens
ucacaggguguuauuagaauua

SEQ ID NO: 91213 - RNA, 22 nt, Homo sapiens
ucacaguagcaaauguuagaaa

SEQ ID NO: 91214 - RNA, 22 nt, Homo sapiens
ucacaguauggggggugguuau

SEQ ID NO: 91215 - RNA, 22 nt, Homo sapiens
ucacaguauucaugaacaugga

SEQ ID NO: 91216 - RNA, 22 nt, Homo sapiens
ucacagucaaaguaaucauaga

SEQ ID NO: 91217 - RNA, 22 nt, Homo sapiens
ucacagucuccucuagggaggg

SEQ ID NO: 91218 - RNA, 22 nt, Homo sapiens
ucacaugaagauuuuaguauac

SEQ ID NO: 91219 - RNA, 22 nt, Homo sapiens
ucacaugaauugucuuguucca

SEQ ID NO: 91220 - RNA, 22 nt, Homo sapiens
ucacauggaaaaguccaguaaa

SEQ ID NO: 91221 - RNA, 22 nt, Homo sapiens
ucacauggauuaacucauuuau

SEQ ID NO: 91222 - RNA, 21 nt, Homo sapiens
ucacauggccagaguaggaac

SEQ ID NO: 91223 - RNA, 22 nt, Homo sapiens
ucacaugugacauauauauuug

SEQ ID NO: 91224 - RNA, 22 nt, Homo sapiens
ucacauguguaaauugguguaa

SEQ ID NO: 91225 - RNA, 22 nt, Homo sapiens
ucacauuaagcuguuauuucuu

SEQ ID NO: 91226 - RNA, 22 nt, Homo sapiens
ucacauucaauuguaauccccg

SEQ ID NO: 91227 - RNA, 22 nt, Homo sapiens
ucaccaguggcacuccagccug

SEQ ID NO: 91228 - RNA, 22 nt, Homo sapiens
ucacccacacaggagacaggga

SEQ ID NO: 91229 - RNA, 22 nt, Homo sapiens
aucacuuucuauuucugugcca

SEQ ID NO: 91230 - RNA, 21 nt, Homo sapiens
aucagagacccaggcuuccuc

SEQ ID NO: 91231 - RNA, 22 nt, Homo sapiens
aucagagugaaacaugggagau

SEQ ID NO: 91232 - RNA, 22 nt, Homo sapiens
aucagaguugucagggagcuuu

SEQ ID NO: 91233 - RNA, 23 nt, Homo sapiens
aucagauaguuguagguaugugg

SEQ ID NO: 91234 - RNA, 22 nt, Homo sapiens
aucagauuccagaggcagcacc

SEQ ID NO: 91235 - RNA, 22 nt, Homo sapiens
aucagcagcaugaaaagcaacu

SEQ ID NO: 91236 - RNA, 22 nt, Homo sapiens
aucaggaaccuuuuuggugugu

SEQ ID NO: 91237 - RNA, 18 nt, Homo sapiens
aucagggugaagagagga

SEQ ID NO: 91238 - RNA, 22 nt, Homo sapiens
aucagucuguuggaauaucgcu

SEQ ID NO: 91239 - RNA, 22 nt, Homo sapiens
aucagugaaagugaaaucuccg

SEQ ID NO: 91240 - RNA, 22 nt, Homo sapiens
aucauacuguuuugauuacugu

SEQ ID NO: 91241 - RNA, 22 nt, Homo sapiens
aucauauccuagauauaacuuc

SEQ ID NO: 91242 - RNA, 22 nt, Homo sapiens
aucauggaguauuugcaagucu

SEQ ID NO: 91243 - RNA, 22 nt, Homo sapiens
aucauuaguuguggaauucuug

SEQ ID NO: 91244 - RNA, 22 nt, Homo sapiens
uguaaacucaguauguuuuacu

SEQ ID NO: 91245 - RNA, 22 nt, Homo sapiens
uguaaaucuauuuuuaguguuu

SEQ ID NO: 91246 - RNA, 22 nt, Homo sapiens
uguaaaucuuucacaguugaug

SEQ ID NO: 91247 - RNA, 16 nt, Homo sapiens
uguaaauguuuugcau

SEQ ID NO: 91248 - RNA, 22 nt, Homo sapiens
uguaacaggaggaaaaugugaa

SEQ ID NO: 91249 - RNA, 22 nt, Homo sapiens
uguaacaguaguuacuauucuu

SEQ ID NO: 91250 - RNA, 22 nt, Homo sapiens
uguaaccauccagagucccagg

SEQ ID NO: 91251 - RNA, 21 nt, Homo sapiens
uguaacugcaaaccucagauu

SEQ ID NO: 91252 - RNA, 22 nt, Homo sapiens
uguaagcauugggcaugcaguc

SEQ ID NO: 91253 - RNA, 22 nt, Homo sapiens
uguaauguuucaucauuauuaa

SEQ ID NO: 91254 - RNA, 19 nt, Homo sapiens
uguacacuguaaaccugug

SEQ ID NO: 91255 - RNA, 22 nt, Homo sapiens
uguagacaccaaagacagcaua

SEQ ID NO: 91256 - RNA, 22 nt, Homo sapiens
uguagcaaauaaaagucuggau

SEQ ID NO: 91257 - RNA, 21 nt, Homo sapiens
uguagcagcaugauucauagu

SEQ ID NO: 91258 - RNA, 22 nt, Homo sapiens
uguagcagccauaaacacagug

SEQ ID NO: 91259 - RNA, 22 nt, Homo sapiens
uguagguagggucuguuuuuga

SEQ ID NO: 91260 - RNA, 20 nt, Homo sapiens
uguagguguacaguaaggag

SEQ ID NO: 91261 - RNA, 22 nt, Homo sapiens
uguagucauuuggaguccagcu

SEQ ID NO: 91262 - RNA, 21 nt, Homo sapiens
uguauauguuuauacacacac

SEQ ID NO: 91263 - RNA, 22 nt, Homo sapiens
uguaugucugcucuuuggaacu

SEQ ID NO: 91264 - RNA, 22 nt, Homo sapiens
uguaugucuucuuuagauaagu

SEQ ID NO: 91265 - RNA, 22 nt, Homo sapiens
uguauguugggucaaaguacau

SEQ ID NO: 91266 - RNA, 22 nt, Homo sapiens
uguauguuguaagacuuagacc

SEQ ID NO: 91267 - RNA, 22 nt, Homo sapiens
uguauuuguuguuaaauggaga

SEQ ID NO: 91268 - RNA, 22 nt, Homo sapiens
ugucaagaugguuugauguugu

SEQ ID NO: 91269 - RNA, 22 nt, Homo sapiens
ugucaccauuuguaggugagga

SEQ ID NO: 91270 - RNA, 18 nt, Homo sapiens
ugucacuggauaaugguc

SEQ ID NO: 91271 - RNA, 22 nt, Homo sapiens
ugucaggaggguccagagaaaa

SEQ ID NO: 91272 - RNA, 22 nt, Homo sapiens
ugucaggaguuuuagaaucuua

SEQ ID NO: 91273 - RNA, 22 nt, Homo sapiens
ugucaguuucuugagauggaac

SEQ ID NO: 91274 - RNA, 22 nt, Homo sapiens
ugucaguuuuaacuagggaaua

SEQ ID NO: 91275 - RNA, 22 nt, Homo sapiens
ugucauauagaauguucuauga

SEQ ID NO: 91276 - RNA, 22 nt, Homo sapiens
ugucaugaacucacauucuggg

SEQ ID NO: 91277 - RNA, 22 nt, Homo sapiens
ugucauggucacaggcauuuca

SEQ ID NO: 91278 - RNA, 22 nt, Homo sapiens
ugucaugguguuaauuuuccug

SEQ ID NO: 91279 - RNA, 22 nt, Homo sapiens
ugucauguaaagaguaaauggu

SEQ ID NO: 91280 - RNA, 22 nt, Homo sapiens
ugucaugugagggaacuuguuc

SEQ ID NO: 91281 - RNA, 22 nt, Homo sapiens
ugucauguuucuacugaccaaa

SEQ ID NO: 91282 - RNA, 22 nt, Homo sapiens
uguccaaauugaaucaucuggu

SEQ ID NO: 91283 - RNA, 19 nt, Homo sapiens
ugucccagccauagaggca

SEQ ID NO: 91284 - RNA, 22 nt, Homo sapiens
gugauauguuaggaucuaaguc

SEQ ID NO: 91285 - RNA, 22 nt, Homo sapiens
gugaucuucauggaaggugaaa

SEQ ID NO: 91286 - RNA, 22 nt, Homo sapiens
gugaugguaguuuguauuucug

SEQ ID NO: 91287 - RNA, 22 nt, Homo sapiens
gugauguguuuguucuaucucu

SEQ ID NO: 91288 - RNA, 22 nt, Homo sapiens
gugauuuaguagaugcuaguua

SEQ ID NO: 91289 - RNA, 22 nt, Homo sapiens
gugcaaaucucugaguaucuuu

SEQ ID NO: 91290 - RNA, 22 nt, Homo sapiens
gugcacaacgugcaaguuuguu

SEQ ID NO: 91291 - RNA, 22 nt, Homo sapiens
gugcacaaucgugcauuccuug

SEQ ID NO: 91292 - RNA, 22 nt, Homo sapiens
gugcacauauggugcauaagug

SEQ ID NO: 91293 - RNA, 22 nt, Homo sapiens
gugcacaucgugcagguuuguu

SEQ ID NO: 91294 - RNA, 22 nt, Homo sapiens
gugcacuguagaacccuuuguu

SEQ ID NO: 91295 - RNA, 22 nt, Homo sapiens
gugcagaugucuuuauaguagc

SEQ ID NO: 91296 - RNA, 23 nt, Homo sapiens
gugcaguggcgagauuucggcuc

SEQ ID NO: 91297 - RNA, 22 nt, Homo sapiens
gugcauacucuggagacauugu

SEQ ID NO: 91298 - RNA, 18 nt, Homo sapiens
gugcauagccauggcagc

SEQ ID NO: 91299 - RNA, 22 nt, Homo sapiens
gugcauauaaguuguuucuagu

SEQ ID NO: 91300 - RNA, 22 nt, Homo sapiens
gugcauaucugugguuggcuga

SEQ ID NO: 91301 - RNA, 23 nt, Homo sapiens
gugcaugagucuuuauaguagca

SEQ ID NO: 91302 - RNA, 22 nt, Homo sapiens
gugccacugcaccuggccuaag

SEQ ID NO: 91303 - RNA, 22 nt, Homo sapiens
gugcccacugucuguccuguag

SEQ ID NO: 91304 - RNA, 20 nt, Homo sapiens
guggaagauaaguagccuga

SEQ ID NO: 91305 - RNA, 22 nt, Homo sapiens
guggaaggucaugaauguucuu

SEQ ID NO: 91306 - RNA, 22 nt, Homo sapiens
guggaaguuaagugacuuucug

SEQ ID NO: 91307 - RNA, 22 nt, Homo sapiens
guggaauacuaugaugguggau

SEQ ID NO: 91308 - RNA, 22 nt, Homo sapiens
guggaaugauaucucauugugg

SEQ ID NO: 91309 - RNA, 22 nt, Homo sapiens
guggaaugcaguguugauucaa

SEQ ID NO: 91310 - RNA, 17 nt, Homo sapiens
guggaaugucaugucaa

SEQ ID NO: 91311 - RNA, 22 nt, Homo sapiens
guggaauuauagagacaucuug

SEQ ID NO: 91312 - RNA, 22 nt, Homo sapiens
guggacagagacuaaauguugu

SEQ ID NO: 91313 - RNA, 22 nt, Homo sapiens
guggacggagguugcagugagc

SEQ ID NO: 91314 - RNA, 22 nt, Homo sapiens
guggaggacuggauaaagaaaa

SEQ ID NO: 91315 - RNA, 22 nt, Homo sapiens
guggagucaucacucagagugg

SEQ ID NO: 91316 - RNA, 22 nt, Homo sapiens
guggcaagaauguacaaaaggu

SEQ ID NO: 91317 - RNA, 22 nt, Homo sapiens
guggcaagaugacuacucacug

SEQ ID NO: 91318 - RNA, 22 nt, Homo sapiens
guggcaugaaagcaucugugau

SEQ ID NO: 91319 - RNA, 22 nt, Homo sapiens
guggcauuucccaaaguauucu

SEQ ID NO: 91320 - RNA, 22 nt, Homo sapiens
guggcgagaucauagcucauug

SEQ ID NO: 91321 - RNA, 22 nt, Homo sapiens
guggcuaaagauuuggaaucug

SEQ ID NO: 91322 - RNA, 22 nt, Homo sapiens
guggcuuuauuuagaagcaggg

SEQ ID NO: 91323 - RNA, 22 nt, Homo sapiens
gugggagugucccguuuuucca

SEQ ID NO: 91324 - RNA, 22 nt, Homo sapiens
gugggaugcaaguaaaauuguc

SEQ ID NO: 91325 - RNA, 22 nt, Homo sapiens
gugggauggagagaagguauga

SEQ ID NO: 91326 - RNA, 22 nt, Homo sapiens
gugggguaggguaggacucaac

SEQ ID NO: 91327 - RNA, 22 nt, Homo sapiens
guggggucaucucauuugugga

SEQ ID NO: 91328 - RNA, 19 nt, Homo sapiens
gugguauuaccuuuugauu

SEQ ID NO: 91329 - RNA, 22 nt, Homo sapiens
guggugucuuuuuugauuagga

SEQ ID NO: 91330 - RNA, 22 nt, Homo sapiens
gugguucuagaauugaguaucc

SEQ ID NO: 91331 - RNA, 22 nt, Homo sapiens
guguaaaacaauuagaggauuu

SEQ ID NO: 91332 - RNA, 22 nt, Homo sapiens
guguaaguccugaguuuggaua

SEQ ID NO: 91333 - RNA, 22 nt, Homo sapiens
guguagagaaaaguaccauuuu

SEQ ID NO: 91334 - RNA, 22 nt, Homo sapiens
guguauauccuauuaguucugu

SEQ ID NO: 91335 - RNA, 22 nt, Homo sapiens
guguauguuguccauggaugcg

SEQ ID NO: 91336 - RNA, 22 nt, Homo sapiens
guguauucaucuggcugaggua

SEQ ID NO: 91337 - RNA, 22 nt, Homo sapiens
gugucaaggaugccugucaggc

SEQ ID NO: 91338 - RNA, 22 nt, Homo sapiens
gugucacagcuuccaucucggu

SEQ ID NO: 91339 - RNA, 22 nt, Homo sapiens
gugucacuguauaauauuuauu

SEQ ID NO: 91340 - RNA, 22 nt, Homo sapiens
gugucacugugaggauauugua

SEQ ID NO: 91341 - RNA, 22 nt, Homo sapiens
gugucaguggggagugaucuuc

SEQ ID NO: 91342 - RNA, 22 nt, Homo sapiens
gugucccagugugcauacaggu

SEQ ID NO: 91343 - RNA, 22 nt, Homo sapiens
gugucuccuguggagcuaugua

SEQ ID NO: 91344 - RNA, 22 nt, Homo sapiens
gugugacuagucaugccugaau

SEQ ID NO: 91345 - RNA, 22 nt, Homo sapiens
gugugcacaaucuggcaugugc

SEQ ID NO: 91346 - RNA, 22 nt, Homo sapiens
gugugcucaucacaugcaauag

SEQ ID NO: 91347 - RNA, 21 nt, Homo sapiens
gugugcuugaauucagcuguc

SEQ ID NO: 91348 - RNA, 22 nt, Homo sapiens
gugugguaggauugguuacuca

SEQ ID NO: 91349 - RNA, 22 nt, Homo sapiens
gugugguauuauaacuagguau

SEQ ID NO: 91350 - RNA, 22 nt, Homo sapiens
guguuauugagaaauagggugu

SEQ ID NO: 91351 - RNA, 22 nt, Homo sapiens
guguucaaacccaggucugucu

SEQ ID NO: 91352 - RNA, 22 nt, Homo sapiens
guguugcacauucuguggaugu

SEQ ID NO: 91353 - RNA, 22 nt, Homo sapiens
guguuugauugcaaauaaucua

SEQ ID NO: 91354 - RNA, 22 nt, Homo sapiens
guuaaagacauccacauaggag

SEQ ID NO: 91355 - RNA, 22 nt, Homo sapiens
guuaagaaguguaacuuaaguu

SEQ ID NO: 91356 - RNA, 22 nt, Homo sapiens
uugcagagaaauuucugguuua

SEQ ID NO: 91357 - RNA, 22 nt, Homo sapiens
uugcagcaaauaggaaugagga

SEQ ID NO: 91358 - RNA, 22 nt, Homo sapiens
uugcagcaacauggaugaaacu

SEQ ID NO: 91359 - RNA, 22 nt, Homo sapiens
uugcagugguuucacuggcaaa

SEQ ID NO: 91360 - RNA, 22 nt, Homo sapiens
uugcagugugacgacuauauuu

SEQ ID NO: 91361 - RNA, 22 nt, Homo sapiens
uugcauaagugcauucugugau

SEQ ID NO: 91362 - RNA, 19 nt, Homo sapiens
uugcauagguugaaccagc

SEQ ID NO: 91363 - RNA, 22 nt, Homo sapiens
uugcauauguugaaccaagcgu

SEQ ID NO: 91364 - RNA, 22 nt, Homo sapiens
uugcauauucucugaggcagga

SEQ ID NO: 91365 - RNA, 22 nt, Homo sapiens
uugcaugcuccuuaugagaauc

SEQ ID NO: 91366 - RNA, 22 nt, Homo sapiens
uugcaugguuuuuaucugaaau

SEQ ID NO: 91367 - RNA, 22 nt, Homo sapiens
uugcaugucauaacugauggaa

SEQ ID NO: 91368 - RNA, 22 nt, Homo sapiens
uugccaacauggugaacuccca

SEQ ID NO: 91369 - RNA, 22 nt, Homo sapiens
uugccgggugcaguggcucaug

SEQ ID NO: 91370 - RNA, 22 nt, Homo sapiens
uugcuaagucaagagaaaugau

SEQ ID NO: 91371 - RNA, 22 nt, Homo sapiens
uugcuacauugauugccucuuu

SEQ ID NO: 91372 - RNA, 22 nt, Homo sapiens
uugcuacuuggauguacaugug

SEQ ID NO: 91373 - RNA, 22 nt, Homo sapiens
uugcuagaugaaaaugguaccu

SEQ ID NO: 91374 - RNA, 22 nt, Homo sapiens
uugcuccucugccaggaccugu

SEQ ID NO: 91375 - RNA, 22 nt, Homo sapiens
uugugaagaaaccagaaaaguu

SEQ ID NO: 91376 - RNA, 22 nt, Homo sapiens
uugugaagaugugaagcaagca

SEQ ID NO: 91377 - RNA, 22 nt, Homo sapiens
uugugaauggaguagcaggauc

SEQ ID NO: 91378 - RNA, 22 nt, Homo sapiens
uugugaucauugucaaauagug

SEQ ID NO: 91379 - RNA, 22 nt, Homo sapiens
uugugcaaaaguaauugcgguu

SEQ ID NO: 91380 - RNA, 22 nt, Homo sapiens
uugugccugguacauggagaaa

SEQ ID NO: 91381 - RNA, 22 nt, Homo sapiens
uugugcuccagagacgggcucg

SEQ ID NO: 91382 - RNA, 22 nt, Homo sapiens
uugugcuugauuugccuagcug

SEQ ID NO: 91383 - RNA, 22 nt, Homo sapiens
uugugcuugcuguguucuaugc

SEQ ID NO: 91384 - RNA, 22 nt, Homo sapiens
uugugcuuguaacuacauucag

SEQ ID NO: 91385 - RNA, 22 nt, Homo sapiens
uugugguuuuaucuaccuuugg

SEQ ID NO: 91386 - RNA, 22 nt, Homo sapiens
uugugguuuuuaaaacuaggug

SEQ ID NO: 91387 - RNA, 22 nt, Homo sapiens
uugugucccuacccaaaucuca

SEQ ID NO: 91388 - RNA, 22 nt, Homo sapiens
uuguguuugaugcugacacgca

SEQ ID NO: 91389 - RNA, 22 nt, Homo sapiens
uuguuaagaugcagauucugga

SEQ ID NO: 91390 - RNA, 22 nt, Homo sapiens
uuguuauguaucucaagauaaa

SEQ ID NO: 91391 - RNA, 22 nt, Homo sapiens
uuguucaggagguuggggaugc

SEQ ID NO: 91392 - RNA, 22 nt, Homo sapiens
acugcacuccagccugugagac

SEQ ID NO: 91393 - RNA, 22 nt, Homo sapiens
acugcacuccagccugugcgua

SEQ ID NO: 91394 - RNA, 22 nt, Homo sapiens
acugcacuccagccuguugaca

SEQ ID NO: 91395 - RNA, 20 nt, Homo sapiens
acugcacuccagccuuccag

SEQ ID NO: 91396 - RNA, 22 nt, Homo sapiens
acugcacuccagccuucggaca

SEQ ID NO: 91397 - RNA, 22 nt, Homo sapiens
acugcacuccagccuugauggc

SEQ ID NO: 91398 - RNA, 22 nt, Homo sapiens
acugcacuccagccuuggagac

SEQ ID NO: 91399 - RNA, 22 nt, Homo sapiens
acugcacuccagcuccagggug

SEQ ID NO: 91400 - RNA, 18 nt, Homo sapiens
acugcacuccauccuagg

SEQ ID NO: 91401 - RNA, 22 nt, Homo sapiens
acugcacucuagcauggguaau

SEQ ID NO: 91402 - RNA, 22 nt, Homo sapiens
acugcacucuagccccugcgac

SEQ ID NO: 91403 - RNA, 22 nt, Homo sapiens
acugcacugcagccuggccaac

SEQ ID NO: 91404 - RNA, 22 nt, Homo sapiens
acugcacugucaaccuccuggg

SEQ ID NO: 91405 - RNA, 22 nt, Homo sapiens
acugcacuguccuagaguccuc

SEQ ID NO: 91406 - RNA, 22 nt, Homo sapiens
acugcacuuauccuccaauguu

SEQ ID NO: 91407 - RNA, 22 nt, Homo sapiens
acugcacuucaaccucauugac

SEQ ID NO: 91408 - RNA, 22 nt, Homo sapiens
acugcacuucagccuugggaaa

SEQ ID NO: 91409 - RNA, 18 nt, Homo sapiens
acuggaauuaaacuuuuu

SEQ ID NO: 91410 - RNA, 21 nt, Homo sapiens
acuggaccccuuccauacacc

SEQ ID NO: 91411 - RNA, 22 nt, Homo sapiens
acuggcuguuaggaauuaccuc

SEQ ID NO: 91412 - RNA, 22 nt, Homo sapiens
acuggcuuuugagaaaaacacu

SEQ ID NO: 91413 - RNA, 20 nt, Homo sapiens
acugggcuaccgaaguaagg

SEQ ID NO: 91414 - RNA, 22 nt, Homo sapiens
acugguguaugggaggucccaa

SEQ ID NO: 91415 - RNA, 22 nt, Homo sapiens
acugguuguuuaacugaauuga

SEQ ID NO: 91416 - RNA, 19 nt, Homo sapiens
acuuuggugauuagaggga

SEQ ID NO: 91417 - RNA, 22 nt, Homo sapiens
agaaagcgcuucccuuugcugg

SEQ ID NO: 91418 - RNA, 22 nt, Homo sapiens
agaaaugcagcaugaggcggca

SEQ ID NO: 91419 - RNA, 23 nt, Homo sapiens
agaaaugucuauucagggucccu

SEQ ID NO: 91420 - RNA, 22 nt, Homo sapiens
agaaauguuuauucaaacccgu

SEQ ID NO: 91421 - RNA, 22 nt, Homo sapiens
agaaugugaccuuauuuggaga

SEQ ID NO: 91422 - RNA, 22 nt, Homo sapiens
agacaagauggcuugagguuca

SEQ ID NO: 91423 - RNA, 22 nt, Homo sapiens
agacacugaaauguauugaaga

SEQ ID NO: 91424 - RNA, 22 nt, Homo sapiens
agacaguauuggcaaagugugu

SEQ ID NO: 91425 - RNA, 22 nt, Homo sapiens
agacccuguauguguuuaguuu

SEQ ID NO: 91426 - RNA, 22 nt, Homo sapiens
agacuagaaaucauuuguugag

SEQ ID NO: 91427 - RNA, 21 nt, Homo sapiens
agagaacugaaacaugugacu

SEQ ID NO: 91428 - RNA, 22 nt, Homo sapiens
agagaacugauucagggaaaau

SEQ ID NO: 91429 - RNA, 22 nt, Homo sapiens
agagaccuguaaaguucaggca

SEQ ID NO: 91430 - RNA, 22 nt, Homo sapiens
agagauaguuuccaacucauac

SEQ ID NO: 91431 - RNA, 22 nt, Homo sapiens
agagaucaacugaauuacugga

SEQ ID NO: 91432 - RNA, 20 nt, Homo sapiens
agagcaaagccgcaccccua

SEQ ID NO: 91433 - RNA, 22 nt, Homo sapiens
agagcaauguuaucagucucug

SEQ ID NO: 91434 - RNA, 22 nt, Homo sapiens
agagcaccauuuagcaagguga

SEQ ID NO: 91435 - RNA, 22 nt, Homo sapiens
agagcacugcugcaggguucug

SEQ ID NO: 91436 - RNA, 22 nt, Homo sapiens
augcagcugaggguaguggagc

SEQ ID NO: 91437 - RNA, 22 nt, Homo sapiens
augcagugugcaacagauuaag

SEQ ID NO: 91438 - RNA, 22 nt, Homo sapiens
augcauauuccugggccucacu

SEQ ID NO: 91439 - RNA, 22 nt, Homo sapiens
augcauggagucuuucacaagu

SEQ ID NO: 91440 - RNA, 22 nt, Homo sapiens
augcauggcagagucaggguac

SEQ ID NO: 91441 - RNA, 22 nt, Homo sapiens
augcauggucugaagucaaccu

SEQ ID NO: 91442 - RNA, 22 nt, Homo sapiens
augcaugucaaauuuguagguu

SEQ ID NO: 91443 - RNA, 22 nt, Homo sapiens
augccaagagacaaagggaauc

SEQ ID NO: 91444 - RNA, 22 nt, Homo sapiens
augccacagaaauaaccaaaau

SEQ ID NO: 91445 - RNA, 19 nt, Homo sapiens
augccacagugaggucaga

SEQ ID NO: 91446 - RNA, 22 nt, Homo sapiens
augccacugcacuucagccugg

SEQ ID NO: 91447 - RNA, 22 nt, Homo sapiens
augccacugcacuucagcuugg

SEQ ID NO: 91448 - RNA, 22 nt, Homo sapiens
augcuacuggacaauggugacu

SEQ ID NO: 91449 - RNA, 19 nt, Homo sapiens
augcugguguugcucaaac

SEQ ID NO: 91450 - RNA, 22 nt, Homo sapiens
augcuguuuugaauucucuaga

SEQ ID NO: 91451 - RNA, 22 nt, Homo sapiens
auggaaacauaagaguauagau

SEQ ID NO: 91452 - RNA, 22 nt, Homo sapiens
auggaaaugaagggcuggcccu

SEQ ID NO: 91453 - RNA, 22 nt, Homo sapiens
auggaacauuauagauguaaaa

SEQ ID NO: 91454 - RNA, 22 nt, Homo sapiens
auggaacuggagaucauuaugu

SEQ ID NO: 91455 - RNA, 22 nt, Homo sapiens
auggaagcauaguauucuauug

SEQ ID NO: 91456 - RNA, 22 nt, Homo sapiens
auggaaugguugggucauaagg

SEQ ID NO: 91457 - RNA, 22 nt, Homo sapiens
auggaauguauagucauguagg

SEQ ID NO: 91458 - RNA, 21 nt, Homo sapiens
auggacugugugacccugcac

SEQ ID NO: 91459 - RNA, 22 nt, Homo sapiens
auggagugagaauggagguucc

SEQ ID NO: 91460 - RNA, 22 nt, Homo sapiens
auggauauuuuuugaacauaga

SEQ ID NO: 91461 - RNA, 22 nt, Homo sapiens
auggauguucuagggaugugau

SEQ ID NO: 91462 - RNA, 22 nt, Homo sapiens
auggauugucuccuugugccau

SEQ ID NO: 91463 - RNA, 22 nt, Homo sapiens
auggcaaaaaaugcaauuacuu

SEQ ID NO: 91464 - RNA, 22 nt, Homo sapiens
auggcacagacucuuggucaag

SEQ ID NO: 91465 - RNA, 22 nt, Homo sapiens
auggcacuaaguucaacacuua

SEQ ID NO: 91466 - RNA, 22 nt, Homo sapiens
auggcacuccagccugggcaac

SEQ ID NO: 91467 - RNA, 22 nt, Homo sapiens
auggcacugaagcguauugaca

SEQ ID NO: 91468 - RNA, 22 nt, Homo sapiens
auggcacuguguauuuuucugu

SEQ ID NO: 91469 - RNA, 22 nt, Homo sapiens
auggcagaaucaagccgacagc

SEQ ID NO: 91470 - RNA, 22 nt, Homo sapiens
auggcagcugacacuuccgucu

SEQ ID NO: 91471 - RNA, 22 nt, Homo sapiens
auggcagugagucucuaguauu

SEQ ID NO: 91472 - RNA, 22 nt, Homo sapiens
auggcccccuguuugugaacau

SEQ ID NO: 91473 - RNA, 22 nt, Homo sapiens
auggcccugggaaaggaggcau

SEQ ID NO: 91474 - RNA, 22 nt, Homo sapiens
auggccugaugcaccuguccca

SEQ ID NO: 91475 - RNA, 22 nt, Homo sapiens
auggccuuuuuaucucaccaag

SEQ ID NO: 91476 - RNA, 22 nt, Homo sapiens
auggcggugugggcggugcagc

SEQ ID NO: 91477 - RNA, 22 nt, Homo sapiens
auggcguguggcuuggaggcug

SEQ ID NO: 91478 - RNA, 22 nt, Homo sapiens
auggcucaguguguaucuauca

SEQ ID NO: 91479 - RNA, 22 nt, Homo sapiens
auggcucuguuuuuuaugcucu

SEQ ID NO: 91480 - RNA, 22 nt, Homo sapiens
auggcuguuuuuuauguuacag

SEQ ID NO: 91481 - RNA, 22 nt, Homo sapiens
auggcuuucaggacguggcgag

SEQ ID NO: 91482 - RNA, 22 nt, Homo sapiens
auggcuuugggcugcucugccc

SEQ ID NO: 91483 - RNA, 22 nt, Homo sapiens
auggcuuuuauuguguugaggu

SEQ ID NO: 91484 - RNA, 22 nt, Homo sapiens
aucacuagaucauagguaaaca

SEQ ID NO: 91485 - RNA, 22 nt, Homo sapiens
aucacuuugcucuccagugugg

SEQ ID NO: 91486 - RNA, 22 nt, Homo sapiens
aucagagugaugguuuaaguau

SEQ ID NO: 91487 - RNA, 22 nt, Homo sapiens
aucagauguuuguauaggagua

SEQ ID NO: 91488 - RNA, 22 nt, Homo sapiens
aucagauuccacauuuuaucag

SEQ ID NO: 91489 - RNA, 23 nt, Homo sapiens
aucagguuguagaauguguuugc

SEQ ID NO: 91490 - RNA, 22 nt, Homo sapiens
aucagugagugguuagugaaug

SEQ ID NO: 91491 - RNA, 22 nt, Homo sapiens
aucagugauugauuuaaagacg

SEQ ID NO: 91492 - RNA, 22 nt, Homo sapiens
aucagugcagugggaacuagaa

SEQ ID NO: 91493 - RNA, 22 nt, Homo sapiens
aucagugcauaguauuuaauga

SEQ ID NO: 91494 - RNA, 22 nt, Homo sapiens
aucagugcauguuuguugagcu

SEQ ID NO: 91495 - RNA, 22 nt, Homo sapiens
aucaucacaguuguguguaaug

SEQ ID NO: 91496 - RNA, 22 nt, Homo sapiens
aucaugucuucccagugauucu

SEQ ID NO: 91497 - RNA, 22 nt, Homo sapiens
aucauugcacaucacagccuca

SEQ ID NO: 91498 - RNA, 18 nt, Homo sapiens
aucauugcacugucuugc

SEQ ID NO: 91499 - RNA, 22 nt, Homo sapiens
auccaguuuuaggagauuucua

SEQ ID NO: 91500 - RNA, 22 nt, Homo sapiens
auccccuugcagugaccggggc

SEQ ID NO: 91501 - RNA, 22 nt, Homo sapiens
aucccgagacuuugcugaaguu

SEQ ID NO: 91502 - RNA, 22 nt, Homo sapiens
aucccugugauccaaucacuuc

SEQ ID NO: 91503 - RNA, 22 nt, Homo sapiens
auccuguacuaagguuuuccca

SEQ ID NO: 91504 - RNA, 22 nt, Homo sapiens
auccuguagucucacagcccca

SEQ ID NO: 91505 - RNA, 21 nt, Homo sapiens
auccuucuuuuucaaccugug

SEQ ID NO: 91506 - RNA, 22 nt, Homo sapiens
auccuugagaaaauaaaugacc

SEQ ID NO: 91507 - RNA, 21 nt, Homo sapiens
aucgcacaauauaccccugua

SEQ ID NO: 91508 - RNA, 22 nt, Homo sapiens
aucuacagccagucugguuugu

SEQ ID NO: 91509 - RNA, 22 nt, Homo sapiens
aucuacuugcugggucucugga

SEQ ID NO: 91510 - RNA, 22 nt, Homo sapiens
aucuagagacauaguaaagaau

SEQ ID NO: 91511 - RNA, 22 nt, Homo sapiens
aucucaguuaauuccaucuuuc

SEQ ID NO: 91512 - RNA, 22 nt, Homo sapiens
aucucauuccuucugggcugau

SEQ ID NO: 91513 - RNA, 22 nt, Homo sapiens
aucuccaggugccagcugcgcc

SEQ ID NO: 91514 - RNA, 22 nt, Homo sapiens
aucuggguccguucugcuucuc

SEQ ID NO: 91515 - RNA, 22 nt, Homo sapiens
aucugguguauuggugcugggu

SEQ ID NO: 91516 - RNA, 22 nt, Homo sapiens
aucugguguuuccuucacauug

SEQ ID NO: 91517 - RNA, 21 nt, Homo sapiens
aucugugagaccuuggggguu

SEQ ID NO: 91518 - RNA, 22 nt, Homo sapiens
aucuuugauuagacugauggau

SEQ ID NO: 91519 - RNA, 22 nt, Homo sapiens
aucuuugcugagaugcauggca

SEQ ID NO: 91520 - RNA, 22 nt, Homo sapiens
aucuuuggugcaugauacuuug

SEQ ID NO: 91521 - RNA, 22 nt, Homo sapiens
augaaaacaugauuugccuguu

SEQ ID NO: 91522 - RNA, 23 nt, Homo sapiens
augaaagcccuugcaaaugcugg

SEQ ID NO: 91523 - RNA, 22 nt, Homo sapiens
augaaagguauguuuucuguga

SEQ ID NO: 91524 - RNA, 22 nt, Homo sapiens
augaaagucaauccccaagugu

SEQ ID NO: 91525 - RNA, 22 nt, Homo sapiens
augaaagugauaaaugucucua

SEQ ID NO: 91526 - RNA, 22 nt, Homo sapiens
augaaaguguguggaaacuuga

SEQ ID NO: 91527 - RNA, 22 nt, Homo sapiens
augaaaucuuuccugugaggau

SEQ ID NO: 91528 - RNA, 22 nt, Homo sapiens
augaaaucuuuggcagaucuua

SEQ ID NO: 91529 - RNA, 22 nt, Homo sapiens
augaaaugcauguuaaguccgu

SEQ ID NO: 91530 - RNA, 17 nt, Homo sapiens
augaacucaucauuuuu

SEQ ID NO: 91531 - RNA, 18 nt, Homo sapiens
augaacucaucauuuuuu

SEQ ID NO: 91532 - RNA, 22 nt, Homo sapiens
augaagucguuacuaccaauug

SEQ ID NO: 91533 - RNA, 22 nt, Homo sapiens
augaaugcuuuuggauguaucu

SEQ ID NO: 91534 - RNA, 23 nt, Homo sapiens
augaauguaaggaguguaagaaa

SEQ ID NO: 91535 - RNA, 22 nt, Homo sapiens
augaaugucuuauuuugagaaa

SEQ ID NO: 91536 - RNA, 22 nt, Homo sapiens
augacaagagccuucuuuccuu

SEQ ID NO: 91537 - RNA, 22 nt, Homo sapiens
augacagugagugagcucucac

SEQ ID NO: 91538 - RNA, 22 nt, Homo sapiens
augacauagcauggugccugcu

SEQ ID NO: 91539 - RNA, 22 nt, Homo sapiens
augaccagagguaugauguuug

SEQ ID NO: 91540 - RNA, 22 nt, Homo sapiens
augacuaaaggguuuauguuga

SEQ ID NO: 91541 - RNA, 22 nt, Homo sapiens
aagaugguauuucauuaguuuu

SEQ ID NO: 91542 - RNA, 22 nt, Homo sapiens
aagcacaauuucaccuucuugu

SEQ ID NO: 91543 - RNA, 22 nt, Homo sapiens
aagcagauguguugaaaguacu

SEQ ID NO: 91544 - RNA, 22 nt, Homo sapiens
aagcaggugaugagugggugug

SEQ ID NO: 91545 - RNA, 22 nt, Homo sapiens
aagcaucacuggaggcagccau

SEQ ID NO: 91546 - RNA, 23 nt, Homo sapiens
aagcaugcacagcuguuuguggu

SEQ ID NO: 91547 - RNA, 22 nt, Homo sapiens
aagcaugguuuccaggggucac

SEQ ID NO: 91548 - RNA, 22 nt, Homo sapiens
aagcgguguugaauuuuguuga

SEQ ID NO: 91549 - RNA, 22 nt, Homo sapiens
aagcuacauuuuauuuauguca

SEQ ID NO: 91550 - RNA, 22 nt, Homo sapiens
aagcugccaggcaugguggcug

SEQ ID NO: 91551 - RNA, 22 nt, Homo sapiens
aagcuggauuucgcauccuguu

SEQ ID NO: 91552 - RNA, 22 nt, Homo sapiens
aagcugguguugcugcucuguu

SEQ ID NO: 91553 - RNA, 22 nt, Homo sapiens
aagcugugucuugucagcuacc

SEQ ID NO: 91554 - RNA, 22 nt, Homo sapiens
aagcuguguguaagcucucaca

SEQ ID NO: 91555 - RNA, 22 nt, Homo sapiens
aagcuguuguucauccugaauu

SEQ ID NO: 91556 - RNA, 22 nt, Homo sapiens
aaggaagcuagcaggaauuggu

SEQ ID NO: 91557 - RNA, 23 nt, Homo sapiens
aaggacacugaacacuucccagc

SEQ ID NO: 91558 - RNA, 22 nt, Homo sapiens
aaggagcagagagcccuguuuc

SEQ ID NO: 91559 - RNA, 22 nt, Homo sapiens
aaggagcuaagagaucauacau

SEQ ID NO: 91560 - RNA, 22 nt, Homo sapiens
aaggaguagacaacauggcgcc

SEQ ID NO: 91561 - RNA, 22 nt, Homo sapiens
aaggaguagaggaauagcaaug

SEQ ID NO: 91562 - RNA, 22 nt, Homo sapiens
aaggaguaucuguuuucucacc

SEQ ID NO: 91563 - RNA, 22 nt, Homo sapiens
aaggcaagaaugcgugcuuuca

SEQ ID NO: 91564 - RNA, 22 nt, Homo sapiens
aaggcuauuugagaaugugugu

SEQ ID NO: 91565 - RNA, 20 nt, Homo sapiens
aaggcuuucgaguuccaggg

SEQ ID NO: 91566 - RNA, 22 nt, Homo sapiens
aaggcuuuuugcugacguccuu

SEQ ID NO: 91567 - RNA, 22 nt, Homo sapiens
aagggaaugcuuccaguuugug

SEQ ID NO: 91568 - RNA, 22 nt, Homo sapiens
aagggaauguuguggcugguuu

SEQ ID NO: 91569 - RNA, 23 nt, Homo sapiens
aagguaagcuagaaagauguaga

SEQ ID NO: 91570 - RNA, 22 nt, Homo sapiens
aagguaguuagaaaauauaacu

SEQ ID NO: 91571 - RNA, 18 nt, Homo sapiens
aaggugcuucuguucuga

SEQ ID NO: 91572 - RNA, 22 nt, Homo sapiens
aagguggugucagagagcuuau

SEQ ID NO: 91573 - RNA, 22 nt, Homo sapiens
aagguuguauuuaauauacugu

SEQ ID NO: 91574 - RNA, 22 nt, Homo sapiens
aaguacuguuuaaauugcagaa

SEQ ID NO: 91575 - RNA, 22 nt, Homo sapiens
aaguagugcuugugcucaucuc

SEQ ID NO: 91576 - RNA, 19 nt, Homo sapiens
aaguaguugugacagaugc

SEQ ID NO: 91577 - RNA, 18 nt, Homo sapiens
aaguauagagagcccuua

SEQ ID NO: 91578 - RNA, 22 nt, Homo sapiens
aaguauuaugaguccuuguuuu

SEQ ID NO: 91579 - RNA, 22 nt, Homo sapiens
aagucaaggagagaagcuucag

SEQ ID NO: 91580 - RNA, 22 nt, Homo sapiens
aagucaugaagaggaaaggaca

SEQ ID NO: 91581 - RNA, 22 nt, Homo sapiens
aagucauggaggaguaugugag

SEQ ID NO: 91582 - RNA, 22 nt, Homo sapiens
aaguccaugaagucuugugggu

SEQ ID NO: 91583 - RNA, 22 nt, Homo sapiens
aagugaaugaugugaaguguaa

SEQ ID NO: 91584 - RNA, 22 nt, Homo sapiens
aagugaauucauuguguuauau

SEQ ID NO: 91585 - RNA, 22 nt, Homo sapiens
aagugaguaauacgucaguugu

SEQ ID NO: 91586 - RNA, 22 nt, Homo sapiens
aagugauguuauugggugacuc

SEQ ID NO: 91587 - RNA, 22 nt, Homo sapiens
aagugccauguggaugggcccu

SEQ ID NO: 91588 - RNA, 22 nt, Homo sapiens
aagugcuucuuuccucgagaag

SEQ ID NO: 91589 - RNA, 22 nt, Homo sapiens
aaguggcauugaggaaaaaaau

SEQ ID NO: 91590 - RNA, 22 nt, Homo sapiens
aaguggccuagagcgaccauuu

SEQ ID NO: 91591 - RNA, 22 nt, Homo sapiens
aagugguagggucaggauugga

SEQ ID NO: 91592 - RNA, 22 nt, Homo sapiens
aagugguucuaugaguuugcaa

SEQ ID NO: 91593 - RNA, 22 nt, Homo sapiens
aagugguuuuaaucuggugagu

SEQ ID NO: 91594 - RNA, 22 nt, Homo sapiens
aaguuguuggaguuccauuguu

SEQ ID NO: 91595 - RNA, 21 nt, Homo sapiens
aauaaagcaaccuuaugccau

SEQ ID NO: 91596 - RNA, 22 nt, Homo sapiens
aauaaagucugaagugugcuua

SEQ ID NO: 91597 - RNA, 22 nt, Homo sapiens
aauaagcauaguaccugauagg

SEQ ID NO: 91598 - RNA, 22 nt, Homo sapiens
aauaauggcaccaaagcacaag

SEQ ID NO: 91599 - RNA, 22 nt, Homo sapiens
aauaaugucacaggggguuagc

SEQ ID NO: 91600 - RNA, 22 nt, Homo sapiens
aauacugaaaguauuuucaaau

SEQ ID NO: 91601 - RNA, 22 nt, Homo sapiens
aauacugagaugugagguacua

SEQ ID NO: 91602 - RNA, 22 nt, Homo sapiens
aauacugcuuugauguaagcua

SEQ ID NO: 91603 - RNA, 22 nt, Homo sapiens
aauagcuguuuuuaauuccugc

SEQ ID NO: 91604 - RNA, 22 nt, Homo sapiens
aauagugcugcaaaaacauacg

SEQ ID NO: 91605 - RNA, 22 nt, Homo sapiens
aauaucacaguuggguguacac

SEQ ID NO: 91606 - RNA, 22 nt, Homo sapiens
aauaucuguguauagauggggg

SEQ ID NO: 91607 - RNA, 22 nt, Homo sapiens
aauauguccuugaaauggugcu

SEQ ID NO: 91608 - RNA, 22 nt, Homo sapiens
aauaugucugcuaauuguuucu

SEQ ID NO: 91609 - RNA, 22 nt, Homo sapiens
aaucacacuugauguugagcaa

SEQ ID NO: 91610 - RNA, 22 nt, Homo sapiens
aaucacaguuaguaagggagaa

SEQ ID NO: 91611 - RNA, 22 nt, Homo sapiens
aaucacguagcaguagggagaa

SEQ ID NO: 91612 - RNA, 22 nt, Homo sapiens
aaucacuaugccaugaaguaca

SEQ ID NO: 91613 - RNA, 22 nt, Homo sapiens
aauccaugugcuuuaccauuuu

SEQ ID NO: 91614 - RNA, 22 nt, Homo sapiens
aaucccugagcuagacacaaag

SEQ ID NO: 91615 - RNA, 22 nt, Homo sapiens
aaucccuggacuuucggaggcu

SEQ ID NO: 91616 - RNA, 22 nt, Homo sapiens
aaucucagagauaucugugucc

SEQ ID NO: 91617 - RNA, 22 nt, Homo sapiens
aaucuguagaaggugcacauuc

SEQ ID NO: 91618 - RNA, 22 nt, Homo sapiens
aaugaaguuagauguugagaag

SEQ ID NO: 91619 - RNA, 22 nt, Homo sapiens
aaugacacugagcaucuuucau

SEQ ID NO: 91620 - RNA, 22 nt, Homo sapiens
aaugacucugccuaaauuucac

SEQ ID NO: 91621 - RNA, 22 nt, Homo sapiens
aaugauauguuauguuuagguu

SEQ ID NO: 91622 - RNA, 22 nt, Homo sapiens
aaugcaagauguuaauuauagg

SEQ ID NO: 91623 - RNA, 22 nt, Homo sapiens
aaugcacuccagccugggcgac

SEQ ID NO: 91624 - RNA, 22 nt, Homo sapiens
aaugccuagugugugacaggug

SEQ ID NO: 91625 - RNA, 22 nt, Homo sapiens
aauggagcuguuuggaugacuu

SEQ ID NO: 91626 - RNA, 22 nt, Homo sapiens
aauggcaaauguuuucuguuga

SEQ ID NO: 91627 - RNA, 22 nt, Homo sapiens
aauggcaguagauggaugggua

SEQ ID NO: 91628 - RNA, 22 nt, Homo sapiens
aauggcaucuacguuaaauguc

SEQ ID NO: 91629 - RNA, 22 nt, Homo sapiens
aauggcauugguccuuuuggau

SEQ ID NO: 91630 - RNA, 18 nt, Homo sapiens
aauggcucuggguucuaa

SEQ ID NO: 91631 - RNA, 19 nt, Homo sapiens
aauggcuuuuccuguuccc

SEQ ID NO: 91632 - RNA, 22 nt, Homo sapiens
aaugggacugacgccucccaga

SEQ ID NO: 91633 - RNA, 22 nt, Homo sapiens
aaugguguuuccguuaagcuga

SEQ ID NO: 91634 - RNA, 22 nt, Homo sapiens
aaugguuuuaucagcguccaaa

SEQ ID NO: 91635 - RNA, 22 nt, Homo sapiens
aaugucaugaguccaaccagaa

SEQ ID NO: 91636 - RNA, 22 nt, Homo sapiens
aauugaaugauaugggacauuu

SEQ ID NO: 91637 - RNA, 22 nt, Homo sapiens
aauugaaugcagaugccaggga

SEQ ID NO: 91638 - RNA, 23 nt, Homo sapiens
aauugcacauuccuugcuggcag

SEQ ID NO: 91639 - RNA, 22 nt, Homo sapiens
aauugcucuccuccaaggucuu

SEQ ID NO: 91640 - RNA, 22 nt, Homo sapiens
aauugcuucuguauuuuggaca

SEQ ID NO: 91641 - RNA, 22 nt, Homo sapiens
aauuguacucccauaauucccu

SEQ ID NO: 91642 - RNA, 22 nt, Homo sapiens
acaaaguguuuucugaaggccu

SEQ ID NO: 91643 - RNA, 22 nt, Homo sapiens
acaagcacaaaugcauagaugg

SEQ ID NO: 91644 - RNA, 23 nt, Homo sapiens
acacaguaaacuaaaagcuagcu

SEQ ID NO: 91645 - RNA, 22 nt, Homo sapiens
acacaguaagcacaguguagau

SEQ ID NO: 91646 - RNA, 22 nt, Homo sapiens
acacagucaaauccacuuggcu

SEQ ID NO: 91647 - RNA, 22 nt, Homo sapiens
acacagugucuguguauuuaaa

SEQ ID NO: 91648 - RNA, 22 nt, Homo sapiens
acaccaucuccuuauuucucuu

SEQ ID NO: 91649 - RNA, 22 nt, Homo sapiens
acaccaugucuguuucugguuu

SEQ ID NO: 91650 - RNA, 22 nt, Homo sapiens
acaccauugcauuccagccugg

SEQ ID NO: 91651 - RNA, 22 nt, Homo sapiens
acacucucucauuacuuguuug

SEQ ID NO: 91652 - RNA, 20 nt, Homo sapiens
acacuggaguaucaaggccc

SEQ ID NO: 91653 - RNA, 22 nt, Homo sapiens
acacuggguaacauaucuguua

SEQ ID NO: 91654 - RNA, 22 nt, Homo sapiens
acacuguaacucuuugagggca

SEQ ID NO: 91655 - RNA, 22 nt, Homo sapiens
acacugucugaugaaaguaguu

SEQ ID NO: 91656 - RNA, 22 nt, Homo sapiens
acacuguuggugggaguguaaa

SEQ ID NO: 91657 - RNA, 22 nt, Homo sapiens
acagaaccauucacuccccugg

SEQ ID NO: 91658 - RNA, 22 nt, Homo sapiens
acagaauucucagaacugggag

SEQ ID NO: 91659 - RNA, 22 nt, Homo sapiens
acagagcaaugagcuacggucu

SEQ ID NO: 91660 - RNA, 22 nt, Homo sapiens
acaguacucugcucuuuugauu

SEQ ID NO: 91661 - RNA, 21 nt, Homo sapiens
acaguacuugagaucuuuuga

SEQ ID NO: 91662 - RNA, 20 nt, Homo sapiens
acaguagaagggauuucaaa

SEQ ID NO: 91663 - RNA, 22 nt, Homo sapiens
acaguauaaugcuguagggaga

SEQ ID NO: 91664 - RNA, 23 nt, Homo sapiens
acaguauguggauguggcuaagu

SEQ ID NO: 91665 - RNA, 23 nt, Homo sapiens
acagucuaguuugaagucaggua

SEQ ID NO: 91666 - RNA, 22 nt, Homo sapiens
acagucuggagaaugggugcuc

SEQ ID NO: 91667 - RNA, 18 nt, Homo sapiens
acagugcugucacugcuu

SEQ ID NO: 91668 - RNA, 22 nt, Homo sapiens
acagugcuuggcacacaguaau

SEQ ID NO: 91669 - RNA, 22 nt, Homo sapiens
acaguggaauguaggguuugag

SEQ ID NO: 91670 - RNA, 22 nt, Homo sapiens
acaguggugcgaucucggcuca

SEQ ID NO: 91671 - RNA, 22 nt, Homo sapiens
acagugucugacacguaggaag

SEQ ID NO: 91672 - RNA, 18 nt, Homo sapiens
acagugucuuacaccugu

SEQ ID NO: 91673 - RNA, 22 nt, Homo sapiens
acauacacuagggauguggugu

SEQ ID NO: 91674 - RNA, 21 nt, Homo sapiens
acaucagaguugugaagguag

SEQ ID NO: 91675 - RNA, 22 nt, Homo sapiens
acaucccuugcucggggccccu

SEQ ID NO: 91676 - RNA, 17 nt, Homo sapiens
acaugagacuggauucu

SEQ ID NO: 91677 - RNA, 22 nt, Homo sapiens
acaugcauauguuggaagaaag

SEQ ID NO: 91678 - RNA, 22 nt, Homo sapiens
acaugcaucauuaggugguuua

SEQ ID NO: 91679 - RNA, 19 nt, Homo sapiens
acauggauuuugugcaaac

SEQ ID NO: 91680 - RNA, 21 nt, Homo sapiens
acauguacacauguaugcaca

SEQ ID NO: 91681 - RNA, 22 nt, Homo sapiens
acauguagacaacggacaaagu

SEQ ID NO: 91682 - RNA, 23 nt, Homo sapiens
acauguauagacuuuuuuuccuu

SEQ ID NO: 91683 - RNA, 22 nt, Homo sapiens
accacaggguaaaguuagauau

SEQ ID NO: 91684 - RNA, 22 nt, Homo sapiens
accaccauugcacugaacuuuc

SEQ ID NO: 91685 - RNA, 20 nt, Homo sapiens
aagugcuauuucuuuugugg

SEQ ID NO: 91686 - RNA, 21 nt, Homo sapiens
aagugcucugggacucuaaau

SEQ ID NO: 91687 - RNA, 22 nt, Homo sapiens
aagugcuuaggauagugugugg

SEQ ID NO: 91688 - RNA, 22 nt, Homo sapiens
aagugcuucagaagacaauauu

SEQ ID NO: 91689 - RNA, 22 nt, Homo sapiens
aaguggaauguuuguggcacaa

SEQ ID NO: 91690 - RNA, 22 nt, Homo sapiens
aagugguguuuguauuuaugca

SEQ ID NO: 91691 - RNA, 22 nt, Homo sapiens
aaguguaaguuaauguuuaggu

SEQ ID NO: 91692 - RNA, 22 nt, Homo sapiens
aaguuaauguuuaagacuccua

SEQ ID NO: 91693 - RNA, 22 nt, Homo sapiens
aaguugguguaugagacagaag

SEQ ID NO: 91694 - RNA, 22 nt, Homo sapiens
aaguuguaguuagagaguugcu

SEQ ID NO: 91695 - RNA, 22 nt, Homo sapiens
aauaaagcagcuuuuugggacu

SEQ ID NO: 91696 - RNA, 22 nt, Homo sapiens
aauaaagcauggcuacuccaua

SEQ ID NO: 91697 - RNA, 22 nt, Homo sapiens
aauaaagcugaauccuuccuga

SEQ ID NO: 91698 - RNA, 22 nt, Homo sapiens
aauaaagcuuugagcuuugcug

SEQ ID NO: 91699 - RNA, 22 nt, Homo sapiens
aauaaaguaggaggugaggaaa

SEQ ID NO: 91700 - RNA, 20 nt, Homo sapiens
aauaacagccccagggaggu

SEQ ID NO: 91701 - RNA, 22 nt, Homo sapiens
augcuacugaccccuacuuaca

SEQ ID NO: 91702 - RNA, 22 nt, Homo sapiens
augcuacugauaagcaaucauu

SEQ ID NO: 91703 - RNA, 22 nt, Homo sapiens
augcuacuggauuuguauaaau

SEQ ID NO: 91704 - RNA, 22 nt, Homo sapiens
augcuaugugugacuucuuaug

SEQ ID NO: 91705 - RNA, 22 nt, Homo sapiens
augcuuguguuggggcagugga

SEQ ID NO: 91706 - RNA, 22 nt, Homo sapiens
augcuuguugcagccugagccu

SEQ ID NO: 91707 - RNA, 20 nt, Homo sapiens
auggaacugugagccaauua

SEQ ID NO: 91708 - RNA, 22 nt, Homo sapiens
auggaagaaaguuggguucuug

SEQ ID NO: 91709 - RNA, 22 nt, Homo sapiens
auggaagaauugucggggaugu

SEQ ID NO: 91710 - RNA, 22 nt, Homo sapiens
auggaagcugauuagauaguac

SEQ ID NO: 91711 - RNA, 22 nt, Homo sapiens
auggaagucucuguuaaguuuc

SEQ ID NO: 91712 - RNA, 22 nt, Homo sapiens
auggaaugccauuuauaaugga

SEQ ID NO: 91713 - RNA, 22 nt, Homo sapiens
auggaauggcacuuugaagauu

SEQ ID NO: 91714 - RNA, 22 nt, Homo sapiens
auggaauguaaguuauguuugc

SEQ ID NO: 91715 - RNA, 22 nt, Homo sapiens
auggaauguggaaugguaagua

SEQ ID NO: 91716 - RNA, 22 nt, Homo sapiens
auggacagacacuggccuucug

SEQ ID NO: 91717 - RNA, 20 nt, Homo sapiens
auggaccuggauuaacagca

SEQ ID NO: 91718 - RNA, 22 nt, Homo sapiens
auggagagaauuauucucucag

SEQ ID NO: 91719 - RNA, 22 nt, Homo sapiens
auggagcuugacaguuguagag

SEQ ID NO: 91720 - RNA, 22 nt, Homo sapiens
auggaggacaaugucaccuuca

SEQ ID NO: 91721 - RNA, 22 nt, Homo sapiens
auggaggaggaagcugaaacaa

SEQ ID NO: 91722 - RNA, 22 nt, Homo sapiens
auggaguguaauauugagagcu

SEQ ID NO: 91723 - RNA, 22 nt, Homo sapiens
auggauauugccuaggguagua

SEQ ID NO: 91724 - RNA, 22 nt, Homo sapiens
auggaucauauucuugaggagg

SEQ ID NO: 91725 - RNA, 22 nt, Homo sapiens
auggauuuguaguacaugguug

SEQ ID NO: 91726 - RNA, 22 nt, Homo sapiens
auggauuuugaacuugagaguu

SEQ ID NO: 91727 - RNA, 22 nt, Homo sapiens
auggauuuuggggccagaggca

SEQ ID NO: 91728 - RNA, 22 nt, Homo sapiens
auggcaaugcgauggugacuga

SEQ ID NO: 91729 - RNA, 22 nt, Homo sapiens
auggcacuacugggaaugucuu

SEQ ID NO: 91730 - RNA, 22 nt, Homo sapiens
auggcacugccuggcuucaugg

SEQ ID NO: 91731 - RNA, 22 nt, Homo sapiens
auggcagagucagaaagucagg

SEQ ID NO: 91732 - RNA, 22 nt, Homo sapiens
auggcagcaccccacucuacug

SEQ ID NO: 91733 - RNA, 22 nt, Homo sapiens
auggcagugucuagggguguuu

SEQ ID NO: 91734 - RNA, 22 nt, Homo sapiens
auggcaguuucagcuauaguuu

SEQ ID NO: 91735 - RNA, 22 nt, Homo sapiens
auggcaguuuggucucugugcu

SEQ ID NO: 91736 - RNA, 22 nt, Homo sapiens
auggcauugaagaguugucccu

SEQ ID NO: 91737 - RNA, 22 nt, Homo sapiens
auggcccugaguucaauauauu

SEQ ID NO: 91738 - RNA, 20 nt, Homo sapiens
auggcccugcugggaguguc

SEQ ID NO: 91739 - RNA, 22 nt, Homo sapiens
auggcccuguguggagcugcug

SEQ ID NO: 91740 - RNA, 22 nt, Homo sapiens
auggcuagauuguaugguaguu

SEQ ID NO: 91741 - RNA, 22 nt, Homo sapiens
auggcucaauucuuucccugaa

SEQ ID NO: 91742 - RNA, 22 nt, Homo sapiens
auggcucuggauagaaugcagg

SEQ ID NO: 91743 - RNA, 22 nt, Homo sapiens
auggcuuaagacaaccuuucau

SEQ ID NO: 91744 - RNA, 22 nt, Homo sapiens
auggcuuuaagagugucugaau

SEQ ID NO: 91745 - RNA, 22 nt, Homo sapiens
auggcuuuggucucccagugau

SEQ ID NO: 91746 - RNA, 22 nt, Homo sapiens
auggcuuuugaccugguaggau

SEQ ID NO: 91747 - RNA, 22 nt, Homo sapiens
augggauaguaucaguggaaua

SEQ ID NO: 91748 - RNA, 22 nt, Homo sapiens
augggcaaauguuggaaauucc

SEQ ID NO: 91749 - RNA, 22 nt, Homo sapiens
augggguaggcuuugcugcagu

SEQ ID NO: 91750 - RNA, 22 nt, Homo sapiens
augguacucucuugucugcaaa

SEQ ID NO: 91751 - RNA, 22 nt, Homo sapiens
augguacuggguaaaagugggg

SEQ ID NO: 91752 - RNA, 22 nt, Homo sapiens
augguauggaaggucuggagga

SEQ ID NO: 91753 - RNA, 22 nt, Homo sapiens
auggucuuuuuguuaugagaga

SEQ ID NO: 91754 - RNA, 21 nt, Homo sapiens
auggugagaaaguagugucaa

SEQ ID NO: 91755 - RNA, 22 nt, Homo sapiens
augguuuauuuguaagcagagu

SEQ ID NO: 91756 - RNA, 22 nt, Homo sapiens
augguuugugcuccuauaagaa

SEQ ID NO: 91757 - RNA, 22 nt, Homo sapiens
auguaaacagaugugcagcuug

SEQ ID NO: 91758 - RNA, 22 nt, Homo sapiens
auguaaacuacagauuuugggu

SEQ ID NO: 91759 - RNA, 22 nt, Homo sapiens
auguaauugagguuuuugccau

SEQ ID NO: 91760 - RNA, 22 nt, Homo sapiens
auguagauaucaagaggcauau

SEQ ID NO: 91761 - RNA, 22 nt, Homo sapiens
auguauacauagauacgugugu

SEQ ID NO: 91762 - RNA, 22 nt, Homo sapiens
auguauacaugcaggucacagg

SEQ ID NO: 91763 - RNA, 22 nt, Homo sapiens
augucaaggugaagaaagauca

SEQ ID NO: 91764 - RNA, 20 nt, Homo sapiens
augucaggaagggagucagg

SEQ ID NO: 91765 - RNA, 22 nt, Homo sapiens
augucuguuugcugagcccggc

SEQ ID NO: 91766 - RNA, 22 nt, Homo sapiens
augugaacaucauagaaugcac

SEQ ID NO: 91767 - RNA, 22 nt, Homo sapiens
augugaacugaauuaauucaca

SEQ ID NO: 91768 - RNA, 22 nt, Homo sapiens
augugacagcaacccccagccc

SEQ ID NO: 91769 - RNA, 22 nt, Homo sapiens
augugcaaagcacuguucagca

SEQ ID NO: 91770 - RNA, 22 nt, Homo sapiens
augugcaaaguuaagaucccag

SEQ ID NO: 91771 - RNA, 22 nt, Homo sapiens
augugcaaauuuccaaacucuu

SEQ ID NO: 91772 - RNA, 22 nt, Homo sapiens
augugcaacugcuggaacaguc

SEQ ID NO: 91773 - RNA, 22 nt, Homo sapiens
augugcacaugcuuacauguga

SEQ ID NO: 91774 - RNA, 22 nt, Homo sapiens
augugcauaugaagcacagaca

SEQ ID NO: 91775 - RNA, 22 nt, Homo sapiens
augugcaugcuguucugccaga

SEQ ID NO: 91776 - RNA, 22 nt, Homo sapiens
auggcuuuuccugucuugcaug

SEQ ID NO: 91777 - RNA, 22 nt, Homo sapiens
auggcuuuuuaaaucauguugu

SEQ ID NO: 91778 - RNA, 22 nt, Homo sapiens
auggcuuuuuucuugggcacuc

SEQ ID NO: 91779 - RNA, 22 nt, Homo sapiens
augggaaaaucagaaggccugg

SEQ ID NO: 91780 - RNA, 22 nt, Homo sapiens
augggcacugauguauucugug

SEQ ID NO: 91781 - RNA, 21 nt, Homo sapiens
augggguagaagagaaggcuu

SEQ ID NO: 91782 - RNA, 18 nt, Homo sapiens
auggguguuggaaaauga

SEQ ID NO: 91783 - RNA, 22 nt, Homo sapiens
augguacuggggucccggaguu

SEQ ID NO: 91784 - RNA, 22 nt, Homo sapiens
augguaguagaugugugguuuu

SEQ ID NO: 91785 - RNA, 22 nt, Homo sapiens
augguauuuaacagucuuucua

SEQ ID NO: 91786 - RNA, 22 nt, Homo sapiens
auggucccauucauucacguau

SEQ ID NO: 91787 - RNA, 22 nt, Homo sapiens
auggucuuuauuguguugagug

SEQ ID NO: 91788 - RNA, 22 nt, Homo sapiens
auggucuuuucccuggauuaua

SEQ ID NO: 91789 - RNA, 22 nt, Homo sapiens
auguaacugggacacaagccuc

SEQ ID NO: 91790 - RNA, 17 nt, Homo sapiens
auguaauccucaucucu

SEQ ID NO: 91791 - RNA, 22 nt, Homo sapiens
auguagugugauuuucacuaga

SEQ ID NO: 91792 - RNA, 22 nt, Homo sapiens
augucaaagaggaaaacuggau

SEQ ID NO: 91793 - RNA, 22 nt, Homo sapiens
augucaacauagacaguagagu

SEQ ID NO: 91794 - RNA, 22 nt, Homo sapiens
augucaaggugggugauaguuu

SEQ ID NO: 91795 - RNA, 22 nt, Homo sapiens
augucacugcacuccugccugg

SEQ ID NO: 91796 - RNA, 22 nt, Homo sapiens
augucauagaagccugugaacc

SEQ ID NO: 91797 - RNA, 22 nt, Homo sapiens
auguccaugagcacauguauca

SEQ ID NO: 91798 - RNA, 22 nt, Homo sapiens
auguccauggaaucuguagcaa

SEQ ID NO: 91799 - RNA, 22 nt, Homo sapiens
auguccuaaucuccuguucuua

SEQ ID NO: 91800 - RNA, 22 nt, Homo sapiens
auguccuagagagauggugguc

SEQ ID NO: 91801 - RNA, 22 nt, Homo sapiens
auguccuggacccagacaaagc

SEQ ID NO: 91802 - RNA, 22 nt, Homo sapiens
augucuagagugauacugaagc

SEQ ID NO: 91803 - RNA, 17 nt, Homo sapiens
augugaauguucaaaua

SEQ ID NO: 91804 - RNA, 22 nt, Homo sapiens
augugacuggaucauggggacg

SEQ ID NO: 91805 - RNA, 22 nt, Homo sapiens
augugacuuuuuccugugccuu

SEQ ID NO: 91806 - RNA, 22 nt, Homo sapiens
augugcaagaucauuaaagcuc

SEQ ID NO: 91807 - RNA, 22 nt, Homo sapiens
augugcaauguguacguagccc

SEQ ID NO: 91808 - RNA, 22 nt, Homo sapiens
augugcacaacgugcagguuug

SEQ ID NO: 91809 - RNA, 20 nt, Homo sapiens
augugcaguguggcaaccaa

SEQ ID NO: 91810 - RNA, 22 nt, Homo sapiens
augugcuuauagguguauguuu

SEQ ID NO: 91811 - RNA, 22 nt, Homo sapiens
augugcuugagggaaaucaguu

SEQ ID NO: 91812 - RNA, 22 nt, Homo sapiens
augugcuuuuggugagagauuu

SEQ ID NO: 91813 - RNA, 22 nt, Homo sapiens
auguggcacuugacuuucucgc

SEQ ID NO: 91814 - RNA, 22 nt, Homo sapiens
auguggcuuuccuagaucuuag

SEQ ID NO: 91815 - RNA, 22 nt, Homo sapiens
auguuacggaguuuuuauccag

SEQ ID NO: 91816 - RNA, 22 nt, Homo sapiens
auguuauguuaaugauaaugga

SEQ ID NO: 91817 - RNA, 18 nt, Homo sapiens
auguuauguuuguagaag

SEQ ID NO: 91818 - RNA, 22 nt, Homo sapiens
auguugcaguuuaauuauccua

SEQ ID NO: 91819 - RNA, 22 nt, Homo sapiens
auguuugguagugaauauggua

SEQ ID NO: 91820 - RNA, 22 nt, Homo sapiens
auuaacaucuagaguuuuggug

SEQ ID NO: 91821 - RNA, 22 nt, Homo sapiens
auuaaguugugccugaaaacuu

SEQ ID NO: 91822 - RNA, 22 nt, Homo sapiens
auuaauguaauuaguaaaguug

SEQ ID NO: 91823 - RNA, 22 nt, Homo sapiens
auuacaugucuauccaugaaca

SEQ ID NO: 91824 - RNA, 22 nt, Homo sapiens
auuacuuugcaccaaccuaaua

SEQ ID NO: 91825 - RNA, 22 nt, Homo sapiens
auuagguacugugguuuccaga

SEQ ID NO: 91826 - RNA, 22 nt, Homo sapiens
cugguuguucuggaugggcagg

SEQ ID NO: 91827 - RNA, 22 nt, Homo sapiens
cuguaaggcacuaagcauaugu

SEQ ID NO: 91828 - RNA, 22 nt, Homo sapiens
cuguacucaucccauaugcacu

SEQ ID NO: 91829 - RNA, 22 nt, Homo sapiens
cugucuagagggcacaugaugc

SEQ ID NO: 91830 - RNA, 22 nt, Homo sapiens
cugugaagaaagucauugguag

SEQ ID NO: 91831 - RNA, 22 nt, Homo sapiens
cugugauagguuagucaugaau

SEQ ID NO: 91832 - RNA, 17 nt, Homo sapiens
cugugaugaucuugucu

SEQ ID NO: 91833 - RNA, 22 nt, Homo sapiens
cugugcauaucuuggacugugu

SEQ ID NO: 91834 - RNA, 22 nt, Homo sapiens
cugugcauaugacuuuauugga

SEQ ID NO: 91835 - RNA, 22 nt, Homo sapiens
cugugcaugcgcggagcugaaa

SEQ ID NO: 91836 - RNA, 22 nt, Homo sapiens
cugugcauucuuaaaucaggaa

SEQ ID NO: 91837 - RNA, 23 nt, Homo sapiens
cuguggauaugaguuguaaaugg

SEQ ID NO: 91838 - RNA, 22 nt, Homo sapiens
cuguggguuuuacuguuuuacu

SEQ ID NO: 91839 - RNA, 22 nt, Homo sapiens
cugugguuuaaggaauuuugac

SEQ ID NO: 91840 - RNA, 22 nt, Homo sapiens
cuguuauguuugauggaugaau

SEQ ID NO: 91841 - RNA, 22 nt, Homo sapiens
cuguugguuaaauuccaugcag

SEQ ID NO: 91842 - RNA, 22 nt, Homo sapiens
cuuaaagcgaauauugguggua

SEQ ID NO: 91843 - RNA, 20 nt, Homo sapiens
cuuaaugcagcauuucucag

SEQ ID NO: 91844 - RNA, 22 nt, Homo sapiens
cuuagcaugucagcaccggguu

SEQ ID NO: 91845 - RNA, 22 nt, Homo sapiens
gugaugguccagggaaucucuu

SEQ ID NO: 91846 - RNA, 22 nt, Homo sapiens
gugauuauccacgucuuuguga

SEQ ID NO: 91847 - RNA, 20 nt, Homo sapiens
gugauuggucacugguuguu

SEQ ID NO: 91848 - RNA, 22 nt, Homo sapiens
gugauugucuaaucaagauaca

SEQ ID NO: 91849 - RNA, 22 nt, Homo sapiens
gugauugugaaaacauuaagaa

SEQ ID NO: 91850 - RNA, 22 nt, Homo sapiens
gugcaagagugacugcaguuuu

SEQ ID NO: 91851 - RNA, 22 nt, Homo sapiens
gugcaagagugauugcaguuuu

SEQ ID NO: 91852 - RNA, 18 nt, Homo sapiens
gugcaaugaauagcagag

SEQ ID NO: 91853 - RNA, 22 nt, Homo sapiens
gugcaaugaguguggcaaagcc

SEQ ID NO: 91854 - RNA, 22 nt, Homo sapiens
gugcaauguuaauuacuugacu

SEQ ID NO: 91855 - RNA, 22 nt, Homo sapiens
gugcaauucacuguuaugucug

SEQ ID NO: 91856 - RNA, 22 nt, Homo sapiens
auggacuuuuuguucagugucu

SEQ ID NO: 91857 - RNA, 22 nt, Homo sapiens
auggagcaaaacagauuuggga

SEQ ID NO: 91858 - RNA, 22 nt, Homo sapiens
auggaggccuacagaauuuugg

SEQ ID NO: 91859 - RNA, 22 nt, Homo sapiens
auggagguguggggagugaguu

SEQ ID NO: 91860 - RNA, 22 nt, Homo sapiens
auggaguuugaacaauuuccug

SEQ ID NO: 91861 - RNA, 22 nt, Homo sapiens
auggaucuuucugcuuuugaau

SEQ ID NO: 91862 - RNA, 22 nt, Homo sapiens
auggauuuuaggauacaguuga

SEQ ID NO: 91863 - RNA, 22 nt, Homo sapiens
auggcaaaauguuccuaguggu

SEQ ID NO: 91864 - RNA, 22 nt, Homo sapiens
auggcaauguaagucagaaaaa

SEQ ID NO: 91865 - RNA, 22 nt, Homo sapiens
auggcacuaaugggaguuuacu

SEQ ID NO: 91866 - RNA, 22 nt, Homo sapiens
auggcacuuuggacugcuagau

SEQ ID NO: 91867 - RNA, 22 nt, Homo sapiens
auggcagcccucuuuauccaug

SEQ ID NO: 91868 - RNA, 22 nt, Homo sapiens
auggcagcugguuuuacccuag

SEQ ID NO: 91869 - RNA, 22 nt, Homo sapiens
auggcaguuuauucuaaaucaa

SEQ ID NO: 91870 - RNA, 22 nt, Homo sapiens
auggcaguuucacucugggauu

SEQ ID NO: 91871 - RNA, 22 nt, Homo sapiens
auggcauuuuuagggcugggug

SEQ ID NO: 91872 - RNA, 22 nt, Homo sapiens
auggccauuacuaagaauguuu

SEQ ID NO: 91873 - RNA, 22 nt, Homo sapiens
auggcccugcuaccacuuuucu

SEQ ID NO: 91874 - RNA, 23 nt, Homo sapiens
auggcccuggugggagugucuuu

SEQ ID NO: 91875 - RNA, 22 nt, Homo sapiens
auggccuaugacagguauguug

SEQ ID NO: 91876 - RNA, 22 nt, Homo sapiens
auggcggugugaucuuggcuca

SEQ ID NO: 91877 - RNA, 22 nt, Homo sapiens
auggcuauuccauaggcagagc

SEQ ID NO: 91878 - RNA, 22 nt, Homo sapiens
auggcuauucuucuuuugucag

SEQ ID NO: 91879 - RNA, 22 nt, Homo sapiens
auggcucuuauuauuugaggua

SEQ ID NO: 91880 - RNA, 22 nt, Homo sapiens
auggcucuuauuauuuugaggu

SEQ ID NO: 91881 - RNA, 22 nt, Homo sapiens
auggcugugagaucgacuuauu

SEQ ID NO: 91882 - RNA, 22 nt, Homo sapiens
auggcuguuuaagaguuucauu

SEQ ID NO: 91883 - RNA, 22 nt, Homo sapiens
auggcuucuucuaaaagugggg

SEQ ID NO: 91884 - RNA, 22 nt, Homo sapiens
auggcuugugacccaugcuuca

SEQ ID NO: 91885 - RNA, 22 nt, Homo sapiens
auggcuuuguguucagagcuga

SEQ ID NO: 91886 - RNA, 22 nt, Homo sapiens
auggcuuuugcccuaaauggau

SEQ ID NO: 91887 - RNA, 22 nt, Homo sapiens
augggguagguagcucggggaa

SEQ ID NO: 91888 - RNA, 17 nt, Homo sapiens
augggguuguagcccca

SEQ ID NO: 91889 - RNA, 22 nt, Homo sapiens
augggugaguaugaguugacuu

SEQ ID NO: 91890 - RNA, 22 nt, Homo sapiens
augguaagcugaaaauaucgaa

SEQ ID NO: 91891 - RNA, 20 nt, Homo sapiens
augguaguagcaccuuuaca

SEQ ID NO: 91892 - RNA, 22 nt, Homo sapiens
augguauuuugugauaccuugu

SEQ ID NO: 91893 - RNA, 22 nt, Homo sapiens
auggucccuguuccaugcuccu

SEQ ID NO: 91894 - RNA, 22 nt, Homo sapiens
augguguauugauuauugcugu

SEQ ID NO: 91895 - RNA, 22 nt, Homo sapiens
augguuuuacugcaaaauggga

SEQ ID NO: 91896 - RNA, 22 nt, Homo sapiens
auguaacacagugcggcugggc

SEQ ID NO: 91897 - RNA, 22 nt, Homo sapiens
auguaacaguauuuggagaugu

SEQ ID NO: 91898 - RNA, 21 nt, Homo sapiens
auguaacugggaaugugagag

SEQ ID NO: 91899 - RNA, 22 nt, Homo sapiens
auguaagugugcucaaauguua

SEQ ID NO: 91900 - RNA, 21 nt, Homo sapiens
auguaaugaagaagccacugg

SEQ ID NO: 91901 - RNA, 20 nt, Homo sapiens
auguaauguaugauauguac

SEQ ID NO: 91902 - RNA, 22 nt, Homo sapiens
auguaauguuaaauugcuaauu

SEQ ID NO: 91903 - RNA, 22 nt, Homo sapiens
auguaguauuaaugagagauaa

SEQ ID NO: 91904 - RNA, 22 nt, Homo sapiens
auguauggagauauuuuugguu

SEQ ID NO: 91905 - RNA, 22 nt, Homo sapiens
auguauggaguuuaggggaugg

SEQ ID NO: 91906 - RNA, 21 nt, Homo sapiens
augucauggaugacuaauuca

SEQ ID NO: 91907 - RNA, 22 nt, Homo sapiens
augucuagagcaagagaugcug

SEQ ID NO: 91908 - RNA, 22 nt, Homo sapiens
augucuggcagaagacuucuca

SEQ ID NO: 91909 - RNA, 22 nt, Homo sapiens
augucugguagccaccuggagg

SEQ ID NO: 91910 - RNA, 22 nt, Homo sapiens
augugaaugugaucggauaguc

SEQ ID NO: 91911 - RNA, 22 nt, Homo sapiens
augugacagugguuuuaagcgu

SEQ ID NO: 91912 - RNA, 22 nt, Homo sapiens
augugacugauguaaucagaca

SEQ ID NO: 91913 - RNA, 22 nt, Homo sapiens
augugaugguuaauuuuaugug

SEQ ID NO: 91914 - RNA, 21 nt, Homo sapiens
augugcacuaugucauuuaau

SEQ ID NO: 91915 - RNA, 22 nt, Homo sapiens
augugccaauuaggauuccaag

SEQ ID NO: 91916 - RNA, 22 nt, Homo sapiens
augugcuuuuuaaacagaugcu

SEQ ID NO: 91917 - RNA, 22 nt, Homo sapiens
auguggaaagcagcaugauaug

SEQ ID NO: 91918 - RNA, 22 nt, Homo sapiens
auguggcauuucucauucauuu

SEQ ID NO: 91919 - RNA, 18 nt, Homo sapiens
auguggcuuuugaaggcu

SEQ ID NO: 91920 - RNA, 22 nt, Homo sapiens
augugggaggacuuggcuguug

SEQ ID NO: 91921 - RNA, 22 nt, Homo sapiens
auguggugguagccaggacagg

SEQ ID NO: 91922 - RNA, 19 nt, Homo sapiens
augugguuagcaugacugc

SEQ ID NO: 91923 - RNA, 23 nt, Homo sapiens
augugguuuuagguguugaacug

SEQ ID NO: 91924 - RNA, 22 nt, Homo sapiens
augugugaaucccagaaccugu

SEQ ID NO: 91925 - RNA, 23 nt, Homo sapiens
augugugcuuggagagcaggaug

SEQ ID NO: 91926 - RNA, 22 nt, Homo sapiens
uccacaguaaggacccugccuu

SEQ ID NO: 91927 - RNA, 22 nt, Homo sapiens
uccacagugguugaacuaguaa

SEQ ID NO: 91928 - RNA, 22 nt, Homo sapiens
uccacagugguugaacuaguuu

SEQ ID NO: 91929 - RNA, 22 nt, Homo sapiens
uccacugagcuagaccacuugg

SEQ ID NO: 91930 - RNA, 22 nt, Homo sapiens
uccagguuucaugcucuuuauu

SEQ ID NO: 91931 - RNA, 22 nt, Homo sapiens
uccaguagaauuuuauucaaca

SEQ ID NO: 91932 - RNA, 22 nt, Homo sapiens
uccauaguacuagaaacugacc

SEQ ID NO: 91933 - RNA, 22 nt, Homo sapiens
uccaugugaaaaggucgugaua

SEQ ID NO: 91934 - RNA, 22 nt, Homo sapiens
uccauugucuagauguaacaca

SEQ ID NO: 91935 - RNA, 22 nt, Homo sapiens
uccauuuguucagcuucaggaa

SEQ ID NO: 91936 - RNA, 22 nt, Homo sapiens
ucccaagaugagaugggggcug

SEQ ID NO: 91937 - RNA, 19 nt, Homo sapiens
ucccaauguuuccaggcag

SEQ ID NO: 91938 - RNA, 22 nt, Homo sapiens
ucccaguauucauuuacagaag

SEQ ID NO: 91939 - RNA, 22 nt, Homo sapiens
ucccagucuagagccggauugg

SEQ ID NO: 91940 - RNA, 22 nt, Homo sapiens
ucccagugcuaugcaaaagccu

SEQ ID NO: 91941 - RNA, 22 nt, Homo sapiens
ucccaguguguagcuugucucu

SEQ ID NO: 91942 - RNA, 19 nt, Homo sapiens
uccccaguuuuccguucag

SEQ ID NO: 91943 - RNA, 23 nt, Homo sapiens
uccccgggagcaccagcuuguug

SEQ ID NO: 91944 - RNA, 22 nt, Homo sapiens
uccccugagaacuugcuagaaa

SEQ ID NO: 91945 - RNA, 22 nt, Homo sapiens
ucccuacuggggcacugccuag

SEQ ID NO: 91946 - RNA, 22 nt, Homo sapiens
ucccugaaaaauuggcuuaaca

SEQ ID NO: 91947 - RNA, 22 nt, Homo sapiens
ucccugaaaauuagcauuuuaa

SEQ ID NO: 91948 - RNA, 22 nt, Homo sapiens
ucccugaacacauguugagaag

SEQ ID NO: 91949 - RNA, 22 nt, Homo sapiens
ucccugagcaaaguuuucugua

SEQ ID NO: 91950 - RNA, 22 nt, Homo sapiens
ucccugguguuaguuuguucuu

SEQ ID NO: 91951 - RNA, 22 nt, Homo sapiens
ucccuguguccugggggcaccu

SEQ ID NO: 91952 - RNA, 22 nt, Homo sapiens
ucccuugagccuggcuucucac

SEQ ID NO: 91953 - RNA, 18 nt, Homo sapiens
ucccuuuguagaugaccc

SEQ ID NO: 91954 - RNA, 22 nt, Homo sapiens
uccgcagugucccucagaguga

SEQ ID NO: 91955 - RNA, 22 nt, Homo sapiens
uccggcuuuuuuuauguugaag

SEQ ID NO: 91956 - RNA, 22 nt, Homo sapiens
uccugagaauagaguugcaugu

SEQ ID NO: 91957 - RNA, 22 nt, Homo sapiens
uccugagacugaggagcuuugg

SEQ ID NO: 91958 - RNA, 22 nt, Homo sapiens
uccuguaaucccagcuaccaga

SEQ ID NO: 91959 - RNA, 22 nt, Homo sapiens
uccuucaguccaguggguuuug

SEQ ID NO: 91960 - RNA, 22 nt, Homo sapiens
uccuucaugcaucaauguaucc

SEQ ID NO: 91961 - RNA, 22 nt, Homo sapiens
uccuucauuugucaacucuagu

SEQ ID NO: 91962 - RNA, 19 nt, Homo sapiens
uccuugauugcaccacugc

SEQ ID NO: 91963 - RNA, 22 nt, Homo sapiens
uccuuggucauggaagagacag

SEQ ID NO: 91964 - RNA, 21 nt, Homo sapiens
uccuuggugaugcccugcagu

SEQ ID NO: 91965 - RNA, 22 nt, Homo sapiens
uccuuuagacugaauccugaga

SEQ ID NO: 91966 - RNA, 22 nt, Homo sapiens
uccuuuaguuaauaaagacaag

SEQ ID NO: 91967 - RNA, 22 nt, Homo sapiens
uccuuuggcuaacuuucuaagu

SEQ ID NO: 91968 - RNA, 22 nt, Homo sapiens
uccuuugguggagucuuuaggg

SEQ ID NO: 91969 - RNA, 22 nt, Homo sapiens
uccuuugguuauaggcaccucu

SEQ ID NO: 91970 - RNA, 22 nt, Homo sapiens
uccuuuguuacaguuggcucug

SEQ ID NO: 91971 - RNA, 20 nt, Homo sapiens
ucgcaccacuauacuccagc

SEQ ID NO: 91972 - RNA, 22 nt, Homo sapiens
ucgcugggaagacugaaguguc

SEQ ID NO: 91973 - RNA, 23 nt, Homo sapiens
ucgguccccuuggcugcccucgg

SEQ ID NO: 91974 - RNA, 22 nt, Homo sapiens
ucgugcaaacguaauugugguu

SEQ ID NO: 91975 - RNA, 22 nt, Homo sapiens
ucguucuugucaguuuauaaag

SEQ ID NO: 91976 - RNA, 22 nt, Homo sapiens
ucuaaagcauccagauugcuuc

SEQ ID NO: 91977 - RNA, 22 nt, Homo sapiens
ucuacccugugagggacacagu

SEQ ID NO: 91978 - RNA, 22 nt, Homo sapiens
ucuagccuaugaagcuugucca

SEQ ID NO: 91979 - RNA, 22 nt, Homo sapiens
ucuaucacagugauguuccaga

SEQ ID NO: 91980 - RNA, 22 nt, Homo sapiens
ucuauggauaaaaugcccucau

SEQ ID NO: 91981 - RNA, 22 nt, Homo sapiens
ucucacaccccucucauauacc

SEQ ID NO: 91982 - RNA, 22 nt, Homo sapiens
ucucacacugaauguguguggg

SEQ ID NO: 91983 - RNA, 22 nt, Homo sapiens
ucucagagccuaggguuuuuca

SEQ ID NO: 91984 - RNA, 22 nt, Homo sapiens
ucucagcacaaacaaaauugcu

SEQ ID NO: 91985 - RNA, 22 nt, Homo sapiens
ucucagugaauugguuuugucu

SEQ ID NO: 91986 - RNA, 22 nt, Homo sapiens
ucucaguggcacccccaacacc

SEQ ID NO: 91987 - RNA, 22 nt, Homo sapiens
ucucaguggugcuggcagggga

SEQ ID NO: 91988 - RNA, 22 nt, Homo sapiens
ucucaguuuucuggggaagaaa

SEQ ID NO: 91989 - RNA, 22 nt, Homo sapiens
ucucauagaggcagagaguaaa

SEQ ID NO: 91990 - RNA, 21 nt, Homo sapiens
ucucauuacugaugagccaga

SEQ ID NO: 91991 - RNA, 17 nt, Homo sapiens
ucucccaucccuuucuc

SEQ ID NO: 91992 - RNA, 22 nt, Homo sapiens
ucucugagaccacuccaaacuc

SEQ ID NO: 91993 - RNA, 22 nt, Homo sapiens
ucucuguuuagagccagcaauu

SEQ ID NO: 91994 - RNA, 22 nt, Homo sapiens
ucucuguuugucuguuacuggu

SEQ ID NO: 91995 - RNA, 19 nt, Homo sapiens
ucugacagccccagucaac

SEQ ID NO: 91996 - RNA, 22 nt, Homo sapiens
ucugacagugugaauauugacu

SEQ ID NO: 91997 - RNA, 22 nt, Homo sapiens
ucugacuagacaagcaguguac

SEQ ID NO: 91998 - RNA, 22 nt, Homo sapiens
ucugagacuguuucuaacaagc

SEQ ID NO: 91999 - RNA, 22 nt, Homo sapiens
ucugagaugagacuuugaauuu

SEQ ID NO: 92000 - RNA, 22 nt, Homo sapiens
ucugagcaauaaacaacauauu

SEQ ID NO: 92001 - RNA, 22 nt, Homo sapiens
ucugagucaucacaaaugaugc

SEQ ID NO: 92002 - RNA, 22 nt, Homo sapiens
ucugaguggcagaaugagcuga

SEQ ID NO: 92003 - RNA, 23 nt, Homo sapiens
ucugauguuauaaaauucuuugg

SEQ ID NO: 92004 - RNA, 20 nt, Homo sapiens
ucugauugcaacugcaugag

SEQ ID NO: 92005 - RNA, 22 nt, Homo sapiens
ucugcauaucaugcagaacuau

SEQ ID NO: 92006 - RNA, 22 nt, Homo sapiens
ucuggauuuuugaggcaauaua

SEQ ID NO: 92007 - RNA, 21 nt, Homo sapiens
ucuggccccuccaaaucucau

SEQ ID NO: 92008 - RNA, 22 nt, Homo sapiens
ucuggccuagaacaauuaauua

SEQ ID NO: 92009 - RNA, 22 nt, Homo sapiens
ucuggcuucugacuuaggggac

SEQ ID NO: 92010 - RNA, 22 nt, Homo sapiens
ucuggcuugugaacugucuucu

SEQ ID NO: 92011 - RNA, 21 nt, Homo sapiens
ucuggcuuucauuccccuucu

SEQ ID NO: 92012 - RNA, 23 nt, Homo sapiens
ucuggcuuugggaugcucaaggg

SEQ ID NO: 92013 - RNA, 22 nt, Homo sapiens
ucuggcuuuuaacaucuauaaa

SEQ ID NO: 92014 - RNA, 22 nt, Homo sapiens
ucugggguuagucaaagguaug

SEQ ID NO: 92015 - RNA, 20 nt, Homo sapiens
ucuggguuuuggccacgccc

SEQ ID NO: 92016 - RNA, 22 nt, Homo sapiens
aauaagaaguggaagggaccgg

SEQ ID NO: 92017 - RNA, 22 nt, Homo sapiens
aauagagucaggguuucaccau

SEQ ID NO: 92018 - RNA, 22 nt, Homo sapiens
aauagcauugaaucuaccaauu

SEQ ID NO: 92019 - RNA, 22 nt, Homo sapiens
aauagugcugugcagugagugg

SEQ ID NO: 92020 - RNA, 22 nt, Homo sapiens
aauaucacaguggguguacacc

SEQ ID NO: 92021 - RNA, 23 nt, Homo sapiens
aauaucacaguggguguacaccc

SEQ ID NO: 92022 - RNA, 22 nt, Homo sapiens
aauaugguuuuaugaagcaauu

SEQ ID NO: 92023 - RNA, 22 nt, Homo sapiens
aauauguccaguguuuugggag

SEQ ID NO: 92024 - RNA, 22 nt, Homo sapiens
aaucaacauuguuuuaagucaa

SEQ ID NO: 92025 - RNA, 22 nt, Homo sapiens
aaucacauuaaugcucccucag

SEQ ID NO: 92026 - RNA, 22 nt, Homo sapiens
aaucacauugaaucugcuaccu

SEQ ID NO: 92027 - RNA, 22 nt, Homo sapiens
aaucagagcccucugagcuuca

SEQ ID NO: 92028 - RNA, 22 nt, Homo sapiens
aaucagauuccagugguuggaa

SEQ ID NO: 92029 - RNA, 22 nt, Homo sapiens
aaucauauugucugccaagagg

SEQ ID NO: 92030 - RNA, 22 nt, Homo sapiens
aaucauggaguauuuguccuug

SEQ ID NO: 92031 - RNA, 16 nt, Homo sapiens
aauccauuggcccugc

SEQ ID NO: 92032 - RNA, 22 nt, Homo sapiens
aaucccuuuguccagucucuuu

SEQ ID NO: 92033 - RNA, 22 nt, Homo sapiens
aaucugucaguuuuguguuaau

SEQ ID NO: 92034 - RNA, 22 nt, Homo sapiens
aaugacagccagauucuucucu

SEQ ID NO: 92035 - RNA, 22 nt, Homo sapiens
aaugacagugcuaaagaacccu

SEQ ID NO: 92036 - RNA, 22 nt, Homo sapiens
aaugcaucuagaaaggugaauu

SEQ ID NO: 92037 - RNA, 22 nt, Homo sapiens
aauggcaagagccacagaggcg

SEQ ID NO: 92038 - RNA, 22 nt, Homo sapiens
aauggcacuuuauaaauguuaa

SEQ ID NO: 92039 - RNA, 22 nt, Homo sapiens
aauggccacugaccuguguuga

SEQ ID NO: 92040 - RNA, 22 nt, Homo sapiens
aauggccuuuuucauuauacug

SEQ ID NO: 92041 - RNA, 22 nt, Homo sapiens
aauggcucugauguuguuguga

SEQ ID NO: 92042 - RNA, 22 nt, Homo sapiens
aauggcucuguuggcccaagac

SEQ ID NO: 92043 - RNA, 22 nt, Homo sapiens
aauggcuucuuauugugguuca

SEQ ID NO: 92044 - RNA, 18 nt, Homo sapiens
aaugggacuacaaagcca

SEQ ID NO: 92045 - RNA, 22 nt, Homo sapiens
aauggguaguacugugguaaca

SEQ ID NO: 92046 - RNA, 22 nt, Homo sapiens
aaugucaucuucaguuguacag

SEQ ID NO: 92047 - RNA, 22 nt, Homo sapiens
aaugugcacuauuagggugaua

SEQ ID NO: 92048 - RNA, 22 nt, Homo sapiens
aaugugcacuuggagccuugcu

SEQ ID NO: 92049 - RNA, 22 nt, Homo sapiens
aaugugccuacagugggcuguu

SEQ ID NO: 92050 - RNA, 22 nt, Homo sapiens
aaugugcuucuggcugugguca

SEQ ID NO: 92051 - RNA, 22 nt, Homo sapiens
aauuacucgugucuuuacugcu

SEQ ID NO: 92052 - RNA, 22 nt, Homo sapiens
aauuaguaaccuaauuccaucu

SEQ ID NO: 92053 - RNA, 22 nt, Homo sapiens
aauuaguugaaagucugcuuuu

SEQ ID NO: 92054 - RNA, 22 nt, Homo sapiens
aauuaguuggcugccuaugauu

SEQ ID NO: 92055 - RNA, 22 nt, Homo sapiens
aauuaguuggcugggugcggug

SEQ ID NO: 92056 - RNA, 22 nt, Homo sapiens
aauuaguugucgugagaguggu

SEQ ID NO: 92057 - RNA, 22 nt, Homo sapiens
aauucuguauuguuuagggacu

SEQ ID NO: 92058 - RNA, 22 nt, Homo sapiens
aauugaaucaugugggcagacu

SEQ ID NO: 92059 - RNA, 22 nt, Homo sapiens
aauugcaauggacaaugcagca

SEQ ID NO: 92060 - RNA, 22 nt, Homo sapiens
aauugcaccaucuagaucaaga

SEQ ID NO: 92061 - RNA, 22 nt, Homo sapiens
aauugcauaaaauucaacucug

SEQ ID NO: 92062 - RNA, 22 nt, Homo sapiens
aauugcauaugcaguagaucua

SEQ ID NO: 92063 - RNA, 22 nt, Homo sapiens
aauuugucaccucucucccuuu

SEQ ID NO: 92064 - RNA, 17 nt, Homo sapiens
acaaauugccagcuagg

SEQ ID NO: 92065 - RNA, 22 nt, Homo sapiens
acaaccauuguaagggcuuugg

SEQ ID NO: 92066 - RNA, 22 nt, Homo sapiens
acaagacuucuuguauucuagu

SEQ ID NO: 92067 - RNA, 22 nt, Homo sapiens
acacauuagcaagugcuguuau

SEQ ID NO: 92068 - RNA, 22 nt, Homo sapiens
acacauuggcaauucuggagca

SEQ ID NO: 92069 - RNA, 22 nt, Homo sapiens
acacuauugagguuuguuugca

SEQ ID NO: 92070 - RNA, 22 nt, Homo sapiens
acacugcugaguaaauaauuuu

SEQ ID NO: 92071 - RNA, 22 nt, Homo sapiens
acacuggaggagagcuguugcu

SEQ ID NO: 92072 - RNA, 22 nt, Homo sapiens
acacuguauccuucuguccuuu

SEQ ID NO: 92073 - RNA, 22 nt, Homo sapiens
acacugucucuugcugaccaug

SEQ ID NO: 92074 - RNA, 22 nt, Homo sapiens
acacuguugacauuuuguagug

SEQ ID NO: 92075 - RNA, 22 nt, Homo sapiens
acacuguuuuguggagaaugua

SEQ ID NO: 92076 - RNA, 22 nt, Homo sapiens
acacuuucuggagcugcacaua

SEQ ID NO: 92077 - RNA, 22 nt, Homo sapiens
acagauugcugggccccagccc

SEQ ID NO: 92078 - RNA, 22 nt, Homo sapiens
acagcacugccaagugacccau

SEQ ID NO: 92079 - RNA, 19 nt, Homo sapiens
acagcugguuuugguuucu

SEQ ID NO: 92080 - RNA, 22 nt, Homo sapiens
acaggguuauuguaauaaugua

SEQ ID NO: 92081 - RNA, 22 nt, Homo sapiens
acagguacaagggauuaggaug

SEQ ID NO: 92082 - RNA, 19 nt, Homo sapiens
acaguaccuggcaugaggu

SEQ ID NO: 92083 - RNA, 22 nt, Homo sapiens
acagucacaauuuguaccuuuu

SEQ ID NO: 92084 - RNA, 22 nt, Homo sapiens
acagugcuguuguguuuucacg

SEQ ID NO: 92085 - RNA, 17 nt, Homo sapiens
acagugcuuugcuuucc

SEQ ID NO: 92086 - RNA, 22 nt, Homo sapiens
acagugcuuuuguuccucuccu

SEQ ID NO: 92087 - RNA, 22 nt, Homo sapiens
acaguguacaauagccuuuuaa

SEQ ID NO: 92088 - RNA, 22 nt, Homo sapiens
acauaguagacacugaaaauau

SEQ ID NO: 92089 - RNA, 22 nt, Homo sapiens
acauauaaggagacuagggcau

SEQ ID NO: 92090 - RNA, 22 nt, Homo sapiens
acaucuguacaguggguguggu

SEQ ID NO: 92091 - RNA, 22 nt, Homo sapiens
acauggcacugcgggcuucuug

SEQ ID NO: 92092 - RNA, 22 nt, Homo sapiens
acauggcuuaugaauuuggaga

SEQ ID NO: 92093 - RNA, 22 nt, Homo sapiens
caaauugcuuguggaggauaau

SEQ ID NO: 92094 - RNA, 20 nt, Homo sapiens
caaauugcuuucuugguuuu

SEQ ID NO: 92095 - RNA, 22 nt, Homo sapiens
caacagucagcccauccacaga

SEQ ID NO: 92096 - RNA, 22 nt, Homo sapiens
caacauccaccuccuggguuca

SEQ ID NO: 92097 - RNA, 22 nt, Homo sapiens
caacucuguaggauccaggugg

SEQ ID NO: 92098 - RNA, 22 nt, Homo sapiens
caagacuguccaacauauuggg

SEQ ID NO: 92099 - RNA, 22 nt, Homo sapiens
caagugcuacagagaaaucuuu

SEQ ID NO: 92100 - RNA, 22 nt, Homo sapiens
caagugcuuucuuggggauuua

SEQ ID NO: 92101 - RNA, 22 nt, Homo sapiens
caaguguuggcuuguauacaaa

SEQ ID NO: 92102 - RNA, 22 nt, Homo sapiens
caauacuguguugaauaagagu

SEQ ID NO: 92103 - RNA, 22 nt, Homo sapiens
caaugcauuauucucccacuuc

SEQ ID NO: 92104 - RNA, 22 nt, Homo sapiens
caauggcaaugaaauagugaga

SEQ ID NO: 92105 - RNA, 22 nt, Homo sapiens
gacccucuagauggaagcacug

SEQ ID NO: 92106 - RNA, 22 nt, Homo sapiens
gaccuaggaggauugcuugagc

SEQ ID NO: 92107 - RNA, 22 nt, Homo sapiens
gaccuggugguccacccgccuu

SEQ ID NO: 92108 - RNA, 22 nt, Homo sapiens
gacgauaucaaggaaaugaagu

SEQ ID NO: 92109 - RNA, 22 nt, Homo sapiens
gacuagaaauuauuuagugagc

SEQ ID NO: 92110 - RNA, 22 nt, Homo sapiens
gacuagaggcaggcaccgcugc

SEQ ID NO: 92111 - RNA, 22 nt, Homo sapiens
gacuauaucaggaauggggauu

SEQ ID NO: 92112 - RNA, 22 nt, Homo sapiens
gacucagucuuggauuuuuaau

SEQ ID NO: 92113 - RNA, 19 nt, Homo sapiens
gacuccagaguugugugcu

SEQ ID NO: 92114 - RNA, 18 nt, Homo sapiens
gacuccauuucagccaga

SEQ ID NO: 92115 - RNA, 22 nt, Homo sapiens
gacugaguaagcagaagcaauu

SEQ ID NO: 92116 - RNA, 22 nt, Homo sapiens
gacuuagaauuuuugccugcua

SEQ ID NO: 92117 - RNA, 22 nt, Homo sapiens
gacuuugguaaacucgguggca

SEQ ID NO: 92118 - RNA, 22 nt, Homo sapiens
gagaacagagauaauuuuacuu

SEQ ID NO: 92119 - RNA, 22 nt, Homo sapiens
gagaacuggcgugaacugcacg

SEQ ID NO: 92120 - RNA, 22 nt, Homo sapiens
gagaaugaacagacugccucuu

SEQ ID NO: 92121 - RNA, 22 nt, Homo sapiens
gagaaugagaggggaaggccac

SEQ ID NO: 92122 - RNA, 22 nt, Homo sapiens
gagaaugaugauuuccaauuuc

SEQ ID NO: 92123 - RNA, 22 nt, Homo sapiens
gagacauguuugcuuaucugag

SEQ ID NO: 92124 - RNA, 22 nt, Homo sapiens
gagaccauuuacugccuacuua

SEQ ID NO: 92125 - RNA, 22 nt, Homo sapiens
gagacuaaagagcuugcccugg

SEQ ID NO: 92126 - RNA, 22 nt, Homo sapiens
gagacugagucuugcccuguca

SEQ ID NO: 92127 - RNA, 22 nt, Homo sapiens
gagacugagucuugcucuguca

SEQ ID NO: 92128 - RNA, 22 nt, Homo sapiens
gagacugaguuuugcucuuguu

SEQ ID NO: 92129 - RNA, 22 nt, Homo sapiens
gagagcuaggccacuggggcuu

SEQ ID NO: 92130 - RNA, 22 nt, Homo sapiens
gagagguaguuuuuuggucguc

SEQ ID NO: 92131 - RNA, 22 nt, Homo sapiens
gagagugcuuggcaucugcuga

SEQ ID NO: 92132 - RNA, 22 nt, Homo sapiens
gagagugcuuuggguguaggcc

SEQ ID NO: 92133 - RNA, 22 nt, Homo sapiens
gagagugugucagaggcugcga

SEQ ID NO: 92134 - RNA, 22 nt, Homo sapiens
gagauaaauaggucacaguucu

SEQ ID NO: 92135 - RNA, 22 nt, Homo sapiens
gagauaauagcuauaggaucuu

SEQ ID NO: 92136 - RNA, 22 nt, Homo sapiens
gagauaauuugaaucauggggg

SEQ ID NO: 92137 - RNA, 22 nt, Homo sapiens
gagauagguauuucauuuaccc

SEQ ID NO: 92138 - RNA, 22 nt, Homo sapiens
gagaucaaugccuauggcuuuc

SEQ ID NO: 92139 - RNA, 22 nt, Homo sapiens
gagaucaaugggauggaauuga

SEQ ID NO: 92140 - RNA, 22 nt, Homo sapiens
gagaucacuguuuauauucucu

SEQ ID NO: 92141 - RNA, 22 nt, Homo sapiens
gagaucaugcugguucucucau

SEQ ID NO: 92142 - RNA, 22 nt, Homo sapiens
gagaucauuaugucagggguca

SEQ ID NO: 92143 - RNA, 22 nt, Homo sapiens
gagaugaagugucaauaaggau

SEQ ID NO: 92144 - RNA, 22 nt, Homo sapiens
gagaugaaguuaaggaucuuua

SEQ ID NO: 92145 - RNA, 22 nt, Homo sapiens
gagaugauuugccccauguauu

SEQ ID NO: 92146 - RNA, 22 nt, Homo sapiens
gagaugcaccuugucacguuuc

SEQ ID NO: 92147 - RNA, 22 nt, Homo sapiens
gagauggaguuucacuucgcuc

SEQ ID NO: 92148 - RNA, 22 nt, Homo sapiens
gagauuaacauuugaggagcug

SEQ ID NO: 92149 - RNA, 22 nt, Homo sapiens
gagauuauuagauguucugcuu

SEQ ID NO: 92150 - RNA, 22 nt, Homo sapiens
gagauuauugucucccucacca

SEQ ID NO: 92151 - RNA, 22 nt, Homo sapiens
gagcacauguggagagucuggg

SEQ ID NO: 92152 - RNA, 22 nt, Homo sapiens
gagcaucauggggccaaagcgc

SEQ ID NO: 92153 - RNA, 22 nt, Homo sapiens
gagcuacauggauagucugcau

SEQ ID NO: 92154 - RNA, 22 nt, Homo sapiens
gagcucaccuuaccucuggagc

SEQ ID NO: 92155 - RNA, 22 nt, Homo sapiens
gagcugaucuuuucugauucca

SEQ ID NO: 92156 - RNA, 20 nt, Homo sapiens
gagcugguguacugccgggc

SEQ ID NO: 92157 - RNA, 22 nt, Homo sapiens
gagcuuguagugugaaugguau

SEQ ID NO: 92158 - RNA, 22 nt, Homo sapiens
gagcuuguggucuucguguuau

SEQ ID NO: 92159 - RNA, 21 nt, Homo sapiens
gaggauauuuuuauguuugga

SEQ ID NO: 92160 - RNA, 22 nt, Homo sapiens
gaggaucucuugagcccagaag

SEQ ID NO: 92161 - RNA, 22 nt, Homo sapiens
gaggcaaguggccaccgagucu

SEQ ID NO: 92162 - RNA, 22 nt, Homo sapiens
gaggcagucugucccuuagcag

SEQ ID NO: 92163 - RNA, 22 nt, Homo sapiens
gaggcaguguguccguucucgg

SEQ ID NO: 92164 - RNA, 22 nt, Homo sapiens
gaggcauugaagauauggaagu

SEQ ID NO: 92165 - RNA, 22 nt, Homo sapiens
gagguaagagaauaaacaguuu

SEQ ID NO: 92166 - RNA, 22 nt, Homo sapiens
gagguaaguggauuaugagguc

SEQ ID NO: 92167 - RNA, 22 nt, Homo sapiens
gagguagagaguuuugauucug

SEQ ID NO: 92168 - RNA, 22 nt, Homo sapiens
gagguaggaauaaacauuugaa

SEQ ID NO: 92169 - RNA, 22 nt, Homo sapiens
gagguaggggccuuaaagaugc

SEQ ID NO: 92170 - RNA, 17 nt, Homo sapiens
gagguaguuuacuuuca

SEQ ID NO: 92171 - RNA, 22 nt, Homo sapiens
gagguaguuuaguuuuggggaa

SEQ ID NO: 92172 - RNA, 22 nt, Homo sapiens
gagguaugauugacauauaaaa

SEQ ID NO: 92173 - RNA, 22 nt, Homo sapiens
gagguaugugggcagacauuua

SEQ ID NO: 92174 - RNA, 22 nt, Homo sapiens
gaggucaggacauuuuugcuuu

SEQ ID NO: 92175 - RNA, 22 nt, Homo sapiens
gaggugguagguucacagcagc

SEQ ID NO: 92176 - RNA, 22 nt, Homo sapiens
gagguugggaugagggauacag

SEQ ID NO: 92177 - RNA, 23 nt, Homo sapiens
gaguacauuaaaagcccagacug

SEQ ID NO: 92178 - RNA, 22 nt, Homo sapiens
gaguagaacugguuaucuaaua

SEQ ID NO: 92179 - RNA, 22 nt, Homo sapiens
gaguagugcugcaauaaacaua

SEQ ID NO: 92180 - RNA, 22 nt, Homo sapiens
gagucagugucuugcucuguca

SEQ ID NO: 92181 - RNA, 22 nt, Homo sapiens
gagugcaaagguccugaggugg

SEQ ID NO: 92182 - RNA, 21 nt, Homo sapiens
gagugcaaauaaagagagggc

SEQ ID NO: 92183 - RNA, 22 nt, Homo sapiens
gagugcaauggcagaucuccgc

SEQ ID NO: 92184 - RNA, 22 nt, Homo sapiens
gagugcaauggcaugaucuggg

SEQ ID NO: 92185 - RNA, 22 nt, Homo sapiens
gagugcaauggcaugaucuugg

SEQ ID NO: 92186 - RNA, 22 nt, Homo sapiens
gagugcaauggugccaucucgg

SEQ ID NO: 92187 - RNA, 22 nt, Homo sapiens
gagugcaauggugcuaucucgg

SEQ ID NO: 92188 - RNA, 22 nt, Homo sapiens
gagugcugagcccacuuccuug

SEQ ID NO: 92189 - RNA, 21 nt, Homo sapiens
gaguggcuuuuguuucaccag

SEQ ID NO: 92190 - RNA, 22 nt, Homo sapiens
gagugguuuugauuuauagcug

SEQ ID NO: 92191 - RNA, 22 nt, Homo sapiens
gaguucaaaucucagcucuguu

SEQ ID NO: 92192 - RNA, 22 nt, Homo sapiens
gaguuuguaaacuauucacuaa

SEQ ID NO: 92193 - RNA, 22 nt, Homo sapiens
gauaaagauagcaauagggaca

SEQ ID NO: 92194 - RNA, 22 nt, Homo sapiens
gauaagagaugauuuugccaug

SEQ ID NO: 92195 - RNA, 22 nt, Homo sapiens
acccugacacgauucuucacuu

SEQ ID NO: 92196 - RNA, 22 nt, Homo sapiens
acccuggagagugcuguaguaa

SEQ ID NO: 92197 - RNA, 22 nt, Homo sapiens
acccuggaguaguaggaaucug

SEQ ID NO: 92198 - RNA, 22 nt, Homo sapiens
acccuggauucguggccuugaa

SEQ ID NO: 92199 - RNA, 22 nt, Homo sapiens
acccuguaggugcuggcagaga

SEQ ID NO: 92200 - RNA, 22 nt, Homo sapiens
acccuguaguuagaaacuuuca

SEQ ID NO: 92201 - RNA, 22 nt, Homo sapiens
acccugucaaaacggaccaauc

SEQ ID NO: 92202 - RNA, 22 nt, Homo sapiens
acccugucaaaauagaccaauc

SEQ ID NO: 92203 - RNA, 22 nt, Homo sapiens
acccugucauccacauggugcu

SEQ ID NO: 92204 - RNA, 22 nt, Homo sapiens
acccugugaauauuuaaacuuc

SEQ ID NO: 92205 - RNA, 22 nt, Homo sapiens
acccuguugagcaacuggccau

SEQ ID NO: 92206 - RNA, 18 nt, Homo sapiens
acccuucagcacugggcc

SEQ ID NO: 92207 - RNA, 22 nt, Homo sapiens
accgaguguucucccgcagcgg

SEQ ID NO: 92208 - RNA, 22 nt, Homo sapiens
accucagcccggggaaguugag

SEQ ID NO: 92209 - RNA, 23 nt, Homo sapiens
accugauguuucuguggggagcc

SEQ ID NO: 92210 - RNA, 22 nt, Homo sapiens
accugcacagccgaacauagac

SEQ ID NO: 92211 - RNA, 22 nt, Homo sapiens
accuggcacuuagcaaaucuga

SEQ ID NO: 92212 - RNA, 22 nt, Homo sapiens
accuguagcagacuuaauauuu

SEQ ID NO: 92213 - RNA, 22 nt, Homo sapiens
accuuguaucuguuaggauugc

SEQ ID NO: 92214 - RNA, 22 nt, Homo sapiens
acggcacugguggaaguguagc

SEQ ID NO: 92215 - RNA, 22 nt, Homo sapiens
acgugguaguacaguauuuuaa

SEQ ID NO: 92216 - RNA, 22 nt, Homo sapiens
acuaugcuuuucuuagaauuaa

SEQ ID NO: 92217 - RNA, 22 nt, Homo sapiens
acuccauuucauuuuagcucuu

SEQ ID NO: 92218 - RNA, 22 nt, Homo sapiens
acugacaugaucaggcauguuc

SEQ ID NO: 92219 - RNA, 21 nt, Homo sapiens
acugagagaucuggggcacau

SEQ ID NO: 92220 - RNA, 23 nt, Homo sapiens
acugagcaauguuuacauacuug

SEQ ID NO: 92221 - RNA, 21 nt, Homo sapiens
acugauguuugaaauucgcug

SEQ ID NO: 92222 - RNA, 22 nt, Homo sapiens
acugcaaugucgaauagagaug

SEQ ID NO: 92223 - RNA, 21 nt, Homo sapiens
acugcacuccaaccucaacag

SEQ ID NO: 92224 - RNA, 22 nt, Homo sapiens
acugcacuccaaccuuggugac

SEQ ID NO: 92225 - RNA, 22 nt, Homo sapiens
acugcacuccacccuuggcagc

SEQ ID NO: 92226 - RNA, 18 nt, Homo sapiens
acugcacuccaccuuggg

SEQ ID NO: 92227 - RNA, 22 nt, Homo sapiens
acugcacuccagccucaugaca

SEQ ID NO: 92228 - RNA, 22 nt, Homo sapiens
acugcacuccagccuccugaca

SEQ ID NO: 92229 - RNA, 22 nt, Homo sapiens
acugcacuccagccugaugaaa

SEQ ID NO: 92230 - RNA, 22 nt, Homo sapiens
acugcacuccagccugcugaca

SEQ ID NO: 92231 - RNA, 22 nt, Homo sapiens
acugcacuccagccugcugggu

SEQ ID NO: 92232 - RNA, 22 nt, Homo sapiens
acugcacuccagccuggaccac

SEQ ID NO: 92233 - RNA, 22 nt, Homo sapiens
acugcacuccagccuggcggac

SEQ ID NO: 92234 - RNA, 22 nt, Homo sapiens
acugcacuccagccuucaggac

SEQ ID NO: 92235 - RNA, 22 nt, Homo sapiens
acugcacuccagccuugcgaca

SEQ ID NO: 92236 - RNA, 22 nt, Homo sapiens
acugcacuccagcuuuggugac

SEQ ID NO: 92237 - RNA, 22 nt, Homo sapiens
acugcacucccgcccgggugac

SEQ ID NO: 92238 - RNA, 22 nt, Homo sapiens
acugcacuccuccuugggugac

SEQ ID NO: 92239 - RNA, 22 nt, Homo sapiens
acugcacucuagcuugggugac

SEQ ID NO: 92240 - RNA, 22 nt, Homo sapiens
acugcacuucagccuguugaca

SEQ ID NO: 92241 - RNA, 22 nt, Homo sapiens
acugcacuucagccuuggcuac

SEQ ID NO: 92242 - RNA, 20 nt, Homo sapiens
acugcauuuaguccucagga

SEQ ID NO: 92243 - RNA, 22 nt, Homo sapiens
acuggaguuuguucaagaaaua

SEQ ID NO: 92244 - RNA, 18 nt, Homo sapiens
acuggauguaaagggucc

SEQ ID NO: 92245 - RNA, 22 nt, Homo sapiens
acuggcucugcuuuacaaacag

SEQ ID NO: 92246 - RNA, 22 nt, Homo sapiens
acugggucaaaguagaaaacua

SEQ ID NO: 92247 - RNA, 22 nt, Homo sapiens
acuggguuaauuugaagguuga

SEQ ID NO: 92248 - RNA, 22 nt, Homo sapiens
acuguacuacagccugggugac

SEQ ID NO: 92249 - RNA, 22 nt, Homo sapiens
acuguacuccagccugggcaac

SEQ ID NO: 92250 - RNA, 22 nt, Homo sapiens
acuguacucuacccugggcaac

SEQ ID NO: 92251 - RNA, 22 nt, Homo sapiens
acuguguguuugucuagcacag

SEQ ID NO: 92252 - RNA, 21 nt, Homo sapiens
acuuucuguggcaguccauuc

SEQ ID NO: 92253 - RNA, 22 nt, Homo sapiens
acuuugcuuagagggcauuaaa

SEQ ID NO: 92254 - RNA, 22 nt, Homo sapiens
acuuuguguuacccagcaagga

SEQ ID NO: 92255 - RNA, 22 nt, Homo sapiens
acuuuuguuauacagugugaua

SEQ ID NO: 92256 - RNA, 20 nt, Homo sapiens
acuuuuugaugaggucguuu

SEQ ID NO: 92257 - RNA, 22 nt, Homo sapiens
acuuuuugaugaggucguuugu

SEQ ID NO: 92258 - RNA, 22 nt, Homo sapiens
acuuuuugcaaccauuuggacc

SEQ ID NO: 92259 - RNA, 21 nt, Homo sapiens
agaaaaucuuaugggaaacau

SEQ ID NO: 92260 - RNA, 22 nt, Homo sapiens
agaaccaaucccacauggauac

SEQ ID NO: 92261 - RNA, 22 nt, Homo sapiens
agaaccauuagagggagauauu

SEQ ID NO: 92262 - RNA, 22 nt, Homo sapiens
agaagaacauagggugacugaa

SEQ ID NO: 92263 - RNA, 22 nt, Homo sapiens
agaagacuauucuggguugggc

SEQ ID NO: 92264 - RNA, 22 nt, Homo sapiens
agaauaauguccccccaaggga

SEQ ID NO: 92265 - RNA, 22 nt, Homo sapiens
agaaugucaguauuggcuaaaa

SEQ ID NO: 92266 - RNA, 22 nt, Homo sapiens
agaauguuuuagaccaauacaa

SEQ ID NO: 92267 - RNA, 22 nt, Homo sapiens
agaauucugucauguuuauauu

SEQ ID NO: 92268 - RNA, 20 nt, Homo sapiens
agacagcugcagcccacauc

SEQ ID NO: 92269 - RNA, 22 nt, Homo sapiens
agacaguguguguauauauggu

SEQ ID NO: 92270 - RNA, 22 nt, Homo sapiens
agacuagagggaaaugaguugg

SEQ ID NO: 92271 - RNA, 22 nt, Homo sapiens
agacucauuuuuaucgagcaug

SEQ ID NO: 92272 - RNA, 23 nt, Homo sapiens
agacugaaguaucugagacucag

SEQ ID NO: 92273 - RNA, 22 nt, Homo sapiens
agacuguaaugcauaauuuacu

SEQ ID NO: 92274 - RNA, 22 nt, Homo sapiens
agacuuagagagucuauucuau

SEQ ID NO: 92275 - RNA, 19 nt, Homo sapiens
auaaaugccuacaagggug

SEQ ID NO: 92276 - RNA, 22 nt, Homo sapiens
ggcacuguggcucaagccugua

SEQ ID NO: 92277 - RNA, 22 nt, Homo sapiens
ggcagagucuugcaucuuuaga

SEQ ID NO: 92278 - RNA, 22 nt, Homo sapiens
ggcagcauugccuuugcaguga

SEQ ID NO: 92279 - RNA, 22 nt, Homo sapiens
ggcagcucaggccccgcgcuga

SEQ ID NO: 92280 - RNA, 22 nt, Homo sapiens
ggcaguggaagugccaguuucu

SEQ ID NO: 92281 - RNA, 22 nt, Homo sapiens
ggcaguuuguuugugaggucca

SEQ ID NO: 92282 - RNA, 22 nt, Homo sapiens
ggcaugaggccauaaaaguaag

SEQ ID NO: 92283 - RNA, 22 nt, Homo sapiens
ggcaugaugcgcacgccuguag

SEQ ID NO: 92284 - RNA, 22 nt, Homo sapiens
ggcauguauucuuauuauuccu

SEQ ID NO: 92285 - RNA, 22 nt, Homo sapiens
ggcauugaguggguaggaguca

SEQ ID NO: 92286 - RNA, 21 nt, Homo sapiens
ggcauugugcccuugcucuag

SEQ ID NO: 92287 - RNA, 22 nt, Homo sapiens
ggccagaugaucuaugaaggaa

SEQ ID NO: 92288 - RNA, 22 nt, Homo sapiens
ggccagaugcgguggcucacac

SEQ ID NO: 92289 - RNA, 22 nt, Homo sapiens
ggccggguggccauggcugccc

SEQ ID NO: 92290 - RNA, 22 nt, Homo sapiens
ggccuguaggguauugguaggg

SEQ ID NO: 92291 - RNA, 22 nt, Homo sapiens
ggcuacauuguuacaauuagua

SEQ ID NO: 92292 - RNA, 22 nt, Homo sapiens
ggcuagaauagggauagaccuu

SEQ ID NO: 92293 - RNA, 22 nt, Homo sapiens
ggcuagaugcuagagauaucau

SEQ ID NO: 92294 - RNA, 19 nt, Homo sapiens
ggcucagucaacugacugu

SEQ ID NO: 92295 - RNA, 22 nt, Homo sapiens
ggcucaguugcaaaucaguuca

SEQ ID NO: 92296 - RNA, 22 nt, Homo sapiens
ggcucguguuuucuguccaguu

SEQ ID NO: 92297 - RNA, 18 nt, Homo sapiens
ggcugguguuuuaguaua

SEQ ID NO: 92298 - RNA, 22 nt, Homo sapiens
ggcuguguguuaaaauaggcuu

SEQ ID NO: 92299 - RNA, 22 nt, Homo sapiens
ggcuuggaggaaugugagggcu

SEQ ID NO: 92300 - RNA, 22 nt, Homo sapiens
gggaaauguaaagucauaagau

SEQ ID NO: 92301 - RNA, 22 nt, Homo sapiens
gggaagaaggagugguuuacuc

SEQ ID NO: 92302 - RNA, 22 nt, Homo sapiens
gggaagauauaggcugggcacc

SEQ ID NO: 92303 - RNA, 22 nt, Homo sapiens
gggaagguaaucauuacuugau

SEQ ID NO: 92304 - RNA, 20 nt, Homo sapiens
gggaaugcaaauucucaucc

SEQ ID NO: 92305 - RNA, 22 nt, Homo sapiens
gggagugugcacacaugguaua

SEQ ID NO: 92306 - RNA, 22 nt, Homo sapiens
gggaucaacuuauacuaaaauu

SEQ ID NO: 92307 - RNA, 22 nt, Homo sapiens
gggaugaagaagaauaguucgu

SEQ ID NO: 92308 - RNA, 22 nt, Homo sapiens
gggaugaauuagguauguuuau

SEQ ID NO: 92309 - RNA, 22 nt, Homo sapiens
gggauguuuuauacugagccug

SEQ ID NO: 92310 - RNA, 22 nt, Homo sapiens
gggcaaaacuguacugccaagg

SEQ ID NO: 92311 - RNA, 22 nt, Homo sapiens
gggcaagaagucuuguaguuuu

SEQ ID NO: 92312 - RNA, 20 nt, Homo sapiens
gggcaaguaugugggaaguc

SEQ ID NO: 92313 - RNA, 22 nt, Homo sapiens
gggcaugugugugcacacacau

SEQ ID NO: 92314 - RNA, 23 nt, Homo sapiens
gggcuagaugagagcuuccuggg

SEQ ID NO: 92315 - RNA, 22 nt, Homo sapiens
ggggaauguuaaagaauuugca

SEQ ID NO: 92316 - RNA, 22 nt, Homo sapiens
gggggagugugguacccagcau

SEQ ID NO: 92317 - RNA, 22 nt, Homo sapiens
gggguuuuaccuucguauucuu

SEQ ID NO: 92318 - RNA, 22 nt, Homo sapiens
gggucaguuuugagaaagcgug

SEQ ID NO: 92319 - RNA, 22 nt, Homo sapiens
gggugguuuuaucucuucccuu

SEQ ID NO: 92320 - RNA, 22 nt, Homo sapiens
ggguucccuucuggcucagggu

SEQ ID NO: 92321 - RNA, 22 nt, Homo sapiens
gguaacaguggggcuaugcuua

SEQ ID NO: 92322 - RNA, 22 nt, Homo sapiens
gguaaguuuggggcuaauuugu

SEQ ID NO: 92323 - RNA, 17 nt, Homo sapiens
gguacguuuuguucugu

SEQ ID NO: 92324 - RNA, 22 nt, Homo sapiens
gguaggcacuggugggaagaga

SEQ ID NO: 92325 - RNA, 22 nt, Homo sapiens
gguaucuuggagagagaaguga

SEQ ID NO: 92326 - RNA, 22 nt, Homo sapiens
gguauugguugagauuaacuuu

SEQ ID NO: 92327 - RNA, 22 nt, Homo sapiens
ggucaggagaaugguaacugag

SEQ ID NO: 92328 - RNA, 22 nt, Homo sapiens
ggucaguuuucuccaggaucca

SEQ ID NO: 92329 - RNA, 19 nt, Homo sapiens
ggucauggagguuguguga

SEQ ID NO: 92330 - RNA, 22 nt, Homo sapiens
ggucauggauaagauccagaag

SEQ ID NO: 92331 - RNA, 19 nt, Homo sapiens
ggucccucucaagucauuc

SEQ ID NO: 92332 - RNA, 22 nt, Homo sapiens
ggugagaaaaacauagucucag

SEQ ID NO: 92333 - RNA, 22 nt, Homo sapiens
ggugagguaguaagguacaaua

SEQ ID NO: 92334 - RNA, 22 nt, Homo sapiens
ggugcuugaggaacggaggcug

SEQ ID NO: 92335 - RNA, 22 nt, Homo sapiens
gguguguaaauuacuuaucucu

SEQ ID NO: 92336 - RNA, 22 nt, Homo sapiens
guaaagacacaugcacacguau

SEQ ID NO: 92337 - RNA, 22 nt, Homo sapiens
guaaaugcagaugcaugaccuu

SEQ ID NO: 92338 - RNA, 22 nt, Homo sapiens
guaacacaugcugcucucuggu

SEQ ID NO: 92339 - RNA, 22 nt, Homo sapiens
guaacagucucaacaguggucu

SEQ ID NO: 92340 - RNA, 22 nt, Homo sapiens
guaacccuguaggccuaaagua

SEQ ID NO: 92341 - RNA, 22 nt, Homo sapiens
guaaggcuucuggucaacagca

SEQ ID NO: 92342 - RNA, 22 nt, Homo sapiens
guaagguuguauuucaagaaac

SEQ ID NO: 92343 - RNA, 22 nt, Homo sapiens
guaauaccuuccccugcuggag

SEQ ID NO: 92344 - RNA, 22 nt, Homo sapiens
guaauacuuuugggauauuaga

SEQ ID NO: 92345 - RNA, 22 nt, Homo sapiens
guaaucucaccuacuugggagg

SEQ ID NO: 92346 - RNA, 22 nt, Homo sapiens
guaaucucagcuacuugggagu

SEQ ID NO: 92347 - RNA, 22 nt, Homo sapiens
guaaugcacucccaaagaucca

SEQ ID NO: 92348 - RNA, 16 nt, Homo sapiens
guacacaguaaguaug

SEQ ID NO: 92349 - RNA, 22 nt, Homo sapiens
guacaggugcaggaugggcagg

SEQ ID NO: 92350 - RNA, 22 nt, Homo sapiens
guacaguauaguaauaggauuu

SEQ ID NO: 92351 - RNA, 22 nt, Homo sapiens
guacaguucucuuuguugucag

SEQ ID NO: 92352 - RNA, 22 nt, Homo sapiens
guacaugcauaguuuauuucug

SEQ ID NO: 92353 - RNA, 22 nt, Homo sapiens
guacauggaaugaaauucaaaa

SEQ ID NO: 92354 - RNA, 22 nt, Homo sapiens
guacuuuguuauaacccacagg

SEQ ID NO: 92355 - RNA, 22 nt, Homo sapiens
guagaaagcauuucagauuugc

SEQ ID NO: 92356 - RNA, 22 nt, Homo sapiens
guagaauguauguauaacgcaa

SEQ ID NO: 92357 - RNA, 22 nt, Homo sapiens
guagagagaaauacaaagcugu

SEQ ID NO: 92358 - RNA, 22 nt, Homo sapiens
guagagugcugggcacuggcuc

SEQ ID NO: 92359 - RNA, 22 nt, Homo sapiens
guagaucucaacacuggaagua

SEQ ID NO: 92360 - RNA, 22 nt, Homo sapiens
guagaugcauggauuuacuucu

SEQ ID NO: 92361 - RNA, 22 nt, Homo sapiens
guagcagaauaucagauaauuu

SEQ ID NO: 92362 - RNA, 22 nt, Homo sapiens
guagcagcaauuuacuccauac

SEQ ID NO: 92363 - RNA, 22 nt, Homo sapiens
guagcagccacacuugauaacu

SEQ ID NO: 92364 - RNA, 22 nt, Homo sapiens
guagcagucacauagcagauug

SEQ ID NO: 92365 - RNA, 22 nt, Homo sapiens
guauacaguugacccuugaacc

SEQ ID NO: 92366 - RNA, 22 nt, Homo sapiens
guauaggcuuucaccacgccau

SEQ ID NO: 92367 - RNA, 22 nt, Homo sapiens
guaugaccucgcuuuauugcag

SEQ ID NO: 92368 - RNA, 22 nt, Homo sapiens
guaugugcauuguaaauuuuga

SEQ ID NO: 92369 - RNA, 22 nt, Homo sapiens
guauugaguaaauguuuauugg

SEQ ID NO: 92370 - RNA, 22 nt, Homo sapiens
guauugcuugagcccaggaguu

SEQ ID NO: 92371 - RNA, 22 nt, Homo sapiens
guauuuuguuagggugugguau

SEQ ID NO: 92372 - RNA, 19 nt, Homo sapiens
gucaaagucgguauucaaa

SEQ ID NO: 92373 - RNA, 22 nt, Homo sapiens
gucaaagugauuguaauuaggu

SEQ ID NO: 92374 - RNA, 22 nt, Homo sapiens
gucaacauauuaauuauguucu

SEQ ID NO: 92375 - RNA, 22 nt, Homo sapiens
gucaagauuuguaggacagaga

SEQ ID NO: 92376 - RNA, 22 nt, Homo sapiens
gucaaguaaauguuaugguuau

SEQ ID NO: 92377 - RNA, 22 nt, Homo sapiens
gucacagaggcuaagaccccac

SEQ ID NO: 92378 - RNA, 22 nt, Homo sapiens
gucacagcacuuuuaguaagug

SEQ ID NO: 92379 - RNA, 22 nt, Homo sapiens
gucacagcuggcauugucugca

SEQ ID NO: 92380 - RNA, 22 nt, Homo sapiens
gucacaggaaacuaauaugcgc

SEQ ID NO: 92381 - RNA, 22 nt, Homo sapiens
gucacugacaagagagaagaac

SEQ ID NO: 92382 - RNA, 22 nt, Homo sapiens
gucacugagcaauagaaaguuu

SEQ ID NO: 92383 - RNA, 20 nt, Homo sapiens
gucacuggcccagggcuugu

SEQ ID NO: 92384 - RNA, 22 nt, Homo sapiens
gucacugugacggcaguuacau

SEQ ID NO: 92385 - RNA, 22 nt, Homo sapiens
gucagagcacugaguugugggc

SEQ ID NO: 92386 - RNA, 22 nt, Homo sapiens
gucaggugcuuacgcggagauc

SEQ ID NO: 92387 - RNA, 22 nt, Homo sapiens
gucagugcauguaaacauaaaa

SEQ ID NO: 92388 - RNA, 22 nt, Homo sapiens
gucaguggauacugucucuguc

SEQ ID NO: 92389 - RNA, 22 nt, Homo sapiens
gucauaugcucggaaaauguua

SEQ ID NO: 92390 - RNA, 22 nt, Homo sapiens
gucaugcaggguucgccagccc

SEQ ID NO: 92391 - RNA, 22 nt, Homo sapiens
gucauggaggaugaauggccaa

SEQ ID NO: 92392 - RNA, 22 nt, Homo sapiens
gucaugggguacuacacauggg

SEQ ID NO: 92393 - RNA, 22 nt, Homo sapiens
gucauggugcuagcgggaaugu

SEQ ID NO: 92394 - RNA, 22 nt, Homo sapiens
gucauguuuaacuucuugagga

SEQ ID NO: 92395 - RNA, 22 nt, Homo sapiens
gucauugaaguggaaucaucca

SEQ ID NO: 92396 - RNA, 22 nt, Homo sapiens
gucauugcacuccagccuggac

SEQ ID NO: 92397 - RNA, 22 nt, Homo sapiens
gucauugcuuaaggguucaugc

SEQ ID NO: 92398 - RNA, 22 nt, Homo sapiens
gucauugguucuguuuauguga

SEQ ID NO: 92399 - RNA, 22 nt, Homo sapiens
guccagagaagucauuacuuca

SEQ ID NO: 92400 - RNA, 18 nt, Homo sapiens
guccauuuguugguacac

SEQ ID NO: 92401 - RNA, 22 nt, Homo sapiens
gucccugcgauugugggauccu

SEQ ID NO: 92402 - RNA, 22 nt, Homo sapiens
guccuggagaagcguggaccgg

SEQ ID NO: 92403 - RNA, 22 nt, Homo sapiens
guccuguuuuuaagguucauag

SEQ ID NO: 92404 - RNA, 22 nt, Homo sapiens
guccuugaggcuuugacugugg

SEQ ID NO: 92405 - RNA, 22 nt, Homo sapiens
gucgugcagaccucacagcauu

SEQ ID NO: 92406 - RNA, 22 nt, Homo sapiens
gucguggagcucacagugugcc

SEQ ID NO: 92407 - RNA, 22 nt, Homo sapiens
gucucacagcuagcugcuuuau

SEQ ID NO: 92408 - RNA, 22 nt, Homo sapiens
gucucugagaugucaacaccua

SEQ ID NO: 92409 - RNA, 22 nt, Homo sapiens
gucucuugguuuagagcauuua

SEQ ID NO: 92410 - RNA, 22 nt, Homo sapiens
gucucuuguuaucauuucugag

SEQ ID NO: 92411 - RNA, 22 nt, Homo sapiens
gucuggagacuugggucaucaa

SEQ ID NO: 92412 - RNA, 22 nt, Homo sapiens
gucuggcuccugucuaaucacu

SEQ ID NO: 92413 - RNA, 22 nt, Homo sapiens
gucugguacuuguuuguaaggg

SEQ ID NO: 92414 - RNA, 22 nt, Homo sapiens
gucuguuugauccagaucaaaa

SEQ ID NO: 92415 - RNA, 20 nt, Homo sapiens
gucuuguagcucaaguuauu

SEQ ID NO: 92416 - RNA, 22 nt, Homo sapiens
gucuuugagauaggguuauuuu

SEQ ID NO: 92417 - RNA, 22 nt, Homo sapiens
gucuuugaugucuaugugcuuc

SEQ ID NO: 92418 - RNA, 22 nt, Homo sapiens
gucuuugcuuuuaaccagaggu

SEQ ID NO: 92419 - RNA, 22 nt, Homo sapiens
gugaaagacauauaugguuuga

SEQ ID NO: 92420 - RNA, 22 nt, Homo sapiens
gugaaagcaucugacugugcca

SEQ ID NO: 92421 - RNA, 22 nt, Homo sapiens
gugaaauauuuaacguccaggu

SEQ ID NO: 92422 - RNA, 17 nt, Homo sapiens
gugaaaucaucauuuuu

SEQ ID NO: 92423 - RNA, 22 nt, Homo sapiens
gugaaauguguagaggaucugg

SEQ ID NO: 92424 - RNA, 22 nt, Homo sapiens
gugaacagcagaugagugagug

SEQ ID NO: 92425 - RNA, 22 nt, Homo sapiens
gugaaucuguuuucuucuguuc

SEQ ID NO: 92426 - RNA, 22 nt, Homo sapiens
gugacagaguaagacccuguau

SEQ ID NO: 92427 - RNA, 22 nt, Homo sapiens
gugacaucagcuccagguauaa

SEQ ID NO: 92428 - RNA, 22 nt, Homo sapiens
gugaccaaagauagcucaaguu

SEQ ID NO: 92429 - RNA, 22 nt, Homo sapiens
gugaccucuguugcugucacua

SEQ ID NO: 92430 - RNA, 22 nt, Homo sapiens
gugacgucauuguuccuggcuc

SEQ ID NO: 92431 - RNA, 22 nt, Homo sapiens
gugacuacaggccacaguuugg

SEQ ID NO: 92432 - RNA, 22 nt, Homo sapiens
gugacugcauccauccaggcuu

SEQ ID NO: 92433 - RNA, 22 nt, Homo sapiens
gugagaagaaaaauauggcugu

SEQ ID NO: 92434 - RNA, 22 nt, Homo sapiens
gugagauaaugucucauugugg

SEQ ID NO: 92435 - RNA, 22 nt, Homo sapiens
gugagauggagucuugcuuugu

SEQ ID NO: 92436 - RNA, 22 nt, Homo sapiens
gugagaugguaucucauugugg

SEQ ID NO: 92437 - RNA, 22 nt, Homo sapiens
gugagaugugacuucugccucu

SEQ ID NO: 92438 - RNA, 22 nt, Homo sapiens
gugagauuaccauuuaaaucag

SEQ ID NO: 92439 - RNA, 22 nt, Homo sapiens
gugagauuaguucuggaccugg

SEQ ID NO: 92440 - RNA, 22 nt, Homo sapiens
gugagcaaacuuaccuaagguu

SEQ ID NO: 92441 - RNA, 22 nt, Homo sapiens
gugagcacugaaagaaggcaag

SEQ ID NO: 92442 - RNA, 22 nt, Homo sapiens
gugagcaguguccuugggggca

SEQ ID NO: 92443 - RNA, 22 nt, Homo sapiens
gugaggcacugcugcuuuccag

SEQ ID NO: 92444 - RNA, 22 nt, Homo sapiens
gugaggcugguccugccuccca

SEQ ID NO: 92445 - RNA, 22 nt, Homo sapiens
gugagguaauuagcucccuuag

SEQ ID NO: 92446 - RNA, 22 nt, Homo sapiens
gugagguagagcaugugaaaga

SEQ ID NO: 92447 - RNA, 20 nt, Homo sapiens
gugagguagaggguuaccug

SEQ ID NO: 92448 - RNA, 21 nt, Homo sapiens
gugaggucauugggcuuucug

SEQ ID NO: 92449 - RNA, 22 nt, Homo sapiens
gugaggugguacaauauuaacu

SEQ ID NO: 92450 - RNA, 22 nt, Homo sapiens
gugagucaaucugagggguuca

SEQ ID NO: 92451 - RNA, 22 nt, Homo sapiens
gugauacugaugacuuagagaa

SEQ ID NO: 92452 - RNA, 22 nt, Homo sapiens
gugauacugcuuauuaauuuaa

SEQ ID NO: 92453 - RNA, 22 nt, Homo sapiens
gugauaucugagccugccccag

SEQ ID NO: 92454 - RNA, 22 nt, Homo sapiens
gugaucauuguauugggguuau

SEQ ID NO: 92455 - RNA, 22 nt, Homo sapiens
gagcuacacugauucauuuguu

SEQ ID NO: 92456 - RNA, 22 nt, Homo sapiens
gagcuagaauauuuuguauagu

SEQ ID NO: 92457 - RNA, 22 nt, Homo sapiens
ucaccucgugaucugcccacuu

SEQ ID NO: 92458 - RNA, 22 nt, Homo sapiens
ucaccuggagacaugaagacug

SEQ ID NO: 92459 - RNA, 22 nt, Homo sapiens
ucaccuggggcacagcugaaga

SEQ ID NO: 92460 - RNA, 22 nt, Homo sapiens
ucaccuuacuugcuucugaacu

SEQ ID NO: 92461 - RNA, 22 nt, Homo sapiens
ucaccuugcacaguuguguggg

SEQ ID NO: 92462 - RNA, 22 nt, Homo sapiens
ucacgugguucauaaggcagaa

SEQ ID NO: 92463 - RNA, 22 nt, Homo sapiens
ucacuaaagaaaauggcaugga

SEQ ID NO: 92464 - RNA, 23 nt, Homo sapiens
ucacuagaguccuggaguuugag

SEQ ID NO: 92465 - RNA, 22 nt, Homo sapiens
ucacuagaucaagggagagaaa

SEQ ID NO: 92466 - RNA, 22 nt, Homo sapiens
ucacuagggagaaacugaggcu

SEQ ID NO: 92467 - RNA, 22 nt, Homo sapiens
ucacugaaaccacugccuccug

SEQ ID NO: 92468 - RNA, 22 nt, Homo sapiens
ucacugaaaccuccgccuucug

SEQ ID NO: 92469 - RNA, 22 nt, Homo sapiens
ucacugaggucugagcuuuaug

SEQ ID NO: 92470 - RNA, 21 nt, Homo sapiens
ucacugagguuaaauaggguu

SEQ ID NO: 92471 - RNA, 22 nt, Homo sapiens
ucacuggaggagaggaagugga

SEQ ID NO: 92472 - RNA, 22 nt, Homo sapiens
ucacuggcaaauauauccguug

SEQ ID NO: 92473 - RNA, 22 nt, Homo sapiens
ucacugugagaguuuauccugu

SEQ ID NO: 92474 - RNA, 22 nt, Homo sapiens
ucacugugcacauaugauaggu

SEQ ID NO: 92475 - RNA, 22 nt, Homo sapiens
ucacugugcaugaaggaugcug

SEQ ID NO: 92476 - RNA, 22 nt, Homo sapiens
ucacugugguuuugaugugcau

SEQ ID NO: 92477 - RNA, 22 nt, Homo sapiens
ucacuguugaugggcaugcagg

SEQ ID NO: 92478 - RNA, 22 nt, Homo sapiens
ucacuuuggguacuauggaaau

SEQ ID NO: 92479 - RNA, 22 nt, Homo sapiens
ucacuuuguauagcgacuggcu

SEQ ID NO: 92480 - RNA, 22 nt, Homo sapiens
ucacuuuguuuuuggauaaguu

SEQ ID NO: 92481 - RNA, 22 nt, Homo sapiens
ucagaaccucugauuuauacuu

SEQ ID NO: 92482 - RNA, 22 nt, Homo sapiens
ucagacacugagcaaacgacua

SEQ ID NO: 92483 - RNA, 22 nt, Homo sapiens
ucagaguagagcgacuucuccu

SEQ ID NO: 92484 - RNA, 22 nt, Homo sapiens
ucagaguagcugucugaggugc

SEQ ID NO: 92485 - RNA, 22 nt, Homo sapiens
ucagaguaguuccuggcagaaa

SEQ ID NO: 92486 - RNA, 22 nt, Homo sapiens
ucagaguggagucugcagccuu

SEQ ID NO: 92487 - RNA, 22 nt, Homo sapiens
ucagagugguuguaccauuuga

SEQ ID NO: 92488 - RNA, 22 nt, Homo sapiens
ucagaugcauccauaccccacu

SEQ ID NO: 92489 - RNA, 22 nt, Homo sapiens
ucagauguuugagaaguauacu

SEQ ID NO: 92490 - RNA, 22 nt, Homo sapiens
ucagauguuuuguuuaucugcu

SEQ ID NO: 92491 - RNA, 22 nt, Homo sapiens
ucagcacauucaaggccugccu

SEQ ID NO: 92492 - RNA, 22 nt, Homo sapiens
ucagcagucacuccuaugacaa

SEQ ID NO: 92493 - RNA, 20 nt, Homo sapiens
ucagcagucuggagcagagg

SEQ ID NO: 92494 - RNA, 22 nt, Homo sapiens
ucagcaguggacagaaugguag

SEQ ID NO: 92495 - RNA, 22 nt, Homo sapiens
ucagcagugugaaaacaaacua

SEQ ID NO: 92496 - RNA, 22 nt, Homo sapiens
ucagcagugugaaaauggacua

SEQ ID NO: 92497 - RNA, 22 nt, Homo sapiens
ucagcaucacaggcagugagug

SEQ ID NO: 92498 - RNA, 22 nt, Homo sapiens
ucagcgcauggucgugcggcau

SEQ ID NO: 92499 - RNA, 21 nt, Homo sapiens
ucaggaccucuaguuagccag

SEQ ID NO: 92500 - RNA, 22 nt, Homo sapiens
ucaggcaccuuccucuuaucug

SEQ ID NO: 92501 - RNA, 22 nt, Homo sapiens
ucaggcuuuucccagagugaug

SEQ ID NO: 92502 - RNA, 22 nt, Homo sapiens
ucagguagugccaugauugauu

SEQ ID NO: 92503 - RNA, 22 nt, Homo sapiens
ucagguaguuugugggagauga

SEQ ID NO: 92504 - RNA, 22 nt, Homo sapiens
ucaguaaucuuagcugugcaga

SEQ ID NO: 92505 - RNA, 22 nt, Homo sapiens
ucaguagcauugcuuauacagu

SEQ ID NO: 92506 - RNA, 22 nt, Homo sapiens
ucagucauucaauuguugaaug

SEQ ID NO: 92507 - RNA, 22 nt, Homo sapiens
ucagucuuuuuuuggcaagcau

SEQ ID NO: 92508 - RNA, 22 nt, Homo sapiens
ucagugaacgaggaggagggug

SEQ ID NO: 92509 - RNA, 22 nt, Homo sapiens
ucagugaauguuggccacuacu

SEQ ID NO: 92510 - RNA, 22 nt, Homo sapiens
ucagugacuggguauuaaauca

SEQ ID NO: 92511 - RNA, 20 nt, Homo sapiens
ucagugauugguuuaguuau

SEQ ID NO: 92512 - RNA, 17 nt, Homo sapiens
ucagugcauuuaagaga

SEQ ID NO: 92513 - RNA, 22 nt, Homo sapiens
ucagugccucaguuuuuaaaga

SEQ ID NO: 92514 - RNA, 22 nt, Homo sapiens
ucagugcgugcauagccuggau

SEQ ID NO: 92515 - RNA, 19 nt, Homo sapiens
ucagugcuauguaauguag

SEQ ID NO: 92516 - RNA, 22 nt, Homo sapiens
ucagugucaucuggguuguuug

SEQ ID NO: 92517 - RNA, 22 nt, Homo sapiens
ucagugucugcauucuuauugu

SEQ ID NO: 92518 - RNA, 23 nt, Homo sapiens
ucagugucuggauccugcucagu

SEQ ID NO: 92519 - RNA, 22 nt, Homo sapiens
ucagugucugugcaccgcugga

SEQ ID NO: 92520 - RNA, 22 nt, Homo sapiens
ucaguguuuuauccuccagagc

SEQ ID NO: 92521 - RNA, 22 nt, Homo sapiens
ucaguuuagguguaacggccac

SEQ ID NO: 92522 - RNA, 22 nt, Homo sapiens
ucauacaggccaccagggaagu

SEQ ID NO: 92523 - RNA, 20 nt, Homo sapiens
ucauagcuuuuuccacuuua

SEQ ID NO: 92524 - RNA, 22 nt, Homo sapiens
ucauaucauuagaucuacugua

SEQ ID NO: 92525 - RNA, 22 nt, Homo sapiens
ucaucaggcucauucaagcuga

SEQ ID NO: 92526 - RNA, 22 nt, Homo sapiens
ucauccauacaguuagcaaagg

SEQ ID NO: 92527 - RNA, 22 nt, Homo sapiens
ucaugacacagcauacugacuu

SEQ ID NO: 92528 - RNA, 22 nt, Homo sapiens
ucaugagacacacuggaaagga

SEQ ID NO: 92529 - RNA, 23 nt, Homo sapiens
ucaugaggccauucaaauccauu

SEQ ID NO: 92530 - RNA, 19 nt, Homo sapiens
ucauggcuuuuucagcugu

SEQ ID NO: 92531 - RNA, 22 nt, Homo sapiens
ucauggguuuugguccaagcaa

SEQ ID NO: 92532 - RNA, 22 nt, Homo sapiens
ucauguaauuuugugucuauga

SEQ ID NO: 92533 - RNA, 22 nt, Homo sapiens
ucauucauucauccagcuugag

SEQ ID NO: 92534 - RNA, 22 nt, Homo sapiens
ucauucauucuucaguggguac

SEQ ID NO: 92535 - RNA, 22 nt, Homo sapiens
ucauugcaaucucugccucccg

SEQ ID NO: 92536 - RNA, 22 nt, Homo sapiens
ucauugcacucccagacacccu

SEQ ID NO: 92537 - RNA, 22 nt, Homo sapiens
ucauugcauuccagcccaagca

SEQ ID NO: 92538 - RNA, 22 nt, Homo sapiens
ucauuggaugucugaaaugauu

SEQ ID NO: 92539 - RNA, 20 nt, Homo sapiens
uagcaggugucaggugauau

SEQ ID NO: 92540 - RNA, 22 nt, Homo sapiens
uagcaguaagaaacugacauug

SEQ ID NO: 92541 - RNA, 22 nt, Homo sapiens
uagcaguaccccaguauccugg

SEQ ID NO: 92542 - RNA, 22 nt, Homo sapiens
uagcaguagacagacuuuggcu

SEQ ID NO: 92543 - RNA, 22 nt, Homo sapiens
uagcaguaucccaccaucuggu

SEQ ID NO: 92544 - RNA, 22 nt, Homo sapiens
uagcagucaagauagucauuau

SEQ ID NO: 92545 - RNA, 22 nt, Homo sapiens
uagcagucucagaaugcauggu

SEQ ID NO: 92546 - RNA, 22 nt, Homo sapiens
uagcauaauuuguagaaaauca

SEQ ID NO: 92547 - RNA, 22 nt, Homo sapiens
uagcaucagauuccauauucua

SEQ ID NO: 92548 - RNA, 22 nt, Homo sapiens
uugagguagcuuugauggaggu

SEQ ID NO: 92549 - RNA, 22 nt, Homo sapiens
uugaggugggaggaucacuuga

SEQ ID NO: 92550 - RNA, 20 nt, Homo sapiens
uugaggugugaggggcagag

SEQ ID NO: 92551 - RNA, 22 nt, Homo sapiens
uugaguagugugaugcaugucu

SEQ ID NO: 92552 - RNA, 22 nt, Homo sapiens
uugagugaaugaaugauuaaau

SEQ ID NO: 92553 - RNA, 22 nt, Homo sapiens
uugaguuuaucuaaagaccugg

SEQ ID NO: 92554 - RNA, 22 nt, Homo sapiens
uugauagaucagggauuugauu

SEQ ID NO: 92555 - RNA, 22 nt, Homo sapiens
uugauaguaccauugggaaauu

SEQ ID NO: 92556 - RNA, 22 nt, Homo sapiens
uugauaguccuguaucuauuuu

SEQ ID NO: 92557 - RNA, 22 nt, Homo sapiens
uugauauguguauagcaugugg

SEQ ID NO: 92558 - RNA, 22 nt, Homo sapiens
uugauauguuguuagauucagu

SEQ ID NO: 92559 - RNA, 22 nt, Homo sapiens
uugaucaaaucugagugagaau

SEQ ID NO: 92560 - RNA, 22 nt, Homo sapiens
uugaucuguguuagaagcuaag

SEQ ID NO: 92561 - RNA, 22 nt, Homo sapiens
uugauguguuuccaggauuugu

SEQ ID NO: 92562 - RNA, 22 nt, Homo sapiens
uugcaaacaucuuguuucacau

SEQ ID NO: 92563 - RNA, 22 nt, Homo sapiens
uugcaacuuagaaaaaucauuu

SEQ ID NO: 92564 - RNA, 22 nt, Homo sapiens
uugcaaggugcucgaagggcuc

SEQ ID NO: 92565 - RNA, 22 nt, Homo sapiens
uugcaagugccguaacuaccaa

SEQ ID NO: 92566 - RNA, 22 nt, Homo sapiens
uugcacaauccugugagugagu

SEQ ID NO: 92567 - RNA, 22 nt, Homo sapiens
uugcacagugguuuagagccug

SEQ ID NO: 92568 - RNA, 22 nt, Homo sapiens
uugcacaguguguacagcacca

SEQ ID NO: 92569 - RNA, 22 nt, Homo sapiens
uugcaccccuacuauuugccaa

SEQ ID NO: 92570 - RNA, 22 nt, Homo sapiens
uugcacuccagccuggaugaca

SEQ ID NO: 92571 - RNA, 22 nt, Homo sapiens
uugcacuccagucuggggggca

SEQ ID NO: 92572 - RNA, 22 nt, Homo sapiens
uugcacucuagccugggugaca

SEQ ID NO: 92573 - RNA, 22 nt, Homo sapiens
uugcacuuccgccugggugaca

SEQ ID NO: 92574 - RNA, 22 nt, Homo sapiens
uugcagagccccacacugggcu

SEQ ID NO: 92575 - RNA, 22 nt, Homo sapiens
uugcagaucccacacucacccu

SEQ ID NO: 92576 - RNA, 22 nt, Homo sapiens
uugcaggcaugagccaccgugc

SEQ ID NO: 92577 - RNA, 22 nt, Homo sapiens
uugcaguacuucuggcuuuaca

SEQ ID NO: 92578 - RNA, 22 nt, Homo sapiens
uugcaguaguaacuccuuaccu

SEQ ID NO: 92579 - RNA, 22 nt, Homo sapiens
uugcauaauaagauuggggggg

SEQ ID NO: 92580 - RNA, 22 nt, Homo sapiens
uugcauagugcugagguucggg

SEQ ID NO: 92581 - RNA, 22 nt, Homo sapiens
uugcaugcacaguucucaauag

SEQ ID NO: 92582 - RNA, 22 nt, Homo sapiens
uugcaugggagcugggugaagc

SEQ ID NO: 92583 - RNA, 22 nt, Homo sapiens
uugcaugggagcugggugaggc

SEQ ID NO: 92584 - RNA, 22 nt, Homo sapiens
uugcauuagugugguacauuug

SEQ ID NO: 92585 - RNA, 22 nt, Homo sapiens
uugcauugacacaugaagcuca

SEQ ID NO: 92586 - RNA, 22 nt, Homo sapiens
uugccacuucucuugccccauu

SEQ ID NO: 92587 - RNA, 22 nt, Homo sapiens
uugccuaggcuggagugcagug

SEQ ID NO: 92588 - RNA, 22 nt, Homo sapiens
uugccuaggcuggaguguggug

SEQ ID NO: 92589 - RNA, 21 nt, Homo sapiens
uugccugacacuggaagaaau

SEQ ID NO: 92590 - RNA, 22 nt, Homo sapiens
uugcuauguugcccagucugga

SEQ ID NO: 92591 - RNA, 22 nt, Homo sapiens
uugcuggugguucgagcaacac

SEQ ID NO: 92592 - RNA, 22 nt, Homo sapiens
uugcuucuuucgucuggcccca

SEQ ID NO: 92593 - RNA, 22 nt, Homo sapiens
uuggaaaaauccaccuugaucu

SEQ ID NO: 92594 - RNA, 22 nt, Homo sapiens
uuggaaacaccuggugagguua

SEQ ID NO: 92595 - RNA, 22 nt, Homo sapiens
uuggaaaccucugcagguguuu

SEQ ID NO: 92596 - RNA, 22 nt, Homo sapiens
uuggaaagagguguuuaugacu

SEQ ID NO: 92597 - RNA, 22 nt, Homo sapiens
uuggaaauguguuugcauucag

SEQ ID NO: 92598 - RNA, 22 nt, Homo sapiens
uuggaagcacauuguuuaauua

SEQ ID NO: 92599 - RNA, 22 nt, Homo sapiens
uuggaauacucaaaagguuggg

SEQ ID NO: 92600 - RNA, 22 nt, Homo sapiens
uuggaauauaaccuguuucuaa

SEQ ID NO: 92601 - RNA, 22 nt, Homo sapiens
uuggaaugcacacugagccugc

SEQ ID NO: 92602 - RNA, 22 nt, Homo sapiens
uuggaauuaagagauauuuucu

SEQ ID NO: 92603 - RNA, 22 nt, Homo sapiens
uuggaauuuauuuggaugggag

SEQ ID NO: 92604 - RNA, 22 nt, Homo sapiens
uuggaauuuuacuucuguaaga

SEQ ID NO: 92605 - RNA, 19 nt, Homo sapiens
uuggaauuuuagaguuuga

SEQ ID NO: 92606 - RNA, 18 nt, Homo sapiens
uuggacggagagucaaau

SEQ ID NO: 92607 - RNA, 22 nt, Homo sapiens
uuggacucccuccccagcuuca

SEQ ID NO: 92608 - RNA, 22 nt, Homo sapiens
uuggacuucuaacugacaugga

SEQ ID NO: 92609 - RNA, 22 nt, Homo sapiens
uuggacuuuuauucugcaggca

SEQ ID NO: 92610 - RNA, 22 nt, Homo sapiens
uuggagagucacuaguuagugc

SEQ ID NO: 92611 - RNA, 22 nt, Homo sapiens
uuggaugauaaagaagccuaag

SEQ ID NO: 92612 - RNA, 22 nt, Homo sapiens
uuggauggucuuuauauaguau

SEQ ID NO: 92613 - RNA, 22 nt, Homo sapiens
uuggcaaaugucacaaaucagg

SEQ ID NO: 92614 - RNA, 22 nt, Homo sapiens
uuggcaacauagugagaccccc

SEQ ID NO: 92615 - RNA, 22 nt, Homo sapiens
uuggcaagaaccuucuuccaag

SEQ ID NO: 92616 - RNA, 22 nt, Homo sapiens
uuggcaagaauguaugccgauc

SEQ ID NO: 92617 - RNA, 22 nt, Homo sapiens
uuggcaaguccccaccucucuc

SEQ ID NO: 92618 - RNA, 22 nt, Homo sapiens
uuggcaauucagauucuuuuau

SEQ ID NO: 92619 - RNA, 22 nt, Homo sapiens
uuggcacugggaaaaugaccac

SEQ ID NO: 92620 - RNA, 19 nt, Homo sapiens
uuggcagaguugcccccua

SEQ ID NO: 92621 - RNA, 22 nt, Homo sapiens
uuggcagcauuccagccaagca

SEQ ID NO: 92622 - RNA, 22 nt, Homo sapiens
uuggcagucugaggcacagacu

SEQ ID NO: 92623 - RNA, 23 nt, Homo sapiens
uuggcaucugggacacaagcuga

SEQ ID NO: 92624 - RNA, 22 nt, Homo sapiens
uuggcauuuuggacacccagga

SEQ ID NO: 92625 - RNA, 22 nt, Homo sapiens
uuggcauuuuuagucaugggaa

SEQ ID NO: 92626 - RNA, 22 nt, Homo sapiens
uuggccauggagcacuuuucua

SEQ ID NO: 92627 - RNA, 22 nt, Homo sapiens
uuggccccuuucauccacagcu

SEQ ID NO: 92628 - RNA, 19 nt, Homo sapiens
uuggcccugguucucuucu

SEQ ID NO: 92629 - RNA, 22 nt, Homo sapiens
uuggccuccuggucauauccag

SEQ ID NO: 92630 - RNA, 22 nt, Homo sapiens
gagcaguugagagugcuggcca

SEQ ID NO: 92631 - RNA, 22 nt, Homo sapiens
gagcaucaguggccucaucuca

SEQ ID NO: 92632 - RNA, 22 nt, Homo sapiens
gagcaucauucaacaaaagucu

SEQ ID NO: 92633 - RNA, 22 nt, Homo sapiens
gagcccauuucacuuguccagc

SEQ ID NO: 92634 - RNA, 22 nt, Homo sapiens
gagcuaguagauuuuaaauauu

SEQ ID NO: 92635 - RNA, 22 nt, Homo sapiens
gagcuaguguaauauuuugggg

SEQ ID NO: 92636 - RNA, 20 nt, Homo sapiens
gagcucaucuucuuuaccac

SEQ ID NO: 92637 - RNA, 22 nt, Homo sapiens
gagcucauuaaaguaggaccua

SEQ ID NO: 92638 - RNA, 22 nt, Homo sapiens
gagcuccuccccuuggcuuuca

SEQ ID NO: 92639 - RNA, 22 nt, Homo sapiens
gagcugccuugccuaugcaaga

SEQ ID NO: 92640 - RNA, 22 nt, Homo sapiens
gagcugguccuuuaaggaugca

SEQ ID NO: 92641 - RNA, 22 nt, Homo sapiens
gagcuuggguuaaaguugccuu

SEQ ID NO: 92642 - RNA, 22 nt, Homo sapiens
gaggaguagggcacaaagccuu

SEQ ID NO: 92643 - RNA, 22 nt, Homo sapiens
gaggcaauaugagggaggcuuc

SEQ ID NO: 92644 - RNA, 22 nt, Homo sapiens
gaggcacucuguacaaaucugc

SEQ ID NO: 92645 - RNA, 22 nt, Homo sapiens
gaggcagucugacccuuagcag

SEQ ID NO: 92646 - RNA, 22 nt, Homo sapiens
gagggcacugcuuuccuuucaa

SEQ ID NO: 92647 - RNA, 22 nt, Homo sapiens
gagguagggucccacuauguug

SEQ ID NO: 92648 - RNA, 22 nt, Homo sapiens
gagguagguacaauugccacca

SEQ ID NO: 92649 - RNA, 22 nt, Homo sapiens
gagguaguuaaugcauucacua

SEQ ID NO: 92650 - RNA, 22 nt, Homo sapiens
gagguauaauugacaagcaaaa

SEQ ID NO: 92651 - RNA, 22 nt, Homo sapiens
gaggucaugucgggccccagga

SEQ ID NO: 92652 - RNA, 22 nt, Homo sapiens
gaggucuuacauuuuaauauuu

SEQ ID NO: 92653 - RNA, 22 nt, Homo sapiens
gagguggugguggaggcauagc

SEQ ID NO: 92654 - RNA, 22 nt, Homo sapiens
gagguguaaggacaacagagac

SEQ ID NO: 92655 - RNA, 22 nt, Homo sapiens
gagguguagagauauaccugaa

SEQ ID NO: 92656 - RNA, 22 nt, Homo sapiens
gagguuuuagugagucccacug

SEQ ID NO: 92657 - RNA, 22 nt, Homo sapiens
gaguagugcugcaguaaacaua

SEQ ID NO: 92658 - RNA, 22 nt, Homo sapiens
gaguaucuuuaaggugguuugg

SEQ ID NO: 92659 - RNA, 22 nt, Homo sapiens
gagugcaauggcaagaucuugg

SEQ ID NO: 92660 - RNA, 22 nt, Homo sapiens
gagugcaauggcaccgucucgg

SEQ ID NO: 92661 - RNA, 22 nt, Homo sapiens
gagugcaauggcgcgaucucgg

SEQ ID NO: 92662 - RNA, 22 nt, Homo sapiens
gagugcuguuagcccuggguuu

SEQ ID NO: 92663 - RNA, 22 nt, Homo sapiens
gagugguaguuucuagaggugu

SEQ ID NO: 92664 - RNA, 22 nt, Homo sapiens
gaguuguuuuaaggcacugacu

SEQ ID NO: 92665 - RNA, 22 nt, Homo sapiens
gauaauucuagcagauacaggc

SEQ ID NO: 92666 - RNA, 22 nt, Homo sapiens
gauagugaaccaagggguaauu

SEQ ID NO: 92667 - RNA, 22 nt, Homo sapiens
gauauguaaaaauuauaucuga

SEQ ID NO: 92668 - RNA, 22 nt, Homo sapiens
gauauguguaucuauguacaug

SEQ ID NO: 92669 - RNA, 22 nt, Homo sapiens
gauauguucugagaaaugcauu

SEQ ID NO: 92670 - RNA, 17 nt, Homo sapiens
gaucacagucgucuccu

SEQ ID NO: 92671 - RNA, 22 nt, Homo sapiens
gaucaguuucuggagauacgua

SEQ ID NO: 92672 - RNA, 22 nt, Homo sapiens
gaucugucuuuccuuauagucu

SEQ ID NO: 92673 - RNA, 22 nt, Homo sapiens
gaucuguuguuuggaaguauca

SEQ ID NO: 92674 - RNA, 22 nt, Homo sapiens
gaugaacugucuuacuacucac

SEQ ID NO: 92675 - RNA, 22 nt, Homo sapiens
gaugagauguucucauggauug

SEQ ID NO: 92676 - RNA, 22 nt, Homo sapiens
gaugagguaggccugcuuugaa

SEQ ID NO: 92677 - RNA, 22 nt, Homo sapiens
gaugagguaguguaccuagucu

SEQ ID NO: 92678 - RNA, 22 nt, Homo sapiens
gaugauguugaauguucucacc

SEQ ID NO: 92679 - RNA, 22 nt, Homo sapiens
gaugauguuggaaacuuggugc

SEQ ID NO: 92680 - RNA, 22 nt, Homo sapiens
gaugauguuugauaaauaauaa

SEQ ID NO: 92681 - RNA, 22 nt, Homo sapiens
gaugccuuuuuguccucaguua

SEQ ID NO: 92682 - RNA, 22 nt, Homo sapiens
gauggauuuuuuaggcagagcu

SEQ ID NO: 92683 - RNA, 22 nt, Homo sapiens
gauggcauuucuggaucugaca

SEQ ID NO: 92684 - RNA, 19 nt, Homo sapiens
uggaacugauucaguucug

SEQ ID NO: 92685 - RNA, 20 nt, Homo sapiens
uggaacuuaauugauggaca

SEQ ID NO: 92686 - RNA, 22 nt, Homo sapiens
uggaagacacauaccugauaac

SEQ ID NO: 92687 - RNA, 22 nt, Homo sapiens
uggaagacauugggugaagggu

SEQ ID NO: 92688 - RNA, 22 nt, Homo sapiens
uggaagacauuuuggaccuugg

SEQ ID NO: 92689 - RNA, 22 nt, Homo sapiens
uggaagacuuuagaggcuuaua

SEQ ID NO: 92690 - RNA, 22 nt, Homo sapiens
uggaagauuacuuuuuguugaa

SEQ ID NO: 92691 - RNA, 20 nt, Homo sapiens
uggaagccuggugcuaucuu

SEQ ID NO: 92692 - RNA, 23 nt, Homo sapiens
uggaaguauggaggaggcagaau

SEQ ID NO: 92693 - RNA, 22 nt, Homo sapiens
uggaagucaugcugcaagaaca

SEQ ID NO: 92694 - RNA, 22 nt, Homo sapiens
uggaagucuauggcauuugagu

SEQ ID NO: 92695 - RNA, 22 nt, Homo sapiens
uggaagugaacaaccaaggcag

SEQ ID NO: 92696 - RNA, 22 nt, Homo sapiens
uggaaguuaaaugacucuuucu

SEQ ID NO: 92697 - RNA, 22 nt, Homo sapiens
uggaauacuauucugugcugga

SEQ ID NO: 92698 - RNA, 22 nt, Homo sapiens
uggaauaugagacgggguuguc

SEQ ID NO: 92699 - RNA, 21 nt, Homo sapiens
uggaaucuauuauuccaguuu

SEQ ID NO: 92700 - RNA, 20 nt, Homo sapiens
uggaaugcagccuccuucug

SEQ ID NO: 92701 - RNA, 22 nt, Homo sapiens
uggaaugcucuccccacggacu

SEQ ID NO: 92702 - RNA, 22 nt, Homo sapiens
uggaaugguaucuuguuggggu

SEQ ID NO: 92703 - RNA, 17 nt, Homo sapiens
uggaaugucuaagccug

SEQ ID NO: 92704 - RNA, 21 nt, Homo sapiens
uggaauguucugacuucaggg

SEQ ID NO: 92705 - RNA, 18 nt, Homo sapiens
uggacagugauuauccau

SEQ ID NO: 92706 - RNA, 22 nt, Homo sapiens
uggacaugaagggcacaggagg

SEQ ID NO: 92707 - RNA, 22 nt, Homo sapiens
uggaccccugcucgggagcccu

SEQ ID NO: 92708 - RNA, 22 nt, Homo sapiens
uggaccccuucuccuauuaaaa

SEQ ID NO: 92709 - RNA, 22 nt, Homo sapiens
uggacuaaagaaacauuccgug

SEQ ID NO: 92710 - RNA, 22 nt, Homo sapiens
uggacuagagggugggcgaggu

SEQ ID NO: 92711 - RNA, 22 nt, Homo sapiens
uggacuguaaauuggggacucu

SEQ ID NO: 92712 - RNA, 22 nt, Homo sapiens
uggacuguaagugccuugagua

SEQ ID NO: 92713 - RNA, 22 nt, Homo sapiens
uggacuguaauagagaacagaa

SEQ ID NO: 92714 - RNA, 22 nt, Homo sapiens
uggagaacauucauuugcaaga

SEQ ID NO: 92715 - RNA, 22 nt, Homo sapiens
uggagagugauaaguaaaugga

SEQ ID NO: 92716 - RNA, 22 nt, Homo sapiens
uggagguagacauugggaagag

SEQ ID NO: 92717 - RNA, 22 nt, Homo sapiens
uggagguaggacgaagaacucu

SEQ ID NO: 92718 - RNA, 22 nt, Homo sapiens
uggagguagggccuaggaaucu

SEQ ID NO: 92719 - RNA, 22 nt, Homo sapiens
uggaguauuauguaauuucaau

SEQ ID NO: 92720 - RNA, 16 nt, Homo sapiens
uggagucauccuugac

SEQ ID NO: 92721 - RNA, 22 nt, Homo sapiens
uggagucuugcucuguugccca

SEQ ID NO: 92722 - RNA, 22 nt, Homo sapiens
uggagugaaaacacacuaaucu

SEQ ID NO: 92723 - RNA, 21 nt, Homo sapiens
uggagugaagaguuuauugac

SEQ ID NO: 92724 - RNA, 20 nt, Homo sapiens
uggagugaagguucuggacc

SEQ ID NO: 92725 - RNA, 22 nt, Homo sapiens
uggagugauaugguuauauggg

SEQ ID NO: 92726 - RNA, 21 nt, Homo sapiens
uggagugcaacacuagguaua

SEQ ID NO: 92727 - RNA, 22 nt, Homo sapiens
uggaguguagcggcaccuauua

SEQ ID NO: 92728 - RNA, 22 nt, Homo sapiens
uggaguguguuaacuuuacaag

SEQ ID NO: 92729 - RNA, 20 nt, Homo sapiens
uggaguuguggcaguuugga

SEQ ID NO: 92730 - RNA, 22 nt, Homo sapiens
uggauagaacuaagugcuuaga

SEQ ID NO: 92731 - RNA, 22 nt, Homo sapiens
uggauaguaauaaacauauagg

SEQ ID NO: 92732 - RNA, 22 nt, Homo sapiens
uggauagugauaagguagauga

SEQ ID NO: 92733 - RNA, 19 nt, Homo sapiens
uggaugacugucugggucu

SEQ ID NO: 92734 - RNA, 22 nt, Homo sapiens
uggaugacuguuauaugcauau

SEQ ID NO: 92735 - RNA, 22 nt, Homo sapiens
uggauggucagaggguuucugu

SEQ ID NO: 92736 - RNA, 22 nt, Homo sapiens
uggauguacagucaguauuugu

SEQ ID NO: 92737 - RNA, 21 nt, Homo sapiens
uggauugagaaccccaggagg

SEQ ID NO: 92738 - RNA, 18 nt, Homo sapiens
uggauuggaaaaguuccu

SEQ ID NO: 92739 - RNA, 22 nt, Homo sapiens
uggauuguaacauagaguaaau

SEQ ID NO: 92740 - RNA, 18 nt, Homo sapiens
uggauuguacuguguucu

SEQ ID NO: 92741 - RNA, 19 nt, Homo sapiens
uggauuguuagagcagugu

SEQ ID NO: 92742 - RNA, 22 nt, Homo sapiens
uggcaaaaaaacgcaauuacgu

SEQ ID NO: 92743 - RNA, 22 nt, Homo sapiens
ugaguucuuuuacauuuugaau

SEQ ID NO: 92744 - RNA, 22 nt, Homo sapiens
ugauaagaaauuguucauguag

SEQ ID NO: 92745 - RNA, 22 nt, Homo sapiens
ugauauauugaaugaugaaaca

SEQ ID NO: 92746 - RNA, 22 nt, Homo sapiens
ugauaucugaucauccuugaua

SEQ ID NO: 92747 - RNA, 22 nt, Homo sapiens
ugauaugaaguucaaaccaggu

SEQ ID NO: 92748 - RNA, 22 nt, Homo sapiens
ugauaugaucgcccuagcuuga

SEQ ID NO: 92749 - RNA, 21 nt, Homo sapiens
ugauaugguuuggauaugugu

SEQ ID NO: 92750 - RNA, 22 nt, Homo sapiens
ugauauguuagaaucuugcaag

SEQ ID NO: 92751 - RNA, 22 nt, Homo sapiens
ugauccccucacauuauuauau

SEQ ID NO: 92752 - RNA, 22 nt, Homo sapiens
ugaucucagcucacugguugaa

SEQ ID NO: 92753 - RNA, 22 nt, Homo sapiens
ugaucugucacuuaucacauuu

SEQ ID NO: 92754 - RNA, 22 nt, Homo sapiens
ugaucuguguauauugaaccag

SEQ ID NO: 92755 - RNA, 22 nt, Homo sapiens
ugaugaaguauaggaagggcuu

SEQ ID NO: 92756 - RNA, 22 nt, Homo sapiens
ugaugacacugauuucuucaau

SEQ ID NO: 92757 - RNA, 22 nt, Homo sapiens
ugaugacucuguggccccaggc

SEQ ID NO: 92758 - RNA, 20 nt, Homo sapiens
ugaugcaaaucuuuaaaagu

SEQ ID NO: 92759 - RNA, 22 nt, Homo sapiens
ugaugcugaugccugccagaag

SEQ ID NO: 92760 - RNA, 22 nt, Homo sapiens
ugaugucuugagauggagcuua

SEQ ID NO: 92761 - RNA, 22 nt, Homo sapiens
ugaugugucaucugagagagug

SEQ ID NO: 92762 - RNA, 22 nt, Homo sapiens
ugauguguuuuguaguucaacu

SEQ ID NO: 92763 - RNA, 21 nt, Homo sapiens
ugauguugaccuaaguaguga

SEQ ID NO: 92764 - RNA, 22 nt, Homo sapiens
ugauugcacaccugcacucaag

SEQ ID NO: 92765 - RNA, 22 nt, Homo sapiens
ugauuggagaacaaacugcaua

SEQ ID NO: 92766 - RNA, 22 nt, Homo sapiens
ugauuuguccauguggcacgug

SEQ ID NO: 92767 - RNA, 22 nt, Homo sapiens
ugauuugucucucagcccuacu

SEQ ID NO: 92768 - RNA, 22 nt, Homo sapiens
ugauuuguuucaggaguuuucu

SEQ ID NO: 92769 - RNA, 18 nt, Homo sapiens
ugcaaacauguguguguu

SEQ ID NO: 92770 - RNA, 22 nt, Homo sapiens
ugcaaaugucaaggguuagugu

SEQ ID NO: 92771 - RNA, 22 nt, Homo sapiens
ugcaaauguuaggugucauuau

SEQ ID NO: 92772 - RNA, 19 nt, Homo sapiens
ugcaaauucuaaaaacuga

SEQ ID NO: 92773 - RNA, 22 nt, Homo sapiens
ugcaagaaacauauuccacaag

SEQ ID NO: 92774 - RNA, 22 nt, Homo sapiens
ugcaaguggauuuuuccccaga

SEQ ID NO: 92775 - RNA, 22 nt, Homo sapiens
ugcaauauccucuacuauaggu

SEQ ID NO: 92776 - RNA, 18 nt, Homo sapiens
ugcaauggagaugcagcc

SEQ ID NO: 92777 - RNA, 22 nt, Homo sapiens
ugcaccacugcacuccacccug

SEQ ID NO: 92778 - RNA, 22 nt, Homo sapiens
ugcaccacugcacuccaggcug

SEQ ID NO: 92779 - RNA, 22 nt, Homo sapiens
ugcaccacugcuagccugggua

SEQ ID NO: 92780 - RNA, 22 nt, Homo sapiens
ugcaccauuacacuccaggcug

SEQ ID NO: 92781 - RNA, 22 nt, Homo sapiens
ugcaccauugcauuccagccug

SEQ ID NO: 92782 - RNA, 22 nt, Homo sapiens
ugcacuguggucugagagacag

SEQ ID NO: 92783 - RNA, 22 nt, Homo sapiens
ugcagagucuguccugccugcc

SEQ ID NO: 92784 - RNA, 17 nt, Homo sapiens
ugcagcacacugauggg

SEQ ID NO: 92785 - RNA, 22 nt, Homo sapiens
ugcagcacuguucacaauagcc

SEQ ID NO: 92786 - RNA, 22 nt, Homo sapiens
ugcagcucaaauuccuaacaag

SEQ ID NO: 92787 - RNA, 18 nt, Homo sapiens
ugcagcuuugugauuggc

SEQ ID NO: 92788 - RNA, 23 nt, Homo sapiens
ugcaguagugagaucuaggcuca

SEQ ID NO: 92789 - RNA, 22 nt, Homo sapiens
ugcagugugcuggggucuccau

SEQ ID NO: 92790 - RNA, 18 nt, Homo sapiens
ugcauacuaucugauuuu

SEQ ID NO: 92791 - RNA, 22 nt, Homo sapiens
ugcauaggcuaaaauccuggcc

SEQ ID NO: 92792 - RNA, 22 nt, Homo sapiens
ugcauauguugaaccaggcuug

SEQ ID NO: 92793 - RNA, 22 nt, Homo sapiens
ugcauauucaaggcaggccauu

SEQ ID NO: 92794 - RNA, 22 nt, Homo sapiens
ugcauauucgaguuauuuuggg

SEQ ID NO: 92795 - RNA, 22 nt, Homo sapiens
ugcauauucuaggauuuuguau

SEQ ID NO: 92796 - RNA, 22 nt, Homo sapiens
ugcaucacaguacuccagccug

SEQ ID NO: 92797 - RNA, 22 nt, Homo sapiens
ugcaugaugcugagauuuggga

SEQ ID NO: 92798 - RNA, 22 nt, Homo sapiens
ugcauggagcucucuuuggacu

SEQ ID NO: 92799 - RNA, 22 nt, Homo sapiens
ugcauuaguaaguaauuuuaau

SEQ ID NO: 92800 - RNA, 22 nt, Homo sapiens
ugcauuguaggauguuuagcag

SEQ ID NO: 92801 - RNA, 22 nt, Homo sapiens
ugcauuguggaucuaaaugcau

SEQ ID NO: 92802 - RNA, 22 nt, Homo sapiens
ugcauuguuccgaauguguccu

SEQ ID NO: 92803 - RNA, 21 nt, Homo sapiens
ugcauuguugcugagagcagg

SEQ ID NO: 92804 - RNA, 22 nt, Homo sapiens
ugcauuguuuagaaacacuggg

SEQ ID NO: 92805 - RNA, 22 nt, Homo sapiens
ugccaguguugccuuucacuag

SEQ ID NO: 92806 - RNA, 22 nt, Homo sapiens
ugagauaauuuacuuguugagg

SEQ ID NO: 92807 - RNA, 22 nt, Homo sapiens
ugagauauugggaguaauguca

SEQ ID NO: 92808 - RNA, 22 nt, Homo sapiens
ugagaucaagauguuagggacu

SEQ ID NO: 92809 - RNA, 22 nt, Homo sapiens
ugagaucaaggugggcccuggg

SEQ ID NO: 92810 - RNA, 18 nt, Homo sapiens
ugagaucagcaucaaggg

SEQ ID NO: 92811 - RNA, 22 nt, Homo sapiens
ugagaucaguuguuauaauucu

SEQ ID NO: 92812 - RNA, 22 nt, Homo sapiens
ugagaucaugccacugcacuuc

SEQ ID NO: 92813 - RNA, 22 nt, Homo sapiens
ugagaucgaguaucgcugucac

SEQ ID NO: 92814 - RNA, 22 nt, Homo sapiens
ugagaucuucgcucuucacaga

SEQ ID NO: 92815 - RNA, 22 nt, Homo sapiens
ugagaucuuggaggcuuuguga

SEQ ID NO: 92816 - RNA, 19 nt, Homo sapiens
ugagaucuuuacuggguuu

SEQ ID NO: 92817 - RNA, 22 nt, Homo sapiens
ugagaucuuuuguggcugagaa

SEQ ID NO: 92818 - RNA, 22 nt, Homo sapiens
ugagaugaagucucacucuguc

SEQ ID NO: 92819 - RNA, 22 nt, Homo sapiens
ugagaugaagugauguaaaaca

SEQ ID NO: 92820 - RNA, 22 nt, Homo sapiens
ugagaugacgacacaccucagu

SEQ ID NO: 92821 - RNA, 22 nt, Homo sapiens
ugagaugauagauauguuaauu

SEQ ID NO: 92822 - RNA, 22 nt, Homo sapiens
ugagaugauuuaauggagccca

SEQ ID NO: 92823 - RNA, 22 nt, Homo sapiens
ugagauggaguuucgcccuugu

SEQ ID NO: 92824 - RNA, 22 nt, Homo sapiens
ugagauggaguuucgcuuuugu

SEQ ID NO: 92825 - RNA, 22 nt, Homo sapiens
ugagauggaucuuggauuugaa

SEQ ID NO: 92826 - RNA, 22 nt, Homo sapiens
ugagaugguaaauuuuuguugu

SEQ ID NO: 92827 - RNA, 22 nt, Homo sapiens
ugagauguaaucucgcucuguc

SEQ ID NO: 92828 - RNA, 22 nt, Homo sapiens
ugagaugugugcauucaacuca

SEQ ID NO: 92829 - RNA, 22 nt, Homo sapiens
ugagauguuccaaugacuauua

SEQ ID NO: 92830 - RNA, 22 nt, Homo sapiens
ugagauguugcucugaaacaag

SEQ ID NO: 92831 - RNA, 22 nt, Homo sapiens
ugagauguuuagauuguugucu

SEQ ID NO: 92832 - RNA, 22 nt, Homo sapiens
ugagauuaaucuuuaaguaaga

SEQ ID NO: 92833 - RNA, 22 nt, Homo sapiens
ugagauuauauuucuuaacaga

SEQ ID NO: 92834 - RNA, 19 nt, Homo sapiens
ugagauuguaugaggagau

SEQ ID NO: 92835 - RNA, 22 nt, Homo sapiens
ugagcagugagugugcugcagg

SEQ ID NO: 92836 - RNA, 22 nt, Homo sapiens
ugagcauuguuuggacuuggau

SEQ ID NO: 92837 - RNA, 22 nt, Homo sapiens
ugagccaaugauuugaauagag

SEQ ID NO: 92838 - RNA, 22 nt, Homo sapiens
ugagccaugguuagcuucucau

SEQ ID NO: 92839 - RNA, 20 nt, Homo sapiens
ugagccccuggacucaagcg

SEQ ID NO: 92840 - RNA, 22 nt, Homo sapiens
ugagcuaagugccaauauuaau

SEQ ID NO: 92841 - RNA, 22 nt, Homo sapiens
ugagcuacuacacccagcuugg

SEQ ID NO: 92842 - RNA, 22 nt, Homo sapiens
ugagcuaggauccugucacugu

SEQ ID NO: 92843 - RNA, 20 nt, Homo sapiens
ugagcucaauuguugcaagu

SEQ ID NO: 92844 - RNA, 22 nt, Homo sapiens
ugagcucagcuuucuuuuucac

SEQ ID NO: 92845 - RNA, 22 nt, Homo sapiens
ugagcucaguauuucauaaaca

SEQ ID NO: 92846 - RNA, 22 nt, Homo sapiens
ugagcugagaucaugcuauugu

SEQ ID NO: 92847 - RNA, 22 nt, Homo sapiens
ugaggaaugaccccgugugguc

SEQ ID NO: 92848 - RNA, 22 nt, Homo sapiens
ugaggagugaacuauuucugau

SEQ ID NO: 92849 - RNA, 22 nt, Homo sapiens
uuaggcucuuuaucaguuaacu

SEQ ID NO: 92850 - RNA, 22 nt, Homo sapiens
uuaggcucuuugaggugcccag

SEQ ID NO: 92851 - RNA, 22 nt, Homo sapiens
uuaggcuuuucagacacuucau

SEQ ID NO: 92852 - RNA, 22 nt, Homo sapiens
uuagggaggagucccucuuuuu

SEQ ID NO: 92853 - RNA, 22 nt, Homo sapiens
uuagggaggcucaggacaagag

SEQ ID NO: 92854 - RNA, 18 nt, Homo sapiens
uuagguaggucuuugugu

SEQ ID NO: 92855 - RNA, 22 nt, Homo sapiens
uuaggugguacacagccccagu

SEQ ID NO: 92856 - RNA, 23 nt, Homo sapiens
uuaguaaacucaaugacaccaca

SEQ ID NO: 92857 - RNA, 22 nt, Homo sapiens
uuaguaguaguuugcauuuacc

SEQ ID NO: 92858 - RNA, 22 nt, Homo sapiens
uuaguaguugugauagguaccu

SEQ ID NO: 92859 - RNA, 22 nt, Homo sapiens
uuaguaguuugaguggggguua

SEQ ID NO: 92860 - RNA, 22 nt, Homo sapiens
uuaguaguuugauaggaauagc

SEQ ID NO: 92861 - RNA, 22 nt, Homo sapiens
uuagugcaaacucuucaaugcu

SEQ ID NO: 92862 - RNA, 22 nt, Homo sapiens
uuaguucccucauucuugacuu

SEQ ID NO: 92863 - RNA, 22 nt, Homo sapiens
uuauaacagagacuccugugcu

SEQ ID NO: 92864 - RNA, 22 nt, Homo sapiens
uuauaacucugcagccugguau

SEQ ID NO: 92865 - RNA, 20 nt, Homo sapiens
uuauaacuuuuguucugggg

SEQ ID NO: 92866 - RNA, 22 nt, Homo sapiens
uuauacacugugggaguguaaa

SEQ ID NO: 92867 - RNA, 22 nt, Homo sapiens
uuauacucgucugaaugauucu

SEQ ID NO: 92868 - RNA, 19 nt, Homo sapiens
uuauacuguauuguuuagg

SEQ ID NO: 92869 - RNA, 22 nt, Homo sapiens
uuauagacacguuguaacaaac

SEQ ID NO: 92870 - RNA, 22 nt, Homo sapiens
uuauagguuucuacaggacuau

SEQ ID NO: 92871 - RNA, 22 nt, Homo sapiens
uuauauguuucuguuuggaggc

SEQ ID NO: 92872 - RNA, 22 nt, Homo sapiens
uuauauguuuguacuuaggccu

SEQ ID NO: 92873 - RNA, 22 nt, Homo sapiens
uuaucauagugcaguuuucuga

SEQ ID NO: 92874 - RNA, 22 nt, Homo sapiens
uuaucucaguguuuguaaacaa

SEQ ID NO: 92875 - RNA, 22 nt, Homo sapiens
uuaugaaguagguuaagagcag

SEQ ID NO: 92876 - RNA, 22 nt, Homo sapiens
uuaugcaucuuccacacucauu

SEQ ID NO: 92877 - RNA, 22 nt, Homo sapiens
uuaugccagugauuauaagggc

SEQ ID NO: 92878 - RNA, 22 nt, Homo sapiens
uuaugcuguuuucuggagauuu

SEQ ID NO: 92879 - RNA, 22 nt, Homo sapiens
uuauggcucuuggggaaguaga

SEQ ID NO: 92880 - RNA, 23 nt, Homo sapiens
uuauggcuuuuauuauguugagg

SEQ ID NO: 92881 - RNA, 22 nt, Homo sapiens
uuaugguuuuucugugagaugg

SEQ ID NO: 92882 - RNA, 22 nt, Homo sapiens
uuauguaaaucaaucuggaauc

SEQ ID NO: 92883 - RNA, 22 nt, Homo sapiens
uuaugucacuguucagucuccc

SEQ ID NO: 92884 - RNA, 22 nt, Homo sapiens
uuaugucuuugagcaaugcugu

SEQ ID NO: 92885 - RNA, 22 nt, Homo sapiens
uuauguguuuaauguuucugaa

SEQ ID NO: 92886 - RNA, 22 nt, Homo sapiens
uuauuagagauauuugguuagg

SEQ ID NO: 92887 - RNA, 22 nt, Homo sapiens
uuauucauuaauugcuaagguu

SEQ ID NO: 92888 - RNA, 22 nt, Homo sapiens
uuauucugucuuuggucucaau

SEQ ID NO: 92889 - RNA, 16 nt, Homo sapiens
uuauugcauucuucuc

SEQ ID NO: 92890 - RNA, 22 nt, Homo sapiens
uuauuguccaaguuucccuuug

SEQ ID NO: 92891 - RNA, 22 nt, Homo sapiens
uuauuugguuauuguaauuggg

SEQ ID NO: 92892 - RNA, 22 nt, Homo sapiens
uuauuugguugcugacuuggaa

SEQ ID NO: 92893 - RNA, 23 nt, Homo sapiens
uucaaaggaugcuuuauggaauu

SEQ ID NO: 92894 - RNA, 22 nt, Homo sapiens
uucaaaggauuuagauuagcua

SEQ ID NO: 92895 - RNA, 22 nt, Homo sapiens
uucaaaguguugguuuugggcu

SEQ ID NO: 92896 - RNA, 22 nt, Homo sapiens
uucaaaucuucguuuugccaua

SEQ ID NO: 92897 - RNA, 22 nt, Homo sapiens
gacuaaugaaagagugugauau

SEQ ID NO: 92898 - RNA, 22 nt, Homo sapiens
gacuacaacuucuauuauucag

SEQ ID NO: 92899 - RNA, 22 nt, Homo sapiens
gacuagauauuguucuauguca

SEQ ID NO: 92900 - RNA, 22 nt, Homo sapiens
gacuagggaaaauuauuuuguu

SEQ ID NO: 92901 - RNA, 22 nt, Homo sapiens
gacucagaacuaaggguguuuc

SEQ ID NO: 92902 - RNA, 22 nt, Homo sapiens
gacucgagggcauaagagcuuu

SEQ ID NO: 92903 - RNA, 22 nt, Homo sapiens
gacuggauagauaaaguuaguu

SEQ ID NO: 92904 - RNA, 22 nt, Homo sapiens
gacuggccuauaauggcgaauu

SEQ ID NO: 92905 - RNA, 22 nt, Homo sapiens
gacuggcuguuuucuuuauuau

SEQ ID NO: 92906 - RNA, 16 nt, Homo sapiens
gacugggcugaggaau

SEQ ID NO: 92907 - RNA, 22 nt, Homo sapiens
gacuuagagauguuguauuugg

SEQ ID NO: 92908 - RNA, 22 nt, Homo sapiens
gagaacagaagcauuccuaauu

SEQ ID NO: 92909 - RNA, 22 nt, Homo sapiens
gagaacauuaauaguuaauuuu

SEQ ID NO: 92910 - RNA, 22 nt, Homo sapiens
gagaaccauuuggagaaaaagu

SEQ ID NO: 92911 - RNA, 22 nt, Homo sapiens
gagaacugacauuaucguguau

SEQ ID NO: 92912 - RNA, 22 nt, Homo sapiens
gagaacugagauaagugauauu

SEQ ID NO: 92913 - RNA, 22 nt, Homo sapiens
gagaacuggcugauucaaggac

SEQ ID NO: 92914 - RNA, 22 nt, Homo sapiens
gagacggagucucgcucugucg

SEQ ID NO: 92915 - RNA, 22 nt, Homo sapiens
gagacggagucuugcucuguug

SEQ ID NO: 92916 - RNA, 22 nt, Homo sapiens
gagagaguacuugauauaauuu

SEQ ID NO: 92917 - RNA, 22 nt, Homo sapiens
gagagcauuaagccaucaucau

SEQ ID NO: 92918 - RNA, 22 nt, Homo sapiens
gagagucacagugaauguggca

SEQ ID NO: 92919 - RNA, 22 nt, Homo sapiens
gagauacacccagugcagaggc

SEQ ID NO: 92920 - RNA, 22 nt, Homo sapiens
gagauauguuggcagcugguau

SEQ ID NO: 92921 - RNA, 22 nt, Homo sapiens
gagaucauguacuagaacaccu

SEQ ID NO: 92922 - RNA, 23 nt, Homo sapiens
gagaucauucuggaauuagagug

SEQ ID NO: 92923 - RNA, 22 nt, Homo sapiens
gagaucuuuaagaacuacugcu

SEQ ID NO: 92924 - RNA, 22 nt, Homo sapiens
gagaugaaaucuugcucuguca

SEQ ID NO: 92925 - RNA, 22 nt, Homo sapiens
gagaugaucaugugguuuuguc

SEQ ID NO: 92926 - RNA, 22 nt, Homo sapiens
gagaugguguuccacugccagu

SEQ ID NO: 92927 - RNA, 22 nt, Homo sapiens
gagauguaagaauuuauuuguu

SEQ ID NO: 92928 - RNA, 22 nt, Homo sapiens
gagauguagucuugcccuguca

SEQ ID NO: 92929 - RNA, 22 nt, Homo sapiens
gagaugucuauuucagagaugu

SEQ ID NO: 92930 - RNA, 22 nt, Homo sapiens
gagaugugguucaaggguguuu

SEQ ID NO: 92931 - RNA, 22 nt, Homo sapiens
gagauguuuuguuaucaaagga

SEQ ID NO: 92932 - RNA, 22 nt, Homo sapiens
gagauugucaugauuacauugu

SEQ ID NO: 92933 - RNA, 22 nt, Homo sapiens
gagauuuucagcuugacuggga

SEQ ID NO: 92934 - RNA, 22 nt, Homo sapiens
gagcaaaaguauguauugguua

SEQ ID NO: 92935 - RNA, 22 nt, Homo sapiens
gagcacauaugacauuuucuuc

SEQ ID NO: 92936 - RNA, 22 nt, Homo sapiens
gagcaccagucccugucagugc

SEQ ID NO: 92937 - RNA, 22 nt, Homo sapiens
ugaggagugagaaauugguuuc

SEQ ID NO: 92938 - RNA, 22 nt, Homo sapiens
ugaggauaguguugaaggcagg

SEQ ID NO: 92939 - RNA, 22 nt, Homo sapiens
ugaggcuaggauaggcugauuc

SEQ ID NO: 92940 - RNA, 22 nt, Homo sapiens
ugagggaugccugguuuguuuu

SEQ ID NO: 92941 - RNA, 22 nt, Homo sapiens
ugagguaacaaacuaugaguua

SEQ ID NO: 92942 - RNA, 22 nt, Homo sapiens
ugagguagaaugauucuaauau

SEQ ID NO: 92943 - RNA, 22 nt, Homo sapiens
ugagguagaggugaacuugacc

SEQ ID NO: 92944 - RNA, 19 nt, Homo sapiens
ugagguauuuguugggaga

SEQ ID NO: 92945 - RNA, 21 nt, Homo sapiens
ugaggucaugaugcugcuucc

SEQ ID NO: 92946 - RNA, 22 nt, Homo sapiens
ugaggucauguucugucagguu

SEQ ID NO: 92947 - RNA, 22 nt, Homo sapiens
ugaggucauucaugugggcgca

SEQ ID NO: 92948 - RNA, 22 nt, Homo sapiens
ugaggucuuuauuuagugcuca

SEQ ID NO: 92949 - RNA, 22 nt, Homo sapiens
ugaggugagauggcuaccccaa

SEQ ID NO: 92950 - RNA, 22 nt, Homo sapiens
ugagguguauugggggaaauuc

SEQ ID NO: 92951 - RNA, 22 nt, Homo sapiens
ugagguugucagugucauucuu

SEQ ID NO: 92952 - RNA, 22 nt, Homo sapiens
ugaguagaacaucaagucauac

SEQ ID NO: 92953 - RNA, 19 nt, Homo sapiens
ugaguauauuguauucauu

SEQ ID NO: 92954 - RNA, 22 nt, Homo sapiens
ugagucuguuccaaagaaauaa

SEQ ID NO: 92955 - RNA, 22 nt, Homo sapiens
ugagucuguucucacauugcua

SEQ ID NO: 92956 - RNA, 22 nt, Homo sapiens
ugagugaaggggcucuguugug

SEQ ID NO: 92957 - RNA, 22 nt, Homo sapiens
ugagugaaugugaaggcuaggg

SEQ ID NO: 92958 - RNA, 22 nt, Homo sapiens
ugagugagguucuacucuguga

SEQ ID NO: 92959 - RNA, 22 nt, Homo sapiens
ugagugccuggagggcagggac

SEQ ID NO: 92960 - RNA, 22 nt, Homo sapiens
ugaguggagacuguguguagag

SEQ ID NO: 92961 - RNA, 22 nt, Homo sapiens
ugaguggagaucgcaccauugc

SEQ ID NO: 92962 - RNA, 22 nt, Homo sapiens
ugaguguguaugugcauacaca

SEQ ID NO: 92963 - RNA, 22 nt, Homo sapiens
ugaguuaauuuuuguaucaugu

SEQ ID NO: 92964 - RNA, 22 nt, Homo sapiens
ugaguuauuaguagaggcuaug

SEQ ID NO: 92965 - RNA, 22 nt, Homo sapiens
ugaguucaauguuaaugaagca

SEQ ID NO: 92966 - RNA, 22 nt, Homo sapiens
ugaguucaauuguauuuuauua

SEQ ID NO: 92967 - RNA, 22 nt, Homo sapiens
ugaguuccuugugugaccuugc

SEQ ID NO: 92968 - RNA, 22 nt, Homo sapiens
ugaguucuuccuaucucugccu

SEQ ID NO: 92969 - RNA, 22 nt, Homo sapiens
ugaguuguaggggucaccuggc

SEQ ID NO: 92970 - RNA, 22 nt, Homo sapiens
ugaguuuaucuaaagaccuggg

SEQ ID NO: 92971 - RNA, 22 nt, Homo sapiens
ugauaacauuucuucugguaca

SEQ ID NO: 92972 - RNA, 20 nt, Homo sapiens
ugauaaguugcacuuuccuu

SEQ ID NO: 92973 - RNA, 22 nt, Homo sapiens
ugauaauguuaggcuuuauuca

SEQ ID NO: 92974 - RNA, 22 nt, Homo sapiens
ugauaauuuugucagguuuugg

SEQ ID NO: 92975 - RNA, 22 nt, Homo sapiens
ugauacuggcuucauagaauga

SEQ ID NO: 92976 - RNA, 22 nt, Homo sapiens
ugauaggagauuuucaucugua

SEQ ID NO: 92977 - RNA, 22 nt, Homo sapiens
ugauagucuuugcuggugaccu

SEQ ID NO: 92978 - RNA, 22 nt, Homo sapiens
ugauaguguccugugccacauu

SEQ ID NO: 92979 - RNA, 18 nt, Homo sapiens
ugauaucaucacaauuga

SEQ ID NO: 92980 - RNA, 22 nt, Homo sapiens
ugauaucugaauagauacacaa

SEQ ID NO: 92981 - RNA, 22 nt, Homo sapiens
ugauaugacagcucugcugcca

SEQ ID NO: 92982 - RNA, 22 nt, Homo sapiens
ugauaugucacuugaucauggu

SEQ ID NO: 92983 - RNA, 22 nt, Homo sapiens
ugauaugucccucgacaucagg

SEQ ID NO: 92984 - RNA, 20 nt, Homo sapiens
ugauauuucuggaaguggag

SEQ ID NO: 92985 - RNA, 22 nt, Homo sapiens
ugauauuuuugauccuuaaguu

SEQ ID NO: 92986 - RNA, 22 nt, Homo sapiens
ugaucaaagugcuggaauuaca

SEQ ID NO: 92987 - RNA, 22 nt, Homo sapiens
ugauccuguccuuaugauguua

SEQ ID NO: 92988 - RNA, 22 nt, Homo sapiens
ugaucuuuuuaauguccauggg

SEQ ID NO: 92989 - RNA, 22 nt, Homo sapiens
ugauggcacagugaguuccagg

SEQ ID NO: 92990 - RNA, 22 nt, Homo sapiens
ugaugguguuaccaucuuuacu

SEQ ID NO: 92991 - RNA, 22 nt, Homo sapiens
ugaugguuuuaaaaagaggagu

SEQ ID NO: 92992 - RNA, 22 nt, Homo sapiens
ugauguaggcauuuaagguuau

SEQ ID NO: 92993 - RNA, 22 nt, Homo sapiens
ugauguugaauuguucagcguc

SEQ ID NO: 92994 - RNA, 20 nt, Homo sapiens
ugauuaguccacuuggcucu

SEQ ID NO: 92995 - RNA, 22 nt, Homo sapiens
ugauucccucaagugccuuaug

SEQ ID NO: 92996 - RNA, 22 nt, Homo sapiens
ugauugacauacauaggugugg

SEQ ID NO: 92997 - RNA, 18 nt, Homo sapiens
ugauugacuuauuuaggu

SEQ ID NO: 92998 - RNA, 22 nt, Homo sapiens
ugauuguucuguccccaggggc

SEQ ID NO: 92999 - RNA, 22 nt, Homo sapiens
ugauuuccaugagaacaugccu

SEQ ID NO: 93000 - RNA, 22 nt, Homo sapiens
ugauuugucugcaggaauagug

SEQ ID NO: 93001 - RNA, 22 nt, Homo sapiens
ugcaaacuuccuugggcagcau

SEQ ID NO: 93002 - RNA, 22 nt, Homo sapiens
ugcaaagaaauuuuggugacca

SEQ ID NO: 93003 - RNA, 22 nt, Homo sapiens
ugcaaaguccucauucuuaccc

SEQ ID NO: 93004 - RNA, 19 nt, Homo sapiens
ugcaaagucuuuuccuauu

SEQ ID NO: 93005 - RNA, 22 nt, Homo sapiens
ugcaaauuauugggccccaacu

SEQ ID NO: 93006 - RNA, 22 nt, Homo sapiens
ugcaaccauuguuaagugugca

SEQ ID NO: 93007 - RNA, 22 nt, Homo sapiens
ugcaagaaucuuucaggcuagc

SEQ ID NO: 93008 - RNA, 22 nt, Homo sapiens
ugcaagaggagacuguacucag

SEQ ID NO: 93009 - RNA, 22 nt, Homo sapiens
ugcaagcacacccagggauugu

SEQ ID NO: 93010 - RNA, 22 nt, Homo sapiens
ugcaaguaauuccagcuacuga

SEQ ID NO: 93011 - RNA, 22 nt, Homo sapiens
ugcaagucaucuguccuucaga

SEQ ID NO: 93012 - RNA, 20 nt, Homo sapiens
ugcaaguugccuuuggaggc

SEQ ID NO: 93013 - RNA, 22 nt, Homo sapiens
ugcaauagcuucaggagaaggg

SEQ ID NO: 93014 - RNA, 22 nt, Homo sapiens
ugcaaucauuuggaggagaaga

SEQ ID NO: 93015 - RNA, 22 nt, Homo sapiens
ugcaaugugaaauaagcacauc

SEQ ID NO: 93016 - RNA, 22 nt, Homo sapiens
ugcaauuuaaugugucccaauu

SEQ ID NO: 93017 - RNA, 22 nt, Homo sapiens
ugcaccacacuccauccugggc

SEQ ID NO: 93018 - RNA, 22 nt, Homo sapiens
ugcaccacuacacuccaggcug

SEQ ID NO: 93019 - RNA, 22 nt, Homo sapiens
ugcaccacugcacugccugggu

SEQ ID NO: 93020 - RNA, 22 nt, Homo sapiens
ugcaccacuguacuccagucug

SEQ ID NO: 93021 - RNA, 22 nt, Homo sapiens
ugcaccaucuugcuucuguggu

SEQ ID NO: 93022 - RNA, 22 nt, Homo sapiens
ugcaccauggcacuccaggcug

SEQ ID NO: 93023 - RNA, 22 nt, Homo sapiens
ugcaccauugcacuccagccug

SEQ ID NO: 93024 - RNA, 22 nt, Homo sapiens
ugcaccauugucaccuggguga

SEQ ID NO: 93025 - RNA, 22 nt, Homo sapiens
ugcagaaucccuucagauccga

SEQ ID NO: 93026 - RNA, 22 nt, Homo sapiens
ugcagauucguuuugaggggua

SEQ ID NO: 93027 - RNA, 21 nt, Homo sapiens
uucaucuggccguauuccagg

SEQ ID NO: 93028 - RNA, 22 nt, Homo sapiens
uucauggagccauccuuugauc

SEQ ID NO: 93029 - RNA, 22 nt, Homo sapiens
uucauggaugcauuugaggggu

SEQ ID NO: 93030 - RNA, 20 nt, Homo sapiens
uucaugggagcaaagaggcc

SEQ ID NO: 93031 - RNA, 22 nt, Homo sapiens
uucauguaauauauuucaggcc

SEQ ID NO: 93032 - RNA, 22 nt, Homo sapiens
uucauugaaugauuuuuagaag

SEQ ID NO: 93033 - RNA, 22 nt, Homo sapiens
uuccaagugggaaacaaaaaug

SEQ ID NO: 93034 - RNA, 22 nt, Homo sapiens
uuccacaauggcugaacuaguu

SEQ ID NO: 93035 - RNA, 22 nt, Homo sapiens
uuccacaggguugaacuaguuu

SEQ ID NO: 93036 - RNA, 23 nt, Homo sapiens
uuccaccauugacuaguuacaua

SEQ ID NO: 93037 - RNA, 22 nt, Homo sapiens
uuccaguuuuauggguauagag

SEQ ID NO: 93038 - RNA, 22 nt, Homo sapiens
uucccagagagggacuucuaau

SEQ ID NO: 93039 - RNA, 22 nt, Homo sapiens
uucccaguaaacucuaucccuc

SEQ ID NO: 93040 - RNA, 22 nt, Homo sapiens
uucccagucaaacgaaggacuu

SEQ ID NO: 93041 - RNA, 22 nt, Homo sapiens
uucccagugccaggcacuggga

SEQ ID NO: 93042 - RNA, 22 nt, Homo sapiens
uucccaguggaacauguaguca

SEQ ID NO: 93043 - RNA, 22 nt, Homo sapiens
uucccuagaacacauggaggga

SEQ ID NO: 93044 - RNA, 20 nt, Homo sapiens
uucccucagccuugagggua

SEQ ID NO: 93045 - RNA, 22 nt, Homo sapiens
uucccugugguauagaagccgu

SEQ ID NO: 93046 - RNA, 22 nt, Homo sapiens
uucccugugugcagaugggugu

SEQ ID NO: 93047 - RNA, 23 nt, Homo sapiens
uucccuuagaagaaggggagaaa

SEQ ID NO: 93048 - RNA, 22 nt, Homo sapiens
uuccguguaguugagcaguuuu

SEQ ID NO: 93049 - RNA, 22 nt, Homo sapiens
uuccuaguccugagucucugcg

SEQ ID NO: 93050 - RNA, 22 nt, Homo sapiens
uuccugagagggcugggugcag

SEQ ID NO: 93051 - RNA, 22 nt, Homo sapiens
uuccugagccuuguaucuagua

SEQ ID NO: 93052 - RNA, 22 nt, Homo sapiens
uuccugcacuugcuugccuaug

SEQ ID NO: 93053 - RNA, 22 nt, Homo sapiens
uuccugugacccccaagcccac

SEQ ID NO: 93054 - RNA, 22 nt, Homo sapiens
uuccuuaguuauuugguccccu

SEQ ID NO: 93055 - RNA, 22 nt, Homo sapiens
uuccuugguucagggaaggucc

SEQ ID NO: 93056 - RNA, 21 nt, Homo sapiens
uucggcaauaugaaccaaugu

SEQ ID NO: 93057 - RNA, 21 nt, Homo sapiens
uucuaaguaaauguuggacau

SEQ ID NO: 93058 - RNA, 22 nt, Homo sapiens
uucuaaguaauuuugcaugccu

SEQ ID NO: 93059 - RNA, 22 nt, Homo sapiens
uucuacaugggucgucggugag

SEQ ID NO: 93060 - RNA, 22 nt, Homo sapiens
uucuaguacucccuggagcugg

SEQ ID NO: 93061 - RNA, 20 nt, Homo sapiens
uucuaguacuucuguuucca

SEQ ID NO: 93062 - RNA, 22 nt, Homo sapiens
uucuaugguuuaauaguuuggg

SEQ ID NO: 93063 - RNA, 22 nt, Homo sapiens
uucuauguuguuagacccacca

SEQ ID NO: 93064 - RNA, 22 nt, Homo sapiens
uucucaguaauuccagauuuuu

SEQ ID NO: 93065 - RNA, 17 nt, Homo sapiens
uucucaguucugaucuc

SEQ ID NO: 93066 - RNA, 22 nt, Homo sapiens
uucucauggugauggcaaaauc

SEQ ID NO: 93067 - RNA, 22 nt, Homo sapiens
uucucgcuuuuuccaccuguau

SEQ ID NO: 93068 - RNA, 22 nt, Homo sapiens
uucucugggacauaggucgggu

SEQ ID NO: 93069 - RNA, 22 nt, Homo sapiens
uucucuguggauugggugagag

SEQ ID NO: 93070 - RNA, 22 nt, Homo sapiens
uucugagguuauauucucucaa

SEQ ID NO: 93071 - RNA, 22 nt, Homo sapiens
uucugcacaucgaucacaagau

SEQ ID NO: 93072 - RNA, 22 nt, Homo sapiens
uucugcuugaucuaguguguug

SEQ ID NO: 93073 - RNA, 22 nt, Homo sapiens
uucugugcuuguggaugaagug

SEQ ID NO: 93074 - RNA, 22 nt, Homo sapiens
uucugugguagaaaucucaaau

SEQ ID NO: 93075 - RNA, 22 nt, Homo sapiens
uucuguguuuaggucacggcua

SEQ ID NO: 93076 - RNA, 22 nt, Homo sapiens
uucuuagguuaaggcugagaga

SEQ ID NO: 93077 - RNA, 22 nt, Homo sapiens
uucuuagucauguaauagucca

SEQ ID NO: 93078 - RNA, 22 nt, Homo sapiens
uucuuaguggcaccacuuuuuu

SEQ ID NO: 93079 - RNA, 22 nt, Homo sapiens
gugaucucagcucacuggaacc

SEQ ID NO: 93080 - RNA, 22 nt, Homo sapiens
gugauguguuucaacagcuccu

SEQ ID NO: 93081 - RNA, 22 nt, Homo sapiens
gugauuauuaugcacugcaugc

SEQ ID NO: 93082 - RNA, 22 nt, Homo sapiens
gugauuguuaaacugccucucu

SEQ ID NO: 93083 - RNA, 22 nt, Homo sapiens
ucuggguuuuuccauugccggu

SEQ ID NO: 93084 - RNA, 22 nt, Homo sapiens
ucugguguuauucauguaguuu

SEQ ID NO: 93085 - RNA, 22 nt, Homo sapiens
ucugguuccugcauucauucaa

SEQ ID NO: 93086 - RNA, 22 nt, Homo sapiens
ucuguaacauccaccuucuggg

SEQ ID NO: 93087 - RNA, 22 nt, Homo sapiens
ucuguaguuaacagcuucagcu

SEQ ID NO: 93088 - RNA, 19 nt, Homo sapiens
ucuguaguuagggcuacag

SEQ ID NO: 93089 - RNA, 22 nt, Homo sapiens
ucugucuugugguuugagugcc

SEQ ID NO: 93090 - RNA, 22 nt, Homo sapiens
ucugucuuugccuaaguuuguc

SEQ ID NO: 93091 - RNA, 22 nt, Homo sapiens
ucugugaaaucauuuccuguaa

SEQ ID NO: 93092 - RNA, 22 nt, Homo sapiens
ucugugcugagaguugaaaguu

SEQ ID NO: 93093 - RNA, 22 nt, Homo sapiens
ucugugcuugucauaugcuuug

SEQ ID NO: 93094 - RNA, 18 nt, Homo sapiens
ucugugguguaaauacgu

SEQ ID NO: 93095 - RNA, 22 nt, Homo sapiens
ucuugaacuucugcacacucag

SEQ ID NO: 93096 - RNA, 22 nt, Homo sapiens
ucuugccacuucauccccuuuc

SEQ ID NO: 93097 - RNA, 22 nt, Homo sapiens
ucuuggcauggcugaagauucc

SEQ ID NO: 93098 - RNA, 20 nt, Homo sapiens
ucuugggaauguagccuagg

SEQ ID NO: 93099 - RNA, 22 nt, Homo sapiens
ucuuggguggauucauucuuuc

SEQ ID NO: 93100 - RNA, 21 nt, Homo sapiens
ucuuggguugaauucucccag

SEQ ID NO: 93101 - RNA, 22 nt, Homo sapiens
ucuugguugaaaauucauaaua

SEQ ID NO: 93102 - RNA, 22 nt, Homo sapiens
ucuugguuuauugugguaugaa

SEQ ID NO: 93103 - RNA, 22 nt, Homo sapiens
ucuuuagguguuauaguucaag

SEQ ID NO: 93104 - RNA, 22 nt, Homo sapiens
ucuuugaguggagcgaggcaga

SEQ ID NO: 93105 - RNA, 22 nt, Homo sapiens
ucuuugaguuauugugcagacu

SEQ ID NO: 93106 - RNA, 22 nt, Homo sapiens
guugauguugcagucuugagga

SEQ ID NO: 93107 - RNA, 22 nt, Homo sapiens
guugcaauugauguaugucuga

SEQ ID NO: 93108 - RNA, 22 nt, Homo sapiens
guugcaugucugggaggccagc

SEQ ID NO: 93109 - RNA, 22 nt, Homo sapiens
guugccuaggcuggucuugaac

SEQ ID NO: 93110 - RNA, 22 nt, Homo sapiens
guugcucaggcuggagugcagu

SEQ ID NO: 93111 - RNA, 22 nt, Homo sapiens
guuggaauguauugcuacuucu

SEQ ID NO: 93112 - RNA, 22 nt, Homo sapiens
guauggaagucaguuuguuggc

SEQ ID NO: 93113 - RNA, 22 nt, Homo sapiens
guaugucuugucuauggcugcu

SEQ ID NO: 93114 - RNA, 22 nt, Homo sapiens
guauuagaugguauuugaagau

SEQ ID NO: 93115 - RNA, 22 nt, Homo sapiens
guauuagguuggggcaaaagua

SEQ ID NO: 93116 - RNA, 22 nt, Homo sapiens
guauuaguuuccuguugcugcu

SEQ ID NO: 93117 - RNA, 18 nt, Homo sapiens
guauuccagccugaguga

SEQ ID NO: 93118 - RNA, 22 nt, Homo sapiens
guauugacuaucaaucaugugc

SEQ ID NO: 93119 - RNA, 22 nt, Homo sapiens
guauugccugugugccagccac

SEQ ID NO: 93120 - RNA, 22 nt, Homo sapiens
guauuugauuauagcaugcuua

SEQ ID NO: 93121 - RNA, 22 nt, Homo sapiens
gucaagagaacuuucuaucacu

SEQ ID NO: 93122 - RNA, 22 nt, Homo sapiens
gucacagaaaaagauaugccaa

SEQ ID NO: 93123 - RNA, 22 nt, Homo sapiens
gucacauugaugcccauggugg

SEQ ID NO: 93124 - RNA, 22 nt, Homo sapiens
gucaccagcuguguuagccccu

SEQ ID NO: 93125 - RNA, 22 nt, Homo sapiens
gucacuggcugucuuguaugau

SEQ ID NO: 93126 - RNA, 21 nt, Homo sapiens
gucacuggggcuggauaauuc

SEQ ID NO: 93127 - RNA, 22 nt, Homo sapiens
gucagcaaaguucuccugcaga

SEQ ID NO: 93128 - RNA, 22 nt, Homo sapiens
gucagcaucaccaugucuauga

SEQ ID NO: 93129 - RNA, 22 nt, Homo sapiens
gucaggaccucgguggcauucu

SEQ ID NO: 93130 - RNA, 22 nt, Homo sapiens
gucagguaccugaaagcagcca

SEQ ID NO: 93131 - RNA, 22 nt, Homo sapiens
gucagugauugauuuaaagacg

SEQ ID NO: 93132 - RNA, 22 nt, Homo sapiens
gucagugccugucccaggcuuu

SEQ ID NO: 93133 - RNA, 22 nt, Homo sapiens
gucagugcuuuaguucaggaug

SEQ ID NO: 93134 - RNA, 22 nt, Homo sapiens
gucagugucuuugcagcucaga

SEQ ID NO: 93135 - RNA, 22 nt, Homo sapiens
gucagugugauaucugcagggg

SEQ ID NO: 93136 - RNA, 22 nt, Homo sapiens
gucaguuucacucagcuggaac

SEQ ID NO: 93137 - RNA, 22 nt, Homo sapiens
gucaucaucaguccucugugca

SEQ ID NO: 93138 - RNA, 22 nt, Homo sapiens
gucauccaggcuggagugaagc

SEQ ID NO: 93139 - RNA, 22 nt, Homo sapiens
gucaugucugcacauaguaaaa

SEQ ID NO: 93140 - RNA, 22 nt, Homo sapiens
gucauucauucagcaagcacug

SEQ ID NO: 93141 - RNA, 22 nt, Homo sapiens
gucauugucaauugacaauugu

SEQ ID NO: 93142 - RNA, 22 nt, Homo sapiens
guccaagacuaggaguuggcag

SEQ ID NO: 93143 - RNA, 22 nt, Homo sapiens
gucccagagauauugugucuuu

SEQ ID NO: 93144 - RNA, 22 nt, Homo sapiens
gucccaguggaaccuccaagcu

SEQ ID NO: 93145 - RNA, 22 nt, Homo sapiens
gucgguguuuccugagaacgaa

SEQ ID NO: 93146 - RNA, 22 nt, Homo sapiens
gucuaugagucccugaauuuaa

SEQ ID NO: 93147 - RNA, 22 nt, Homo sapiens
gucucccagccuacaucuuucu

SEQ ID NO: 93148 - RNA, 22 nt, Homo sapiens
gucucugguugcuuuuguacca

SEQ ID NO: 93149 - RNA, 22 nt, Homo sapiens
gucugagcauggggccggcagg

SEQ ID NO: 93150 - RNA, 21 nt, Homo sapiens
gucugguguuuuaaugaggac

SEQ ID NO: 93151 - RNA, 22 nt, Homo sapiens
gucugguuuuuuauauccucac

SEQ ID NO: 93152 - RNA, 22 nt, Homo sapiens
gucugucuuuugucuuugaaau

SEQ ID NO: 93153 - RNA, 22 nt, Homo sapiens
gucuguuuggggaccuguggcc

SEQ ID NO: 93154 - RNA, 22 nt, Homo sapiens
gucuuagguuuaaucacuucua

SEQ ID NO: 93155 - RNA, 22 nt, Homo sapiens
gucuuccagccuccaucuuucu

SEQ ID NO: 93156 - RNA, 22 nt, Homo sapiens
gucuugaaggcugaguaccugu

SEQ ID NO: 93157 - RNA, 22 nt, Homo sapiens
gucuugcacuuaccuaagaacu

SEQ ID NO: 93158 - RNA, 20 nt, Homo sapiens
gucuugcuccguugcccagg

SEQ ID NO: 93159 - RNA, 22 nt, Homo sapiens
gucuuggagaacucagcuuggc

SEQ ID NO: 93160 - RNA, 17 nt, Homo sapiens
gucuuugguugaguuua

SEQ ID NO: 93161 - RNA, 22 nt, Homo sapiens
gucuuuguuauuaugaaucaac

SEQ ID NO: 93162 - RNA, 22 nt, Homo sapiens
gucuuuguuuggucuguaucag

SEQ ID NO: 93163 - RNA, 22 nt, Homo sapiens
gucuuuugcuagccagagagcu

SEQ ID NO: 93164 - RNA, 22 nt, Homo sapiens
gugaaagauuaaaccagugugu

SEQ ID NO: 93165 - RNA, 22 nt, Homo sapiens
gugaaauacauaaucccaagug

SEQ ID NO: 93166 - RNA, 22 nt, Homo sapiens
gugaaaugaaucuggaaauauu

SEQ ID NO: 93167 - RNA, 22 nt, Homo sapiens
gugaaguuuuuugcugagaguc

SEQ ID NO: 93168 - RNA, 20 nt, Homo sapiens
gugaauacauuugguuucau

SEQ ID NO: 93169 - RNA, 22 nt, Homo sapiens
gugaaugcauuaagaaggggga

SEQ ID NO: 93170 - RNA, 22 nt, Homo sapiens
gugaauguaaagucaugugacu

SEQ ID NO: 93171 - RNA, 22 nt, Homo sapiens
gugacauuuuuacugaugagag

SEQ ID NO: 93172 - RNA, 22 nt, Homo sapiens
gugaccucauuacggggccugc

SEQ ID NO: 93173 - RNA, 22 nt, Homo sapiens
gugacugcauauaaguguaugu

SEQ ID NO: 93174 - RNA, 20 nt, Homo sapiens
gugagaacaugugguauuug

SEQ ID NO: 93175 - RNA, 16 nt, Homo sapiens
gugagagaugacaaac

SEQ ID NO: 93176 - RNA, 22 nt, Homo sapiens
gugagaggaggcagcuuuuaca

SEQ ID NO: 93177 - RNA, 22 nt, Homo sapiens
gugagauacuagagauauagug

SEQ ID NO: 93178 - RNA, 22 nt, Homo sapiens
gugagaugaggucucacucugu

SEQ ID NO: 93179 - RNA, 19 nt, Homo sapiens
gugagcacagacaauacaa

SEQ ID NO: 93180 - RNA, 22 nt, Homo sapiens
gugagcagagaucgcgugauug

SEQ ID NO: 93181 - RNA, 22 nt, Homo sapiens
gugagcauucaaggaaggagcu

SEQ ID NO: 93182 - RNA, 22 nt, Homo sapiens
gugagcuaagcaaauaugagcc

SEQ ID NO: 93183 - RNA, 22 nt, Homo sapiens
gugagcuccucuucugcugcag

SEQ ID NO: 93184 - RNA, 21 nt, Homo sapiens
gugaggaguuacuggcuuuga

SEQ ID NO: 93185 - RNA, 22 nt, Homo sapiens
gugagguaagaguugcuuugcu

SEQ ID NO: 93186 - RNA, 17 nt, Homo sapiens
gugagguauccucaaaa

SEQ ID NO: 93187 - RNA, 22 nt, Homo sapiens
gugagguguuaaccaaccugug

SEQ ID NO: 93188 - RNA, 22 nt, Homo sapiens
gugaguaaagguucauugaauu

SEQ ID NO: 93189 - RNA, 22 nt, Homo sapiens
gugagucagucuguguagggcu

SEQ ID NO: 93190 - RNA, 20 nt, Homo sapiens
gugagucauuaguaaccaaa

SEQ ID NO: 93191 - RNA, 22 nt, Homo sapiens
gugaguuauuauuuauguaaac

SEQ ID NO: 93192 - RNA, 22 nt, Homo sapiens
gugauagguugucacugucacu

SEQ ID NO: 93193 - RNA, 22 nt, Homo sapiens
gugaugacauucagagaugaag

SEQ ID NO: 93194 - RNA, 18 nt, Homo sapiens
uaggaacauugauuggag

SEQ ID NO: 93195 - RNA, 22 nt, Homo sapiens
uaggaaguacaucucagaaucu

SEQ ID NO: 93196 - RNA, 22 nt, Homo sapiens
uaggaaguuuucuugcugggcc

SEQ ID NO: 93197 - RNA, 22 nt, Homo sapiens
uaggacaaugguacagcagaaa

SEQ ID NO: 93198 - RNA, 22 nt, Homo sapiens
uaggacacagauggagaaaagc

SEQ ID NO: 93199 - RNA, 22 nt, Homo sapiens
uaggacacucucuccaccagua

SEQ ID NO: 93200 - RNA, 22 nt, Homo sapiens
uaggacauugcccuuguggaga

SEQ ID NO: 93201 - RNA, 19 nt, Homo sapiens
uaggacccugguggccccc

SEQ ID NO: 93202 - RNA, 20 nt, Homo sapiens
uaggagcaaugagaguagaa

SEQ ID NO: 93203 - RNA, 22 nt, Homo sapiens
uaggagcacagcagcauguggg

SEQ ID NO: 93204 - RNA, 22 nt, Homo sapiens
uuuguguccccacccaaacauc

SEQ ID NO: 93205 - RNA, 23 nt, Homo sapiens
uuuguguccccacccaaaucuca

SEQ ID NO: 93206 - RNA, 16 nt, Homo sapiens
uuugugugugacgaga

SEQ ID NO: 93207 - RNA, 22 nt, Homo sapiens
uuugugugugauuauaaaaggu

SEQ ID NO: 93208 - RNA, 22 nt, Homo sapiens
uuuguucaccucaaggauggga

SEQ ID NO: 93209 - RNA, 22 nt, Homo sapiens
uuuguuugaagucgagacaacu

SEQ ID NO: 93210 - RNA, 22 nt, Homo sapiens
uuuuacacuguugguuggaaug

SEQ ID NO: 93211 - RNA, 22 nt, Homo sapiens
uuuuacagaggagguugcugau

SEQ ID NO: 93212 - RNA, 22 nt, Homo sapiens
uuuuaguggaauauuuacaguu

SEQ ID NO: 93213 - RNA, 22 nt, Homo sapiens
uuuuaguugcucagguauucuc

SEQ ID NO: 93214 - RNA, 22 nt, Homo sapiens
uuuuauguuuguucccugccaa

SEQ ID NO: 93215 - RNA, 22 nt, Homo sapiens
uuuucaguuuuccagguagccg

SEQ ID NO: 93216 - RNA, 22 nt, Homo sapiens
uuuugcaaauuccaguggccau

SEQ ID NO: 93217 - RNA, 23 nt, Homo sapiens
uuuugcaauaagucacuggaaua

SEQ ID NO: 93218 - RNA, 22 nt, Homo sapiens
uuuugcacauugauuugguauc

SEQ ID NO: 93219 - RNA, 20 nt, Homo sapiens
uuuugcacuccuacuaaggu

SEQ ID NO: 93220 - RNA, 22 nt, Homo sapiens
uuuugcaggucaggggcagaga

SEQ ID NO: 93221 - RNA, 22 nt, Homo sapiens
uuuugcauuggcugaggagugu

SEQ ID NO: 93222 - RNA, 19 nt, Homo sapiens
uuuugcucuuuauaccuau

SEQ ID NO: 93223 - RNA, 20 nt, Homo sapiens
uuuuggacuaaaggcauccc

SEQ ID NO: 93224 - RNA, 22 nt, Homo sapiens
uuuuggacuucaauuugacacu

SEQ ID NO: 93225 - RNA, 22 nt, Homo sapiens
uuuuggcuuuuccucagcaagc

SEQ ID NO: 93226 - RNA, 22 nt, Homo sapiens
uuuuggugguuaugugucaaug

SEQ ID NO: 93227 - RNA, 22 nt, Homo sapiens
uuuugguguauuguauaaggua

SEQ ID NO: 93228 - RNA, 22 nt, Homo sapiens
uuuugguucaauuaauuugcua

SEQ ID NO: 93229 - RNA, 22 nt, Homo sapiens
uuuugguuuuauccagggucuc

SEQ ID NO: 93230 - RNA, 19 nt, Homo sapiens
uuuuguacucugugacuug

SEQ ID NO: 93231 - RNA, 22 nt, Homo sapiens
uuuugugcauggcccaguggua

SEQ ID NO: 93232 - RNA, 21 nt, Homo sapiens
uuuugugcaugugcagccugc

SEQ ID NO: 93233 - RNA, 22 nt, Homo sapiens
uuuuugaguagcuggagagcag

SEQ ID NO: 93234 - RNA, 22 nt, Homo sapiens
uuuuugugguauauugcaacaa

SEQ ID NO: 93235 - RNA, 21 nt, Homo sapiens
ucauugggugcagcccacccu

SEQ ID NO: 93236 - RNA, 22 nt, Homo sapiens
ucauugguagcuugaaggggau

SEQ ID NO: 93237 - RNA, 18 nt, Homo sapiens
ucauuggugagcaccucc

SEQ ID NO: 93238 - RNA, 22 nt, Homo sapiens
ucauuguccaacuucuuucagu

SEQ ID NO: 93239 - RNA, 22 nt, Homo sapiens
uccaaaucucuggcacugggau

SEQ ID NO: 93240 - RNA, 22 nt, Homo sapiens
uccacagugguggaauuguuca

SEQ ID NO: 93241 - RNA, 19 nt, Homo sapiens
uccaccgcgugcaccucua

SEQ ID NO: 93242 - RNA, 22 nt, Homo sapiens
uccaccgugggcugcggggcuc

SEQ ID NO: 93243 - RNA, 18 nt, Homo sapiens
uccacgugcuuuccagau

SEQ ID NO: 93244 - RNA, 22 nt, Homo sapiens
uccacguggucuaucuguccuu

SEQ ID NO: 93245 - RNA, 22 nt, Homo sapiens
uccacuuuugugcugaauugga

SEQ ID NO: 93246 - RNA, 17 nt, Homo sapiens
uccagauuucaauugaa

SEQ ID NO: 93247 - RNA, 22 nt, Homo sapiens
uccagcuuuuucuaauucugug

SEQ ID NO: 93248 - RNA, 22 nt, Homo sapiens
uccagguacucagggggcugag

SEQ ID NO: 93249 - RNA, 22 nt, Homo sapiens
uccaguacaggucucucauuuc

SEQ ID NO: 93250 - RNA, 22 nt, Homo sapiens
uccagugcauucagacacuugg

SEQ ID NO: 93251 - RNA, 22 nt, Homo sapiens
uuaaaugcucacauaaagguag

SEQ ID NO: 93252 - RNA, 22 nt, Homo sapiens
uuaaaugucuguagaugugcug

SEQ ID NO: 93253 - RNA, 22 nt, Homo sapiens
uuaacagugucaaucuguagua

SEQ ID NO: 93254 - RNA, 22 nt, Homo sapiens
uuaacaguugcaugagacugag

SEQ ID NO: 93255 - RNA, 22 nt, Homo sapiens
uuaagaagugauuuuccucauu

SEQ ID NO: 93256 - RNA, 22 nt, Homo sapiens
uuaagaugcauuuugaaguuaa

SEQ ID NO: 93257 - RNA, 22 nt, Homo sapiens
uuaaggaaagcauuuaauucag

SEQ ID NO: 93258 - RNA, 22 nt, Homo sapiens
uuaaggcagugcaucuggaguu

SEQ ID NO: 93259 - RNA, 22 nt, Homo sapiens
uuaaggcauucuuugucuucau

SEQ ID NO: 93260 - RNA, 22 nt, Homo sapiens
uuaagguuuuuguagcaaggau

SEQ ID NO: 93261 - RNA, 22 nt, Homo sapiens
uuaaguacuucccuguuggaca

SEQ ID NO: 93262 - RNA, 19 nt, Homo sapiens
uuaaguaguuagagggucu

SEQ ID NO: 93263 - RNA, 22 nt, Homo sapiens
uuaagugaauuaucuaacaugu

SEQ ID NO: 93264 - RNA, 22 nt, Homo sapiens
uuaagugcucaguuacucaguu

SEQ ID NO: 93265 - RNA, 22 nt, Homo sapiens
uuaauacucuucuaaguagucc

SEQ ID NO: 93266 - RNA, 22 nt, Homo sapiens
uuaauagugacucauuuuccac

SEQ ID NO: 93267 - RNA, 22 nt, Homo sapiens
uuaaucacagcugaacucaaac

SEQ ID NO: 93268 - RNA, 22 nt, Homo sapiens
uuaaucacagugucuuccuuca

SEQ ID NO: 93269 - RNA, 22 nt, Homo sapiens
uuaaucucaggaguuugggacc

SEQ ID NO: 93270 - RNA, 22 nt, Homo sapiens
uuaaucugucuaugauuuuggu

SEQ ID NO: 93271 - RNA, 22 nt, Homo sapiens
uuaaugaacuuuauuuuguaga

SEQ ID NO: 93272 - RNA, 22 nt, Homo sapiens
uuaauggagaguuucauuggug

SEQ ID NO: 93273 - RNA, 22 nt, Homo sapiens
uuaauguaauugauugauugac

SEQ ID NO: 93274 - RNA, 22 nt, Homo sapiens
uuaauuguaucuauagauguca

SEQ ID NO: 93275 - RNA, 22 nt, Homo sapiens
uuacaaccucagcagugcaaag

SEQ ID NO: 93276 - RNA, 22 nt, Homo sapiens
uuacaacugucuuacugguuau

SEQ ID NO: 93277 - RNA, 22 nt, Homo sapiens
uuacaagaugucuguccaacac

SEQ ID NO: 93278 - RNA, 22 nt, Homo sapiens
uuacaaguggcaucucucugga

SEQ ID NO: 93279 - RNA, 22 nt, Homo sapiens
uuacacaguugguaggggcaga

SEQ ID NO: 93280 - RNA, 22 nt, Homo sapiens
uuacagauggcacacucaaggg

SEQ ID NO: 93281 - RNA, 22 nt, Homo sapiens
uuacagcugggugugucuggua

SEQ ID NO: 93282 - RNA, 22 nt, Homo sapiens
gaauguuuacuuuguuuaauac

SEQ ID NO: 93283 - RNA, 22 nt, Homo sapiens
gaauucugucgcuuacuagaug

SEQ ID NO: 93284 - RNA, 22 nt, Homo sapiens
gaauugcacaaaaacugcuugu

SEQ ID NO: 93285 - RNA, 22 nt, Homo sapiens
gacaaguuugauuuauuccaag

SEQ ID NO: 93286 - RNA, 22 nt, Homo sapiens
gacacagugaagucucuacuug

SEQ ID NO: 93287 - RNA, 22 nt, Homo sapiens
gacaccauuucaguacuagguu

SEQ ID NO: 93288 - RNA, 22 nt, Homo sapiens
gacacugucuucugcucuuaaa

SEQ ID NO: 93289 - RNA, 18 nt, Homo sapiens
gacagugugaagauuccu

SEQ ID NO: 93290 - RNA, 18 nt, Homo sapiens
gacaguguggugauuccu

SEQ ID NO: 93291 - RNA, 22 nt, Homo sapiens
gacaguuuggugaggaagacga

SEQ ID NO: 93292 - RNA, 22 nt, Homo sapiens
gacauagagccuugacuucauu

SEQ ID NO: 93293 - RNA, 21 nt, Homo sapiens
gacauggcgauacuccgucuc

SEQ ID NO: 93294 - RNA, 22 nt, Homo sapiens
gacauguuuucaagauuuauaa

SEQ ID NO: 93295 - RNA, 22 nt, Homo sapiens
gacauguuuuuuaagguuuaug

SEQ ID NO: 93296 - RNA, 22 nt, Homo sapiens
augugccauucucauggcgcuu

SEQ ID NO: 93297 - RNA, 22 nt, Homo sapiens
augugcuaguaucaaacgagac

SEQ ID NO: 93298 - RNA, 22 nt, Homo sapiens
augugcuuaaaaaugcagagaa

SEQ ID NO: 93299 - RNA, 22 nt, Homo sapiens
auguggauaucuauaucuggau

SEQ ID NO: 93300 - RNA, 22 nt, Homo sapiens
augugucaaaucuaggccaaag

SEQ ID NO: 93301 - RNA, 22 nt, Homo sapiens
auguguucaucacagcacaauu

SEQ ID NO: 93302 - RNA, 22 nt, Homo sapiens
auguuaacaucuuaguuuucau

SEQ ID NO: 93303 - RNA, 22 nt, Homo sapiens
auguuaagauggaacaugggaa

SEQ ID NO: 93304 - RNA, 22 nt, Homo sapiens
auguuagcaucuggcacuaugg

SEQ ID NO: 93305 - RNA, 20 nt, Homo sapiens
auguucuggaggacagaagc

SEQ ID NO: 93306 - RNA, 22 nt, Homo sapiens
auguugcuugaaggcauuuugu

SEQ ID NO: 93307 - RNA, 22 nt, Homo sapiens
auguuguaguaugagucaaaau

SEQ ID NO: 93308 - RNA, 22 nt, Homo sapiens
auguuuagagagggugucaaau

SEQ ID NO: 93309 - RNA, 22 nt, Homo sapiens
auguuugguaagaauauuguua

SEQ ID NO: 93310 - RNA, 22 nt, Homo sapiens
auuaaggaguggguucauggug

SEQ ID NO: 93311 - RNA, 23 nt, Homo sapiens
auuaagguuacuacaguaugagg

SEQ ID NO: 93312 - RNA, 22 nt, Homo sapiens
auuacacuuucuauucaaugag

SEQ ID NO: 93313 - RNA, 22 nt, Homo sapiens
auuacauagucaaggugucuca

SEQ ID NO: 93314 - RNA, 20 nt, Homo sapiens
auuagacuugccuuauccuu

SEQ ID NO: 93315 - RNA, 22 nt, Homo sapiens
auuagguauuuguccuaaauau

SEQ ID NO: 93316 - RNA, 22 nt, Homo sapiens
auuagguuagugcaaaaguaau

SEQ ID NO: 93317 - RNA, 22 nt, Homo sapiens
auuagguuguugcaaaaguaau

SEQ ID NO: 93318 - RNA, 22 nt, Homo sapiens
auuagugaaugugaugucuuga

SEQ ID NO: 93319 - RNA, 22 nt, Homo sapiens
auuauaguguauacuugaaauu

SEQ ID NO: 93320 - RNA, 22 nt, Homo sapiens
auuauguuguauuuccuugcag

SEQ ID NO: 93321 - RNA, 22 nt, Homo sapiens
auucaaagugcauguucccacu

SEQ ID NO: 93322 - RNA, 22 nt, Homo sapiens
auucaagggauuucaggaggcu

SEQ ID NO: 93323 - RNA, 22 nt, Homo sapiens
auucacagggggagaaggguau

SEQ ID NO: 93324 - RNA, 22 nt, Homo sapiens
auucacuguggguccuuuggau

SEQ ID NO: 93325 - RNA, 22 nt, Homo sapiens
auucacuuuuauagacaggucu

SEQ ID NO: 93326 - RNA, 22 nt, Homo sapiens
auucauagugcuaagguguauc

SEQ ID NO: 93327 - RNA, 22 nt, Homo sapiens
auuccacuuacaugaaguaccu

SEQ ID NO: 93328 - RNA, 22 nt, Homo sapiens
auuccauuuguuaucacacccg

SEQ ID NO: 93329 - RNA, 22 nt, Homo sapiens
auucccuguagaauaaggaugg

SEQ ID NO: 93330 - RNA, 22 nt, Homo sapiens
auugaacacuucugugugccag

SEQ ID NO: 93331 - RNA, 20 nt, Homo sapiens
auugaacucaguauucugaa

SEQ ID NO: 93332 - RNA, 22 nt, Homo sapiens
auugaacuuaaaagacuugcca

SEQ ID NO: 93333 - RNA, 20 nt, Homo sapiens
auugaagacuccggggcaga

SEQ ID NO: 93334 - RNA, 22 nt, Homo sapiens
auugaaugaaauggcagacacu

SEQ ID NO: 93335 - RNA, 22 nt, Homo sapiens
auugacaguuggccaguaagug

SEQ ID NO: 93336 - RNA, 19 nt, Homo sapiens
auugacauugggguguuca

SEQ ID NO: 93337 - RNA, 22 nt, Homo sapiens
auugauagaucauaugguaggu

SEQ ID NO: 93338 - RNA, 19 nt, Homo sapiens
auugauuaaguuugcuguc

SEQ ID NO: 93339 - RNA, 22 nt, Homo sapiens
auugcaacaguguugagaggug

SEQ ID NO: 93340 - RNA, 22 nt, Homo sapiens
auugcaacuuccgccuccuggg

SEQ ID NO: 93341 - RNA, 22 nt, Homo sapiens
auugcacacagaaucaggguaa

SEQ ID NO: 93342 - RNA, 22 nt, Homo sapiens
auugcaccacugcccuccagcc

SEQ ID NO: 93343 - RNA, 19 nt, Homo sapiens
auugcacuccaaccugggu

SEQ ID NO: 93344 - RNA, 22 nt, Homo sapiens
auugcacuccagccccggggac

SEQ ID NO: 93345 - RNA, 23 nt, Homo sapiens
auugcacuccagccuaccugggc

SEQ ID NO: 93346 - RNA, 22 nt, Homo sapiens
auugcacuccagccuggcaaua

SEQ ID NO: 93347 - RNA, 22 nt, Homo sapiens
auugcacuccagccugggcgac

SEQ ID NO: 93348 - RNA, 22 nt, Homo sapiens
auugcacuccagccugggcuag

SEQ ID NO: 93349 - RNA, 22 nt, Homo sapiens
auugcacuccagucugggcaac

SEQ ID NO: 93350 - RNA, 22 nt, Homo sapiens
auugcacuccauccuaggugac

SEQ ID NO: 93351 - RNA, 22 nt, Homo sapiens
auugcacucuaaccuaggugac

SEQ ID NO: 93352 - RNA, 22 nt, Homo sapiens
auugcagaaaugacagagcgcc

SEQ ID NO: 93353 - RNA, 22 nt, Homo sapiens
auugcagauucgcuuuguguug

SEQ ID NO: 93354 - RNA, 22 nt, Homo sapiens
auugcauugugaucuucccaga

SEQ ID NO: 93355 - RNA, 22 nt, Homo sapiens
auugcauuuucagguuggucug

SEQ ID NO: 93356 - RNA, 22 nt, Homo sapiens
auugcuaauaugcuucaggcaa

SEQ ID NO: 93357 - RNA, 22 nt, Homo sapiens
auugcucuuagaaauauuucuu

SEQ ID NO: 93358 - RNA, 22 nt, Homo sapiens
auugcuuacccuguauuagauc

SEQ ID NO: 93359 - RNA, 22 nt, Homo sapiens
auugcuuacuaaucaucuucag

SEQ ID NO: 93360 - RNA, 22 nt, Homo sapiens
auuggcaauagcuuucuuacua

SEQ ID NO: 93361 - RNA, 22 nt, Homo sapiens
auuggcaaucgucuccauuuuu

SEQ ID NO: 93362 - RNA, 22 nt, Homo sapiens
auuggcagaaaucuuuauagua

SEQ ID NO: 93363 - RNA, 22 nt, Homo sapiens
auuggcauauccacgacaaugc

SEQ ID NO: 93364 - RNA, 22 nt, Homo sapiens
auuggcuuuauacauaagaaua

SEQ ID NO: 93365 - RNA, 22 nt, Homo sapiens
auuggucuugaaaccagagaga

SEQ ID NO: 93366 - RNA, 22 nt, Homo sapiens
auuggugaccugcggcaguaug

SEQ ID NO: 93367 - RNA, 22 nt, Homo sapiens
auuguaauuuuagagaaagugg

SEQ ID NO: 93368 - RNA, 22 nt, Homo sapiens
auuguacuccagccugggcgac

SEQ ID NO: 93369 - RNA, 22 nt, Homo sapiens
auuguacugccccccuguugcu

SEQ ID NO: 93370 - RNA, 21 nt, Homo sapiens
auuguauguaaaccaaaugag

SEQ ID NO: 93371 - RNA, 22 nt, Homo sapiens
auugucauuuucugagaaguaa

SEQ ID NO: 93372 - RNA, 22 nt, Homo sapiens
auugugauugcugcuaggccua

SEQ ID NO: 93373 - RNA, 22 nt, Homo sapiens
auuguguagucuuacugcuugc

SEQ ID NO: 93374 - RNA, 22 nt, Homo sapiens
auuuaaccaucugcaguggcac

SEQ ID NO: 93375 - RNA, 22 nt, Homo sapiens
auuuaugguuaauauaggaagu

SEQ ID NO: 93376 - RNA, 22 nt, Homo sapiens
auuuccuguaggggcuugcgaa

SEQ ID NO: 93377 - RNA, 19 nt, Homo sapiens
auuugaucaucaggcacag

SEQ ID NO: 93378 - RNA, 22 nt, Homo sapiens
auuuggcagugaagggaucaca

SEQ ID NO: 93379 - RNA, 22 nt, Homo sapiens
auuugggaaugugcauuauacu

SEQ ID NO: 93380 - RNA, 22 nt, Homo sapiens
auuugguguuguuuggagccua

SEQ ID NO: 93381 - RNA, 22 nt, Homo sapiens
auuugguuauggucauggacac

SEQ ID NO: 93382 - RNA, 22 nt, Homo sapiens
auuugguuauucaguuguucag

SEQ ID NO: 93383 - RNA, 22 nt, Homo sapiens
auuugucacuauguggcuaaua

SEQ ID NO: 93384 - RNA, 21 nt, Homo sapiens
auuuuugcagagcugguagug

SEQ ID NO: 93385 - RNA, 22 nt, Homo sapiens
caaaccuguaggggccaagagg

SEQ ID NO: 93386 - RNA, 22 nt, Homo sapiens
caaaggugcuuuccagguccaa

SEQ ID NO: 93387 - RNA, 22 nt, Homo sapiens
cugacaagauucaucacucagu

SEQ ID NO: 93388 - RNA, 22 nt, Homo sapiens
cugacacuucaaaacugccaau

SEQ ID NO: 93389 - RNA, 22 nt, Homo sapiens
cugacagucucauugauuugcu

SEQ ID NO: 93390 - RNA, 22 nt, Homo sapiens
cugaccauagacuacucugggc

SEQ ID NO: 93391 - RNA, 22 nt, Homo sapiens
cugaccucugucaaagacaccc

SEQ ID NO: 93392 - RNA, 22 nt, Homo sapiens
cugacucagacacauguauaug

SEQ ID NO: 93393 - RNA, 22 nt, Homo sapiens
cugacugugcaugcccagcccc

SEQ ID NO: 93394 - RNA, 22 nt, Homo sapiens
cugagaacaucauucagauauu

SEQ ID NO: 93395 - RNA, 22 nt, Homo sapiens
cugagaaugaugauuuccaguu

SEQ ID NO: 93396 - RNA, 22 nt, Homo sapiens
cugagagaugagaccucucacu

SEQ ID NO: 93397 - RNA, 22 nt, Homo sapiens
cugagcaaagaagugauaauga

SEQ ID NO: 93398 - RNA, 22 nt, Homo sapiens
cugagcaucauggcagaaucuu

SEQ ID NO: 93399 - RNA, 22 nt, Homo sapiens
cugagguaauuuuccagauaau

SEQ ID NO: 93400 - RNA, 22 nt, Homo sapiens
cugagguauaucccauuagaag

SEQ ID NO: 93401 - RNA, 22 nt, Homo sapiens
cugaggugggaggauuggcuug

SEQ ID NO: 93402 - RNA, 20 nt, Homo sapiens
cugagguugggguccuuccc

SEQ ID NO: 93403 - RNA, 18 nt, Homo sapiens
cugagucauuccuggguc

SEQ ID NO: 93404 - RNA, 20 nt, Homo sapiens
cugauacagccugagcucuc

SEQ ID NO: 93405 - RNA, 22 nt, Homo sapiens
cugauaguucucuuuagaguuu

SEQ ID NO: 93406 - RNA, 22 nt, Homo sapiens
cugaucuaugaacacaggauau

SEQ ID NO: 93407 - RNA, 22 nt, Homo sapiens
cugaugguuuuacacaagggca

SEQ ID NO: 93408 - RNA, 22 nt, Homo sapiens
cugauuguagagccccagggcu

SEQ ID NO: 93409 - RNA, 22 nt, Homo sapiens
cugauuguuugccucuaaaauc

SEQ ID NO: 93410 - RNA, 22 nt, Homo sapiens
cugcaaauacuugugggauuuu

SEQ ID NO: 93411 - RNA, 22 nt, Homo sapiens
cugcaagaaucguaguauuuga

SEQ ID NO: 93412 - RNA, 22 nt, Homo sapiens
cugcaauguuugaaauggcaaa

SEQ ID NO: 93413 - RNA, 20 nt, Homo sapiens
cugcacauccacucuacuuc

SEQ ID NO: 93414 - RNA, 19 nt, Homo sapiens
cugcacugagaaaaggagg

SEQ ID NO: 93415 - RNA, 22 nt, Homo sapiens
cugcauaaucaucucucugcau

SEQ ID NO: 93416 - RNA, 22 nt, Homo sapiens
cugccuagaucugaaccuggcu

SEQ ID NO: 93417 - RNA, 20 nt, Homo sapiens
cugcuccccuacaaaucuca

SEQ ID NO: 93418 - RNA, 22 nt, Homo sapiens
cugcuggucuuuaaggucuagg

SEQ ID NO: 93419 - RNA, 22 nt, Homo sapiens
cugcuguuguuaacuuuuggag

SEQ ID NO: 93420 - RNA, 22 nt, Homo sapiens
cuggaaacaucuuaggaaugca

SEQ ID NO: 93421 - RNA, 22 nt, Homo sapiens
cuggaaagaaacccuuaauucu

SEQ ID NO: 93422 - RNA, 22 nt, Homo sapiens
cuggaaagcaaguccauugcuc

SEQ ID NO: 93423 - RNA, 22 nt, Homo sapiens
cuggaagcacaacgcauuuauu

SEQ ID NO: 93424 - RNA, 18 nt, Homo sapiens
cuggaaggcuacuacagu

SEQ ID NO: 93425 - RNA, 22 nt, Homo sapiens
cuggaauuacaggguugagcua

SEQ ID NO: 93426 - RNA, 22 nt, Homo sapiens
cuggaauucaaaaucugaauuu

SEQ ID NO: 93427 - RNA, 22 nt, Homo sapiens
cuggagauuaaccaauugccau

SEQ ID NO: 93428 - RNA, 22 nt, Homo sapiens
cuggaguaugaaccauguauca

SEQ ID NO: 93429 - RNA, 22 nt, Homo sapiens
cuggaguaugauguuagcguug

SEQ ID NO: 93430 - RNA, 22 nt, Homo sapiens
cuggauagucaggagauauaua

SEQ ID NO: 93431 - RNA, 22 nt, Homo sapiens
cuggauauguugcaacauuucc

SEQ ID NO: 93432 - RNA, 20 nt, Homo sapiens
cuggaugucgaggcagaggu

SEQ ID NO: 93433 - RNA, 18 nt, Homo sapiens
cuggaugucgaguguguu

SEQ ID NO: 93434 - RNA, 22 nt, Homo sapiens
cuggcaaaaagagggcaauaau

SEQ ID NO: 93435 - RNA, 22 nt, Homo sapiens
cuggcaaauaguagagccagga

SEQ ID NO: 93436 - RNA, 22 nt, Homo sapiens
cuggcaccauuuugaucaaagg

SEQ ID NO: 93437 - RNA, 22 nt, Homo sapiens
cuggcaucuaaauacuugaugu

SEQ ID NO: 93438 - RNA, 22 nt, Homo sapiens
cuggccagagacauucauuaaa

SEQ ID NO: 93439 - RNA, 22 nt, Homo sapiens
cuggcgagacagcuccaucacu

SEQ ID NO: 93440 - RNA, 22 nt, Homo sapiens
cuggcucugggcuaaagaaaua

SEQ ID NO: 93441 - RNA, 22 nt, Homo sapiens
cuggcugagugguaaguagagg

SEQ ID NO: 93442 - RNA, 22 nt, Homo sapiens
cugggcaaugcggcuggauaga

SEQ ID NO: 93443 - RNA, 22 nt, Homo sapiens
cugggguaggacuggcuuuuga

SEQ ID NO: 93444 - RNA, 22 nt, Homo sapiens
cugguaagaaggucuaagucaa

SEQ ID NO: 93445 - RNA, 22 nt, Homo sapiens
cugguaguguuuauaaggguau

SEQ ID NO: 93446 - RNA, 22 nt, Homo sapiens
cuggugauugguuucauucagu

SEQ ID NO: 93447 - RNA, 22 nt, Homo sapiens
cuguaaaguucucauuguagcc

SEQ ID NO: 93448 - RNA, 22 nt, Homo sapiens
cuguagacauuaggccugcacu

SEQ ID NO: 93449 - RNA, 19 nt, Homo sapiens
cugucacugaggaagacug

SEQ ID NO: 93450 - RNA, 22 nt, Homo sapiens
cugucacuggggcacauguccc

SEQ ID NO: 93451 - RNA, 22 nt, Homo sapiens
cugucagugggaguucaggcuu

SEQ ID NO: 93452 - RNA, 22 nt, Homo sapiens
cugucaucauuucuaugugcca

SEQ ID NO: 93453 - RNA, 22 nt, Homo sapiens
cuguccugcagagucagaauga

SEQ ID NO: 93454 - RNA, 22 nt, Homo sapiens
cugucuaugagccaggaagcca

SEQ ID NO: 93455 - RNA, 22 nt, Homo sapiens
cugucucagccucuccaguagc

SEQ ID NO: 93456 - RNA, 22 nt, Homo sapiens
cugucuggaggccugcaaauaa

SEQ ID NO: 93457 - RNA, 22 nt, Homo sapiens
cugugaucuuuuuucauguggu

SEQ ID NO: 93458 - RNA, 22 nt, Homo sapiens
cugugcaaguuauaggccaggu

SEQ ID NO: 93459 - RNA, 22 nt, Homo sapiens
cugugccaagcuugcgaugugc

SEQ ID NO: 93460 - RNA, 22 nt, Homo sapiens
cugugcuugagagaugacacag

SEQ ID NO: 93461 - RNA, 22 nt, Homo sapiens
cugugcuuggagucccccuagg

SEQ ID NO: 93462 - RNA, 20 nt, Homo sapiens
cugugguagggaccaggaau

SEQ ID NO: 93463 - RNA, 22 nt, Homo sapiens
cugugguauuauuagaaauauc

SEQ ID NO: 93464 - RNA, 22 nt, Homo sapiens
cugugguguaacucuuggggcg

SEQ ID NO: 93465 - RNA, 22 nt, Homo sapiens
cugugguuacguucuuugugcu

SEQ ID NO: 93466 - RNA, 22 nt, Homo sapiens
cuguuagguuaaggaauggcaa

SEQ ID NO: 93467 - RNA, 19 nt, Homo sapiens
cuguuguacuccaggcauu

SEQ ID NO: 93468 - RNA, 22 nt, Homo sapiens
cuguuugaggguuugcuuucag

SEQ ID NO: 93469 - RNA, 22 nt, Homo sapiens
cuguuugauuaagugguggaaa

SEQ ID NO: 93470 - RNA, 22 nt, Homo sapiens
cuguuugguuaucuuuuccugu

SEQ ID NO: 93471 - RNA, 22 nt, Homo sapiens
cuuaaguaguuguggaaugaau

SEQ ID NO: 93472 - RNA, 22 nt, Homo sapiens
cuuagcaaugucguguacucac

SEQ ID NO: 93473 - RNA, 20 nt, Homo sapiens
cuuaucaguggcaaguauaa

SEQ ID NO: 93474 - RNA, 22 nt, Homo sapiens
cuucaaaguuggcuaggagaca

SEQ ID NO: 93475 - RNA, 17 nt, Homo sapiens
cuucaaauaauuucccc

SEQ ID NO: 93476 - RNA, 22 nt, Homo sapiens
cuucacggugccuacuuguguc

SEQ ID NO: 93477 - RNA, 22 nt, Homo sapiens
cuucaguucuguaaggacagca

SEQ ID NO: 93478 - RNA, 22 nt, Homo sapiens
uuugauguugauacuaccuuca

SEQ ID NO: 93479 - RNA, 23 nt, Homo sapiens
caugaacuaguuugcagccauga

SEQ ID NO: 93480 - RNA, 22 nt, Homo sapiens
caugacacauguuuaccuaugu

SEQ ID NO: 93481 - RNA, 22 nt, Homo sapiens
caugcauagccauucauucguu

SEQ ID NO: 93482 - RNA, 22 nt, Homo sapiens
caugccacugcacgccauccug

SEQ ID NO: 93483 - RNA, 22 nt, Homo sapiens
caugccacugcacuccaaccug

SEQ ID NO: 93484 - RNA, 22 nt, Homo sapiens
cauggagcuaggcuugaucccu

SEQ ID NO: 93485 - RNA, 22 nt, Homo sapiens
cauggauuuuuuugaauggcag

SEQ ID NO: 93486 - RNA, 22 nt, Homo sapiens
cauggcacuggugggagugucu

SEQ ID NO: 93487 - RNA, 22 nt, Homo sapiens
cauggcauuucaagauuuacca

SEQ ID NO: 93488 - RNA, 22 nt, Homo sapiens
cauggcccugggcugggcgaac

SEQ ID NO: 93489 - RNA, 22 nt, Homo sapiens
cauggccuuuggaaugugucua

SEQ ID NO: 93490 - RNA, 22 nt, Homo sapiens
caugggacugucuuggcuauac

SEQ ID NO: 93491 - RNA, 22 nt, Homo sapiens
cauguauagauuccauaguggu

SEQ ID NO: 93492 - RNA, 21 nt, Homo sapiens
caugucacugcacucuagccu

SEQ ID NO: 93493 - RNA, 22 nt, Homo sapiens
caugucacuuccucucugaugg

SEQ ID NO: 93494 - RNA, 22 nt, Homo sapiens
caugucuuuuaaacauucaacu

SEQ ID NO: 93495 - RNA, 19 nt, Homo sapiens
caugugcacuacuggcuuc

SEQ ID NO: 93496 - RNA, 22 nt, Homo sapiens
cauuacacuccagccuggguga

SEQ ID NO: 93497 - RNA, 22 nt, Homo sapiens
cauugcaauccagccugggcaa

SEQ ID NO: 93498 - RNA, 22 nt, Homo sapiens
cauugcaaugaggucuugcagu

SEQ ID NO: 93499 - RNA, 19 nt, Homo sapiens
cauugcacuccacccuggg

SEQ ID NO: 93500 - RNA, 22 nt, Homo sapiens
cauugcacuccagccugaguga

SEQ ID NO: 93501 - RNA, 20 nt, Homo sapiens
cauugcacuccagccugcug

SEQ ID NO: 93502 - RNA, 22 nt, Homo sapiens
cauugcacuccagcucugggcg

SEQ ID NO: 93503 - RNA, 16 nt, Homo sapiens
cauugcacucuagccu

SEQ ID NO: 93504 - RNA, 22 nt, Homo sapiens
cauugcacucuagucuggguga

SEQ ID NO: 93505 - RNA, 22 nt, Homo sapiens
cauugcacugcauucugggcaa

SEQ ID NO: 93506 - RNA, 22 nt, Homo sapiens
cauugcacuuagacaacuuuug

SEQ ID NO: 93507 - RNA, 22 nt, Homo sapiens
cauugcauuuucuuuguaccuu

SEQ ID NO: 93508 - RNA, 20 nt, Homo sapiens
cauugcccuccagccugggc

SEQ ID NO: 93509 - RNA, 22 nt, Homo sapiens
cauugcuaaaagucauauauaa

SEQ ID NO: 93510 - RNA, 22 nt, Homo sapiens
cauugcuuuuggugguuuagac

SEQ ID NO: 93511 - RNA, 22 nt, Homo sapiens
cauuugguggcuacagaguaac

SEQ ID NO: 93512 - RNA, 22 nt, Homo sapiens
ccaaaguauuuucacugauauc

SEQ ID NO: 93513 - RNA, 22 nt, Homo sapiens
ccaaaucucauguugaaaugug

SEQ ID NO: 93514 - RNA, 22 nt, Homo sapiens
ccaaggaauacccucccuuuuu

SEQ ID NO: 93515 - RNA, 22 nt, Homo sapiens
ccaaggcacugauucuguacuc

SEQ ID NO: 93516 - RNA, 22 nt, Homo sapiens
ccacaaccuccauauccugggu

SEQ ID NO: 93517 - RNA, 22 nt, Homo sapiens
ccacaguggauuaaaguuacug

SEQ ID NO: 93518 - RNA, 22 nt, Homo sapiens
ccacaguugaaauuuugacugu

SEQ ID NO: 93519 - RNA, 22 nt, Homo sapiens
ccacccuuccauucuuccucuu

SEQ ID NO: 93520 - RNA, 22 nt, Homo sapiens
ccacugggcaguuuauuaucag

SEQ ID NO: 93521 - RNA, 22 nt, Homo sapiens
ccacugggcuagguguuuugga

SEQ ID NO: 93522 - RNA, 22 nt, Homo sapiens
ccagauguuuucauucagcaag

SEQ ID NO: 93523 - RNA, 22 nt, Homo sapiens
ccagcaccauuuguugaauagg

SEQ ID NO: 93524 - RNA, 20 nt, Homo sapiens
ccagcaucauuagauucugg

SEQ ID NO: 93525 - RNA, 22 nt, Homo sapiens
ccagccgggugcaguggcucac

SEQ ID NO: 93526 - RNA, 22 nt, Homo sapiens
ccaguauuuuauugaggguuuu

SEQ ID NO: 93527 - RNA, 22 nt, Homo sapiens
ccagucuuggugucuguagcac

SEQ ID NO: 93528 - RNA, 22 nt, Homo sapiens
ccagugauggcugccucauuug

SEQ ID NO: 93529 - RNA, 22 nt, Homo sapiens
ccagugguugggccggagacgg

SEQ ID NO: 93530 - RNA, 21 nt, Homo sapiens
ccaguguaaugauagcaggca

SEQ ID NO: 93531 - RNA, 22 nt, Homo sapiens
ccaguguucuggaaggcugagu

SEQ ID NO: 93532 - RNA, 22 nt, Homo sapiens
ccaguguuuggauuagggaugc

SEQ ID NO: 93533 - RNA, 22 nt, Homo sapiens
ccaguuuucaagauaaugguuu

SEQ ID NO: 93534 - RNA, 17 nt, Homo sapiens
ccaguuuucccucagug

SEQ ID NO: 93535 - RNA, 22 nt, Homo sapiens
ccaguuuuucauuuauacuagu

SEQ ID NO: 93536 - RNA, 22 nt, Homo sapiens
ccaucacacugugauuauuauc

SEQ ID NO: 93537 - RNA, 22 nt, Homo sapiens
ccaucccuuucugagcaguucc

SEQ ID NO: 93538 - RNA, 22 nt, Homo sapiens
ccauggcuauucuguaaggguu

SEQ ID NO: 93539 - RNA, 18 nt, Homo sapiens
ccauucaacagauuuguc

SEQ ID NO: 93540 - RNA, 23 nt, Homo sapiens
ccauugcacuccagccucaguga

SEQ ID NO: 93541 - RNA, 22 nt, Homo sapiens
ccauugcacuccagccucggca

SEQ ID NO: 93542 - RNA, 22 nt, Homo sapiens
ccauuugguuauguaucgaaac

SEQ ID NO: 93543 - RNA, 22 nt, Homo sapiens
cccagcguucggcauggcugag

SEQ ID NO: 93544 - RNA, 22 nt, Homo sapiens
cccaguaaucuugccaguuuuc

SEQ ID NO: 93545 - RNA, 22 nt, Homo sapiens
cccauuguuaaguugaguaucu

SEQ ID NO: 93546 - RNA, 20 nt, Homo sapiens
ccccaguuuuucuauuagcu

SEQ ID NO: 93547 - RNA, 22 nt, Homo sapiens
ccccauguucucucugcagcuc

SEQ ID NO: 93548 - RNA, 22 nt, Homo sapiens
ccccauuguugugguuuuaucu

SEQ ID NO: 93549 - RNA, 22 nt, Homo sapiens
ccccauuugaacuccuucaacu

SEQ ID NO: 93550 - RNA, 22 nt, Homo sapiens
ccccguuacagccucagugccu

SEQ ID NO: 93551 - RNA, 22 nt, Homo sapiens
ccccugaaacucacucauuauc

SEQ ID NO: 93552 - RNA, 17 nt, Homo sapiens
ccccugagcgaugcagu

SEQ ID NO: 93553 - RNA, 22 nt, Homo sapiens
cccuaagacagugaggggugca

SEQ ID NO: 93554 - RNA, 22 nt, Homo sapiens
cccugaagauacagaguuuggg

SEQ ID NO: 93555 - RNA, 22 nt, Homo sapiens
cccugacauucggagauguagu

SEQ ID NO: 93556 - RNA, 22 nt, Homo sapiens
cccugagagcagggucuuucuc

SEQ ID NO: 93557 - RNA, 22 nt, Homo sapiens
cccugagaugcuguuaaucugu

SEQ ID NO: 93558 - RNA, 22 nt, Homo sapiens
cccugagcagccugaguuuccc

SEQ ID NO: 93559 - RNA, 21 nt, Homo sapiens
cccugguguuuggaguuugag

SEQ ID NO: 93560 - RNA, 22 nt, Homo sapiens
ccggguguuuuguucucucaga

SEQ ID NO: 93561 - RNA, 20 nt, Homo sapiens
ccuaguguucuuaggcugca

SEQ ID NO: 93562 - RNA, 19 nt, Homo sapiens
ccucaaguacuaauauguu

SEQ ID NO: 93563 - RNA, 22 nt, Homo sapiens
ccucacaaccuuuauugaagag

SEQ ID NO: 93564 - RNA, 22 nt, Homo sapiens
ccucaguguuuaucauuauuuu

SEQ ID NO: 93565 - RNA, 22 nt, Homo sapiens
ccucauggagaacaucugcuag

SEQ ID NO: 93566 - RNA, 22 nt, Homo sapiens
ccucauggagaaccucugcuag

SEQ ID NO: 93567 - RNA, 21 nt, Homo sapiens
ccuccauuuguauucuugccc

SEQ ID NO: 93568 - RNA, 21 nt, Homo sapiens
ccucuuugagggaagaaaggg

SEQ ID NO: 93569 - RNA, 22 nt, Homo sapiens
ccugagacuugagggggcuucu

SEQ ID NO: 93570 - RNA, 22 nt, Homo sapiens
gauuccauugcgaauuuucaga

SEQ ID NO: 93571 - RNA, 22 nt, Homo sapiens
gauuccauuuguggcuauuuac

SEQ ID NO: 93572 - RNA, 22 nt, Homo sapiens
gauugcuaaauuguccuucugu

SEQ ID NO: 93573 - RNA, 22 nt, Homo sapiens
gauugguugaaaguagaauacu

SEQ ID NO: 93574 - RNA, 22 nt, Homo sapiens
gauuguguucauaggcauguua

SEQ ID NO: 93575 - RNA, 22 nt, Homo sapiens
gauuuguauuaaaagugugacg

SEQ ID NO: 93576 - RNA, 20 nt, Homo sapiens
gcaaauggaucccacaagcc

SEQ ID NO: 93577 - RNA, 22 nt, Homo sapiens
gcaacugguuucaguuuuucag

SEQ ID NO: 93578 - RNA, 22 nt, Homo sapiens
gcaagacaugucuaagguuuaa

SEQ ID NO: 93579 - RNA, 22 nt, Homo sapiens
gcaauacugacagcauuaguuu

SEQ ID NO: 93580 - RNA, 22 nt, Homo sapiens
gcaauguuacugaauguguuuu

SEQ ID NO: 93581 - RNA, 22 nt, Homo sapiens
gcacacguagaagcaugcauca

SEQ ID NO: 93582 - RNA, 22 nt, Homo sapiens
gcacacuuacacgaaccuagau

SEQ ID NO: 93583 - RNA, 22 nt, Homo sapiens
gcacaguggcucccgucuauaa

SEQ ID NO: 93584 - RNA, 22 nt, Homo sapiens
gcacaguuaaagggucauguga

SEQ ID NO: 93585 - RNA, 22 nt, Homo sapiens
gcaccacugcacucucagcuug

SEQ ID NO: 93586 - RNA, 22 nt, Homo sapiens
gcaccaugguagaauaauggua

SEQ ID NO: 93587 - RNA, 17 nt, Homo sapiens
gcacuggcguaucccac

SEQ ID NO: 93588 - RNA, 22 nt, Homo sapiens
gcagaauugguuucuucuaagg

SEQ ID NO: 93589 - RNA, 22 nt, Homo sapiens
gcagagaaacaggucuaaggag

SEQ ID NO: 93590 - RNA, 19 nt, Homo sapiens
gcagagaugugguagcuug

SEQ ID NO: 93591 - RNA, 20 nt, Homo sapiens
gcagcaccauauuucuaaga

SEQ ID NO: 93592 - RNA, 22 nt, Homo sapiens
gcagcagugcccuggauggaaa

SEQ ID NO: 93593 - RNA, 22 nt, Homo sapiens
gcagcagugugggcugaaccua

SEQ ID NO: 93594 - RNA, 22 nt, Homo sapiens
gcaggauuggagccucucugaa

SEQ ID NO: 93595 - RNA, 22 nt, Homo sapiens
gcagguguuaugcaaacaacug

SEQ ID NO: 93596 - RNA, 17 nt, Homo sapiens
gcaguacuuaguaagga

SEQ ID NO: 93597 - RNA, 23 nt, Homo sapiens
gcagucauuuggaaaagguugaa

SEQ ID NO: 93598 - RNA, 22 nt, Homo sapiens
gcagugacaugugccaguuuau

SEQ ID NO: 93599 - RNA, 20 nt, Homo sapiens
gcaguguucugaccugaauc

SEQ ID NO: 93600 - RNA, 22 nt, Homo sapiens
gcaguguucugggcaggaagaa

SEQ ID NO: 93601 - RNA, 22 nt, Homo sapiens
gcauaaagcuaauaagacgaag

SEQ ID NO: 93602 - RNA, 22 nt, Homo sapiens
gcauaugucuuuauagcagcau

SEQ ID NO: 93603 - RNA, 22 nt, Homo sapiens
gcaugcacaugugaaaaaauga

SEQ ID NO: 93604 - RNA, 22 nt, Homo sapiens
gcaugcacuguauuuaaguauc

SEQ ID NO: 93605 - RNA, 22 nt, Homo sapiens
gcaugcauuuuccuaacuagaa

SEQ ID NO: 93606 - RNA, 22 nt, Homo sapiens
gcauggaaggcgcuuugugacu

SEQ ID NO: 93607 - RNA, 22 nt, Homo sapiens
gcauggagaaggggacugauuc

SEQ ID NO: 93608 - RNA, 22 nt, Homo sapiens
gcauggccuuuaaaugucacag

SEQ ID NO: 93609 - RNA, 22 nt, Homo sapiens
gcauugcacuuggcauagacug

SEQ ID NO: 93610 - RNA, 22 nt, Homo sapiens
gccaagaagugucuaagcagga

SEQ ID NO: 93611 - RNA, 22 nt, Homo sapiens
gccauggaggauuuauagaggc

SEQ ID NO: 93612 - RNA, 22 nt, Homo sapiens
gcccacuguuaaauuuguuuua

SEQ ID NO: 93613 - RNA, 22 nt, Homo sapiens
gcccagcguucagggaggggcu

SEQ ID NO: 93614 - RNA, 22 nt, Homo sapiens
gccccaguacaggcuccuuaga

SEQ ID NO: 93615 - RNA, 22 nt, Homo sapiens
gccccgggugaugcagccguca

SEQ ID NO: 93616 - RNA, 22 nt, Homo sapiens
gcccgugagacuggaagcaaga

SEQ ID NO: 93617 - RNA, 22 nt, Homo sapiens
gcccugagauucuuggauucug

SEQ ID NO: 93618 - RNA, 22 nt, Homo sapiens
gcccugauacauucuucugccu

SEQ ID NO: 93619 - RNA, 22 nt, Homo sapiens
gccuagggacaaaccguccgac

SEQ ID NO: 93620 - RNA, 22 nt, Homo sapiens
gcguugcacuccagccugggua

SEQ ID NO: 93621 - RNA, 22 nt, Homo sapiens
gcuaaaugcaugaggcgaugug

SEQ ID NO: 93622 - RNA, 22 nt, Homo sapiens
gcucaguuuccucagcugcaaa

SEQ ID NO: 93623 - RNA, 22 nt, Homo sapiens
gcuccuuugaguagcuucugug

SEQ ID NO: 93624 - RNA, 22 nt, Homo sapiens
gcucuuuugggguaauucugag

SEQ ID NO: 93625 - RNA, 22 nt, Homo sapiens
gcugaaauguuuaauuugggag

SEQ ID NO: 93626 - RNA, 22 nt, Homo sapiens
gcugacagugguuauacuuaga

SEQ ID NO: 93627 - RNA, 22 nt, Homo sapiens
gcugagcuaugccauauaugcc

SEQ ID NO: 93628 - RNA, 22 nt, Homo sapiens
gcugaguaguauuucauuguau

SEQ ID NO: 93629 - RNA, 22 nt, Homo sapiens
gcugcguguagaguucucacug

SEQ ID NO: 93630 - RNA, 22 nt, Homo sapiens
gcugcuguuucucuuucagcau

SEQ ID NO: 93631 - RNA, 22 nt, Homo sapiens
gcugcuuuugaugacaaaaaca

SEQ ID NO: 93632 - RNA, 22 nt, Homo sapiens
gcuggaauuaacauagaugugc

SEQ ID NO: 93633 - RNA, 22 nt, Homo sapiens
gcuggcaaguggccuacuuugu

SEQ ID NO: 93634 - RNA, 22 nt, Homo sapiens
gcugugauucuguguagauagu

SEQ ID NO: 93635 - RNA, 22 nt, Homo sapiens
gcugugguuuaguagaaagaag

SEQ ID NO: 93636 - RNA, 22 nt, Homo sapiens
gcuguguucucgaggcggggga

SEQ ID NO: 93637 - RNA, 22 nt, Homo sapiens
gcuguguugugcccagcaucau

SEQ ID NO: 93638 - RNA, 22 nt, Homo sapiens
gcuguugugaacuauacaucua

SEQ ID NO: 93639 - RNA, 22 nt, Homo sapiens
gcuuguguucaagucacccuua

SEQ ID NO: 93640 - RNA, 22 nt, Homo sapiens
gcuuugguucaaccaggcaauu

SEQ ID NO: 93641 - RNA, 19 nt, Homo sapiens
gcuuuguggggaaggagcc

SEQ ID NO: 93642 - RNA, 21 nt, Homo sapiens
gcuuuuucggaagucuuuggc

SEQ ID NO: 93643 - RNA, 22 nt, Homo sapiens
ggaaagauguaauauuaucuaa

SEQ ID NO: 93644 - RNA, 22 nt, Homo sapiens
ggaaaguccuucuguaggcucc

SEQ ID NO: 93645 - RNA, 22 nt, Homo sapiens
ggaaaucucugaggcucccuuc

SEQ ID NO: 93646 - RNA, 22 nt, Homo sapiens
ggaaauguuggugucaugaguu

SEQ ID NO: 93647 - RNA, 23 nt, Homo sapiens
ggaaauguuuaagggguugggag

SEQ ID NO: 93648 - RNA, 22 nt, Homo sapiens
ggaacaccauuuuuccugccuu

SEQ ID NO: 93649 - RNA, 22 nt, Homo sapiens
ggaagacaguguggugauuccu

SEQ ID NO: 93650 - RNA, 22 nt, Homo sapiens
ggaagacuuagaguagcaucag

SEQ ID NO: 93651 - RNA, 20 nt, Homo sapiens
ggaagagugacacaagguau

SEQ ID NO: 93652 - RNA, 22 nt, Homo sapiens
ggaagccugcacucgggcaggg

SEQ ID NO: 93653 - RNA, 22 nt, Homo sapiens
ggaaugagaaauauuacacaau

SEQ ID NO: 93654 - RNA, 22 nt, Homo sapiens
ggaaugcuaaaauaggaugcug

SEQ ID NO: 93655 - RNA, 19 nt, Homo sapiens
ggaaugcuauucaaccuuu

SEQ ID NO: 93656 - RNA, 22 nt, Homo sapiens
ggaauuaaggcaauugaaagcu

SEQ ID NO: 93657 - RNA, 22 nt, Homo sapiens
ggacaagagacugggacacuga

SEQ ID NO: 93658 - RNA, 22 nt, Homo sapiens
ggacagaaaggguucaccaaac

SEQ ID NO: 93659 - RNA, 22 nt, Homo sapiens
ggacaguagugcuuucuaucau

SEQ ID NO: 93660 - RNA, 22 nt, Homo sapiens
ggacagugaaugccacuccucc

SEQ ID NO: 93661 - RNA, 22 nt, Homo sapiens
guaauaacuguggaaaaagguu

SEQ ID NO: 93662 - RNA, 22 nt, Homo sapiens
guaaucucagcuacucaggagg

SEQ ID NO: 93663 - RNA, 22 nt, Homo sapiens
guaaucucagcuacucgggaga

SEQ ID NO: 93664 - RNA, 22 nt, Homo sapiens
guaaucucagcuacuugggagc

SEQ ID NO: 93665 - RNA, 22 nt, Homo sapiens
guaaucucagcuucuugggagg

SEQ ID NO: 93666 - RNA, 19 nt, Homo sapiens
guaaucucaguacuuuggu

SEQ ID NO: 93667 - RNA, 22 nt, Homo sapiens
guacaagugcaguuucguuaca

SEQ ID NO: 93668 - RNA, 22 nt, Homo sapiens
guacagugcucacaaugagagc

SEQ ID NO: 93669 - RNA, 22 nt, Homo sapiens
guacaguggguguagggaccag

SEQ ID NO: 93670 - RNA, 22 nt, Homo sapiens
guaccucaguuggaaaugcaga

SEQ ID NO: 93671 - RNA, 22 nt, Homo sapiens
guaccuguauguucauuucaca

SEQ ID NO: 93672 - RNA, 17 nt, Homo sapiens
guacucagugaccaugg

SEQ ID NO: 93673 - RNA, 22 nt, Homo sapiens
guagaaaguuugcugucacaug

SEQ ID NO: 93674 - RNA, 22 nt, Homo sapiens
guagaagcacagggccuguauu

SEQ ID NO: 93675 - RNA, 22 nt, Homo sapiens
guagaauguauacaguauacag

SEQ ID NO: 93676 - RNA, 22 nt, Homo sapiens
guagcaccagugcucuucucaa

SEQ ID NO: 93677 - RNA, 22 nt, Homo sapiens
guaguuuaucagaaagaauagg

SEQ ID NO: 93678 - RNA, 23 nt, Homo sapiens
guaguuugaugcaauccacuugu

SEQ ID NO: 93679 - RNA, 22 nt, Homo sapiens
guauaaguugacucaaucuuug

SEQ ID NO: 93680 - RNA, 22 nt, Homo sapiens
guauaugccucaguuauagcac

SEQ ID NO: 93681 - RNA, 22 nt, Homo sapiens
guaucccuugcuaucugaaucu

SEQ ID NO: 93682 - RNA, 22 nt, Homo sapiens
guauccugaaguucucagcacu

SEQ ID NO: 93683 - RNA, 22 nt, Homo sapiens
guaugacacaggaagcuuaacc

SEQ ID NO: 93684 - RNA, 22 nt, Homo sapiens
guaugaguuuucugaugugugg

SEQ ID NO: 93685 - RNA, 22 nt, Homo sapiens
guauggaauuugugaccuuaua

SEQ ID NO: 93686 - RNA, 22 nt, Homo sapiens
guauggcacuauccucucugau

SEQ ID NO: 93687 - RNA, 22 nt, Homo sapiens
guaugugacuggaacaguagga

SEQ ID NO: 93688 - RNA, 22 nt, Homo sapiens
guauuguacuacaagcucuuua

SEQ ID NO: 93689 - RNA, 19 nt, Homo sapiens
guauuugacuuucuuguuu

SEQ ID NO: 93690 - RNA, 19 nt, Homo sapiens
guauuugguaaacucucca

SEQ ID NO: 93691 - RNA, 22 nt, Homo sapiens
guauuuggugaugccuccaaac

SEQ ID NO: 93692 - RNA, 22 nt, Homo sapiens
gucaaagucuauuggcuaauuc

SEQ ID NO: 93693 - RNA, 22 nt, Homo sapiens
gucaagugaagaccugacucuu

SEQ ID NO: 93694 - RNA, 22 nt, Homo sapiens
gucaagugaagcagugggagua

SEQ ID NO: 93695 - RNA, 22 nt, Homo sapiens
gucaaguguuuucaaggcuucc

SEQ ID NO: 93696 - RNA, 22 nt, Homo sapiens
gucaauguaucuagcuguauua

SEQ ID NO: 93697 - RNA, 22 nt, Homo sapiens
gucacugagaagguuaguuugu

SEQ ID NO: 93698 - RNA, 22 nt, Homo sapiens
gucacugagcagaaggaagcga

SEQ ID NO: 93699 - RNA, 22 nt, Homo sapiens
gucacugucuacuguaauagcc

SEQ ID NO: 93700 - RNA, 22 nt, Homo sapiens
gucacuguggagaagaaagugg

SEQ ID NO: 93701 - RNA, 22 nt, Homo sapiens
gucagaaucucagaugacaacg

SEQ ID NO: 93702 - RNA, 22 nt, Homo sapiens
gucagauaauuugcauccaucu

SEQ ID NO: 93703 - RNA, 22 nt, Homo sapiens
gucagaugcagauuccaguucu

SEQ ID NO: 93704 - RNA, 22 nt, Homo sapiens
gucagcaaagaggaauaguuug

SEQ ID NO: 93705 - RNA, 22 nt, Homo sapiens
gucagcuuguccagagacucug

SEQ ID NO: 93706 - RNA, 22 nt, Homo sapiens
gucagggagucucuaucagugg

SEQ ID NO: 93707 - RNA, 22 nt, Homo sapiens
gucaguucuugugguugcauuc

SEQ ID NO: 93708 - RNA, 21 nt, Homo sapiens
gucauaugucucugauuagug

SEQ ID NO: 93709 - RNA, 22 nt, Homo sapiens
gucaugaaguuuugaaugaaau

SEQ ID NO: 93710 - RNA, 22 nt, Homo sapiens
gucauggguuaaagguggauac

SEQ ID NO: 93711 - RNA, 22 nt, Homo sapiens
gucauugcuuaucugcugacgu

SEQ ID NO: 93712 - RNA, 22 nt, Homo sapiens
gucauuguguggacauggagaa

SEQ ID NO: 93713 - RNA, 21 nt, Homo sapiens
guccaaaacaguguccaaugc

SEQ ID NO: 93714 - RNA, 22 nt, Homo sapiens
guccaaagugggagaggugggg

SEQ ID NO: 93715 - RNA, 22 nt, Homo sapiens
guccaaauccaugggauguaca

SEQ ID NO: 93716 - RNA, 22 nt, Homo sapiens
guccaguguuggagguuuuacc

SEQ ID NO: 93717 - RNA, 22 nt, Homo sapiens
guccaguuguuuucugagguug

SEQ ID NO: 93718 - RNA, 20 nt, Homo sapiens
guccauuugcugccauugcu

SEQ ID NO: 93719 - RNA, 22 nt, Homo sapiens
guccauuuguuuccagagcacu

SEQ ID NO: 93720 - RNA, 22 nt, Homo sapiens
gucucacaggcaugaugccagc

SEQ ID NO: 93721 - RNA, 22 nt, Homo sapiens
gucucagugcgaaucucaaaga

SEQ ID NO: 93722 - RNA, 22 nt, Homo sapiens
gucucauugcaguuagaccugu

SEQ ID NO: 93723 - RNA, 22 nt, Homo sapiens
gucucccagccuacauauuucu

SEQ ID NO: 93724 - RNA, 22 nt, Homo sapiens
gucuggcuccuucuacuacaug

SEQ ID NO: 93725 - RNA, 21 nt, Homo sapiens
gucuuacagccagaugccucu

SEQ ID NO: 93726 - RNA, 22 nt, Homo sapiens
gucuuggagacauugccauuga

SEQ ID NO: 93727 - RNA, 22 nt, Homo sapiens
gucuuggcaugugcagcuggga

SEQ ID NO: 93728 - RNA, 22 nt, Homo sapiens
gucuuuaguugaaacauguggu

SEQ ID NO: 93729 - RNA, 22 nt, Homo sapiens
gucuuugcauguauguucauga

SEQ ID NO: 93730 - RNA, 22 nt, Homo sapiens
gucuuuggaaagacaaaguuca

SEQ ID NO: 93731 - RNA, 22 nt, Homo sapiens
gugaaaagaugagcaccauaca

SEQ ID NO: 93732 - RNA, 22 nt, Homo sapiens
gugaaagacagcauuaauggcu

SEQ ID NO: 93733 - RNA, 22 nt, Homo sapiens
gugaaaugaaacgcuaugucuu

SEQ ID NO: 93734 - RNA, 15 nt, Homo sapiens
gugaaauguuucaga

SEQ ID NO: 93735 - RNA, 22 nt, Homo sapiens
gugaacaagcaaaggcaggagg

SEQ ID NO: 93736 - RNA, 22 nt, Homo sapiens
gugaacaauguuuuauccuggg

SEQ ID NO: 93737 - RNA, 22 nt, Homo sapiens
gugaacagaaccugggaucgaa

SEQ ID NO: 93738 - RNA, 22 nt, Homo sapiens
gugaagaugugcaucagaucca

SEQ ID NO: 93739 - RNA, 22 nt, Homo sapiens
gugaaugaaugggugaauacau

SEQ ID NO: 93740 - RNA, 22 nt, Homo sapiens
gugaauguuuucuuacauggua

SEQ ID NO: 93741 - RNA, 22 nt, Homo sapiens
gugacacagcaagacuccgucu

SEQ ID NO: 93742 - RNA, 22 nt, Homo sapiens
gugacagucaaagacaugacuu

SEQ ID NO: 93743 - RNA, 22 nt, Homo sapiens
gugacaguggagacuuacuuca

SEQ ID NO: 93744 - RNA, 22 nt, Homo sapiens
gugacauuauuucagcuacaug

SEQ ID NO: 93745 - RNA, 22 nt, Homo sapiens
gugaccauuugacauauccuug

SEQ ID NO: 93746 - RNA, 22 nt, Homo sapiens
gugacuaagauucuuugauaug

SEQ ID NO: 93747 - RNA, 20 nt, Homo sapiens
gugacugagcacgggcacag

SEQ ID NO: 93748 - RNA, 22 nt, Homo sapiens
gugacuggacucugaagaaaau

SEQ ID NO: 93749 - RNA, 22 nt, Homo sapiens
gugagaacugugucuuauaaac

SEQ ID NO: 93750 - RNA, 22 nt, Homo sapiens
gugagaauauuuuaaauacuaa

SEQ ID NO: 93751 - RNA, 22 nt, Homo sapiens
gugagaccaauguacuaccuuc

SEQ ID NO: 93752 - RNA, 22 nt, Homo sapiens
guuauguuaaauuguuguaugc

SEQ ID NO: 93753 - RNA, 22 nt, Homo sapiens
guuauuguccauuuauuuagca

SEQ ID NO: 93754 - RNA, 22 nt, Homo sapiens
guucaaggaauguuggcuucuc

SEQ ID NO: 93755 - RNA, 22 nt, Homo sapiens
guucacaguucagccuguaaca

SEQ ID NO: 93756 - RNA, 22 nt, Homo sapiens
guucacucuggagaauauugac

SEQ ID NO: 93757 - RNA, 22 nt, Homo sapiens
guucagguauucuggaacagag

SEQ ID NO: 93758 - RNA, 22 nt, Homo sapiens
guucaguuugcugaugcguuga

SEQ ID NO: 93759 - RNA, 22 nt, Homo sapiens
guucaucaggcuuucucuagag

SEQ ID NO: 93760 - RNA, 22 nt, Homo sapiens
guucaucagggacacugguuug

SEQ ID NO: 93761 - RNA, 22 nt, Homo sapiens
guucaucagggauacuggcuua

SEQ ID NO: 93762 - RNA, 22 nt, Homo sapiens
guucaucagggauauuggccug

SEQ ID NO: 93763 - RNA, 22 nt, Homo sapiens
guucccaguugaaaugauuagu

SEQ ID NO: 93764 - RNA, 20 nt, Homo sapiens
guucccuguaggugugcgga

SEQ ID NO: 93765 - RNA, 22 nt, Homo sapiens
guuccuuguagaugcuggauau

SEQ ID NO: 93766 - RNA, 22 nt, Homo sapiens
guucucacuggacugugaaaau

SEQ ID NO: 93767 - RNA, 22 nt, Homo sapiens
guugaaauccuaacccccuagu

SEQ ID NO: 93768 - RNA, 22 nt, Homo sapiens
guugagcaagcuuuggagccua

SEQ ID NO: 93769 - RNA, 22 nt, Homo sapiens
guugaguuugaccugaacucug

SEQ ID NO: 93770 - RNA, 22 nt, Homo sapiens
guugaucuauguugcuggcagu

SEQ ID NO: 93771 - RNA, 22 nt, Homo sapiens
guugcugagucccaucaccaga

SEQ ID NO: 93772 - RNA, 22 nt, Homo sapiens
guuggaauuaaaaggcaaguau

SEQ ID NO: 93773 - RNA, 22 nt, Homo sapiens
guuggaguuaagcaguaaugaa

SEQ ID NO: 93774 - RNA, 22 nt, Homo sapiens
guuggucucguauaaaucaagg

SEQ ID NO: 93775 - RNA, 22 nt, Homo sapiens
guuggugaccugaagagaguaa

SEQ ID NO: 93776 - RNA, 22 nt, Homo sapiens
guugugcuuaagccuauugauu

SEQ ID NO: 93777 - RNA, 22 nt, Homo sapiens
guuguggcuugugauuaagcac

SEQ ID NO: 93778 - RNA, 22 nt, Homo sapiens
guuugcacuccuaugagaaucu

SEQ ID NO: 93779 - RNA, 22 nt, Homo sapiens
guuugccuuuuagauaggaaug

SEQ ID NO: 93780 - RNA, 22 nt, Homo sapiens
guuuggauauuaggcaagagua

SEQ ID NO: 93781 - RNA, 22 nt, Homo sapiens
guuugugcuccuaugagaaucu

SEQ ID NO: 93782 - RNA, 22 nt, Homo sapiens
guuuuuggggucacuauuaccg

SEQ ID NO: 93783 - RNA, 22 nt, Homo sapiens
uaaaagucaucacaacuggagu

SEQ ID NO: 93784 - RNA, 22 nt, Homo sapiens
uaaagagcuuuugaggugucau

SEQ ID NO: 93785 - RNA, 22 nt, Homo sapiens
uaaagcacaaguaaagaauacu

SEQ ID NO: 93786 - RNA, 22 nt, Homo sapiens
uaaagcacuuuuuucugcaugg

SEQ ID NO: 93787 - RNA, 22 nt, Homo sapiens
uaaagcauguaauuagguuaga

SEQ ID NO: 93788 - RNA, 22 nt, Homo sapiens
uaaagccauugucaaguuugua

SEQ ID NO: 93789 - RNA, 22 nt, Homo sapiens
uaaagccuagaacuuucagccc

SEQ ID NO: 93790 - RNA, 21 nt, Homo sapiens
uaaagcuagaaccuuagcuuu

SEQ ID NO: 93791 - RNA, 20 nt, Homo sapiens
uaaagcugcucagggggcuc

SEQ ID NO: 93792 - RNA, 22 nt, Homo sapiens
uaaagcuuagauccaugguggc

SEQ ID NO: 93793 - RNA, 22 nt, Homo sapiens
uaaagcuuggauuuaggcuaau

SEQ ID NO: 93794 - RNA, 22 nt, Homo sapiens
uaaagugaggauggcaguaggu

SEQ ID NO: 93795 - RNA, 22 nt, Homo sapiens
uaaaguguuuguuauuaaaggu

SEQ ID NO: 93796 - RNA, 22 nt, Homo sapiens
uaaaugacugucaguagaugaa

SEQ ID NO: 93797 - RNA, 20 nt, Homo sapiens
uaaaugccucaugcuuuauu

SEQ ID NO: 93798 - RNA, 22 nt, Homo sapiens
uaaauggauaaaugaauaccua

SEQ ID NO: 93799 - RNA, 18 nt, Homo sapiens
uaaauugcuucaccugag

SEQ ID NO: 93800 - RNA, 22 nt, Homo sapiens
uaacaagagagucagucagucc

SEQ ID NO: 93801 - RNA, 22 nt, Homo sapiens
uaacaccuuugauagcacuuuu

SEQ ID NO: 93802 - RNA, 21 nt, Homo sapiens
uaacagcuccacuccauucuc

SEQ ID NO: 93803 - RNA, 22 nt, Homo sapiens
uaacaguauauuuaccaaaccu

SEQ ID NO: 93804 - RNA, 22 nt, Homo sapiens
uaacagucaagguuugaccagg

SEQ ID NO: 93805 - RNA, 18 nt, Homo sapiens
uaacagucucucaggauc

SEQ ID NO: 93806 - RNA, 22 nt, Homo sapiens
uaacaguggucugugguaucug

SEQ ID NO: 93807 - RNA, 22 nt, Homo sapiens
uaacccacgcagaauggacaag

SEQ ID NO: 93808 - RNA, 22 nt, Homo sapiens
uaacuaguagauggcugacaua

SEQ ID NO: 93809 - RNA, 22 nt, Homo sapiens
uaacuguggaaaugacuuuaaa

SEQ ID NO: 93810 - RNA, 18 nt, Homo sapiens
uaacugugggaacuaacu

SEQ ID NO: 93811 - RNA, 22 nt, Homo sapiens
uaagaauucuguccgguauacu

SEQ ID NO: 93812 - RNA, 22 nt, Homo sapiens
uaagacacauguguucccaggc

SEQ ID NO: 93813 - RNA, 22 nt, Homo sapiens
uaagacucuggacucuaauguu

SEQ ID NO: 93814 - RNA, 22 nt, Homo sapiens
uaagaugaaggcucaccuagaa

SEQ ID NO: 93815 - RNA, 22 nt, Homo sapiens
uaagcagugcaagaauggaaua

SEQ ID NO: 93816 - RNA, 16 nt, Homo sapiens
uaagccccacgugcau

SEQ ID NO: 93817 - RNA, 22 nt, Homo sapiens
uaagcucauuccagccaugucc

SEQ ID NO: 93818 - RNA, 22 nt, Homo sapiens
uaaggaaccagaaguggguagc

SEQ ID NO: 93819 - RNA, 22 nt, Homo sapiens
uaaggaacucugauaucuggaa

SEQ ID NO: 93820 - RNA, 22 nt, Homo sapiens
uaaggaaggcugugugcuuuua

SEQ ID NO: 93821 - RNA, 22 nt, Homo sapiens
uaaggcaaaccuuggcugcagu

SEQ ID NO: 93822 - RNA, 22 nt, Homo sapiens
uaaggcaaguuuuuaguggaca

SEQ ID NO: 93823 - RNA, 22 nt, Homo sapiens
uaaggcacccuucugaguagag

SEQ ID NO: 93824 - RNA, 22 nt, Homo sapiens
uaaggcacuacuuuaggcuuuc

SEQ ID NO: 93825 - RNA, 22 nt, Homo sapiens
uaaggcuuugucuuaggacuuu

SEQ ID NO: 93826 - RNA, 22 nt, Homo sapiens
uaagggcaugcugcaugagagu

SEQ ID NO: 93827 - RNA, 22 nt, Homo sapiens
uaagguccuuaaauguguaacc

SEQ ID NO: 93828 - RNA, 22 nt, Homo sapiens
uaaguaguauaagguuuuuuga

SEQ ID NO: 93829 - RNA, 22 nt, Homo sapiens
uaaguaguccugauuuaaccuu

SEQ ID NO: 93830 - RNA, 22 nt, Homo sapiens
uaaguagugugcauguauguau

SEQ ID NO: 93831 - RNA, 22 nt, Homo sapiens
uaaguaguuucuggauauucuc

SEQ ID NO: 93832 - RNA, 22 nt, Homo sapiens
uaagugaauauggacaguuagc

SEQ ID NO: 93833 - RNA, 22 nt, Homo sapiens
uaagugaauuugacagguaaug

SEQ ID NO: 93834 - RNA, 22 nt, Homo sapiens
uaagugacuuugagauuccuca

SEQ ID NO: 93835 - RNA, 22 nt, Homo sapiens
uaagugcuguguuguuaccuaa

SEQ ID NO: 93836 - RNA, 22 nt, Homo sapiens
uaagugcuugacuuugauguuu

SEQ ID NO: 93837 - RNA, 22 nt, Homo sapiens
uaaguggugcauuguuaaaugg

SEQ ID NO: 93838 - RNA, 21 nt, Homo sapiens
uaauaaugucucagacaccua

SEQ ID NO: 93839 - RNA, 22 nt, Homo sapiens
uaauacauucaaggugguaguu

SEQ ID NO: 93840 - RNA, 22 nt, Homo sapiens
uaaucacagagguuuggccuca

SEQ ID NO: 93841 - RNA, 22 nt, Homo sapiens
uaaucucagcugagcugagauu

SEQ ID NO: 93842 - RNA, 22 nt, Homo sapiens
uaaugcauacagaagguguuuu

SEQ ID NO: 93843 - RNA, 22 nt, Homo sapiens
uaggguaguaauaguuguuuca

SEQ ID NO: 93844 - RNA, 22 nt, Homo sapiens
uagguaaguaugugugaugggg

SEQ ID NO: 93845 - RNA, 19 nt, Homo sapiens
uagguacauucaagucucc

SEQ ID NO: 93846 - RNA, 22 nt, Homo sapiens
uagguacuuaagaucucagcua

SEQ ID NO: 93847 - RNA, 22 nt, Homo sapiens
uagguagaaucuugaagccauu

SEQ ID NO: 93848 - RNA, 22 nt, Homo sapiens
uagguaggauagucuuuauuuu

SEQ ID NO: 93849 - RNA, 22 nt, Homo sapiens
uagguagguggaaaaguaauug

SEQ ID NO: 93850 - RNA, 22 nt, Homo sapiens
uagguaguuacacagcaaugua

SEQ ID NO: 93851 - RNA, 22 nt, Homo sapiens
uagguaguuagcauacuacaca

SEQ ID NO: 93852 - RNA, 22 nt, Homo sapiens
uaggucaguuuuggcuuggcuu

SEQ ID NO: 93853 - RNA, 22 nt, Homo sapiens
uaggucccguuucagacugaga

SEQ ID NO: 93854 - RNA, 22 nt, Homo sapiens
uaggucuuuuaugaaauauauu

SEQ ID NO: 93855 - RNA, 22 nt, Homo sapiens
uaggugaaugcuggaagaaaug

SEQ ID NO: 93856 - RNA, 22 nt, Homo sapiens
uaguaaacauuuuucuaucauu

SEQ ID NO: 93857 - RNA, 23 nt, Homo sapiens
uaguaccauauuguuggcagcac

SEQ ID NO: 93858 - RNA, 18 nt, Homo sapiens
uaguacuguucucaugau

SEQ ID NO: 93859 - RNA, 22 nt, Homo sapiens
uagucacacacucaacuuuuca

SEQ ID NO: 93860 - RNA, 22 nt, Homo sapiens
uaguccauuuucaugcugcuau

SEQ ID NO: 93861 - RNA, 22 nt, Homo sapiens
uagugaauguuggcuauuaaua

SEQ ID NO: 93862 - RNA, 22 nt, Homo sapiens
uagugacauugcugggaaugcu

SEQ ID NO: 93863 - RNA, 21 nt, Homo sapiens
uagugcagugggguaugacuu

SEQ ID NO: 93864 - RNA, 18 nt, Homo sapiens
uagugcuguucucaugau

SEQ ID NO: 93865 - RNA, 22 nt, Homo sapiens
uagugguauuagcgauacuacu

SEQ ID NO: 93866 - RNA, 22 nt, Homo sapiens
uaguuauggaguaauuuuaagc

SEQ ID NO: 93867 - RNA, 20 nt, Homo sapiens
uauaacaguuuggacccagu

SEQ ID NO: 93868 - RNA, 23 nt, Homo sapiens
uauaacuuuuaauuuacuggccu

SEQ ID NO: 93869 - RNA, 22 nt, Homo sapiens
uauaagguuaggaaaaauuucu

SEQ ID NO: 93870 - RNA, 22 nt, Homo sapiens
uauagcacugaccuuccaggac

SEQ ID NO: 93871 - RNA, 22 nt, Homo sapiens
uauagcacugagaauguaauuc

SEQ ID NO: 93872 - RNA, 21 nt, Homo sapiens
uauagcagcacgauuuauaau

SEQ ID NO: 93873 - RNA, 22 nt, Homo sapiens
uauagcaguguaagaaucgagu

SEQ ID NO: 93874 - RNA, 22 nt, Homo sapiens
uauagcauuuugauccuguaga

SEQ ID NO: 93875 - RNA, 22 nt, Homo sapiens
uauagcuuaaaguuuagauccu

SEQ ID NO: 93876 - RNA, 22 nt, Homo sapiens
uauaggacuugguguaguuucu

SEQ ID NO: 93877 - RNA, 22 nt, Homo sapiens
uauaguguuuucaaaaguaugu

SEQ ID NO: 93878 - RNA, 22 nt, Homo sapiens
uauauaagcugaugagccacaa

SEQ ID NO: 93879 - RNA, 22 nt, Homo sapiens
uauaucacaugcacucauuuuc

SEQ ID NO: 93880 - RNA, 22 nt, Homo sapiens
uauaugcucugggauccugaaa

SEQ ID NO: 93881 - RNA, 22 nt, Homo sapiens
uaucaaguguuagggagaugug

SEQ ID NO: 93882 - RNA, 22 nt, Homo sapiens
uaucacaaacuuagcaguuuaa

SEQ ID NO: 93883 - RNA, 22 nt, Homo sapiens
uaucacaggucaggaaucuugc

SEQ ID NO: 93884 - RNA, 22 nt, Homo sapiens
uaucacaguaucuagcacagug

SEQ ID NO: 93885 - RNA, 21 nt, Homo sapiens
uaucacauuggugauuaaguu

SEQ ID NO: 93886 - RNA, 22 nt, Homo sapiens
uaucaccacccugggaaacaua

SEQ ID NO: 93887 - RNA, 22 nt, Homo sapiens
uaucaccauguccguuuuaaaa

SEQ ID NO: 93888 - RNA, 22 nt, Homo sapiens
uaucaccuugcaggagcuauga

SEQ ID NO: 93889 - RNA, 22 nt, Homo sapiens
uaucagauugcugccaucugcu

SEQ ID NO: 93890 - RNA, 22 nt, Homo sapiens
uaucagugaaucuuauuuugcc

SEQ ID NO: 93891 - RNA, 22 nt, Homo sapiens
uaucauggaaugagguuggaca

SEQ ID NO: 93892 - RNA, 22 nt, Homo sapiens
uaucaugucuguguguaccuag

SEQ ID NO: 93893 - RNA, 22 nt, Homo sapiens
uaucauuguguuauuucuucca

SEQ ID NO: 93894 - RNA, 21 nt, Homo sapiens
uaucccagucacaucuaccca

SEQ ID NO: 93895 - RNA, 20 nt, Homo sapiens
uaucuacuugcaaaugccau

SEQ ID NO: 93896 - RNA, 22 nt, Homo sapiens
uaucucacauauucaguagguu

SEQ ID NO: 93897 - RNA, 22 nt, Homo sapiens
uaucucagaguguacaagauua

SEQ ID NO: 93898 - RNA, 22 nt, Homo sapiens
uaucugcacauacacuuauagc

SEQ ID NO: 93899 - RNA, 22 nt, Homo sapiens
uaucuuggaguuugacaaccaa

SEQ ID NO: 93900 - RNA, 20 nt, Homo sapiens
uaugaaacaguguagagcaa

SEQ ID NO: 93901 - RNA, 22 nt, Homo sapiens
uaugaacacuuuugggaggcau

SEQ ID NO: 93902 - RNA, 22 nt, Homo sapiens
uaugaauuuuauccaggauaua

SEQ ID NO: 93903 - RNA, 20 nt, Homo sapiens
uaugacaaagccuagugagu

SEQ ID NO: 93904 - RNA, 22 nt, Homo sapiens
uaugacauaguccuuaacccuc

SEQ ID NO: 93905 - RNA, 21 nt, Homo sapiens
uaugagucugcaagaaccaca

SEQ ID NO: 93906 - RNA, 22 nt, Homo sapiens
uaugaucacuacagcagggaug

SEQ ID NO: 93907 - RNA, 22 nt, Homo sapiens
uaugaucauuauguuauugcag

SEQ ID NO: 93908 - RNA, 22 nt, Homo sapiens
uaugcacaugcaugcuugaaua

SEQ ID NO: 93909 - RNA, 22 nt, Homo sapiens
uaugcacuauagcauauguggu

SEQ ID NO: 93910 - RNA, 22 nt, Homo sapiens
uaugcccauuuaaauugaacaa

SEQ ID NO: 93911 - RNA, 22 nt, Homo sapiens
uaugccuuuuggcucaagaaac

SEQ ID NO: 93912 - RNA, 22 nt, Homo sapiens
uaugcuuauuaaaacagugugu

SEQ ID NO: 93913 - RNA, 22 nt, Homo sapiens
uauggauauuacuccacaaaga

SEQ ID NO: 93914 - RNA, 22 nt, Homo sapiens
uauggauguuaagguucacagc

SEQ ID NO: 93915 - RNA, 22 nt, Homo sapiens
uauggauuuucagauucuuauc

SEQ ID NO: 93916 - RNA, 22 nt, Homo sapiens
uauggauuuuggaauauguggg

SEQ ID NO: 93917 - RNA, 22 nt, Homo sapiens
uauggcacuaguacuggaaagc

SEQ ID NO: 93918 - RNA, 22 nt, Homo sapiens
uauggcauuauuuugauagaca

SEQ ID NO: 93919 - RNA, 22 nt, Homo sapiens
uauggccacugucuuugaguca

SEQ ID NO: 93920 - RNA, 22 nt, Homo sapiens
uauggcccuuaaguauugguug

SEQ ID NO: 93921 - RNA, 22 nt, Homo sapiens
uauggcugugacuuaucuuguu

SEQ ID NO: 93922 - RNA, 21 nt, Homo sapiens
uauggcuuagucaguguuucc

SEQ ID NO: 93923 - RNA, 22 nt, Homo sapiens
uauggcuuuguuaacauuuucu

SEQ ID NO: 93924 - RNA, 22 nt, Homo sapiens
uauggcuuuguucaacagccuc

SEQ ID NO: 93925 - RNA, 22 nt, Homo sapiens
uaugggcuuuguuuuguacuag

SEQ ID NO: 93926 - RNA, 22 nt, Homo sapiens
uauggguaguacaaaguguaua

SEQ ID NO: 93927 - RNA, 22 nt, Homo sapiens
uauggguauuuuauacauaacc

SEQ ID NO: 93928 - RNA, 22 nt, Homo sapiens
uaugggucuuaaaucacuuagu

SEQ ID NO: 93929 - RNA, 22 nt, Homo sapiens
uaugguuuuaagguuaaggacu

SEQ ID NO: 93930 - RNA, 19 nt, Homo sapiens
uauguaguuuucucaauau

SEQ ID NO: 93931 - RNA, 22 nt, Homo sapiens
uaugugcuuuguuaaacagaug

SEQ ID NO: 93932 - RNA, 22 nt, Homo sapiens
uaugugguuaauaggaauuugu

SEQ ID NO: 93933 - RNA, 22 nt, Homo sapiens
uauguuaucaaaaagcuaagga

SEQ ID NO: 93934 - RNA, 22 nt, Homo sapiens
uucaguggacuuaguagugcuu

SEQ ID NO: 93935 - RNA, 22 nt, Homo sapiens
uucaguggguggaugaauauga

SEQ ID NO: 93936 - RNA, 22 nt, Homo sapiens
uucagugucauuaacacaguag

SEQ ID NO: 93937 - RNA, 22 nt, Homo sapiens
uucaguucugcucugaucuuag

SEQ ID NO: 93938 - RNA, 18 nt, Homo sapiens
uucaguuuguaucugggg

SEQ ID NO: 93939 - RNA, 22 nt, Homo sapiens
uucauagaggacauuacuggag

SEQ ID NO: 93940 - RNA, 22 nt, Homo sapiens
uucauaguaacaguaacuaugg

SEQ ID NO: 93941 - RNA, 22 nt, Homo sapiens
uucauagugaaaaauucaaagu

SEQ ID NO: 93942 - RNA, 22 nt, Homo sapiens
uucauaguguaccugaaggcac

SEQ ID NO: 93943 - RNA, 22 nt, Homo sapiens
uucauaguuuauacugauauuu

SEQ ID NO: 93944 - RNA, 21 nt, Homo sapiens
uucauaugcacugagugccca

SEQ ID NO: 93945 - RNA, 22 nt, Homo sapiens
uucaucagcuguagaugucaug

SEQ ID NO: 93946 - RNA, 20 nt, Homo sapiens
uucaucaggauauuggucua

SEQ ID NO: 93947 - RNA, 22 nt, Homo sapiens
uucaucagggagaaauaauuuc

SEQ ID NO: 93948 - RNA, 22 nt, Homo sapiens
uucaucaguuauauuggccuga

SEQ ID NO: 93949 - RNA, 22 nt, Homo sapiens
uucaucaguugagcugguugcu

SEQ ID NO: 93950 - RNA, 22 nt, Homo sapiens
uucauggaauauugaccauuuu

SEQ ID NO: 93951 - RNA, 22 nt, Homo sapiens
uucauggaguuuaaauuguagu

SEQ ID NO: 93952 - RNA, 22 nt, Homo sapiens
uucauggugguacaaaagcaau

SEQ ID NO: 93953 - RNA, 22 nt, Homo sapiens
uucauguaauauuucacagcuu

SEQ ID NO: 93954 - RNA, 22 nt, Homo sapiens
uucauguaaucaaggcagcuaa

SEQ ID NO: 93955 - RNA, 22 nt, Homo sapiens
uucauguaauuccauaagguaa

SEQ ID NO: 93956 - RNA, 22 nt, Homo sapiens
uucauugcugcuuaucuccaga

SEQ ID NO: 93957 - RNA, 22 nt, Homo sapiens
uuccacaaugguugaacuaguu

SEQ ID NO: 93958 - RNA, 16 nt, Homo sapiens
uuccacagucgaggug

SEQ ID NO: 93959 - RNA, 22 nt, Homo sapiens
uuccagagucaccuuucugucg

SEQ ID NO: 93960 - RNA, 22 nt, Homo sapiens
uuccagaugggaguucuauucu

SEQ ID NO: 93961 - RNA, 22 nt, Homo sapiens
uuccagcugggggcaacucugc

SEQ ID NO: 93962 - RNA, 21 nt, Homo sapiens
uuccagugagccuagaugccu

SEQ ID NO: 93963 - RNA, 22 nt, Homo sapiens
uuccaguggaguaaauggacaa

SEQ ID NO: 93964 - RNA, 22 nt, Homo sapiens
uuccagugggacgagaugugga

SEQ ID NO: 93965 - RNA, 22 nt, Homo sapiens
uuccaguguguucauccucaga

SEQ ID NO: 93966 - RNA, 22 nt, Homo sapiens
uuccaguguuugacucaccuuu

SEQ ID NO: 93967 - RNA, 22 nt, Homo sapiens
uuccauguaguugaacgguuuu

SEQ ID NO: 93968 - RNA, 22 nt, Homo sapiens
uuccaugugggcuugucaagua

SEQ ID NO: 93969 - RNA, 22 nt, Homo sapiens
uucccagagaaaaggguuucuu

SEQ ID NO: 93970 - RNA, 22 nt, Homo sapiens
uucccaguuggggaaagcgacc

SEQ ID NO: 93971 - RNA, 22 nt, Homo sapiens
uucccauuguuggccagcaugu

SEQ ID NO: 93972 - RNA, 22 nt, Homo sapiens
uucccgggguggaaugcaguga

SEQ ID NO: 93973 - RNA, 22 nt, Homo sapiens
uucccguacugguguugccuau

SEQ ID NO: 93974 - RNA, 22 nt, Homo sapiens
uucccugaaauauucacuuuca

SEQ ID NO: 93975 - RNA, 22 nt, Homo sapiens
uucccugugggaguaggaaagu

SEQ ID NO: 93976 - RNA, 22 nt, Homo sapiens
uucccuugcaggaugaucugga

SEQ ID NO: 93977 - RNA, 22 nt, Homo sapiens
uucccuuucugaaaaucucauu

SEQ ID NO: 93978 - RNA, 22 nt, Homo sapiens
uucccuuucuuaaagaguuagg

SEQ ID NO: 93979 - RNA, 22 nt, Homo sapiens
uucccuuugugcauaggauuug

SEQ ID NO: 93980 - RNA, 22 nt, Homo sapiens
uuccuacuguucaucaggaacc

SEQ ID NO: 93981 - RNA, 19 nt, Homo sapiens
uuccugagaacaagggcuu

SEQ ID NO: 93982 - RNA, 22 nt, Homo sapiens
uuccuggaggggaaguguccaa

SEQ ID NO: 93983 - RNA, 22 nt, Homo sapiens
uuccuugaaacagucaagagaa

SEQ ID NO: 93984 - RNA, 22 nt, Homo sapiens
uuccuugagaaaguacaaggcu

SEQ ID NO: 93985 - RNA, 22 nt, Homo sapiens
uuccuugagucuuuuuccugag

SEQ ID NO: 93986 - RNA, 22 nt, Homo sapiens
uuccuugugacuaguagugacc

SEQ ID NO: 93987 - RNA, 22 nt, Homo sapiens
uucgucaugagacagaugcuga

SEQ ID NO: 93988 - RNA, 22 nt, Homo sapiens
uucuagcaauggcagagugucu

SEQ ID NO: 93989 - RNA, 21 nt, Homo sapiens
uucuauggucagaauucaaua

SEQ ID NO: 93990 - RNA, 20 nt, Homo sapiens
uucuauggugaugaguccug

SEQ ID NO: 93991 - RNA, 22 nt, Homo sapiens
uucuauugguaauauuuucugu

SEQ ID NO: 93992 - RNA, 22 nt, Homo sapiens
uucucaaggagccuucguaacu

SEQ ID NO: 93993 - RNA, 22 nt, Homo sapiens
uucucaauggaugugggaccag

SEQ ID NO: 93994 - RNA, 22 nt, Homo sapiens
uucucaauggcaacuuguugcu

SEQ ID NO: 93995 - RNA, 21 nt, Homo sapiens
uucucagaggcaggggauaaa

SEQ ID NO: 93996 - RNA, 22 nt, Homo sapiens
uucucagcccccugacagucag

SEQ ID NO: 93997 - RNA, 22 nt, Homo sapiens
uucucagugaacuccagcuugu

SEQ ID NO: 93998 - RNA, 22 nt, Homo sapiens
uucucagugaaguuuagaacau

SEQ ID NO: 93999 - RNA, 22 nt, Homo sapiens
uucucagugcuaucuuuuaugc

SEQ ID NO: 94000 - RNA, 22 nt, Homo sapiens
uucucaguucgguggcagugcu

SEQ ID NO: 94001 - RNA, 22 nt, Homo sapiens
uucuccugguggacccuaaacg

SEQ ID NO: 94002 - RNA, 22 nt, Homo sapiens
uucucuggucagaggggagguu

SEQ ID NO: 94003 - RNA, 22 nt, Homo sapiens
uucuggaaaucagcagagggug

SEQ ID NO: 94004 - RNA, 22 nt, Homo sapiens
uucuggcuaugggauacuaaau

SEQ ID NO: 94005 - RNA, 22 nt, Homo sapiens
uucuggcuuuuaaagaaauguu

SEQ ID NO: 94006 - RNA, 22 nt, Homo sapiens
uucugugcugaaucaaagacug

SEQ ID NO: 94007 - RNA, 21 nt, Homo sapiens
uucuucaggcagaaggauuau

SEQ ID NO: 94008 - RNA, 22 nt, Homo sapiens
uucuucaggcauucccagaagc

SEQ ID NO: 94009 - RNA, 22 nt, Homo sapiens
uucuucaguuacaacaaggggg

SEQ ID NO: 94010 - RNA, 22 nt, Homo sapiens
uucuucugguuaugaaauuuga

SEQ ID NO: 94011 - RNA, 22 nt, Homo sapiens
uucuugcacugaucccauaagc

SEQ ID NO: 94012 - RNA, 22 nt, Homo sapiens
uucuugcacuuaacugacauuc

SEQ ID NO: 94013 - RNA, 22 nt, Homo sapiens
uugaaagacagaggggcaaguu

SEQ ID NO: 94014 - RNA, 22 nt, Homo sapiens
uugaaagacaucaccuacugcu

SEQ ID NO: 94015 - RNA, 22 nt, Homo sapiens
uugaaagcuaucucaaaucgcu

SEQ ID NO: 94016 - RNA, 22 nt, Homo sapiens
uugaaagucauggcacaggcaa

SEQ ID NO: 94017 - RNA, 22 nt, Homo sapiens
uugaacugguaguuggaaaucu

SEQ ID NO: 94018 - RNA, 22 nt, Homo sapiens
uugaacuguaagggucugugug

SEQ ID NO: 94019 - RNA, 22 nt, Homo sapiens
uugaagacuaauuuagauaaug

SEQ ID NO: 94020 - RNA, 22 nt, Homo sapiens
uugaagacuaccuaccauacuu

SEQ ID NO: 94021 - RNA, 22 nt, Homo sapiens
uugaaggaggugcucacucucg

SEQ ID NO: 94022 - RNA, 22 nt, Homo sapiens
uugaaguagcauuucaugucua

SEQ ID NO: 94023 - RNA, 22 nt, Homo sapiens
uugaaguguguauacauugugg

SEQ ID NO: 94024 - RNA, 22 nt, Homo sapiens
uugaauaguggugaaaguuuga

SEQ ID NO: 94025 - RNA, 22 nt, Homo sapiens
uugccauggaguagaauugaag

SEQ ID NO: 94026 - RNA, 22 nt, Homo sapiens
uugccuaggcuggagugcagua

SEQ ID NO: 94027 - RNA, 22 nt, Homo sapiens
uugccuaggcuggauugcagug

SEQ ID NO: 94028 - RNA, 22 nt, Homo sapiens
uugccuuuguuggaaacaagug

SEQ ID NO: 94029 - RNA, 22 nt, Homo sapiens
uugcuagagaugagggaugugu

SEQ ID NO: 94030 - RNA, 22 nt, Homo sapiens
uugcucaccugagaagaauaga

SEQ ID NO: 94031 - RNA, 22 nt, Homo sapiens
uugcucaggcuagaguucagcu

SEQ ID NO: 94032 - RNA, 22 nt, Homo sapiens
uugcuccccaggaaaggaagca

SEQ ID NO: 94033 - RNA, 22 nt, Homo sapiens
uugcugagucuuucuagguugc

SEQ ID NO: 94034 - RNA, 22 nt, Homo sapiens
uugcuuagagccaaucuugauu

SEQ ID NO: 94035 - RNA, 22 nt, Homo sapiens
uugcuuaggcuggagugcagug

SEQ ID NO: 94036 - RNA, 22 nt, Homo sapiens
uuggaaacauuuaugguaacag

SEQ ID NO: 94037 - RNA, 22 nt, Homo sapiens
uuggaaauauguuaagugucau

SEQ ID NO: 94038 - RNA, 22 nt, Homo sapiens
uuggaaaugguaaaggguuaau

SEQ ID NO: 94039 - RNA, 22 nt, Homo sapiens
uuggaagacaaugcugauucuc

SEQ ID NO: 94040 - RNA, 22 nt, Homo sapiens
uuggaagagaagggagauaaac

SEQ ID NO: 94041 - RNA, 22 nt, Homo sapiens
uuggaaggcugaauggccucuc

SEQ ID NO: 94042 - RNA, 23 nt, Homo sapiens
uuggaaugagaccuaagaguuuu

SEQ ID NO: 94043 - RNA, 22 nt, Homo sapiens
uuggaaugcaacagaaggauaa

SEQ ID NO: 94044 - RNA, 22 nt, Homo sapiens
uuggaauguacucuagccuaug

SEQ ID NO: 94045 - RNA, 22 nt, Homo sapiens
uuggaauuaaccuggugcugga

SEQ ID NO: 94046 - RNA, 22 nt, Homo sapiens
uuggaauuuuaaaauaggcaac

SEQ ID NO: 94047 - RNA, 22 nt, Homo sapiens
uuggaccacuugauuucugguc

SEQ ID NO: 94048 - RNA, 22 nt, Homo sapiens
uuggacugagaguuccaccauu

SEQ ID NO: 94049 - RNA, 22 nt, Homo sapiens
uuggacugggauggccgaggcu

SEQ ID NO: 94050 - RNA, 22 nt, Homo sapiens
uuggacuuuaagauagagaugu

SEQ ID NO: 94051 - RNA, 22 nt, Homo sapiens
uuggagugugagagcagccugg

SEQ ID NO: 94052 - RNA, 22 nt, Homo sapiens
uuggagugugcucauaacugcu

SEQ ID NO: 94053 - RNA, 22 nt, Homo sapiens
uuggagugugucuuauuccauu

SEQ ID NO: 94054 - RNA, 22 nt, Homo sapiens
uuggaguguucugguccgggcu

SEQ ID NO: 94055 - RNA, 22 nt, Homo sapiens
uuggauaguuuaugaaaaaugg

SEQ ID NO: 94056 - RNA, 22 nt, Homo sapiens
uuggauccauccugucuucucu

SEQ ID NO: 94057 - RNA, 22 nt, Homo sapiens
uuggauuguuucuagauugggg

SEQ ID NO: 94058 - RNA, 22 nt, Homo sapiens
uuggauuuuaacaaacuaggug

SEQ ID NO: 94059 - RNA, 22 nt, Homo sapiens
uuggcaaagaggaaugccacuu

SEQ ID NO: 94060 - RNA, 22 nt, Homo sapiens
uuggcaagcuguuaauuauaaa

SEQ ID NO: 94061 - RNA, 22 nt, Homo sapiens
uuggcacgugguggggcucgga

SEQ ID NO: 94062 - RNA, 22 nt, Homo sapiens
uuggcacugagcaagaacaggg

SEQ ID NO: 94063 - RNA, 22 nt, Homo sapiens
uuggcagaauguuagaaacuua

SEQ ID NO: 94064 - RNA, 20 nt, Homo sapiens
uuggcagagucuuuagggua

SEQ ID NO: 94065 - RNA, 22 nt, Homo sapiens
uuggcagcuguggaaucugggc

SEQ ID NO: 94066 - RNA, 22 nt, Homo sapiens
uuggcagugguucugacggacc

SEQ ID NO: 94067 - RNA, 22 nt, Homo sapiens
uuggcauagaggcucucaagcu

SEQ ID NO: 94068 - RNA, 22 nt, Homo sapiens
uuggccagugucuuuuuuuccu

SEQ ID NO: 94069 - RNA, 22 nt, Homo sapiens
uuggcccugcugaccauucccu

SEQ ID NO: 94070 - RNA, 22 nt, Homo sapiens
uuggccuuucucuaaauacuuu

SEQ ID NO: 94071 - RNA, 22 nt, Homo sapiens
uuggcuaugaguccuaugugca

SEQ ID NO: 94072 - RNA, 22 nt, Homo sapiens
uuggcuuaguugaccacagucu

SEQ ID NO: 94073 - RNA, 22 nt, Homo sapiens
uugggacuggaaggaguaaggg

SEQ ID NO: 94074 - RNA, 22 nt, Homo sapiens
uugggagugucucuggacugca

SEQ ID NO: 94075 - RNA, 22 nt, Homo sapiens
uugggauaaucacaaaguaaaa

SEQ ID NO: 94076 - RNA, 23 nt, Homo sapiens
uugggcaaaucacuaacgucucc

SEQ ID NO: 94077 - RNA, 17 nt, Homo sapiens
uugggcaagguagguga

SEQ ID NO: 94078 - RNA, 22 nt, Homo sapiens
uugggcaaguggcaugaccaug

SEQ ID NO: 94079 - RNA, 22 nt, Homo sapiens
uugggcaauaggaagcaggugg

SEQ ID NO: 94080 - RNA, 22 nt, Homo sapiens
uugggcuugagggugcccaguc

SEQ ID NO: 94081 - RNA, 22 nt, Homo sapiens
uugggguagaauugcaacauau

SEQ ID NO: 94082 - RNA, 22 nt, Homo sapiens
uugggguaggaauauggaauga

SEQ ID NO: 94083 - RNA, 22 nt, Homo sapiens
uugguaaaaugaccacagacau

SEQ ID NO: 94084 - RNA, 22 nt, Homo sapiens
uuggucagcuagauuauucccu

SEQ ID NO: 94085 - RNA, 22 nt, Homo sapiens
uuggucagcucaauggagaggg

SEQ ID NO: 94086 - RNA, 22 nt, Homo sapiens
uugguuaccuucagaaaugagu

SEQ ID NO: 94087 - RNA, 22 nt, Homo sapiens
uugguucaguuuaacgaguaau

SEQ ID NO: 94088 - RNA, 22 nt, Homo sapiens
uugguuccauuuuaccagcucu

SEQ ID NO: 94089 - RNA, 21 nt, Homo sapiens
uugguucccucugacaggucu

SEQ ID NO: 94090 - RNA, 22 nt, Homo sapiens
uugguucucuuagccaucuuaa

SEQ ID NO: 94091 - RNA, 22 nt, Homo sapiens
uuguaaaguucucucccgaaaa

SEQ ID NO: 94092 - RNA, 22 nt, Homo sapiens
uuguaacucugaauacauccua

SEQ ID NO: 94093 - RNA, 23 nt, Homo sapiens
uuguaacuggagaguaacauucc

SEQ ID NO: 94094 - RNA, 22 nt, Homo sapiens
uuguaaucaacacaucauuggg

SEQ ID NO: 94095 - RNA, 23 nt, Homo sapiens
uuguacacuaagaaucgcagaug

SEQ ID NO: 94096 - RNA, 22 nt, Homo sapiens
uuguacuagaaaauuauucuuu

SEQ ID NO: 94097 - RNA, 22 nt, Homo sapiens
uuguacuccagccugggugaca

SEQ ID NO: 94098 - RNA, 22 nt, Homo sapiens
uuguaguagucucguucuuuua

SEQ ID NO: 94099 - RNA, 22 nt, Homo sapiens
uuguauaguucuauguguuuug

SEQ ID NO: 94100 - RNA, 22 nt, Homo sapiens
uugucacccuacauaacaggga

SEQ ID NO: 94101 - RNA, 22 nt, Homo sapiens
uugucaccucuaaaucucauau

SEQ ID NO: 94102 - RNA, 22 nt, Homo sapiens
uugucaguguucacucaaagcu

SEQ ID NO: 94103 - RNA, 22 nt, Homo sapiens
uuguccaagucccauuuguuga

SEQ ID NO: 94104 - RNA, 22 nt, Homo sapiens
uuguccccacccaaaugucauc

SEQ ID NO: 94105 - RNA, 22 nt, Homo sapiens
uuguccuugagauaguuugcug

SEQ ID NO: 94106 - RNA, 22 nt, Homo sapiens
uugucucacuggaguuuaguaa

SEQ ID NO: 94107 - RNA, 22 nt, Homo sapiens
uugucuugcagcuuaggcauca

SEQ ID NO: 94108 - RNA, 22 nt, Homo sapiens
uugugaaaaaccucucguggaa

SEQ ID NO: 94109 - RNA, 22 nt, Homo sapiens
uugugaaugaugucgcaauaaa

SEQ ID NO: 94110 - RNA, 22 nt, Homo sapiens
uugugaaugaugucgcaguaaa

SEQ ID NO: 94111 - RNA, 22 nt, Homo sapiens
uugugaauggugccgcaauaaa

SEQ ID NO: 94112 - RNA, 22 nt, Homo sapiens
uugugaauggugccgcgauaaa

SEQ ID NO: 94113 - RNA, 22 nt, Homo sapiens
uugugaauggugccucaguaaa

SEQ ID NO: 94114 - RNA, 22 nt, Homo sapiens
uugugcacauguacccuagaac

SEQ ID NO: 94115 - RNA, 22 nt, Homo sapiens
uugugcaugaugcauacauggu

SEQ ID NO: 94116 - RNA, 21 nt, Homo sapiens
uuuggcuucucugcugcagcc

SEQ ID NO: 94117 - RNA, 22 nt, Homo sapiens
uuugguguauaaaaaugcuagu

SEQ ID NO: 94118 - RNA, 22 nt, Homo sapiens
uuugguuauauauauacacucu

SEQ ID NO: 94119 - RNA, 22 nt, Homo sapiens
uuugguugucacaacuggggga

SEQ ID NO: 94120 - RNA, 22 nt, Homo sapiens
uuugguuuuuguuaucacucau

SEQ ID NO: 94121 - RNA, 22 nt, Homo sapiens
uuuguaagaugcauagauugca

SEQ ID NO: 94122 - RNA, 22 nt, Homo sapiens
uuuguacacgugggugaauugu

SEQ ID NO: 94123 - RNA, 22 nt, Homo sapiens
uuuguacuccuuggccagcuuc

SEQ ID NO: 94124 - RNA, 22 nt, Homo sapiens
uuuguacuucauacaauaacuc

SEQ ID NO: 94125 - RNA, 22 nt, Homo sapiens
uuuguacuugaaacccagggcc

SEQ ID NO: 94126 - RNA, 22 nt, Homo sapiens
uuuguacuugaagaaucuuuau

SEQ ID NO: 94127 - RNA, 18 nt, Homo sapiens
uuuguacuuuuucuaaug

SEQ ID NO: 94128 - RNA, 19 nt, Homo sapiens
uuuguauguuuccaguaau

SEQ ID NO: 94129 - RNA, 22 nt, Homo sapiens
uuugucccucucaccaacgggg

SEQ ID NO: 94130 - RNA, 23 nt, Homo sapiens
uuugugacacucuccaucuccag

SEQ ID NO: 94131 - RNA, 23 nt, Homo sapiens
uuugugcuaauuuaugggcucuu

SEQ ID NO: 94132 - RNA, 22 nt, Homo sapiens
uuugugcugcaauuaauuuccc

SEQ ID NO: 94133 - RNA, 22 nt, Homo sapiens
uuuuagcaaagagacugguggc

SEQ ID NO: 94134 - RNA, 22 nt, Homo sapiens
uuuuagcagccaugacaaagau

SEQ ID NO: 94135 - RNA, 22 nt, Homo sapiens
uuuuagcuuuucccaggacucc

SEQ ID NO: 94136 - RNA, 19 nt, Homo sapiens
uuuuccccuuucuuaagac

SEQ ID NO: 94137 - RNA, 22 nt, Homo sapiens
uuuugcaccauccuaauaguau

SEQ ID NO: 94138 - RNA, 22 nt, Homo sapiens
uuuugcacuagaaccagagguu

SEQ ID NO: 94139 - RNA, 22 nt, Homo sapiens
uuuugcaggcauuggaaguuua

SEQ ID NO: 94140 - RNA, 22 nt, Homo sapiens
uuuugcucuucggaagagcuug

SEQ ID NO: 94141 - RNA, 22 nt, Homo sapiens
uuuugcucuugguaaugaaaga

SEQ ID NO: 94142 - RNA, 18 nt, Homo sapiens
uuuugcuuaacugcgcca

SEQ ID NO: 94143 - RNA, 22 nt, Homo sapiens
uuuuggacuugcuccccugucc

SEQ ID NO: 94144 - RNA, 22 nt, Homo sapiens
uuuuggcuagaaauauaccucc

SEQ ID NO: 94145 - RNA, 20 nt, Homo sapiens
uuuuggcuuaaagcagucug

SEQ ID NO: 94146 - RNA, 22 nt, Homo sapiens
uuuugguaaugaacuuaggaag

SEQ ID NO: 94147 - RNA, 22 nt, Homo sapiens
uuuugguauacacaaggguccu

SEQ ID NO: 94148 - RNA, 22 nt, Homo sapiens
uuuugguauauacggggguccu

SEQ ID NO: 94149 - RNA, 21 nt, Homo sapiens
uuuuggucauucaggaagaaa

SEQ ID NO: 94150 - RNA, 22 nt, Homo sapiens
uuuugguguacaauucuaugga

SEQ ID NO: 94151 - RNA, 22 nt, Homo sapiens
uuuugguuguuggguaagagua

SEQ ID NO: 94152 - RNA, 22 nt, Homo sapiens
uuuuguacaacagcucugggga

SEQ ID NO: 94153 - RNA, 22 nt, Homo sapiens
uuuugugacuauuguaaauggg

SEQ ID NO: 94154 - RNA, 22 nt, Homo sapiens
uuuuucacuuaaguuaggcuca

SEQ ID NO: 94155 - RNA, 22 nt, Homo sapiens
uuuuugagaauuggugaaacac

SEQ ID NO: 94156 - RNA, 18 nt, Homo sapiens
uuuuugaggcacagggga

SEQ ID NO: 94157 - RNA, 22 nt, Homo sapiens
uuuuugaguaaauauaaauugu

SEQ ID NO: 94158 - RNA, 16 nt, Homo sapiens
uuuuugcagaaaugac

SEQ ID NO: 94159 - RNA, 22 nt, Homo sapiens
uuuuuggaggagguuagaucau

SEQ ID NO: 94160 - RNA, 21 nt, Homo sapiens
uuuuugguggucauggauaga

SEQ ID NO: 94161 - RNA, 22 nt, Homo sapiens
uuuuugguugguaggcuauuaa

SEQ ID NO: 94162 - RNA, 22 nt, Homo sapiens
uuuuuugcuguaugcaaacauc

SEQ ID NO: 94163 - RNA, 22 nt, Homo sapiens
cauugcacuccagccugaggga

SEQ ID NO: 94164 - RNA, 22 nt, Homo sapiens
cauugcacuccagccugcacga

SEQ ID NO: 94165 - RNA, 22 nt, Homo sapiens
cauugcacuccagccugcugac

SEQ ID NO: 94166 - RNA, 22 nt, Homo sapiens
cauugcacuccagccuuggcaa

SEQ ID NO: 94167 - RNA, 22 nt, Homo sapiens
cauugcacuccagccuugguga

SEQ ID NO: 94168 - RNA, 22 nt, Homo sapiens
cauugcacuccaucuugggcaa

SEQ ID NO: 94169 - RNA, 22 nt, Homo sapiens
cauugcacugcagcccgggcaa

SEQ ID NO: 94170 - RNA, 22 nt, Homo sapiens
cauugcaguuuuugguguaucu

SEQ ID NO: 94171 - RNA, 22 nt, Homo sapiens
cauugguugaacagauuguguu

SEQ ID NO: 94172 - RNA, 22 nt, Homo sapiens
cauugguuuuucaggaguauau

SEQ ID NO: 94173 - RNA, 22 nt, Homo sapiens
cauuguacauaaguauggagua

SEQ ID NO: 94174 - RNA, 22 nt, Homo sapiens
cauugucccucaaugucuauga

SEQ ID NO: 94175 - RNA, 22 nt, Homo sapiens
cauuuuacuuuccagacgugga

SEQ ID NO: 94176 - RNA, 22 nt, Homo sapiens
ccaaauccauccaaaucauaga

SEQ ID NO: 94177 - RNA, 22 nt, Homo sapiens
ccaagccucaguuucccucugu

SEQ ID NO: 94178 - RNA, 22 nt, Homo sapiens
ccacaaccucaacagcaucuau

SEQ ID NO: 94179 - RNA, 19 nt, Homo sapiens
ccacaaugguugaacuaga

SEQ ID NO: 94180 - RNA, 22 nt, Homo sapiens
ccacacugucuuggugggaaac

SEQ ID NO: 94181 - RNA, 22 nt, Homo sapiens
ccacccuuccacacccugggua

SEQ ID NO: 94182 - RNA, 22 nt, Homo sapiens
ccaccgggucccagcucugcuc

SEQ ID NO: 94183 - RNA, 22 nt, Homo sapiens
ccaccuguacuuaagucacuuu

SEQ ID NO: 94184 - RNA, 22 nt, Homo sapiens
ccaggguuccacgccuggcugu

SEQ ID NO: 94185 - RNA, 22 nt, Homo sapiens
ccaggguugcuuuagauucuga

SEQ ID NO: 94186 - RNA, 22 nt, Homo sapiens
ccaguauugaacacaaugaaag

SEQ ID NO: 94187 - RNA, 17 nt, Homo sapiens
ccagugaucccuuuugu

SEQ ID NO: 94188 - RNA, 22 nt, Homo sapiens
ccagugcauggaucccaggggg

SEQ ID NO: 94189 - RNA, 22 nt, Homo sapiens
ccagugcugugcaguguaugag

SEQ ID NO: 94190 - RNA, 22 nt, Homo sapiens
aguuuuugcugauagcaugcuu

SEQ ID NO: 94191 - RNA, 22 nt, Homo sapiens
auaaaagcaggucuaggucagg

SEQ ID NO: 94192 - RNA, 22 nt, Homo sapiens
auaaaccuacauuuucacuucu

SEQ ID NO: 94193 - RNA, 19 nt, Homo sapiens
auaaacuagaacugucccc

SEQ ID NO: 94194 - RNA, 22 nt, Homo sapiens
auaaaguucugcuggcauauau

SEQ ID NO: 94195 - RNA, 18 nt, Homo sapiens
auaaccuggugcuuucaa

SEQ ID NO: 94196 - RNA, 22 nt, Homo sapiens
auaagaguaguacauaugagac

SEQ ID NO: 94197 - RNA, 22 nt, Homo sapiens
auaagauaguggaagugggauu

SEQ ID NO: 94198 - RNA, 22 nt, Homo sapiens
auaagaucauuugcuaagaggg

SEQ ID NO: 94199 - RNA, 22 nt, Homo sapiens
auaagcuaagaguuucugggcu

SEQ ID NO: 94200 - RNA, 22 nt, Homo sapiens
auaaggcugguauagacauuca

SEQ ID NO: 94201 - RNA, 22 nt, Homo sapiens
auaagguuagcucugagaaagu

SEQ ID NO: 94202 - RNA, 22 nt, Homo sapiens
auaaguaguaaagcagugacua

SEQ ID NO: 94203 - RNA, 22 nt, Homo sapiens
auaaguauuuggacuuuacugu

SEQ ID NO: 94204 - RNA, 22 nt, Homo sapiens
auaauagguugauugacauugc

SEQ ID NO: 94205 - RNA, 22 nt, Homo sapiens
auaauaucagguugugaugaug

SEQ ID NO: 94206 - RNA, 18 nt, Homo sapiens
auacaagcagcagagauu

SEQ ID NO: 94207 - RNA, 22 nt, Homo sapiens
auacaagcaguccaacuccaua

SEQ ID NO: 94208 - RNA, 22 nt, Homo sapiens
auacaaggaaugaagagauuug

SEQ ID NO: 94209 - RNA, 22 nt, Homo sapiens
auacaguguauguauaguacau

SEQ ID NO: 94210 - RNA, 20 nt, Homo sapiens
auacccaguagcacaacagc

SEQ ID NO: 94211 - RNA, 22 nt, Homo sapiens
auacccaguaguggaauugcua

SEQ ID NO: 94212 - RNA, 22 nt, Homo sapiens
auacccauacauauuggugacu

SEQ ID NO: 94213 - RNA, 22 nt, Homo sapiens
auaccuuuuaggggaacguucu

SEQ ID NO: 94214 - RNA, 22 nt, Homo sapiens
auacguacauaugcacauaugg

SEQ ID NO: 94215 - RNA, 22 nt, Homo sapiens
auacuguacugaaguacccauu

SEQ ID NO: 94216 - RNA, 22 nt, Homo sapiens
auacuguuucugaacuuugauu

SEQ ID NO: 94217 - RNA, 22 nt, Homo sapiens
auacuguuuuacaucauugccu

SEQ ID NO: 94218 - RNA, 22 nt, Homo sapiens
auagaagcuauguauaggggcc

SEQ ID NO: 94219 - RNA, 18 nt, Homo sapiens
cuaagacacuuggcagag

SEQ ID NO: 94220 - RNA, 22 nt, Homo sapiens
cuaagauugucuuaguguguug

SEQ ID NO: 94221 - RNA, 22 nt, Homo sapiens
cuaaggaaggacugaaaggaca

SEQ ID NO: 94222 - RNA, 22 nt, Homo sapiens
cuaauacaguuguccaagcugg

SEQ ID NO: 94223 - RNA, 22 nt, Homo sapiens
cuaaugcagucaggagaaggaa

SEQ ID NO: 94224 - RNA, 22 nt, Homo sapiens
cuacacaugcaggcucccugcc

SEQ ID NO: 94225 - RNA, 22 nt, Homo sapiens
cuacagaguaucuaaagaggua

SEQ ID NO: 94226 - RNA, 22 nt, Homo sapiens
cuacagcacugagcugugugca

SEQ ID NO: 94227 - RNA, 22 nt, Homo sapiens
uaaaguucuuuuaugggccggg

SEQ ID NO: 94228 - RNA, 22 nt, Homo sapiens
uaaauggauauugccaucuccu

SEQ ID NO: 94229 - RNA, 16 nt, Homo sapiens
uaacacaguucccacc

SEQ ID NO: 94230 - RNA, 22 nt, Homo sapiens
uaacaccuugcucugucaauaa

SEQ ID NO: 94231 - RNA, 22 nt, Homo sapiens
uaacaguguagaggccuauugg

SEQ ID NO: 94232 - RNA, 22 nt, Homo sapiens
uaacauagucauauacuugcuu

SEQ ID NO: 94233 - RNA, 22 nt, Homo sapiens
uaacauugcuggacuaccugcu

SEQ ID NO: 94234 - RNA, 22 nt, Homo sapiens
uaacauugucuugcuuaguuuu

SEQ ID NO: 94235 - RNA, 21 nt, Homo sapiens
uaacccugaaggagcucugga

SEQ ID NO: 94236 - RNA, 22 nt, Homo sapiens
uaacuagaaaggagacaguugc

SEQ ID NO: 94237 - RNA, 22 nt, Homo sapiens
uaacuauagagaauguugagua

SEQ ID NO: 94238 - RNA, 22 nt, Homo sapiens
uaacucugccuagugacauggu

SEQ ID NO: 94239 - RNA, 22 nt, Homo sapiens
uaacugcaaccuccgccucccg

SEQ ID NO: 94240 - RNA, 22 nt, Homo sapiens
uaacugcaaccucugccugcug

SEQ ID NO: 94241 - RNA, 22 nt, Homo sapiens
uaacugccuacugugcaaauau

SEQ ID NO: 94242 - RNA, 22 nt, Homo sapiens
uaagagagcuccaucuuuuccu

SEQ ID NO: 94243 - RNA, 22 nt, Homo sapiens
uaagagcuaggauuuuaaauca

SEQ ID NO: 94244 - RNA, 20 nt, Homo sapiens
uaagccacacagucuaaggu

SEQ ID NO: 94245 - RNA, 22 nt, Homo sapiens
uaagcuguguggacuaugccuc

SEQ ID NO: 94246 - RNA, 22 nt, Homo sapiens
uaaggaguagaauaguaaggca

SEQ ID NO: 94247 - RNA, 22 nt, Homo sapiens
uaaggauuuuggugauuacacu

SEQ ID NO: 94248 - RNA, 18 nt, Homo sapiens
uaaggcacuauaggcauu

SEQ ID NO: 94249 - RNA, 22 nt, Homo sapiens
uaaggcccauucuaugaagcag

SEQ ID NO: 94250 - RNA, 22 nt, Homo sapiens
uaaggcuucuuggaauacugca

SEQ ID NO: 94251 - RNA, 22 nt, Homo sapiens
uaaggcuuugcuggacucaguc

SEQ ID NO: 94252 - RNA, 22 nt, Homo sapiens
uaagggacauguguugccuaag

SEQ ID NO: 94253 - RNA, 22 nt, Homo sapiens
uaagguuacaaaggacuucaua

SEQ ID NO: 94254 - RNA, 22 nt, Homo sapiens
uaaguaaaugaaagguugauuu

SEQ ID NO: 94255 - RNA, 22 nt, Homo sapiens
uaaguaauugcagcaauuugcc

SEQ ID NO: 94256 - RNA, 22 nt, Homo sapiens
uaaguaauuuguauuuuaccca

SEQ ID NO: 94257 - RNA, 22 nt, Homo sapiens
uaaguauuuuaauuccuggcau

SEQ ID NO: 94258 - RNA, 23 nt, Homo sapiens
uaagucacacagauuaauuuauu

SEQ ID NO: 94259 - RNA, 22 nt, Homo sapiens
uaagugaauguuggcuacugaa

SEQ ID NO: 94260 - RNA, 22 nt, Homo sapiens
uaagugcaacauaaguguuaaa

SEQ ID NO: 94261 - RNA, 20 nt, Homo sapiens
uaagugcauaggauauuucu

SEQ ID NO: 94262 - RNA, 22 nt, Homo sapiens
uaaguguaaugucugaaguuug

SEQ ID NO: 94263 - RNA, 22 nt, Homo sapiens
uaaguuagugugagaauuuugc

SEQ ID NO: 94264 - RNA, 20 nt, Homo sapiens
uaaguuguauuugucaugaa

SEQ ID NO: 94265 - RNA, 22 nt, Homo sapiens
uaauacucuucucauuuuacag

SEQ ID NO: 94266 - RNA, 22 nt, Homo sapiens
uaauacuguaauggugguuccg

SEQ ID NO: 94267 - RNA, 22 nt, Homo sapiens
uaauacuugucauaaaggcauu

SEQ ID NO: 94268 - RNA, 22 nt, Homo sapiens
uaauagagucauuauuauuguu

SEQ ID NO: 94269 - RNA, 22 nt, Homo sapiens
uaauaguuggcacuggagaaag

SEQ ID NO: 94270 - RNA, 22 nt, Homo sapiens
uaauauguuuugaaaucaggaa

SEQ ID NO: 94271 - RNA, 22 nt, Homo sapiens
uaaugcacauuuauuuuaccuu

SEQ ID NO: 94272 - RNA, 22 nt, Homo sapiens
uaaugcauguaaugggcugaua

SEQ ID NO: 94273 - RNA, 22 nt, Homo sapiens
uaaugcuaucugggccaggggu

SEQ ID NO: 94274 - RNA, 22 nt, Homo sapiens
uaaugcucauuagcaggccaau

SEQ ID NO: 94275 - RNA, 22 nt, Homo sapiens
uaaugcuccauggguuauuaaa

SEQ ID NO: 94276 - RNA, 22 nt, Homo sapiens
uaaugugaauagugcuguaaug

SEQ ID NO: 94277 - RNA, 22 nt, Homo sapiens
uaaugugcuucucuaccauagg

SEQ ID NO: 94278 - RNA, 22 nt, Homo sapiens
uaauucacauaaagcacuuaga

SEQ ID NO: 94279 - RNA, 22 nt, Homo sapiens
uaauucugacaacaguggcguu

SEQ ID NO: 94280 - RNA, 22 nt, Homo sapiens
uaauugaaugcagacaccaggg

SEQ ID NO: 94281 - RNA, 22 nt, Homo sapiens
uacaaagugggaaacgaagguu

SEQ ID NO: 94282 - RNA, 16 nt, Homo sapiens
uacaacagugaguaug

SEQ ID NO: 94283 - RNA, 22 nt, Homo sapiens
uacaagcacaggcagcaggcug

SEQ ID NO: 94284 - RNA, 22 nt, Homo sapiens
uacaaguaauaagggaagaauu

SEQ ID NO: 94285 - RNA, 21 nt, Homo sapiens
uacaaugcacaggagagccuc

SEQ ID NO: 94286 - RNA, 18 nt, Homo sapiens
uacagaacuggaguagaa

SEQ ID NO: 94287 - RNA, 22 nt, Homo sapiens
uacagaguauccauuugaguuc

SEQ ID NO: 94288 - RNA, 22 nt, Homo sapiens
uacagaucaguuauuuuguaga

SEQ ID NO: 94289 - RNA, 22 nt, Homo sapiens
uacagcuaugugcaugcaugcu

SEQ ID NO: 94290 - RNA, 20 nt, Homo sapiens
uacaggacugagaaucugug

SEQ ID NO: 94291 - RNA, 22 nt, Homo sapiens
uacagguauagauguguguucu

SEQ ID NO: 94292 - RNA, 22 nt, Homo sapiens
uacaguaauguuaaucuuugug

SEQ ID NO: 94293 - RNA, 19 nt, Homo sapiens
uacaguacacaacaccuuu

SEQ ID NO: 94294 - RNA, 22 nt, Homo sapiens
uacaguagagaucagcaaacua

SEQ ID NO: 94295 - RNA, 22 nt, Homo sapiens
uacaguaguaucuucauuuguu

SEQ ID NO: 94296 - RNA, 22 nt, Homo sapiens
uacaguauuaugagugauugaa

SEQ ID NO: 94297 - RNA, 22 nt, Homo sapiens
uacagucacauuccugaccaua

SEQ ID NO: 94298 - RNA, 22 nt, Homo sapiens
uacagucauaaugccuagugac

SEQ ID NO: 94299 - RNA, 22 nt, Homo sapiens
uacaguccaugcauuauccucc

SEQ ID NO: 94300 - RNA, 22 nt, Homo sapiens
uacagugcauagaggcaugaua

SEQ ID NO: 94301 - RNA, 22 nt, Homo sapiens
uacaguggugugaucucagcuc

SEQ ID NO: 94302 - RNA, 22 nt, Homo sapiens
uacauacuucacagacuuuaaa

SEQ ID NO: 94303 - RNA, 22 nt, Homo sapiens
uacauaguaagcaucuccugug

SEQ ID NO: 94304 - RNA, 22 nt, Homo sapiens
uauggaaaucuuaccuuauggu

SEQ ID NO: 94305 - RNA, 22 nt, Homo sapiens
uauggauuugcauuccccaugu

SEQ ID NO: 94306 - RNA, 22 nt, Homo sapiens
uauggauuuuuuugacaagagc

SEQ ID NO: 94307 - RNA, 22 nt, Homo sapiens
uauggccugcguccagugguau

SEQ ID NO: 94308 - RNA, 22 nt, Homo sapiens
uauggcguaugaauuauaucuc

SEQ ID NO: 94309 - RNA, 22 nt, Homo sapiens
uauggcuucuauaaggaagcuu

SEQ ID NO: 94310 - RNA, 22 nt, Homo sapiens
uauggcuucuuuaaauugaggu

SEQ ID NO: 94311 - RNA, 22 nt, Homo sapiens
uauggcuuucuacuugaguucu

SEQ ID NO: 94312 - RNA, 22 nt, Homo sapiens
uauggcuuuuaacugucguaug

SEQ ID NO: 94313 - RNA, 22 nt, Homo sapiens
uauggcuuuucacuuaaguccu

SEQ ID NO: 94314 - RNA, 19 nt, Homo sapiens
uaugggauuuuuagggugu

SEQ ID NO: 94315 - RNA, 22 nt, Homo sapiens
uauggguguuauugcaugggag

SEQ ID NO: 94316 - RNA, 22 nt, Homo sapiens
uauggguuucagagggugauag

SEQ ID NO: 94317 - RNA, 22 nt, Homo sapiens
uauggguuuuugucuguuuacu

SEQ ID NO: 94318 - RNA, 22 nt, Homo sapiens
ucacugugguuggaaggcuuaa

SEQ ID NO: 94319 - RNA, 22 nt, Homo sapiens
ucacugugguuugggaaagugc

SEQ ID NO: 94320 - RNA, 22 nt, Homo sapiens
ucacugugugucucuguaucug

SEQ ID NO: 94321 - RNA, 22 nt, Homo sapiens
ucacuuugacggccaacuucua

SEQ ID NO: 94322 - RNA, 22 nt, Homo sapiens
ucagaacugauacuagaacuuu

SEQ ID NO: 94323 - RNA, 22 nt, Homo sapiens
ucagaauguaacuuuaguugga

SEQ ID NO: 94324 - RNA, 22 nt, Homo sapiens
ucagacacugcccuccaccugu

SEQ ID NO: 94325 - RNA, 22 nt, Homo sapiens
ucagacacuguggccuuuggac

SEQ ID NO: 94326 - RNA, 22 nt, Homo sapiens
ucagagcaaagacacuuuauca

SEQ ID NO: 94327 - RNA, 22 nt, Homo sapiens
ucagaguagaaacacuuccaua

SEQ ID NO: 94328 - RNA, 22 nt, Homo sapiens
ucagagucuagaucacucacug

SEQ ID NO: 94329 - RNA, 18 nt, Homo sapiens
ucagagugcagacuauac

SEQ ID NO: 94330 - RNA, 22 nt, Homo sapiens
ucagaucacuggcgcuggcgga

SEQ ID NO: 94331 - RNA, 22 nt, Homo sapiens
ucagaugaugucccuguucuaa

SEQ ID NO: 94332 - RNA, 22 nt, Homo sapiens
ucagcagugccccacucuacug

SEQ ID NO: 94333 - RNA, 21 nt, Homo sapiens
ucagcucaucacugccuggag

SEQ ID NO: 94334 - RNA, 22 nt, Homo sapiens
ucaggcaugcagcaaugcagug

SEQ ID NO: 94335 - RNA, 20 nt, Homo sapiens
ucaggcuccgcauuaacuua

SEQ ID NO: 94336 - RNA, 22 nt, Homo sapiens
ucagggacgcuugacacaagcc

SEQ ID NO: 94337 - RNA, 22 nt, Homo sapiens
ucaggguacuuguggccaaagu

SEQ ID NO: 94338 - RNA, 22 nt, Homo sapiens
ucagguagcauuuuggaaacag

SEQ ID NO: 94339 - RNA, 22 nt, Homo sapiens
ucagguaucucuauagcaaugu

SEQ ID NO: 94340 - RNA, 22 nt, Homo sapiens
ucagguaucuucauagcaaugc

SEQ ID NO: 94341 - RNA, 22 nt, Homo sapiens
ucaggucauuccaggagggcca

SEQ ID NO: 94342 - RNA, 22 nt, Homo sapiens
ucagguccuuacugugcucccu

SEQ ID NO: 94343 - RNA, 22 nt, Homo sapiens
ucaggugccuuggcuaauuguu

SEQ ID NO: 94344 - RNA, 22 nt, Homo sapiens
ucagguugcuaaguauaauauu

SEQ ID NO: 94345 - RNA, 22 nt, Homo sapiens
ucaguacgugggcaguuccuuc

SEQ ID NO: 94346 - RNA, 23 nt, Homo sapiens
ucaguacucuauaagugccagcu

SEQ ID NO: 94347 - RNA, 23 nt, Homo sapiens
ucaguagucauugggaaagugug

SEQ ID NO: 94348 - RNA, 19 nt, Homo sapiens
ucaguagugcacauaagcc

SEQ ID NO: 94349 - RNA, 22 nt, Homo sapiens
ucaguaguuccaguggguauuu

SEQ ID NO: 94350 - RNA, 22 nt, Homo sapiens
ucaguaguuuuuuuacuaggug

SEQ ID NO: 94351 - RNA, 22 nt, Homo sapiens
ucaguauaugaaucuggggcag

SEQ ID NO: 94352 - RNA, 22 nt, Homo sapiens
ucagugaauauauaacagcgau

SEQ ID NO: 94353 - RNA, 22 nt, Homo sapiens
ucagugauugguuauuuuaggc

SEQ ID NO: 94354 - RNA, 22 nt, Homo sapiens
ucagugccauugccauaugagu

SEQ ID NO: 94355 - RNA, 22 nt, Homo sapiens
ucaguggagagcuuccaggauu

SEQ ID NO: 94356 - RNA, 22 nt, Homo sapiens
ucaguggagccucacucugugg

SEQ ID NO: 94357 - RNA, 22 nt, Homo sapiens
ucaguggagcuacaauucuggg

SEQ ID NO: 94358 - RNA, 22 nt, Homo sapiens
ucagugguuaaaagauucuaga

SEQ ID NO: 94359 - RNA, 22 nt, Homo sapiens
ucagugucugugauggagaggu

SEQ ID NO: 94360 - RNA, 22 nt, Homo sapiens
ucaguguuuggaaucucaauuu

SEQ ID NO: 94361 - RNA, 22 nt, Homo sapiens
ucaguuaaugcugccugcugga

SEQ ID NO: 94362 - RNA, 21 nt, Homo sapiens
ucaguuacugagagagaagug

SEQ ID NO: 94363 - RNA, 22 nt, Homo sapiens
ucauaaaguuguuuuaauggga

SEQ ID NO: 94364 - RNA, 22 nt, Homo sapiens
ucauacaguaguccucacuugu

SEQ ID NO: 94365 - RNA, 22 nt, Homo sapiens
ucauacuguccaauucuagugg

SEQ ID NO: 94366 - RNA, 20 nt, Homo sapiens
ucauacuguggaguaccagg

SEQ ID NO: 94367 - RNA, 22 nt, Homo sapiens
ucauaguagucacuuaauaaau

SEQ ID NO: 94368 - RNA, 16 nt, Homo sapiens
ucauaguaucucuucu

SEQ ID NO: 94369 - RNA, 21 nt, Homo sapiens
ucaucaagcuguagacaugau

SEQ ID NO: 94370 - RNA, 22 nt, Homo sapiens
ucaucagaaucccuuagggaug

SEQ ID NO: 94371 - RNA, 22 nt, Homo sapiens
ucaucagaguuuacaagcucag

SEQ ID NO: 94372 - RNA, 22 nt, Homo sapiens
ucaucaggaaacuuaugcagug

SEQ ID NO: 94373 - RNA, 21 nt, Homo sapiens
ucaucagucaaagacaauggu

SEQ ID NO: 94374 - RNA, 22 nt, Homo sapiens
ucaucaguggggaugugguuga

SEQ ID NO: 94375 - RNA, 22 nt, Homo sapiens
ucaucaguuuuuuauaugugau

SEQ ID NO: 94376 - RNA, 22 nt, Homo sapiens
ucaucucaguuucuugccguac

SEQ ID NO: 94377 - RNA, 22 nt, Homo sapiens
ucaucuggcgaaugugaagagu

SEQ ID NO: 94378 - RNA, 22 nt, Homo sapiens
ucaugcaaugcaaggggaaauu

SEQ ID NO: 94379 - RNA, 21 nt, Homo sapiens
ucaugccacugcacuuuagcc

SEQ ID NO: 94380 - RNA, 20 nt, Homo sapiens
ucaugccacugcgcuccagc

SEQ ID NO: 94381 - RNA, 22 nt, Homo sapiens
ucauggcacugaugagaguuuc

SEQ ID NO: 94382 - RNA, 23 nt, Homo sapiens
ucauguauucccuguaaugggua

SEQ ID NO: 94383 - RNA, 22 nt, Homo sapiens
ucaugucuuguuguauuuauuu

SEQ ID NO: 94384 - RNA, 22 nt, Homo sapiens
ucauucauuugcucacuccaca

SEQ ID NO: 94385 - RNA, 22 nt, Homo sapiens
ucauugagacuuguuuuguggc

SEQ ID NO: 94386 - RNA, 22 nt, Homo sapiens
ucauugcacuccagccugggug

SEQ ID NO: 94387 - RNA, 22 nt, Homo sapiens
ucauugcacuucuuuaguugca

SEQ ID NO: 94388 - RNA, 22 nt, Homo sapiens
ucauugguucuggguguuguug

SEQ ID NO: 94389 - RNA, 22 nt, Homo sapiens
uccacaauggagaagaguauga

SEQ ID NO: 94390 - RNA, 22 nt, Homo sapiens
uagggcuuuccggccugucaga

SEQ ID NO: 94391 - RNA, 22 nt, Homo sapiens
uaggggcacacuucgguuagca

SEQ ID NO: 94392 - RNA, 22 nt, Homo sapiens
uagguaggaaguguuguuuuua

SEQ ID NO: 94393 - RNA, 22 nt, Homo sapiens
uagguagugugugcaugagagg

SEQ ID NO: 94394 - RNA, 22 nt, Homo sapiens
uagguaguugugggcuugaaug

SEQ ID NO: 94395 - RNA, 22 nt, Homo sapiens
uagguaguuuucccguauccaa

SEQ ID NO: 94396 - RNA, 22 nt, Homo sapiens
uaggucacugcucugugucuaa

SEQ ID NO: 94397 - RNA, 22 nt, Homo sapiens
uaggucuccuuuuugccuaaau

SEQ ID NO: 94398 - RNA, 22 nt, Homo sapiens
uaggugauccauuuguauuuua

SEQ ID NO: 94399 - RNA, 22 nt, Homo sapiens
uagguuguccaucucuagaagc

SEQ ID NO: 94400 - RNA, 22 nt, Homo sapiens
uaguagagauggggcacaugcc

SEQ ID NO: 94401 - RNA, 22 nt, Homo sapiens
uaguagcaccucucaugagcuu

SEQ ID NO: 94402 - RNA, 22 nt, Homo sapiens
uaguaggacaggauuucaguua

SEQ ID NO: 94403 - RNA, 22 nt, Homo sapiens
uaguaguuuuguguauaauaau

SEQ ID NO: 94404 - RNA, 22 nt, Homo sapiens
uaguaucacaagguguacaccc

SEQ ID NO: 94405 - RNA, 22 nt, Homo sapiens
uaguaucacauggucuuaauua

SEQ ID NO: 94406 - RNA, 22 nt, Homo sapiens
uaguaucauugaaacggcuugu

SEQ ID NO: 94407 - RNA, 22 nt, Homo sapiens
uagugcugagauugagaagccc

SEQ ID NO: 94408 - RNA, 21 nt, Homo sapiens
uagugcugaggcaguauggga

SEQ ID NO: 94409 - RNA, 22 nt, Homo sapiens
ugaagacucaauuauuaugaac

SEQ ID NO: 94410 - RNA, 22 nt, Homo sapiens
ugaagacucaguuugagggaca

SEQ ID NO: 94411 - RNA, 22 nt, Homo sapiens
ugaagagucuaaaucugucuuc

SEQ ID NO: 94412 - RNA, 22 nt, Homo sapiens
ugaagcuaugacuauugagcau

SEQ ID NO: 94413 - RNA, 22 nt, Homo sapiens
ugaagcuuguuucuguaccuuu

SEQ ID NO: 94414 - RNA, 22 nt, Homo sapiens
ugaaggacauaaggcagaguga

SEQ ID NO: 94415 - RNA, 22 nt, Homo sapiens
ugaaggacauucuaugguagau

SEQ ID NO: 94416 - RNA, 22 nt, Homo sapiens
ugaaggaguauggauaagucgu

SEQ ID NO: 94417 - RNA, 22 nt, Homo sapiens
ugaaggccgggcaugguggcuc

SEQ ID NO: 94418 - RNA, 21 nt, Homo sapiens
ugaaguagcauaggaugucaa

SEQ ID NO: 94419 - RNA, 22 nt, Homo sapiens
ugaagugaaugguaaguaugcc

SEQ ID NO: 94420 - RNA, 21 nt, Homo sapiens
ugaauacugcugcucccuuug

SEQ ID NO: 94421 - RNA, 22 nt, Homo sapiens
ugaauagacacuaaagacugua

SEQ ID NO: 94422 - RNA, 22 nt, Homo sapiens
ugaauauguuaaauaauguucu

SEQ ID NO: 94423 - RNA, 22 nt, Homo sapiens
ugaauauguuucuaaaagugca

SEQ ID NO: 94424 - RNA, 22 nt, Homo sapiens
ugaaugcaucauguagggcuca

SEQ ID NO: 94425 - RNA, 22 nt, Homo sapiens
ugaaugcuucaugucugggcug

SEQ ID NO: 94426 - RNA, 21 nt, Homo sapiens
ugaaugcuuuaaauauuagaa

SEQ ID NO: 94427 - RNA, 22 nt, Homo sapiens
ugaauguaacuaaaccugugaa

SEQ ID NO: 94428 - RNA, 22 nt, Homo sapiens
ugaauguaacuaaaggacuuuu

SEQ ID NO: 94429 - RNA, 20 nt, Homo sapiens
ugaauguaauuacagaugua

SEQ ID NO: 94430 - RNA, 22 nt, Homo sapiens
ugaauguccauugauguuuuga

SEQ ID NO: 94431 - RNA, 22 nt, Homo sapiens
ugaaugugauggguuucaugug

SEQ ID NO: 94432 - RNA, 16 nt, Homo sapiens
ugaauguuuguggcug

SEQ ID NO: 94433 - RNA, 22 nt, Homo sapiens
ugaauuguuucauucuuuacau

SEQ ID NO: 94434 - RNA, 22 nt, Homo sapiens
ugacaagaacuuuccauaguaa

SEQ ID NO: 94435 - RNA, 22 nt, Homo sapiens
ugacaagaguagagagggugcc

SEQ ID NO: 94436 - RNA, 22 nt, Homo sapiens
ugacaagauauggucuuaucaa

SEQ ID NO: 94437 - RNA, 22 nt, Homo sapiens
ugacaagcucccucugcaccuu

SEQ ID NO: 94438 - RNA, 20 nt, Homo sapiens
ugacaaggugcaaagaauca

SEQ ID NO: 94439 - RNA, 22 nt, Homo sapiens
ugacaagugauuaaggcauauu

SEQ ID NO: 94440 - RNA, 22 nt, Homo sapiens
ugacacagcaagauggaaccau

SEQ ID NO: 94441 - RNA, 17 nt, Homo sapiens
ugacagaaacuuguugu

SEQ ID NO: 94442 - RNA, 22 nt, Homo sapiens
ugacagcaucaggauuggagag

SEQ ID NO: 94443 - RNA, 22 nt, Homo sapiens
ugacagcuguugaggcauuuau

SEQ ID NO: 94444 - RNA, 22 nt, Homo sapiens
ugacagguuggaauuaugggag

SEQ ID NO: 94445 - RNA, 23 nt, Homo sapiens
ugacagucucccgauggcuaggc

SEQ ID NO: 94446 - RNA, 22 nt, Homo sapiens
ugacagugaacagguuaccacu

SEQ ID NO: 94447 - RNA, 22 nt, Homo sapiens
ugacaguguccucauucccaac

SEQ ID NO: 94448 - RNA, 20 nt, Homo sapiens
ugacaguuaagggauagaag

SEQ ID NO: 94449 - RNA, 22 nt, Homo sapiens
ugacaucaccaccuccgucauc

SEQ ID NO: 94450 - RNA, 22 nt, Homo sapiens
ugacaucugcuugugcccagga

SEQ ID NO: 94451 - RNA, 22 nt, Homo sapiens
ugacaugaaggcaccucugucc

SEQ ID NO: 94452 - RNA, 22 nt, Homo sapiens
ugacaugaagucucccucuguu

SEQ ID NO: 94453 - RNA, 22 nt, Homo sapiens
ugacaugaugagcaauaauggc

SEQ ID NO: 94454 - RNA, 22 nt, Homo sapiens
ugacaugauuguauauuuagaa

SEQ ID NO: 94455 - RNA, 22 nt, Homo sapiens
ugacauggagggugcggcugca

SEQ ID NO: 94456 - RNA, 23 nt, Homo sapiens
ugacauguaauucaguccagcag

SEQ ID NO: 94457 - RNA, 22 nt, Homo sapiens
ugacauguccaggugguccugu

SEQ ID NO: 94458 - RNA, 22 nt, Homo sapiens
uguguaauaccuuugacuauau

SEQ ID NO: 94459 - RNA, 22 nt, Homo sapiens
uguguacaucucuacacacaug

SEQ ID NO: 94460 - RNA, 22 nt, Homo sapiens
uguguagagaaauauuacuuau

SEQ ID NO: 94461 - RNA, 22 nt, Homo sapiens
ugugucacugaggguuagugua

SEQ ID NO: 94462 - RNA, 22 nt, Homo sapiens
ugugucacugcacuccagccug

SEQ ID NO: 94463 - RNA, 22 nt, Homo sapiens
ugugucuacugagaugaucaug

SEQ ID NO: 94464 - RNA, 22 nt, Homo sapiens
ugugucuugcuggugccugcau

SEQ ID NO: 94465 - RNA, 22 nt, Homo sapiens
ugugucuuguuuauagcuuucu

SEQ ID NO: 94466 - RNA, 22 nt, Homo sapiens
uguguuugauaaguccauaguu

SEQ ID NO: 94467 - RNA, 22 nt, Homo sapiens
uguuacacugugcacuaaauuu

SEQ ID NO: 94468 - RNA, 22 nt, Homo sapiens
uguuacagcagaauugaaagag

SEQ ID NO: 94469 - RNA, 22 nt, Homo sapiens
uguuagguuggugcaaaaguga

SEQ ID NO: 94470 - RNA, 22 nt, Homo sapiens
uguuaguuguucauguuaagag

SEQ ID NO: 94471 - RNA, 16 nt, Homo sapiens
uguuauggagacagcu

SEQ ID NO: 94472 - RNA, 22 nt, Homo sapiens
uguuauugagguuacuuauaag

SEQ ID NO: 94473 - RNA, 22 nt, Homo sapiens
uguucacaguguuucuuugaga

SEQ ID NO: 94474 - RNA, 22 nt, Homo sapiens
uguucauggauccaguggcuuc

SEQ ID NO: 94475 - RNA, 22 nt, Homo sapiens
uguucuggagaggcaggccaca

SEQ ID NO: 94476 - RNA, 22 nt, Homo sapiens
uguucuggagaguuuagucugg

SEQ ID NO: 94477 - RNA, 22 nt, Homo sapiens
uguucuugaguugggaguacaa

SEQ ID NO: 94478 - RNA, 22 nt, Homo sapiens
uguugcaccugccuugcuuuag

SEQ ID NO: 94479 - RNA, 22 nt, Homo sapiens
uguugcacucuagccugggcaa

SEQ ID NO: 94480 - RNA, 22 nt, Homo sapiens
uguugcacugguaauguacuga

SEQ ID NO: 94481 - RNA, 22 nt, Homo sapiens
uguugcauuugucaaggucaag

SEQ ID NO: 94482 - RNA, 22 nt, Homo sapiens
uguuggacuuacuuggcagauu

SEQ ID NO: 94483 - RNA, 22 nt, Homo sapiens
uguugguuaaaucagguuuuaa

SEQ ID NO: 94484 - RNA, 22 nt, Homo sapiens
uguuugcuuaacguggagccag

SEQ ID NO: 94485 - RNA, 22 nt, Homo sapiens
uguuuuggagguccucacuaga

SEQ ID NO: 94486 - RNA, 22 nt, Homo sapiens
uuaaaaguauaggccuggcaua

SEQ ID NO: 94487 - RNA, 22 nt, Homo sapiens
uuaaacucaucacccagguagu

SEQ ID NO: 94488 - RNA, 22 nt, Homo sapiens
uuaaacugcuugaauuggguuu

SEQ ID NO: 94489 - RNA, 22 nt, Homo sapiens
uuaaagcuggcguuacaguuug

SEQ ID NO: 94490 - RNA, 22 nt, Homo sapiens
uuaaagugcacacgggucaggc

SEQ ID NO: 94491 - RNA, 22 nt, Homo sapiens
uuaaagugcuguuuuugccggg

SEQ ID NO: 94492 - RNA, 22 nt, Homo sapiens
uuaaaugcacauacuugagaaa

SEQ ID NO: 94493 - RNA, 22 nt, Homo sapiens
uuaacacugccauugauacugu

SEQ ID NO: 94494 - RNA, 23 nt, Homo sapiens
uuaagcaacggcugcuuuucaga

SEQ ID NO: 94495 - RNA, 22 nt, Homo sapiens
uuaagcaguaguuaaggagagg

SEQ ID NO: 94496 - RNA, 22 nt, Homo sapiens
uuaagcaguggauuagaauuuu

SEQ ID NO: 94497 - RNA, 22 nt, Homo sapiens
uuaagccacucaagagauagag

SEQ ID NO: 94498 - RNA, 22 nt, Homo sapiens
uuaagccaggugugguggcaca

SEQ ID NO: 94499 - RNA, 22 nt, Homo sapiens
uuaagcuaguuuauucaggaaa

SEQ ID NO: 94500 - RNA, 22 nt, Homo sapiens
uuaagcugaauuuaagcuucgg

SEQ ID NO: 94501 - RNA, 22 nt, Homo sapiens
uuaaggaguagugucugguauu

SEQ ID NO: 94502 - RNA, 22 nt, Homo sapiens
uuaaggcagugucuaugccagu

SEQ ID NO: 94503 - RNA, 22 nt, Homo sapiens
uuaaggcuccuguuggcuuuua

SEQ ID NO: 94504 - RNA, 22 nt, Homo sapiens
uuaaggcuuguacuuguuuucu

SEQ ID NO: 94505 - RNA, 22 nt, Homo sapiens
uuaaggcuuuaaguaaacacag

SEQ ID NO: 94506 - RNA, 22 nt, Homo sapiens
uuaagguaugugggcauuuugu

SEQ ID NO: 94507 - RNA, 22 nt, Homo sapiens
uuaaguaaucagagaagagaac

SEQ ID NO: 94508 - RNA, 21 nt, Homo sapiens
uuaaguaauuacccaacucuc

SEQ ID NO: 94509 - RNA, 20 nt, Homo sapiens
uuaagugcuuucugcuuaga

SEQ ID NO: 94510 - RNA, 21 nt, Homo sapiens
uuaagugcuuuguaugcacua

SEQ ID NO: 94511 - RNA, 22 nt, Homo sapiens
uuaaguuaggcuucagcagucu

SEQ ID NO: 94512 - RNA, 22 nt, Homo sapiens
uuaaguuguagcuacaaauaca

SEQ ID NO: 94513 - RNA, 22 nt, Homo sapiens
uuaauaccgucacauggcugaa

SEQ ID NO: 94514 - RNA, 22 nt, Homo sapiens
uuaauucugucugcccucaucc

SEQ ID NO: 94515 - RNA, 22 nt, Homo sapiens
uuaauuguccauuauucuguuc

SEQ ID NO: 94516 - RNA, 19 nt, Homo sapiens
uuacacaaccuaguggggc

SEQ ID NO: 94517 - RNA, 22 nt, Homo sapiens
uuacagcagugccccacuccca

SEQ ID NO: 94518 - RNA, 17 nt, Homo sapiens
uuacaggugcugagagu

SEQ ID NO: 94519 - RNA, 22 nt, Homo sapiens
uuacagguggagaaguaaggcu

SEQ ID NO: 94520 - RNA, 23 nt, Homo sapiens
uuacaguggcaugaucucugcuc

SEQ ID NO: 94521 - RNA, 22 nt, Homo sapiens
uuacagugguugcuauugugaa

SEQ ID NO: 94522 - RNA, 19 nt, Homo sapiens
uuacagugugcccuuuuag

SEQ ID NO: 94523 - RNA, 22 nt, Homo sapiens
uuacaguugugagccaccaugc

SEQ ID NO: 94524 - RNA, 19 nt, Homo sapiens
uuacauccauugcauuuca

SEQ ID NO: 94525 - RNA, 22 nt, Homo sapiens
uuaccacagugccugucuaaug

SEQ ID NO: 94526 - RNA, 22 nt, Homo sapiens
uuaccagagaagacgaggggga

SEQ ID NO: 94527 - RNA, 22 nt, Homo sapiens
uuacuacucucuaugaccaguu

SEQ ID NO: 94528 - RNA, 22 nt, Homo sapiens
uuacuauguuucaaagugucuc

SEQ ID NO: 94529 - RNA, 22 nt, Homo sapiens
uuacuguauagaaucaucuuga

SEQ ID NO: 94530 - RNA, 22 nt, Homo sapiens
uuagaauggaaaugcgagguua

SEQ ID NO: 94531 - RNA, 22 nt, Homo sapiens
uuagacacacauacauuuaucu

SEQ ID NO: 94532 - RNA, 22 nt, Homo sapiens
uuagacucauuuuggucaagga

SEQ ID NO: 94533 - RNA, 17 nt, Homo sapiens
uuagagguagacucauu

SEQ ID NO: 94534 - RNA, 22 nt, Homo sapiens
uuagaguguagcaggaagaggc

SEQ ID NO: 94535 - RNA, 22 nt, Homo sapiens
uuagcacauuuccagcacaugg

SEQ ID NO: 94536 - RNA, 22 nt, Homo sapiens
uuagcagcacaaaagcagacua

SEQ ID NO: 94537 - RNA, 22 nt, Homo sapiens
uuagcagcaugaaaauggacug

SEQ ID NO: 94538 - RNA, 20 nt, Homo sapiens
uuagcagcaugauuuauaau

SEQ ID NO: 94539 - RNA, 22 nt, Homo sapiens
uuagcagccuucaagcuccaag

SEQ ID NO: 94540 - RNA, 22 nt, Homo sapiens
uuagcagcucuggugacaaggu

SEQ ID NO: 94541 - RNA, 22 nt, Homo sapiens
uuagcagugugaaaaaagacua

SEQ ID NO: 94542 - RNA, 22 nt, Homo sapiens
uuagcauccauaggagauuggu

SEQ ID NO: 94543 - RNA, 22 nt, Homo sapiens
uuaggacaauguucguuuuuug

SEQ ID NO: 94544 - RNA, 22 nt, Homo sapiens
uuaggacacuguggguggguca

SEQ ID NO: 94545 - RNA, 21 nt, Homo sapiens
uuaggcagugucagaggugag

SEQ ID NO: 94546 - RNA, 22 nt, Homo sapiens
uuaggcaguuuauugauuuuca

SEQ ID NO: 94547 - RNA, 22 nt, Homo sapiens
uuaggcuaguuucuuaaacucu

SEQ ID NO: 94548 - RNA, 22 nt, Homo sapiens
cuaaaugcacugucaaaggaag

SEQ ID NO: 94549 - RNA, 22 nt, Homo sapiens
cuaaaugucucuacuaaguuua

SEQ ID NO: 94550 - RNA, 22 nt, Homo sapiens
cuaagcaccuuaguggggaauc

SEQ ID NO: 94551 - RNA, 22 nt, Homo sapiens
cuaaggcaguagccugaauaau

SEQ ID NO: 94552 - RNA, 22 nt, Homo sapiens
cuaagugaacugucacugagaa

SEQ ID NO: 94553 - RNA, 20 nt, Homo sapiens
cuaaucaucccagaagaaau

SEQ ID NO: 94554 - RNA, 22 nt, Homo sapiens
cuaaucuagccuuauaaguauu

SEQ ID NO: 94555 - RNA, 21 nt, Homo sapiens
cuaaucucacccuuuucuggg

SEQ ID NO: 94556 - RNA, 22 nt, Homo sapiens
cuaauucuggccaaagggauaa

SEQ ID NO: 94557 - RNA, 22 nt, Homo sapiens
cuacaguucucaggaguuggcc

SEQ ID NO: 94558 - RNA, 22 nt, Homo sapiens
cuacucugugguguauuugcau

SEQ ID NO: 94559 - RNA, 22 nt, Homo sapiens
cuagauuauccaacuuauuagc

SEQ ID NO: 94560 - RNA, 22 nt, Homo sapiens
cuagauuguuuccauaaugaca

SEQ ID NO: 94561 - RNA, 22 nt, Homo sapiens
cuagcaacauuucagugaguuu

SEQ ID NO: 94562 - RNA, 22 nt, Homo sapiens
cuagcagacacuuccagagagu

SEQ ID NO: 94563 - RNA, 22 nt, Homo sapiens
cuagcagacaugggcugaacca

SEQ ID NO: 94564 - RNA, 22 nt, Homo sapiens
cuagcagcauaagaaucaccaa

SEQ ID NO: 94565 - RNA, 22 nt, Homo sapiens
cuagcccagugcuccuggauca

SEQ ID NO: 94566 - RNA, 22 nt, Homo sapiens
cuagcugcacuuccugcuacug

SEQ ID NO: 94567 - RNA, 22 nt, Homo sapiens
cuagcuuuuuaugacaaucuug

SEQ ID NO: 94568 - RNA, 22 nt, Homo sapiens
cuaggaaguauguguuauugcu

SEQ ID NO: 94569 - RNA, 22 nt, Homo sapiens
cuaggcacgccugggucuccag

SEQ ID NO: 94570 - RNA, 22 nt, Homo sapiens
cuaggcacugauaguuguauuu

SEQ ID NO: 94571 - RNA, 22 nt, Homo sapiens
cuaggcuuuucuuggauccagg

SEQ ID NO: 94572 - RNA, 22 nt, Homo sapiens
cuaggugauccacugcucucuu

SEQ ID NO: 94573 - RNA, 22 nt, Homo sapiens
cuagguuauacucugaaauggu

SEQ ID NO: 94574 - RNA, 22 nt, Homo sapiens
cuauacuguacacugaaugagg

SEQ ID NO: 94575 - RNA, 22 nt, Homo sapiens
cuaucucaggcccaggcccuug

SEQ ID NO: 94576 - RNA, 22 nt, Homo sapiens
cuaucucauugguuuuugaaag

SEQ ID NO: 94577 - RNA, 22 nt, Homo sapiens
cuauggauuuacuguauagggu

SEQ ID NO: 94578 - RNA, 22 nt, Homo sapiens
cuauguaccuggaacuguauua

SEQ ID NO: 94579 - RNA, 22 nt, Homo sapiens
cuauuugcauucagaggcaugu

SEQ ID NO: 94580 - RNA, 21 nt, Homo sapiens
cucaaaguacugauauuacag

SEQ ID NO: 94581 - RNA, 22 nt, Homo sapiens
cucaaagugcugggacuggcug

SEQ ID NO: 94582 - RNA, 22 nt, Homo sapiens
cucaaagugcugggauuggcca

SEQ ID NO: 94583 - RNA, 19 nt, Homo sapiens
cucaaagugguauuuggag

SEQ ID NO: 94584 - RNA, 18 nt, Homo sapiens
cucaaccucaugcagggc

SEQ ID NO: 94585 - RNA, 22 nt, Homo sapiens
cucaaguacaugggauuacagg

SEQ ID NO: 94586 - RNA, 18 nt, Homo sapiens
cucacaguaacuuuuaag

SEQ ID NO: 94587 - RNA, 22 nt, Homo sapiens
cucaccuugugauccacccgcc

SEQ ID NO: 94588 - RNA, 17 nt, Homo sapiens
cucacugagaacagcua

SEQ ID NO: 94589 - RNA, 22 nt, Homo sapiens
cucacugcauuucaguuuuguu

SEQ ID NO: 94590 - RNA, 22 nt, Homo sapiens
cucagagcacaguuuaugacag

SEQ ID NO: 94591 - RNA, 22 nt, Homo sapiens
cucagcaguggauuuaccacca

SEQ ID NO: 94592 - RNA, 22 nt, Homo sapiens
cuguggauguauugcacagucu

SEQ ID NO: 94593 - RNA, 19 nt, Homo sapiens
cuguggucauuauuuugcu

SEQ ID NO: 94594 - RNA, 23 nt, Homo sapiens
cuguggugaggcccuagaaucug

SEQ ID NO: 94595 - RNA, 22 nt, Homo sapiens
cuguguaguacuagauugagca

SEQ ID NO: 94596 - RNA, 22 nt, Homo sapiens
cuguucaaauuguuugugaagu

SEQ ID NO: 94597 - RNA, 22 nt, Homo sapiens
cuguugguguuuaaucacugca

SEQ ID NO: 94598 - RNA, 22 nt, Homo sapiens
cuguuugguaaggaugccucag

SEQ ID NO: 94599 - RNA, 22 nt, Homo sapiens
cuuaacagugguauugaugacc

SEQ ID NO: 94600 - RNA, 18 nt, Homo sapiens
cuuaacauugggaugaua

SEQ ID NO: 94601 - RNA, 22 nt, Homo sapiens
cuuaaggccagauaauuucuau

SEQ ID NO: 94602 - RNA, 18 nt, Homo sapiens
cuuagguagcucauucca

SEQ ID NO: 94603 - RNA, 22 nt, Homo sapiens
cuuagguaggugccagguuuuu

SEQ ID NO: 94604 - RNA, 22 nt, Homo sapiens
cuucaccaguuuggcagucuca

SEQ ID NO: 94605 - RNA, 22 nt, Homo sapiens
cuucacuggagucccuggauuc

SEQ ID NO: 94606 - RNA, 22 nt, Homo sapiens
cuucacuuuguuaaacuccaau

SEQ ID NO: 94607 - RNA, 22 nt, Homo sapiens
cuuccaaguggggcacgugcca

SEQ ID NO: 94608 - RNA, 18 nt, Homo sapiens
cuuccuuagucugguuaa

SEQ ID NO: 94609 - RNA, 22 nt, Homo sapiens
cuucggugaguagauggguuaa

SEQ ID NO: 94610 - RNA, 22 nt, Homo sapiens
cuucuugagggccugcugggaa

SEQ ID NO: 94611 - RNA, 22 nt, Homo sapiens
cuugacacugcaguuuuccugg

SEQ ID NO: 94612 - RNA, 22 nt, Homo sapiens
cuugacacugucacucaggcca

SEQ ID NO: 94613 - RNA, 22 nt, Homo sapiens
cuugaccaauauggugaaaccc

SEQ ID NO: 94614 - RNA, 22 nt, Homo sapiens
cuugagcaaacaaaggugguag

SEQ ID NO: 94615 - RNA, 22 nt, Homo sapiens
cuugagcuugagauccuuucug

SEQ ID NO: 94616 - RNA, 22 nt, Homo sapiens
cuugcacauuacagaucugcau

SEQ ID NO: 94617 - RNA, 22 nt, Homo sapiens
cuugcacuagugcagaggcgcu

SEQ ID NO: 94618 - RNA, 22 nt, Homo sapiens
cuugcacuugaaauuccaguuu

SEQ ID NO: 94619 - RNA, 22 nt, Homo sapiens
cuugcagagucauucuaauuuc

SEQ ID NO: 94620 - RNA, 22 nt, Homo sapiens
cuugccuacucacugguuuacu

SEQ ID NO: 94621 - RNA, 22 nt, Homo sapiens
cuuggauuauaauggaauauuu

SEQ ID NO: 94622 - RNA, 22 nt, Homo sapiens
cuuggcacucuguggaguuagg

SEQ ID NO: 94623 - RNA, 22 nt, Homo sapiens
cuuggcuccgacuccccuccaa

SEQ ID NO: 94624 - RNA, 22 nt, Homo sapiens
cuugggcagugugcauguguau

SEQ ID NO: 94625 - RNA, 19 nt, Homo sapiens
cuugugccugaagcuuggg

SEQ ID NO: 94626 - RNA, 22 nt, Homo sapiens
cuuguucuccuaagaugaaugc

SEQ ID NO: 94627 - RNA, 22 nt, Homo sapiens
cuuuacacauccuaaccagugu

SEQ ID NO: 94628 - RNA, 22 nt, Homo sapiens
cuuuaguugucuccucaagggu

SEQ ID NO: 94629 - RNA, 22 nt, Homo sapiens
cuuucacacuguuggugggaau

SEQ ID NO: 94630 - RNA, 22 nt, Homo sapiens
cuuugcacaucucugcuuuccc

SEQ ID NO: 94631 - RNA, 18 nt, Homo sapiens
cuuugcagcuuccagagg

SEQ ID NO: 94632 - RNA, 22 nt, Homo sapiens
cuuuggcaaugucauuuucaau

SEQ ID NO: 94633 - RNA, 22 nt, Homo sapiens
cuuuggcacuuccuaagugcca

SEQ ID NO: 94634 - RNA, 22 nt, Homo sapiens
cuuuggcauuagccuguauaga

SEQ ID NO: 94635 - RNA, 23 nt, Homo sapiens
cuuugguaggaaauuugaauuau

SEQ ID NO: 94636 - RNA, 22 nt, Homo sapiens
cuuuggucaaaauaaguaaguu

SEQ ID NO: 94637 - RNA, 22 nt, Homo sapiens
ugguaucauuuuaucugcucua

SEQ ID NO: 94638 - RNA, 22 nt, Homo sapiens
ugguaucuaagaugcacguugu

SEQ ID NO: 94639 - RNA, 22 nt, Homo sapiens
ugguauguuuauaaguauagga

SEQ ID NO: 94640 - RNA, 22 nt, Homo sapiens
uggucaccugaauuaugcaugu

SEQ ID NO: 94641 - RNA, 22 nt, Homo sapiens
uggucaccuucuugcucugucu

SEQ ID NO: 94642 - RNA, 22 nt, Homo sapiens
uggucagaugcugaguggaucu

SEQ ID NO: 94643 - RNA, 19 nt, Homo sapiens
uggucaguucugggagcug

SEQ ID NO: 94644 - RNA, 22 nt, Homo sapiens
uggucaugaggugaggcuucuc

SEQ ID NO: 94645 - RNA, 22 nt, Homo sapiens
uggucauggggcagcugacacu

SEQ ID NO: 94646 - RNA, 22 nt, Homo sapiens
ugguccaguucugugauauugc

SEQ ID NO: 94647 - RNA, 20 nt, Homo sapiens
ugguccccugagucuggcuu

SEQ ID NO: 94648 - RNA, 21 nt, Homo sapiens
uggucccuucagaucggauuu

SEQ ID NO: 94649 - RNA, 22 nt, Homo sapiens
uggugcccuguccuucuguggc

SEQ ID NO: 94650 - RNA, 19 nt, Homo sapiens
uggugccuuguucuuggau

SEQ ID NO: 94651 - RNA, 22 nt, Homo sapiens
uggugcuugaugaggguggagc

SEQ ID NO: 94652 - RNA, 20 nt, Homo sapiens
ugguguuugaacagugaaug

SEQ ID NO: 94653 - RNA, 22 nt, Homo sapiens
ugguguuugagaagcugauguc

SEQ ID NO: 94654 - RNA, 21 nt, Homo sapiens
ugguugauccuccuagugccu

SEQ ID NO: 94655 - RNA, 22 nt, Homo sapiens
ugguuguuuuaaaugucgucug

SEQ ID NO: 94656 - RNA, 23 nt, Homo sapiens
uguaaaagcauuugucagccugg

SEQ ID NO: 94657 - RNA, 22 nt, Homo sapiens
uguaaacuuuugagauugacuu

SEQ ID NO: 94658 - RNA, 20 nt, Homo sapiens
uguaacacauggagaacucu

SEQ ID NO: 94659 - RNA, 22 nt, Homo sapiens
uguaagcagcagagacuauccu

SEQ ID NO: 94660 - RNA, 22 nt, Homo sapiens
uguaauaguaggcucacauuug

SEQ ID NO: 94661 - RNA, 20 nt, Homo sapiens
uguaaucuaaguuuuaagcc

SEQ ID NO: 94662 - RNA, 22 nt, Homo sapiens
uguaauguuugguagguuaggu

SEQ ID NO: 94663 - RNA, 22 nt, Homo sapiens
uguacaaauuucugugguggug

SEQ ID NO: 94664 - RNA, 19 nt, Homo sapiens
uguaccagcaagucuuuuc

SEQ ID NO: 94665 - RNA, 22 nt, Homo sapiens
uguacuucaagauuaugguuua

SEQ ID NO: 94666 - RNA, 22 nt, Homo sapiens
uguagauaucauuagugcugug

SEQ ID NO: 94667 - RNA, 21 nt, Homo sapiens
uguagcagcauaauuuauaau

SEQ ID NO: 94668 - RNA, 21 nt, Homo sapiens
uguagcagcaugauuuauaau

SEQ ID NO: 94669 - RNA, 22 nt, Homo sapiens
uguagggagagggaguugcacc

SEQ ID NO: 94670 - RNA, 22 nt, Homo sapiens
uguagucauuugaaggaugucc

SEQ ID NO: 94671 - RNA, 21 nt, Homo sapiens
uguauacauggaagaaugguc

SEQ ID NO: 94672 - RNA, 22 nt, Homo sapiens
uguauaguugagucaaguuuca

SEQ ID NO: 94673 - RNA, 22 nt, Homo sapiens
uguauauguuuguacauauguc

SEQ ID NO: 94674 - RNA, 22 nt, Homo sapiens
ugucaaacauuaugaugcucua

SEQ ID NO: 94675 - RNA, 22 nt, Homo sapiens
ugucaaagagacaucugcacuc

SEQ ID NO: 94676 - RNA, 19 nt, Homo sapiens
ugucaaaugucuccugggg

SEQ ID NO: 94677 - RNA, 22 nt, Homo sapiens
ugucaaauucuggguuaaaaca

SEQ ID NO: 94678 - RNA, 22 nt, Homo sapiens
ugucaacauuuaucaaguuauu

SEQ ID NO: 94679 - RNA, 20 nt, Homo sapiens
ugucaagaaacauuacuuau

SEQ ID NO: 94680 - RNA, 20 nt, Homo sapiens
ugucaaggaauucccaaauc

SEQ ID NO: 94681 - RNA, 22 nt, Homo sapiens
ugucaaugggaauuuguuuuag

SEQ ID NO: 94682 - RNA, 22 nt, Homo sapiens
ugucacauccaagaaggugcag

SEQ ID NO: 94683 - RNA, 22 nt, Homo sapiens
ugucacugugaguuugacugcu

SEQ ID NO: 94684 - RNA, 22 nt, Homo sapiens
ugucagaaucuagaggcugcua

SEQ ID NO: 94685 - RNA, 18 nt, Homo sapiens
ugucagaguggauuguaa

SEQ ID NO: 94686 - RNA, 22 nt, Homo sapiens
ugucagggaggcucggccgcac

SEQ ID NO: 94687 - RNA, 22 nt, Homo sapiens
ugucaguguacuguaagaauua

SEQ ID NO: 94688 - RNA, 22 nt, Homo sapiens
ugucaguuucaguguuagccuu

SEQ ID NO: 94689 - RNA, 21 nt, Homo sapiens
ugucaguuuccagaguucaac

SEQ ID NO: 94690 - RNA, 22 nt, Homo sapiens
ugucauacaguaacaugguugg

SEQ ID NO: 94691 - RNA, 22 nt, Homo sapiens
ugucaucuagguuuuaagccuu

SEQ ID NO: 94692 - RNA, 22 nt, Homo sapiens
ugucaugagucuccuccaucuu

SEQ ID NO: 94693 - RNA, 22 nt, Homo sapiens
ugucaugguagcaaggacgagg

SEQ ID NO: 94694 - RNA, 22 nt, Homo sapiens
ugucauguugguguacugcacc

SEQ ID NO: 94695 - RNA, 20 nt, Homo sapiens
ugucauuaagcacugugcca

SEQ ID NO: 94696 - RNA, 22 nt, Homo sapiens
uguccaaaucagagguaccaaa

SEQ ID NO: 94697 - RNA, 22 nt, Homo sapiens
uguccaguguuccucagaagaa

SEQ ID NO: 94698 - RNA, 22 nt, Homo sapiens
uguccugcagagguguuugccu

SEQ ID NO: 94699 - RNA, 21 nt, Homo sapiens
ugucgugcaggaucuguggga

SEQ ID NO: 94700 - RNA, 22 nt, Homo sapiens
ugucuaaagaauggcagacuca

SEQ ID NO: 94701 - RNA, 20 nt, Homo sapiens
cuuuguccuccugcugugcu

SEQ ID NO: 94702 - RNA, 22 nt, Homo sapiens
cuuuguccuucaagguguguca

SEQ ID NO: 94703 - RNA, 22 nt, Homo sapiens
cuuuuacacugcuggugggaau

SEQ ID NO: 94704 - RNA, 22 nt, Homo sapiens
aaaugcuucuauguggcauguu

SEQ ID NO: 94705 - RNA, 19 nt, Homo sapiens
aaaugugcacuguuuucca

SEQ ID NO: 94706 - RNA, 22 nt, Homo sapiens
aaauucaugucaccucuaggua

SEQ ID NO: 94707 - RNA, 22 nt, Homo sapiens
aaauugcaguuaggaugauggu

SEQ ID NO: 94708 - RNA, 22 nt, Homo sapiens
aaauugcauugagcugcuuauu

SEQ ID NO: 94709 - RNA, 22 nt, Homo sapiens
aaauuguccuauugguuuaagc

SEQ ID NO: 94710 - RNA, 22 nt, Homo sapiens
aacaccuugcgugggcgucaau

SEQ ID NO: 94711 - RNA, 22 nt, Homo sapiens
aacacuaucugccuuacaggga

SEQ ID NO: 94712 - RNA, 22 nt, Homo sapiens
aacacuggcugcucgaguucuc

SEQ ID NO: 94713 - RNA, 22 nt, Homo sapiens
aacagaccuagauaguauaguc

SEQ ID NO: 94714 - RNA, 22 nt, Homo sapiens
aacagauugcugagccccaccc

SEQ ID NO: 94715 - RNA, 22 nt, Homo sapiens
aacagcauaguacccgugauaa

SEQ ID NO: 94716 - RNA, 22 nt, Homo sapiens
aacaggguggugccugguccau

SEQ ID NO: 94717 - RNA, 22 nt, Homo sapiens
aacauagucaugggguaauguu

SEQ ID NO: 94718 - RNA, 22 nt, Homo sapiens
aacauguuuagcagauaccugu

SEQ ID NO: 94719 - RNA, 16 nt, Homo sapiens
uuugcaagaucagaag

SEQ ID NO: 94720 - RNA, 22 nt, Homo sapiens
uuugcaauagguuguggggagg

SEQ ID NO: 94721 - RNA, 23 nt, Homo sapiens
uuugcacuugcuccuucuauggc

SEQ ID NO: 94722 - RNA, 21 nt, Homo sapiens
uuugcacuuugcaaaucccua

SEQ ID NO: 94723 - RNA, 22 nt, Homo sapiens
uuugcaugcuccuuaugagaau

SEQ ID NO: 94724 - RNA, 22 nt, Homo sapiens
uuugccaauauuuuauugagga

SEQ ID NO: 94725 - RNA, 22 nt, Homo sapiens
uuugcugagucugacuucaugg

SEQ ID NO: 94726 - RNA, 22 nt, Homo sapiens
uuugcuuaguaaauguagaaaa

SEQ ID NO: 94727 - RNA, 22 nt, Homo sapiens
uuugcuuguguaaaaaucugga

SEQ ID NO: 94728 - RNA, 22 nt, Homo sapiens
uuuggcaauaaacuccccuaac

SEQ ID NO: 94729 - RNA, 20 nt, Homo sapiens
uuuggcaauaggguuuuugu

SEQ ID NO: 94730 - RNA, 22 nt, Homo sapiens
uuuggcaauuugacuguauagg

SEQ ID NO: 94731 - RNA, 22 nt, Homo sapiens
uuuggcacuauagguaaauuug

SEQ ID NO: 94732 - RNA, 22 nt, Homo sapiens
uuuggcagaaaacaagaaucug

SEQ ID NO: 94733 - RNA, 22 nt, Homo sapiens
uuuggcauuagauaauugugua

SEQ ID NO: 94734 - RNA, 22 nt, Homo sapiens
uuuggcauuuaaauaugcaugg

SEQ ID NO: 94735 - RNA, 22 nt, Homo sapiens
uuuggcauuugaguuuguagga

SEQ ID NO: 94736 - RNA, 22 nt, Homo sapiens
uuuggcuuuuguaauaacugcc

SEQ ID NO: 94737 - RNA, 22 nt, Homo sapiens
uuuggcuuuugugauacguaau

SEQ ID NO: 94738 - RNA, 22 nt, Homo sapiens
uuugggccaugguuuguguaua

SEQ ID NO: 94739 - RNA, 22 nt, Homo sapiens
uuugggccucugauuucuuugg

SEQ ID NO: 94740 - RNA, 22 nt, Homo sapiens
uuuggguuaguuuuccaaucuu

SEQ ID NO: 94741 - RNA, 22 nt, Homo sapiens
uuuggguuuuauguaacagcua

SEQ ID NO: 94742 - RNA, 22 nt, Homo sapiens
uuugguaauguuucauugcaga

SEQ ID NO: 94743 - RNA, 18 nt, Homo sapiens
uuugguccuuuauaaaca

SEQ ID NO: 94744 - RNA, 22 nt, Homo sapiens
uuuguaauaccugaggcugggu

SEQ ID NO: 94745 - RNA, 22 nt, Homo sapiens
uuuguacacuguugguaggauu

SEQ ID NO: 94746 - RNA, 22 nt, Homo sapiens
uuuguacuaugguuuuucacua

SEQ ID NO: 94747 - RNA, 21 nt, Homo sapiens
uuuguaguagcaugauuuaua

SEQ ID NO: 94748 - RNA, 22 nt, Homo sapiens
uuugucacccugaauguaagau

SEQ ID NO: 94749 - RNA, 22 nt, Homo sapiens
uuugucauagcagcaggaaugg

SEQ ID NO: 94750 - RNA, 22 nt, Homo sapiens
uuugucuccuaagacucugugg

SEQ ID NO: 94751 - RNA, 22 nt, Homo sapiens
uuugugacacaaacacauauau

SEQ ID NO: 94752 - RNA, 22 nt, Homo sapiens
uuugugagguggauagauugca

SEQ ID NO: 94753 - RNA, 22 nt, Homo sapiens
uuugugcuaacuuuaacucuua

SEQ ID NO: 94754 - RNA, 22 nt, Homo sapiens
uuugugcuaaugcuagauuacu

SEQ ID NO: 94755 - RNA, 18 nt, Homo sapiens
uuugugcuccacaaagga

SEQ ID NO: 94756 - RNA, 22 nt, Homo sapiens
uuugugcuccuaugagaaucua

SEQ ID NO: 94757 - RNA, 22 nt, Homo sapiens
uuugugcuccucucaguaugug

SEQ ID NO: 94758 - RNA, 22 nt, Homo sapiens
uuugugcuccugugagaaucua

SEQ ID NO: 94759 - RNA, 22 nt, Homo sapiens
uuugugcuccuguugagaaucu

SEQ ID NO: 94760 - RNA, 22 nt, Homo sapiens
uuuguggaaugcccuuauuuau

SEQ ID NO: 94761 - RNA, 22 nt, Homo sapiens
uuuguguccccacccacaucuc

SEQ ID NO: 94762 - RNA, 23 nt, Homo sapiens
uuugugucccucuagaauucaug

SEQ ID NO: 94763 - RNA, 22 nt, Homo sapiens
uuuuaacagccaggggacggcc

SEQ ID NO: 94764 - RNA, 22 nt, Homo sapiens
uuuuaagcuacaagagacauau

SEQ ID NO: 94765 - RNA, 22 nt, Homo sapiens
uuuuacacaucaccgcucgugu

SEQ ID NO: 94766 - RNA, 20 nt, Homo sapiens
uuuuagcuuuuauugaaagc

SEQ ID NO: 94767 - RNA, 22 nt, Homo sapiens
uuuuaguggacaaagguauuua

SEQ ID NO: 94768 - RNA, 22 nt, Homo sapiens
uuuuaugggcuauuugcauuag

SEQ ID NO: 94769 - RNA, 22 nt, Homo sapiens
uuuucacggugucccagagagu

SEQ ID NO: 94770 - RNA, 20 nt, Homo sapiens
uuuugaacuuggcaaccugu

SEQ ID NO: 94771 - RNA, 22 nt, Homo sapiens
uuuugcaauauguuccugaaua

SEQ ID NO: 94772 - RNA, 22 nt, Homo sapiens
uuuugcacuguuuuaucugaca

SEQ ID NO: 94773 - RNA, 22 nt, Homo sapiens
uuuugcaguuacagagagugag

SEQ ID NO: 94774 - RNA, 22 nt, Homo sapiens
uuuugcuccuggcaaacucaua

SEQ ID NO: 94775 - RNA, 22 nt, Homo sapiens
uuuugcuugugaauagccacau

SEQ ID NO: 94776 - RNA, 19 nt, Homo sapiens
uuuuggaaaugugaacagc

SEQ ID NO: 94777 - RNA, 22 nt, Homo sapiens
uuuuggcucugucuguaucuuu

SEQ ID NO: 94778 - RNA, 22 nt, Homo sapiens
uuuuggcuuaaagagaauguau

SEQ ID NO: 94779 - RNA, 22 nt, Homo sapiens
uuuugggggugauucacacagu

SEQ ID NO: 94780 - RNA, 22 nt, Homo sapiens
uuuugguauaugcaggggucuu

SEQ ID NO: 94781 - RNA, 22 nt, Homo sapiens
uuuuuauggccaauccucagaa

SEQ ID NO: 94782 - RNA, 22 nt, Homo sapiens
uuuuugauuaauggguagacca

SEQ ID NO: 94783 - RNA, 22 nt, Homo sapiens
uuuuuuaguuagcugggcauga

SEQ ID NO: 94784 - RNA, 22 nt, Homo sapiens
guagugcaguuugagaaucagu

SEQ ID NO: 94785 - RNA, 22 nt, Homo sapiens
guaguggcaugaucuuggcuca

SEQ ID NO: 94786 - RNA, 22 nt, Homo sapiens
guauagcacauaauacuugaug

SEQ ID NO: 94787 - RNA, 22 nt, Homo sapiens
guaucaucauguuggccaggcu

SEQ ID NO: 94788 - RNA, 22 nt, Homo sapiens
guaucauugccuaaugcucuca

SEQ ID NO: 94789 - RNA, 22 nt, Homo sapiens
guaugaaaaucggagauugggu

SEQ ID NO: 94790 - RNA, 22 nt, Homo sapiens
guaugauacuguaacagugggu

SEQ ID NO: 94791 - RNA, 22 nt, Homo sapiens
guaugcacauauguguauguau

SEQ ID NO: 94792 - RNA, 22 nt, Homo sapiens
uaggagcauaggauuguuugag

SEQ ID NO: 94793 - RNA, 22 nt, Homo sapiens
uaggcaaaugcaagaguagaac

SEQ ID NO: 94794 - RNA, 22 nt, Homo sapiens
uaggcacacaucuacuacaaau

SEQ ID NO: 94795 - RNA, 22 nt, Homo sapiens
uaggcagccagcuguggauuga

SEQ ID NO: 94796 - RNA, 22 nt, Homo sapiens
uaggcuguguggccguggggcu

SEQ ID NO: 94797 - RNA, 22 nt, Homo sapiens
uaggcuuuuggacccugucucu

SEQ ID NO: 94798 - RNA, 22 nt, Homo sapiens
uagggaguuuuggggugcagaa

SEQ ID NO: 94799 - RNA, 22 nt, Homo sapiens
uagggcauuuagaggcuauuaa

SEQ ID NO: 94800 - RNA, 22 nt, Homo sapiens
uagggcuugugaucagguguag

SEQ ID NO: 94801 - RNA, 22 nt, Homo sapiens
uagggcuuuaguuugcuugugu

SEQ ID NO: 94802 - RNA, 22 nt, Homo sapiens
uagguacuuuacauguuaucuc

SEQ ID NO: 94803 - RNA, 22 nt, Homo sapiens
uagguagcuuuggcguuucuug

SEQ ID NO: 94804 - RNA, 22 nt, Homo sapiens
uaggugauugaagguggaaugu

SEQ ID NO: 94805 - RNA, 22 nt, Homo sapiens
uaggugcacaguaaauauaugu

SEQ ID NO: 94806 - RNA, 19 nt, Homo sapiens
uaggugguuuuccccucac

SEQ ID NO: 94807 - RNA, 22 nt, Homo sapiens
uagguuaugauccaucuuggcu

SEQ ID NO: 94808 - RNA, 23 nt, Homo sapiens
uagguuauuugguaaauauaugu

SEQ ID NO: 94809 - RNA, 22 nt, Homo sapiens
uagguucuccacagguucucca

SEQ ID NO: 94810 - RNA, 22 nt, Homo sapiens
uaguagcauaccuaaguauacu

SEQ ID NO: 94811 - RNA, 22 nt, Homo sapiens
uaguagugucccugacuaucac

SEQ ID NO: 94812 - RNA, 22 nt, Homo sapiens
uaguauguuuauagcauugagu

SEQ ID NO: 94813 - RNA, 22 nt, Homo sapiens
uagucaaaucugaaggaaauuu

SEQ ID NO: 94814 - RNA, 22 nt, Homo sapiens
uagugcauguugaguucccgac

SEQ ID NO: 94815 - RNA, 22 nt, Homo sapiens
uagugcuagaugacuuugccau

SEQ ID NO: 94816 - RNA, 20 nt, Homo sapiens
uaguggcaugcaccuguagc

SEQ ID NO: 94817 - RNA, 22 nt, Homo sapiens
uagugguaguagcaguaauauu

SEQ ID NO: 94818 - RNA, 22 nt, Homo sapiens
uaguuaguagacucugauuauu

SEQ ID NO: 94819 - RNA, 22 nt, Homo sapiens
uaguugcaucuuaggucuguga

SEQ ID NO: 94820 - RNA, 22 nt, Homo sapiens
uauaaccauuucuucucucuuc

SEQ ID NO: 94821 - RNA, 22 nt, Homo sapiens
uauacaguaggcacucaguggc

SEQ ID NO: 94822 - RNA, 22 nt, Homo sapiens
uauacaugugccauguuggugu

SEQ ID NO: 94823 - RNA, 22 nt, Homo sapiens
uauacugucuuuguaugccuag

SEQ ID NO: 94824 - RNA, 22 nt, Homo sapiens
uauagagguagguuaauuggaa

SEQ ID NO: 94825 - RNA, 22 nt, Homo sapiens
uauagcaaugugccacucucug

SEQ ID NO: 94826 - RNA, 22 nt, Homo sapiens
uauagcacaucuguguguacau

SEQ ID NO: 94827 - RNA, 22 nt, Homo sapiens
uauaguuuuuccugggaggaaa

SEQ ID NO: 94828 - RNA, 22 nt, Homo sapiens
uauaucuagagcggaccaggcu

SEQ ID NO: 94829 - RNA, 22 nt, Homo sapiens
uauaucuguccauggcccugcu

SEQ ID NO: 94830 - RNA, 23 nt, Homo sapiens
uauaugugucuaggagcuauggu

SEQ ID NO: 94831 - RNA, 22 nt, Homo sapiens
uaucaaacccaaggaggggguu

SEQ ID NO: 94832 - RNA, 22 nt, Homo sapiens
uaucaagauggauaaggauaga

SEQ ID NO: 94833 - RNA, 22 nt, Homo sapiens
uaucacacgccuugcuucauuu

SEQ ID NO: 94834 - RNA, 22 nt, Homo sapiens
uaucacacuggaagaaguuaag

SEQ ID NO: 94835 - RNA, 23 nt, Homo sapiens
uaucacacuuucucugugccaca

SEQ ID NO: 94836 - RNA, 22 nt, Homo sapiens
uaucacagcaaggacccauuau

SEQ ID NO: 94837 - RNA, 22 nt, Homo sapiens
uaucacaggucaggaaccuugu

SEQ ID NO: 94838 - RNA, 22 nt, Homo sapiens
uaucacaguaaaucugggugca

SEQ ID NO: 94839 - RNA, 22 nt, Homo sapiens
uaucacagugcuggaguauucc

SEQ ID NO: 94840 - RNA, 22 nt, Homo sapiens
uaucacccuuucauuguucuuc

SEQ ID NO: 94841 - RNA, 22 nt, Homo sapiens
uaucaccuugguagucuugggg

SEQ ID NO: 94842 - RNA, 22 nt, Homo sapiens
uaucacuauucauccuagcucc

SEQ ID NO: 94843 - RNA, 19 nt, Homo sapiens
uaucacuucccuggaaaca

SEQ ID NO: 94844 - RNA, 22 nt, Homo sapiens
uaucagaucccaauuucuggcc

SEQ ID NO: 94845 - RNA, 22 nt, Homo sapiens
uaucagcagagucauacuucaa

SEQ ID NO: 94846 - RNA, 22 nt, Homo sapiens
uaucagcagcaggggcugcaga

SEQ ID NO: 94847 - RNA, 22 nt, Homo sapiens
uaucaguauggauucauggauu

SEQ ID NO: 94848 - RNA, 22 nt, Homo sapiens
uaucaucauguuuuugcugugu

SEQ ID NO: 94849 - RNA, 22 nt, Homo sapiens
uaucaucauuggcaggugagaa

SEQ ID NO: 94850 - RNA, 21 nt, Homo sapiens
uaucauggugaaacccugucu

SEQ ID NO: 94851 - RNA, 21 nt, Homo sapiens
uauccacuugcaacagagaag

SEQ ID NO: 94852 - RNA, 22 nt, Homo sapiens
uaucccuuagagcggggugguu

SEQ ID NO: 94853 - RNA, 22 nt, Homo sapiens
uauccuagugggguuucaguca

SEQ ID NO: 94854 - RNA, 22 nt, Homo sapiens
uauccuguagcucauccaccgc

SEQ ID NO: 94855 - RNA, 21 nt, Homo sapiens
uaucucaguuuuccuuugugg

SEQ ID NO: 94856 - RNA, 22 nt, Homo sapiens
uaugaaacucuaagauucacau

SEQ ID NO: 94857 - RNA, 20 nt, Homo sapiens
uaugacacugucauaaaaau

SEQ ID NO: 94858 - RNA, 20 nt, Homo sapiens
uaugaccugucuuuucucuc

SEQ ID NO: 94859 - RNA, 22 nt, Homo sapiens
uaugacucagaaggcacacaca

SEQ ID NO: 94860 - RNA, 22 nt, Homo sapiens
uaugacugagacuuaaauugug

SEQ ID NO: 94861 - RNA, 22 nt, Homo sapiens
uaugacuuuggaaaaauuacuu

SEQ ID NO: 94862 - RNA, 22 nt, Homo sapiens
uaugagagcugguagguagaga

SEQ ID NO: 94863 - RNA, 22 nt, Homo sapiens
uaugaggaguauaacccgguga

SEQ ID NO: 94864 - RNA, 22 nt, Homo sapiens
uaugaugcuguuuagaaucucu

SEQ ID NO: 94865 - RNA, 22 nt, Homo sapiens
uaugcacacacguguuuaugug

SEQ ID NO: 94866 - RNA, 22 nt, Homo sapiens
uaugcacacguguccaugugca

SEQ ID NO: 94867 - RNA, 22 nt, Homo sapiens
uaugcacacucucccaggaggg

SEQ ID NO: 94868 - RNA, 22 nt, Homo sapiens
uaugcacuauggaaguagcuca

SEQ ID NO: 94869 - RNA, 22 nt, Homo sapiens
uaugcagacauuguuccaacca

SEQ ID NO: 94870 - RNA, 22 nt, Homo sapiens
uaugccuuucucacuaagcuua

SEQ ID NO: 94871 - RNA, 19 nt, Homo sapiens
uaugcuauuuauuagaagu

SEQ ID NO: 94872 - RNA, 22 nt, Homo sapiens
gcagugcaguggcgcgaucucg

SEQ ID NO: 94873 - RNA, 22 nt, Homo sapiens
gcaguggugugugccagccuag

SEQ ID NO: 94874 - RNA, 19 nt, Homo sapiens
gcaucauuaguugcuuuuc

SEQ ID NO: 94875 - RNA, 22 nt, Homo sapiens
gcaugacaaugauugcucuuca

SEQ ID NO: 94876 - RNA, 20 nt, Homo sapiens
gcaugagucuuuauaguaga

SEQ ID NO: 94877 - RNA, 22 nt, Homo sapiens
gcauggagcauacauuucuguu

SEQ ID NO: 94878 - RNA, 22 nt, Homo sapiens
gcaugguacuggaugguaguau

SEQ ID NO: 94879 - RNA, 22 nt, Homo sapiens
gcaugguaguaaccuacauuug

SEQ ID NO: 94880 - RNA, 22 nt, Homo sapiens
gccaaaaugcugggauuacagg

SEQ ID NO: 94881 - RNA, 22 nt, Homo sapiens
gccaacauggcgcuccauucuu

SEQ ID NO: 94882 - RNA, 22 nt, Homo sapiens
gccaguauuuuauugagaauuu

SEQ ID NO: 94883 - RNA, 22 nt, Homo sapiens
gccaguauuuuguugagaauuu

SEQ ID NO: 94884 - RNA, 21 nt, Homo sapiens
gccaguguggcaauuuuucaa

SEQ ID NO: 94885 - RNA, 22 nt, Homo sapiens
gccauugcacuccagccugagc

SEQ ID NO: 94886 - RNA, 22 nt, Homo sapiens
gccccugagacuugccucgggc

SEQ ID NO: 94887 - RNA, 22 nt, Homo sapiens
gcccuguguuuggguaugguca

SEQ ID NO: 94888 - RNA, 17 nt, Homo sapiens
gcccuuugugccucuuc

SEQ ID NO: 94889 - RNA, 22 nt, Homo sapiens
gcccuuugugucuggcuggggu

SEQ ID NO: 94890 - RNA, 22 nt, Homo sapiens
gccuagagacuugguaucuugc

SEQ ID NO: 94891 - RNA, 22 nt, Homo sapiens
gccuagauccaaauauggugca

SEQ ID NO: 94892 - RNA, 22 nt, Homo sapiens
gccuuuggugacaggcaugugu

SEQ ID NO: 94893 - RNA, 22 nt, Homo sapiens
gcuaaaucuguaaaaugaggag

SEQ ID NO: 94894 - RNA, 22 nt, Homo sapiens
gcuaguguuugccagcguagcc

SEQ ID NO: 94895 - RNA, 22 nt, Homo sapiens
gcuccauuuuccauuucucuaa

SEQ ID NO: 94896 - RNA, 22 nt, Homo sapiens
gcucguccccuccugacucugc

SEQ ID NO: 94897 - RNA, 22 nt, Homo sapiens
gcugacacugggcuauagaucu

SEQ ID NO: 94898 - RNA, 22 nt, Homo sapiens
gcugagacauugguuuucuccu

SEQ ID NO: 94899 - RNA, 22 nt, Homo sapiens
gcugagaucucuugccugaacu

SEQ ID NO: 94900 - RNA, 19 nt, Homo sapiens
gcugauguuacauucuugc

SEQ ID NO: 94901 - RNA, 22 nt, Homo sapiens
gcugauguugaccuugaucacc

SEQ ID NO: 94902 - RNA, 22 nt, Homo sapiens
gcugauguuggccucugggcuu

SEQ ID NO: 94903 - RNA, 22 nt, Homo sapiens
gcugcuguaccagaugugguua

SEQ ID NO: 94904 - RNA, 22 nt, Homo sapiens
gcuggcaagaugcugaugcaac

SEQ ID NO: 94905 - RNA, 22 nt, Homo sapiens
gcuggcuuucuccugaucucag

SEQ ID NO: 94906 - RNA, 22 nt, Homo sapiens
gcuggguucagagugggcugcg

SEQ ID NO: 94907 - RNA, 22 nt, Homo sapiens
gcuguguguuaucagaaauugc

SEQ ID NO: 94908 - RNA, 22 nt, Homo sapiens
gcuguugcuauuauuccgagaa

SEQ ID NO: 94909 - RNA, 16 nt, Homo sapiens
gcuguuguuuuguccu

SEQ ID NO: 94910 - RNA, 19 nt, Homo sapiens
gcuuagagacaaaacauug

SEQ ID NO: 94911 - RNA, 19 nt, Homo sapiens
gcuucuugaggacgaugac

SEQ ID NO: 94912 - RNA, 22 nt, Homo sapiens
gcuugguccccacccaaaucgc

SEQ ID NO: 94913 - RNA, 22 nt, Homo sapiens
gcuuggugugcaagugguacua

SEQ ID NO: 94914 - RNA, 22 nt, Homo sapiens
gcuuuguugauggugagucugu

SEQ ID NO: 94915 - RNA, 18 nt, Homo sapiens
ggaaaacuuuucuaagua

SEQ ID NO: 94916 - RNA, 22 nt, Homo sapiens
ggaaagacuauuguaaaggaug

SEQ ID NO: 94917 - RNA, 22 nt, Homo sapiens
ggaaaguaacccauucucuuac

SEQ ID NO: 94918 - RNA, 21 nt, Homo sapiens
ggaaaguuaaggaaauacccc

SEQ ID NO: 94919 - RNA, 22 nt, Homo sapiens
ggaaaucaucauucucgguaua

SEQ ID NO: 94920 - RNA, 22 nt, Homo sapiens
ggaagaauaaugggccuuagag

SEQ ID NO: 94921 - RNA, 17 nt, Homo sapiens
ggaagccuuugguuuaa

SEQ ID NO: 94922 - RNA, 22 nt, Homo sapiens
ggaagguaauuggguaaugaga

SEQ ID NO: 94923 - RNA, 22 nt, Homo sapiens
ggaagguaauugucagcucaua

SEQ ID NO: 94924 - RNA, 22 nt, Homo sapiens
ggaaggucaaagggaaagcaga

SEQ ID NO: 94925 - RNA, 20 nt, Homo sapiens
ggaauagucuacacucugac

SEQ ID NO: 94926 - RNA, 22 nt, Homo sapiens
ggaaucugaaccaugggaaugg

SEQ ID NO: 94927 - RNA, 17 nt, Homo sapiens
ggaaugaauuccagccc

SEQ ID NO: 94928 - RNA, 19 nt, Homo sapiens
ggaaugcaccaguccuugc

SEQ ID NO: 94929 - RNA, 22 nt, Homo sapiens
ggaaugugugucaugcuuuugc

SEQ ID NO: 94930 - RNA, 20 nt, Homo sapiens
ggaauguuaaucuccaugau

SEQ ID NO: 94931 - RNA, 21 nt, Homo sapiens
ggaauguugccagcagccaga

SEQ ID NO: 94932 - RNA, 21 nt, Homo sapiens
ggaauuuagggaaugauuuag

SEQ ID NO: 94933 - RNA, 22 nt, Homo sapiens
ggacaagaucuuccaccauuca

SEQ ID NO: 94934 - RNA, 22 nt, Homo sapiens
ggacauuaacugcaagauagau

SEQ ID NO: 94935 - RNA, 22 nt, Homo sapiens
ggacuagaggugaaaagaagac

SEQ ID NO: 94936 - RNA, 22 nt, Homo sapiens
ggacuaggagcuaggaagaucu

SEQ ID NO: 94937 - RNA, 22 nt, Homo sapiens
ggacugagaggacuacagugua

SEQ ID NO: 94938 - RNA, 19 nt, Homo sapiens
ggacugucauggaguaguu

SEQ ID NO: 94939 - RNA, 22 nt, Homo sapiens
ggagaauugcuuggacccggga

SEQ ID NO: 94940 - RNA, 22 nt, Homo sapiens
ggagaucacucuuuguagcgug

SEQ ID NO: 94941 - RNA, 22 nt, Homo sapiens
ggagaucuuugaaguguugugc

SEQ ID NO: 94942 - RNA, 22 nt, Homo sapiens
ggagcucaucuagcauagaggu

SEQ ID NO: 94943 - RNA, 22 nt, Homo sapiens
ggagcuuugaaaguuuccgguu

SEQ ID NO: 94944 - RNA, 22 nt, Homo sapiens
ggaguaggaaggaaauguuaaa

SEQ ID NO: 94945 - RNA, 22 nt, Homo sapiens
ggaguaggcuguccggcaccca

SEQ ID NO: 94946 - RNA, 22 nt, Homo sapiens
ggaguaugaaacccacuccaau

SEQ ID NO: 94947 - RNA, 22 nt, Homo sapiens
ggaguguaguggcuccaucucg

SEQ ID NO: 94948 - RNA, 23 nt, Homo sapiens
ggaguguauuggcacgaucucag

SEQ ID NO: 94949 - RNA, 22 nt, Homo sapiens
ggagugucccaaucucagcuca

SEQ ID NO: 94950 - RNA, 22 nt, Homo sapiens
ggagugucugugcuggucaaag

SEQ ID NO: 94951 - RNA, 22 nt, Homo sapiens
ggagugugauucaguauaauau

SEQ ID NO: 94952 - RNA, 22 nt, Homo sapiens
ggauaucauuauuucuagggcu

SEQ ID NO: 94953 - RNA, 22 nt, Homo sapiens
ggaucacagagcuugggaaagg

SEQ ID NO: 94954 - RNA, 22 nt, Homo sapiens
ggaucacuugagaccaggaguu

SEQ ID NO: 94955 - RNA, 22 nt, Homo sapiens
ggaucauaugauagcucaauuu

SEQ ID NO: 94956 - RNA, 22 nt, Homo sapiens
ggaugcauuuuugguugucaca

SEQ ID NO: 94957 - RNA, 22 nt, Homo sapiens
ggcaaaucugcaauuacuuuug

SEQ ID NO: 94958 - RNA, 22 nt, Homo sapiens
ggcaacaauuccuacuucuuuu

SEQ ID NO: 94959 - RNA, 20 nt, Homo sapiens
augugcuaauauuaauaugu

SEQ ID NO: 94960 - RNA, 22 nt, Homo sapiens
auguggaaauguauaugugucu

SEQ ID NO: 94961 - RNA, 22 nt, Homo sapiens
auguggcuuuucaacuguguga

SEQ ID NO: 94962 - RNA, 22 nt, Homo sapiens
augugguaggcccaugagucau

SEQ ID NO: 94963 - RNA, 22 nt, Homo sapiens
augugguaguuauagugauaag

SEQ ID NO: 94964 - RNA, 22 nt, Homo sapiens
auguguaaagcuuuucuuuguu

SEQ ID NO: 94965 - RNA, 22 nt, Homo sapiens
auguguauuaccucgauuguga

SEQ ID NO: 94966 - RNA, 22 nt, Homo sapiens
augugugcuugauguaaaaagu

SEQ ID NO: 94967 - RNA, 22 nt, Homo sapiens
auguuagcaucaauauucauca

SEQ ID NO: 94968 - RNA, 22 nt, Homo sapiens
auuaaauguuggacguauacau

SEQ ID NO: 94969 - RNA, 22 nt, Homo sapiens
auuaagagcacauguucugggu

SEQ ID NO: 94970 - RNA, 22 nt, Homo sapiens
auuaaguaaugguuccaauaau

SEQ ID NO: 94971 - RNA, 22 nt, Homo sapiens
auuaagugaaugaaguuguucc

SEQ ID NO: 94972 - RNA, 22 nt, Homo sapiens
auuaagugcuugccagugcugg

SEQ ID NO: 94973 - RNA, 22 nt, Homo sapiens
auuaaguuaggauuuugagaua

SEQ ID NO: 94974 - RNA, 22 nt, Homo sapiens
cuuagguuaugauaaauuuagu

SEQ ID NO: 94975 - RNA, 22 nt, Homo sapiens
cuucaaguaauucugauggcua

SEQ ID NO: 94976 - RNA, 22 nt, Homo sapiens
cuucaagucuuuggauaauuag

SEQ ID NO: 94977 - RNA, 22 nt, Homo sapiens
cuucaaguguggccaccugacc

SEQ ID NO: 94978 - RNA, 20 nt, Homo sapiens
cuucacagaaguggaaucau

SEQ ID NO: 94979 - RNA, 22 nt, Homo sapiens
cuucaucugguuugugaacuuu

SEQ ID NO: 94980 - RNA, 22 nt, Homo sapiens
cuucaugggagaaccacaggua

SEQ ID NO: 94981 - RNA, 22 nt, Homo sapiens
cuuccaguggcagccgggcaug

SEQ ID NO: 94982 - RNA, 22 nt, Homo sapiens
cuuccauaguauuuuuacaaaa

SEQ ID NO: 94983 - RNA, 22 nt, Homo sapiens
cuucccguuauugcccuugggu

SEQ ID NO: 94984 - RNA, 22 nt, Homo sapiens
cuugacacugguuuucugaaua

SEQ ID NO: 94985 - RNA, 23 nt, Homo sapiens
cuugagacaaaugcgugugugca

SEQ ID NO: 94986 - RNA, 22 nt, Homo sapiens
cuugauagugguaaucauuuuu

SEQ ID NO: 94987 - RNA, 22 nt, Homo sapiens
cuugcacuguuguaagggacuu

SEQ ID NO: 94988 - RNA, 22 nt, Homo sapiens
cuugcagagcccauggauguca

SEQ ID NO: 94989 - RNA, 22 nt, Homo sapiens
cuugcagaggcccuggggagag

SEQ ID NO: 94990 - RNA, 22 nt, Homo sapiens
cuugcauuuuggagaaugcuga

SEQ ID NO: 94991 - RNA, 19 nt, Homo sapiens
cuugccccauucauccucu

SEQ ID NO: 94992 - RNA, 20 nt, Homo sapiens
cuugccuagcccuuugccuc

SEQ ID NO: 94993 - RNA, 22 nt, Homo sapiens
cuugccuuugucuucaaaggcu

SEQ ID NO: 94994 - RNA, 22 nt, Homo sapiens
cuuggcuagucaaaccuccccg

SEQ ID NO: 94995 - RNA, 22 nt, Homo sapiens
cuuggcuugguaucaaauaacc

SEQ ID NO: 94996 - RNA, 22 nt, Homo sapiens
cuugggauauguguuacucugu

SEQ ID NO: 94997 - RNA, 22 nt, Homo sapiens
cuugggccccacccaaaucuua

SEQ ID NO: 94998 - RNA, 22 nt, Homo sapiens
cuuggguugauugauaaugcca

SEQ ID NO: 94999 - RNA, 22 nt, Homo sapiens
cuuguacacuguuggugggaau

SEQ ID NO: 95000 - RNA, 22 nt, Homo sapiens
cuuguaccccugagucccauaa

SEQ ID NO: 95001 - RNA, 21 nt, Homo sapiens
cuugucuugcuuagaauagac

SEQ ID NO: 95002 - RNA, 22 nt, Homo sapiens
cuugugauugcacggcugccug

SEQ ID NO: 95003 - RNA, 22 nt, Homo sapiens
cuuguguuacauauuuaagaga

SEQ ID NO: 95004 - RNA, 21 nt, Homo sapiens
cuuuaugcuguguuagaaaag

SEQ ID NO: 95005 - RNA, 22 nt, Homo sapiens
cuuucucagugagacccgagau

SEQ ID NO: 95006 - RNA, 22 nt, Homo sapiens
cuuucugaggagaauagagaac

SEQ ID NO: 95007 - RNA, 22 nt, Homo sapiens
cuuugaugagaaaauacuuugu

SEQ ID NO: 95008 - RNA, 22 nt, Homo sapiens
cuuugcaaaacauugagaccuc

SEQ ID NO: 95009 - RNA, 22 nt, Homo sapiens
cuuugcaaauggccuuuccaag

SEQ ID NO: 95010 - RNA, 22 nt, Homo sapiens
cuuuggagaaaaguucuugggc

SEQ ID NO: 95011 - RNA, 20 nt, Homo sapiens
cuuuggcaaugagaacaggg

SEQ ID NO: 95012 - RNA, 21 nt, Homo sapiens
cuuugguagaguuuuuagggu

SEQ ID NO: 95013 - RNA, 22 nt, Homo sapiens
cuuuguaugucaugacaacugu

SEQ ID NO: 95014 - RNA, 22 nt, Homo sapiens
cuuuguguaggugccucuggcu

SEQ ID NO: 95015 - RNA, 22 nt, Homo sapiens
cuuuguguggacauuucaggca

SEQ ID NO: 95016 - RNA, 22 nt, Homo sapiens
cuuuuacacugguggugggaau

SEQ ID NO: 95017 - RNA, 22 nt, Homo sapiens
cuuuugcugggucagcgguggu

SEQ ID NO: 95018 - RNA, 22 nt, Homo sapiens
cuuuuguggaucuucuguugcu

SEQ ID NO: 95019 - RNA, 21 nt, Homo sapiens
cuuuuuacucguucauaugca

SEQ ID NO: 95020 - RNA, 22 nt, Homo sapiens
cuuuuugcaaauacaacucuga

SEQ ID NO: 95021 - RNA, 22 nt, Homo sapiens
gaaaauccauccccagggagua

SEQ ID NO: 95022 - RNA, 22 nt, Homo sapiens
gaaacugcauuucuaacaagcu

SEQ ID NO: 95023 - RNA, 22 nt, Homo sapiens
gaaagugcugcaaggccaugca

SEQ ID NO: 95024 - RNA, 22 nt, Homo sapiens
gaaaguguugagauuacaggca

SEQ ID NO: 95025 - RNA, 22 nt, Homo sapiens
gaaaucucuacuauuuugaucu

SEQ ID NO: 95026 - RNA, 22 nt, Homo sapiens
gaaaugcucagggguuuuccag

SEQ ID NO: 95027 - RNA, 22 nt, Homo sapiens
gaaauggaucagagcaagcuuu

SEQ ID NO: 95028 - RNA, 22 nt, Homo sapiens
gaaaugucugagauguggcuca

SEQ ID NO: 95029 - RNA, 23 nt, Homo sapiens
gaaaugucuuagugaaauugcuu

SEQ ID NO: 95030 - RNA, 22 nt, Homo sapiens
gaacccuggaggcggagguugc

SEQ ID NO: 95031 - RNA, 22 nt, Homo sapiens
gaacuggcuuagugaaacuucc

SEQ ID NO: 95032 - RNA, 22 nt, Homo sapiens
gaagaaguacaagacaaauuuu

SEQ ID NO: 95033 - RNA, 18 nt, Homo sapiens
gaagaaguaggcauggca

SEQ ID NO: 95034 - RNA, 22 nt, Homo sapiens
gaaggcacugugugccacccug

SEQ ID NO: 95035 - RNA, 22 nt, Homo sapiens
gaagguacgcuuaggaaaugau

SEQ ID NO: 95036 - RNA, 22 nt, Homo sapiens
gaaguaauaaauggauucuuaa

SEQ ID NO: 95037 - RNA, 22 nt, Homo sapiens
gaaguaguaaaauuuauugcag

SEQ ID NO: 95038 - RNA, 23 nt, Homo sapiens
gaaguauagcaugcacauggaaa

SEQ ID NO: 95039 - RNA, 22 nt, Homo sapiens
gaagugcaguggcacagucaug

SEQ ID NO: 95040 - RNA, 17 nt, Homo sapiens
gaaguguuucagcagcu

SEQ ID NO: 95041 - RNA, 17 nt, Homo sapiens
gaaguguuucuucauga

SEQ ID NO: 95042 - RNA, 22 nt, Homo sapiens
gaauacuguccaagagugaugg

SEQ ID NO: 95043 - RNA, 22 nt, Homo sapiens
gaauagugcugcaauaaacaua

SEQ ID NO: 95044 - RNA, 22 nt, Homo sapiens
gaaucacagauuaugaguaucu

SEQ ID NO: 95045 - RNA, 22 nt, Homo sapiens
gaaucacaguuauuagagcagc

SEQ ID NO: 95046 - RNA, 22 nt, Homo sapiens
gaaucauuggguugauucaaga

SEQ ID NO: 95047 - RNA, 22 nt, Homo sapiens
gaaucauuguuucuaaguuugu

SEQ ID NO: 95048 - RNA, 22 nt, Homo sapiens
gaaugcagcagugacagggcug

SEQ ID NO: 95049 - RNA, 22 nt, Homo sapiens
gaaugcuaagcaugugggaauu

SEQ ID NO: 95050 - RNA, 18 nt, Homo sapiens
acauucagcuugaagaua

SEQ ID NO: 95051 - RNA, 22 nt, Homo sapiens
acauugcauauggcacccucuu

SEQ ID NO: 95052 - RNA, 22 nt, Homo sapiens
accacagugcuuccugcucacg

SEQ ID NO: 95053 - RNA, 22 nt, Homo sapiens
accacuguuucaagaagcuugu

SEQ ID NO: 95054 - RNA, 22 nt, Homo sapiens
accaguagaaucaguggauucu

SEQ ID NO: 95055 - RNA, 22 nt, Homo sapiens
accauugcacuccagcccaggc

SEQ ID NO: 95056 - RNA, 17 nt, Homo sapiens
accccuaccucagaagc

SEQ ID NO: 95057 - RNA, 22 nt, Homo sapiens
acccgguuagggggcaguggau

SEQ ID NO: 95058 - RNA, 22 nt, Homo sapiens
acccgugcugaauauguaggug

SEQ ID NO: 95059 - RNA, 22 nt, Homo sapiens
acccguuacuuagcagaccagg

SEQ ID NO: 95060 - RNA, 22 nt, Homo sapiens
acccuacauaguagauccuaca

SEQ ID NO: 95061 - RNA, 22 nt, Homo sapiens
acccucaagggacugacagaau

SEQ ID NO: 95062 - RNA, 20 nt, Homo sapiens
acccucuaggaugauuucuu

SEQ ID NO: 95063 - RNA, 22 nt, Homo sapiens
auuagaugguuauaggugugag

SEQ ID NO: 95064 - RNA, 22 nt, Homo sapiens
auuagguaauauaaucauggca

SEQ ID NO: 95065 - RNA, 22 nt, Homo sapiens
auuagguagggaauauggaggu

SEQ ID NO: 95066 - RNA, 22 nt, Homo sapiens
auuagguuggugcaaaaguaau

SEQ ID NO: 95067 - RNA, 22 nt, Homo sapiens
auuaucacaguuuugcauaugg

SEQ ID NO: 95068 - RNA, 22 nt, Homo sapiens
auucaagucaucucuccgcauu

SEQ ID NO: 95069 - RNA, 22 nt, Homo sapiens
auucaagugaugugauucuucu

SEQ ID NO: 95070 - RNA, 22 nt, Homo sapiens
auucacagcuuuaaaaggcgug

SEQ ID NO: 95071 - RNA, 22 nt, Homo sapiens
auucaccauggcuaccaagggu

SEQ ID NO: 95072 - RNA, 22 nt, Homo sapiens
auuccacuuagugacucauuug

SEQ ID NO: 95073 - RNA, 20 nt, Homo sapiens
auuccacuuauaugaggucc

SEQ ID NO: 95074 - RNA, 22 nt, Homo sapiens
auuccagguggcgccauucaca

SEQ ID NO: 95075 - RNA, 22 nt, Homo sapiens
auuccaguuugugagaagcugu

SEQ ID NO: 95076 - RNA, 22 nt, Homo sapiens
auuccauaguacagugaugagu

SEQ ID NO: 95077 - RNA, 22 nt, Homo sapiens
auuccauagugucuguggcaga

SEQ ID NO: 95078 - RNA, 22 nt, Homo sapiens
auuccuuaggcccuuugguuag

SEQ ID NO: 95079 - RNA, 23 nt, Homo sapiens
auugaacacuuucauaugugagg

SEQ ID NO: 95080 - RNA, 22 nt, Homo sapiens
auugaacuuuugucacugacau

SEQ ID NO: 95081 - RNA, 22 nt, Homo sapiens
auugacacugauuuuucuuuaa

SEQ ID NO: 95082 - RNA, 22 nt, Homo sapiens
auugagcaaggucuccuaguau

SEQ ID NO: 95083 - RNA, 21 nt, Homo sapiens
auugagcacaugaaacauggc

SEQ ID NO: 95084 - RNA, 22 nt, Homo sapiens
auugcaaucuccgccuccgggg

SEQ ID NO: 95085 - RNA, 22 nt, Homo sapiens
auugcaaugggaaacuaugaaa

SEQ ID NO: 95086 - RNA, 22 nt, Homo sapiens
auugcacaaagagggaaacuga

SEQ ID NO: 95087 - RNA, 21 nt, Homo sapiens
auugcacaauauacccaugua

SEQ ID NO: 95088 - RNA, 22 nt, Homo sapiens
auugcacaucugcacuacagcc

SEQ ID NO: 95089 - RNA, 22 nt, Homo sapiens
auugcacuccacccugggcaac

SEQ ID NO: 95090 - RNA, 22 nt, Homo sapiens
auugcacuccagcccugcugac

SEQ ID NO: 95091 - RNA, 22 nt, Homo sapiens
auugcacuccagccuaggcaac

SEQ ID NO: 95092 - RNA, 22 nt, Homo sapiens
auugcacuccagccuagguaac

SEQ ID NO: 95093 - RNA, 22 nt, Homo sapiens
auugcacuccagccucggugac

SEQ ID NO: 95094 - RNA, 22 nt, Homo sapiens
auugcacuccagccugagcaaa

SEQ ID NO: 95095 - RNA, 22 nt, Homo sapiens
auugcacuccagccuggcagca

SEQ ID NO: 95096 - RNA, 22 nt, Homo sapiens
auugcacuccagccuggggaac

SEQ ID NO: 95097 - RNA, 22 nt, Homo sapiens
auugcacuccagccugggugag

SEQ ID NO: 95098 - RNA, 22 nt, Homo sapiens
auugcacuccauccugggcaau

SEQ ID NO: 95099 - RNA, 22 nt, Homo sapiens
auugcacucugaucugcacucc

SEQ ID NO: 95100 - RNA, 22 nt, Homo sapiens
auugcagcccacccugggugau

SEQ ID NO: 95101 - RNA, 22 nt, Homo sapiens
auugcaguuagaacagaagucu

SEQ ID NO: 95102 - RNA, 22 nt, Homo sapiens
auugcaugucauguuuagugua

SEQ ID NO: 95103 - RNA, 22 nt, Homo sapiens
auugcccaggcuggagugcagu

SEQ ID NO: 95104 - RNA, 18 nt, Homo sapiens
auugcccucauggggcuu

SEQ ID NO: 95105 - RNA, 23 nt, Homo sapiens
auugcccuugaaggcuaaacucu

SEQ ID NO: 95106 - RNA, 22 nt, Homo sapiens
auugcucacacaaagccuguuu

SEQ ID NO: 95107 - RNA, 22 nt, Homo sapiens
auuggcaauggcaaagcagagu

SEQ ID NO: 95108 - RNA, 22 nt, Homo sapiens
auuggccaaugggacgucagca

SEQ ID NO: 95109 - RNA, 22 nt, Homo sapiens
auuggcuauuuggugagugauu

SEQ ID NO: 95110 - RNA, 22 nt, Homo sapiens
auuggguuaaaggauaugaaca

SEQ ID NO: 95111 - RNA, 18 nt, Homo sapiens
auuguaagauguauggga

SEQ ID NO: 95112 - RNA, 22 nt, Homo sapiens
auuguacauacaccggugugua

SEQ ID NO: 95113 - RNA, 22 nt, Homo sapiens
auuguacuccagccugggcaaa

SEQ ID NO: 95114 - RNA, 22 nt, Homo sapiens
auuguacuccagccuguggagc

SEQ ID NO: 95115 - RNA, 22 nt, Homo sapiens
auugucauuuauaacuguguag

SEQ ID NO: 95116 - RNA, 22 nt, Homo sapiens
auugugcuaaaguaauaaguca

SEQ ID NO: 95117 - RNA, 22 nt, Homo sapiens
auugugucuuguagagagauau

SEQ ID NO: 95118 - RNA, 22 nt, Homo sapiens
auuguucuuacaugcugucauc

SEQ ID NO: 95119 - RNA, 22 nt, Homo sapiens
auuuaacuggucuaggggccca

SEQ ID NO: 95120 - RNA, 22 nt, Homo sapiens
auuuagcaauggagguagugua

SEQ ID NO: 95121 - RNA, 15 nt, Homo sapiens
auuucacuuagcaug

SEQ ID NO: 95122 - RNA, 19 nt, Homo sapiens
auuuccuggagcuggucuc

SEQ ID NO: 95123 - RNA, 22 nt, Homo sapiens
auuugacacugagagccucagu

SEQ ID NO: 95124 - RNA, 20 nt, Homo sapiens
auuugcauuauggagcaccc

SEQ ID NO: 95125 - RNA, 22 nt, Homo sapiens
auuuggguaaugagugcaaggg

SEQ ID NO: 95126 - RNA, 21 nt, Homo sapiens
auuugguguuagaaauaaauu

SEQ ID NO: 95127 - RNA, 22 nt, Homo sapiens
auuugucaauacacuucuucca

SEQ ID NO: 95128 - RNA, 22 nt, Homo sapiens
auuugucacuuaacagccauua

SEQ ID NO: 95129 - RNA, 22 nt, Homo sapiens
auuuugcauugcuguaaaggaa

SEQ ID NO: 95130 - RNA, 22 nt, Homo sapiens
auuuugguuacauaguugagcu

SEQ ID NO: 95131 - RNA, 22 nt, Homo sapiens
auuuuugguugguaggcuauua

SEQ ID NO: 95132 - RNA, 22 nt, Homo sapiens
auuuuugguugucagcacuagg

SEQ ID NO: 95133 - RNA, 22 nt, Homo sapiens
caaaggcuuccacugcauccuu

SEQ ID NO: 95134 - RNA, 22 nt, Homo sapiens
caaaggcuucugaaacugcaga

SEQ ID NO: 95135 - RNA, 22 nt, Homo sapiens
caaaguaauugcuguuuugcca

SEQ ID NO: 95136 - RNA, 22 nt, Homo sapiens
caaagucuucucauuaugucuu

SEQ ID NO: 95137 - RNA, 19 nt, Homo sapiens
caaaguguucuucuuugcc

SEQ ID NO: 95138 - RNA, 22 nt, Homo sapiens
caaauccucaccucaucaugaa

SEQ ID NO: 95139 - RNA, 22 nt, Homo sapiens
caaaugaucugcuggccucagc

SEQ ID NO: 95140 - RNA, 22 nt, Homo sapiens
caaaugcuucuauggacugucu

SEQ ID NO: 95141 - RNA, 22 nt, Homo sapiens
agagaacuggcuucaccauucu

SEQ ID NO: 95142 - RNA, 22 nt, Homo sapiens
agagacauugcuccaacucacc

SEQ ID NO: 95143 - RNA, 22 nt, Homo sapiens
agagagcuugggguguuaaauu

SEQ ID NO: 95144 - RNA, 22 nt, Homo sapiens
agagagcuuuugguugcccuaa

SEQ ID NO: 95145 - RNA, 22 nt, Homo sapiens
agagauaauuagguuaaaugag

SEQ ID NO: 95146 - RNA, 22 nt, Homo sapiens
agagaucacugaaucacggggg

SEQ ID NO: 95147 - RNA, 20 nt, Homo sapiens
agagaucaguaauucaucaa

SEQ ID NO: 95148 - RNA, 22 nt, Homo sapiens
agagaucauuuuguuucaaauc

SEQ ID NO: 95149 - RNA, 22 nt, Homo sapiens
agagaugauuaacauuuuggua

SEQ ID NO: 95150 - RNA, 22 nt, Homo sapiens
agagauuauccuggcuucucug

SEQ ID NO: 95151 - RNA, 22 nt, Homo sapiens
caaugguccccauuggcaggaa

SEQ ID NO: 95152 - RNA, 22 nt, Homo sapiens
caauugcacucuuagguguaca

SEQ ID NO: 95153 - RNA, 22 nt, Homo sapiens
cacaaaguagauuagucuucca

SEQ ID NO: 95154 - RNA, 22 nt, Homo sapiens
cacaaccuccgccuccuggguu

SEQ ID NO: 95155 - RNA, 22 nt, Homo sapiens
cacaaugucugguaggccacuu

SEQ ID NO: 95156 - RNA, 22 nt, Homo sapiens
cacaccuaccucauuauggaca

SEQ ID NO: 95157 - RNA, 22 nt, Homo sapiens
cacacugucuucaauggguggu

SEQ ID NO: 95158 - RNA, 22 nt, Homo sapiens
cacagagugagacccugucucu

SEQ ID NO: 95159 - RNA, 22 nt, Homo sapiens
cacagcgacuuccgccuaccgg

SEQ ID NO: 95160 - RNA, 22 nt, Homo sapiens
cacagucugggcuuguuuguac

SEQ ID NO: 95161 - RNA, 22 nt, Homo sapiens
cacagugaacaauauccucugu

SEQ ID NO: 95162 - RNA, 22 nt, Homo sapiens
cacauagcuagucaguagugaa

SEQ ID NO: 95163 - RNA, 22 nt, Homo sapiens
cacauugcaggaaaguucauua

SEQ ID NO: 95164 - RNA, 22 nt, Homo sapiens
caccagguggcugaggccauga

SEQ ID NO: 95165 - RNA, 23 nt, Homo sapiens
caccaguagaaugugugggaggg

SEQ ID NO: 95166 - RNA, 22 nt, Homo sapiens
cacccaguaagcaugaggcccu

SEQ ID NO: 95167 - RNA, 22 nt, Homo sapiens
cacccgugcucccuccagcugc

SEQ ID NO: 95168 - RNA, 22 nt, Homo sapiens
cacccuaucagauguccagaga

SEQ ID NO: 95169 - RNA, 22 nt, Homo sapiens
caccuagacuggagugcagugg

SEQ ID NO: 95170 - RNA, 22 nt, Homo sapiens
caccugagcgggaugcucgccu

SEQ ID NO: 95171 - RNA, 22 nt, Homo sapiens
cacugcacuccagccuaagagg

SEQ ID NO: 95172 - RNA, 22 nt, Homo sapiens
cacugcacuccagcuuugguga

SEQ ID NO: 95173 - RNA, 21 nt, Homo sapiens
cacugcacuugccuucugggu

SEQ ID NO: 95174 - RNA, 22 nt, Homo sapiens
cacugcaguaaauugcgucggu

SEQ ID NO: 95175 - RNA, 21 nt, Homo sapiens
cacugcaucacaggacagcau

SEQ ID NO: 95176 - RNA, 22 nt, Homo sapiens
cacugcauccuccaccuccugg

SEQ ID NO: 95177 - RNA, 22 nt, Homo sapiens
cacuggcacuguguuuagaugg

SEQ ID NO: 95178 - RNA, 22 nt, Homo sapiens
cacugggccaucacuuaauauu

SEQ ID NO: 95179 - RNA, 17 nt, Homo sapiens
cacugggugcaagagga

SEQ ID NO: 95180 - RNA, 21 nt, Homo sapiens
cacuggguucaggcuugugga

SEQ ID NO: 95181 - RNA, 16 nt, Homo sapiens
cacuggucuuaccaug

SEQ ID NO: 95182 - RNA, 22 nt, Homo sapiens
cagagaacauucagagcuguag

SEQ ID NO: 95183 - RNA, 22 nt, Homo sapiens
cagagaucaugcaacugcucgc

SEQ ID NO: 95184 - RNA, 22 nt, Homo sapiens
cagagguaagcaagucagcauu

SEQ ID NO: 95185 - RNA, 22 nt, Homo sapiens
cagagucaagcucuuguuccau

SEQ ID NO: 95186 - RNA, 22 nt, Homo sapiens
cagagugcauguuuagaugagu

SEQ ID NO: 95187 - RNA, 22 nt, Homo sapiens
cagcaagucucuaagaguucau

SEQ ID NO: 95188 - RNA, 22 nt, Homo sapiens
cagcacauagcaguugcucagu

SEQ ID NO: 95189 - RNA, 22 nt, Homo sapiens
cagcacauuacaaguacuuggu

SEQ ID NO: 95190 - RNA, 20 nt, Homo sapiens
cagcuagugguaggagucgg

SEQ ID NO: 95191 - RNA, 22 nt, Homo sapiens
cagcuaguuuuugguuuacagu

SEQ ID NO: 95192 - RNA, 22 nt, Homo sapiens
cagcucauugcagucucgaccu

SEQ ID NO: 95193 - RNA, 22 nt, Homo sapiens
cagcugcuuuggaaaauauuuu

SEQ ID NO: 95194 - RNA, 22 nt, Homo sapiens
cagcuguuguugggguauagga

SEQ ID NO: 95195 - RNA, 22 nt, Homo sapiens
caggaccucuugccuggaagcc

SEQ ID NO: 95196 - RNA, 22 nt, Homo sapiens
caggcacgcuugggagacacac

SEQ ID NO: 95197 - RNA, 22 nt, Homo sapiens
caggcauuguccaugcugaagg

SEQ ID NO: 95198 - RNA, 22 nt, Homo sapiens
cagguacuucugggcugagcag

SEQ ID NO: 95199 - RNA, 21 nt, Homo sapiens
cagguagugucugaagccaga

SEQ ID NO: 95200 - RNA, 22 nt, Homo sapiens
caggugaaugccucuccuucug

SEQ ID NO: 95201 - RNA, 22 nt, Homo sapiens
caguaguagccccuuagaugga

SEQ ID NO: 95202 - RNA, 20 nt, Homo sapiens
cagucaugaagaacugugag

SEQ ID NO: 95203 - RNA, 22 nt, Homo sapiens
cagugaauuucaggucaagagu

SEQ ID NO: 95204 - RNA, 20 nt, Homo sapiens
cagugcaccuggcguguuga

SEQ ID NO: 95205 - RNA, 22 nt, Homo sapiens
cagugcauagaugugccacauu

SEQ ID NO: 95206 - RNA, 23 nt, Homo sapiens
cagugcaugacuguauaugcaaa

SEQ ID NO: 95207 - RNA, 20 nt, Homo sapiens
cagugcauugcuucugauuu

SEQ ID NO: 95208 - RNA, 22 nt, Homo sapiens
cagugcuuuaucaaguccucca

SEQ ID NO: 95209 - RNA, 22 nt, Homo sapiens
caguggacuaaauggggaauau

SEQ ID NO: 95210 - RNA, 22 nt, Homo sapiens
caguggauuggauggauaaugc

SEQ ID NO: 95211 - RNA, 22 nt, Homo sapiens
caguuacuugacacaaccaauu

SEQ ID NO: 95212 - RNA, 22 nt, Homo sapiens
caguuguuuuaugacauaagau

SEQ ID NO: 95213 - RNA, 22 nt, Homo sapiens
cauaaaucuuguugaauagcac

SEQ ID NO: 95214 - RNA, 22 nt, Homo sapiens
cauacaagcuacaaucacaaag

SEQ ID NO: 95215 - RNA, 22 nt, Homo sapiens
cauacaguaggcacuauuugua

SEQ ID NO: 95216 - RNA, 22 nt, Homo sapiens
cauagcacacguauaccuaugu

SEQ ID NO: 95217 - RNA, 22 nt, Homo sapiens
cauaguacuugcauaguacuau

SEQ ID NO: 95218 - RNA, 22 nt, Homo sapiens
cauauaguaguacuguuagguu

SEQ ID NO: 95219 - RNA, 22 nt, Homo sapiens
cauauucacuuuacagagcugu

SEQ ID NO: 95220 - RNA, 21 nt, Homo sapiens
caucaaauugucauggugggu

SEQ ID NO: 95221 - RNA, 19 nt, Homo sapiens
caucacagagucuuccauu

SEQ ID NO: 95222 - RNA, 23 nt, Homo sapiens
caucacauagaggaaagaggaca

SEQ ID NO: 95223 - RNA, 22 nt, Homo sapiens
caucacuuugccuccgucucua

SEQ ID NO: 95224 - RNA, 22 nt, Homo sapiens
caucagcaauguaugaggguuc

SEQ ID NO: 95225 - RNA, 22 nt, Homo sapiens
caucccauucgaggggcacagc

SEQ ID NO: 95226 - RNA, 22 nt, Homo sapiens
caucgcacuccagcuugggcaa

SEQ ID NO: 95227 - RNA, 22 nt, Homo sapiens
caugaaagugagaaacuccugg

SEQ ID NO: 95228 - RNA, 22 nt, Homo sapiens
caugauauugcagaauguuggu

SEQ ID NO: 95229 - RNA, 22 nt, Homo sapiens
caugcacugaguccaccucugg

SEQ ID NO: 95230 - RNA, 22 nt, Homo sapiens
caugccacuguggacaaagaca

SEQ ID NO: 95231 - RNA, 22 nt, Homo sapiens
caugccauugcucuccugggug

SEQ ID NO: 95232 - RNA, 22 nt, Homo sapiens
uagugcugugauaaacauauau

SEQ ID NO: 95233 - RNA, 22 nt, Homo sapiens
uagugcugugauuaacauaaug

SEQ ID NO: 95234 - RNA, 20 nt, Homo sapiens
uaguggaaaucagguccucu

SEQ ID NO: 95235 - RNA, 22 nt, Homo sapiens
uaguucauuauguguugcucag

SEQ ID NO: 95236 - RNA, 20 nt, Homo sapiens
uaguuggugauacagugcau

SEQ ID NO: 95237 - RNA, 22 nt, Homo sapiens
uaguuuaucuucuggauggaca

SEQ ID NO: 95238 - RNA, 22 nt, Homo sapiens
uauaagacuagcagcugaauug

SEQ ID NO: 95239 - RNA, 22 nt, Homo sapiens
uauacagcaaguuacugugcug

SEQ ID NO: 95240 - RNA, 22 nt, Homo sapiens
uauaccacugauuuuauucuga

SEQ ID NO: 95241 - RNA, 22 nt, Homo sapiens
uauacuguuuucuauaguggcu

SEQ ID NO: 95242 - RNA, 20 nt, Homo sapiens
uauagcaauuuuuuucuccu

SEQ ID NO: 95243 - RNA, 17 nt, Homo sapiens
uauagcacuucucacau

SEQ ID NO: 95244 - RNA, 22 nt, Homo sapiens
uauagcagugugagaacagacu

SEQ ID NO: 95245 - RNA, 22 nt, Homo sapiens
uauagcuaugggauguauuugc

SEQ ID NO: 95246 - RNA, 22 nt, Homo sapiens
uauagcuugaaggaauggucau

SEQ ID NO: 95247 - RNA, 22 nt, Homo sapiens
uauagcuugauuauggugaugg

SEQ ID NO: 95248 - RNA, 21 nt, Homo sapiens
uauaguaguaugauuuacaau

SEQ ID NO: 95249 - RNA, 22 nt, Homo sapiens
uauauagcuaugucuguccauu

SEQ ID NO: 95250 - RNA, 21 nt, Homo sapiens
uauaugacuuacuauugccuc

SEQ ID NO: 95251 - RNA, 22 nt, Homo sapiens
uauaugcaacauaguguaugug

SEQ ID NO: 95252 - RNA, 22 nt, Homo sapiens
uauaugcacucagguguaugug

SEQ ID NO: 95253 - RNA, 22 nt, Homo sapiens
uauaugcauugugggguacuga

SEQ ID NO: 95254 - RNA, 22 nt, Homo sapiens
uauaugucuucuuguaauuggc

SEQ ID NO: 95255 - RNA, 22 nt, Homo sapiens
uauaugucuuuguuauguugag

SEQ ID NO: 95256 - RNA, 22 nt, Homo sapiens
uauauguucugugucccuuucg

SEQ ID NO: 95257 - RNA, 22 nt, Homo sapiens
uauauguuuucauaaggcuaga

SEQ ID NO: 95258 - RNA, 22 nt, Homo sapiens
uaucaacaggguggccagugua

SEQ ID NO: 95259 - RNA, 22 nt, Homo sapiens
uaucaaggccacucauuuuaug

SEQ ID NO: 95260 - RNA, 19 nt, Homo sapiens
uaucaaguaugcacuguac

SEQ ID NO: 95261 - RNA, 22 nt, Homo sapiens
uaucaaguuggaagagaaguaa

SEQ ID NO: 95262 - RNA, 22 nt, Homo sapiens
uaucacagaggguauccuagag

SEQ ID NO: 95263 - RNA, 20 nt, Homo sapiens
uaucacaggucagaaacccu

SEQ ID NO: 95264 - RNA, 22 nt, Homo sapiens
uaucacaguagaacucuuucca

SEQ ID NO: 95265 - RNA, 21 nt, Homo sapiens
uaucacaguagaauaggaucu

SEQ ID NO: 95266 - RNA, 20 nt, Homo sapiens
uaucacaguucaggaacucu

SEQ ID NO: 95267 - RNA, 20 nt, Homo sapiens
uaucacauggggagaaaccu

SEQ ID NO: 95268 - RNA, 22 nt, Homo sapiens
uaucaccuugcaguggaugcua

SEQ ID NO: 95269 - RNA, 22 nt, Homo sapiens
uaucacuuugauaguuuaaaug

SEQ ID NO: 95270 - RNA, 22 nt, Homo sapiens
uaucagaguuacacugaagacu

SEQ ID NO: 95271 - RNA, 22 nt, Homo sapiens
uaucagcacaguggguucaugg

SEQ ID NO: 95272 - RNA, 22 nt, Homo sapiens
uaucccaguggauguaccccau

SEQ ID NO: 95273 - RNA, 22 nt, Homo sapiens
uaucccuguggacuucccaaca

SEQ ID NO: 95274 - RNA, 23 nt, Homo sapiens
uaucccuugccuuaugaugugag

SEQ ID NO: 95275 - RNA, 22 nt, Homo sapiens
uaucuacauguagguauguaug

SEQ ID NO: 95276 - RNA, 22 nt, Homo sapiens
uaucucagagaaucagauuuac

SEQ ID NO: 95277 - RNA, 22 nt, Homo sapiens
uaucucaguguacaggaugaua

SEQ ID NO: 95278 - RNA, 22 nt, Homo sapiens
uaucucauccuccuugauccca

SEQ ID NO: 95279 - RNA, 18 nt, Homo sapiens
uaucucauuucuuagguc

SEQ ID NO: 95280 - RNA, 22 nt, Homo sapiens
uaucucuguggguagugcugaa

SEQ ID NO: 95281 - RNA, 22 nt, Homo sapiens
uaucugcaucccauuuuuauca

SEQ ID NO: 95282 - RNA, 22 nt, Homo sapiens
uaucugguuauugcugcugauu

SEQ ID NO: 95283 - RNA, 22 nt, Homo sapiens
uaugaaagcuacuucucacaau

SEQ ID NO: 95284 - RNA, 22 nt, Homo sapiens
uaugaaccuguuaucuagguuu

SEQ ID NO: 95285 - RNA, 22 nt, Homo sapiens
uaugaagccaggauuuauuauu

SEQ ID NO: 95286 - RNA, 22 nt, Homo sapiens
uaugaaucuggcuacuccaggg

SEQ ID NO: 95287 - RNA, 23 nt, Homo sapiens
uaugacagaggaagggggagcug

SEQ ID NO: 95288 - RNA, 22 nt, Homo sapiens
uaugacuuguuuucuggucugc

SEQ ID NO: 95289 - RNA, 20 nt, Homo sapiens
uaugagacugggagaaguuc

SEQ ID NO: 95290 - RNA, 19 nt, Homo sapiens
uaugagcuaugacaugcau

SEQ ID NO: 95291 - RNA, 22 nt, Homo sapiens
uaugagguagguaugacuauca

SEQ ID NO: 95292 - RNA, 22 nt, Homo sapiens
uaugauuuuugggagaggucaa

SEQ ID NO: 95293 - RNA, 19 nt, Homo sapiens
uaugcaacuuauagugcug

SEQ ID NO: 95294 - RNA, 22 nt, Homo sapiens
uaugcaugucucuguacacgug

SEQ ID NO: 95295 - RNA, 22 nt, Homo sapiens
uaugccucuucauaaaguauga

SEQ ID NO: 95296 - RNA, 23 nt, Homo sapiens
uaugccuguuucaaacaaacuuu

SEQ ID NO: 95297 - RNA, 22 nt, Homo sapiens
uaugccuuugaccauuuuguga

SEQ ID NO: 95298 - RNA, 22 nt, Homo sapiens
uaugccuuuugguucaagcaac

SEQ ID NO: 95299 - RNA, 19 nt, Homo sapiens
uaugcuagagagggaagcu

SEQ ID NO: 95300 - RNA, 22 nt, Homo sapiens
uaugcuguuucugauuuaggga

SEQ ID NO: 95301 - RNA, 22 nt, Homo sapiens
uaugcuuguuuauuuaagaaac

SEQ ID NO: 95302 - RNA, 22 nt, Homo sapiens
uauggauucuagcucaguaggu

SEQ ID NO: 95303 - RNA, 22 nt, Homo sapiens
augcacaucagcuccagggacc

SEQ ID NO: 95304 - RNA, 22 nt, Homo sapiens
augcacaugcgaaaacuugugu

SEQ ID NO: 95305 - RNA, 22 nt, Homo sapiens
augcagguguuuugcacugagu

SEQ ID NO: 95306 - RNA, 22 nt, Homo sapiens
augcauagugggaugcucugug

SEQ ID NO: 95307 - RNA, 22 nt, Homo sapiens
augccacugcacuccaaccugg

SEQ ID NO: 95308 - RNA, 22 nt, Homo sapiens
augccacugcacucuagccugg

SEQ ID NO: 95309 - RNA, 22 nt, Homo sapiens
augccacugcgcucuagccugg

SEQ ID NO: 95310 - RNA, 22 nt, Homo sapiens
augccagggagaauuguucaag

SEQ ID NO: 95311 - RNA, 22 nt, Homo sapiens
augccaguguccagaguggguu

SEQ ID NO: 95312 - RNA, 22 nt, Homo sapiens
augccauugcacuccagccugg

SEQ ID NO: 95313 - RNA, 22 nt, Homo sapiens
augccuaagacccuguggggga

SEQ ID NO: 95314 - RNA, 22 nt, Homo sapiens
augccucugacaauuggauucu

SEQ ID NO: 95315 - RNA, 22 nt, Homo sapiens
augcuggugguucacaugcgca

SEQ ID NO: 95316 - RNA, 22 nt, Homo sapiens
augcuguuuuguagcucccucu

SEQ ID NO: 95317 - RNA, 21 nt, Homo sapiens
auggaaagacugccucuucaa

SEQ ID NO: 95318 - RNA, 19 nt, Homo sapiens
auggaacugcuggagccac

SEQ ID NO: 95319 - RNA, 22 nt, Homo sapiens
auggaagacuccucuuugggua

SEQ ID NO: 95320 - RNA, 22 nt, Homo sapiens
auggaaggagaauggucuuuga

SEQ ID NO: 95321 - RNA, 22 nt, Homo sapiens
auggacagaaaaaaauagaugu

SEQ ID NO: 95322 - RNA, 21 nt, Homo sapiens
auggacaugguuaggcuuugu

SEQ ID NO: 95323 - RNA, 22 nt, Homo sapiens
ucuuugccuaacccaaggucau

SEQ ID NO: 95324 - RNA, 22 nt, Homo sapiens
ucuuuggagacaaccccagucu

SEQ ID NO: 95325 - RNA, 22 nt, Homo sapiens
ucuuuggaggcgaucuguuuga

SEQ ID NO: 95326 - RNA, 23 nt, Homo sapiens
ucuuuggcucuaauauaccuugu

SEQ ID NO: 95327 - RNA, 22 nt, Homo sapiens
ucuuuggucaucaugggaagca

SEQ ID NO: 95328 - RNA, 22 nt, Homo sapiens
ucuuuggugaauggucauccag

SEQ ID NO: 95329 - RNA, 22 nt, Homo sapiens
ucuuuguguaggucaaucuggc

SEQ ID NO: 95330 - RNA, 22 nt, Homo sapiens
ucuuuguugcauaggcuuguuc

SEQ ID NO: 95331 - RNA, 22 nt, Homo sapiens
ucuuuugguuucuagaggccgc

SEQ ID NO: 95332 - RNA, 22 nt, Homo sapiens
ucuuuugugagucagccucucc

SEQ ID NO: 95333 - RNA, 20 nt, Homo sapiens
ucuuuuuguggccccagagu

SEQ ID NO: 95334 - RNA, 22 nt, Homo sapiens
ugaaaaguuguugaaggcuuca

SEQ ID NO: 95335 - RNA, 22 nt, Homo sapiens
ugaaacacacagagaagggaga

SEQ ID NO: 95336 - RNA, 20 nt, Homo sapiens
ugaaacacauggacuggggu

SEQ ID NO: 95337 - RNA, 22 nt, Homo sapiens
ugaaagguauagguucuggagg

SEQ ID NO: 95338 - RNA, 20 nt, Homo sapiens
ugaaaucuucacuaagucuc

SEQ ID NO: 95339 - RNA, 22 nt, Homo sapiens
ugaaaucuuugaugguggcauu

SEQ ID NO: 95340 - RNA, 22 nt, Homo sapiens
ugaaaugauuauaugguguuug

SEQ ID NO: 95341 - RNA, 21 nt, Homo sapiens
ugaaaugcaugugcacauuaa

SEQ ID NO: 95342 - RNA, 22 nt, Homo sapiens
ugaaaugccuugagauuuugac

SEQ ID NO: 95343 - RNA, 22 nt, Homo sapiens
ugaaaugcugucuaggggaaau

SEQ ID NO: 95344 - RNA, 22 nt, Homo sapiens
ugaaauggugcggucugcagca

SEQ ID NO: 95345 - RNA, 22 nt, Homo sapiens
ugaaauguaaguugucuagucu

SEQ ID NO: 95346 - RNA, 22 nt, Homo sapiens
ugaaauguguuaucugggccug

SEQ ID NO: 95347 - RNA, 22 nt, Homo sapiens
ugaaauuguuugcaaggauagg

SEQ ID NO: 95348 - RNA, 22 nt, Homo sapiens
ugaaauuuuuuauucguuggcu

SEQ ID NO: 95349 - RNA, 22 nt, Homo sapiens
ugaacagcuaucuugucagugu

SEQ ID NO: 95350 - RNA, 22 nt, Homo sapiens
ugaacuaguaguuuacuugaug

SEQ ID NO: 95351 - RNA, 22 nt, Homo sapiens
ugaacugagacuagacuuguuc

SEQ ID NO: 95352 - RNA, 22 nt, Homo sapiens
ugaagacauuuuugggugugua

SEQ ID NO: 95353 - RNA, 22 nt, Homo sapiens
ugaagcuaacuugauugugaug

SEQ ID NO: 95354 - RNA, 22 nt, Homo sapiens
ugaagcuaggauuaauuuucau

SEQ ID NO: 95355 - RNA, 20 nt, Homo sapiens
ugaaggaggucauuuauacc

SEQ ID NO: 95356 - RNA, 22 nt, Homo sapiens
ugaagggcauuguuuugccaaa

SEQ ID NO: 95357 - RNA, 22 nt, Homo sapiens
ugaaguaggcauaaguuaagcu

SEQ ID NO: 95358 - RNA, 22 nt, Homo sapiens
ugaagugaagacucacagaagg

SEQ ID NO: 95359 - RNA, 22 nt, Homo sapiens
ugaagugaagcaguaguguggg

SEQ ID NO: 95360 - RNA, 22 nt, Homo sapiens
ugaagugcugugggccaggcgu

SEQ ID NO: 95361 - RNA, 22 nt, Homo sapiens
ugaaguguuuuuucaggcaugu

SEQ ID NO: 95362 - RNA, 22 nt, Homo sapiens
ugaauacuucguucaaagauaa

SEQ ID NO: 95363 - RNA, 22 nt, Homo sapiens
ugaauagaaguggcaggaguag

SEQ ID NO: 95364 - RNA, 22 nt, Homo sapiens
ugaauagaaguuuacuccuuuu

SEQ ID NO: 95365 - RNA, 22 nt, Homo sapiens
ugaauaggcaguuaaguuuaug

SEQ ID NO: 95366 - RNA, 22 nt, Homo sapiens
ugaauaguaauguguuuggucu

SEQ ID NO: 95367 - RNA, 22 nt, Homo sapiens
ugaauagugucacaauaaacau

SEQ ID NO: 95368 - RNA, 18 nt, Homo sapiens
ugaauaguguccccauga

SEQ ID NO: 95369 - RNA, 22 nt, Homo sapiens
ugaauaguuugacagaacucuu

SEQ ID NO: 95370 - RNA, 22 nt, Homo sapiens
ugaaugcauggggccaagaagg

SEQ ID NO: 95371 - RNA, 22 nt, Homo sapiens
ugaaugguuuuuagagaacaau

SEQ ID NO: 95372 - RNA, 22 nt, Homo sapiens
ugaauguaagaugucugcuggu

SEQ ID NO: 95373 - RNA, 22 nt, Homo sapiens
ugaauguacacgcguacuuguu

SEQ ID NO: 95374 - RNA, 22 nt, Homo sapiens
ugaauguauuuauuaccauuca

SEQ ID NO: 95375 - RNA, 22 nt, Homo sapiens
ugaauguuugcuuacuuccaua

SEQ ID NO: 95376 - RNA, 22 nt, Homo sapiens
ugaauucaucucacagaguuaa

SEQ ID NO: 95377 - RNA, 23 nt, Homo sapiens
ugacaaccucaugcuuugucaug

SEQ ID NO: 95378 - RNA, 22 nt, Homo sapiens
ugacacagugggggauccuuuu

SEQ ID NO: 95379 - RNA, 22 nt, Homo sapiens
ugacagagcaggacuucaucuc

SEQ ID NO: 95380 - RNA, 22 nt, Homo sapiens
ugacagcugaggcccagaguac

SEQ ID NO: 95381 - RNA, 22 nt, Homo sapiens
ugacaggagauuaugugauguu

SEQ ID NO: 95382 - RNA, 22 nt, Homo sapiens
ugacaggucuaauuuacugaca

SEQ ID NO: 95383 - RNA, 22 nt, Homo sapiens
ugacaguaaacagucuugauua

SEQ ID NO: 95384 - RNA, 18 nt, Homo sapiens
ugacaucauuuagaaagg

SEQ ID NO: 95385 - RNA, 19 nt, Homo sapiens
ugacaugaaacccaagauc

SEQ ID NO: 95386 - RNA, 22 nt, Homo sapiens
ugacauggaaguagguauacau

SEQ ID NO: 95387 - RNA, 22 nt, Homo sapiens
ugacauggagagagaagccuuu

SEQ ID NO: 95388 - RNA, 22 nt, Homo sapiens
ugacauguauaucuuacgcuau

SEQ ID NO: 95389 - RNA, 22 nt, Homo sapiens
ugacauguugcauuauauuucc

SEQ ID NO: 95390 - RNA, 22 nt, Homo sapiens
uauggauuugccuauucuguau

SEQ ID NO: 95391 - RNA, 22 nt, Homo sapiens
uauggcauuguuggugaugaua

SEQ ID NO: 95392 - RNA, 22 nt, Homo sapiens
uauggcuaugggaacugggagu

SEQ ID NO: 95393 - RNA, 22 nt, Homo sapiens
uauggcucuauuuccuugucua

SEQ ID NO: 95394 - RNA, 21 nt, Homo sapiens
uaugguuucuaauucugcagg

SEQ ID NO: 95395 - RNA, 22 nt, Homo sapiens
uaugguuuuggaauccugcaga

SEQ ID NO: 95396 - RNA, 17 nt, Homo sapiens
uauguaguacuuauaaa

SEQ ID NO: 95397 - RNA, 22 nt, Homo sapiens
uaugucuauuauguagcaggaa

SEQ ID NO: 95398 - RNA, 22 nt, Homo sapiens
uaugucuggaguuacugagcug

SEQ ID NO: 95399 - RNA, 22 nt, Homo sapiens
uaugugcacaugcccuggugac

SEQ ID NO: 95400 - RNA, 22 nt, Homo sapiens
uauuacacuuuagugucuucca

SEQ ID NO: 95401 - RNA, 22 nt, Homo sapiens
uauuagguuggggcaaaaguaa

SEQ ID NO: 95402 - RNA, 22 nt, Homo sapiens
uauuagguuggugcaaaaguaa

SEQ ID NO: 95403 - RNA, 22 nt, Homo sapiens
uauuaugcacuuuauaaaaauu

SEQ ID NO: 95404 - RNA, 22 nt, Homo sapiens
uauucacaggugugggacaaag

SEQ ID NO: 95405 - RNA, 20 nt, Homo sapiens
uauucacucuccagucuugc

SEQ ID NO: 95406 - RNA, 22 nt, Homo sapiens
uauuccagcccuggugagccag

SEQ ID NO: 95407 - RNA, 18 nt, Homo sapiens
uauuccucuuccucuauc

SEQ ID NO: 95408 - RNA, 22 nt, Homo sapiens
uauugaauuugagcugucucuu

SEQ ID NO: 95409 - RNA, 22 nt, Homo sapiens
uauugaauuuuuaagcccuuug

SEQ ID NO: 95410 - RNA, 22 nt, Homo sapiens
uauugacuugaugagggagggu

SEQ ID NO: 95411 - RNA, 22 nt, Homo sapiens
uauugcacgccagccugagcaa

SEQ ID NO: 95412 - RNA, 22 nt, Homo sapiens
uauugcacuccagccuuggcaa

SEQ ID NO: 95413 - RNA, 22 nt, Homo sapiens
uauugcacuccucaugcauuug

SEQ ID NO: 95414 - RNA, 22 nt, Homo sapiens
uauugcagauacccaggaaguu

SEQ ID NO: 95415 - RNA, 22 nt, Homo sapiens
uauugccucuuuuguaaaagug

SEQ ID NO: 95416 - RNA, 22 nt, Homo sapiens
uauugcuaaaacucaugguugc

SEQ ID NO: 95417 - RNA, 22 nt, Homo sapiens
uauugcuacuuugccuuccaaa

SEQ ID NO: 95418 - RNA, 22 nt, Homo sapiens
uauugcugaaaaugcuaaugau

SEQ ID NO: 95419 - RNA, 22 nt, Homo sapiens
uauugcuggauguauuacaugu

SEQ ID NO: 95420 - RNA, 22 nt, Homo sapiens
uauugcuggcucugucuucauu

SEQ ID NO: 95421 - RNA, 22 nt, Homo sapiens
uauuggcucuguuucucugaag

SEQ ID NO: 95422 - RNA, 22 nt, Homo sapiens
uauuguacauauccucccuuca

SEQ ID NO: 95423 - RNA, 22 nt, Homo sapiens
uauugucaccaucccuguuuua

SEQ ID NO: 95424 - RNA, 22 nt, Homo sapiens
uauugugcauguugaauaacua

SEQ ID NO: 95425 - RNA, 22 nt, Homo sapiens
uauuguuuuucccaggagucua

SEQ ID NO: 95426 - RNA, 22 nt, Homo sapiens
uauuucaguugugcagguaguu

SEQ ID NO: 95427 - RNA, 22 nt, Homo sapiens
uauuuggauagucuggaaaaaa

SEQ ID NO: 95428 - RNA, 22 nt, Homo sapiens
ucaaaaccucagagaguagagc

SEQ ID NO: 95429 - RNA, 22 nt, Homo sapiens
ucaaacugcuugaggccauuua

SEQ ID NO: 95430 - RNA, 20 nt, Homo sapiens
ucaaagacauggcugucaga

SEQ ID NO: 95431 - RNA, 22 nt, Homo sapiens
ucaaaguagaaaaggggcaauu

SEQ ID NO: 95432 - RNA, 22 nt, Homo sapiens
ucaaagugacaaaguugcagca

SEQ ID NO: 95433 - RNA, 22 nt, Homo sapiens
ucaaagugagcuccuucucacu

SEQ ID NO: 95434 - RNA, 22 nt, Homo sapiens
ucaaauguuuguuuaaggcuua

SEQ ID NO: 95435 - RNA, 20 nt, Homo sapiens
ucaaauucuuggccuccagc

SEQ ID NO: 95436 - RNA, 21 nt, Homo sapiens
ucaaauugaaauuaggucauu

SEQ ID NO: 95437 - RNA, 22 nt, Homo sapiens
ucaacacaguuaaauggggaaa

SEQ ID NO: 95438 - RNA, 21 nt, Homo sapiens
ucaacccuugcgucaccaagc

SEQ ID NO: 95439 - RNA, 22 nt, Homo sapiens
ucaacguauuuauauagcagag

SEQ ID NO: 95440 - RNA, 22 nt, Homo sapiens
ucaacugcuugagaucacaaau

SEQ ID NO: 95441 - RNA, 22 nt, Homo sapiens
ucaagcaauucuccucucagcc

SEQ ID NO: 95442 - RNA, 22 nt, Homo sapiens
ucaagcaauucuccugccucag

SEQ ID NO: 95443 - RNA, 22 nt, Homo sapiens
ucaagcaauucugcugccucag

SEQ ID NO: 95444 - RNA, 22 nt, Homo sapiens
ucaaguaauacucccaucuugg

SEQ ID NO: 95445 - RNA, 22 nt, Homo sapiens
ucaaguacugccuugcucuggc

SEQ ID NO: 95446 - RNA, 22 nt, Homo sapiens
ucaaguacuuugcauagugccg

SEQ ID NO: 95447 - RNA, 22 nt, Homo sapiens
ucaaguaguaacuaacugugac

SEQ ID NO: 95448 - RNA, 22 nt, Homo sapiens
ucaauguaucuccaagaauuga

SEQ ID NO: 95449 - RNA, 22 nt, Homo sapiens
ucacaaagcuuggccugcuucu

SEQ ID NO: 95450 - RNA, 20 nt, Homo sapiens
ucacaagccaagaucacguc

SEQ ID NO: 95451 - RNA, 21 nt, Homo sapiens
ucacaaugaacagcagcagaa

SEQ ID NO: 95452 - RNA, 22 nt, Homo sapiens
ucacaauggagacucgggcgga

SEQ ID NO: 95453 - RNA, 22 nt, Homo sapiens
ucacaccauucuucuacuucag

SEQ ID NO: 95454 - RNA, 22 nt, Homo sapiens
ucacacucucaccaacauuugg

SEQ ID NO: 95455 - RNA, 22 nt, Homo sapiens
ucacacugaaacuaggguguga

SEQ ID NO: 95456 - RNA, 22 nt, Homo sapiens
ucacacugaauuugaagcaaug

SEQ ID NO: 95457 - RNA, 22 nt, Homo sapiens
ucacagacugagccaaauagag

SEQ ID NO: 95458 - RNA, 21 nt, Homo sapiens
ucacagccuaggaccugaaga

SEQ ID NO: 95459 - RNA, 22 nt, Homo sapiens
ucacagccuaguuuuauacauu

SEQ ID NO: 95460 - RNA, 19 nt, Homo sapiens
ucacaggguugacuugagg

SEQ ID NO: 95461 - RNA, 22 nt, Homo sapiens
ucacaguaacuuuguugcuuuu

SEQ ID NO: 95462 - RNA, 22 nt, Homo sapiens
ucacaguagggaacugacaaag

SEQ ID NO: 95463 - RNA, 22 nt, Homo sapiens
ucacaguaucaugggggacaga

SEQ ID NO: 95464 - RNA, 20 nt, Homo sapiens
ucacagucacacauaauccu

SEQ ID NO: 95465 - RNA, 22 nt, Homo sapiens
ucacagucacugucacguugaa

SEQ ID NO: 95466 - RNA, 22 nt, Homo sapiens
ucacagugcaggaucaguuaau

SEQ ID NO: 95467 - RNA, 23 nt, Homo sapiens
ucacaguggcugcuuaauuguga

SEQ ID NO: 95468 - RNA, 22 nt, Homo sapiens
ucacaguguuaaaccuuucuuu

SEQ ID NO: 95469 - RNA, 22 nt, Homo sapiens
ucacauagcauaaugucugcaa

SEQ ID NO: 95470 - RNA, 20 nt, Homo sapiens
ucacauccucucccaacaug

SEQ ID NO: 95471 - RNA, 22 nt, Homo sapiens
ucacaucucagguuucuugaca

SEQ ID NO: 95472 - RNA, 18 nt, Homo sapiens
ucacauggccgagagaga

SEQ ID NO: 95473 - RNA, 22 nt, Homo sapiens
ucacaugugcguuuuggcaugu

SEQ ID NO: 95474 - RNA, 22 nt, Homo sapiens
ucacauuguguagccugcucac

SEQ ID NO: 95475 - RNA, 22 nt, Homo sapiens
ucaccaccugcugauuguagag

SEQ ID NO: 95476 - RNA, 22 nt, Homo sapiens
ucaccagugucagggaacugcu

SEQ ID NO: 95477 - RNA, 22 nt, Homo sapiens
ucaccuggagagcuugcuaaua

SEQ ID NO: 95478 - RNA, 22 nt, Homo sapiens
ucaccuggagccuucacauucu

SEQ ID NO: 95479 - RNA, 22 nt, Homo sapiens
ucaccuggggaucuuguuuaca

SEQ ID NO: 95480 - RNA, 22 nt, Homo sapiens
augugugcuugugacacagccu

SEQ ID NO: 95481 - RNA, 22 nt, Homo sapiens
auguuauguucuucucuguaua

SEQ ID NO: 95482 - RNA, 22 nt, Homo sapiens
auuaagugcuugcagaagucca

SEQ ID NO: 95483 - RNA, 22 nt, Homo sapiens
auuaaucaggcaaugcuugcua

SEQ ID NO: 95484 - RNA, 20 nt, Homo sapiens
auuagagcuacauggcuaca

SEQ ID NO: 95485 - RNA, 22 nt, Homo sapiens
auuagguauuuucuggacaggg

SEQ ID NO: 95486 - RNA, 22 nt, Homo sapiens
auuagguuaggcaaacuucugu

SEQ ID NO: 95487 - RNA, 22 nt, Homo sapiens
auuauuaguuguugaaugaagu

SEQ ID NO: 95488 - RNA, 22 nt, Homo sapiens
auucaacuaauuauugaagaug

SEQ ID NO: 95489 - RNA, 23 nt, Homo sapiens
auucaaguagugagagugguuau

SEQ ID NO: 95490 - RNA, 22 nt, Homo sapiens
auucacugugcuuggccaaauu

SEQ ID NO: 95491 - RNA, 22 nt, Homo sapiens
auucacuguggcuuucucugau

SEQ ID NO: 95492 - RNA, 22 nt, Homo sapiens
auucaucagggauauuggucug

SEQ ID NO: 95493 - RNA, 20 nt, Homo sapiens
auucauggaggagcaauugg

SEQ ID NO: 95494 - RNA, 22 nt, Homo sapiens
auuccacuuccacuaguuucuc

SEQ ID NO: 95495 - RNA, 21 nt, Homo sapiens
auuccacuuuuccuucaggga

SEQ ID NO: 95496 - RNA, 22 nt, Homo sapiens
auucccuuggucaacggaugca

SEQ ID NO: 95497 - RNA, 22 nt, Homo sapiens
auucuauaguccuaggauuggg

SEQ ID NO: 95498 - RNA, 22 nt, Homo sapiens
auugaacuguuggagagguuuu

SEQ ID NO: 95499 - RNA, 22 nt, Homo sapiens
auugaauuugguuugcuaagaa

SEQ ID NO: 95500 - RNA, 22 nt, Homo sapiens
auugacuugauauauagcugau

SEQ ID NO: 95501 - RNA, 22 nt, Homo sapiens
auugagacaaauuuguaugcag

SEQ ID NO: 95502 - RNA, 22 nt, Homo sapiens
auugagcuuuuuaaaauauagu

SEQ ID NO: 95503 - RNA, 22 nt, Homo sapiens
auugaggcauguaccaaugguc

SEQ ID NO: 95504 - RNA, 22 nt, Homo sapiens
auugagguauaauugcuaugca

SEQ ID NO: 95505 - RNA, 22 nt, Homo sapiens
auugaguaaaaaauagugaugu

SEQ ID NO: 95506 - RNA, 22 nt, Homo sapiens
auugaguaacaauuuuguucaa

SEQ ID NO: 95507 - RNA, 23 nt, Homo sapiens
auugauagugccuuugugcuaau

SEQ ID NO: 95508 - RNA, 22 nt, Homo sapiens
auugauaguuuaauaggaauug

SEQ ID NO: 95509 - RNA, 22 nt, Homo sapiens
auugcaauuaguccauagaguu

SEQ ID NO: 95510 - RNA, 22 nt, Homo sapiens
auugcacuccagcccgggugac

SEQ ID NO: 95511 - RNA, 22 nt, Homo sapiens
auugcacuccagccuagucaac

SEQ ID NO: 95512 - RNA, 22 nt, Homo sapiens
auugcacuccagccugcggaac

SEQ ID NO: 95513 - RNA, 22 nt, Homo sapiens
auugcacuccagccugggcaac

SEQ ID NO: 95514 - RNA, 22 nt, Homo sapiens
auugcacuccagccugggcagc

SEQ ID NO: 95515 - RNA, 22 nt, Homo sapiens
auugcacuccagccugggggac

SEQ ID NO: 95516 - RNA, 22 nt, Homo sapiens
auugcacuccagccugggugac

SEQ ID NO: 95517 - RNA, 22 nt, Homo sapiens
auugcacuccagccuugacaca

SEQ ID NO: 95518 - RNA, 22 nt, Homo sapiens
auugcacuccagccuugugaca

SEQ ID NO: 95519 - RNA, 22 nt, Homo sapiens
auugcacuccagcuuaggcgac

SEQ ID NO: 95520 - RNA, 22 nt, Homo sapiens
auugcacuccagcuugggugac

SEQ ID NO: 95521 - RNA, 18 nt, Homo sapiens
auugcacuccugccuggg

SEQ ID NO: 95522 - RNA, 23 nt, Homo sapiens
auugcagaaucacagagguagug

SEQ ID NO: 95523 - RNA, 22 nt, Homo sapiens
auugcauaaacacauuucuuau

SEQ ID NO: 95524 - RNA, 22 nt, Homo sapiens
auugccacaucucagaggcaga

SEQ ID NO: 95525 - RNA, 22 nt, Homo sapiens
auugcccauaaggauauuguca

SEQ ID NO: 95526 - RNA, 22 nt, Homo sapiens
auugccuaacauagauguucag

SEQ ID NO: 95527 - RNA, 22 nt, Homo sapiens
auugccucaauuccaagacugc

SEQ ID NO: 95528 - RNA, 22 nt, Homo sapiens
auugcuaacugaaauaagacca

SEQ ID NO: 95529 - RNA, 22 nt, Homo sapiens
auugcuauuauuugaccauugu

SEQ ID NO: 95530 - RNA, 22 nt, Homo sapiens
auugcuucugauuuuaaaugag

SEQ ID NO: 95531 - RNA, 22 nt, Homo sapiens
auuggacagcauuucuagacuu

SEQ ID NO: 95532 - RNA, 22 nt, Homo sapiens
auuggaguuguacgcacgcuca

SEQ ID NO: 95533 - RNA, 22 nt, Homo sapiens
auuggauagucuuuaucuguug

SEQ ID NO: 95534 - RNA, 22 nt, Homo sapiens
auuggcaagauagcauaugagg

SEQ ID NO: 95535 - RNA, 22 nt, Homo sapiens
auuggccccguuuuaaauguca

SEQ ID NO: 95536 - RNA, 22 nt, Homo sapiens
auuggcuuuugaaagucugcga

SEQ ID NO: 95537 - RNA, 22 nt, Homo sapiens
auuguacuccagccugggcaag

SEQ ID NO: 95538 - RNA, 22 nt, Homo sapiens
auuguacuccagccugggcagc

SEQ ID NO: 95539 - RNA, 22 nt, Homo sapiens
auuguacuccagccugggugac

SEQ ID NO: 95540 - RNA, 22 nt, Homo sapiens
auuguacucuagccucugggca

SEQ ID NO: 95541 - RNA, 22 nt, Homo sapiens
auugucacuuaaaagugcaugu

SEQ ID NO: 95542 - RNA, 22 nt, Homo sapiens
auugucccucuuaaucccagca

SEQ ID NO: 95543 - RNA, 20 nt, Homo sapiens
auuguccuugauuacacaga

SEQ ID NO: 95544 - RNA, 22 nt, Homo sapiens
auuucacugagacaugugccca

SEQ ID NO: 95545 - RNA, 22 nt, Homo sapiens
auuucacuucgcaugguguccg

SEQ ID NO: 95546 - RNA, 22 nt, Homo sapiens
auuucuacuccuguguccagaa

SEQ ID NO: 95547 - RNA, 21 nt, Homo sapiens
auuugcacugagcuccugugc

SEQ ID NO: 95548 - RNA, 22 nt, Homo sapiens
auuugguagaguucgauaccug

SEQ ID NO: 95549 - RNA, 21 nt, Homo sapiens
auuugguggcugugugacacu

SEQ ID NO: 95550 - RNA, 22 nt, Homo sapiens
auuugguugggugcgguggcuu

SEQ ID NO: 95551 - RNA, 22 nt, Homo sapiens
auuuguccugccuuuuccuccu

SEQ ID NO: 95552 - RNA, 18 nt, Homo sapiens
auuuuugcaguccacaug

SEQ ID NO: 95553 - RNA, 22 nt, Homo sapiens
auuuuugguuucaccugcacgc

SEQ ID NO: 95554 - RNA, 22 nt, Homo sapiens
caaaagugauugcgguuuuugc

SEQ ID NO: 95555 - RNA, 22 nt, Homo sapiens
caaagcacuuggcuuggaagau

SEQ ID NO: 95556 - RNA, 22 nt, Homo sapiens
caaagcuauagcaccagaggga

SEQ ID NO: 95557 - RNA, 22 nt, Homo sapiens
caaaguaauugugguuuugcca

SEQ ID NO: 95558 - RNA, 22 nt, Homo sapiens
caaagucuauucuacccuuacc

SEQ ID NO: 95559 - RNA, 22 nt, Homo sapiens
caaagugcuggaauuggccggg

SEQ ID NO: 95560 - RNA, 22 nt, Homo sapiens
caaagugcugggacuggccggg

SEQ ID NO: 95561 - RNA, 22 nt, Homo sapiens
caacacagugaaacccgucucu

SEQ ID NO: 95562 - RNA, 22 nt, Homo sapiens
caacugguuuuauacaguuuag

SEQ ID NO: 95563 - RNA, 22 nt, Homo sapiens
caagagagcugaugguuuuaaa

SEQ ID NO: 95564 - RNA, 22 nt, Homo sapiens
caaggugcugagacaggagccc

SEQ ID NO: 95565 - RNA, 22 nt, Homo sapiens
caagugacugagccgccucggc

SEQ ID NO: 95566 - RNA, 21 nt, Homo sapiens
caaugacacuguagcugugcu

SEQ ID NO: 95567 - RNA, 21 nt, Homo sapiens
caauggcacaaucucugcuca

SEQ ID NO: 95568 - RNA, 22 nt, Homo sapiens
caaugguacuagauaucuucag

SEQ ID NO: 95569 - RNA, 22 nt, Homo sapiens
cacacugucuuucagaaugguu

SEQ ID NO: 95570 - RNA, 22 nt, Homo sapiens
ugacauuacagucacuugcugu

SEQ ID NO: 95571 - RNA, 22 nt, Homo sapiens
ugaccaaugacauugaagagcu

SEQ ID NO: 95572 - RNA, 22 nt, Homo sapiens
ugaccagaaaacaaauuaguuu

SEQ ID NO: 95573 - RNA, 22 nt, Homo sapiens
ugacggaggcauuggaagcuug

SEQ ID NO: 95574 - RNA, 22 nt, Homo sapiens
ugacuacaccacacgguuaagg

SEQ ID NO: 95575 - RNA, 22 nt, Homo sapiens
ugacuacauaaguaaucucaaa

SEQ ID NO: 95576 - RNA, 22 nt, Homo sapiens
ugacuagagcaauuggaaacaa

SEQ ID NO: 95577 - RNA, 22 nt, Homo sapiens
ugacuagagggcuuuuguguag

SEQ ID NO: 95578 - RNA, 22 nt, Homo sapiens
ugacuagggacauucuuccacg

SEQ ID NO: 95579 - RNA, 22 nt, Homo sapiens
ugacuaggggcccuggcuucuu

SEQ ID NO: 95580 - RNA, 22 nt, Homo sapiens
ugacuagucauaggcauggggg

SEQ ID NO: 95581 - RNA, 22 nt, Homo sapiens
ugacuauaucucuguauaaacu

SEQ ID NO: 95582 - RNA, 22 nt, Homo sapiens
ugacucaguuucucagguagua

SEQ ID NO: 95583 - RNA, 22 nt, Homo sapiens
ugacuucauuugguaauugggu

SEQ ID NO: 95584 - RNA, 22 nt, Homo sapiens
ugacuugaaguuaccauaugca

SEQ ID NO: 95585 - RNA, 22 nt, Homo sapiens
ugacuugaucacccccuaaggg

SEQ ID NO: 95586 - RNA, 22 nt, Homo sapiens
ugagaacaugugauauuuggug

SEQ ID NO: 95587 - RNA, 19 nt, Homo sapiens
ugagaacaugugguauuug

SEQ ID NO: 95588 - RNA, 22 nt, Homo sapiens
ugagaacauuccucuuccuggc

SEQ ID NO: 95589 - RNA, 22 nt, Homo sapiens
ugagaauauuugaagauguuag

SEQ ID NO: 95590 - RNA, 22 nt, Homo sapiens
ugagaauauuuuccaugucuca

SEQ ID NO: 95591 - RNA, 22 nt, Homo sapiens
ugagaaugacugggcaugcugc

SEQ ID NO: 95592 - RNA, 19 nt, Homo sapiens
ugagaauguuaccaggucc

SEQ ID NO: 95593 - RNA, 22 nt, Homo sapiens
ugagacaaaguuguuggauguu

SEQ ID NO: 95594 - RNA, 21 nt, Homo sapiens
ugagacaauccuggucaauau

SEQ ID NO: 95595 - RNA, 22 nt, Homo sapiens
ugagacaaucucaucucaguga

SEQ ID NO: 95596 - RNA, 22 nt, Homo sapiens
ugagacacugaauccggccuga

SEQ ID NO: 95597 - RNA, 22 nt, Homo sapiens
ugagacaugugaacuguaguuc

SEQ ID NO: 95598 - RNA, 22 nt, Homo sapiens
ugagacggagucucgcucucua

SEQ ID NO: 95599 - RNA, 22 nt, Homo sapiens
ugagacggagucucgcucuguc

SEQ ID NO: 95600 - RNA, 22 nt, Homo sapiens
ugagacggagucuggcacuguc

SEQ ID NO: 95601 - RNA, 22 nt, Homo sapiens
ugagacugaaauuaggaaacug

SEQ ID NO: 95602 - RNA, 22 nt, Homo sapiens
ugagacugaguuucgcucuugu

SEQ ID NO: 95603 - RNA, 22 nt, Homo sapiens
ugagacugaguuuugcucuugu

SEQ ID NO: 95604 - RNA, 22 nt, Homo sapiens
ugagacugguaauguguagggc

SEQ ID NO: 95605 - RNA, 22 nt, Homo sapiens
ugagagacaguuucgucggagg

SEQ ID NO: 95606 - RNA, 21 nt, Homo sapiens
ugagaguaguguauuauucuc

SEQ ID NO: 95607 - RNA, 22 nt, Homo sapiens
ugagagucacugaccugguaua

SEQ ID NO: 95608 - RNA, 22 nt, Homo sapiens
ugagauaaugcaugugaagauc

SEQ ID NO: 95609 - RNA, 18 nt, Homo sapiens
ugagauacuagaauaggu

SEQ ID NO: 95610 - RNA, 22 nt, Homo sapiens
ugagauaggaucuugcucuguu

SEQ ID NO: 95611 - RNA, 22 nt, Homo sapiens
ugagauagggucucacucuguc

SEQ ID NO: 95612 - RNA, 22 nt, Homo sapiens
ugagauaguacuuuuuuaaagg

SEQ ID NO: 95613 - RNA, 22 nt, Homo sapiens
ugagauauauauauuugagaca

SEQ ID NO: 95614 - RNA, 22 nt, Homo sapiens
ugagauaucauuucacacccag

SEQ ID NO: 95615 - RNA, 20 nt, Homo sapiens
ugagauccacgugaaguaug

SEQ ID NO: 95616 - RNA, 22 nt, Homo sapiens
ugagauccaugcuauuugggcu

SEQ ID NO: 95617 - RNA, 22 nt, Homo sapiens
ugagauccugugacuacacuga

SEQ ID NO: 95618 - RNA, 23 nt, Homo sapiens
ugagaucuacagaucucagaucu

SEQ ID NO: 95619 - RNA, 22 nt, Homo sapiens
ugagaucuguaaagucugacau

SEQ ID NO: 95620 - RNA, 22 nt, Homo sapiens
ugagaucuuugcuguccucacc

SEQ ID NO: 95621 - RNA, 22 nt, Homo sapiens
ugagaugagaaucaguucuaau

SEQ ID NO: 95622 - RNA, 22 nt, Homo sapiens
ugagaugagggaagccuaggca

SEQ ID NO: 95623 - RNA, 22 nt, Homo sapiens
ugagaugaggucucacucuguu

SEQ ID NO: 95624 - RNA, 22 nt, Homo sapiens
ugagaugaguugcuggcucuga

SEQ ID NO: 95625 - RNA, 22 nt, Homo sapiens
ugagaugauaucuuauuguaau

SEQ ID NO: 95626 - RNA, 22 nt, Homo sapiens
ugagaugaucaaaguauaggcu

SEQ ID NO: 95627 - RNA, 22 nt, Homo sapiens
ugagaugcaaaaugagaauugu

SEQ ID NO: 95628 - RNA, 22 nt, Homo sapiens
ugagaugcucgccggccagcau

SEQ ID NO: 95629 - RNA, 22 nt, Homo sapiens
ugagauggagucuugucgccua

SEQ ID NO: 95630 - RNA, 22 nt, Homo sapiens
ugagauggguaauuaaauggug

SEQ ID NO: 95631 - RNA, 22 nt, Homo sapiens
ugagauguggcuagagagguug

SEQ ID NO: 95632 - RNA, 22 nt, Homo sapiens
ugagauguguccagaucuaguu

SEQ ID NO: 95633 - RNA, 22 nt, Homo sapiens
ugagauuacguucggcccacuu

SEQ ID NO: 95634 - RNA, 21 nt, Homo sapiens
ugagauuauauuaacauggua

SEQ ID NO: 95635 - RNA, 22 nt, Homo sapiens
ugagauucucugauuguagguc

SEQ ID NO: 95636 - RNA, 22 nt, Homo sapiens
ugagauuguaucugcaaugugu

SEQ ID NO: 95637 - RNA, 22 nt, Homo sapiens
ugagcaacauuucaaaacucca

SEQ ID NO: 95638 - RNA, 22 nt, Homo sapiens
ugagcacaggugcgcgguuacu

SEQ ID NO: 95639 - RNA, 22 nt, Homo sapiens
ugagcagaaagcugcaaggucg

SEQ ID NO: 95640 - RNA, 22 nt, Homo sapiens
ugagcagaaguuuugauuggcg

SEQ ID NO: 95641 - RNA, 22 nt, Homo sapiens
ugagcagagaagugcccugcgc

SEQ ID NO: 95642 - RNA, 22 nt, Homo sapiens
ugagcagagaucacggcauugu

SEQ ID NO: 95643 - RNA, 22 nt, Homo sapiens
ugagcagagggagaaguaaauu

SEQ ID NO: 95644 - RNA, 22 nt, Homo sapiens
ugagcagaguuguuucuccuga

SEQ ID NO: 95645 - RNA, 22 nt, Homo sapiens
ugagcaucauucacaccuuggu

SEQ ID NO: 95646 - RNA, 22 nt, Homo sapiens
ugagccauggcaccuugucuaa

SEQ ID NO: 95647 - RNA, 22 nt, Homo sapiens
ugagcccauuguccugguuuau

SEQ ID NO: 95648 - RNA, 22 nt, Homo sapiens
ugagcuaggucuugcucuguca

SEQ ID NO: 95649 - RNA, 22 nt, Homo sapiens
ugagcucagcuaguugaggugu

SEQ ID NO: 95650 - RNA, 22 nt, Homo sapiens
ugagcugagaucgugccauugu

SEQ ID NO: 95651 - RNA, 22 nt, Homo sapiens
ugagcugagaucuuaccacugc

SEQ ID NO: 95652 - RNA, 22 nt, Homo sapiens
ugagcuguuugaagaagcauuu

SEQ ID NO: 95653 - RNA, 20 nt, Homo sapiens
ugagcuuguaaacacuguuu

SEQ ID NO: 95654 - RNA, 22 nt, Homo sapiens
ugaggaacuagcuacccuaaua

SEQ ID NO: 95655 - RNA, 22 nt, Homo sapiens
ugaggaguguauuucauucgcu

SEQ ID NO: 95656 - RNA, 22 nt, Homo sapiens
ugaggcacucccuagcggggug

SEQ ID NO: 95657 - RNA, 22 nt, Homo sapiens
ugaggcacucuagacuuauuca

SEQ ID NO: 95658 - RNA, 22 nt, Homo sapiens
ugagguaacagaagcgagcauu

SEQ ID NO: 95659 - RNA, 22 nt, Homo sapiens
ugagguaauagauaauauuuuu

SEQ ID NO: 95660 - RNA, 22 nt, Homo sapiens
ugagguaaugcuguagcuguga

SEQ ID NO: 95661 - RNA, 22 nt, Homo sapiens
ugagguacaacauggacugaag

SEQ ID NO: 95662 - RNA, 22 nt, Homo sapiens
ugagguaugacuuauuauucuu

SEQ ID NO: 95663 - RNA, 22 nt, Homo sapiens
ugagguauuuuguuaugcagcc

SEQ ID NO: 95664 - RNA, 22 nt, Homo sapiens
ugagguguuaacuuuacuuuua

SEQ ID NO: 95665 - RNA, 22 nt, Homo sapiens
ugagguguuugugcaccaucug

SEQ ID NO: 95666 - RNA, 22 nt, Homo sapiens
ugagguuauuuguucaagaagu

SEQ ID NO: 95667 - RNA, 22 nt, Homo sapiens
ugagguuggguaauuuaugaag

SEQ ID NO: 95668 - RNA, 22 nt, Homo sapiens
ugaguacuacuaguuacugcua

SEQ ID NO: 95669 - RNA, 22 nt, Homo sapiens
ugaguagaacuagucuagagcu

SEQ ID NO: 95670 - RNA, 20 nt, Homo sapiens
ugaguagaggaguucuauca

SEQ ID NO: 95671 - RNA, 22 nt, Homo sapiens
ugaguagcuaagacgauaggca

SEQ ID NO: 95672 - RNA, 22 nt, Homo sapiens
ugaguaggauugguauuucuuc

SEQ ID NO: 95673 - RNA, 22 nt, Homo sapiens
ugaguagucagugggcaggaag

SEQ ID NO: 95674 - RNA, 22 nt, Homo sapiens
ugaguauagaucaguucaagug

SEQ ID NO: 95675 - RNA, 22 nt, Homo sapiens
ugagucaauggaggcucagagc

SEQ ID NO: 95676 - RNA, 22 nt, Homo sapiens
ugagucaauucuaacaauggca

SEQ ID NO: 95677 - RNA, 23 nt, Homo sapiens
ugagucacuuugcuggggucucu

SEQ ID NO: 95678 - RNA, 22 nt, Homo sapiens
ugagucgagauugcgccacugu

SEQ ID NO: 95679 - RNA, 22 nt, Homo sapiens
ugagugaaagaagcacuaagga

SEQ ID NO: 95680 - RNA, 21 nt, Homo sapiens
ugagugcugagugaggguuga

SEQ ID NO: 95681 - RNA, 22 nt, Homo sapiens
ugaguuaaucucuacgauagaa

SEQ ID NO: 95682 - RNA, 17 nt, Homo sapiens
ugaguuaaucuuugugc

SEQ ID NO: 95683 - RNA, 22 nt, Homo sapiens
ugaguuaggagaguguggcucu

SEQ ID NO: 95684 - RNA, 22 nt, Homo sapiens
ugaguuagguguuuuaaauaua

SEQ ID NO: 95685 - RNA, 22 nt, Homo sapiens
ugaguucaugcuuguaguucua

SEQ ID NO: 95686 - RNA, 22 nt, Homo sapiens
ugaguucuuuguagauucugug

SEQ ID NO: 95687 - RNA, 22 nt, Homo sapiens
uaucucagaugagacuuguaac

SEQ ID NO: 95688 - RNA, 20 nt, Homo sapiens
uaucucaguuuguccuaaac

SEQ ID NO: 95689 - RNA, 22 nt, Homo sapiens
uaucucuuuucauguguaaaug

SEQ ID NO: 95690 - RNA, 22 nt, Homo sapiens
uugguaaucccuagugucuaga

SEQ ID NO: 95691 - RNA, 22 nt, Homo sapiens
uugguaugaaaaggaauuagac

SEQ ID NO: 95692 - RNA, 22 nt, Homo sapiens
uuggucaggcuaaucucgaacg

SEQ ID NO: 95693 - RNA, 21 nt, Homo sapiens
uugguccacaugucauaguua

SEQ ID NO: 95694 - RNA, 22 nt, Homo sapiens
uugguccccuucaaccagcugu

SEQ ID NO: 95695 - RNA, 19 nt, Homo sapiens
uuggucccuuuggguucuu

SEQ ID NO: 95696 - RNA, 22 nt, Homo sapiens
uuggucugcucugauguuuucu

SEQ ID NO: 95697 - RNA, 22 nt, Homo sapiens
uuggucuucuaauguaccuguu

SEQ ID NO: 95698 - RNA, 21 nt, Homo sapiens
uuggucuucucugugauucuu

SEQ ID NO: 95699 - RNA, 22 nt, Homo sapiens
uugguucucuuuauaugcugga

SEQ ID NO: 95700 - RNA, 22 nt, Homo sapiens
uuguacuagucauauuuugaaa

SEQ ID NO: 95701 - RNA, 22 nt, Homo sapiens
uuguacuucagacaugccaaag

SEQ ID NO: 95702 - RNA, 22 nt, Homo sapiens
uuguagaucuucaguugcuaca

SEQ ID NO: 95703 - RNA, 22 nt, Homo sapiens
uuguagcaaauauauuuuggaa

SEQ ID NO: 95704 - RNA, 22 nt, Homo sapiens
uuguagcuuuuuaaugugcugc

SEQ ID NO: 95705 - RNA, 22 nt, Homo sapiens
uuguauguuucugugcacauga

SEQ ID NO: 95706 - RNA, 22 nt, Homo sapiens
uuguauguuuguucuuucagau

SEQ ID NO: 95707 - RNA, 22 nt, Homo sapiens
uugucacucuuccuaggguagg

SEQ ID NO: 95708 - RNA, 22 nt, Homo sapiens
uugucauggucuugauccauua

SEQ ID NO: 95709 - RNA, 22 nt, Homo sapiens
uugucauuuucagaguguuacg

SEQ ID NO: 95710 - RNA, 23 nt, Homo sapiens
uuguccccuccaaagcucauguu

SEQ ID NO: 95711 - RNA, 19 nt, Homo sapiens
uuguccccucuaaaucuca

SEQ ID NO: 95712 - RNA, 22 nt, Homo sapiens
uuguccuccacauuugaucagu

SEQ ID NO: 95713 - RNA, 22 nt, Homo sapiens
uugucuagugaauacauuaaug

SEQ ID NO: 95714 - RNA, 19 nt, Homo sapiens
uugucuuagaguugucauu

SEQ ID NO: 95715 - RNA, 22 nt, Homo sapiens
uugugaauggugccacaauaaa

SEQ ID NO: 95716 - RNA, 22 nt, Homo sapiens
uugugagggagcuaagaugagu

SEQ ID NO: 95717 - RNA, 22 nt, Homo sapiens
uugugaguggugccgcaauaaa

SEQ ID NO: 95718 - RNA, 22 nt, Homo sapiens
uugugauugagugauccuuguu

SEQ ID NO: 95719 - RNA, 22 nt, Homo sapiens
uugugcauaucagagguuugcu

SEQ ID NO: 95720 - RNA, 22 nt, Homo sapiens
uugugcauguauauuaguucac

SEQ ID NO: 95721 - RNA, 20 nt, Homo sapiens
uugugcauugggccauuggg

SEQ ID NO: 95722 - RNA, 22 nt, Homo sapiens
uugugccacugaagcccuccag

SEQ ID NO: 95723 - RNA, 18 nt, Homo sapiens
uugugccugagaaggugg

SEQ ID NO: 95724 - RNA, 22 nt, Homo sapiens
uugugcuuuuuaaauagcuucc

SEQ ID NO: 95725 - RNA, 22 nt, Homo sapiens
uuguggcuuaucucauuuagcg

SEQ ID NO: 95726 - RNA, 22 nt, Homo sapiens
uugugguaggcauguaagauga

SEQ ID NO: 95727 - RNA, 22 nt, Homo sapiens
uugugguugaugaagacugucu

SEQ ID NO: 95728 - RNA, 22 nt, Homo sapiens
uuguguacuacaguaugccaca

SEQ ID NO: 95729 - RNA, 22 nt, Homo sapiens
uugugucaaauggcaauuagca

SEQ ID NO: 95730 - RNA, 19 nt, Homo sapiens
uuguguccccacaaaauuc

SEQ ID NO: 95731 - RNA, 22 nt, Homo sapiens
uuguguccccacccaaauuuca

SEQ ID NO: 95732 - RNA, 22 nt, Homo sapiens
uuguuaugggguggcuugaaag

SEQ ID NO: 95733 - RNA, 22 nt, Homo sapiens
uuguuauguuggucaguaaugu

SEQ ID NO: 95734 - RNA, 23 nt, Homo sapiens
uuguucccuuccacucagucucc

SEQ ID NO: 95735 - RNA, 22 nt, Homo sapiens
uuuaaacugucuuggguuugga

SEQ ID NO: 95736 - RNA, 22 nt, Homo sapiens
uuuaacauuggaugagaucguc

SEQ ID NO: 95737 - RNA, 20 nt, Homo sapiens
uuuaagacaugcugaauuga

SEQ ID NO: 95738 - RNA, 22 nt, Homo sapiens
uuuaagguauguggugaaaauu

SEQ ID NO: 95739 - RNA, 22 nt, Homo sapiens
uuuaaguguuuguuccugaaaa

SEQ ID NO: 95740 - RNA, 17 nt, Homo sapiens
uuuaaugcuaggacucu

SEQ ID NO: 95741 - RNA, 18 nt, Homo sapiens
uuuacaguagaaggacuu

SEQ ID NO: 95742 - RNA, 22 nt, Homo sapiens
uuuacagucuuuugugugaguc

SEQ ID NO: 95743 - RNA, 22 nt, Homo sapiens
uuuagcgaaugcuugcuccugu

SEQ ID NO: 95744 - RNA, 22 nt, Homo sapiens
uuuagcucauucaauuucaguc

SEQ ID NO: 95745 - RNA, 22 nt, Homo sapiens
uuuaggcaugcaguucuauuua

SEQ ID NO: 95746 - RNA, 22 nt, Homo sapiens
uuuagggcaggccuggugguga

SEQ ID NO: 95747 - RNA, 22 nt, Homo sapiens
uuuaguucauuaaggaaucucc

SEQ ID NO: 95748 - RNA, 23 nt, Homo sapiens
uuuauacguugucauuuaucagg

SEQ ID NO: 95749 - RNA, 22 nt, Homo sapiens
uuuauagucaggaacuugagga

SEQ ID NO: 95750 - RNA, 22 nt, Homo sapiens
uuuaugcuacauguguuggaaa

SEQ ID NO: 95751 - RNA, 22 nt, Homo sapiens
uuuauggagagauauuuauggu

SEQ ID NO: 95752 - RNA, 18 nt, Homo sapiens
uuucaagucuuaggugac

SEQ ID NO: 95753 - RNA, 19 nt, Homo sapiens
uuucacacucgccuacuuc

SEQ ID NO: 95754 - RNA, 22 nt, Homo sapiens
uuucacagcugucuuccgucuc

SEQ ID NO: 95755 - RNA, 22 nt, Homo sapiens
uuucaccguguuggccaggcug

SEQ ID NO: 95756 - RNA, 22 nt, Homo sapiens
uuucacuagccagcccuuuauu

SEQ ID NO: 95757 - RNA, 20 nt, Homo sapiens
uuucaguacuuucuacuggc

SEQ ID NO: 95758 - RNA, 22 nt, Homo sapiens
uuucaguguggcaggcauagcu

SEQ ID NO: 95759 - RNA, 22 nt, Homo sapiens
uuucauagccuucuaaugaguu

SEQ ID NO: 95760 - RNA, 18 nt, Homo sapiens
uuucauugagugugauau

SEQ ID NO: 95761 - RNA, 22 nt, Homo sapiens
uuuccacauggacuuaccuucg

SEQ ID NO: 95762 - RNA, 22 nt, Homo sapiens
uuucccagugguacaguuuaua

SEQ ID NO: 95763 - RNA, 22 nt, Homo sapiens
uuucccauuguucugcucugug

SEQ ID NO: 95764 - RNA, 22 nt, Homo sapiens
uuucccugaaggcucugaaguc

SEQ ID NO: 95765 - RNA, 19 nt, Homo sapiens
uuucccugcagaccuacua

SEQ ID NO: 95766 - RNA, 22 nt, Homo sapiens
uuucccuuacuuaaacuuacuc

SEQ ID NO: 95767 - RNA, 22 nt, Homo sapiens
uuuccuggagaaucuuaacaaa

SEQ ID NO: 95768 - RNA, 22 nt, Homo sapiens
uuucuauguugaccagucuaga

SEQ ID NO: 95769 - RNA, 16 nt, Homo sapiens
uuucuauguuuuacua

SEQ ID NO: 95770 - RNA, 22 nt, Homo sapiens
uuucugguuaauuucuaagagc

SEQ ID NO: 95771 - RNA, 22 nt, Homo sapiens
uuucugugguccucuugaaggu

SEQ ID NO: 95772 - RNA, 23 nt, Homo sapiens
uuucuugggcaugcuaugucagu

SEQ ID NO: 95773 - RNA, 22 nt, Homo sapiens
uuugacuagaguguuuuacaac

SEQ ID NO: 95774 - RNA, 22 nt, Homo sapiens
uuugagaucuuuagaaucaggc

SEQ ID NO: 95775 - RNA, 22 nt, Homo sapiens
uuugaggaaaggcauaaguagg

SEQ ID NO: 95776 - RNA, 22 nt, Homo sapiens
uuugagguguauggcaaguuga

SEQ ID NO: 95777 - RNA, 22 nt, Homo sapiens
uuugagugugauaucgauugga

SEQ ID NO: 95778 - RNA, 21 nt, Homo sapiens
uuugaucauuaaaagugaauc

SEQ ID NO: 95779 - RNA, 22 nt, Homo sapiens
uccaguggacagacauaccaug

SEQ ID NO: 95780 - RNA, 22 nt, Homo sapiens
uccaguguuucuuccacuauuu

SEQ ID NO: 95781 - RNA, 22 nt, Homo sapiens
uccaguuuggaggcuugaugug

SEQ ID NO: 95782 - RNA, 20 nt, Homo sapiens
uccaguuuuggagacauucu

SEQ ID NO: 95783 - RNA, 19 nt, Homo sapiens
uccaugagcccacagugau

SEQ ID NO: 95784 - RNA, 22 nt, Homo sapiens
uccauguagaagacaggggaga

SEQ ID NO: 95785 - RNA, 22 nt, Homo sapiens
uccauguagaugcuauguuguc

SEQ ID NO: 95786 - RNA, 18 nt, Homo sapiens
uccauuuguaugggaugg

SEQ ID NO: 95787 - RNA, 22 nt, Homo sapiens
uccauuugucuauguuucuguu

SEQ ID NO: 95788 - RNA, 23 nt, Homo sapiens
ucccaagauggaccagaccaagg

SEQ ID NO: 95789 - RNA, 22 nt, Homo sapiens
ucccaguggucuugaaacaggg

SEQ ID NO: 95790 - RNA, 22 nt, Homo sapiens
ucccauguagcuaggauuacag

SEQ ID NO: 95791 - RNA, 22 nt, Homo sapiens
uccccgagcccaggcugugacu

SEQ ID NO: 95792 - RNA, 22 nt, Homo sapiens
uccccggaugacggccgcuuca

SEQ ID NO: 95793 - RNA, 19 nt, Homo sapiens
uccccgggucuagugcagc

SEQ ID NO: 95794 - RNA, 22 nt, Homo sapiens
uccccugagucaccugcuucuc

SEQ ID NO: 95795 - RNA, 22 nt, Homo sapiens
uccccuuuguaagauggaaacg

SEQ ID NO: 95796 - RNA, 22 nt, Homo sapiens
ucccgaggacaucugggggcaa

SEQ ID NO: 95797 - RNA, 22 nt, Homo sapiens
ucccuagagaagugauuuuuga

SEQ ID NO: 95798 - RNA, 18 nt, Homo sapiens
ucccucagaauuauagaa

SEQ ID NO: 95799 - RNA, 22 nt, Homo sapiens
ucccugaaagcugagauuggaa

SEQ ID NO: 95800 - RNA, 22 nt, Homo sapiens
ucccugacagggucugagcuuu

SEQ ID NO: 95801 - RNA, 22 nt, Homo sapiens
ucccugaguaucuaauguguuu

SEQ ID NO: 95802 - RNA, 17 nt, Homo sapiens
ucccuguuuuuucaguc

SEQ ID NO: 95803 - RNA, 22 nt, Homo sapiens
ucccuuaaugaugaacaaugag

SEQ ID NO: 95804 - RNA, 22 nt, Homo sapiens
ucccuuuguccaacggauccac

SEQ ID NO: 95805 - RNA, 22 nt, Homo sapiens
uccucauggagaaccucugcua

SEQ ID NO: 95806 - RNA, 22 nt, Homo sapiens
uccugauacgguugcaguucuc

SEQ ID NO: 95807 - RNA, 22 nt, Homo sapiens
uccugcauucugacuugcuuuc

SEQ ID NO: 95808 - RNA, 22 nt, Homo sapiens
uccuugagaggacagagccaua

SEQ ID NO: 95809 - RNA, 22 nt, Homo sapiens
uccuugagccugggaguuauag

SEQ ID NO: 95810 - RNA, 22 nt, Homo sapiens
uccuugagccuuaaauuauaaa

SEQ ID NO: 95811 - RNA, 22 nt, Homo sapiens
uccuuggucaaaaagaaagugu

SEQ ID NO: 95812 - RNA, 23 nt, Homo sapiens
uccuugguuggcgcccuaugugu

SEQ ID NO: 95813 - RNA, 22 nt, Homo sapiens
uccuuuggguagcuguucagau

SEQ ID NO: 95814 - RNA, 23 nt, Homo sapiens
ucgcagcauucaauaccaggcag

SEQ ID NO: 95815 - RNA, 19 nt, Homo sapiens
ucgcgccauucuccugccu

SEQ ID NO: 95816 - RNA, 22 nt, Homo sapiens
ucuaaaguacuacuacuguugg

SEQ ID NO: 95817 - RNA, 19 nt, Homo sapiens
ucuaaaucucuugauagac

SEQ ID NO: 95818 - RNA, 22 nt, Homo sapiens
ucuaagaauucauuuauaagcc

SEQ ID NO: 95819 - RNA, 22 nt, Homo sapiens
ucuacagccaguucaggaagaa

SEQ ID NO: 95820 - RNA, 22 nt, Homo sapiens
ucuauggaguuugaaugagaaa

SEQ ID NO: 95821 - RNA, 22 nt, Homo sapiens
ucuauguuuuugcuaguagugu

SEQ ID NO: 95822 - RNA, 22 nt, Homo sapiens
ucucaaguaacugggacaauaa

SEQ ID NO: 95823 - RNA, 22 nt, Homo sapiens
ucucaauggguuguagacaaag

SEQ ID NO: 95824 - RNA, 22 nt, Homo sapiens
ucucaguguuaucuaucugccu

SEQ ID NO: 95825 - RNA, 21 nt, Homo sapiens
ucucauagaguuucacuuucu

SEQ ID NO: 95826 - RNA, 22 nt, Homo sapiens
ucucauggagucaggagcagaa

SEQ ID NO: 95827 - RNA, 22 nt, Homo sapiens
ucucauggcucacccugcauag

SEQ ID NO: 95828 - RNA, 22 nt, Homo sapiens
ucuccaguuuccuucgucuauc

SEQ ID NO: 95829 - RNA, 22 nt, Homo sapiens
ucuccauuguccagaugaggaa

SEQ ID NO: 95830 - RNA, 22 nt, Homo sapiens
ucuccauuuguaaggguuucuc

SEQ ID NO: 95831 - RNA, 22 nt, Homo sapiens
ucucccuaccugagccgagcca

SEQ ID NO: 95832 - RNA, 22 nt, Homo sapiens
ucucugacacugaccccaaaaa

SEQ ID NO: 95833 - RNA, 22 nt, Homo sapiens
ucucugguuuguggaaucuuag

SEQ ID NO: 95834 - RNA, 22 nt, Homo sapiens
ucucugguuuucaaagcaguau

SEQ ID NO: 95835 - RNA, 22 nt, Homo sapiens
ucucuguuuauuuuugguguau

SEQ ID NO: 95836 - RNA, 22 nt, Homo sapiens
ucucuuggcggaaguugcagug

SEQ ID NO: 95837 - RNA, 22 nt, Homo sapiens
ucucuuggugacuuaaaauguu

SEQ ID NO: 95838 - RNA, 22 nt, Homo sapiens
ucucuugguugaacaguuugga

SEQ ID NO: 95839 - RNA, 22 nt, Homo sapiens
ucugacacagugauuaguaaau

SEQ ID NO: 95840 - RNA, 22 nt, Homo sapiens
ucugacucugugaugggcccaa

SEQ ID NO: 95841 - RNA, 22 nt, Homo sapiens
ucugccaaccacaaaauuuauu

SEQ ID NO: 95842 - RNA, 22 nt, Homo sapiens
ucugccuacugguuggaggaac

SEQ ID NO: 95843 - RNA, 23 nt, Homo sapiens
ucugcggguguggacccuagugc

SEQ ID NO: 95844 - RNA, 22 nt, Homo sapiens
ucuggaauguaaaguuuauggg

SEQ ID NO: 95845 - RNA, 22 nt, Homo sapiens
ucuggagugugaaguggauaug

SEQ ID NO: 95846 - RNA, 23 nt, Homo sapiens
ucuggaucauucguagugccagc

SEQ ID NO: 95847 - RNA, 22 nt, Homo sapiens
ucuggcaagauauccauugcuu

SEQ ID NO: 95848 - RNA, 22 nt, Homo sapiens
ucuggcauuuucucugcuugca

SEQ ID NO: 95849 - RNA, 22 nt, Homo sapiens
ucuggccuccuaugagaaucga

SEQ ID NO: 95850 - RNA, 16 nt, Homo sapiens
ucuggcucuacaguuc

SEQ ID NO: 95851 - RNA, 15 nt, Homo sapiens
ucuggcucugucacu

SEQ ID NO: 95852 - RNA, 22 nt, Homo sapiens
ucuggcuuauuucacuuagcau

SEQ ID NO: 95853 - RNA, 22 nt, Homo sapiens
ggcaaguucuaaugauuagaau

SEQ ID NO: 95854 - RNA, 22 nt, Homo sapiens
ggcaauauuauuaacccucugu

SEQ ID NO: 95855 - RNA, 22 nt, Homo sapiens
ggcaaugaggcggaccagcagg

SEQ ID NO: 95856 - RNA, 22 nt, Homo sapiens
ggcacaaugucagcucacugca

SEQ ID NO: 95857 - RNA, 22 nt, Homo sapiens
ggcacgguggcucacaccugua

SEQ ID NO: 95858 - RNA, 22 nt, Homo sapiens
ggcacgguggcucacgccugua

SEQ ID NO: 95859 - RNA, 22 nt, Homo sapiens
ggcacuguugccggccugaauu

SEQ ID NO: 95860 - RNA, 22 nt, Homo sapiens
ggcagaauugcugaggaugcua

SEQ ID NO: 95861 - RNA, 22 nt, Homo sapiens
ggcagcaugggugccuuuguga

SEQ ID NO: 95862 - RNA, 22 nt, Homo sapiens
ggcagcgugguggauugaaaau

SEQ ID NO: 95863 - RNA, 22 nt, Homo sapiens
ggcagcuguguccuucguaagg

SEQ ID NO: 95864 - RNA, 17 nt, Homo sapiens
ggcaggaauuaauguca

SEQ ID NO: 95865 - RNA, 17 nt, Homo sapiens
ggcaggauccaggaucc

SEQ ID NO: 95866 - RNA, 23 nt, Homo sapiens
ggcagguuggucuaggucuauuc

SEQ ID NO: 95867 - RNA, 22 nt, Homo sapiens
ggcaguguaauaauuuauuaau

SEQ ID NO: 95868 - RNA, 22 nt, Homo sapiens
ggcaguguuauuauauuuuugg

SEQ ID NO: 95869 - RNA, 22 nt, Homo sapiens
ggcaguuuggcaguuucauaaa

SEQ ID NO: 95870 - RNA, 22 nt, Homo sapiens
ggcauguugauagguagaugua

SEQ ID NO: 95871 - RNA, 22 nt, Homo sapiens
ggcauguuuaguagaauguggu

SEQ ID NO: 95872 - RNA, 23 nt, Homo sapiens
ggcauuguggcucacaucuguaa

SEQ ID NO: 95873 - RNA, 22 nt, Homo sapiens
ggcccaguugcgggugguaccg

SEQ ID NO: 95874 - RNA, 22 nt, Homo sapiens
ggcccugagacaggaaaaagcu

SEQ ID NO: 95875 - RNA, 22 nt, Homo sapiens
ggccugaugaaauguuagagua

SEQ ID NO: 95876 - RNA, 22 nt, Homo sapiens
ggcuagagagcucagggauaug

SEQ ID NO: 95877 - RNA, 22 nt, Homo sapiens
ggcuauagauaugugaacacuu

SEQ ID NO: 95878 - RNA, 22 nt, Homo sapiens
ggcucagugggguccugguucu

SEQ ID NO: 95879 - RNA, 22 nt, Homo sapiens
gggaaaaugucuauugaaugaa

SEQ ID NO: 95880 - RNA, 22 nt, Homo sapiens
gggaacaugagaaugugaauga

SEQ ID NO: 95881 - RNA, 22 nt, Homo sapiens
gggaagugugguuucuuuacag

SEQ ID NO: 95882 - RNA, 22 nt, Homo sapiens
gggaaugaagagaaccuuccca

SEQ ID NO: 95883 - RNA, 22 nt, Homo sapiens
gggaauggaagacauuaugaug

SEQ ID NO: 95884 - RNA, 22 nt, Homo sapiens
gggaauguagcaaaucugcaau

SEQ ID NO: 95885 - RNA, 22 nt, Homo sapiens
gggagcaaaaaugaugcccaag

SEQ ID NO: 95886 - RNA, 22 nt, Homo sapiens
gggaggucauuguaaggucuua

SEQ ID NO: 95887 - RNA, 22 nt, Homo sapiens
gggagguuguauguaugcgggg

SEQ ID NO: 95888 - RNA, 22 nt, Homo sapiens
gggaugaagcccuaggguuggu

SEQ ID NO: 95889 - RNA, 22 nt, Homo sapiens
gggaugaaguugauguagaaag

SEQ ID NO: 95890 - RNA, 22 nt, Homo sapiens
gggaugauuaugguucacuaca

SEQ ID NO: 95891 - RNA, 22 nt, Homo sapiens
gggcaaauuauguaucucucag

SEQ ID NO: 95892 - RNA, 18 nt, Homo sapiens
gggcaaguugccuggcuu

SEQ ID NO: 95893 - RNA, 22 nt, Homo sapiens
gggcauaucacuugaggucagg

SEQ ID NO: 95894 - RNA, 16 nt, Homo sapiens
gggcaugugaagccua

SEQ ID NO: 95895 - RNA, 22 nt, Homo sapiens
ggggcaaaaugccacgagucuc

SEQ ID NO: 95896 - RNA, 22 nt, Homo sapiens
ggggcauugugacauaucucug

SEQ ID NO: 95897 - RNA, 22 nt, Homo sapiens
ggggcauugugucuggguuccu

SEQ ID NO: 95898 - RNA, 22 nt, Homo sapiens
gggguaggcuacacugaguucc

SEQ ID NO: 95899 - RNA, 22 nt, Homo sapiens
ggguucaaaucuuggcucuuac

SEQ ID NO: 95900 - RNA, 22 nt, Homo sapiens
gguauuuaaaguaccugucugc

SEQ ID NO: 95901 - RNA, 22 nt, Homo sapiens
ggucacauuggacuaucaaguu

SEQ ID NO: 95902 - RNA, 22 nt, Homo sapiens
ggucagaaagacaggcauucag

SEQ ID NO: 95903 - RNA, 22 nt, Homo sapiens
ggucagauggcagcugggccug

SEQ ID NO: 95904 - RNA, 22 nt, Homo sapiens
ggucauggauugucuuuucuug

SEQ ID NO: 95905 - RNA, 22 nt, Homo sapiens
ggucccccuccacucucgcaaa

SEQ ID NO: 95906 - RNA, 22 nt, Homo sapiens
ggugacagugguuaaaauuugu

SEQ ID NO: 95907 - RNA, 22 nt, Homo sapiens
ggugagauaucugcugauguuu

SEQ ID NO: 95908 - RNA, 23 nt, Homo sapiens
ggugaggaguacagagucuucau

SEQ ID NO: 95909 - RNA, 22 nt, Homo sapiens
ggugaguggugcuuaaguucag

SEQ ID NO: 95910 - RNA, 22 nt, Homo sapiens
ggugcagcacaccaacauggca

SEQ ID NO: 95911 - RNA, 19 nt, Homo sapiens
ggugcuugaauauuccucc

SEQ ID NO: 95912 - RNA, 22 nt, Homo sapiens
gguggcaaaucugaguggcgcu

SEQ ID NO: 95913 - RNA, 22 nt, Homo sapiens
gguggucuuccccuggaguucg

SEQ ID NO: 95914 - RNA, 22 nt, Homo sapiens
gguguuccccuuaccucuuggc

SEQ ID NO: 95915 - RNA, 22 nt, Homo sapiens
gguuagaaacagguccucagga

SEQ ID NO: 95916 - RNA, 22 nt, Homo sapiens
guaaaucucuguuuucauggac

SEQ ID NO: 95917 - RNA, 22 nt, Homo sapiens
guaaauguccccugugauauug

SEQ ID NO: 95918 - RNA, 22 nt, Homo sapiens
guaacaccaguuauaucaguuc

SEQ ID NO: 95919 - RNA, 20 nt, Homo sapiens
guaacagcacuuucccaaag

SEQ ID NO: 95920 - RNA, 22 nt, Homo sapiens
guaacucugucacuuacuaguu

SEQ ID NO: 95921 - RNA, 22 nt, Homo sapiens
guaacuggccuucaauuucuuc

SEQ ID NO: 95922 - RNA, 22 nt, Homo sapiens
guaaggcuguuaucuucacguc

SEQ ID NO: 95923 - RNA, 22 nt, Homo sapiens
guaagugauagaauuaggauuc

SEQ ID NO: 95924 - RNA, 22 nt, Homo sapiens
guaagugguagagcugggcuau

SEQ ID NO: 95925 - RNA, 22 nt, Homo sapiens
guaaucucagcuacgcgggagg

SEQ ID NO: 95926 - RNA, 22 nt, Homo sapiens
guacaguacugaaugaauguau

SEQ ID NO: 95927 - RNA, 22 nt, Homo sapiens
guacaguaguaaaagugaauga

SEQ ID NO: 95928 - RNA, 22 nt, Homo sapiens
guacaguuuucaguguucacug

SEQ ID NO: 95929 - RNA, 22 nt, Homo sapiens
guacaugcauacaugcacaucu

SEQ ID NO: 95930 - RNA, 22 nt, Homo sapiens
guacauguaugcaugcaugcau

SEQ ID NO: 95931 - RNA, 22 nt, Homo sapiens
guaccacaguugcucacggguu

SEQ ID NO: 95932 - RNA, 22 nt, Homo sapiens
guaccugggugacaggauuauu

SEQ ID NO: 95933 - RNA, 22 nt, Homo sapiens
guacugagagacaguuacuguu

SEQ ID NO: 95934 - RNA, 22 nt, Homo sapiens
guacuuagagauagggucuuua

SEQ ID NO: 95935 - RNA, 22 nt, Homo sapiens
guagaggaauggcuccaccaua

SEQ ID NO: 95936 - RNA, 22 nt, Homo sapiens
guagcagcuacuaaguugcugu

SEQ ID NO: 95937 - RNA, 22 nt, Homo sapiens
guagggcaggcugagaaauaua

SEQ ID NO: 95938 - RNA, 22 nt, Homo sapiens
ucuggcuuuagcaugugggaag

SEQ ID NO: 95939 - RNA, 17 nt, Homo sapiens
ucuggcuuucacaccug

SEQ ID NO: 95940 - RNA, 22 nt, Homo sapiens
ucugggguuuccacuuuuacuu

SEQ ID NO: 95941 - RNA, 22 nt, Homo sapiens
ucuggguuuuuacaauguuuac

SEQ ID NO: 95942 - RNA, 22 nt, Homo sapiens
ucuggucccugcacauauuuuc

SEQ ID NO: 95943 - RNA, 23 nt, Homo sapiens
ucugguguugucaaaugcugguu

SEQ ID NO: 95944 - RNA, 22 nt, Homo sapiens
ucugguuccuuggcuucggguc

SEQ ID NO: 95945 - RNA, 22 nt, Homo sapiens
ucuguacuccuugaguagugcu

SEQ ID NO: 95946 - RNA, 22 nt, Homo sapiens
ucuguacuuccguaccuaaagu

SEQ ID NO: 95947 - RNA, 22 nt, Homo sapiens
ucugucuuugucaggaccagag

SEQ ID NO: 95948 - RNA, 22 nt, Homo sapiens
ucugugcauggcagaggaauga

SEQ ID NO: 95949 - RNA, 19 nt, Homo sapiens
ucugugcuugucccccugu

SEQ ID NO: 95950 - RNA, 22 nt, Homo sapiens
ucuguggucagcauccgccacu

SEQ ID NO: 95951 - RNA, 22 nt, Homo sapiens
ucugugguucuagcuacuuugg

SEQ ID NO: 95952 - RNA, 22 nt, Homo sapiens
ucuguguugaugcucauuaauu

SEQ ID NO: 95953 - RNA, 22 nt, Homo sapiens
ucuguugguucuuugaggagga

SEQ ID NO: 95954 - RNA, 22 nt, Homo sapiens
ucuuagugcggcugcugcagcc

SEQ ID NO: 95955 - RNA, 22 nt, Homo sapiens
ucuuauggagaaaggugguugg

SEQ ID NO: 95956 - RNA, 22 nt, Homo sapiens
ucuucagucauauuggccugga

SEQ ID NO: 95957 - RNA, 22 nt, Homo sapiens
ucuugcaauuuccuuaguggug

SEQ ID NO: 95958 - RNA, 22 nt, Homo sapiens
ucuugcacacaguaaguguuuu

SEQ ID NO: 95959 - RNA, 22 nt, Homo sapiens
ucuugcauuuuuaaauagugcu

SEQ ID NO: 95960 - RNA, 22 nt, Homo sapiens
ucuuggccaugaauggcaaggc

SEQ ID NO: 95961 - RNA, 22 nt, Homo sapiens
ucuugggugaguuugugaauaa

SEQ ID NO: 95962 - RNA, 22 nt, Homo sapiens
ucuuggguuugccuugcugcug

SEQ ID NO: 95963 - RNA, 21 nt, Homo sapiens
ucuugguauguauuuaggagg

SEQ ID NO: 95964 - RNA, 23 nt, Homo sapiens
ucuuguacuuugagugagcaugg

SEQ ID NO: 95965 - RNA, 20 nt, Homo sapiens
ucuuucgguuaccaggcagu

SEQ ID NO: 95966 - RNA, 19 nt, Homo sapiens
ucuuugaggcaucgcccuc

SEQ ID NO: 95967 - RNA, 22 nt, Homo sapiens
ucuuugaguguauacuuagauu

SEQ ID NO: 95968 - RNA, 22 nt, Homo sapiens
ucuuugauaagauccagaagaa

SEQ ID NO: 95969 - RNA, 22 nt, Homo sapiens
ucuuugauuaugcagauggguu

SEQ ID NO: 95970 - RNA, 19 nt, Homo sapiens
ucuuugcuuuucuaagagg

SEQ ID NO: 95971 - RNA, 18 nt, Homo sapiens
ucuuuggcugaacuguag

SEQ ID NO: 95972 - RNA, 22 nt, Homo sapiens
ucuuuggguagauauguagcug

SEQ ID NO: 95973 - RNA, 22 nt, Homo sapiens
ucuuuggguguauuucacagcc

SEQ ID NO: 95974 - RNA, 22 nt, Homo sapiens
ucuuugguagaagcuauuuuau

SEQ ID NO: 95975 - RNA, 22 nt, Homo sapiens
ucuuugguauugugaauagugu

SEQ ID NO: 95976 - RNA, 22 nt, Homo sapiens
ucuuugguauuuguggggaauu

SEQ ID NO: 95977 - RNA, 22 nt, Homo sapiens
ucuuuggucuacuuucauaugu

SEQ ID NO: 95978 - RNA, 22 nt, Homo sapiens
ucuuugguuagguuuaguugau

SEQ ID NO: 95979 - RNA, 22 nt, Homo sapiens
ucuuugguucuguuuauguaau

SEQ ID NO: 95980 - RNA, 22 nt, Homo sapiens
ucuuugguuucugucucuguaa

SEQ ID NO: 95981 - RNA, 22 nt, Homo sapiens
ucuuuguuuucugauccugaag

SEQ ID NO: 95982 - RNA, 22 nt, Homo sapiens
ucuuuugggccucuugucagac

SEQ ID NO: 95983 - RNA, 22 nt, Homo sapiens
ucuuuuggguauggagccauca

SEQ ID NO: 95984 - RNA, 18 nt, Homo sapiens
ugaaacacauuuuuuccu

SEQ ID NO: 95985 - RNA, 22 nt, Homo sapiens
ugaaacauacacucugaugggg

SEQ ID NO: 95986 - RNA, 22 nt, Homo sapiens
ugaaagacacagaaguugccca

SEQ ID NO: 95987 - RNA, 22 nt, Homo sapiens
ugaaagacugaagaauaggcau

SEQ ID NO: 95988 - RNA, 22 nt, Homo sapiens
ugaaaguuauauugugaaauuc

SEQ ID NO: 95989 - RNA, 22 nt, Homo sapiens
ugaaauacuuuggcucuuuguu

SEQ ID NO: 95990 - RNA, 22 nt, Homo sapiens
ugaaaucauguaguuauugcaa

SEQ ID NO: 95991 - RNA, 22 nt, Homo sapiens
ugaaaucuaaaauguuccaaga

SEQ ID NO: 95992 - RNA, 22 nt, Homo sapiens
ugaaaugaucaguuugguuacu

SEQ ID NO: 95993 - RNA, 22 nt, Homo sapiens
ugaaaugccuuuaaugaauuua

SEQ ID NO: 95994 - RNA, 22 nt, Homo sapiens
ugaaaugcuaauucguagcuaa

SEQ ID NO: 95995 - RNA, 22 nt, Homo sapiens
ugaaauggaagaagucccuuuu

SEQ ID NO: 95996 - RNA, 22 nt, Homo sapiens
ugaaaugucuuuaggaggcuuc

SEQ ID NO: 95997 - RNA, 22 nt, Homo sapiens
ugaaauguuaaacaaguggcuc

SEQ ID NO: 95998 - RNA, 22 nt, Homo sapiens
ugaacagcaccuccuagaguug

SEQ ID NO: 95999 - RNA, 22 nt, Homo sapiens
ugaacucauccuuucuuauggc

SEQ ID NO: 96000 - RNA, 22 nt, Homo sapiens
ugaagaucuuaggagcugaggg

SEQ ID NO: 96001 - RNA, 22 nt, Homo sapiens
ugaaggcaggagggagaaaagu

SEQ ID NO: 96002 - RNA, 22 nt, Homo sapiens
ugaaguagguucucguaucgcc

SEQ ID NO: 96003 - RNA, 19 nt, Homo sapiens
ugaaguauagggcuucuga

SEQ ID NO: 96004 - RNA, 21 nt, Homo sapiens
ugaaguguaaccgugcagggc

SEQ ID NO: 96005 - RNA, 22 nt, Homo sapiens
ugaauacugugcaaaggauuug

SEQ ID NO: 96006 - RNA, 22 nt, Homo sapiens
ugaauauagacagggguagaga

SEQ ID NO: 96007 - RNA, 22 nt, Homo sapiens
ugaauauguuaauuagcaucau

SEQ ID NO: 96008 - RNA, 22 nt, Homo sapiens
ugaauauuugcuacucacucuu

SEQ ID NO: 96009 - RNA, 22 nt, Homo sapiens
ugaaucaugcugcuauaaagac

SEQ ID NO: 96010 - RNA, 22 nt, Homo sapiens
ugaaugauuuuaaaagccucuc

SEQ ID NO: 96011 - RNA, 22 nt, Homo sapiens
ugaaugcaucuagaaauuuauu

SEQ ID NO: 96012 - RNA, 22 nt, Homo sapiens
ugaaugcuaaaggaaaacagua

SEQ ID NO: 96013 - RNA, 22 nt, Homo sapiens
ugaauggauccaauucuuagua

SEQ ID NO: 96014 - RNA, 22 nt, Homo sapiens
ugaaugguaauuuaguaggcac

SEQ ID NO: 96015 - RNA, 22 nt, Homo sapiens
ugaauguccugacgcugcaguu

SEQ ID NO: 96016 - RNA, 21 nt, Homo sapiens
ugaaugucuaggcagaaguuu

SEQ ID NO: 96017 - RNA, 23 nt, Homo sapiens
ugaauguuuauucucggugcaga

SEQ ID NO: 96018 - RNA, 22 nt, Homo sapiens
ugaauguuugcagcuuauacca

SEQ ID NO: 96019 - RNA, 22 nt, Homo sapiens
ugaauucuguccaaaauaacug

SEQ ID NO: 96020 - RNA, 22 nt, Homo sapiens
ugaauugucucucacuggguuc

SEQ ID NO: 96021 - RNA, 22 nt, Homo sapiens
ugacaagaaagcgucuucuuuu

SEQ ID NO: 96022 - RNA, 22 nt, Homo sapiens
ugacaagacuacauaucccauu

SEQ ID NO: 96023 - RNA, 23 nt, Homo sapiens
ugacaagagcgagacuuggucuc

SEQ ID NO: 96024 - RNA, 20 nt, Homo sapiens
ugacaagugagaauuauggg

SEQ ID NO: 96025 - RNA, 18 nt, Homo sapiens
ugacaaugcuaguccugg

SEQ ID NO: 96026 - RNA, 19 nt, Homo sapiens
ugacacuguuggugggagg

SEQ ID NO: 96027 - RNA, 22 nt, Homo sapiens
ugacacuugcccuuagaaacau

SEQ ID NO: 96028 - RNA, 22 nt, Homo sapiens
ugcaaagucgaaacugcaguuu

SEQ ID NO: 96029 - RNA, 22 nt, Homo sapiens
ugcaaaucuuguguaguuguga

SEQ ID NO: 96030 - RNA, 22 nt, Homo sapiens
ugcaacauguguaccacucugu

SEQ ID NO: 96031 - RNA, 22 nt, Homo sapiens
ugcaagacacuguccugggcau

SEQ ID NO: 96032 - RNA, 22 nt, Homo sapiens
ugcaagacuaaaccuuccccuc

SEQ ID NO: 96033 - RNA, 22 nt, Homo sapiens
ugcaagaugagauuuuggaugg

SEQ ID NO: 96034 - RNA, 22 nt, Homo sapiens
ugcaaugucuucugaggggagc

SEQ ID NO: 96035 - RNA, 22 nt, Homo sapiens
ugcaccaauucuaaacaguucu

SEQ ID NO: 96036 - RNA, 22 nt, Homo sapiens
ugcaccacugcacuccagcuug

SEQ ID NO: 96037 - RNA, 22 nt, Homo sapiens
ugcaccacugcacuucagccug

SEQ ID NO: 96038 - RNA, 18 nt, Homo sapiens
ugcaccaguuuacacuuc

SEQ ID NO: 96039 - RNA, 22 nt, Homo sapiens
ugcacugucuugucgcauagca

SEQ ID NO: 96040 - RNA, 20 nt, Homo sapiens
ugcagcacugggaaugcagu

SEQ ID NO: 96041 - RNA, 22 nt, Homo sapiens
ugcagcauguaggcacguuauu

SEQ ID NO: 96042 - RNA, 22 nt, Homo sapiens
ugcagcauugcacuccagccug

SEQ ID NO: 96043 - RNA, 22 nt, Homo sapiens
ugcaggauguucaguaauuucc

SEQ ID NO: 96044 - RNA, 22 nt, Homo sapiens
ugcaggguccauugucccaagu

SEQ ID NO: 96045 - RNA, 22 nt, Homo sapiens
ugcagguacuugacaacuuggg

SEQ ID NO: 96046 - RNA, 22 nt, Homo sapiens
ugcaguacauucagcauccucu

SEQ ID NO: 96047 - RNA, 22 nt, Homo sapiens
ugcaguacugucagacuucuua

SEQ ID NO: 96048 - RNA, 22 nt, Homo sapiens
ugcaguaggcccagcgggaggc

SEQ ID NO: 96049 - RNA, 22 nt, Homo sapiens
ugcaguagugugaucuuggcuc

SEQ ID NO: 96050 - RNA, 20 nt, Homo sapiens
ugcaguguccucacuuguca

SEQ ID NO: 96051 - RNA, 22 nt, Homo sapiens
ugcagugugaaagagccugaca

SEQ ID NO: 96052 - RNA, 22 nt, Homo sapiens
ugcagugugauuuucuggcuga

SEQ ID NO: 96053 - RNA, 22 nt, Homo sapiens
ugcaguguucuuuagaggaaau

SEQ ID NO: 96054 - RNA, 22 nt, Homo sapiens
ugcauaauuccuugcaccagaa

SEQ ID NO: 96055 - RNA, 22 nt, Homo sapiens
ugcauacugggagguugggugu

SEQ ID NO: 96056 - RNA, 22 nt, Homo sapiens
ugcauacuguaugcgugcauac

SEQ ID NO: 96057 - RNA, 22 nt, Homo sapiens
ugcauagaauguucuguaaaua

SEQ ID NO: 96058 - RNA, 17 nt, Homo sapiens
ugcauaggcaggcucag

SEQ ID NO: 96059 - RNA, 22 nt, Homo sapiens
ugcauaucuuguggaauaucuc

SEQ ID NO: 96060 - RNA, 22 nt, Homo sapiens
ugcauaugucuuuauaguagca

SEQ ID NO: 96061 - RNA, 22 nt, Homo sapiens
ugcauauguugaaccagccuug

SEQ ID NO: 96062 - RNA, 22 nt, Homo sapiens
ugcauauguugagaugcauauu

SEQ ID NO: 96063 - RNA, 22 nt, Homo sapiens
ugcauggaagggagggaaagag

SEQ ID NO: 96064 - RNA, 22 nt, Homo sapiens
ugcauggagauauacaguuuuu

SEQ ID NO: 96065 - RNA, 22 nt, Homo sapiens
ugcauggaggagcuccccgcag

SEQ ID NO: 96066 - RNA, 20 nt, Homo sapiens
ugcauguccucacuuacuug

SEQ ID NO: 96067 - RNA, 22 nt, Homo sapiens
ugcauuaucagauguuugcuuu

SEQ ID NO: 96068 - RNA, 22 nt, Homo sapiens
ugccaaaaugggcuuuauaccg

SEQ ID NO: 96069 - RNA, 22 nt, Homo sapiens
ugccaacaugccuggcuguuuu

SEQ ID NO: 96070 - RNA, 22 nt, Homo sapiens
uaucugcacuucugucuagguc

SEQ ID NO: 96071 - RNA, 22 nt, Homo sapiens
uaugaccuuggacaaguuacuu

SEQ ID NO: 96072 - RNA, 21 nt, Homo sapiens
ugacagaaaauugaguuugcu

SEQ ID NO: 96073 - RNA, 23 nt, Homo sapiens
ugacagaccuucuggaagaaguc

SEQ ID NO: 96074 - RNA, 22 nt, Homo sapiens
ugacagagaagcauugaguuca

SEQ ID NO: 96075 - RNA, 22 nt, Homo sapiens
ugacagaggucuuuuaauagcu

SEQ ID NO: 96076 - RNA, 22 nt, Homo sapiens
ugacagcugaagauguugaacc

SEQ ID NO: 96077 - RNA, 22 nt, Homo sapiens
ugacagguugauaggugcagca

SEQ ID NO: 96078 - RNA, 23 nt, Homo sapiens
ugacagugcuugaaauugcucuu

SEQ ID NO: 96079 - RNA, 22 nt, Homo sapiens
ugacaguuuccagggcugucuc

SEQ ID NO: 96080 - RNA, 18 nt, Homo sapiens
ugacaguuucuuuauauu

SEQ ID NO: 96081 - RNA, 22 nt, Homo sapiens
ugacauagcuauuaagugaugc

SEQ ID NO: 96082 - RNA, 20 nt, Homo sapiens
ugacaucagcaauguaauaa

SEQ ID NO: 96083 - RNA, 22 nt, Homo sapiens
ugacaugaagaaaaacagauuu

SEQ ID NO: 96084 - RNA, 22 nt, Homo sapiens
ugacauggaagauguucaugau

SEQ ID NO: 96085 - RNA, 22 nt, Homo sapiens
ugacauggagguggaggaagau

SEQ ID NO: 96086 - RNA, 22 nt, Homo sapiens
ugacauguauuagcucagugcu

SEQ ID NO: 96087 - RNA, 21 nt, Homo sapiens
ugacauguugguguucugcac

SEQ ID NO: 96088 - RNA, 19 nt, Homo sapiens
ugaccagggacagaaacca

SEQ ID NO: 96089 - RNA, 22 nt, Homo sapiens
ugacccauagaaauguggauaa

SEQ ID NO: 96090 - RNA, 22 nt, Homo sapiens
ugaccuagaacucuaaugccug

SEQ ID NO: 96091 - RNA, 22 nt, Homo sapiens
ugaccuguuugaaauugccaau

SEQ ID NO: 96092 - RNA, 22 nt, Homo sapiens
ugacuaaaacugaguuucauua

SEQ ID NO: 96093 - RNA, 22 nt, Homo sapiens
ugacuacaaccuccaccucccg

SEQ ID NO: 96094 - RNA, 22 nt, Homo sapiens
ugacuacagauuugcugccaga

SEQ ID NO: 96095 - RNA, 22 nt, Homo sapiens
ugacuagcagagugagaaacuc

SEQ ID NO: 96096 - RNA, 22 nt, Homo sapiens
ugacuaggaggcuggaggauga

SEQ ID NO: 96097 - RNA, 22 nt, Homo sapiens
ugacuagggcucuaaacagcuc

SEQ ID NO: 96098 - RNA, 22 nt, Homo sapiens
ugacuauugauuuagacgugcu

SEQ ID NO: 96099 - RNA, 22 nt, Homo sapiens
ugacuccagagacugugcuguc

SEQ ID NO: 96100 - RNA, 22 nt, Homo sapiens
ugacuggagaccucaguagggu

SEQ ID NO: 96101 - RNA, 22 nt, Homo sapiens
ugacuggagucuugcucugucg

SEQ ID NO: 96102 - RNA, 22 nt, Homo sapiens
ugacugugcagcuccaucaggg

SEQ ID NO: 96103 - RNA, 22 nt, Homo sapiens
ucacauggaggugauaguugaa

SEQ ID NO: 96104 - RNA, 22 nt, Homo sapiens
ucacauggcagagaagaagcuc

SEQ ID NO: 96105 - RNA, 22 nt, Homo sapiens
ucacauguguaugagcuuugau

SEQ ID NO: 96106 - RNA, 22 nt, Homo sapiens
ucacauuguuauguaaauguuu

SEQ ID NO: 96107 - RNA, 22 nt, Homo sapiens
ucaccaccugcugaucauagag

SEQ ID NO: 96108 - RNA, 22 nt, Homo sapiens
ucaccaccuuccaggaccacug

SEQ ID NO: 96109 - RNA, 22 nt, Homo sapiens
ucaccggagguggguugaccag

SEQ ID NO: 96110 - RNA, 22 nt, Homo sapiens
ucaccgugaauuaacaacacuu

SEQ ID NO: 96111 - RNA, 22 nt, Homo sapiens
aaaagcuuagaugggcuuguau

SEQ ID NO: 96112 - RNA, 22 nt, Homo sapiens
aaaaggcuagcuaguaacagaa

SEQ ID NO: 96113 - RNA, 22 nt, Homo sapiens
aaacagucuucuccugagggac

SEQ ID NO: 96114 - RNA, 22 nt, Homo sapiens
aaaccaccauuacuuuugcacc

SEQ ID NO: 96115 - RNA, 20 nt, Homo sapiens
aaacucugucuucuuuauca

SEQ ID NO: 96116 - RNA, 22 nt, Homo sapiens
aaacugccuuccuuguaggugc

SEQ ID NO: 96117 - RNA, 22 nt, Homo sapiens
aaacugucuggaugcuugugga

SEQ ID NO: 96118 - RNA, 23 nt, Homo sapiens
aaagacuagucaggugcaguggu

SEQ ID NO: 96119 - RNA, 22 nt, Homo sapiens
aaagcacugaauaaauuugcuu

SEQ ID NO: 96120 - RNA, 22 nt, Homo sapiens
aaagcgcuguuaagaagacuga

SEQ ID NO: 96121 - RNA, 22 nt, Homo sapiens
aaagcugucaaggcaggaggcu

SEQ ID NO: 96122 - RNA, 22 nt, Homo sapiens
aaaggaccacauauaugguggc

SEQ ID NO: 96123 - RNA, 22 nt, Homo sapiens
aaaggcacacacuccuuguuau

SEQ ID NO: 96124 - RNA, 22 nt, Homo sapiens
aaaggcacuagaaguuaccuuu

SEQ ID NO: 96125 - RNA, 22 nt, Homo sapiens
aaaggcacugugacuuuauagg

SEQ ID NO: 96126 - RNA, 22 nt, Homo sapiens
aaaggcaucugcucggcucccu

SEQ ID NO: 96127 - RNA, 22 nt, Homo sapiens
aaagggcacugugcuuuggcaa

SEQ ID NO: 96128 - RNA, 22 nt, Homo sapiens
aaagguaguacuucuagaaggg

SEQ ID NO: 96129 - RNA, 22 nt, Homo sapiens
aaaguacucaguucaguuccgu

SEQ ID NO: 96130 - RNA, 19 nt, Homo sapiens
aaaguacucugaugccucu

SEQ ID NO: 96131 - RNA, 22 nt, Homo sapiens
aaaguacugggauuggccgggu

SEQ ID NO: 96132 - RNA, 20 nt, Homo sapiens
aaaguaggcuaauaccaaaa

SEQ ID NO: 96133 - RNA, 22 nt, Homo sapiens
aaagucuguuacagcuauuucu

SEQ ID NO: 96134 - RNA, 22 nt, Homo sapiens
aaagugaauguaucccguaagu

SEQ ID NO: 96135 - RNA, 22 nt, Homo sapiens
aaagugacuuagugccccauuu

SEQ ID NO: 96136 - RNA, 22 nt, Homo sapiens
aaagugcaguauuugggcagaa

SEQ ID NO: 96137 - RNA, 22 nt, Homo sapiens
aaagugcuguagacugggcgca

SEQ ID NO: 96138 - RNA, 22 nt, Homo sapiens
aaagugcuuacuaaguugccaa

SEQ ID NO: 96139 - RNA, 22 nt, Homo sapiens
aaaguggacuaagugaauauga

SEQ ID NO: 96140 - RNA, 22 nt, Homo sapiens
aaagugguuuuucagacuuuga

SEQ ID NO: 96141 - RNA, 22 nt, Homo sapiens
aaaguguuucugcaguagguuu

SEQ ID NO: 96142 - RNA, 22 nt, Homo sapiens
aaauaguagcugaaugagggaa

SEQ ID NO: 96143 - RNA, 22 nt, Homo sapiens
aaauccaucucuuggggcauug

SEQ ID NO: 96144 - RNA, 22 nt, Homo sapiens
aaaugcacgcuacccagcuaga

SEQ ID NO: 96145 - RNA, 22 nt, Homo sapiens
aaaugcagauucugcuuagguu

SEQ ID NO: 96146 - RNA, 22 nt, Homo sapiens
aaaugcauaucaagauugcccu

SEQ ID NO: 96147 - RNA, 22 nt, Homo sapiens
aaaugcaugaauaagcucgugu

SEQ ID NO: 96148 - RNA, 18 nt, Homo sapiens
aaaugcucuucuggaaua

SEQ ID NO: 96149 - RNA, 22 nt, Homo sapiens
aaaugcuguuccaggaccuauc

SEQ ID NO: 96150 - RNA, 22 nt, Homo sapiens
aguggaaucuguuauacuaacu

SEQ ID NO: 96151 - RNA, 22 nt, Homo sapiens
aguggcuuuuuaguggcagaug

SEQ ID NO: 96152 - RNA, 22 nt, Homo sapiens
agugggccccuagaggugaggu

SEQ ID NO: 96153 - RNA, 19 nt, Homo sapiens
aguggguguuuucuguuug

SEQ ID NO: 96154 - RNA, 22 nt, Homo sapiens
aguggugucugaguggccaggg

SEQ ID NO: 96155 - RNA, 22 nt, Homo sapiens
agugguuugaucacagcucacu

SEQ ID NO: 96156 - RNA, 22 nt, Homo sapiens
agugguuuuaaguagagcauac

SEQ ID NO: 96157 - RNA, 22 nt, Homo sapiens
agugguuuuggaauggaauuca

SEQ ID NO: 96158 - RNA, 22 nt, Homo sapiens
aguguaaugauauuuggagagg

SEQ ID NO: 96159 - RNA, 22 nt, Homo sapiens
aguguuuuucaugggauacuuu

SEQ ID NO: 96160 - RNA, 22 nt, Homo sapiens
aguuccuacuggcuguaaagaa

SEQ ID NO: 96161 - RNA, 17 nt, Homo sapiens
auaaacucaucauuuuu

SEQ ID NO: 96162 - RNA, 22 nt, Homo sapiens
auaaaguagaggugaggugcau

SEQ ID NO: 96163 - RNA, 22 nt, Homo sapiens
auaaaguguuuaguauaggcaa

SEQ ID NO: 96164 - RNA, 22 nt, Homo sapiens
auaaauaguaguugugguggcc

SEQ ID NO: 96165 - RNA, 22 nt, Homo sapiens
auaaaugcaaugguauuuuuga

SEQ ID NO: 96166 - RNA, 20 nt, Homo sapiens
auaaauguauagguguacau

SEQ ID NO: 96167 - RNA, 22 nt, Homo sapiens
auaaauucauuuaagcuccuua

SEQ ID NO: 96168 - RNA, 22 nt, Homo sapiens
auaacaggaaauacagggcuuu

SEQ ID NO: 96169 - RNA, 22 nt, Homo sapiens
auaacauggaguuugucauuua

SEQ ID NO: 96170 - RNA, 22 nt, Homo sapiens
auaagagcaggcuucuggccag

SEQ ID NO: 96171 - RNA, 22 nt, Homo sapiens
auaaggaguaucauauuaaaac

SEQ ID NO: 96172 - RNA, 22 nt, Homo sapiens
auaaggcagcugcuaaaaggca

SEQ ID NO: 96173 - RNA, 22 nt, Homo sapiens
auaagugagugauucaguguua

SEQ ID NO: 96174 - RNA, 22 nt, Homo sapiens
auaauacugggaagaugagcau

SEQ ID NO: 96175 - RNA, 22 nt, Homo sapiens
auaauagcugaucauuuagaag

SEQ ID NO: 96176 - RNA, 22 nt, Homo sapiens
auaaucacacccagguuaaaug

SEQ ID NO: 96177 - RNA, 22 nt, Homo sapiens
auaaugcuggaacuagagggca

SEQ ID NO: 96178 - RNA, 22 nt, Homo sapiens
auaauguuugauugagcagaua

SEQ ID NO: 96179 - RNA, 19 nt, Homo sapiens
auaauuagcagugaggaca

SEQ ID NO: 96180 - RNA, 22 nt, Homo sapiens
auacaagugccauguuggugug

SEQ ID NO: 96181 - RNA, 22 nt, Homo sapiens
auacacgguaggcacauauuua

SEQ ID NO: 96182 - RNA, 22 nt, Homo sapiens
auacacuagggcuccugcagaa

SEQ ID NO: 96183 - RNA, 22 nt, Homo sapiens
auacaguaucuucuggcaagca

SEQ ID NO: 96184 - RNA, 22 nt, Homo sapiens
auacagugaauaucuggggcag

SEQ ID NO: 96185 - RNA, 22 nt, Homo sapiens
auacaguguucugggaagaagu

SEQ ID NO: 96186 - RNA, 22 nt, Homo sapiens
auacaugugcaggucagguuac

SEQ ID NO: 96187 - RNA, 22 nt, Homo sapiens
auacaugugccauguucgugug

SEQ ID NO: 96188 - RNA, 22 nt, Homo sapiens
auacaugugucauguugguuug

SEQ ID NO: 96189 - RNA, 22 nt, Homo sapiens
auacauguucaagggcauauau

SEQ ID NO: 96190 - RNA, 22 nt, Homo sapiens
auacauguuucauguuggugug

SEQ ID NO: 96191 - RNA, 20 nt, Homo sapiens
auaccacagacuggguaguu

SEQ ID NO: 96192 - RNA, 20 nt, Homo sapiens
auagaagacuagugcagcag

SEQ ID NO: 96193 - RNA, 22 nt, Homo sapiens
auagacugaguggcuuaaacca

SEQ ID NO: 96194 - RNA, 23 nt, Homo sapiens
auagagcuaggaugcagacagau

SEQ ID NO: 96195 - RNA, 22 nt, Homo sapiens
auagaguuagaaagaaauguuu

SEQ ID NO: 96196 - RNA, 22 nt, Homo sapiens
auagaucauugucauuuuagau

SEQ ID NO: 96197 - RNA, 22 nt, Homo sapiens
auagcaagaugauugauccauu

SEQ ID NO: 96198 - RNA, 20 nt, Homo sapiens
auagcaccagacagcccuag

SEQ ID NO: 96199 - RNA, 22 nt, Homo sapiens
auagcacugguuuuucuugguu

SEQ ID NO: 96200 - RNA, 22 nt, Homo sapiens
auagcacuuauagauuuggucu

SEQ ID NO: 96201 - RNA, 22 nt, Homo sapiens
auagcagaacagugucucacug

SEQ ID NO: 96202 - RNA, 22 nt, Homo sapiens
auagcagaagaagggacaauuc

SEQ ID NO: 96203 - RNA, 22 nt, Homo sapiens
auagcagcauauguaauguuga

SEQ ID NO: 96204 - RNA, 22 nt, Homo sapiens
auagcagugccccaaacuccug

SEQ ID NO: 96205 - RNA, 22 nt, Homo sapiens
auagcagugucccacuccuugg

SEQ ID NO: 96206 - RNA, 22 nt, Homo sapiens
auagcagugugaaaacagacua

SEQ ID NO: 96207 - RNA, 22 nt, Homo sapiens
auagcagugugaaaauggacua

SEQ ID NO: 96208 - RNA, 22 nt, Homo sapiens
auagcagugugaggacagacua

SEQ ID NO: 96209 - RNA, 22 nt, Homo sapiens
auagccucauucuucagaugag

SEQ ID NO: 96210 - RNA, 22 nt, Homo sapiens
auaggagcacaaacuauuguga

SEQ ID NO: 96211 - RNA, 22 nt, Homo sapiens
auaggcacauuaggaacuuuug

SEQ ID NO: 96212 - RNA, 21 nt, Homo sapiens
auagggcuuguugauaguuaa

SEQ ID NO: 96213 - RNA, 22 nt, Homo sapiens
auagguagcauagcaggaauau

SEQ ID NO: 96214 - RNA, 22 nt, Homo sapiens
ugucccaguuggguauugaauu

SEQ ID NO: 96215 - RNA, 18 nt, Homo sapiens
ugucccuuugcuguucau

SEQ ID NO: 96216 - RNA, 22 nt, Homo sapiens
uguccguuuuguuucaggcuca

SEQ ID NO: 96217 - RNA, 22 nt, Homo sapiens
ugucuagaucugaauguaauug

SEQ ID NO: 96218 - RNA, 20 nt, Homo sapiens
ugucuauggggguucucugc

SEQ ID NO: 96219 - RNA, 22 nt, Homo sapiens
ugucucagugauuggcuuucug

SEQ ID NO: 96220 - RNA, 22 nt, Homo sapiens
ugucucaguuacggcaauucca

SEQ ID NO: 96221 - RNA, 22 nt, Homo sapiens
ugucucccuucccauuaggaag

SEQ ID NO: 96222 - RNA, 22 nt, Homo sapiens
ugucuguuugcgaaauugcuuc

SEQ ID NO: 96223 - RNA, 22 nt, Homo sapiens
ugucuuuguuaguuguccuagu

SEQ ID NO: 96224 - RNA, 22 nt, Homo sapiens
ugugaacauuuuguauauauua

SEQ ID NO: 96225 - RNA, 22 nt, Homo sapiens
ugugaauggugcugcaaugaac

SEQ ID NO: 96226 - RNA, 22 nt, Homo sapiens
ugugacagcacagcaucucuuu

SEQ ID NO: 96227 - RNA, 22 nt, Homo sapiens
ugugacagcacgguucaacugc

SEQ ID NO: 96228 - RNA, 22 nt, Homo sapiens
ugugacagguauccuguguucu

SEQ ID NO: 96229 - RNA, 18 nt, Homo sapiens
ugugacauugagcauguc

SEQ ID NO: 96230 - RNA, 22 nt, Homo sapiens
ugugacuaguggugaaugacgc

SEQ ID NO: 96231 - RNA, 19 nt, Homo sapiens
ugugacugggccagccuag

SEQ ID NO: 96232 - RNA, 22 nt, Homo sapiens
ugugacugguugucccacuuuc

SEQ ID NO: 96233 - RNA, 22 nt, Homo sapiens
ugugauaguuggcuaaagcagu

SEQ ID NO: 96234 - RNA, 22 nt, Homo sapiens
ugugaucaauuagugaugucug

SEQ ID NO: 96235 - RNA, 22 nt, Homo sapiens
ugugaugauuugauaaacguau

SEQ ID NO: 96236 - RNA, 20 nt, Homo sapiens
ugugauuauuuaguugcaug

SEQ ID NO: 96237 - RNA, 22 nt, Homo sapiens
ugugauuauuuauagacaguca

SEQ ID NO: 96238 - RNA, 22 nt, Homo sapiens
ugugcaaauguuaaacuaacuu

SEQ ID NO: 96239 - RNA, 22 nt, Homo sapiens
ugugcaauucgauggagcucau

SEQ ID NO: 96240 - RNA, 22 nt, Homo sapiens
ugugcacaauguacagguuagu

SEQ ID NO: 96241 - RNA, 22 nt, Homo sapiens
ugugcacaugauauaucacaua

SEQ ID NO: 96242 - RNA, 22 nt, Homo sapiens
ugugccacuccaaccuggguga

SEQ ID NO: 96243 - RNA, 22 nt, Homo sapiens
ugugccacuccagcucuagcuu

SEQ ID NO: 96244 - RNA, 22 nt, Homo sapiens
ugugccacuguucuguaaagug

SEQ ID NO: 96245 - RNA, 22 nt, Homo sapiens
ugugccuaguaauguguccaga

SEQ ID NO: 96246 - RNA, 22 nt, Homo sapiens
ugugccuucuaagaaggagucu

SEQ ID NO: 96247 - RNA, 22 nt, Homo sapiens
ugugcuauguuauucacauggg

SEQ ID NO: 96248 - RNA, 22 nt, Homo sapiens
ugugcuugaaauucaguuuuga

SEQ ID NO: 96249 - RNA, 22 nt, Homo sapiens
uguggaaauggugcuacgaaca

SEQ ID NO: 96250 - RNA, 22 nt, Homo sapiens
uguggaguguaugugacagaga

SEQ ID NO: 96251 - RNA, 22 nt, Homo sapiens
uguggcaaauggucaggaagaa

SEQ ID NO: 96252 - RNA, 22 nt, Homo sapiens
uguggcucuucuguucuccacu

SEQ ID NO: 96253 - RNA, 22 nt, Homo sapiens
uguggcuucuuugguucaguau

SEQ ID NO: 96254 - RNA, 22 nt, Homo sapiens
uguggcuuuuucuuggcugagg

SEQ ID NO: 96255 - RNA, 22 nt, Homo sapiens
ugugggaggugcuaauguaaau

SEQ ID NO: 96256 - RNA, 22 nt, Homo sapiens
ugugguauuagguguaguaucu

SEQ ID NO: 96257 - RNA, 23 nt, Homo sapiens
ugugguauuauuccauuuauagg

SEQ ID NO: 96258 - RNA, 22 nt, Homo sapiens
uguggucaucacuugaagguaa

SEQ ID NO: 96259 - RNA, 19 nt, Homo sapiens
uguggucauccugggacga

SEQ ID NO: 96260 - RNA, 22 nt, Homo sapiens
ugugguccucugaaggcuuuuc

SEQ ID NO: 96261 - RNA, 22 nt, Homo sapiens
ugugguuuuucacauuuagaga

SEQ ID NO: 96262 - RNA, 22 nt, Homo sapiens
uguguaaagcuuguuccagaaa

SEQ ID NO: 96263 - RNA, 22 nt, Homo sapiens
uguguaaauagcuacggaucug

SEQ ID NO: 96264 - RNA, 22 nt, Homo sapiens
ucuguguuugguuggcaauuuc

SEQ ID NO: 96265 - RNA, 22 nt, Homo sapiens
ucuguuguuaucauaauauuga

SEQ ID NO: 96266 - RNA, 22 nt, Homo sapiens
ucuuaggauacugaagucgguu

SEQ ID NO: 96267 - RNA, 22 nt, Homo sapiens
ucuucaugcuugaaauaauagc

SEQ ID NO: 96268 - RNA, 22 nt, Homo sapiens
ucuucguuuaaagcaguggaag

SEQ ID NO: 96269 - RNA, 22 nt, Homo sapiens
ucuucuagcggaacccucuugu

SEQ ID NO: 96270 - RNA, 17 nt, Homo sapiens
ucuucuguuacuguggc

SEQ ID NO: 96271 - RNA, 22 nt, Homo sapiens
ucuugaacuucauaggucuaga

SEQ ID NO: 96272 - RNA, 22 nt, Homo sapiens
ucuugcacaaauuauuuuaacu

SEQ ID NO: 96273 - RNA, 19 nt, Homo sapiens
ucuugcacaugugaacuca

SEQ ID NO: 96274 - RNA, 22 nt, Homo sapiens
ucuuggacuuuugugagaaauc

SEQ ID NO: 96275 - RNA, 22 nt, Homo sapiens
ucuuggguuuguccuucuccua

SEQ ID NO: 96276 - RNA, 22 nt, Homo sapiens
ucuugguaaugucacauuuccu

SEQ ID NO: 96277 - RNA, 22 nt, Homo sapiens
ucuugguuaggggaaauaggca

SEQ ID NO: 96278 - RNA, 23 nt, Homo sapiens
ucuugguuauagaaaaauaguug

SEQ ID NO: 96279 - RNA, 22 nt, Homo sapiens
ucuuuagugacaguugugcaag

SEQ ID NO: 96280 - RNA, 22 nt, Homo sapiens
ucuuugauuuuguuacuaagac

SEQ ID NO: 96281 - RNA, 22 nt, Homo sapiens
ucuuuggauggaaauuggaguc

SEQ ID NO: 96282 - RNA, 22 nt, Homo sapiens
ucuuuggcugugaagaauaaug

SEQ ID NO: 96283 - RNA, 22 nt, Homo sapiens
ucuuugguaugugcaugugcuu

SEQ ID NO: 96284 - RNA, 21 nt, Homo sapiens
ucuuuggucaccaguuuucau

SEQ ID NO: 96285 - RNA, 22 nt, Homo sapiens
ucuuugguucugugcagccuau

SEQ ID NO: 96286 - RNA, 22 nt, Homo sapiens
ucuuugguugcacugcaggugu

SEQ ID NO: 96287 - RNA, 22 nt, Homo sapiens
ucuuugguuguuuagggugcau

SEQ ID NO: 96288 - RNA, 22 nt, Homo sapiens
ucuuugucuacauccuguuaaa

SEQ ID NO: 96289 - RNA, 22 nt, Homo sapiens
ucuuuguguucaggagccacgu

SEQ ID NO: 96290 - RNA, 22 nt, Homo sapiens
ucuuuguuagaacccucuccuu

SEQ ID NO: 96291 - RNA, 22 nt, Homo sapiens
ucuuuguucaggagccaacucc

SEQ ID NO: 96292 - RNA, 22 nt, Homo sapiens
ucuuuguuggaguccaaggaua

SEQ ID NO: 96293 - RNA, 22 nt, Homo sapiens
ugaaaagucuaagauuaagguu

SEQ ID NO: 96294 - RNA, 22 nt, Homo sapiens
ugaaacacacauugcccuuuau

SEQ ID NO: 96295 - RNA, 22 nt, Homo sapiens
ugaaagacugaaagcuuuucuu

SEQ ID NO: 96296 - RNA, 22 nt, Homo sapiens
ugaaagguuuaauucugugaga

SEQ ID NO: 96297 - RNA, 22 nt, Homo sapiens
ugaaauaguuaaguugccuagu

SEQ ID NO: 96298 - RNA, 22 nt, Homo sapiens
ugaaaugcagaacuuuaggucu

SEQ ID NO: 96299 - RNA, 22 nt, Homo sapiens
ugaaauggaaagaguguagacu

SEQ ID NO: 96300 - RNA, 22 nt, Homo sapiens
ugaaauguugggugauggaauc

SEQ ID NO: 96301 - RNA, 22 nt, Homo sapiens
ugaacacaucuccugguaccug

SEQ ID NO: 96302 - RNA, 22 nt, Homo sapiens
ugaacagcacguuuauucagaa

SEQ ID NO: 96303 - RNA, 21 nt, Homo sapiens
ugaaccccugcucucaagaaa

SEQ ID NO: 96304 - RNA, 20 nt, Homo sapiens
ugaacugguuacuuucuguc

SEQ ID NO: 96305 - RNA, 22 nt, Homo sapiens
cucagcuacuugagaggcuuag

SEQ ID NO: 96306 - RNA, 22 nt, Homo sapiens
cucaggguacuucuccuuugcu

SEQ ID NO: 96307 - RNA, 22 nt, Homo sapiens
cucagucuaugauacuuugcua

SEQ ID NO: 96308 - RNA, 22 nt, Homo sapiens
cucagugaagggcaagaggcaa

SEQ ID NO: 96309 - RNA, 22 nt, Homo sapiens
cucagugguugauuuauuuauc

SEQ ID NO: 96310 - RNA, 22 nt, Homo sapiens
cucaguguuaaggccaccucug

SEQ ID NO: 96311 - RNA, 22 nt, Homo sapiens
cucaguguuucagcugcucaga

SEQ ID NO: 96312 - RNA, 21 nt, Homo sapiens
cucauauugcuuuuccauggu

SEQ ID NO: 96313 - RNA, 22 nt, Homo sapiens
cucauggaauacuucacagcca

SEQ ID NO: 96314 - RNA, 22 nt, Homo sapiens
cucauggauggucuggcagcca

SEQ ID NO: 96315 - RNA, 22 nt, Homo sapiens
cucauugcaaucuccaccuccc

SEQ ID NO: 96316 - RNA, 23 nt, Homo sapiens
cuccaugagccguccagggccug

SEQ ID NO: 96317 - RNA, 22 nt, Homo sapiens
cucccagugacccaggaacagg

SEQ ID NO: 96318 - RNA, 20 nt, Homo sapiens
cucccugacaaauguggaaa

SEQ ID NO: 96319 - RNA, 22 nt, Homo sapiens
cucccugagccagggcuuugac

SEQ ID NO: 96320 - RNA, 22 nt, Homo sapiens
cuccgggugcgucggcgcccug

SEQ ID NO: 96321 - RNA, 22 nt, Homo sapiens
cucucugagccauggcugcccu

SEQ ID NO: 96322 - RNA, 22 nt, Homo sapiens
cucugacagugguuagcacugu

SEQ ID NO: 96323 - RNA, 20 nt, Homo sapiens
cucugguugugaauugucuu

SEQ ID NO: 96324 - RNA, 21 nt, Homo sapiens
cucugguuugcauuggauuau

SEQ ID NO: 96325 - RNA, 22 nt, Homo sapiens
cucuuagauuagccauccuaau

SEQ ID NO: 96326 - RNA, 22 nt, Homo sapiens
cucuuugaggugagcugcccau

SEQ ID NO: 96327 - RNA, 22 nt, Homo sapiens
cucuuugcuucuggcaucauug

SEQ ID NO: 96328 - RNA, 22 nt, Homo sapiens
cucuuuuguuccuaguuugauc

SEQ ID NO: 96329 - RNA, 19 nt, Homo sapiens
cugaaacacagagagggcu

SEQ ID NO: 96330 - RNA, 22 nt, Homo sapiens
cugaaagagcauuugaaugggu

SEQ ID NO: 96331 - RNA, 22 nt, Homo sapiens
cugaaagguauacgcuuguuau

SEQ ID NO: 96332 - RNA, 22 nt, Homo sapiens
cugaaucauugcauuaucaagg

SEQ ID NO: 96333 - RNA, 22 nt, Homo sapiens
cugaauguccaggcagagguuu

SEQ ID NO: 96334 - RNA, 22 nt, Homo sapiens
cugaauguucuauagaagccgc

SEQ ID NO: 96335 - RNA, 22 nt, Homo sapiens
cugacaagugaucacagcagca

SEQ ID NO: 96336 - RNA, 22 nt, Homo sapiens
cugacagaugacugccacugua

SEQ ID NO: 96337 - RNA, 22 nt, Homo sapiens
cugacaugcagccacugcaccu

SEQ ID NO: 96338 - RNA, 22 nt, Homo sapiens
cugacuaguuuuaaugcagauu

SEQ ID NO: 96339 - RNA, 22 nt, Homo sapiens
cugacuuuagaacccaaaaagu

SEQ ID NO: 96340 - RNA, 22 nt, Homo sapiens
cugagagugguauguuuaagug

SEQ ID NO: 96341 - RNA, 22 nt, Homo sapiens
cugagaguugaugaaauauggu

SEQ ID NO: 96342 - RNA, 22 nt, Homo sapiens
cugagaucguggggcugcuguc

SEQ ID NO: 96343 - RNA, 22 nt, Homo sapiens
cugagaucugaaccaggagugu

SEQ ID NO: 96344 - RNA, 22 nt, Homo sapiens
cugagaucuuauuagaaaugca

SEQ ID NO: 96345 - RNA, 22 nt, Homo sapiens
cugagauuuuuagauccuggcg

SEQ ID NO: 96346 - RNA, 22 nt, Homo sapiens
cugagcaugacaucaugugacu

SEQ ID NO: 96347 - RNA, 22 nt, Homo sapiens
cugagcuagaccauuuggcucc

SEQ ID NO: 96348 - RNA, 22 nt, Homo sapiens
cugagcuaguagcauuguguca

SEQ ID NO: 96349 - RNA, 22 nt, Homo sapiens
cugaggcacggcgaccuuaagu

SEQ ID NO: 96350 - RNA, 22 nt, Homo sapiens
cugagguaauuuguugccagua

SEQ ID NO: 96351 - RNA, 22 nt, Homo sapiens
cugagguaggcccugagaauau

SEQ ID NO: 96352 - RNA, 22 nt, Homo sapiens
cugagguauuuaggugaaagaa

SEQ ID NO: 96353 - RNA, 22 nt, Homo sapiens
cugaggugggagaaucacauaa

SEQ ID NO: 96354 - RNA, 22 nt, Homo sapiens
cugaggugggaggauuacuuga

SEQ ID NO: 96355 - RNA, 22 nt, Homo sapiens
cugagguuguucuucucagugg

SEQ ID NO: 96356 - RNA, 22 nt, Homo sapiens
cugauaugaugggugauuuuca

SEQ ID NO: 96357 - RNA, 21 nt, Homo sapiens
cugaucacaggugagcugccu

SEQ ID NO: 96358 - RNA, 22 nt, Homo sapiens
cugauugucaucaauauuauua

SEQ ID NO: 96359 - RNA, 22 nt, Homo sapiens
cugcagucaucugaagauuuug

SEQ ID NO: 96360 - RNA, 22 nt, Homo sapiens
cugcauuggguuaugcauuuuu

SEQ ID NO: 96361 - RNA, 22 nt, Homo sapiens
cugccacugacaccucaaggac

SEQ ID NO: 96362 - RNA, 18 nt, Homo sapiens
cugccagugugcucuccg

SEQ ID NO: 96363 - RNA, 22 nt, Homo sapiens
cugcccguaauccucuccccag

SEQ ID NO: 96364 - RNA, 22 nt, Homo sapiens
cugcccuuucuauaugauguaa

SEQ ID NO: 96365 - RNA, 22 nt, Homo sapiens
cugccuagauguuguagggggu

SEQ ID NO: 96366 - RNA, 22 nt, Homo sapiens
cugcuaagagaaugagacuuag

SEQ ID NO: 96367 - RNA, 22 nt, Homo sapiens
cuggaagaaaaucacgccaucu

SEQ ID NO: 96368 - RNA, 22 nt, Homo sapiens
cuggaaucuagaaaagguaagg

SEQ ID NO: 96369 - RNA, 22 nt, Homo sapiens
cuggaaugugagccccaaaaag

SEQ ID NO: 96370 - RNA, 22 nt, Homo sapiens
cuggacaaaucuggaaagaacc

SEQ ID NO: 96371 - RNA, 22 nt, Homo sapiens
cuggacguugaggcugcaguga

SEQ ID NO: 96372 - RNA, 22 nt, Homo sapiens
cuggagaucuugacauugaagu

SEQ ID NO: 96373 - RNA, 22 nt, Homo sapiens
cuggaguuugaggcugcaguga

SEQ ID NO: 96374 - RNA, 22 nt, Homo sapiens
cuggauggugagauaaagaaaa

SEQ ID NO: 96375 - RNA, 22 nt, Homo sapiens
cuggcaaauguuuucuguaaag

SEQ ID NO: 96376 - RNA, 22 nt, Homo sapiens
cuggcaagagugaaccagcugu

SEQ ID NO: 96377 - RNA, 22 nt, Homo sapiens
cuggcagugcuuguuauccugg

SEQ ID NO: 96378 - RNA, 22 nt, Homo sapiens
cuggcaguguuucuugugggcu

SEQ ID NO: 96379 - RNA, 22 nt, Homo sapiens
cuggcucugagguguuuagggc

SEQ ID NO: 96380 - RNA, 22 nt, Homo sapiens
cugggaugauguaaauaggcua

SEQ ID NO: 96381 - RNA, 22 nt, Homo sapiens
cugggaugugacuguugccccc

SEQ ID NO: 96382 - RNA, 22 nt, Homo sapiens
cugggucaguuucugauuauug

SEQ ID NO: 96383 - RNA, 22 nt, Homo sapiens
cugguaugcuucauaugcaaac

SEQ ID NO: 96384 - RNA, 22 nt, Homo sapiens
cuggugugugacuuuucauuau

SEQ ID NO: 96385 - RNA, 21 nt, Homo sapiens
cugguguuagcacuucuuccc

SEQ ID NO: 96386 - RNA, 22 nt, Homo sapiens
cuguaaaguaagagguaaguua

SEQ ID NO: 96387 - RNA, 22 nt, Homo sapiens
cuguagcuuuuauaugcuuagc

SEQ ID NO: 96388 - RNA, 22 nt, Homo sapiens
cuguaugugagaaauaauaagu

SEQ ID NO: 96389 - RNA, 22 nt, Homo sapiens
cuguauguuucuaugaauguga

SEQ ID NO: 96390 - RNA, 22 nt, Homo sapiens
cugucacugggaggggcagcag

SEQ ID NO: 96391 - RNA, 22 nt, Homo sapiens
cugugacugcagggcauauuug

SEQ ID NO: 96392 - RNA, 22 nt, Homo sapiens
cugugcaaacaagugaaccccu

SEQ ID NO: 96393 - RNA, 22 nt, Homo sapiens
cugugcacaucuggcggcccga

SEQ ID NO: 96394 - RNA, 22 nt, Homo sapiens
cugugcauguuguccaauucuu

SEQ ID NO: 96395 - RNA, 22 nt, Homo sapiens
cugugcuaggcaaugugguaga

SEQ ID NO: 96396 - RNA, 22 nt, Homo sapiens
ugugcaaaaacaauugcgguuu

SEQ ID NO: 96397 - RNA, 22 nt, Homo sapiens
ugugcacaacgugcagguuugu

SEQ ID NO: 96398 - RNA, 22 nt, Homo sapiens
ugugcacaaugugcagguuugu

SEQ ID NO: 96399 - RNA, 22 nt, Homo sapiens
ugugcacauugugcagguugau

SEQ ID NO: 96400 - RNA, 22 nt, Homo sapiens
ugugcacuggaccuugucuucu

SEQ ID NO: 96401 - RNA, 22 nt, Homo sapiens
ugugcauagugugugcggggcg

SEQ ID NO: 96402 - RNA, 22 nt, Homo sapiens
ugugcaugaaauuuaccuuuaa

SEQ ID NO: 96403 - RNA, 22 nt, Homo sapiens
ugugcaugacagcauacaaacg

SEQ ID NO: 96404 - RNA, 22 nt, Homo sapiens
ugugccaaucauagggcuuggu

SEQ ID NO: 96405 - RNA, 22 nt, Homo sapiens
ugugccacugcacucccgccug

SEQ ID NO: 96406 - RNA, 22 nt, Homo sapiens
ugugccacugcacuccugccug

SEQ ID NO: 96407 - RNA, 22 nt, Homo sapiens
ugugccacugcacucuggccug

SEQ ID NO: 96408 - RNA, 22 nt, Homo sapiens
ugugcgcaucggggccugcuuc

SEQ ID NO: 96409 - RNA, 22 nt, Homo sapiens
ugugcgugugccuguaagaauu

SEQ ID NO: 96410 - RNA, 22 nt, Homo sapiens
ugugcuaauacauacagugcua

SEQ ID NO: 96411 - RNA, 22 nt, Homo sapiens
ugugcugaucgggcacgguguc

SEQ ID NO: 96412 - RNA, 22 nt, Homo sapiens
ugugcuugaauuuaguagcuua

SEQ ID NO: 96413 - RNA, 22 nt, Homo sapiens
ugugcuugcuucuucuccuagu

SEQ ID NO: 96414 - RNA, 22 nt, Homo sapiens
ugugcuuguaaaggccagagca

SEQ ID NO: 96415 - RNA, 21 nt, Homo sapiens
uguggcaauggccucacagau

SEQ ID NO: 96416 - RNA, 22 nt, Homo sapiens
uguggcagugcuuuaugaaacc

SEQ ID NO: 96417 - RNA, 22 nt, Homo sapiens
uguggccuuuguuucaguuggg

SEQ ID NO: 96418 - RNA, 22 nt, Homo sapiens
ugugguagugcuuaccugcagu

SEQ ID NO: 96419 - RNA, 22 nt, Homo sapiens
uguguaaauacaagugcuugaa

SEQ ID NO: 96420 - RNA, 22 nt, Homo sapiens
uguguaaauaugauagaggaau

SEQ ID NO: 96421 - RNA, 22 nt, Homo sapiens
ugugucuccugaaaauucacau

SEQ ID NO: 96422 - RNA, 22 nt, Homo sapiens
ugugucuuuuaucacacaaugu

SEQ ID NO: 96423 - RNA, 22 nt, Homo sapiens
uguuaacauggucucagucugu

SEQ ID NO: 96424 - RNA, 22 nt, Homo sapiens
uguuaagaugucaauuuuccac

SEQ ID NO: 96425 - RNA, 22 nt, Homo sapiens
uguuaagauguguuuuguggcu

SEQ ID NO: 96426 - RNA, 22 nt, Homo sapiens
uguuacagcagcacaaaaugga

SEQ ID NO: 96427 - RNA, 22 nt, Homo sapiens
uguuacagugacuaauguuuua

SEQ ID NO: 96428 - RNA, 22 nt, Homo sapiens
uguuacaguguaggccuugggu

SEQ ID NO: 96429 - RNA, 22 nt, Homo sapiens
uguuaucauuacguucuuaguu

SEQ ID NO: 96430 - RNA, 22 nt, Homo sapiens
uguucuugagccuuuagaccua

SEQ ID NO: 96431 - RNA, 19 nt, Homo sapiens
uguugcacauaucaauaug

SEQ ID NO: 96432 - RNA, 22 nt, Homo sapiens
uguugcacuccagccuagguga

SEQ ID NO: 96433 - RNA, 22 nt, Homo sapiens
uguugcacuccagccugggcaa

SEQ ID NO: 96434 - RNA, 22 nt, Homo sapiens
uguugcacuccagccuggguga

SEQ ID NO: 96435 - RNA, 22 nt, Homo sapiens
uguugcacuccauccugggcga

SEQ ID NO: 96436 - RNA, 22 nt, Homo sapiens
uguugccacuguuauuaaccua

SEQ ID NO: 96437 - RNA, 22 nt, Homo sapiens
uguugcuuaagccacccagucu

SEQ ID NO: 96438 - RNA, 22 nt, Homo sapiens
uguuggcauugcugcugacccu

SEQ ID NO: 96439 - RNA, 22 nt, Homo sapiens
uguuuaguuaagacauagaauu

SEQ ID NO: 96440 - RNA, 22 nt, Homo sapiens
uguuucuacugucucuguagua

SEQ ID NO: 96441 - RNA, 22 nt, Homo sapiens
uguuugcuguuuucuccaauga

SEQ ID NO: 96442 - RNA, 22 nt, Homo sapiens
uguuugguggucucuucacaug

SEQ ID NO: 96443 - RNA, 22 nt, Homo sapiens
uguuuguuugauaugggauaaa

SEQ ID NO: 96444 - RNA, 22 nt, Homo sapiens
uguuuuggaggccagaagucca

SEQ ID NO: 96445 - RNA, 22 nt, Homo sapiens
uuaaagugaucauaaggauagu

SEQ ID NO: 96446 - RNA, 22 nt, Homo sapiens
uuaaaguguuugcagacaggug

SEQ ID NO: 96447 - RNA, 21 nt, Homo sapiens
uuaacagacaagugucuuccc

SEQ ID NO: 96448 - RNA, 22 nt, Homo sapiens
uuaacagcacaugcugucccuu

SEQ ID NO: 96449 - RNA, 22 nt, Homo sapiens
uuaacaguuaauucuuuggcaa

SEQ ID NO: 96450 - RNA, 22 nt, Homo sapiens
uuaagacaccaaucauuggauu

SEQ ID NO: 96451 - RNA, 22 nt, Homo sapiens
uuaagagcauggugccagguug

SEQ ID NO: 96452 - RNA, 22 nt, Homo sapiens
uuaagcucauuuccauucuaca

SEQ ID NO: 96453 - RNA, 22 nt, Homo sapiens
uuaaggaaggagucuuaaaugg

SEQ ID NO: 96454 - RNA, 18 nt, Homo sapiens
uuaaggcaggacuuuaag

SEQ ID NO: 96455 - RNA, 22 nt, Homo sapiens
uuaaggccugaagcucauaaag

SEQ ID NO: 96456 - RNA, 22 nt, Homo sapiens
uuaaggcuuucccuauguaaaa

SEQ ID NO: 96457 - RNA, 23 nt, Homo sapiens
uuaaggugaugucuuugugccuc

SEQ ID NO: 96458 - RNA, 22 nt, Homo sapiens
uuaaguagcugggcaugguggu

SEQ ID NO: 96459 - RNA, 22 nt, Homo sapiens
uuaagucacacuagacaacuga

SEQ ID NO: 96460 - RNA, 23 nt, Homo sapiens
uuaagugcuuuucugaaacucuu

SEQ ID NO: 96461 - RNA, 22 nt, Homo sapiens
uuaagugguagguggugcccaa

SEQ ID NO: 96462 - RNA, 22 nt, Homo sapiens
uuaaucaggccguuuccuaaga

SEQ ID NO: 96463 - RNA, 22 nt, Homo sapiens
uuaaucuguucucuguauucua

SEQ ID NO: 96464 - RNA, 22 nt, Homo sapiens
uuaaugacaucauaggugaagu

SEQ ID NO: 96465 - RNA, 22 nt, Homo sapiens
uuaauguaucuaucacaucaca

SEQ ID NO: 96466 - RNA, 22 nt, Homo sapiens
uuaauuguccaaguucaucucu

SEQ ID NO: 96467 - RNA, 22 nt, Homo sapiens
uuacagcugcuccccaucacuc

SEQ ID NO: 96468 - RNA, 22 nt, Homo sapiens
uuacaguagaugaggguauaau

SEQ ID NO: 96469 - RNA, 22 nt, Homo sapiens
uuacaguauugcaaggacuagg

SEQ ID NO: 96470 - RNA, 20 nt, Homo sapiens
uuacagugggaccuuccuga

SEQ ID NO: 96471 - RNA, 22 nt, Homo sapiens
uuacaguggugaccuuguauug

SEQ ID NO: 96472 - RNA, 21 nt, Homo sapiens
uuacaguugguugugaggugg

SEQ ID NO: 96473 - RNA, 22 nt, Homo sapiens
uuacauaguguguggguucggg

SEQ ID NO: 96474 - RNA, 22 nt, Homo sapiens
uuacauguuguggguuguggcc

SEQ ID NO: 96475 - RNA, 22 nt, Homo sapiens
uuaccaguggugcuguaaacuu

SEQ ID NO: 96476 - RNA, 22 nt, Homo sapiens
uuacuagaacauuuagggaacu

SEQ ID NO: 96477 - RNA, 22 nt, Homo sapiens
uuacugcuagcugugugcucuu

SEQ ID NO: 96478 - RNA, 22 nt, Homo sapiens
uuacugcuuaagugauucaaca

SEQ ID NO: 96479 - RNA, 22 nt, Homo sapiens
uuagaaaguagaaaagcugguu

SEQ ID NO: 96480 - RNA, 22 nt, Homo sapiens
uuagaacagugcucaccacaaa

SEQ ID NO: 96481 - RNA, 17 nt, Homo sapiens
uuagacagacauccugc

SEQ ID NO: 96482 - RNA, 18 nt, Homo sapiens
uuagagugcauuacuuug

SEQ ID NO: 96483 - RNA, 22 nt, Homo sapiens
uuagauaguacuuagggaaaua

SEQ ID NO: 96484 - RNA, 22 nt, Homo sapiens
uuagaugaagucacagaaccca

SEQ ID NO: 96485 - RNA, 22 nt, Homo sapiens
uuagauguuuagaagugggcca

SEQ ID NO: 96486 - RNA, 22 nt, Homo sapiens
agcuggucuuggggaagaguag

SEQ ID NO: 96487 - RNA, 22 nt, Homo sapiens
agcugguuuauuucucacaaca

SEQ ID NO: 96488 - RNA, 21 nt, Homo sapiens
agcugguuucuucuuacuccu

SEQ ID NO: 96489 - RNA, 22 nt, Homo sapiens
agcuguaguuuauucauguuaa

SEQ ID NO: 96490 - RNA, 22 nt, Homo sapiens
agcuguuguuaauuaacucauu

SEQ ID NO: 96491 - RNA, 22 nt, Homo sapiens
agcuguuuuugugggcauguga

SEQ ID NO: 96492 - RNA, 22 nt, Homo sapiens
gauacaccauuuucuagcuauu

SEQ ID NO: 96493 - RNA, 22 nt, Homo sapiens
gauacuggcuuuauagaaugau

SEQ ID NO: 96494 - RNA, 22 nt, Homo sapiens
gauaguugugagaacucuuacu

SEQ ID NO: 96495 - RNA, 19 nt, Homo sapiens
gauaucuagggggagguuc

SEQ ID NO: 96496 - RNA, 22 nt, Homo sapiens
gauaucuuuuguauggugagcu

SEQ ID NO: 96497 - RNA, 22 nt, Homo sapiens
gauaugaguagucgcauugaug

SEQ ID NO: 96498 - RNA, 22 nt, Homo sapiens
gauauguguuuuagucaggguu

SEQ ID NO: 96499 - RNA, 22 nt, Homo sapiens
gauauguuagggggagaaguua

SEQ ID NO: 96500 - RNA, 19 nt, Homo sapiens
gauauguugagcacccuuu

SEQ ID NO: 96501 - RNA, 22 nt, Homo sapiens
gauauguuucuucaauaccuag

SEQ ID NO: 96502 - RNA, 22 nt, Homo sapiens
gauauuacuuccaauauugcaa

SEQ ID NO: 96503 - RNA, 22 nt, Homo sapiens
gaucacauggccauuucuagcu

SEQ ID NO: 96504 - RNA, 22 nt, Homo sapiens
gaucacauuguuucauacauau

SEQ ID NO: 96505 - RNA, 20 nt, Homo sapiens
gaucaguuuggaguaagugc

SEQ ID NO: 96506 - RNA, 22 nt, Homo sapiens
gaucugagaaagugucauaaca

SEQ ID NO: 96507 - RNA, 22 nt, Homo sapiens
gaucugugugauuggaugcauu

SEQ ID NO: 96508 - RNA, 22 nt, Homo sapiens
gaucuguguuuguaugcauaag

SEQ ID NO: 96509 - RNA, 22 nt, Homo sapiens
gaucuguuucaauugucuuagu

SEQ ID NO: 96510 - RNA, 22 nt, Homo sapiens
gaugacuaagaauuuuauaauu

SEQ ID NO: 96511 - RNA, 22 nt, Homo sapiens
gaugagaucauaaguguggagc

SEQ ID NO: 96512 - RNA, 22 nt, Homo sapiens
gaugaggcuagagacaugugua

SEQ ID NO: 96513 - RNA, 22 nt, Homo sapiens
gaugaucaugaccuacagaugg

SEQ ID NO: 96514 - RNA, 22 nt, Homo sapiens
gaugaugcuagguguuagggcu

SEQ ID NO: 96515 - RNA, 22 nt, Homo sapiens
gaugauguuacucuuuuuccuu

SEQ ID NO: 96516 - RNA, 22 nt, Homo sapiens
gaugcagcuaggauuugugaca

SEQ ID NO: 96517 - RNA, 22 nt, Homo sapiens
gaugcaguaagaaugcauagcg

SEQ ID NO: 96518 - RNA, 22 nt, Homo sapiens
gauggaguaauguaaucuugag

SEQ ID NO: 96519 - RNA, 22 nt, Homo sapiens
gauggaguugucgccugggcug

SEQ ID NO: 96520 - RNA, 22 nt, Homo sapiens
gauggauuuuaagugaaugaaa

SEQ ID NO: 96521 - RNA, 22 nt, Homo sapiens
gauggcacuaagccauguagga

SEQ ID NO: 96522 - RNA, 22 nt, Homo sapiens
gauggcaucugagaguguuaga

SEQ ID NO: 96523 - RNA, 22 nt, Homo sapiens
gauggcuauucuuaccauuucu

SEQ ID NO: 96524 - RNA, 22 nt, Homo sapiens
gauggguuuuuugaagacagca

SEQ ID NO: 96525 - RNA, 22 nt, Homo sapiens
gauguguuuguuucuggaggag

SEQ ID NO: 96526 - RNA, 22 nt, Homo sapiens
gauuggcauugcugcaccugag

SEQ ID NO: 96527 - RNA, 22 nt, Homo sapiens
gauuugagagaggguguuuaua

SEQ ID NO: 96528 - RNA, 21 nt, Homo sapiens
gcaaacauccuuugaugccag

SEQ ID NO: 96529 - RNA, 21 nt, Homo sapiens
gcaaaguggcuaccuugcucc

SEQ ID NO: 96530 - RNA, 22 nt, Homo sapiens
gcaaaguguuuuuaggaagucu

SEQ ID NO: 96531 - RNA, 20 nt, Homo sapiens
gcaaaguuuagcucccacua

SEQ ID NO: 96532 - RNA, 22 nt, Homo sapiens
gcaaaugcuaugccauuuuaua

SEQ ID NO: 96533 - RNA, 22 nt, Homo sapiens
gcaagagguaucuuauuuuccc

SEQ ID NO: 96534 - RNA, 20 nt, Homo sapiens
gcaagcaugaagaguagaga

SEQ ID NO: 96535 - RNA, 22 nt, Homo sapiens
gcaagcuugcugggccugacuc

SEQ ID NO: 96536 - RNA, 22 nt, Homo sapiens
gcaaggacucccugggucauuc

SEQ ID NO: 96537 - RNA, 22 nt, Homo sapiens
gcaaggaugagugcccaugaga

SEQ ID NO: 96538 - RNA, 22 nt, Homo sapiens
gcaaugcugucugugcacagau

SEQ ID NO: 96539 - RNA, 22 nt, Homo sapiens
gcaauggaaucccuugaucaau

SEQ ID NO: 96540 - RNA, 22 nt, Homo sapiens
gcacagaugaggagaggucuca

SEQ ID NO: 96541 - RNA, 22 nt, Homo sapiens
gcacauggccacuaggaauaaa

SEQ ID NO: 96542 - RNA, 22 nt, Homo sapiens
gcacauggccccaucgugccga

SEQ ID NO: 96543 - RNA, 22 nt, Homo sapiens
gcaccauugacaagaaauaggu

SEQ ID NO: 96544 - RNA, 22 nt, Homo sapiens
gcaccccuuaccgggcuggguu

SEQ ID NO: 96545 - RNA, 22 nt, Homo sapiens
gcaccguggaguauggggagga

SEQ ID NO: 96546 - RNA, 22 nt, Homo sapiens
gcacgcauuguccuucuaguca

SEQ ID NO: 96547 - RNA, 22 nt, Homo sapiens
gcacgugcucauuugaggucuu

SEQ ID NO: 96548 - RNA, 22 nt, Homo sapiens
gcagaauugacucuguuuuuuc

SEQ ID NO: 96549 - RNA, 23 nt, Homo sapiens
gcagcaaugucacagggguccgg

SEQ ID NO: 96550 - RNA, 22 nt, Homo sapiens
gcagcaguggcaguuaauauuu

SEQ ID NO: 96551 - RNA, 22 nt, Homo sapiens
gcagcaucaaaucacacaagau

SEQ ID NO: 96552 - RNA, 22 nt, Homo sapiens
gcagcauuaccaagacauggca

SEQ ID NO: 96553 - RNA, 22 nt, Homo sapiens
gcaggaaucuugagaaggauuc

SEQ ID NO: 96554 - RNA, 22 nt, Homo sapiens
gcaggaauuucucugcagaccc

SEQ ID NO: 96555 - RNA, 22 nt, Homo sapiens
gcaggcaugacauuucacucuu

SEQ ID NO: 96556 - RNA, 22 nt, Homo sapiens
gcagguaguuucugacuuuuac

SEQ ID NO: 96557 - RNA, 22 nt, Homo sapiens
gcaguagugcgaucucagcuca

SEQ ID NO: 96558 - RNA, 22 nt, Homo sapiens
gcaguagugugaucuuggcuca

SEQ ID NO: 96559 - RNA, 22 nt, Homo sapiens
gcaguauuguugaaauguccau

SEQ ID NO: 96560 - RNA, 22 nt, Homo sapiens
gcagucacagggagauggugac

SEQ ID NO: 96561 - RNA, 22 nt, Homo sapiens
gcagugaugugaucauagcuca

SEQ ID NO: 96562 - RNA, 22 nt, Homo sapiens
gcagugcaugacgguauauaua

SEQ ID NO: 96563 - RNA, 22 nt, Homo sapiens
gcagugcuggagcccccgugug

SEQ ID NO: 96564 - RNA, 22 nt, Homo sapiens
gcagugugauguuuuaaucuau

SEQ ID NO: 96565 - RNA, 22 nt, Homo sapiens
gcaguguggguagagggcaaga

SEQ ID NO: 96566 - RNA, 16 nt, Homo sapiens
gcaguguguuuaauag

SEQ ID NO: 96567 - RNA, 22 nt, Homo sapiens
gcaguguucaaaucaugcccau

SEQ ID NO: 96568 - RNA, 20 nt, Homo sapiens
gcaguguucacuguauuccu

SEQ ID NO: 96569 - RNA, 22 nt, Homo sapiens
gcaguucuguaguugaaauuua

SEQ ID NO: 96570 - RNA, 22 nt, Homo sapiens
gcauauuuuaaaguguaaccug

SEQ ID NO: 96571 - RNA, 22 nt, Homo sapiens
gcaucacagcuccugugcuggc

SEQ ID NO: 96572 - RNA, 22 nt, Homo sapiens
gcaucacagggagacaggccuc

SEQ ID NO: 96573 - RNA, 22 nt, Homo sapiens
gcaugauuuuauaucuauguaa

SEQ ID NO: 96574 - RNA, 22 nt, Homo sapiens
gcauggauguugauggcugcug

SEQ ID NO: 96575 - RNA, 22 nt, Homo sapiens
gccaagaugcugcccacagaca

SEQ ID NO: 96576 - RNA, 20 nt, Homo sapiens
gccacaguuaagcuucugcc

SEQ ID NO: 96577 - RNA, 22 nt, Homo sapiens
cugcagguaggggcagcuuugg

SEQ ID NO: 96578 - RNA, 22 nt, Homo sapiens
cugcaguaaacuuucccauuca

SEQ ID NO: 96579 - RNA, 22 nt, Homo sapiens
cugcaguaaccacuguaggugu

SEQ ID NO: 96580 - RNA, 19 nt, Homo sapiens
cugcaugagacaguugguu

SEQ ID NO: 96581 - RNA, 22 nt, Homo sapiens
cugcauuugaugacguauggug

SEQ ID NO: 96582 - RNA, 22 nt, Homo sapiens
cugccugagaaaauggagggca

SEQ ID NO: 96583 - RNA, 22 nt, Homo sapiens
cuggaaagcaaagggugcauug

SEQ ID NO: 96584 - RNA, 22 nt, Homo sapiens
cuggaauauuagcuggucuuaa

SEQ ID NO: 96585 - RNA, 22 nt, Homo sapiens
cuggaaucuauggauaacaucg

SEQ ID NO: 96586 - RNA, 22 nt, Homo sapiens
cuggaaugcagcuuuaggggcu

SEQ ID NO: 96587 - RNA, 22 nt, Homo sapiens
cuggaauguuccuaaagauuca

SEQ ID NO: 96588 - RNA, 22 nt, Homo sapiens
cuggagauauuggaagaaagaa

SEQ ID NO: 96589 - RNA, 22 nt, Homo sapiens
cuggagcauugguggauuuguu

SEQ ID NO: 96590 - RNA, 22 nt, Homo sapiens
cuggagucugacugacacaagg

SEQ ID NO: 96591 - RNA, 22 nt, Homo sapiens
cuggauauuaacauugaugaaa

SEQ ID NO: 96592 - RNA, 20 nt, Homo sapiens
cuggaucaucaguaaaguua

SEQ ID NO: 96593 - RNA, 19 nt, Homo sapiens
cuggcaaaugcuuuggcca

SEQ ID NO: 96594 - RNA, 22 nt, Homo sapiens
cuggcaagaggauaaaguccua

SEQ ID NO: 96595 - RNA, 22 nt, Homo sapiens
cuggcaauaaauuuuuguguug

SEQ ID NO: 96596 - RNA, 22 nt, Homo sapiens
cuggcaauaggcagugucccaa

SEQ ID NO: 96597 - RNA, 22 nt, Homo sapiens
cuggcaccauacacuguuguug

SEQ ID NO: 96598 - RNA, 22 nt, Homo sapiens
cuggcucuguuagaagaaccag

SEQ ID NO: 96599 - RNA, 22 nt, Homo sapiens
cugggaucaguucuagucagaa

SEQ ID NO: 96600 - RNA, 22 nt, Homo sapiens
cugggauggaggagaauuagag

SEQ ID NO: 96601 - RNA, 22 nt, Homo sapiens
cuggguacccuuuaaacaggaa

SEQ ID NO: 96602 - RNA, 22 nt, Homo sapiens
cuggucaagagcaaaggccagg

SEQ ID NO: 96603 - RNA, 21 nt, Homo sapiens
cugguccccuuuauguaugug

SEQ ID NO: 96604 - RNA, 22 nt, Homo sapiens
cuggugagaugucuuuccucuu

SEQ ID NO: 96605 - RNA, 22 nt, Homo sapiens
cugguuguuacaugcuugccag

SEQ ID NO: 96606 - RNA, 22 nt, Homo sapiens
cugguuuguaaaguuccugaga

SEQ ID NO: 96607 - RNA, 22 nt, Homo sapiens
cuguaaagaucacagagcuggu

SEQ ID NO: 96608 - RNA, 22 nt, Homo sapiens
cuguaacagaauaaauuuguuu

SEQ ID NO: 96609 - RNA, 22 nt, Homo sapiens
cuguaagcauuauaaagagaua

SEQ ID NO: 96610 - RNA, 23 nt, Homo sapiens
cuguacacauauacaucuaagua

SEQ ID NO: 96611 - RNA, 22 nt, Homo sapiens
cuguaguuagcagaugaugaau

SEQ ID NO: 96612 - RNA, 22 nt, Homo sapiens
cugucacaguuuuggaggccag

SEQ ID NO: 96613 - RNA, 22 nt, Homo sapiens
cugucucagugaauugguuuua

SEQ ID NO: 96614 - RNA, 22 nt, Homo sapiens
cugucuggaguccuucgugugc

SEQ ID NO: 96615 - RNA, 22 nt, Homo sapiens
cugucuguuucaaaagugguua

SEQ ID NO: 96616 - RNA, 22 nt, Homo sapiens
cugugaacaugggagaaauggc

SEQ ID NO: 96617 - RNA, 22 nt, Homo sapiens
cugugauuauauaguuaaggua

SEQ ID NO: 96618 - RNA, 22 nt, Homo sapiens
cugugcaaagcgcucucggggu

SEQ ID NO: 96619 - RNA, 22 nt, Homo sapiens
cugugcauggauuuuaagauug

SEQ ID NO: 96620 - RNA, 22 nt, Homo sapiens
cugugcauguaugcgugaguuc

SEQ ID NO: 96621 - RNA, 22 nt, Homo sapiens
cugugcauuggaugucucccug

SEQ ID NO: 96622 - RNA, 19 nt, Homo sapiens
cugugcauuucuguggaag

SEQ ID NO: 96623 - RNA, 22 nt, Homo sapiens
cugugcuugauuauaugagugu

SEQ ID NO: 96624 - RNA, 22 nt, Homo sapiens
cugugguugagcuuugccauga

SEQ ID NO: 96625 - RNA, 22 nt, Homo sapiens
cuguucaggaggcauuuggugg

SEQ ID NO: 96626 - RNA, 22 nt, Homo sapiens
cuguugcaguuauggcugcagg

SEQ ID NO: 96627 - RNA, 22 nt, Homo sapiens
cuguuuguuuaggguacucaga

SEQ ID NO: 96628 - RNA, 22 nt, Homo sapiens
cuuaagcauugacuuuggacag

SEQ ID NO: 96629 - RNA, 22 nt, Homo sapiens
cuuacagucuaucagccacaac

SEQ ID NO: 96630 - RNA, 19 nt, Homo sapiens
cuuaggugaccaguuccca

SEQ ID NO: 96631 - RNA, 22 nt, Homo sapiens
cuucaaguuggaagggaccuaa

SEQ ID NO: 96632 - RNA, 22 nt, Homo sapiens
cuucagcaauauauccccuggg

SEQ ID NO: 96633 - RNA, 22 nt, Homo sapiens
cuucaugagacuuuuggaaggc

SEQ ID NO: 96634 - RNA, 22 nt, Homo sapiens
cuuccagcuggguucagucagu

SEQ ID NO: 96635 - RNA, 22 nt, Homo sapiens
cuuccugaguccugggcucaca

SEQ ID NO: 96636 - RNA, 22 nt, Homo sapiens
cuucucagugcucaucuuauuu

SEQ ID NO: 96637 - RNA, 22 nt, Homo sapiens
cuucugauugaaaauggaguag

SEQ ID NO: 96638 - RNA, 22 nt, Homo sapiens
cuucuguuaguucugauaacuu

SEQ ID NO: 96639 - RNA, 22 nt, Homo sapiens
cuucuugagacuuaggcuuugg

SEQ ID NO: 96640 - RNA, 22 nt, Homo sapiens
cuucuugcuguguccucacaug

SEQ ID NO: 96641 - RNA, 20 nt, Homo sapiens
cuugaagacuaugcugcuga

SEQ ID NO: 96642 - RNA, 22 nt, Homo sapiens
cuugaauguaaauaauguacag

SEQ ID NO: 96643 - RNA, 22 nt, Homo sapiens
cuugacaaugcuucaggcugaa

SEQ ID NO: 96644 - RNA, 22 nt, Homo sapiens
cuugagacauuguuuuccaagu

SEQ ID NO: 96645 - RNA, 22 nt, Homo sapiens
cuugaucaaugugguacuugau

SEQ ID NO: 96646 - RNA, 22 nt, Homo sapiens
cuugcacucagaagauucaguu

SEQ ID NO: 96647 - RNA, 22 nt, Homo sapiens
cuugccuaaucugcaugauuuu

SEQ ID NO: 96648 - RNA, 20 nt, Homo sapiens
cuugcuccccuuguucuaga

SEQ ID NO: 96649 - RNA, 22 nt, Homo sapiens
cuuggacaccucaugcccaccu

SEQ ID NO: 96650 - RNA, 22 nt, Homo sapiens
cuuggcacgugauagguguuga

SEQ ID NO: 96651 - RNA, 22 nt, Homo sapiens
cuuggcauugccccuggaauuu

SEQ ID NO: 96652 - RNA, 22 nt, Homo sapiens
cuuggcauuguguugauagaag

SEQ ID NO: 96653 - RNA, 22 nt, Homo sapiens
cuuggcuuguuguccccugcuc

SEQ ID NO: 96654 - RNA, 22 nt, Homo sapiens
cuuggguaagucauuaaaauua

SEQ ID NO: 96655 - RNA, 22 nt, Homo sapiens
cuugguuacauuuuccuagaaa

SEQ ID NO: 96656 - RNA, 22 nt, Homo sapiens
cuugucuugcacacgguugcca

SEQ ID NO: 96657 - RNA, 22 nt, Homo sapiens
cuuguggugcuuuuacgugggc

SEQ ID NO: 96658 - RNA, 22 nt, Homo sapiens
cuuguuguggaggggagugcag

SEQ ID NO: 96659 - RNA, 17 nt, Homo sapiens
cuuguugugguaguuug

SEQ ID NO: 96660 - RNA, 22 nt, Homo sapiens
cuuuaguuaaaauugggguugu

SEQ ID NO: 96661 - RNA, 21 nt, Homo sapiens
cuuugcacugcuccucagcuc

SEQ ID NO: 96662 - RNA, 22 nt, Homo sapiens
cuuuggauggaaccucucuuuc

SEQ ID NO: 96663 - RNA, 22 nt, Homo sapiens
cuuugggaccgcgguuuauacu

SEQ ID NO: 96664 - RNA, 22 nt, Homo sapiens
cuuuggucaauugcugugggga

SEQ ID NO: 96665 - RNA, 23 nt, Homo sapiens
cuuuggucucugguugacuucag

SEQ ID NO: 96666 - RNA, 22 nt, Homo sapiens
cuuugguggagucuuuagguuc

SEQ ID NO: 96667 - RNA, 22 nt, Homo sapiens
cuuugguguauuuucagagacc

SEQ ID NO: 96668 - RNA, 19 nt, Homo sapiens
ggcaccuuuuccaaaaaug

SEQ ID NO: 96669 - RNA, 23 nt, Homo sapiens
ggcacggaauucaaagaggcauu

SEQ ID NO: 96670 - RNA, 22 nt, Homo sapiens
agcuuguccuccacccacacug

SEQ ID NO: 96671 - RNA, 22 nt, Homo sapiens
agcuuguguuugucugccuggg

SEQ ID NO: 96672 - RNA, 22 nt, Homo sapiens
agcuuguguuuuucuaaguauc

SEQ ID NO: 96673 - RNA, 22 nt, Homo sapiens
agcuuguuuuccugcaacuaga

SEQ ID NO: 96674 - RNA, 22 nt, Homo sapiens
agcuuuggauaccugcuguucc

SEQ ID NO: 96675 - RNA, 22 nt, Homo sapiens
aggaagacauauagaacuaaaa

SEQ ID NO: 96676 - RNA, 22 nt, Homo sapiens
aggacacugauguaugcugugg

SEQ ID NO: 96677 - RNA, 22 nt, Homo sapiens
aggaccaugguauugcuuuggg

SEQ ID NO: 96678 - RNA, 22 nt, Homo sapiens
aggagaucagccucccugcaac

SEQ ID NO: 96679 - RNA, 23 nt, Homo sapiens
aggagcuuagaaguugccauugc

SEQ ID NO: 96680 - RNA, 22 nt, Homo sapiens
aggaguguguauuaaugaaauu

SEQ ID NO: 96681 - RNA, 22 nt, Homo sapiens
aggcaaaugccagcaaucacac

SEQ ID NO: 96682 - RNA, 22 nt, Homo sapiens
aggcaacaugguaaaacccugu

SEQ ID NO: 96683 - RNA, 21 nt, Homo sapiens
aggcaagauuacuuacgagca

SEQ ID NO: 96684 - RNA, 22 nt, Homo sapiens
aggcaagcaucuugcucccuuc

SEQ ID NO: 96685 - RNA, 22 nt, Homo sapiens
aggcaagugggagacagcauuu

SEQ ID NO: 96686 - RNA, 22 nt, Homo sapiens
aggcaaugugagaguuuauuca

SEQ ID NO: 96687 - RNA, 22 nt, Homo sapiens
aggcacacaacccuggaccuga

SEQ ID NO: 96688 - RNA, 22 nt, Homo sapiens
aggcaguuucagugagagguga

SEQ ID NO: 96689 - RNA, 22 nt, Homo sapiens
aggcaugauggcuccagaucau

SEQ ID NO: 96690 - RNA, 22 nt, Homo sapiens
aggcaugauuguauuuugcucu

SEQ ID NO: 96691 - RNA, 22 nt, Homo sapiens
aggcauguggcucuguucugac

SEQ ID NO: 96692 - RNA, 22 nt, Homo sapiens
aggcauugugcaucgaugauuu

SEQ ID NO: 96693 - RNA, 21 nt, Homo sapiens
aggcuguuguuuugggaugga

SEQ ID NO: 96694 - RNA, 22 nt, Homo sapiens
aggcuuuauuacagggucucag

SEQ ID NO: 96695 - RNA, 22 nt, Homo sapiens
agggcacuguagguccugccuc

SEQ ID NO: 96696 - RNA, 22 nt, Homo sapiens
aggguaguaggcuugggauugg

SEQ ID NO: 96697 - RNA, 22 nt, Homo sapiens
agguaauagcacaugauaccuu

SEQ ID NO: 96698 - RNA, 20 nt, Homo sapiens
agguacacugacaugccuuc

SEQ ID NO: 96699 - RNA, 22 nt, Homo sapiens
agguacuuucccaaccauacug

SEQ ID NO: 96700 - RNA, 22 nt, Homo sapiens
agguagaguguuuuguucuucu

SEQ ID NO: 96701 - RNA, 20 nt, Homo sapiens
agguaguuauacaaaugugu

SEQ ID NO: 96702 - RNA, 22 nt, Homo sapiens
agguauguuuuaugguccauaa

SEQ ID NO: 96703 - RNA, 22 nt, Homo sapiens
agguauuuuuuauccuccagca

SEQ ID NO: 96704 - RNA, 22 nt, Homo sapiens
aggucccauguccucccugacc

SEQ ID NO: 96705 - RNA, 22 nt, Homo sapiens
aggugaaugcucacauucuaau

SEQ ID NO: 96706 - RNA, 22 nt, Homo sapiens
aggugcaauggugguuuugugg

SEQ ID NO: 96707 - RNA, 22 nt, Homo sapiens
aggugcucuuccuguaggucac

SEQ ID NO: 96708 - RNA, 22 nt, Homo sapiens
aggugguuuuaggcagagacau

SEQ ID NO: 96709 - RNA, 22 nt, Homo sapiens
aggugguuuugaugagcaggua

SEQ ID NO: 96710 - RNA, 22 nt, Homo sapiens
agguuaugauuguagagcgagg

SEQ ID NO: 96711 - RNA, 22 nt, Homo sapiens
agguucccuuuuggccugggau

SEQ ID NO: 96712 - RNA, 22 nt, Homo sapiens
agguuuucagccccagccuagg

SEQ ID NO: 96713 - RNA, 22 nt, Homo sapiens
aguaacaggauccaaagaaugu

SEQ ID NO: 96714 - RNA, 22 nt, Homo sapiens
aguaacauuucuaguagagagu

SEQ ID NO: 96715 - RNA, 22 nt, Homo sapiens
aguaaucaucugagggcagaaa

SEQ ID NO: 96716 - RNA, 22 nt, Homo sapiens
aguacacuguuaaaaagaagug

SEQ ID NO: 96717 - RNA, 22 nt, Homo sapiens
aguaccauuccguuggagcugg

SEQ ID NO: 96718 - RNA, 17 nt, Homo sapiens
aguacugucccauccuu

SEQ ID NO: 96719 - RNA, 22 nt, Homo sapiens
aguagcauuggggggcauccuc

SEQ ID NO: 96720 - RNA, 22 nt, Homo sapiens
aguaucacaagguguacaccca

SEQ ID NO: 96721 - RNA, 22 nt, Homo sapiens
aguauuaggugaguguauuuca

SEQ ID NO: 96722 - RNA, 22 nt, Homo sapiens
agucaacaucaugaaguggaaa

SEQ ID NO: 96723 - RNA, 22 nt, Homo sapiens
agucaagaugagauuugggugg

SEQ ID NO: 96724 - RNA, 22 nt, Homo sapiens
agucaaggaggccuuucagaug

SEQ ID NO: 96725 - RNA, 22 nt, Homo sapiens
agucaagugggguuagauaguu

SEQ ID NO: 96726 - RNA, 22 nt, Homo sapiens
agucacagccuuuuacuuuaga

SEQ ID NO: 96727 - RNA, 22 nt, Homo sapiens
agucagauuggcauuuguuggg

SEQ ID NO: 96728 - RNA, 17 nt, Homo sapiens
agucaguaguuuguauu

SEQ ID NO: 96729 - RNA, 22 nt, Homo sapiens
agucagucuguccugugcugag

SEQ ID NO: 96730 - RNA, 22 nt, Homo sapiens
agucaguggaguaaauguaauu

SEQ ID NO: 96731 - RNA, 22 nt, Homo sapiens
agucaguguguauugauggcac

SEQ ID NO: 96732 - RNA, 22 nt, Homo sapiens
aguccagguuuuguaauggcaa

SEQ ID NO: 96733 - RNA, 22 nt, Homo sapiens
aguccaguguuaugaucaguag

SEQ ID NO: 96734 - RNA, 22 nt, Homo sapiens
aguccauuugaugaugauucca

SEQ ID NO: 96735 - RNA, 22 nt, Homo sapiens
agugaauguuggaaaguuauuu

SEQ ID NO: 96736 - RNA, 22 nt, Homo sapiens
agugacaugggaucaaaucuga

SEQ ID NO: 96737 - RNA, 22 nt, Homo sapiens
agugagcugcagucuggggucc

SEQ ID NO: 96738 - RNA, 22 nt, Homo sapiens
agugauauguuugccuugaggg

SEQ ID NO: 96739 - RNA, 22 nt, Homo sapiens
agugcaauaaggauguagaacu

SEQ ID NO: 96740 - RNA, 22 nt, Homo sapiens
agugcaaugauccggugcuggg

SEQ ID NO: 96741 - RNA, 22 nt, Homo sapiens
agugcaauggcgugaucuuggc

SEQ ID NO: 96742 - RNA, 22 nt, Homo sapiens
agugcaauggugccaucauagc

SEQ ID NO: 96743 - RNA, 22 nt, Homo sapiens
agugcaguggugccaucauaac

SEQ ID NO: 96744 - RNA, 22 nt, Homo sapiens
agugcauugcaucucugcuuca

SEQ ID NO: 96745 - RNA, 22 nt, Homo sapiens
agugcauuugcaucucaauaua

SEQ ID NO: 96746 - RNA, 22 nt, Homo sapiens
agugcauuuguucugugucagg

SEQ ID NO: 96747 - RNA, 22 nt, Homo sapiens
agugccauggcugcuagauggc

SEQ ID NO: 96748 - RNA, 22 nt, Homo sapiens
aguggaauuaagaaacugaauu

SEQ ID NO: 96749 - RNA, 22 nt, Homo sapiens
aguggauuuuauuugacaacua

SEQ ID NO: 96750 - RNA, 22 nt, Homo sapiens
aguggguguuccauuggauaaa

SEQ ID NO: 96751 - RNA, 20 nt, Homo sapiens
agugguuuucaaauaugucu

SEQ ID NO: 96752 - RNA, 19 nt, Homo sapiens
agugucauggucauuauuu

SEQ ID NO: 96753 - RNA, 22 nt, Homo sapiens
aguuggccccuacugggaggug

SEQ ID NO: 96754 - RNA, 22 nt, Homo sapiens
aguuggugauugauugggucug

SEQ ID NO: 96755 - RNA, 22 nt, Homo sapiens
auaaacugucaguggagaguaa

SEQ ID NO: 96756 - RNA, 22 nt, Homo sapiens
auaaagacacuuggcaugauuu

SEQ ID NO: 96757 - RNA, 22 nt, Homo sapiens
auaaagccaggagacguaauug

SEQ ID NO: 96758 - RNA, 22 nt, Homo sapiens
auaaaugcauugagaacugcug

SEQ ID NO: 96759 - RNA, 22 nt, Homo sapiens
auaaucaugucugaaaccuuug

SEQ ID NO: 96760 - RNA, 22 nt, Homo sapiens
auaaugacuuccaguuccacuc

SEQ ID NO: 96761 - RNA, 22 nt, Homo sapiens
auaaugcuuuucuagguugcau

SEQ ID NO: 96762 - RNA, 22 nt, Homo sapiens
auaauguuuauccagaggaguu

SEQ ID NO: 96763 - RNA, 22 nt, Homo sapiens
auaauugcuaagugaagauggu

SEQ ID NO: 96764 - RNA, 22 nt, Homo sapiens
auacacgugcagaacaugcagg

SEQ ID NO: 96765 - RNA, 22 nt, Homo sapiens
auacaguaaugucuuaggcugu

SEQ ID NO: 96766 - RNA, 22 nt, Homo sapiens
auacaucugccauguuggugug

SEQ ID NO: 96767 - RNA, 22 nt, Homo sapiens
auacaugcauuugcacgagagu

SEQ ID NO: 96768 - RNA, 22 nt, Homo sapiens
auacaugugccauguugguaug

SEQ ID NO: 96769 - RNA, 16 nt, Homo sapiens
auaccacagugacaca

SEQ ID NO: 96770 - RNA, 22 nt, Homo sapiens
auaccugguagucuugcuacac

SEQ ID NO: 96771 - RNA, 22 nt, Homo sapiens
auacuccugucucagcugagau

SEQ ID NO: 96772 - RNA, 22 nt, Homo sapiens
auacugccuuuagcaaaacagu

SEQ ID NO: 96773 - RNA, 22 nt, Homo sapiens
auacugguuuuugucaugugga

SEQ ID NO: 96774 - RNA, 22 nt, Homo sapiens
auacuguauaggauuguagccu

SEQ ID NO: 96775 - RNA, 22 nt, Homo sapiens
auacugucucuugcuccugccc

SEQ ID NO: 96776 - RNA, 21 nt, Homo sapiens
auacuugcauccuuggagaga

SEQ ID NO: 96777 - RNA, 22 nt, Homo sapiens
auagaccuggagaguagauaua

SEQ ID NO: 96778 - RNA, 22 nt, Homo sapiens
auagaggacugaggugaucuuu

SEQ ID NO: 96779 - RNA, 22 nt, Homo sapiens
auagcaaugccccaauccuugg

SEQ ID NO: 96780 - RNA, 22 nt, Homo sapiens
auagcacacuauagcuucaaac

SEQ ID NO: 96781 - RNA, 21 nt, Homo sapiens
auagcacuucacuugguuaga

SEQ ID NO: 96782 - RNA, 22 nt, Homo sapiens
auagcagaauuuggucaagucu

SEQ ID NO: 96783 - RNA, 22 nt, Homo sapiens
auagcagcaccucacucuacug

SEQ ID NO: 96784 - RNA, 22 nt, Homo sapiens
auagcagugugaaaauugacug

SEQ ID NO: 96785 - RNA, 22 nt, Homo sapiens
auagcagugugagaaugaacua

SEQ ID NO: 96786 - RNA, 22 nt, Homo sapiens
auagcauaucccacaugucaga

SEQ ID NO: 96787 - RNA, 22 nt, Homo sapiens
auagcugcucaggcuuuccuca

SEQ ID NO: 96788 - RNA, 22 nt, Homo sapiens
auagcuguccuuacuagcuagg

SEQ ID NO: 96789 - RNA, 22 nt, Homo sapiens
auagcuguugaauggaauauuc

SEQ ID NO: 96790 - RNA, 22 nt, Homo sapiens
auagggcacgagaugugagccu

SEQ ID NO: 96791 - RNA, 22 nt, Homo sapiens
auaguagcaugcacuggugcug

SEQ ID NO: 96792 - RNA, 22 nt, Homo sapiens
auagugcugcaaaaaacauacg

SEQ ID NO: 96793 - RNA, 22 nt, Homo sapiens
auagugcugcaauaaacacacg

SEQ ID NO: 96794 - RNA, 22 nt, Homo sapiens
auagugcugcaauaaacauacg

SEQ ID NO: 96795 - RNA, 22 nt, Homo sapiens
auagugcugcaauaaccauggg

SEQ ID NO: 96796 - RNA, 22 nt, Homo sapiens
auagugcugcaaugaacauaca

SEQ ID NO: 96797 - RNA, 22 nt, Homo sapiens
auagugcugcauuaaacauacg

SEQ ID NO: 96798 - RNA, 22 nt, Homo sapiens
auaguggcaugaucauagcuca

SEQ ID NO: 96799 - RNA, 23 nt, Homo sapiens
auauaguagaugugcaguaacau

SEQ ID NO: 96800 - RNA, 22 nt, Homo sapiens
auauaugcacacgugugcauau

SEQ ID NO: 96801 - RNA, 22 nt, Homo sapiens
auaucaaggccauuuucuaaau

SEQ ID NO: 96802 - RNA, 22 nt, Homo sapiens
auaucagugucuuacuguuuuu

SEQ ID NO: 96803 - RNA, 22 nt, Homo sapiens
auaucccaguguguaaacacug

SEQ ID NO: 96804 - RNA, 22 nt, Homo sapiens
auaucccuguauaagugaaugu

SEQ ID NO: 96805 - RNA, 22 nt, Homo sapiens
auaugcacgugcauacacacuu

SEQ ID NO: 96806 - RNA, 22 nt, Homo sapiens
auaugcuuauuagcaagaaaua

SEQ ID NO: 96807 - RNA, 22 nt, Homo sapiens
auauggguuuuauauuaggcuc

SEQ ID NO: 96808 - RNA, 22 nt, Homo sapiens
auaugguguuugcuauucagcu

SEQ ID NO: 96809 - RNA, 20 nt, Homo sapiens
auaugguugugagugauuuu

SEQ ID NO: 96810 - RNA, 22 nt, Homo sapiens
auauguauuuuaacguguaagg

SEQ ID NO: 96811 - RNA, 22 nt, Homo sapiens
auaugucuguuuagucuguaau

SEQ ID NO: 96812 - RNA, 22 nt, Homo sapiens
auauguucucauucauaugugg

SEQ ID NO: 96813 - RNA, 22 nt, Homo sapiens
auauuacuggcuauaucgcaag

SEQ ID NO: 96814 - RNA, 22 nt, Homo sapiens
auauucaagugaggauggcuaa

SEQ ID NO: 96815 - RNA, 22 nt, Homo sapiens
auauucacagguaucagagauu

SEQ ID NO: 96816 - RNA, 22 nt, Homo sapiens
auauugacuuucucuuagauca

SEQ ID NO: 96817 - RNA, 22 nt, Homo sapiens
auauugcuccuaauaccacggu

SEQ ID NO: 96818 - RNA, 22 nt, Homo sapiens
auauugcuuagugaugaagucu

SEQ ID NO: 96819 - RNA, 22 nt, Homo sapiens
auauuggacucugugcuaggaa

SEQ ID NO: 96820 - RNA, 22 nt, Homo sapiens
auauugguuaaauauuauguga

SEQ ID NO: 96821 - RNA, 22 nt, Homo sapiens
auauuugguuaccugugggucu

SEQ ID NO: 96822 - RNA, 20 nt, Homo sapiens
aucaaagacuuagaggggga

SEQ ID NO: 96823 - RNA, 22 nt, Homo sapiens
aucaaaucuccagaaccugucu

SEQ ID NO: 96824 - RNA, 22 nt, Homo sapiens
aucaagcuggcauauguaguuc

SEQ ID NO: 96825 - RNA, 22 nt, Homo sapiens
aucacaauuguacguaggagcc

SEQ ID NO: 96826 - RNA, 22 nt, Homo sapiens
aucacacuguuauuuuaguuaa

SEQ ID NO: 96827 - RNA, 22 nt, Homo sapiens
aucacagaacuuugagcagaga

SEQ ID NO: 96828 - RNA, 22 nt, Homo sapiens
aucacagcccuccucuuggaug

SEQ ID NO: 96829 - RNA, 22 nt, Homo sapiens
aucacaggcaaaauuccuucuc

SEQ ID NO: 96830 - RNA, 22 nt, Homo sapiens
aucacagugaaaacagucaauu

SEQ ID NO: 96831 - RNA, 22 nt, Homo sapiens
aucacaguggucagguauagau

SEQ ID NO: 96832 - RNA, 22 nt, Homo sapiens
aucacaguuaagaggugaugaa

SEQ ID NO: 96833 - RNA, 21 nt, Homo sapiens
aucaccgugcaguucuccagg

SEQ ID NO: 96834 - RNA, 22 nt, Homo sapiens
aucacugggauggaacugcuga

SEQ ID NO: 96835 - RNA, 22 nt, Homo sapiens
aucacugggcaagauaucauga

SEQ ID NO: 96836 - RNA, 23 nt, Homo sapiens
aucacuguuaacaauuucuuccu

SEQ ID NO: 96837 - RNA, 22 nt, Homo sapiens
guuuggcuuucucucuauccug

SEQ ID NO: 96838 - RNA, 22 nt, Homo sapiens
guuugugcuccuaugagaaccu

SEQ ID NO: 96839 - RNA, 15 nt, Homo sapiens
guuuuuggauacaau

SEQ ID NO: 96840 - RNA, 21 nt, Homo sapiens
uaaaacuguaacuuuguccug

SEQ ID NO: 96841 - RNA, 22 nt, Homo sapiens
uaaacacucacuucauagccau

SEQ ID NO: 96842 - RNA, 22 nt, Homo sapiens
uaaaccacguuuacauuugaga

SEQ ID NO: 96843 - RNA, 22 nt, Homo sapiens
uaaacugcuugaaaugguguca

SEQ ID NO: 96844 - RNA, 22 nt, Homo sapiens
uaaagauaaggcucgcuuggau

SEQ ID NO: 96845 - RNA, 22 nt, Homo sapiens
uaaagaugcugggaaggcuagg

SEQ ID NO: 96846 - RNA, 17 nt, Homo sapiens
uaaagccagucaaguca

SEQ ID NO: 96847 - RNA, 22 nt, Homo sapiens
uaaagcuagagcuggaguggca

SEQ ID NO: 96848 - RNA, 22 nt, Homo sapiens
uaaagcugaaaugauuaugaca

SEQ ID NO: 96849 - RNA, 22 nt, Homo sapiens
uaaagugcugagaugaggcugg

SEQ ID NO: 96850 - RNA, 22 nt, Homo sapiens
uaccucuguaaguaaagauuca

SEQ ID NO: 96851 - RNA, 22 nt, Homo sapiens
uaccuguagacuacagcuucag

SEQ ID NO: 96852 - RNA, 22 nt, Homo sapiens
uacguuaucagguaugcaagag

SEQ ID NO: 96853 - RNA, 22 nt, Homo sapiens
uacuacuuucucuucugggaaa

SEQ ID NO: 96854 - RNA, 22 nt, Homo sapiens
uacuagaggcgggguuucgcca

SEQ ID NO: 96855 - RNA, 23 nt, Homo sapiens
uacuaguaagcguguucuuugca

SEQ ID NO: 96856 - RNA, 22 nt, Homo sapiens
uacuauugcaucggugauuagg

SEQ ID NO: 96857 - RNA, 22 nt, Homo sapiens
uacucaauugcagucaccuggc

SEQ ID NO: 96858 - RNA, 22 nt, Homo sapiens
uacucugcagagaugcauaaca

SEQ ID NO: 96859 - RNA, 22 nt, Homo sapiens
uacucugcagccauaaaacaga

SEQ ID NO: 96860 - RNA, 22 nt, Homo sapiens
uacucugcaguaauuccagccc

SEQ ID NO: 96861 - RNA, 22 nt, Homo sapiens
uacugcacauaugaagguuccc

SEQ ID NO: 96862 - RNA, 19 nt, Homo sapiens
uacugcaccucaaccuggg

SEQ ID NO: 96863 - RNA, 20 nt, Homo sapiens
uacugcacuccaaccuaggc

SEQ ID NO: 96864 - RNA, 22 nt, Homo sapiens
uacugcacuccacccuggguga

SEQ ID NO: 96865 - RNA, 22 nt, Homo sapiens
uacugcacuccagccugccaac

SEQ ID NO: 96866 - RNA, 22 nt, Homo sapiens
uacugcacuccagccugggaga

SEQ ID NO: 96867 - RNA, 22 nt, Homo sapiens
uacugcacuccagccuugccaa

SEQ ID NO: 96868 - RNA, 22 nt, Homo sapiens
uacugcacuccagcuuaggaga

SEQ ID NO: 96869 - RNA, 18 nt, Homo sapiens
uacugcacucuccagccu

SEQ ID NO: 96870 - RNA, 20 nt, Homo sapiens
uacugcacuuuccucauggu

SEQ ID NO: 96871 - RNA, 22 nt, Homo sapiens
uacugcaguugcagcuugagga

SEQ ID NO: 96872 - RNA, 23 nt, Homo sapiens
uacugcauccuccgccucuaggg

SEQ ID NO: 96873 - RNA, 22 nt, Homo sapiens
uacugcauuucacuguuaaaga

SEQ ID NO: 96874 - RNA, 22 nt, Homo sapiens
uacugcuaccuccagcuucugg

SEQ ID NO: 96875 - RNA, 21 nt, Homo sapiens
uacuggagauacagucugcaa

SEQ ID NO: 96876 - RNA, 22 nt, Homo sapiens
uacugguuuuauauauuucucc

SEQ ID NO: 96877 - RNA, 22 nt, Homo sapiens
uacugguuuuggugggcaggug

SEQ ID NO: 96878 - RNA, 22 nt, Homo sapiens
uacuuuguagagugugagaauu

SEQ ID NO: 96879 - RNA, 22 nt, Homo sapiens
uacuuuguuauagcagcaggaa

SEQ ID NO: 96880 - RNA, 22 nt, Homo sapiens
uagaacauuccaggugauguug

SEQ ID NO: 96881 - RNA, 22 nt, Homo sapiens
uagaagcugagaauguccucag

SEQ ID NO: 96882 - RNA, 22 nt, Homo sapiens
uagaaucuaacucgcaugaaaa

SEQ ID NO: 96883 - RNA, 22 nt, Homo sapiens
uagaauguaacaguuaaaagca

SEQ ID NO: 96884 - RNA, 22 nt, Homo sapiens
uagacuguaagauccaggagag

SEQ ID NO: 96885 - RNA, 22 nt, Homo sapiens
uagagcaaugacucuggaaacc

SEQ ID NO: 96886 - RNA, 18 nt, Homo sapiens
uagagcacaagcuuuggc

SEQ ID NO: 96887 - RNA, 22 nt, Homo sapiens
uagagcaugugccauacguaca

SEQ ID NO: 96888 - RNA, 22 nt, Homo sapiens
uagagcuugacacuuuccaugg

SEQ ID NO: 96889 - RNA, 21 nt, Homo sapiens
uagagcuuggcacagaguaga

SEQ ID NO: 96890 - RNA, 22 nt, Homo sapiens
uagagguauguauaguauucuu

SEQ ID NO: 96891 - RNA, 22 nt, Homo sapiens
uagagguucuaagauucucaga

SEQ ID NO: 96892 - RNA, 22 nt, Homo sapiens
uagauaauuagaggguuuuaag

SEQ ID NO: 96893 - RNA, 22 nt, Homo sapiens
uagaucacucaggcaauaaaag

SEQ ID NO: 96894 - RNA, 22 nt, Homo sapiens
uagaucauauucagugcuuacu

SEQ ID NO: 96895 - RNA, 22 nt, Homo sapiens
uagauuauuccuuugaauggcc

SEQ ID NO: 96896 - RNA, 22 nt, Homo sapiens
uagauucauuuuagcaaaaguu

SEQ ID NO: 96897 - RNA, 23 nt, Homo sapiens
uagcaacaguuggaggugaggua

SEQ ID NO: 96898 - RNA, 22 nt, Homo sapiens
uagcaacauucagcucagguac

SEQ ID NO: 96899 - RNA, 22 nt, Homo sapiens
uagcaccaggguugacugaccu

SEQ ID NO: 96900 - RNA, 22 nt, Homo sapiens
uagcaccucuuuggccuuucgu

SEQ ID NO: 96901 - RNA, 22 nt, Homo sapiens
uagcaccugugcacaccaggca

SEQ ID NO: 96902 - RNA, 22 nt, Homo sapiens
uagcacuauuuuucacuauccu

SEQ ID NO: 96903 - RNA, 22 nt, Homo sapiens
uagcacugucuugcaccugugc

SEQ ID NO: 96904 - RNA, 22 nt, Homo sapiens
uagcagaauaacuugccagccu

SEQ ID NO: 96905 - RNA, 20 nt, Homo sapiens
uagcagcagacagagggagg

SEQ ID NO: 96906 - RNA, 22 nt, Homo sapiens
uagcagcagugguguauuuaga

SEQ ID NO: 96907 - RNA, 22 nt, Homo sapiens
uagcaguaaagaaugugauguu

SEQ ID NO: 96908 - RNA, 22 nt, Homo sapiens
uagcaguauugaaagaugaggg

SEQ ID NO: 96909 - RNA, 22 nt, Homo sapiens
uagccucacaaagugcuuaaga

SEQ ID NO: 96910 - RNA, 22 nt, Homo sapiens
uagcucagcccagcuaagcuca

SEQ ID NO: 96911 - RNA, 22 nt, Homo sapiens
uagcugcaaaauauagacuucu

SEQ ID NO: 96912 - RNA, 22 nt, Homo sapiens
uagcugcacuuacaagugagaa

SEQ ID NO: 96913 - RNA, 22 nt, Homo sapiens
uagcuucuccauagcuccaugu

SEQ ID NO: 96914 - RNA, 23 nt, Homo sapiens
uagcuucucccagaccugcuccc

SEQ ID NO: 96915 - RNA, 22 nt, Homo sapiens
uaggaaguuucuugauuacuua

SEQ ID NO: 96916 - RNA, 22 nt, Homo sapiens
uaggacacaggacauauguaga

SEQ ID NO: 96917 - RNA, 22 nt, Homo sapiens
uaggagugugaacccuguuuug

SEQ ID NO: 96918 - RNA, 22 nt, Homo sapiens
uaggcaauguggcgaaacucug

SEQ ID NO: 96919 - RNA, 22 nt, Homo sapiens
uaggcacugagaauaugaggau

SEQ ID NO: 96920 - RNA, 22 nt, Homo sapiens
uaggcaguggagaaauaaacag

SEQ ID NO: 96921 - RNA, 21 nt, Homo sapiens
uaggccgggugcaggaugcuu

SEQ ID NO: 96922 - RNA, 22 nt, Homo sapiens
uagggaguguccuuucgggaaa

SEQ ID NO: 96923 - RNA, 22 nt, Homo sapiens
uagggagugucuucauuuugua

SEQ ID NO: 96924 - RNA, 22 nt, Homo sapiens
uaugacguuuuauuggcgcagu

SEQ ID NO: 96925 - RNA, 22 nt, Homo sapiens
uaugacuguuugcucauucagg

SEQ ID NO: 96926 - RNA, 22 nt, Homo sapiens
uaugacuuuugaauacagaugg

SEQ ID NO: 96927 - RNA, 22 nt, Homo sapiens
uaugagacugguuaauuuuugu

SEQ ID NO: 96928 - RNA, 22 nt, Homo sapiens
uaugagaugaggccacugggua

SEQ ID NO: 96929 - RNA, 22 nt, Homo sapiens
uaugagcacauauguaucuaug

SEQ ID NO: 96930 - RNA, 22 nt, Homo sapiens
uaugcacuaggcacuguguuug

SEQ ID NO: 96931 - RNA, 22 nt, Homo sapiens
uaugcuuauaaacauuugucag

SEQ ID NO: 96932 - RNA, 22 nt, Homo sapiens
uaugcuuauugucucauccacu

SEQ ID NO: 96933 - RNA, 22 nt, Homo sapiens
uauggacuuuaggauagcuuuu

SEQ ID NO: 96934 - RNA, 21 nt, Homo sapiens
uauggauuugccuauucugga

SEQ ID NO: 96935 - RNA, 22 nt, Homo sapiens
uauggcaaugcauaggaaggaa

SEQ ID NO: 96936 - RNA, 22 nt, Homo sapiens
uauggcauuuuguaagggcuug

SEQ ID NO: 96937 - RNA, 22 nt, Homo sapiens
uauggccccuacaugugcaaaa

SEQ ID NO: 96938 - RNA, 22 nt, Homo sapiens
uauggcuucuuauucuuucccg

SEQ ID NO: 96939 - RNA, 22 nt, Homo sapiens
uauggcuuuuauuauguuguag

SEQ ID NO: 96940 - RNA, 22 nt, Homo sapiens
uaugggauuucauuaagugucu

SEQ ID NO: 96941 - RNA, 22 nt, Homo sapiens
uauggguuuauuucuggucuca

SEQ ID NO: 96942 - RNA, 20 nt, Homo sapiens
uaugguuuuagguauagcau

SEQ ID NO: 96943 - RNA, 22 nt, Homo sapiens
uaugguuuucucuuacguguug

SEQ ID NO: 96944 - RNA, 22 nt, Homo sapiens
uauguguuuuauggucagggag

SEQ ID NO: 96945 - RNA, 18 nt, Homo sapiens
uauuaagcuagauauuau

SEQ ID NO: 96946 - RNA, 22 nt, Homo sapiens
uauuagguuggugcaaaaguua

SEQ ID NO: 96947 - RNA, 22 nt, Homo sapiens
uauuagguugguggaaaaguaa

SEQ ID NO: 96948 - RNA, 22 nt, Homo sapiens
uauuaguuguaugauucccaag

SEQ ID NO: 96949 - RNA, 22 nt, Homo sapiens
uauuauuguccuucuauaccca

SEQ ID NO: 96950 - RNA, 22 nt, Homo sapiens
uauuccacucuguuggagguaa

SEQ ID NO: 96951 - RNA, 22 nt, Homo sapiens
uauugaacgugggauauugaag

SEQ ID NO: 96952 - RNA, 22 nt, Homo sapiens
uauugaacuggaucagaaggcc

SEQ ID NO: 96953 - RNA, 22 nt, Homo sapiens
uauugacauuacagugggucuu

SEQ ID NO: 96954 - RNA, 17 nt, Homo sapiens
uauugaccuuuguaugu

SEQ ID NO: 96955 - RNA, 22 nt, Homo sapiens
uauugacuugagaagggauuag

SEQ ID NO: 96956 - RNA, 22 nt, Homo sapiens
uauugcaaauggugaucccagg

SEQ ID NO: 96957 - RNA, 22 nt, Homo sapiens
uauugcaacagaagaaagaguc

SEQ ID NO: 96958 - RNA, 22 nt, Homo sapiens
uauugcacuuuuccauaggagu

SEQ ID NO: 96959 - RNA, 22 nt, Homo sapiens
uauugcccugcuuuguucuaaa

SEQ ID NO: 96960 - RNA, 22 nt, Homo sapiens
uauugcuaaauucuuuuccuag

SEQ ID NO: 96961 - RNA, 22 nt, Homo sapiens
uauugcuccccauaucgcagug

SEQ ID NO: 96962 - RNA, 22 nt, Homo sapiens
uauugcuccuaauaucacggug

SEQ ID NO: 96963 - RNA, 22 nt, Homo sapiens
uauugcuugaggaaaugguaau

SEQ ID NO: 96964 - RNA, 22 nt, Homo sapiens
uauuguacauguuauagauuuu

SEQ ID NO: 96965 - RNA, 22 nt, Homo sapiens
uauugucacuaaaggaagcugg

SEQ ID NO: 96966 - RNA, 22 nt, Homo sapiens
uauuguuaaagauguuaaugau

SEQ ID NO: 96967 - RNA, 22 nt, Homo sapiens
uauuucccuuaacuuuccugca

SEQ ID NO: 96968 - RNA, 22 nt, Homo sapiens
uauuugauuaacaagagccuaa

SEQ ID NO: 96969 - RNA, 22 nt, Homo sapiens
uauuugguagcuauuuugcagu

SEQ ID NO: 96970 - RNA, 22 nt, Homo sapiens
uauuuggugaaugaaugcaugu

SEQ ID NO: 96971 - RNA, 22 nt, Homo sapiens
uauuugguuauaugaguaaguu

SEQ ID NO: 96972 - RNA, 20 nt, Homo sapiens
uauuugguuauuuccauggu

SEQ ID NO: 96973 - RNA, 22 nt, Homo sapiens
uauuugguuggugcaaaaguaa

SEQ ID NO: 96974 - RNA, 22 nt, Homo sapiens
ucaaacauccccaccagggacu

SEQ ID NO: 96975 - RNA, 20 nt, Homo sapiens
ucaaaguaugcucugcacua

SEQ ID NO: 96976 - RNA, 22 nt, Homo sapiens
ucaaaguauucuucugagaacc

SEQ ID NO: 96977 - RNA, 22 nt, Homo sapiens
ucaaagugcuauggcucagguu

SEQ ID NO: 96978 - RNA, 22 nt, Homo sapiens
ucaaaugauucagaagccaccu

SEQ ID NO: 96979 - RNA, 22 nt, Homo sapiens
ucaaaugauucuccugccucag

SEQ ID NO: 96980 - RNA, 22 nt, Homo sapiens
ucaaaugguccacgugaacauu

SEQ ID NO: 96981 - RNA, 22 nt, Homo sapiens
ucaacaggucaauugcauagaa

SEQ ID NO: 96982 - RNA, 22 nt, Homo sapiens
ucaagcaauucgccugucucag

SEQ ID NO: 96983 - RNA, 18 nt, Homo sapiens
ucaagcaauugucaugcc

SEQ ID NO: 96984 - RNA, 22 nt, Homo sapiens
ucaaggacuacauggggugaaa

SEQ ID NO: 96985 - RNA, 21 nt, Homo sapiens
ucaaggaguauacguaugcca

SEQ ID NO: 96986 - RNA, 22 nt, Homo sapiens
ucaaggcacauuugacauuuuc

SEQ ID NO: 96987 - RNA, 20 nt, Homo sapiens
ucaaggcaggaacuguacau

SEQ ID NO: 96988 - RNA, 22 nt, Homo sapiens
ucaaguacuuauuugauaauua

SEQ ID NO: 96989 - RNA, 23 nt, Homo sapiens
ucaagugaugguggccacaaggg

SEQ ID NO: 96990 - RNA, 22 nt, Homo sapiens
ucaagugcauaugcuaacgguu

SEQ ID NO: 96991 - RNA, 22 nt, Homo sapiens
ucaauugcuuaugaagauacau

SEQ ID NO: 96992 - RNA, 16 nt, Homo sapiens
ucacaaacucuagcag

SEQ ID NO: 96993 - RNA, 22 nt, Homo sapiens
ucacaauucacuacaggcuuga

SEQ ID NO: 96994 - RNA, 22 nt, Homo sapiens
ucacaauucucaauuugugaaa

SEQ ID NO: 96995 - RNA, 22 nt, Homo sapiens
ucacacggugaugauuccuaga

SEQ ID NO: 96996 - RNA, 22 nt, Homo sapiens
ucacacugucuugguuacucuu

SEQ ID NO: 96997 - RNA, 19 nt, Homo sapiens
ucacacuguggcuucuuua

SEQ ID NO: 96998 - RNA, 22 nt, Homo sapiens
ucacacuguuuugauuauuaua

SEQ ID NO: 96999 - RNA, 23 nt, Homo sapiens
ucacacuuaagagaaaugcagcu

SEQ ID NO: 97000 - RNA, 22 nt, Homo sapiens
ucacagacauugaggggaccuu

SEQ ID NO: 97001 - RNA, 22 nt, Homo sapiens
ucacagaugaggcgagaggcag

SEQ ID NO: 97002 - RNA, 22 nt, Homo sapiens
ucacagcuaaaaugaaaguagu

SEQ ID NO: 97003 - RNA, 22 nt, Homo sapiens
ucacaguaaauccagaagaaau

SEQ ID NO: 97004 - RNA, 22 nt, Homo sapiens
ucacaguagagcuucuuucaga

SEQ ID NO: 97005 - RNA, 22 nt, Homo sapiens
ucacaguagccccucccaucau

SEQ ID NO: 97006 - RNA, 22 nt, Homo sapiens
ucacagucggugacuucuugcu

SEQ ID NO: 97007 - RNA, 22 nt, Homo sapiens
ucacagugaguggaguggggug

SEQ ID NO: 97008 - RNA, 17 nt, Homo sapiens
ucacaguguuaggauga

SEQ ID NO: 97009 - RNA, 23 nt, Homo sapiens
ucacaguuacuuuugcaucaacc

SEQ ID NO: 97010 - RNA, 22 nt, Homo sapiens
ucacaguugauugaaacacagc

SEQ ID NO: 97011 - RNA, 22 nt, Homo sapiens
ucacaguuggccuggccuuuua

SEQ ID NO: 97012 - RNA, 22 nt, Homo sapiens
guagcagaacauguuccuugua

SEQ ID NO: 97013 - RNA, 22 nt, Homo sapiens
guagcaucauuugcaauuucau

SEQ ID NO: 97014 - RNA, 22 nt, Homo sapiens
guagcaugcaauauuauagaga

SEQ ID NO: 97015 - RNA, 22 nt, Homo sapiens
guaggcacuggcucagcuuauc

SEQ ID NO: 97016 - RNA, 22 nt, Homo sapiens
guagguaaguacuucuggugag

SEQ ID NO: 97017 - RNA, 22 nt, Homo sapiens
guaguaccauuaggauauuucu

SEQ ID NO: 97018 - RNA, 22 nt, Homo sapiens
guauacacccugugauauuauu

SEQ ID NO: 97019 - RNA, 22 nt, Homo sapiens
guauacaugucaaaacucacau

SEQ ID NO: 97020 - RNA, 22 nt, Homo sapiens
guauagaucguagaccaauaaa

SEQ ID NO: 97021 - RNA, 22 nt, Homo sapiens
guauaguaguacaaaaguuuuu

SEQ ID NO: 97022 - RNA, 22 nt, Homo sapiens
guaucauuggcauguaaccaga

SEQ ID NO: 97023 - RNA, 22 nt, Homo sapiens
guaugcaagugauaugacauau

SEQ ID NO: 97024 - RNA, 18 nt, Homo sapiens
guaugcacaugccccugc

SEQ ID NO: 97025 - RNA, 22 nt, Homo sapiens
guaugguugaagugacaagcca

SEQ ID NO: 97026 - RNA, 22 nt, Homo sapiens
guauuaguuaucuacugcugug

SEQ ID NO: 97027 - RNA, 22 nt, Homo sapiens
guauuugguuauugcagccuga

SEQ ID NO: 97028 - RNA, 22 nt, Homo sapiens
guauuuguugcagcagcacuau

SEQ ID NO: 97029 - RNA, 22 nt, Homo sapiens
gucaaaugcacagaaccauuaa

SEQ ID NO: 97030 - RNA, 22 nt, Homo sapiens
gucaaggaauuuauccauuucu

SEQ ID NO: 97031 - RNA, 22 nt, Homo sapiens
gucacaguggccagugauguuc

SEQ ID NO: 97032 - RNA, 22 nt, Homo sapiens
gucacaguguuuguucauccca

SEQ ID NO: 97033 - RNA, 22 nt, Homo sapiens
gucaccauugagucauuuccuc

SEQ ID NO: 97034 - RNA, 22 nt, Homo sapiens
gucacugccugaggcugaugca

SEQ ID NO: 97035 - RNA, 22 nt, Homo sapiens
gucacugggugcugcgccuguc

SEQ ID NO: 97036 - RNA, 22 nt, Homo sapiens
gucacugugaggaggggccagg

SEQ ID NO: 97037 - RNA, 22 nt, Homo sapiens
gucacuguuuccuauuauauuu

SEQ ID NO: 97038 - RNA, 22 nt, Homo sapiens
gucagcuuuuccuuacuuuagg

SEQ ID NO: 97039 - RNA, 22 nt, Homo sapiens
gucaggaugauuuggggaggug

SEQ ID NO: 97040 - RNA, 22 nt, Homo sapiens
gucaggcaccgauacaguuuuu

SEQ ID NO: 97041 - RNA, 22 nt, Homo sapiens
gucagggagggauagaugauua

SEQ ID NO: 97042 - RNA, 22 nt, Homo sapiens
gucagguauguuccaaaggcgg

SEQ ID NO: 97043 - RNA, 22 nt, Homo sapiens
gucagucugucccugccuggcg

SEQ ID NO: 97044 - RNA, 22 nt, Homo sapiens
gucaguggagaaaaggacaugu

SEQ ID NO: 97045 - RNA, 22 nt, Homo sapiens
gucagugucuuaacagagauua

SEQ ID NO: 97046 - RNA, 22 nt, Homo sapiens
gucaguuugguuaaucauucca

SEQ ID NO: 97047 - RNA, 18 nt, Homo sapiens
gucauagaaugaugguuc

SEQ ID NO: 97048 - RNA, 22 nt, Homo sapiens
gucauauaggguuuaccuguau

SEQ ID NO: 97049 - RNA, 22 nt, Homo sapiens
gucaucaggacgggucaucugc

SEQ ID NO: 97050 - RNA, 22 nt, Homo sapiens
gucaugaacuguacuacuccua

SEQ ID NO: 97051 - RNA, 22 nt, Homo sapiens
gucauggacaaggugugagcca

SEQ ID NO: 97052 - RNA, 22 nt, Homo sapiens
gucauggacaguuugcuaauug

SEQ ID NO: 97053 - RNA, 22 nt, Homo sapiens
gucauugagucagggaguaucu

SEQ ID NO: 97054 - RNA, 22 nt, Homo sapiens
gucccugaggaacauccagggc

SEQ ID NO: 97055 - RNA, 22 nt, Homo sapiens
guccugaagaccuuccucugga

SEQ ID NO: 97056 - RNA, 22 nt, Homo sapiens
gucuagaacuucugaccuuagg

SEQ ID NO: 97057 - RNA, 22 nt, Homo sapiens
gucuaugguucaggguggagug

SEQ ID NO: 97058 - RNA, 18 nt, Homo sapiens
gucucacaugguggaagc

SEQ ID NO: 97059 - RNA, 22 nt, Homo sapiens
gucucccaaccccugugcccag

SEQ ID NO: 97060 - RNA, 22 nt, Homo sapiens
gucuccgagccguguggagccg

SEQ ID NO: 97061 - RNA, 22 nt, Homo sapiens
gucugcaugucauaugauagua

SEQ ID NO: 97062 - RNA, 22 nt, Homo sapiens
gucuggcaauggcagacuggca

SEQ ID NO: 97063 - RNA, 22 nt, Homo sapiens
gucuggcacagggaaaguacaa

SEQ ID NO: 97064 - RNA, 22 nt, Homo sapiens
gucuggcuuaucucacuuacca

SEQ ID NO: 97065 - RNA, 22 nt, Homo sapiens
gucugguuccugggagauuucu

SEQ ID NO: 97066 - RNA, 22 nt, Homo sapiens
gucugguugacagcauguggcc

SEQ ID NO: 97067 - RNA, 22 nt, Homo sapiens
gucugguuggaguaguuuucag

SEQ ID NO: 97068 - RNA, 20 nt, Homo sapiens
gucugucuccgaguagaauu

SEQ ID NO: 97069 - RNA, 22 nt, Homo sapiens
gucugugcauuaauacgugcug

SEQ ID NO: 97070 - RNA, 22 nt, Homo sapiens
gucugugguuccuaugucaccu

SEQ ID NO: 97071 - RNA, 22 nt, Homo sapiens
gucuuuggaaaaaaugucuguu

SEQ ID NO: 97072 - RNA, 22 nt, Homo sapiens
gucuuuguuuugauuuaccaga

SEQ ID NO: 97073 - RNA, 22 nt, Homo sapiens
gugaacuguuugaggaagagaa

SEQ ID NO: 97074 - RNA, 22 nt, Homo sapiens
gugaagaucccuguccuguucc

SEQ ID NO: 97075 - RNA, 22 nt, Homo sapiens
gugaagugugaccucagcaucu

SEQ ID NO: 97076 - RNA, 22 nt, Homo sapiens
gugaaguuuuugugaggccuaa

SEQ ID NO: 97077 - RNA, 22 nt, Homo sapiens
gugaauagggaauaaugggauc

SEQ ID NO: 97078 - RNA, 22 nt, Homo sapiens
gugaaucauaugccagucaugc

SEQ ID NO: 97079 - RNA, 20 nt, Homo sapiens
gugacacucguuaaccucug

SEQ ID NO: 97080 - RNA, 22 nt, Homo sapiens
gugacacuggagcuggcacaau

SEQ ID NO: 97081 - RNA, 22 nt, Homo sapiens
gugaccagaugggcaggggugu

SEQ ID NO: 97082 - RNA, 22 nt, Homo sapiens
gugacugggaguggugaagaua

SEQ ID NO: 97083 - RNA, 22 nt, Homo sapiens
gugagaacugcuggggccacag

SEQ ID NO: 97084 - RNA, 22 nt, Homo sapiens
gugagaaucaaacuacauaaau

SEQ ID NO: 97085 - RNA, 18 nt, Homo sapiens
gugagaaugacuguucug

SEQ ID NO: 97086 - RNA, 22 nt, Homo sapiens
gugagaauugacacccuugucu

SEQ ID NO: 97087 - RNA, 22 nt, Homo sapiens
gugagacugguccugaacccag

SEQ ID NO: 97088 - RNA, 22 nt, Homo sapiens
gugagacugguucugaacccag

SEQ ID NO: 97089 - RNA, 22 nt, Homo sapiens
gugagagaaugacuauguguuu

SEQ ID NO: 97090 - RNA, 22 nt, Homo sapiens
gugagauaucuagacuagggaa

SEQ ID NO: 97091 - RNA, 22 nt, Homo sapiens
gugagauccucucuuauauggg

SEQ ID NO: 97092 - RNA, 19 nt, Homo sapiens
gugagcaaugcauugcacu

SEQ ID NO: 97093 - RNA, 22 nt, Homo sapiens
gugagcaauugauacuugaagu

SEQ ID NO: 97094 - RNA, 22 nt, Homo sapiens
gugagcauauuaguauugcacu

SEQ ID NO: 97095 - RNA, 22 nt, Homo sapiens
gugagcauuacucaugggauca

SEQ ID NO: 97096 - RNA, 22 nt, Homo sapiens
gugagccaugauuuuaccacug

SEQ ID NO: 97097 - RNA, 22 nt, Homo sapiens
gugagcuauguccugguuuggg

SEQ ID NO: 97098 - RNA, 22 nt, Homo sapiens
gugagcuccucucuauguguca

SEQ ID NO: 97099 - RNA, 22 nt, Homo sapiens
gugaggaaggaaaccugcuagc

SEQ ID NO: 97100 - RNA, 22 nt, Homo sapiens
gugaggcuuuuccuguuagacu

SEQ ID NO: 97101 - RNA, 17 nt, Homo sapiens
gugagguggguaguauc

SEQ ID NO: 97102 - RNA, 22 nt, Homo sapiens
ugaccacagaaagugagggagc

SEQ ID NO: 97103 - RNA, 22 nt, Homo sapiens
ugaccacugucuaagauaggug

SEQ ID NO: 97104 - RNA, 22 nt, Homo sapiens
ugacuacacacaauuugucaag

SEQ ID NO: 97105 - RNA, 22 nt, Homo sapiens
ugacuacaggucaggaagcugu

SEQ ID NO: 97106 - RNA, 22 nt, Homo sapiens
ugacuaguuuugcuguuguuau

SEQ ID NO: 97107 - RNA, 22 nt, Homo sapiens
ugacuauaggauaacaugcauu

SEQ ID NO: 97108 - RNA, 22 nt, Homo sapiens
ugacucaagagccugacucauc

SEQ ID NO: 97109 - RNA, 22 nt, Homo sapiens
ugacucagauagguguguauuc

SEQ ID NO: 97110 - RNA, 22 nt, Homo sapiens
ugacucgaggcgccuccagucc

SEQ ID NO: 97111 - RNA, 22 nt, Homo sapiens
ugacugaguaguauuccacuau

SEQ ID NO: 97112 - RNA, 22 nt, Homo sapiens
ugacuggaaacaguguuauuug

SEQ ID NO: 97113 - RNA, 22 nt, Homo sapiens
ugacuggaacuuuagugagucu

SEQ ID NO: 97114 - RNA, 23 nt, Homo sapiens
ugacuggagacuguugauccuuu

SEQ ID NO: 97115 - RNA, 20 nt, Homo sapiens
ugacuggauacccuuuggcu

SEQ ID NO: 97116 - RNA, 22 nt, Homo sapiens
ugacugguguuuaaugagucaa

SEQ ID NO: 97117 - RNA, 22 nt, Homo sapiens
ugacugucuagauagagcuugg

SEQ ID NO: 97118 - RNA, 22 nt, Homo sapiens
ugacuuaugcaacucugaugug

SEQ ID NO: 97119 - RNA, 22 nt, Homo sapiens
ugacuugaaacgugaacagauc

SEQ ID NO: 97120 - RNA, 22 nt, Homo sapiens
ugacuugaacuucuaugucacc

SEQ ID NO: 97121 - RNA, 22 nt, Homo sapiens
ugacuugauacauguuuuugaa

SEQ ID NO: 97122 - RNA, 23 nt, Homo sapiens
ugacuuguccagugauaguucgu

SEQ ID NO: 97123 - RNA, 21 nt, Homo sapiens
ugagaacaacaggucaagcag

SEQ ID NO: 97124 - RNA, 19 nt, Homo sapiens
ugagaaccucuacagaguc

SEQ ID NO: 97125 - RNA, 22 nt, Homo sapiens
ugagaacuguuuugguuugggu

SEQ ID NO: 97126 - RNA, 22 nt, Homo sapiens
ugagaagacaucagcuuucgga

SEQ ID NO: 97127 - RNA, 22 nt, Homo sapiens
ugagaagacaucuuugcuuugu

SEQ ID NO: 97128 - RNA, 22 nt, Homo sapiens
ugagaagugacgcagcaggguu

SEQ ID NO: 97129 - RNA, 22 nt, Homo sapiens
ugagaagugauauagaaguuaa

SEQ ID NO: 97130 - RNA, 22 nt, Homo sapiens
ugagaaugaugauugguaaacc

SEQ ID NO: 97131 - RNA, 22 nt, Homo sapiens
ugagaaugcagaaucucgugca

SEQ ID NO: 97132 - RNA, 22 nt, Homo sapiens
ugagacacuucccagaucccuu

SEQ ID NO: 97133 - RNA, 22 nt, Homo sapiens
ugagacaucacaaaauccucaa

SEQ ID NO: 97134 - RNA, 22 nt, Homo sapiens
ugagacaucucuccugagacag

SEQ ID NO: 97135 - RNA, 23 nt, Homo sapiens
ugagacauuggaaaguuaggcag

SEQ ID NO: 97136 - RNA, 22 nt, Homo sapiens
ugagacgaagucucguucugua

SEQ ID NO: 97137 - RNA, 22 nt, Homo sapiens
ugagacgaagucuugcucuguu

SEQ ID NO: 97138 - RNA, 22 nt, Homo sapiens
ugagacggagucucacucuguu

SEQ ID NO: 97139 - RNA, 22 nt, Homo sapiens
ugagacggagucuugcccuguc

SEQ ID NO: 97140 - RNA, 22 nt, Homo sapiens
ugagacggaguuauuuauaaua

SEQ ID NO: 97141 - RNA, 22 nt, Homo sapiens
ugagacggaguuucgcucuugu

SEQ ID NO: 97142 - RNA, 22 nt, Homo sapiens
ugagacugagucuugcucuugu

SEQ ID NO: 97143 - RNA, 22 nt, Homo sapiens
ugagacugaguuucucucuugu

SEQ ID NO: 97144 - RNA, 22 nt, Homo sapiens
ugagacugguuaauugauaaag

SEQ ID NO: 97145 - RNA, 22 nt, Homo sapiens
ugagagacagacauuaucuuau

SEQ ID NO: 97146 - RNA, 22 nt, Homo sapiens
ugagagacauuuguuguagagu

SEQ ID NO: 97147 - RNA, 22 nt, Homo sapiens
ugagagcuuugaugcacuguuu

SEQ ID NO: 97148 - RNA, 22 nt, Homo sapiens
ugagauaaggaaauugaggcuc

SEQ ID NO: 97149 - RNA, 22 nt, Homo sapiens
ugucuagaaaagccugccuucu

SEQ ID NO: 97150 - RNA, 22 nt, Homo sapiens
ugucugagacuguuuuacuuuc

SEQ ID NO: 97151 - RNA, 21 nt, Homo sapiens
ugucugagagaggagaucuac

SEQ ID NO: 97152 - RNA, 22 nt, Homo sapiens
ugucuuggacuugaaucucauu

SEQ ID NO: 97153 - RNA, 21 nt, Homo sapiens
ugucuuggagccagacgccag

SEQ ID NO: 97154 - RNA, 22 nt, Homo sapiens
ugucuuggaugaggauuaacag

SEQ ID NO: 97155 - RNA, 22 nt, Homo sapiens
ugugaaauguuaucccgucgug

SEQ ID NO: 97156 - RNA, 22 nt, Homo sapiens
ugugaacaaaauuuguugcaua

SEQ ID NO: 97157 - RNA, 22 nt, Homo sapiens
ugugaacagcagcugggcuuug

SEQ ID NO: 97158 - RNA, 19 nt, Homo sapiens
ugugaacaucacagagugu

SEQ ID NO: 97159 - RNA, 22 nt, Homo sapiens
ugugaacugagcauuaacuaca

SEQ ID NO: 97160 - RNA, 20 nt, Homo sapiens
ugugaacuguagauagucuu

SEQ ID NO: 97161 - RNA, 22 nt, Homo sapiens
ugugaauggugcugccgugaag

SEQ ID NO: 97162 - RNA, 22 nt, Homo sapiens
ugugaauggugcuuccuagaug

SEQ ID NO: 97163 - RNA, 22 nt, Homo sapiens
ugugaauguaagaaaauccaac

SEQ ID NO: 97164 - RNA, 22 nt, Homo sapiens
ugugacaaauuuaguggacugu

SEQ ID NO: 97165 - RNA, 22 nt, Homo sapiens
ugugacaguuaguuugguguua

SEQ ID NO: 97166 - RNA, 22 nt, Homo sapiens
ugugaccaaaaucaacauaccu

SEQ ID NO: 97167 - RNA, 21 nt, Homo sapiens
ugugaccucugucucugaguc

SEQ ID NO: 97168 - RNA, 22 nt, Homo sapiens
ugugagaaaugcagaaucucag

SEQ ID NO: 97169 - RNA, 22 nt, Homo sapiens
ugugagacugacagggcagggu

SEQ ID NO: 97170 - RNA, 19 nt, Homo sapiens
ugugagcauuagcauuuag

SEQ ID NO: 97171 - RNA, 17 nt, Homo sapiens
ugugaucaucacccuug

SEQ ID NO: 97172 - RNA, 16 nt, Homo sapiens
ugugaucuuuuuucuu

SEQ ID NO: 97173 - RNA, 18 nt, Homo sapiens
ugugauggauauguuaau

SEQ ID NO: 97174 - RNA, 22 nt, Homo sapiens
ugugaugguuuagcauuuucuu

SEQ ID NO: 97175 - RNA, 22 nt, Homo sapiens
ugugauguggagggcagaucca

SEQ ID NO: 97176 - RNA, 22 nt, Homo sapiens
uuuguguggccuuggccuggca

SEQ ID NO: 97177 - RNA, 22 nt, Homo sapiens
uuuguucuucguuccugagcca

SEQ ID NO: 97178 - RNA, 22 nt, Homo sapiens
uuuuacacuucgguugugugca

SEQ ID NO: 97179 - RNA, 20 nt, Homo sapiens
uuuuagcacuuguuauggug

SEQ ID NO: 97180 - RNA, 22 nt, Homo sapiens
uuuucaguggccauaguggaga

SEQ ID NO: 97181 - RNA, 22 nt, Homo sapiens
uuuuccagugggacucccauua

SEQ ID NO: 97182 - RNA, 21 nt, Homo sapiens
uuuugcacacuaugcagcuuu

SEQ ID NO: 97183 - RNA, 22 nt, Homo sapiens
uuuugcucuucauagguccugu

SEQ ID NO: 97184 - RNA, 22 nt, Homo sapiens
uuuugcuuuuccucggucccac

SEQ ID NO: 97185 - RNA, 17 nt, Homo sapiens
uuuuggauuagaaaucc

SEQ ID NO: 97186 - RNA, 22 nt, Homo sapiens
uuuuggcacuuugucugauucu

SEQ ID NO: 97187 - RNA, 22 nt, Homo sapiens
uuuuggcucuugguaggucaga

SEQ ID NO: 97188 - RNA, 22 nt, Homo sapiens
uuuuggucuccaguuucugcug

SEQ ID NO: 97189 - RNA, 22 nt, Homo sapiens
uuuugguuaggauggguggcau

SEQ ID NO: 97190 - RNA, 22 nt, Homo sapiens
uuuuguacgccuguguccauca

SEQ ID NO: 97191 - RNA, 22 nt, Homo sapiens
uuuuugagguauaguguggcua

SEQ ID NO: 97192 - RNA, 22 nt, Homo sapiens
uuuuuggauaaugguacaugua

SEQ ID NO: 97193 - RNA, 21 nt, Homo sapiens
uuuuugggcuuucauaguguu

SEQ ID NO: 97194 - RNA, 23 nt, Homo sapiens
uuuuuguguuucauggaaauagg

SEQ ID NO: 97195 - RNA, 22 nt, Homo sapiens
uuuuuugguaauugaacaauga

SEQ ID NO: 97196 - RNA, 22 nt, Homo sapiens
auagguaguugaggagauuuca

SEQ ID NO: 97197 - RNA, 22 nt, Homo sapiens
auagguuuucacuguagauucu

SEQ ID NO: 97198 - RNA, 22 nt, Homo sapiens
auaguacuauugcaguguuaua

SEQ ID NO: 97199 - RNA, 22 nt, Homo sapiens
auagugcugcaacaaauauacg

SEQ ID NO: 97200 - RNA, 22 nt, Homo sapiens
auagugcugcaagaaacauacg

SEQ ID NO: 97201 - RNA, 22 nt, Homo sapiens
auagugcugcagucaauguacg

SEQ ID NO: 97202 - RNA, 22 nt, Homo sapiens
auagugcugccauaaacauacg

SEQ ID NO: 97203 - RNA, 19 nt, Homo sapiens
auauaacauccaggagcag

SEQ ID NO: 97204 - RNA, 22 nt, Homo sapiens
auauaugcuaagugcuaauaaa

SEQ ID NO: 97205 - RNA, 22 nt, Homo sapiens
auaucacagguguuuaccugau

SEQ ID NO: 97206 - RNA, 22 nt, Homo sapiens
auaugacuuuccucuacuuccu

SEQ ID NO: 97207 - RNA, 22 nt, Homo sapiens
auaugcacuauacacacguaua

SEQ ID NO: 97208 - RNA, 20 nt, Homo sapiens
auaugcagacacauacauac

SEQ ID NO: 97209 - RNA, 22 nt, Homo sapiens
auaugcauacauguaugcagga

SEQ ID NO: 97210 - RNA, 22 nt, Homo sapiens
auaugcauguacccacacaggc

SEQ ID NO: 97211 - RNA, 22 nt, Homo sapiens
auaugccacugaacuguaccca

SEQ ID NO: 97212 - RNA, 21 nt, Homo sapiens
auauggaacuggugacguguu

SEQ ID NO: 97213 - RNA, 22 nt, Homo sapiens
auauggcauucagaacuguaua

SEQ ID NO: 97214 - RNA, 22 nt, Homo sapiens
auaugguacuuaugcucaaacu

SEQ ID NO: 97215 - RNA, 22 nt, Homo sapiens
auaugguuuuuggaagcauauc

SEQ ID NO: 97216 - RNA, 22 nt, Homo sapiens
auauguaguauggaaacauugu

SEQ ID NO: 97217 - RNA, 22 nt, Homo sapiens
auaugucuauuauuagggcagg

SEQ ID NO: 97218 - RNA, 22 nt, Homo sapiens
auauuacagagaggaccuggga

SEQ ID NO: 97219 - RNA, 21 nt, Homo sapiens
auauuacuguuagaggacugc

SEQ ID NO: 97220 - RNA, 19 nt, Homo sapiens
aucaaacugcucuuugagg

SEQ ID NO: 97221 - RNA, 22 nt, Homo sapiens
aucaaagcagcauggcccaguc

SEQ ID NO: 97222 - RNA, 22 nt, Homo sapiens
aucaaauugucauuuuaaggau

SEQ ID NO: 97223 - RNA, 22 nt, Homo sapiens
aucaagccaaagaaaguccuug

SEQ ID NO: 97224 - RNA, 22 nt, Homo sapiens
aucaagcuugacuccuuaaagg

SEQ ID NO: 97225 - RNA, 22 nt, Homo sapiens
aucaaguaaucugaguaagagu

SEQ ID NO: 97226 - RNA, 22 nt, Homo sapiens
aucacagaguuaaaacuuucuu

SEQ ID NO: 97227 - RNA, 22 nt, Homo sapiens
aucacauuuauaguggcacgca

SEQ ID NO: 97228 - RNA, 22 nt, Homo sapiens
aucaccuggaguagcccguccc

SEQ ID NO: 97229 - RNA, 22 nt, Homo sapiens
cacaaugucuaagauguuucua

SEQ ID NO: 97230 - RNA, 22 nt, Homo sapiens
cacacugucuucauuacuguag

SEQ ID NO: 97231 - RNA, 22 nt, Homo sapiens
cacagcuagucaaugguagaca

SEQ ID NO: 97232 - RNA, 22 nt, Homo sapiens
cacaggccugucucuuucuaac

SEQ ID NO: 97233 - RNA, 22 nt, Homo sapiens
cacaguagaauagagcacuagg

SEQ ID NO: 97234 - RNA, 22 nt, Homo sapiens
cacagucuugcaauauugagau

SEQ ID NO: 97235 - RNA, 22 nt, Homo sapiens
cacaguguuacugguaugaagu

SEQ ID NO: 97236 - RNA, 22 nt, Homo sapiens
cacaguugccuaucuccugaag

SEQ ID NO: 97237 - RNA, 22 nt, Homo sapiens
cacauagucccugcuaaucuuc

SEQ ID NO: 97238 - RNA, 22 nt, Homo sapiens
caccaaccucaguagcaucugu

SEQ ID NO: 97239 - RNA, 22 nt, Homo sapiens
caccacagccauuauugucccc

SEQ ID NO: 97240 - RNA, 22 nt, Homo sapiens
caccccuaccugagucaggagu

SEQ ID NO: 97241 - RNA, 22 nt, Homo sapiens
cacccgugacgcugucugaaau

SEQ ID NO: 97242 - RNA, 22 nt, Homo sapiens
caccgagguuggagugcagugg

SEQ ID NO: 97243 - RNA, 22 nt, Homo sapiens
caccgagugugccaucuucuca

SEQ ID NO: 97244 - RNA, 22 nt, Homo sapiens
caccgguuaaucuguuuuuucu

SEQ ID NO: 97245 - RNA, 22 nt, Homo sapiens
cacucaguuugugguacuuugu

SEQ ID NO: 97246 - RNA, 18 nt, Homo sapiens
cacugagcccuucacucu

SEQ ID NO: 97247 - RNA, 22 nt, Homo sapiens
cacugcacuccagucugacgac

SEQ ID NO: 97248 - RNA, 22 nt, Homo sapiens
cacugcaguggaagauuaagaa

SEQ ID NO: 97249 - RNA, 22 nt, Homo sapiens
cacugcaguguaauuaagguug

SEQ ID NO: 97250 - RNA, 22 nt, Homo sapiens
cacugcauccucugccuggcgg

SEQ ID NO: 97251 - RNA, 22 nt, Homo sapiens
cacugcauucuccaccucccag

SEQ ID NO: 97252 - RNA, 23 nt, Homo sapiens
cacugggcagcagguguucccag

SEQ ID NO: 97253 - RNA, 22 nt, Homo sapiens
cacugggugagauccauguuua

SEQ ID NO: 97254 - RNA, 22 nt, Homo sapiens
cacuggucagugaaacaguauu

SEQ ID NO: 97255 - RNA, 22 nt, Homo sapiens
cacuguggauggaacuauguga

SEQ ID NO: 97256 - RNA, 18 nt, Homo sapiens
cacuuggcuuugccccuc

SEQ ID NO: 97257 - RNA, 22 nt, Homo sapiens
cagaaguauugguaugcucugu

SEQ ID NO: 97258 - RNA, 22 nt, Homo sapiens
cagacagugucccgagucccug

SEQ ID NO: 97259 - RNA, 22 nt, Homo sapiens
cagacaugucuuguggccgugg

SEQ ID NO: 97260 - RNA, 21 nt, Homo sapiens
cagagaucaucucuguuuuaa

SEQ ID NO: 97261 - RNA, 22 nt, Homo sapiens
aauggcucuuccuggaguugug

SEQ ID NO: 97262 - RNA, 22 nt, Homo sapiens
aauggcucuuuaggcaauagau

SEQ ID NO: 97263 - RNA, 22 nt, Homo sapiens
aauggcuuuuaauauccauaau

SEQ ID NO: 97264 - RNA, 21 nt, Homo sapiens
aaugguguugccaacaaggug

SEQ ID NO: 97265 - RNA, 22 nt, Homo sapiens
aaaagucuguagugaaagguga

SEQ ID NO: 97266 - RNA, 22 nt, Homo sapiens
aaacaccacgcggucccucgga

SEQ ID NO: 97267 - RNA, 18 nt, Homo sapiens
aaacagugucucuuucug

SEQ ID NO: 97268 - RNA, 22 nt, Homo sapiens
aaacgugcagagaucaauagca

SEQ ID NO: 97269 - RNA, 22 nt, Homo sapiens
aaacucuguagcagagacagau

SEQ ID NO: 97270 - RNA, 22 nt, Homo sapiens
aaacugaucugaaggccaggcu

SEQ ID NO: 97271 - RNA, 18 nt, Homo sapiens
aaacugcuuccuuggccu

SEQ ID NO: 97272 - RNA, 22 nt, Homo sapiens
aaagagaucuaugggcacuaug

SEQ ID NO: 97273 - RNA, 22 nt, Homo sapiens
aaagaguucagguagauuucaa

SEQ ID NO: 97274 - RNA, 22 nt, Homo sapiens
aaagcacuggagucaucaucua

SEQ ID NO: 97275 - RNA, 22 nt, Homo sapiens
aaaggcacugaucuuauccagu

SEQ ID NO: 97276 - RNA, 22 nt, Homo sapiens
aaagggcuguuucuugacuugg

SEQ ID NO: 97277 - RNA, 22 nt, Homo sapiens
aaaguaauugcaguuuuugcaa

SEQ ID NO: 97278 - RNA, 22 nt, Homo sapiens
aaaguaguagcaguuucugcca

SEQ ID NO: 97279 - RNA, 18 nt, Homo sapiens
aaagugaugucauucuuu

SEQ ID NO: 97280 - RNA, 22 nt, Homo sapiens
aaagugcacuuggaagagggcc

SEQ ID NO: 97281 - RNA, 22 nt, Homo sapiens
aaagugcugagaguucuaacuu

SEQ ID NO: 97282 - RNA, 22 nt, Homo sapiens
aaagugcugagauuguaggcau

SEQ ID NO: 97283 - RNA, 22 nt, Homo sapiens
aaagugcugggaucacacugaa

SEQ ID NO: 97284 - RNA, 22 nt, Homo sapiens
aaagugcugggauuaggccagg

SEQ ID NO: 97285 - RNA, 22 nt, Homo sapiens
aaagugcugggauuggccgggc

SEQ ID NO: 97286 - RNA, 22 nt, Homo sapiens
aaagugcugggauuggcugggc

SEQ ID NO: 97287 - RNA, 22 nt, Homo sapiens
aaaguggugugaguauguaucu

SEQ ID NO: 97288 - RNA, 19 nt, Homo sapiens
aaaguucuucccuuuggag

SEQ ID NO: 97289 - RNA, 15 nt, Homo sapiens
aaauaugucaguucu

SEQ ID NO: 97290 - RNA, 22 nt, Homo sapiens
aaaugacuuuuuaugcagagua

SEQ ID NO: 97291 - RNA, 22 nt, Homo sapiens
aaaugcaccacucuggugcagg

SEQ ID NO: 97292 - RNA, 22 nt, Homo sapiens
aaaugcagucuuuguucugggc

SEQ ID NO: 97293 - RNA, 22 nt, Homo sapiens
aaaugcucuuuaugaaguugga

SEQ ID NO: 97294 - RNA, 22 nt, Homo sapiens
aaaugcugcuuuggccucuucu

SEQ ID NO: 97295 - RNA, 22 nt, Homo sapiens
aaaugggacugggguccuuuga

SEQ ID NO: 97296 - RNA, 22 nt, Homo sapiens
aacaccuugcagggauuaugac

SEQ ID NO: 97297 - RNA, 22 nt, Homo sapiens
aacacggcccgcagagcaagcu

SEQ ID NO: 97298 - RNA, 22 nt, Homo sapiens
aacagaauccucuuuuccuggg

SEQ ID NO: 97299 - RNA, 22 nt, Homo sapiens
aacagagcuggugacuccaggu

SEQ ID NO: 97300 - RNA, 22 nt, Homo sapiens
aacagcacacccgcugcuucca

SEQ ID NO: 97301 - RNA, 22 nt, Homo sapiens
aacaggcuccuaggggugcacc

SEQ ID NO: 97302 - RNA, 22 nt, Homo sapiens
aacaggguguuugcaguuucuu

SEQ ID NO: 97303 - RNA, 22 nt, Homo sapiens
aacaguaucuaacgagugauga

SEQ ID NO: 97304 - RNA, 22 nt, Homo sapiens
aacagucaauugcugaugaccu

SEQ ID NO: 97305 - RNA, 22 nt, Homo sapiens
aacagugcauuccuguccauau

SEQ ID NO: 97306 - RNA, 22 nt, Homo sapiens
aacauugaacuuggcacaccca

SEQ ID NO: 97307 - RNA, 22 nt, Homo sapiens
aaccacauggcucaguggacau

SEQ ID NO: 97308 - RNA, 22 nt, Homo sapiens
aaccuacauucuuaacuguugc

SEQ ID NO: 97309 - RNA, 22 nt, Homo sapiens
aaccuuuagucagcucuuagga

SEQ ID NO: 97310 - RNA, 22 nt, Homo sapiens
aacucugucuccuucaaguuca

SEQ ID NO: 97311 - RNA, 22 nt, Homo sapiens
aacugcacuaggacagguuuuu

SEQ ID NO: 97312 - RNA, 22 nt, Homo sapiens
aacugcucuuaccagauggguc

SEQ ID NO: 97313 - RNA, 22 nt, Homo sapiens
aacuggccuccuugggaaauua

SEQ ID NO: 97314 - RNA, 22 nt, Homo sapiens
aacuggccuggcgugcagaggg

SEQ ID NO: 97315 - RNA, 22 nt, Homo sapiens
aacuggucuuaugcaagcacua

SEQ ID NO: 97316 - RNA, 19 nt, Homo sapiens
aacuggugugagaugauau

SEQ ID NO: 97317 - RNA, 22 nt, Homo sapiens
aagacuguaauccaucuugagu

SEQ ID NO: 97318 - RNA, 22 nt, Homo sapiens
aagagaacugacaguaccuggg

SEQ ID NO: 97319 - RNA, 22 nt, Homo sapiens
aagagcgcugauaacauguuug

SEQ ID NO: 97320 - RNA, 22 nt, Homo sapiens
aagaggccuaggaaucuguauu

SEQ ID NO: 97321 - RNA, 22 nt, Homo sapiens
aagagguuauagaguguauacu

SEQ ID NO: 97322 - RNA, 22 nt, Homo sapiens
aagagguuguaccuaaaguguu

SEQ ID NO: 97323 - RNA, 22 nt, Homo sapiens
aagagguuuaacugacucacag

SEQ ID NO: 97324 - RNA, 22 nt, Homo sapiens
aagaguaguaguggcacucucu

SEQ ID NO: 97325 - RNA, 22 nt, Homo sapiens
aagagugcucgugggacucagc

SEQ ID NO: 97326 - RNA, 22 nt, Homo sapiens
aagagugucuuugugcuggccc

SEQ ID NO: 97327 - RNA, 22 nt, Homo sapiens
aagaugauguuguguuuucacu

SEQ ID NO: 97328 - RNA, 19 nt, Homo sapiens
aagaugauguuugggcuaa

SEQ ID NO: 97329 - RNA, 22 nt, Homo sapiens
aagcaaacaucagcuugguuaa

SEQ ID NO: 97330 - RNA, 22 nt, Homo sapiens
aagcaggugugggaggaaaugg

SEQ ID NO: 97331 - RNA, 22 nt, Homo sapiens
aagccacuguaccugucucuua

SEQ ID NO: 97332 - RNA, 22 nt, Homo sapiens
aagcccauuguaaguugaggag

SEQ ID NO: 97333 - RNA, 22 nt, Homo sapiens
aagcuaggguuaauuuauuauu

SEQ ID NO: 97334 - RNA, 22 nt, Homo sapiens
aagcugccuugcugaggagaaa

SEQ ID NO: 97335 - RNA, 22 nt, Homo sapiens
aagcuggagugcaguggugcga

SEQ ID NO: 97336 - RNA, 22 nt, Homo sapiens
aagcuggcauucaugagauuac

SEQ ID NO: 97337 - RNA, 22 nt, Homo sapiens
aagcuguauuguguugcuauaa

SEQ ID NO: 97338 - RNA, 22 nt, Homo sapiens
aaggagcaguggacggguccua

SEQ ID NO: 97339 - RNA, 22 nt, Homo sapiens
aaggagcuuaagugacuuguac

SEQ ID NO: 97340 - RNA, 22 nt, Homo sapiens
aaggauuguaaaguugacaaau

SEQ ID NO: 97341 - RNA, 22 nt, Homo sapiens
aaggcaagaaaauggauucucc

SEQ ID NO: 97342 - RNA, 22 nt, Homo sapiens
aaggcaagguggauaaugaagc

SEQ ID NO: 97343 - RNA, 22 nt, Homo sapiens
aaggcaugcaguacguuucuau

SEQ ID NO: 97344 - RNA, 22 nt, Homo sapiens
aagggaaugcgcugccuguguu

SEQ ID NO: 97345 - RNA, 22 nt, Homo sapiens
aagggaaugugguagcugguuu

SEQ ID NO: 97346 - RNA, 22 nt, Homo sapiens
aagggagcugcauaaucuugug

SEQ ID NO: 97347 - RNA, 22 nt, Homo sapiens
aagguagguuccaaaauaccua

SEQ ID NO: 97348 - RNA, 22 nt, Homo sapiens
aaggugcucucuuauguagaaa

SEQ ID NO: 97349 - RNA, 17 nt, Homo sapiens
aaggugcuucgaccucc

SEQ ID NO: 97350 - RNA, 22 nt, Homo sapiens
aagguguagucucuggauaagc

SEQ ID NO: 97351 - RNA, 22 nt, Homo sapiens
aaguaaaucuuaugucagggag

SEQ ID NO: 97352 - RNA, 22 nt, Homo sapiens
aaguauagcuaugauaaacauu

SEQ ID NO: 97353 - RNA, 22 nt, Homo sapiens
aaguauguaucaagucauacuu

SEQ ID NO: 97354 - RNA, 22 nt, Homo sapiens
aaguauuagugaggauauggaa

SEQ ID NO: 97355 - RNA, 22 nt, Homo sapiens
aagucacugagacuuguggcug

SEQ ID NO: 97356 - RNA, 22 nt, Homo sapiens
aaguccccugacagaggggagg

SEQ ID NO: 97357 - RNA, 22 nt, Homo sapiens
aagugaaugugcuggaauagcu

SEQ ID NO: 97358 - RNA, 22 nt, Homo sapiens
aagugaauguuugguagcagug

SEQ ID NO: 97359 - RNA, 23 nt, Homo sapiens
aagugagcuccaauugggugaga

SEQ ID NO: 97360 - RNA, 22 nt, Homo sapiens
cauggcuacugcagauguaggg

SEQ ID NO: 97361 - RNA, 23 nt, Homo sapiens
cauggcuguuaacacuguuugag

SEQ ID NO: 97362 - RNA, 22 nt, Homo sapiens
cauggcuuguauaagauucuca

SEQ ID NO: 97363 - RNA, 22 nt, Homo sapiens
cauggcuuuuauaacaagaaau

SEQ ID NO: 97364 - RNA, 22 nt, Homo sapiens
caugguacugccacagaagagu

SEQ ID NO: 97365 - RNA, 22 nt, Homo sapiens
cauguaacaucccgcuguagga

SEQ ID NO: 97366 - RNA, 22 nt, Homo sapiens
caugucuuuuauucugugugau

SEQ ID NO: 97367 - RNA, 22 nt, Homo sapiens
caugugcaugagcacauacgug

SEQ ID NO: 97368 - RNA, 22 nt, Homo sapiens
caugugcaugcuuucuuaugug

SEQ ID NO: 97369 - RNA, 22 nt, Homo sapiens
cauugcaacuucugccucccag

SEQ ID NO: 97370 - RNA, 22 nt, Homo sapiens
cauugcacuccagccucggcaa

SEQ ID NO: 97371 - RNA, 22 nt, Homo sapiens
cauugcacuccagccugaccaa

SEQ ID NO: 97372 - RNA, 22 nt, Homo sapiens
cauugcacuccagccugccugg

SEQ ID NO: 97373 - RNA, 22 nt, Homo sapiens
cauugcacuccagccuggcaac

SEQ ID NO: 97374 - RNA, 22 nt, Homo sapiens
cauugcacuccagccuggccaa

SEQ ID NO: 97375 - RNA, 22 nt, Homo sapiens
cauugcacuccagcuugggcaa

SEQ ID NO: 97376 - RNA, 22 nt, Homo sapiens
cauugcacuccagucugggcaa

SEQ ID NO: 97377 - RNA, 22 nt, Homo sapiens
cauugcacuccauccuuggcaa

SEQ ID NO: 97378 - RNA, 22 nt, Homo sapiens
cauugcacucugcauuccaguc

SEQ ID NO: 97379 - RNA, 22 nt, Homo sapiens
cauugcaguaagagugggcucu

SEQ ID NO: 97380 - RNA, 22 nt, Homo sapiens
cauugcaguggaguggggaaga

SEQ ID NO: 97381 - RNA, 22 nt, Homo sapiens
cauugcaugcauauggcuuggu

SEQ ID NO: 97382 - RNA, 22 nt, Homo sapiens
cauugcccuccagccugggcaa

SEQ ID NO: 97383 - RNA, 19 nt, Homo sapiens
cauuggacuugcuuuugcc

SEQ ID NO: 97384 - RNA, 22 nt, Homo sapiens
cauuggugauuagugaaugaac

SEQ ID NO: 97385 - RNA, 22 nt, Homo sapiens
cauugguuggacaguucucucu

SEQ ID NO: 97386 - RNA, 22 nt, Homo sapiens
cauuguccuccuggggcuauuu

SEQ ID NO: 97387 - RNA, 22 nt, Homo sapiens
cauuugcacugagacucagcuu

SEQ ID NO: 97388 - RNA, 22 nt, Homo sapiens
cauuuugguuaaauagguagcu

SEQ ID NO: 97389 - RNA, 22 nt, Homo sapiens
ccaagugcuuaaaauuucauuu

SEQ ID NO: 97390 - RNA, 22 nt, Homo sapiens
ccaaguguucucauuguucaau

SEQ ID NO: 97391 - RNA, 22 nt, Homo sapiens
ccaaguguuuucauuguuccau

SEQ ID NO: 97392 - RNA, 22 nt, Homo sapiens
ccacauuaccuugcuugcucca

SEQ ID NO: 97393 - RNA, 22 nt, Homo sapiens
ccacauuggaaaggaucccccc

SEQ ID NO: 97394 - RNA, 22 nt, Homo sapiens
ccacccuggagaauuugagguc

SEQ ID NO: 97395 - RNA, 22 nt, Homo sapiens
ccacugugguaucugauacugg

SEQ ID NO: 97396 - RNA, 22 nt, Homo sapiens
ccagaguugccucagguuucug

SEQ ID NO: 97397 - RNA, 22 nt, Homo sapiens
ccagcaccauuuauuaaauagg

SEQ ID NO: 97398 - RNA, 22 nt, Homo sapiens
ccagguuucuagaauaauuccu

SEQ ID NO: 97399 - RNA, 22 nt, Homo sapiens
ccagugauuguauggugaaggu

SEQ ID NO: 97400 - RNA, 22 nt, Homo sapiens
ccagugguucccuguggccuga

SEQ ID NO: 97401 - RNA, 20 nt, Homo sapiens
ccaguguuauuuauguucua

SEQ ID NO: 97402 - RNA, 22 nt, Homo sapiens
ccaguguuuuugaauuccagga

SEQ ID NO: 97403 - RNA, 19 nt, Homo sapiens
ccauggcaaugaucugaug

SEQ ID NO: 97404 - RNA, 21 nt, Homo sapiens
ccaugggacggaaugaauaca

SEQ ID NO: 97405 - RNA, 22 nt, Homo sapiens
ccauugcacuccauccugggca

SEQ ID NO: 97406 - RNA, 22 nt, Homo sapiens
ccauugcacucuggccuaggug

SEQ ID NO: 97407 - RNA, 22 nt, Homo sapiens
ccauugcacuucagccuaggug

SEQ ID NO: 97408 - RNA, 22 nt, Homo sapiens
ccauuucacucuuccugaagga

SEQ ID NO: 97409 - RNA, 22 nt, Homo sapiens
cccacaguggccucauauccuu

SEQ ID NO: 97410 - RNA, 22 nt, Homo sapiens
cccaguagagauugccgaauug

SEQ ID NO: 97411 - RNA, 18 nt, Homo sapiens
cccagugacuuauggccu

SEQ ID NO: 97412 - RNA, 22 nt, Homo sapiens
cccagugguuacauaaggagua

SEQ ID NO: 97413 - RNA, 22 nt, Homo sapiens
cccagugugaacuuggcauuuu

SEQ ID NO: 97414 - RNA, 22 nt, Homo sapiens
cccagugugcugggugacagcu

SEQ ID NO: 97415 - RNA, 22 nt, Homo sapiens
cccaguguguuguggauauuua

SEQ ID NO: 97416 - RNA, 22 nt, Homo sapiens
cccaguguuacgugacagccug

SEQ ID NO: 97417 - RNA, 22 nt, Homo sapiens
cccaguuuugccacuuacuagc

SEQ ID NO: 97418 - RNA, 22 nt, Homo sapiens
cccucgagaaaccaucugcuga

SEQ ID NO: 97419 - RNA, 22 nt, Homo sapiens
cccugaagaaagccuaggacau

SEQ ID NO: 97420 - RNA, 22 nt, Homo sapiens
cccuggacacacacuuuuauuc

SEQ ID NO: 97421 - RNA, 19 nt, Homo sapiens
cccuggcacauggaaaaug

SEQ ID NO: 97422 - RNA, 22 nt, Homo sapiens
cccuguguuuagcugaagguuu

SEQ ID NO: 97423 - RNA, 22 nt, Homo sapiens
cccuugcacuucagagcugcau

SEQ ID NO: 97424 - RNA, 23 nt, Homo sapiens
ccgugagagaguucauagaaagc

SEQ ID NO: 97425 - RNA, 22 nt, Homo sapiens
ccgugcacggaaaggcauauuu

SEQ ID NO: 97426 - RNA, 22 nt, Homo sapiens
ccuccauuugugucaggaaguc

SEQ ID NO: 97427 - RNA, 22 nt, Homo sapiens
ccucuguaguccugcaagagga

SEQ ID NO: 97428 - RNA, 22 nt, Homo sapiens
ccugagguagaguuuauauuga

SEQ ID NO: 97429 - RNA, 21 nt, Homo sapiens
ccugaguacaacccacuccac

SEQ ID NO: 97430 - RNA, 22 nt, Homo sapiens
ccuguagcauccaagaagcugc

SEQ ID NO: 97431 - RNA, 22 nt, Homo sapiens
ccugucuugaagagauccuccu

SEQ ID NO: 97432 - RNA, 22 nt, Homo sapiens
ccugugguuaaccagcuagaug

SEQ ID NO: 97433 - RNA, 22 nt, Homo sapiens
ccuguguuaugguuucuaaugu

SEQ ID NO: 97434 - RNA, 22 nt, Homo sapiens
ccuucauccuccagcaggcuag

SEQ ID NO: 97435 - RNA, 22 nt, Homo sapiens
ccuucauugcaucuuuaagaga

SEQ ID NO: 97436 - RNA, 22 nt, Homo sapiens
ccuucuuuuguaaggcugaaua

SEQ ID NO: 97437 - RNA, 21 nt, Homo sapiens
ccuugguuaucuucccauuca

SEQ ID NO: 97438 - RNA, 22 nt, Homo sapiens
ccuugguugugcuucaacuucu

SEQ ID NO: 97439 - RNA, 22 nt, Homo sapiens
ccuuuguggggcgguggguaau

SEQ ID NO: 97440 - RNA, 22 nt, Homo sapiens
ccuuuguuaguuugcugagaau

SEQ ID NO: 97441 - RNA, 22 nt, Homo sapiens
ccuuuguuuaguugaauuguau

SEQ ID NO: 97442 - RNA, 22 nt, Homo sapiens
cgacuggccuagacuaguguuu

SEQ ID NO: 97443 - RNA, 22 nt, Homo sapiens
cgaggaguaucuuugugguguu

SEQ ID NO: 97444 - RNA, 22 nt, Homo sapiens
cgccgggggaugggcaccagcg

SEQ ID NO: 97445 - RNA, 22 nt, Homo sapiens
cgccugagcugaggaagcugca

SEQ ID NO: 97446 - RNA, 22 nt, Homo sapiens
cuaaagauagugacaugauuug

SEQ ID NO: 97447 - RNA, 22 nt, Homo sapiens
cuaaaguagccaggacugcagg

SEQ ID NO: 97448 - RNA, 23 nt, Homo sapiens
cuaaagucugucacugaggacuu

SEQ ID NO: 97449 - RNA, 22 nt, Homo sapiens
cuaaagugcuuaaaaucucauu

SEQ ID NO: 97450 - RNA, 19 nt, Homo sapiens
cuaaaugggucccuagugg

SEQ ID NO: 97451 - RNA, 22 nt, Homo sapiens
cuuuuacacuguuggcaggauu

SEQ ID NO: 97452 - RNA, 22 nt, Homo sapiens
cuuuuacacuguuggugggaau

SEQ ID NO: 97453 - RNA, 20 nt, Homo sapiens
cuuuuagcagcagcaagaga

SEQ ID NO: 97454 - RNA, 23 nt, Homo sapiens
cuuuugcaaugugaucuugccac

SEQ ID NO: 97455 - RNA, 22 nt, Homo sapiens
cuuuuggucuaucagagaagca

SEQ ID NO: 97456 - RNA, 22 nt, Homo sapiens
cuuuuggugguucugaugcagg

SEQ ID NO: 97457 - RNA, 22 nt, Homo sapiens
cuuuuugcuagagucuaggguc

SEQ ID NO: 97458 - RNA, 22 nt, Homo sapiens
cuuuuugcugcagcaauacugg

SEQ ID NO: 97459 - RNA, 22 nt, Homo sapiens
gaaaacugcuucucuggguuuc

SEQ ID NO: 97460 - RNA, 20 nt, Homo sapiens
gaaacaucuauccucuccuu

SEQ ID NO: 97461 - RNA, 22 nt, Homo sapiens
gaaagcuaaugacuuuggguga

SEQ ID NO: 97462 - RNA, 22 nt, Homo sapiens
gaaagcugguauagauacauua

SEQ ID NO: 97463 - RNA, 22 nt, Homo sapiens
gaaaguaauuaacgauuguugc

SEQ ID NO: 97464 - RNA, 18 nt, Homo sapiens
gaaaugccucuugcuuac

SEQ ID NO: 97465 - RNA, 22 nt, Homo sapiens
gaaaugcucauuuuggauccuu

SEQ ID NO: 97466 - RNA, 22 nt, Homo sapiens
gaaauguauuaaugaguugaaa

SEQ ID NO: 97467 - RNA, 22 nt, Homo sapiens
gaaauguugauagugggcauug

SEQ ID NO: 97468 - RNA, 22 nt, Homo sapiens
gaaauguuuuucaugugggcaa

SEQ ID NO: 97469 - RNA, 22 nt, Homo sapiens
gaaccagcagacuuugacaggu

SEQ ID NO: 97470 - RNA, 20 nt, Homo sapiens
gaacugguguauguuuaacu

SEQ ID NO: 97471 - RNA, 22 nt, Homo sapiens
gaacuguaaagaaauucuaagg

SEQ ID NO: 97472 - RNA, 22 nt, Homo sapiens
gaacuguuucuggugaaagagu

SEQ ID NO: 97473 - RNA, 22 nt, Homo sapiens
gaacuuucuacauuaccucuuu

SEQ ID NO: 97474 - RNA, 22 nt, Homo sapiens
gaagauaucuaguaccauuguc

SEQ ID NO: 97475 - RNA, 22 nt, Homo sapiens
gaagaucacacuguagaucuau

SEQ ID NO: 97476 - RNA, 22 nt, Homo sapiens
gaagcagcauucugguuuuugg

SEQ ID NO: 97477 - RNA, 22 nt, Homo sapiens
gaagcgaggugauuagcagaca

SEQ ID NO: 97478 - RNA, 22 nt, Homo sapiens
gaaggagcuuaucugccauuuc

SEQ ID NO: 97479 - RNA, 22 nt, Homo sapiens
gaaguaggugcuguuauuaucu

SEQ ID NO: 97480 - RNA, 19 nt, Homo sapiens
gaaguguuuguucuccaug

SEQ ID NO: 97481 - RNA, 22 nt, Homo sapiens
gaauaaacuagagaggacugag

SEQ ID NO: 97482 - RNA, 22 nt, Homo sapiens
gaauagugcugcaagaaacaua

SEQ ID NO: 97483 - RNA, 22 nt, Homo sapiens
gaauagugcugcaguaaacaua

SEQ ID NO: 97484 - RNA, 22 nt, Homo sapiens
gaauggaacugacuauagcuga

SEQ ID NO: 97485 - RNA, 22 nt, Homo sapiens
gacacuggguguuuguuggcgu

SEQ ID NO: 97486 - RNA, 22 nt, Homo sapiens
gacagguuuucuguuucugaaa

SEQ ID NO: 97487 - RNA, 22 nt, Homo sapiens
gacagugugauacuuagucuca

SEQ ID NO: 97488 - RNA, 22 nt, Homo sapiens
gacaguguggcgauuccucaag

SEQ ID NO: 97489 - RNA, 20 nt, Homo sapiens
gacauaggcugguaucuggc

SEQ ID NO: 97490 - RNA, 20 nt, Homo sapiens
gacauguugguuugcugcac

SEQ ID NO: 97491 - RNA, 22 nt, Homo sapiens
gacauguuuacaguguugagag

SEQ ID NO: 97492 - RNA, 22 nt, Homo sapiens
gacauguuucucucuguuuacu

SEQ ID NO: 97493 - RNA, 20 nt, Homo sapiens
gacauguuuuguggccuaac

SEQ ID NO: 97494 - RNA, 22 nt, Homo sapiens
gaccccuagagauaggaggaac

SEQ ID NO: 97495 - RNA, 22 nt, Homo sapiens
gacccuuagaaugugaucuuau

SEQ ID NO: 97496 - RNA, 22 nt, Homo sapiens
gaccuguaguuuaguugccugu

SEQ ID NO: 97497 - RNA, 22 nt, Homo sapiens
gacuauguuaccuuacacauca

SEQ ID NO: 97498 - RNA, 22 nt, Homo sapiens
gacucuguagacaaucacaucu

SEQ ID NO: 97499 - RNA, 22 nt, Homo sapiens
gacugaggaagcgcucucuccu

SEQ ID NO: 97500 - RNA, 22 nt, Homo sapiens
gacuugaagaaucuaagggagg

SEQ ID NO: 97501 - RNA, 20 nt, Homo sapiens
gacuugagagugggagagua

SEQ ID NO: 97502 - RNA, 18 nt, Homo sapiens
gacuuggaguuuacagug

SEQ ID NO: 97503 - RNA, 22 nt, Homo sapiens
gacuuugguagaggaaaaaucu

SEQ ID NO: 97504 - RNA, 22 nt, Homo sapiens
gagaacaguguuguauuuuuuc

SEQ ID NO: 97505 - RNA, 22 nt, Homo sapiens
gagaacauuuaagccacucagg

SEQ ID NO: 97506 - RNA, 22 nt, Homo sapiens
gagaaccuccagcaagguagua

SEQ ID NO: 97507 - RNA, 20 nt, Homo sapiens
gagaacugagaugcguuuga

SEQ ID NO: 97508 - RNA, 22 nt, Homo sapiens
gagaaguaaauuuauuugcaaa

SEQ ID NO: 97509 - RNA, 22 nt, Homo sapiens
gagaagugcgucguuugaugau

SEQ ID NO: 97510 - RNA, 21 nt, Homo sapiens
gagaaucaucauggcugcaua

SEQ ID NO: 97511 - RNA, 21 nt, Homo sapiens
gagaaucuuuucagggcaaac

SEQ ID NO: 97512 - RNA, 22 nt, Homo sapiens
gagaaugagauuaugguuacau

SEQ ID NO: 97513 - RNA, 22 nt, Homo sapiens
gagacauugacuuuguuccaga

SEQ ID NO: 97514 - RNA, 20 nt, Homo sapiens
gagaccugagauucacucaa

SEQ ID NO: 97515 - RNA, 22 nt, Homo sapiens
gagacggagucacgcccuguca

SEQ ID NO: 97516 - RNA, 22 nt, Homo sapiens
gagacugagucucacucuguca

SEQ ID NO: 97517 - RNA, 22 nt, Homo sapiens
gagacugagucuugcucugucg

SEQ ID NO: 97518 - RNA, 22 nt, Homo sapiens
gagagcaugugcuggcaucagu

SEQ ID NO: 97519 - RNA, 22 nt, Homo sapiens
gagaggucguauaugauuucug

SEQ ID NO: 97520 - RNA, 22 nt, Homo sapiens
gagauaggauucacuuucaugu

SEQ ID NO: 97521 - RNA, 21 nt, Homo sapiens
gagauagguaccgaagcuuag

SEQ ID NO: 97522 - RNA, 22 nt, Homo sapiens
gagauauuuagaaauguguucu

SEQ ID NO: 97523 - RNA, 22 nt, Homo sapiens
gagaucaguuaaugaagugagc

SEQ ID NO: 97524 - RNA, 22 nt, Homo sapiens
gagaucuauuccucacccuucu

SEQ ID NO: 97525 - RNA, 22 nt, Homo sapiens
gagaucuucguguggggagaca

SEQ ID NO: 97526 - RNA, 22 nt, Homo sapiens
gagaucuuggccaaguuucuua

SEQ ID NO: 97527 - RNA, 22 nt, Homo sapiens
gagaugaugagauguucacagu

SEQ ID NO: 97528 - RNA, 22 nt, Homo sapiens
gagauggagucuuuuucuguca

SEQ ID NO: 97529 - RNA, 22 nt, Homo sapiens
gagauuaauacacaucaaaugc

SEQ ID NO: 97530 - RNA, 22 nt, Homo sapiens
gagcaacaguggcagugguggg

SEQ ID NO: 97531 - RNA, 22 nt, Homo sapiens
gagcaaugagcugccugcugag

SEQ ID NO: 97532 - RNA, 21 nt, Homo sapiens
gagcacauuguccucuaacgc

SEQ ID NO: 97533 - RNA, 22 nt, Homo sapiens
gagcacccuuuguugauugcaa

SEQ ID NO: 97534 - RNA, 18 nt, Homo sapiens
gagcaccuuuuuugcaga

SEQ ID NO: 97535 - RNA, 22 nt, Homo sapiens
gagcacugaauacugugguggu

SEQ ID NO: 97536 - RNA, 22 nt, Homo sapiens
gagcacugauuuauuuuugucu

SEQ ID NO: 97537 - RNA, 22 nt, Homo sapiens
gagcagacaugaggaccgcugg

SEQ ID NO: 97538 - RNA, 20 nt, Homo sapiens
gagcaucacaggccucugcu

SEQ ID NO: 97539 - RNA, 22 nt, Homo sapiens
gagccauggagaaaacagcuau

SEQ ID NO: 97540 - RNA, 22 nt, Homo sapiens
gagccuguaggaggagaggugg

SEQ ID NO: 97541 - RNA, 22 nt, Homo sapiens
guauacuucugaaaauagcuau

SEQ ID NO: 97542 - RNA, 22 nt, Homo sapiens
gagcuagggucaugcuacugca

SEQ ID NO: 97543 - RNA, 21 nt, Homo sapiens
gagcuaggugaggcuguaaug

SEQ ID NO: 97544 - RNA, 22 nt, Homo sapiens
gagcuagguuuugaauccagac

SEQ ID NO: 97545 - RNA, 22 nt, Homo sapiens
gagcugaucuuuauguaaauuc

SEQ ID NO: 97546 - RNA, 22 nt, Homo sapiens
gagcuguuuuucacuagaccaa

SEQ ID NO: 97547 - RNA, 22 nt, Homo sapiens
gaggaaguaauuuuaggccugu

SEQ ID NO: 97548 - RNA, 22 nt, Homo sapiens
gaggaaguagcuacugucuuuc

SEQ ID NO: 97549 - RNA, 22 nt, Homo sapiens
gaggaaguuuacaaagcaucug

SEQ ID NO: 97550 - RNA, 22 nt, Homo sapiens
gaggacauuaugcuaaguggaa

SEQ ID NO: 97551 - RNA, 22 nt, Homo sapiens
gaggcaagaguaguuaaguuag

SEQ ID NO: 97552 - RNA, 22 nt, Homo sapiens
gaggcauugaaauauugcuuau

SEQ ID NO: 97553 - RNA, 22 nt, Homo sapiens
gagguaagaaagucaguccuuc

SEQ ID NO: 97554 - RNA, 22 nt, Homo sapiens
gagguaagaguuuuccauuucu

SEQ ID NO: 97555 - RNA, 22 nt, Homo sapiens
gagguaagaugauucguguccu

SEQ ID NO: 97556 - RNA, 22 nt, Homo sapiens
gagguaaguaagaauggcaagc

SEQ ID NO: 97557 - RNA, 21 nt, Homo sapiens
gagguaccucauguaagugga

SEQ ID NO: 97558 - RNA, 22 nt, Homo sapiens
gagguagaauguuuuucagcug

SEQ ID NO: 97559 - RNA, 22 nt, Homo sapiens
gagguagagacuauguauuaga

SEQ ID NO: 97560 - RNA, 22 nt, Homo sapiens
gagguagugagcagcugaacua

SEQ ID NO: 97561 - RNA, 22 nt, Homo sapiens
gaggucauucugugguacccag

SEQ ID NO: 97562 - RNA, 22 nt, Homo sapiens
gaggugaaggucucaauaaaua

SEQ ID NO: 97563 - RNA, 22 nt, Homo sapiens
gaggugauaucucauugugguu

SEQ ID NO: 97564 - RNA, 22 nt, Homo sapiens
gagguggauacauuaaauaaug

SEQ ID NO: 97565 - RNA, 22 nt, Homo sapiens
gagguuauuggggugcuugugu

SEQ ID NO: 97566 - RNA, 22 nt, Homo sapiens
gaguaacauugacaacuucaug

SEQ ID NO: 97567 - RNA, 22 nt, Homo sapiens
gaguauguauaugagugugucu

SEQ ID NO: 97568 - RNA, 22 nt, Homo sapiens
gaguauuuuacaucguguaauu

SEQ ID NO: 97569 - RNA, 22 nt, Homo sapiens
gagugcaucguggccauuuuaa

SEQ ID NO: 97570 - RNA, 22 nt, Homo sapiens
gagugcauugguggucaggugu

SEQ ID NO: 97571 - RNA, 18 nt, Homo sapiens
gaguggugcuucccuugu

SEQ ID NO: 97572 - RNA, 22 nt, Homo sapiens
gagugguucuauauguaauugg

SEQ ID NO: 97573 - RNA, 22 nt, Homo sapiens
gaguuacauuguaauugccgag

SEQ ID NO: 97574 - RNA, 22 nt, Homo sapiens
gaguucaauuuccagcuguucu

SEQ ID NO: 97575 - RNA, 22 nt, Homo sapiens
gaguucauaucuaugagugugc

SEQ ID NO: 97576 - RNA, 22 nt, Homo sapiens
gaguucauuuugaaaccuugau

SEQ ID NO: 97577 - RNA, 22 nt, Homo sapiens
gaguuccuuugagccugagagg

SEQ ID NO: 97578 - RNA, 22 nt, Homo sapiens
gauaaaguauuggguacuaugc

SEQ ID NO: 97579 - RNA, 22 nt, Homo sapiens
gauaaauccagauucugaugua

SEQ ID NO: 97580 - RNA, 22 nt, Homo sapiens
gauaaaucuuggcuagucuaag

SEQ ID NO: 97581 - RNA, 22 nt, Homo sapiens
gauaacagauaaugucaguuau

SEQ ID NO: 97582 - RNA, 18 nt, Homo sapiens
gauaacaguggacuaugc

SEQ ID NO: 97583 - RNA, 22 nt, Homo sapiens
gauagguagaagauguuuucau

SEQ ID NO: 97584 - RNA, 22 nt, Homo sapiens
gauagguucuaagcagguguug

SEQ ID NO: 97585 - RNA, 22 nt, Homo sapiens
gauaugaccauguagaccucag

SEQ ID NO: 97586 - RNA, 22 nt, Homo sapiens
gauauguucuuucacguuggug

SEQ ID NO: 97587 - RNA, 22 nt, Homo sapiens
gauauguugaguagaguuuuug

SEQ ID NO: 97588 - RNA, 22 nt, Homo sapiens
gauauugacuuauucuauguuu

SEQ ID NO: 97589 - RNA, 22 nt, Homo sapiens
gaucaauuggcugaagacacgu

SEQ ID NO: 97590 - RNA, 22 nt, Homo sapiens
gaucacuuugaugccaggaacu

SEQ ID NO: 97591 - RNA, 22 nt, Homo sapiens
gaucagagugaaccuuguuaug

SEQ ID NO: 97592 - RNA, 22 nt, Homo sapiens
gaucuggagguuuuccucauga

SEQ ID NO: 97593 - RNA, 19 nt, Homo sapiens
gaucuguugaucaaugugu

SEQ ID NO: 97594 - RNA, 22 nt, Homo sapiens
gaucuguuuuccuauuguuugu

SEQ ID NO: 97595 - RNA, 22 nt, Homo sapiens
gaugaaacaucuuuggaaacug

SEQ ID NO: 97596 - RNA, 22 nt, Homo sapiens
gaugacagcugacucccuugcu

SEQ ID NO: 97597 - RNA, 22 nt, Homo sapiens
gaugacagugaguaaccccaac

SEQ ID NO: 97598 - RNA, 22 nt, Homo sapiens
gaugagaugagcauuugaauug

SEQ ID NO: 97599 - RNA, 22 nt, Homo sapiens
gaugagcuaaguucucacagca

SEQ ID NO: 97600 - RNA, 22 nt, Homo sapiens
gaugagguagaagacucagcaa

SEQ ID NO: 97601 - RNA, 22 nt, Homo sapiens
gaugcaaauuaagcuugggaca

SEQ ID NO: 97602 - RNA, 19 nt, Homo sapiens
gaugcaaugcacugagguc

SEQ ID NO: 97603 - RNA, 22 nt, Homo sapiens
gauggaauuaaaaucagaauca

SEQ ID NO: 97604 - RNA, 22 nt, Homo sapiens
gauggcacuguagcaacacaaa

SEQ ID NO: 97605 - RNA, 22 nt, Homo sapiens
gaugguggucuacccuuucccu

SEQ ID NO: 97606 - RNA, 22 nt, Homo sapiens
gaugguguuuugauaggaauug

SEQ ID NO: 97607 - RNA, 22 nt, Homo sapiens
gaugugaaaucauaguuucuag

SEQ ID NO: 97608 - RNA, 22 nt, Homo sapiens
gauguguugggaagauuucaag

SEQ ID NO: 97609 - RNA, 22 nt, Homo sapiens
gauguguuuuaggaucucagca

SEQ ID NO: 97610 - RNA, 22 nt, Homo sapiens
gauuagaacagaagucagauua

SEQ ID NO: 97611 - RNA, 20 nt, Homo sapiens
gauuagagagaggcugugca

SEQ ID NO: 97612 - RNA, 22 nt, Homo sapiens
gauuagcacuucaguuacagua

SEQ ID NO: 97613 - RNA, 22 nt, Homo sapiens
gauuagucccauuuuacaggug

SEQ ID NO: 97614 - RNA, 22 nt, Homo sapiens
gauugcaauuuaggugagagag

SEQ ID NO: 97615 - RNA, 22 nt, Homo sapiens
gauuggccaaacuaaagaacug

SEQ ID NO: 97616 - RNA, 22 nt, Homo sapiens
gcaaaauugagaagggaauaua

SEQ ID NO: 97617 - RNA, 22 nt, Homo sapiens
gcaaaguaauuguuguuuuugc

SEQ ID NO: 97618 - RNA, 22 nt, Homo sapiens
gcaaaguguuuuccaacuuggu

SEQ ID NO: 97619 - RNA, 22 nt, Homo sapiens
gcaaaucuuauguccucacauu

SEQ ID NO: 97620 - RNA, 20 nt, Homo sapiens
gcaacauggccagagugaau

SEQ ID NO: 97621 - RNA, 22 nt, Homo sapiens
gcaacccgucaucuagguuuua

SEQ ID NO: 97622 - RNA, 22 nt, Homo sapiens
gcaagaaugagaaggauuaauu

SEQ ID NO: 97623 - RNA, 22 nt, Homo sapiens
gcaagaauggaacaggagagcc

SEQ ID NO: 97624 - RNA, 21 nt, Homo sapiens
gcaaguacuaucaucauuauc

SEQ ID NO: 97625 - RNA, 22 nt, Homo sapiens
gcacaaugccugacgaguccug

SEQ ID NO: 97626 - RNA, 22 nt, Homo sapiens
gcacagucaacacuuauucacc

SEQ ID NO: 97627 - RNA, 22 nt, Homo sapiens
gcacaguguuacuugauauauu

SEQ ID NO: 97628 - RNA, 22 nt, Homo sapiens
gcacauauguaaauagcugccu

SEQ ID NO: 97629 - RNA, 22 nt, Homo sapiens
gcacgugcacccacaugcacgu

SEQ ID NO: 97630 - RNA, 22 nt, Homo sapiens
gcagaguauagagggcugggcc

SEQ ID NO: 97631 - RNA, 22 nt, Homo sapiens
gcaguacacuguugguaggaau

SEQ ID NO: 97632 - RNA, 19 nt, Homo sapiens
gcaguauugaaggccaguc

SEQ ID NO: 97633 - RNA, 21 nt, Homo sapiens
gugcaaacaucauagaaugua

SEQ ID NO: 97634 - RNA, 22 nt, Homo sapiens
gugcaaauguuauugagguuuu

SEQ ID NO: 97635 - RNA, 22 nt, Homo sapiens
gugcaacaucccuccauaauuu

SEQ ID NO: 97636 - RNA, 22 nt, Homo sapiens
gugcaacaugccuggcuaauuu

SEQ ID NO: 97637 - RNA, 22 nt, Homo sapiens
gugcaaccaucaccacugacuc

SEQ ID NO: 97638 - RNA, 22 nt, Homo sapiens
gugcaaugucaggagaugcagc

SEQ ID NO: 97639 - RNA, 22 nt, Homo sapiens
gugcacaacaugcaguuuuguu

SEQ ID NO: 97640 - RNA, 22 nt, Homo sapiens
gugcacaacgugcagguuaguu

SEQ ID NO: 97641 - RNA, 22 nt, Homo sapiens
gugcacaugguagguauugagu

SEQ ID NO: 97642 - RNA, 21 nt, Homo sapiens
gugcagacacacauauaggcu

SEQ ID NO: 97643 - RNA, 22 nt, Homo sapiens
gugcaguuuacaguuacccagu

SEQ ID NO: 97644 - RNA, 22 nt, Homo sapiens
gugcaguuuuaagugaguuucu

SEQ ID NO: 97645 - RNA, 19 nt, Homo sapiens
gugcauaguuauuaaagag

SEQ ID NO: 97646 - RNA, 22 nt, Homo sapiens
gugcauaugcaugugcaugcac

SEQ ID NO: 97647 - RNA, 22 nt, Homo sapiens
gugcaugucuaugcgagucuaa

SEQ ID NO: 97648 - RNA, 23 nt, Homo sapiens
gugccuucugagccuagucucca

SEQ ID NO: 97649 - RNA, 22 nt, Homo sapiens
gugccuuuucugagcaaugagc

SEQ ID NO: 97650 - RNA, 22 nt, Homo sapiens
gugcuauguuauccagcaagau

SEQ ID NO: 97651 - RNA, 16 nt, Homo sapiens
gugcuguguuguuagg

SEQ ID NO: 97652 - RNA, 22 nt, Homo sapiens
gugcuuguguuaauauguagcu

SEQ ID NO: 97653 - RNA, 22 nt, Homo sapiens
gugcuuuguuguggcaguggca

SEQ ID NO: 97654 - RNA, 22 nt, Homo sapiens
guggaagaaaucagguuauuug

SEQ ID NO: 97655 - RNA, 22 nt, Homo sapiens
guggaagaccagacuuuccaac

SEQ ID NO: 97656 - RNA, 22 nt, Homo sapiens
guggaagauaguguguuaaugu

SEQ ID NO: 97657 - RNA, 22 nt, Homo sapiens
guggaagguaaugcagcuuacu

SEQ ID NO: 97658 - RNA, 20 nt, Homo sapiens
guggaaguagaaacauaugu

SEQ ID NO: 97659 - RNA, 22 nt, Homo sapiens
guggaagucuuugguauuggua

SEQ ID NO: 97660 - RNA, 22 nt, Homo sapiens
guggacugggagagauaguucc

SEQ ID NO: 97661 - RNA, 22 nt, Homo sapiens
guggagacaaaggcugagugag

SEQ ID NO: 97662 - RNA, 18 nt, Homo sapiens
guggagugucuuccugga

SEQ ID NO: 97663 - RNA, 22 nt, Homo sapiens
guggaucacuugagguuagaag

SEQ ID NO: 97664 - RNA, 22 nt, Homo sapiens
guggcaaacucagcaugcccca

SEQ ID NO: 97665 - RNA, 22 nt, Homo sapiens
guggcaaguguuccaagaggcg

SEQ ID NO: 97666 - RNA, 22 nt, Homo sapiens
guggcacaauuaaguagcuauu

SEQ ID NO: 97667 - RNA, 22 nt, Homo sapiens
guggcagaaaagagaagcaaug

SEQ ID NO: 97668 - RNA, 22 nt, Homo sapiens
guggcagagucagagggaaaug

SEQ ID NO: 97669 - RNA, 22 nt, Homo sapiens
guggcagcacauauagguuguu

SEQ ID NO: 97670 - RNA, 22 nt, Homo sapiens
guggcuauuguucccugguugc

SEQ ID NO: 97671 - RNA, 22 nt, Homo sapiens
gugggauggaaaugggcuucag

SEQ ID NO: 97672 - RNA, 20 nt, Homo sapiens
gugggcaaauccuuuccucu

SEQ ID NO: 97673 - RNA, 22 nt, Homo sapiens
gugggguaggaggaguacuucc

SEQ ID NO: 97674 - RNA, 22 nt, Homo sapiens
guggguaaaucucuggggcucu

SEQ ID NO: 97675 - RNA, 22 nt, Homo sapiens
gugguacuaucuuugguuucag

SEQ ID NO: 97676 - RNA, 22 nt, Homo sapiens
guggucagaaaucucaguggca

SEQ ID NO: 97677 - RNA, 22 nt, Homo sapiens
gugguguuugagcugccaggga

SEQ ID NO: 97678 - RNA, 22 nt, Homo sapiens
gugguucuaaaccuuuuuuggu

SEQ ID NO: 97679 - RNA, 21 nt, Homo sapiens
gugguucuagagaaacagaau

SEQ ID NO: 97680 - RNA, 22 nt, Homo sapiens
gugguuuuaucccagaaauuaa

SEQ ID NO: 97681 - RNA, 22 nt, Homo sapiens
gugguuuucaacuccaccugca

SEQ ID NO: 97682 - RNA, 22 nt, Homo sapiens
gugguuuuuaaaguaccugugg

SEQ ID NO: 97683 - RNA, 22 nt, Homo sapiens
gugguuuuuagauuucuacagu

SEQ ID NO: 97684 - RNA, 22 nt, Homo sapiens
guguaauaaucguggacuaugu

SEQ ID NO: 97685 - RNA, 22 nt, Homo sapiens
guguaugguaggaugacggagu

SEQ ID NO: 97686 - RNA, 22 nt, Homo sapiens
gugucaugagggggacaggaag

SEQ ID NO: 97687 - RNA, 22 nt, Homo sapiens
gugugaacaucauagaguguau

SEQ ID NO: 97688 - RNA, 22 nt, Homo sapiens
gugugacugcucuauuagggcg

SEQ ID NO: 97689 - RNA, 22 nt, Homo sapiens
gugugauguaaagaacugggga

SEQ ID NO: 97690 - RNA, 22 nt, Homo sapiens
gugugauuguuaauuuuaggug

SEQ ID NO: 97691 - RNA, 23 nt, Homo sapiens
gugugguaggcuauaccaucuag

SEQ ID NO: 97692 - RNA, 22 nt, Homo sapiens
gugugucuugaccaggaucgga

SEQ ID NO: 97693 - RNA, 22 nt, Homo sapiens
guguuaaucucaaguacucuca

SEQ ID NO: 97694 - RNA, 22 nt, Homo sapiens
guguuauuuugcugggaaugau

SEQ ID NO: 97695 - RNA, 22 nt, Homo sapiens
guguucaaagcugauugagauu

SEQ ID NO: 97696 - RNA, 22 nt, Homo sapiens
guguuugguugauagagccacu

SEQ ID NO: 97697 - RNA, 20 nt, Homo sapiens
guuaaggcagcauuacucuu

SEQ ID NO: 97698 - RNA, 22 nt, Homo sapiens
guuaaugcuggaauaaguuaag

SEQ ID NO: 97699 - RNA, 22 nt, Homo sapiens
guuagaugaagaccaagggcaa

SEQ ID NO: 97700 - RNA, 22 nt, Homo sapiens
guuagguagaaguuuacuuuga

SEQ ID NO: 97701 - RNA, 18 nt, Homo sapiens
guuagguaguaugaugcu

SEQ ID NO: 97702 - RNA, 22 nt, Homo sapiens
guuauguuauguuauguuaugu

SEQ ID NO: 97703 - RNA, 22 nt, Homo sapiens
guucaagugauagcugggauua

SEQ ID NO: 97704 - RNA, 21 nt, Homo sapiens
guucaagugauccuccugucu

SEQ ID NO: 97705 - RNA, 20 nt, Homo sapiens
guucacaggcuuccuuucag

SEQ ID NO: 97706 - RNA, 22 nt, Homo sapiens
guucacagugguugccuuccag

SEQ ID NO: 97707 - RNA, 22 nt, Homo sapiens
guucacaguuaggacaacugcu

SEQ ID NO: 97708 - RNA, 22 nt, Homo sapiens
guucacaguuucuaaucccagc

SEQ ID NO: 97709 - RNA, 22 nt, Homo sapiens
guucagcaggggcuucaauggu

SEQ ID NO: 97710 - RNA, 22 nt, Homo sapiens
guucaguuuuaaagggaaauug

SEQ ID NO: 97711 - RNA, 22 nt, Homo sapiens
guucaguuuugaaauguuaauu

SEQ ID NO: 97712 - RNA, 22 nt, Homo sapiens
guucaucaggaauauuggccua

SEQ ID NO: 97713 - RNA, 20 nt, Homo sapiens
guucauguaauuaguucagg

SEQ ID NO: 97714 - RNA, 17 nt, Homo sapiens
guucccaguggcauuug

SEQ ID NO: 97715 - RNA, 22 nt, Homo sapiens
guucucacuggugcugguaagu

SEQ ID NO: 97716 - RNA, 22 nt, Homo sapiens
guugacuaggagcuacuacuac

SEQ ID NO: 97717 - RNA, 22 nt, Homo sapiens
guugagcaaacagcuuaacagu

SEQ ID NO: 97718 - RNA, 17 nt, Homo sapiens
guugaguuugagucaag

SEQ ID NO: 97719 - RNA, 22 nt, Homo sapiens
ggcaacaugaugaaaugccauc

SEQ ID NO: 97720 - RNA, 21 nt, Homo sapiens
ggcaagaaacacaaucaagua

SEQ ID NO: 97721 - RNA, 22 nt, Homo sapiens
ggcaaggugaugaaugucuaca

SEQ ID NO: 97722 - RNA, 22 nt, Homo sapiens
ggcaaguauguuuuaggaugcu

SEQ ID NO: 97723 - RNA, 22 nt, Homo sapiens
ggcaagugggagggaguguuuc

SEQ ID NO: 97724 - RNA, 22 nt, Homo sapiens
guugguauuacagaaauuaguu

SEQ ID NO: 97725 - RNA, 22 nt, Homo sapiens
guuguacuaccucucguauuag

SEQ ID NO: 97726 - RNA, 22 nt, Homo sapiens
guuguggagucuucuguucugg

SEQ ID NO: 97727 - RNA, 22 nt, Homo sapiens
guuuacagucgacuugggaaua

SEQ ID NO: 97728 - RNA, 22 nt, Homo sapiens
guuuguaacucuagugacuaga

SEQ ID NO: 97729 - RNA, 22 nt, Homo sapiens
uaaaccuagcauuuugcauaug

SEQ ID NO: 97730 - RNA, 22 nt, Homo sapiens
uaaacugcuugaggguaaguac

SEQ ID NO: 97731 - RNA, 22 nt, Homo sapiens
uaaagcuacagagcggaaaauu

SEQ ID NO: 97732 - RNA, 22 nt, Homo sapiens
uaaagcuacaguauaugguauu

SEQ ID NO: 97733 - RNA, 22 nt, Homo sapiens
uaaagcuagaauuguuccagca

SEQ ID NO: 97734 - RNA, 22 nt, Homo sapiens
uaaagcuauuauaguuauguuu

SEQ ID NO: 97735 - RNA, 18 nt, Homo sapiens
uaaaggcacuguguuguu

SEQ ID NO: 97736 - RNA, 22 nt, Homo sapiens
uaaaugcucuuuaaaagugcuu

SEQ ID NO: 97737 - RNA, 22 nt, Homo sapiens
uaaaugcuuaauugaaugugga

SEQ ID NO: 97738 - RNA, 22 nt, Homo sapiens
uaaaugcuugagaugauggaua

SEQ ID NO: 97739 - RNA, 22 nt, Homo sapiens
uaacaaugucuuaugggcuuaa

SEQ ID NO: 97740 - RNA, 22 nt, Homo sapiens
uaacagcauuugugucuaguag

SEQ ID NO: 97741 - RNA, 22 nt, Homo sapiens
uaacagcucuacagcugcucuu

SEQ ID NO: 97742 - RNA, 22 nt, Homo sapiens
uaacaggcaaggucacaccuug

SEQ ID NO: 97743 - RNA, 22 nt, Homo sapiens
uaacaggcuacucuugcauugc

SEQ ID NO: 97744 - RNA, 22 nt, Homo sapiens
uaacaguauaugugguaucuau

SEQ ID NO: 97745 - RNA, 23 nt, Homo sapiens
uaacauguuuuuaagggaagcuu

SEQ ID NO: 97746 - RNA, 22 nt, Homo sapiens
uaacauuguugauuauacuaag

SEQ ID NO: 97747 - RNA, 22 nt, Homo sapiens
uaacccagugucugugaugggu

SEQ ID NO: 97748 - RNA, 22 nt, Homo sapiens
uaacccuuacaacuacacucgu

SEQ ID NO: 97749 - RNA, 22 nt, Homo sapiens
uaacuacuucugcuucagagua

SEQ ID NO: 97750 - RNA, 20 nt, Homo sapiens
uaacuguggcuucuuuuggc

SEQ ID NO: 97751 - RNA, 22 nt, Homo sapiens
uaacuucaucauaagucaagaa

SEQ ID NO: 97752 - RNA, 23 nt, Homo sapiens
uaagacacuaacuuuaugcuuug

SEQ ID NO: 97753 - RNA, 22 nt, Homo sapiens
uaagacacuuaaaauguuacau

SEQ ID NO: 97754 - RNA, 21 nt, Homo sapiens
uaagacugccaguagggcugu

SEQ ID NO: 97755 - RNA, 22 nt, Homo sapiens
uaagacuguuggcaauuuuugc

SEQ ID NO: 97756 - RNA, 22 nt, Homo sapiens
uaagacuuuuugggaauauaga

SEQ ID NO: 97757 - RNA, 22 nt, Homo sapiens
uaagcaguaaaugaagucuugc

SEQ ID NO: 97758 - RNA, 22 nt, Homo sapiens
uaagcaguguggauccaccuug

SEQ ID NO: 97759 - RNA, 21 nt, Homo sapiens
uaagcuaaacauucaguuaac

SEQ ID NO: 97760 - RNA, 22 nt, Homo sapiens
uaagcuagcauagggguaaauu

SEQ ID NO: 97761 - RNA, 22 nt, Homo sapiens
uaaggcaaucagucaugguguu

SEQ ID NO: 97762 - RNA, 20 nt, Homo sapiens
uaaggcacugugcuuuuagg

SEQ ID NO: 97763 - RNA, 22 nt, Homo sapiens
uaaggcccgugaguuucauauc

SEQ ID NO: 97764 - RNA, 22 nt, Homo sapiens
uaaggcuagcaagaugagaaua

SEQ ID NO: 97765 - RNA, 22 nt, Homo sapiens
uaaggcuugaucuuggugagau

SEQ ID NO: 97766 - RNA, 22 nt, Homo sapiens
uaaggcuuuuguucagcguggg

SEQ ID NO: 97767 - RNA, 22 nt, Homo sapiens
uaagggacgcccccuucucucu

SEQ ID NO: 97768 - RNA, 22 nt, Homo sapiens
uaagggcacuaaucccauuuau

SEQ ID NO: 97769 - RNA, 22 nt, Homo sapiens
uaagguuuuugauaugcugcug

SEQ ID NO: 97770 - RNA, 22 nt, Homo sapiens
uaaguaauugugguuucugcca

SEQ ID NO: 97771 - RNA, 22 nt, Homo sapiens
uaaguaauugugguuuuugcca

SEQ ID NO: 97772 - RNA, 22 nt, Homo sapiens
uaaguacaugcuagauggaaug

SEQ ID NO: 97773 - RNA, 22 nt, Homo sapiens
uaaguacugucagaauuggacu

SEQ ID NO: 97774 - RNA, 15 nt, Homo sapiens
uaaguaguuggcugu

SEQ ID NO: 97775 - RNA, 22 nt, Homo sapiens
uaaguauagguaacagaagcaa

SEQ ID NO: 97776 - RNA, 22 nt, Homo sapiens
uaaguauuaggccccaggcugg

SEQ ID NO: 97777 - RNA, 22 nt, Homo sapiens
uaaguauuaugugcugcauuuu

SEQ ID NO: 97778 - RNA, 22 nt, Homo sapiens
uaagucuuuuuggaguuuauaa

SEQ ID NO: 97779 - RNA, 22 nt, Homo sapiens
uaagugcaugauuacaugcaua

SEQ ID NO: 97780 - RNA, 20 nt, Homo sapiens
uaagugcuugagacuucuga

SEQ ID NO: 97781 - RNA, 20 nt, Homo sapiens
uaagugcuugaugaaugaac

SEQ ID NO: 97782 - RNA, 18 nt, Homo sapiens
uaagugcuuuaaacacau

SEQ ID NO: 97783 - RNA, 20 nt, Homo sapiens
uaagugcuuuauauugauua

SEQ ID NO: 97784 - RNA, 22 nt, Homo sapiens
uaaguggaagaugucaaucaua

SEQ ID NO: 97785 - RNA, 22 nt, Homo sapiens
uaagugguguucauucuuuuga

SEQ ID NO: 97786 - RNA, 22 nt, Homo sapiens
uaaguucauucaugaaacuuag

SEQ ID NO: 97787 - RNA, 22 nt, Homo sapiens
uaaguuguugacauuaggggaa

SEQ ID NO: 97788 - RNA, 22 nt, Homo sapiens
uaauaauguuaggcuuacucaa

SEQ ID NO: 97789 - RNA, 22 nt, Homo sapiens
uaauacuagugaauagcaggau

SEQ ID NO: 97790 - RNA, 22 nt, Homo sapiens
uaauaugugguugcuugggcac

SEQ ID NO: 97791 - RNA, 22 nt, Homo sapiens
uaaugcuguggucugguuuaaa

SEQ ID NO: 97792 - RNA, 21 nt, Homo sapiens
uaauggcaugaucucggcuca

SEQ ID NO: 97793 - RNA, 22 nt, Homo sapiens
uacaaagcuacucgagggcagg

SEQ ID NO: 97794 - RNA, 22 nt, Homo sapiens
uacaaagcuuucugcaaaucau

SEQ ID NO: 97795 - RNA, 22 nt, Homo sapiens
uacaacacugguucgacaugug

SEQ ID NO: 97796 - RNA, 22 nt, Homo sapiens
uacaaccucugccucccaaguu

SEQ ID NO: 97797 - RNA, 22 nt, Homo sapiens
uacaagcuaaaauggaagauca

SEQ ID NO: 97798 - RNA, 22 nt, Homo sapiens
uacacacguguguauauauaca

SEQ ID NO: 97799 - RNA, 22 nt, Homo sapiens
uacagaauauuucugcccugag

SEQ ID NO: 97800 - RNA, 22 nt, Homo sapiens
uacagaauucugucccuugagu

SEQ ID NO: 97801 - RNA, 22 nt, Homo sapiens
uacaggaaugucagguugcugu

SEQ ID NO: 97802 - RNA, 19 nt, Homo sapiens
uacaggacugagcugaggu

SEQ ID NO: 97803 - RNA, 22 nt, Homo sapiens
uacaggauagacaauuuauuaa

SEQ ID NO: 97804 - RNA, 22 nt, Homo sapiens
uacaggcaccuggcuaauuuuu

SEQ ID NO: 97805 - RNA, 22 nt, Homo sapiens
uacaggcagguguucccugguu

SEQ ID NO: 97806 - RNA, 22 nt, Homo sapiens
uacagguaugugucuauauaca

SEQ ID NO: 97807 - RNA, 22 nt, Homo sapiens
uacagucuagaggagaaucagg

SEQ ID NO: 97808 - RNA, 22 nt, Homo sapiens
uacagugcuugguaucuaguaa

SEQ ID NO: 97809 - RNA, 22 nt, Homo sapiens
uacagugggcacuggcgcccug

SEQ ID NO: 97810 - RNA, 22 nt, Homo sapiens
uacaguguuuugguauuccaca

SEQ ID NO: 97811 - RNA, 20 nt, Homo sapiens
uacauaguaaacugagagca

SEQ ID NO: 97812 - RNA, 22 nt, Homo sapiens
uacauagucuucuuuugguuau

SEQ ID NO: 97813 - RNA, 22 nt, Homo sapiens
uacaucagccugaaagagcucg

SEQ ID NO: 97814 - RNA, 22 nt, Homo sapiens
uacauguauccauuguuuuugg

SEQ ID NO: 97815 - RNA, 22 nt, Homo sapiens
uacauguauguguuuauggcug

SEQ ID NO: 97816 - RNA, 22 nt, Homo sapiens
uacaugugcacaacgugcaggu

SEQ ID NO: 97817 - RNA, 16 nt, Homo sapiens
uacauuuguuacaugg

SEQ ID NO: 97818 - RNA, 22 nt, Homo sapiens
uaccaaaguuucggccucuguu

SEQ ID NO: 97819 - RNA, 22 nt, Homo sapiens
uaccaaguauuuucacaugaac

SEQ ID NO: 97820 - RNA, 22 nt, Homo sapiens
uaccacaggcuggguaaucuau

SEQ ID NO: 97821 - RNA, 22 nt, Homo sapiens
uaccaguaaugggucaaaggca

SEQ ID NO: 97822 - RNA, 22 nt, Homo sapiens
uaccaugaagguggagagagaa

SEQ ID NO: 97823 - RNA, 22 nt, Homo sapiens
uacccuguaaucugaaacauga

SEQ ID NO: 97824 - RNA, 22 nt, Homo sapiens
uacccuuauguaaucauuauac

SEQ ID NO: 97825 - RNA, 22 nt, Homo sapiens
uacccuuuaguauaaaaucaga

SEQ ID NO: 97826 - RNA, 22 nt, Homo sapiens
uaccuaguaggagggaggugga

SEQ ID NO: 97827 - RNA, 22 nt, Homo sapiens
uacguaucagucguuucuguga

SEQ ID NO: 97828 - RNA, 22 nt, Homo sapiens
uacucaguagacacucauaugu

SEQ ID NO: 97829 - RNA, 22 nt, Homo sapiens
uacugaccugaaggccauggaa

SEQ ID NO: 97830 - RNA, 22 nt, Homo sapiens
uacugcacuccaaccugagaga

SEQ ID NO: 97831 - RNA, 22 nt, Homo sapiens
uacugcacuccagccuggguga

SEQ ID NO: 97832 - RNA, 22 nt, Homo sapiens
uacugcacuggaggccucagau

SEQ ID NO: 97833 - RNA, 22 nt, Homo sapiens
uacugcagucagacuccugggc

SEQ ID NO: 97834 - RNA, 22 nt, Homo sapiens
uacugcugucagugccaaguag

SEQ ID NO: 97835 - RNA, 22 nt, Homo sapiens
uacuggccccaaaguagguagu

SEQ ID NO: 97836 - RNA, 22 nt, Homo sapiens
uacuggguguucugagaaaaua

SEQ ID NO: 97837 - RNA, 22 nt, Homo sapiens
uacuuagagacaugcagcacug

SEQ ID NO: 97838 - RNA, 22 nt, Homo sapiens
uacuuagagauuccaggaacuc

SEQ ID NO: 97839 - RNA, 22 nt, Homo sapiens
uacuucauucuugaccuugcau

SEQ ID NO: 97840 - RNA, 22 nt, Homo sapiens
uagaaagcaugaccuucagaua

SEQ ID NO: 97841 - RNA, 22 nt, Homo sapiens
uagaaaguagggaagguaggau

SEQ ID NO: 97842 - RNA, 22 nt, Homo sapiens
uagaaugaaacaagcugugccu

SEQ ID NO: 97843 - RNA, 22 nt, Homo sapiens
uagaauggaaggcauguuugcc

SEQ ID NO: 97844 - RNA, 22 nt, Homo sapiens
uagaauguaaauuccaagggca

SEQ ID NO: 97845 - RNA, 22 nt, Homo sapiens
uagaauguauaauauuuuacuu

SEQ ID NO: 97846 - RNA, 22 nt, Homo sapiens
uagacacuagauaugugacuga

SEQ ID NO: 97847 - RNA, 22 nt, Homo sapiens
uagaccauucuauuuccuaugc

SEQ ID NO: 97848 - RNA, 21 nt, Homo sapiens
uagagagcaauaccuccagag

SEQ ID NO: 97849 - RNA, 22 nt, Homo sapiens
uagagagcuguuugaaagcagg

SEQ ID NO: 97850 - RNA, 22 nt, Homo sapiens
uagagcuaguuuuuaaucuaac

SEQ ID NO: 97851 - RNA, 22 nt, Homo sapiens
uagagcucaucuucuuuaaacu

SEQ ID NO: 97852 - RNA, 22 nt, Homo sapiens
uagaggaaggauuggaaacgca

SEQ ID NO: 97853 - RNA, 22 nt, Homo sapiens
uagaggaaugaauuuggccaga

SEQ ID NO: 97854 - RNA, 22 nt, Homo sapiens
uagagguagagugacuucccca

SEQ ID NO: 97855 - RNA, 22 nt, Homo sapiens
uagagguaggucuucgagucuc

SEQ ID NO: 97856 - RNA, 22 nt, Homo sapiens
uagagguauaccaaaaaggcau

SEQ ID NO: 97857 - RNA, 22 nt, Homo sapiens
uagaguaguggcgugaucucgg

SEQ ID NO: 97858 - RNA, 22 nt, Homo sapiens
uagaguguuuuguuaggcagca

SEQ ID NO: 97859 - RNA, 22 nt, Homo sapiens
uagauaguaaagccauuagcuu

SEQ ID NO: 97860 - RNA, 22 nt, Homo sapiens
uagaucaauuaauuguuacuug

SEQ ID NO: 97861 - RNA, 21 nt, Homo sapiens
uagaugguguucuagagagaa

SEQ ID NO: 97862 - RNA, 22 nt, Homo sapiens
uagauuauccggcugggacaau

SEQ ID NO: 97863 - RNA, 22 nt, Homo sapiens
uagauucaucuguuccuuuuga

SEQ ID NO: 97864 - RNA, 22 nt, Homo sapiens
uagauuguaauaugcagaaugg

SEQ ID NO: 97865 - RNA, 22 nt, Homo sapiens
uagauuguuuaaguggcacaca

SEQ ID NO: 97866 - RNA, 22 nt, Homo sapiens
uagcaagaugaauuugugcaaa

SEQ ID NO: 97867 - RNA, 20 nt, Homo sapiens
uagcacacauguagaauagu

SEQ ID NO: 97868 - RNA, 22 nt, Homo sapiens
uagcacaguucacccucgauuu

SEQ ID NO: 97869 - RNA, 22 nt, Homo sapiens
uagcacccucuccuaguccugc

SEQ ID NO: 97870 - RNA, 22 nt, Homo sapiens
uagcaccuuagcauuucuagug

SEQ ID NO: 97871 - RNA, 22 nt, Homo sapiens
uagcagacuauuuugugauaau

SEQ ID NO: 97872 - RNA, 22 nt, Homo sapiens
uagcagcaccccacucuacugg

SEQ ID NO: 97873 - RNA, 22 nt, Homo sapiens
uagcagcauaaauggacuaaga

SEQ ID NO: 97874 - RNA, 19 nt, Homo sapiens
uagcagcaugauuuauaau

SEQ ID NO: 97875 - RNA, 21 nt, Homo sapiens
uagcagcguuguugcaaaugu

SEQ ID NO: 97876 - RNA, 22 nt, Homo sapiens
uagcagcuuuauugagguaaau

SEQ ID NO: 97877 - RNA, 22 nt, Homo sapiens
uagcaggaaaccuguguugagg

SEQ ID NO: 97878 - RNA, 22 nt, Homo sapiens
uagcaggaaaggggucagaucu

SEQ ID NO: 97879 - RNA, 22 nt, Homo sapiens
uagcagguguuccacaaauauu

SEQ ID NO: 97880 - RNA, 22 nt, Homo sapiens
uagcaguauacguacugggucc

SEQ ID NO: 97881 - RNA, 22 nt, Homo sapiens
uagcaguauggagcgaggccca

SEQ ID NO: 97882 - RNA, 22 nt, Homo sapiens
uagcagugugaaaacagacuaa

SEQ ID NO: 97883 - RNA, 22 nt, Homo sapiens
uagcagugugaaaacggacuaa

SEQ ID NO: 97884 - RNA, 22 nt, Homo sapiens
uagcaguucauuguugugugaa

SEQ ID NO: 97885 - RNA, 21 nt, Homo sapiens
uagcauacauuuugcaucuua

SEQ ID NO: 97886 - RNA, 22 nt, Homo sapiens
uagcaucaauucauguuaugau

SEQ ID NO: 97887 - RNA, 22 nt, Homo sapiens
uagccgggugugguggaacucc

SEQ ID NO: 97888 - RNA, 21 nt, Homo sapiens
uagcuacacugugauucaugg

SEQ ID NO: 97889 - RNA, 22 nt, Homo sapiens
uagcuaguauuuugcugaggau

SEQ ID NO: 97890 - RNA, 21 nt, Homo sapiens
uagcucagugguguugccaua

SEQ ID NO: 97891 - RNA, 22 nt, Homo sapiens
uagcuccagugggguuacugcu

SEQ ID NO: 97892 - RNA, 18 nt, Homo sapiens
uagcucuuguugguccau

SEQ ID NO: 97893 - RNA, 22 nt, Homo sapiens
uagcugagacuacaguaggugc

SEQ ID NO: 97894 - RNA, 22 nt, Homo sapiens
uagcugaucuuuuaaagaauga

SEQ ID NO: 97895 - RNA, 22 nt, Homo sapiens
uagcuggaguuuuuguuauagg

SEQ ID NO: 97896 - RNA, 22 nt, Homo sapiens
uagcuguuggugggaagucaga

SEQ ID NO: 97897 - RNA, 17 nt, Homo sapiens
uagcuucacauuaggaa

SEQ ID NO: 97898 - RNA, 22 nt, Homo sapiens
agcuccauuguaaucaccuggu

SEQ ID NO: 97899 - RNA, 22 nt, Homo sapiens
agcuccuacuguuacaucauug

SEQ ID NO: 97900 - RNA, 22 nt, Homo sapiens
agcuccuuucugcaggcagguc

SEQ ID NO: 97901 - RNA, 22 nt, Homo sapiens
agcuccuuugcuuuuuccagga

SEQ ID NO: 97902 - RNA, 22 nt, Homo sapiens
agcugaguguuccaagagcgag

SEQ ID NO: 97903 - RNA, 22 nt, Homo sapiens
agcugauuuuaaguccuugucc

SEQ ID NO: 97904 - RNA, 22 nt, Homo sapiens
agcugcaaagggagagaugauu

SEQ ID NO: 97905 - RNA, 22 nt, Homo sapiens
agcugcauucguaucauauugu

SEQ ID NO: 97906 - RNA, 22 nt, Homo sapiens
agcuggaauuuaagguagauag

SEQ ID NO: 97907 - RNA, 22 nt, Homo sapiens
agcuggcuguagcugcaagucu

SEQ ID NO: 97908 - RNA, 22 nt, Homo sapiens
agcuggucuacguguguaugag

SEQ ID NO: 97909 - RNA, 21 nt, Homo sapiens
agcugguuuccacagugugcu

SEQ ID NO: 97910 - RNA, 20 nt, Homo sapiens
agcugguuuuaugaaucuuu

SEQ ID NO: 97911 - RNA, 22 nt, Homo sapiens
agcugugucuucuuaaagauuu

SEQ ID NO: 97912 - RNA, 19 nt, Homo sapiens
agcuguguugccugugaga

SEQ ID NO: 97913 - RNA, 22 nt, Homo sapiens
agcuguuguucucagaggcuuu

SEQ ID NO: 97914 - RNA, 22 nt, Homo sapiens
agcuucacaaugcagagggcag

SEQ ID NO: 97915 - RNA, 22 nt, Homo sapiens
agcuugucuuauacuacuucau

SEQ ID NO: 97916 - RNA, 22 nt, Homo sapiens
agcuuguuuuauagaaagucaa

SEQ ID NO: 97917 - RNA, 19 nt, Homo sapiens
agcuuuggcuaacuuucuc

SEQ ID NO: 97918 - RNA, 22 nt, Homo sapiens
agcuuuuugggcagcuauugac

SEQ ID NO: 97919 - RNA, 22 nt, Homo sapiens
aggaaauguuggucccauuucu

SEQ ID NO: 97920 - RNA, 21 nt, Homo sapiens
aggaagacuaugaucaauugg

SEQ ID NO: 97921 - RNA, 22 nt, Homo sapiens
aggaagacugaaauugcuguuc

SEQ ID NO: 97922 - RNA, 22 nt, Homo sapiens
aggaagcuagcauuuguucagu

SEQ ID NO: 97923 - RNA, 23 nt, Homo sapiens
aggaaguaacuaucuuuucuguc

SEQ ID NO: 97924 - RNA, 22 nt, Homo sapiens
aggaagugucuucuuuuaggca

SEQ ID NO: 97925 - RNA, 22 nt, Homo sapiens
aggaaugcuaaguuuuccuccu

SEQ ID NO: 97926 - RNA, 18 nt, Homo sapiens
aggaaugguaauacuuca

SEQ ID NO: 97927 - RNA, 22 nt, Homo sapiens
aggaaugucaaugguaguuuaa

SEQ ID NO: 97928 - RNA, 22 nt, Homo sapiens
aggacacugagcaugggagguu

SEQ ID NO: 97929 - RNA, 22 nt, Homo sapiens
aggacacugauagucuuuggca

SEQ ID NO: 97930 - RNA, 19 nt, Homo sapiens
aggacuaaagacuagaagu

SEQ ID NO: 97931 - RNA, 22 nt, Homo sapiens
aggagaauugguucuucuugau

SEQ ID NO: 97932 - RNA, 22 nt, Homo sapiens
aggagaugaagcuuuaucuaaa

SEQ ID NO: 97933 - RNA, 21 nt, Homo sapiens
aggagcauucaugacgagguu

SEQ ID NO: 97934 - RNA, 21 nt, Homo sapiens
aggagcauucucuugcuuugu

SEQ ID NO: 97935 - RNA, 21 nt, Homo sapiens
aggagcauuguugugguggag

SEQ ID NO: 97936 - RNA, 20 nt, Homo sapiens
aggagcauuuacauuggcuc

SEQ ID NO: 97937 - RNA, 22 nt, Homo sapiens
aggagguagaacauugccauuu

SEQ ID NO: 97938 - RNA, 22 nt, Homo sapiens
aggagguaggaauugugcuagg

SEQ ID NO: 97939 - RNA, 21 nt, Homo sapiens
aggauaguagauuaaauauuu

SEQ ID NO: 97940 - RNA, 22 nt, Homo sapiens
aggaucauugacuauuauaagg

SEQ ID NO: 97941 - RNA, 16 nt, Homo sapiens
aggcaagaauugaggu

SEQ ID NO: 97942 - RNA, 21 nt, Homo sapiens
aggcaagguguuauuauugaa

SEQ ID NO: 97943 - RNA, 22 nt, Homo sapiens
aggcaaguugcucaaaugcaaa

SEQ ID NO: 97944 - RNA, 22 nt, Homo sapiens
aggcacgguggcucacaccugu

SEQ ID NO: 97945 - RNA, 22 nt, Homo sapiens
aggcaggugaaagauaguuuua

SEQ ID NO: 97946 - RNA, 22 nt, Homo sapiens
aggcaugguggcacauacaugu

SEQ ID NO: 97947 - RNA, 20 nt, Homo sapiens
aggcauguugguuugcgugu

SEQ ID NO: 97948 - RNA, 23 nt, Homo sapiens
aggcauuguacaguaauggaaaa

SEQ ID NO: 97949 - RNA, 23 nt, Homo sapiens
aggccaguuuuuccugcuugcug

SEQ ID NO: 97950 - RNA, 22 nt, Homo sapiens
aggccaguuuuuggagggaaac

SEQ ID NO: 97951 - RNA, 22 nt, Homo sapiens
aggcuaagaugacuccaccccc

SEQ ID NO: 97952 - RNA, 22 nt, Homo sapiens
aggcuuuuguuuuggucucagg

SEQ ID NO: 97953 - RNA, 22 nt, Homo sapiens
agggccuuuguagauguacuca

SEQ ID NO: 97954 - RNA, 22 nt, Homo sapiens
agggcuuuugagcugagauggu

SEQ ID NO: 97955 - RNA, 22 nt, Homo sapiens
agguacuugagauucugaacug

SEQ ID NO: 97956 - RNA, 20 nt, Homo sapiens
agguagauagaugauagaua

SEQ ID NO: 97957 - RNA, 22 nt, Homo sapiens
agguagcauagcgggaauauca

SEQ ID NO: 97958 - RNA, 22 nt, Homo sapiens
agguagugugaugcuccuguuu

SEQ ID NO: 97959 - RNA, 22 nt, Homo sapiens
agguauauuggacagauguaaa

SEQ ID NO: 97960 - RNA, 21 nt, Homo sapiens
aggucaguaagaaugcagcac

SEQ ID NO: 97961 - RNA, 22 nt, Homo sapiens
agguccauuauuuucauucaug

SEQ ID NO: 97962 - RNA, 22 nt, Homo sapiens
aggugacugguuuaucuggcag

SEQ ID NO: 97963 - RNA, 22 nt, Homo sapiens
aggugcacucagaaaacagaua

SEQ ID NO: 97964 - RNA, 22 nt, Homo sapiens
aggugcaugcuucacuggauau

SEQ ID NO: 97965 - RNA, 22 nt, Homo sapiens
aggugcugagcagagaauccug

SEQ ID NO: 97966 - RNA, 22 nt, Homo sapiens
aggugguguuggguuccagccc

SEQ ID NO: 97967 - RNA, 22 nt, Homo sapiens
agguuaucccgcauuauuuggu

SEQ ID NO: 97968 - RNA, 22 nt, Homo sapiens
augacugaguagcauuccauua

SEQ ID NO: 97969 - RNA, 17 nt, Homo sapiens
augacuucuucagugug

SEQ ID NO: 97970 - RNA, 22 nt, Homo sapiens
augagaacugucaaugagagcu

SEQ ID NO: 97971 - RNA, 22 nt, Homo sapiens
augagaauguaaguuaaugaaa

SEQ ID NO: 97972 - RNA, 22 nt, Homo sapiens
augagacaguucccuuuaucuu

SEQ ID NO: 97973 - RNA, 22 nt, Homo sapiens
augagagcugacuuuaaggcaa

SEQ ID NO: 97974 - RNA, 22 nt, Homo sapiens
augagagugagagcagccccuu

SEQ ID NO: 97975 - RNA, 22 nt, Homo sapiens
augagaucaaauuuaagcuguu

SEQ ID NO: 97976 - RNA, 22 nt, Homo sapiens
augagaucugugaacaccuguc

SEQ ID NO: 97977 - RNA, 22 nt, Homo sapiens
augagaugcaagauuagauggg

SEQ ID NO: 97978 - RNA, 22 nt, Homo sapiens
augagauuauguaaagagacca

SEQ ID NO: 97979 - RNA, 22 nt, Homo sapiens
augagauuguuuguacuccaca

SEQ ID NO: 97980 - RNA, 22 nt, Homo sapiens
augagcagaagagauacacugu

SEQ ID NO: 97981 - RNA, 22 nt, Homo sapiens
augagcagaugcuccugccucu

SEQ ID NO: 97982 - RNA, 22 nt, Homo sapiens
augagcaucaccagaaucaaua

SEQ ID NO: 97983 - RNA, 22 nt, Homo sapiens
augagcuccucaaggucagaga

SEQ ID NO: 97984 - RNA, 22 nt, Homo sapiens
augagcugauuuccuuaccaua

SEQ ID NO: 97985 - RNA, 22 nt, Homo sapiens
augaggaaggagccuuugucug

SEQ ID NO: 97986 - RNA, 22 nt, Homo sapiens
augaggagauauuaaauaccau

SEQ ID NO: 97987 - RNA, 22 nt, Homo sapiens
augaggagguaugauuuucuga

SEQ ID NO: 97988 - RNA, 22 nt, Homo sapiens
augagggagggguggugccgca

SEQ ID NO: 97989 - RNA, 22 nt, Homo sapiens
augagguaauaaguccuuggaa

SEQ ID NO: 97990 - RNA, 23 nt, Homo sapiens
augagguaucugagcccagaaau

SEQ ID NO: 97991 - RNA, 22 nt, Homo sapiens
augaggugauaucuggaaauua

SEQ ID NO: 97992 - RNA, 22 nt, Homo sapiens
augaggugauuucuguucgggu

SEQ ID NO: 97993 - RNA, 20 nt, Homo sapiens
augagguguaugacacugaa

SEQ ID NO: 97994 - RNA, 22 nt, Homo sapiens
augaguaguugcuaaauauuga

SEQ ID NO: 97995 - RNA, 18 nt, Homo sapiens
augagucauuguggaaau

SEQ ID NO: 97996 - RNA, 22 nt, Homo sapiens
augagugugaccugccaagaga

SEQ ID NO: 97997 - RNA, 22 nt, Homo sapiens
augaguuccuuccuugccuagg

SEQ ID NO: 97998 - RNA, 22 nt, Homo sapiens
augaucacaccacugcacucca

SEQ ID NO: 97999 - RNA, 22 nt, Homo sapiens
augaucaucugaaagcuuuuac

SEQ ID NO: 98000 - RNA, 22 nt, Homo sapiens
augaucauggaagugcacccau

SEQ ID NO: 98001 - RNA, 22 nt, Homo sapiens
augaucuagaguaggaaacaga

SEQ ID NO: 98002 - RNA, 22 nt, Homo sapiens
augaucuguuuggugaucuugu

SEQ ID NO: 98003 - RNA, 22 nt, Homo sapiens
augaugaaguaagugcuuagga

SEQ ID NO: 98004 - RNA, 22 nt, Homo sapiens
augauguguguuuaagaugucu

SEQ ID NO: 98005 - RNA, 22 nt, Homo sapiens
augauguguucuguguucccau

SEQ ID NO: 98006 - RNA, 22 nt, Homo sapiens
augauucugaucuagagcuugg

SEQ ID NO: 98007 - RNA, 22 nt, Homo sapiens
augauugugaauaugugguuuu

SEQ ID NO: 98008 - RNA, 22 nt, Homo sapiens
augcaagacaccgauuagcuuu

SEQ ID NO: 98009 - RNA, 22 nt, Homo sapiens
augcaagcacacaagaggaaau

SEQ ID NO: 98010 - RNA, 22 nt, Homo sapiens
agagguaagcaguggcaagugc

SEQ ID NO: 98011 - RNA, 22 nt, Homo sapiens
agagguauacauuugagagcca

SEQ ID NO: 98012 - RNA, 22 nt, Homo sapiens
agagguguuaaagucucuuuua

SEQ ID NO: 98013 - RNA, 23 nt, Homo sapiens
agagguuuaaucaggcaguugcu

SEQ ID NO: 98014 - RNA, 22 nt, Homo sapiens
agagguuuugcacugguucuuu

SEQ ID NO: 98015 - RNA, 19 nt, Homo sapiens
agaguauuguuacuucucu

SEQ ID NO: 98016 - RNA, 21 nt, Homo sapiens
agagucaucucuaucuguacc

SEQ ID NO: 98017 - RNA, 22 nt, Homo sapiens
agagugaagcuuuuuauauucu

SEQ ID NO: 98018 - RNA, 22 nt, Homo sapiens
agagugcuaaggaaguaauuua

SEQ ID NO: 98019 - RNA, 20 nt, Homo sapiens
agagugcugucuguccugag

SEQ ID NO: 98020 - RNA, 22 nt, Homo sapiens
agagugcuuuauuagauguagc

SEQ ID NO: 98021 - RNA, 22 nt, Homo sapiens
agauauguuauugauguuaaug

SEQ ID NO: 98022 - RNA, 22 nt, Homo sapiens
agaugauguuuacugagcauca

SEQ ID NO: 98023 - RNA, 22 nt, Homo sapiens
agaugcauuuuuauuggaauac

SEQ ID NO: 98024 - RNA, 22 nt, Homo sapiens
agauggguuuucacauguuggc

SEQ ID NO: 98025 - RNA, 18 nt, Homo sapiens
agaugguguugcuucugu

SEQ ID NO: 98026 - RNA, 22 nt, Homo sapiens
agcaacauagaaauuugggugg

SEQ ID NO: 98027 - RNA, 22 nt, Homo sapiens
agcaacaucagcagcaggaaaa

SEQ ID NO: 98028 - RNA, 22 nt, Homo sapiens
agcaacauggaguuugugcgca

SEQ ID NO: 98029 - RNA, 22 nt, Homo sapiens
agcaagaaugaacucucccaga

SEQ ID NO: 98030 - RNA, 22 nt, Homo sapiens
agcacagugaaugguuuacuca

SEQ ID NO: 98031 - RNA, 22 nt, Homo sapiens
agcacagugguuaaguuucuua

SEQ ID NO: 98032 - RNA, 22 nt, Homo sapiens
agcaccacauacuacagagaua

SEQ ID NO: 98033 - RNA, 22 nt, Homo sapiens
agcaccauuagcguugggccgg

SEQ ID NO: 98034 - RNA, 22 nt, Homo sapiens
agcaccauuguacuccagccug

SEQ ID NO: 98035 - RNA, 22 nt, Homo sapiens
agcacgaaaccaaauucuguga

SEQ ID NO: 98036 - RNA, 22 nt, Homo sapiens
agcacgauggggucacgaugag

SEQ ID NO: 98037 - RNA, 22 nt, Homo sapiens
agcacuacugcacuccagccug

SEQ ID NO: 98038 - RNA, 22 nt, Homo sapiens
agcagagcaguggauuuuguga

SEQ ID NO: 98039 - RNA, 22 nt, Homo sapiens
agcagcaccaaacagacuaaga

SEQ ID NO: 98040 - RNA, 22 nt, Homo sapiens
agcagcaucgggaaguuggcca

SEQ ID NO: 98041 - RNA, 22 nt, Homo sapiens
agcagcauuccaaaaaucugcu

SEQ ID NO: 98042 - RNA, 22 nt, Homo sapiens
agcagcuuugcauggccugugg

SEQ ID NO: 98043 - RNA, 22 nt, Homo sapiens
agcaggacaauaugggaucagg

SEQ ID NO: 98044 - RNA, 22 nt, Homo sapiens
agcaguagaauuccugcaucac

SEQ ID NO: 98045 - RNA, 22 nt, Homo sapiens
agcaguagugaaaguagacuua

SEQ ID NO: 98046 - RNA, 22 nt, Homo sapiens
agcauagugccuugaaaacaau

SEQ ID NO: 98047 - RNA, 22 nt, Homo sapiens
agcaucagugauuuuguugaag

SEQ ID NO: 98048 - RNA, 20 nt, Homo sapiens
agcaucauugcaauuuguca

SEQ ID NO: 98049 - RNA, 22 nt, Homo sapiens
agcaugauugggguugggcaca

SEQ ID NO: 98050 - RNA, 22 nt, Homo sapiens
agccaguuuggcuaauuuuggc

SEQ ID NO: 98051 - RNA, 23 nt, Homo sapiens
agcccugugacucgaacgaggag

SEQ ID NO: 98052 - RNA, 22 nt, Homo sapiens
agccucauucuacauguuaaug

SEQ ID NO: 98053 - RNA, 21 nt, Homo sapiens
agccugugggucauaguugcc

SEQ ID NO: 98054 - RNA, 22 nt, Homo sapiens
agcgccacugcacuccagccug

SEQ ID NO: 98055 - RNA, 22 nt, Homo sapiens
agcgccauugcacuccagccuu

SEQ ID NO: 98056 - RNA, 22 nt, Homo sapiens
agcuaaaucucauguugaauug

SEQ ID NO: 98057 - RNA, 22 nt, Homo sapiens
agcuagcauucauaguuugagg

SEQ ID NO: 98058 - RNA, 22 nt, Homo sapiens
agcuaguggucauucaauccuu

SEQ ID NO: 98059 - RNA, 22 nt, Homo sapiens
agcucauugcaaccuccgccuc

SEQ ID NO: 98060 - RNA, 22 nt, Homo sapiens
agcuccaucuucagggguucag

SEQ ID NO: 98061 - RNA, 22 nt, Homo sapiens
agcugcacaaauggaugugagg

SEQ ID NO: 98062 - RNA, 16 nt, Homo sapiens
agcuggaauuacaggc

SEQ ID NO: 98063 - RNA, 23 nt, Homo sapiens
agcugguacuagaggcuugcgcc

SEQ ID NO: 98064 - RNA, 22 nt, Homo sapiens
agcugguaugaaaaucucccca

SEQ ID NO: 98065 - RNA, 19 nt, Homo sapiens
accagauugcauucuugga

SEQ ID NO: 98066 - RNA, 22 nt, Homo sapiens
accaguguuuaccaaguagcau

SEQ ID NO: 98067 - RNA, 22 nt, Homo sapiens
acccagaguuccuugucuuuca

SEQ ID NO: 98068 - RNA, 22 nt, Homo sapiens
acccaguaacauaugggaggga

SEQ ID NO: 98069 - RNA, 22 nt, Homo sapiens
acccaguagccagauguagcug

SEQ ID NO: 98070 - RNA, 22 nt, Homo sapiens
acccaguguugggcagaacugu

SEQ ID NO: 98071 - RNA, 22 nt, Homo sapiens
accccgagacugccaagaaucc

SEQ ID NO: 98072 - RNA, 22 nt, Homo sapiens
accccugagaucgaaucaugcu

SEQ ID NO: 98073 - RNA, 22 nt, Homo sapiens
acccgcccagguguggccggga

SEQ ID NO: 98074 - RNA, 22 nt, Homo sapiens
acccgugcucacugccucugcc

SEQ ID NO: 98075 - RNA, 22 nt, Homo sapiens
acccucagaccaguuucccugg

SEQ ID NO: 98076 - RNA, 21 nt, Homo sapiens
acccucuaguuuucaacaggc

SEQ ID NO: 98077 - RNA, 22 nt, Homo sapiens
acccugaagccaugaguggaac

SEQ ID NO: 98078 - RNA, 22 nt, Homo sapiens
acccugcuaaacagcccccugc

SEQ ID NO: 98079 - RNA, 22 nt, Homo sapiens
acccugguagcuaugaagucuu

SEQ ID NO: 98080 - RNA, 22 nt, Homo sapiens
acccuguaacauacaagugguu

SEQ ID NO: 98081 - RNA, 22 nt, Homo sapiens
acccuguaggacuauucuaauc

SEQ ID NO: 98082 - RNA, 22 nt, Homo sapiens
acccugucaaaauggaccaauc

SEQ ID NO: 98083 - RNA, 22 nt, Homo sapiens
acccugugagagaguuaauauu

SEQ ID NO: 98084 - RNA, 22 nt, Homo sapiens
acccuuaagcacuaguucagcu

SEQ ID NO: 98085 - RNA, 22 nt, Homo sapiens
accgggcugagcgcaggccccg

SEQ ID NO: 98086 - RNA, 21 nt, Homo sapiens
accugauguuucaguuggagu

SEQ ID NO: 98087 - RNA, 22 nt, Homo sapiens
accuggacacuuugggcuccuc

SEQ ID NO: 98088 - RNA, 22 nt, Homo sapiens
accugggugcugaugggcuuua

SEQ ID NO: 98089 - RNA, 22 nt, Homo sapiens
accuggguguauguucaguuug

SEQ ID NO: 98090 - RNA, 22 nt, Homo sapiens
accugguuuucucacaguggcu

SEQ ID NO: 98091 - RNA, 22 nt, Homo sapiens
accuugcacugagccgagauug

SEQ ID NO: 98092 - RNA, 22 nt, Homo sapiens
accuuuacaacuuguuagagua

SEQ ID NO: 98093 - RNA, 20 nt, Homo sapiens
acuaaaucucauuuuaugca

SEQ ID NO: 98094 - RNA, 22 nt, Homo sapiens
acuaaggcacaauuuucucaua

SEQ ID NO: 98095 - RNA, 22 nt, Homo sapiens
acuacugucagacugccacuga

SEQ ID NO: 98096 - RNA, 22 nt, Homo sapiens
acuacuucuaaguuuuggaaga

SEQ ID NO: 98097 - RNA, 22 nt, Homo sapiens
acuauacuguaacuguauucag

SEQ ID NO: 98098 - RNA, 22 nt, Homo sapiens
acucagagagaacugucauuug

SEQ ID NO: 98099 - RNA, 22 nt, Homo sapiens
acucagagugggccccuagaua

SEQ ID NO: 98100 - RNA, 22 nt, Homo sapiens
acuccauuuggacucugggagg

SEQ ID NO: 98101 - RNA, 22 nt, Homo sapiens
acucuguaagcaagcuggggaa

SEQ ID NO: 98102 - RNA, 22 nt, Homo sapiens
acucuguauaaacauugcugua

SEQ ID NO: 98103 - RNA, 22 nt, Homo sapiens
acucugucuaguuguaaaauuu

SEQ ID NO: 98104 - RNA, 19 nt, Homo sapiens
acugagcuaccugggggca

SEQ ID NO: 98105 - RNA, 19 nt, Homo sapiens
acugcacuccaaccuccug

SEQ ID NO: 98106 - RNA, 22 nt, Homo sapiens
acugcacuccagccuaggcgac

SEQ ID NO: 98107 - RNA, 22 nt, Homo sapiens
acugcacuccagccucgcaaca

SEQ ID NO: 98108 - RNA, 22 nt, Homo sapiens
acugcacuccagccugcccaac

SEQ ID NO: 98109 - RNA, 22 nt, Homo sapiens
acugcacuccagccugccgaca

SEQ ID NO: 98110 - RNA, 22 nt, Homo sapiens
acugcacuccagccuggacgaa

SEQ ID NO: 98111 - RNA, 22 nt, Homo sapiens
auuagguuggugcaaaacuuuc

SEQ ID NO: 98112 - RNA, 22 nt, Homo sapiens
auuauaugucaucacagacacc

SEQ ID NO: 98113 - RNA, 22 nt, Homo sapiens
auuauauguguaugugcauacc

SEQ ID NO: 98114 - RNA, 22 nt, Homo sapiens
auuauuagucggccagcuguua

SEQ ID NO: 98115 - RNA, 20 nt, Homo sapiens
auucaaguaugccuugagaa

SEQ ID NO: 98116 - RNA, 22 nt, Homo sapiens
auucaagugaugcagcuguuuu

SEQ ID NO: 98117 - RNA, 22 nt, Homo sapiens
auucaccauggaccaggggccu

SEQ ID NO: 98118 - RNA, 22 nt, Homo sapiens
auucagaggggcagcugucuug

SEQ ID NO: 98119 - RNA, 22 nt, Homo sapiens
auucaucagggauacuggccug

SEQ ID NO: 98120 - RNA, 22 nt, Homo sapiens
auucaucagggauauugguuga

SEQ ID NO: 98121 - RNA, 20 nt, Homo sapiens
auucauggugguacguuguc

SEQ ID NO: 98122 - RNA, 22 nt, Homo sapiens
auuccacagccgauaccaugac

SEQ ID NO: 98123 - RNA, 22 nt, Homo sapiens
auuccacaguuaacacagaccg

SEQ ID NO: 98124 - RNA, 22 nt, Homo sapiens
auuccacuuauaugagguaucu

SEQ ID NO: 98125 - RNA, 20 nt, Homo sapiens
auuccacuuguuugagguac

SEQ ID NO: 98126 - RNA, 22 nt, Homo sapiens
auuccagauggaguugaggguu

SEQ ID NO: 98127 - RNA, 23 nt, Homo sapiens
auuccaguggcaauuggagaaac

SEQ ID NO: 98128 - RNA, 22 nt, Homo sapiens
auuccaguggguuuacauccca

SEQ ID NO: 98129 - RNA, 22 nt, Homo sapiens
auuccaguuguaagguuuuuca

SEQ ID NO: 98130 - RNA, 22 nt, Homo sapiens
auuccauuuguguggaauggcu

SEQ ID NO: 98131 - RNA, 22 nt, Homo sapiens
auucccuuagcugccucagccu

SEQ ID NO: 98132 - RNA, 18 nt, Homo sapiens
auucuacaggccuuuuga

SEQ ID NO: 98133 - RNA, 22 nt, Homo sapiens
auugaacacagaguagcuuucc

SEQ ID NO: 98134 - RNA, 22 nt, Homo sapiens
auugaacaugccauauguacca

SEQ ID NO: 98135 - RNA, 22 nt, Homo sapiens
auugaacuuacuaucuaaacua

SEQ ID NO: 98136 - RNA, 22 nt, Homo sapiens
auugagcaauuccuaugugcuu

SEQ ID NO: 98137 - RNA, 22 nt, Homo sapiens
auugagcacugacucugugcca

SEQ ID NO: 98138 - RNA, 18 nt, Homo sapiens
auugagcaugacagaccu

SEQ ID NO: 98139 - RNA, 22 nt, Homo sapiens
auugaggcaggaggaccaucua

SEQ ID NO: 98140 - RNA, 22 nt, Homo sapiens
auugagucauuucaaauccaag

SEQ ID NO: 98141 - RNA, 22 nt, Homo sapiens
auugcaaagcguagacucuaaa

SEQ ID NO: 98142 - RNA, 18 nt, Homo sapiens
auugcacaccagccuggg

SEQ ID NO: 98143 - RNA, 22 nt, Homo sapiens
auugcacaccagucugggcaaa

SEQ ID NO: 98144 - RNA, 22 nt, Homo sapiens
auugcacuccagccuggaugac

SEQ ID NO: 98145 - RNA, 22 nt, Homo sapiens
auugcacuccagccuggccaac

SEQ ID NO: 98146 - RNA, 22 nt, Homo sapiens
auugcacuccagccuggccgag

SEQ ID NO: 98147 - RNA, 21 nt, Homo sapiens
auugcacuccagccugggcga

SEQ ID NO: 98148 - RNA, 22 nt, Homo sapiens
auugcacuccagccuggugaca

SEQ ID NO: 98149 - RNA, 22 nt, Homo sapiens
auugcacuccagccuugggcaa

SEQ ID NO: 98150 - RNA, 22 nt, Homo sapiens
auugcacuccagccuuggggau

SEQ ID NO: 98151 - RNA, 22 nt, Homo sapiens
auugcacuccagucucaccagg

SEQ ID NO: 98152 - RNA, 22 nt, Homo sapiens
auugcacuccggccugggugac

SEQ ID NO: 98153 - RNA, 22 nt, Homo sapiens
auugcacucuagccugggugac

SEQ ID NO: 98154 - RNA, 22 nt, Homo sapiens
auugcacucuagccuuggcgac

SEQ ID NO: 98155 - RNA, 22 nt, Homo sapiens
auugcacugcagccugggcaac

SEQ ID NO: 98156 - RNA, 22 nt, Homo sapiens
auugcacuggggguuagaauuu

SEQ ID NO: 98157 - RNA, 23 nt, Homo sapiens
auugcagucuugaacuccugggc

SEQ ID NO: 98158 - RNA, 19 nt, Homo sapiens
auugcaguguaaaacuauu

SEQ ID NO: 98159 - RNA, 22 nt, Homo sapiens
auugcaguuucaacuccagggc

SEQ ID NO: 98160 - RNA, 21 nt, Homo sapiens
auugcccaaaguggaggggaa

SEQ ID NO: 98161 - RNA, 22 nt, Homo sapiens
auugccuagccuggucucaaaa

SEQ ID NO: 98162 - RNA, 21 nt, Homo sapiens
auugcgcuccagccuccuggg

SEQ ID NO: 98163 - RNA, 22 nt, Homo sapiens
auugcucaaaucaguacuugag

SEQ ID NO: 98164 - RNA, 22 nt, Homo sapiens
auugcucagucagggagcucgg

SEQ ID NO: 98165 - RNA, 22 nt, Homo sapiens
auugcuuaagucccuguauuag

SEQ ID NO: 98166 - RNA, 22 nt, Homo sapiens
auugcuuuuacugggagcuuug

SEQ ID NO: 98167 - RNA, 22 nt, Homo sapiens
auuggcaauccauauauuuucu

SEQ ID NO: 98168 - RNA, 22 nt, Homo sapiens
auuggcaauguacauaucuugc

SEQ ID NO: 98169 - RNA, 22 nt, Homo sapiens
auuggggaaugguggcuuuagu

SEQ ID NO: 98170 - RNA, 22 nt, Homo sapiens
auuggucuauuaaaccuaaguu

SEQ ID NO: 98171 - RNA, 22 nt, Homo sapiens
auuguacuccagccuuggggac

SEQ ID NO: 98172 - RNA, 22 nt, Homo sapiens
auuguacuuaagccugggugaa

SEQ ID NO: 98173 - RNA, 22 nt, Homo sapiens
auuguaguuugcuauggcaaua

SEQ ID NO: 98174 - RNA, 22 nt, Homo sapiens
auugucacccgggcaguaagca

SEQ ID NO: 98175 - RNA, 22 nt, Homo sapiens
auugucacugugcuccaccagu

SEQ ID NO: 98176 - RNA, 22 nt, Homo sapiens
auugugauggucaaaggaaaua

SEQ ID NO: 98177 - RNA, 22 nt, Homo sapiens
auuguguuugaaugaggcucca

SEQ ID NO: 98178 - RNA, 22 nt, Homo sapiens
auuguuccccggucauuuuugu

SEQ ID NO: 98179 - RNA, 22 nt, Homo sapiens
auuguucuuguguccuuuuccu

SEQ ID NO: 98180 - RNA, 22 nt, Homo sapiens
auuuggcaacguagggaggcau

SEQ ID NO: 98181 - RNA, 22 nt, Homo sapiens
auuuggcaauuuugaagaugcc

SEQ ID NO: 98182 - RNA, 22 nt, Homo sapiens
auuuggcaguauaaugcuuugg

SEQ ID NO: 98183 - RNA, 22 nt, Homo sapiens
auuuggcauagaguaucauucu

SEQ ID NO: 98184 - RNA, 20 nt, Homo sapiens
auuuggcauaguuuaagcaa

SEQ ID NO: 98185 - RNA, 22 nt, Homo sapiens
auuuggguuuuacaucaggcua

SEQ ID NO: 98186 - RNA, 22 nt, Homo sapiens
auuugguaauauuuaaggacuu

SEQ ID NO: 98187 - RNA, 22 nt, Homo sapiens
auuuuuggauauagggaaggau

SEQ ID NO: 98188 - RNA, 22 nt, Homo sapiens
caaaagugguucuuauccuuuu

SEQ ID NO: 98189 - RNA, 22 nt, Homo sapiens
caaaggauucauuuccaggagu

SEQ ID NO: 98190 - RNA, 22 nt, Homo sapiens
caaaggcuguuauaggccagga

SEQ ID NO: 98191 - RNA, 22 nt, Homo sapiens
caaagugcuggccgggcgcagu

SEQ ID NO: 98192 - RNA, 22 nt, Homo sapiens
caaagugcugggaugggccagg

SEQ ID NO: 98193 - RNA, 22 nt, Homo sapiens
caaauacuuucauguugucuug

SEQ ID NO: 98194 - RNA, 22 nt, Homo sapiens
caaauugcuugucuguagugga

SEQ ID NO: 98195 - RNA, 22 nt, Homo sapiens
caacacuguuuauuggauagcc

SEQ ID NO: 98196 - RNA, 22 nt, Homo sapiens
caacaguaaagcauuuuuaagu

SEQ ID NO: 98197 - RNA, 22 nt, Homo sapiens
caaccaguagcugaguucaaaa

SEQ ID NO: 98198 - RNA, 19 nt, Homo sapiens
caacccugcagagaaagga

SEQ ID NO: 98199 - RNA, 22 nt, Homo sapiens
caacugcucacuccuggguuca

SEQ ID NO: 98200 - RNA, 22 nt, Homo sapiens
caagagaccugagugucauucu

SEQ ID NO: 98201 - RNA, 22 nt, Homo sapiens
caagaggcuguguauaaagcca

SEQ ID NO: 98202 - RNA, 22 nt, Homo sapiens
caagugcuugaugaaugaucaa

SEQ ID NO: 98203 - RNA, 22 nt, Homo sapiens
caaguguuuccuuaaauacuug

SEQ ID NO: 98204 - RNA, 22 nt, Homo sapiens
caauacuguuaccugaaauagg

SEQ ID NO: 98205 - RNA, 19 nt, Homo sapiens
caauacuucuuggcauaca

SEQ ID NO: 98206 - RNA, 22 nt, Homo sapiens
caauggcacgaucucgucucac

SEQ ID NO: 98207 - RNA, 22 nt, Homo sapiens
caauggcacuauuggaaaaggu

SEQ ID NO: 98208 - RNA, 22 nt, Homo sapiens
caaugugcuuggggcacaugag

SEQ ID NO: 98209 - RNA, 22 nt, Homo sapiens
augcaaacaucugaagagacau

SEQ ID NO: 98210 - RNA, 22 nt, Homo sapiens
augcaaaucuuaaguaugugug

SEQ ID NO: 98211 - RNA, 22 nt, Homo sapiens
augcaagacaccacgugagaau

SEQ ID NO: 98212 - RNA, 19 nt, Homo sapiens
augcaaugucacaggcugc

SEQ ID NO: 98213 - RNA, 22 nt, Homo sapiens
augcacaguccagcccaugugg

SEQ ID NO: 98214 - RNA, 19 nt, Homo sapiens
augcacgugaaaugcauuu

SEQ ID NO: 98215 - RNA, 22 nt, Homo sapiens
augcacuguuguuauuggauaa

SEQ ID NO: 98216 - RNA, 22 nt, Homo sapiens
augcagacacaaguuauaguaa

SEQ ID NO: 98217 - RNA, 22 nt, Homo sapiens
augcagagaaaucuaaaauaug

SEQ ID NO: 98218 - RNA, 22 nt, Homo sapiens
augcagagucccagccccuagc

SEQ ID NO: 98219 - RNA, 22 nt, Homo sapiens
augcagauauuuuugugguugc

SEQ ID NO: 98220 - RNA, 22 nt, Homo sapiens
augcauagcaucugcaaauguu

SEQ ID NO: 98221 - RNA, 22 nt, Homo sapiens
augcauauuuuaccuagaagag

SEQ ID NO: 98222 - RNA, 22 nt, Homo sapiens
augccaagaugagcacgcgucu

SEQ ID NO: 98223 - RNA, 22 nt, Homo sapiens
augccacugcacuucagccugc

SEQ ID NO: 98224 - RNA, 22 nt, Homo sapiens
augccacuguacucuagccuag

SEQ ID NO: 98225 - RNA, 22 nt, Homo sapiens
augccacuguccuccugccuag

SEQ ID NO: 98226 - RNA, 22 nt, Homo sapiens
augcccauuuguuuucugaaag

SEQ ID NO: 98227 - RNA, 19 nt, Homo sapiens
augccuggagaugguuaua

SEQ ID NO: 98228 - RNA, 22 nt, Homo sapiens
augcuacauucuacaauuaggc

SEQ ID NO: 98229 - RNA, 22 nt, Homo sapiens
cucaguguucccauucuaccuu

SEQ ID NO: 98230 - RNA, 19 nt, Homo sapiens
cucauggagaaggagaaua

SEQ ID NO: 98231 - RNA, 22 nt, Homo sapiens
cuccacugagcaggugggaggc

SEQ ID NO: 98232 - RNA, 22 nt, Homo sapiens
cuccauagucuucgaagaauga

SEQ ID NO: 98233 - RNA, 22 nt, Homo sapiens
cuccauuuaguccuuuuagaag

SEQ ID NO: 98234 - RNA, 22 nt, Homo sapiens
cucccauugcaaacaacagaag

SEQ ID NO: 98235 - RNA, 22 nt, Homo sapiens
cucccuuugcugaauguuuuuc

SEQ ID NO: 98236 - RNA, 22 nt, Homo sapiens
cuccuggugauuggagugugaa

SEQ ID NO: 98237 - RNA, 22 nt, Homo sapiens
cuccuguagccccaucaucuuu

SEQ ID NO: 98238 - RNA, 20 nt, Homo sapiens
cuccuucauuccuuuggacc

SEQ ID NO: 98239 - RNA, 20 nt, Homo sapiens
cucuaguaauaaaguuuccc

SEQ ID NO: 98240 - RNA, 22 nt, Homo sapiens
cucucaguguggaggccagaaa

SEQ ID NO: 98241 - RNA, 17 nt, Homo sapiens
cucucugguuuaaagca

SEQ ID NO: 98242 - RNA, 22 nt, Homo sapiens
cucucuguuugucuguuauugg

SEQ ID NO: 98243 - RNA, 22 nt, Homo sapiens
cucugguuucgcaggaaauaga

SEQ ID NO: 98244 - RNA, 22 nt, Homo sapiens
cugaaaguuauucaggggcaag

SEQ ID NO: 98245 - RNA, 22 nt, Homo sapiens
cugaaaugaauuauuuucuuuc

SEQ ID NO: 98246 - RNA, 22 nt, Homo sapiens
cugaaauggaaugugugcacag

SEQ ID NO: 98247 - RNA, 22 nt, Homo sapiens
cugaauguuuucuucuauucug

SEQ ID NO: 98248 - RNA, 22 nt, Homo sapiens
cugacaucuucaagugaggaga

SEQ ID NO: 98249 - RNA, 22 nt, Homo sapiens
cugacauggggauccaccuuag

SEQ ID NO: 98250 - RNA, 22 nt, Homo sapiens
cugacauuguugaucacagcca

SEQ ID NO: 98251 - RNA, 17 nt, Homo sapiens
cugaccucauuguguac

SEQ ID NO: 98252 - RNA, 22 nt, Homo sapiens
cugagaagaaacagguaaggac

SEQ ID NO: 98253 - RNA, 22 nt, Homo sapiens
cugagacacucuuaucugcaua

SEQ ID NO: 98254 - RNA, 22 nt, Homo sapiens
cugagacuggguaauguauaaa

SEQ ID NO: 98255 - RNA, 22 nt, Homo sapiens
cugagacuggugauuuaugaag

SEQ ID NO: 98256 - RNA, 22 nt, Homo sapiens
cugagagaggagcuaaaacugc

SEQ ID NO: 98257 - RNA, 22 nt, Homo sapiens
cugagauaggacucugcuggcu

SEQ ID NO: 98258 - RNA, 22 nt, Homo sapiens
cugagauuaagauauugggagu

SEQ ID NO: 98259 - RNA, 22 nt, Homo sapiens
cugagcaaaaugaagacacgau

SEQ ID NO: 98260 - RNA, 22 nt, Homo sapiens
cugagcaaaguucuauuuaugg

SEQ ID NO: 98261 - RNA, 22 nt, Homo sapiens
cugagcaauauagugagaucuu

SEQ ID NO: 98262 - RNA, 22 nt, Homo sapiens
cugagcacugagauccucuagc

SEQ ID NO: 98263 - RNA, 22 nt, Homo sapiens
cugagcccauucuggggagaag

SEQ ID NO: 98264 - RNA, 22 nt, Homo sapiens
cugaggaaguucuuuaacaguu

SEQ ID NO: 98265 - RNA, 22 nt, Homo sapiens
cugaggacaucagggaagcauc

SEQ ID NO: 98266 - RNA, 22 nt, Homo sapiens
cugaggauauucagccucugug

SEQ ID NO: 98267 - RNA, 22 nt, Homo sapiens
cugaggguagaaggaucacuug

SEQ ID NO: 98268 - RNA, 22 nt, Homo sapiens
cugagguacugggggccaggau

SEQ ID NO: 98269 - RNA, 22 nt, Homo sapiens
cugagguaggugaucagugcuu

SEQ ID NO: 98270 - RNA, 22 nt, Homo sapiens
cugaggucugaauccagguauc

SEQ ID NO: 98271 - RNA, 22 nt, Homo sapiens
cugaggugauauauacauauuu

SEQ ID NO: 98272 - RNA, 20 nt, Homo sapiens
cugaggugggagaaucgcuu

SEQ ID NO: 98273 - RNA, 22 nt, Homo sapiens
cugagugcaagugauccuccca

SEQ ID NO: 98274 - RNA, 22 nt, Homo sapiens
cugauaaguuuuucuuuauaag

SEQ ID NO: 98275 - RNA, 22 nt, Homo sapiens
cugaucuggaggugucugggga

SEQ ID NO: 98276 - RNA, 22 nt, Homo sapiens
cugaugaaguauuuguucugga

SEQ ID NO: 98277 - RNA, 22 nt, Homo sapiens
cugauguagguggucugugauc

SEQ ID NO: 98278 - RNA, 22 nt, Homo sapiens
cugauuguucuugcugggccuu

SEQ ID NO: 98279 - RNA, 22 nt, Homo sapiens
cugcaagaugcauaggaauuuu

SEQ ID NO: 98280 - RNA, 19 nt, Homo sapiens
cugcaagguaauaggucag

SEQ ID NO: 98281 - RNA, 22 nt, Homo sapiens
cugcaauggagaaagugagacu

SEQ ID NO: 98282 - RNA, 22 nt, Homo sapiens
cugcacugagacccucuuugcu

SEQ ID NO: 98283 - RNA, 21 nt, Homo sapiens
cugcauccauuucugagugau

SEQ ID NO: 98284 - RNA, 22 nt, Homo sapiens
cugcauuagucuguuuaguguu

SEQ ID NO: 98285 - RNA, 22 nt, Homo sapiens
cugccaguuugauucgggccac

SEQ ID NO: 98286 - RNA, 22 nt, Homo sapiens
cugccuaaagaaaaagacguug

SEQ ID NO: 98287 - RNA, 22 nt, Homo sapiens
cuggaaaguagacaaucuaaaa

SEQ ID NO: 98288 - RNA, 22 nt, Homo sapiens
cuggaaggaaaaacaaccacag

SEQ ID NO: 98289 - RNA, 22 nt, Homo sapiens
cuggagcaaaggugacucuugu

SEQ ID NO: 98290 - RNA, 22 nt, Homo sapiens
cuggaggccugaacauaaaugg

SEQ ID NO: 98291 - RNA, 22 nt, Homo sapiens
cuggauagagauugaugaugcu

SEQ ID NO: 98292 - RNA, 22 nt, Homo sapiens
cuggcacagugucagaaacaca

SEQ ID NO: 98293 - RNA, 22 nt, Homo sapiens
cuggcacccuugcuuaggaaga

SEQ ID NO: 98294 - RNA, 22 nt, Homo sapiens
cuggcagucugccucuucacug

SEQ ID NO: 98295 - RNA, 22 nt, Homo sapiens
cuggcccaguucugcguuuugc

SEQ ID NO: 98296 - RNA, 22 nt, Homo sapiens
cuggcuaagugcuugagugugc

SEQ ID NO: 98297 - RNA, 22 nt, Homo sapiens
cuggcucauuucauuuagcaua

SEQ ID NO: 98298 - RNA, 22 nt, Homo sapiens
cuggucaugggggcacccucug

SEQ ID NO: 98299 - RNA, 22 nt, Homo sapiens
cugguuguuacaaagagccugg

SEQ ID NO: 98300 - RNA, 18 nt, Homo sapiens
uucagugaauucuuuuga

SEQ ID NO: 98301 - RNA, 22 nt, Homo sapiens
uucagugagacgaaaacaacaa

SEQ ID NO: 98302 - RNA, 22 nt, Homo sapiens
uucaguggagaggcugaguggu

SEQ ID NO: 98303 - RNA, 22 nt, Homo sapiens
uucauacaguggcugcacucca

SEQ ID NO: 98304 - RNA, 22 nt, Homo sapiens
uucauaguauuuuucuccaaau

SEQ ID NO: 98305 - RNA, 22 nt, Homo sapiens
uucauagucuaauuuuuuccac

SEQ ID NO: 98306 - RNA, 18 nt, Homo sapiens
uucauauguugaaccaga

SEQ ID NO: 98307 - RNA, 22 nt, Homo sapiens
uucaucacagucuccgaugccc

SEQ ID NO: 98308 - RNA, 21 nt, Homo sapiens
uucaucagccagaaaucaagc

SEQ ID NO: 98309 - RNA, 22 nt, Homo sapiens
uucaucaggaauauugaccugu

SEQ ID NO: 98310 - RNA, 22 nt, Homo sapiens
uucauggaguugagaaggcuaa

SEQ ID NO: 98311 - RNA, 22 nt, Homo sapiens
uucauguagucaucauccugcu

SEQ ID NO: 98312 - RNA, 22 nt, Homo sapiens
uucaugucuuggcuguuagagu

SEQ ID NO: 98313 - RNA, 22 nt, Homo sapiens
uucauuggauguuacacugugu

SEQ ID NO: 98314 - RNA, 22 nt, Homo sapiens
uuccacagggauuugcauugau

SEQ ID NO: 98315 - RNA, 22 nt, Homo sapiens
uuccaggugggcgugggccugg

SEQ ID NO: 98316 - RNA, 22 nt, Homo sapiens
uuccaguggacuacuucauccu

SEQ ID NO: 98317 - RNA, 22 nt, Homo sapiens
uacacgugcacaacgugcacgu

SEQ ID NO: 98318 - RNA, 20 nt, Homo sapiens
uacacguguagcauucucua

SEQ ID NO: 98319 - RNA, 22 nt, Homo sapiens
uacagaauugcagguguggcag

SEQ ID NO: 98320 - RNA, 22 nt, Homo sapiens
uacagaguagaagauuugcaga

SEQ ID NO: 98321 - RNA, 23 nt, Homo sapiens
uacagcacacugaugggucuuga

SEQ ID NO: 98322 - RNA, 22 nt, Homo sapiens
uacagcacaggugcagguguug

SEQ ID NO: 98323 - RNA, 22 nt, Homo sapiens
uacaggacuucucagaguuauu

SEQ ID NO: 98324 - RNA, 22 nt, Homo sapiens
uacaguagaaugucuuucaaaa

SEQ ID NO: 98325 - RNA, 22 nt, Homo sapiens
uacaguaggauuuucagggucu

SEQ ID NO: 98326 - RNA, 22 nt, Homo sapiens
uacagucuggaggccuguguug

SEQ ID NO: 98327 - RNA, 22 nt, Homo sapiens
uacaguggaaguuaaccccauu

SEQ ID NO: 98328 - RNA, 22 nt, Homo sapiens
uacaguggcaugucaggugcuu

SEQ ID NO: 98329 - RNA, 22 nt, Homo sapiens
uacauaguagauauaggguuua

SEQ ID NO: 98330 - RNA, 19 nt, Homo sapiens
uacauaguauuuaguggca

SEQ ID NO: 98331 - RNA, 19 nt, Homo sapiens
uacaugcagcaggcacgca

SEQ ID NO: 98332 - RNA, 23 nt, Homo sapiens
uaccacauuccuucuuuccuguu

SEQ ID NO: 98333 - RNA, 22 nt, Homo sapiens
uaccaccauuguaguuuggaaa

SEQ ID NO: 98334 - RNA, 22 nt, Homo sapiens
uaccacccuuuuuccagaagcc

SEQ ID NO: 98335 - RNA, 22 nt, Homo sapiens
uaccauguauguuucuccauug

SEQ ID NO: 98336 - RNA, 22 nt, Homo sapiens
uacccaguaacaaguauuuugg

SEQ ID NO: 98337 - RNA, 22 nt, Homo sapiens
uaccuaguguugacuucucuuc

SEQ ID NO: 98338 - RNA, 22 nt, Homo sapiens
uaccucaguucaauaacagaua

SEQ ID NO: 98339 - RNA, 22 nt, Homo sapiens
uaccugagaaagaaagcccucg

SEQ ID NO: 98340 - RNA, 22 nt, Homo sapiens
uaccugagcccucugcugaguu

SEQ ID NO: 98341 - RNA, 22 nt, Homo sapiens
uaccuuugucaguuacucaccu

SEQ ID NO: 98342 - RNA, 22 nt, Homo sapiens
uacguguauuguuuucacaaga

SEQ ID NO: 98343 - RNA, 22 nt, Homo sapiens
uacuacagccugagcgacugag

SEQ ID NO: 98344 - RNA, 22 nt, Homo sapiens
uacuacuuucugacaucuuuaa

SEQ ID NO: 98345 - RNA, 22 nt, Homo sapiens
uacuagaggaaaacuugaagac

SEQ ID NO: 98346 - RNA, 22 nt, Homo sapiens
uacuagaguagugcagagggga

SEQ ID NO: 98347 - RNA, 22 nt, Homo sapiens
uacucacauucuguuucuugcu

SEQ ID NO: 98348 - RNA, 22 nt, Homo sapiens
uacucaguaagugcuggcugcu

SEQ ID NO: 98349 - RNA, 22 nt, Homo sapiens
uacucagugacugguggaucaa

SEQ ID NO: 98350 - RNA, 22 nt, Homo sapiens
uacugcacuccagccucgguga

SEQ ID NO: 98351 - RNA, 22 nt, Homo sapiens
uacugcacuccaggcucaccug

SEQ ID NO: 98352 - RNA, 20 nt, Homo sapiens
uacugcacuccauccugggu

SEQ ID NO: 98353 - RNA, 22 nt, Homo sapiens
uacugcacucuagccuggguga

SEQ ID NO: 98354 - RNA, 22 nt, Homo sapiens
uacugcacuugaccuccugggc

SEQ ID NO: 98355 - RNA, 22 nt, Homo sapiens
uacugcaucgaaaugcuuuuau

SEQ ID NO: 98356 - RNA, 22 nt, Homo sapiens
uacugcaucuacuuagagccag

SEQ ID NO: 98357 - RNA, 22 nt, Homo sapiens
uacugcuuaagggcaugggccc

SEQ ID NO: 98358 - RNA, 22 nt, Homo sapiens
uacuggccuugaacucuggugu

SEQ ID NO: 98359 - RNA, 22 nt, Homo sapiens
uacuguguaguuagaccucaga

SEQ ID NO: 98360 - RNA, 20 nt, Homo sapiens
uagaaaguagaguggugguu

SEQ ID NO: 98361 - RNA, 22 nt, Homo sapiens
uagaacaauugcuggauccgaa

SEQ ID NO: 98362 - RNA, 22 nt, Homo sapiens
uagaaguaggcuacgugucugg

SEQ ID NO: 98363 - RNA, 18 nt, Homo sapiens
uagaauauaggucauucu

SEQ ID NO: 98364 - RNA, 22 nt, Homo sapiens
uagaaugcauuagguugcccag

SEQ ID NO: 98365 - RNA, 22 nt, Homo sapiens
uagaauggaagguugagaagaa

SEQ ID NO: 98366 - RNA, 22 nt, Homo sapiens
uagaaugucagcuucuugaggg

SEQ ID NO: 98367 - RNA, 22 nt, Homo sapiens
uagacaacugaaacacugugca

SEQ ID NO: 98368 - RNA, 22 nt, Homo sapiens
uagacacugcauauuuuuuuaa

SEQ ID NO: 98369 - RNA, 22 nt, Homo sapiens
uagacccauuacguaguuucca

SEQ ID NO: 98370 - RNA, 22 nt, Homo sapiens
uagacugguuuagcacugaaua

SEQ ID NO: 98371 - RNA, 22 nt, Homo sapiens
uagagauccuucacuaggggca

SEQ ID NO: 98372 - RNA, 22 nt, Homo sapiens
uagagcacaagguagauuucua

SEQ ID NO: 98373 - RNA, 22 nt, Homo sapiens
uagagcacauuaucauuuccaa

SEQ ID NO: 98374 - RNA, 22 nt, Homo sapiens
uagagguagguguaugaacuag

SEQ ID NO: 98375 - RNA, 22 nt, Homo sapiens
uagaguguaaaccacauaguga

SEQ ID NO: 98376 - RNA, 21 nt, Homo sapiens
uagauacuguauuaaaccuag

SEQ ID NO: 98377 - RNA, 22 nt, Homo sapiens
uagaucauauacuugccaugac

SEQ ID NO: 98378 - RNA, 23 nt, Homo sapiens
uagaucaucaaguuuacugugcu

SEQ ID NO: 98379 - RNA, 22 nt, Homo sapiens
uagaugauucacuuuacuucca

SEQ ID NO: 98380 - RNA, 20 nt, Homo sapiens
uagaugcauuuagauucauu

SEQ ID NO: 98381 - RNA, 22 nt, Homo sapiens
uagauuaucauucauacaggga

SEQ ID NO: 98382 - RNA, 22 nt, Homo sapiens
uagauuaucccugauuugucca

SEQ ID NO: 98383 - RNA, 22 nt, Homo sapiens
uagauuaucucaccacucgagu

SEQ ID NO: 98384 - RNA, 22 nt, Homo sapiens
uagcaaaucaauggaauugaag

SEQ ID NO: 98385 - RNA, 21 nt, Homo sapiens
uagcaaauugcuauuaaggca

SEQ ID NO: 98386 - RNA, 19 nt, Homo sapiens
uagcacagggucccagacu

SEQ ID NO: 98387 - RNA, 17 nt, Homo sapiens
uagcacagugccuggua

SEQ ID NO: 98388 - RNA, 22 nt, Homo sapiens
uagcacagugucauucuaggua

SEQ ID NO: 98389 - RNA, 22 nt, Homo sapiens
uagcacaucuucuuggccugca

SEQ ID NO: 98390 - RNA, 22 nt, Homo sapiens
uagcaccaaacauauacucagu

SEQ ID NO: 98391 - RNA, 22 nt, Homo sapiens
uagcaccacaaucaagauacag

SEQ ID NO: 98392 - RNA, 22 nt, Homo sapiens
uagcacuauguuaucacauacu

SEQ ID NO: 98393 - RNA, 22 nt, Homo sapiens
uagcacuauuuauugaaaagga

SEQ ID NO: 98394 - RNA, 23 nt, Homo sapiens
uagcacuuuuuacauauggacau

SEQ ID NO: 98395 - RNA, 22 nt, Homo sapiens
uagcagcaaagcaggaucugcu

SEQ ID NO: 98396 - RNA, 22 nt, Homo sapiens
uagcagcauuuuuguagaguau

SEQ ID NO: 98397 - RNA, 22 nt, Homo sapiens
uagcagguggugaccacauuuu

SEQ ID NO: 98398 - RNA, 22 nt, Homo sapiens
uuccauguugauacgugaaguu

SEQ ID NO: 98399 - RNA, 22 nt, Homo sapiens
uuccauugugucaucuuggugg

SEQ ID NO: 98400 - RNA, 22 nt, Homo sapiens
uuccauuuguucggugucgcca

SEQ ID NO: 98401 - RNA, 22 nt, Homo sapiens
uucccagagccugggagugagg

SEQ ID NO: 98402 - RNA, 22 nt, Homo sapiens
uucccagugguuagcucugguc

SEQ ID NO: 98403 - RNA, 22 nt, Homo sapiens
uucccugaguaucuuaccaugg

SEQ ID NO: 98404 - RNA, 22 nt, Homo sapiens
uucccugugggcuggugcucca

SEQ ID NO: 98405 - RNA, 22 nt, Homo sapiens
uucccuuucugccuugaaucuu

SEQ ID NO: 98406 - RNA, 22 nt, Homo sapiens
uucccuuugaaacuaaacuugc

SEQ ID NO: 98407 - RNA, 22 nt, Homo sapiens
uucccuuugaauuggaaaggug

SEQ ID NO: 98408 - RNA, 22 nt, Homo sapiens
uucccuuuuuucuaguagguag

SEQ ID NO: 98409 - RNA, 22 nt, Homo sapiens
uuccucuagacugucgguuucu

SEQ ID NO: 98410 - RNA, 22 nt, Homo sapiens
uuccugaggccuccccagaagc

SEQ ID NO: 98411 - RNA, 22 nt, Homo sapiens
uuccugucuuccaagagagauu

SEQ ID NO: 98412 - RNA, 22 nt, Homo sapiens
uuccuugagaaaggcacaaguu

SEQ ID NO: 98413 - RNA, 22 nt, Homo sapiens
uuccuuguagcaaaugcgauga

SEQ ID NO: 98414 - RNA, 22 nt, Homo sapiens
uucuaaguaagucuguggggaa

SEQ ID NO: 98415 - RNA, 20 nt, Homo sapiens
uucuacagucacaggaagau

SEQ ID NO: 98416 - RNA, 22 nt, Homo sapiens
uucuacagugacugcagccaua

SEQ ID NO: 98417 - RNA, 21 nt, Homo sapiens
uucuacuccggcguuguuuuu

SEQ ID NO: 98418 - RNA, 22 nt, Homo sapiens
uucuacuucauuaggaggauug

SEQ ID NO: 98419 - RNA, 22 nt, Homo sapiens
uucuauggucacagaugcuuga

SEQ ID NO: 98420 - RNA, 22 nt, Homo sapiens
uucuaugguuaccaggcuaguc

SEQ ID NO: 98421 - RNA, 22 nt, Homo sapiens
uucucacaguacagggagcucu

SEQ ID NO: 98422 - RNA, 21 nt, Homo sapiens
uucucaggguguguccuaccc

SEQ ID NO: 98423 - RNA, 22 nt, Homo sapiens
uucucaguuccuacuuugguga

SEQ ID NO: 98424 - RNA, 22 nt, Homo sapiens
uucugccaaucaacccacaucc

SEQ ID NO: 98425 - RNA, 23 nt, Homo sapiens
uucugccacugaaaaugccucag

SEQ ID NO: 98426 - RNA, 22 nt, Homo sapiens
uucuggccccucccaaucucau

SEQ ID NO: 98427 - RNA, 22 nt, Homo sapiens
uucuggccuccauuuuucuccu

SEQ ID NO: 98428 - RNA, 22 nt, Homo sapiens
uucuggcucgauucucugaccg

SEQ ID NO: 98429 - RNA, 22 nt, Homo sapiens
uucuggcuuauaaacgugacuu

SEQ ID NO: 98430 - RNA, 22 nt, Homo sapiens
uucugguuaauacuugcaaaaa

SEQ ID NO: 98431 - RNA, 22 nt, Homo sapiens
uucuuccagccuugaggggccc

SEQ ID NO: 98432 - RNA, 22 nt, Homo sapiens
uucuugaggcaugccgcuggga

SEQ ID NO: 98433 - RNA, 20 nt, Homo sapiens
uucuugaguuaacaaguuac

SEQ ID NO: 98434 - RNA, 22 nt, Homo sapiens
uucuugcacuuggcccucauua

SEQ ID NO: 98435 - RNA, 22 nt, Homo sapiens
uucuugguguaguaguugaaaa

SEQ ID NO: 98436 - RNA, 22 nt, Homo sapiens
uucuugguuuaucgcuuuaaaa

SEQ ID NO: 98437 - RNA, 22 nt, Homo sapiens
uucuuuaguucacuugcuccag

SEQ ID NO: 98438 - RNA, 19 nt, Homo sapiens
uucuuuguugugggggcug

SEQ ID NO: 98439 - RNA, 22 nt, Homo sapiens
uugaaagaaaggagacugaguu

SEQ ID NO: 98440 - RNA, 22 nt, Homo sapiens
uugaaaguaaacaucacaaaga

SEQ ID NO: 98441 - RNA, 22 nt, Homo sapiens
uugaaagucauuucuucuaagu

SEQ ID NO: 98442 - RNA, 22 nt, Homo sapiens
uugaaagucuaggcuuacagua

SEQ ID NO: 98443 - RNA, 22 nt, Homo sapiens
uugaaccauucuuuugauagag

SEQ ID NO: 98444 - RNA, 22 nt, Homo sapiens
uugaacuagaaccugcaaauuu

SEQ ID NO: 98445 - RNA, 22 nt, Homo sapiens
uugaagacuauaugauucuuca

SEQ ID NO: 98446 - RNA, 19 nt, Homo sapiens
uugaaggccgccuugcaga

SEQ ID NO: 98447 - RNA, 22 nt, Homo sapiens
uugaagguaggaugugcuauca

SEQ ID NO: 98448 - RNA, 22 nt, Homo sapiens
uugaaguaggaaaggaggaggu

SEQ ID NO: 98449 - RNA, 22 nt, Homo sapiens
uugaaguauagaguuuaagaac

SEQ ID NO: 98450 - RNA, 22 nt, Homo sapiens
uugaauagaaguguugaaagug

SEQ ID NO: 98451 - RNA, 22 nt, Homo sapiens
uugaauagacagccagcuuuaa

SEQ ID NO: 98452 - RNA, 18 nt, Homo sapiens
uugaauaguguccaaucu

SEQ ID NO: 98453 - RNA, 22 nt, Homo sapiens
uugaaugaaauuggugugggga

SEQ ID NO: 98454 - RNA, 22 nt, Homo sapiens
uugaauguguugggaagcccuu

SEQ ID NO: 98455 - RNA, 22 nt, Homo sapiens
uugacaaugcacugugcuaagu

SEQ ID NO: 98456 - RNA, 20 nt, Homo sapiens
uugacagagggaaaguugcu

SEQ ID NO: 98457 - RNA, 22 nt, Homo sapiens
uugaccccuucuaauagccuca

SEQ ID NO: 98458 - RNA, 22 nt, Homo sapiens
uugacuagaccaucuuucuaga

SEQ ID NO: 98459 - RNA, 22 nt, Homo sapiens
uugacugggccagacagagauc

SEQ ID NO: 98460 - RNA, 22 nt, Homo sapiens
uugacuguaagauggcuauuac

SEQ ID NO: 98461 - RNA, 22 nt, Homo sapiens
uugacugugguaauggaagcug

SEQ ID NO: 98462 - RNA, 21 nt, Homo sapiens
uugagaagaauuagcucuucc

SEQ ID NO: 98463 - RNA, 22 nt, Homo sapiens
uugagaaucuuugcuaaaggaa

SEQ ID NO: 98464 - RNA, 22 nt, Homo sapiens
uugagagcugaugaaagauaaa

SEQ ID NO: 98465 - RNA, 17 nt, Homo sapiens
uugagaguauaucuuac

SEQ ID NO: 98466 - RNA, 22 nt, Homo sapiens
uugagauagggucuaccucugu

SEQ ID NO: 98467 - RNA, 22 nt, Homo sapiens
uugagauccuuuugcucaucag

SEQ ID NO: 98468 - RNA, 22 nt, Homo sapiens
uugagauggaaucucgcuuugu

SEQ ID NO: 98469 - RNA, 22 nt, Homo sapiens
uugagauggagccucacucugc

SEQ ID NO: 98470 - RNA, 22 nt, Homo sapiens
uugagauggagucucacucugu

SEQ ID NO: 98471 - RNA, 22 nt, Homo sapiens
uugagauggagucucgcucugu

SEQ ID NO: 98472 - RNA, 22 nt, Homo sapiens
uugagauggagucuugcucuug

SEQ ID NO: 98473 - RNA, 22 nt, Homo sapiens
uugagauggagucuuguucucu

SEQ ID NO: 98474 - RNA, 22 nt, Homo sapiens
uugagauggagucuuguucuuu

SEQ ID NO: 98475 - RNA, 22 nt, Homo sapiens
uaaugcuugguuguuuggaaaa

SEQ ID NO: 98476 - RNA, 22 nt, Homo sapiens
uaauucuguauguaucagaguu

SEQ ID NO: 98477 - RNA, 22 nt, Homo sapiens
uaauugcaguucuguguuauau

SEQ ID NO: 98478 - RNA, 22 nt, Homo sapiens
uacaaagcuuugaugugucuuu

SEQ ID NO: 98479 - RNA, 22 nt, Homo sapiens
uacaaaguaacaguuccuguau

SEQ ID NO: 98480 - RNA, 22 nt, Homo sapiens
uacaaaucuagguuuguuacug

SEQ ID NO: 98481 - RNA, 22 nt, Homo sapiens
uacaaguauuuuuauuagugcc

SEQ ID NO: 98482 - RNA, 22 nt, Homo sapiens
uacaaguggguuugugcaggag

SEQ ID NO: 98483 - RNA, 22 nt, Homo sapiens
uacaauagugacaaaucagcau

SEQ ID NO: 98484 - RNA, 16 nt, Homo sapiens
uacaauguagaaaaca

SEQ ID NO: 98485 - RNA, 22 nt, Homo sapiens
uacaccugaguuugugguuuuc

SEQ ID NO: 98486 - RNA, 22 nt, Homo sapiens
uacaccugcacucuagccuggg

SEQ ID NO: 98487 - RNA, 22 nt, Homo sapiens
ucagcguguggacggccaucuu

SEQ ID NO: 98488 - RNA, 22 nt, Homo sapiens
ucaggcacucagcuuagagucu

SEQ ID NO: 98489 - RNA, 22 nt, Homo sapiens
ucagggacuuacaaaccagaag

SEQ ID NO: 98490 - RNA, 22 nt, Homo sapiens
ucagguaaucuauuugucuuuu

SEQ ID NO: 98491 - RNA, 20 nt, Homo sapiens
ucagguagaucuuugagguc

SEQ ID NO: 98492 - RNA, 23 nt, Homo sapiens
ucagguaggccuagaguauucuu

SEQ ID NO: 98493 - RNA, 22 nt, Homo sapiens
ucagguauuuuaucacaugaag

SEQ ID NO: 98494 - RNA, 22 nt, Homo sapiens
ucaggugcaguggcucaugcuu

SEQ ID NO: 98495 - RNA, 22 nt, Homo sapiens
ucaggugcaguggcucugaccu

SEQ ID NO: 98496 - RNA, 22 nt, Homo sapiens
ucaguaaauguuaggacauuuc

SEQ ID NO: 98497 - RNA, 22 nt, Homo sapiens
ucaguaccugagagugggcaga

SEQ ID NO: 98498 - RNA, 22 nt, Homo sapiens
ucaguacuuuggagcucacaua

SEQ ID NO: 98499 - RNA, 20 nt, Homo sapiens
ucaguauauuguuuccacag

SEQ ID NO: 98500 - RNA, 18 nt, Homo sapiens
ucagucacugccuggcuu

SEQ ID NO: 98501 - RNA, 22 nt, Homo sapiens
ucagucauugauggaguagguc

SEQ ID NO: 98502 - RNA, 22 nt, Homo sapiens
ucagucuuuuaccauuaaguau

SEQ ID NO: 98503 - RNA, 22 nt, Homo sapiens
ucagugaauacauguacucaug

SEQ ID NO: 98504 - RNA, 21 nt, Homo sapiens
ucagugcaauucuauggggaa

SEQ ID NO: 98505 - RNA, 22 nt, Homo sapiens
ucagugcaggaaucucuagcca

SEQ ID NO: 98506 - RNA, 22 nt, Homo sapiens
ucagugcaggaauuuccuuaga

SEQ ID NO: 98507 - RNA, 21 nt, Homo sapiens
ucagugcugugggcaaggugc

SEQ ID NO: 98508 - RNA, 22 nt, Homo sapiens
ucagugcuuggcacagagagcu

SEQ ID NO: 98509 - RNA, 22 nt, Homo sapiens
ucagugcuuuuuguugucauca

SEQ ID NO: 98510 - RNA, 22 nt, Homo sapiens
ucaguggauuauuaaagucacc

SEQ ID NO: 98511 - RNA, 22 nt, Homo sapiens
ucaguucauggaggugucugcu

SEQ ID NO: 98512 - RNA, 22 nt, Homo sapiens
ucauacgucuccuugugccacc

SEQ ID NO: 98513 - RNA, 22 nt, Homo sapiens
ucauacuguuaaaugguuuagu

SEQ ID NO: 98514 - RNA, 22 nt, Homo sapiens
ucauacuguugugaaacaaaac

SEQ ID NO: 98515 - RNA, 22 nt, Homo sapiens
ucauagaucaaguaauaagaca

SEQ ID NO: 98516 - RNA, 22 nt, Homo sapiens
ucauaguacuuuguuuugaaaa

SEQ ID NO: 98517 - RNA, 22 nt, Homo sapiens
ucauagucuaagguucuuuugc

SEQ ID NO: 98518 - RNA, 22 nt, Homo sapiens
ucauaugucauaguaugaucuu

SEQ ID NO: 98519 - RNA, 22 nt, Homo sapiens
ucaucagugcuugcaaauuauu

SEQ ID NO: 98520 - RNA, 22 nt, Homo sapiens
ucaugaaguaguuaacugguug

SEQ ID NO: 98521 - RNA, 22 nt, Homo sapiens
ucaugcaaugagucaggaggca

SEQ ID NO: 98522 - RNA, 22 nt, Homo sapiens
ucauggcauuguuaaggguuuu

SEQ ID NO: 98523 - RNA, 22 nt, Homo sapiens
ucaugggagcccccaucaugag

SEQ ID NO: 98524 - RNA, 22 nt, Homo sapiens
ucaugguuuuauaacccucuug

SEQ ID NO: 98525 - RNA, 22 nt, Homo sapiens
ucaugugagcacagagcaagau

SEQ ID NO: 98526 - RNA, 22 nt, Homo sapiens
ucaugugaggauaacaauagug

SEQ ID NO: 98527 - RNA, 22 nt, Homo sapiens
ucauucacucccuugaaguuag

SEQ ID NO: 98528 - RNA, 22 nt, Homo sapiens
ucauucuuucuguggaggggcu

SEQ ID NO: 98529 - RNA, 22 nt, Homo sapiens
ucauugcauguuaauuaaacag

SEQ ID NO: 98530 - RNA, 22 nt, Homo sapiens
ucauugguugcguaauuugauu

SEQ ID NO: 98531 - RNA, 21 nt, Homo sapiens
ucauugguuggcugcccugua

SEQ ID NO: 98532 - RNA, 22 nt, Homo sapiens
uccaagaugcuggcagcuacag

SEQ ID NO: 98533 - RNA, 22 nt, Homo sapiens
uccacaguggugaggugcagca

SEQ ID NO: 98534 - RNA, 19 nt, Homo sapiens
uccacagugguugaacuag

SEQ ID NO: 98535 - RNA, 22 nt, Homo sapiens
uccagaguggugaugcuggggc

SEQ ID NO: 98536 - RNA, 22 nt, Homo sapiens
uccagguuuugugaguuuaaau

SEQ ID NO: 98537 - RNA, 22 nt, Homo sapiens
uccagugugcaggcaaguuuga

SEQ ID NO: 98538 - RNA, 22 nt, Homo sapiens
uccaguguuauaauaugcgucu

SEQ ID NO: 98539 - RNA, 18 nt, Homo sapiens
uccaguuuucccagcauc

SEQ ID NO: 98540 - RNA, 22 nt, Homo sapiens
uccauagugagcagucaaugua

SEQ ID NO: 98541 - RNA, 22 nt, Homo sapiens
uccaugagaauaguuaggcucu

SEQ ID NO: 98542 - RNA, 22 nt, Homo sapiens
uccauguaguugagcggcuuug

SEQ ID NO: 98543 - RNA, 22 nt, Homo sapiens
uccauuuguagguagugagaca

SEQ ID NO: 98544 - RNA, 22 nt, Homo sapiens
ucccacugucuucucgugcucg

SEQ ID NO: 98545 - RNA, 22 nt, Homo sapiens
ucccagaaacgcauauguucau

SEQ ID NO: 98546 - RNA, 22 nt, Homo sapiens
ucccauugucucugaccuugcc

SEQ ID NO: 98547 - RNA, 22 nt, Homo sapiens
cacagaauucauuggauuaccu

SEQ ID NO: 98548 - RNA, 22 nt, Homo sapiens
cacagcacaggcaugaguguca

SEQ ID NO: 98549 - RNA, 22 nt, Homo sapiens
cacagcuaacaacuguuucuuc

SEQ ID NO: 98550 - RNA, 23 nt, Homo sapiens
cacagggugaacaccccuaaucc

SEQ ID NO: 98551 - RNA, 22 nt, Homo sapiens
cacaggucauccuggaucaagg

SEQ ID NO: 98552 - RNA, 22 nt, Homo sapiens
cacagugaacugguggguuuuu

SEQ ID NO: 98553 - RNA, 22 nt, Homo sapiens
cacagugaaugucaucauugcc

SEQ ID NO: 98554 - RNA, 22 nt, Homo sapiens
cacaguguucauagccaucagg

SEQ ID NO: 98555 - RNA, 22 nt, Homo sapiens
cacauguucaggagcacuuaga

SEQ ID NO: 98556 - RNA, 22 nt, Homo sapiens
cacauguuugcuacauuuuucu

SEQ ID NO: 98557 - RNA, 22 nt, Homo sapiens
caccacauuccauugaucaggc

SEQ ID NO: 98558 - RNA, 22 nt, Homo sapiens
cacccagucaucuuggguuuuu

SEQ ID NO: 98559 - RNA, 22 nt, Homo sapiens
caccuguacauggcaguguccu

SEQ ID NO: 98560 - RNA, 22 nt, Homo sapiens
caccuugugauccacccgccuu

SEQ ID NO: 98561 - RNA, 22 nt, Homo sapiens
cacuaccucuacaggcagcugg

SEQ ID NO: 98562 - RNA, 22 nt, Homo sapiens
cacuaggcuggagugcaguggc

SEQ ID NO: 98563 - RNA, 22 nt, Homo sapiens
cacugcaauuacuuuugcacca

SEQ ID NO: 98564 - RNA, 22 nt, Homo sapiens
cacugcacuccagucuggcgac

SEQ ID NO: 98565 - RNA, 22 nt, Homo sapiens
cacugcacuccaguuuggauga

SEQ ID NO: 98566 - RNA, 22 nt, Homo sapiens
cacugcacucuucuucugggca

SEQ ID NO: 98567 - RNA, 22 nt, Homo sapiens
cacugcauuacucaugagcaug

SEQ ID NO: 98568 - RNA, 22 nt, Homo sapiens
cacugcauuggaugguuccucc

SEQ ID NO: 98569 - RNA, 22 nt, Homo sapiens
cacugcgaccuccaccucccgg

SEQ ID NO: 98570 - RNA, 22 nt, Homo sapiens
cacugcgaccucugccuaccgg

SEQ ID NO: 98571 - RNA, 22 nt, Homo sapiens
cacugcgacguccgccucccgg

SEQ ID NO: 98572 - RNA, 22 nt, Homo sapiens
cacugggugccauauguuugcu

SEQ ID NO: 98573 - RNA, 22 nt, Homo sapiens
cacuggucucauggcaugagag

SEQ ID NO: 98574 - RNA, 21 nt, Homo sapiens
cacugguguugcuauaucaaa

SEQ ID NO: 98575 - RNA, 22 nt, Homo sapiens
cacugugcaaccuccaccuccc

SEQ ID NO: 98576 - RNA, 22 nt, Homo sapiens
cagagaacugaguuauuuucuu

SEQ ID NO: 98577 - RNA, 22 nt, Homo sapiens
cagagagcuugcccuuguauau

SEQ ID NO: 98578 - RNA, 18 nt, Homo sapiens
ugcuaugagauuauuuua

SEQ ID NO: 98579 - RNA, 22 nt, Homo sapiens
ugcuauguaacacauuaccuuu

SEQ ID NO: 98580 - RNA, 21 nt, Homo sapiens
ugcuauguuguccaggcuggc

SEQ ID NO: 98581 - RNA, 22 nt, Homo sapiens
ugcucaguuuaaaacuuuugag

SEQ ID NO: 98582 - RNA, 21 nt, Homo sapiens
ugcuccauuuucuagccugaa

SEQ ID NO: 98583 - RNA, 22 nt, Homo sapiens
ugcugcaaacaggcaucugugg

SEQ ID NO: 98584 - RNA, 22 nt, Homo sapiens
ugcugcacaguucuuaagauua

SEQ ID NO: 98585 - RNA, 22 nt, Homo sapiens
ugcugcacuuauggcucugagg

SEQ ID NO: 98586 - RNA, 22 nt, Homo sapiens
ugcuggcguuacucuccaucag

SEQ ID NO: 98587 - RNA, 22 nt, Homo sapiens
ugcugguggucccauaugauua

SEQ ID NO: 98588 - RNA, 22 nt, Homo sapiens
ugcugguuuucaucaucagugg

SEQ ID NO: 98589 - RNA, 22 nt, Homo sapiens
ugcuguguugcuggcuuaaaga

SEQ ID NO: 98590 - RNA, 18 nt, Homo sapiens
ugcuuagucauuuucaau

SEQ ID NO: 98591 - RNA, 22 nt, Homo sapiens
ugcuuaguuguauguuccacau

SEQ ID NO: 98592 - RNA, 19 nt, Homo sapiens
ugcuuaguuuuauguguaa

SEQ ID NO: 98593 - RNA, 22 nt, Homo sapiens
ugcuugagacacauaugaauuu

SEQ ID NO: 98594 - RNA, 22 nt, Homo sapiens
uggaaaacaugcacauuggauu

SEQ ID NO: 98595 - RNA, 21 nt, Homo sapiens
uggaaacuucuagcuuacgua

SEQ ID NO: 98596 - RNA, 22 nt, Homo sapiens
uggaaaguacugagguccaccu

SEQ ID NO: 98597 - RNA, 22 nt, Homo sapiens
uggaaaguacuugaguuuguau

SEQ ID NO: 98598 - RNA, 22 nt, Homo sapiens
uggaaaguccaagccaaccggg

SEQ ID NO: 98599 - RNA, 22 nt, Homo sapiens
uggaaauuaacagggauugucc

SEQ ID NO: 98600 - RNA, 20 nt, Homo sapiens
uggaaauuaaccuuucaggu

SEQ ID NO: 98601 - RNA, 22 nt, Homo sapiens
uggaacacauaaauagcauagu

SEQ ID NO: 98602 - RNA, 21 nt, Homo sapiens
uggaacgcaaaugagaugaau

SEQ ID NO: 98603 - RNA, 22 nt, Homo sapiens
uggaagacaaguguuagcaugg

SEQ ID NO: 98604 - RNA, 22 nt, Homo sapiens
uggaagauggaguuuuaucauu

SEQ ID NO: 98605 - RNA, 22 nt, Homo sapiens
uggaagaugggaccucaguuuu

SEQ ID NO: 98606 - RNA, 22 nt, Homo sapiens
uggaagauucuagaagauucca

SEQ ID NO: 98607 - RNA, 22 nt, Homo sapiens
uggaagcaugcaaucugugggg

SEQ ID NO: 98608 - RNA, 22 nt, Homo sapiens
uggaaggucauuguucauuuga

SEQ ID NO: 98609 - RNA, 22 nt, Homo sapiens
uggaaguaaccaugaauggaau

SEQ ID NO: 98610 - RNA, 22 nt, Homo sapiens
uggaagugucugugcccagcuc

SEQ ID NO: 98611 - RNA, 22 nt, Homo sapiens
uggaauacaugucgcugagcug

SEQ ID NO: 98612 - RNA, 22 nt, Homo sapiens
uggaauaucaugagaguuuguu

SEQ ID NO: 98613 - RNA, 22 nt, Homo sapiens
uugagauauccauaaaugggaa

SEQ ID NO: 98614 - RNA, 22 nt, Homo sapiens
uugagauaucuuggccuuugca

SEQ ID NO: 98615 - RNA, 22 nt, Homo sapiens
uugagaucugugcuuuugcguu

SEQ ID NO: 98616 - RNA, 22 nt, Homo sapiens
uugagauggagucucacucuug

SEQ ID NO: 98617 - RNA, 22 nt, Homo sapiens
uugagauggagucucacucuuu

SEQ ID NO: 98618 - RNA, 22 nt, Homo sapiens
uugagauggagucucgcucuuu

SEQ ID NO: 98619 - RNA, 22 nt, Homo sapiens
uugagauggagucuugcacugu

SEQ ID NO: 98620 - RNA, 22 nt, Homo sapiens
uugagauggagucuugcgcugu

SEQ ID NO: 98621 - RNA, 22 nt, Homo sapiens
uugagauggaguuucacucucg

SEQ ID NO: 98622 - RNA, 22 nt, Homo sapiens
uugagauggaguuucacucuug

SEQ ID NO: 98623 - RNA, 22 nt, Homo sapiens
uugagauggaguuucgcucuug

SEQ ID NO: 98624 - RNA, 22 nt, Homo sapiens
uugagauggaguuucgcucuuu

SEQ ID NO: 98625 - RNA, 19 nt, Homo sapiens
uugagaugugaacucacac

SEQ ID NO: 98626 - RNA, 22 nt, Homo sapiens
uugagauguggcaguuuaugag

SEQ ID NO: 98627 - RNA, 22 nt, Homo sapiens
uugagauuuuccucaaauauuu

SEQ ID NO: 98628 - RNA, 22 nt, Homo sapiens
uugagcaaaacauuaauauuag

SEQ ID NO: 98629 - RNA, 22 nt, Homo sapiens
uugagcaacauagugagacugu

SEQ ID NO: 98630 - RNA, 22 nt, Homo sapiens
uugagcaaugaacgauucaggg

SEQ ID NO: 98631 - RNA, 22 nt, Homo sapiens
uugagcauugguauagguuuua

SEQ ID NO: 98632 - RNA, 22 nt, Homo sapiens
uugagcccuggagguggaggcu

SEQ ID NO: 98633 - RNA, 22 nt, Homo sapiens
uugagcuaguugcaccagcagg

SEQ ID NO: 98634 - RNA, 22 nt, Homo sapiens
uugagcucuucuagcaauucua

SEQ ID NO: 98635 - RNA, 22 nt, Homo sapiens
uugagcuuuuuacuuguccaau

SEQ ID NO: 98636 - RNA, 22 nt, Homo sapiens
uugaggaaugugauuucaaaua

SEQ ID NO: 98637 - RNA, 22 nt, Homo sapiens
uugaggacuggaacacaggucu

SEQ ID NO: 98638 - RNA, 22 nt, Homo sapiens
uugaggaggcagucucuccauu

SEQ ID NO: 98639 - RNA, 22 nt, Homo sapiens
uugaggaucauuguuuucggag

SEQ ID NO: 98640 - RNA, 22 nt, Homo sapiens
uugagguaggaggagcuuggau

SEQ ID NO: 98641 - RNA, 22 nt, Homo sapiens
uugagguauaaagguagguugu

SEQ ID NO: 98642 - RNA, 22 nt, Homo sapiens
uugagguauugauaaaacauuu

SEQ ID NO: 98643 - RNA, 20 nt, Homo sapiens
uugaggucaggaguuuggga

SEQ ID NO: 98644 - RNA, 22 nt, Homo sapiens
uugaggugaauuugcaggaugc

SEQ ID NO: 98645 - RNA, 22 nt, Homo sapiens
uugagguguauuguacagcaca

SEQ ID NO: 98646 - RNA, 22 nt, Homo sapiens
uugaguagauaccuaggaauag

SEQ ID NO: 98647 - RNA, 20 nt, Homo sapiens
uugaguauugccagggaggc

SEQ ID NO: 98648 - RNA, 22 nt, Homo sapiens
uugauaacauucugcauccuau

SEQ ID NO: 98649 - RNA, 22 nt, Homo sapiens
uugauaagaaaaauauaccaga

SEQ ID NO: 98650 - RNA, 22 nt, Homo sapiens
uugauacuagagucuuucugac

SEQ ID NO: 98651 - RNA, 22 nt, Homo sapiens
uugauaguguccucuuuggcag

SEQ ID NO: 98652 - RNA, 22 nt, Homo sapiens
uugauauguaguuggacuugau

SEQ ID NO: 98653 - RNA, 22 nt, Homo sapiens
uugaucacuguacuaugacuau

SEQ ID NO: 98654 - RNA, 22 nt, Homo sapiens
uugaucaucagcuuugucaucu

SEQ ID NO: 98655 - RNA, 22 nt, Homo sapiens
uugauccucugagaaucuaucg

SEQ ID NO: 98656 - RNA, 22 nt, Homo sapiens
uugaucuaugugucuguuuuua

SEQ ID NO: 98657 - RNA, 22 nt, Homo sapiens
uugauguugaggacauaaaccu

SEQ ID NO: 98658 - RNA, 20 nt, Homo sapiens
uugauucccucuaaacucgc

SEQ ID NO: 98659 - RNA, 22 nt, Homo sapiens
uugauugacaugucucuguuca

SEQ ID NO: 98660 - RNA, 22 nt, Homo sapiens
uugauuuguagaaugccccaac

SEQ ID NO: 98661 - RNA, 22 nt, Homo sapiens
uugcaacauuguaaguuuauau

SEQ ID NO: 98662 - RNA, 22 nt, Homo sapiens
uugcaagaaaucagagccuucc

SEQ ID NO: 98663 - RNA, 22 nt, Homo sapiens
uugcaagauguuaacauuggag

SEQ ID NO: 98664 - RNA, 22 nt, Homo sapiens
uugcaagauguucaugggcugu

SEQ ID NO: 98665 - RNA, 22 nt, Homo sapiens
uugcaaggugcagcuuaugcaa

SEQ ID NO: 98666 - RNA, 22 nt, Homo sapiens
uugcacaauggaauuuaucuuu

SEQ ID NO: 98667 - RNA, 22 nt, Homo sapiens
uugcacauggcaggugcucaau

SEQ ID NO: 98668 - RNA, 22 nt, Homo sapiens
uugcacauugauuuuguauccu

SEQ ID NO: 98669 - RNA, 22 nt, Homo sapiens
ggaauauaaaacuuuugacagg

SEQ ID NO: 98670 - RNA, 22 nt, Homo sapiens
ggaaugggauuugaagucuggc

SEQ ID NO: 98671 - RNA, 22 nt, Homo sapiens
ggacaaaguauuuucaaaugua

SEQ ID NO: 98672 - RNA, 22 nt, Homo sapiens
ggacagaugggcucccgggucu

SEQ ID NO: 98673 - RNA, 22 nt, Homo sapiens
ggacuagaacugagaaucauau

SEQ ID NO: 98674 - RNA, 22 nt, Homo sapiens
ggacuguacuccuggccagugu

SEQ ID NO: 98675 - RNA, 22 nt, Homo sapiens
ggagaauguaauugguauuuug

SEQ ID NO: 98676 - RNA, 22 nt, Homo sapiens
ggagagcuaggcagagguuugu

SEQ ID NO: 98677 - RNA, 22 nt, Homo sapiens
ggagaguaauuagacugaaaga

SEQ ID NO: 98678 - RNA, 22 nt, Homo sapiens
ggagaucauuuccuauuugaag

SEQ ID NO: 98679 - RNA, 22 nt, Homo sapiens
ggagaugaaaugagcuacuuaa

SEQ ID NO: 98680 - RNA, 22 nt, Homo sapiens
ggagaugauuaugaaucacuua

SEQ ID NO: 98681 - RNA, 22 nt, Homo sapiens
ggagauguuuaaccuuuuaucu

SEQ ID NO: 98682 - RNA, 22 nt, Homo sapiens
ggaggcuaguaaaaagguagaa

SEQ ID NO: 98683 - RNA, 22 nt, Homo sapiens
ggagggugagaucaauuuggga

SEQ ID NO: 98684 - RNA, 22 nt, Homo sapiens
ggagguaauaaguuccagugua

SEQ ID NO: 98685 - RNA, 20 nt, Homo sapiens
ggagguguugauuuuucuuu

SEQ ID NO: 98686 - RNA, 21 nt, Homo sapiens
ggaguauaaggcaaaggagug

SEQ ID NO: 98687 - RNA, 22 nt, Homo sapiens
ggagucugaacuggacaaugac

SEQ ID NO: 98688 - RNA, 22 nt, Homo sapiens
ggaguguaauggcgccaucuca

SEQ ID NO: 98689 - RNA, 22 nt, Homo sapiens
ggaguguguaggagaaagguaa

SEQ ID NO: 98690 - RNA, 22 nt, Homo sapiens
ggauacaucuggacagccgaau

SEQ ID NO: 98691 - RNA, 22 nt, Homo sapiens
ggauauguagggcauaucuaca

SEQ ID NO: 98692 - RNA, 22 nt, Homo sapiens
ggaucacagccagcucccagaa

SEQ ID NO: 98693 - RNA, 22 nt, Homo sapiens
ggauuagagauguuauuaagag

SEQ ID NO: 98694 - RNA, 23 nt, Homo sapiens
ggauucaucuguuuguucgcugu

SEQ ID NO: 98695 - RNA, 22 nt, Homo sapiens
ggcaaaaucgcaauuacuuuug

SEQ ID NO: 98696 - RNA, 22 nt, Homo sapiens
ggcaaaauggccagugggucac

SEQ ID NO: 98697 - RNA, 22 nt, Homo sapiens
ggcaacaaagacauuucaacau

SEQ ID NO: 98698 - RNA, 22 nt, Homo sapiens
ggcaacaugccgaaaccacguc

SEQ ID NO: 98699 - RNA, 22 nt, Homo sapiens
ggcaagaaagaaaucaucuguc

SEQ ID NO: 98700 - RNA, 22 nt, Homo sapiens
ggcaagaaccacaauuacuuuu

SEQ ID NO: 98701 - RNA, 18 nt, Homo sapiens
cuuugguccccgcacccu

SEQ ID NO: 98702 - RNA, 22 nt, Homo sapiens
cuuuggugagggauaaauuuca

SEQ ID NO: 98703 - RNA, 22 nt, Homo sapiens
cuuugguuaauaggauauggca

SEQ ID NO: 98704 - RNA, 22 nt, Homo sapiens
cuuugguucuguuuauaugcug

SEQ ID NO: 98705 - RNA, 22 nt, Homo sapiens
cuuugguugugcucuccacuuu

SEQ ID NO: 98706 - RNA, 22 nt, Homo sapiens
cuuugguuuacuuggugcuagu

SEQ ID NO: 98707 - RNA, 21 nt, Homo sapiens
cuuugguuucugacuugcaua

SEQ ID NO: 98708 - RNA, 23 nt, Homo sapiens
cuuuguacagcuugacuacuggg

SEQ ID NO: 98709 - RNA, 22 nt, Homo sapiens
cuuugugcccuucugcccauca

SEQ ID NO: 98710 - RNA, 22 nt, Homo sapiens
cuuuguggggucuuuccucaaa

SEQ ID NO: 98711 - RNA, 21 nt, Homo sapiens
cuuuugcacuccagccugggu

SEQ ID NO: 98712 - RNA, 22 nt, Homo sapiens
cuuuuggcuuaagauugucuug

SEQ ID NO: 98713 - RNA, 22 nt, Homo sapiens
cuuuugugauucuucaguuacu

SEQ ID NO: 98714 - RNA, 22 nt, Homo sapiens
cuuuugugauucuucaguugcu

SEQ ID NO: 98715 - RNA, 20 nt, Homo sapiens
cuuuuugcugugcugggagc

SEQ ID NO: 98716 - RNA, 22 nt, Homo sapiens
cuuuuugguagagcaggugugc

SEQ ID NO: 98717 - RNA, 22 nt, Homo sapiens
gaaagacuuucugcuguggaua

SEQ ID NO: 98718 - RNA, 22 nt, Homo sapiens
gaaagauuuccugagcuagaaa

SEQ ID NO: 98719 - RNA, 21 nt, Homo sapiens
gaaauacugccuuaggagcug

SEQ ID NO: 98720 - RNA, 23 nt, Homo sapiens
gaaauguaagugaugccccacag

SEQ ID NO: 98721 - RNA, 22 nt, Homo sapiens
gaacacaucuuugguuagagga

SEQ ID NO: 98722 - RNA, 22 nt, Homo sapiens
gaacugggguuggguugcgaua

SEQ ID NO: 98723 - RNA, 22 nt, Homo sapiens
gaagaacuaggugagaucuaga

SEQ ID NO: 98724 - RNA, 22 nt, Homo sapiens
gaagacauuugcugcacguccu

SEQ ID NO: 98725 - RNA, 22 nt, Homo sapiens
gaagauguugcuuaccuuggag

SEQ ID NO: 98726 - RNA, 22 nt, Homo sapiens
gaagauucaaccaaaccagaac

SEQ ID NO: 98727 - RNA, 22 nt, Homo sapiens
gaaggcaugcugcauggccaga

SEQ ID NO: 98728 - RNA, 22 nt, Homo sapiens
gaagguaguuuauagauguggu

SEQ ID NO: 98729 - RNA, 22 nt, Homo sapiens
gaagguauauucuguuaaugcu

SEQ ID NO: 98730 - RNA, 22 nt, Homo sapiens
gaaggugcuuggugaaugcauu

SEQ ID NO: 98731 - RNA, 23 nt, Homo sapiens
gaaguaauaaauggauucuuaac

SEQ ID NO: 98732 - RNA, 19 nt, Homo sapiens
gaaguguuguccuccagua

SEQ ID NO: 98733 - RNA, 22 nt, Homo sapiens
gaauacugacuauuucaucugg

SEQ ID NO: 98734 - RNA, 22 nt, Homo sapiens
gaaugcuaaguuuccucccuau

SEQ ID NO: 98735 - RNA, 22 nt, Homo sapiens
gaaugcuaaguuuccucccugu

SEQ ID NO: 98736 - RNA, 22 nt, Homo sapiens
gaaugcuaccagcaucuagugg

SEQ ID NO: 98737 - RNA, 21 nt, Homo sapiens
gaauggcaccauuagcauaua

SEQ ID NO: 98738 - RNA, 22 nt, Homo sapiens
gaaugguaaacuuccaugacug

SEQ ID NO: 98739 - RNA, 20 nt, Homo sapiens
gaaugguuucgggguucuug

SEQ ID NO: 98740 - RNA, 22 nt, Homo sapiens
gacaguuucucaggcuuccuua

SEQ ID NO: 98741 - RNA, 20 nt, Homo sapiens
gacauagagacucucaaaaa

SEQ ID NO: 98742 - RNA, 22 nt, Homo sapiens
gacaucauuaugagauuuaaac

SEQ ID NO: 98743 - RNA, 20 nt, Homo sapiens
gacaugacuaggagauagcc

SEQ ID NO: 98744 - RNA, 22 nt, Homo sapiens
gacauguaaggcucucucuguu

SEQ ID NO: 98745 - RNA, 22 nt, Homo sapiens
gacauguuuucauguauuugga

SEQ ID NO: 98746 - RNA, 22 nt, Homo sapiens
gaccaaagaggcaggcauuaga

SEQ ID NO: 98747 - RNA, 22 nt, Homo sapiens
gacccucuagagggaagcgcuu

SEQ ID NO: 98748 - RNA, 22 nt, Homo sapiens
gaccugagagguacauguauuu

SEQ ID NO: 98749 - RNA, 22 nt, Homo sapiens
gaccuuguagaaucucaugauu

SEQ ID NO: 98750 - RNA, 17 nt, Homo sapiens
gacgaucaucaggaggc

SEQ ID NO: 98751 - RNA, 22 nt, Homo sapiens
uucuugcugaauugugcccuuc

SEQ ID NO: 98752 - RNA, 22 nt, Homo sapiens
uucuugguugcucacacccauc

SEQ ID NO: 98753 - RNA, 18 nt, Homo sapiens
uucuuguguugauauuuu

SEQ ID NO: 98754 - RNA, 21 nt, Homo sapiens
uucuuugcucaguguuagagu

SEQ ID NO: 98755 - RNA, 22 nt, Homo sapiens
uucuuugguacaagggccgacc

SEQ ID NO: 98756 - RNA, 23 nt, Homo sapiens
uugaaaagucaguagccucugau

SEQ ID NO: 98757 - RNA, 22 nt, Homo sapiens
uugaaaguguucacaaugguau

SEQ ID NO: 98758 - RNA, 22 nt, Homo sapiens
uugaaauguguaagcuccgaaa

SEQ ID NO: 98759 - RNA, 22 nt, Homo sapiens
uugaagagaaccgcggcuuauu

SEQ ID NO: 98760 - RNA, 22 nt, Homo sapiens
uugaaggaacgcuguucccuug

SEQ ID NO: 98761 - RNA, 22 nt, Homo sapiens
uugaagguaauugguuuuauga

SEQ ID NO: 98762 - RNA, 22 nt, Homo sapiens
uugaagguagaaguucucaauu

SEQ ID NO: 98763 - RNA, 22 nt, Homo sapiens
uugaagugaagaacaauaucac

SEQ ID NO: 98764 - RNA, 22 nt, Homo sapiens
uugaauagaagguuuuuuguuc

SEQ ID NO: 98765 - RNA, 22 nt, Homo sapiens
uugaaugaauggaaagaagggu

SEQ ID NO: 98766 - RNA, 18 nt, Homo sapiens
uugaaugcgucccagaga

SEQ ID NO: 98767 - RNA, 22 nt, Homo sapiens
uugaaugcguuguguggcccgu

SEQ ID NO: 98768 - RNA, 22 nt, Homo sapiens
uugaauggaauguuggaacuau

SEQ ID NO: 98769 - RNA, 22 nt, Homo sapiens
uugacaaggagugggguugaga

SEQ ID NO: 98770 - RNA, 22 nt, Homo sapiens
uugacaaguuguccaguaugag

SEQ ID NO: 98771 - RNA, 22 nt, Homo sapiens
uugacacuaauuauuauaggug

SEQ ID NO: 98772 - RNA, 22 nt, Homo sapiens
uugacacuuuguaagaaagggg

SEQ ID NO: 98773 - RNA, 20 nt, Homo sapiens
uugacaguggguuguuaaag

SEQ ID NO: 98774 - RNA, 22 nt, Homo sapiens
uugacauaaucauuucacagug

SEQ ID NO: 98775 - RNA, 22 nt, Homo sapiens
uugacauaguuucugaaauaga

SEQ ID NO: 98776 - RNA, 22 nt, Homo sapiens
uugaccucaucacuucccaaag

SEQ ID NO: 98777 - RNA, 22 nt, Homo sapiens
uugacguaggaggauguugaga

SEQ ID NO: 98778 - RNA, 22 nt, Homo sapiens
uugacuuuuaggaggaaaauga

SEQ ID NO: 98779 - RNA, 22 nt, Homo sapiens
uugacuuuuauucacucugcua

SEQ ID NO: 98780 - RNA, 22 nt, Homo sapiens
uugagaagugucuguucauguc

SEQ ID NO: 98781 - RNA, 22 nt, Homo sapiens
uugagacgaagucucacucuug

SEQ ID NO: 98782 - RNA, 22 nt, Homo sapiens
uugagacggagucuugcucuuu

SEQ ID NO: 98783 - RNA, 22 nt, Homo sapiens
uugagacggaguuuugcucuug

SEQ ID NO: 98784 - RNA, 22 nt, Homo sapiens
uugagagaaaaaauuuauuggu

SEQ ID NO: 98785 - RNA, 22 nt, Homo sapiens
uugagagaaaaggccaugccuu

SEQ ID NO: 98786 - RNA, 22 nt, Homo sapiens
uugagaguggaggcuauaucuu

SEQ ID NO: 98787 - RNA, 22 nt, Homo sapiens
uugagauagaauaggaauggga

SEQ ID NO: 98788 - RNA, 22 nt, Homo sapiens
uugagauaggagcuguuguucu

SEQ ID NO: 98789 - RNA, 22 nt, Homo sapiens
uccccugauaccaaccaccaug

SEQ ID NO: 98790 - RNA, 19 nt, Homo sapiens
uccccuguggauaccaaga

SEQ ID NO: 98791 - RNA, 22 nt, Homo sapiens
ucccuagacuccugccuuucag

SEQ ID NO: 98792 - RNA, 22 nt, Homo sapiens
ucccugaaucucagguucugua

SEQ ID NO: 98793 - RNA, 22 nt, Homo sapiens
ucccugagguccuggauuauug

SEQ ID NO: 98794 - RNA, 22 nt, Homo sapiens
ucccuggacagccuugccuggg

SEQ ID NO: 98795 - RNA, 22 nt, Homo sapiens
ucccuguguuccuuuugaauug

SEQ ID NO: 98796 - RNA, 22 nt, Homo sapiens
ucccuguuaggcacagauuuau

SEQ ID NO: 98797 - RNA, 22 nt, Homo sapiens
ucccuuagccaaauccccagcc

SEQ ID NO: 98798 - RNA, 22 nt, Homo sapiens
ucccuuucuggaguuucccaag

SEQ ID NO: 98799 - RNA, 19 nt, Homo sapiens
ucccuuuguauggacauac

SEQ ID NO: 98800 - RNA, 22 nt, Homo sapiens
uccgaguguuagagagcugugu

SEQ ID NO: 98801 - RNA, 22 nt, Homo sapiens
uccuacaugcaguacauucaaa

SEQ ID NO: 98802 - RNA, 22 nt, Homo sapiens
uccugagagcagacccucuaua

SEQ ID NO: 98803 - RNA, 20 nt, Homo sapiens
uccugagauucccaguucuc

SEQ ID NO: 98804 - RNA, 22 nt, Homo sapiens
uccugcauucugaaauacaagu

SEQ ID NO: 98805 - RNA, 22 nt, Homo sapiens
uccuggcuccacuguuuauucc

SEQ ID NO: 98806 - RNA, 22 nt, Homo sapiens
uccuucacucuacaucuuuguu

SEQ ID NO: 98807 - RNA, 22 nt, Homo sapiens
uccuugagucugaacuuuggau

SEQ ID NO: 98808 - RNA, 22 nt, Homo sapiens
uccuugagucuuugcucagaug

SEQ ID NO: 98809 - RNA, 22 nt, Homo sapiens
uccuugcacuaacuuaaggagg

SEQ ID NO: 98810 - RNA, 22 nt, Homo sapiens
uccuugguugauccugugcaga

SEQ ID NO: 98811 - RNA, 22 nt, Homo sapiens
uccuuugguucuugucacccca

SEQ ID NO: 98812 - RNA, 18 nt, Homo sapiens
uccuuuugggguaggaga

SEQ ID NO: 98813 - RNA, 22 nt, Homo sapiens
ucgcaccauugcacuccagcca

SEQ ID NO: 98814 - RNA, 22 nt, Homo sapiens
ucgcauuucccucuguagcuuc

SEQ ID NO: 98815 - RNA, 22 nt, Homo sapiens
ucgcugggaaccagagguaaag

SEQ ID NO: 98816 - RNA, 22 nt, Homo sapiens
ucggcucagugcaagcucugcc

SEQ ID NO: 98817 - RNA, 22 nt, Homo sapiens
ucgugcugugucaucuuguggc

SEQ ID NO: 98818 - RNA, 22 nt, Homo sapiens
ucguggccugugaguccucccc

SEQ ID NO: 98819 - RNA, 22 nt, Homo sapiens
ucuaaaacuagauugugaugau

SEQ ID NO: 98820 - RNA, 22 nt, Homo sapiens
ucuaaggcaccuagagucauca

SEQ ID NO: 98821 - RNA, 17 nt, Homo sapiens
ucuaauaauaugcauuu

SEQ ID NO: 98822 - RNA, 21 nt, Homo sapiens
ucuaccuacugcucacaggcu

SEQ ID NO: 98823 - RNA, 22 nt, Homo sapiens
uggcuguuuauuucaccugggc

SEQ ID NO: 98824 - RNA, 22 nt, Homo sapiens
uggcuguuuauuucaccugggu

SEQ ID NO: 98825 - RNA, 22 nt, Homo sapiens
uggcuuuucauccugggacauu

SEQ ID NO: 98826 - RNA, 22 nt, Homo sapiens
uggcuuuuccaggcauuacgau

SEQ ID NO: 98827 - RNA, 22 nt, Homo sapiens
ugggaagagggagcgauuuugg

SEQ ID NO: 98828 - RNA, 22 nt, Homo sapiens
ugggaagaugcugcuucuuccu

SEQ ID NO: 98829 - RNA, 22 nt, Homo sapiens
ugggaagcugcugaacuacagu

SEQ ID NO: 98830 - RNA, 22 nt, Homo sapiens
ugggaaugaaauuacauagcuu

SEQ ID NO: 98831 - RNA, 22 nt, Homo sapiens
ugggagcauugcauuagaagcc

SEQ ID NO: 98832 - RNA, 22 nt, Homo sapiens
ugggagugugcacaauuucagc

SEQ ID NO: 98833 - RNA, 22 nt, Homo sapiens
ugggauccaugugguuuaagca

SEQ ID NO: 98834 - RNA, 22 nt, Homo sapiens
ugggaucgucaagugaggcucg

SEQ ID NO: 98835 - RNA, 22 nt, Homo sapiens
ugggaugaaaauagcuucuucc

SEQ ID NO: 98836 - RNA, 22 nt, Homo sapiens
ugggcaaaugcuuuuuagucaa

SEQ ID NO: 98837 - RNA, 22 nt, Homo sapiens
ugggcaagagagcaugacccug

SEQ ID NO: 98838 - RNA, 22 nt, Homo sapiens
ugggccgcugcaggaugguccc

SEQ ID NO: 98839 - RNA, 22 nt, Homo sapiens
uggggcuuuuucuuguauucuc

SEQ ID NO: 98840 - RNA, 22 nt, Homo sapiens
uggguaaaucuguuuggggcuc

SEQ ID NO: 98841 - RNA, 22 nt, Homo sapiens
uggguaauggagaaauaaaucu

SEQ ID NO: 98842 - RNA, 22 nt, Homo sapiens
uggguagauaucauaguugccc

SEQ ID NO: 98843 - RNA, 22 nt, Homo sapiens
uggguagucauuggaggguuuu

SEQ ID NO: 98844 - RNA, 19 nt, Homo sapiens
uggguagugaugagacaua

SEQ ID NO: 98845 - RNA, 22 nt, Homo sapiens
uggguaguguaaagcacuccag

SEQ ID NO: 98846 - RNA, 19 nt, Homo sapiens
uggguaguuuucuggcugg

SEQ ID NO: 98847 - RNA, 22 nt, Homo sapiens
ugggugugaccgcucaaggggg

SEQ ID NO: 98848 - RNA, 23 nt, Homo sapiens
uggguucauucuugaagucagug

SEQ ID NO: 98849 - RNA, 22 nt, Homo sapiens
uggguucccugucuguccuuga

SEQ ID NO: 98850 - RNA, 22 nt, Homo sapiens
ugguaagaaaaccauuauuagc

SEQ ID NO: 98851 - RNA, 22 nt, Homo sapiens
ugguaaguuuaacaugcauccc

SEQ ID NO: 98852 - RNA, 22 nt, Homo sapiens
ugguacugucucuauuuuguag

SEQ ID NO: 98853 - RNA, 22 nt, Homo sapiens
ugguacuucaugcucacagaua

SEQ ID NO: 98854 - RNA, 22 nt, Homo sapiens
ugguagugugagucuaaauugg

SEQ ID NO: 98855 - RNA, 22 nt, Homo sapiens
uggucaaaugccaaucuguagu

SEQ ID NO: 98856 - RNA, 22 nt, Homo sapiens
uggucaguugaguccuugccaa

SEQ ID NO: 98857 - RNA, 21 nt, Homo sapiens
uggucaguuuucucacuagga

SEQ ID NO: 98858 - RNA, 22 nt, Homo sapiens
uggucauggaaauagaaugcac

SEQ ID NO: 98859 - RNA, 22 nt, Homo sapiens
ugguccacuaacccucaguauc

SEQ ID NO: 98860 - RNA, 19 nt, Homo sapiens
uggucccccgcaaucucau

SEQ ID NO: 98861 - RNA, 23 nt, Homo sapiens
uggucccguguucuggcuuuagg

SEQ ID NO: 98862 - RNA, 22 nt, Homo sapiens
ugguccuuuccauuggagacac

SEQ ID NO: 98863 - RNA, 22 nt, Homo sapiens
uggucuccuuuguacccugggc

SEQ ID NO: 98864 - RNA, 22 nt, Homo sapiens
uggucuggagagucccgcccag

SEQ ID NO: 98865 - RNA, 22 nt, Homo sapiens
uggugagaaacuagauauuuuu

SEQ ID NO: 98866 - RNA, 22 nt, Homo sapiens
uggugagaaaugagaugcuuuu

SEQ ID NO: 98867 - RNA, 22 nt, Homo sapiens
uggugcaaugaagugaucucaa

SEQ ID NO: 98868 - RNA, 22 nt, Homo sapiens
uggugcuuaaauaaggcuuuca

SEQ ID NO: 98869 - RNA, 22 nt, Homo sapiens
ugguggcuuuucguagguucac

SEQ ID NO: 98870 - RNA, 15 nt, Homo sapiens
uggugguguugagac

SEQ ID NO: 98871 - RNA, 20 nt, Homo sapiens
uggugucuuggaaagagcuc

SEQ ID NO: 98872 - RNA, 22 nt, Homo sapiens
ugguuagucuguguguauauau

SEQ ID NO: 98873 - RNA, 21 nt, Homo sapiens
ugguucaguucguuacgugug

SEQ ID NO: 98874 - RNA, 22 nt, Homo sapiens
ugguucaguugcacaggcuguu

SEQ ID NO: 98875 - RNA, 22 nt, Homo sapiens
ugguuccauauuaauuuuagga

SEQ ID NO: 98876 - RNA, 23 nt, Homo sapiens
ugguuuguaagagauggacugga

SEQ ID NO: 98877 - RNA, 18 nt, Homo sapiens
uguaaacuaccucaaccu

SEQ ID NO: 98878 - RNA, 22 nt, Homo sapiens
caugcauuggucuauuauguga

SEQ ID NO: 98879 - RNA, 22 nt, Homo sapiens
cauggcacagagaauguguucu

SEQ ID NO: 98880 - RNA, 22 nt, Homo sapiens
cauggcacaucuuuucugacua

SEQ ID NO: 98881 - RNA, 22 nt, Homo sapiens
cauggcacugagcagguaugca

SEQ ID NO: 98882 - RNA, 22 nt, Homo sapiens
cauggcacuguaugaaaugugc

SEQ ID NO: 98883 - RNA, 22 nt, Homo sapiens
cauggcucuuugcugcuaaagu

SEQ ID NO: 98884 - RNA, 22 nt, Homo sapiens
cauggcuuuauuuucagcuucu

SEQ ID NO: 98885 - RNA, 22 nt, Homo sapiens
cauggcuuucacaguaaagccu

SEQ ID NO: 98886 - RNA, 22 nt, Homo sapiens
caugggcacugacuugcauucg

SEQ ID NO: 98887 - RNA, 22 nt, Homo sapiens
cauggucaccuuccaaguuauu

SEQ ID NO: 98888 - RNA, 20 nt, Homo sapiens
cauuacacuccaaccugggu

SEQ ID NO: 98889 - RNA, 22 nt, Homo sapiens
cauuacacuuguaagguuuuuc

SEQ ID NO: 98890 - RNA, 22 nt, Homo sapiens
cauuccacauguaggacaauuu

SEQ ID NO: 98891 - RNA, 22 nt, Homo sapiens
cauugcacuccagcccuggcaa

SEQ ID NO: 98892 - RNA, 22 nt, Homo sapiens
cauugcacuccagccuaggcaa

SEQ ID NO: 98893 - RNA, 20 nt, Homo sapiens
cauugcacuccagcuugggc

SEQ ID NO: 98894 - RNA, 22 nt, Homo sapiens
cauugcacuccagcuugggcga

SEQ ID NO: 98895 - RNA, 22 nt, Homo sapiens
cauugcacucuagccucggcaa

SEQ ID NO: 98896 - RNA, 22 nt, Homo sapiens
cauugcacugcuucuugggugu

SEQ ID NO: 98897 - RNA, 22 nt, Homo sapiens
cauugcagauccuucaaaugac

SEQ ID NO: 98898 - RNA, 22 nt, Homo sapiens
cauugcaugccagccugggcaa

SEQ ID NO: 98899 - RNA, 22 nt, Homo sapiens
cauugcauuccagucugggcaa

SEQ ID NO: 98900 - RNA, 22 nt, Homo sapiens
cauugcucuuacagagugagua

SEQ ID NO: 98901 - RNA, 22 nt, Homo sapiens
cauugggugagaacaugcuccu

SEQ ID NO: 98902 - RNA, 22 nt, Homo sapiens
cauugguuaguuaacuuuaaga

SEQ ID NO: 98903 - RNA, 22 nt, Homo sapiens
cauugguuccaguuuguccuua

SEQ ID NO: 98904 - RNA, 22 nt, Homo sapiens
cauugguuuauagauggggaaa

SEQ ID NO: 98905 - RNA, 22 nt, Homo sapiens
cauugucccucaaugacuauga

SEQ ID NO: 98906 - RNA, 22 nt, Homo sapiens
cauuuugcaguuucugucucca

SEQ ID NO: 98907 - RNA, 23 nt, Homo sapiens
ccacaaugguugaacuagauuac

SEQ ID NO: 98908 - RNA, 23 nt, Homo sapiens
ccacacuguuuagaauggcauca

SEQ ID NO: 98909 - RNA, 22 nt, Homo sapiens
ccacaguagucuugggaugggc

SEQ ID NO: 98910 - RNA, 22 nt, Homo sapiens
ccacagucuaugcaacaagguc

SEQ ID NO: 98911 - RNA, 22 nt, Homo sapiens
ccacugcacuccagcccggcaa

SEQ ID NO: 98912 - RNA, 22 nt, Homo sapiens
ccacuguuuaaauggcugagga

SEQ ID NO: 98913 - RNA, 22 nt, Homo sapiens
ccagaguggagccuuugcgagg

SEQ ID NO: 98914 - RNA, 22 nt, Homo sapiens
uuuaaagcuaaaauauguuuau

SEQ ID NO: 98915 - RNA, 22 nt, Homo sapiens
uuuaaggcacuucaugguuuca

SEQ ID NO: 98916 - RNA, 22 nt, Homo sapiens
uuuaaggcaugccuguacaugc

SEQ ID NO: 98917 - RNA, 22 nt, Homo sapiens
uuuaauagcagggacuuccggg

SEQ ID NO: 98918 - RNA, 22 nt, Homo sapiens
uuuaaugcacuaggugguguuc

SEQ ID NO: 98919 - RNA, 22 nt, Homo sapiens
uuuaaugcaucccaaaauguag

SEQ ID NO: 98920 - RNA, 22 nt, Homo sapiens
uuuaaugcugcccagucauggg

SEQ ID NO: 98921 - RNA, 22 nt, Homo sapiens
uuuacaguuuucuaggcuacca

SEQ ID NO: 98922 - RNA, 22 nt, Homo sapiens
uuuacccugaggaaucuauuuu

SEQ ID NO: 98923 - RNA, 22 nt, Homo sapiens
uuuacugucuucagucccucug

SEQ ID NO: 98924 - RNA, 21 nt, Homo sapiens
uuuacuguggacccauugcuu

SEQ ID NO: 98925 - RNA, 19 nt, Homo sapiens
uuuagaucuuuuaugcagc

SEQ ID NO: 98926 - RNA, 22 nt, Homo sapiens
uuuagcacugugauugacaaaa

SEQ ID NO: 98927 - RNA, 22 nt, Homo sapiens
uuuagggcagggacaguucuuc

SEQ ID NO: 98928 - RNA, 22 nt, Homo sapiens
uuuagguaauauuaaguagcug

SEQ ID NO: 98929 - RNA, 22 nt, Homo sapiens
uuuaucaggccuuuggaaaaau

SEQ ID NO: 98930 - RNA, 22 nt, Homo sapiens
uuuauccagccucuagcaaggu

SEQ ID NO: 98931 - RNA, 22 nt, Homo sapiens
uuuaugagguagagugguuuau

SEQ ID NO: 98932 - RNA, 22 nt, Homo sapiens
uuuauucggcuaggagcuucgg

SEQ ID NO: 98933 - RNA, 22 nt, Homo sapiens
uuuauugcucuaaaguugccau

SEQ ID NO: 98934 - RNA, 21 nt, Homo sapiens
uuucacugugaguuuuucugu

SEQ ID NO: 98935 - RNA, 22 nt, Homo sapiens
uuucagcguggggugcugaaga

SEQ ID NO: 98936 - RNA, 22 nt, Homo sapiens
uuucaggcaagggugacccuga

SEQ ID NO: 98937 - RNA, 23 nt, Homo sapiens
uuucaggcaggugaaagaccagc

SEQ ID NO: 98938 - RNA, 22 nt, Homo sapiens
uuucagguauuuaagggccguu

SEQ ID NO: 98939 - RNA, 22 nt, Homo sapiens
uuucauagaucaugcuuuugga

SEQ ID NO: 98940 - RNA, 22 nt, Homo sapiens
uuucauggaauauagucauuuu

SEQ ID NO: 98941 - RNA, 22 nt, Homo sapiens
uuucauggagaaucuucuuacu

SEQ ID NO: 98942 - RNA, 22 nt, Homo sapiens
uuucauggcgaggcuucauggg

SEQ ID NO: 98943 - RNA, 19 nt, Homo sapiens
uuucauguuuuuggugaga

SEQ ID NO: 98944 - RNA, 22 nt, Homo sapiens
uuuccaguuguucuagaaagcu

SEQ ID NO: 98945 - RNA, 22 nt, Homo sapiens
uuucccuuugcuuugucagcca

SEQ ID NO: 98946 - RNA, 21 nt, Homo sapiens
uuuccuggagcguauggcuuc

SEQ ID NO: 98947 - RNA, 22 nt, Homo sapiens
uuuccuguaggaaggaaauaga

SEQ ID NO: 98948 - RNA, 22 nt, Homo sapiens
uuuccuguagggggcaaggccu

SEQ ID NO: 98949 - RNA, 22 nt, Homo sapiens
uuucuacagggcuugccaggua

SEQ ID NO: 98950 - RNA, 22 nt, Homo sapiens
uuucuacagugaacgauuucua

SEQ ID NO: 98951 - RNA, 22 nt, Homo sapiens
uuucucaguguuucaggguagg

SEQ ID NO: 98952 - RNA, 21 nt, Homo sapiens
uuucugggggagcauggcagg

SEQ ID NO: 98953 - RNA, 22 nt, Homo sapiens
uuucuuggagcucuuagggucg

SEQ ID NO: 98954 - RNA, 22 nt, Homo sapiens
uuugaagcuaaggugcuugguu

SEQ ID NO: 98955 - RNA, 19 nt, Homo sapiens
uuugaauauaaugcagcua

SEQ ID NO: 98956 - RNA, 22 nt, Homo sapiens
uuugaaugcaacaaaugcggga

SEQ ID NO: 98957 - RNA, 22 nt, Homo sapiens
uuugaauggaaguuuugugaaa

SEQ ID NO: 98958 - RNA, 22 nt, Homo sapiens
uuugacucacagccuggcugcc

SEQ ID NO: 98959 - RNA, 22 nt, Homo sapiens
uuugagaaugcuaccagagaag

SEQ ID NO: 98960 - RNA, 22 nt, Homo sapiens
uuugagauaucuuccaucagua

SEQ ID NO: 98961 - RNA, 22 nt, Homo sapiens
uuugagcaagaggugacauuau

SEQ ID NO: 98962 - RNA, 22 nt, Homo sapiens
uuugagcauguaguuuaacccu

SEQ ID NO: 98963 - RNA, 23 nt, Homo sapiens
uuugagugugauaaacacuguca

SEQ ID NO: 98964 - RNA, 22 nt, Homo sapiens
uuugauugguguaccugaaagu

SEQ ID NO: 98965 - RNA, 22 nt, Homo sapiens
uuugcacucaguaagugggagc

SEQ ID NO: 98966 - RNA, 22 nt, Homo sapiens
uuugcacuugaaaacacucuca

SEQ ID NO: 98967 - RNA, 22 nt, Homo sapiens
uuugcagagacuuguuaggaau

SEQ ID NO: 98968 - RNA, 22 nt, Homo sapiens
uuugcagagucuuucgcugggc

SEQ ID NO: 98969 - RNA, 22 nt, Homo sapiens
uuugcagugucagcuucugugu

SEQ ID NO: 98970 - RNA, 22 nt, Homo sapiens
uuugcaguuuauuccuggggcu

SEQ ID NO: 98971 - RNA, 22 nt, Homo sapiens
uuugcauaauaagauuagggug

SEQ ID NO: 98972 - RNA, 22 nt, Homo sapiens
uuugcauauguugaaccagccu

SEQ ID NO: 98973 - RNA, 22 nt, Homo sapiens
uuugcugagucauuccaugcug

SEQ ID NO: 98974 - RNA, 22 nt, Homo sapiens
uuugcuucacuguuuggcaaaa

SEQ ID NO: 98975 - RNA, 22 nt, Homo sapiens
uuuggaagaugccacuguauca

SEQ ID NO: 98976 - RNA, 22 nt, Homo sapiens
uuuggaaugaaacagcagagcc

SEQ ID NO: 98977 - RNA, 22 nt, Homo sapiens
uuuggcacuguaaauuucucuu

SEQ ID NO: 98978 - RNA, 22 nt, Homo sapiens
uuuggcagaaaacuaaaaggua

SEQ ID NO: 98979 - RNA, 22 nt, Homo sapiens
uuuggcagaugacccucaaguu

SEQ ID NO: 98980 - RNA, 21 nt, Homo sapiens
uuuggcauuaugucaccagag

SEQ ID NO: 98981 - RNA, 22 nt, Homo sapiens
uuuggccauaauuuuaauuggc

SEQ ID NO: 98982 - RNA, 22 nt, Homo sapiens
uuuggcccugagggauggcaua

SEQ ID NO: 98983 - RNA, 22 nt, Homo sapiens
uuuggcucugugucccacccaa

SEQ ID NO: 98984 - RNA, 22 nt, Homo sapiens
uuuggcuuaagauugacugcaa

SEQ ID NO: 98985 - RNA, 22 nt, Homo sapiens
uuuggcuuugagaagcagugga

SEQ ID NO: 98986 - RNA, 22 nt, Homo sapiens
uuugggaaaugaaguugguaga

SEQ ID NO: 98987 - RNA, 22 nt, Homo sapiens
uuugggaaugguuugucuccca

SEQ ID NO: 98988 - RNA, 22 nt, Homo sapiens
uuugggccaugcuucccgguca

SEQ ID NO: 98989 - RNA, 22 nt, Homo sapiens
uuuggucuuuuauuuaaagcag

SEQ ID NO: 98990 - RNA, 22 nt, Homo sapiens
uggaaguaaucaugagguagca

SEQ ID NO: 98991 - RNA, 22 nt, Homo sapiens
uggaaguagauagauuguguca

SEQ ID NO: 98992 - RNA, 22 nt, Homo sapiens
uggaaguauagauaauugaaag

SEQ ID NO: 98993 - RNA, 22 nt, Homo sapiens
uggaagucuucauuauguauag

SEQ ID NO: 98994 - RNA, 21 nt, Homo sapiens
uggaaguguacaauuauaccc

SEQ ID NO: 98995 - RNA, 22 nt, Homo sapiens
uggaaguuaaauuaguugauga

SEQ ID NO: 98996 - RNA, 22 nt, Homo sapiens
uggaaucuuaggugaaggcuuu

SEQ ID NO: 98997 - RNA, 19 nt, Homo sapiens
uggaaugaaauguuagggg

SEQ ID NO: 98998 - RNA, 19 nt, Homo sapiens
uggaauggauuuaaaugug

SEQ ID NO: 98999 - RNA, 22 nt, Homo sapiens
uggaaugggauuggaaauuuug

SEQ ID NO: 99000 - RNA, 22 nt, Homo sapiens
uggaaugguuggugugauuuua

SEQ ID NO: 99001 - RNA, 22 nt, Homo sapiens
uggaauguauaucguuuuuugu

SEQ ID NO: 99002 - RNA, 22 nt, Homo sapiens
uggaaugucagcuacaagaggg

SEQ ID NO: 99003 - RNA, 22 nt, Homo sapiens
uggaaugucuuuuccccaaagc

SEQ ID NO: 99004 - RNA, 22 nt, Homo sapiens
uggaauguuauggcuuuaaucu

SEQ ID NO: 99005 - RNA, 22 nt, Homo sapiens
uggaauuaauuaaaauauacug

SEQ ID NO: 99006 - RNA, 22 nt, Homo sapiens
uggaauuuacuuauuuaggggc

SEQ ID NO: 99007 - RNA, 22 nt, Homo sapiens
uggaauuuagguugauaguaua

SEQ ID NO: 99008 - RNA, 22 nt, Homo sapiens
uggacaagauagguucuauauu

SEQ ID NO: 99009 - RNA, 22 nt, Homo sapiens
uggacauguacauauguguaug

SEQ ID NO: 99010 - RNA, 20 nt, Homo sapiens
uggaccagagagguggggac

SEQ ID NO: 99011 - RNA, 21 nt, Homo sapiens
uggaccccuuccuugcaccau

SEQ ID NO: 99012 - RNA, 22 nt, Homo sapiens
uggagaacugaugucuccaaga

SEQ ID NO: 99013 - RNA, 22 nt, Homo sapiens
uggagauccuucauuuuggugu

SEQ ID NO: 99014 - RNA, 22 nt, Homo sapiens
uggagauguuuaaaauccacug

SEQ ID NO: 99015 - RNA, 22 nt, Homo sapiens
uggaggacugcagaacugaggc

SEQ ID NO: 99016 - RNA, 22 nt, Homo sapiens
uggagggcuagucauuucuuuu

SEQ ID NO: 99017 - RNA, 22 nt, Homo sapiens
uggaggucauuggaucaugggg

SEQ ID NO: 99018 - RNA, 22 nt, Homo sapiens
uggagucuugaugauuuucaaa

SEQ ID NO: 99019 - RNA, 22 nt, Homo sapiens
uggagugcgugucugaguuuuu

SEQ ID NO: 99020 - RNA, 22 nt, Homo sapiens
uggaguguaauuagccaucagu

SEQ ID NO: 99021 - RNA, 22 nt, Homo sapiens
uggagugucaguuuccagaguu

SEQ ID NO: 99022 - RNA, 20 nt, Homo sapiens
uggaguuugaguucuuggag

SEQ ID NO: 99023 - RNA, 22 nt, Homo sapiens
uggauagaaauguacuguuuuc

SEQ ID NO: 99024 - RNA, 22 nt, Homo sapiens
uggauaguaaagucagauuccc

SEQ ID NO: 99025 - RNA, 22 nt, Homo sapiens
uggauaguucuucuacuagagu

SEQ ID NO: 99026 - RNA, 22 nt, Homo sapiens
uggaucaugcgaggccuccccu

SEQ ID NO: 99027 - RNA, 22 nt, Homo sapiens
uggaucauucuuucuugcaggg

SEQ ID NO: 99028 - RNA, 22 nt, Homo sapiens
uggaucuguucuauuuaucuga

SEQ ID NO: 99029 - RNA, 22 nt, Homo sapiens
uggaugccuaauaaaugcagac

SEQ ID NO: 99030 - RNA, 22 nt, Homo sapiens
uggauugcaaaaucuuuuugag

SEQ ID NO: 99031 - RNA, 22 nt, Homo sapiens
uggcaaaaaaccgcaguugccu

SEQ ID NO: 99032 - RNA, 22 nt, Homo sapiens
uggcaaaaaucacaaguaccuu

SEQ ID NO: 99033 - RNA, 22 nt, Homo sapiens
uggcaaauagcaauaggagggu

SEQ ID NO: 99034 - RNA, 22 nt, Homo sapiens
uggcaaauuccaaaguuaauuc

SEQ ID NO: 99035 - RNA, 22 nt, Homo sapiens
uggcaacaucuggggacauguu

SEQ ID NO: 99036 - RNA, 22 nt, Homo sapiens
uggcaagaaccacaguuacuuu

SEQ ID NO: 99037 - RNA, 22 nt, Homo sapiens
uggcaagaagagcaugagacca

SEQ ID NO: 99038 - RNA, 22 nt, Homo sapiens
uugaaaucuuccacagcccaag

SEQ ID NO: 99039 - RNA, 22 nt, Homo sapiens
uugaaauguuuagaaguuugga

SEQ ID NO: 99040 - RNA, 22 nt, Homo sapiens
uugaagacuaaguuaucaggau

SEQ ID NO: 99041 - RNA, 22 nt, Homo sapiens
uugaaguagaaagacgaaauuu

SEQ ID NO: 99042 - RNA, 22 nt, Homo sapiens
uugaaguagguaccguucaauu

SEQ ID NO: 99043 - RNA, 22 nt, Homo sapiens
uugaaguaguacuuuauuauag

SEQ ID NO: 99044 - RNA, 22 nt, Homo sapiens
uugaaguaugaccgcugagaau

SEQ ID NO: 99045 - RNA, 18 nt, Homo sapiens
uugaauagagccaagcac

SEQ ID NO: 99046 - RNA, 22 nt, Homo sapiens
uugaauaggcucaugcuuauca

SEQ ID NO: 99047 - RNA, 22 nt, Homo sapiens
uugaauagugacuuugauucug

SEQ ID NO: 99048 - RNA, 22 nt, Homo sapiens
uugaaugaaaugaugucauuug

SEQ ID NO: 99049 - RNA, 21 nt, Homo sapiens
uugaaugguuuuccuugggag

SEQ ID NO: 99050 - RNA, 22 nt, Homo sapiens
uugaauguacuuguucucacua

SEQ ID NO: 99051 - RNA, 22 nt, Homo sapiens
uugaaugucuauuaaguuguuu

SEQ ID NO: 99052 - RNA, 22 nt, Homo sapiens
uugacagaccuuggucauaucc

SEQ ID NO: 99053 - RNA, 21 nt, Homo sapiens
uugacagugacagguaaaguu

SEQ ID NO: 99054 - RNA, 22 nt, Homo sapiens
uugacaguugggcagggaaguu

SEQ ID NO: 99055 - RNA, 22 nt, Homo sapiens
uugacauguaaguacucuauag

SEQ ID NO: 99056 - RNA, 22 nt, Homo sapiens
uugacauugcuguaguguccag

SEQ ID NO: 99057 - RNA, 22 nt, Homo sapiens
uugaccaaagaagagucauugc

SEQ ID NO: 99058 - RNA, 22 nt, Homo sapiens
uugaccacugggcacaguaagu

SEQ ID NO: 99059 - RNA, 22 nt, Homo sapiens
uugaccuauguuucuucaucug

SEQ ID NO: 99060 - RNA, 22 nt, Homo sapiens
uugacuacaccaugccaggaac

SEQ ID NO: 99061 - RNA, 22 nt, Homo sapiens
uugacuuagacauucaguugga

SEQ ID NO: 99062 - RNA, 22 nt, Homo sapiens
uugacuucagagcugauucaag

SEQ ID NO: 99063 - RNA, 22 nt, Homo sapiens
uugagaaucuuucgaauguucu

SEQ ID NO: 99064 - RNA, 22 nt, Homo sapiens
uugagacugaacauuuguguac

SEQ ID NO: 99065 - RNA, 22 nt, Homo sapiens
uugagacugagucucgcccugu

SEQ ID NO: 99066 - RNA, 22 nt, Homo sapiens
uugagauacauaauuaugaaug

SEQ ID NO: 99067 - RNA, 22 nt, Homo sapiens
uugagauaggaacucacuaugc

SEQ ID NO: 99068 - RNA, 20 nt, Homo sapiens
uugagaucuguaucugguuu

SEQ ID NO: 99069 - RNA, 22 nt, Homo sapiens
uugagaucuugauauguuugaa

SEQ ID NO: 99070 - RNA, 22 nt, Homo sapiens
uugagaugaagucuugcucucu

SEQ ID NO: 99071 - RNA, 22 nt, Homo sapiens
uugagaugaaguuuugcucuuu

SEQ ID NO: 99072 - RNA, 22 nt, Homo sapiens
uugagauggagcuucacucuug

SEQ ID NO: 99073 - RNA, 22 nt, Homo sapiens
uugagauggagucucacucugc

SEQ ID NO: 99074 - RNA, 22 nt, Homo sapiens
uugagauggagucucacugugu

SEQ ID NO: 99075 - RNA, 22 nt, Homo sapiens
uugagauggagucucgcugugu

SEQ ID NO: 99076 - RNA, 22 nt, Homo sapiens
uugagauggagucucguucugu

SEQ ID NO: 99077 - RNA, 22 nt, Homo sapiens
uugagauggagucuugcucucu

SEQ ID NO: 99078 - RNA, 22 nt, Homo sapiens
uugagauggagucuugcucugu

SEQ ID NO: 99079 - RNA, 22 nt, Homo sapiens
uugagauggaguguugcucugu

SEQ ID NO: 99080 - RNA, 22 nt, Homo sapiens
uugagauguaguuucacuccug

SEQ ID NO: 99081 - RNA, 22 nt, Homo sapiens
uugagauguggguuggugacuu

SEQ ID NO: 99082 - RNA, 22 nt, Homo sapiens
uugagauuauuguguuccuuua

SEQ ID NO: 99083 - RNA, 22 nt, Homo sapiens
uugagcaauccuccugccaugu

SEQ ID NO: 99084 - RNA, 22 nt, Homo sapiens
uugagcacaggaguuugagacc

SEQ ID NO: 99085 - RNA, 22 nt, Homo sapiens
uugagcacaggaguuuugagac

SEQ ID NO: 99086 - RNA, 22 nt, Homo sapiens
uugagcacaguagguuguggcu

SEQ ID NO: 99087 - RNA, 22 nt, Homo sapiens
uugagcacugucugugugcagu

SEQ ID NO: 99088 - RNA, 22 nt, Homo sapiens
uugagcuagggagaucgagguc

SEQ ID NO: 99089 - RNA, 22 nt, Homo sapiens
uugagcucaucaagauagagaa

SEQ ID NO: 99090 - RNA, 22 nt, Homo sapiens
uugagcucaucuucagggguga

SEQ ID NO: 99091 - RNA, 22 nt, Homo sapiens
uugagcuccucucaaccuaagg

SEQ ID NO: 99092 - RNA, 22 nt, Homo sapiens
uugaggacugcuaagcauuuga

SEQ ID NO: 99093 - RNA, 22 nt, Homo sapiens
uugaggacugguugaaagcuuu

SEQ ID NO: 99094 - RNA, 23 nt, Homo sapiens
uugaggcauguaccaucaauauc

SEQ ID NO: 99095 - RNA, 22 nt, Homo sapiens
uugagggaaacauucacaucau

SEQ ID NO: 99096 - RNA, 22 nt, Homo sapiens
uugagggaagccagaggucugc

SEQ ID NO: 99097 - RNA, 22 nt, Homo sapiens
uugagggaggcagggcuugucu

SEQ ID NO: 99098 - RNA, 22 nt, Homo sapiens
uugagggaggccucaguuuaca

SEQ ID NO: 99099 - RNA, 22 nt, Homo sapiens
uugagguaguacuuauuauugg

SEQ ID NO: 99100 - RNA, 22 nt, Homo sapiens
uugagguauuuugucaacugua

SEQ ID NO: 99101 - RNA, 22 nt, Homo sapiens
uugaggucagagguucgagacc

SEQ ID NO: 99102 - RNA, 22 nt, Homo sapiens
uugaggucuucaggaucaggcu

SEQ ID NO: 99103 - RNA, 22 nt, Homo sapiens
uugaggucuuugagcaaacgca

SEQ ID NO: 99104 - RNA, 22 nt, Homo sapiens
uugaggugaagggcagagcagc

SEQ ID NO: 99105 - RNA, 22 nt, Homo sapiens
uugagguggugucuugcucugu

SEQ ID NO: 99106 - RNA, 22 nt, Homo sapiens
uugaguaguaagugguucaccg

SEQ ID NO: 99107 - RNA, 22 nt, Homo sapiens
uugaguccauucgaugcugauu

SEQ ID NO: 99108 - RNA, 22 nt, Homo sapiens
uugaguccccacacuggguccc

SEQ ID NO: 99109 - RNA, 22 nt, Homo sapiens
uugauaagaaaugccaguuugg

SEQ ID NO: 99110 - RNA, 22 nt, Homo sapiens
uugauagacacauauccaugug

SEQ ID NO: 99111 - RNA, 22 nt, Homo sapiens
uugauaugaauggcuguuugug

SEQ ID NO: 99112 - RNA, 22 nt, Homo sapiens
uugauauggcugcuuaccauaa

SEQ ID NO: 99113 - RNA, 22 nt, Homo sapiens
uugauaugguauaagauuucau

SEQ ID NO: 99114 - RNA, 22 nt, Homo sapiens
uugauauguggaauauuuaucu

SEQ ID NO: 99115 - RNA, 22 nt, Homo sapiens
uugauauguuguuggauucacu

SEQ ID NO: 99116 - RNA, 22 nt, Homo sapiens
uugaugauguuucugccuugcc

SEQ ID NO: 99117 - RNA, 22 nt, Homo sapiens
uugauguccaucucuagguaaa

SEQ ID NO: 99118 - RNA, 22 nt, Homo sapiens
uugauuagauccaguugauuga

SEQ ID NO: 99119 - RNA, 23 nt, Homo sapiens
uugcaaagccugaaacucuucag

SEQ ID NO: 99120 - RNA, 22 nt, Homo sapiens
uugcaaaguugccaaggaagga

SEQ ID NO: 99121 - RNA, 18 nt, Homo sapiens
uugcaaauucuucccugu

SEQ ID NO: 99122 - RNA, 22 nt, Homo sapiens
uugcaagaaaugcagauucuca

SEQ ID NO: 99123 - RNA, 22 nt, Homo sapiens
uugcaaugugaugugauuugga

SEQ ID NO: 99124 - RNA, 22 nt, Homo sapiens
uugcacagucuagcuccaccuu

SEQ ID NO: 99125 - RNA, 22 nt, Homo sapiens
uugcacauguugaaccagcaaa

SEQ ID NO: 99126 - RNA, 22 nt, Homo sapiens
uugcacauugauuuuguaucuu

SEQ ID NO: 99127 - RNA, 22 nt, Homo sapiens
uugcacuauaggaaaauguguc

SEQ ID NO: 99128 - RNA, 22 nt, Homo sapiens
uugcacuccagccugggugaca

SEQ ID NO: 99129 - RNA, 22 nt, Homo sapiens
uugcacuccagccuuggggaga

SEQ ID NO: 99130 - RNA, 22 nt, Homo sapiens
uugcacuccagcucuaggugac

SEQ ID NO: 99131 - RNA, 22 nt, Homo sapiens
uugcacuucauguaggccaaag

SEQ ID NO: 99132 - RNA, 22 nt, Homo sapiens
aauagcuguccuuagaagugug

SEQ ID NO: 99133 - RNA, 22 nt, Homo sapiens
aauaguggcuuggacuaaauau

SEQ ID NO: 99134 - RNA, 22 nt, Homo sapiens
aauauagcuauguacaugucca

SEQ ID NO: 99135 - RNA, 22 nt, Homo sapiens
aauaugucuugaaauuggguaa

SEQ ID NO: 99136 - RNA, 19 nt, Homo sapiens
aauauugacaguggugucu

SEQ ID NO: 99137 - RNA, 22 nt, Homo sapiens
aauauugucaaaauggauucca

SEQ ID NO: 99138 - RNA, 21 nt, Homo sapiens
aaucacaguuguucugccuuc

SEQ ID NO: 99139 - RNA, 22 nt, Homo sapiens
aaucaccaugcacuacagccuu

SEQ ID NO: 99140 - RNA, 22 nt, Homo sapiens
aaucagcacacugugcuuucca

SEQ ID NO: 99141 - RNA, 22 nt, Homo sapiens
aaucgcuuuugguaggcaagga

SEQ ID NO: 99142 - RNA, 22 nt, Homo sapiens
aaucucaacacuuugggaggcu

SEQ ID NO: 99143 - RNA, 22 nt, Homo sapiens
aaucucagcauuuugggcugag

SEQ ID NO: 99144 - RNA, 22 nt, Homo sapiens
aaugacccugauuggcaaguug

SEQ ID NO: 99145 - RNA, 22 nt, Homo sapiens
aaugacuaagaugguacauuuu

SEQ ID NO: 99146 - RNA, 22 nt, Homo sapiens
aaugacugugauauuuuucuuc

SEQ ID NO: 99147 - RNA, 22 nt, Homo sapiens
aaugaucaauguuugaggugau

SEQ ID NO: 99148 - RNA, 22 nt, Homo sapiens
aaugccaucagagaaaacucuu

SEQ ID NO: 99149 - RNA, 22 nt, Homo sapiens
aaugcuguguuauuucaugacc

SEQ ID NO: 99150 - RNA, 22 nt, Homo sapiens
aauggcagaugaaauugucauu

SEQ ID NO: 99151 - RNA, 22 nt, Homo sapiens
aauggcuauuucaugugguagg

SEQ ID NO: 99152 - RNA, 22 nt, Homo sapiens
aauggcuuucagcuuuucccca

SEQ ID NO: 99153 - RNA, 22 nt, Homo sapiens
aaugugcuguucagaggagucc

SEQ ID NO: 99154 - RNA, 22 nt, Homo sapiens
aaugugcuuucuuucacacagu

SEQ ID NO: 99155 - RNA, 22 nt, Homo sapiens
aaugugcuuugaaaagagcuga

SEQ ID NO: 99156 - RNA, 22 nt, Homo sapiens
aauuacuucuacaccaaccuaa

SEQ ID NO: 99157 - RNA, 22 nt, Homo sapiens
aauucacuuguggcagauccuu

SEQ ID NO: 99158 - RNA, 22 nt, Homo sapiens
aauucugugagauggugcagau

SEQ ID NO: 99159 - RNA, 22 nt, Homo sapiens
aauugaccuaaucugauuacug

SEQ ID NO: 99160 - RNA, 22 nt, Homo sapiens
aauugcacuaagcauaguccag

SEQ ID NO: 99161 - RNA, 22 nt, Homo sapiens
aauugcacuacugcacucccac

SEQ ID NO: 99162 - RNA, 22 nt, Homo sapiens
aauugcuuuuauuuagggccag

SEQ ID NO: 99163 - RNA, 23 nt, Homo sapiens
aauugcuuuugaggacuuaguug

SEQ ID NO: 99164 - RNA, 22 nt, Homo sapiens
aauuggugaccaagggaaggac

SEQ ID NO: 99165 - RNA, 22 nt, Homo sapiens
aauugguuaagauaagaucaua

SEQ ID NO: 99166 - RNA, 22 nt, Homo sapiens
aauuguacucccaucauuccua

SEQ ID NO: 99167 - RNA, 16 nt, Homo sapiens
acaaagcuggcuaucu

SEQ ID NO: 99168 - RNA, 22 nt, Homo sapiens
acaaaguaggcagugggcugga

SEQ ID NO: 99169 - RNA, 20 nt, Homo sapiens
acaaaugcauucugugacau

SEQ ID NO: 99170 - RNA, 22 nt, Homo sapiens
acaagugaauacaggauucucu

SEQ ID NO: 99171 - RNA, 22 nt, Homo sapiens
acaagugcuuuuccuggagaca

SEQ ID NO: 99172 - RNA, 22 nt, Homo sapiens
acacaaugguaaguguuugugu

SEQ ID NO: 99173 - RNA, 22 nt, Homo sapiens
acacaguaaauauugucuccuc

SEQ ID NO: 99174 - RNA, 22 nt, Homo sapiens
acacauacacauaugguguaua

SEQ ID NO: 99175 - RNA, 22 nt, Homo sapiens
acacaugcuccacuguggccuc

SEQ ID NO: 99176 - RNA, 22 nt, Homo sapiens
acacgggugccggcaucagcac

SEQ ID NO: 99177 - RNA, 22 nt, Homo sapiens
acacuguacuuauguuuugcag

SEQ ID NO: 99178 - RNA, 22 nt, Homo sapiens
acacuguagcugagggcaugcg

SEQ ID NO: 99179 - RNA, 23 nt, Homo sapiens
acacuugcugaguaaaucaaaua

SEQ ID NO: 99180 - RNA, 22 nt, Homo sapiens
acacuugcuugcaauagccucc

SEQ ID NO: 99181 - RNA, 22 nt, Homo sapiens
acagaacugggcuugcuuuugg

SEQ ID NO: 99182 - RNA, 22 nt, Homo sapiens
acagaccuauuucaaucauuua

SEQ ID NO: 99183 - RNA, 20 nt, Homo sapiens
acagcacugguuucaagcaa

SEQ ID NO: 99184 - RNA, 20 nt, Homo sapiens
acagcauagccuuuuaaagc

SEQ ID NO: 99185 - RNA, 22 nt, Homo sapiens
acaguaaugggccccuuuuccu

SEQ ID NO: 99186 - RNA, 22 nt, Homo sapiens
acaguacaugauaaauaaggua

SEQ ID NO: 99187 - RNA, 22 nt, Homo sapiens
acaguacuuuuggauuugugaa

SEQ ID NO: 99188 - RNA, 22 nt, Homo sapiens
acaguagaaaacaauggauuug

SEQ ID NO: 99189 - RNA, 22 nt, Homo sapiens
acaguagcgcaaucucggcuca

SEQ ID NO: 99190 - RNA, 22 nt, Homo sapiens
acaguagugggcuacagaauca

SEQ ID NO: 99191 - RNA, 20 nt, Homo sapiens
acaguauguuuggaugcaua

SEQ ID NO: 99192 - RNA, 22 nt, Homo sapiens
acagugacagaaagcugauuau

SEQ ID NO: 99193 - RNA, 22 nt, Homo sapiens
acagugcugucugcuuuggcua

SEQ ID NO: 99194 - RNA, 22 nt, Homo sapiens
acagugcuguggucaugggucu

SEQ ID NO: 99195 - RNA, 22 nt, Homo sapiens
acagugcuucugauaugaugcc

SEQ ID NO: 99196 - RNA, 22 nt, Homo sapiens
acagugcuuucaauguucagua

SEQ ID NO: 99197 - RNA, 19 nt, Homo sapiens
acagugcuuugucagaagc

SEQ ID NO: 99198 - RNA, 23 nt, Homo sapiens
acaguggugugaucuuggcucag

SEQ ID NO: 99199 - RNA, 22 nt, Homo sapiens
acaguguagugacugccaacuu

SEQ ID NO: 99200 - RNA, 22 nt, Homo sapiens
acaguguguguguucaccuaga

SEQ ID NO: 99201 - RNA, 22 nt, Homo sapiens
acaguguuacuugauaguguau

SEQ ID NO: 99202 - RNA, 22 nt, Homo sapiens
acaguguuccuuuguugugacu

SEQ ID NO: 99203 - RNA, 22 nt, Homo sapiens
acauaaagaagcaggacauugu

SEQ ID NO: 99204 - RNA, 22 nt, Homo sapiens
acaucauugggggcuacaggug

SEQ ID NO: 99205 - RNA, 22 nt, Homo sapiens
acaucccaugccuggguacucc

SEQ ID NO: 99206 - RNA, 22 nt, Homo sapiens
acaucccuuucccacccuucac

SEQ ID NO: 99207 - RNA, 22 nt, Homo sapiens
acaugcauccaugugaagagac

SEQ ID NO: 99208 - RNA, 22 nt, Homo sapiens
acaugcauggcaugcauuguac

SEQ ID NO: 99209 - RNA, 22 nt, Homo sapiens
acaugguacugauuuacgaaau

SEQ ID NO: 99210 - RNA, 22 nt, Homo sapiens
acauucagcuguuguuucaaug

SEQ ID NO: 99211 - RNA, 22 nt, Homo sapiens
acauugcagauguguuuaaugu

SEQ ID NO: 99212 - RNA, 19 nt, Homo sapiens
acauugcauuuguaggcuu

SEQ ID NO: 99213 - RNA, 22 nt, Homo sapiens
accaccacucccgcauucuaaa

SEQ ID NO: 99214 - RNA, 17 nt, Homo sapiens
accagugcaugugcuuu

SEQ ID NO: 99215 - RNA, 22 nt, Homo sapiens
accaguuuuuuauacaucuucu

SEQ ID NO: 99216 - RNA, 22 nt, Homo sapiens
accaugcaguccaauaugcaca

SEQ ID NO: 99217 - RNA, 22 nt, Homo sapiens
accauugcacuccuuucugggc

SEQ ID NO: 99218 - RNA, 22 nt, Homo sapiens
acccagaauucagucuuaggcc

SEQ ID NO: 99219 - RNA, 17 nt, Homo sapiens
acccagucuuuuugcac

SEQ ID NO: 99220 - RNA, 22 nt, Homo sapiens
acccaguguucagacuaccugu

SEQ ID NO: 99221 - RNA, 21 nt, Homo sapiens
acccccacaccuccuuaguuc

SEQ ID NO: 99222 - RNA, 22 nt, Homo sapiens
acccggagagcaggcgagaagg

SEQ ID NO: 99223 - RNA, 22 nt, Homo sapiens
agagguuuaauugauucacagu

SEQ ID NO: 99224 - RNA, 22 nt, Homo sapiens
agagguuuugcccucgagauaa

SEQ ID NO: 99225 - RNA, 22 nt, Homo sapiens
agaguaguuuauuaugcuaagg

SEQ ID NO: 99226 - RNA, 22 nt, Homo sapiens
agaguaguuucuauauucuuca

SEQ ID NO: 99227 - RNA, 22 nt, Homo sapiens
agagugcaaagguuggggcugg

SEQ ID NO: 99228 - RNA, 22 nt, Homo sapiens
agagugcaauggcaccaucucg

SEQ ID NO: 99229 - RNA, 22 nt, Homo sapiens
agauauguuuaguuucaaaaug

SEQ ID NO: 99230 - RNA, 22 nt, Homo sapiens
agaucacaguaccguaaggcug

SEQ ID NO: 99231 - RNA, 22 nt, Homo sapiens
agaucacagucuuugguuuuag

SEQ ID NO: 99232 - RNA, 22 nt, Homo sapiens
agaucacucagguuucucccug

SEQ ID NO: 99233 - RNA, 23 nt, Homo sapiens
agaugcaucuggcugcgaggcaa

SEQ ID NO: 99234 - RNA, 18 nt, Homo sapiens
agaugcaugcucacuaca

SEQ ID NO: 99235 - RNA, 22 nt, Homo sapiens
agaugcauugguggcauauuca

SEQ ID NO: 99236 - RNA, 22 nt, Homo sapiens
agaugccucauguucuagguuc

SEQ ID NO: 99237 - RNA, 22 nt, Homo sapiens
agauggauuuuguagccccagc

SEQ ID NO: 99238 - RNA, 23 nt, Homo sapiens
agauggcauuucaguucuuuagg

SEQ ID NO: 99239 - RNA, 22 nt, Homo sapiens
agaugguguuggcugaguguau

SEQ ID NO: 99240 - RNA, 22 nt, Homo sapiens
agaugguuuuguucacagcucu

SEQ ID NO: 99241 - RNA, 22 nt, Homo sapiens
agcaaccuugaauagcccuuuc

SEQ ID NO: 99242 - RNA, 22 nt, Homo sapiens
agcaagacauggcuuccaaaug

SEQ ID NO: 99243 - RNA, 22 nt, Homo sapiens
agcacauauauuucccaaaaca

SEQ ID NO: 99244 - RNA, 22 nt, Homo sapiens
agcaccaugggcugaguaagug

SEQ ID NO: 99245 - RNA, 22 nt, Homo sapiens
agcaccauuucucuaaagcacu

SEQ ID NO: 99246 - RNA, 21 nt, Homo sapiens
agcagaguggcagcucuuuug

SEQ ID NO: 99247 - RNA, 22 nt, Homo sapiens
agcagauguuuagugagcgccu

SEQ ID NO: 99248 - RNA, 22 nt, Homo sapiens
agcagcaauuuuguaugguuua

SEQ ID NO: 99249 - RNA, 22 nt, Homo sapiens
agcagcaugaggggacuucugc

SEQ ID NO: 99250 - RNA, 22 nt, Homo sapiens
agcagcaugcaaauggacuaau

SEQ ID NO: 99251 - RNA, 22 nt, Homo sapiens
agcagcauuaugauauaucuua

SEQ ID NO: 99252 - RNA, 20 nt, Homo sapiens
agcagccacagauuccucag

SEQ ID NO: 99253 - RNA, 22 nt, Homo sapiens
agcaggauuguuacaauaguaa

SEQ ID NO: 99254 - RNA, 22 nt, Homo sapiens
agcaggucuuaacuugugaggu

SEQ ID NO: 99255 - RNA, 22 nt, Homo sapiens
agcagugugaaaugauuuaagg

SEQ ID NO: 99256 - RNA, 22 nt, Homo sapiens
agcaguguggccuuagacccgg

SEQ ID NO: 99257 - RNA, 22 nt, Homo sapiens
agcaucacaugggcugcuuggg

SEQ ID NO: 99258 - RNA, 20 nt, Homo sapiens
agcaucguuguguuauagcc

SEQ ID NO: 99259 - RNA, 22 nt, Homo sapiens
agcauuaguugugaagccuuua

SEQ ID NO: 99260 - RNA, 16 nt, Homo sapiens
agccaccauuuacuug

SEQ ID NO: 99261 - RNA, 22 nt, Homo sapiens
agccaguauuuuauugaggauu

SEQ ID NO: 99262 - RNA, 20 nt, Homo sapiens
agccccauguaaaccacaug

SEQ ID NO: 99263 - RNA, 17 nt, Homo sapiens
agccccauuagcuaguu

SEQ ID NO: 99264 - RNA, 22 nt, Homo sapiens
agccuagagagccacuuugaga

SEQ ID NO: 99265 - RNA, 23 nt, Homo sapiens
agccugguuucccugcuucuccc

SEQ ID NO: 99266 - RNA, 22 nt, Homo sapiens
agcgacauugguugcuuugguu

SEQ ID NO: 99267 - RNA, 19 nt, Homo sapiens
agcuagugcucagcuguca

SEQ ID NO: 99268 - RNA, 22 nt, Homo sapiens
agcuaguguucaccagagguca

SEQ ID NO: 99269 - RNA, 22 nt, Homo sapiens
agcucacagccuagcacuguga

SEQ ID NO: 99270 - RNA, 22 nt, Homo sapiens
agcugcaauguuuaguauaaua

SEQ ID NO: 99271 - RNA, 22 nt, Homo sapiens
agcuggacuugauaaaugaaua

SEQ ID NO: 99272 - RNA, 22 nt, Homo sapiens
agcuggauguggaugacccugu

SEQ ID NO: 99273 - RNA, 22 nt, Homo sapiens
agcuggauuguuuaccuggggc

SEQ ID NO: 99274 - RNA, 22 nt, Homo sapiens
agcuggcuguggagaaaccccu

SEQ ID NO: 99275 - RNA, 20 nt, Homo sapiens
agcuggguguguuggugcau

SEQ ID NO: 99276 - RNA, 22 nt, Homo sapiens
agcugguaguuuucuaguguuu

SEQ ID NO: 99277 - RNA, 22 nt, Homo sapiens
agcugguauuuguuagggaguu

SEQ ID NO: 99278 - RNA, 22 nt, Homo sapiens
agcugguccugugacuugcuuc

SEQ ID NO: 99279 - RNA, 22 nt, Homo sapiens
agcugguucuuugccuuguaga

SEQ ID NO: 99280 - RNA, 22 nt, Homo sapiens
agcugguuuaauaugcugucug

SEQ ID NO: 99281 - RNA, 22 nt, Homo sapiens
agcugguuuauuucuauauccu

SEQ ID NO: 99282 - RNA, 22 nt, Homo sapiens
agcuguguugucugaagucaga

SEQ ID NO: 99283 - RNA, 22 nt, Homo sapiens
agcuguuguacacuuuaccuuu

SEQ ID NO: 99284 - RNA, 20 nt, Homo sapiens
agcuguuguuaaaaaggagg

SEQ ID NO: 99285 - RNA, 20 nt, Homo sapiens
agcuguuguuaugagguuua

SEQ ID NO: 99286 - RNA, 22 nt, Homo sapiens
agcuguuguuuuaagauacuaa

SEQ ID NO: 99287 - RNA, 22 nt, Homo sapiens
agcuuaugcuuggaagagauga

SEQ ID NO: 99288 - RNA, 22 nt, Homo sapiens
agcuucauucugaauagguuga

SEQ ID NO: 99289 - RNA, 22 nt, Homo sapiens
agcuugugauucuccaucaugu

SEQ ID NO: 99290 - RNA, 22 nt, Homo sapiens
agcuugugcuguaugaagggcc

SEQ ID NO: 99291 - RNA, 22 nt, Homo sapiens
agcuuguggugaauacugcuag

SEQ ID NO: 99292 - RNA, 21 nt, Homo sapiens
agcuuguguguaucacagugu

SEQ ID NO: 99293 - RNA, 22 nt, Homo sapiens
agcuuuuugggaggccuuagga

SEQ ID NO: 99294 - RNA, 22 nt, Homo sapiens
aggaaaucuuagcugaggggau

SEQ ID NO: 99295 - RNA, 22 nt, Homo sapiens
aggaagguaaacuaacuugccu

SEQ ID NO: 99296 - RNA, 23 nt, Homo sapiens
aggaauggaaaaccaaguaucau

SEQ ID NO: 99297 - RNA, 22 nt, Homo sapiens
aggaccauuguguagcagacau

SEQ ID NO: 99298 - RNA, 22 nt, Homo sapiens
aggaccccucaucagcaccagu

SEQ ID NO: 99299 - RNA, 22 nt, Homo sapiens
aggagcacaauggucaugugga

SEQ ID NO: 99300 - RNA, 22 nt, Homo sapiens
aggagcacaggacuuugauuau

SEQ ID NO: 99301 - RNA, 22 nt, Homo sapiens
aggagcacuggccuuggaguca

SEQ ID NO: 99302 - RNA, 18 nt, Homo sapiens
aggagcauagugcuauga

SEQ ID NO: 99303 - RNA, 22 nt, Homo sapiens
aggagguagggugugaaacagc

SEQ ID NO: 99304 - RNA, 22 nt, Homo sapiens
aggagguugguaccaucuguuu

SEQ ID NO: 99305 - RNA, 22 nt, Homo sapiens
aggauacugguaugggcugaau

SEQ ID NO: 99306 - RNA, 22 nt, Homo sapiens
aggauaguaaugauagagaggc

SEQ ID NO: 99307 - RNA, 22 nt, Homo sapiens
aggauuagagacuucucuaccu

SEQ ID NO: 99308 - RNA, 22 nt, Homo sapiens
aggcaagaaugcuuguuucacc

SEQ ID NO: 99309 - RNA, 21 nt, Homo sapiens
aggcaagacuuuuagguuugu

SEQ ID NO: 99310 - RNA, 22 nt, Homo sapiens
aggcaagagugacuacgugaaa

SEQ ID NO: 99311 - RNA, 22 nt, Homo sapiens
aggcaagugauagcugcguaau

SEQ ID NO: 99312 - RNA, 22 nt, Homo sapiens
aggcacggugucucaugccugu

SEQ ID NO: 99313 - RNA, 22 nt, Homo sapiens
aggcagaugagguccucagcug

SEQ ID NO: 99314 - RNA, 19 nt, Homo sapiens
auacccacuagguuacuua

SEQ ID NO: 99315 - RNA, 22 nt, Homo sapiens
auacccugucgugagucagaga

SEQ ID NO: 99316 - RNA, 22 nt, Homo sapiens
auacuagucaagaauguaugag

SEQ ID NO: 99317 - RNA, 22 nt, Homo sapiens
auacuaugagauaauaaagacu

SEQ ID NO: 99318 - RNA, 22 nt, Homo sapiens
auacuggcuuuccaauugugau

SEQ ID NO: 99319 - RNA, 21 nt, Homo sapiens
auacuugagacuggguaauuu

SEQ ID NO: 99320 - RNA, 22 nt, Homo sapiens
auagaaucaucugugcacuagu

SEQ ID NO: 99321 - RNA, 22 nt, Homo sapiens
auagaauguaauguaccuccuu

SEQ ID NO: 99322 - RNA, 22 nt, Homo sapiens
auagacacugaaaucccugcca

SEQ ID NO: 99323 - RNA, 20 nt, Homo sapiens
auagaccauugguagguagg

SEQ ID NO: 99324 - RNA, 22 nt, Homo sapiens
auagagcuggcagacacccuua

SEQ ID NO: 99325 - RNA, 22 nt, Homo sapiens
auagaucuauuuauguaucccu

SEQ ID NO: 99326 - RNA, 22 nt, Homo sapiens
auagauucauuugaggagauuu

SEQ ID NO: 99327 - RNA, 22 nt, Homo sapiens
auagcaaugcaagaauggcuua

SEQ ID NO: 99328 - RNA, 21 nt, Homo sapiens
auagcacaucagauuuuauua

SEQ ID NO: 99329 - RNA, 22 nt, Homo sapiens
auagcacaugugcaaauggcug

SEQ ID NO: 99330 - RNA, 22 nt, Homo sapiens
auagcacuuaccacaggcugca

SEQ ID NO: 99331 - RNA, 22 nt, Homo sapiens
auagcagacauuucaaggcagg

SEQ ID NO: 99332 - RNA, 22 nt, Homo sapiens
auagcagaccaccucucccacu

SEQ ID NO: 99333 - RNA, 22 nt, Homo sapiens
auagcagcaccccacuaccuca

SEQ ID NO: 99334 - RNA, 22 nt, Homo sapiens
auagcagcagcuaguagugaua

SEQ ID NO: 99335 - RNA, 22 nt, Homo sapiens
auagcagugugaaaauguacua

SEQ ID NO: 99336 - RNA, 22 nt, Homo sapiens
auagcauagucagcuucgcuga

SEQ ID NO: 99337 - RNA, 22 nt, Homo sapiens
auagcaucauuucuugaaaaga

SEQ ID NO: 99338 - RNA, 22 nt, Homo sapiens
auaggacuauugugaggauuaa

SEQ ID NO: 99339 - RNA, 22 nt, Homo sapiens
auaggagcacgaacucuagugu

SEQ ID NO: 99340 - RNA, 22 nt, Homo sapiens
auaggagugugcacagaguagg

SEQ ID NO: 99341 - RNA, 22 nt, Homo sapiens
auaggcaagaugagguuuuuau

SEQ ID NO: 99342 - RNA, 22 nt, Homo sapiens
auagguuauuagagcaaagcuu

SEQ ID NO: 99343 - RNA, 22 nt, Homo sapiens
auaguauaguugaggauggcau

SEQ ID NO: 99344 - RNA, 22 nt, Homo sapiens
auagucaaaucucauuaccccc

SEQ ID NO: 99345 - RNA, 22 nt, Homo sapiens
auagucaguagucucauaauga

SEQ ID NO: 99346 - RNA, 22 nt, Homo sapiens
auagugaacuuugugagaacaa

SEQ ID NO: 99347 - RNA, 22 nt, Homo sapiens
auagugcagugaugaaccuagg

SEQ ID NO: 99348 - RNA, 21 nt, Homo sapiens
auagugcuagagaguagcagg

SEQ ID NO: 99349 - RNA, 22 nt, Homo sapiens
auagugcugcaauaaacauaca

SEQ ID NO: 99350 - RNA, 22 nt, Homo sapiens
auagugcugcaauuaacauaca

SEQ ID NO: 99351 - RNA, 22 nt, Homo sapiens
auagugcuggaauaaauauacg

SEQ ID NO: 99352 - RNA, 22 nt, Homo sapiens
auagugcugugaugaacauaca

SEQ ID NO: 99353 - RNA, 22 nt, Homo sapiens
auauagcaaugaaagagaugaa

SEQ ID NO: 99354 - RNA, 22 nt, Homo sapiens
auauauguuuucugggaagaaa

SEQ ID NO: 99355 - RNA, 22 nt, Homo sapiens
auaucaacaucgugucauuagu

SEQ ID NO: 99356 - RNA, 22 nt, Homo sapiens
auauccuggagcauuuuugcaa

SEQ ID NO: 99357 - RNA, 17 nt, Homo sapiens
auaugaauuuuggagau

SEQ ID NO: 99358 - RNA, 16 nt, Homo sapiens
auaugacuuuaggagg

SEQ ID NO: 99359 - RNA, 22 nt, Homo sapiens
auaugcacaguggaguacuauu

SEQ ID NO: 99360 - RNA, 21 nt, Homo sapiens
auaugugcuguggaagucagc

SEQ ID NO: 99361 - RNA, 22 nt, Homo sapiens
auauuagcacuaaugucacgau

SEQ ID NO: 99362 - RNA, 22 nt, Homo sapiens
auauuguuggcugcuggcugau

SEQ ID NO: 99363 - RNA, 22 nt, Homo sapiens
aucaaacugcaaggcagcagca

SEQ ID NO: 99364 - RNA, 22 nt, Homo sapiens
aucaaagugaaauauuaguuau

SEQ ID NO: 99365 - RNA, 22 nt, Homo sapiens
aucaaagugaauuaaugagaau

SEQ ID NO: 99366 - RNA, 22 nt, Homo sapiens
aucaaaguuucccagaaguugu

SEQ ID NO: 99367 - RNA, 22 nt, Homo sapiens
aucaagcuacacccuuuggaaa

SEQ ID NO: 99368 - RNA, 22 nt, Homo sapiens
aucaaguaguuauacguaaagg

SEQ ID NO: 99369 - RNA, 22 nt, Homo sapiens
aucacacucaccuucuguccuu

SEQ ID NO: 99370 - RNA, 22 nt, Homo sapiens
aucacagagucacgggcaacuu

SEQ ID NO: 99371 - RNA, 22 nt, Homo sapiens
aucacagauauggguuuaaauc

SEQ ID NO: 99372 - RNA, 22 nt, Homo sapiens
aucacagcuacuccucugucuu

SEQ ID NO: 99373 - RNA, 22 nt, Homo sapiens
aucacagguacuauggcugaca

SEQ ID NO: 99374 - RNA, 22 nt, Homo sapiens
aucacaggucaaaucauuauuu

SEQ ID NO: 99375 - RNA, 22 nt, Homo sapiens
aucacaguuauaacauccuuuu

SEQ ID NO: 99376 - RNA, 22 nt, Homo sapiens
aucacauggccagguaguaauc

SEQ ID NO: 99377 - RNA, 22 nt, Homo sapiens
aucacauggccuagccuaaccu

SEQ ID NO: 99378 - RNA, 22 nt, Homo sapiens
aucaccagaugcuucaagcaga

SEQ ID NO: 99379 - RNA, 19 nt, Homo sapiens
aucaccagucuuuccacug

SEQ ID NO: 99380 - RNA, 22 nt, Homo sapiens
aucaccauguguacauuagacc

SEQ ID NO: 99381 - RNA, 19 nt, Homo sapiens
aucaccauuauuuggaaca

SEQ ID NO: 99382 - RNA, 22 nt, Homo sapiens
aucaccuggaggugaucacuug

SEQ ID NO: 99383 - RNA, 22 nt, Homo sapiens
aucaccuuucccuuucugaauc

SEQ ID NO: 99384 - RNA, 22 nt, Homo sapiens
aucacuaugcaggugucucggg

SEQ ID NO: 99385 - RNA, 22 nt, Homo sapiens
aucacugggagcagccauuaau

SEQ ID NO: 99386 - RNA, 22 nt, Homo sapiens
aucacuggucaugagagaagua

SEQ ID NO: 99387 - RNA, 22 nt, Homo sapiens
aucacuguccacucaucuuucu

SEQ ID NO: 99388 - RNA, 22 nt, Homo sapiens
aucacugugauuucuacugugc

SEQ ID NO: 99389 - RNA, 16 nt, Homo sapiens
aucacuugcuucuuuu

SEQ ID NO: 99390 - RNA, 22 nt, Homo sapiens
aucagaaucucuagaggacugu

SEQ ID NO: 99391 - RNA, 22 nt, Homo sapiens
aucagaaucucuagugggacca

SEQ ID NO: 99392 - RNA, 20 nt, Homo sapiens
aucagagacuaggauugcca

SEQ ID NO: 99393 - RNA, 22 nt, Homo sapiens
aucagaguggguuuuaaaagug

SEQ ID NO: 99394 - RNA, 22 nt, Homo sapiens
aucagauaccuguugggaaaug

SEQ ID NO: 99395 - RNA, 22 nt, Homo sapiens
aucagauggcuaaaacagaaga

SEQ ID NO: 99396 - RNA, 22 nt, Homo sapiens
aucagcagcaugaaaacaggcu

SEQ ID NO: 99397 - RNA, 22 nt, Homo sapiens
aucagcaguguaaaaacggacu

SEQ ID NO: 99398 - RNA, 22 nt, Homo sapiens
aucagcauucccaaaugaugug

SEQ ID NO: 99399 - RNA, 21 nt, Homo sapiens
aucauaugcucacuccuagaa

SEQ ID NO: 99400 - RNA, 22 nt, Homo sapiens
aucauccugucaggagcuguga

SEQ ID NO: 99401 - RNA, 22 nt, Homo sapiens
aucauguaguaagacacauuua

SEQ ID NO: 99402 - RNA, 22 nt, Homo sapiens
aucauugugugaguugauggga

SEQ ID NO: 99403 - RNA, 22 nt, Homo sapiens
auccacagugucaauguuguga

SEQ ID NO: 99404 - RNA, 22 nt, Homo sapiens
auccacauucauggaccagucc

SEQ ID NO: 99405 - RNA, 22 nt, Homo sapiens
ucagauguuucuuuaacgcaug

SEQ ID NO: 99406 - RNA, 22 nt, Homo sapiens
ucagcaaugaccuaagcaaaua

SEQ ID NO: 99407 - RNA, 22 nt, Homo sapiens
ucagcaccauguaacaauugau

SEQ ID NO: 99408 - RNA, 19 nt, Homo sapiens
ucagcaguaaucaacuuca

SEQ ID NO: 99409 - RNA, 22 nt, Homo sapiens
ucagcagugagagaccucaccc

SEQ ID NO: 99410 - RNA, 22 nt, Homo sapiens
ucagcaucacgugggcucccgu

SEQ ID NO: 99411 - RNA, 16 nt, Homo sapiens
ucagcgagggagccag

SEQ ID NO: 99412 - RNA, 22 nt, Homo sapiens
ucagcgggaguggaaagucaga

SEQ ID NO: 99413 - RNA, 22 nt, Homo sapiens
ucaggcacuaguaagaaaaagg

SEQ ID NO: 99414 - RNA, 21 nt, Homo sapiens
ucaggcuuuuugagugccaau

SEQ ID NO: 99415 - RNA, 21 nt, Homo sapiens
ucagggaccugcuguacugau

SEQ ID NO: 99416 - RNA, 22 nt, Homo sapiens
ucagguagcuagauuaugugag

SEQ ID NO: 99417 - RNA, 20 nt, Homo sapiens
ucagguagggcuucaacauu

SEQ ID NO: 99418 - RNA, 23 nt, Homo sapiens
ucagguaguuucagaggaccuug

SEQ ID NO: 99419 - RNA, 22 nt, Homo sapiens
ucagguauuucuuuuagcugug

SEQ ID NO: 99420 - RNA, 22 nt, Homo sapiens
ucaggugcagagaagaaauggg

SEQ ID NO: 99421 - RNA, 22 nt, Homo sapiens
ucaguaaaugcuguucucuuuu

SEQ ID NO: 99422 - RNA, 23 nt, Homo sapiens
ucaguacuccacuuucaauagug

SEQ ID NO: 99423 - RNA, 22 nt, Homo sapiens
ucaguagagacaggauuucacc

SEQ ID NO: 99424 - RNA, 22 nt, Homo sapiens
ucaguaguaaauggauuuggaa

SEQ ID NO: 99425 - RNA, 22 nt, Homo sapiens
ucagucauguuuaccagacgua

SEQ ID NO: 99426 - RNA, 22 nt, Homo sapiens
ucagucauucacucacucggac

SEQ ID NO: 99427 - RNA, 22 nt, Homo sapiens
ucaguccccucgcugagucuac

SEQ ID NO: 99428 - RNA, 23 nt, Homo sapiens
ucagugaaggaacaacuaaauag

SEQ ID NO: 99429 - RNA, 22 nt, Homo sapiens
ucagugacugcugcuuguauac

SEQ ID NO: 99430 - RNA, 22 nt, Homo sapiens
ucagugauugcuuucauggaaa

SEQ ID NO: 99431 - RNA, 20 nt, Homo sapiens
ucagugcagauuguccaagu

SEQ ID NO: 99432 - RNA, 22 nt, Homo sapiens
ucagugcuguaccaucuaagga

SEQ ID NO: 99433 - RNA, 22 nt, Homo sapiens
ucagugcuguuugcccucguuu

SEQ ID NO: 99434 - RNA, 22 nt, Homo sapiens
ucaguggacuuagucuuucccc

SEQ ID NO: 99435 - RNA, 22 nt, Homo sapiens
ucaguggauuuaaccugaauca

SEQ ID NO: 99436 - RNA, 22 nt, Homo sapiens
ucagugggcuauguaauuaacu

SEQ ID NO: 99437 - RNA, 22 nt, Homo sapiens
ucaguguugauggcugcugacu

SEQ ID NO: 99438 - RNA, 22 nt, Homo sapiens
ucaguuuguauuucagguugca

SEQ ID NO: 99439 - RNA, 21 nt, Homo sapiens
ucauaagcucaacaucuguag

SEQ ID NO: 99440 - RNA, 18 nt, Homo sapiens
ucauagaucaugacagug

SEQ ID NO: 99441 - RNA, 20 nt, Homo sapiens
ucauagggugguggcagugg

SEQ ID NO: 99442 - RNA, 19 nt, Homo sapiens
ucauagucuaagaugagaa

SEQ ID NO: 99443 - RNA, 21 nt, Homo sapiens
ucauauguaucuuugugccuc

SEQ ID NO: 99444 - RNA, 22 nt, Homo sapiens
ucauauguaugugcaauuuugu

SEQ ID NO: 99445 - RNA, 23 nt, Homo sapiens
ucaucacagcauuuccugguauu

SEQ ID NO: 99446 - RNA, 16 nt, Homo sapiens
ucaucacagucucugg

SEQ ID NO: 99447 - RNA, 22 nt, Homo sapiens
ucaucagguaugucagcggagu

SEQ ID NO: 99448 - RNA, 20 nt, Homo sapiens
ucaucaguuggugcucgcug

SEQ ID NO: 99449 - RNA, 22 nt, Homo sapiens
ucaugacacuggcaggagcuaa

SEQ ID NO: 99450 - RNA, 22 nt, Homo sapiens
ucaugaccaugguauagaccac

SEQ ID NO: 99451 - RNA, 22 nt, Homo sapiens
ucaugcaucuuguggaauuuga

SEQ ID NO: 99452 - RNA, 22 nt, Homo sapiens
ucauggcuuuuauuauguugag

SEQ ID NO: 99453 - RNA, 22 nt, Homo sapiens
ucauggggugagcuacaggcac

SEQ ID NO: 99454 - RNA, 22 nt, Homo sapiens
ucauggggugcuuugcuagauu

SEQ ID NO: 99455 - RNA, 22 nt, Homo sapiens
ucauguauuaucauuagugggu

SEQ ID NO: 99456 - RNA, 19 nt, Homo sapiens
ucaugugcauacauuuggg

SEQ ID NO: 99457 - RNA, 22 nt, Homo sapiens
ucauguguugcacugaggaccu

SEQ ID NO: 99458 - RNA, 22 nt, Homo sapiens
ucauuagagacagggugucacu

SEQ ID NO: 99459 - RNA, 22 nt, Homo sapiens
ucauuagagaucuuggggaaaa

SEQ ID NO: 99460 - RNA, 22 nt, Homo sapiens
ucauuggauggaaugcucugua

SEQ ID NO: 99461 - RNA, 22 nt, Homo sapiens
ucauugguagcucauggaaccg

SEQ ID NO: 99462 - RNA, 22 nt, Homo sapiens
uccaauguaaucaucauugaau

SEQ ID NO: 99463 - RNA, 22 nt, Homo sapiens
uccacaauggcugaacuagauu

SEQ ID NO: 99464 - RNA, 20 nt, Homo sapiens
uccacugagcgucacggcag

SEQ ID NO: 99465 - RNA, 21 nt, Homo sapiens
uccagcuuugagaguuguggu

SEQ ID NO: 99466 - RNA, 22 nt, Homo sapiens
uccagguuuggcuuuauaacuu

SEQ ID NO: 99467 - RNA, 22 nt, Homo sapiens
uccaguguuccucagucacccc

SEQ ID NO: 99468 - RNA, 22 nt, Homo sapiens
uccaguuauccuguggggagga

SEQ ID NO: 99469 - RNA, 22 nt, Homo sapiens
uccaguuguuauuuuuauaaag

SEQ ID NO: 99470 - RNA, 22 nt, Homo sapiens
uccaguuuucuuuccuagggcu

SEQ ID NO: 99471 - RNA, 22 nt, Homo sapiens
uccaguuuuguuaacauauggu

SEQ ID NO: 99472 - RNA, 22 nt, Homo sapiens
uccauaguugcacucuggagcc

SEQ ID NO: 99473 - RNA, 22 nt, Homo sapiens
uccaugaggcuacaguaaucuc

SEQ ID NO: 99474 - RNA, 22 nt, Homo sapiens
uccaugaguccauuagaaaaaa

SEQ ID NO: 99475 - RNA, 22 nt, Homo sapiens
uccauggagacacauuuuauau

SEQ ID NO: 99476 - RNA, 22 nt, Homo sapiens
uccaugugaaaucuaugaggac

SEQ ID NO: 99477 - RNA, 18 nt, Homo sapiens
uccauugcagcauuauuu

SEQ ID NO: 99478 - RNA, 22 nt, Homo sapiens
uccauuuguuguaggguauagu

SEQ ID NO: 99479 - RNA, 19 nt, Homo sapiens
ucccaagaugcucauacau

SEQ ID NO: 99480 - RNA, 16 nt, Homo sapiens
ucccaccauugcuugu

SEQ ID NO: 99481 - RNA, 20 nt, Homo sapiens
ucccaguaggagaaggaagg

SEQ ID NO: 99482 - RNA, 22 nt, Homo sapiens
ucccagugaaaccccaccuuca

SEQ ID NO: 99483 - RNA, 22 nt, Homo sapiens
ucccaguuuuucugaauaguca

SEQ ID NO: 99484 - RNA, 17 nt, Homo sapiens
ucccauguuucuucuac

SEQ ID NO: 99485 - RNA, 22 nt, Homo sapiens
uccccaguaggcaauuaacacc

SEQ ID NO: 99486 - RNA, 22 nt, Homo sapiens
uccccgaggcuggagugcagug

SEQ ID NO: 99487 - RNA, 22 nt, Homo sapiens
uccccugagaccccucagcacu

SEQ ID NO: 99488 - RNA, 20 nt, Homo sapiens
ucccuaagagccuuuccuuc

SEQ ID NO: 99489 - RNA, 22 nt, Homo sapiens
ucccuacugggguacugccuag

SEQ ID NO: 99490 - RNA, 20 nt, Homo sapiens
ucccucaaacuuuuccacug

SEQ ID NO: 99491 - RNA, 22 nt, Homo sapiens
ucccugaagcugcagcaacaca

SEQ ID NO: 99492 - RNA, 22 nt, Homo sapiens
ucccugacagucacagagcuac

SEQ ID NO: 99493 - RNA, 18 nt, Homo sapiens
ucccugacucaaauucuu

SEQ ID NO: 99494 - RNA, 19 nt, Homo sapiens
ucccugagucuuagcuuga

SEQ ID NO: 99495 - RNA, 22 nt, Homo sapiens
ucccuggagcaagagaagaagg

SEQ ID NO: 99496 - RNA, 19 nt, Homo sapiens
ucccuguagaccacagugc

SEQ ID NO: 99497 - RNA, 22 nt, Homo sapiens
ucuuggcaaagaauuuuuggcu

SEQ ID NO: 99498 - RNA, 22 nt, Homo sapiens
ucuuggguuguuggcuucuccu

SEQ ID NO: 99499 - RNA, 20 nt, Homo sapiens
ucuugguuggaggucuuuua

SEQ ID NO: 99500 - RNA, 22 nt, Homo sapiens
ucuugguuuauugauggagagg

SEQ ID NO: 99501 - RNA, 22 nt, Homo sapiens
ucuugucacugcauccccagcu

SEQ ID NO: 99502 - RNA, 17 nt, Homo sapiens
ucuugugguucuugaau

SEQ ID NO: 99503 - RNA, 19 nt, Homo sapiens
ucuuuagucacauuuuuau

SEQ ID NO: 99504 - RNA, 22 nt, Homo sapiens
ucuuuaguuaagggacauuuua

SEQ ID NO: 99505 - RNA, 22 nt, Homo sapiens
ucuuucacuuagcaugauguuu

SEQ ID NO: 99506 - RNA, 22 nt, Homo sapiens
ucuuugagugcccugagucccu

SEQ ID NO: 99507 - RNA, 22 nt, Homo sapiens
ucuuugauguucugaaagaugg

SEQ ID NO: 99508 - RNA, 22 nt, Homo sapiens
ucuuugggauauucugaaaggg

SEQ ID NO: 99509 - RNA, 22 nt, Homo sapiens
ucuuugguaauggaugucugau

SEQ ID NO: 99510 - RNA, 19 nt, Homo sapiens
ucuuugguacgugcuuuga

SEQ ID NO: 99511 - RNA, 22 nt, Homo sapiens
ucuuugguaggaguaggaggcc

SEQ ID NO: 99512 - RNA, 22 nt, Homo sapiens
ucuuuggucagaaagauuacac

SEQ ID NO: 99513 - RNA, 22 nt, Homo sapiens
ucuuuuguaaaaugaggaggug

SEQ ID NO: 99514 - RNA, 22 nt, Homo sapiens
ucuuuuguucuauucaggccuu

SEQ ID NO: 99515 - RNA, 22 nt, Homo sapiens
ucuuuuugagucaguuucggua

SEQ ID NO: 99516 - RNA, 22 nt, Homo sapiens
ugaaacacaccuccucuccauc

SEQ ID NO: 99517 - RNA, 22 nt, Homo sapiens
ugaaacugcagugggcuuggca

SEQ ID NO: 99518 - RNA, 22 nt, Homo sapiens
ugaaagcuacaggaaaguauuu

SEQ ID NO: 99519 - RNA, 22 nt, Homo sapiens
ugaaagcuacagucuccuagga

SEQ ID NO: 99520 - RNA, 22 nt, Homo sapiens
ugaaaguaauugcaguuuuuac

SEQ ID NO: 99521 - RNA, 22 nt, Homo sapiens
ugaaauacuuaauuucuccaug

SEQ ID NO: 99522 - RNA, 22 nt, Homo sapiens
ugaaaugguuaugugaggagau

SEQ ID NO: 99523 - RNA, 22 nt, Homo sapiens
ugaaauuauucuuaccaaggug

SEQ ID NO: 99524 - RNA, 22 nt, Homo sapiens
ugaacacagccugccucugcca

SEQ ID NO: 99525 - RNA, 21 nt, Homo sapiens
ugaacacuggacugagugucc

SEQ ID NO: 99526 - RNA, 22 nt, Homo sapiens
ugaacacuggauaaggagucag

SEQ ID NO: 99527 - RNA, 22 nt, Homo sapiens
ugaacagagaaacacuggccau

SEQ ID NO: 99528 - RNA, 16 nt, Homo sapiens
ugaacagagaggauuc

SEQ ID NO: 99529 - RNA, 22 nt, Homo sapiens
ugaacagucaucucucuuguau

SEQ ID NO: 99530 - RNA, 22 nt, Homo sapiens
ugaacucagcauccagggccaa

SEQ ID NO: 99531 - RNA, 22 nt, Homo sapiens
ugaacuguaagguauaggugau

SEQ ID NO: 99532 - RNA, 22 nt, Homo sapiens
ugaagacucauacuugaaucag

SEQ ID NO: 99533 - RNA, 22 nt, Homo sapiens
ugaaguaauguuuuauucuauu

SEQ ID NO: 99534 - RNA, 22 nt, Homo sapiens
ugaagugggaaaugaguauuaa

SEQ ID NO: 99535 - RNA, 22 nt, Homo sapiens
ugaauacagcacacccaugggu

SEQ ID NO: 99536 - RNA, 22 nt, Homo sapiens
ugaauacuucaaaaaaauagcu

SEQ ID NO: 99537 - RNA, 22 nt, Homo sapiens
ugaauagacagucacugccucc

SEQ ID NO: 99538 - RNA, 21 nt, Homo sapiens
ugaauauuuggguugugucca

SEQ ID NO: 99539 - RNA, 22 nt, Homo sapiens
ugaaucauuucuugucuucagu

SEQ ID NO: 99540 - RNA, 19 nt, Homo sapiens
ugaaugacaucuaaagucc

SEQ ID NO: 99541 - RNA, 22 nt, Homo sapiens
ugaaugguaaagaaaagcacug

SEQ ID NO: 99542 - RNA, 22 nt, Homo sapiens
ugaauguacuuaacacuggauu

SEQ ID NO: 99543 - RNA, 23 nt, Homo sapiens
ugaauguaucgaaugugggaaag

SEQ ID NO: 99544 - RNA, 22 nt, Homo sapiens
ugaauguucuuaaaacccuugu

SEQ ID NO: 99545 - RNA, 22 nt, Homo sapiens
ugaauguuguugguugagauau

SEQ ID NO: 99546 - RNA, 22 nt, Homo sapiens
ugaauuguuuacgagaugugag

SEQ ID NO: 99547 - RNA, 22 nt, Homo sapiens
ugacaacugauuaacuccuuua

SEQ ID NO: 99548 - RNA, 22 nt, Homo sapiens
ugacaagagaccccuccgcagg

SEQ ID NO: 99549 - RNA, 22 nt, Homo sapiens
ugacaagggaaaugcaaaaugu

SEQ ID NO: 99550 - RNA, 22 nt, Homo sapiens
ugacaaguaaacagucagcacc

SEQ ID NO: 99551 - RNA, 22 nt, Homo sapiens
ugacacauguagacaucuggug

SEQ ID NO: 99552 - RNA, 18 nt, Homo sapiens
ugacagcacaugugggga

SEQ ID NO: 99553 - RNA, 22 nt, Homo sapiens
ugacaggauggagaucgguauu

SEQ ID NO: 99554 - RNA, 22 nt, Homo sapiens
ugacaguaucuacagcuucuua

SEQ ID NO: 99555 - RNA, 22 nt, Homo sapiens
ugacagucaccaggacccacag

SEQ ID NO: 99556 - RNA, 22 nt, Homo sapiens
ugacagugaauaagucucuuaa

SEQ ID NO: 99557 - RNA, 22 nt, Homo sapiens
ugacaguguccuccuccugaga

SEQ ID NO: 99558 - RNA, 22 nt, Homo sapiens
ugacagugugagacuuugucuc

SEQ ID NO: 99559 - RNA, 22 nt, Homo sapiens
ugacagugugagauccugucuc

SEQ ID NO: 99560 - RNA, 22 nt, Homo sapiens
ugacaugagauuugggaggggc

SEQ ID NO: 99561 - RNA, 22 nt, Homo sapiens
ugacaugauguuccuacacugu

SEQ ID NO: 99562 - RNA, 22 nt, Homo sapiens
ugacauggugcucuuucaggca

SEQ ID NO: 99563 - RNA, 22 nt, Homo sapiens
ugacauguagagaacuucucau

SEQ ID NO: 99564 - RNA, 21 nt, Homo sapiens
ugacauguugguuugcugcac

SEQ ID NO: 99565 - RNA, 21 nt, Homo sapiens
ugacauuauuucaugucagua

SEQ ID NO: 99566 - RNA, 18 nt, Homo sapiens
ugacauugagcugagaaa

SEQ ID NO: 99567 - RNA, 22 nt, Homo sapiens
ugacauugggagugaagugaag

SEQ ID NO: 99568 - RNA, 22 nt, Homo sapiens
ugacccuguggcagcgucuaag

SEQ ID NO: 99569 - RNA, 22 nt, Homo sapiens
ugaccucugauagcaguaggug

SEQ ID NO: 99570 - RNA, 22 nt, Homo sapiens
ugacggaggacaccugcggaau

SEQ ID NO: 99571 - RNA, 22 nt, Homo sapiens
ugacuaagaugaggucuggaua

SEQ ID NO: 99572 - RNA, 22 nt, Homo sapiens
ugacuaaggaaggauuaugugc

SEQ ID NO: 99573 - RNA, 22 nt, Homo sapiens
ugacuagacuugcaagguugca

SEQ ID NO: 99574 - RNA, 22 nt, Homo sapiens
ugacuagagacagaaacuaaaa

SEQ ID NO: 99575 - RNA, 21 nt, Homo sapiens
ugacuagauuccagauuggcc

SEQ ID NO: 99576 - RNA, 22 nt, Homo sapiens
ugacuagcgauccccuuucuag

SEQ ID NO: 99577 - RNA, 22 nt, Homo sapiens
ugacuaggaaauuagaacuuuu

SEQ ID NO: 99578 - RNA, 21 nt, Homo sapiens
ugacuagggauaugugccacu

SEQ ID NO: 99579 - RNA, 22 nt, Homo sapiens
ugacuagugcccuuugcugccu

SEQ ID NO: 99580 - RNA, 19 nt, Homo sapiens
ugacuauagccugaucagu

SEQ ID NO: 99581 - RNA, 22 nt, Homo sapiens
ugacuauaguuuucuugacaca

SEQ ID NO: 99582 - RNA, 22 nt, Homo sapiens
ugacucaguuguuagucuucau

SEQ ID NO: 99583 - RNA, 23 nt, Homo sapiens
ugacugaguauauguuuggugcu

SEQ ID NO: 99584 - RNA, 18 nt, Homo sapiens
ugacuguccagguggacc

SEQ ID NO: 99585 - RNA, 22 nt, Homo sapiens
ugacuucauuuuuggccaugag

SEQ ID NO: 99586 - RNA, 22 nt, Homo sapiens
ugacuugaucauuacacauucu

SEQ ID NO: 99587 - RNA, 22 nt, Homo sapiens
ugagaacagauggcuuuauuau

SEQ ID NO: 99588 - RNA, 19 nt, Homo sapiens
ugaguaucuuuacacaucu

SEQ ID NO: 99589 - RNA, 22 nt, Homo sapiens
ugaguaugaguucaggaaaggc

SEQ ID NO: 99590 - RNA, 22 nt, Homo sapiens
ugaguauguuuaaugugacaau

SEQ ID NO: 99591 - RNA, 22 nt, Homo sapiens
ugaguauguuuagaaguaaagg

SEQ ID NO: 99592 - RNA, 22 nt, Homo sapiens
ugagugaacgcugagaccaaau

SEQ ID NO: 99593 - RNA, 22 nt, Homo sapiens
ugagugaggcugggcagucccu

SEQ ID NO: 99594 - RNA, 22 nt, Homo sapiens
ugaguuaguguggugcuuggaa

SEQ ID NO: 99595 - RNA, 22 nt, Homo sapiens
ugaguucauggucauuugucac

SEQ ID NO: 99596 - RNA, 22 nt, Homo sapiens
ugaguuccuuucccaguccagu

SEQ ID NO: 99597 - RNA, 22 nt, Homo sapiens
ugaguucuuccaccgggaccag

SEQ ID NO: 99598 - RNA, 22 nt, Homo sapiens
ugaguucuuuuagggauauugc

SEQ ID NO: 99599 - RNA, 22 nt, Homo sapiens
ugaguuguagcuauaguuucuu

SEQ ID NO: 99600 - RNA, 23 nt, Homo sapiens
ugauaacagcauaugaagauucu

SEQ ID NO: 99601 - RNA, 22 nt, Homo sapiens
ugauaacauugggggaagcuga

SEQ ID NO: 99602 - RNA, 22 nt, Homo sapiens
ugauaagugaaagugcucuauc

SEQ ID NO: 99603 - RNA, 22 nt, Homo sapiens
ugauaagugagauagcaaguga

SEQ ID NO: 99604 - RNA, 22 nt, Homo sapiens
ugauacugugcauuagaggcua

SEQ ID NO: 99605 - RNA, 22 nt, Homo sapiens
ugauaguugucagugggggacc

SEQ ID NO: 99606 - RNA, 22 nt, Homo sapiens
ugauaucucuugccuccaaaug

SEQ ID NO: 99607 - RNA, 22 nt, Homo sapiens
ugauaugaaagggaaauaagug

SEQ ID NO: 99608 - RNA, 23 nt, Homo sapiens
ugauaugccuaggaguauauuuu

SEQ ID NO: 99609 - RNA, 22 nt, Homo sapiens
ugauaugcuuugaacucucugg

SEQ ID NO: 99610 - RNA, 21 nt, Homo sapiens
ugauaugguagaagagagaca

SEQ ID NO: 99611 - RNA, 22 nt, Homo sapiens
ugauauguaacuacuccuuaua

SEQ ID NO: 99612 - RNA, 22 nt, Homo sapiens
ugauauguguaaacaauguaua

SEQ ID NO: 99613 - RNA, 22 nt, Homo sapiens
ugaucacagcuugacuaaagga

SEQ ID NO: 99614 - RNA, 22 nt, Homo sapiens
ugauccagugcucaguuggagu

SEQ ID NO: 99615 - RNA, 22 nt, Homo sapiens
ugaucuguccaccucagcuucc

SEQ ID NO: 99616 - RNA, 22 nt, Homo sapiens
ugaucugucucggguuaucagu

SEQ ID NO: 99617 - RNA, 22 nt, Homo sapiens
ugaucuguguaacauaggaguc

SEQ ID NO: 99618 - RNA, 22 nt, Homo sapiens
ugaugacauugucacagucuga

SEQ ID NO: 99619 - RNA, 22 nt, Homo sapiens
ugaugacccugcaguucucaag

SEQ ID NO: 99620 - RNA, 21 nt, Homo sapiens
ugaugcuuuucuuaaccuugc

SEQ ID NO: 99621 - RNA, 22 nt, Homo sapiens
ugauggcauuucauguuuguaa

SEQ ID NO: 99622 - RNA, 22 nt, Homo sapiens
ugauggcauuuggaguugggac

SEQ ID NO: 99623 - RNA, 22 nt, Homo sapiens
ugaugguaguucagucaaugua

SEQ ID NO: 99624 - RNA, 22 nt, Homo sapiens
ugaugucuugcaggcacgagau

SEQ ID NO: 99625 - RNA, 22 nt, Homo sapiens
ugauuagagcccaagcuuugaa

SEQ ID NO: 99626 - RNA, 22 nt, Homo sapiens
ugauugacauucuuuggaguau

SEQ ID NO: 99627 - RNA, 20 nt, Homo sapiens
ugauugaccagagcaguuuu

SEQ ID NO: 99628 - RNA, 22 nt, Homo sapiens
ugauuuguuuagugccaaguuu

SEQ ID NO: 99629 - RNA, 22 nt, Homo sapiens
ugcaaaugcugcuauuucucuu

SEQ ID NO: 99630 - RNA, 22 nt, Homo sapiens
ugcaaauguuaguaacaccacu

SEQ ID NO: 99631 - RNA, 22 nt, Homo sapiens
ugcaaauguuauuuugguuucu

SEQ ID NO: 99632 - RNA, 22 nt, Homo sapiens
ugcaacacauugccccugcucu

SEQ ID NO: 99633 - RNA, 22 nt, Homo sapiens
ugcaagaaucagccuaucauua

SEQ ID NO: 99634 - RNA, 21 nt, Homo sapiens
ugcaagaaucaggaagcugcc

SEQ ID NO: 99635 - RNA, 22 nt, Homo sapiens
ugcaagauaggcaguuugcacu

SEQ ID NO: 99636 - RNA, 22 nt, Homo sapiens
ugcaagaugauuucaauugaua

SEQ ID NO: 99637 - RNA, 22 nt, Homo sapiens
ugcaaucaucgcuguuggccac

SEQ ID NO: 99638 - RNA, 17 nt, Homo sapiens
ugcaauuuaagcuagau

SEQ ID NO: 99639 - RNA, 22 nt, Homo sapiens
ugcacacucuguaugagaaucu

SEQ ID NO: 99640 - RNA, 22 nt, Homo sapiens
ugcacaguccagugcccacuga

SEQ ID NO: 99641 - RNA, 23 nt, Homo sapiens
ugcaccacuacacacucuugggu

SEQ ID NO: 99642 - RNA, 22 nt, Homo sapiens
ugcaccacugcaccccagucug

SEQ ID NO: 99643 - RNA, 22 nt, Homo sapiens
ugcagagaaacauuuuguauuu

SEQ ID NO: 99644 - RNA, 16 nt, Homo sapiens
ugcagaguaggugaau

SEQ ID NO: 99645 - RNA, 20 nt, Homo sapiens
ugcagauucaaccaacugug

SEQ ID NO: 99646 - RNA, 23 nt, Homo sapiens
ugcagcacacugaugggucuuga

SEQ ID NO: 99647 - RNA, 20 nt, Homo sapiens
ugcagcacgggcccuuucca

SEQ ID NO: 99648 - RNA, 18 nt, Homo sapiens
ugcagcaucaguacccag

SEQ ID NO: 99649 - RNA, 21 nt, Homo sapiens
ugcagccauucagcccuaugc

SEQ ID NO: 99650 - RNA, 22 nt, Homo sapiens
ugcauaucuucagccgggcacg

SEQ ID NO: 99651 - RNA, 22 nt, Homo sapiens
ugcauauguauacaugugccau

SEQ ID NO: 99652 - RNA, 22 nt, Homo sapiens
ugcauauuuuauaaagauggaa

SEQ ID NO: 99653 - RNA, 22 nt, Homo sapiens
ugcauccauucuagacucaucu

SEQ ID NO: 99654 - RNA, 22 nt, Homo sapiens
ugcaugcaucuuuuauaguagc

SEQ ID NO: 99655 - RNA, 22 nt, Homo sapiens
ugcauggucauacauggcaccc

SEQ ID NO: 99656 - RNA, 22 nt, Homo sapiens
ugcauguucuuacucauacaug

SEQ ID NO: 99657 - RNA, 21 nt, Homo sapiens
ugcauuggagaauguuucuca

SEQ ID NO: 99658 - RNA, 22 nt, Homo sapiens
ugcauuguauuguugacucgcc

SEQ ID NO: 99659 - RNA, 22 nt, Homo sapiens
ugcauuguuuuugguucccagg

SEQ ID NO: 99660 - RNA, 20 nt, Homo sapiens
ugccaagaaaugaggguauu

SEQ ID NO: 99661 - RNA, 22 nt, Homo sapiens
ugccaagaacauuuucuguuuu

SEQ ID NO: 99662 - RNA, 22 nt, Homo sapiens
ugccaaggagucagucccuaga

SEQ ID NO: 99663 - RNA, 22 nt, Homo sapiens
ugccagaugugcccucuccacc

SEQ ID NO: 99664 - RNA, 22 nt, Homo sapiens
ugccaguauuuuauuaagaauu

SEQ ID NO: 99665 - RNA, 22 nt, Homo sapiens
ugccaguauuuuauugaagauu

SEQ ID NO: 99666 - RNA, 22 nt, Homo sapiens
ugccaguauuuuauugaggauu

SEQ ID NO: 99667 - RNA, 22 nt, Homo sapiens
ugccaguauuuuguugaagauu

SEQ ID NO: 99668 - RNA, 22 nt, Homo sapiens
ugccaguauuuuguugaggauu

SEQ ID NO: 99669 - RNA, 22 nt, Homo sapiens
ugccaucauuaauauuaggcau

SEQ ID NO: 99670 - RNA, 22 nt, Homo sapiens
ugccaugaagagaggaagcagu

SEQ ID NO: 99671 - RNA, 22 nt, Homo sapiens
ugccaugaagaucccugaaaug

SEQ ID NO: 99672 - RNA, 22 nt, Homo sapiens
ugccaugucauagguuaagccu

SEQ ID NO: 99673 - RNA, 22 nt, Homo sapiens
ugccuagaaacacuauuucucc

SEQ ID NO: 99674 - RNA, 23 nt, Homo sapiens
ugccuagaccaucagccugaggu

SEQ ID NO: 99675 - RNA, 23 nt, Homo sapiens
ugccuagaugcugcccugggaca

SEQ ID NO: 99676 - RNA, 22 nt, Homo sapiens
ugccuaggcuggagugcagugg

SEQ ID NO: 99677 - RNA, 22 nt, Homo sapiens
ugccuaggcuggaguguagugg

SEQ ID NO: 99678 - RNA, 22 nt, Homo sapiens
ugccuagucuauugagagucuu

SEQ ID NO: 99679 - RNA, 22 nt, Homo sapiens
uggcauggggcagaacauuaca

SEQ ID NO: 99680 - RNA, 22 nt, Homo sapiens
uggcaugggguaguagcgcugg

SEQ ID NO: 99681 - RNA, 22 nt, Homo sapiens
uggcauggucugcccaaguuuc

SEQ ID NO: 99682 - RNA, 22 nt, Homo sapiens
uggcauguaaugcagaaguugc

SEQ ID NO: 99683 - RNA, 22 nt, Homo sapiens
uggcaugucagguuucuggguu

SEQ ID NO: 99684 - RNA, 22 nt, Homo sapiens
uggcauuuucucuguucuuaga

SEQ ID NO: 99685 - RNA, 22 nt, Homo sapiens
uggcauuuuguuuuagaauuag

SEQ ID NO: 99686 - RNA, 18 nt, Homo sapiens
uggccaauggcaaacaga

SEQ ID NO: 99687 - RNA, 22 nt, Homo sapiens
uggccaguugaagacaaugcuc

SEQ ID NO: 99688 - RNA, 22 nt, Homo sapiens
uggccaguuuuuaauugggucu

SEQ ID NO: 99689 - RNA, 20 nt, Homo sapiens
uggcuaaaugaaugauagca

SEQ ID NO: 99690 - RNA, 18 nt, Homo sapiens
uggcuacugaacuagaug

SEQ ID NO: 99691 - RNA, 22 nt, Homo sapiens
uggcuacugaccugcuaggggg

SEQ ID NO: 99692 - RNA, 23 nt, Homo sapiens
uggcuagacguccuuuccugaug

SEQ ID NO: 99693 - RNA, 19 nt, Homo sapiens
uggcuagaggccaggcguu

SEQ ID NO: 99694 - RNA, 22 nt, Homo sapiens
uggcuccguuguacaggcugga

SEQ ID NO: 99695 - RNA, 22 nt, Homo sapiens
uggcucuuucuagacuuaauua

SEQ ID NO: 99696 - RNA, 20 nt, Homo sapiens
uggcucuuugcugcuaaagu

SEQ ID NO: 99697 - RNA, 22 nt, Homo sapiens
uggcuguuguuacuaacaguuc

SEQ ID NO: 99698 - RNA, 22 nt, Homo sapiens
uggcuuuuccuugaaucugccu

SEQ ID NO: 99699 - RNA, 22 nt, Homo sapiens
ugggaacaugaagguuaaagag

SEQ ID NO: 99700 - RNA, 22 nt, Homo sapiens
ugggaagcugcauuuuaacaag

SEQ ID NO: 99701 - RNA, 19 nt, Homo sapiens
ugggaauguaaauuaguuc

SEQ ID NO: 99702 - RNA, 22 nt, Homo sapiens
ugggaugaauacaaugggauca

SEQ ID NO: 99703 - RNA, 22 nt, Homo sapiens
ugggaugaugaaaaggcuuucu

SEQ ID NO: 99704 - RNA, 22 nt, Homo sapiens
ugggaugaugcuugagaauauc

SEQ ID NO: 99705 - RNA, 22 nt, Homo sapiens
ugggaugauguuaaacguacuc

SEQ ID NO: 99706 - RNA, 22 nt, Homo sapiens
ugggauguagccuucuauuuuc

SEQ ID NO: 99707 - RNA, 22 nt, Homo sapiens
uggggcaaugaacauuuuugca

SEQ ID NO: 99708 - RNA, 22 nt, Homo sapiens
ugggguaggcuguauacucugu

SEQ ID NO: 99709 - RNA, 22 nt, Homo sapiens
uggggugugagggagaaagaaa

SEQ ID NO: 99710 - RNA, 22 nt, Homo sapiens
uggguagagaaucaggaucuua

SEQ ID NO: 99711 - RNA, 22 nt, Homo sapiens
uggguaggaccagaaaugcacu

SEQ ID NO: 99712 - RNA, 22 nt, Homo sapiens
uggguaguuuuucagcucuugc

SEQ ID NO: 99713 - RNA, 22 nt, Homo sapiens
ugguaagaggcccugaguuugu

SEQ ID NO: 99714 - RNA, 22 nt, Homo sapiens
ugguaagaucagaacuggaguc

SEQ ID NO: 99715 - RNA, 22 nt, Homo sapiens
ugguaagaucugugagccaggc

SEQ ID NO: 99716 - RNA, 20 nt, Homo sapiens
ugguaauguaagagaggaga

SEQ ID NO: 99717 - RNA, 22 nt, Homo sapiens
ugguauguauacuagcgacacu

SEQ ID NO: 99718 - RNA, 22 nt, Homo sapiens
ugguauguaugauuaacaugga

SEQ ID NO: 99719 - RNA, 22 nt, Homo sapiens
ugguaugucuagauggggaagu

SEQ ID NO: 99720 - RNA, 20 nt, Homo sapiens
uggucaccuucaggagguuc

SEQ ID NO: 99721 - RNA, 22 nt, Homo sapiens
uggucaguugugccucaauucc

SEQ ID NO: 99722 - RNA, 21 nt, Homo sapiens
uggucccauaagauuacaaug

SEQ ID NO: 99723 - RNA, 22 nt, Homo sapiens
ugguccccaauacuucuauaga

SEQ ID NO: 99724 - RNA, 20 nt, Homo sapiens
ugguccccaccaaaucucau

SEQ ID NO: 99725 - RNA, 22 nt, Homo sapiens
uggugagaaaagaugucuuugu

SEQ ID NO: 99726 - RNA, 22 nt, Homo sapiens
uggugccgugguccuggggcca

SEQ ID NO: 99727 - RNA, 17 nt, Homo sapiens
uggugcuugaaaguugc

SEQ ID NO: 99728 - RNA, 22 nt, Homo sapiens
ugguugaucccaucacccaggu

SEQ ID NO: 99729 - RNA, 22 nt, Homo sapiens
uguaaaaagcccagccgcugag

SEQ ID NO: 99730 - RNA, 22 nt, Homo sapiens
uguaaagaaagcuguuguugua

SEQ ID NO: 99731 - RNA, 23 nt, Homo sapiens
uguaaagcuaugaauuauucuuu

SEQ ID NO: 99732 - RNA, 22 nt, Homo sapiens
uguaaaucugguuaauuggaua

SEQ ID NO: 99733 - RNA, 20 nt, Homo sapiens
uguaacaaucuggauguugc

SEQ ID NO: 99734 - RNA, 22 nt, Homo sapiens
uguaagcauuauauaauuguug

SEQ ID NO: 99735 - RNA, 22 nt, Homo sapiens
uguaauuuaaaugauccuugga

SEQ ID NO: 99736 - RNA, 22 nt, Homo sapiens
uguacaaaacaagaugggggua

SEQ ID NO: 99737 - RNA, 22 nt, Homo sapiens
uguacacauaugugggguacau

SEQ ID NO: 99738 - RNA, 22 nt, Homo sapiens
uguacaugggacaggaggagag

SEQ ID NO: 99739 - RNA, 22 nt, Homo sapiens
uguacccuuagagagugaucga

SEQ ID NO: 99740 - RNA, 22 nt, Homo sapiens
uguagauaucuaucaggucaau

SEQ ID NO: 99741 - RNA, 22 nt, Homo sapiens
uguagcaaaucgauacuauugg

SEQ ID NO: 99742 - RNA, 22 nt, Homo sapiens
uguagcuuuugagauuuauauu

SEQ ID NO: 99743 - RNA, 22 nt, Homo sapiens
uguauaacucacauugaaguuu

SEQ ID NO: 99744 - RNA, 22 nt, Homo sapiens
uguauacauguguguucacgca

SEQ ID NO: 99745 - RNA, 22 nt, Homo sapiens
uguauagaucugauucaucucc

SEQ ID NO: 99746 - RNA, 22 nt, Homo sapiens
uguaugguuauuuguggauggu

SEQ ID NO: 99747 - RNA, 22 nt, Homo sapiens
uguauugcuugaagagugaauu

SEQ ID NO: 99748 - RNA, 21 nt, Homo sapiens
ugucaagaugacugcugcggc

SEQ ID NO: 99749 - RNA, 22 nt, Homo sapiens
ugucaaggaaugucauugguuu

SEQ ID NO: 99750 - RNA, 22 nt, Homo sapiens
ugucaaguugugguucaauuuu

SEQ ID NO: 99751 - RNA, 22 nt, Homo sapiens
ugucacccuuuauccauuuccu

SEQ ID NO: 99752 - RNA, 22 nt, Homo sapiens
ugucacguugcuuuucuguugu

SEQ ID NO: 99753 - RNA, 22 nt, Homo sapiens
ugucacugugcagucaugcauu

SEQ ID NO: 99754 - RNA, 22 nt, Homo sapiens
ugucacuuugccuucuggacuu

SEQ ID NO: 99755 - RNA, 22 nt, Homo sapiens
ugucagaaucugagacgacaac

SEQ ID NO: 99756 - RNA, 22 nt, Homo sapiens
ugucagcacaacucagguuccu

SEQ ID NO: 99757 - RNA, 22 nt, Homo sapiens
ugucaggagcaaugauaaauuu

SEQ ID NO: 99758 - RNA, 22 nt, Homo sapiens
ugucaggaugcuccuuuuggcu

SEQ ID NO: 99759 - RNA, 22 nt, Homo sapiens
ugucaguguaugagccccggau

SEQ ID NO: 99760 - RNA, 22 nt, Homo sapiens
ugucauagaugauuuuuuucgg

SEQ ID NO: 99761 - RNA, 23 nt, Homo sapiens
ugucaucaagaugaggucacacu

SEQ ID NO: 99762 - RNA, 19 nt, Homo sapiens
ugucaucaucuuuucuugc

SEQ ID NO: 99763 - RNA, 22 nt, Homo sapiens
ugucaucauuccaucagggcuu

SEQ ID NO: 99764 - RNA, 22 nt, Homo sapiens
ugucaucauuggaaucugccuc

SEQ ID NO: 99765 - RNA, 22 nt, Homo sapiens
ugucaucauuugagagaagaaa

SEQ ID NO: 99766 - RNA, 22 nt, Homo sapiens
ugucaugaaauauguuuuucua

SEQ ID NO: 99767 - RNA, 22 nt, Homo sapiens
ugucauggcauuuguaaacugc

SEQ ID NO: 99768 - RNA, 22 nt, Homo sapiens
ugucauggggaaaauaacagac

SEQ ID NO: 99769 - RNA, 22 nt, Homo sapiens
ugucauggugcucugggcccug

SEQ ID NO: 99770 - RNA, 22 nt, Homo sapiens
augauggaggccgugauggacg

SEQ ID NO: 99771 - RNA, 19 nt, Homo sapiens
augauugucuauggaggaa

SEQ ID NO: 99772 - RNA, 20 nt, Homo sapiens
augcaaacccugcuuugugg

SEQ ID NO: 99773 - RNA, 22 nt, Homo sapiens
augcaacugcacuccagccugg

SEQ ID NO: 99774 - RNA, 22 nt, Homo sapiens
augcaacuugaaauuuuccgga

SEQ ID NO: 99775 - RNA, 22 nt, Homo sapiens
augcaagaaauaucucuuuuuc

SEQ ID NO: 99776 - RNA, 22 nt, Homo sapiens
augcaaggaugguuagauauau

SEQ ID NO: 99777 - RNA, 22 nt, Homo sapiens
augcaauucuagauugauagua

SEQ ID NO: 99778 - RNA, 22 nt, Homo sapiens
augcacauauguacugcccuau

SEQ ID NO: 99779 - RNA, 22 nt, Homo sapiens
augcacauggcuaacuuuuuuc

SEQ ID NO: 99780 - RNA, 22 nt, Homo sapiens
augcacuguauaggaucuugcg

SEQ ID NO: 99781 - RNA, 22 nt, Homo sapiens
augcacuguuuucuugaugaga

SEQ ID NO: 99782 - RNA, 22 nt, Homo sapiens
augcacuuggcaggaugauucc

SEQ ID NO: 99783 - RNA, 22 nt, Homo sapiens
augcagaucacauuuuucuguc

SEQ ID NO: 99784 - RNA, 22 nt, Homo sapiens
augcauaugucuuuauaguggc

SEQ ID NO: 99785 - RNA, 18 nt, Homo sapiens
augcauauuuuaaguugu

SEQ ID NO: 99786 - RNA, 20 nt, Homo sapiens
augccacugagcagugguga

SEQ ID NO: 99787 - RNA, 22 nt, Homo sapiens
augccacugcauaagguuuuca

SEQ ID NO: 99788 - RNA, 22 nt, Homo sapiens
augccacuguuuaugucacuua

SEQ ID NO: 99789 - RNA, 22 nt, Homo sapiens
augccacuucucuaagucaugu

SEQ ID NO: 99790 - RNA, 22 nt, Homo sapiens
augccauugcacuccagccuag

SEQ ID NO: 99791 - RNA, 22 nt, Homo sapiens
augccuagagucaguggaggug

SEQ ID NO: 99792 - RNA, 19 nt, Homo sapiens
augccucaguuuuguacuu

SEQ ID NO: 99793 - RNA, 22 nt, Homo sapiens
augcuggugcuagaaacuggaa

SEQ ID NO: 99794 - RNA, 22 nt, Homo sapiens
auggaaagcuguuccuacacaa

SEQ ID NO: 99795 - RNA, 22 nt, Homo sapiens
auggaacauaacuauuugggga

SEQ ID NO: 99796 - RNA, 22 nt, Homo sapiens
auggaacuggagaugguuauau

SEQ ID NO: 99797 - RNA, 22 nt, Homo sapiens
auggaagaaacgauuuucugga

SEQ ID NO: 99798 - RNA, 22 nt, Homo sapiens
auggaaggagaggaaugaauga

SEQ ID NO: 99799 - RNA, 22 nt, Homo sapiens
auggaaucauccuccugggagc

SEQ ID NO: 99800 - RNA, 22 nt, Homo sapiens
auggacauuaaagcgauguaga

SEQ ID NO: 99801 - RNA, 22 nt, Homo sapiens
auggacguagauucucaaggau

SEQ ID NO: 99802 - RNA, 22 nt, Homo sapiens
auggagaugaacuuggguaaag

SEQ ID NO: 99803 - RNA, 22 nt, Homo sapiens
auggagaugaauaucaucuguu

SEQ ID NO: 99804 - RNA, 22 nt, Homo sapiens
auggagaugugcgaacugagua

SEQ ID NO: 99805 - RNA, 22 nt, Homo sapiens
auggaguguggaacugggaauc

SEQ ID NO: 99806 - RNA, 22 nt, Homo sapiens
auggaguguucugaauccuuug

SEQ ID NO: 99807 - RNA, 22 nt, Homo sapiens
auggaguuuacuuaguguaaua

SEQ ID NO: 99808 - RNA, 22 nt, Homo sapiens
auggauagucucacucacauac

SEQ ID NO: 99809 - RNA, 22 nt, Homo sapiens
auggcaauaauagcuaccauuu

SEQ ID NO: 99810 - RNA, 22 nt, Homo sapiens
auggcaauaugaugcacuguuu

SEQ ID NO: 99811 - RNA, 22 nt, Homo sapiens
auggcaaugcgaugaugacuga

SEQ ID NO: 99812 - RNA, 22 nt, Homo sapiens
auggcacagaguagaugcucaa

SEQ ID NO: 99813 - RNA, 22 nt, Homo sapiens
auggcacucaaucaaguugaga

SEQ ID NO: 99814 - RNA, 22 nt, Homo sapiens
auggcacugauggaaguaccuu

SEQ ID NO: 99815 - RNA, 22 nt, Homo sapiens
auggcacuguguccugggguca

SEQ ID NO: 99816 - RNA, 18 nt, Homo sapiens
auggcagaacaauuuaca

SEQ ID NO: 99817 - RNA, 22 nt, Homo sapiens
auggcaguguaugauuauauua

SEQ ID NO: 99818 - RNA, 22 nt, Homo sapiens
auggcauggugaagucuuugga

SEQ ID NO: 99819 - RNA, 22 nt, Homo sapiens
auggcauggugcaggguuuaag

SEQ ID NO: 99820 - RNA, 22 nt, Homo sapiens
auggcccaguuugcuaucccua

SEQ ID NO: 99821 - RNA, 22 nt, Homo sapiens
auggccgggugcgguggcucac

SEQ ID NO: 99822 - RNA, 22 nt, Homo sapiens
auggccuuuacaauuugguaug

SEQ ID NO: 99823 - RNA, 22 nt, Homo sapiens
auggccuuucuggcacauuucc

SEQ ID NO: 99824 - RNA, 22 nt, Homo sapiens
auggcucuguuccaugugucuu

SEQ ID NO: 99825 - RNA, 22 nt, Homo sapiens
auggcugagugauuucaaacag

SEQ ID NO: 99826 - RNA, 22 nt, Homo sapiens
auggcugugaaaugguaggugg

SEQ ID NO: 99827 - RNA, 22 nt, Homo sapiens
auggcuguuccugggaguucua

SEQ ID NO: 99828 - RNA, 22 nt, Homo sapiens
auggcuguuucugcaaugucua

SEQ ID NO: 99829 - RNA, 22 nt, Homo sapiens
auggcuucuuacucuucugcau

SEQ ID NO: 99830 - RNA, 22 nt, Homo sapiens
auggcuuguuaugcauuaguac

SEQ ID NO: 99831 - RNA, 21 nt, Homo sapiens
augggacuaacugaugggucu

SEQ ID NO: 99832 - RNA, 22 nt, Homo sapiens
augggacugggugccguggagc

SEQ ID NO: 99833 - RNA, 22 nt, Homo sapiens
augggagugugguuagagaccu

SEQ ID NO: 99834 - RNA, 22 nt, Homo sapiens
augggcuaguaaagacaaacuu

SEQ ID NO: 99835 - RNA, 22 nt, Homo sapiens
augggguaggcuugcuguagua

SEQ ID NO: 99836 - RNA, 22 nt, Homo sapiens
augggucuccugaauacagcac

SEQ ID NO: 99837 - RNA, 22 nt, Homo sapiens
augguacuagaguaagaauugu

SEQ ID NO: 99838 - RNA, 22 nt, Homo sapiens
augguacuccagagaagcagaa

SEQ ID NO: 99839 - RNA, 21 nt, Homo sapiens
augguacugucucuggagaua

SEQ ID NO: 99840 - RNA, 22 nt, Homo sapiens
augguagacucucgggucaugg

SEQ ID NO: 99841 - RNA, 22 nt, Homo sapiens
auggucuuuguuucuaauucug

SEQ ID NO: 99842 - RNA, 22 nt, Homo sapiens
augguguccuguuuccccagga

SEQ ID NO: 99843 - RNA, 22 nt, Homo sapiens
auggugugugaauuaaauguua

SEQ ID NO: 99844 - RNA, 22 nt, Homo sapiens
augguugguuaaaucuguguau

SEQ ID NO: 99845 - RNA, 22 nt, Homo sapiens
auguaaacauuuggucuaaauu

SEQ ID NO: 99846 - RNA, 22 nt, Homo sapiens
auguaacuaucugagccauggg

SEQ ID NO: 99847 - RNA, 22 nt, Homo sapiens
auguaguagcagaaaauauuuu

SEQ ID NO: 99848 - RNA, 22 nt, Homo sapiens
auguaguaugaagaagaugcuu

SEQ ID NO: 99849 - RNA, 17 nt, Homo sapiens
auguauacauccaugua

SEQ ID NO: 99850 - RNA, 22 nt, Homo sapiens
auguaugagaguuccagcugau

SEQ ID NO: 99851 - RNA, 22 nt, Homo sapiens
augucacagguccuagccaagu

SEQ ID NO: 99852 - RNA, 20 nt, Homo sapiens
augucagaguguggguacgg

SEQ ID NO: 99853 - RNA, 22 nt, Homo sapiens
augucauagauaaggaagugga

SEQ ID NO: 99854 - RNA, 22 nt, Homo sapiens
augucuuucauagagacccaga

SEQ ID NO: 99855 - RNA, 22 nt, Homo sapiens
augugacugauggagaauaugu

SEQ ID NO: 99856 - RNA, 22 nt, Homo sapiens
augugacuugugaaaaguucag

SEQ ID NO: 99857 - RNA, 22 nt, Homo sapiens
augugcaauggugucaccacau

SEQ ID NO: 99858 - RNA, 18 nt, Homo sapiens
augugcaauuuuguauuu

SEQ ID NO: 99859 - RNA, 22 nt, Homo sapiens
augugcacauucugguaaauau

SEQ ID NO: 99860 - RNA, 22 nt, Homo sapiens
augugcagauguuacaaauugu

SEQ ID NO: 99861 - RNA, 22 nt, Homo sapiens
ccugaugacacgggagauguac

SEQ ID NO: 99862 - RNA, 21 nt, Homo sapiens
ccugaugaccucugagaguua

SEQ ID NO: 99863 - RNA, 22 nt, Homo sapiens
ccugcauugucaaggccaagcc

SEQ ID NO: 99864 - RNA, 22 nt, Homo sapiens
ccuggaagaaaggugcuaaaua

SEQ ID NO: 99865 - RNA, 22 nt, Homo sapiens
ccuucacaggcacugguucaga

SEQ ID NO: 99866 - RNA, 22 nt, Homo sapiens
ccuucauucauuaauuuagccc

SEQ ID NO: 99867 - RNA, 22 nt, Homo sapiens
ccuuggcacuacugacauugua

SEQ ID NO: 99868 - RNA, 19 nt, Homo sapiens
ccuugguuagguauauucc

SEQ ID NO: 99869 - RNA, 19 nt, Homo sapiens
ccuuugguuuccaugacau

SEQ ID NO: 99870 - RNA, 22 nt, Homo sapiens
ccuuuuuguaguggaaguagga

SEQ ID NO: 99871 - RNA, 22 nt, Homo sapiens
cgcccuguagcuagcuagaggu

SEQ ID NO: 99872 - RNA, 22 nt, Homo sapiens
cgcuggugaucuagacccccaa

SEQ ID NO: 99873 - RNA, 22 nt, Homo sapiens
cgugaggaguauuuuuaggugc

SEQ ID NO: 99874 - RNA, 22 nt, Homo sapiens
cguugcacuccagccugggcaa

SEQ ID NO: 99875 - RNA, 16 nt, Homo sapiens
cuaaaaugucuacuug

SEQ ID NO: 99876 - RNA, 22 nt, Homo sapiens
cuaaagucacgauuugugggua

SEQ ID NO: 99877 - RNA, 22 nt, Homo sapiens
cuaacacagagguuuauuucuc

SEQ ID NO: 99878 - RNA, 22 nt, Homo sapiens
cuaagggaggaagcugugcagg

SEQ ID NO: 99879 - RNA, 18 nt, Homo sapiens
cuaauacuauucaacaag

SEQ ID NO: 99880 - RNA, 22 nt, Homo sapiens
cuaauucuguaccuggcacaua

SEQ ID NO: 99881 - RNA, 22 nt, Homo sapiens
cuacagguaugaaagggaguau

SEQ ID NO: 99882 - RNA, 22 nt, Homo sapiens
cuacaguguauuuauggagggu

SEQ ID NO: 99883 - RNA, 21 nt, Homo sapiens
cuacccuguauuagagaaaga

SEQ ID NO: 99884 - RNA, 22 nt, Homo sapiens
cuaccuggguggcucaugacuu

SEQ ID NO: 99885 - RNA, 22 nt, Homo sapiens
cuacuauguagagauauugaau

SEQ ID NO: 99886 - RNA, 22 nt, Homo sapiens
cuacugcacaucaucugaguua

SEQ ID NO: 99887 - RNA, 22 nt, Homo sapiens
cuagaacuagaacugcuggggu

SEQ ID NO: 99888 - RNA, 22 nt, Homo sapiens
cuagaagguaagagcuggaugc

SEQ ID NO: 99889 - RNA, 22 nt, Homo sapiens
cuagagagaagcugugugaccu

SEQ ID NO: 99890 - RNA, 22 nt, Homo sapiens
cuagaguacuuaccacagcaug

SEQ ID NO: 99891 - RNA, 22 nt, Homo sapiens
cuagcacauaguuauucacuca

SEQ ID NO: 99892 - RNA, 22 nt, Homo sapiens
cuagcacauuuaucuuuauaca

SEQ ID NO: 99893 - RNA, 22 nt, Homo sapiens
cuagcaggcaagauaagauuca

SEQ ID NO: 99894 - RNA, 22 nt, Homo sapiens
cuaguaaugucugucuuaugga

SEQ ID NO: 99895 - RNA, 22 nt, Homo sapiens
cuauauacugccugcugauuag

SEQ ID NO: 99896 - RNA, 19 nt, Homo sapiens
cuaugaccaugugauuuuu

SEQ ID NO: 99897 - RNA, 22 nt, Homo sapiens
cuaugcuuucugggcccugggu

SEQ ID NO: 99898 - RNA, 22 nt, Homo sapiens
cuauggcagccacggccuggag

SEQ ID NO: 99899 - RNA, 22 nt, Homo sapiens
cuauggcuguaugacgugcaug

SEQ ID NO: 99900 - RNA, 22 nt, Homo sapiens
cuauggguuauaauucauuagu

SEQ ID NO: 99901 - RNA, 22 nt, Homo sapiens
cuaugguuucuccauaucauca

SEQ ID NO: 99902 - RNA, 22 nt, Homo sapiens
cuauuacuuuuauugaacucag

SEQ ID NO: 99903 - RNA, 22 nt, Homo sapiens
cuauuagguuggugcaaaagua

SEQ ID NO: 99904 - RNA, 22 nt, Homo sapiens
cuauucacaauggugaagauau

SEQ ID NO: 99905 - RNA, 19 nt, Homo sapiens
cuauugcacauagcugaag

SEQ ID NO: 99906 - RNA, 20 nt, Homo sapiens
cucacagacagcuucuuucu

SEQ ID NO: 99907 - RNA, 22 nt, Homo sapiens
cucacagucagaagggacuugc

SEQ ID NO: 99908 - RNA, 22 nt, Homo sapiens
cucacagugacacgaaccccca

SEQ ID NO: 99909 - RNA, 22 nt, Homo sapiens
cucacaugcucaccugguguuc

SEQ ID NO: 99910 - RNA, 22 nt, Homo sapiens
cucaccuugugauccacccacc

SEQ ID NO: 99911 - RNA, 22 nt, Homo sapiens
cucaccuugugauccuccugcc

SEQ ID NO: 99912 - RNA, 22 nt, Homo sapiens
cucacggcccugcgcacuggca

SEQ ID NO: 99913 - RNA, 22 nt, Homo sapiens
cucacugggaccacucugaagu

SEQ ID NO: 99914 - RNA, 22 nt, Homo sapiens
cucacuggguguaaaacaugua

SEQ ID NO: 99915 - RNA, 20 nt, Homo sapiens
cucagauuauucugaagcaa

SEQ ID NO: 99916 - RNA, 22 nt, Homo sapiens
cucagcuacuugggaagcugag

SEQ ID NO: 99917 - RNA, 22 nt, Homo sapiens
cucaguacuugcacagaagaac

SEQ ID NO: 99918 - RNA, 22 nt, Homo sapiens
cucagugucuggggccccaggg

SEQ ID NO: 99919 - RNA, 22 nt, Homo sapiens
cucaguuuugccuuguuuaagg

SEQ ID NO: 99920 - RNA, 22 nt, Homo sapiens
cucauggagaaccucugcuagg

SEQ ID NO: 99921 - RNA, 22 nt, Homo sapiens
cucauggagauagagaauagaa

SEQ ID NO: 99922 - RNA, 22 nt, Homo sapiens
cucauuggcuacugaggcuugu

SEQ ID NO: 99923 - RNA, 22 nt, Homo sapiens
cuccacgugaaugccaaguauu

SEQ ID NO: 99924 - RNA, 22 nt, Homo sapiens
cuccaggugagguuaagggacu

SEQ ID NO: 99925 - RNA, 22 nt, Homo sapiens
cuccaggugucauccaccuccu

SEQ ID NO: 99926 - RNA, 22 nt, Homo sapiens
cuccaguuucagaaucccaugu

SEQ ID NO: 99927 - RNA, 22 nt, Homo sapiens
cuccaugagauuguugaaguag

SEQ ID NO: 99928 - RNA, 22 nt, Homo sapiens
cuccauguggcuaacuuuuaaa

SEQ ID NO: 99929 - RNA, 22 nt, Homo sapiens
cuccauuuaucugaaauuuuau

SEQ ID NO: 99930 - RNA, 22 nt, Homo sapiens
cucccagagccaguuauaggcu

SEQ ID NO: 99931 - RNA, 22 nt, Homo sapiens
cuccuugauuagaguauagagu

SEQ ID NO: 99932 - RNA, 22 nt, Homo sapiens
cucgagagaaaaugcuucacug

SEQ ID NO: 99933 - RNA, 22 nt, Homo sapiens
cucucaagaugcugggauuaca

SEQ ID NO: 99934 - RNA, 21 nt, Homo sapiens
cucucugcuuaugaauaguga

SEQ ID NO: 99935 - RNA, 22 nt, Homo sapiens
cucugagccugagguuccuacu

SEQ ID NO: 99936 - RNA, 22 nt, Homo sapiens
cucugagguuauucguaauauu

SEQ ID NO: 99937 - RNA, 22 nt, Homo sapiens
cucugguggaagcagggggcaa

SEQ ID NO: 99938 - RNA, 15 nt, Homo sapiens
cucugguuuuucuuc

SEQ ID NO: 99939 - RNA, 22 nt, Homo sapiens
cucugguuuuucuuccauuaag

SEQ ID NO: 99940 - RNA, 22 nt, Homo sapiens
cucuuacaguguguggugaaag

SEQ ID NO: 99941 - RNA, 22 nt, Homo sapiens
cucuuggguagauuuugcagag

SEQ ID NO: 99942 - RNA, 22 nt, Homo sapiens
cucuuuaguaagcaguugauga

SEQ ID NO: 99943 - RNA, 22 nt, Homo sapiens
cucuuugaguuccuccuggugu

SEQ ID NO: 99944 - RNA, 22 nt, Homo sapiens
cucuuuggaugccuuaggguua

SEQ ID NO: 99945 - RNA, 19 nt, Homo sapiens
cucuuuggugucucuucuu

SEQ ID NO: 99946 - RNA, 22 nt, Homo sapiens
cucuuuuguuuagcugagaggg

SEQ ID NO: 99947 - RNA, 22 nt, Homo sapiens
cugaaggcagguagaauagaga

SEQ ID NO: 99948 - RNA, 22 nt, Homo sapiens
cugaauagucaacgauggacug

SEQ ID NO: 99949 - RNA, 22 nt, Homo sapiens
cugaaucauugguuaugaguac

SEQ ID NO: 99950 - RNA, 22 nt, Homo sapiens
cugaauguucuggauggaagag

SEQ ID NO: 99951 - RNA, 22 nt, Homo sapiens
cugaauguuucacucugaaaug

SEQ ID NO: 99952 - RNA, 18 nt, Homo sapiens
cuucauugcuguuuugcu

SEQ ID NO: 99953 - RNA, 20 nt, Homo sapiens
cuuccaguggccccaucuuu

SEQ ID NO: 99954 - RNA, 22 nt, Homo sapiens
cuuccauaguuacacccaggga

SEQ ID NO: 99955 - RNA, 21 nt, Homo sapiens
cuucuuggggcagggcagggu

SEQ ID NO: 99956 - RNA, 22 nt, Homo sapiens
cuugaacaaagagauuccauua

SEQ ID NO: 99957 - RNA, 22 nt, Homo sapiens
cuugacaucugucaguuccuca

SEQ ID NO: 99958 - RNA, 22 nt, Homo sapiens
cuugagcauauucuauauuaaa

SEQ ID NO: 99959 - RNA, 22 nt, Homo sapiens
cuugcacuccacuguucuccug

SEQ ID NO: 99960 - RNA, 22 nt, Homo sapiens
cuugcauagaguuauugcccuu

SEQ ID NO: 99961 - RNA, 22 nt, Homo sapiens
cuuggcacugcucacccuccuu

SEQ ID NO: 99962 - RNA, 22 nt, Homo sapiens
cuuggcaugaagaauaauuuuu

SEQ ID NO: 99963 - RNA, 22 nt, Homo sapiens
cuuggcuucuuuauguggcuau

SEQ ID NO: 99964 - RNA, 20 nt, Homo sapiens
cuuggcuuucuugguguuaa

SEQ ID NO: 99965 - RNA, 22 nt, Homo sapiens
cuugguacucugugucccagcu

SEQ ID NO: 99966 - RNA, 18 nt, Homo sapiens
cuugucaaaucuuuccuc

SEQ ID NO: 99967 - RNA, 22 nt, Homo sapiens
cuugucacuguuggcuuuagaa

SEQ ID NO: 99968 - RNA, 22 nt, Homo sapiens
cuugugcaugaccccagguggg

SEQ ID NO: 99969 - RNA, 22 nt, Homo sapiens
cuuuacaguuggacucacgagg

SEQ ID NO: 99970 - RNA, 22 nt, Homo sapiens
cuuuagcaaggauauggggaug

SEQ ID NO: 99971 - RNA, 22 nt, Homo sapiens
cuuuaugagguuggauggaucu

SEQ ID NO: 99972 - RNA, 22 nt, Homo sapiens
cuuuccauuguuggagcauaaa

SEQ ID NO: 99973 - RNA, 22 nt, Homo sapiens
cuuugauuauaaaaggguguuu

SEQ ID NO: 99974 - RNA, 22 nt, Homo sapiens
cuuugcguugaacaaagccaua

SEQ ID NO: 99975 - RNA, 22 nt, Homo sapiens
cuuugcuaauccaacccucauc

SEQ ID NO: 99976 - RNA, 22 nt, Homo sapiens
cuuuggccauagcuaaaugauu

SEQ ID NO: 99977 - RNA, 22 nt, Homo sapiens
cuuuggguauucucccuugggg

SEQ ID NO: 99978 - RNA, 22 nt, Homo sapiens
cuuuggucaauugcugcgggga

SEQ ID NO: 99979 - RNA, 20 nt, Homo sapiens
cuuuggugagucaacuccuu

SEQ ID NO: 99980 - RNA, 22 nt, Homo sapiens
cuuuggugauagauaccccaua

SEQ ID NO: 99981 - RNA, 19 nt, Homo sapiens
cuuugguugagcguguugg

SEQ ID NO: 99982 - RNA, 23 nt, Homo sapiens
cuuuguccccacccaaaucucau

SEQ ID NO: 99983 - RNA, 22 nt, Homo sapiens
cuuugugugggccaagggcugg

SEQ ID NO: 99984 - RNA, 22 nt, Homo sapiens
cuuuuacacuguuagugggaau

SEQ ID NO: 99985 - RNA, 22 nt, Homo sapiens
cuuuuggcuuagaauugucuug

SEQ ID NO: 99986 - RNA, 22 nt, Homo sapiens
cuuuuggugugaagaagcucuu

SEQ ID NO: 99987 - RNA, 22 nt, Homo sapiens
cuuuugugauuccucaguuacu

SEQ ID NO: 99988 - RNA, 22 nt, Homo sapiens
gaaagauuuuaacugggagacu

SEQ ID NO: 99989 - RNA, 22 nt, Homo sapiens
gaaagguaggaacagggugcag

SEQ ID NO: 99990 - RNA, 22 nt, Homo sapiens
gaaagugcugcuugacugggau

SEQ ID NO: 99991 - RNA, 22 nt, Homo sapiens
gaacuuguguugcuucacaugu

SEQ ID NO: 99992 - RNA, 22 nt, Homo sapiens
gaagacauuuacaugggagacc

SEQ ID NO: 99993 - RNA, 22 nt, Homo sapiens
gaagagacagguucccacaaaa

SEQ ID NO: 99994 - RNA, 22 nt, Homo sapiens
gaagcauugauccacaggcgug

SEQ ID NO: 99995 - RNA, 22 nt, Homo sapiens
gaagugcuuuuggacuaacagu

SEQ ID NO: 99996 - RNA, 22 nt, Homo sapiens
gaauagugcugcaaugaacaua

SEQ ID NO: 99997 - RNA, 22 nt, Homo sapiens
gaauagugcugcagcaaacaua

SEQ ID NO: 99998 - RNA, 22 nt, Homo sapiens
gaauagugcugcgauaaacaua

SEQ ID NO: 99999 - RNA, 22 nt, Homo sapiens
gaaucaauugaucuaugugucu

SEQ ID NO: 100000 - RNA, 22 nt, Homo sapiens
gaaucacugugguaucccaugc

SEQ ID NO: 100001 - RNA, 22 nt, Homo sapiens
gaaucccuugcauuaucccuuu

SEQ ID NO: 100002 - RNA, 22 nt, Homo sapiens
gaaugaauguuuauccuuagau

SEQ ID NO: 100003 - RNA, 22 nt, Homo sapiens
gaaugauacuguuaacgaaaga

SEQ ID NO: 100004 - RNA, 22 nt, Homo sapiens
gaaugcaugaggggaucagaug

SEQ ID NO: 100005 - RNA, 22 nt, Homo sapiens
gaaugcuaagcaugugggaguu

SEQ ID NO: 100006 - RNA, 22 nt, Homo sapiens
gaaugguuuacaaguguaaucu

SEQ ID NO: 100007 - RNA, 22 nt, Homo sapiens
gaaugucuuauugcucguugua

SEQ ID NO: 100008 - RNA, 22 nt, Homo sapiens
gaaugugcuguuggcugggcgu

SEQ ID NO: 100009 - RNA, 22 nt, Homo sapiens
gaauuguacugcaaucagggga

SEQ ID NO: 100010 - RNA, 20 nt, Homo sapiens
gacaaaccuagaugguacag

SEQ ID NO: 100011 - RNA, 22 nt, Homo sapiens
gacaagagaacacugcuauauu

SEQ ID NO: 100012 - RNA, 22 nt, Homo sapiens
gacaccugguguggaacuggag

SEQ ID NO: 100013 - RNA, 22 nt, Homo sapiens
gacagacacaauugauccauga

SEQ ID NO: 100014 - RNA, 22 nt, Homo sapiens
gacagagcaagacccuauuuaa

SEQ ID NO: 100015 - RNA, 22 nt, Homo sapiens
gacagugagaugucaugugaaa

SEQ ID NO: 100016 - RNA, 18 nt, Homo sapiens
gacaguguggcaauuccu

SEQ ID NO: 100017 - RNA, 18 nt, Homo sapiens
gacaguguggcgauuccu

SEQ ID NO: 100018 - RNA, 22 nt, Homo sapiens
gacauagcuagauaaccucaug

SEQ ID NO: 100019 - RNA, 17 nt, Homo sapiens
gacauaggaaaaggaga

SEQ ID NO: 100020 - RNA, 19 nt, Homo sapiens
gacaugagauuuggugggg

SEQ ID NO: 100021 - RNA, 16 nt, Homo sapiens
gacaugaucuuguuua

SEQ ID NO: 100022 - RNA, 20 nt, Homo sapiens
gacauggaggaggauuauua

SEQ ID NO: 100023 - RNA, 22 nt, Homo sapiens
gacauuaucagguuuguuuucu

SEQ ID NO: 100024 - RNA, 22 nt, Homo sapiens
gaccacagacuggaaagagggc

SEQ ID NO: 100025 - RNA, 21 nt, Homo sapiens
gaccacagcagggaaugucag

SEQ ID NO: 100026 - RNA, 22 nt, Homo sapiens
gaccacauuccacacaggcuuu

SEQ ID NO: 100027 - RNA, 21 nt, Homo sapiens
gaccuguaguaagcauucaca

SEQ ID NO: 100028 - RNA, 21 nt, Homo sapiens
gacuacaccaggaugcuaguu

SEQ ID NO: 100029 - RNA, 22 nt, Homo sapiens
gacuaggagauauguuuucuuc

SEQ ID NO: 100030 - RNA, 22 nt, Homo sapiens
gacuagggaccaugagcaaucc

SEQ ID NO: 100031 - RNA, 22 nt, Homo sapiens
gacugcagugcagcuguuaggc

SEQ ID NO: 100032 - RNA, 22 nt, Homo sapiens
gacugcauuugccccaucgaau

SEQ ID NO: 100033 - RNA, 22 nt, Homo sapiens
gacuggagcuguaugugguuac

SEQ ID NO: 100034 - RNA, 22 nt, Homo sapiens
gacuggccauugauacagaggu

SEQ ID NO: 100035 - RNA, 22 nt, Homo sapiens
gacuggguuaguuugaaagacu

SEQ ID NO: 100036 - RNA, 20 nt, Homo sapiens
gacuucagaagcuucagagu

SEQ ID NO: 100037 - RNA, 22 nt, Homo sapiens
gacuucaucauacuaugugugg

SEQ ID NO: 100038 - RNA, 22 nt, Homo sapiens
gagaacauacggcauuugguuu

SEQ ID NO: 100039 - RNA, 22 nt, Homo sapiens
gagaacuaaugguuugauaagg

SEQ ID NO: 100040 - RNA, 22 nt, Homo sapiens
gagaacugagugugcuggcgga

SEQ ID NO: 100041 - RNA, 22 nt, Homo sapiens
gagacagugucagccauugaaa

SEQ ID NO: 100042 - RNA, 22 nt, Homo sapiens
gagacauguuugccaauaauuu

SEQ ID NO: 100043 - RNA, 23 nt, Homo sapiens
gagaccagcuucagaaagcacga

SEQ ID NO: 100044 - RNA, 22 nt, Homo sapiens
caaaguaauuacgguuuuggcc

SEQ ID NO: 100045 - RNA, 22 nt, Homo sapiens
caaagucuucaguugauucuga

SEQ ID NO: 100046 - RNA, 22 nt, Homo sapiens
caaagugcugaaagaggccagg

SEQ ID NO: 100047 - RNA, 22 nt, Homo sapiens
caaagugguuuauacaugauug

SEQ ID NO: 100048 - RNA, 22 nt, Homo sapiens
caaaugacaucauuucauucaa

SEQ ID NO: 100049 - RNA, 22 nt, Homo sapiens
caacccgugcagagcgcuuagu

SEQ ID NO: 100050 - RNA, 22 nt, Homo sapiens
caagaucauuuaugcuaaaauu

SEQ ID NO: 100051 - RNA, 22 nt, Homo sapiens
caaggaauucucaauagaguua

SEQ ID NO: 100052 - RNA, 22 nt, Homo sapiens
caaggcacagccccuacuuccu

SEQ ID NO: 100053 - RNA, 22 nt, Homo sapiens
caagggguggaaaugguagugu

SEQ ID NO: 100054 - RNA, 22 nt, Homo sapiens
caagguacuuuuacaauuuccc

SEQ ID NO: 100055 - RNA, 22 nt, Homo sapiens
caaguacugggcuauggauauu

SEQ ID NO: 100056 - RNA, 22 nt, Homo sapiens
caagugaauaguugcucucaga

SEQ ID NO: 100057 - RNA, 21 nt, Homo sapiens
caagugaugcuucugcuuuaa

SEQ ID NO: 100058 - RNA, 22 nt, Homo sapiens
caagugcucuaggauccugagu

SEQ ID NO: 100059 - RNA, 23 nt, Homo sapiens
caauacugaccucacguuaauag

SEQ ID NO: 100060 - RNA, 22 nt, Homo sapiens
caaugcagcuuuuggagagaaa

SEQ ID NO: 100061 - RNA, 21 nt, Homo sapiens
caauggcacgaucuuggcuca

SEQ ID NO: 100062 - RNA, 22 nt, Homo sapiens
cacacuguuuuccauggggguu

SEQ ID NO: 100063 - RNA, 22 nt, Homo sapiens
cacaggaagaggcacggucccu

SEQ ID NO: 100064 - RNA, 22 nt, Homo sapiens
cacagggcuaacauuuuugccc

SEQ ID NO: 100065 - RNA, 22 nt, Homo sapiens
cacaguguuccagcuauuugaa

SEQ ID NO: 100066 - RNA, 21 nt, Homo sapiens
cacauggaggcagagagugua

SEQ ID NO: 100067 - RNA, 22 nt, Homo sapiens
cacauguuuuagcauggcuguu

SEQ ID NO: 100068 - RNA, 22 nt, Homo sapiens
cacauugaauuucugaugacaa

SEQ ID NO: 100069 - RNA, 16 nt, Homo sapiens
cacauugcugcauggc

SEQ ID NO: 100070 - RNA, 22 nt, Homo sapiens
caccacuacaccccaggcuggg

SEQ ID NO: 100071 - RNA, 22 nt, Homo sapiens
caccagcuggcauugaauaccu

SEQ ID NO: 100072 - RNA, 22 nt, Homo sapiens
caccaggugcccagcacggcca

SEQ ID NO: 100073 - RNA, 22 nt, Homo sapiens
caccagguuggagugcaguggu

SEQ ID NO: 100074 - RNA, 23 nt, Homo sapiens
caccaguauaauuagcuuuuaaa

SEQ ID NO: 100075 - RNA, 19 nt, Homo sapiens
caccagugcaugcuacuau

SEQ ID NO: 100076 - RNA, 22 nt, Homo sapiens
caccaguuuuucagugauucaa

SEQ ID NO: 100077 - RNA, 22 nt, Homo sapiens
caccauguguucagaaggauug

SEQ ID NO: 100078 - RNA, 22 nt, Homo sapiens
cacccuuagaguuggaaguggg

SEQ ID NO: 100079 - RNA, 22 nt, Homo sapiens
cacccuugcagggacagcuuug

SEQ ID NO: 100080 - RNA, 22 nt, Homo sapiens
caccgagugacaguagccauca

SEQ ID NO: 100081 - RNA, 19 nt, Homo sapiens
caccgccugcccccugcug

SEQ ID NO: 100082 - RNA, 22 nt, Homo sapiens
caccuguagucccagcugaggc

SEQ ID NO: 100083 - RNA, 22 nt, Homo sapiens
cacgugcuuucuuuucauuuag

SEQ ID NO: 100084 - RNA, 22 nt, Homo sapiens
cacuagagaauagguaguucug

SEQ ID NO: 100085 - RNA, 22 nt, Homo sapiens
cacugaaugugagguuggggag

SEQ ID NO: 100086 - RNA, 22 nt, Homo sapiens
cacugcacuccagcuugugggc

SEQ ID NO: 100087 - RNA, 22 nt, Homo sapiens
cacugcacuccagucccgucuc

SEQ ID NO: 100088 - RNA, 22 nt, Homo sapiens
cacugcacuccaguuucgguaa

SEQ ID NO: 100089 - RNA, 22 nt, Homo sapiens
cacugcauccuccaccugccag

SEQ ID NO: 100090 - RNA, 22 nt, Homo sapiens
cacugcauccuccauauccugg

SEQ ID NO: 100091 - RNA, 22 nt, Homo sapiens
cacugcauccuugaccuucugg

SEQ ID NO: 100092 - RNA, 22 nt, Homo sapiens
cacugcauggccacccauguua

SEQ ID NO: 100093 - RNA, 22 nt, Homo sapiens
cacugcauggucuagcuggguu

SEQ ID NO: 100094 - RNA, 22 nt, Homo sapiens
cacuggguuagaacaugcuccu

SEQ ID NO: 100095 - RNA, 22 nt, Homo sapiens
cacuuugguucaccugaguuuc

SEQ ID NO: 100096 - RNA, 22 nt, Homo sapiens
cagagaaugucuuuuuuaacca

SEQ ID NO: 100097 - RNA, 22 nt, Homo sapiens
cagagcacugauacuggguucu

SEQ ID NO: 100098 - RNA, 22 nt, Homo sapiens
cagagguauugcaaaagccuag

SEQ ID NO: 100099 - RNA, 22 nt, Homo sapiens
cagauacuggccuggagcugug

SEQ ID NO: 100100 - RNA, 22 nt, Homo sapiens
cagaugguggucccacagccca

SEQ ID NO: 100101 - RNA, 20 nt, Homo sapiens
cagcaaccugcucucuuccu

SEQ ID NO: 100102 - RNA, 22 nt, Homo sapiens
cagcaguuguuucggauuggga

SEQ ID NO: 100103 - RNA, 22 nt, Homo sapiens
cagcgaggucugcgucacauug

SEQ ID NO: 100104 - RNA, 20 nt, Homo sapiens
cagcuaccugggaaauuugg

SEQ ID NO: 100105 - RNA, 22 nt, Homo sapiens
cagcugaugucgaaugcacucu

SEQ ID NO: 100106 - RNA, 22 nt, Homo sapiens
cagcuggugggagcuggguucc

SEQ ID NO: 100107 - RNA, 22 nt, Homo sapiens
cagcuguuguuaugucugcagg

SEQ ID NO: 100108 - RNA, 22 nt, Homo sapiens
cagcuguuguuccagucuuuua

SEQ ID NO: 100109 - RNA, 22 nt, Homo sapiens
cagcuugugguauugcugguug

SEQ ID NO: 100110 - RNA, 22 nt, Homo sapiens
caggcaaggugaaguguacugg

SEQ ID NO: 100111 - RNA, 22 nt, Homo sapiens
caggcauagucuugaguuuuau

SEQ ID NO: 100112 - RNA, 22 nt, Homo sapiens
caggguccccuaccuuuugaug

SEQ ID NO: 100113 - RNA, 22 nt, Homo sapiens
cagguacaugcaugugugugca

SEQ ID NO: 100114 - RNA, 22 nt, Homo sapiens
cagguaggccaauguuuuccaa

SEQ ID NO: 100115 - RNA, 22 nt, Homo sapiens
caggucaucugaguuuaguucu

SEQ ID NO: 100116 - RNA, 22 nt, Homo sapiens
caguacaauguggaaaaggagu

SEQ ID NO: 100117 - RNA, 22 nt, Homo sapiens
caguagcaugccucagaaugag

SEQ ID NO: 100118 - RNA, 22 nt, Homo sapiens
cagugauaggugguuguuggca

SEQ ID NO: 100119 - RNA, 18 nt, Homo sapiens
cagugcaauacaggagag

SEQ ID NO: 100120 - RNA, 22 nt, Homo sapiens
cagugcacugggauuauaagug

SEQ ID NO: 100121 - RNA, 22 nt, Homo sapiens
cagugcaugacuguauauuauc

SEQ ID NO: 100122 - RNA, 23 nt, Homo sapiens
cagugcauuguggcauucagcau

SEQ ID NO: 100123 - RNA, 22 nt, Homo sapiens
cagugguuuucaacccugguug

SEQ ID NO: 100124 - RNA, 22 nt, Homo sapiens
caguguuuuuaacaggugcccg

SEQ ID NO: 100125 - RNA, 22 nt, Homo sapiens
caguucaugguaggcaccauag

SEQ ID NO: 100126 - RNA, 22 nt, Homo sapiens
caguugguguacauauauguau

SEQ ID NO: 100127 - RNA, 22 nt, Homo sapiens
cauaaugcuaagagcugccccu

SEQ ID NO: 100128 - RNA, 22 nt, Homo sapiens
caucaaaguggagggaaggacc

SEQ ID NO: 100129 - RNA, 22 nt, Homo sapiens
caucacaguacuaaucgucaua

SEQ ID NO: 100130 - RNA, 22 nt, Homo sapiens
caucacauucugagauacugag

SEQ ID NO: 100131 - RNA, 22 nt, Homo sapiens
caucacuguugguacaaguaau

SEQ ID NO: 100132 - RNA, 22 nt, Homo sapiens
caucauugcacccuauagagaa

SEQ ID NO: 100133 - RNA, 22 nt, Homo sapiens
caucccugaaccccagaaaucu

SEQ ID NO: 100134 - RNA, 22 nt, Homo sapiens
caucgcacuccagccugggcaa

SEQ ID NO: 100135 - RNA, 22 nt, Homo sapiens
gagacggagucucgcucuguca

SEQ ID NO: 100136 - RNA, 22 nt, Homo sapiens
gagacucuuagauuggaaaucu

SEQ ID NO: 100137 - RNA, 22 nt, Homo sapiens
gagacugagucucgcucugccg

SEQ ID NO: 100138 - RNA, 22 nt, Homo sapiens
gagacugagucuugcuuuguca

SEQ ID NO: 100139 - RNA, 21 nt, Homo sapiens
gagaggauucgccagccucuu

SEQ ID NO: 100140 - RNA, 22 nt, Homo sapiens
gagagugaaguuugcuaccugu

SEQ ID NO: 100141 - RNA, 22 nt, Homo sapiens
gagauacuugguuucuguuucu

SEQ ID NO: 100142 - RNA, 22 nt, Homo sapiens
gagauauuauuucccuuucaca

SEQ ID NO: 100143 - RNA, 22 nt, Homo sapiens
gagauauucugguuuacuaaau

SEQ ID NO: 100144 - RNA, 22 nt, Homo sapiens
gagaucaaguauucuccacuaa

SEQ ID NO: 100145 - RNA, 22 nt, Homo sapiens
gagaucaucuaaucuggccucu

SEQ ID NO: 100146 - RNA, 22 nt, Homo sapiens
gagaucauucugauccagaguc

SEQ ID NO: 100147 - RNA, 22 nt, Homo sapiens
gagauggagacuuggccuuaaa

SEQ ID NO: 100148 - RNA, 22 nt, Homo sapiens
gagaugguacacauacgauucu

SEQ ID NO: 100149 - RNA, 22 nt, Homo sapiens
gagauggugugcuguuggaagu

SEQ ID NO: 100150 - RNA, 22 nt, Homo sapiens
gagaugugugugauuauauaau

SEQ ID NO: 100151 - RNA, 20 nt, Homo sapiens
gagauguugaucagggcuau

SEQ ID NO: 100152 - RNA, 22 nt, Homo sapiens
gagauguuuguuucacugucac

SEQ ID NO: 100153 - RNA, 22 nt, Homo sapiens
gagauuauuuaaaaggugauuu

SEQ ID NO: 100154 - RNA, 22 nt, Homo sapiens
gagauucaucuagguccagaga

SEQ ID NO: 100155 - RNA, 22 nt, Homo sapiens
gagauucuucaauauuuauucu

SEQ ID NO: 100156 - RNA, 22 nt, Homo sapiens
gagcaaugauugagccacugua

SEQ ID NO: 100157 - RNA, 22 nt, Homo sapiens
gagcaucaauggcaugugggaa

SEQ ID NO: 100158 - RNA, 22 nt, Homo sapiens
gagcuagcauuuagacaucugg

SEQ ID NO: 100159 - RNA, 22 nt, Homo sapiens
gagcucauuaaaaauguagaau

SEQ ID NO: 100160 - RNA, 22 nt, Homo sapiens
gagcucauuguugcuaaagaga

SEQ ID NO: 100161 - RNA, 22 nt, Homo sapiens
gagcucguuuuugcugacucuu

SEQ ID NO: 100162 - RNA, 22 nt, Homo sapiens
gagcugaaguuuccauuuguac

SEQ ID NO: 100163 - RNA, 22 nt, Homo sapiens
gagcugaauugcugccauuugc

SEQ ID NO: 100164 - RNA, 22 nt, Homo sapiens
gagcuggacuucuuaccuuuuc

SEQ ID NO: 100165 - RNA, 22 nt, Homo sapiens
gagcuguugguuugaaagaauu

SEQ ID NO: 100166 - RNA, 22 nt, Homo sapiens
gaggagauauucugcuggaugg

SEQ ID NO: 100167 - RNA, 22 nt, Homo sapiens
gaggaguauuuugucgaauguc

SEQ ID NO: 100168 - RNA, 22 nt, Homo sapiens
gaggagucagacugugcaaggu

SEQ ID NO: 100169 - RNA, 22 nt, Homo sapiens
gaggcaaugugcccggcccaca

SEQ ID NO: 100170 - RNA, 22 nt, Homo sapiens
gaggcagucuguccauucucag

SEQ ID NO: 100171 - RNA, 22 nt, Homo sapiens
gaggcauuauucccaucuuaca

SEQ ID NO: 100172 - RNA, 22 nt, Homo sapiens
gaggguguuguguugcuuaaua

SEQ ID NO: 100173 - RNA, 22 nt, Homo sapiens
gagguaggaggauugcuuaagg

SEQ ID NO: 100174 - RNA, 21 nt, Homo sapiens
gagguagggauuaaagaccuc

SEQ ID NO: 100175 - RNA, 22 nt, Homo sapiens
gagguagguuugguuacaaaag

SEQ ID NO: 100176 - RNA, 22 nt, Homo sapiens
gagguaucauuauguugcccag

SEQ ID NO: 100177 - RNA, 22 nt, Homo sapiens
gagguauggauaucuggagagg

SEQ ID NO: 100178 - RNA, 22 nt, Homo sapiens
gaggucauguggcaggcagcca

SEQ ID NO: 100179 - RNA, 22 nt, Homo sapiens
gagguguagucaugccaagauc

SEQ ID NO: 100180 - RNA, 22 nt, Homo sapiens
gaguaaaugucaaguacuuagg

SEQ ID NO: 100181 - RNA, 22 nt, Homo sapiens
gaguaaaugucacuguugcugu

SEQ ID NO: 100182 - RNA, 22 nt, Homo sapiens
gaguaaauguccuagcuucuug

SEQ ID NO: 100183 - RNA, 22 nt, Homo sapiens
gaguaacagcauaaauuuguga

SEQ ID NO: 100184 - RNA, 22 nt, Homo sapiens
gaguagugcugcaguaaacaca

SEQ ID NO: 100185 - RNA, 22 nt, Homo sapiens
gaguagugcuguaauaaacaua

SEQ ID NO: 100186 - RNA, 22 nt, Homo sapiens
gaguauauuugcacuguuaugu

SEQ ID NO: 100187 - RNA, 22 nt, Homo sapiens
gagugcaagguuuuucugagug

SEQ ID NO: 100188 - RNA, 23 nt, Homo sapiens
gagugcaaugacaugaucucgga

SEQ ID NO: 100189 - RNA, 22 nt, Homo sapiens
gagugcaauggcgcgaucuggg

SEQ ID NO: 100190 - RNA, 22 nt, Homo sapiens
gagugcauaugggccuguguca

SEQ ID NO: 100191 - RNA, 23 nt, Homo sapiens
gaguggagacucauugauuuccu

SEQ ID NO: 100192 - RNA, 22 nt, Homo sapiens
gaguggugguucugaaacuuuu

SEQ ID NO: 100193 - RNA, 22 nt, Homo sapiens
gaguuagguugucaaugucuua

SEQ ID NO: 100194 - RNA, 19 nt, Homo sapiens
gaguugggguuuacuguaa

SEQ ID NO: 100195 - RNA, 22 nt, Homo sapiens
gaguuuguacuaauuuguugua

SEQ ID NO: 100196 - RNA, 22 nt, Homo sapiens
gauacaguaugcaugugguauu

SEQ ID NO: 100197 - RNA, 19 nt, Homo sapiens
gauagacaucacagugcca

SEQ ID NO: 100198 - RNA, 22 nt, Homo sapiens
gauagcagccauucuuuuuauu

SEQ ID NO: 100199 - RNA, 22 nt, Homo sapiens
gauagcauucaauuaucuguug

SEQ ID NO: 100200 - RNA, 21 nt, Homo sapiens
gauaucuuuauucccaagagc

SEQ ID NO: 100201 - RNA, 21 nt, Homo sapiens
gauaugacauggguaaaacca

SEQ ID NO: 100202 - RNA, 22 nt, Homo sapiens
gauauguacagcucucuaggau

SEQ ID NO: 100203 - RNA, 22 nt, Homo sapiens
gauauguaguaguugaaaaaga

SEQ ID NO: 100204 - RNA, 22 nt, Homo sapiens
gauaugugauaagaguuaucuu

SEQ ID NO: 100205 - RNA, 22 nt, Homo sapiens
gauauguuguuggauucgguua

SEQ ID NO: 100206 - RNA, 22 nt, Homo sapiens
gaucacaguuccucacgggcau

SEQ ID NO: 100207 - RNA, 22 nt, Homo sapiens
gaucacaugggagaaugagagu

SEQ ID NO: 100208 - RNA, 22 nt, Homo sapiens
gaucacauguguacucaaugug

SEQ ID NO: 100209 - RNA, 22 nt, Homo sapiens
gaucagauggcuguuggugugu

SEQ ID NO: 100210 - RNA, 22 nt, Homo sapiens
gaucccauuggcugccaugugg

SEQ ID NO: 100211 - RNA, 22 nt, Homo sapiens
gaucucaguggauacugugaug

SEQ ID NO: 100212 - RNA, 22 nt, Homo sapiens
gaugacacugggucaaaucuca

SEQ ID NO: 100213 - RNA, 22 nt, Homo sapiens
gaugaucucuggugguaaagac

SEQ ID NO: 100214 - RNA, 22 nt, Homo sapiens
gaugccuauugcuaguccuaaa

SEQ ID NO: 100215 - RNA, 22 nt, Homo sapiens
gauggaguugacuaagacaaca

SEQ ID NO: 100216 - RNA, 22 nt, Homo sapiens
gauggcacuuaagagcaagagc

SEQ ID NO: 100217 - RNA, 22 nt, Homo sapiens
gauggcagugcagccccuggcu

SEQ ID NO: 100218 - RNA, 22 nt, Homo sapiens
gauggcaugugcugccaccaag

SEQ ID NO: 100219 - RNA, 22 nt, Homo sapiens
gauggcucugcaggugagggua

SEQ ID NO: 100220 - RNA, 22 nt, Homo sapiens
gauggugucccaggcucaggcu

SEQ ID NO: 100221 - RNA, 22 nt, Homo sapiens
gaugguuuucaccugcaugcuu

SEQ ID NO: 100222 - RNA, 22 nt, Homo sapiens
gaugguuuuuuaagaagagccu

SEQ ID NO: 100223 - RNA, 22 nt, Homo sapiens
gauguguuuaucacccaguccu

SEQ ID NO: 100224 - RNA, 22 nt, Homo sapiens
gauguuguuuagccuuugaugu

SEQ ID NO: 100225 - RNA, 22 nt, Homo sapiens
gauuccacuuucaaauucaaau

SEQ ID NO: 100226 - RNA, 22 nt, Homo sapiens
ggacaucauuaccauggaccca

SEQ ID NO: 100227 - RNA, 22 nt, Homo sapiens
ggacuagggacauggggagcug

SEQ ID NO: 100228 - RNA, 22 nt, Homo sapiens
ggacuggaagcauauuuauuuu

SEQ ID NO: 100229 - RNA, 22 nt, Homo sapiens
ggacugucagggcuauuaguca

SEQ ID NO: 100230 - RNA, 22 nt, Homo sapiens
ggagagugacauauuucuaggc

SEQ ID NO: 100231 - RNA, 22 nt, Homo sapiens
ggagauuauugaaucaugaggg

SEQ ID NO: 100232 - RNA, 22 nt, Homo sapiens
ggagcugugauuugaguccaga

SEQ ID NO: 100233 - RNA, 20 nt, Homo sapiens
ggagguuguauaaguacauc

SEQ ID NO: 100234 - RNA, 22 nt, Homo sapiens
ggaguaaaagaguaggaggaau

SEQ ID NO: 100235 - RNA, 22 nt, Homo sapiens
ggagucuugcuauguugccaag

SEQ ID NO: 100236 - RNA, 22 nt, Homo sapiens
ggagugcuguuguuacacaagg

SEQ ID NO: 100237 - RNA, 23 nt, Homo sapiens
ggaguguaaugacucgaucucgg

SEQ ID NO: 100238 - RNA, 22 nt, Homo sapiens
ggaguguguuuuccaacuuggu

SEQ ID NO: 100239 - RNA, 22 nt, Homo sapiens
ggaguguuccauuugucacauu

SEQ ID NO: 100240 - RNA, 22 nt, Homo sapiens
ggaguucaucaggugaggggua

SEQ ID NO: 100241 - RNA, 22 nt, Homo sapiens
ggaguuuaagucuugugcaucu

SEQ ID NO: 100242 - RNA, 22 nt, Homo sapiens
ggauacauuuuuccuccucuuc

SEQ ID NO: 100243 - RNA, 21 nt, Homo sapiens
ggauagaaaacuuggcuguau

SEQ ID NO: 100244 - RNA, 22 nt, Homo sapiens
ggaucacugugaaccgugucag

SEQ ID NO: 100245 - RNA, 22 nt, Homo sapiens
ggaucgauuccaaauguagauc

SEQ ID NO: 100246 - RNA, 22 nt, Homo sapiens
ggaugcauucaacuuccaguuc

SEQ ID NO: 100247 - RNA, 23 nt, Homo sapiens
ggauggaaaguuuugagggccac

SEQ ID NO: 100248 - RNA, 21 nt, Homo sapiens
ggauucaucccucaugaauuu

SEQ ID NO: 100249 - RNA, 22 nt, Homo sapiens
ggauugcuuaagaaguuucauu

SEQ ID NO: 100250 - RNA, 22 nt, Homo sapiens
ggauugugauaauuguugcaaa

SEQ ID NO: 100251 - RNA, 22 nt, Homo sapiens
ggcaaaugaagauggagaggcu

SEQ ID NO: 100252 - RNA, 22 nt, Homo sapiens
ggcaagaaccagggauuugcgu

SEQ ID NO: 100253 - RNA, 22 nt, Homo sapiens
ggcaagaagagaguuuaaacau

SEQ ID NO: 100254 - RNA, 20 nt, Homo sapiens
ggcaagacccaaagugugug

SEQ ID NO: 100255 - RNA, 22 nt, Homo sapiens
ggcaagaggagauucugcuccc

SEQ ID NO: 100256 - RNA, 19 nt, Homo sapiens
ggcaagaguuguucugugu

SEQ ID NO: 100257 - RNA, 22 nt, Homo sapiens
ggcaagauagauaucaguguca

SEQ ID NO: 100258 - RNA, 22 nt, Homo sapiens
ggcaagaucuuggcucacugaa

SEQ ID NO: 100259 - RNA, 22 nt, Homo sapiens
ggcaagcucaggccucaggugu

SEQ ID NO: 100260 - RNA, 22 nt, Homo sapiens
ggcaagugucagcagcaacacc

SEQ ID NO: 100261 - RNA, 21 nt, Homo sapiens
ggcaagugugagguuuggggu

SEQ ID NO: 100262 - RNA, 22 nt, Homo sapiens
ggcaaugucagcuaaugaugga

SEQ ID NO: 100263 - RNA, 22 nt, Homo sapiens
ggcaccauggaaggacgggagc

SEQ ID NO: 100264 - RNA, 22 nt, Homo sapiens
ggcaccauuuuacuccuucccu

SEQ ID NO: 100265 - RNA, 19 nt, Homo sapiens
ggcacugugugagugagga

SEQ ID NO: 100266 - RNA, 22 nt, Homo sapiens
ggcagacuguggaguucuuucu

SEQ ID NO: 100267 - RNA, 22 nt, Homo sapiens
ggcagaguggacauuuaaaugu

SEQ ID NO: 100268 - RNA, 22 nt, Homo sapiens
ggcagcacaauuuucugaugga

SEQ ID NO: 100269 - RNA, 22 nt, Homo sapiens
ggcagcgugcacuuucgccacu

SEQ ID NO: 100270 - RNA, 22 nt, Homo sapiens
ggcagguaaggagugggagccu

SEQ ID NO: 100271 - RNA, 22 nt, Homo sapiens
ggcaguguggcugcauauagca

SEQ ID NO: 100272 - RNA, 22 nt, Homo sapiens
ggcaguuuguucuugcuccuuu

SEQ ID NO: 100273 - RNA, 22 nt, Homo sapiens
ggcauguguggguuauuaaaga

SEQ ID NO: 100274 - RNA, 22 nt, Homo sapiens
ggccagaugcaguggcucacac

SEQ ID NO: 100275 - RNA, 18 nt, Homo sapiens
ggcggguguuuuauucac

SEQ ID NO: 100276 - RNA, 22 nt, Homo sapiens
ggcuagagaauagugccacuaa

SEQ ID NO: 100277 - RNA, 22 nt, Homo sapiens
ggcugguuuucaguuacugagu

SEQ ID NO: 100278 - RNA, 22 nt, Homo sapiens
gggaagugugcagaguucucuu

SEQ ID NO: 100279 - RNA, 19 nt, Homo sapiens
gggaggaugcgucuucagg

SEQ ID NO: 100280 - RNA, 22 nt, Homo sapiens
gggagguagguauuagcuuuuc

SEQ ID NO: 100281 - RNA, 22 nt, Homo sapiens
gggaggucauuguucaaugcug

SEQ ID NO: 100282 - RNA, 22 nt, Homo sapiens
gggaguagagaguuucucugac

SEQ ID NO: 100283 - RNA, 22 nt, Homo sapiens
gggagugucuaaccuguuaaca

SEQ ID NO: 100284 - RNA, 22 nt, Homo sapiens
gggaguguguaggacccagugu

SEQ ID NO: 100285 - RNA, 22 nt, Homo sapiens
gggauuauugugauuucauguu

SEQ ID NO: 100286 - RNA, 21 nt, Homo sapiens
gggcaaaucuuuauccuaagc

SEQ ID NO: 100287 - RNA, 22 nt, Homo sapiens
gggcaacauugaguacccugaa

SEQ ID NO: 100288 - RNA, 22 nt, Homo sapiens
gggcagaugucuggacaccuca

SEQ ID NO: 100289 - RNA, 22 nt, Homo sapiens
gggcaguauggucauuuucaca

SEQ ID NO: 100290 - RNA, 22 nt, Homo sapiens
gggcgagaaucggcugcucagc

SEQ ID NO: 100291 - RNA, 22 nt, Homo sapiens
ggggucaucagagaaucuaccc

SEQ ID NO: 100292 - RNA, 22 nt, Homo sapiens
ggguaggcaagcggaugucaga

SEQ ID NO: 100293 - RNA, 17 nt, Homo sapiens
gggucaccuugcaggua

SEQ ID NO: 100294 - RNA, 19 nt, Homo sapiens
gggucaguuugaaugauua

SEQ ID NO: 100295 - RNA, 22 nt, Homo sapiens
gggucauggaugugaagcuaga

SEQ ID NO: 100296 - RNA, 22 nt, Homo sapiens
gguaaacauacugcugucuucu

SEQ ID NO: 100297 - RNA, 22 nt, Homo sapiens
gguagacaucgugcucugugau

SEQ ID NO: 100298 - RNA, 22 nt, Homo sapiens
gguauguagcaaaagaggugcu

SEQ ID NO: 100299 - RNA, 22 nt, Homo sapiens
gguauguuuagaccauuuacau

SEQ ID NO: 100300 - RNA, 22 nt, Homo sapiens
ggucacccugaugcuggugguc

SEQ ID NO: 100301 - RNA, 22 nt, Homo sapiens
ggucaguguuaucaccgaagga

SEQ ID NO: 100302 - RNA, 22 nt, Homo sapiens
ggucauagagcaagcaaacagc

SEQ ID NO: 100303 - RNA, 21 nt, Homo sapiens
ggugagaaaggagacauagac

SEQ ID NO: 100304 - RNA, 22 nt, Homo sapiens
ggugagauguucagacgaacug

SEQ ID NO: 100305 - RNA, 22 nt, Homo sapiens
ggugaggaaaguugaguuucua

SEQ ID NO: 100306 - RNA, 22 nt, Homo sapiens
ggugagguaggaaaaguuagga

SEQ ID NO: 100307 - RNA, 22 nt, Homo sapiens
ggugccuacugugugucaggca

SEQ ID NO: 100308 - RNA, 22 nt, Homo sapiens
ggugucuuguuuaauacucauu

SEQ ID NO: 100309 - RNA, 22 nt, Homo sapiens
guaaacuuccccucaugaauga

SEQ ID NO: 100310 - RNA, 22 nt, Homo sapiens
guaacguaaugucaaaaucuau

SEQ ID NO: 100311 - RNA, 22 nt, Homo sapiens
guaagagaauggguuacuuucc

SEQ ID NO: 100312 - RNA, 22 nt, Homo sapiens
guaagagcauguaguggcucua

SEQ ID NO: 100313 - RNA, 22 nt, Homo sapiens
guaaggaguaguguaacagugc

SEQ ID NO: 100314 - RNA, 22 nt, Homo sapiens
guaaggcuucuggcccuuaacu

SEQ ID NO: 100315 - RNA, 22 nt, Homo sapiens
guaaguauuaggugugagauuc

SEQ ID NO: 100316 - RNA, 22 nt, Homo sapiens
guaagucucaugagaucugaug

SEQ ID NO: 100317 - RNA, 22 nt, Homo sapiens
gugagacugaguuucgcucuug

SEQ ID NO: 100318 - RNA, 22 nt, Homo sapiens
gugagaugauggguauguuaau

SEQ ID NO: 100319 - RNA, 22 nt, Homo sapiens
gugagauggaguuggugucuuu

SEQ ID NO: 100320 - RNA, 22 nt, Homo sapiens
gugagauuagcugagauccuug

SEQ ID NO: 100321 - RNA, 22 nt, Homo sapiens
gugagauuuucuccagguucag

SEQ ID NO: 100322 - RNA, 22 nt, Homo sapiens
gugagcauaacaacagaguuua

SEQ ID NO: 100323 - RNA, 22 nt, Homo sapiens
gugagcauaggaggcuucuguu

SEQ ID NO: 100324 - RNA, 22 nt, Homo sapiens
gugagcuagaccacuuggcucc

SEQ ID NO: 100325 - RNA, 22 nt, Homo sapiens
gugagggagcuggaauauuuau

SEQ ID NO: 100326 - RNA, 22 nt, Homo sapiens
gugagggaugugaaaaagguca

SEQ ID NO: 100327 - RNA, 22 nt, Homo sapiens
gugagguacgugucaagaacca

SEQ ID NO: 100328 - RNA, 22 nt, Homo sapiens
gugagguauacugggaucacua

SEQ ID NO: 100329 - RNA, 22 nt, Homo sapiens
gugaggucagggcuguggacag

SEQ ID NO: 100330 - RNA, 22 nt, Homo sapiens
gugaggucguagucauaggcaa

SEQ ID NO: 100331 - RNA, 22 nt, Homo sapiens
gugagguugaaaauaauggaaa

SEQ ID NO: 100332 - RNA, 22 nt, Homo sapiens
gugagucaugucccaucugauu

SEQ ID NO: 100333 - RNA, 22 nt, Homo sapiens
gugaguggacgugaccaauaaa

SEQ ID NO: 100334 - RNA, 22 nt, Homo sapiens
gugauagaucugggauucagaa

SEQ ID NO: 100335 - RNA, 22 nt, Homo sapiens
gugauaguucuuacuccaaagu

SEQ ID NO: 100336 - RNA, 22 nt, Homo sapiens
gugaucaugauccugaagcauu

SEQ ID NO: 100337 - RNA, 21 nt, Homo sapiens
gugaucaugucacugcacucc

SEQ ID NO: 100338 - RNA, 23 nt, Homo sapiens
gugaucauuguuguggguugaau

SEQ ID NO: 100339 - RNA, 22 nt, Homo sapiens
gugaucuuucaggcuugaccau

SEQ ID NO: 100340 - RNA, 22 nt, Homo sapiens
gugaugcaguacguagaggaga

SEQ ID NO: 100341 - RNA, 22 nt, Homo sapiens
gugcaaacuccaggucucuuca

SEQ ID NO: 100342 - RNA, 22 nt, Homo sapiens
gugcaaauuccagcucaacucc

SEQ ID NO: 100343 - RNA, 21 nt, Homo sapiens
gugcaacucccucucccuaca

SEQ ID NO: 100344 - RNA, 22 nt, Homo sapiens
gugcaaguguaauacagcuagg

SEQ ID NO: 100345 - RNA, 22 nt, Homo sapiens
gugcacaaaucuuaaauguaca

SEQ ID NO: 100346 - RNA, 22 nt, Homo sapiens
gugcacaacaugcagguuuguu

SEQ ID NO: 100347 - RNA, 21 nt, Homo sapiens
gugcacaguaguguuuaauag

SEQ ID NO: 100348 - RNA, 22 nt, Homo sapiens
gugcacaugcgugcgcacauau

SEQ ID NO: 100349 - RNA, 22 nt, Homo sapiens
gugcacauuguuuaugucuguu

SEQ ID NO: 100350 - RNA, 21 nt, Homo sapiens
gugcagaugccacagucacuc

SEQ ID NO: 100351 - RNA, 22 nt, Homo sapiens
gugcagugugauccuuccguau

SEQ ID NO: 100352 - RNA, 22 nt, Homo sapiens
gugcaguguuugcauggaauca

SEQ ID NO: 100353 - RNA, 22 nt, Homo sapiens
gugcauacgucuuuauaguagc

SEQ ID NO: 100354 - RNA, 22 nt, Homo sapiens
gugcauguccacuaguccauau

SEQ ID NO: 100355 - RNA, 22 nt, Homo sapiens
gugcaugucugugacgacccug

SEQ ID NO: 100356 - RNA, 22 nt, Homo sapiens
gugccacugcacuccggccugg

SEQ ID NO: 100357 - RNA, 22 nt, Homo sapiens
gugccuucuagcuaugguuggc

SEQ ID NO: 100358 - RNA, 22 nt, Homo sapiens
gugcuuguauuuaaaucaugug

SEQ ID NO: 100359 - RNA, 22 nt, Homo sapiens
guggaaaaguaguugcgguuuu

SEQ ID NO: 100360 - RNA, 22 nt, Homo sapiens
guggaaaauuauugcuguuuuu

SEQ ID NO: 100361 - RNA, 22 nt, Homo sapiens
guggaaagaacacaaaauuagg

SEQ ID NO: 100362 - RNA, 22 nt, Homo sapiens
guggaaaucucugugugacuua

SEQ ID NO: 100363 - RNA, 22 nt, Homo sapiens
guggaagugucuggggccaggg

SEQ ID NO: 100364 - RNA, 22 nt, Homo sapiens
guggaaucuagagaggcaguag

SEQ ID NO: 100365 - RNA, 22 nt, Homo sapiens
guggacaugaauuuuggaggca

SEQ ID NO: 100366 - RNA, 22 nt, Homo sapiens
guggaguacugagggucacuua

SEQ ID NO: 100367 - RNA, 17 nt, Homo sapiens
guggauagaacaaugaa

SEQ ID NO: 100368 - RNA, 22 nt, Homo sapiens
guggaucacuugaggucaagag

SEQ ID NO: 100369 - RNA, 22 nt, Homo sapiens
guggcaaagaugccuucuccaa

SEQ ID NO: 100370 - RNA, 22 nt, Homo sapiens
guggcaaggaaaugcugcucac

SEQ ID NO: 100371 - RNA, 21 nt, Homo sapiens
guggccuuuggagcaugucag

SEQ ID NO: 100372 - RNA, 22 nt, Homo sapiens
guggcuagaaugaagguagcug

SEQ ID NO: 100373 - RNA, 22 nt, Homo sapiens
guggcuuguaggggucaaggga

SEQ ID NO: 100374 - RNA, 22 nt, Homo sapiens
gugggcucguucguguuagaca

SEQ ID NO: 100375 - RNA, 22 nt, Homo sapiens
gugggguaggugacuugaugag

SEQ ID NO: 100376 - RNA, 22 nt, Homo sapiens
guggguaaaucucuguucgagg

SEQ ID NO: 100377 - RNA, 22 nt, Homo sapiens
guggguaaaucucuguuugagg

SEQ ID NO: 100378 - RNA, 22 nt, Homo sapiens
gugguaaaauggcauagagcua

SEQ ID NO: 100379 - RNA, 22 nt, Homo sapiens
gugguagaaauguagaugcuag

SEQ ID NO: 100380 - RNA, 22 nt, Homo sapiens
gugguauaaguaccuccuuuca

SEQ ID NO: 100381 - RNA, 22 nt, Homo sapiens
gugguaucauuuaaccauuaga

SEQ ID NO: 100382 - RNA, 22 nt, Homo sapiens
guggugucuuguuuaauauaua

SEQ ID NO: 100383 - RNA, 22 nt, Homo sapiens
gugguucuagagggacagaaug

SEQ ID NO: 100384 - RNA, 22 nt, Homo sapiens
gugguuguuggaguggcaauuu

SEQ ID NO: 100385 - RNA, 22 nt, Homo sapiens
gugguuuuaauauucagucuag

SEQ ID NO: 100386 - RNA, 22 nt, Homo sapiens
gugguuuuacaaagagaaagau

SEQ ID NO: 100387 - RNA, 22 nt, Homo sapiens
gugguuuuuuucugccuuauag

SEQ ID NO: 100388 - RNA, 22 nt, Homo sapiens
guguaaaucaaucuguugucuu

SEQ ID NO: 100389 - RNA, 22 nt, Homo sapiens
guguaaaucugcugugaacauu

SEQ ID NO: 100390 - RNA, 20 nt, Homo sapiens
guguaagagcaagcuuccua

SEQ ID NO: 100391 - RNA, 22 nt, Homo sapiens
guguaauacacacauauaugca

SEQ ID NO: 100392 - RNA, 22 nt, Homo sapiens
guguaauacauuagcaaaccaa

SEQ ID NO: 100393 - RNA, 22 nt, Homo sapiens
guguagagaaauagccugaagg

SEQ ID NO: 100394 - RNA, 22 nt, Homo sapiens
guguauacauagaauuguguau

SEQ ID NO: 100395 - RNA, 22 nt, Homo sapiens
guguaugugagaaugcucaugu

SEQ ID NO: 100396 - RNA, 22 nt, Homo sapiens
gugucaugggcauguccuuaac

SEQ ID NO: 100397 - RNA, 22 nt, Homo sapiens
gugucuccugccuucaugcagc

SEQ ID NO: 100398 - RNA, 22 nt, Homo sapiens
gugugacagcuauagacaugau

SEQ ID NO: 100399 - RNA, 22 nt, Homo sapiens
gugugauuauuucaauugaugc

SEQ ID NO: 100400 - RNA, 19 nt, Homo sapiens
gugugcauaucacagagca

SEQ ID NO: 100401 - RNA, 22 nt, Homo sapiens
gugugcauggagggggcaguga

SEQ ID NO: 100402 - RNA, 20 nt, Homo sapiens
gugugcauuucagauuuugg

SEQ ID NO: 100403 - RNA, 22 nt, Homo sapiens
guguucaaauucugacagagag

SEQ ID NO: 100404 - RNA, 22 nt, Homo sapiens
guuaggcagugugguauagcag

SEQ ID NO: 100405 - RNA, 22 nt, Homo sapiens
guuauauguuuggaaugaggaa

SEQ ID NO: 100406 - RNA, 22 nt, Homo sapiens
guuaugcagcuuagaaaaugaa

SEQ ID NO: 100407 - RNA, 22 nt, Homo sapiens
guuauguguuuccuuaauugcu

SEQ ID NO: 100408 - RNA, 22 nt, Homo sapiens
uaaugcaucagugguaguucuu

SEQ ID NO: 100409 - RNA, 22 nt, Homo sapiens
uacaagcaggaaaugguauaug

SEQ ID NO: 100410 - RNA, 21 nt, Homo sapiens
uacaagcuguagcacaugcca

SEQ ID NO: 100411 - RNA, 22 nt, Homo sapiens
uacacagucaaaaauuuccagg

SEQ ID NO: 100412 - RNA, 22 nt, Homo sapiens
uacacaugugaguucuuuucua

SEQ ID NO: 100413 - RNA, 22 nt, Homo sapiens
uacaccaauuuaaucaaaagca

SEQ ID NO: 100414 - RNA, 22 nt, Homo sapiens
uacaccauuugauucuuuaagc

SEQ ID NO: 100415 - RNA, 20 nt, Homo sapiens
uacacguaugagcacaugug

SEQ ID NO: 100416 - RNA, 21 nt, Homo sapiens
uacacuacugguggaaaugca

SEQ ID NO: 100417 - RNA, 22 nt, Homo sapiens
uacagcacugugcauagugguu

SEQ ID NO: 100418 - RNA, 22 nt, Homo sapiens
uacagccacauaauguaugauu

SEQ ID NO: 100419 - RNA, 23 nt, Homo sapiens
uacagcugcagaaucaggcuaag

SEQ ID NO: 100420 - RNA, 22 nt, Homo sapiens
uacaggacuauagaacuuuccc

SEQ ID NO: 100421 - RNA, 22 nt, Homo sapiens
uacaggugcucuacagacagga

SEQ ID NO: 100422 - RNA, 22 nt, Homo sapiens
uacaggugcuuauguggacaua

SEQ ID NO: 100423 - RNA, 22 nt, Homo sapiens
uacaguacacagguaccaagcu

SEQ ID NO: 100424 - RNA, 22 nt, Homo sapiens
uacaguacagugacaccauuau

SEQ ID NO: 100425 - RNA, 22 nt, Homo sapiens
uacagugcuuuuugguggagaa

SEQ ID NO: 100426 - RNA, 22 nt, Homo sapiens
uacauacuguaugguucuguuu

SEQ ID NO: 100427 - RNA, 22 nt, Homo sapiens
uacauccauccugcugggcagu

SEQ ID NO: 100428 - RNA, 22 nt, Homo sapiens
uacauguauacaggguuuacuu

SEQ ID NO: 100429 - RNA, 22 nt, Homo sapiens
uaccacagucauuacacuugua

SEQ ID NO: 100430 - RNA, 19 nt, Homo sapiens
uaccagcacaguguuugag

SEQ ID NO: 100431 - RNA, 22 nt, Homo sapiens
uaccaguaaugguucuagagga

SEQ ID NO: 100432 - RNA, 22 nt, Homo sapiens
uacccuuagcuuacauucuagg

SEQ ID NO: 100433 - RNA, 22 nt, Homo sapiens
uaccugagacaacuuugaggaa

SEQ ID NO: 100434 - RNA, 22 nt, Homo sapiens
uaccugagucuagagucuagaa

SEQ ID NO: 100435 - RNA, 22 nt, Homo sapiens
uaccuguagcucuucuaggcug

SEQ ID NO: 100436 - RNA, 22 nt, Homo sapiens
uaccuuaucccuaacuucccau

SEQ ID NO: 100437 - RNA, 23 nt, Homo sapiens
uacuacacuuuucccaagguuuu

SEQ ID NO: 100438 - RNA, 22 nt, Homo sapiens
uacuagaaccuuauucagagug

SEQ ID NO: 100439 - RNA, 22 nt, Homo sapiens
uacuagaggaauugcuauaacu

SEQ ID NO: 100440 - RNA, 22 nt, Homo sapiens
uacucaguagucuguugcuguc

SEQ ID NO: 100441 - RNA, 22 nt, Homo sapiens
uacuccccuuguucugugagcu

SEQ ID NO: 100442 - RNA, 22 nt, Homo sapiens
uacucuuuagcuccuuaaggaa

SEQ ID NO: 100443 - RNA, 22 nt, Homo sapiens
uacugagagaggaauauugaaa

SEQ ID NO: 100444 - RNA, 19 nt, Homo sapiens
uacugcacuccagucuggg

SEQ ID NO: 100445 - RNA, 22 nt, Homo sapiens
uacugcauuccaaucugggcga

SEQ ID NO: 100446 - RNA, 22 nt, Homo sapiens
uacugcuuaaaagucaauuacu

SEQ ID NO: 100447 - RNA, 19 nt, Homo sapiens
uacuggcucgggaauuuuc

SEQ ID NO: 100448 - RNA, 22 nt, Homo sapiens
uacuguacugcaguucugcaaa

SEQ ID NO: 100449 - RNA, 22 nt, Homo sapiens
uacuuuguagauuguuuccuuu

SEQ ID NO: 100450 - RNA, 22 nt, Homo sapiens
uagaagcacuaucccuccuagu

SEQ ID NO: 100451 - RNA, 22 nt, Homo sapiens
uagaagcuacucuucuuguggc

SEQ ID NO: 100452 - RNA, 22 nt, Homo sapiens
uagaauguaacuuccaugucau

SEQ ID NO: 100453 - RNA, 23 nt, Homo sapiens
uagaauguuuuuccauguuucuu

SEQ ID NO: 100454 - RNA, 20 nt, Homo sapiens
uagacagcuagauuagauag

SEQ ID NO: 100455 - RNA, 22 nt, Homo sapiens
uagaccaauuggcauauaguaa

SEQ ID NO: 100456 - RNA, 22 nt, Homo sapiens
uagacccauuguucagagagug

SEQ ID NO: 100457 - RNA, 20 nt, Homo sapiens
uagagagauauggggguucc

SEQ ID NO: 100458 - RNA, 21 nt, Homo sapiens
uagagcaacacacgcccucuc

SEQ ID NO: 100459 - RNA, 22 nt, Homo sapiens
uagagcacagugauuagaccua

SEQ ID NO: 100460 - RNA, 22 nt, Homo sapiens
uagagccauugcagauguuuga

SEQ ID NO: 100461 - RNA, 22 nt, Homo sapiens
uagagcuacagcccucacuguc

SEQ ID NO: 100462 - RNA, 22 nt, Homo sapiens
uagagcuagggacucgcaaugu

SEQ ID NO: 100463 - RNA, 22 nt, Homo sapiens
uagagcuaguugcucacugcuu

SEQ ID NO: 100464 - RNA, 22 nt, Homo sapiens
uagagguagccuacuacacacc

SEQ ID NO: 100465 - RNA, 22 nt, Homo sapiens
uagagguauuaacaguagaaga

SEQ ID NO: 100466 - RNA, 19 nt, Homo sapiens
uagagguuuaagaaaagaa

SEQ ID NO: 100467 - RNA, 22 nt, Homo sapiens
uagauaguuaugauuugaugau

SEQ ID NO: 100468 - RNA, 21 nt, Homo sapiens
uagauaguugguucugaaucu

SEQ ID NO: 100469 - RNA, 22 nt, Homo sapiens
uagaucaacuuugguaagagaa

SEQ ID NO: 100470 - RNA, 22 nt, Homo sapiens
uagaucuuuaaaaggugcuaga

SEQ ID NO: 100471 - RNA, 19 nt, Homo sapiens
uagaugucuuugcauagau

SEQ ID NO: 100472 - RNA, 22 nt, Homo sapiens
uagauuaucuaugaggcuucca

SEQ ID NO: 100473 - RNA, 22 nt, Homo sapiens
uagauuaucuguaugugcucuu

SEQ ID NO: 100474 - RNA, 22 nt, Homo sapiens
uagauuauuggcugauuugauc

SEQ ID NO: 100475 - RNA, 22 nt, Homo sapiens
uagcacagggaauugguucucu

SEQ ID NO: 100476 - RNA, 22 nt, Homo sapiens
uagcacaucccuaaaaugcugu

SEQ ID NO: 100477 - RNA, 20 nt, Homo sapiens
uagcacaucuggcuguagag

SEQ ID NO: 100478 - RNA, 22 nt, Homo sapiens
uagcacaugucagguaauuugc

SEQ ID NO: 100479 - RNA, 22 nt, Homo sapiens
uagcagaauauaccucuuacuu

SEQ ID NO: 100480 - RNA, 18 nt, Homo sapiens
uagcagacaucauugggg

SEQ ID NO: 100481 - RNA, 22 nt, Homo sapiens
uagcagcaucucuggcuucuac

SEQ ID NO: 100482 - RNA, 22 nt, Homo sapiens
uagcagccaggaagggcuggcu

SEQ ID NO: 100483 - RNA, 22 nt, Homo sapiens
uagcaguauaugagagcuauug

SEQ ID NO: 100484 - RNA, 22 nt, Homo sapiens
uagcaguuguuguuacuuguau

SEQ ID NO: 100485 - RNA, 22 nt, Homo sapiens
uagcauggagucaugcacggcu

SEQ ID NO: 100486 - RNA, 22 nt, Homo sapiens
uagcuaaauucagcucuaggua

SEQ ID NO: 100487 - RNA, 21 nt, Homo sapiens
uagcugcacccaggccuccuu

SEQ ID NO: 100488 - RNA, 22 nt, Homo sapiens
uagcugcuguauguacacggau

SEQ ID NO: 100489 - RNA, 22 nt, Homo sapiens
uagcuggaauuacuugcaccug

SEQ ID NO: 100490 - RNA, 22 nt, Homo sapiens
uaggagcacaaaccccauugug

SEQ ID NO: 100491 - RNA, 22 nt, Homo sapiens
uaggagcacaaacccuacugug

SEQ ID NO: 100492 - RNA, 22 nt, Homo sapiens
uaggagugugaacccuaugaac

SEQ ID NO: 100493 - RNA, 22 nt, Homo sapiens
uaggaucauuuuauguugccca

SEQ ID NO: 100494 - RNA, 22 nt, Homo sapiens
uaggcaaguugcccaaucucuc

SEQ ID NO: 100495 - RNA, 22 nt, Homo sapiens
uaggcaguguucucacuuguaa

SEQ ID NO: 100496 - RNA, 22 nt, Homo sapiens
uaggccuuuuuaugucaauauc

SEQ ID NO: 100497 - RNA, 22 nt, Homo sapiens
uaggccuuuuucagauggguag

SEQ ID NO: 100498 - RNA, 22 nt, Homo sapiens
uagggcaaggaacaguuaaaaa

SEQ ID NO: 100499 - RNA, 22 nt, Homo sapiens
uauuaagcuaguugucagugcu

SEQ ID NO: 100500 - RNA, 22 nt, Homo sapiens
uauuacauccauaggcucugcu

SEQ ID NO: 100501 - RNA, 22 nt, Homo sapiens
uauuacuugucugugucucaau

SEQ ID NO: 100502 - RNA, 22 nt, Homo sapiens
uauuagguuggugcaacaguaa

SEQ ID NO: 100503 - RNA, 22 nt, Homo sapiens
uauucaagccaaauucaagcca

SEQ ID NO: 100504 - RNA, 22 nt, Homo sapiens
uauucacuguaucauugauggg

SEQ ID NO: 100505 - RNA, 22 nt, Homo sapiens
uauucaucuuaagcuuuggcuu

SEQ ID NO: 100506 - RNA, 22 nt, Homo sapiens
uauuccauuugggucaggauga

SEQ ID NO: 100507 - RNA, 22 nt, Homo sapiens
uauuccauuugugaaaggaagu

SEQ ID NO: 100508 - RNA, 22 nt, Homo sapiens
uauuccuuuugcauuuccacau

SEQ ID NO: 100509 - RNA, 22 nt, Homo sapiens
uauugauuaauugugauuaggc

SEQ ID NO: 100510 - RNA, 22 nt, Homo sapiens
uauugcaauuggggaaacuggg

SEQ ID NO: 100511 - RNA, 22 nt, Homo sapiens
uauugcacaugaggagacauug

SEQ ID NO: 100512 - RNA, 20 nt, Homo sapiens
uauugcacuccagucugggc

SEQ ID NO: 100513 - RNA, 22 nt, Homo sapiens
uauugcauuugagguugguuga

SEQ ID NO: 100514 - RNA, 22 nt, Homo sapiens
uauugccugucuccaaaaauca

SEQ ID NO: 100515 - RNA, 22 nt, Homo sapiens
uauugcucaugcauuuaauuuc

SEQ ID NO: 100516 - RNA, 22 nt, Homo sapiens
uauugcuuuuaacccaaucucu

SEQ ID NO: 100517 - RNA, 22 nt, Homo sapiens
uauugcuuuugauucaaggcag

SEQ ID NO: 100518 - RNA, 22 nt, Homo sapiens
uauugggcuucucagaauagag

SEQ ID NO: 100519 - RNA, 22 nt, Homo sapiens
uauuugauugacuuuagcagga

SEQ ID NO: 100520 - RNA, 22 nt, Homo sapiens
ucaaaaucucuuagcugugucu

SEQ ID NO: 100521 - RNA, 21 nt, Homo sapiens
ucaaaguguucuuuuguugaa

SEQ ID NO: 100522 - RNA, 22 nt, Homo sapiens
ucaaaucaucuuuuccaaagcu

SEQ ID NO: 100523 - RNA, 22 nt, Homo sapiens
ucaaaugaucugcccgccuugg

SEQ ID NO: 100524 - RNA, 22 nt, Homo sapiens
ucaaaugauucacccaccuuug

SEQ ID NO: 100525 - RNA, 22 nt, Homo sapiens
ucaaauguucccuguacuggcc

SEQ ID NO: 100526 - RNA, 22 nt, Homo sapiens
ucaacagugauggaaaguuaua

SEQ ID NO: 100527 - RNA, 22 nt, Homo sapiens
ucaacagugggcacuguaaaug

SEQ ID NO: 100528 - RNA, 18 nt, Homo sapiens
ucaagcuauugucaugcc

SEQ ID NO: 100529 - RNA, 20 nt, Homo sapiens
ucaaggcacgaauaaaaguu

SEQ ID NO: 100530 - RNA, 22 nt, Homo sapiens
ucaaggcacuagcugagcugca

SEQ ID NO: 100531 - RNA, 22 nt, Homo sapiens
ucaagguacguugccucagauu

SEQ ID NO: 100532 - RNA, 22 nt, Homo sapiens
ucaaguaagaagugggcauaaa

SEQ ID NO: 100533 - RNA, 22 nt, Homo sapiens
ucaagugauucuugugccuuag

SEQ ID NO: 100534 - RNA, 22 nt, Homo sapiens
ucaaugcaugugacaaagagua

SEQ ID NO: 100535 - RNA, 19 nt, Homo sapiens
ucaauucugucaauggcuu

SEQ ID NO: 100536 - RNA, 22 nt, Homo sapiens
ucaauugcaucaacaguguaca

SEQ ID NO: 100537 - RNA, 18 nt, Homo sapiens
ucacaaccacagugcugu

SEQ ID NO: 100538 - RNA, 22 nt, Homo sapiens
ucacaagcuccugccuuugcuu

SEQ ID NO: 100539 - RNA, 22 nt, Homo sapiens
ucacaaggcaggaaugaaaggg

SEQ ID NO: 100540 - RNA, 22 nt, Homo sapiens
ucacaagugagaggaauuagau

SEQ ID NO: 100541 - RNA, 22 nt, Homo sapiens
ucacaaguguauagacaugucc

SEQ ID NO: 100542 - RNA, 22 nt, Homo sapiens
ucacaauguaaaugaggguugg

SEQ ID NO: 100543 - RNA, 22 nt, Homo sapiens
ucacacugcaucuguuggaauu

SEQ ID NO: 100544 - RNA, 22 nt, Homo sapiens
ucacagaugcuugacccauuuc

SEQ ID NO: 100545 - RNA, 18 nt, Homo sapiens
ucacagguaaaguugaca

SEQ ID NO: 100546 - RNA, 18 nt, Homo sapiens
ucacagguaauuaggauu

SEQ ID NO: 100547 - RNA, 22 nt, Homo sapiens
ucacaguccuguuuaggagagg

SEQ ID NO: 100548 - RNA, 22 nt, Homo sapiens
ucacagucugcgugaugagaca

SEQ ID NO: 100549 - RNA, 22 nt, Homo sapiens
ucacaguucagcauggcugagg

SEQ ID NO: 100550 - RNA, 22 nt, Homo sapiens
ucacaugcacaucucuggaacc

SEQ ID NO: 100551 - RNA, 22 nt, Homo sapiens
ucacauggggaagggacuagcu

SEQ ID NO: 100552 - RNA, 22 nt, Homo sapiens
ucacaugggugcaauauaauca

SEQ ID NO: 100553 - RNA, 22 nt, Homo sapiens
ucacaugucagccguggggaag

SEQ ID NO: 100554 - RNA, 22 nt, Homo sapiens
ucacaugugaagauugggagua

SEQ ID NO: 100555 - RNA, 22 nt, Homo sapiens
ucacauuguacaaacagguaag

SEQ ID NO: 100556 - RNA, 22 nt, Homo sapiens
ucacauuguauauguaccuauc

SEQ ID NO: 100557 - RNA, 22 nt, Homo sapiens
ucaccaguaauaaagagccugc

SEQ ID NO: 100558 - RNA, 19 nt, Homo sapiens
ucaccaguacacaauacaa

SEQ ID NO: 100559 - RNA, 22 nt, Homo sapiens
ucaccaguacuccaaauugagg

SEQ ID NO: 100560 - RNA, 20 nt, Homo sapiens
ucacccugacaucugcccag

SEQ ID NO: 100561 - RNA, 22 nt, Homo sapiens
ucacccugacaugcggccgaac

SEQ ID NO: 100562 - RNA, 22 nt, Homo sapiens
ucacccuguguuuugcguuugc

SEQ ID NO: 100563 - RNA, 22 nt, Homo sapiens
ucaccggcagacguggccugau

SEQ ID NO: 100564 - RNA, 22 nt, Homo sapiens
ucaccuggagaagauggaucau

SEQ ID NO: 100565 - RNA, 19 nt, Homo sapiens
ucaccuugcccugcacaca

SEQ ID NO: 100566 - RNA, 22 nt, Homo sapiens
ucacgugcucuuguguguucug

SEQ ID NO: 100567 - RNA, 22 nt, Homo sapiens
ucacuaggcuggagugcagugg

SEQ ID NO: 100568 - RNA, 22 nt, Homo sapiens
ucacucagaccuggugauaugc

SEQ ID NO: 100569 - RNA, 22 nt, Homo sapiens
ucacugagaaugauguuucuga

SEQ ID NO: 100570 - RNA, 20 nt, Homo sapiens
ucacugaguaucuacgauua

SEQ ID NO: 100571 - RNA, 22 nt, Homo sapiens
ucacugcacuccagccuuuaug

SEQ ID NO: 100572 - RNA, 22 nt, Homo sapiens
ucacugcacucuccgccuugcg

SEQ ID NO: 100573 - RNA, 22 nt, Homo sapiens
ucacugcacuucaggcuuucuc

SEQ ID NO: 100574 - RNA, 22 nt, Homo sapiens
ucacugcgaccuccaccucccg

SEQ ID NO: 100575 - RNA, 22 nt, Homo sapiens
ucacugcgaccuccaccuccug

SEQ ID NO: 100576 - RNA, 22 nt, Homo sapiens
ucacugcgaccucugccucccg

SEQ ID NO: 100577 - RNA, 22 nt, Homo sapiens
ucacugggagcauuugagccuu

SEQ ID NO: 100578 - RNA, 22 nt, Homo sapiens
ucacuguguauguauaugcagg

SEQ ID NO: 100579 - RNA, 18 nt, Homo sapiens
ucacugugugucuugggu

SEQ ID NO: 100580 - RNA, 22 nt, Homo sapiens
ucacuugguggcaaaguuuaug

SEQ ID NO: 100581 - RNA, 22 nt, Homo sapiens
ucagaaccuccuagcaguguuc

SEQ ID NO: 100582 - RNA, 21 nt, Homo sapiens
ucagaagcucccagggaggac

SEQ ID NO: 100583 - RNA, 22 nt, Homo sapiens
ucagaccauuucauuacagacu

SEQ ID NO: 100584 - RNA, 22 nt, Homo sapiens
ucagagugcagggaguagcagc

SEQ ID NO: 100585 - RNA, 22 nt, Homo sapiens
ucagauacuggugacaugaaug

SEQ ID NO: 100586 - RNA, 22 nt, Homo sapiens
ucagaucauauucuucgcugcu

SEQ ID NO: 100587 - RNA, 22 nt, Homo sapiens
ucagaucauuaagguagguuua

SEQ ID NO: 100588 - RNA, 22 nt, Homo sapiens
ucagaugauucuguuguugugu

SEQ ID NO: 100589 - RNA, 19 nt, Homo sapiens
ucagaugcauuagggguua

SEQ ID NO: 100590 - RNA, 22 nt, Homo sapiens
uuaaugcuuuugggauauuucu

SEQ ID NO: 100591 - RNA, 22 nt, Homo sapiens
uuaaugugaaucaggaugcauu

SEQ ID NO: 100592 - RNA, 21 nt, Homo sapiens
uuacaauggcuccuugaaggu

SEQ ID NO: 100593 - RNA, 22 nt, Homo sapiens
uuacaccuguaauccagcacuu

SEQ ID NO: 100594 - RNA, 22 nt, Homo sapiens
uuacagauggauggcagcuggc

SEQ ID NO: 100595 - RNA, 22 nt, Homo sapiens
uuacaggacuaagcagcuuugc

SEQ ID NO: 100596 - RNA, 22 nt, Homo sapiens
uuacaguaugaguaagaguucu

SEQ ID NO: 100597 - RNA, 22 nt, Homo sapiens
uuacagucaaguuacauuucuc

SEQ ID NO: 100598 - RNA, 22 nt, Homo sapiens
uuacagucuuaggcagugcuuu

SEQ ID NO: 100599 - RNA, 22 nt, Homo sapiens
uuacaucaucacauuaguuugc

SEQ ID NO: 100600 - RNA, 22 nt, Homo sapiens
uuacaugagacugucgcuaguu

SEQ ID NO: 100601 - RNA, 22 nt, Homo sapiens
uuacaugcaugacaaggugcca

SEQ ID NO: 100602 - RNA, 22 nt, Homo sapiens
uuacauugcuucaaauucagug

SEQ ID NO: 100603 - RNA, 22 nt, Homo sapiens
uuaccagucuagggcucaguuu

SEQ ID NO: 100604 - RNA, 22 nt, Homo sapiens
uuaccagucugauaaacagaaa

SEQ ID NO: 100605 - RNA, 22 nt, Homo sapiens
uuaccucagaccugcucugugu

SEQ ID NO: 100606 - RNA, 22 nt, Homo sapiens
uuaccugagaaggugacauuug

SEQ ID NO: 100607 - RNA, 22 nt, Homo sapiens
uuaccuguguuuugggcccaga

SEQ ID NO: 100608 - RNA, 22 nt, Homo sapiens
uuaccuugcacugagucugaaa

SEQ ID NO: 100609 - RNA, 22 nt, Homo sapiens
uuacguaguuuuggagaucaua

SEQ ID NO: 100610 - RNA, 20 nt, Homo sapiens
uuacuauguaguauuggcuc

SEQ ID NO: 100611 - RNA, 22 nt, Homo sapiens
uuacugcucuuuugucaugagu

SEQ ID NO: 100612 - RNA, 22 nt, Homo sapiens
uuacuguacugcucuuaaccug

SEQ ID NO: 100613 - RNA, 22 nt, Homo sapiens
uuagaacaguguuugccucgcu

SEQ ID NO: 100614 - RNA, 22 nt, Homo sapiens
uuagaacuagaggaguuugagu

SEQ ID NO: 100615 - RNA, 19 nt, Homo sapiens
uuagagaucaucugcuuca

SEQ ID NO: 100616 - RNA, 20 nt, Homo sapiens
uuagaguaguaugauuuaua

SEQ ID NO: 100617 - RNA, 22 nt, Homo sapiens
uuagauaguacugaaugguucu

SEQ ID NO: 100618 - RNA, 22 nt, Homo sapiens
uuagaucaacauggaacucuau

SEQ ID NO: 100619 - RNA, 22 nt, Homo sapiens
uuagauuauugagcauccacug

SEQ ID NO: 100620 - RNA, 22 nt, Homo sapiens
uuagauuauugguguuuugcaa

SEQ ID NO: 100621 - RNA, 22 nt, Homo sapiens
uuagcaauugauucucauaagc

SEQ ID NO: 100622 - RNA, 22 nt, Homo sapiens
uuagcacaguucauucauguua

SEQ ID NO: 100623 - RNA, 22 nt, Homo sapiens
uuagcagcaccccacucuacug

SEQ ID NO: 100624 - RNA, 22 nt, Homo sapiens
uuagcagcaucccuggccugua

SEQ ID NO: 100625 - RNA, 22 nt, Homo sapiens
uuagcaugucuacuaauuugcu

SEQ ID NO: 100626 - RNA, 22 nt, Homo sapiens
uuagcccaucuugaggaaagua

SEQ ID NO: 100627 - RNA, 22 nt, Homo sapiens
uuaggcuuuauugaaaacaaua

SEQ ID NO: 100628 - RNA, 22 nt, Homo sapiens
uuagguaggugcuuuuuucaca

SEQ ID NO: 100629 - RNA, 22 nt, Homo sapiens
uuagguauuaggaaauaugcuu

SEQ ID NO: 100630 - RNA, 22 nt, Homo sapiens
uuagguauuuuguuaugucagc

SEQ ID NO: 100631 - RNA, 22 nt, Homo sapiens
uuaguagagacgagcguuccac

SEQ ID NO: 100632 - RNA, 22 nt, Homo sapiens
uuaguagcacagaguaucagca

SEQ ID NO: 100633 - RNA, 22 nt, Homo sapiens
uuaguaguagugcuguaauuuu

SEQ ID NO: 100634 - RNA, 22 nt, Homo sapiens
uuagucaaguguacugugaaug

SEQ ID NO: 100635 - RNA, 20 nt, Homo sapiens
uuagucuccucugcccuguc

SEQ ID NO: 100636 - RNA, 21 nt, Homo sapiens
uuagugcucaguuugacaaaa

SEQ ID NO: 100637 - RNA, 22 nt, Homo sapiens
uuagugcuuacgaugagcuaag

SEQ ID NO: 100638 - RNA, 22 nt, Homo sapiens
uuaguucauugugacuggacuc

SEQ ID NO: 100639 - RNA, 20 nt, Homo sapiens
uuaguucauuuagaagguuu

SEQ ID NO: 100640 - RNA, 22 nt, Homo sapiens
uuauagcacuaagaagguaaua

SEQ ID NO: 100641 - RNA, 21 nt, Homo sapiens
uuauaguggcaugauuuauaa

SEQ ID NO: 100642 - RNA, 22 nt, Homo sapiens
uuauaugcuaaacaaggggugg

SEQ ID NO: 100643 - RNA, 22 nt, Homo sapiens
uuaucagcagugcgaaaacaga

SEQ ID NO: 100644 - RNA, 22 nt, Homo sapiens
uuaucucagugaacugagugga

SEQ ID NO: 100645 - RNA, 22 nt, Homo sapiens
uuaugacaggcucaggagcccc

SEQ ID NO: 100646 - RNA, 22 nt, Homo sapiens
uuaugcuuauugguguacggua

SEQ ID NO: 100647 - RNA, 22 nt, Homo sapiens
uuaugcuugugugaauuuuccc

SEQ ID NO: 100648 - RNA, 22 nt, Homo sapiens
uuauggauuuauauucuguagu

SEQ ID NO: 100649 - RNA, 22 nt, Homo sapiens
uuaugguuguuaucuugguucg

SEQ ID NO: 100650 - RNA, 22 nt, Homo sapiens
uuaugguuuucucucacgcagg

SEQ ID NO: 100651 - RNA, 22 nt, Homo sapiens
uuaugucauuuuuggauguuaa

SEQ ID NO: 100652 - RNA, 22 nt, Homo sapiens
uuaugucuuuuguguucagcua

SEQ ID NO: 100653 - RNA, 22 nt, Homo sapiens
uuauuacuccuauuuuguagau

SEQ ID NO: 100654 - RNA, 22 nt, Homo sapiens
uuauuagguuaaccuauagcua

SEQ ID NO: 100655 - RNA, 22 nt, Homo sapiens
uuauuagguuagugcaaaaguu

SEQ ID NO: 100656 - RNA, 22 nt, Homo sapiens
uuauuauguuggugcaaaggua

SEQ ID NO: 100657 - RNA, 22 nt, Homo sapiens
uuauucagcaccugcuguguuc

SEQ ID NO: 100658 - RNA, 22 nt, Homo sapiens
uuauugcuaaaucaugaccaca

SEQ ID NO: 100659 - RNA, 22 nt, Homo sapiens
uuauugcuuuugugcaggugag

SEQ ID NO: 100660 - RNA, 22 nt, Homo sapiens
uucaaaucuuuggcucccacua

SEQ ID NO: 100661 - RNA, 22 nt, Homo sapiens
uucaacagugauggccuuugua

SEQ ID NO: 100662 - RNA, 22 nt, Homo sapiens
uucaagaauuaaaguggcuuuu

SEQ ID NO: 100663 - RNA, 22 nt, Homo sapiens
uucaagcuauggugaucuuuuc

SEQ ID NO: 100664 - RNA, 22 nt, Homo sapiens
uucaagucaauuuuugaaugac

SEQ ID NO: 100665 - RNA, 22 nt, Homo sapiens
uucaagugaacaaaaugaggag

SEQ ID NO: 100666 - RNA, 20 nt, Homo sapiens
uucaagugauucucaugccu

SEQ ID NO: 100667 - RNA, 22 nt, Homo sapiens
uucaauuaauauuauacucuca

SEQ ID NO: 100668 - RNA, 22 nt, Homo sapiens
uucacaauuaaaugugguuauu

SEQ ID NO: 100669 - RNA, 22 nt, Homo sapiens
uucacaguggugggagacguca

SEQ ID NO: 100670 - RNA, 22 nt, Homo sapiens
uucaccuguagcaugcccuugg

SEQ ID NO: 100671 - RNA, 20 nt, Homo sapiens
uucacugggcucucuguugg

SEQ ID NO: 100672 - RNA, 21 nt, Homo sapiens
uucacuggucuauuucccuuu

SEQ ID NO: 100673 - RNA, 22 nt, Homo sapiens
uucacugugaacucauauucag

SEQ ID NO: 100674 - RNA, 22 nt, Homo sapiens
uucacugugcuuaaauucugcu

SEQ ID NO: 100675 - RNA, 22 nt, Homo sapiens
uucagagugaggcucucggaac

SEQ ID NO: 100676 - RNA, 22 nt, Homo sapiens
uucaggcaccauugucauugau

SEQ ID NO: 100677 - RNA, 22 nt, Homo sapiens
uucagggcauuggaguuucuga

SEQ ID NO: 100678 - RNA, 22 nt, Homo sapiens
uucagguaguuuaacuguucca

SEQ ID NO: 100679 - RNA, 22 nt, Homo sapiens
uucaguagucaaaagauaaggg

SEQ ID NO: 100680 - RNA, 22 nt, Homo sapiens
uucaguauugcaccuggagucc

SEQ ID NO: 100681 - RNA, 17 nt, Homo sapiens
uugaaugcauuacuugg

SEQ ID NO: 100682 - RNA, 22 nt, Homo sapiens
uugaauguaugcuggguuuacu

SEQ ID NO: 100683 - RNA, 23 nt, Homo sapiens
uugaauguuuccccucccaaauu

SEQ ID NO: 100684 - RNA, 22 nt, Homo sapiens
uugacagagaaaagugugacuu

SEQ ID NO: 100685 - RNA, 22 nt, Homo sapiens
uugacaggaugcucagggccca

SEQ ID NO: 100686 - RNA, 22 nt, Homo sapiens
uugacauauguguguccacaua

SEQ ID NO: 100687 - RNA, 22 nt, Homo sapiens
uugacauauuugugcuuaagaa

SEQ ID NO: 100688 - RNA, 22 nt, Homo sapiens
uugaccuggagaguacuuugac

SEQ ID NO: 100689 - RNA, 23 nt, Homo sapiens
uugacuguggguacaaugugaua

SEQ ID NO: 100690 - RNA, 21 nt, Homo sapiens
uugagacggagucucacucug

SEQ ID NO: 100691 - RNA, 22 nt, Homo sapiens
uugagacggagucucacucugu

SEQ ID NO: 100692 - RNA, 22 nt, Homo sapiens
uugagagagaacauuuguuaca

SEQ ID NO: 100693 - RNA, 22 nt, Homo sapiens
uugagaucaugcuacugcacuc

SEQ ID NO: 100694 - RNA, 22 nt, Homo sapiens
uugagaucuuuuaggccuuugu

SEQ ID NO: 100695 - RNA, 22 nt, Homo sapiens
uugagaugauggauaugcuaau

SEQ ID NO: 100696 - RNA, 22 nt, Homo sapiens
uugagauggagucucacgcauu

SEQ ID NO: 100697 - RNA, 22 nt, Homo sapiens
uugagauggagucucacuccuu

SEQ ID NO: 100698 - RNA, 22 nt, Homo sapiens
uugagauggagucucacucuuc

SEQ ID NO: 100699 - RNA, 22 nt, Homo sapiens
uugagauggagucucgcacugu

SEQ ID NO: 100700 - RNA, 22 nt, Homo sapiens
uugagauggaguuucaauauug

SEQ ID NO: 100701 - RNA, 22 nt, Homo sapiens
uugagauggugccacuguacuc

SEQ ID NO: 100702 - RNA, 22 nt, Homo sapiens
uugagauguaagauguuaauau

SEQ ID NO: 100703 - RNA, 21 nt, Homo sapiens
uugagcaacuaggguuauagg

SEQ ID NO: 100704 - RNA, 22 nt, Homo sapiens
uugagcaucauguuagcacuca

SEQ ID NO: 100705 - RNA, 22 nt, Homo sapiens
uugagcccuggaggcagaggcu

SEQ ID NO: 100706 - RNA, 22 nt, Homo sapiens
uugagcuauguacagaugcugu

SEQ ID NO: 100707 - RNA, 22 nt, Homo sapiens
uugagcucuuccagccuggagc

SEQ ID NO: 100708 - RNA, 21 nt, Homo sapiens
uugagcuuuuaguacagacag

SEQ ID NO: 100709 - RNA, 22 nt, Homo sapiens
uugaggaagugguuccccagag

SEQ ID NO: 100710 - RNA, 22 nt, Homo sapiens
uugaggaaugucauuuguguuu

SEQ ID NO: 100711 - RNA, 22 nt, Homo sapiens
uugaggaggcagucugcccauu

SEQ ID NO: 100712 - RNA, 22 nt, Homo sapiens
uugaggaggcagucuguccguu

SEQ ID NO: 100713 - RNA, 22 nt, Homo sapiens
uugaggaguacugauuagguau

SEQ ID NO: 100714 - RNA, 22 nt, Homo sapiens
uugaggcaaugaggagaagcug

SEQ ID NO: 100715 - RNA, 16 nt, Homo sapiens
uugaggcaugucucag

SEQ ID NO: 100716 - RNA, 22 nt, Homo sapiens
uugaggccugauaacacacuga

SEQ ID NO: 100717 - RNA, 22 nt, Homo sapiens
uugaggcuuuugaccucaugug

SEQ ID NO: 100718 - RNA, 22 nt, Homo sapiens
uugagggagcacagauucuuau

SEQ ID NO: 100719 - RNA, 22 nt, Homo sapiens
uugaggguggcauauauugauu

SEQ ID NO: 100720 - RNA, 21 nt, Homo sapiens
uugagguaaaauccuauggga

SEQ ID NO: 100721 - RNA, 22 nt, Homo sapiens
uugaguaguaagaagaugauag

SEQ ID NO: 100722 - RNA, 22 nt, Homo sapiens
uugaguaguaaggauauuaucu

SEQ ID NO: 100723 - RNA, 22 nt, Homo sapiens
uugaguauuggacugguaucuu

SEQ ID NO: 100724 - RNA, 22 nt, Homo sapiens
uugaguauuugcagucugaaca

SEQ ID NO: 100725 - RNA, 22 nt, Homo sapiens
uugagugaaggcuguguucuug

SEQ ID NO: 100726 - RNA, 21 nt, Homo sapiens
uugaguugaagcaaggaggga

SEQ ID NO: 100727 - RNA, 22 nt, Homo sapiens
uugaguuugaguauucuaaagc

SEQ ID NO: 100728 - RNA, 22 nt, Homo sapiens
uugauaauguuaacuuugguca

SEQ ID NO: 100729 - RNA, 22 nt, Homo sapiens
uugauagacaucugaguuguug

SEQ ID NO: 100730 - RNA, 22 nt, Homo sapiens
uugauagguuuuauguauaguu

SEQ ID NO: 100731 - RNA, 22 nt, Homo sapiens
uugauaguuuaauuaaugcuag

SEQ ID NO: 100732 - RNA, 22 nt, Homo sapiens
uugauaguuuuaaaauuaaucu

SEQ ID NO: 100733 - RNA, 22 nt, Homo sapiens
uugauaugacuaucuuuuaugu

SEQ ID NO: 100734 - RNA, 22 nt, Homo sapiens
uugauauuaaguacugaagugg

SEQ ID NO: 100735 - RNA, 22 nt, Homo sapiens
uugauauuacucaguaacagau

SEQ ID NO: 100736 - RNA, 22 nt, Homo sapiens
uugauauucugagaagcugaag

SEQ ID NO: 100737 - RNA, 22 nt, Homo sapiens
uugauauucuuucuggauccca

SEQ ID NO: 100738 - RNA, 22 nt, Homo sapiens
uugaucaauagaauacaacaga

SEQ ID NO: 100739 - RNA, 22 nt, Homo sapiens
uugauguaggcauucaaggcua

SEQ ID NO: 100740 - RNA, 22 nt, Homo sapiens
uugcaaagaccucuucacuucc

SEQ ID NO: 100741 - RNA, 22 nt, Homo sapiens
uugcaaaguuugccuccuguag

SEQ ID NO: 100742 - RNA, 22 nt, Homo sapiens
uugcaaaucucuuguguuuggu

SEQ ID NO: 100743 - RNA, 21 nt, Homo sapiens
uugcaaaugcugcugccugau

SEQ ID NO: 100744 - RNA, 22 nt, Homo sapiens
uugcaacauguauucuggugau

SEQ ID NO: 100745 - RNA, 22 nt, Homo sapiens
uugcaaguggagcuuccagggc

SEQ ID NO: 100746 - RNA, 20 nt, Homo sapiens
uugcacagagaaggaggcag

SEQ ID NO: 100747 - RNA, 22 nt, Homo sapiens
uugcacagugcuuucuuugccc

SEQ ID NO: 100748 - RNA, 22 nt, Homo sapiens
uugcacauggcuggggaggccu

SEQ ID NO: 100749 - RNA, 22 nt, Homo sapiens
uugcacauuuuuucuggcagaa

SEQ ID NO: 100750 - RNA, 22 nt, Homo sapiens
uugcaccacugcacuccacccu

SEQ ID NO: 100751 - RNA, 22 nt, Homo sapiens
uugcaccacugcguuccagccu

SEQ ID NO: 100752 - RNA, 22 nt, Homo sapiens
uugcaccuuaugucuguucucu

SEQ ID NO: 100753 - RNA, 22 nt, Homo sapiens
uugcaccuugaagccaauagca

SEQ ID NO: 100754 - RNA, 22 nt, Homo sapiens
uugcacuccagcucgggugaca

SEQ ID NO: 100755 - RNA, 22 nt, Homo sapiens
uugcacuccauccuggguugac

SEQ ID NO: 100756 - RNA, 22 nt, Homo sapiens
uugcacuccggccuggguaaca

SEQ ID NO: 100757 - RNA, 18 nt, Homo sapiens
uugcacuccugccugggu

SEQ ID NO: 100758 - RNA, 22 nt, Homo sapiens
uugcacucuccagccucggcaa

SEQ ID NO: 100759 - RNA, 22 nt, Homo sapiens
uugcacuugcugaggagugauu

SEQ ID NO: 100760 - RNA, 22 nt, Homo sapiens
uugcagagccccugcaaggguc

SEQ ID NO: 100761 - RNA, 22 nt, Homo sapiens
uugcagcauucugguuccuggu

SEQ ID NO: 100762 - RNA, 19 nt, Homo sapiens
uugcaguauccuauauguu

SEQ ID NO: 100763 - RNA, 22 nt, Homo sapiens
uugcauaaguugaaccagccuu

SEQ ID NO: 100764 - RNA, 23 nt, Homo sapiens
uugcauagacauccucauagauu

SEQ ID NO: 100765 - RNA, 22 nt, Homo sapiens
uugcauagaccgaugucuugga

SEQ ID NO: 100766 - RNA, 22 nt, Homo sapiens
uugcauauguugaaccagccuu

SEQ ID NO: 100767 - RNA, 19 nt, Homo sapiens
uugcauauguugaaccagg

SEQ ID NO: 100768 - RNA, 22 nt, Homo sapiens
uugcaucagcaggcauaauugg

SEQ ID NO: 100769 - RNA, 22 nt, Homo sapiens
uugcaugguggaacuuggagcu

SEQ ID NO: 100770 - RNA, 22 nt, Homo sapiens
uugcauguacguacagagagag

SEQ ID NO: 100771 - RNA, 22 nt, Homo sapiens
uugccaauauuuuacugagaag

SEQ ID NO: 100772 - RNA, 21 nt, Homo sapiens
uugugccaaacccuggaggga

SEQ ID NO: 100773 - RNA, 22 nt, Homo sapiens
uugugcuuaauaaaaaguggua

SEQ ID NO: 100774 - RNA, 22 nt, Homo sapiens
uugugcuuaaugaguguaaggu

SEQ ID NO: 100775 - RNA, 22 nt, Homo sapiens
uugugcuuuacuuacuaccaga

SEQ ID NO: 100776 - RNA, 22 nt, Homo sapiens
uugugcuuuugagcugagauga

SEQ ID NO: 100777 - RNA, 16 nt, Homo sapiens
uuguggcuuuugcaca

SEQ ID NO: 100778 - RNA, 19 nt, Homo sapiens
uugugggaggacagagggg

SEQ ID NO: 100779 - RNA, 22 nt, Homo sapiens
uugugguaaucugugacagcag

SEQ ID NO: 100780 - RNA, 22 nt, Homo sapiens
uugugguuauagagucucccug

SEQ ID NO: 100781 - RNA, 22 nt, Homo sapiens
uugugguugacuaaauuuguaa

SEQ ID NO: 100782 - RNA, 22 nt, Homo sapiens
uugugguugauacacguaggaa

SEQ ID NO: 100783 - RNA, 22 nt, Homo sapiens
uuguguccccacccaaaucuca

SEQ ID NO: 100784 - RNA, 22 nt, Homo sapiens
uuguguccccacucaaauuaca

SEQ ID NO: 100785 - RNA, 22 nt, Homo sapiens
uugugucccugcggcugaggag

SEQ ID NO: 100786 - RNA, 17 nt, Homo sapiens
uuguucccauuaaaaag

SEQ ID NO: 100787 - RNA, 22 nt, Homo sapiens
uuguucccuucuggcuuuuaug

SEQ ID NO: 100788 - RNA, 22 nt, Homo sapiens
uuguugcacugcuuuccuggcc

SEQ ID NO: 100789 - RNA, 22 nt, Homo sapiens
uuguuuuggagaugagcuaaaa

SEQ ID NO: 100790 - RNA, 22 nt, Homo sapiens
uuuaaagcacggaguuuguggc

SEQ ID NO: 100791 - RNA, 22 nt, Homo sapiens
uuuaaagcuccaagcaugucug

SEQ ID NO: 100792 - RNA, 22 nt, Homo sapiens
uuuaaggcaggucuggugguga

SEQ ID NO: 100793 - RNA, 22 nt, Homo sapiens
uuuacagucucauagguggaag

SEQ ID NO: 100794 - RNA, 22 nt, Homo sapiens
uuuacugugggguuucuuagag

SEQ ID NO: 100795 - RNA, 22 nt, Homo sapiens
uuuagcaaagcaauuuacacca

SEQ ID NO: 100796 - RNA, 22 nt, Homo sapiens
uuuagcaauucauuuugugucu

SEQ ID NO: 100797 - RNA, 22 nt, Homo sapiens
uuuagcagcaaagagcuguguu

SEQ ID NO: 100798 - RNA, 22 nt, Homo sapiens
uuuaggcaauauauucaugucu

SEQ ID NO: 100799 - RNA, 22 nt, Homo sapiens
uuuagguauuugguauagcagu

SEQ ID NO: 100800 - RNA, 22 nt, Homo sapiens
uuuaucuguuuaaaacuguuca

SEQ ID NO: 100801 - RNA, 22 nt, Homo sapiens
uuucaacaggucuggggugguc

SEQ ID NO: 100802 - RNA, 19 nt, Homo sapiens
uuucaauguaaggauggag

SEQ ID NO: 100803 - RNA, 22 nt, Homo sapiens
uuucacagagggcuucuuucua

SEQ ID NO: 100804 - RNA, 23 nt, Homo sapiens
uuucacaguagcuggaucagccu

SEQ ID NO: 100805 - RNA, 22 nt, Homo sapiens
uuucacaguguucucccccaga

SEQ ID NO: 100806 - RNA, 22 nt, Homo sapiens
uuucagagucaucugcccaagu

SEQ ID NO: 100807 - RNA, 22 nt, Homo sapiens
uuucaggcagggagcuucagug

SEQ ID NO: 100808 - RNA, 18 nt, Homo sapiens
uuucaggguggacaugag

SEQ ID NO: 100809 - RNA, 15 nt, Homo sapiens
uuucaguacagauuc

SEQ ID NO: 100810 - RNA, 22 nt, Homo sapiens
uuucaguagagacacgguuuug

SEQ ID NO: 100811 - RNA, 23 nt, Homo sapiens
uuucaguaguuguauccuguugc

SEQ ID NO: 100812 - RNA, 22 nt, Homo sapiens
uuucauagccuuugucgucuga

SEQ ID NO: 100813 - RNA, 22 nt, Homo sapiens
uuucauaguuugcauagggcau

SEQ ID NO: 100814 - RNA, 22 nt, Homo sapiens
uuucaucaagcacagaguagau

SEQ ID NO: 100815 - RNA, 16 nt, Homo sapiens
uuucaucaguuuuaau

SEQ ID NO: 100816 - RNA, 22 nt, Homo sapiens
uuucauccggcuguguauuaug

SEQ ID NO: 100817 - RNA, 22 nt, Homo sapiens
uuucauggaggauuugcuucuu

SEQ ID NO: 100818 - RNA, 22 nt, Homo sapiens
uuucauggaggcauuuuagauu

SEQ ID NO: 100819 - RNA, 23 nt, Homo sapiens
uuucauggggauuuacucauucc

SEQ ID NO: 100820 - RNA, 22 nt, Homo sapiens
uuucauguuuuucugugaggca

SEQ ID NO: 100821 - RNA, 22 nt, Homo sapiens
uuuccagguggccaacauuuua

SEQ ID NO: 100822 - RNA, 22 nt, Homo sapiens
uuuccaguuuggaggaugcauu

SEQ ID NO: 100823 - RNA, 22 nt, Homo sapiens
uuucccuuuagcuuagugauuu

SEQ ID NO: 100824 - RNA, 22 nt, Homo sapiens
uuucgguuaucuagcuuuauga

SEQ ID NO: 100825 - RNA, 15 nt, Homo sapiens
uuucuacugcacuuc

SEQ ID NO: 100826 - RNA, 17 nt, Homo sapiens
uuucucagcccucuucu

SEQ ID NO: 100827 - RNA, 22 nt, Homo sapiens
uuucugagaccaaaacuuguaa

SEQ ID NO: 100828 - RNA, 22 nt, Homo sapiens
uuucugaggccucaccagaagc

SEQ ID NO: 100829 - RNA, 22 nt, Homo sapiens
uuucugcuugagagaauugcug

SEQ ID NO: 100830 - RNA, 22 nt, Homo sapiens
uuugaaaguaauuugguuggug

SEQ ID NO: 100831 - RNA, 22 nt, Homo sapiens
uuugaaccauuugaagaaugau

SEQ ID NO: 100832 - RNA, 22 nt, Homo sapiens
uuugaagacuacugggagugaa

SEQ ID NO: 100833 - RNA, 20 nt, Homo sapiens
uuugaauguaaagcauguca

SEQ ID NO: 100834 - RNA, 22 nt, Homo sapiens
uuugacaaugugugcuuguauu

SEQ ID NO: 100835 - RNA, 22 nt, Homo sapiens
uuugacuaccaggaauguucuu

SEQ ID NO: 100836 - RNA, 22 nt, Homo sapiens
uuugacuuuuagaauaugaguu

SEQ ID NO: 100837 - RNA, 22 nt, Homo sapiens
uuugagcaugcagauugccagg

SEQ ID NO: 100838 - RNA, 22 nt, Homo sapiens
uuugagcauggaaauggcauga

SEQ ID NO: 100839 - RNA, 22 nt, Homo sapiens
uuugagcuugacucagcuggag

SEQ ID NO: 100840 - RNA, 22 nt, Homo sapiens
uuugaguaggcuuauauuuugg

SEQ ID NO: 100841 - RNA, 22 nt, Homo sapiens
uuugauguccaccucagcccac

SEQ ID NO: 100842 - RNA, 22 nt, Homo sapiens
uuugauguugagacuauaaagc

SEQ ID NO: 100843 - RNA, 22 nt, Homo sapiens
uuugauuguacuaaaauuguac

SEQ ID NO: 100844 - RNA, 22 nt, Homo sapiens
uuugcaauguugugauggugaa

SEQ ID NO: 100845 - RNA, 22 nt, Homo sapiens
uuugcacauauuugggcaaaag

SEQ ID NO: 100846 - RNA, 22 nt, Homo sapiens
uuugcacuggagauucaauggg

SEQ ID NO: 100847 - RNA, 20 nt, Homo sapiens
uuugcagaaucuaagaagag

SEQ ID NO: 100848 - RNA, 22 nt, Homo sapiens
uuugcaguguaguuggccagca

SEQ ID NO: 100849 - RNA, 19 nt, Homo sapiens
uuugcauagugagaauaua

SEQ ID NO: 100850 - RNA, 21 nt, Homo sapiens
uuugcauauguugaaccagcc

SEQ ID NO: 100851 - RNA, 22 nt, Homo sapiens
uuugcaucuuuugcuuccugga

SEQ ID NO: 100852 - RNA, 22 nt, Homo sapiens
uuugccaaugggaauuuuccua

SEQ ID NO: 100853 - RNA, 22 nt, Homo sapiens
uuugccacugcaggcuguuuaa

SEQ ID NO: 100854 - RNA, 19 nt, Homo sapiens
uuugccuaggcacauggcc

SEQ ID NO: 100855 - RNA, 22 nt, Homo sapiens
uuugccuguagacacuuacccu

SEQ ID NO: 100856 - RNA, 22 nt, Homo sapiens
uuugcuaaucaacacuggccug

SEQ ID NO: 100857 - RNA, 22 nt, Homo sapiens
uuugcuuaaaguccuuguggga

SEQ ID NO: 100858 - RNA, 22 nt, Homo sapiens
uuuggaaugugcacucagauug

SEQ ID NO: 100859 - RNA, 22 nt, Homo sapiens
uuuggacuucuagccuccagag

SEQ ID NO: 100860 - RNA, 22 nt, Homo sapiens
uuuggauagugugguccuuuua

SEQ ID NO: 100861 - RNA, 23 nt, Homo sapiens
uuuggcauuccagaaauuuucau

SEQ ID NO: 100862 - RNA, 18 nt, Homo sapiens
uuuggcuguucaugacuc

SEQ ID NO: 100863 - RNA, 22 nt, Homo sapiens
uuuggcuguuucuggacuaaga

SEQ ID NO: 100864 - RNA, 22 nt, Homo sapiens
auagaauguauuaguaaauuug

SEQ ID NO: 100865 - RNA, 22 nt, Homo sapiens
auagagcuaccauagaauccag

SEQ ID NO: 100866 - RNA, 22 nt, Homo sapiens
auagcaaugccccacuccuugg

SEQ ID NO: 100867 - RNA, 22 nt, Homo sapiens
auagcaaugccccauucccagu

SEQ ID NO: 100868 - RNA, 22 nt, Homo sapiens
auagcaauuugggaaucagacu

SEQ ID NO: 100869 - RNA, 22 nt, Homo sapiens
auagcacaguguguguacacca

SEQ ID NO: 100870 - RNA, 22 nt, Homo sapiens
auagcacauggcauccucucuu

SEQ ID NO: 100871 - RNA, 20 nt, Homo sapiens
auagcagcaugauuuauaau

SEQ ID NO: 100872 - RNA, 20 nt, Homo sapiens
auagcagcaugauuuauagu

SEQ ID NO: 100873 - RNA, 22 nt, Homo sapiens
auagcaggagaauggucauggg

SEQ ID NO: 100874 - RNA, 22 nt, Homo sapiens
auagcagugugaaaacagacug

SEQ ID NO: 100875 - RNA, 22 nt, Homo sapiens
auagccaguagagagcuguuag

SEQ ID NO: 100876 - RNA, 22 nt, Homo sapiens
auagguauguaauacaaaugaa

SEQ ID NO: 100877 - RNA, 22 nt, Homo sapiens
auagguauuuuuaaaugacugu

SEQ ID NO: 100878 - RNA, 22 nt, Homo sapiens
auaguagagagggcaaaaugcu

SEQ ID NO: 100879 - RNA, 22 nt, Homo sapiens
auagugcuauggcagaccuuga

SEQ ID NO: 100880 - RNA, 22 nt, Homo sapiens
auagugcugcaauaaacauaug

SEQ ID NO: 100881 - RNA, 22 nt, Homo sapiens
auagugcugcaaucaacauaca

SEQ ID NO: 100882 - RNA, 22 nt, Homo sapiens
auagugcugcacuaaacauaca

SEQ ID NO: 100883 - RNA, 22 nt, Homo sapiens
auagugcuguauuaaacauacg

SEQ ID NO: 100884 - RNA, 22 nt, Homo sapiens
auagugcuuuugaaucuuguug

SEQ ID NO: 100885 - RNA, 22 nt, Homo sapiens
auagugcuuuuuagaaccugga

SEQ ID NO: 100886 - RNA, 19 nt, Homo sapiens
auaguguaggaaaacagcu

SEQ ID NO: 100887 - RNA, 22 nt, Homo sapiens
auauaccuaggcuacaugguuu

SEQ ID NO: 100888 - RNA, 22 nt, Homo sapiens
auauagcucuggcuggaugacu

SEQ ID NO: 100889 - RNA, 22 nt, Homo sapiens
auauaguguuuuuugguacgcu

SEQ ID NO: 100890 - RNA, 15 nt, Homo sapiens
auauaugcaaugugu

SEQ ID NO: 100891 - RNA, 22 nt, Homo sapiens
auaucacaaacaagucuguacu

SEQ ID NO: 100892 - RNA, 22 nt, Homo sapiens
auaucacaggaaaggaagauac

SEQ ID NO: 100893 - RNA, 22 nt, Homo sapiens
auaucacucccaauaucgcagg

SEQ ID NO: 100894 - RNA, 22 nt, Homo sapiens
auaucccagugaugauugauag

SEQ ID NO: 100895 - RNA, 22 nt, Homo sapiens
auaucugcauugccauuuaugu

SEQ ID NO: 100896 - RNA, 22 nt, Homo sapiens
auaugcaaauccauagagacag

SEQ ID NO: 100897 - RNA, 22 nt, Homo sapiens
auaugcauacccucaccaacua

SEQ ID NO: 100898 - RNA, 20 nt, Homo sapiens
auaugcauguguuuucacuu

SEQ ID NO: 100899 - RNA, 22 nt, Homo sapiens
auauggcuaugugagcauacca

SEQ ID NO: 100900 - RNA, 19 nt, Homo sapiens
auaugggguuugaacugug

SEQ ID NO: 100901 - RNA, 22 nt, Homo sapiens
auauguaguuucagaaguggaa

SEQ ID NO: 100902 - RNA, 17 nt, Homo sapiens
auaugucugcuggggga

SEQ ID NO: 100903 - RNA, 22 nt, Homo sapiens
auaugugacuucaugcaaggcu

SEQ ID NO: 100904 - RNA, 22 nt, Homo sapiens
auauuacuggccauaucgcagg

SEQ ID NO: 100905 - RNA, 22 nt, Homo sapiens
auauuagguuggugcaaaagua

SEQ ID NO: 100906 - RNA, 18 nt, Homo sapiens
auauugcauuggauggau

SEQ ID NO: 100907 - RNA, 18 nt, Homo sapiens
auauugccuucagacuag

SEQ ID NO: 100908 - RNA, 22 nt, Homo sapiens
auauugcuugaggccaggaggu

SEQ ID NO: 100909 - RNA, 22 nt, Homo sapiens
auauuggccuaaaauucucuuu

SEQ ID NO: 100910 - RNA, 22 nt, Homo sapiens
auauuggucuucaagaccugug

SEQ ID NO: 100911 - RNA, 22 nt, Homo sapiens
auauuguacugcuacugguucu

SEQ ID NO: 100912 - RNA, 22 nt, Homo sapiens
aucaaagccaugcucaguuuuc

SEQ ID NO: 100913 - RNA, 22 nt, Homo sapiens
aucaaaguaggcauauguuuuu

SEQ ID NO: 100914 - RNA, 22 nt, Homo sapiens
aucaaaguaucucaauauggua

SEQ ID NO: 100915 - RNA, 22 nt, Homo sapiens
aucaaaugcuggcagagugccu

SEQ ID NO: 100916 - RNA, 22 nt, Homo sapiens
aucaagcugcuuguuugaaucu

SEQ ID NO: 100917 - RNA, 22 nt, Homo sapiens
aucaaguacuguacugaaagug

SEQ ID NO: 100918 - RNA, 22 nt, Homo sapiens
aucacagugagcauaugucuau

SEQ ID NO: 100919 - RNA, 22 nt, Homo sapiens
aucacaguggcucacaagagcc

SEQ ID NO: 100920 - RNA, 22 nt, Homo sapiens
aucacaguuuuaccauuuggua

SEQ ID NO: 100921 - RNA, 20 nt, Homo sapiens
aucacuggagaaggaaaccu

SEQ ID NO: 100922 - RNA, 22 nt, Homo sapiens
aucacuggccuuuuuaaaugcu

SEQ ID NO: 100923 - RNA, 22 nt, Homo sapiens
aucacuguaaguuuacacuuug

SEQ ID NO: 100924 - RNA, 22 nt, Homo sapiens
aucacuguuuugaugcucggac

SEQ ID NO: 100925 - RNA, 22 nt, Homo sapiens
aucagaaucucuugagaguguu

SEQ ID NO: 100926 - RNA, 20 nt, Homo sapiens
aucagagccggugaaagggc

SEQ ID NO: 100927 - RNA, 22 nt, Homo sapiens
aucagagccugugugcccugaa

SEQ ID NO: 100928 - RNA, 22 nt, Homo sapiens
aucagagugaauaaugacaaaa

SEQ ID NO: 100929 - RNA, 22 nt, Homo sapiens
cagagcaaugcuuuugcuuuga

SEQ ID NO: 100930 - RNA, 22 nt, Homo sapiens
cagauacuccuggucucaggag

SEQ ID NO: 100931 - RNA, 22 nt, Homo sapiens
cagauacuggaguccugaaguu

SEQ ID NO: 100932 - RNA, 22 nt, Homo sapiens
cagauaguuguagauaugcagc

SEQ ID NO: 100933 - RNA, 22 nt, Homo sapiens
cagauaguuguagguguguggc

SEQ ID NO: 100934 - RNA, 22 nt, Homo sapiens
cagaugcaugaccugggcuugg

SEQ ID NO: 100935 - RNA, 22 nt, Homo sapiens
cagauggucuuaaggcagccuu

SEQ ID NO: 100936 - RNA, 22 nt, Homo sapiens
cagauguaguauuuuagugaaa

SEQ ID NO: 100937 - RNA, 22 nt, Homo sapiens
cagcaaaucauccuauuugagc

SEQ ID NO: 100938 - RNA, 22 nt, Homo sapiens
cagcuaaauuguuaaauccaag

SEQ ID NO: 100939 - RNA, 22 nt, Homo sapiens
cagcucuuguuaaaacuaacua

SEQ ID NO: 100940 - RNA, 22 nt, Homo sapiens
cagcuggugcugcaccaguggg

SEQ ID NO: 100941 - RNA, 22 nt, Homo sapiens
cagcugguggcaagaagacaga

SEQ ID NO: 100942 - RNA, 22 nt, Homo sapiens
cagcuguguuauaaacuaccau

SEQ ID NO: 100943 - RNA, 23 nt, Homo sapiens
cagcuucauugaacauaacuccu

SEQ ID NO: 100944 - RNA, 22 nt, Homo sapiens
caggaaugugaggguucccugc

SEQ ID NO: 100945 - RNA, 22 nt, Homo sapiens
caggcagucuggggguguaucc

SEQ ID NO: 100946 - RNA, 22 nt, Homo sapiens
caggcagugggagacaaaacug

SEQ ID NO: 100947 - RNA, 22 nt, Homo sapiens
caggcauuguauuguaaucccc

SEQ ID NO: 100948 - RNA, 22 nt, Homo sapiens
cagggcaugugggucuauuggc

SEQ ID NO: 100949 - RNA, 22 nt, Homo sapiens
cagggcauuggcugguaccugg

SEQ ID NO: 100950 - RNA, 22 nt, Homo sapiens
cagguaguguguagcacagcag

SEQ ID NO: 100951 - RNA, 23 nt, Homo sapiens
cagguaguucuuuauaguagugu

SEQ ID NO: 100952 - RNA, 22 nt, Homo sapiens
caggugcuuacuuaauagccau

SEQ ID NO: 100953 - RNA, 22 nt, Homo sapiens
caguacaauguugauuagaagu

SEQ ID NO: 100954 - RNA, 19 nt, Homo sapiens
caguaucauugcacauagu

SEQ ID NO: 100955 - RNA, 20 nt, Homo sapiens
cagucauagacaucagaguc

SEQ ID NO: 100956 - RNA, 22 nt, Homo sapiens
cagugcaaagccucugcccaga

SEQ ID NO: 100957 - RNA, 22 nt, Homo sapiens
cagugcauaggaucuaaaauuu

SEQ ID NO: 100958 - RNA, 22 nt, Homo sapiens
cagugcuuguuauuguucuauu

SEQ ID NO: 100959 - RNA, 22 nt, Homo sapiens
cagugguuuuuagcuugcuggg

SEQ ID NO: 100960 - RNA, 22 nt, Homo sapiens
cagugucugcauuuggaacuca

SEQ ID NO: 100961 - RNA, 22 nt, Homo sapiens
cauacagcuaguaaguguaaga

SEQ ID NO: 100962 - RNA, 22 nt, Homo sapiens
cauagcacugagcucuacccuc

SEQ ID NO: 100963 - RNA, 22 nt, Homo sapiens
cauagcacugcacuucagccug

SEQ ID NO: 100964 - RNA, 22 nt, Homo sapiens
cauagguugggcguuugauuuu

SEQ ID NO: 100965 - RNA, 22 nt, Homo sapiens
caucacagcaaguagggagugg

SEQ ID NO: 100966 - RNA, 22 nt, Homo sapiens
caucacaugcuuauuuuccuca

SEQ ID NO: 100967 - RNA, 22 nt, Homo sapiens
caucagauugagaucaucuaag

SEQ ID NO: 100968 - RNA, 22 nt, Homo sapiens
caucaggugaggauucaaugca

SEQ ID NO: 100969 - RNA, 22 nt, Homo sapiens
cauccccugcaccaaccuuuac

SEQ ID NO: 100970 - RNA, 21 nt, Homo sapiens
cauccccugccauuguggucu

SEQ ID NO: 100971 - RNA, 22 nt, Homo sapiens
caugaaagacugaggaauugga

SEQ ID NO: 100972 - RNA, 22 nt, Homo sapiens
caugacacuggcauguuucuuu

SEQ ID NO: 100973 - RNA, 22 nt, Homo sapiens
caugaugcuagguauggaugaa

SEQ ID NO: 100974 - RNA, 22 nt, Homo sapiens
caugcagcacacaugucugugc

SEQ ID NO: 100975 - RNA, 19 nt, Homo sapiens
caugccacugcacuugagu

SEQ ID NO: 100976 - RNA, 22 nt, Homo sapiens
cauggcacauauauaucuaggu

SEQ ID NO: 100977 - RNA, 22 nt, Homo sapiens
cauggcaucuguguggccucca

SEQ ID NO: 100978 - RNA, 22 nt, Homo sapiens
cauggcccuggguccauaggaa

SEQ ID NO: 100979 - RNA, 22 nt, Homo sapiens
cauggcucuuguuuacucccag

SEQ ID NO: 100980 - RNA, 19 nt, Homo sapiens
cauggcuuauaauuuuaau

SEQ ID NO: 100981 - RNA, 22 nt, Homo sapiens
cauggguuuucucaaguaguca

SEQ ID NO: 100982 - RNA, 22 nt, Homo sapiens
caugguguuaggcacugggaau

SEQ ID NO: 100983 - RNA, 22 nt, Homo sapiens
cauguaguagaaggagccagac

SEQ ID NO: 100984 - RNA, 22 nt, Homo sapiens
cauuaagcuacuuagaaggugc

SEQ ID NO: 100985 - RNA, 22 nt, Homo sapiens
cauuaguugaagugcagggaga

SEQ ID NO: 100986 - RNA, 22 nt, Homo sapiens
cauuccacuggauaaacaaggu

SEQ ID NO: 100987 - RNA, 20 nt, Homo sapiens
cauuccacuuuccugucagu

SEQ ID NO: 100988 - RNA, 22 nt, Homo sapiens
cauugcacacauuuaccuaugu

SEQ ID NO: 100989 - RNA, 22 nt, Homo sapiens
cauugcacuccaccuuggguaa

SEQ ID NO: 100990 - RNA, 22 nt, Homo sapiens
cauugcacuccacuccugaaca

SEQ ID NO: 100991 - RNA, 22 nt, Homo sapiens
cauugcacuccagccuagccaa

SEQ ID NO: 100992 - RNA, 23 nt, Homo sapiens
ugacuuaggccucaacuaugacu

SEQ ID NO: 100993 - RNA, 22 nt, Homo sapiens
ugacuucagacugaaaugauuc

SEQ ID NO: 100994 - RNA, 22 nt, Homo sapiens
ugacuugaggcucgcacaaguu

SEQ ID NO: 100995 - RNA, 22 nt, Homo sapiens
ugacuugaguaacuggcucagg

SEQ ID NO: 100996 - RNA, 22 nt, Homo sapiens
ugacuugauccauggggcucca

SEQ ID NO: 100997 - RNA, 20 nt, Homo sapiens
ugacuuguccgagguccccc

SEQ ID NO: 100998 - RNA, 22 nt, Homo sapiens
ugacuuuagaauuuuauccaga

SEQ ID NO: 100999 - RNA, 22 nt, Homo sapiens
ugagaacaugcacuugagguug

SEQ ID NO: 101000 - RNA, 20 nt, Homo sapiens
ugagaacauguggcauuugg

SEQ ID NO: 101001 - RNA, 17 nt, Homo sapiens
ugagaacaugugguauu

SEQ ID NO: 101002 - RNA, 20 nt, Homo sapiens
ugagaacaugugguauuugg

SEQ ID NO: 101003 - RNA, 18 nt, Homo sapiens
ugagaacauguguacaca

SEQ ID NO: 101004 - RNA, 22 nt, Homo sapiens
ugagaacuaaaaugugguauau

SEQ ID NO: 101005 - RNA, 22 nt, Homo sapiens
ugagaacuaaugaagaauuuau

SEQ ID NO: 101006 - RNA, 22 nt, Homo sapiens
ugagaacucaugaaucuuucca

SEQ ID NO: 101007 - RNA, 22 nt, Homo sapiens
ugagaacucaugggucugcugg

SEQ ID NO: 101008 - RNA, 22 nt, Homo sapiens
ugagaacugcagggagcugcau

SEQ ID NO: 101009 - RNA, 22 nt, Homo sapiens
ugagaacuuauggugauuuuuu

SEQ ID NO: 101010 - RNA, 22 nt, Homo sapiens
ugagaacuuugucuuuuacucu

SEQ ID NO: 101011 - RNA, 22 nt, Homo sapiens
ugagaagcauaccagugucugu

SEQ ID NO: 101012 - RNA, 22 nt, Homo sapiens
ugagaaugaugauuuccaguuu

SEQ ID NO: 101013 - RNA, 22 nt, Homo sapiens
ugagaauguagggcucucccag

SEQ ID NO: 101014 - RNA, 22 nt, Homo sapiens
ugagacauauuauacugcuuuu

SEQ ID NO: 101015 - RNA, 22 nt, Homo sapiens
ugagacaucugagauuuuaagc

SEQ ID NO: 101016 - RNA, 22 nt, Homo sapiens
ugagaccaacagauuccaguuc

SEQ ID NO: 101017 - RNA, 22 nt, Homo sapiens
ugagaccuuucauuucucagug

SEQ ID NO: 101018 - RNA, 22 nt, Homo sapiens
ugagacggagucucgcuguguc

SEQ ID NO: 101019 - RNA, 22 nt, Homo sapiens
ugagacggagucuugcuaaguu

SEQ ID NO: 101020 - RNA, 22 nt, Homo sapiens
ugagacggaguuuugcucuugu

SEQ ID NO: 101021 - RNA, 22 nt, Homo sapiens
ugagacgucuucucuucuucaa

SEQ ID NO: 101022 - RNA, 22 nt, Homo sapiens
ugagacugagucucgcucuauu

SEQ ID NO: 101023 - RNA, 22 nt, Homo sapiens
ugagacugagucuugcucuauu

SEQ ID NO: 101024 - RNA, 22 nt, Homo sapiens
ugagacugaguuucacuuuugu

SEQ ID NO: 101025 - RNA, 22 nt, Homo sapiens
ugagacugauaggacauuuucu

SEQ ID NO: 101026 - RNA, 22 nt, Homo sapiens
ugagagacaguuuguuaaaauu

SEQ ID NO: 101027 - RNA, 22 nt, Homo sapiens
ugagagaugaacuauucuugaa

SEQ ID NO: 101028 - RNA, 22 nt, Homo sapiens
ugagagcuuuuuugccugguga

SEQ ID NO: 101029 - RNA, 22 nt, Homo sapiens
ugagaggugauaaagcaagggu

SEQ ID NO: 101030 - RNA, 22 nt, Homo sapiens
ugagaguauaaauugaugcagc

SEQ ID NO: 101031 - RNA, 22 nt, Homo sapiens
ugagagucauacaaauaaaaau

SEQ ID NO: 101032 - RNA, 22 nt, Homo sapiens
ugagauaaagcauguacugugu

SEQ ID NO: 101033 - RNA, 22 nt, Homo sapiens
ugagauaacuaaaaacauuuug

SEQ ID NO: 101034 - RNA, 21 nt, Homo sapiens
ugagauaauauguuucugaug

SEQ ID NO: 101035 - RNA, 22 nt, Homo sapiens
ugagauagcauaagggacagaa

SEQ ID NO: 101036 - RNA, 20 nt, Homo sapiens
ugagauaguaauccccuaca

SEQ ID NO: 101037 - RNA, 22 nt, Homo sapiens
ugagauaguuguagauguacau

SEQ ID NO: 101038 - RNA, 22 nt, Homo sapiens
ugagaucaagguuaauauaauc

SEQ ID NO: 101039 - RNA, 22 nt, Homo sapiens
ugagaucacuaagagguaaugg

SEQ ID NO: 101040 - RNA, 22 nt, Homo sapiens
ugagaucagugaagaaguguuu

SEQ ID NO: 101041 - RNA, 22 nt, Homo sapiens
ugagaucaugucauuugcacuc

SEQ ID NO: 101042 - RNA, 19 nt, Homo sapiens
ugagauccacugaagauuc

SEQ ID NO: 101043 - RNA, 22 nt, Homo sapiens
ugagauccugagaguugggacu

SEQ ID NO: 101044 - RNA, 22 nt, Homo sapiens
ugagaucgagucucgcucuguc

SEQ ID NO: 101045 - RNA, 19 nt, Homo sapiens
ugagaugaagacagggguu

SEQ ID NO: 101046 - RNA, 22 nt, Homo sapiens
ugagaugaagcuagaagaaugg

SEQ ID NO: 101047 - RNA, 22 nt, Homo sapiens
ugagaugaagucuugcucuguu

SEQ ID NO: 101048 - RNA, 22 nt, Homo sapiens
ugagaugagagaaugcuugccu

SEQ ID NO: 101049 - RNA, 22 nt, Homo sapiens
ugagaugaguucucgcucuguc

SEQ ID NO: 101050 - RNA, 22 nt, Homo sapiens
ugagaugaugggauaagagggc

SEQ ID NO: 101051 - RNA, 20 nt, Homo sapiens
ugagaugcauugggauguuu

SEQ ID NO: 101052 - RNA, 22 nt, Homo sapiens
ugagaugcuccucuugcaaagc

SEQ ID NO: 101053 - RNA, 22 nt, Homo sapiens
ugagaugcuuguaaauucauuu

SEQ ID NO: 101054 - RNA, 22 nt, Homo sapiens
ugagauggaguuucgcucuugu

SEQ ID NO: 101055 - RNA, 22 nt, Homo sapiens
ugagauggcugaauucagaaua

SEQ ID NO: 101056 - RNA, 23 nt, Homo sapiens
ugagaugucugauugcgaggguc

SEQ ID NO: 101057 - RNA, 23 nt, Homo sapiens
ugagauuauaaucuuuuacuucu

SEQ ID NO: 101058 - RNA, 22 nt, Homo sapiens
ugagauuaucuugaucuugaaa

SEQ ID NO: 101059 - RNA, 20 nt, Homo sapiens
ugagauuggugugguauaag

SEQ ID NO: 101060 - RNA, 22 nt, Homo sapiens
ugagcaaaauuuuggacauaga

SEQ ID NO: 101061 - RNA, 23 nt, Homo sapiens
ugagcaauauucuacuauugagu

SEQ ID NO: 101062 - RNA, 22 nt, Homo sapiens
ugagcacagagccugggguggc

SEQ ID NO: 101063 - RNA, 22 nt, Homo sapiens
ugagcacagcgugugggagagc

SEQ ID NO: 101064 - RNA, 22 nt, Homo sapiens
ugagcacauuuacaucaguucc

SEQ ID NO: 101065 - RNA, 22 nt, Homo sapiens
ugagcacuguacuuuaucaggu

SEQ ID NO: 101066 - RNA, 22 nt, Homo sapiens
ugagcagugaguguggugcagg

SEQ ID NO: 101067 - RNA, 22 nt, Homo sapiens
ugagcauauuuaagguaugcua

SEQ ID NO: 101068 - RNA, 21 nt, Homo sapiens
ugagcauuaguacaguaggga

SEQ ID NO: 101069 - RNA, 22 nt, Homo sapiens
ugagcauuguguuugacuguga

SEQ ID NO: 101070 - RNA, 22 nt, Homo sapiens
ugagccaaguucacaccauugc

SEQ ID NO: 101071 - RNA, 23 nt, Homo sapiens
ugagccaugggacuccaagggag

SEQ ID NO: 101072 - RNA, 22 nt, Homo sapiens
ugagccaugggguaaaugugau

SEQ ID NO: 101073 - RNA, 17 nt, Homo sapiens
ugagcuaagauuacccc

SEQ ID NO: 101074 - RNA, 22 nt, Homo sapiens
ugagcuagagaguuuaguguca

SEQ ID NO: 101075 - RNA, 22 nt, Homo sapiens
ugagcuaggaucacaccugcau

SEQ ID NO: 101076 - RNA, 20 nt, Homo sapiens
ugagcucaugacauuuuucu

SEQ ID NO: 101077 - RNA, 22 nt, Homo sapiens
ugagcucaugcauucuugagga

SEQ ID NO: 101078 - RNA, 22 nt, Homo sapiens
ugagcuccuucauaaaaaggca

SEQ ID NO: 101079 - RNA, 22 nt, Homo sapiens
ugagcugagaaaugcagcagcu

SEQ ID NO: 101080 - RNA, 22 nt, Homo sapiens
ugagcugagauuaagcugcugc

SEQ ID NO: 101081 - RNA, 18 nt, Homo sapiens
ugaggaaaggguuugcua

SEQ ID NO: 101082 - RNA, 22 nt, Homo sapiens
ugaggacugagaggcacugugg

SEQ ID NO: 101083 - RNA, 22 nt, Homo sapiens
ugaggcaaggcugaaugaaggc

SEQ ID NO: 101084 - RNA, 17 nt, Homo sapiens
ugaggcacuaguaucac

SEQ ID NO: 101085 - RNA, 17 nt, Homo sapiens
ugagggaugccugguuc

SEQ ID NO: 101086 - RNA, 22 nt, Homo sapiens
ugaggguauagccagcccuuag

SEQ ID NO: 101087 - RNA, 22 nt, Homo sapiens
ugagguaagauguucauuuuuc

SEQ ID NO: 101088 - RNA, 22 nt, Homo sapiens
ugaggucacuuguuuuaugcuu

SEQ ID NO: 101089 - RNA, 20 nt, Homo sapiens
ugaggucaggaguuacagac

SEQ ID NO: 101090 - RNA, 22 nt, Homo sapiens
ugaggugcagcaauccucaugu

SEQ ID NO: 101091 - RNA, 22 nt, Homo sapiens
ugagguugaaggacauuuuuau

SEQ ID NO: 101092 - RNA, 22 nt, Homo sapiens
ugagguugguauuacugucucu

SEQ ID NO: 101093 - RNA, 22 nt, Homo sapiens
ugaguaauguugaucuuugaua

SEQ ID NO: 101094 - RNA, 22 nt, Homo sapiens
ugaguacugauuuaagauacac

SEQ ID NO: 101095 - RNA, 22 nt, Homo sapiens
ugaguagauccaagacuguccu

SEQ ID NO: 101096 - RNA, 22 nt, Homo sapiens
ugaguagcuaauguuuacugag

SEQ ID NO: 101097 - RNA, 23 nt, Homo sapiens
ugaguaggcaguuuuccccucac

SEQ ID NO: 101098 - RNA, 23 nt, Homo sapiens
ugaguaggugguuuuccccucac

SEQ ID NO: 101099 - RNA, 22 nt, Homo sapiens
ugaguaguauucuaugguaugu

SEQ ID NO: 101100 - RNA, 22 nt, Homo sapiens
ugaguagucuagaguggaaugu

SEQ ID NO: 101101 - RNA, 22 nt, Homo sapiens
ugaguagugcugcaauaaacau

SEQ ID NO: 101102 - RNA, 22 nt, Homo sapiens
ugaguaucuugaugaauuugaa

SEQ ID NO: 101103 - RNA, 22 nt, Homo sapiens
ugaguauguaggaugugucuua

SEQ ID NO: 101104 - RNA, 22 nt, Homo sapiens
ugagucagucucacucugcugc

SEQ ID NO: 101105 - RNA, 22 nt, Homo sapiens
ugagucaugcuggagucauggc

SEQ ID NO: 101106 - RNA, 22 nt, Homo sapiens
ugagucauguaauaaugcugcu

SEQ ID NO: 101107 - RNA, 22 nt, Homo sapiens
ugaguguccaaguaaggugaaa

SEQ ID NO: 101108 - RNA, 22 nt, Homo sapiens
ugaguguccaccccuuucacag

SEQ ID NO: 101109 - RNA, 22 nt, Homo sapiens
ugagugugacuuagcagaagga

SEQ ID NO: 101110 - RNA, 22 nt, Homo sapiens
ugagugugaggaagaauuagaa

SEQ ID NO: 101111 - RNA, 22 nt, Homo sapiens
ugaguuagguaauaauaaauau

SEQ ID NO: 101112 - RNA, 18 nt, Homo sapiens
ugaguucauuagacuucc

SEQ ID NO: 101113 - RNA, 22 nt, Homo sapiens
ugaguugagauaagguuacauu

SEQ ID NO: 101114 - RNA, 22 nt, Homo sapiens
ugaguuguugcauucuuggugu

SEQ ID NO: 101115 - RNA, 22 nt, Homo sapiens
ugauaacugaucuggauuugua

SEQ ID NO: 101116 - RNA, 22 nt, Homo sapiens
ugauagaucugggcaaaguaaa

SEQ ID NO: 101117 - RNA, 22 nt, Homo sapiens
ugauagucauucaauuuagcca

SEQ ID NO: 101118 - RNA, 22 nt, Homo sapiens
ugauagugccuuuuauaucucu

SEQ ID NO: 101119 - RNA, 22 nt, Homo sapiens
ugauaugaaguuagcuggcugu

SEQ ID NO: 101120 - RNA, 22 nt, Homo sapiens
ugauauguaugugaccuagaaa

SEQ ID NO: 101121 - RNA, 22 nt, Homo sapiens
ugauaugugaguauaugguuau

SEQ ID NO: 101122 - RNA, 22 nt, Homo sapiens
ugauauguggauucagcucaaa

SEQ ID NO: 101123 - RNA, 22 nt, Homo sapiens
ugauauguggcuauugagauug

SEQ ID NO: 101124 - RNA, 17 nt, Homo sapiens
ugauauuuucccagaua

SEQ ID NO: 101125 - RNA, 20 nt, Homo sapiens
ugauauuuucugagcaggaa

SEQ ID NO: 101126 - RNA, 21 nt, Homo sapiens
ugaucacaugaaaaccaugca

SEQ ID NO: 101127 - RNA, 22 nt, Homo sapiens
ugaugaugaaugaucuuuuaca

SEQ ID NO: 101128 - RNA, 22 nt, Homo sapiens
ugaugcuacuaccugggcugaa

SEQ ID NO: 101129 - RNA, 22 nt, Homo sapiens
ugaugcugaguggcuauuugaa

SEQ ID NO: 101130 - RNA, 22 nt, Homo sapiens
ugauggcaauggcauucauuuu

SEQ ID NO: 101131 - RNA, 22 nt, Homo sapiens
ugaugguccauaguucauggua

SEQ ID NO: 101132 - RNA, 22 nt, Homo sapiens
ugaugguuuuauaagggagagu

SEQ ID NO: 101133 - RNA, 22 nt, Homo sapiens
ugauguauuauuaagaccuggc

SEQ ID NO: 101134 - RNA, 23 nt, Homo sapiens
ugauguccacuuagggucuaggu

SEQ ID NO: 101135 - RNA, 20 nt, Homo sapiens
ugauguccaggcagagguuu

SEQ ID NO: 101136 - RNA, 22 nt, Homo sapiens
ugauguugacuguaggcagaga

SEQ ID NO: 101137 - RNA, 22 nt, Homo sapiens
ugauuagagagcuggguguccu

SEQ ID NO: 101138 - RNA, 22 nt, Homo sapiens
ugauuagaggaaugguagauua

SEQ ID NO: 101139 - RNA, 19 nt, Homo sapiens
ugauuguaagcuuggugag

SEQ ID NO: 101140 - RNA, 19 nt, Homo sapiens
ugcaaagucagugaagggu

SEQ ID NO: 101141 - RNA, 22 nt, Homo sapiens
ugggaagauucuguguuuuucc

SEQ ID NO: 101142 - RNA, 22 nt, Homo sapiens
ugggaccccuacucuuuccaca

SEQ ID NO: 101143 - RNA, 22 nt, Homo sapiens
ugggaucagcugggcucucugu

SEQ ID NO: 101144 - RNA, 22 nt, Homo sapiens
ugggaucauuaugcauagugua

SEQ ID NO: 101145 - RNA, 22 nt, Homo sapiens
ugggcaguauggucauuuucgu

SEQ ID NO: 101146 - RNA, 22 nt, Homo sapiens
ugggcagugggacagcuuugug

SEQ ID NO: 101147 - RNA, 22 nt, Homo sapiens
ugggcauggaguggccuuaugu

SEQ ID NO: 101148 - RNA, 22 nt, Homo sapiens
uggggucguaggugcccgccag

SEQ ID NO: 101149 - RNA, 22 nt, Homo sapiens
uggguaaaucucuguucagggc

SEQ ID NO: 101150 - RNA, 22 nt, Homo sapiens
uggguaggcccucauuggacag

SEQ ID NO: 101151 - RNA, 22 nt, Homo sapiens
ugggucaguagcauguaugucu

SEQ ID NO: 101152 - RNA, 23 nt, Homo sapiens
ugggucaguuuuucugacaucau

SEQ ID NO: 101153 - RNA, 22 nt, Homo sapiens
ugggugaguaucuauuauucag

SEQ ID NO: 101154 - RNA, 23 nt, Homo sapiens
uggguucccuaagcgcaugcugc

SEQ ID NO: 101155 - RNA, 22 nt, Homo sapiens
ugguaaaaugucauuuaccaga

SEQ ID NO: 101156 - RNA, 22 nt, Homo sapiens
ugguaauguaauuuggagaagg

SEQ ID NO: 101157 - RNA, 22 nt, Homo sapiens
ugguaugucuuucuuccuguag

SEQ ID NO: 101158 - RNA, 22 nt, Homo sapiens
ugguauguguucuaaaauuaug

SEQ ID NO: 101159 - RNA, 22 nt, Homo sapiens
ugguauguugucucuuuguucu

SEQ ID NO: 101160 - RNA, 22 nt, Homo sapiens
ugguauuuaauauaugagaguu

SEQ ID NO: 101161 - RNA, 22 nt, Homo sapiens
uggucaaaucugaugugagaaa

SEQ ID NO: 101162 - RNA, 22 nt, Homo sapiens
uggucagaaaauuacuugauau

SEQ ID NO: 101163 - RNA, 21 nt, Homo sapiens
uggucccauaagauuauaaug

SEQ ID NO: 101164 - RNA, 22 nt, Homo sapiens
uggucccaugaacuuuagguca

SEQ ID NO: 101165 - RNA, 22 nt, Homo sapiens
ugguccucugcuuccagaauuc

SEQ ID NO: 101166 - RNA, 22 nt, Homo sapiens
uggucucuuugcuuuagucauc

SEQ ID NO: 101167 - RNA, 22 nt, Homo sapiens
uggucuucuggccuccagaacc

SEQ ID NO: 101168 - RNA, 22 nt, Homo sapiens
uggucuuuucaacaaaugguau

SEQ ID NO: 101169 - RNA, 20 nt, Homo sapiens
uggugguuuuaugugguuua

SEQ ID NO: 101170 - RNA, 22 nt, Homo sapiens
ugguguccugucucugcgcuug

SEQ ID NO: 101171 - RNA, 22 nt, Homo sapiens
uguaaacauguauguguuuaug

SEQ ID NO: 101172 - RNA, 22 nt, Homo sapiens
uguaaaccauauauguauguag

SEQ ID NO: 101173 - RNA, 22 nt, Homo sapiens
uguaaacuaugagcugauuauu

SEQ ID NO: 101174 - RNA, 20 nt, Homo sapiens
uguaaaggagauugcagcug

SEQ ID NO: 101175 - RNA, 22 nt, Homo sapiens
uguaacacacacuguuuacucc

SEQ ID NO: 101176 - RNA, 22 nt, Homo sapiens
uguaacugcuuagaagguuuua

SEQ ID NO: 101177 - RNA, 22 nt, Homo sapiens
uguaagugugcaauucagugau

SEQ ID NO: 101178 - RNA, 22 nt, Homo sapiens
uguaaugaucaaaucagaguaa

SEQ ID NO: 101179 - RNA, 20 nt, Homo sapiens
uguacacaguguacccacau

SEQ ID NO: 101180 - RNA, 22 nt, Homo sapiens
uguacuagaaauuaaggcaggg

SEQ ID NO: 101181 - RNA, 22 nt, Homo sapiens
uguagauauucuuucaguuuuu

SEQ ID NO: 101182 - RNA, 22 nt, Homo sapiens
uguagcacauuugaagagaagc

SEQ ID NO: 101183 - RNA, 18 nt, Homo sapiens
uguagcaccuuucuugug

SEQ ID NO: 101184 - RNA, 22 nt, Homo sapiens
uguagguguacauacaugguua

SEQ ID NO: 101185 - RNA, 22 nt, Homo sapiens
uguagucauuccuuuuugcuuu

SEQ ID NO: 101186 - RNA, 22 nt, Homo sapiens
uguaguuugaaagcucccucug

SEQ ID NO: 101187 - RNA, 23 nt, Homo sapiens
uguauacacccugugcaucuggg

SEQ ID NO: 101188 - RNA, 22 nt, Homo sapiens
uguauacauauguauguuuugu

SEQ ID NO: 101189 - RNA, 21 nt, Homo sapiens
uguauacauauguuaggugca

SEQ ID NO: 101190 - RNA, 22 nt, Homo sapiens
uguauacugucuaauauguugu

SEQ ID NO: 101191 - RNA, 22 nt, Homo sapiens
uguaugagagugaaagcauuuc

SEQ ID NO: 101192 - RNA, 22 nt, Homo sapiens
uguaugaguuguuuauaaauuu

SEQ ID NO: 101193 - RNA, 22 nt, Homo sapiens
uguaugcuuuugagagauauuu

SEQ ID NO: 101194 - RNA, 22 nt, Homo sapiens
uguauguaaagacaggauaaca

SEQ ID NO: 101195 - RNA, 22 nt, Homo sapiens
uguauguugauguuauauucug

SEQ ID NO: 101196 - RNA, 22 nt, Homo sapiens
uguauguuuaaggccaguggaa

SEQ ID NO: 101197 - RNA, 16 nt, Homo sapiens
uguauugcuaaaaaga

SEQ ID NO: 101198 - RNA, 22 nt, Homo sapiens
ugucaaaugcagugauauuuga

SEQ ID NO: 101199 - RNA, 22 nt, Homo sapiens
ugucaagaaaucaaggugugag

SEQ ID NO: 101200 - RNA, 21 nt, Homo sapiens
ugucaagugggaaaacaugua

SEQ ID NO: 101201 - RNA, 22 nt, Homo sapiens
ugucaauauguaauaacugaau

SEQ ID NO: 101202 - RNA, 22 nt, Homo sapiens
ugucacagagauuuugguaugu

SEQ ID NO: 101203 - RNA, 22 nt, Homo sapiens
ugucacaguuuguacuuuauag

SEQ ID NO: 101204 - RNA, 22 nt, Homo sapiens
ugucaguggacugugaaaggca

SEQ ID NO: 101205 - RNA, 22 nt, Homo sapiens
ugucaguggucuggaugcagcc

SEQ ID NO: 101206 - RNA, 22 nt, Homo sapiens
ugucaguuucccuccucuuccu

SEQ ID NO: 101207 - RNA, 22 nt, Homo sapiens
ugucaucuagguauuaagcccc

SEQ ID NO: 101208 - RNA, 21 nt, Homo sapiens
ugucaugcagagacccuggag

SEQ ID NO: 101209 - RNA, 22 nt, Homo sapiens
ugucauguauauaccacuucca

SEQ ID NO: 101210 - RNA, 22 nt, Homo sapiens
ugucaugucuuuguguaucaau

SEQ ID NO: 101211 - RNA, 22 nt, Homo sapiens
ugucauucaggaaauucuaagu

SEQ ID NO: 101212 - RNA, 22 nt, Homo sapiens
ugucauuguggugcagauauaa

SEQ ID NO: 101213 - RNA, 16 nt, Homo sapiens
uguccaaauaaauaca

SEQ ID NO: 101214 - RNA, 22 nt, Homo sapiens
uguccugaagcuuuguuaugua

SEQ ID NO: 101215 - RNA, 22 nt, Homo sapiens
uguccuguaggaggcagaacaa

SEQ ID NO: 101216 - RNA, 22 nt, Homo sapiens
ugucuacugaugauguaguuaa

SEQ ID NO: 101217 - RNA, 22 nt, Homo sapiens
ugucucaguucccuucucugga

SEQ ID NO: 101218 - RNA, 22 nt, Homo sapiens
ugucuggaaggguggccuccug

SEQ ID NO: 101219 - RNA, 22 nt, Homo sapiens
ugucuggaguccauagaagugu

SEQ ID NO: 101220 - RNA, 22 nt, Homo sapiens
ugucuuagagauaaagaaugaa

SEQ ID NO: 101221 - RNA, 22 nt, Homo sapiens
ugucuugagagaggacaugacu

SEQ ID NO: 101222 - RNA, 22 nt, Homo sapiens
ugucuuggagaauccuggguuu

SEQ ID NO: 101223 - RNA, 22 nt, Homo sapiens
ugucuuguagacaauguauagu

SEQ ID NO: 101224 - RNA, 22 nt, Homo sapiens
ugugaaacacgaaagucuaaaa

SEQ ID NO: 101225 - RNA, 22 nt, Homo sapiens
ugugaaaucagauagccuuuuu

SEQ ID NO: 101226 - RNA, 21 nt, Homo sapiens
ugugaaaucuaggcagagguu

SEQ ID NO: 101227 - RNA, 22 nt, Homo sapiens
ugugaacacagaggcuauggca

SEQ ID NO: 101228 - RNA, 22 nt, Homo sapiens
ugugaacagaauuagucaccua

SEQ ID NO: 101229 - RNA, 22 nt, Homo sapiens
ugugaacagcuccaaaugugga

SEQ ID NO: 101230 - RNA, 19 nt, Homo sapiens
ugugaagaaaugcugcaag

SEQ ID NO: 101231 - RNA, 22 nt, Homo sapiens
ugugaagaugagaugacgcccu

SEQ ID NO: 101232 - RNA, 22 nt, Homo sapiens
ugugacacugaauggcagaacu

SEQ ID NO: 101233 - RNA, 22 nt, Homo sapiens
ugugacaguguuacauuucaug

SEQ ID NO: 101234 - RNA, 22 nt, Homo sapiens
ugugacucuggcacauggugag

SEQ ID NO: 101235 - RNA, 22 nt, Homo sapiens
ugugacugguugucccgcuuuc

SEQ ID NO: 101236 - RNA, 22 nt, Homo sapiens
ugugagacugguucugaaccca

SEQ ID NO: 101237 - RNA, 22 nt, Homo sapiens
ugugauagagaaugguggagaa

SEQ ID NO: 101238 - RNA, 19 nt, Homo sapiens
ugugauaguugaaccugcc

SEQ ID NO: 101239 - RNA, 22 nt, Homo sapiens
ugugaucauuucaggaauuuug

SEQ ID NO: 101240 - RNA, 22 nt, Homo sapiens
ugugaugaagaguccaagaaca

SEQ ID NO: 101241 - RNA, 22 nt, Homo sapiens
ugugauuauuuaaauaggacag

SEQ ID NO: 101242 - RNA, 22 nt, Homo sapiens
ugugauugauuaaugugugcua

SEQ ID NO: 101243 - RNA, 22 nt, Homo sapiens
ugugcaaaaguaauugcgguuu

SEQ ID NO: 101244 - RNA, 22 nt, Homo sapiens
ugugcaaauuagcacaacccga

SEQ ID NO: 101245 - RNA, 22 nt, Homo sapiens
ugugcaaggcucucaaccugug

SEQ ID NO: 101246 - RNA, 22 nt, Homo sapiens
ugugcaaucagcuucauuacau

SEQ ID NO: 101247 - RNA, 22 nt, Homo sapiens
ugugcaaucuuccauuuuuagg

SEQ ID NO: 101248 - RNA, 22 nt, Homo sapiens
ugugcacaaccugcagguuugu

SEQ ID NO: 101249 - RNA, 23 nt, Homo sapiens
ugugcacauuuacauauauacac

SEQ ID NO: 101250 - RNA, 22 nt, Homo sapiens
ugugcaccucuucacacaggga

SEQ ID NO: 101251 - RNA, 22 nt, Homo sapiens
ugugcaguuuuagcguauuuua

SEQ ID NO: 101252 - RNA, 22 nt, Homo sapiens
ugugccaaaucccauaauaaau

SEQ ID NO: 101253 - RNA, 22 nt, Homo sapiens
ugugccacuccaggaggcuguu

SEQ ID NO: 101254 - RNA, 22 nt, Homo sapiens
ugugccacugcacucugggcaa

SEQ ID NO: 101255 - RNA, 22 nt, Homo sapiens
ugugcguguaagagaucuaggu

SEQ ID NO: 101256 - RNA, 22 nt, Homo sapiens
ugugcuaaaaugggacuucuaa

SEQ ID NO: 101257 - RNA, 22 nt, Homo sapiens
uguggcaaagucuugugaauau

SEQ ID NO: 101258 - RNA, 20 nt, Homo sapiens
uguggcacuguaucucucag

SEQ ID NO: 101259 - RNA, 22 nt, Homo sapiens
uguggcacuguguccagagaaa

SEQ ID NO: 101260 - RNA, 22 nt, Homo sapiens
uguggcauuuucagaaaggaug

SEQ ID NO: 101261 - RNA, 22 nt, Homo sapiens
uguggccccuagcuacuagaga

SEQ ID NO: 101262 - RNA, 17 nt, Homo sapiens
uguggcucuuaugcuga

SEQ ID NO: 101263 - RNA, 22 nt, Homo sapiens
uguggcugguggcaccuuuucc

SEQ ID NO: 101264 - RNA, 22 nt, Homo sapiens
uguggcuuuacagcaugguuca

SEQ ID NO: 101265 - RNA, 22 nt, Homo sapiens
uguggcuuuguaaccauggguc

SEQ ID NO: 101266 - RNA, 22 nt, Homo sapiens
uguguauaucacugcaugagug

SEQ ID NO: 101267 - RNA, 22 nt, Homo sapiens
ugugucuugaauuuuguaugua

SEQ ID NO: 101268 - RNA, 22 nt, Homo sapiens
ugugucuugagagucucgagaa

SEQ ID NO: 101269 - RNA, 22 nt, Homo sapiens
ugugucuuguuuuuucccaggc

SEQ ID NO: 101270 - RNA, 22 nt, Homo sapiens
uguguuuuuauguaaaauggaa

SEQ ID NO: 101271 - RNA, 22 nt, Homo sapiens
uguuaaggcagagauaauacau

SEQ ID NO: 101272 - RNA, 22 nt, Homo sapiens
uguuacagcagaauugauugca

SEQ ID NO: 101273 - RNA, 22 nt, Homo sapiens
uguuauguauggagugauccca

SEQ ID NO: 101274 - RNA, 22 nt, Homo sapiens
uguuauguucuacuuuuaggug

SEQ ID NO: 101275 - RNA, 22 nt, Homo sapiens
uguuauguuuuagagguuucaa

SEQ ID NO: 101276 - RNA, 22 nt, Homo sapiens
uguucaauucccaccuaugagu

SEQ ID NO: 101277 - RNA, 22 nt, Homo sapiens
uguucaugaguucucauuuuua

SEQ ID NO: 101278 - RNA, 22 nt, Homo sapiens
uguucuggagccgguucaaaug

SEQ ID NO: 101279 - RNA, 19 nt, Homo sapiens
uguugcacuccagcuuggg

SEQ ID NO: 101280 - RNA, 18 nt, Homo sapiens
uguugguguucacucacu

SEQ ID NO: 101281 - RNA, 22 nt, Homo sapiens
uguuuguuugagauggagucuc

SEQ ID NO: 101282 - RNA, 22 nt, Homo sapiens
uguuuuggaguggacuuugcau

SEQ ID NO: 101283 - RNA, 21 nt, Homo sapiens
uguuuuugcuguguaucucuc

SEQ ID NO: 101284 - RNA, 22 nt, Homo sapiens
uuaaaagcuaucuccaagguca

SEQ ID NO: 101285 - RNA, 22 nt, Homo sapiens
uuaaagccauaccugagagagu

SEQ ID NO: 101286 - RNA, 22 nt, Homo sapiens
uuaaaggcauguacacuagagu

SEQ ID NO: 101287 - RNA, 22 nt, Homo sapiens
uuaaaguaauugaaauggccuu

SEQ ID NO: 101288 - RNA, 22 nt, Homo sapiens
uuaaaugcauagaauguguagu

SEQ ID NO: 101289 - RNA, 22 nt, Homo sapiens
uuaaaugcuagaauuuucuuug

SEQ ID NO: 101290 - RNA, 20 nt, Homo sapiens
uugcugguguuagaggaggc

SEQ ID NO: 101291 - RNA, 22 nt, Homo sapiens
uugcugguuuucauaugagcag

SEQ ID NO: 101292 - RNA, 22 nt, Homo sapiens
uugcuucauucaacauugaggg

SEQ ID NO: 101293 - RNA, 22 nt, Homo sapiens
uugcuuuguuacugcaguuucc

SEQ ID NO: 101294 - RNA, 22 nt, Homo sapiens
uuggaaaguuguuguaguuauu

SEQ ID NO: 101295 - RNA, 20 nt, Homo sapiens
uuggaaaugugaauugggag

SEQ ID NO: 101296 - RNA, 22 nt, Homo sapiens
uuggaagacauucugucugcua

SEQ ID NO: 101297 - RNA, 22 nt, Homo sapiens
uuggaauguauggcaucuugcg

SEQ ID NO: 101298 - RNA, 22 nt, Homo sapiens
uuggaaugugacugauaauauu

SEQ ID NO: 101299 - RNA, 22 nt, Homo sapiens
uuggaauuagacaagugguggu

SEQ ID NO: 101300 - RNA, 22 nt, Homo sapiens
uuggacuacagauuacuucauc

SEQ ID NO: 101301 - RNA, 22 nt, Homo sapiens
uuggacugugagguuucguggg

SEQ ID NO: 101302 - RNA, 22 nt, Homo sapiens
uuggauuuugguggcaacucau

SEQ ID NO: 101303 - RNA, 22 nt, Homo sapiens
uuggcaaauagguuuuauugca

SEQ ID NO: 101304 - RNA, 22 nt, Homo sapiens
uuggcaaguuucugucagcaaa

SEQ ID NO: 101305 - RNA, 22 nt, Homo sapiens
uuggcaaucaauucugacgucu

SEQ ID NO: 101306 - RNA, 22 nt, Homo sapiens
uuggcacuugauaauauucugg

SEQ ID NO: 101307 - RNA, 22 nt, Homo sapiens
uuggcagaguuaauuuguugag

SEQ ID NO: 101308 - RNA, 22 nt, Homo sapiens
uuggcagcacgcaguccagagg

SEQ ID NO: 101309 - RNA, 22 nt, Homo sapiens
uuggcauaguugcacuuacuag

SEQ ID NO: 101310 - RNA, 22 nt, Homo sapiens
uuggcauugaguuucaaaucau

SEQ ID NO: 101311 - RNA, 22 nt, Homo sapiens
uuggcauugccaaacugucaac

SEQ ID NO: 101312 - RNA, 22 nt, Homo sapiens
uuggcauuguggauggaaucau

SEQ ID NO: 101313 - RNA, 20 nt, Homo sapiens
uuggcauuuagacaagaguu

SEQ ID NO: 101314 - RNA, 22 nt, Homo sapiens
uuggccaauggugauucccggc

SEQ ID NO: 101315 - RNA, 22 nt, Homo sapiens
uuggccauaugacuugcuuugg

SEQ ID NO: 101316 - RNA, 22 nt, Homo sapiens
uuggcgugaaacagccuuacau

SEQ ID NO: 101317 - RNA, 22 nt, Homo sapiens
uuggcuacagauuaugaauuuc

SEQ ID NO: 101318 - RNA, 21 nt, Homo sapiens
uuggcuacugcuucagaggga

SEQ ID NO: 101319 - RNA, 22 nt, Homo sapiens
uuggcuauagauacauggauua

SEQ ID NO: 101320 - RNA, 22 nt, Homo sapiens
uuggcucugcgucucgcggacg

SEQ ID NO: 101321 - RNA, 22 nt, Homo sapiens
uugggaaugcuaaaccucuauu

SEQ ID NO: 101322 - RNA, 22 nt, Homo sapiens
uugggaauguccuaauaucucg

SEQ ID NO: 101323 - RNA, 22 nt, Homo sapiens
uugggauggaacuuuucaguga

SEQ ID NO: 101324 - RNA, 22 nt, Homo sapiens
uugggcauugcuauaaauucuu

SEQ ID NO: 101325 - RNA, 22 nt, Homo sapiens
uugggcauugggcuaaacuccc

SEQ ID NO: 101326 - RNA, 22 nt, Homo sapiens
uuggggcacggccucuguugcc

SEQ ID NO: 101327 - RNA, 22 nt, Homo sapiens
uugguaagguggaugaugaaua

SEQ ID NO: 101328 - RNA, 22 nt, Homo sapiens
uugguacuagcugaucgcagag

SEQ ID NO: 101329 - RNA, 22 nt, Homo sapiens
uugguaggcuggccucucucag

SEQ ID NO: 101330 - RNA, 22 nt, Homo sapiens
uugguauguaauuuauauugua

SEQ ID NO: 101331 - RNA, 22 nt, Homo sapiens
uuggucaggagccucccucuuu

SEQ ID NO: 101332 - RNA, 22 nt, Homo sapiens
uugguccacugugaaauuggga

SEQ ID NO: 101333 - RNA, 22 nt, Homo sapiens
uugguccccacuccccugccaa

SEQ ID NO: 101334 - RNA, 22 nt, Homo sapiens
uugguccucccaugcucaagag

SEQ ID NO: 101335 - RNA, 22 nt, Homo sapiens
uuggucucaucaagagcagcuu

SEQ ID NO: 101336 - RNA, 23 nt, Homo sapiens
uuggucucccaaaguguugagau

SEQ ID NO: 101337 - RNA, 22 nt, Homo sapiens
uugguuccuuagccuaggacua

SEQ ID NO: 101338 - RNA, 22 nt, Homo sapiens
uuguaaacaucuguacauugcu

SEQ ID NO: 101339 - RNA, 22 nt, Homo sapiens
uuguaaagaucauaugcuguuc

SEQ ID NO: 101340 - RNA, 22 nt, Homo sapiens
uuguaaagucugucucagucag

SEQ ID NO: 101341 - RNA, 22 nt, Homo sapiens
uuguaaaguucuuaggaagcuc

SEQ ID NO: 101342 - RNA, 22 nt, Homo sapiens
uuguaacaguucugcgagcagc

SEQ ID NO: 101343 - RNA, 22 nt, Homo sapiens
uuguaacaguuuauugacucga

SEQ ID NO: 101344 - RNA, 22 nt, Homo sapiens
uuguaacaugcuuucacuucag

SEQ ID NO: 101345 - RNA, 22 nt, Homo sapiens
uuguaauguuaggguguccaug

SEQ ID NO: 101346 - RNA, 22 nt, Homo sapiens
uuguaccacagggcaugaagug

SEQ ID NO: 101347 - RNA, 22 nt, Homo sapiens
uuguacuuuuaguagagacggg

SEQ ID NO: 101348 - RNA, 22 nt, Homo sapiens
uuguagcaaauguguaaacaaa

SEQ ID NO: 101349 - RNA, 22 nt, Homo sapiens
uuguauacucuauuuuagcagu

SEQ ID NO: 101350 - RNA, 22 nt, Homo sapiens
uuguauguaaccauuuggcaaa

SEQ ID NO: 101351 - RNA, 22 nt, Homo sapiens
uuguaugucuucauuugaaaaa

SEQ ID NO: 101352 - RNA, 22 nt, Homo sapiens
uuguauguuguuugucagagaa

SEQ ID NO: 101353 - RNA, 22 nt, Homo sapiens
uugucaaacucauucuccaucc

SEQ ID NO: 101354 - RNA, 22 nt, Homo sapiens
uugucaacaugaaacuguguuu

SEQ ID NO: 101355 - RNA, 22 nt, Homo sapiens
uugucaaugggugagugcagag

SEQ ID NO: 101356 - RNA, 22 nt, Homo sapiens
uugucacuauaaauaagcauuu

SEQ ID NO: 101357 - RNA, 22 nt, Homo sapiens
uugucacugcacuccagucugg

SEQ ID NO: 101358 - RNA, 22 nt, Homo sapiens
uuguccacugcuagccucugca

SEQ ID NO: 101359 - RNA, 22 nt, Homo sapiens
uuguccauggacagcaccacag

SEQ ID NO: 101360 - RNA, 22 nt, Homo sapiens
uuguccuggagguucuugcaag

SEQ ID NO: 101361 - RNA, 22 nt, Homo sapiens
uugucuccuagacgaccaggcg

SEQ ID NO: 101362 - RNA, 22 nt, Homo sapiens
uugugaaaucuaggcagagguu

SEQ ID NO: 101363 - RNA, 22 nt, Homo sapiens
agguaaguauguuauuacuuuu

SEQ ID NO: 101364 - RNA, 22 nt, Homo sapiens
agguaauuuuaucauuauguga

SEQ ID NO: 101365 - RNA, 22 nt, Homo sapiens
agguagguugagaugggcauca

SEQ ID NO: 101366 - RNA, 22 nt, Homo sapiens
agguaguguuauuugcagcuga

SEQ ID NO: 101367 - RNA, 22 nt, Homo sapiens
agguauguauguaugggagaaa

SEQ ID NO: 101368 - RNA, 22 nt, Homo sapiens
aggucaccucaggaaauacuga

SEQ ID NO: 101369 - RNA, 21 nt, Homo sapiens
aggucaugaagauguucuaau

SEQ ID NO: 101370 - RNA, 22 nt, Homo sapiens
agguccacuuacuacuccuguu

SEQ ID NO: 101371 - RNA, 22 nt, Homo sapiens
aggugcugacaggauagguuuc

SEQ ID NO: 101372 - RNA, 22 nt, Homo sapiens
aggugguauuuaaaauuauuug

SEQ ID NO: 101373 - RNA, 22 nt, Homo sapiens
aggugguauuucaaaguggcag

SEQ ID NO: 101374 - RNA, 22 nt, Homo sapiens
aggugguuuuucaacacacacu

SEQ ID NO: 101375 - RNA, 21 nt, Homo sapiens
aggugucuuggguucccuggc

SEQ ID NO: 101376 - RNA, 22 nt, Homo sapiens
agguuaacaucuauuuuggaug

SEQ ID NO: 101377 - RNA, 23 nt, Homo sapiens
agguuaugauuauagagcgagga

SEQ ID NO: 101378 - RNA, 22 nt, Homo sapiens
agguuguguuugugauuagaua

SEQ ID NO: 101379 - RNA, 22 nt, Homo sapiens
aguaaauuucugugcuuucaua

SEQ ID NO: 101380 - RNA, 22 nt, Homo sapiens
aguaagauggcaacucuccaca

SEQ ID NO: 101381 - RNA, 22 nt, Homo sapiens
aguacacuguugaacagaagug

SEQ ID NO: 101382 - RNA, 22 nt, Homo sapiens
aguaccauuacucacuuauuuu

SEQ ID NO: 101383 - RNA, 22 nt, Homo sapiens
aguacugucagcaggguguuga

SEQ ID NO: 101384 - RNA, 21 nt, Homo sapiens
aguagcacugugucuuacaaa

SEQ ID NO: 101385 - RNA, 16 nt, Homo sapiens
aguaguuuuacagauu

SEQ ID NO: 101386 - RNA, 22 nt, Homo sapiens
aguauguagugcaaucagucag

SEQ ID NO: 101387 - RNA, 22 nt, Homo sapiens
aguauguuuugaaaccaagaag

SEQ ID NO: 101388 - RNA, 20 nt, Homo sapiens
aguauucacuuuuuucaugg

SEQ ID NO: 101389 - RNA, 22 nt, Homo sapiens
agucaaaugcuuauguauaaag

SEQ ID NO: 101390 - RNA, 22 nt, Homo sapiens
agucaagauggcaagguaaggc

SEQ ID NO: 101391 - RNA, 22 nt, Homo sapiens
agucaaguuuuuucagagaaua

SEQ ID NO: 101392 - RNA, 22 nt, Homo sapiens
agucacagguucuugggauuag

SEQ ID NO: 101393 - RNA, 22 nt, Homo sapiens
agucacaugccagcacacccag

SEQ ID NO: 101394 - RNA, 22 nt, Homo sapiens
agucacggugguuugcacuugu

SEQ ID NO: 101395 - RNA, 23 nt, Homo sapiens
agucaguaugcuccuuggauccc

SEQ ID NO: 101396 - RNA, 22 nt, Homo sapiens
agucauaggagagauaucacug

SEQ ID NO: 101397 - RNA, 21 nt, Homo sapiens
agucauaggaguacauaaugc

SEQ ID NO: 101398 - RNA, 22 nt, Homo sapiens
agugaaaugucaccuuuuagga

SEQ ID NO: 101399 - RNA, 22 nt, Homo sapiens
agugaacacagcuucuuugguu

SEQ ID NO: 101400 - RNA, 21 nt, Homo sapiens
agugagucauuuggaaagcaa

SEQ ID NO: 101401 - RNA, 22 nt, Homo sapiens
agugaucauuugaauugaugau

SEQ ID NO: 101402 - RNA, 22 nt, Homo sapiens
agugauguggaguuuggaugga

SEQ ID NO: 101403 - RNA, 22 nt, Homo sapiens
agugauuuuaacuuccagcaau

SEQ ID NO: 101404 - RNA, 22 nt, Homo sapiens
agugcaaagccgagguuucuug

SEQ ID NO: 101405 - RNA, 22 nt, Homo sapiens
agugcaaggacauuuagguugu

SEQ ID NO: 101406 - RNA, 22 nt, Homo sapiens
agugcacucuuuccucucuuac

SEQ ID NO: 101407 - RNA, 22 nt, Homo sapiens
agugcacugcccgcuuccuguc

SEQ ID NO: 101408 - RNA, 22 nt, Homo sapiens
agugccacugcacucuagccug

SEQ ID NO: 101409 - RNA, 22 nt, Homo sapiens
agugcuuaauagauguccagca

SEQ ID NO: 101410 - RNA, 22 nt, Homo sapiens
aguggauguuguggccugggag

SEQ ID NO: 101411 - RNA, 22 nt, Homo sapiens
aguggcaaugugauguccugaa

SEQ ID NO: 101412 - RNA, 22 nt, Homo sapiens
aguggcacuauucucagaguca

SEQ ID NO: 101413 - RNA, 19 nt, Homo sapiens
agugggcuagaaaucaggg

SEQ ID NO: 101414 - RNA, 22 nt, Homo sapiens
agugguauaauauuauuuugaa

SEQ ID NO: 101415 - RNA, 23 nt, Homo sapiens
aguggucuccugggcccagcugu

SEQ ID NO: 101416 - RNA, 22 nt, Homo sapiens
agugucaggagacagguagcug

SEQ ID NO: 101417 - RNA, 22 nt, Homo sapiens
aguguuuuuacaagcacucugg

SEQ ID NO: 101418 - RNA, 22 nt, Homo sapiens
aguguuuuuaucaugaaagggu

SEQ ID NO: 101419 - RNA, 22 nt, Homo sapiens
aguuaguguugugauaaaucca

SEQ ID NO: 101420 - RNA, 21 nt, Homo sapiens
aguucacauggcuccuguguu

SEQ ID NO: 101421 - RNA, 22 nt, Homo sapiens
aguugcaagucuugaguaaaga

SEQ ID NO: 101422 - RNA, 22 nt, Homo sapiens
aguuggcacugagcugugauug

SEQ ID NO: 101423 - RNA, 22 nt, Homo sapiens
aguuuugguugaguuacuagca

SEQ ID NO: 101424 - RNA, 22 nt, Homo sapiens
gcccagauguuuggggucaugg

SEQ ID NO: 101425 - RNA, 22 nt, Homo sapiens
gcccaguagcaguacaucccuu

SEQ ID NO: 101426 - RNA, 22 nt, Homo sapiens
gcccuguaguauaguuugaagu

SEQ ID NO: 101427 - RNA, 22 nt, Homo sapiens
gcccuguugcccugaauacaua

SEQ ID NO: 101428 - RNA, 22 nt, Homo sapiens
gccuagagaaguaaauauuauc

SEQ ID NO: 101429 - RNA, 22 nt, Homo sapiens
cuacagcagcccaguccccgaa

SEQ ID NO: 101430 - RNA, 22 nt, Homo sapiens
cuacaguaugaaaccuuuacuc

SEQ ID NO: 101431 - RNA, 23 nt, Homo sapiens
cuacagugccugucucuuuggcc

SEQ ID NO: 101432 - RNA, 22 nt, Homo sapiens
cuacagugggucuguaguccuu

SEQ ID NO: 101433 - RNA, 22 nt, Homo sapiens
cuacaguucuuaauuaaguagu

SEQ ID NO: 101434 - RNA, 23 nt, Homo sapiens
cuacuagucaagucuuuuccagu

SEQ ID NO: 101435 - RNA, 22 nt, Homo sapiens
cuacugacacuacugcaaucau

SEQ ID NO: 101436 - RNA, 22 nt, Homo sapiens
cuagaagcauauucagaacaga

SEQ ID NO: 101437 - RNA, 22 nt, Homo sapiens
cuagcagaacaauacaauucgg

SEQ ID NO: 101438 - RNA, 22 nt, Homo sapiens
cuagcagacaggcugggagcag

SEQ ID NO: 101439 - RNA, 22 nt, Homo sapiens
cuagcagcaugagaauggacca

SEQ ID NO: 101440 - RNA, 22 nt, Homo sapiens
cuagccuggagugcaguggugc

SEQ ID NO: 101441 - RNA, 22 nt, Homo sapiens
cuagcuccauauaaagcaggau

SEQ ID NO: 101442 - RNA, 22 nt, Homo sapiens
cuagcuuuugauguaaagugag

SEQ ID NO: 101443 - RNA, 22 nt, Homo sapiens
cuaggcuguagagaaguucagu

SEQ ID NO: 101444 - RNA, 22 nt, Homo sapiens
cuagguucucaaaccagcguca

SEQ ID NO: 101445 - RNA, 22 nt, Homo sapiens
cuagucacaggaguugaaggau

SEQ ID NO: 101446 - RNA, 22 nt, Homo sapiens
cuagucacauuuucaucaaaua

SEQ ID NO: 101447 - RNA, 22 nt, Homo sapiens
cuaucacuguuuugaugcccgg

SEQ ID NO: 101448 - RNA, 22 nt, Homo sapiens
cuaucugcacaggguggaaauu

SEQ ID NO: 101449 - RNA, 22 nt, Homo sapiens
cuaugcuucuuaaauuaguuau

SEQ ID NO: 101450 - RNA, 22 nt, Homo sapiens
cuauggcucugguuauggcugu

SEQ ID NO: 101451 - RNA, 22 nt, Homo sapiens
cuauuagguuggugcaaaaguc

SEQ ID NO: 101452 - RNA, 22 nt, Homo sapiens
cuauucacaggcaauauguaca

SEQ ID NO: 101453 - RNA, 22 nt, Homo sapiens
cucaaagucaagggaaagcagg

SEQ ID NO: 101454 - RNA, 22 nt, Homo sapiens
cucaaagugcuaagauuaggcu

SEQ ID NO: 101455 - RNA, 22 nt, Homo sapiens
cucacaguucuaaaggcaagaa

SEQ ID NO: 101456 - RNA, 22 nt, Homo sapiens
cucaccuugugauccaccggcc

SEQ ID NO: 101457 - RNA, 22 nt, Homo sapiens
cucacuaggaaguaaaguuugu

SEQ ID NO: 101458 - RNA, 22 nt, Homo sapiens
cucaggcacucugauuccagug

SEQ ID NO: 101459 - RNA, 20 nt, Homo sapiens
cucagguauuugaggcugca

SEQ ID NO: 101460 - RNA, 22 nt, Homo sapiens
cucaguagaaaauacauggacu

SEQ ID NO: 101461 - RNA, 22 nt, Homo sapiens
cucagugucuggcacacagaaa

SEQ ID NO: 101462 - RNA, 22 nt, Homo sapiens
cucaugcugucuucugggguaa

SEQ ID NO: 101463 - RNA, 22 nt, Homo sapiens
cucauggagaacaucugcuagg

SEQ ID NO: 101464 - RNA, 22 nt, Homo sapiens
cucauuaguuguuuuaagauga

SEQ ID NO: 101465 - RNA, 22 nt, Homo sapiens
cucauugcaaucucugccuccc

SEQ ID NO: 101466 - RNA, 22 nt, Homo sapiens
cucauuggucagacgcgucggu

SEQ ID NO: 101467 - RNA, 22 nt, Homo sapiens
cuccagugcaaagucaugauca

SEQ ID NO: 101468 - RNA, 22 nt, Homo sapiens
cuccauuuggaacagauguccu

SEQ ID NO: 101469 - RNA, 22 nt, Homo sapiens
cucccacccucauuuuuaggca

SEQ ID NO: 101470 - RNA, 22 nt, Homo sapiens
cuccccuuuaguuucuuaauaa

SEQ ID NO: 101471 - RNA, 23 nt, Homo sapiens
cucccugaacaugacacaccaga

SEQ ID NO: 101472 - RNA, 22 nt, Homo sapiens
cuccuaaccagggcuguuaguc

SEQ ID NO: 101473 - RNA, 22 nt, Homo sapiens
cucucaguugucuaauuaguuu

SEQ ID NO: 101474 - RNA, 22 nt, Homo sapiens
cucucugagccccagacaccuu

SEQ ID NO: 101475 - RNA, 22 nt, Homo sapiens
cucugauggagauauacaagga

SEQ ID NO: 101476 - RNA, 22 nt, Homo sapiens
cucugcuuaaugucccacuuga

SEQ ID NO: 101477 - RNA, 22 nt, Homo sapiens
cucuggauauuccugucuaaaa

SEQ ID NO: 101478 - RNA, 22 nt, Homo sapiens
cucugguuaaggcugaacuaua

SEQ ID NO: 101479 - RNA, 22 nt, Homo sapiens
cucugguucugcagugcacccu

SEQ ID NO: 101480 - RNA, 22 nt, Homo sapiens
cucuuugaugugaaccgugguu

SEQ ID NO: 101481 - RNA, 22 nt, Homo sapiens
cugaaaagcaucugcauagcug

SEQ ID NO: 101482 - RNA, 22 nt, Homo sapiens
cugaaagagcauguaacacagu

SEQ ID NO: 101483 - RNA, 22 nt, Homo sapiens
cugaaaucagccaguuaguuuc

SEQ ID NO: 101484 - RNA, 22 nt, Homo sapiens
cugaaauguccaucgacugaug

SEQ ID NO: 101485 - RNA, 22 nt, Homo sapiens
cugaagugcuugccacauaaaa

SEQ ID NO: 101486 - RNA, 22 nt, Homo sapiens
cugaauagagcacacugauggg

SEQ ID NO: 101487 - RNA, 20 nt, Homo sapiens
cugaaugucaaggcagaggu

SEQ ID NO: 101488 - RNA, 22 nt, Homo sapiens
cugacguguuuuccagaccuuu

SEQ ID NO: 101489 - RNA, 22 nt, Homo sapiens
cugacugaggaucaguucauca

SEQ ID NO: 101490 - RNA, 22 nt, Homo sapiens
cugagaauguaaaugaagcuuu

SEQ ID NO: 101491 - RNA, 22 nt, Homo sapiens
cugagauaauuucuagguguca

SEQ ID NO: 101492 - RNA, 22 nt, Homo sapiens
cugagauacacuaauagucucu

SEQ ID NO: 101493 - RNA, 22 nt, Homo sapiens
cugagaucaagucuugcucugu

SEQ ID NO: 101494 - RNA, 22 nt, Homo sapiens
cugagaucaugggucagguggu

SEQ ID NO: 101495 - RNA, 22 nt, Homo sapiens
cugagauggagucucgcauugu

SEQ ID NO: 101496 - RNA, 22 nt, Homo sapiens
cugagcaagucauuuuguuaaa

SEQ ID NO: 101497 - RNA, 18 nt, Homo sapiens
cugagcacugcuuuauga

SEQ ID NO: 101498 - RNA, 22 nt, Homo sapiens
cugagcuagaccacuuggcucc

SEQ ID NO: 101499 - RNA, 22 nt, Homo sapiens
cugagcuaugccuggaaaggca

SEQ ID NO: 101500 - RNA, 22 nt, Homo sapiens
cugagcucauuucuuuugcuac

SEQ ID NO: 101501 - RNA, 20 nt, Homo sapiens
cugagguacgaggguuaaau

SEQ ID NO: 101502 - RNA, 22 nt, Homo sapiens
cugagguagcucaggguauugc

SEQ ID NO: 101503 - RNA, 22 nt, Homo sapiens
cugaggugggaguuuuucucau

SEQ ID NO: 101504 - RNA, 22 nt, Homo sapiens
cugagguuaggaguuugagacc

SEQ ID NO: 101505 - RNA, 22 nt, Homo sapiens
cugauacugagaccuuggguua

SEQ ID NO: 101506 - RNA, 22 nt, Homo sapiens
cugauauuuuaaaauuggcugg

SEQ ID NO: 101507 - RNA, 22 nt, Homo sapiens
cugaucuguagcagccaccaca

SEQ ID NO: 101508 - RNA, 22 nt, Homo sapiens
cugaucuguuauacuuuucuau

SEQ ID NO: 101509 - RNA, 22 nt, Homo sapiens
cugauugucuauuuaguucacu

SEQ ID NO: 101510 - RNA, 22 nt, Homo sapiens
cugauugugcagagguguaauu

SEQ ID NO: 101511 - RNA, 22 nt, Homo sapiens
cugauuuguccccagccucaug

SEQ ID NO: 101512 - RNA, 21 nt, Homo sapiens
cugcaaaugcugcugccugau

SEQ ID NO: 101513 - RNA, 20 nt, Homo sapiens
cugcaaaugcugcugcugau

SEQ ID NO: 101514 - RNA, 22 nt, Homo sapiens
cugcagaucuuggggcuugcca

SEQ ID NO: 101515 - RNA, 22 nt, Homo sapiens
gugcacaacgugcaggcuuguu

SEQ ID NO: 101516 - RNA, 22 nt, Homo sapiens
gugcacaacgugcagguuuguu

SEQ ID NO: 101517 - RNA, 22 nt, Homo sapiens
gugcacaacguguagguuuguu

SEQ ID NO: 101518 - RNA, 22 nt, Homo sapiens
gugcacaaugugcagguuuguu

SEQ ID NO: 101519 - RNA, 22 nt, Homo sapiens
gugcacaucuguguuccagcua

SEQ ID NO: 101520 - RNA, 22 nt, Homo sapiens
gugcaguuugaaaguagaaaca

SEQ ID NO: 101521 - RNA, 22 nt, Homo sapiens
gugcaguuuugagugaguuucu

SEQ ID NO: 101522 - RNA, 22 nt, Homo sapiens
gugccacaguguuaagggauuc

SEQ ID NO: 101523 - RNA, 22 nt, Homo sapiens
gugcgggaggcgcgccuaggug

SEQ ID NO: 101524 - RNA, 22 nt, Homo sapiens
gugcuaggugcuaggaagauag

SEQ ID NO: 101525 - RNA, 22 nt, Homo sapiens
gugcucauuuagagagaagcac

SEQ ID NO: 101526 - RNA, 22 nt, Homo sapiens
gugcuuauccccauucuggagg

SEQ ID NO: 101527 - RNA, 21 nt, Homo sapiens
gugcuuguagccucacuucug

SEQ ID NO: 101528 - RNA, 22 nt, Homo sapiens
guggaaaacauaugcuuguuga

SEQ ID NO: 101529 - RNA, 21 nt, Homo sapiens
guggaaauggaauuuacuaau

SEQ ID NO: 101530 - RNA, 22 nt, Homo sapiens
guggaagcacaggccuccugga

SEQ ID NO: 101531 - RNA, 22 nt, Homo sapiens
guggaaguguaaaagcucuugg

SEQ ID NO: 101532 - RNA, 22 nt, Homo sapiens
guggaauggaaugauuguguau

SEQ ID NO: 101533 - RNA, 22 nt, Homo sapiens
guggagcuguguggccuugggc

SEQ ID NO: 101534 - RNA, 22 nt, Homo sapiens
guggaggagaaagaagcauuuc

SEQ ID NO: 101535 - RNA, 22 nt, Homo sapiens
guggaguaugaaaacugacuuu

SEQ ID NO: 101536 - RNA, 22 nt, Homo sapiens
guggcacgaugaucugggcuca

SEQ ID NO: 101537 - RNA, 22 nt, Homo sapiens
guggcagaacagguaggguucu

SEQ ID NO: 101538 - RNA, 22 nt, Homo sapiens
guggcagugugaggauccugcu

SEQ ID NO: 101539 - RNA, 22 nt, Homo sapiens
guggcaguuuuaaauaugaaaa

SEQ ID NO: 101540 - RNA, 22 nt, Homo sapiens
guggcaugaaagcagauaccac

SEQ ID NO: 101541 - RNA, 22 nt, Homo sapiens
gugggaagcuggaacucccucc

SEQ ID NO: 101542 - RNA, 22 nt, Homo sapiens
gugggaugaucacaguucacug

SEQ ID NO: 101543 - RNA, 22 nt, Homo sapiens
gugggaugaucgcuugagccca

SEQ ID NO: 101544 - RNA, 22 nt, Homo sapiens
gugggcaaagcuaguguguaga

SEQ ID NO: 101545 - RNA, 22 nt, Homo sapiens
gugggcaagucacuucaguucu

SEQ ID NO: 101546 - RNA, 22 nt, Homo sapiens
gugggguagcaggcuccuaucu

SEQ ID NO: 101547 - RNA, 22 nt, Homo sapiens
gugggguaggcaauuccuagug

SEQ ID NO: 101548 - RNA, 22 nt, Homo sapiens
gugguagaaaguaccaaacuag

SEQ ID NO: 101549 - RNA, 22 nt, Homo sapiens
gugguaggaaagugcaaaugua

SEQ ID NO: 101550 - RNA, 22 nt, Homo sapiens
gugguguccugcaccuauaguc

SEQ ID NO: 101551 - RNA, 22 nt, Homo sapiens
guguaaaugagugcugaaggag

SEQ ID NO: 101552 - RNA, 22 nt, Homo sapiens
guguaacaacagcacuccacug

SEQ ID NO: 101553 - RNA, 18 nt, Homo sapiens
guguauggauggaggcca

SEQ ID NO: 101554 - RNA, 22 nt, Homo sapiens
guguauguuucucccugucccu

SEQ ID NO: 101555 - RNA, 21 nt, Homo sapiens
gugucacagacaugacagaug

SEQ ID NO: 101556 - RNA, 22 nt, Homo sapiens
gugucacuguugagaaguccac

SEQ ID NO: 101557 - RNA, 22 nt, Homo sapiens
gugucaugaagguuuuaugcag

SEQ ID NO: 101558 - RNA, 22 nt, Homo sapiens
guguccucgaguacacaucagg

SEQ ID NO: 101559 - RNA, 22 nt, Homo sapiens
gugucucagcccagaccuauuu

SEQ ID NO: 101560 - RNA, 18 nt, Homo sapiens
gugucugguuaugggagu

SEQ ID NO: 101561 - RNA, 22 nt, Homo sapiens
gugugauggcgcacacagggug

SEQ ID NO: 101562 - RNA, 22 nt, Homo sapiens
gugugcaaauguguaccuacau

SEQ ID NO: 101563 - RNA, 22 nt, Homo sapiens
gugugcaacuuucauuaauauu

SEQ ID NO: 101564 - RNA, 22 nt, Homo sapiens
gugugcaauuuugugggaggca

SEQ ID NO: 101565 - RNA, 22 nt, Homo sapiens
gugugcauaugucuuuauagua

SEQ ID NO: 101566 - RNA, 22 nt, Homo sapiens
gugugcaugucuuuuuaguagg

SEQ ID NO: 101567 - RNA, 21 nt, Homo sapiens
gugugcuugagugaugggauu

SEQ ID NO: 101568 - RNA, 22 nt, Homo sapiens
guguggcaggugggggcucaga

SEQ ID NO: 101569 - RNA, 22 nt, Homo sapiens
guguuauggagccaaacuacua

SEQ ID NO: 101570 - RNA, 22 nt, Homo sapiens
guguucauggaauuugcaauug

SEQ ID NO: 101571 - RNA, 22 nt, Homo sapiens
guuaagggaagccuggguaaga

SEQ ID NO: 101572 - RNA, 22 nt, Homo sapiens
guuacagucuuguguaagguua

SEQ ID NO: 101573 - RNA, 22 nt, Homo sapiens
guuagcuaguagacaauuuucc

SEQ ID NO: 101574 - RNA, 22 nt, Homo sapiens
guuagugcuuauuaaauaguau

SEQ ID NO: 101575 - RNA, 22 nt, Homo sapiens
guuauggaguauaugugaacug

SEQ ID NO: 101576 - RNA, 22 nt, Homo sapiens
guuauguuaguuacaaggcuag

SEQ ID NO: 101577 - RNA, 22 nt, Homo sapiens
guuauuaguugauauuaaguuc

SEQ ID NO: 101578 - RNA, 22 nt, Homo sapiens
guuauugcucucgaagacucuc

SEQ ID NO: 101579 - RNA, 22 nt, Homo sapiens
guucaagcaauucugcugccuc

SEQ ID NO: 101580 - RNA, 22 nt, Homo sapiens
guucaagugauucuacugccuc

SEQ ID NO: 101581 - RNA, 22 nt, Homo sapiens
guucacacuugcaaccccagca

SEQ ID NO: 101582 - RNA, 20 nt, Homo sapiens
guucacagagguuaugauua

SEQ ID NO: 101583 - RNA, 22 nt, Homo sapiens
guucaguaguucauucauuuau

SEQ ID NO: 101584 - RNA, 22 nt, Homo sapiens
guucaucagggauacuggccuu

SEQ ID NO: 101585 - RNA, 22 nt, Homo sapiens
guucaucagggauauuggcuua

SEQ ID NO: 101586 - RNA, 18 nt, Homo sapiens
guugagcuuuuccuuuag

SEQ ID NO: 101587 - RNA, 22 nt, Homo sapiens
guugcagcacacaggcugucag

SEQ ID NO: 101588 - RNA, 22 nt, Homo sapiens
guuggcuguuucccccaaguga

SEQ ID NO: 101589 - RNA, 22 nt, Homo sapiens
guuggcuuuuuaaggaaauugc

SEQ ID NO: 101590 - RNA, 22 nt, Homo sapiens
guugggcccauagacugccagu

SEQ ID NO: 101591 - RNA, 22 nt, Homo sapiens
guuggucaaugugauuaggcca

SEQ ID NO: 101592 - RNA, 22 nt, Homo sapiens
guugguuuccuguaacuggaca

SEQ ID NO: 101593 - RNA, 22 nt, Homo sapiens
guuuaacugguacuucaagucu

SEQ ID NO: 101594 - RNA, 22 nt, Homo sapiens
auaaaugccuguuguuuuaagc

SEQ ID NO: 101595 - RNA, 22 nt, Homo sapiens
auaaaugcuuagaucuguauau

SEQ ID NO: 101596 - RNA, 22 nt, Homo sapiens
auaaaugcuuccagucauuaaa

SEQ ID NO: 101597 - RNA, 22 nt, Homo sapiens
auaacucuguuuuuuucaugca

SEQ ID NO: 101598 - RNA, 22 nt, Homo sapiens
auaaggcuaguguaggagccag

SEQ ID NO: 101599 - RNA, 19 nt, Homo sapiens
auaagugaaucacgggggc

SEQ ID NO: 101600 - RNA, 22 nt, Homo sapiens
auaagugcuuguugaauaauag

SEQ ID NO: 101601 - RNA, 22 nt, Homo sapiens
auaauaccugccacauuugaau

SEQ ID NO: 101602 - RNA, 22 nt, Homo sapiens
auaauaccugccucagagaguu

SEQ ID NO: 101603 - RNA, 22 nt, Homo sapiens
auaauacuuuuauuuugaggaa

SEQ ID NO: 101604 - RNA, 22 nt, Homo sapiens
auaauagguaguaauggauuga

SEQ ID NO: 101605 - RNA, 22 nt, Homo sapiens
auaauaguguuuagauuuggga

SEQ ID NO: 101606 - RNA, 22 nt, Homo sapiens
auccacaugcaguuggaaacag

SEQ ID NO: 101607 - RNA, 22 nt, Homo sapiens
auccauugcucaagagaaguca

SEQ ID NO: 101608 - RNA, 22 nt, Homo sapiens
auccauugucuaaugcuaagau

SEQ ID NO: 101609 - RNA, 22 nt, Homo sapiens
aucccagaaacucggguuucuc

SEQ ID NO: 101610 - RNA, 22 nt, Homo sapiens
auccccugcacggggugucauu

SEQ ID NO: 101611 - RNA, 22 nt, Homo sapiens
aucccugagccugacucucaga

SEQ ID NO: 101612 - RNA, 22 nt, Homo sapiens
aucccuugacguggagucucug

SEQ ID NO: 101613 - RNA, 22 nt, Homo sapiens
aucccuuucugauacuuucccu

SEQ ID NO: 101614 - RNA, 22 nt, Homo sapiens
auccucugagaucuaggcagag

SEQ ID NO: 101615 - RNA, 22 nt, Homo sapiens
auccuguagagaugagggugga

SEQ ID NO: 101616 - RNA, 22 nt, Homo sapiens
aucgcacuccauccugggcaac

SEQ ID NO: 101617 - RNA, 20 nt, Homo sapiens
aucguggccugaggagauac

SEQ ID NO: 101618 - RNA, 22 nt, Homo sapiens
aucuagagaggcagucuggccg

SEQ ID NO: 101619 - RNA, 22 nt, Homo sapiens
aucucaaugcuuuuguaggcca

SEQ ID NO: 101620 - RNA, 22 nt, Homo sapiens
aucucaguucaggcuggccaca

SEQ ID NO: 101621 - RNA, 20 nt, Homo sapiens
aucucugggcaaaggaaaau

SEQ ID NO: 101622 - RNA, 22 nt, Homo sapiens
aucugcacaucuguguuuuugu

SEQ ID NO: 101623 - RNA, 22 nt, Homo sapiens
aucuggcuccuuuugacaaugc

SEQ ID NO: 101624 - RNA, 22 nt, Homo sapiens
aucuggcuucuuuuaguccaca

SEQ ID NO: 101625 - RNA, 22 nt, Homo sapiens
aucugguguggcugugauccuc

SEQ ID NO: 101626 - RNA, 22 nt, Homo sapiens
aucuguagauucagcacaagcu

SEQ ID NO: 101627 - RNA, 22 nt, Homo sapiens
aucugugguuguaugcauauua

SEQ ID NO: 101628 - RNA, 22 nt, Homo sapiens
aucuuuaguggcuguuuucaga

SEQ ID NO: 101629 - RNA, 22 nt, Homo sapiens
aucuuuggauacuugauauagu

SEQ ID NO: 101630 - RNA, 22 nt, Homo sapiens
aucuuuggucaucacagcuaga

SEQ ID NO: 101631 - RNA, 22 nt, Homo sapiens
augaaacuggcuaauuuuugua

SEQ ID NO: 101632 - RNA, 22 nt, Homo sapiens
augaaagguugucuuaagccau

SEQ ID NO: 101633 - RNA, 22 nt, Homo sapiens
augaacacuccaauuguacucc

SEQ ID NO: 101634 - RNA, 22 nt, Homo sapiens
augaacagagccuugagaaccu

SEQ ID NO: 101635 - RNA, 19 nt, Homo sapiens
augaacucaucauuucuca

SEQ ID NO: 101636 - RNA, 22 nt, Homo sapiens
augaacucaucauuuuuuaugg

SEQ ID NO: 101637 - RNA, 22 nt, Homo sapiens
augaagaucucugccuuguguc

SEQ ID NO: 101638 - RNA, 20 nt, Homo sapiens
augaaggcaggugugaguuu

SEQ ID NO: 101639 - RNA, 22 nt, Homo sapiens
augaagugcaugauaguugguu

SEQ ID NO: 101640 - RNA, 22 nt, Homo sapiens
augaaugcagcacuguuuuucu

SEQ ID NO: 101641 - RNA, 21 nt, Homo sapiens
augaauguaaagaauguggga

SEQ ID NO: 101642 - RNA, 22 nt, Homo sapiens
augaauguaaagaaugugggaa

SEQ ID NO: 101643 - RNA, 22 nt, Homo sapiens
augaauucaucugguuuuggga

SEQ ID NO: 101644 - RNA, 22 nt, Homo sapiens
augacaaugaaucccuguuuca

SEQ ID NO: 101645 - RNA, 22 nt, Homo sapiens
augacagagauaugugaauuuu

SEQ ID NO: 101646 - RNA, 22 nt, Homo sapiens
augacauugaaaagcaagugga

SEQ ID NO: 101647 - RNA, 22 nt, Homo sapiens
augaccagagagugcgcagggu

SEQ ID NO: 101648 - RNA, 22 nt, Homo sapiens
augaccaugauccuugccgacc

SEQ ID NO: 101649 - RNA, 22 nt, Homo sapiens
augacccugaccuaagccaauc

SEQ ID NO: 101650 - RNA, 21 nt, Homo sapiens
augacccuggguguccuuucc

SEQ ID NO: 101651 - RNA, 18 nt, Homo sapiens
augaccugcggguuauau

SEQ ID NO: 101652 - RNA, 22 nt, Homo sapiens
augaccuuguccucagugucau

SEQ ID NO: 101653 - RNA, 22 nt, Homo sapiens
augacucagaucuguuccuggu

SEQ ID NO: 101654 - RNA, 22 nt, Homo sapiens
augacuggaacggcacuuuaca

SEQ ID NO: 101655 - RNA, 22 nt, Homo sapiens
augacugucuugcagaggcuau

SEQ ID NO: 101656 - RNA, 22 nt, Homo sapiens
augacuuuucugaaaaccacca

SEQ ID NO: 101657 - RNA, 22 nt, Homo sapiens
augagaaugaagccuggcgugu

SEQ ID NO: 101658 - RNA, 18 nt, Homo sapiens
augagagccgauuccugg

SEQ ID NO: 101659 - RNA, 22 nt, Homo sapiens
augagauaaaccaucucuuaag

SEQ ID NO: 101660 - RNA, 22 nt, Homo sapiens
augagauacuacaaaugaguuu

SEQ ID NO: 101661 - RNA, 22 nt, Homo sapiens
augagauauuuuauaagaucau

SEQ ID NO: 101662 - RNA, 22 nt, Homo sapiens
augagauucuuagagaagucug

SEQ ID NO: 101663 - RNA, 22 nt, Homo sapiens
augagcuaggacagaaugucag

SEQ ID NO: 101664 - RNA, 22 nt, Homo sapiens
augagcuauggagacagggcca

SEQ ID NO: 101665 - RNA, 17 nt, Homo sapiens
augagcucaucauuuuu

SEQ ID NO: 101666 - RNA, 22 nt, Homo sapiens
augaggauagguuucuauuagg

SEQ ID NO: 101667 - RNA, 22 nt, Homo sapiens
augaggcacugcgcccuacuga

SEQ ID NO: 101668 - RNA, 22 nt, Homo sapiens
augagggaagcucacgugucca

SEQ ID NO: 101669 - RNA, 22 nt, Homo sapiens
augaggugaguaaauaaaugaa

SEQ ID NO: 101670 - RNA, 22 nt, Homo sapiens
augagguguuuauuguauccug

SEQ ID NO: 101671 - RNA, 22 nt, Homo sapiens
augaguugaagcuacaagaggc

SEQ ID NO: 101672 - RNA, 22 nt, Homo sapiens
augauaacagccaggcacggug

SEQ ID NO: 101673 - RNA, 22 nt, Homo sapiens
augauacugaguugaguucuca

SEQ ID NO: 101674 - RNA, 22 nt, Homo sapiens
augauacuggcuucauagaaug

SEQ ID NO: 101675 - RNA, 22 nt, Homo sapiens
augauacuguucuaagauuuuu

SEQ ID NO: 101676 - RNA, 22 nt, Homo sapiens
augauauggguugucaguugua

SEQ ID NO: 101677 - RNA, 22 nt, Homo sapiens
augauauggucacccuuaugaa

SEQ ID NO: 101678 - RNA, 22 nt, Homo sapiens
augauguccacagggguguuca

SEQ ID NO: 101679 - RNA, 22 nt, Homo sapiens
augauuguucucacucaagaga

SEQ ID NO: 101680 - RNA, 22 nt, Homo sapiens
augauuuuuguaucgccugaug

SEQ ID NO: 101681 - RNA, 22 nt, Homo sapiens
uacaugcaugggcaugugugca

SEQ ID NO: 101682 - RNA, 22 nt, Homo sapiens
uacaugugcaggucuguggggg

SEQ ID NO: 101683 - RNA, 22 nt, Homo sapiens
uacaugugccauguugguuugc

SEQ ID NO: 101684 - RNA, 22 nt, Homo sapiens
uacauugcacuuuauuagauac

SEQ ID NO: 101685 - RNA, 22 nt, Homo sapiens
uacauuggcuagguuuggaggc

SEQ ID NO: 101686 - RNA, 22 nt, Homo sapiens
uacauugucauauucucucucu

SEQ ID NO: 101687 - RNA, 22 nt, Homo sapiens
uaccacauuguagagggcauuc

SEQ ID NO: 101688 - RNA, 22 nt, Homo sapiens
uaccacugccgagaaaacagau

SEQ ID NO: 101689 - RNA, 22 nt, Homo sapiens
uaccagcauuucucuuuaagua

SEQ ID NO: 101690 - RNA, 22 nt, Homo sapiens
uaccagugaauuccaggggcua

SEQ ID NO: 101691 - RNA, 22 nt, Homo sapiens
uaccagugucagcuuccugugu

SEQ ID NO: 101692 - RNA, 22 nt, Homo sapiens
uaccaugcagguguauguuugu

SEQ ID NO: 101693 - RNA, 22 nt, Homo sapiens
uaccauguaucugggaugcuuu

SEQ ID NO: 101694 - RNA, 19 nt, Homo sapiens
uacccagaagcagcauugu

SEQ ID NO: 101695 - RNA, 22 nt, Homo sapiens
uacccgucuacuuugaacaaaa

SEQ ID NO: 101696 - RNA, 22 nt, Homo sapiens
uaccucagccaaugcccagaag

SEQ ID NO: 101697 - RNA, 22 nt, Homo sapiens
ccagaguucuaggcauuggaaa

SEQ ID NO: 101698 - RNA, 22 nt, Homo sapiens
ccagaguuucugauucagcagg

SEQ ID NO: 101699 - RNA, 22 nt, Homo sapiens
ccaggguugagacccacugacu

SEQ ID NO: 101700 - RNA, 23 nt, Homo sapiens
ccaguauuuauguaaggaagugu

SEQ ID NO: 101701 - RNA, 22 nt, Homo sapiens
ccagugaacugcaagguuuuuc

SEQ ID NO: 101702 - RNA, 18 nt, Homo sapiens
ccagugcaaggaaagccc

SEQ ID NO: 101703 - RNA, 21 nt, Homo sapiens
ccagugguuggaaacuauggg

SEQ ID NO: 101704 - RNA, 22 nt, Homo sapiens
ccaguguauuuuugggaccugc

SEQ ID NO: 101705 - RNA, 22 nt, Homo sapiens
ccagugucugacagacacggcg

SEQ ID NO: 101706 - RNA, 19 nt, Homo sapiens
ccaguguucugauugcacu

SEQ ID NO: 101707 - RNA, 19 nt, Homo sapiens
ccaguguugccagagcuga

SEQ ID NO: 101708 - RNA, 22 nt, Homo sapiens
ccaguucaaugauauggaaacu

SEQ ID NO: 101709 - RNA, 22 nt, Homo sapiens
ccaguuuucccagcaccauuaa

SEQ ID NO: 101710 - RNA, 22 nt, Homo sapiens
ccaguuuucucacuguugcagu

SEQ ID NO: 101711 - RNA, 22 nt, Homo sapiens
ccaguuuuuggcaaugaugaau

SEQ ID NO: 101712 - RNA, 22 nt, Homo sapiens
ccaucacaggccucagugggaa

SEQ ID NO: 101713 - RNA, 22 nt, Homo sapiens
ccaucacgugcaguggccccac

SEQ ID NO: 101714 - RNA, 22 nt, Homo sapiens
ccauggcuucugcauucuguca

SEQ ID NO: 101715 - RNA, 22 nt, Homo sapiens
ccauugcacuccagccuaggca

SEQ ID NO: 101716 - RNA, 22 nt, Homo sapiens
cccagagacagaaugauaaacu

SEQ ID NO: 101717 - RNA, 21 nt, Homo sapiens
cccagguucucugaggguaga

SEQ ID NO: 101718 - RNA, 22 nt, Homo sapiens
cccagugaagagaaccuuacga

SEQ ID NO: 101719 - RNA, 23 nt, Homo sapiens
cccaguuaauccuuaaucuccac

SEQ ID NO: 101720 - RNA, 21 nt, Homo sapiens
ccccugauacuuagucaagag

SEQ ID NO: 101721 - RNA, 19 nt, Homo sapiens
ccccuguggauaccgaggg

SEQ ID NO: 101722 - RNA, 22 nt, Homo sapiens
cccgggcugaaaucagauuugu

SEQ ID NO: 101723 - RNA, 23 nt, Homo sapiens
cccucagaagugcagggagagaa

SEQ ID NO: 101724 - RNA, 22 nt, Homo sapiens
cccugaagacuccaccgucaug

SEQ ID NO: 101725 - RNA, 22 nt, Homo sapiens
cccugagaugugaauuucagag

SEQ ID NO: 101726 - RNA, 22 nt, Homo sapiens
cccuggacauucaucauuaugu

SEQ ID NO: 101727 - RNA, 22 nt, Homo sapiens
cccuguagcagcauucuuaaau

SEQ ID NO: 101728 - RNA, 22 nt, Homo sapiens
cccuguguuguucaaggaucug

SEQ ID NO: 101729 - RNA, 22 nt, Homo sapiens
ccuaaguaauggcaguuuuugc

SEQ ID NO: 101730 - RNA, 22 nt, Homo sapiens
ccucauugcuaucccaggcuga

SEQ ID NO: 101731 - RNA, 22 nt, Homo sapiens
ccucccuuuguugcaagggaaa

SEQ ID NO: 101732 - RNA, 22 nt, Homo sapiens
ccucuuuguugagacuucacca

SEQ ID NO: 101733 - RNA, 22 nt, Homo sapiens
ccugagacgaauggagugaaca

SEQ ID NO: 101734 - RNA, 22 nt, Homo sapiens
ccugagacugauugacucacaa

SEQ ID NO: 101735 - RNA, 22 nt, Homo sapiens
ccugagaucauacuguuaguaa

SEQ ID NO: 101736 - RNA, 19 nt, Homo sapiens
ccugcuguucuuuugcacc

SEQ ID NO: 101737 - RNA, 22 nt, Homo sapiens
ccuggaucauugucauucccaa

SEQ ID NO: 101738 - RNA, 22 nt, Homo sapiens
ccuggcaagagacugaagauag

SEQ ID NO: 101739 - RNA, 22 nt, Homo sapiens
ccuggguuacaggugugagcca

SEQ ID NO: 101740 - RNA, 22 nt, Homo sapiens
ccugucuugauuaaauuacuua

SEQ ID NO: 101741 - RNA, 18 nt, Homo sapiens
ccuuaguuauagagaguc

SEQ ID NO: 101742 - RNA, 22 nt, Homo sapiens
ccuuuuugaguugccagaguuc

SEQ ID NO: 101743 - RNA, 22 nt, Homo sapiens
cgcaguguuugugucccugggu

SEQ ID NO: 101744 - RNA, 22 nt, Homo sapiens
cgcuggugucuaagcgacagcu

SEQ ID NO: 101745 - RNA, 22 nt, Homo sapiens
cggucacagugauucaaggguc

SEQ ID NO: 101746 - RNA, 22 nt, Homo sapiens
cggugcaaauguaauugcaguu

SEQ ID NO: 101747 - RNA, 22 nt, Homo sapiens
cggugcaauucuccugucucag

SEQ ID NO: 101748 - RNA, 22 nt, Homo sapiens
cgugaggaaaacagaggguguu

SEQ ID NO: 101749 - RNA, 20 nt, Homo sapiens
cguugcacuccagccugggc

SEQ ID NO: 101750 - RNA, 22 nt, Homo sapiens
cuaaagugcugagauuauaggu

SEQ ID NO: 101751 - RNA, 22 nt, Homo sapiens
aaaagcauucagagugcugggc

SEQ ID NO: 101752 - RNA, 22 nt, Homo sapiens
aaaagugguguuguuucuaaau

SEQ ID NO: 101753 - RNA, 22 nt, Homo sapiens
aaacauugaccucauccuggca

SEQ ID NO: 101754 - RNA, 22 nt, Homo sapiens
aaacccauauaccagcugugcu

SEQ ID NO: 101755 - RNA, 22 nt, Homo sapiens
aaacccguagauccgaucuugu

SEQ ID NO: 101756 - RNA, 22 nt, Homo sapiens
aaacugcuuuccaugguggcug

SEQ ID NO: 101757 - RNA, 21 nt, Homo sapiens
aaacuggcccaauuguuccau

SEQ ID NO: 101758 - RNA, 22 nt, Homo sapiens
aaagcagcaggugguuuucaau

SEQ ID NO: 101759 - RNA, 22 nt, Homo sapiens
aaagcuaagguagcauuggaga

SEQ ID NO: 101760 - RNA, 22 nt, Homo sapiens
aaagcuacaggaccugcucauu

SEQ ID NO: 101761 - RNA, 22 nt, Homo sapiens
aaagcuaccagauucuguugga

SEQ ID NO: 101762 - RNA, 22 nt, Homo sapiens
aaagcuagagaagcugcuguca

SEQ ID NO: 101763 - RNA, 22 nt, Homo sapiens
aaaggcaucauuaguaccaagu

SEQ ID NO: 101764 - RNA, 22 nt, Homo sapiens
aaaggcuucggaucagaaggua

SEQ ID NO: 101765 - RNA, 22 nt, Homo sapiens
aaagggcuugaauacucuuuuu

SEQ ID NO: 101766 - RNA, 22 nt, Homo sapiens
aaagggcuuuguaaacuucaag

SEQ ID NO: 101767 - RNA, 19 nt, Homo sapiens
aaagguaguaaccucugau

SEQ ID NO: 101768 - RNA, 17 nt, Homo sapiens
aaaguccuuugcuaucu

SEQ ID NO: 101769 - RNA, 22 nt, Homo sapiens
aaagucuagaggaucaugugug

SEQ ID NO: 101770 - RNA, 22 nt, Homo sapiens
aaagugauugcgguuuuugcca

SEQ ID NO: 101771 - RNA, 22 nt, Homo sapiens
aaagugccuucuauuuuaguga

SEQ ID NO: 101772 - RNA, 22 nt, Homo sapiens
aaagugcuaggauuaccugggg

SEQ ID NO: 101773 - RNA, 22 nt, Homo sapiens
aaagugcugggauuuuaggcau

SEQ ID NO: 101774 - RNA, 22 nt, Homo sapiens
aaaguggugggauuccaggcau

SEQ ID NO: 101775 - RNA, 22 nt, Homo sapiens
aaagugucuguuccuagcauga

SEQ ID NO: 101776 - RNA, 22 nt, Homo sapiens
aaaguguguuuccaaccugugg

SEQ ID NO: 101777 - RNA, 22 nt, Homo sapiens
aaaguucuguugauagugcuga

SEQ ID NO: 101778 - RNA, 22 nt, Homo sapiens
aaauaacugucagguucuggaa

SEQ ID NO: 101779 - RNA, 22 nt, Homo sapiens
aaaugcacaaagauuuugcacu

SEQ ID NO: 101780 - RNA, 22 nt, Homo sapiens
aaaugcagcacucaagugggaa

SEQ ID NO: 101781 - RNA, 22 nt, Homo sapiens
aaaugcaugaggugggaagaaa

SEQ ID NO: 101782 - RNA, 22 nt, Homo sapiens
aaaugcauggacagcuggucuu

SEQ ID NO: 101783 - RNA, 22 nt, Homo sapiens
aaaugcccuaaaauggagcauc

SEQ ID NO: 101784 - RNA, 22 nt, Homo sapiens
aaaugccucccauucuacugac

SEQ ID NO: 101785 - RNA, 22 nt, Homo sapiens
aaaugcucucuacacguuucug

SEQ ID NO: 101786 - RNA, 20 nt, Homo sapiens
aaaugcuguaauguuuggga

SEQ ID NO: 101787 - RNA, 20 nt, Homo sapiens
agguuauuauaauuagaaga

SEQ ID NO: 101788 - RNA, 22 nt, Homo sapiens
aguaacacaccugcauggugug

SEQ ID NO: 101789 - RNA, 22 nt, Homo sapiens
aguacaauguugaguagaagug

SEQ ID NO: 101790 - RNA, 22 nt, Homo sapiens
aguaccauuagauuaggaugac

SEQ ID NO: 101791 - RNA, 23 nt, Homo sapiens
aguacuguaguaauugaggggaa

SEQ ID NO: 101792 - RNA, 22 nt, Homo sapiens
aguagcacaugccacccugucu

SEQ ID NO: 101793 - RNA, 22 nt, Homo sapiens
aguaucaagccacacaugguca

SEQ ID NO: 101794 - RNA, 22 nt, Homo sapiens
aguauuuguuggaauaccuguu

SEQ ID NO: 101795 - RNA, 22 nt, Homo sapiens
agucagugcauaagaaugaagu

SEQ ID NO: 101796 - RNA, 22 nt, Homo sapiens
agucauggcagaaggcaccucu

SEQ ID NO: 101797 - RNA, 19 nt, Homo sapiens
agucaugugaggacccuug

SEQ ID NO: 101798 - RNA, 23 nt, Homo sapiens
agucuguguuuacaggcucucug

SEQ ID NO: 101799 - RNA, 22 nt, Homo sapiens
agugaaaucugaagaaggucau

SEQ ID NO: 101800 - RNA, 22 nt, Homo sapiens
agugaacaaagaagugcagaua

SEQ ID NO: 101801 - RNA, 22 nt, Homo sapiens
agugacuagaauaugaauuuua

SEQ ID NO: 101802 - RNA, 17 nt, Homo sapiens
agugagaucauggcuua

SEQ ID NO: 101803 - RNA, 22 nt, Homo sapiens
agugcaguggcacaaucuuggc

SEQ ID NO: 101804 - RNA, 22 nt, Homo sapiens
agugcaguggcauggucauaac

SEQ ID NO: 101805 - RNA, 22 nt, Homo sapiens
agugcaguggcucaaaaugccu

SEQ ID NO: 101806 - RNA, 22 nt, Homo sapiens
agugcagugguuaggagccagg

SEQ ID NO: 101807 - RNA, 22 nt, Homo sapiens
agugcaguugucacgugccuuc

SEQ ID NO: 101808 - RNA, 22 nt, Homo sapiens
agugcauaugucuuuuuggaag

SEQ ID NO: 101809 - RNA, 22 nt, Homo sapiens
agugcauugagacuugugaguu

SEQ ID NO: 101810 - RNA, 22 nt, Homo sapiens
agugccaaaucgagggcucuga

SEQ ID NO: 101811 - RNA, 22 nt, Homo sapiens
agugccuacuugaauuguagug

SEQ ID NO: 101812 - RNA, 23 nt, Homo sapiens
agugccuaguauauaggaggcgc

SEQ ID NO: 101813 - RNA, 22 nt, Homo sapiens
aaaugcugucaaauuguguucu

SEQ ID NO: 101814 - RNA, 22 nt, Homo sapiens
aaauggauuaaguucacuugcu

SEQ ID NO: 101815 - RNA, 22 nt, Homo sapiens
aaauggcaccggcucuucccuc

SEQ ID NO: 101816 - RNA, 22 nt, Homo sapiens
aaaugucauggaguguuucccc

SEQ ID NO: 101817 - RNA, 22 nt, Homo sapiens
aaauugcaaugcgaggcagagg

SEQ ID NO: 101818 - RNA, 22 nt, Homo sapiens
aacaccaucccuuugaugcuuu

SEQ ID NO: 101819 - RNA, 22 nt, Homo sapiens
aacaccauucucuguaacaaga

SEQ ID NO: 101820 - RNA, 22 nt, Homo sapiens
aacaccauuuuucugcagccuu

SEQ ID NO: 101821 - RNA, 22 nt, Homo sapiens
aacaccguagaaacacaaggga

SEQ ID NO: 101822 - RNA, 22 nt, Homo sapiens
aacacuguuuccagucaugauc

SEQ ID NO: 101823 - RNA, 22 nt, Homo sapiens
aacagacugucacauaaaauug

SEQ ID NO: 101824 - RNA, 20 nt, Homo sapiens
aacagcacugucugaagcuu

SEQ ID NO: 101825 - RNA, 22 nt, Homo sapiens
aacagugcauucagggauauau

SEQ ID NO: 101826 - RNA, 22 nt, Homo sapiens
aacagugccugucauuuaguag

SEQ ID NO: 101827 - RNA, 21 nt, Homo sapiens
aacagugcugaacagacaccu

SEQ ID NO: 101828 - RNA, 22 nt, Homo sapiens
aacagugcuguuauaaauguac

SEQ ID NO: 101829 - RNA, 21 nt, Homo sapiens
aacagugcuuaguagauguuc

SEQ ID NO: 101830 - RNA, 22 nt, Homo sapiens
aacagugcuucauucacacauu

SEQ ID NO: 101831 - RNA, 22 nt, Homo sapiens
aaccugaagaaaauauuugcug

SEQ ID NO: 101832 - RNA, 22 nt, Homo sapiens
aaccuucauuccuuucccugcc

SEQ ID NO: 101833 - RNA, 22 nt, Homo sapiens
aacuacaucucuuugaggcagg

SEQ ID NO: 101834 - RNA, 22 nt, Homo sapiens
aacugcauuuucugauugugug

SEQ ID NO: 101835 - RNA, 22 nt, Homo sapiens
aacugcuguuuggguacuggug

SEQ ID NO: 101836 - RNA, 22 nt, Homo sapiens
aacuggcauguuuuaaggcuua

SEQ ID NO: 101837 - RNA, 22 nt, Homo sapiens
aacuggucuuuggaggaggagg

SEQ ID NO: 101838 - RNA, 22 nt, Homo sapiens
aacuugcacuugauugagagcu

SEQ ID NO: 101839 - RNA, 22 nt, Homo sapiens
aagaccuaugcaggaagaaaug

SEQ ID NO: 101840 - RNA, 22 nt, Homo sapiens
aagagagcuaugugcauaauua

SEQ ID NO: 101841 - RNA, 22 nt, Homo sapiens
aagagcauuauuuaguaauuuc

SEQ ID NO: 101842 - RNA, 20 nt, Homo sapiens
aagagcucaccagaauaucu

SEQ ID NO: 101843 - RNA, 18 nt, Homo sapiens
aagagcucagcacagguu

SEQ ID NO: 101844 - RNA, 22 nt, Homo sapiens
aagagcucucuguagcauguga

SEQ ID NO: 101845 - RNA, 22 nt, Homo sapiens
aagaggcuguaggauaaugccu

SEQ ID NO: 101846 - RNA, 22 nt, Homo sapiens
aagauagcuaagcuucuucuaa

SEQ ID NO: 101847 - RNA, 22 nt, Homo sapiens
aagaucauucagggaaggcuga

SEQ ID NO: 101848 - RNA, 22 nt, Homo sapiens
aagaugauguucuuuuucuuag

SEQ ID NO: 101849 - RNA, 22 nt, Homo sapiens
agcugguauuuugucaaggaua

SEQ ID NO: 101850 - RNA, 22 nt, Homo sapiens
agcuggucucaggugcccugcu

SEQ ID NO: 101851 - RNA, 22 nt, Homo sapiens
agcuguaguuugguggauguaa

SEQ ID NO: 101852 - RNA, 22 nt, Homo sapiens
agcuucauuccaacuuccuucu

SEQ ID NO: 101853 - RNA, 22 nt, Homo sapiens
agcuucauuguuaugaauguca

SEQ ID NO: 101854 - RNA, 20 nt, Homo sapiens
agcuugguuuggaugaucac

SEQ ID NO: 101855 - RNA, 22 nt, Homo sapiens
agcuuguauuuguagccuguug

SEQ ID NO: 101856 - RNA, 22 nt, Homo sapiens
agcuugugauuuagagugagag

SEQ ID NO: 101857 - RNA, 22 nt, Homo sapiens
agcuuguuuucccauaacuaga

SEQ ID NO: 101858 - RNA, 22 nt, Homo sapiens
aggaacuguaacuaugucucug

SEQ ID NO: 101859 - RNA, 22 nt, Homo sapiens
aggaaguaauaaguuugguucu

SEQ ID NO: 101860 - RNA, 22 nt, Homo sapiens
aggaagugugcaauuaauuucu

SEQ ID NO: 101861 - RNA, 22 nt, Homo sapiens
aggaaucuaagguaucagguua

SEQ ID NO: 101862 - RNA, 22 nt, Homo sapiens
aggaauggaaacuuuugauggu

SEQ ID NO: 101863 - RNA, 22 nt, Homo sapiens
aggaauguuaguacuucuuagu

SEQ ID NO: 101864 - RNA, 22 nt, Homo sapiens
aggaauuuaauguaugauaaua

SEQ ID NO: 101865 - RNA, 21 nt, Homo sapiens
aggagauguuuguccuuuuag

SEQ ID NO: 101866 - RNA, 22 nt, Homo sapiens
aggagcuuuggggaaaacagau

SEQ ID NO: 101867 - RNA, 22 nt, Homo sapiens
aggaggauugcuuucaucuuuu

SEQ ID NO: 101868 - RNA, 22 nt, Homo sapiens
aggagguagucugucccuuagc

SEQ ID NO: 101869 - RNA, 21 nt, Homo sapiens
aggcaaaugaagcagccgcuc

SEQ ID NO: 101870 - RNA, 22 nt, Homo sapiens
aggcagucucugccggcugagg

SEQ ID NO: 101871 - RNA, 22 nt, Homo sapiens
aggcagucugaguuuugaaagg

SEQ ID NO: 101872 - RNA, 22 nt, Homo sapiens
aggcaugaaauacaugcauuga

SEQ ID NO: 101873 - RNA, 22 nt, Homo sapiens
aggcaugaguucagaggguaug

SEQ ID NO: 101874 - RNA, 22 nt, Homo sapiens
aggcauggagacuaaaauuaua

SEQ ID NO: 101875 - RNA, 22 nt, Homo sapiens
aggcugguauuuacaaaagcuc

SEQ ID NO: 101876 - RNA, 22 nt, Homo sapiens
aggcuguguggauaauauuggg

SEQ ID NO: 101877 - RNA, 22 nt, Homo sapiens
aggcuuuuggagaacacugcac

SEQ ID NO: 101878 - RNA, 22 nt, Homo sapiens
agggaagugugcuaugcauuua

SEQ ID NO: 101879 - RNA, 22 nt, Homo sapiens
agggagcaaaguggucuuucuc

SEQ ID NO: 101880 - RNA, 23 nt, Homo sapiens
agggcacuauagauguuauucua

SEQ ID NO: 101881 - RNA, 22 nt, Homo sapiens
agggcuuaucuguguagaguuc

SEQ ID NO: 101882 - RNA, 22 nt, Homo sapiens
agggcuuguuuaacuaucauua

SEQ ID NO: 101883 - RNA, 22 nt, Homo sapiens
agguaagaugugacuugguguu

SEQ ID NO: 101884 - RNA, 19 nt, Homo sapiens
aucagcacaagugugcuuu

SEQ ID NO: 101885 - RNA, 22 nt, Homo sapiens
aucagcagcaugaaaacggacu

SEQ ID NO: 101886 - RNA, 22 nt, Homo sapiens
aucaggcacacauuggaguuug

SEQ ID NO: 101887 - RNA, 22 nt, Homo sapiens
aucauagcucacugcagccucg

SEQ ID NO: 101888 - RNA, 22 nt, Homo sapiens
aucauaucaucugcaaacaaag

SEQ ID NO: 101889 - RNA, 22 nt, Homo sapiens
aucauaucauuggugaacagug

SEQ ID NO: 101890 - RNA, 22 nt, Homo sapiens
aucaucaugcacuacagccugg

SEQ ID NO: 101891 - RNA, 22 nt, Homo sapiens
aucauccagccccagaagggag

SEQ ID NO: 101892 - RNA, 22 nt, Homo sapiens
aucaugcacaugcauagguaug

SEQ ID NO: 101893 - RNA, 22 nt, Homo sapiens
aucauugugcaucuucauucca

SEQ ID NO: 101894 - RNA, 22 nt, Homo sapiens
auccaagagacugaugacuucc

SEQ ID NO: 101895 - RNA, 22 nt, Homo sapiens
auccaucagacggcaggcguug

SEQ ID NO: 101896 - RNA, 22 nt, Homo sapiens
auccauugcacuauggaaagug

SEQ ID NO: 101897 - RNA, 20 nt, Homo sapiens
aucccauuccugaagauacu

SEQ ID NO: 101898 - RNA, 22 nt, Homo sapiens
aucccugaggaauuucugcacu

SEQ ID NO: 101899 - RNA, 22 nt, Homo sapiens
aucccuguaguaauauucuagc

SEQ ID NO: 101900 - RNA, 22 nt, Homo sapiens
aucccuguguccagcaccugug

SEQ ID NO: 101901 - RNA, 22 nt, Homo sapiens
aucccuuccuagcacuuggugu

SEQ ID NO: 101902 - RNA, 22 nt, Homo sapiens
aucccuuucucuggcuaggggg

SEQ ID NO: 101903 - RNA, 22 nt, Homo sapiens
auccucaguggcuuaaguauag

SEQ ID NO: 101904 - RNA, 22 nt, Homo sapiens
auccucugagagaguuucauaa

SEQ ID NO: 101905 - RNA, 22 nt, Homo sapiens
auccugagacuuuucugaaguu

SEQ ID NO: 101906 - RNA, 22 nt, Homo sapiens
auccugaugacacagugcugca

SEQ ID NO: 101907 - RNA, 22 nt, Homo sapiens
auccuuuagacuguccaguuga

SEQ ID NO: 101908 - RNA, 22 nt, Homo sapiens
aucgcaccauugcacuccagca

SEQ ID NO: 101909 - RNA, 20 nt, Homo sapiens
ccaucaguccucucuuguuc

SEQ ID NO: 101910 - RNA, 22 nt, Homo sapiens
ccaugaacuagaauagaacaug

SEQ ID NO: 101911 - RNA, 21 nt, Homo sapiens
ccauggcaaugguaaacugac

SEQ ID NO: 101912 - RNA, 22 nt, Homo sapiens
ccauggcaauggucagucuauu

SEQ ID NO: 101913 - RNA, 22 nt, Homo sapiens
ccauugaacaugaaggaaugug

SEQ ID NO: 101914 - RNA, 22 nt, Homo sapiens
cccagaguucuuaaauacugag

SEQ ID NO: 101915 - RNA, 19 nt, Homo sapiens
cccagugucagagaagggu

SEQ ID NO: 101916 - RNA, 22 nt, Homo sapiens
cccaguguuuauuuugagccaa

SEQ ID NO: 101917 - RNA, 22 nt, Homo sapiens
cccaguuuugcuucucaugagg

SEQ ID NO: 101918 - RNA, 22 nt, Homo sapiens
ccccagguuucaauaaagccca

SEQ ID NO: 101919 - RNA, 22 nt, Homo sapiens
ccccagugguugcaacagcaga

SEQ ID NO: 101920 - RNA, 22 nt, Homo sapiens
ccccaguguguaaaggccuugc

SEQ ID NO: 101921 - RNA, 22 nt, Homo sapiens
ccccggguucugucugcccuug

SEQ ID NO: 101922 - RNA, 20 nt, Homo sapiens
ccccguguuuagcauaucau

SEQ ID NO: 101923 - RNA, 20 nt, Homo sapiens
ccccuggaguggggcugcuu

SEQ ID NO: 101924 - RNA, 22 nt, Homo sapiens
ccccuguaaacuggcuucccug

SEQ ID NO: 101925 - RNA, 18 nt, Homo sapiens
cccgggugggcuguuccc

SEQ ID NO: 101926 - RNA, 17 nt, Homo sapiens
cccuaguagcugggacu

SEQ ID NO: 101927 - RNA, 22 nt, Homo sapiens
cccucauucauucauccuaugu

SEQ ID NO: 101928 - RNA, 22 nt, Homo sapiens
cccugagaaaacuuuguccuua

SEQ ID NO: 101929 - RNA, 22 nt, Homo sapiens
cccuuagaauuuuguaguuauu

SEQ ID NO: 101930 - RNA, 22 nt, Homo sapiens
cccuuagacuacuaauaugagc

SEQ ID NO: 101931 - RNA, 22 nt, Homo sapiens
cccuucauucaaggguugugag

SEQ ID NO: 101932 - RNA, 22 nt, Homo sapiens
ccuaggcacugggguccagccc

SEQ ID NO: 101933 - RNA, 22 nt, Homo sapiens
ccucauggagaacuucugcuag

SEQ ID NO: 101934 - RNA, 21 nt, Homo sapiens
ccugaagaagugaccucugag

SEQ ID NO: 101935 - RNA, 21 nt, Homo sapiens
ccugauguucacuuggccuuc

SEQ ID NO: 101936 - RNA, 22 nt, Homo sapiens
ccugcauaguucaccgcugaua

SEQ ID NO: 101937 - RNA, 22 nt, Homo sapiens
ccuggaaugaagcuuauauugc

SEQ ID NO: 101938 - RNA, 22 nt, Homo sapiens
ccuggcacugagcaguguucua

SEQ ID NO: 101939 - RNA, 22 nt, Homo sapiens
ccuggcacugggccccguggcu

SEQ ID NO: 101940 - RNA, 22 nt, Homo sapiens
ccugguguuuugauggucgggu

SEQ ID NO: 101941 - RNA, 21 nt, Homo sapiens
ccuugagaacaucaauuugcu

SEQ ID NO: 101942 - RNA, 22 nt, Homo sapiens
ccuuggcaauggcuggggcuga

SEQ ID NO: 101943 - RNA, 22 nt, Homo sapiens
ccuuggcacuuugccacagugc

SEQ ID NO: 101944 - RNA, 22 nt, Homo sapiens
ccuugguaauguguuuuauucu

SEQ ID NO: 101945 - RNA, 22 nt, Homo sapiens
ccuugguggccacaagacauug

SEQ ID NO: 101946 - RNA, 22 nt, Homo sapiens
ccuugucacugaguggaaugaa

SEQ ID NO: 101947 - RNA, 22 nt, Homo sapiens
cggcaguggguaagccaagcuu

SEQ ID NO: 101948 - RNA, 22 nt, Homo sapiens
cuaaaacuuucugagugcagca

SEQ ID NO: 101949 - RNA, 22 nt, Homo sapiens
cuaaaguauugagugguaaaga

SEQ ID NO: 101950 - RNA, 22 nt, Homo sapiens
cuaaaguucuucugagagaaca

SEQ ID NO: 101951 - RNA, 22 nt, Homo sapiens
cuaacacagggcaagucaggcu

SEQ ID NO: 101952 - RNA, 22 nt, Homo sapiens
cuaacuaugucucaggaugucc

SEQ ID NO: 101953 - RNA, 21 nt, Homo sapiens
cuaaggaaagcuaugaacccu

SEQ ID NO: 101954 - RNA, 17 nt, Homo sapiens
cuaaggcaagagucugc

SEQ ID NO: 101955 - RNA, 22 nt, Homo sapiens
cuaagugaguauaauuuuaaga

SEQ ID NO: 101956 - RNA, 22 nt, Homo sapiens
cuaauccugugguagcacucaa

SEQ ID NO: 101957 - RNA, 22 nt, Homo sapiens
cuaaucugugcauagaagaggc

SEQ ID NO: 101958 - RNA, 22 nt, Homo sapiens
cuacaguagagaggauguagaa

SEQ ID NO: 101959 - RNA, 22 nt, Homo sapiens
cuacaguuauguuuuaaaugug

SEQ ID NO: 101960 - RNA, 22 nt, Homo sapiens
cuacauuguagguauucaaacu

SEQ ID NO: 101961 - RNA, 22 nt, Homo sapiens
cuacucuggagagugacaauca

SEQ ID NO: 101962 - RNA, 22 nt, Homo sapiens
cuagaauguauaaaaccaagcu

SEQ ID NO: 101963 - RNA, 22 nt, Homo sapiens
cuagacacugacguuccuccga

SEQ ID NO: 101964 - RNA, 22 nt, Homo sapiens
cuagaggcacagccuaggcacu

SEQ ID NO: 101965 - RNA, 22 nt, Homo sapiens
cuagaguagaguuuccuuagga

SEQ ID NO: 101966 - RNA, 22 nt, Homo sapiens
cuagcccugagauaaaugucau

SEQ ID NO: 101967 - RNA, 22 nt, Homo sapiens
cuagguagcuuuucugucaugu

SEQ ID NO: 101968 - RNA, 18 nt, Homo sapiens
cuaguguuucuugaauca

SEQ ID NO: 101969 - RNA, 22 nt, Homo sapiens
cuauaacagugugguuuggaga

SEQ ID NO: 101970 - RNA, 22 nt, Homo sapiens
cuauaugucuguuuugguacca

SEQ ID NO: 101971 - RNA, 21 nt, Homo sapiens
cuaucucaguguuuacauuug

SEQ ID NO: 101972 - RNA, 22 nt, Homo sapiens
cuaugcauuuuggaggagggaa

SEQ ID NO: 101973 - RNA, 18 nt, Homo sapiens
cuaugccacuuuauauca

SEQ ID NO: 101974 - RNA, 22 nt, Homo sapiens
cuauggccugcuuagaacauac

SEQ ID NO: 101975 - RNA, 22 nt, Homo sapiens
cuauggcuguaaggauaguaac

SEQ ID NO: 101976 - RNA, 22 nt, Homo sapiens
cuauggcuguagucccugugua

SEQ ID NO: 101977 - RNA, 22 nt, Homo sapiens
cuauggugauagaaaucagaau

SEQ ID NO: 101978 - RNA, 22 nt, Homo sapiens
cuaugguuucucaaacuccuga

SEQ ID NO: 101979 - RNA, 22 nt, Homo sapiens
cuaugucuuucauauuuugggg

SEQ ID NO: 101980 - RNA, 22 nt, Homo sapiens
cuauuugguuggugaaaaaagu

SEQ ID NO: 101981 - RNA, 22 nt, Homo sapiens
cucaaaguacuuugguuauugu

SEQ ID NO: 101982 - RNA, 22 nt, Homo sapiens
cucaaaguguggucuguggguu

SEQ ID NO: 101983 - RNA, 22 nt, Homo sapiens
cucaaaugguccagcuaguggu

SEQ ID NO: 101984 - RNA, 22 nt, Homo sapiens
cucaaguaauccucccgccuug

SEQ ID NO: 101985 - RNA, 22 nt, Homo sapiens
cucaaguagugguuuucauuga

SEQ ID NO: 101986 - RNA, 22 nt, Homo sapiens
cucaauuuggaauugucaguaa

SEQ ID NO: 101987 - RNA, 18 nt, Homo sapiens
cucacacccuaaucagga

SEQ ID NO: 101988 - RNA, 22 nt, Homo sapiens
cucacagucucucccuaauuuu

SEQ ID NO: 101989 - RNA, 20 nt, Homo sapiens
cucaccagguguaggcugag

SEQ ID NO: 101990 - RNA, 22 nt, Homo sapiens
cucacggugcaggcuucuggga

SEQ ID NO: 101991 - RNA, 22 nt, Homo sapiens
cucacuaguaaggcuguuuagu

SEQ ID NO: 101992 - RNA, 22 nt, Homo sapiens
cucacugucaacauguauuugg

SEQ ID NO: 101993 - RNA, 22 nt, Homo sapiens
cucacugugguguccuuaggua

SEQ ID NO: 101994 - RNA, 22 nt, Homo sapiens
cucagaguacuuuucccacuuc

SEQ ID NO: 101995 - RNA, 22 nt, Homo sapiens
cucagauacuugggagguugag

SEQ ID NO: 101996 - RNA, 22 nt, Homo sapiens
cucagggugguggacucuaaua

SEQ ID NO: 101997 - RNA, 20 nt, Homo sapiens
cucagugcacccccauaaaa

SEQ ID NO: 101998 - RNA, 22 nt, Homo sapiens
cucaguggauuagauaaugcac

SEQ ID NO: 101999 - RNA, 22 nt, Homo sapiens
aucgcugagaaagggacuuuca

SEQ ID NO: 102000 - RNA, 22 nt, Homo sapiens
aucucagagaaaauuacuaaga

SEQ ID NO: 102001 - RNA, 22 nt, Homo sapiens
aucucagcaacuaaagauccuu

SEQ ID NO: 102002 - RNA, 22 nt, Homo sapiens
aucucaguuaaugacccuaugc

SEQ ID NO: 102003 - RNA, 22 nt, Homo sapiens
aucucauggagguagagaguaa

SEQ ID NO: 102004 - RNA, 22 nt, Homo sapiens
aucugauggagagcguguggcu

SEQ ID NO: 102005 - RNA, 19 nt, Homo sapiens
aucuggaguuccuggggcu

SEQ ID NO: 102006 - RNA, 22 nt, Homo sapiens
aucugugaaugaaguuauuuug

SEQ ID NO: 102007 - RNA, 22 nt, Homo sapiens
aucuuggauuaccugggugggu

SEQ ID NO: 102008 - RNA, 21 nt, Homo sapiens
aucuugguauagucuuauugg

SEQ ID NO: 102009 - RNA, 22 nt, Homo sapiens
aucuuguccugagguuuuauug

SEQ ID NO: 102010 - RNA, 22 nt, Homo sapiens
aucuuguguugaauggugcaga

SEQ ID NO: 102011 - RNA, 22 nt, Homo sapiens
aucuuugauuguagguacaaug

SEQ ID NO: 102012 - RNA, 22 nt, Homo sapiens
augaaaagcauaaacgcugaag

SEQ ID NO: 102013 - RNA, 22 nt, Homo sapiens
augaaacuggagcgccuggagg

SEQ ID NO: 102014 - RNA, 22 nt, Homo sapiens
augaaaucacugugaugcccua

SEQ ID NO: 102015 - RNA, 22 nt, Homo sapiens
augaaauugcuaucgcaguacu

SEQ ID NO: 102016 - RNA, 22 nt, Homo sapiens
augaacuaugugggauguuuua

SEQ ID NO: 102017 - RNA, 18 nt, Homo sapiens
augaacucaucauuuuua

SEQ ID NO: 102018 - RNA, 22 nt, Homo sapiens
augaagacaucgucugggauua

SEQ ID NO: 102019 - RNA, 22 nt, Homo sapiens
augaagagaaaguggaucuugg

SEQ ID NO: 102020 - RNA, 22 nt, Homo sapiens
augaagaucaugaagacggcuu

SEQ ID NO: 102021 - RNA, 22 nt, Homo sapiens
augaaguauuaggacacauuua

SEQ ID NO: 102022 - RNA, 17 nt, Homo sapiens
augaagucaucauuuuu

SEQ ID NO: 102023 - RNA, 20 nt, Homo sapiens
augaagugaaguuagggaac

SEQ ID NO: 102024 - RNA, 22 nt, Homo sapiens
augaauacagcuaugcgugcau

SEQ ID NO: 102025 - RNA, 22 nt, Homo sapiens
augaauacugcugcaaugaaca

SEQ ID NO: 102026 - RNA, 22 nt, Homo sapiens
augaauagaguuaauugaguac

SEQ ID NO: 102027 - RNA, 22 nt, Homo sapiens
augacacugcagagauguccca

SEQ ID NO: 102028 - RNA, 23 nt, Homo sapiens
augacacuguccuugaccauuuc

SEQ ID NO: 102029 - RNA, 22 nt, Homo sapiens
augacaguaugacuccaaaagu

SEQ ID NO: 102030 - RNA, 22 nt, Homo sapiens
augacauguauuuccaggauuu

SEQ ID NO: 102031 - RNA, 22 nt, Homo sapiens
augacauugaugcucuggcugg

SEQ ID NO: 102032 - RNA, 22 nt, Homo sapiens
augaccaaagaaaugcuauagg

SEQ ID NO: 102033 - RNA, 22 nt, Homo sapiens
augaccaaugggcagagcuaga

SEQ ID NO: 102034 - RNA, 22 nt, Homo sapiens
augaccauuucaauugauaugg

SEQ ID NO: 102035 - RNA, 20 nt, Homo sapiens
augaccuauggugguauaag

SEQ ID NO: 102036 - RNA, 22 nt, Homo sapiens
augacgagaugguguuuggcuu

SEQ ID NO: 102037 - RNA, 22 nt, Homo sapiens
augacguugugggcucucaagc

SEQ ID NO: 102038 - RNA, 20 nt, Homo sapiens
augacuagaggacaugguaa

SEQ ID NO: 102039 - RNA, 22 nt, Homo sapiens
augacuggaacagcaauuuaca

SEQ ID NO: 102040 - RNA, 22 nt, Homo sapiens
augacuggauaauggacacaca

SEQ ID NO: 102041 - RNA, 22 nt, Homo sapiens
augagacauuaaaguguguuug

SEQ ID NO: 102042 - RNA, 22 nt, Homo sapiens
augagaccagcagaaaaccugu

SEQ ID NO: 102043 - RNA, 22 nt, Homo sapiens
augagacuguucuuccucauug

SEQ ID NO: 102044 - RNA, 22 nt, Homo sapiens
augagauauguuaaaaguuaaa

SEQ ID NO: 102045 - RNA, 22 nt, Homo sapiens
augagaugaggaauggcccucc

SEQ ID NO: 102046 - RNA, 22 nt, Homo sapiens
augagauuguuugugugaaaua

SEQ ID NO: 102047 - RNA, 22 nt, Homo sapiens
augagcaaagagaugagacccu

SEQ ID NO: 102048 - RNA, 19 nt, Homo sapiens
augagcaauaguuuuaauc

SEQ ID NO: 102049 - RNA, 20 nt, Homo sapiens
augagcucaucuugaaaacc

SEQ ID NO: 102050 - RNA, 22 nt, Homo sapiens
augagcucauugggugacuggg

SEQ ID NO: 102051 - RNA, 22 nt, Homo sapiens
augaggaagucaggcccagggg

SEQ ID NO: 102052 - RNA, 22 nt, Homo sapiens
augaggacaucuuccuuaugga

SEQ ID NO: 102053 - RNA, 22 nt, Homo sapiens
augaggcuauaauuuuuaugua

SEQ ID NO: 102054 - RNA, 22 nt, Homo sapiens
augaggugaggucaguaaggua

SEQ ID NO: 102055 - RNA, 22 nt, Homo sapiens
augaggugggcggcuuggaaga

SEQ ID NO: 102056 - RNA, 22 nt, Homo sapiens
augaguauguucuguauuuuca

SEQ ID NO: 102057 - RNA, 19 nt, Homo sapiens
augagucugcaagaaccag

SEQ ID NO: 102058 - RNA, 19 nt, Homo sapiens
augaguuaggggaaauuuc

SEQ ID NO: 102059 - RNA, 22 nt, Homo sapiens
augauagucuugagaagcauuu

SEQ ID NO: 102060 - RNA, 22 nt, Homo sapiens
augauaucuuguuuuucaugca

SEQ ID NO: 102061 - RNA, 22 nt, Homo sapiens
augauauuauucuagcccagag

SEQ ID NO: 102062 - RNA, 22 nt, Homo sapiens
augaugcaguacuuugggaaca

SEQ ID NO: 102063 - RNA, 22 nt, Homo sapiens
augaugcugcaguuguugccaa

SEQ ID NO: 102064 - RNA, 22 nt, Homo sapiens
augauggagguagauuguccau

SEQ ID NO: 102065 - RNA, 22 nt, Homo sapiens
augauguaggccauggguuucu

SEQ ID NO: 102066 - RNA, 22 nt, Homo sapiens
augaugucauuuuaauuucuaa

SEQ ID NO: 102067 - RNA, 22 nt, Homo sapiens
augcaaacagcuaucuggcugg

SEQ ID NO: 102068 - RNA, 22 nt, Homo sapiens
augcaaacaucauagaguguac

SEQ ID NO: 102069 - RNA, 20 nt, Homo sapiens
agcaucacagagccgggugu

SEQ ID NO: 102070 - RNA, 22 nt, Homo sapiens
agcaucaugcaguugcuauuca

SEQ ID NO: 102071 - RNA, 22 nt, Homo sapiens
agcaucauguuuucgagguuca

SEQ ID NO: 102072 - RNA, 19 nt, Homo sapiens
agcaucauuauuguuuugg

SEQ ID NO: 102073 - RNA, 22 nt, Homo sapiens
agcauggucacuuugggcccca

SEQ ID NO: 102074 - RNA, 21 nt, Homo sapiens
agccaguguuccuuguggcuc

SEQ ID NO: 102075 - RNA, 22 nt, Homo sapiens
agcccagagacuguguaaauuu

SEQ ID NO: 102076 - RNA, 22 nt, Homo sapiens
agcccugugauuacuuuuauaa

SEQ ID NO: 102077 - RNA, 22 nt, Homo sapiens
agccuauccaauaucagugaga

SEQ ID NO: 102078 - RNA, 22 nt, Homo sapiens
agccuguguugaauuauagaaa

SEQ ID NO: 102079 - RNA, 23 nt, Homo sapiens
agccuguugccuaggcagcucau

SEQ ID NO: 102080 - RNA, 22 nt, Homo sapiens
agccuucauucugacaguagga

SEQ ID NO: 102081 - RNA, 22 nt, Homo sapiens
agcggcuguuccccuggucuau

SEQ ID NO: 102082 - RNA, 23 nt, Homo sapiens
agcuagagaggcuggggauacag

SEQ ID NO: 102083 - RNA, 22 nt, Homo sapiens
agcuaugucugaugccugauua

SEQ ID NO: 102084 - RNA, 18 nt, Homo sapiens
agcucaguguuugcuuac

SEQ ID NO: 102085 - RNA, 22 nt, Homo sapiens
agcucauugcuguccuggagga

SEQ ID NO: 102086 - RNA, 21 nt, Homo sapiens
agcuccacucguucccaaagc

SEQ ID NO: 102087 - RNA, 22 nt, Homo sapiens
agcuccaugauaguaugucugu

SEQ ID NO: 102088 - RNA, 20 nt, Homo sapiens
agcuccauuccugaaggcug

SEQ ID NO: 102089 - RNA, 22 nt, Homo sapiens
acugcacuccaccuugggcaac

SEQ ID NO: 102090 - RNA, 22 nt, Homo sapiens
acugcacuccagacucugucuc

SEQ ID NO: 102091 - RNA, 22 nt, Homo sapiens
acugcacuccagcccgggugac

SEQ ID NO: 102092 - RNA, 22 nt, Homo sapiens
acugcacuccagccucccgucu

SEQ ID NO: 102093 - RNA, 22 nt, Homo sapiens
acugcacuccagccucggcaau

SEQ ID NO: 102094 - RNA, 22 nt, Homo sapiens
acugcacuccagccucggggac

SEQ ID NO: 102095 - RNA, 22 nt, Homo sapiens
acugcacuccagccucgugaca

SEQ ID NO: 102096 - RNA, 22 nt, Homo sapiens
acugcacuccagccuucgugac

SEQ ID NO: 102097 - RNA, 22 nt, Homo sapiens
acugcacuccagccuuggcggc

SEQ ID NO: 102098 - RNA, 22 nt, Homo sapiens
acugcacuccagccuuugcgau

SEQ ID NO: 102099 - RNA, 22 nt, Homo sapiens
acugcacuccagcuugggugac

SEQ ID NO: 102100 - RNA, 22 nt, Homo sapiens
acugcacuccagcuuuggguga

SEQ ID NO: 102101 - RNA, 20 nt, Homo sapiens
acugcacuccaggcugccca

SEQ ID NO: 102102 - RNA, 20 nt, Homo sapiens
acugcacuccagucucuggg

SEQ ID NO: 102103 - RNA, 22 nt, Homo sapiens
acugcacuccaucuuagguggc

SEQ ID NO: 102104 - RNA, 22 nt, Homo sapiens
acugcacuccggccuggcaaca

SEQ ID NO: 102105 - RNA, 22 nt, Homo sapiens
acugcacucuagccuuggcaac

SEQ ID NO: 102106 - RNA, 20 nt, Homo sapiens
acugcacuucagccugcugg

SEQ ID NO: 102107 - RNA, 22 nt, Homo sapiens
acugcacuucagccuuggggac

SEQ ID NO: 102108 - RNA, 22 nt, Homo sapiens
acugcauaaauauguguaauau

SEQ ID NO: 102109 - RNA, 22 nt, Homo sapiens
acugcauuugguaaagucaaga

SEQ ID NO: 102110 - RNA, 22 nt, Homo sapiens
acugcauuugucccuuuugaac

SEQ ID NO: 102111 - RNA, 22 nt, Homo sapiens
acugccuaaugacuuauguuuu

SEQ ID NO: 102112 - RNA, 22 nt, Homo sapiens
acuggcaauggcagaaauaguu

SEQ ID NO: 102113 - RNA, 22 nt, Homo sapiens
acuggcuuauuucacuuagcau

SEQ ID NO: 102114 - RNA, 22 nt, Homo sapiens
acuguacuccagccugggugac

SEQ ID NO: 102115 - RNA, 22 nt, Homo sapiens
acuguacuccauccugggugac

SEQ ID NO: 102116 - RNA, 22 nt, Homo sapiens
acuguauagauggaguugauuu

SEQ ID NO: 102117 - RNA, 22 nt, Homo sapiens
acuuaguauggggcuuuugaga

SEQ ID NO: 102118 - RNA, 22 nt, Homo sapiens
acuucauucucuggaucagaau

SEQ ID NO: 102119 - RNA, 22 nt, Homo sapiens
acuugacacuuauauuacucac

SEQ ID NO: 102120 - RNA, 22 nt, Homo sapiens
acuuggcaaaguuuuaaacagc

SEQ ID NO: 102121 - RNA, 22 nt, Homo sapiens
acuuugguuuauagaauuuagg

SEQ ID NO: 102122 - RNA, 21 nt, Homo sapiens
acuuuguugggggcugaggca

SEQ ID NO: 102123 - RNA, 17 nt, Homo sapiens
acuuuuugaggaggcau

SEQ ID NO: 102124 - RNA, 22 nt, Homo sapiens
acuuuuugauggggagaacauu

SEQ ID NO: 102125 - RNA, 22 nt, Homo sapiens
agaaacacagguggaauugcuu

SEQ ID NO: 102126 - RNA, 22 nt, Homo sapiens
agaaauguuuacucacccccuu

SEQ ID NO: 102127 - RNA, 22 nt, Homo sapiens
agaacacugaguucagggucag

SEQ ID NO: 102128 - RNA, 22 nt, Homo sapiens
agaacccuuugaaauguguuug

SEQ ID NO: 102129 - RNA, 22 nt, Homo sapiens
agaaugauccuucucagaggca

SEQ ID NO: 102130 - RNA, 22 nt, Homo sapiens
agaauguaaacagaauagagga

SEQ ID NO: 102131 - RNA, 22 nt, Homo sapiens
agaauguaacucuaugaaggca

SEQ ID NO: 102132 - RNA, 22 nt, Homo sapiens
agaaugugaacaucuugaaagu

SEQ ID NO: 102133 - RNA, 22 nt, Homo sapiens
agacagcugguagcacuuccug

SEQ ID NO: 102134 - RNA, 20 nt, Homo sapiens
agacaguguggagauuccuu

SEQ ID NO: 102135 - RNA, 22 nt, Homo sapiens
agacaucauuugauggugggag

SEQ ID NO: 102136 - RNA, 22 nt, Homo sapiens
agaccacuuuagagauuguuca

SEQ ID NO: 102137 - RNA, 22 nt, Homo sapiens
agacuagacagaugaacagcac

SEQ ID NO: 102138 - RNA, 19 nt, Homo sapiens
agacuggcccaggcgggug

SEQ ID NO: 102139 - RNA, 22 nt, Homo sapiens
agagagguggguggagccccca

SEQ ID NO: 102140 - RNA, 22 nt, Homo sapiens
agagauaaagauuuuaauuuug

SEQ ID NO: 102141 - RNA, 22 nt, Homo sapiens
agagauacauucugagaagugc

SEQ ID NO: 102142 - RNA, 22 nt, Homo sapiens
agagcaaugacaugcuaugugg

SEQ ID NO: 102143 - RNA, 18 nt, Homo sapiens
agagcacugaguuuuaga

SEQ ID NO: 102144 - RNA, 22 nt, Homo sapiens
agagcauugaguuaaugguuca

SEQ ID NO: 102145 - RNA, 18 nt, Homo sapiens
agagcuaugaacauaugc

SEQ ID NO: 102146 - RNA, 22 nt, Homo sapiens
agaguacaggcaaguuagucau

SEQ ID NO: 102147 - RNA, 22 nt, Homo sapiens
agaguauagcaacuuaguaaaa

SEQ ID NO: 102148 - RNA, 18 nt, Homo sapiens
agaguaucauuuccccca

SEQ ID NO: 102149 - RNA, 19 nt, Homo sapiens
agaguauugaauuugcccu

SEQ ID NO: 102150 - RNA, 20 nt, Homo sapiens
agagugcuggacugaggagc

SEQ ID NO: 102151 - RNA, 22 nt, Homo sapiens
agauacaucuaugugucugugu

SEQ ID NO: 102152 - RNA, 22 nt, Homo sapiens
agaugguguuuucucaccagau

SEQ ID NO: 102153 - RNA, 22 nt, Homo sapiens
agcaaaucuaugaauguauauu

SEQ ID NO: 102154 - RNA, 23 nt, Homo sapiens
agcaaaugcucuagcacuccaac

SEQ ID NO: 102155 - RNA, 22 nt, Homo sapiens
agcaagauugauggccugcagg

SEQ ID NO: 102156 - RNA, 22 nt, Homo sapiens
agcaagauuguucccauuuucu

SEQ ID NO: 102157 - RNA, 22 nt, Homo sapiens
agcacacuggguggcuuaaaca

SEQ ID NO: 102158 - RNA, 22 nt, Homo sapiens
agcacagccuuguguuuucuug

SEQ ID NO: 102159 - RNA, 22 nt, Homo sapiens
agcacaguuaaaugaggcuucu

SEQ ID NO: 102160 - RNA, 22 nt, Homo sapiens
agcacauuaguaucuaagaaca

SEQ ID NO: 102161 - RNA, 22 nt, Homo sapiens
agcaccaauaaucagaguucuu

SEQ ID NO: 102162 - RNA, 17 nt, Homo sapiens
agcaccacacucucuug

SEQ ID NO: 102163 - RNA, 23 nt, Homo sapiens
agcaccaccccaggucacaagug

SEQ ID NO: 102164 - RNA, 22 nt, Homo sapiens
agcaccaccguugcucuauccc

SEQ ID NO: 102165 - RNA, 22 nt, Homo sapiens
agcaccauuuauugaaaagaca

SEQ ID NO: 102166 - RNA, 22 nt, Homo sapiens
agcaccguucaaacccagguua

SEQ ID NO: 102167 - RNA, 22 nt, Homo sapiens
agcagcauauuuuuauaaugua

SEQ ID NO: 102168 - RNA, 17 nt, Homo sapiens
agcagcccauaucccca

SEQ ID NO: 102169 - RNA, 22 nt, Homo sapiens
agcagcgacacccuguggugag

SEQ ID NO: 102170 - RNA, 22 nt, Homo sapiens
agcagcucaagacuuaaauuug

SEQ ID NO: 102171 - RNA, 22 nt, Homo sapiens
agcagcucaugccuuugggagg

SEQ ID NO: 102172 - RNA, 22 nt, Homo sapiens
agcagcuuugaucugaaugauu

SEQ ID NO: 102173 - RNA, 21 nt, Homo sapiens
agcagcuuugguugaagcaga

SEQ ID NO: 102174 - RNA, 22 nt, Homo sapiens
agcagguauucgggucaugggg

SEQ ID NO: 102175 - RNA, 22 nt, Homo sapiens
agcagguguccacaauguuugc

SEQ ID NO: 102176 - RNA, 22 nt, Homo sapiens
agcaguacauaaaaagcauccu

SEQ ID NO: 102177 - RNA, 22 nt, Homo sapiens
agcagugucauuuucuggugag

SEQ ID NO: 102178 - RNA, 22 nt, Homo sapiens
agcagugugagaauggacuaau

SEQ ID NO: 102179 - RNA, 22 nt, Homo sapiens
aaugucacugugguccuccagu

SEQ ID NO: 102180 - RNA, 22 nt, Homo sapiens
aaugugccuacuggagcuugca

SEQ ID NO: 102181 - RNA, 22 nt, Homo sapiens
aauguguuuugaaaucaggaag

SEQ ID NO: 102182 - RNA, 22 nt, Homo sapiens
aauuacauggcaauugggaaau

SEQ ID NO: 102183 - RNA, 22 nt, Homo sapiens
aauucacuucuuuuaggcaggg

SEQ ID NO: 102184 - RNA, 22 nt, Homo sapiens
aauugcauugaauuuguagcuu

SEQ ID NO: 102185 - RNA, 22 nt, Homo sapiens
aauuggcagugcucuugccaca

SEQ ID NO: 102186 - RNA, 22 nt, Homo sapiens
aauugugcuuguaggccaggca

SEQ ID NO: 102187 - RNA, 22 nt, Homo sapiens
acaaagcuagggaauccaucuu

SEQ ID NO: 102188 - RNA, 21 nt, Homo sapiens
acaaagcuggagggagacugc

SEQ ID NO: 102189 - RNA, 22 nt, Homo sapiens
acaaaguauggaauguuggugu

SEQ ID NO: 102190 - RNA, 22 nt, Homo sapiens
acaaagugccuccuuuuagagu

SEQ ID NO: 102191 - RNA, 22 nt, Homo sapiens
acaagcacaaauuuaauccugu

SEQ ID NO: 102192 - RNA, 22 nt, Homo sapiens
acaauggaauggaguggaaagu

SEQ ID NO: 102193 - RNA, 22 nt, Homo sapiens
acaauguauauuuuacuguagg

SEQ ID NO: 102194 - RNA, 22 nt, Homo sapiens
acacaguaaauauguauugaau

SEQ ID NO: 102195 - RNA, 22 nt, Homo sapiens
acacaguauaugacaaugcuuu

SEQ ID NO: 102196 - RNA, 22 nt, Homo sapiens
acacaguguuuauugugguuag

SEQ ID NO: 102197 - RNA, 22 nt, Homo sapiens
acacaugugaaaaaaauguuac

SEQ ID NO: 102198 - RNA, 22 nt, Homo sapiens
acacaugugcguagacucuuua

SEQ ID NO: 102199 - RNA, 22 nt, Homo sapiens
acaccaguacuuuauacaagca

SEQ ID NO: 102200 - RNA, 22 nt, Homo sapiens
acaccuguggucccaguaacuu

SEQ ID NO: 102201 - RNA, 22 nt, Homo sapiens
acacgugcguauauguacguau

SEQ ID NO: 102202 - RNA, 22 nt, Homo sapiens
acacucuaguguucuuaaucag

SEQ ID NO: 102203 - RNA, 22 nt, Homo sapiens
acacuggaguuaaaggugauuu

SEQ ID NO: 102204 - RNA, 20 nt, Homo sapiens
acacuggcuuugagauuuag

SEQ ID NO: 102205 - RNA, 22 nt, Homo sapiens
acacugucaugucucacaggca

SEQ ID NO: 102206 - RNA, 22 nt, Homo sapiens
acacuguccaguuaggcuacau

SEQ ID NO: 102207 - RNA, 20 nt, Homo sapiens
acacugugcuaaggauuuuc

SEQ ID NO: 102208 - RNA, 22 nt, Homo sapiens
acacuguuuuaguuauuauagc

SEQ ID NO: 102209 - RNA, 22 nt, Homo sapiens
acacuuucuagacaagggaaua

SEQ ID NO: 102210 - RNA, 19 nt, Homo sapiens
acagauagaauguucuaca

SEQ ID NO: 102211 - RNA, 22 nt, Homo sapiens
acagauagacauauauagcuca

SEQ ID NO: 102212 - RNA, 22 nt, Homo sapiens
acagauagcacuaagggaucug

SEQ ID NO: 102213 - RNA, 22 nt, Homo sapiens
acagaucagagauauuuagguu

SEQ ID NO: 102214 - RNA, 22 nt, Homo sapiens
acagcagugccccacucuacug

SEQ ID NO: 102215 - RNA, 22 nt, Homo sapiens
acagccauuccagccaaauacu

SEQ ID NO: 102216 - RNA, 22 nt, Homo sapiens
acaggagugggauuugaguccu

SEQ ID NO: 102217 - RNA, 22 nt, Homo sapiens
acagguacacagaauauccaga

SEQ ID NO: 102218 - RNA, 22 nt, Homo sapiens
acaggugaaguauuacacuaag

SEQ ID NO: 102219 - RNA, 22 nt, Homo sapiens
acaguacuguuguuugcugcca

SEQ ID NO: 102220 - RNA, 21 nt, Homo sapiens
acaguaguaauaguguagcca

SEQ ID NO: 102221 - RNA, 19 nt, Homo sapiens
acaguauugugcacagguu

SEQ ID NO: 102222 - RNA, 22 nt, Homo sapiens
acagucauagcagccuuuguua

SEQ ID NO: 102223 - RNA, 18 nt, Homo sapiens
acagugcuggcaugagau

SEQ ID NO: 102224 - RNA, 18 nt, Homo sapiens
acagugucauggcucaau

SEQ ID NO: 102225 - RNA, 22 nt, Homo sapiens
acagugucaugucguguucccc

SEQ ID NO: 102226 - RNA, 17 nt, Homo sapiens
acagugucuaugaaaug

SEQ ID NO: 102227 - RNA, 19 nt, Homo sapiens
acagugucucuauaaugau

SEQ ID NO: 102228 - RNA, 18 nt, Homo sapiens
acaguguguaaggguucu

SEQ ID NO: 102229 - RNA, 22 nt, Homo sapiens
acaguuaugugagggccaccag

SEQ ID NO: 102230 - RNA, 22 nt, Homo sapiens
acauaugaguacaugugccaug

SEQ ID NO: 102231 - RNA, 22 nt, Homo sapiens
acaucacuguuugauugauuga

SEQ ID NO: 102232 - RNA, 22 nt, Homo sapiens
acaucaggcuugugaugauuac

SEQ ID NO: 102233 - RNA, 18 nt, Homo sapiens
acaucccaugcuggggug

SEQ ID NO: 102234 - RNA, 22 nt, Homo sapiens
acaugacauugggguggggaua

SEQ ID NO: 102235 - RNA, 22 nt, Homo sapiens
acaugagacuggguuuguaggg

SEQ ID NO: 102236 - RNA, 22 nt, Homo sapiens
acaugccucccugguccgcugu

SEQ ID NO: 102237 - RNA, 22 nt, Homo sapiens
acauguaauugauuuuguguua

SEQ ID NO: 102238 - RNA, 22 nt, Homo sapiens
acauguauauaaugcauagcga

SEQ ID NO: 102239 - RNA, 22 nt, Homo sapiens
acauugcucuuaccaaguuugu

SEQ ID NO: 102240 - RNA, 22 nt, Homo sapiens
accauugcacuccagccugggc

SEQ ID NO: 102241 - RNA, 22 nt, Homo sapiens
acccacuagaugccaguggcac

SEQ ID NO: 102242 - RNA, 22 nt, Homo sapiens
acccagaagucauucaggaaca

SEQ ID NO: 102243 - RNA, 22 nt, Homo sapiens
acccaguagucauucaggagca

SEQ ID NO: 102244 - RNA, 22 nt, Homo sapiens
acccaguguucaacauucacau

SEQ ID NO: 102245 - RNA, 22 nt, Homo sapiens
acccauacacacauauuuaugu

SEQ ID NO: 102246 - RNA, 22 nt, Homo sapiens
accccauuugcacugagcccuu

SEQ ID NO: 102247 - RNA, 23 nt, Homo sapiens
accccuacaggcuuguguccugc

SEQ ID NO: 102248 - RNA, 22 nt, Homo sapiens
accccugugacggguauuugag

SEQ ID NO: 102249 - RNA, 22 nt, Homo sapiens
acccugucacucccaucaauuu

SEQ ID NO: 102250 - RNA, 19 nt, Homo sapiens
acccuguccccaccuuuac

SEQ ID NO: 102251 - RNA, 22 nt, Homo sapiens
acccuguugguggaucagauug

SEQ ID NO: 102252 - RNA, 22 nt, Homo sapiens
acccuuagguuaaaguugaguc

SEQ ID NO: 102253 - RNA, 23 nt, Homo sapiens
accugugguuauuuuacucuucc

SEQ ID NO: 102254 - RNA, 23 nt, Homo sapiens
accuucauucauucagcugaagu

SEQ ID NO: 102255 - RNA, 22 nt, Homo sapiens
acggcaguguggugcggucagg

SEQ ID NO: 102256 - RNA, 22 nt, Homo sapiens
acuacauaugacaucuucuuua

SEQ ID NO: 102257 - RNA, 22 nt, Homo sapiens
acuauacugaagcaaauuaaca

SEQ ID NO: 102258 - RNA, 22 nt, Homo sapiens
acuaugagacgaaugcaucagu

SEQ ID NO: 102259 - RNA, 22 nt, Homo sapiens
acucacagcaaccuccgccucc

SEQ ID NO: 102260 - RNA, 22 nt, Homo sapiens
acuccacuuucaccacagcgga

SEQ ID NO: 102261 - RNA, 18 nt, Homo sapiens
acucuguauguggagugg

SEQ ID NO: 102262 - RNA, 22 nt, Homo sapiens
acugaaucaucagguguguuug

SEQ ID NO: 102263 - RNA, 22 nt, Homo sapiens
acugagucauugggugcccaga

SEQ ID NO: 102264 - RNA, 23 nt, Homo sapiens
acugcaauuacguuugcaccaac

SEQ ID NO: 102265 - RNA, 23 nt, Homo sapiens
guuaagugaauguguacucuauu

SEQ ID NO: 102266 - RNA, 22 nt, Homo sapiens
guuaugcagcaauugauaaucu

SEQ ID NO: 102267 - RNA, 22 nt, Homo sapiens
guuauguaucuugauugggugg

SEQ ID NO: 102268 - RNA, 22 nt, Homo sapiens
guucaaguuuucucuugugggu

SEQ ID NO: 102269 - RNA, 22 nt, Homo sapiens
guucagucacgugcccaaguuc

SEQ ID NO: 102270 - RNA, 22 nt, Homo sapiens
guucaucagggauacuggccug

SEQ ID NO: 102271 - RNA, 23 nt, Homo sapiens
guucaucagggauauuggccuga

SEQ ID NO: 102272 - RNA, 22 nt, Homo sapiens
guucuggagauaaagccaaggu

SEQ ID NO: 102273 - RNA, 22 nt, Homo sapiens
guugaaaucaucacuuggcaug

SEQ ID NO: 102274 - RNA, 22 nt, Homo sapiens
guugaacaauagauucauauca

SEQ ID NO: 102275 - RNA, 22 nt, Homo sapiens
guugaggcaggagaauuacuug

SEQ ID NO: 102276 - RNA, 22 nt, Homo sapiens
guugcaaaguaauugugguuuu

SEQ ID NO: 102277 - RNA, 22 nt, Homo sapiens
guugcacagucuuuccuggacu

SEQ ID NO: 102278 - RNA, 22 nt, Homo sapiens
guugcccuuagcacuucagccu

SEQ ID NO: 102279 - RNA, 22 nt, Homo sapiens
guugccuaggcuggagugcagu

SEQ ID NO: 102280 - RNA, 22 nt, Homo sapiens
guugcucaggccggagugcagu

SEQ ID NO: 102281 - RNA, 22 nt, Homo sapiens
guugcucaggcugaagugcagu

SEQ ID NO: 102282 - RNA, 22 nt, Homo sapiens
guuggcaaguggcugagcuggg

SEQ ID NO: 102283 - RNA, 22 nt, Homo sapiens
uuagcaccacacacuuuagagg

SEQ ID NO: 102284 - RNA, 22 nt, Homo sapiens
uuagcacugucuacucuggauu

SEQ ID NO: 102285 - RNA, 22 nt, Homo sapiens
uuagcacuugggaguauuuauu

SEQ ID NO: 102286 - RNA, 22 nt, Homo sapiens
uuagcagcaugagaauggacua

SEQ ID NO: 102287 - RNA, 22 nt, Homo sapiens
uuagcagcucuaauaacugcua

SEQ ID NO: 102288 - RNA, 22 nt, Homo sapiens
uuagccggguguguuggcgggc

SEQ ID NO: 102289 - RNA, 22 nt, Homo sapiens
uuagcucaguuggugagagcgu

SEQ ID NO: 102290 - RNA, 22 nt, Homo sapiens
uuagggaguaaucuaaaaaugg

SEQ ID NO: 102291 - RNA, 22 nt, Homo sapiens
uuagguaauauauugcugcuuu

SEQ ID NO: 102292 - RNA, 22 nt, Homo sapiens
uuagguagucucugucagaggg

SEQ ID NO: 102293 - RNA, 22 nt, Homo sapiens
uuagguuauuacugacaauaau

SEQ ID NO: 102294 - RNA, 22 nt, Homo sapiens
uuaguccacuggaacuguuaua

SEQ ID NO: 102295 - RNA, 22 nt, Homo sapiens
uuagugaaugcaccacuucuga

SEQ ID NO: 102296 - RNA, 22 nt, Homo sapiens
uuagugaaugggugugauuugu

SEQ ID NO: 102297 - RNA, 22 nt, Homo sapiens
uuagugcugaguggaauguucu

SEQ ID NO: 102298 - RNA, 22 nt, Homo sapiens
uuaguuuaucagugguuucuga

SEQ ID NO: 102299 - RNA, 22 nt, Homo sapiens
uuauaaacaugaagauuugggg

SEQ ID NO: 102300 - RNA, 18 nt, Homo sapiens
uuauacuccccaggcaau

SEQ ID NO: 102301 - RNA, 20 nt, Homo sapiens
uuauagcuacaucuugacug

SEQ ID NO: 102302 - RNA, 18 nt, Homo sapiens
uuauaugcauguguagga

SEQ ID NO: 102303 - RNA, 22 nt, Homo sapiens
uuauauguuacucccucuagca

SEQ ID NO: 102304 - RNA, 22 nt, Homo sapiens
uuauauguuagacauggugggu

SEQ ID NO: 102305 - RNA, 22 nt, Homo sapiens
uuaucacauugacugauuugca

SEQ ID NO: 102306 - RNA, 22 nt, Homo sapiens
uuaucagcagcaugaaacugga

SEQ ID NO: 102307 - RNA, 22 nt, Homo sapiens
uuaucccacuuucuguuccugu

SEQ ID NO: 102308 - RNA, 22 nt, Homo sapiens
uuaugacuuucagcuaggggau

SEQ ID NO: 102309 - RNA, 17 nt, Homo sapiens
uuaugagacuucuuagc

SEQ ID NO: 102310 - RNA, 22 nt, Homo sapiens
uuauggccauucuuguaggagu

SEQ ID NO: 102311 - RNA, 22 nt, Homo sapiens
uuauggcuauugaugacaauug

SEQ ID NO: 102312 - RNA, 22 nt, Homo sapiens
uuaugguuuuuagcagaguaau

SEQ ID NO: 102313 - RNA, 22 nt, Homo sapiens
uuaugugccuuuuugccauuca

SEQ ID NO: 102314 - RNA, 22 nt, Homo sapiens
uuauucauuaacagggaccaaa

SEQ ID NO: 102315 - RNA, 22 nt, Homo sapiens
uuauugaguaaaaagaaugguu

SEQ ID NO: 102316 - RNA, 22 nt, Homo sapiens
uucaaaggauagauuaagauca

SEQ ID NO: 102317 - RNA, 23 nt, Homo sapiens
uucaaauguucucugguugucag

SEQ ID NO: 102318 - RNA, 22 nt, Homo sapiens
uucaaauguucuuucaccaccc

SEQ ID NO: 102319 - RNA, 22 nt, Homo sapiens
uucaagcuacaguggcaggguu

SEQ ID NO: 102320 - RNA, 22 nt, Homo sapiens
uucaagucaaggaaagaggucu

SEQ ID NO: 102321 - RNA, 22 nt, Homo sapiens
uucaagugguucagaagucuga

SEQ ID NO: 102322 - RNA, 22 nt, Homo sapiens
uucaauacuguugauccuuaug

SEQ ID NO: 102323 - RNA, 22 nt, Homo sapiens
uucaauaugucauuggcaggca

SEQ ID NO: 102324 - RNA, 19 nt, Homo sapiens
uucaaugcagcauugccac

SEQ ID NO: 102325 - RNA, 21 nt, Homo sapiens
uucacaagggaaguagggggc

SEQ ID NO: 102326 - RNA, 22 nt, Homo sapiens
uucacagaaaaaggcgaugagg

SEQ ID NO: 102327 - RNA, 20 nt, Homo sapiens
uucacaggcagcuucuuucu

SEQ ID NO: 102328 - RNA, 22 nt, Homo sapiens
uucacagucacccuucuccaug

SEQ ID NO: 102329 - RNA, 22 nt, Homo sapiens
uucacaugguugccuuuugauc

SEQ ID NO: 102330 - RNA, 22 nt, Homo sapiens
uucaccagggaagucucaacuc

SEQ ID NO: 102331 - RNA, 22 nt, Homo sapiens
uucaccuggaguucaggauaag

SEQ ID NO: 102332 - RNA, 22 nt, Homo sapiens
uucaccuggguuggccaucauu

SEQ ID NO: 102333 - RNA, 20 nt, Homo sapiens
uucacggaggccgcgccccc

SEQ ID NO: 102334 - RNA, 19 nt, Homo sapiens
uucacguaggagaaagaag

SEQ ID NO: 102335 - RNA, 22 nt, Homo sapiens
uucacugcacuccagccugggu

SEQ ID NO: 102336 - RNA, 22 nt, Homo sapiens
uucacuggagcccaggaguugg

SEQ ID NO: 102337 - RNA, 22 nt, Homo sapiens
uucacugugugacccugggcca

SEQ ID NO: 102338 - RNA, 22 nt, Homo sapiens
uucacuguuaagcaguuaaacu

SEQ ID NO: 102339 - RNA, 22 nt, Homo sapiens
uucagaguggacagaaauuaag

SEQ ID NO: 102340 - RNA, 22 nt, Homo sapiens
uucagagugguaugaagugaug

SEQ ID NO: 102341 - RNA, 22 nt, Homo sapiens
uucagaucaucccagcuccacu

SEQ ID NO: 102342 - RNA, 22 nt, Homo sapiens
uucagaugcacacuguagucua

SEQ ID NO: 102343 - RNA, 22 nt, Homo sapiens
uucagauugcauaccgaaagua

SEQ ID NO: 102344 - RNA, 22 nt, Homo sapiens
uucagcaaugacagccuauaua

SEQ ID NO: 102345 - RNA, 22 nt, Homo sapiens
uucagcacugaaaauaugucau

SEQ ID NO: 102346 - RNA, 19 nt, Homo sapiens
uucagcagugucugcucuu

SEQ ID NO: 102347 - RNA, 22 nt, Homo sapiens
uucagcuacuuggaaacagcaa

SEQ ID NO: 102348 - RNA, 22 nt, Homo sapiens
uucagcuacuugggaggcugaa

SEQ ID NO: 102349 - RNA, 22 nt, Homo sapiens
uucaggcuccugugagaaucua

SEQ ID NO: 102350 - RNA, 22 nt, Homo sapiens
uucaggcuuuuauuuacugaua

SEQ ID NO: 102351 - RNA, 22 nt, Homo sapiens
uucagggagaaggcaaacguug

SEQ ID NO: 102352 - RNA, 22 nt, Homo sapiens
uucagguaauuaugguuugucu

SEQ ID NO: 102353 - RNA, 22 nt, Homo sapiens
uucagguacugggggaguaugg

SEQ ID NO: 102354 - RNA, 22 nt, Homo sapiens
uucagguaucccuugucuauag

SEQ ID NO: 102355 - RNA, 22 nt, Homo sapiens
uucagguucauuugcugcuauu

SEQ ID NO: 102356 - RNA, 22 nt, Homo sapiens
uuggaagguaaucaaaaguucu

SEQ ID NO: 102357 - RNA, 22 nt, Homo sapiens
uuggaaguguguauguauagcu

SEQ ID NO: 102358 - RNA, 22 nt, Homo sapiens
uuggaauacuuguuaaagucca

SEQ ID NO: 102359 - RNA, 22 nt, Homo sapiens
uuggacaagauugcagagaauu

SEQ ID NO: 102360 - RNA, 22 nt, Homo sapiens
uuggacagaugguuacauuuuu

SEQ ID NO: 102361 - RNA, 22 nt, Homo sapiens
uuggacuaagaacuuaaaauaa

SEQ ID NO: 102362 - RNA, 22 nt, Homo sapiens
uuggacuggaacuauaccauug

SEQ ID NO: 102363 - RNA, 22 nt, Homo sapiens
uuggagagaaaggcaguuccug

SEQ ID NO: 102364 - RNA, 22 nt, Homo sapiens
uuggagagagaggacucccggc

SEQ ID NO: 102365 - RNA, 22 nt, Homo sapiens
uuggagagugauauucagaugc

SEQ ID NO: 102366 - RNA, 22 nt, Homo sapiens
uuggagcacuggggcacugaca

SEQ ID NO: 102367 - RNA, 22 nt, Homo sapiens
uuggagcccuaacucucaguac

SEQ ID NO: 102368 - RNA, 22 nt, Homo sapiens
uuggauauucaguuuuuccauc

SEQ ID NO: 102369 - RNA, 22 nt, Homo sapiens
uuggauggugauaugguuugga

SEQ ID NO: 102370 - RNA, 22 nt, Homo sapiens
uuggauuauaaacugagauuug

SEQ ID NO: 102371 - RNA, 22 nt, Homo sapiens
uuggcaaagugucuggcauuua

SEQ ID NO: 102372 - RNA, 22 nt, Homo sapiens
uuggcaauauuuacugaaguug

SEQ ID NO: 102373 - RNA, 22 nt, Homo sapiens
uuggcaauugcuaugauuugaa

SEQ ID NO: 102374 - RNA, 21 nt, Homo sapiens
uuggcacucuucucuccuuau

SEQ ID NO: 102375 - RNA, 22 nt, Homo sapiens
uuggcagaaaaggucggggguu

SEQ ID NO: 102376 - RNA, 22 nt, Homo sapiens
uuggcaguaucuacuacagcua

SEQ ID NO: 102377 - RNA, 22 nt, Homo sapiens
uuggcagugcccgaugcugggg

SEQ ID NO: 102378 - RNA, 22 nt, Homo sapiens
uuggcauuuauucuaaggucaa

SEQ ID NO: 102379 - RNA, 22 nt, Homo sapiens
uuggccccuccaaaucucaugu

SEQ ID NO: 102380 - RNA, 22 nt, Homo sapiens
uuggccccucccaaauuucaug

SEQ ID NO: 102381 - RNA, 23 nt, Homo sapiens
uuggccuccuugugucuagggcu

SEQ ID NO: 102382 - RNA, 22 nt, Homo sapiens
uuggcucuggcugggcuccagc

SEQ ID NO: 102383 - RNA, 22 nt, Homo sapiens
uuggcuguguuccucaaggagu

SEQ ID NO: 102384 - RNA, 22 nt, Homo sapiens
uuggcuguguuucccuacaaau

SEQ ID NO: 102385 - RNA, 22 nt, Homo sapiens
uuggcuucuggacuauugugca

SEQ ID NO: 102386 - RNA, 22 nt, Homo sapiens
uuggcuuggagaguugaaaugu

SEQ ID NO: 102387 - RNA, 22 nt, Homo sapiens
uuggcuuuuaugcagcuuaggu

SEQ ID NO: 102388 - RNA, 22 nt, Homo sapiens
uugggacccuguccuguaacaa

SEQ ID NO: 102389 - RNA, 22 nt, Homo sapiens
uugggcuuuuagguccuuaaca

SEQ ID NO: 102390 - RNA, 21 nt, Homo sapiens
uuggggaauggagagguuuuc

SEQ ID NO: 102391 - RNA, 22 nt, Homo sapiens
uuggguaguauagaagcaacaa

SEQ ID NO: 102392 - RNA, 22 nt, Homo sapiens
uuggguagugaguuccuccagg

SEQ ID NO: 102393 - RNA, 22 nt, Homo sapiens
uugguacuaaaaaguagggugu

SEQ ID NO: 102394 - RNA, 22 nt, Homo sapiens
uugguacuacacuucuaaucuu

SEQ ID NO: 102395 - RNA, 22 nt, Homo sapiens
uugguaguuucugucuuuagau

SEQ ID NO: 102396 - RNA, 22 nt, Homo sapiens
uuggucaaaucugaugggagaa

SEQ ID NO: 102397 - RNA, 22 nt, Homo sapiens
uuggucacugacauguuugaaa

SEQ ID NO: 102398 - RNA, 22 nt, Homo sapiens
uuggucaggcuagaguguggug

SEQ ID NO: 102399 - RNA, 22 nt, Homo sapiens
uuggucaucucccuccuuuuag

SEQ ID NO: 102400 - RNA, 22 nt, Homo sapiens
uugguccauuacauugaugaca

SEQ ID NO: 102401 - RNA, 22 nt, Homo sapiens
uuggucucuuaaucacacuuuu

SEQ ID NO: 102402 - RNA, 22 nt, Homo sapiens
uugguuuccuuccugcuuaacu

SEQ ID NO: 102403 - RNA, 22 nt, Homo sapiens
uuguaagaaucuagcucuuuau

SEQ ID NO: 102404 - RNA, 22 nt, Homo sapiens
uuguaauguuaccaaauggugu

SEQ ID NO: 102405 - RNA, 22 nt, Homo sapiens
uuguacaggaguguaagcuuca

SEQ ID NO: 102406 - RNA, 22 nt, Homo sapiens
uuguacuauuuuuaucagugau

SEQ ID NO: 102407 - RNA, 22 nt, Homo sapiens
uuguaguagcauuauuuauaau

SEQ ID NO: 102408 - RNA, 22 nt, Homo sapiens
uuguaguguuuauucugucaac

SEQ ID NO: 102409 - RNA, 22 nt, Homo sapiens
uuguauaggcucaguaagaauc

SEQ ID NO: 102410 - RNA, 21 nt, Homo sapiens
uuguaugguugaacuugauac

SEQ ID NO: 102411 - RNA, 22 nt, Homo sapiens
uuguauguugaaugaugguaua

SEQ ID NO: 102412 - RNA, 22 nt, Homo sapiens
uuguauugucuugaugaguuga

SEQ ID NO: 102413 - RNA, 22 nt, Homo sapiens
uugucccauggggucuuccuuu

SEQ ID NO: 102414 - RNA, 22 nt, Homo sapiens
uuguccccaucugcugccagaa

SEQ ID NO: 102415 - RNA, 22 nt, Homo sapiens
uuguccccuuccaaaucucaug

SEQ ID NO: 102416 - RNA, 22 nt, Homo sapiens
uuguccucuccaaaucucaugu

SEQ ID NO: 102417 - RNA, 22 nt, Homo sapiens
uuguccuugagauaguuugcag

SEQ ID NO: 102418 - RNA, 21 nt, Homo sapiens
uugucuagagaaauauaucuc

SEQ ID NO: 102419 - RNA, 22 nt, Homo sapiens
uugugaaugaugccgcaauaaa

SEQ ID NO: 102420 - RNA, 22 nt, Homo sapiens
uugugaauggugccgcaguaaa

SEQ ID NO: 102421 - RNA, 22 nt, Homo sapiens
uugugaauggugcugcaguaaa

SEQ ID NO: 102422 - RNA, 22 nt, Homo sapiens
uugugacacagcugggccuaua

SEQ ID NO: 102423 - RNA, 22 nt, Homo sapiens
uugugauggugcauacugagcu

SEQ ID NO: 102424 - RNA, 22 nt, Homo sapiens
uugugcaaaguugugguuucug

SEQ ID NO: 102425 - RNA, 22 nt, Homo sapiens
uugugccauucuucugccucag

SEQ ID NO: 102426 - RNA, 22 nt, Homo sapiens
uugugccccuucucagucgggc

SEQ ID NO: 102427 - RNA, 22 nt, Homo sapiens
uugugcuucaucaccuagcaga

SEQ ID NO: 102428 - RNA, 18 nt, Homo sapiens
uuguggccccuacaaauu

SEQ ID NO: 102429 - RNA, 22 nt, Homo sapiens
uugugguaggaguugccauguu

SEQ ID NO: 102430 - RNA, 22 nt, Homo sapiens
uugugguaggaugaagagauga

SEQ ID NO: 102431 - RNA, 22 nt, Homo sapiens
uugugguagugaaugagucuca

SEQ ID NO: 102432 - RNA, 22 nt, Homo sapiens
uugugguuuuagcacuguggau

SEQ ID NO: 102433 - RNA, 22 nt, Homo sapiens
uugugguuuucagcuuauauau

SEQ ID NO: 102434 - RNA, 22 nt, Homo sapiens
uuguguaguaccucucacauug

SEQ ID NO: 102435 - RNA, 23 nt, Homo sapiens
uugugucccuacccaaaucucau

SEQ ID NO: 102436 - RNA, 22 nt, Homo sapiens
uugugucccugcccaaaucuca

SEQ ID NO: 102437 - RNA, 22 nt, Homo sapiens
uuguguuuuuaguagggaaggg

SEQ ID NO: 102438 - RNA, 22 nt, Homo sapiens
uuguuuagagacuggaauuaaa

SEQ ID NO: 102439 - RNA, 22 nt, Homo sapiens
uuuaaagcaugacgagaagaag

SEQ ID NO: 102440 - RNA, 22 nt, Homo sapiens
uuuaaaguuagaaggaaagggc

SEQ ID NO: 102441 - RNA, 23 nt, Homo sapiens
uuuaagcuucauguccuaacauc

SEQ ID NO: 102442 - RNA, 22 nt, Homo sapiens
uuuaauacugcaucuuuacucu

SEQ ID NO: 102443 - RNA, 22 nt, Homo sapiens
uuuaaugcgucucugaguuuug

SEQ ID NO: 102444 - RNA, 22 nt, Homo sapiens
uuuaauguuacaguauugguau

SEQ ID NO: 102445 - RNA, 22 nt, Homo sapiens
uuuagcaaugcuguggggaagu

SEQ ID NO: 102446 - RNA, 22 nt, Homo sapiens
uggaaucuacuaaagcaaaauc

SEQ ID NO: 102447 - RNA, 20 nt, Homo sapiens
uggaaucugaagaucucagu

SEQ ID NO: 102448 - RNA, 22 nt, Homo sapiens
uggaauggagagagggugcacg

SEQ ID NO: 102449 - RNA, 22 nt, Homo sapiens
uggaauguaacuugaaacuuuu

SEQ ID NO: 102450 - RNA, 22 nt, Homo sapiens
uggaaugugaauaacuuccuuc

SEQ ID NO: 102451 - RNA, 18 nt, Homo sapiens
uggaauguuuggguuaau

SEQ ID NO: 102452 - RNA, 22 nt, Homo sapiens
uggacacuggagauucgucagu

SEQ ID NO: 102453 - RNA, 22 nt, Homo sapiens
uggacagaaacauguuuucagu

SEQ ID NO: 102454 - RNA, 22 nt, Homo sapiens
uggacagagagaccggcauuuu

SEQ ID NO: 102455 - RNA, 21 nt, Homo sapiens
uggaccccuuccagucaucau

SEQ ID NO: 102456 - RNA, 21 nt, Homo sapiens
uggaccccuuccuuacaucau

SEQ ID NO: 102457 - RNA, 22 nt, Homo sapiens
uggacuguaauuuuauaggcau

SEQ ID NO: 102458 - RNA, 22 nt, Homo sapiens
uggagacaaagauagaaaagca

SEQ ID NO: 102459 - RNA, 22 nt, Homo sapiens
uggagacugaucccucuuuccu

SEQ ID NO: 102460 - RNA, 22 nt, Homo sapiens
uggagagucauuuauaguauuu

SEQ ID NO: 102461 - RNA, 18 nt, Homo sapiens
uggagauaagaagaacuu

SEQ ID NO: 102462 - RNA, 22 nt, Homo sapiens
uggagcccuaguuccucauaac

SEQ ID NO: 102463 - RNA, 22 nt, Homo sapiens
uggagguagagaugggaucucc

SEQ ID NO: 102464 - RNA, 22 nt, Homo sapiens
uggagugagaacuucaaugaug

SEQ ID NO: 102465 - RNA, 22 nt, Homo sapiens
uggagugcaauggcaccaucuu

SEQ ID NO: 102466 - RNA, 22 nt, Homo sapiens
uggagugcgagggugaaacuuu

SEQ ID NO: 102467 - RNA, 20 nt, Homo sapiens
uggagugcuguguugagaag

SEQ ID NO: 102468 - RNA, 22 nt, Homo sapiens
uggaguguagaagccagccucc

SEQ ID NO: 102469 - RNA, 22 nt, Homo sapiens
uggauagauacuauccaggacu

SEQ ID NO: 102470 - RNA, 18 nt, Homo sapiens
uggauaugaaauucugga

SEQ ID NO: 102471 - RNA, 22 nt, Homo sapiens
uggauauguucuuuguguaagg

SEQ ID NO: 102472 - RNA, 22 nt, Homo sapiens
uggauauguuuauauguugucu

SEQ ID NO: 102473 - RNA, 22 nt, Homo sapiens
uggauccaucacgccucuuccc

SEQ ID NO: 102474 - RNA, 22 nt, Homo sapiens
uggaugaagagaugguaguugc

SEQ ID NO: 102475 - RNA, 22 nt, Homo sapiens
uggaugacauccuuguaugcag

SEQ ID NO: 102476 - RNA, 22 nt, Homo sapiens
uggauggagaggcuugugaugc

SEQ ID NO: 102477 - RNA, 22 nt, Homo sapiens
uggauugagaagcuguggcuca

SEQ ID NO: 102478 - RNA, 22 nt, Homo sapiens
uggcaaaauauuuugguuucug

SEQ ID NO: 102479 - RNA, 22 nt, Homo sapiens
uggcaaauauuuuguuuuguaa

SEQ ID NO: 102480 - RNA, 21 nt, Homo sapiens
uggcaacauggauggauucug

SEQ ID NO: 102481 - RNA, 22 nt, Homo sapiens
uggcaagaaccacaauuacuuu

SEQ ID NO: 102482 - RNA, 22 nt, Homo sapiens
uggcaagaccccaucucuacaa

SEQ ID NO: 102483 - RNA, 22 nt, Homo sapiens
uggcaagagggaugcaagguuu

SEQ ID NO: 102484 - RNA, 22 nt, Homo sapiens
uggcaagaucacaauuacuuuu

SEQ ID NO: 102485 - RNA, 20 nt, Homo sapiens
uggcaagauggcagaauaga

SEQ ID NO: 102486 - RNA, 18 nt, Homo sapiens
uggcaagugccauacggu

SEQ ID NO: 102487 - RNA, 19 nt, Homo sapiens
uggcacauguauacuuaug

SEQ ID NO: 102488 - RNA, 22 nt, Homo sapiens
uggcagaugggugagcuggaga

SEQ ID NO: 102489 - RNA, 22 nt, Homo sapiens
uggcagcgugaauguggcugaa

SEQ ID NO: 102490 - RNA, 22 nt, Homo sapiens
uggcaggugcacuggcuuugaa

SEQ ID NO: 102491 - RNA, 22 nt, Homo sapiens
uggcaguuuugauguggagaga

SEQ ID NO: 102492 - RNA, 22 nt, Homo sapiens
uggcauauaaagauguguucaa

SEQ ID NO: 102493 - RNA, 22 nt, Homo sapiens
uggcauaugguauuugauaucu

SEQ ID NO: 102494 - RNA, 17 nt, Homo sapiens
uggcaugaggguguggg

SEQ ID NO: 102495 - RNA, 22 nt, Homo sapiens
uggcauggaguggauggcccca

SEQ ID NO: 102496 - RNA, 22 nt, Homo sapiens
uggcauguagucugggaccugg

SEQ ID NO: 102497 - RNA, 22 nt, Homo sapiens
uggcauguauuuuguguauuaa

SEQ ID NO: 102498 - RNA, 23 nt, Homo sapiens
uggcauuuuaguuagcuucagug

SEQ ID NO: 102499 - RNA, 23 nt, Homo sapiens
uggccaagauaaucucaguuuuc

SEQ ID NO: 102500 - RNA, 22 nt, Homo sapiens
uggccaguguuuuuccugggcu

SEQ ID NO: 102501 - RNA, 22 nt, Homo sapiens
uggccuguaacccucucauagg

SEQ ID NO: 102502 - RNA, 22 nt, Homo sapiens
uggccuuuuccaagaacuacua

SEQ ID NO: 102503 - RNA, 22 nt, Homo sapiens
uggcgggaaaguugggagaaga

SEQ ID NO: 102504 - RNA, 22 nt, Homo sapiens
uggcuacugacugaugauuaua

SEQ ID NO: 102505 - RNA, 21 nt, Homo sapiens
uggcuauuucuguggcauaca

SEQ ID NO: 102506 - RNA, 22 nt, Homo sapiens
uggcuguguccucucccaaauc

SEQ ID NO: 102507 - RNA, 22 nt, Homo sapiens
uggcuguuuauuucaccuggau

SEQ ID NO: 102508 - RNA, 20 nt, Homo sapiens
uggcuucuuaauugcaggca

SEQ ID NO: 102509 - RNA, 22 nt, Homo sapiens
uggcuugauggcacaagguuuc

SEQ ID NO: 102510 - RNA, 22 nt, Homo sapiens
uggcuuuguaagguuucauuuu

SEQ ID NO: 102511 - RNA, 22 nt, Homo sapiens
uggcuuuuaucuacucucaacu

SEQ ID NO: 102512 - RNA, 22 nt, Homo sapiens
uggcuuuuauuauguugaggua

SEQ ID NO: 102513 - RNA, 22 nt, Homo sapiens
ugggaaacauccagcacauacu

SEQ ID NO: 102514 - RNA, 20 nt, Homo sapiens
ugggaacaugugguauaugg

SEQ ID NO: 102515 - RNA, 18 nt, Homo sapiens
ugggaagaaauucuucuc

SEQ ID NO: 102516 - RNA, 22 nt, Homo sapiens
ugggaauaugauacaggucuuu

SEQ ID NO: 102517 - RNA, 22 nt, Homo sapiens
ugggagacuacauuuuuaacaa

SEQ ID NO: 102518 - RNA, 22 nt, Homo sapiens
ugggaucagucuggaauauuga

SEQ ID NO: 102519 - RNA, 22 nt, Homo sapiens
ugggaucaugagcaccgcuucc

SEQ ID NO: 102520 - RNA, 22 nt, Homo sapiens
ugggaucauucaaugacgaaau

SEQ ID NO: 102521 - RNA, 22 nt, Homo sapiens
ugggaucuuuccuauuagcgag

SEQ ID NO: 102522 - RNA, 23 nt, Homo sapiens
ugggauguuuuuggaaacuucug

SEQ ID NO: 102523 - RNA, 22 nt, Homo sapiens
ugggcaaaacuaagagcugugg

SEQ ID NO: 102524 - RNA, 22 nt, Homo sapiens
ugggcaaauugugagggaggua

SEQ ID NO: 102525 - RNA, 22 nt, Homo sapiens
ugggcaagugacuuggcuucuc

SEQ ID NO: 102526 - RNA, 22 nt, Homo sapiens
ugggcauuguuccuaguuaucu

SEQ ID NO: 102527 - RNA, 21 nt, Homo sapiens
ugggccccuuccuuacaucau

SEQ ID NO: 102528 - RNA, 22 nt, Homo sapiens
ugggcggagacgugcagccgcc

SEQ ID NO: 102529 - RNA, 22 nt, Homo sapiens
ugggcuagaugcuuugggguca

SEQ ID NO: 102530 - RNA, 22 nt, Homo sapiens
ugggguaggccugguuaugugc

SEQ ID NO: 102531 - RNA, 22 nt, Homo sapiens
uggguagagcacugggggcgag

SEQ ID NO: 102532 - RNA, 22 nt, Homo sapiens
uggguagaugaauccauuccaa

SEQ ID NO: 102533 - RNA, 21 nt, Homo sapiens
uggguaguuuucaaggccccg

SEQ ID NO: 102534 - RNA, 22 nt, Homo sapiens
uggguccccuacucuuuccaca

SEQ ID NO: 102535 - RNA, 23 nt, Homo sapiens
ugguaacauguuguggcagggga

SEQ ID NO: 102536 - RNA, 23 nt, Homo sapiens
ggcaagaucucagcucacugcaa

SEQ ID NO: 102537 - RNA, 22 nt, Homo sapiens
ggcaaggaggggcacuuucacu

SEQ ID NO: 102538 - RNA, 22 nt, Homo sapiens
ggcacaauugcagcaauaaaca

SEQ ID NO: 102539 - RNA, 22 nt, Homo sapiens
ggcacaguuaagugcuaccuaa

SEQ ID NO: 102540 - RNA, 22 nt, Homo sapiens
ggcacugugaugugagggggua

SEQ ID NO: 102541 - RNA, 22 nt, Homo sapiens
ggcagaucauuggccucaguuu

SEQ ID NO: 102542 - RNA, 22 nt, Homo sapiens
ggcaguguauuacuuaggguuc

SEQ ID NO: 102543 - RNA, 22 nt, Homo sapiens
ggcaguuucucaggcaggggua

SEQ ID NO: 102544 - RNA, 22 nt, Homo sapiens
ggcaugaaguagcccacaggca

SEQ ID NO: 102545 - RNA, 21 nt, Homo sapiens
ggcaugaauggaaaagugaga

SEQ ID NO: 102546 - RNA, 22 nt, Homo sapiens
ggcaugauggcugaggcuucug

SEQ ID NO: 102547 - RNA, 22 nt, Homo sapiens
ggcaugguggugugugccuaua

SEQ ID NO: 102548 - RNA, 22 nt, Homo sapiens
ggcccugauacaaguaaggucu

SEQ ID NO: 102549 - RNA, 22 nt, Homo sapiens
ggcgguguccuccaagugcuuc

SEQ ID NO: 102550 - RNA, 22 nt, Homo sapiens
ggcgguguugauggcccccaca

SEQ ID NO: 102551 - RNA, 22 nt, Homo sapiens
ggcuagagacaaguugcugaga

SEQ ID NO: 102552 - RNA, 22 nt, Homo sapiens
ggcuagauauucacauauggcu

SEQ ID NO: 102553 - RNA, 22 nt, Homo sapiens
ggcucagugaucuguuucugua

SEQ ID NO: 102554 - RNA, 22 nt, Homo sapiens
ggcucaguuuccuccgucugcu

SEQ ID NO: 102555 - RNA, 21 nt, Homo sapiens
ggcucuguggucucagguuuc

SEQ ID NO: 102556 - RNA, 22 nt, Homo sapiens
ggcucuguugcuaccaauuaag

SEQ ID NO: 102557 - RNA, 22 nt, Homo sapiens
ggcuuuggucacacaggggcaa

SEQ ID NO: 102558 - RNA, 22 nt, Homo sapiens
gggaacauggaaauucugcucu

SEQ ID NO: 102559 - RNA, 18 nt, Homo sapiens
gggaauauggggaguuga

SEQ ID NO: 102560 - RNA, 22 nt, Homo sapiens
gggagcacaagaaauguuucau

SEQ ID NO: 102561 - RNA, 22 nt, Homo sapiens
gggagguaggaguuauuauuuu

SEQ ID NO: 102562 - RNA, 22 nt, Homo sapiens
gggauauguagauuuuuaucuu

SEQ ID NO: 102563 - RNA, 22 nt, Homo sapiens
gggauguaaaagugggcacauu

SEQ ID NO: 102564 - RNA, 20 nt, Homo sapiens
gggaugugagguacacucuu

SEQ ID NO: 102565 - RNA, 23 nt, Homo sapiens
gggauuguaaaauaugagggcag

SEQ ID NO: 102566 - RNA, 22 nt, Homo sapiens
gggauuguaauacugaguuggu

SEQ ID NO: 102567 - RNA, 22 nt, Homo sapiens
gggcaugauggugcacacaugu

SEQ ID NO: 102568 - RNA, 22 nt, Homo sapiens
gggcaugaugucuuaugccuau

SEQ ID NO: 102569 - RNA, 22 nt, Homo sapiens
gggcauguggacuuguauguuu

SEQ ID NO: 102570 - RNA, 22 nt, Homo sapiens
gggcauugugggcagagggcag

SEQ ID NO: 102571 - RNA, 22 nt, Homo sapiens
gggccagaugcauuuguuauuu

SEQ ID NO: 102572 - RNA, 22 nt, Homo sapiens
ggggaguguggacaucacccug

SEQ ID NO: 102573 - RNA, 22 nt, Homo sapiens
gggguauguaagugagugagug

SEQ ID NO: 102574 - RNA, 22 nt, Homo sapiens
ggggucauuaaauuccgcuggu

SEQ ID NO: 102575 - RNA, 15 nt, Homo sapiens
ggguccucucccaaa

SEQ ID NO: 102576 - RNA, 22 nt, Homo sapiens
gggugguuuuauuaucagugac

SEQ ID NO: 102577 - RNA, 22 nt, Homo sapiens
gguaaacauaagagagcugacu

SEQ ID NO: 102578 - RNA, 22 nt, Homo sapiens
gguauguaggucuacgguacaa

SEQ ID NO: 102579 - RNA, 22 nt, Homo sapiens
ggucaacaucaucaugguaagu

SEQ ID NO: 102580 - RNA, 19 nt, Homo sapiens
ggucacagggguuacaagg

SEQ ID NO: 102581 - RNA, 22 nt, Homo sapiens
ggucacauugcuagcauggguu

SEQ ID NO: 102582 - RNA, 19 nt, Homo sapiens
ggucagcaaagucuagcug

SEQ ID NO: 102583 - RNA, 22 nt, Homo sapiens
ggucagugcauucuaaaggcaa

SEQ ID NO: 102584 - RNA, 22 nt, Homo sapiens
ggucauagagaauucaccagga

SEQ ID NO: 102585 - RNA, 22 nt, Homo sapiens
ggucauggagcuuuacuuuaug

SEQ ID NO: 102586 - RNA, 22 nt, Homo sapiens
gguccgccugccuuggccuccc

SEQ ID NO: 102587 - RNA, 22 nt, Homo sapiens
ggucuagagagagggguggacu

SEQ ID NO: 102588 - RNA, 22 nt, Homo sapiens
ggucugguguugaaauucuuca

SEQ ID NO: 102589 - RNA, 22 nt, Homo sapiens
ggucuuggagaauuguccuggg

SEQ ID NO: 102590 - RNA, 22 nt, Homo sapiens
ggugaauuguaccccauaggau

SEQ ID NO: 102591 - RNA, 22 nt, Homo sapiens
ggugacugguuuaucuggcagu

SEQ ID NO: 102592 - RNA, 22 nt, Homo sapiens
ggugagaaagggauuccuguuc

SEQ ID NO: 102593 - RNA, 19 nt, Homo sapiens
ggugagaaauuaugggucu

SEQ ID NO: 102594 - RNA, 22 nt, Homo sapiens
ggugagcacagaaugcccugag

SEQ ID NO: 102595 - RNA, 22 nt, Homo sapiens
ggugauguuugaguugagacag

SEQ ID NO: 102596 - RNA, 22 nt, Homo sapiens
gguggcuuuuugugauggcuga

SEQ ID NO: 102597 - RNA, 22 nt, Homo sapiens
gguggugguauuucagaaaaug

SEQ ID NO: 102598 - RNA, 22 nt, Homo sapiens
ggugucaguuggccccuacugg

SEQ ID NO: 102599 - RNA, 20 nt, Homo sapiens
guaaacucucagcauagaug

SEQ ID NO: 102600 - RNA, 22 nt, Homo sapiens
guaaaguaaagcacaucaaggu

SEQ ID NO: 102601 - RNA, 22 nt, Homo sapiens
guaaauaccaguuucuggaaca

SEQ ID NO: 102602 - RNA, 18 nt, Homo sapiens
guaaauguaucuauugcc

SEQ ID NO: 102603 - RNA, 22 nt, Homo sapiens
guaaauguccugcuacagagug

SEQ ID NO: 102604 - RNA, 22 nt, Homo sapiens
guaacugguuuucuucccucuc

SEQ ID NO: 102605 - RNA, 22 nt, Homo sapiens
guaagauaguauguuuaaccca

SEQ ID NO: 102606 - RNA, 23 nt, Homo sapiens
guaauacuagucauaguagcagg

SEQ ID NO: 102607 - RNA, 22 nt, Homo sapiens
guaaucucagcuacucgggagg

SEQ ID NO: 102608 - RNA, 22 nt, Homo sapiens
guaaucucagcuacuugggagg

SEQ ID NO: 102609 - RNA, 22 nt, Homo sapiens
guaaucucagcuccucaugagg

SEQ ID NO: 102610 - RNA, 22 nt, Homo sapiens
guaaucuguaguaaagcaccau

SEQ ID NO: 102611 - RNA, 22 nt, Homo sapiens
guaaugaacuugaaagccuguu

SEQ ID NO: 102612 - RNA, 19 nt, Homo sapiens
guaaugugcuucaguagca

SEQ ID NO: 102613 - RNA, 22 nt, Homo sapiens
guacaaguaagaaaauugccca

SEQ ID NO: 102614 - RNA, 22 nt, Homo sapiens
guacacaacaugcagguuuguu

SEQ ID NO: 102615 - RNA, 22 nt, Homo sapiens
guacacauacauauaugugugu

SEQ ID NO: 102616 - RNA, 17 nt, Homo sapiens
guacacuucuucuguga

SEQ ID NO: 102617 - RNA, 22 nt, Homo sapiens
guacaggcagcaaacaccauaa

SEQ ID NO: 102618 - RNA, 22 nt, Homo sapiens
guacaguuuagugcuuugagaa

SEQ ID NO: 102619 - RNA, 22 nt, Homo sapiens
guacauagucacacauauacau

SEQ ID NO: 102620 - RNA, 22 nt, Homo sapiens
guacaugcaugcaugggugugc

SEQ ID NO: 102621 - RNA, 22 nt, Homo sapiens
guacaugugcacagugugcagg

SEQ ID NO: 102622 - RNA, 22 nt, Homo sapiens
guacccaguagauaguuuuuca

SEQ ID NO: 102623 - RNA, 22 nt, Homo sapiens
guagaagcacaggugaguuggu

SEQ ID NO: 102624 - RNA, 22 nt, Homo sapiens
guagaccauuuaucuggggagu

SEQ ID NO: 102625 - RNA, 22 nt, Homo sapiens
guagagguagacuuccuugucu

SEQ ID NO: 102626 - RNA, 22 nt, Homo sapiens
uuuagcaauggagggugacuuu

SEQ ID NO: 102627 - RNA, 22 nt, Homo sapiens
uuuagcagcaaagagccaugcu

SEQ ID NO: 102628 - RNA, 22 nt, Homo sapiens
uuuagguagucaaagguuaguc

SEQ ID NO: 102629 - RNA, 22 nt, Homo sapiens
uuuaguacugcuuuaugugugu

SEQ ID NO: 102630 - RNA, 23 nt, Homo sapiens
uuuaguccccuaugagcuggugu

SEQ ID NO: 102631 - RNA, 22 nt, Homo sapiens
uuuaguccucugaaaaucuaua

SEQ ID NO: 102632 - RNA, 22 nt, Homo sapiens
uuuaugucuguacaucgggcgg

SEQ ID NO: 102633 - RNA, 22 nt, Homo sapiens
uuuauguggagcacuugacaca

SEQ ID NO: 102634 - RNA, 22 nt, Homo sapiens
uuucaacuaauuuuuuggugag

SEQ ID NO: 102635 - RNA, 22 nt, Homo sapiens
uuucaagugcugucuuagcugu

SEQ ID NO: 102636 - RNA, 23 nt, Homo sapiens
uuucacagaaggauuguagggcc

SEQ ID NO: 102637 - RNA, 22 nt, Homo sapiens
uuucacagcaauugccuauugu

SEQ ID NO: 102638 - RNA, 17 nt, Homo sapiens
uuucagaguggaagugu

SEQ ID NO: 102639 - RNA, 22 nt, Homo sapiens
uuucaucagccagggucagucu

SEQ ID NO: 102640 - RNA, 22 nt, Homo sapiens
uuucauggacgcaaugccuuuu

SEQ ID NO: 102641 - RNA, 22 nt, Homo sapiens
uuucauggcaguuuggggccug

SEQ ID NO: 102642 - RNA, 22 nt, Homo sapiens
uuuccaagaugcuuacuuucuc

SEQ ID NO: 102643 - RNA, 19 nt, Homo sapiens
uuuccaguaaucuuaugug

SEQ ID NO: 102644 - RNA, 22 nt, Homo sapiens
uuuccaguuggaaagccuguuu

SEQ ID NO: 102645 - RNA, 22 nt, Homo sapiens
uuuccaguuggaagaaggggga

SEQ ID NO: 102646 - RNA, 22 nt, Homo sapiens
uuuccauguuggugaaaugagg

SEQ ID NO: 102647 - RNA, 16 nt, Homo sapiens
uuucccuuugguguuu

SEQ ID NO: 102648 - RNA, 22 nt, Homo sapiens
uuucgugucuggucugugaugg

SEQ ID NO: 102649 - RNA, 20 nt, Homo sapiens
uuucuccccuauaaaucuca

SEQ ID NO: 102650 - RNA, 22 nt, Homo sapiens
uuucugggggugcugauggaaa

SEQ ID NO: 102651 - RNA, 22 nt, Homo sapiens
uuucuugguuguauuuagacuu

SEQ ID NO: 102652 - RNA, 22 nt, Homo sapiens
uuugaagcaauugugaauggga

SEQ ID NO: 102653 - RNA, 22 nt, Homo sapiens
uuugaagugugaugccuugaug

SEQ ID NO: 102654 - RNA, 22 nt, Homo sapiens
uuugaaguguggcacugaguuu

SEQ ID NO: 102655 - RNA, 22 nt, Homo sapiens
uuugaauguaaugagcaggaag

SEQ ID NO: 102656 - RNA, 22 nt, Homo sapiens
uuugacuacugaugguguacgc

SEQ ID NO: 102657 - RNA, 18 nt, Homo sapiens
uuugacugguguccuuau

SEQ ID NO: 102658 - RNA, 22 nt, Homo sapiens
uuugacuguggagucgaugcuu

SEQ ID NO: 102659 - RNA, 22 nt, Homo sapiens
uuugagcaggcuaaucaauaua

SEQ ID NO: 102660 - RNA, 22 nt, Homo sapiens
uuugagcauuagggcaaaggca

SEQ ID NO: 102661 - RNA, 22 nt, Homo sapiens
uuugagcuagagucucacucug

SEQ ID NO: 102662 - RNA, 22 nt, Homo sapiens
uuugaguuugaggugcugauga

SEQ ID NO: 102663 - RNA, 22 nt, Homo sapiens
uuugaugcaucucuacuuuguu

SEQ ID NO: 102664 - RNA, 22 nt, Homo sapiens
uuugcaagaugaaaaaguucua

SEQ ID NO: 102665 - RNA, 22 nt, Homo sapiens
uuugcaccuuccuaguggcuga

SEQ ID NO: 102666 - RNA, 22 nt, Homo sapiens
uuugcacuucugagugugacau

SEQ ID NO: 102667 - RNA, 22 nt, Homo sapiens
uuugcacuuuaauauaauguga

SEQ ID NO: 102668 - RNA, 22 nt, Homo sapiens
uuugcacuuuuguaauaugguu

SEQ ID NO: 102669 - RNA, 22 nt, Homo sapiens
uuugcaucuuagaaaguucucc

SEQ ID NO: 102670 - RNA, 22 nt, Homo sapiens
uuugccaauauuuuacugagga

SEQ ID NO: 102671 - RNA, 23 nt, Homo sapiens
uuugccacuuauuagcugggagg

SEQ ID NO: 102672 - RNA, 18 nt, Homo sapiens
uuugccacuucccagaaa

SEQ ID NO: 102673 - RNA, 22 nt, Homo sapiens
uuugccuuugugauauggucua

SEQ ID NO: 102674 - RNA, 22 nt, Homo sapiens
uuugcuauagugaauagugcug

SEQ ID NO: 102675 - RNA, 22 nt, Homo sapiens
uuugcuuaaaucuuaaucagau

SEQ ID NO: 102676 - RNA, 22 nt, Homo sapiens
uuugcuugaggucuagcuaccc

SEQ ID NO: 102677 - RNA, 22 nt, Homo sapiens
uuuggcaaagaucaacauguua

SEQ ID NO: 102678 - RNA, 22 nt, Homo sapiens
uuuggcaacguuggaucccuca

SEQ ID NO: 102679 - RNA, 20 nt, Homo sapiens
uuuggcacugagugguauaa

SEQ ID NO: 102680 - RNA, 22 nt, Homo sapiens
uuuggcaguuauuuacucagug

SEQ ID NO: 102681 - RNA, 22 nt, Homo sapiens
uuuggcauauuuuaagcugguu

SEQ ID NO: 102682 - RNA, 22 nt, Homo sapiens
uuuggcaugggcuauuugcuuu

SEQ ID NO: 102683 - RNA, 22 nt, Homo sapiens
uuuggcauuaagaugcuguauc

SEQ ID NO: 102684 - RNA, 22 nt, Homo sapiens
uuuggcauuagagagacuugca

SEQ ID NO: 102685 - RNA, 22 nt, Homo sapiens
uuuggcauuuuacuacucaaau

SEQ ID NO: 102686 - RNA, 22 nt, Homo sapiens
uuuggccauguuggucaggcug

SEQ ID NO: 102687 - RNA, 22 nt, Homo sapiens
uuuggcccccagcucaggacau

SEQ ID NO: 102688 - RNA, 22 nt, Homo sapiens
uuuggcuauguuguaucuuucc

SEQ ID NO: 102689 - RNA, 22 nt, Homo sapiens
uuugggaaugaguuuaucauuu

SEQ ID NO: 102690 - RNA, 22 nt, Homo sapiens
uuugggacuguauuaaaugccu

SEQ ID NO: 102691 - RNA, 22 nt, Homo sapiens
uuugggccauggcuuuuccacg

SEQ ID NO: 102692 - RNA, 22 nt, Homo sapiens
uuugggcuuuuaaucuagagca

SEQ ID NO: 102693 - RNA, 22 nt, Homo sapiens
uuuggucacugccgccgccagc

SEQ ID NO: 102694 - RNA, 22 nt, Homo sapiens
uuuggucagcugcgggucagcu

SEQ ID NO: 102695 - RNA, 22 nt, Homo sapiens
uuugguccaguguucagguccu

SEQ ID NO: 102696 - RNA, 22 nt, Homo sapiens
uuugguccuccuacagggcagg

SEQ ID NO: 102697 - RNA, 22 nt, Homo sapiens
uuugguuauuugaaacuagcau

SEQ ID NO: 102698 - RNA, 22 nt, Homo sapiens
uuugguugcauucacauauuuc

SEQ ID NO: 102699 - RNA, 22 nt, Homo sapiens
uuugguugccucuaugagccug

SEQ ID NO: 102700 - RNA, 22 nt, Homo sapiens
uuuguacacuguuggugguuau

SEQ ID NO: 102701 - RNA, 22 nt, Homo sapiens
uuuguacuucauugguucuacu

SEQ ID NO: 102702 - RNA, 22 nt, Homo sapiens
uuuguacuugguguucuggaaa

SEQ ID NO: 102703 - RNA, 22 nt, Homo sapiens
uuuguagcuacaaagugagaug

SEQ ID NO: 102704 - RNA, 23 nt, Homo sapiens
uuuguaguagcaugauuuauaau

SEQ ID NO: 102705 - RNA, 22 nt, Homo sapiens
uuuguauguuggagauuggaga

SEQ ID NO: 102706 - RNA, 21 nt, Homo sapiens
uuuguccaccuguguucacca

SEQ ID NO: 102707 - RNA, 22 nt, Homo sapiens
uuuguccccgcccagaucucau

SEQ ID NO: 102708 - RNA, 22 nt, Homo sapiens
uuuguccugccaugguuuauuu

SEQ ID NO: 102709 - RNA, 22 nt, Homo sapiens
uuugugaaugucauaagcucca

SEQ ID NO: 102710 - RNA, 22 nt, Homo sapiens
uuugugacucauggucuagugc

SEQ ID NO: 102711 - RNA, 22 nt, Homo sapiens
uuugugaggugauggauauguc

SEQ ID NO: 102712 - RNA, 22 nt, Homo sapiens
uuugugcaaacuaggauugcga

SEQ ID NO: 102713 - RNA, 22 nt, Homo sapiens
uuugugcuauguuauauauucu

SEQ ID NO: 102714 - RNA, 21 nt, Homo sapiens
uuugugguuacugugugagcu

SEQ ID NO: 102715 - RNA, 22 nt, Homo sapiens
uuugugucccucuaaaauuuau

SEQ ID NO: 102716 - RNA, 18 nt, Homo sapiens
ucaccuugcuuuuagaac

SEQ ID NO: 102717 - RNA, 18 nt, Homo sapiens
ucaccuugugagagagag

SEQ ID NO: 102718 - RNA, 22 nt, Homo sapiens
ucacgcugcugcaaccagccug

SEQ ID NO: 102719 - RNA, 23 nt, Homo sapiens
ucacggagaccugcaagaccaau

SEQ ID NO: 102720 - RNA, 19 nt, Homo sapiens
ucacgugcagcagccacac

SEQ ID NO: 102721 - RNA, 22 nt, Homo sapiens
ucacugaaaccgccuccaccuc

SEQ ID NO: 102722 - RNA, 22 nt, Homo sapiens
ucacugaaacuguccuggguua

SEQ ID NO: 102723 - RNA, 22 nt, Homo sapiens
ucacugagcuagaucacuugac

SEQ ID NO: 102724 - RNA, 22 nt, Homo sapiens
ucacugcacuagguaaugccac

SEQ ID NO: 102725 - RNA, 22 nt, Homo sapiens
ucacugcgaccuccgccucccg

SEQ ID NO: 102726 - RNA, 22 nt, Homo sapiens
ucacugcgcuucagccugggug

SEQ ID NO: 102727 - RNA, 22 nt, Homo sapiens
ucacuggacagaaauaaaggug

SEQ ID NO: 102728 - RNA, 22 nt, Homo sapiens
ucacuggacucuagccugggug

SEQ ID NO: 102729 - RNA, 22 nt, Homo sapiens
ucacuggagauagcaaucuggu

SEQ ID NO: 102730 - RNA, 20 nt, Homo sapiens
ucacuggagcucauuugauu

SEQ ID NO: 102731 - RNA, 22 nt, Homo sapiens
ucacuggccaaauucuggguga

SEQ ID NO: 102732 - RNA, 20 nt, Homo sapiens
ucacuggguucuugaagucu

SEQ ID NO: 102733 - RNA, 20 nt, Homo sapiens
ucacugugaacuucuugagg

SEQ ID NO: 102734 - RNA, 22 nt, Homo sapiens
ucacuuggccgcagccuucucu

SEQ ID NO: 102735 - RNA, 22 nt, Homo sapiens
ucacuuggugaacacauuaugu

SEQ ID NO: 102736 - RNA, 22 nt, Homo sapiens
ucagaacugaacaaaccagucu

SEQ ID NO: 102737 - RNA, 22 nt, Homo sapiens
ucagaguguuuuccaacuuggu

SEQ ID NO: 102738 - RNA, 22 nt, Homo sapiens
ucagaucaguuccacaagaacu

SEQ ID NO: 102739 - RNA, 22 nt, Homo sapiens
ucagaucaugcuuaugauggga

SEQ ID NO: 102740 - RNA, 22 nt, Homo sapiens
ucagaucuucagcaggggcccc

SEQ ID NO: 102741 - RNA, 22 nt, Homo sapiens
ucagaugaucugguaagaacuu

SEQ ID NO: 102742 - RNA, 22 nt, Homo sapiens
ucagaugauuccguugacgaga

SEQ ID NO: 102743 - RNA, 22 nt, Homo sapiens
ucagauugaugcauacuuaaau

SEQ ID NO: 102744 - RNA, 22 nt, Homo sapiens
ucagauuggugcaaaaguaauu

SEQ ID NO: 102745 - RNA, 22 nt, Homo sapiens
ucagcaaugcugcacucuacug

SEQ ID NO: 102746 - RNA, 20 nt, Homo sapiens
cagagcaaagcaguccuggc

SEQ ID NO: 102747 - RNA, 22 nt, Homo sapiens
cagagcacuaaagguaaaaggc

SEQ ID NO: 102748 - RNA, 22 nt, Homo sapiens
cagaucaucuugagcuuaggaa

SEQ ID NO: 102749 - RNA, 20 nt, Homo sapiens
cagcacgcacaugagacugu

SEQ ID NO: 102750 - RNA, 22 nt, Homo sapiens
cagcagguuuuuaucaguuaag

SEQ ID NO: 102751 - RNA, 22 nt, Homo sapiens
cagcaucauucaucugggguaa

SEQ ID NO: 102752 - RNA, 22 nt, Homo sapiens
cagcccguaaucccagcacuuu

SEQ ID NO: 102753 - RNA, 22 nt, Homo sapiens
cagcccuacacagacugacuca

SEQ ID NO: 102754 - RNA, 22 nt, Homo sapiens
cagccgggugagguggcuuguu

SEQ ID NO: 102755 - RNA, 22 nt, Homo sapiens
cagccggguggcuccuagggua

SEQ ID NO: 102756 - RNA, 22 nt, Homo sapiens
cagcuaguaauuuauugaagau

SEQ ID NO: 102757 - RNA, 23 nt, Homo sapiens
cagcucauuuggguccccuuguc

SEQ ID NO: 102758 - RNA, 23 nt, Homo sapiens
cagcuggugauuuuaaguugaag

SEQ ID NO: 102759 - RNA, 22 nt, Homo sapiens
cagcugguguuacaaaccagag

SEQ ID NO: 102760 - RNA, 22 nt, Homo sapiens
caggcaacauggcgaaacucug

SEQ ID NO: 102761 - RNA, 22 nt, Homo sapiens
caggcagucuggcucccaagug

SEQ ID NO: 102762 - RNA, 22 nt, Homo sapiens
caggcuuuuccacacauggguu

SEQ ID NO: 102763 - RNA, 22 nt, Homo sapiens
cagggaauguuauuuaauagca

SEQ ID NO: 102764 - RNA, 20 nt, Homo sapiens
cagggcaaugaggagguaaa

SEQ ID NO: 102765 - RNA, 22 nt, Homo sapiens
cagggcauugucuucuuaguac

SEQ ID NO: 102766 - RNA, 22 nt, Homo sapiens
cagguaagaugcuuucucuuau

SEQ ID NO: 102767 - RNA, 22 nt, Homo sapiens
cagguacauuuuaaagggcuca

SEQ ID NO: 102768 - RNA, 22 nt, Homo sapiens
cagguaguauuugguuacauaa

SEQ ID NO: 102769 - RNA, 19 nt, Homo sapiens
cagguagugugcugacaug

SEQ ID NO: 102770 - RNA, 22 nt, Homo sapiens
caggugcauuggcugacaccug

SEQ ID NO: 102771 - RNA, 22 nt, Homo sapiens
caggugguauuugguuuucugu

SEQ ID NO: 102772 - RNA, 22 nt, Homo sapiens
caguaaauaucugagcgagguc

SEQ ID NO: 102773 - RNA, 22 nt, Homo sapiens
cagucacagugacaggaugugg

SEQ ID NO: 102774 - RNA, 22 nt, Homo sapiens
cagucacugggauuauggucau

SEQ ID NO: 102775 - RNA, 22 nt, Homo sapiens
cagugacacugaaaaguucggg

SEQ ID NO: 102776 - RNA, 22 nt, Homo sapiens
cagugcaaccuccaucucucgg

SEQ ID NO: 102777 - RNA, 20 nt, Homo sapiens
cagugcacuuucccacuggu

SEQ ID NO: 102778 - RNA, 22 nt, Homo sapiens
cagugcauccauguucagcagu

SEQ ID NO: 102779 - RNA, 22 nt, Homo sapiens
cagugcauguggcacucuccag

SEQ ID NO: 102780 - RNA, 22 nt, Homo sapiens
caguggaugaacaagaagugau

SEQ ID NO: 102781 - RNA, 22 nt, Homo sapiens
caguggaugauguuuucugugg

SEQ ID NO: 102782 - RNA, 23 nt, Homo sapiens
cagugguguuagagaaaucuuuu

SEQ ID NO: 102783 - RNA, 22 nt, Homo sapiens
cagugguuuucucaguucagca

SEQ ID NO: 102784 - RNA, 22 nt, Homo sapiens
caguguaugcuucuauuuuugg

SEQ ID NO: 102785 - RNA, 22 nt, Homo sapiens
caguuacuuuugcaccaaccua

SEQ ID NO: 102786 - RNA, 22 nt, Homo sapiens
caguugcacuagccccguuuca

SEQ ID NO: 102787 - RNA, 22 nt, Homo sapiens
cauaaagauggaggaggccagg

SEQ ID NO: 102788 - RNA, 22 nt, Homo sapiens
cauacaugugcuugucuuaugc

SEQ ID NO: 102789 - RNA, 22 nt, Homo sapiens
cauagcacacauuuaccuaugu

SEQ ID NO: 102790 - RNA, 18 nt, Homo sapiens
cauagcacuucagcacau

SEQ ID NO: 102791 - RNA, 22 nt, Homo sapiens
cauauaguaggugcucuguguu

SEQ ID NO: 102792 - RNA, 22 nt, Homo sapiens
cauaugguuuuauguucuucau

SEQ ID NO: 102793 - RNA, 22 nt, Homo sapiens
caucacacuuggauguaagaca

SEQ ID NO: 102794 - RNA, 23 nt, Homo sapiens
caucacagagccuuccuugacuc

SEQ ID NO: 102795 - RNA, 22 nt, Homo sapiens
caucacaucugcaugguaagua

SEQ ID NO: 102796 - RNA, 21 nt, Homo sapiens
caucacauuacucaaaguccu

SEQ ID NO: 102797 - RNA, 20 nt, Homo sapiens
caucaccuggcaggauuugu

SEQ ID NO: 102798 - RNA, 22 nt, Homo sapiens
caucacuuuuccuuuuacagau

SEQ ID NO: 102799 - RNA, 22 nt, Homo sapiens
caucagagugagauauaagauc

SEQ ID NO: 102800 - RNA, 19 nt, Homo sapiens
caucccugagcugaagugg

SEQ ID NO: 102801 - RNA, 22 nt, Homo sapiens
caucccugucgucaagucucug

SEQ ID NO: 102802 - RNA, 22 nt, Homo sapiens
caucucauugaauugcugagca

SEQ ID NO: 102803 - RNA, 22 nt, Homo sapiens
caugaacacugugcggcuuccu

SEQ ID NO: 102804 - RNA, 22 nt, Homo sapiens
caugcacugagagggucucggc

SEQ ID NO: 102805 - RNA, 22 nt, Homo sapiens
ugccaguuuuuacauuuccugu

SEQ ID NO: 102806 - RNA, 19 nt, Homo sapiens
ugccauguaacaggaaaau

SEQ ID NO: 102807 - RNA, 22 nt, Homo sapiens
ugcccuuugucagaugaguagg

SEQ ID NO: 102808 - RNA, 22 nt, Homo sapiens
ugccuacugagacuggguggcc

SEQ ID NO: 102809 - RNA, 22 nt, Homo sapiens
ugccuacugguuguucugggca

SEQ ID NO: 102810 - RNA, 22 nt, Homo sapiens
ugccuggagagcuccuacauau

SEQ ID NO: 102811 - RNA, 22 nt, Homo sapiens
ugccuucuguuaaacgaggaug

SEQ ID NO: 102812 - RNA, 22 nt, Homo sapiens
ugccuuuguucuggaaugggaa

SEQ ID NO: 102813 - RNA, 22 nt, Homo sapiens
ugcgaucuuuuuccuuguuccu

SEQ ID NO: 102814 - RNA, 22 nt, Homo sapiens
ugcgccauugcacuccagccug

SEQ ID NO: 102815 - RNA, 22 nt, Homo sapiens
ugcgccauugcauuccagccug

SEQ ID NO: 102816 - RNA, 22 nt, Homo sapiens
ugcuacccuucgucucucuggu

SEQ ID NO: 102817 - RNA, 22 nt, Homo sapiens
ugcuaucauugauuagugaugu

SEQ ID NO: 102818 - RNA, 22 nt, Homo sapiens
ugcuaugucagccaggcugguc

SEQ ID NO: 102819 - RNA, 16 nt, Homo sapiens
ugcuauguuggccagg

SEQ ID NO: 102820 - RNA, 22 nt, Homo sapiens
ugcuauguuuucccuccuuauc

SEQ ID NO: 102821 - RNA, 22 nt, Homo sapiens
ugcucaccugcugcucaccucc

SEQ ID NO: 102822 - RNA, 21 nt, Homo sapiens
ugcucaugaguaaugcaguga

SEQ ID NO: 102823 - RNA, 18 nt, Homo sapiens
ugcuccccugggugagca

SEQ ID NO: 102824 - RNA, 22 nt, Homo sapiens
ugcugcaaucucggcacuuugg

SEQ ID NO: 102825 - RNA, 21 nt, Homo sapiens
ugcugcacuucuuuugcugug

SEQ ID NO: 102826 - RNA, 22 nt, Homo sapiens
ugcugcauuggggauuaaguuu

SEQ ID NO: 102827 - RNA, 22 nt, Homo sapiens
ugcugcuguuguuguuacuagc

SEQ ID NO: 102828 - RNA, 22 nt, Homo sapiens
ugcuggugauuaaauccugaag

SEQ ID NO: 102829 - RNA, 22 nt, Homo sapiens
ugcuuaggcuuccuuacaguau

SEQ ID NO: 102830 - RNA, 22 nt, Homo sapiens
ugcuucauuggccaccaggaag

SEQ ID NO: 102831 - RNA, 22 nt, Homo sapiens
ugcuuugguagaaaucuuuggu

SEQ ID NO: 102832 - RNA, 22 nt, Homo sapiens
uggaaaauuaggggagguuaua

SEQ ID NO: 102833 - RNA, 22 nt, Homo sapiens
uggaaauuaagucuuuccugag

SEQ ID NO: 102834 - RNA, 22 nt, Homo sapiens
uggaacacaucuaaggaagcag

SEQ ID NO: 102835 - RNA, 22 nt, Homo sapiens
uggaacaccaggcuggcguggc

SEQ ID NO: 102836 - RNA, 23 nt, Homo sapiens
uggaacugaauuucuuagcauuu

SEQ ID NO: 102837 - RNA, 18 nt, Homo sapiens
ucuagacacugugucuau

SEQ ID NO: 102838 - RNA, 22 nt, Homo sapiens
ucuaguaaugagaggcaggaga

SEQ ID NO: 102839 - RNA, 15 nt, Homo sapiens
ucuaguuuugaagac

SEQ ID NO: 102840 - RNA, 22 nt, Homo sapiens
ucuaucacagccccacacucuc

SEQ ID NO: 102841 - RNA, 22 nt, Homo sapiens
ucucaaguggucgcaguuagau

SEQ ID NO: 102842 - RNA, 22 nt, Homo sapiens
ucucaauuugauuacauucaua

SEQ ID NO: 102843 - RNA, 18 nt, Homo sapiens
ucucacagcaaucuguca

SEQ ID NO: 102844 - RNA, 22 nt, Homo sapiens
ucucacagccauuucucccucu

SEQ ID NO: 102845 - RNA, 19 nt, Homo sapiens
ucucacagcucuacuaugu

SEQ ID NO: 102846 - RNA, 22 nt, Homo sapiens
ucucacaggguuauugaggggg

SEQ ID NO: 102847 - RNA, 22 nt, Homo sapiens
ucucagugaaauaaauuauuuu

SEQ ID NO: 102848 - RNA, 22 nt, Homo sapiens
ucucagugugguaaaaguuuuu

SEQ ID NO: 102849 - RNA, 22 nt, Homo sapiens
ucucaugaagauagagaauaga

SEQ ID NO: 102850 - RNA, 22 nt, Homo sapiens
ucucaugaagguggagaguagg

SEQ ID NO: 102851 - RNA, 20 nt, Homo sapiens
ucucauggagguagagaaua

SEQ ID NO: 102852 - RNA, 22 nt, Homo sapiens
ucucauggagguagagaguaaa

SEQ ID NO: 102853 - RNA, 23 nt, Homo sapiens
ucucauuccuugaaaauaaugac

SEQ ID NO: 102854 - RNA, 20 nt, Homo sapiens
ucucccaaacagcaggcccu

SEQ ID NO: 102855 - RNA, 22 nt, Homo sapiens
ucucccauccaugaacuucugu

SEQ ID NO: 102856 - RNA, 22 nt, Homo sapiens
ucucccauccguacacggauug

SEQ ID NO: 102857 - RNA, 22 nt, Homo sapiens
ucuccggguggcggcgaaggga

SEQ ID NO: 102858 - RNA, 22 nt, Homo sapiens
ucucuagagagccugguguuca

SEQ ID NO: 102859 - RNA, 21 nt, Homo sapiens
ucucucaaccaggaagugggc

SEQ ID NO: 102860 - RNA, 19 nt, Homo sapiens
ucucugguguuggagggga

SEQ ID NO: 102861 - RNA, 22 nt, Homo sapiens
ucucugguuaugucauuaagca

SEQ ID NO: 102862 - RNA, 22 nt, Homo sapiens
ucugaaucguucccaugcagga

SEQ ID NO: 102863 - RNA, 22 nt, Homo sapiens
ucugacaaugaacaaucuauag

SEQ ID NO: 102864 - RNA, 22 nt, Homo sapiens
ucugacacuucugcagaauuga

SEQ ID NO: 102865 - RNA, 22 nt, Homo sapiens
ucugagcaauagauguggauau

SEQ ID NO: 102866 - RNA, 22 nt, Homo sapiens
ucugagguaggugcauggauac

SEQ ID NO: 102867 - RNA, 22 nt, Homo sapiens
ucugagguuaaauuuuauaguu

SEQ ID NO: 102868 - RNA, 22 nt, Homo sapiens
ucugagguuacugcuuuguaga

SEQ ID NO: 102869 - RNA, 22 nt, Homo sapiens
ucugauggaguugccagggaga

SEQ ID NO: 102870 - RNA, 22 nt, Homo sapiens
ucugcaagucuaaacuagccau

SEQ ID NO: 102871 - RNA, 22 nt, Homo sapiens
ucugccuuuucaugugggaugg

SEQ ID NO: 102872 - RNA, 22 nt, Homo sapiens
ucuggcaagagccgagggcagu

SEQ ID NO: 102873 - RNA, 22 nt, Homo sapiens
ucuggcacugaugugggaugcu

SEQ ID NO: 102874 - RNA, 21 nt, Homo sapiens
ucuggcccccucaaaucucau

SEQ ID NO: 102875 - RNA, 20 nt, Homo sapiens
ucuggccccuccaaaucuca

SEQ ID NO: 102876 - RNA, 22 nt, Homo sapiens
ucuggccccucccaaaucucau

SEQ ID NO: 102877 - RNA, 22 nt, Homo sapiens
ucuggccccucucaaaucucau

SEQ ID NO: 102878 - RNA, 18 nt, Homo sapiens
ucuggcuucuuuguucca

SEQ ID NO: 102879 - RNA, 22 nt, Homo sapiens
ucuggcuuugugaguugccaga

SEQ ID NO: 102880 - RNA, 22 nt, Homo sapiens
ucuguacugccaaguuucuuua

SEQ ID NO: 102881 - RNA, 22 nt, Homo sapiens
ucugucacugaaucccugucac

SEQ ID NO: 102882 - RNA, 19 nt, Homo sapiens
ucugucacuggggguauuc

SEQ ID NO: 102883 - RNA, 22 nt, Homo sapiens
ucugucacugguggacgaucac

SEQ ID NO: 102884 - RNA, 22 nt, Homo sapiens
ucugucuuguccucacccuaga

SEQ ID NO: 102885 - RNA, 22 nt, Homo sapiens
ucugugcauuguaacaacuaaa

SEQ ID NO: 102886 - RNA, 22 nt, Homo sapiens
ucugugcauuuucuuuuagacu

SEQ ID NO: 102887 - RNA, 22 nt, Homo sapiens
ucuguggucagaguccuuggcc

SEQ ID NO: 102888 - RNA, 22 nt, Homo sapiens
ucuguggugggcuccacccagu

SEQ ID NO: 102889 - RNA, 22 nt, Homo sapiens
ucugugguucaggcuggagugc

SEQ ID NO: 102890 - RNA, 21 nt, Homo sapiens
ucuguguugaucucacuggga

SEQ ID NO: 102891 - RNA, 22 nt, Homo sapiens
ucuguguuuagacccaggguag

SEQ ID NO: 102892 - RNA, 22 nt, Homo sapiens
ucuguguuugaucaagauugua

SEQ ID NO: 102893 - RNA, 22 nt, Homo sapiens
uggcaaaauggaauauguuggg

SEQ ID NO: 102894 - RNA, 22 nt, Homo sapiens
uggcaaagugugacgugggggu

SEQ ID NO: 102895 - RNA, 22 nt, Homo sapiens
uggcaaaucagaggcauggaca

SEQ ID NO: 102896 - RNA, 22 nt, Homo sapiens
uggcaaaugugagaugagaacu

SEQ ID NO: 102897 - RNA, 22 nt, Homo sapiens
uggcaacuugcaaccucauucu

SEQ ID NO: 102898 - RNA, 22 nt, Homo sapiens
uggcaagaacugcaauugcuuu

SEQ ID NO: 102899 - RNA, 22 nt, Homo sapiens
uggcaagagaacaacaucucuc

SEQ ID NO: 102900 - RNA, 22 nt, Homo sapiens
uggcaagcuuuaauugacucuu

SEQ ID NO: 102901 - RNA, 20 nt, Homo sapiens
uggcaagugggaauuguggg

SEQ ID NO: 102902 - RNA, 22 nt, Homo sapiens
uggcaagugggaccuaguuaaa

SEQ ID NO: 102903 - RNA, 22 nt, Homo sapiens
uggcaaguuucaauccgaggga

SEQ ID NO: 102904 - RNA, 22 nt, Homo sapiens
uggcaauaaggacuccuuaggu

SEQ ID NO: 102905 - RNA, 19 nt, Homo sapiens
uggcacauguauacauaug

SEQ ID NO: 102906 - RNA, 22 nt, Homo sapiens
uggcaccugacuccgagaugca

SEQ ID NO: 102907 - RNA, 22 nt, Homo sapiens
uggcacuaugugacaagguuuu

SEQ ID NO: 102908 - RNA, 22 nt, Homo sapiens
uggcagauggugacaccauuag

SEQ ID NO: 102909 - RNA, 22 nt, Homo sapiens
uggcagugggagauauuuuauu

SEQ ID NO: 102910 - RNA, 22 nt, Homo sapiens
uggcaguuucacauggcucaac

SEQ ID NO: 102911 - RNA, 20 nt, Homo sapiens
uggcaugaaauuuuccaagc

SEQ ID NO: 102912 - RNA, 22 nt, Homo sapiens
uggcaugucguuuuucauagga

SEQ ID NO: 102913 - RNA, 22 nt, Homo sapiens
uggcaugugugaagugcccagc

SEQ ID NO: 102914 - RNA, 22 nt, Homo sapiens
uggcauguguuugaaugaguau

SEQ ID NO: 102915 - RNA, 22 nt, Homo sapiens
uggcauuguccaauaaaauuuu

SEQ ID NO: 102916 - RNA, 22 nt, Homo sapiens
uggccaagagcacagauauugg

SEQ ID NO: 102917 - RNA, 23 nt, Homo sapiens
uggccagaaacuucuuuucaucc

SEQ ID NO: 102918 - RNA, 22 nt, Homo sapiens
uggccagagggcaauuagcugu

SEQ ID NO: 102919 - RNA, 22 nt, Homo sapiens
uggccagugucggaggccagga

SEQ ID NO: 102920 - RNA, 22 nt, Homo sapiens
uggccagugucuauugguuucc

SEQ ID NO: 102921 - RNA, 22 nt, Homo sapiens
uggcgagaaaccauaugcuuuc

SEQ ID NO: 102922 - RNA, 22 nt, Homo sapiens
uggcuaagaugcacacuucacu

SEQ ID NO: 102923 - RNA, 22 nt, Homo sapiens
uggcuaaguuaaucaaggagau

SEQ ID NO: 102924 - RNA, 22 nt, Homo sapiens
uggcuacagaaaguacuaguga

SEQ ID NO: 102925 - RNA, 22 nt, Homo sapiens
uggcuagaugagauguacugca

SEQ ID NO: 102926 - RNA, 22 nt, Homo sapiens
uggcucuguuuguuaacuagac

SEQ ID NO: 102927 - RNA, 22 nt, Homo sapiens
uggcuguuuauuucacaugggu

SEQ ID NO: 102928 - RNA, 23 nt, Homo sapiens
uucaacagguagacccucccugc

SEQ ID NO: 102929 - RNA, 22 nt, Homo sapiens
uucaagauggcaccagugagug

SEQ ID NO: 102930 - RNA, 22 nt, Homo sapiens
uucaagauggccccagugagcc

SEQ ID NO: 102931 - RNA, 22 nt, Homo sapiens
uucaaguagguaggaccacagg

SEQ ID NO: 102932 - RNA, 22 nt, Homo sapiens
uucaagucaacaagcacuugag

SEQ ID NO: 102933 - RNA, 22 nt, Homo sapiens
uucacacuagccacucugguag

SEQ ID NO: 102934 - RNA, 22 nt, Homo sapiens
uucacagaguuauuuuuaugcu

SEQ ID NO: 102935 - RNA, 22 nt, Homo sapiens
uucacagccgcaccccaucacu

SEQ ID NO: 102936 - RNA, 22 nt, Homo sapiens
uucacagcuuaauaaggcucag

SEQ ID NO: 102937 - RNA, 22 nt, Homo sapiens
uucacaguguguacaccagggg

SEQ ID NO: 102938 - RNA, 22 nt, Homo sapiens
uucacaugacagggugaagcau

SEQ ID NO: 102939 - RNA, 16 nt, Homo sapiens
uucacauggcagcagg

SEQ ID NO: 102940 - RNA, 21 nt, Homo sapiens
uucaccauggcuccacacucu

SEQ ID NO: 102941 - RNA, 23 nt, Homo sapiens
uucaccguguuggccaggcuggu

SEQ ID NO: 102942 - RNA, 23 nt, Homo sapiens
uucaccugguuauuaauagccuc

SEQ ID NO: 102943 - RNA, 22 nt, Homo sapiens
uucaccuugcccacagcagucu

SEQ ID NO: 102944 - RNA, 22 nt, Homo sapiens
uucaccuugggucccacuugcu

SEQ ID NO: 102945 - RNA, 22 nt, Homo sapiens
uucacugcacuccagccugagc

SEQ ID NO: 102946 - RNA, 22 nt, Homo sapiens
uucacugcaugaaaaggacagc

SEQ ID NO: 102947 - RNA, 22 nt, Homo sapiens
uucacuguagcuuggauguuua

SEQ ID NO: 102948 - RNA, 22 nt, Homo sapiens
uucacugugaauaaaggcuccc

SEQ ID NO: 102949 - RNA, 22 nt, Homo sapiens
uucagagagggagggauaccua

SEQ ID NO: 102950 - RNA, 22 nt, Homo sapiens
uucagcacaguguggaucauuc

SEQ ID NO: 102951 - RNA, 22 nt, Homo sapiens
uucaggcaccauggucauugau

SEQ ID NO: 102952 - RNA, 22 nt, Homo sapiens
uucagggacuuuagacaagaga

SEQ ID NO: 102953 - RNA, 22 nt, Homo sapiens
uucaggguggagaguaugaggu

SEQ ID NO: 102954 - RNA, 22 nt, Homo sapiens
uucagguacuauaggcuguugg

SEQ ID NO: 102955 - RNA, 22 nt, Homo sapiens
uucaguacacguguucucauuu

SEQ ID NO: 102956 - RNA, 22 nt, Homo sapiens
uucaguacuucaaaaucuuuaa

SEQ ID NO: 102957 - RNA, 22 nt, Homo sapiens
uucaguagucuccauagaaccg

SEQ ID NO: 102958 - RNA, 20 nt, Homo sapiens
uucagugcagguaacaaucc

SEQ ID NO: 102959 - RNA, 22 nt, Homo sapiens
uucagugccuggaagucgugcu

SEQ ID NO: 102960 - RNA, 22 nt, Homo sapiens
uucagugguuauuugugagauu

SEQ ID NO: 102961 - RNA, 19 nt, Homo sapiens
uucauacagugagagcagc

SEQ ID NO: 102962 - RNA, 18 nt, Homo sapiens
uucauaguagcaugauuu

SEQ ID NO: 102963 - RNA, 22 nt, Homo sapiens
uucauagucacauucgaugucu

SEQ ID NO: 102964 - RNA, 22 nt, Homo sapiens
uucauagucuaugcaaguaaga

SEQ ID NO: 102965 - RNA, 22 nt, Homo sapiens
uucauaguucuuuuagucauua

SEQ ID NO: 102966 - RNA, 23 nt, Homo sapiens
uucaucagggauauuggccugaa

SEQ ID NO: 102967 - RNA, 22 nt, Homo sapiens
uucaucagggguauuggccaau

SEQ ID NO: 102968 - RNA, 18 nt, Homo sapiens
uucaucaguccucagcug

SEQ ID NO: 102969 - RNA, 22 nt, Homo sapiens
uucauccccuccaaaucucaug

SEQ ID NO: 102970 - RNA, 22 nt, Homo sapiens
uagcauccuucucuaaacagga

SEQ ID NO: 102971 - RNA, 22 nt, Homo sapiens
uagcauggaggcggccauagug

SEQ ID NO: 102972 - RNA, 22 nt, Homo sapiens
uagcccagugagguugauuugg

SEQ ID NO: 102973 - RNA, 20 nt, Homo sapiens
uagccggguguugugucaug

SEQ ID NO: 102974 - RNA, 22 nt, Homo sapiens
uagccuguggugaauguuucug

SEQ ID NO: 102975 - RNA, 19 nt, Homo sapiens
uagcuagauuggguacuua

SEQ ID NO: 102976 - RNA, 22 nt, Homo sapiens
uagcuccacagcuauauauaau

SEQ ID NO: 102977 - RNA, 17 nt, Homo sapiens
uagcucuauuucuagcc

SEQ ID NO: 102978 - RNA, 22 nt, Homo sapiens
uagcugauguuugucuaguagc

SEQ ID NO: 102979 - RNA, 22 nt, Homo sapiens
uagcugcauccugugcacucaa

SEQ ID NO: 102980 - RNA, 22 nt, Homo sapiens
uagcugcccagcacgaaguugg

SEQ ID NO: 102981 - RNA, 22 nt, Homo sapiens
uagcugcugcuaggcuaaggau

SEQ ID NO: 102982 - RNA, 22 nt, Homo sapiens
uagcugguucuccaggagcuag

SEQ ID NO: 102983 - RNA, 22 nt, Homo sapiens
uaggaaugaacgauuuauuggu

SEQ ID NO: 102984 - RNA, 22 nt, Homo sapiens
uaggacacagaccuggauggaa

SEQ ID NO: 102985 - RNA, 22 nt, Homo sapiens
uaggacuuuucuugagagugac

SEQ ID NO: 102986 - RNA, 22 nt, Homo sapiens
uaggcaauggagauagaggaug

SEQ ID NO: 102987 - RNA, 22 nt, Homo sapiens
uaggcaauguacauaucggccc

SEQ ID NO: 102988 - RNA, 22 nt, Homo sapiens
uaggcacuguguuuguaggagu

SEQ ID NO: 102989 - RNA, 22 nt, Homo sapiens
uaggcaguuuuccuuucacagu

SEQ ID NO: 102990 - RNA, 22 nt, Homo sapiens
uaggcauuuuucugauaaacua

SEQ ID NO: 102991 - RNA, 22 nt, Homo sapiens
uaggcgagauguguguuucaug

SEQ ID NO: 102992 - RNA, 22 nt, Homo sapiens
uaggcuuuucugggaugugggc

SEQ ID NO: 102993 - RNA, 19 nt, Homo sapiens
uagggcacgaggcagaguc

SEQ ID NO: 102994 - RNA, 22 nt, Homo sapiens
uagggcuuuuccaagcugccac

SEQ ID NO: 102995 - RNA, 22 nt, Homo sapiens
uagguaagauguuaacagcuga

SEQ ID NO: 102996 - RNA, 22 nt, Homo sapiens
uagguaaguaauauacagauga

SEQ ID NO: 102997 - RNA, 22 nt, Homo sapiens
uagguaggacguaguccuuuug

SEQ ID NO: 102998 - RNA, 22 nt, Homo sapiens
uagguaggugucauaauccaug

SEQ ID NO: 102999 - RNA, 22 nt, Homo sapiens
uagguagucagcagugcuuaca

SEQ ID NO: 103000 - RNA, 22 nt, Homo sapiens
uagguaucuugguauaucagga

SEQ ID NO: 103001 - RNA, 22 nt, Homo sapiens
uagguauguauauacacacaca

SEQ ID NO: 103002 - RNA, 22 nt, Homo sapiens
uaggugaauguaguaagguguu

SEQ ID NO: 103003 - RNA, 22 nt, Homo sapiens
uaggugguuugaaauacucaag

SEQ ID NO: 103004 - RNA, 22 nt, Homo sapiens
uagguucucaggaaugagcuuc

SEQ ID NO: 103005 - RNA, 22 nt, Homo sapiens
uagguugucaucagucuccacu

SEQ ID NO: 103006 - RNA, 22 nt, Homo sapiens
uagguugucuucccagaguuuu

SEQ ID NO: 103007 - RNA, 20 nt, Homo sapiens
uagguuuucacagaauugcc

SEQ ID NO: 103008 - RNA, 22 nt, Homo sapiens
uaguaaacagcucugccacaau

SEQ ID NO: 103009 - RNA, 22 nt, Homo sapiens
uaguaacacauugaacgaucgc

SEQ ID NO: 103010 - RNA, 22 nt, Homo sapiens
uaguacuggcauguauuuccca

SEQ ID NO: 103011 - RNA, 20 nt, Homo sapiens
uagucaugagauucuccaag

SEQ ID NO: 103012 - RNA, 22 nt, Homo sapiens
uagucccauaugauuuagugaa

SEQ ID NO: 103013 - RNA, 22 nt, Homo sapiens
uagucccuuucuauuaaugaga

SEQ ID NO: 103014 - RNA, 22 nt, Homo sapiens
uagugaaugucacuggcuguug

SEQ ID NO: 103015 - RNA, 22 nt, Homo sapiens
uagugcaguggcuccaucucag

SEQ ID NO: 103016 - RNA, 22 nt, Homo sapiens
uagugcuguaauucuaaugaaa

SEQ ID NO: 103017 - RNA, 22 nt, Homo sapiens
uagugcugugauauuuuuggcc

SEQ ID NO: 103018 - RNA, 22 nt, Homo sapiens
uagugguaguuauggauuugcu

SEQ ID NO: 103019 - RNA, 22 nt, Homo sapiens
uaguguuuuucauuggcagagg

SEQ ID NO: 103020 - RNA, 22 nt, Homo sapiens
uaguucauuuuucuugcuuaga

SEQ ID NO: 103021 - RNA, 22 nt, Homo sapiens
uaguugcauucaggauaugacg

SEQ ID NO: 103022 - RNA, 22 nt, Homo sapiens
uaguugcauuggcugcuaugcu

SEQ ID NO: 103023 - RNA, 22 nt, Homo sapiens
uaguuguugcagguaggaugua

SEQ ID NO: 103024 - RNA, 22 nt, Homo sapiens
uauaaaguaauuucuaggggcu

SEQ ID NO: 103025 - RNA, 22 nt, Homo sapiens
uauaacaaugcaagaauggccu

SEQ ID NO: 103026 - RNA, 22 nt, Homo sapiens
uauaacacccacauauagucuu

SEQ ID NO: 103027 - RNA, 22 nt, Homo sapiens
uauacacgugugcauauauaca

SEQ ID NO: 103028 - RNA, 22 nt, Homo sapiens
uauacaugugggcaucaggaga

SEQ ID NO: 103029 - RNA, 22 nt, Homo sapiens
uauagcaaugccccacuccuga

SEQ ID NO: 103030 - RNA, 22 nt, Homo sapiens
uauagcacugcaauauuucccu

SEQ ID NO: 103031 - RNA, 21 nt, Homo sapiens
uauagcagcacgauuuauagu

SEQ ID NO: 103032 - RNA, 22 nt, Homo sapiens
uauagcagccugaacaaaguaa

SEQ ID NO: 103033 - RNA, 22 nt, Homo sapiens
uauagcagugaguauugacuaa

SEQ ID NO: 103034 - RNA, 22 nt, Homo sapiens
uauagcuauuguuaauggaacu

SEQ ID NO: 103035 - RNA, 22 nt, Homo sapiens
uauagcuuuuuagggaauuugg

SEQ ID NO: 103036 - RNA, 22 nt, Homo sapiens
uauauguucuugcacuggaaag

SEQ ID NO: 103037 - RNA, 22 nt, Homo sapiens
uaucaagaugacaaacuuugcu

SEQ ID NO: 103038 - RNA, 22 nt, Homo sapiens
uaucaaucuagggaaacuccaa

SEQ ID NO: 103039 - RNA, 22 nt, Homo sapiens
uaucacagauauuaugggccaa

SEQ ID NO: 103040 - RNA, 22 nt, Homo sapiens
uaucacagauucuccaggguuu

SEQ ID NO: 103041 - RNA, 22 nt, Homo sapiens
uaucacagcauugucuauaaua

SEQ ID NO: 103042 - RNA, 22 nt, Homo sapiens
uaucacagcgggguguacaccc

SEQ ID NO: 103043 - RNA, 22 nt, Homo sapiens
uaucacagguggacugcacacc

SEQ ID NO: 103044 - RNA, 22 nt, Homo sapiens
uaucacaguugcauauuuaagg

SEQ ID NO: 103045 - RNA, 22 nt, Homo sapiens
uaucacugucaggcccucauau

SEQ ID NO: 103046 - RNA, 22 nt, Homo sapiens
uaucacuguuguuuguuuaagg

SEQ ID NO: 103047 - RNA, 21 nt, Homo sapiens
uaucagagacauugagaggca

SEQ ID NO: 103048 - RNA, 22 nt, Homo sapiens
uaucagagcugucagccuaccu

SEQ ID NO: 103049 - RNA, 22 nt, Homo sapiens
uaucauagacaaucaguuauug

SEQ ID NO: 103050 - RNA, 22 nt, Homo sapiens
uaucauagucacuuccaguuug

SEQ ID NO: 103051 - RNA, 22 nt, Homo sapiens
uaucauaguuuggacuuucauu

SEQ ID NO: 103052 - RNA, 22 nt, Homo sapiens
uaucauggaaagauguugaaau

SEQ ID NO: 103053 - RNA, 21 nt, Homo sapiens
uaucauggccauccucuucuc

SEQ ID NO: 103054 - RNA, 22 nt, Homo sapiens
uaucauugccucaaucuguauu

SEQ ID NO: 103055 - RNA, 22 nt, Homo sapiens
uaucccaauguaauaucacaaa

SEQ ID NO: 103056 - RNA, 22 nt, Homo sapiens
uauccugaagcuuuauuuaagu

SEQ ID NO: 103057 - RNA, 22 nt, Homo sapiens
gauggcauuucuggaucugccc

SEQ ID NO: 103058 - RNA, 22 nt, Homo sapiens
gauggcuacugauuaaauauag

SEQ ID NO: 103059 - RNA, 22 nt, Homo sapiens
gaugguuuuucuccgauuuaua

SEQ ID NO: 103060 - RNA, 22 nt, Homo sapiens
gauguagaaagagugggcugga

SEQ ID NO: 103061 - RNA, 22 nt, Homo sapiens
gauguaggugcauuugcacgug

SEQ ID NO: 103062 - RNA, 22 nt, Homo sapiens
gauguguuuccaggauuuguuu

SEQ ID NO: 103063 - RNA, 22 nt, Homo sapiens
gauuucaucuuuagaggaagga

SEQ ID NO: 103064 - RNA, 22 nt, Homo sapiens
gauuugguguucuggcucaaga

SEQ ID NO: 103065 - RNA, 22 nt, Homo sapiens
gauuuguuggccugugagcuag

SEQ ID NO: 103066 - RNA, 22 nt, Homo sapiens
gauuuuccaguggcccugauca

SEQ ID NO: 103067 - RNA, 22 nt, Homo sapiens
gauuuugguuagggaaggauac

SEQ ID NO: 103068 - RNA, 22 nt, Homo sapiens
gauuuuuggggaagccucuuau

SEQ ID NO: 103069 - RNA, 22 nt, Homo sapiens
gcaaaaaguagugcugguuagg

SEQ ID NO: 103070 - RNA, 22 nt, Homo sapiens
gcaaagaaugcagauuugccuc

SEQ ID NO: 103071 - RNA, 21 nt, Homo sapiens
gcaaaggaauugccuaagcuu

SEQ ID NO: 103072 - RNA, 23 nt, Homo sapiens
gcaaauaucguagagugucccug

SEQ ID NO: 103073 - RNA, 22 nt, Homo sapiens
gcaaaugcuacaccauuuugua

SEQ ID NO: 103074 - RNA, 22 nt, Homo sapiens
gcaagaaucugggaguaaaauu

SEQ ID NO: 103075 - RNA, 22 nt, Homo sapiens
gcaagaguauuucaaggaagau

SEQ ID NO: 103076 - RNA, 22 nt, Homo sapiens
gcaagauuguguggcugaagua

SEQ ID NO: 103077 - RNA, 22 nt, Homo sapiens
gcaagugucugagguuuuguau

SEQ ID NO: 103078 - RNA, 22 nt, Homo sapiens
gcacaggguuacauucuaaggu

SEQ ID NO: 103079 - RNA, 22 nt, Homo sapiens
gcacaguaggugguaggacuuu

SEQ ID NO: 103080 - RNA, 22 nt, Homo sapiens
gcacauuacaaguauuagcuca

SEQ ID NO: 103081 - RNA, 22 nt, Homo sapiens
gcacccugucaaaauggaccaa

SEQ ID NO: 103082 - RNA, 22 nt, Homo sapiens
gcacuacugcacuccagucuag

SEQ ID NO: 103083 - RNA, 22 nt, Homo sapiens
gcacugagagaagccccaagua

SEQ ID NO: 103084 - RNA, 22 nt, Homo sapiens
gcacugggccacauuuauuuuc

SEQ ID NO: 103085 - RNA, 22 nt, Homo sapiens
gcagaucucuucauuucucuua

SEQ ID NO: 103086 - RNA, 22 nt, Homo sapiens
gcagaucuucgcgguaaguguu

SEQ ID NO: 103087 - RNA, 22 nt, Homo sapiens
gcagcacaugacuguauguaua

SEQ ID NO: 103088 - RNA, 22 nt, Homo sapiens
gcagcacauggcagaacauauu

SEQ ID NO: 103089 - RNA, 22 nt, Homo sapiens
gcagguauuagagagccugaaa

SEQ ID NO: 103090 - RNA, 20 nt, Homo sapiens
gcaguacuuuuaguucuaag

SEQ ID NO: 103091 - RNA, 22 nt, Homo sapiens
gcagucaucugaaggcuuaacu

SEQ ID NO: 103092 - RNA, 22 nt, Homo sapiens
gcagugugaucacagcuuacug

SEQ ID NO: 103093 - RNA, 19 nt, Homo sapiens
ugcagcaauguaaaagaca

SEQ ID NO: 103094 - RNA, 22 nt, Homo sapiens
ugcagcacaguagguuugcaau

SEQ ID NO: 103095 - RNA, 22 nt, Homo sapiens
ugcagcacugaacuucugggcu

SEQ ID NO: 103096 - RNA, 23 nt, Homo sapiens
ugcagcuacauguggccaugugc

SEQ ID NO: 103097 - RNA, 22 nt, Homo sapiens
ugcagcucagcugcggaguuuu

SEQ ID NO: 103098 - RNA, 22 nt, Homo sapiens
ugcagguaggcaguaucauuua

SEQ ID NO: 103099 - RNA, 22 nt, Homo sapiens
ugcaguacuuugaaauauacug

SEQ ID NO: 103100 - RNA, 22 nt, Homo sapiens
ugcagugcaugacuguguuaug

SEQ ID NO: 103101 - RNA, 22 nt, Homo sapiens
ugcagugucaauaauaauuagu

SEQ ID NO: 103102 - RNA, 22 nt, Homo sapiens
ugcaguguggcucacgccugua

SEQ ID NO: 103103 - RNA, 21 nt, Homo sapiens
ugcagugugguugcccugcug

SEQ ID NO: 103104 - RNA, 22 nt, Homo sapiens
ugcaguuuaggaacugguaaca

SEQ ID NO: 103105 - RNA, 22 nt, Homo sapiens
ugcauacacaagcauacaugua

SEQ ID NO: 103106 - RNA, 22 nt, Homo sapiens
ugcauacugaaauauuuuagag

SEQ ID NO: 103107 - RNA, 21 nt, Homo sapiens
ugcauacuucucagaugauua

SEQ ID NO: 103108 - RNA, 22 nt, Homo sapiens
ugcauagcaaaauaggauuaga

SEQ ID NO: 103109 - RNA, 22 nt, Homo sapiens
ugcauagcauauauuguagagu

SEQ ID NO: 103110 - RNA, 19 nt, Homo sapiens
ugcauaggguuacauacuc

SEQ ID NO: 103111 - RNA, 23 nt, Homo sapiens
ugcauaguacccaauacuuuauc

SEQ ID NO: 103112 - RNA, 21 nt, Homo sapiens
ugcauaucucuaaugaccagu

SEQ ID NO: 103113 - RNA, 22 nt, Homo sapiens
ugcauaucuucuuuugagaaau

SEQ ID NO: 103114 - RNA, 22 nt, Homo sapiens
ugcauaugcagcauuuaugauu

SEQ ID NO: 103115 - RNA, 22 nt, Homo sapiens
ugcauaugucuuuauagcagca

SEQ ID NO: 103116 - RNA, 22 nt, Homo sapiens
ugcauauguucaaaguauucug

SEQ ID NO: 103117 - RNA, 18 nt, Homo sapiens
ugcauauguugaaccagc

SEQ ID NO: 103118 - RNA, 21 nt, Homo sapiens
ugcauauuggaacuuucucuc

SEQ ID NO: 103119 - RNA, 22 nt, Homo sapiens
ugcaucaggcugcuuauuacaa

SEQ ID NO: 103120 - RNA, 21 nt, Homo sapiens
ugcauggagaacacugagggu

SEQ ID NO: 103121 - RNA, 22 nt, Homo sapiens
ugcauggauguuugaacacacu

SEQ ID NO: 103122 - RNA, 21 nt, Homo sapiens
ugcaugguagucacaugauuc

SEQ ID NO: 103123 - RNA, 22 nt, Homo sapiens
ugcauugcacuugcaugagaua

SEQ ID NO: 103124 - RNA, 21 nt, Homo sapiens
ugcauugucuugaguuuaaau

SEQ ID NO: 103125 - RNA, 20 nt, Homo sapiens
ugccaagaugacuauagcuc

SEQ ID NO: 103126 - RNA, 22 nt, Homo sapiens
ugccaagauuucaggaauuaag

SEQ ID NO: 103127 - RNA, 22 nt, Homo sapiens
ugccagagacguagggaauauu

SEQ ID NO: 103128 - RNA, 22 nt, Homo sapiens
ugccaguauuuuauugagcauu

SEQ ID NO: 103129 - RNA, 22 nt, Homo sapiens
ugccauagcaaugguaagcuga

SEQ ID NO: 103130 - RNA, 19 nt, Homo sapiens
ugccauguagcacaugguc

SEQ ID NO: 103131 - RNA, 22 nt, Homo sapiens
ugccauugcacuccagccuggg

SEQ ID NO: 103132 - RNA, 21 nt, Homo sapiens
ugcccaguggcuuggggucag

SEQ ID NO: 103133 - RNA, 22 nt, Homo sapiens
ugcccguaauuccagcacuuug

SEQ ID NO: 103134 - RNA, 22 nt, Homo sapiens
ugcccuguaucccacuguuuca

SEQ ID NO: 103135 - RNA, 22 nt, Homo sapiens
ugccuacagaaggggcucagca

SEQ ID NO: 103136 - RNA, 22 nt, Homo sapiens
ugccuacucucugccaggaaug

SEQ ID NO: 103137 - RNA, 22 nt, Homo sapiens
ugccuacuuugcaucugucagg

SEQ ID NO: 103138 - RNA, 22 nt, Homo sapiens
ugccuagagagaaccauaacug

SEQ ID NO: 103139 - RNA, 22 nt, Homo sapiens
ugccuaggcccaguccucagaa

SEQ ID NO: 103140 - RNA, 22 nt, Homo sapiens
ugccuaggcuggaaugcagugg

SEQ ID NO: 103141 - RNA, 22 nt, Homo sapiens
ugccuaguagaaggugaacaug

SEQ ID NO: 103142 - RNA, 22 nt, Homo sapiens
ugccuaguggccuuaugaguau

SEQ ID NO: 103143 - RNA, 22 nt, Homo sapiens
ugccugagccagguuuuaggag

SEQ ID NO: 103144 - RNA, 22 nt, Homo sapiens
ugccugcugucuaauauauucu

SEQ ID NO: 103145 - RNA, 21 nt, Homo sapiens
ugcuacugucacuuccuuugu

SEQ ID NO: 103146 - RNA, 22 nt, Homo sapiens
ugcuagaagaucacacacauca

SEQ ID NO: 103147 - RNA, 22 nt, Homo sapiens
ugcuagaugcuguagggauuua

SEQ ID NO: 103148 - RNA, 22 nt, Homo sapiens
uugcacauugcaccuuuuguau

SEQ ID NO: 103149 - RNA, 22 nt, Homo sapiens
uugcacucugaagaccuacugu

SEQ ID NO: 103150 - RNA, 22 nt, Homo sapiens
uugcacugagauuuugcuuaca

SEQ ID NO: 103151 - RNA, 22 nt, Homo sapiens
uugcacuguaauuuauuuaugu

SEQ ID NO: 103152 - RNA, 20 nt, Homo sapiens
uugcagagcccaacccugga

SEQ ID NO: 103153 - RNA, 22 nt, Homo sapiens
uugcagagucaguuauuuugcc

SEQ ID NO: 103154 - RNA, 22 nt, Homo sapiens
uugcagcaaagagggaggggca

SEQ ID NO: 103155 - RNA, 22 nt, Homo sapiens
uugcaggugguuuaugcaagac

SEQ ID NO: 103156 - RNA, 22 nt, Homo sapiens
uugcaguagucugaaagcaaua

SEQ ID NO: 103157 - RNA, 22 nt, Homo sapiens
uugcauaauaagagggauacgu

SEQ ID NO: 103158 - RNA, 22 nt, Homo sapiens
uugcauagacaauauuaaucuu

SEQ ID NO: 103159 - RNA, 22 nt, Homo sapiens
uugcauagaggugaguauagua

SEQ ID NO: 103160 - RNA, 18 nt, Homo sapiens
uugcauaguguauccaaa

SEQ ID NO: 103161 - RNA, 19 nt, Homo sapiens
uugcauauguugaaccagc

SEQ ID NO: 103162 - RNA, 22 nt, Homo sapiens
uugcaucagcuccugauguacu

SEQ ID NO: 103163 - RNA, 18 nt, Homo sapiens
uugcaucauuuuguuguu

SEQ ID NO: 103164 - RNA, 22 nt, Homo sapiens
uugcaugucugcuucuccuccu

SEQ ID NO: 103165 - RNA, 23 nt, Homo sapiens
uugcauugcccuccauaguacuc

SEQ ID NO: 103166 - RNA, 22 nt, Homo sapiens
uugcauuuucuaggagggcaaa

SEQ ID NO: 103167 - RNA, 22 nt, Homo sapiens
uugccauagugcugccagauau

SEQ ID NO: 103168 - RNA, 22 nt, Homo sapiens
uugccaucaucucuuacucagu

SEQ ID NO: 103169 - RNA, 22 nt, Homo sapiens
uugcccuuuagguaacuauaua

SEQ ID NO: 103170 - RNA, 22 nt, Homo sapiens
uugccuaggcuggaguucagug

SEQ ID NO: 103171 - RNA, 22 nt, Homo sapiens
uugccuaguuuaggucugugcu

SEQ ID NO: 103172 - RNA, 22 nt, Homo sapiens
uugccuauucacucugaugaua

SEQ ID NO: 103173 - RNA, 22 nt, Homo sapiens
uugccugagaagccaagaauaa

SEQ ID NO: 103174 - RNA, 22 nt, Homo sapiens
uugcgcuuuuccuauguugccc

SEQ ID NO: 103175 - RNA, 22 nt, Homo sapiens
uugcucaggcuggaguacaaug

SEQ ID NO: 103176 - RNA, 22 nt, Homo sapiens
uugcuuagucaugaaucacuga

SEQ ID NO: 103177 - RNA, 22 nt, Homo sapiens
uugcuuuguugucuggggaaua

SEQ ID NO: 103178 - RNA, 22 nt, Homo sapiens
uuggaacacauguuuuucuacc

SEQ ID NO: 103179 - RNA, 22 nt, Homo sapiens
uuggaacuguucguauugaaau

SEQ ID NO: 103180 - RNA, 22 nt, Homo sapiens
uuggaagauuacuuaguuuucu

SEQ ID NO: 103181 - RNA, 22 nt, Homo sapiens
uuggaaggcuccuaaugaaugg

SEQ ID NO: 103182 - RNA, 22 nt, Homo sapiens
gcagugugugaggaauuugggu

SEQ ID NO: 103183 - RNA, 17 nt, Homo sapiens
gcauaugucgaaccagc

SEQ ID NO: 103184 - RNA, 20 nt, Homo sapiens
gcauaugucuuuauagcaga

SEQ ID NO: 103185 - RNA, 20 nt, Homo sapiens
gcauaugucuuuauggcagc

SEQ ID NO: 103186 - RNA, 17 nt, Homo sapiens
gcauauguugaaccagc

SEQ ID NO: 103187 - RNA, 17 nt, Homo sapiens
gcauauguugaaccagu

SEQ ID NO: 103188 - RNA, 22 nt, Homo sapiens
gcauauguuuggguguguauau

SEQ ID NO: 103189 - RNA, 22 nt, Homo sapiens
gcaugaugaauaauaucacaag

SEQ ID NO: 103190 - RNA, 22 nt, Homo sapiens
gcauggaguggaaauucuuggg

SEQ ID NO: 103191 - RNA, 18 nt, Homo sapiens
gccaacauguaaacaggu

SEQ ID NO: 103192 - RNA, 22 nt, Homo sapiens
gccaagaucugaauaauuaaga

SEQ ID NO: 103193 - RNA, 22 nt, Homo sapiens
gccaagauugguuuaauauucc

SEQ ID NO: 103194 - RNA, 22 nt, Homo sapiens
gccaagauuuaauucaucaguu

SEQ ID NO: 103195 - RNA, 19 nt, Homo sapiens
gccaccuggugcguguucu

SEQ ID NO: 103196 - RNA, 22 nt, Homo sapiens
gccagauuguccaguuuuuuau

SEQ ID NO: 103197 - RNA, 22 nt, Homo sapiens
gccaguauuuuauugaggauuu

SEQ ID NO: 103198 - RNA, 22 nt, Homo sapiens
gccagugugaugugaucauggc

SEQ ID NO: 103199 - RNA, 22 nt, Homo sapiens
gccaguguguguuguucuccgc

SEQ ID NO: 103200 - RNA, 22 nt, Homo sapiens
gccaguguuuuauugagaauuu

SEQ ID NO: 103201 - RNA, 22 nt, Homo sapiens
gccauugcacuccgcccugggc

SEQ ID NO: 103202 - RNA, 22 nt, Homo sapiens
gccauugcacucuagccugagc

SEQ ID NO: 103203 - RNA, 22 nt, Homo sapiens
gcccuacuguuuauacauagga

SEQ ID NO: 103204 - RNA, 22 nt, Homo sapiens
gcccuguugcccaggcuggagu

SEQ ID NO: 103205 - RNA, 22 nt, Homo sapiens
gccgagagauuuggaaugggga

SEQ ID NO: 103206 - RNA, 22 nt, Homo sapiens
gccuagagaguuaucaggcugu

SEQ ID NO: 103207 - RNA, 19 nt, Homo sapiens
gcggcacuggagacacagc

SEQ ID NO: 103208 - RNA, 22 nt, Homo sapiens
gcgguuuuaagugaguuucuua

SEQ ID NO: 103209 - RNA, 22 nt, Homo sapiens
gcuaaggcagggcaaucauuug

SEQ ID NO: 103210 - RNA, 22 nt, Homo sapiens
gcuagcauucaaaugugcagcc

SEQ ID NO: 103211 - RNA, 23 nt, Homo sapiens
gcuaggagagaugaaacacaggu

SEQ ID NO: 103212 - RNA, 22 nt, Homo sapiens
gcuauggccugaauguuugugu

SEQ ID NO: 103213 - RNA, 22 nt, Homo sapiens
gcugauguuuucagguaauucu

SEQ ID NO: 103214 - RNA, 22 nt, Homo sapiens
gcugcacuuuaaggcauccccu

SEQ ID NO: 103215 - RNA, 22 nt, Homo sapiens
gcugcuguuauucaucagaacu

SEQ ID NO: 103216 - RNA, 22 nt, Homo sapiens
gcuggguugccagguuacuuaa

SEQ ID NO: 103217 - RNA, 22 nt, Homo sapiens
gcuggucugccguaguaggugc

SEQ ID NO: 103218 - RNA, 22 nt, Homo sapiens
gcuggugacuuuaaguugaagc

SEQ ID NO: 103219 - RNA, 22 nt, Homo sapiens
gcugguguugugaaucaggccg

SEQ ID NO: 103220 - RNA, 22 nt, Homo sapiens
gcuguaguugaggauuuuaaga

SEQ ID NO: 103221 - RNA, 20 nt, Homo sapiens
gcugugcuuaauacacuuuc

SEQ ID NO: 103222 - RNA, 22 nt, Homo sapiens
gcuguugguaaaaaggacauga

SEQ ID NO: 103223 - RNA, 18 nt, Homo sapiens
gcuguugucagagcacau

SEQ ID NO: 103224 - RNA, 22 nt, Homo sapiens
gcuguuugccgccaucgcagac

SEQ ID NO: 103225 - RNA, 22 nt, Homo sapiens
gcuucauggaggcugggcgcag

SEQ ID NO: 103226 - RNA, 19 nt, Homo sapiens
gcuuguccacgugagauaa

SEQ ID NO: 103227 - RNA, 22 nt, Homo sapiens
gcuuuguuaaaacacagccaca

SEQ ID NO: 103228 - RNA, 22 nt, Homo sapiens
gcuuuguuguugaugggaaauc

SEQ ID NO: 103229 - RNA, 22 nt, Homo sapiens
gcuuuugcaggaaaggaagaau

SEQ ID NO: 103230 - RNA, 22 nt, Homo sapiens
ggaaagaucagcuaaauguaag

SEQ ID NO: 103231 - RNA, 22 nt, Homo sapiens
ggaaagcuagguguggguguac

SEQ ID NO: 103232 - RNA, 22 nt, Homo sapiens
ggaaauguaaacaauggggcua

SEQ ID NO: 103233 - RNA, 19 nt, Homo sapiens
ggaaaugucuauuaagauc

SEQ ID NO: 103234 - RNA, 22 nt, Homo sapiens
ggaagagugaauuaucuugacu

SEQ ID NO: 103235 - RNA, 18 nt, Homo sapiens
ggaagauuggcuaugugc

SEQ ID NO: 103236 - RNA, 18 nt, Homo sapiens
ggaagccuauuuaguaac

SEQ ID NO: 103237 - RNA, 22 nt, Homo sapiens
ggaagguaauuggcuaaugaga

SEQ ID NO: 103238 - RNA, 22 nt, Homo sapiens
ggaagugugaguaggauuugga

SEQ ID NO: 103239 - RNA, 22 nt, Homo sapiens
ggaaguuaauacagauagagua

SEQ ID NO: 103240 - RNA, 22 nt, Homo sapiens
uugagauggaguucauuuuugu

SEQ ID NO: 103241 - RNA, 22 nt, Homo sapiens
uugagauggaguuucacucugu

SEQ ID NO: 103242 - RNA, 22 nt, Homo sapiens
uugagauggaguuuugcucuug

SEQ ID NO: 103243 - RNA, 22 nt, Homo sapiens
uugagauggauagacauagcau

SEQ ID NO: 103244 - RNA, 22 nt, Homo sapiens
uugagauguauguauauaaugu

SEQ ID NO: 103245 - RNA, 22 nt, Homo sapiens
uugagcaaugucacugaggcuu

SEQ ID NO: 103246 - RNA, 22 nt, Homo sapiens
uugagcaccaugccuggccaug

SEQ ID NO: 103247 - RNA, 22 nt, Homo sapiens
uugagccaaggauugucuuucc

SEQ ID NO: 103248 - RNA, 22 nt, Homo sapiens
uugaggacugagacagaccaag

SEQ ID NO: 103249 - RNA, 22 nt, Homo sapiens
uugaggaggcagucuucccauu

SEQ ID NO: 103250 - RNA, 22 nt, Homo sapiens
uugagggagcauuuguuuugag

SEQ ID NO: 103251 - RNA, 22 nt, Homo sapiens
uugagggagccuguuagucccg

SEQ ID NO: 103252 - RNA, 22 nt, Homo sapiens
uugagguaauaaacagccauuc

SEQ ID NO: 103253 - RNA, 22 nt, Homo sapiens
guuguauaggcauggggagaau

SEQ ID NO: 103254 - RNA, 22 nt, Homo sapiens
guuuaggaaugagaauauuuag

SEQ ID NO: 103255 - RNA, 22 nt, Homo sapiens
guuugcagaucaugaagaaccc

SEQ ID NO: 103256 - RNA, 22 nt, Homo sapiens
guuugcauagugcugggagggg

SEQ ID NO: 103257 - RNA, 22 nt, Homo sapiens
guuuggauuuucuaauuucugu

SEQ ID NO: 103258 - RNA, 22 nt, Homo sapiens
guuuggcucuuguuucugucaa

SEQ ID NO: 103259 - RNA, 17 nt, Homo sapiens
guuuggguacuggguaa

SEQ ID NO: 103260 - RNA, 22 nt, Homo sapiens
guuugguugcauggaaaauuua

SEQ ID NO: 103261 - RNA, 22 nt, Homo sapiens
guuugugguuaaagccuuucau

SEQ ID NO: 103262 - RNA, 22 nt, Homo sapiens
guuuugguuauauggaucaguu

SEQ ID NO: 103263 - RNA, 22 nt, Homo sapiens
uaaacugucuugcaguuacaug

SEQ ID NO: 103264 - RNA, 22 nt, Homo sapiens
uaaacugucuuuggagcuuugc

SEQ ID NO: 103265 - RNA, 22 nt, Homo sapiens
uaaagccagugauuaugucucu

SEQ ID NO: 103266 - RNA, 22 nt, Homo sapiens
uaaagcgaggucuccuacaaga

SEQ ID NO: 103267 - RNA, 16 nt, Homo sapiens
uaaagcuaaucacuuu

SEQ ID NO: 103268 - RNA, 22 nt, Homo sapiens
uaaagcuaucacauuggugauu

SEQ ID NO: 103269 - RNA, 22 nt, Homo sapiens
uaaagcuaugagaacaccguag

SEQ ID NO: 103270 - RNA, 21 nt, Homo sapiens
uaaagcuuagcuauaguggcu

SEQ ID NO: 103271 - RNA, 22 nt, Homo sapiens
uaaaguuauugccccucaguua

SEQ ID NO: 103272 - RNA, 21 nt, Homo sapiens
uaaaugucauacaaagcaaug

SEQ ID NO: 103273 - RNA, 22 nt, Homo sapiens
uaaauugcauaaguacaaauga

SEQ ID NO: 103274 - RNA, 22 nt, Homo sapiens
uaacaacauucuaacugacggc

SEQ ID NO: 103275 - RNA, 22 nt, Homo sapiens
uaacacagagcuccuaaucccu

SEQ ID NO: 103276 - RNA, 19 nt, Homo sapiens
uaacacaguuguguuugag

SEQ ID NO: 103277 - RNA, 22 nt, Homo sapiens
uaacacccuucuccagguacau

SEQ ID NO: 103278 - RNA, 22 nt, Homo sapiens
uaacagucuccucaagguguug

SEQ ID NO: 103279 - RNA, 22 nt, Homo sapiens
uaacaguguauuccuuuggaca

SEQ ID NO: 103280 - RNA, 22 nt, Homo sapiens
uaacaguguauuuacuacuucc

SEQ ID NO: 103281 - RNA, 22 nt, Homo sapiens
uaacauucacaugcugcaaaaa

SEQ ID NO: 103282 - RNA, 23 nt, Homo sapiens
uaacauugcaugauuaccugcau

SEQ ID NO: 103283 - RNA, 22 nt, Homo sapiens
uaacccuuaguaucuguggguu

SEQ ID NO: 103284 - RNA, 22 nt, Homo sapiens
uaacuaaagagaagucaauguc

SEQ ID NO: 103285 - RNA, 22 nt, Homo sapiens
uaacuaguggaauuugauuuca

SEQ ID NO: 103286 - RNA, 22 nt, Homo sapiens
uaacuccauuuggacucaguau

SEQ ID NO: 103287 - RNA, 18 nt, Homo sapiens
uaacuggugugagauggu

SEQ ID NO: 103288 - RNA, 22 nt, Homo sapiens
uaacugucucaggccaugggcg

SEQ ID NO: 103289 - RNA, 20 nt, Homo sapiens
uaagacaugguccacaugcc

SEQ ID NO: 103290 - RNA, 22 nt, Homo sapiens
uaagacugccccagacagcaag

SEQ ID NO: 103291 - RNA, 22 nt, Homo sapiens
uaagacuguguaauuuaugaag

SEQ ID NO: 103292 - RNA, 19 nt, Homo sapiens
uaagaugaagcugucuggg

SEQ ID NO: 103293 - RNA, 20 nt, Homo sapiens
uaagcauaguugucaggguc

SEQ ID NO: 103294 - RNA, 22 nt, Homo sapiens
uaagccaccgugccuggccuaa

SEQ ID NO: 103295 - RNA, 22 nt, Homo sapiens
uaagcuaauguguuuucucuua

SEQ ID NO: 103296 - RNA, 22 nt, Homo sapiens
uaagcuauagugaauaaauugc

SEQ ID NO: 103297 - RNA, 22 nt, Homo sapiens
uaaggcacauaggccuggaaac

SEQ ID NO: 103298 - RNA, 22 nt, Homo sapiens
uaaggcacucuucugugugccu

SEQ ID NO: 103299 - RNA, 22 nt, Homo sapiens
uaaggcauuuuuuugaguugca

SEQ ID NO: 103300 - RNA, 22 nt, Homo sapiens
uaaggcucuuguuauuuugagg

SEQ ID NO: 103301 - RNA, 22 nt, Homo sapiens
uaaggcuuaugguaaaguccug

SEQ ID NO: 103302 - RNA, 22 nt, Homo sapiens
uaaggcuugcuucagucuugaa

SEQ ID NO: 103303 - RNA, 22 nt, Homo sapiens
uaaggcuuugguagguuugguc

SEQ ID NO: 103304 - RNA, 22 nt, Homo sapiens
uaagguauuuacauuucuguuu

SEQ ID NO: 103305 - RNA, 22 nt, Homo sapiens
uaaguaauuguuaauagggaag

SEQ ID NO: 103306 - RNA, 22 nt, Homo sapiens
uaaguacuuuacagacauuauc

SEQ ID NO: 103307 - RNA, 22 nt, Homo sapiens
uaaguagaggaaucauuuugug

SEQ ID NO: 103308 - RNA, 19 nt, Homo sapiens
uaaguagaugacugaugcu

SEQ ID NO: 103309 - RNA, 22 nt, Homo sapiens
uaaguaguguugagacaaguuu

SEQ ID NO: 103310 - RNA, 22 nt, Homo sapiens
uaaguaguuuucuuggaggcga

SEQ ID NO: 103311 - RNA, 22 nt, Homo sapiens
uaaguaucaguuuagcuaugau

SEQ ID NO: 103312 - RNA, 22 nt, Homo sapiens
uaagucacuccagguuaaagug

SEQ ID NO: 103313 - RNA, 22 nt, Homo sapiens
uaagucguggaugauucuucgg

SEQ ID NO: 103314 - RNA, 22 nt, Homo sapiens
uaagugaaggaaguguguuuac

SEQ ID NO: 103315 - RNA, 22 nt, Homo sapiens
uaagugaauuucacuacugagu

SEQ ID NO: 103316 - RNA, 22 nt, Homo sapiens
uaagugaugucuuuuugugugc

SEQ ID NO: 103317 - RNA, 23 nt, Homo sapiens
uaaguucaucucuaauaggugga

SEQ ID NO: 103318 - RNA, 22 nt, Homo sapiens
uaaguugcagguugugauucca

SEQ ID NO: 103319 - RNA, 22 nt, Homo sapiens
uaaguuguagaacguuuucuua

SEQ ID NO: 103320 - RNA, 18 nt, Homo sapiens
uaauaacugugaccuuga

SEQ ID NO: 103321 - RNA, 22 nt, Homo sapiens
uaauacugcugugcuugaguug

SEQ ID NO: 103322 - RNA, 22 nt, Homo sapiens
uaauagcaguguuacuaggacu

SEQ ID NO: 103323 - RNA, 22 nt, Homo sapiens
uaauagcucggauaaacaugau

SEQ ID NO: 103324 - RNA, 22 nt, Homo sapiens
uaauaguguuaaugcuagagcu

SEQ ID NO: 103325 - RNA, 22 nt, Homo sapiens
uaauaguuucagaaguuguuuu

SEQ ID NO: 103326 - RNA, 22 nt, Homo sapiens
uaauauguauacagacagauac

SEQ ID NO: 103327 - RNA, 22 nt, Homo sapiens
uaauccuagcacuuuggaagac

SEQ ID NO: 103328 - RNA, 22 nt, Homo sapiens
uaaucucagcuacucaggaggc

SEQ ID NO: 103329 - RNA, 22 nt, Homo sapiens
uaaugcaucaugguuggcaaac

SEQ ID NO: 103330 - RNA, 22 nt, Homo sapiens
uaaugcuguggucuaaugggga

SEQ ID NO: 103331 - RNA, 19 nt, Homo sapiens
ugccaagaaagucagcuua

SEQ ID NO: 103332 - RNA, 22 nt, Homo sapiens
ugccagaugcaguguucaacaa

SEQ ID NO: 103333 - RNA, 22 nt, Homo sapiens
ugccagaugcuggugugagggg

SEQ ID NO: 103334 - RNA, 22 nt, Homo sapiens
ugccaggaugaggucaauguuu

SEQ ID NO: 103335 - RNA, 20 nt, Homo sapiens
ugccagugugucaauuuaua

SEQ ID NO: 103336 - RNA, 22 nt, Homo sapiens
ugccaguguuuuguugaagauu

SEQ ID NO: 103337 - RNA, 22 nt, Homo sapiens
ugccauagagacucaacagccu

SEQ ID NO: 103338 - RNA, 22 nt, Homo sapiens
ugccauagagauuuguggaacu

SEQ ID NO: 103339 - RNA, 22 nt, Homo sapiens
ugccaugaaguaauggcaaaaa

SEQ ID NO: 103340 - RNA, 22 nt, Homo sapiens
ugcccaguggacagaaagucau

SEQ ID NO: 103341 - RNA, 22 nt, Homo sapiens
ugccuacugaauuuaccuggcu

SEQ ID NO: 103342 - RNA, 22 nt, Homo sapiens
ugccuaggcuggaaugcaaugg

SEQ ID NO: 103343 - RNA, 22 nt, Homo sapiens
ugccuaguggaaggagagcaaa

SEQ ID NO: 103344 - RNA, 22 nt, Homo sapiens
ugccuuauuccaacugagcucu

SEQ ID NO: 103345 - RNA, 16 nt, Homo sapiens
ugccuuauuccagcuc

SEQ ID NO: 103346 - RNA, 16 nt, Homo sapiens
ugccuucuucuguauu

SEQ ID NO: 103347 - RNA, 21 nt, Homo sapiens
ugccuuuguaguaggugucuu

SEQ ID NO: 103348 - RNA, 22 nt, Homo sapiens
ugcgccauugcacuccagucuu

SEQ ID NO: 103349 - RNA, 22 nt, Homo sapiens
ugcguaggcuagagugcagugg

SEQ ID NO: 103350 - RNA, 22 nt, Homo sapiens
ugcuaugucuucucucacagag

SEQ ID NO: 103351 - RNA, 23 nt, Homo sapiens
ugcugagaccuagauccuaaaga

SEQ ID NO: 103352 - RNA, 22 nt, Homo sapiens
ugcugcuguuaucauuuuacca

SEQ ID NO: 103353 - RNA, 22 nt, Homo sapiens
ugcugguaguuuaugacuaauu

SEQ ID NO: 103354 - RNA, 22 nt, Homo sapiens
ugcugguauuuggaccagccug

SEQ ID NO: 103355 - RNA, 22 nt, Homo sapiens
ugcuggugauucagauucaaau

SEQ ID NO: 103356 - RNA, 22 nt, Homo sapiens
ugcuggugucaucaaggcuuug

SEQ ID NO: 103357 - RNA, 22 nt, Homo sapiens
ugcugguguggucuagccgcuu

SEQ ID NO: 103358 - RNA, 22 nt, Homo sapiens
ugcugguguuuaggaauaagaa

SEQ ID NO: 103359 - RNA, 22 nt, Homo sapiens
ugcugguuuaaaaugcaaauuc

SEQ ID NO: 103360 - RNA, 22 nt, Homo sapiens
ugcuguuguuugaugaaguaau

SEQ ID NO: 103361 - RNA, 21 nt, Homo sapiens
ugcuuacugaauguuaauuuc

SEQ ID NO: 103362 - RNA, 22 nt, Homo sapiens
ugcuuaggcuaacaaaaauagc

SEQ ID NO: 103363 - RNA, 22 nt, Homo sapiens
ugcuuagucuugcuuuagcuau

SEQ ID NO: 103364 - RNA, 22 nt, Homo sapiens
ugcuuaguguugacccucugcc

SEQ ID NO: 103365 - RNA, 21 nt, Homo sapiens
ugcuuuggucauacuucuucc

SEQ ID NO: 103366 - RNA, 22 nt, Homo sapiens
uggaaacuuauguucuucugug

SEQ ID NO: 103367 - RNA, 20 nt, Homo sapiens
uggaaaguaagucaugauau

SEQ ID NO: 103368 - RNA, 22 nt, Homo sapiens
uggaaauaaaauagaguuugcc

SEQ ID NO: 103369 - RNA, 22 nt, Homo sapiens
uggaaauaaaugugccaagauc

SEQ ID NO: 103370 - RNA, 22 nt, Homo sapiens
uggaacugauauugauggaaaa

SEQ ID NO: 103371 - RNA, 22 nt, Homo sapiens
uggaagacaggcuguauuuuaa

SEQ ID NO: 103372 - RNA, 23 nt, Homo sapiens
uggaagacuccucucuuggcugc

SEQ ID NO: 103373 - RNA, 22 nt, Homo sapiens
uggaagacucuagucucuugag

SEQ ID NO: 103374 - RNA, 22 nt, Homo sapiens
uggaagcauagcagcgugugug

SEQ ID NO: 103375 - RNA, 22 nt, Homo sapiens
uggaagccuagauucuuuucuu

SEQ ID NO: 103376 - RNA, 22 nt, Homo sapiens
uggaaggcuucauauguaaaga

SEQ ID NO: 103377 - RNA, 22 nt, Homo sapiens
uggaagguaaguuuugagcauu

SEQ ID NO: 103378 - RNA, 20 nt, Homo sapiens
uggaaguaagaauauaggug

SEQ ID NO: 103379 - RNA, 22 nt, Homo sapiens
uuacagucaccugggggacaua

SEQ ID NO: 103380 - RNA, 22 nt, Homo sapiens
uuacagucucaagagugcugca

SEQ ID NO: 103381 - RNA, 22 nt, Homo sapiens
uuacaguguuuguucuguuacu

SEQ ID NO: 103382 - RNA, 22 nt, Homo sapiens
uuacaguucugguggagaggua

SEQ ID NO: 103383 - RNA, 22 nt, Homo sapiens
uuacaugucuugguaagguuag

SEQ ID NO: 103384 - RNA, 22 nt, Homo sapiens
uuacauguggugugaagaagag

SEQ ID NO: 103385 - RNA, 22 nt, Homo sapiens
uuacccauuagagaauuuaaga

SEQ ID NO: 103386 - RNA, 22 nt, Homo sapiens
uuacccuuuaacccuuuaaagu

SEQ ID NO: 103387 - RNA, 22 nt, Homo sapiens
uuaccucuguggcucucggacu

SEQ ID NO: 103388 - RNA, 22 nt, Homo sapiens
uuaccuuuuuaagacagguuag

SEQ ID NO: 103389 - RNA, 22 nt, Homo sapiens
uuacuagaaacagggcuucgcc

SEQ ID NO: 103390 - RNA, 22 nt, Homo sapiens
uuacuguagugucauaucguau

SEQ ID NO: 103391 - RNA, 22 nt, Homo sapiens
uuacuugagaugaguuggacaa

SEQ ID NO: 103392 - RNA, 22 nt, Homo sapiens
uuacuugagauggggugucacu

SEQ ID NO: 103393 - RNA, 22 nt, Homo sapiens
uuagacaguggugcacugcacu

SEQ ID NO: 103394 - RNA, 22 nt, Homo sapiens
uuagagcacugaucugcucuuu

SEQ ID NO: 103395 - RNA, 22 nt, Homo sapiens
uuagaguacaggggaaucaagg

SEQ ID NO: 103396 - RNA, 22 nt, Homo sapiens
uuagaugaaugucucuuaaaca

SEQ ID NO: 103397 - RNA, 18 nt, Homo sapiens
uuagaugguuuuaaaacu

SEQ ID NO: 103398 - RNA, 22 nt, Homo sapiens
uuagauguuugacugggccuua

SEQ ID NO: 103399 - RNA, 22 nt, Homo sapiens
uuagcacaucuuucuauguaag

SEQ ID NO: 103400 - RNA, 22 nt, Homo sapiens
uuagcacuaauucguuggggca

SEQ ID NO: 103401 - RNA, 22 nt, Homo sapiens
uuagcacugagaauggcuugcu

SEQ ID NO: 103402 - RNA, 22 nt, Homo sapiens
uuagcaguggauggguggagaa

SEQ ID NO: 103403 - RNA, 22 nt, Homo sapiens
uuagcagugugagcacagacua

SEQ ID NO: 103404 - RNA, 21 nt, Homo sapiens
uuagcauccauguucaucaac

SEQ ID NO: 103405 - RNA, 21 nt, Homo sapiens
uuagccuguaagcacuuugca

SEQ ID NO: 103406 - RNA, 22 nt, Homo sapiens
uuaggagacuggauaucucuuu

SEQ ID NO: 103407 - RNA, 22 nt, Homo sapiens
uuaggaucacagaaaauccucu

SEQ ID NO: 103408 - RNA, 22 nt, Homo sapiens
uuaggcaaugcucucaaauuug

SEQ ID NO: 103409 - RNA, 22 nt, Homo sapiens
uuaggcaggauaguuacauauu

SEQ ID NO: 103410 - RNA, 16 nt, Homo sapiens
uuaggcagugugauac

SEQ ID NO: 103411 - RNA, 22 nt, Homo sapiens
uuaggcuaguugauauaguuug

SEQ ID NO: 103412 - RNA, 22 nt, Homo sapiens
uuaggcuuuuuaaccaguuguu

SEQ ID NO: 103413 - RNA, 22 nt, Homo sapiens
uuagggaggacaguuacaacag

SEQ ID NO: 103414 - RNA, 22 nt, Homo sapiens
uuagggcaggcaugagagaacu

SEQ ID NO: 103415 - RNA, 22 nt, Homo sapiens
uuagguagaauugauuaaguuu

SEQ ID NO: 103416 - RNA, 22 nt, Homo sapiens
uuaguaguagcugcaugucagu

SEQ ID NO: 103417 - RNA, 22 nt, Homo sapiens
uuaguggaugcugaauaaagaa

SEQ ID NO: 103418 - RNA, 22 nt, Homo sapiens
uuauacuacuauaaagagguag

SEQ ID NO: 103419 - RNA, 22 nt, Homo sapiens
uuauagcagugcaggaacagac

SEQ ID NO: 103420 - RNA, 22 nt, Homo sapiens
uuauagcagugcccaacuccug

SEQ ID NO: 103421 - RNA, 22 nt, Homo sapiens
uuauagcuaacaucugugaaaa

SEQ ID NO: 103422 - RNA, 22 nt, Homo sapiens
uuauaggcaggugguguagaug

SEQ ID NO: 103423 - RNA, 22 nt, Homo sapiens
uuauauguuucuuagggacaga

SEQ ID NO: 103424 - RNA, 22 nt, Homo sapiens
uuaucaaacccuaggagguggu

SEQ ID NO: 103425 - RNA, 21 nt, Homo sapiens
uuauccagcacuguuucggac

SEQ ID NO: 103426 - RNA, 21 nt, Homo sapiens
uuaucccagugucucugcagg

SEQ ID NO: 103427 - RNA, 22 nt, Homo sapiens
uuauccugucaguaaauauuuu

SEQ ID NO: 103428 - RNA, 22 nt, Homo sapiens
uuaugacauugacaguuuuuag

SEQ ID NO: 103429 - RNA, 22 nt, Homo sapiens
uuaugcagcaaagugcuugaaa

SEQ ID NO: 103430 - RNA, 22 nt, Homo sapiens
uuaugggucuuggaaugcaaua

SEQ ID NO: 103431 - RNA, 22 nt, Homo sapiens
uuauguaggcuauagcucugca

SEQ ID NO: 103432 - RNA, 22 nt, Homo sapiens
uuauuagguugguggaaaagua

SEQ ID NO: 103433 - RNA, 22 nt, Homo sapiens
uuauugcacuccagccugggua

SEQ ID NO: 103434 - RNA, 17 nt, Homo sapiens
uuauugcuauaagcuga

SEQ ID NO: 103435 - RNA, 22 nt, Homo sapiens
uuauugcucauuugggcauucu

SEQ ID NO: 103436 - RNA, 22 nt, Homo sapiens
uuauugcuccagaggcugauuu

SEQ ID NO: 103437 - RNA, 22 nt, Homo sapiens
uucaaaaccucugcuuaagccc

SEQ ID NO: 103438 - RNA, 22 nt, Homo sapiens
uucaaaguaaaaauguguucac

SEQ ID NO: 103439 - RNA, 22 nt, Homo sapiens
uucaaaguaaagggauggagac

SEQ ID NO: 103440 - RNA, 22 nt, Homo sapiens
uucaaaguuggaggacaaacug

SEQ ID NO: 103441 - RNA, 22 nt, Homo sapiens
uucaacugcuucagccucccaa

SEQ ID NO: 103442 - RNA, 22 nt, Homo sapiens
uucaaggacuaaggauuuuugg

SEQ ID NO: 103443 - RNA, 22 nt, Homo sapiens
uucaaguaagaaagacaucagg

SEQ ID NO: 103444 - RNA, 22 nt, Homo sapiens
uucaaguaguucucaugccuca

SEQ ID NO: 103445 - RNA, 22 nt, Homo sapiens
uucaagucuuggcuuugccacc

SEQ ID NO: 103446 - RNA, 22 nt, Homo sapiens
uucaaguguucaggagcuacag

SEQ ID NO: 103447 - RNA, 22 nt, Homo sapiens
uucacaaugccuuguugauggu

SEQ ID NO: 103448 - RNA, 22 nt, Homo sapiens
uucacacugggccuacucugug

SEQ ID NO: 103449 - RNA, 22 nt, Homo sapiens
uucacagacaacuggucccuua

SEQ ID NO: 103450 - RNA, 22 nt, Homo sapiens
uucacagagagaacucaaacca

SEQ ID NO: 103451 - RNA, 22 nt, Homo sapiens
uucacaguacucccuggaauua

SEQ ID NO: 103452 - RNA, 22 nt, Homo sapiens
uucacagugugaucuaugggca

SEQ ID NO: 103453 - RNA, 22 nt, Homo sapiens
uucacaguguuucucacgguua

SEQ ID NO: 103454 - RNA, 22 nt, Homo sapiens
uucaccaguuuugucacgaaug

SEQ ID NO: 103455 - RNA, 22 nt, Homo sapiens
uucacgguguucacgggggucc

SEQ ID NO: 103456 - RNA, 22 nt, Homo sapiens
uucacugagccagacuaagaca

SEQ ID NO: 103457 - RNA, 22 nt, Homo sapiens
uucacugcauuucagccugggc

SEQ ID NO: 103458 - RNA, 22 nt, Homo sapiens
uucacugggugugguggcucac

SEQ ID NO: 103459 - RNA, 22 nt, Homo sapiens
uucacuguaaaaugaagagggu

SEQ ID NO: 103460 - RNA, 22 nt, Homo sapiens
uucacuguagccucagccucuu

SEQ ID NO: 103461 - RNA, 22 nt, Homo sapiens
uucagagcauugguuuuuugaa

SEQ ID NO: 103462 - RNA, 20 nt, Homo sapiens
uucagcaaaggaaugggagu

SEQ ID NO: 103463 - RNA, 22 nt, Homo sapiens
uucagcaggccaggcccugacu

SEQ ID NO: 103464 - RNA, 22 nt, Homo sapiens
uucagcaguggccaguggaaau

SEQ ID NO: 103465 - RNA, 22 nt, Homo sapiens
uucagcuaccugggaugcugaa

SEQ ID NO: 103466 - RNA, 22 nt, Homo sapiens
uucaggcuccgugccagcuccg

SEQ ID NO: 103467 - RNA, 22 nt, Homo sapiens
uucaguaaauguucuuacuaua

SEQ ID NO: 103468 - RNA, 22 nt, Homo sapiens
uucaguaguaaguuggaacucu

SEQ ID NO: 103469 - RNA, 22 nt, Homo sapiens
uggcaagagcaaaauguacagu

SEQ ID NO: 103470 - RNA, 23 nt, Homo sapiens
uggcaagauuuguauugccugga

SEQ ID NO: 103471 - RNA, 22 nt, Homo sapiens
uggcaauaaaaugcaguuacuu

SEQ ID NO: 103472 - RNA, 18 nt, Homo sapiens
uggcaauaugguucuacc

SEQ ID NO: 103473 - RNA, 20 nt, Homo sapiens
uggcaccugacagauagcca

SEQ ID NO: 103474 - RNA, 22 nt, Homo sapiens
uggcagauagaaaugugguuaa

SEQ ID NO: 103475 - RNA, 22 nt, Homo sapiens
uggcagauaggauacaggacua

SEQ ID NO: 103476 - RNA, 22 nt, Homo sapiens
uggcagaugcucuuggugccca

SEQ ID NO: 103477 - RNA, 22 nt, Homo sapiens
uggcagcgcaguugaaaaagaa

SEQ ID NO: 103478 - RNA, 22 nt, Homo sapiens
uggcagcugcuucaugggaugc

SEQ ID NO: 103479 - RNA, 22 nt, Homo sapiens
uggcaguuuacagcuuuaggag

SEQ ID NO: 103480 - RNA, 22 nt, Homo sapiens
uggcaguuucauaugguucaac

SEQ ID NO: 103481 - RNA, 22 nt, Homo sapiens
uggcaguuuuaugugguucaac

SEQ ID NO: 103482 - RNA, 22 nt, Homo sapiens
uggcauauaauauagaagacua

SEQ ID NO: 103483 - RNA, 22 nt, Homo sapiens
uggcaucuguucuacacauaaa

SEQ ID NO: 103484 - RNA, 22 nt, Homo sapiens
uggcaugaagaccccauccuuu

SEQ ID NO: 103485 - RNA, 19 nt, Homo sapiens
uggcaugaaugugaacuaa

SEQ ID NO: 103486 - RNA, 22 nt, Homo sapiens
uggcaugauauauauucguuug

SEQ ID NO: 103487 - RNA, 22 nt, Homo sapiens
uggcaugauguguucauugaaa

SEQ ID NO: 103488 - RNA, 22 nt, Homo sapiens
uggcaugcauuguggguaauua

SEQ ID NO: 103489 - RNA, 22 nt, Homo sapiens
uggcauggaaagcuuuucauac

SEQ ID NO: 103490 - RNA, 22 nt, Homo sapiens
uggcauggaacuacuuugaaac

SEQ ID NO: 103491 - RNA, 22 nt, Homo sapiens
uggcauguuggguguugacucc

SEQ ID NO: 103492 - RNA, 20 nt, Homo sapiens
uggcauguugguaugcaccc

SEQ ID NO: 103493 - RNA, 22 nt, Homo sapiens
uggcauuuugugugaauuagaa

SEQ ID NO: 103494 - RNA, 23 nt, Homo sapiens
uggcauuuuuggcaaugccuucu

SEQ ID NO: 103495 - RNA, 22 nt, Homo sapiens
uggcccccucccaaaucucaua

SEQ ID NO: 103496 - RNA, 22 nt, Homo sapiens
uggccuguaacgcugucucagc

SEQ ID NO: 103497 - RNA, 22 nt, Homo sapiens
uggcgagaugcucgugugcaga

SEQ ID NO: 103498 - RNA, 22 nt, Homo sapiens
uggcggagacauggacuucaga

SEQ ID NO: 103499 - RNA, 22 nt, Homo sapiens
uggcuacuguacuugagcuauu

SEQ ID NO: 103500 - RNA, 22 nt, Homo sapiens
uggcuagaccugcauaacagcu

SEQ ID NO: 103501 - RNA, 22 nt, Homo sapiens
uggcucauuucuaaacccagcu

SEQ ID NO: 103502 - RNA, 22 nt, Homo sapiens
uggcuguuuauuucacgugggu

SEQ ID NO: 103503 - RNA, 21 nt, Homo sapiens
uggcuguuuucaugcuagaac

SEQ ID NO: 103504 - RNA, 21 nt, Homo sapiens
uggcuuauuugaaucuggcuu

SEQ ID NO: 103505 - RNA, 22 nt, Homo sapiens
uggcuuucuggggcuucuguuc

SEQ ID NO: 103506 - RNA, 22 nt, Homo sapiens
uggcuuuuguuauuuggaagcu

SEQ ID NO: 103507 - RNA, 22 nt, Homo sapiens
ugggaaauguagccuagcugug

SEQ ID NO: 103508 - RNA, 20 nt, Homo sapiens
ugggaaauguccaggacaua

SEQ ID NO: 103509 - RNA, 22 nt, Homo sapiens
ugggaacugaggugaaaagaca

SEQ ID NO: 103510 - RNA, 22 nt, Homo sapiens
ugggaagaagguuuacuugcca

SEQ ID NO: 103511 - RNA, 22 nt, Homo sapiens
uucaguaguacauucccguguu

SEQ ID NO: 103512 - RNA, 22 nt, Homo sapiens
uucaguccauuuccuuggucac

SEQ ID NO: 103513 - RNA, 22 nt, Homo sapiens
uucaguucugcacugaucuuag

SEQ ID NO: 103514 - RNA, 22 nt, Homo sapiens
uucaguugcaucaguugaccag

SEQ ID NO: 103515 - RNA, 21 nt, Homo sapiens
uucauaaggcuucucuccugu

SEQ ID NO: 103516 - RNA, 22 nt, Homo sapiens
uucauaguguuuccuuccagug

SEQ ID NO: 103517 - RNA, 22 nt, Homo sapiens
uucaucuggcaauucagagauu

SEQ ID NO: 103518 - RNA, 22 nt, Homo sapiens
uucaugcaucuguagugguuaa

SEQ ID NO: 103519 - RNA, 22 nt, Homo sapiens
uucauggaacaaguggguucaa

SEQ ID NO: 103520 - RNA, 22 nt, Homo sapiens
uucauggacucaauaguuucgc

SEQ ID NO: 103521 - RNA, 22 nt, Homo sapiens
uucauggauggaaaugauuuug

SEQ ID NO: 103522 - RNA, 22 nt, Homo sapiens
uucaugugagucuguauuaacu

SEQ ID NO: 103523 - RNA, 22 nt, Homo sapiens
uucauuggacuuguguucuuga

SEQ ID NO: 103524 - RNA, 22 nt, Homo sapiens
uuccaauguuccguguugcagu

SEQ ID NO: 103525 - RNA, 22 nt, Homo sapiens
uuccacaaugguugaacuaauu

SEQ ID NO: 103526 - RNA, 22 nt, Homo sapiens
uuccacaaugguugaacuagcu

SEQ ID NO: 103527 - RNA, 22 nt, Homo sapiens
uuccacgugaaguauucuaaag

SEQ ID NO: 103528 - RNA, 22 nt, Homo sapiens
uuccacuuuuuccuugugcucc

SEQ ID NO: 103529 - RNA, 20 nt, Homo sapiens
uuccagcacauuagggaagc

SEQ ID NO: 103530 - RNA, 22 nt, Homo sapiens
uuccaguaauagcacagcauug

SEQ ID NO: 103531 - RNA, 22 nt, Homo sapiens
uuccaguauuugggcaagcgca

SEQ ID NO: 103532 - RNA, 22 nt, Homo sapiens
uuccaguuauuauaccucuuaa

SEQ ID NO: 103533 - RNA, 22 nt, Homo sapiens
uuccaguugugagcuauccggg

SEQ ID NO: 103534 - RNA, 22 nt, Homo sapiens
uuccaugagaugcaucaaagcu

SEQ ID NO: 103535 - RNA, 22 nt, Homo sapiens
uuccauguaguugagcaguuuu

SEQ ID NO: 103536 - RNA, 22 nt, Homo sapiens
uucccguugcugugcuccugcc

SEQ ID NO: 103537 - RNA, 22 nt, Homo sapiens
uucccucagaaacacacagccc

SEQ ID NO: 103538 - RNA, 22 nt, Homo sapiens
uucccugaaguguuacucuaga

SEQ ID NO: 103539 - RNA, 22 nt, Homo sapiens
uucccugagcaucuguugagcc

SEQ ID NO: 103540 - RNA, 22 nt, Homo sapiens
uucccuguaucuucugccaugu

SEQ ID NO: 103541 - RNA, 22 nt, Homo sapiens
uucccuuuguuaaauuggaaga

SEQ ID NO: 103542 - RNA, 22 nt, Homo sapiens
uuccuacugcccauuaaaaugg

SEQ ID NO: 103543 - RNA, 22 nt, Homo sapiens
uuccuacugugcaaaguugcaa

SEQ ID NO: 103544 - RNA, 22 nt, Homo sapiens
uuccuagagauuagcaagcugc

SEQ ID NO: 103545 - RNA, 19 nt, Homo sapiens
uuccuagugguugggaagu

SEQ ID NO: 103546 - RNA, 22 nt, Homo sapiens
uuccugagaucagaauucaaau

SEQ ID NO: 103547 - RNA, 22 nt, Homo sapiens
uuccuguagcgauuuuaguaau

SEQ ID NO: 103548 - RNA, 22 nt, Homo sapiens
uuccugugacuguguggcaccc

SEQ ID NO: 103549 - RNA, 20 nt, Homo sapiens
uuccuuaggcauuggaagaa

SEQ ID NO: 103550 - RNA, 22 nt, Homo sapiens
uuccuucaugcuugaaggguau

SEQ ID NO: 103551 - RNA, 22 nt, Homo sapiens
uuccuuguuuauuuacaggagg

SEQ ID NO: 103552 - RNA, 22 nt, Homo sapiens
uucuaaacaucuuacaaugcau

SEQ ID NO: 103553 - RNA, 22 nt, Homo sapiens
uucuacaggcuguucaagaagc

SEQ ID NO: 103554 - RNA, 22 nt, Homo sapiens
uucuagagagaagacuuaagcu

SEQ ID NO: 103555 - RNA, 22 nt, Homo sapiens
uucuagcacuuugggagacuga

SEQ ID NO: 103556 - RNA, 23 nt, Homo sapiens
uucuaucaggcccaggagcccug

SEQ ID NO: 103557 - RNA, 22 nt, Homo sapiens
uucuaugguuuuuaugguguua

SEQ ID NO: 103558 - RNA, 22 nt, Homo sapiens
uucuauguuugaaaaugccaaa

SEQ ID NO: 103559 - RNA, 22 nt, Homo sapiens
uucucauggaacaucuguacug

SEQ ID NO: 103560 - RNA, 22 nt, Homo sapiens
uucucuaguuacuuuaauggag

SEQ ID NO: 103561 - RNA, 19 nt, Homo sapiens
uucucugguuguacuaccc

SEQ ID NO: 103562 - RNA, 22 nt, Homo sapiens
uucugacuggugugagauggua

SEQ ID NO: 103563 - RNA, 22 nt, Homo sapiens
uucugaguggcuuucaacacug

SEQ ID NO: 103564 - RNA, 22 nt, Homo sapiens
uucugcuagucugucagaucuu

SEQ ID NO: 103565 - RNA, 22 nt, Homo sapiens
uucuggcucaggucaacacuuc

SEQ ID NO: 103566 - RNA, 22 nt, Homo sapiens
uucugugguugaaaggagagau

SEQ ID NO: 103567 - RNA, 22 nt, Homo sapiens
uucugugguuucauuuaccugu

SEQ ID NO: 103568 - RNA, 22 nt, Homo sapiens
uucuuagucaaguuguauuuca

SEQ ID NO: 103569 - RNA, 22 nt, Homo sapiens
uucuucaggccacaaaaauggu

SEQ ID NO: 103570 - RNA, 22 nt, Homo sapiens
uucuugcuguauccucacaugg

SEQ ID NO: 103571 - RNA, 22 nt, Homo sapiens
uucuugguuggcaaccaacagu

SEQ ID NO: 103572 - RNA, 22 nt, Homo sapiens
uucuuugcaugaucucaaaguc

SEQ ID NO: 103573 - RNA, 22 nt, Homo sapiens
uucuuugcuuggaagcggggga

SEQ ID NO: 103574 - RNA, 22 nt, Homo sapiens
uucuuuggaaacaguacuaauu

SEQ ID NO: 103575 - RNA, 22 nt, Homo sapiens
uucuuuggauaaaguuuuaugc

SEQ ID NO: 103576 - RNA, 22 nt, Homo sapiens
uugaaagaugaacuggauugga

SEQ ID NO: 103577 - RNA, 22 nt, Homo sapiens
uugaaagcuaucagagauucca

SEQ ID NO: 103578 - RNA, 22 nt, Homo sapiens
uuuggucuuuuguaaguuaucu

SEQ ID NO: 103579 - RNA, 22 nt, Homo sapiens
uuuguaauccuauuccaaagga

SEQ ID NO: 103580 - RNA, 23 nt, Homo sapiens
uuuguacuaugucaguuuagaua

SEQ ID NO: 103581 - RNA, 22 nt, Homo sapiens
uuuguacucccuuuagauaaaa

SEQ ID NO: 103582 - RNA, 22 nt, Homo sapiens
uuuguacugagccaagauggua

SEQ ID NO: 103583 - RNA, 22 nt, Homo sapiens
uuugucaauaacuaccaacagg

SEQ ID NO: 103584 - RNA, 22 nt, Homo sapiens
uuugucacucuuggagguuguu

SEQ ID NO: 103585 - RNA, 22 nt, Homo sapiens
uuugucccccguaguucauaua

SEQ ID NO: 103586 - RNA, 22 nt, Homo sapiens
uuugucccuuugcaguggcaca

SEQ ID NO: 103587 - RNA, 19 nt, Homo sapiens
uuuguccugcccuuucuca

SEQ ID NO: 103588 - RNA, 22 nt, Homo sapiens
uuugugacuugcuucucagaau

SEQ ID NO: 103589 - RNA, 22 nt, Homo sapiens
uuugugauugcacacucaagau

SEQ ID NO: 103590 - RNA, 22 nt, Homo sapiens
uuugugcaugaagagggggugc

SEQ ID NO: 103591 - RNA, 22 nt, Homo sapiens
uuuguggaaugcucauguguag

SEQ ID NO: 103592 - RNA, 21 nt, Homo sapiens
uuggccuggaggccugaaugu

SEQ ID NO: 103593 - RNA, 22 nt, Homo sapiens
uuggccuuuucaaugccucuuu

SEQ ID NO: 103594 - RNA, 22 nt, Homo sapiens
uuggcuguguuuauaugcugga

SEQ ID NO: 103595 - RNA, 22 nt, Homo sapiens
uuggcuuguaaaaugaaaagcu

SEQ ID NO: 103596 - RNA, 22 nt, Homo sapiens
uugggauggaaauuuguacccc

SEQ ID NO: 103597 - RNA, 23 nt, Homo sapiens
uugggcaaaucacugagggcaga

SEQ ID NO: 103598 - RNA, 22 nt, Homo sapiens
uugggccacuuuaguuuccuua

SEQ ID NO: 103599 - RNA, 22 nt, Homo sapiens
uuggguccucugguccuugguu

SEQ ID NO: 103600 - RNA, 23 nt, Homo sapiens
ucacuagaguccuggaguuugag

SEQ ID NO: 103601 - RNA, 22 nt, Homo sapiens
ucacugcacuccagccuuuaug

SEQ ID NO: 103602 - RNA, 22 nt, Homo sapiens
ucacugcacuucaggcuuucuc

SEQ ID NO: 103603 - RNA, 22 nt, Homo sapiens
ucagagcaaagacacuuuauca

SEQ ID NO: 103604 - RNA, 22 nt, Homo sapiens
ucagugcuuggcacagagagcu

SEQ ID NO: 103605 - RNA, 20 nt, Homo sapiens
ucauagcuuuuuccacuuua

SEQ ID NO: 103606 - RNA, 22 nt, Homo sapiens
ucauauguaugugcaauuuugu

SEQ ID NO: 103607 - RNA, 22 nt, Homo sapiens
ucauaugucauaguaugaucuu

SEQ ID NO: 103608 - RNA, 22 nt, Homo sapiens
uccagugcauucagacacuugg

SEQ ID NO: 103609 - RNA, 22 nt, Homo sapiens
ucccugacagucacagagcuac

SEQ ID NO: 103610 - RNA, 21 nt, Homo sapiens
uucaucagccagaaaucaagc

SEQ ID NO: 103611 - RNA, 22 nt, Homo sapiens
uuccacaggguugaacuaguuu

SEQ ID NO: 103612 - RNA, 22 nt, Homo sapiens
uucccagagccugggagugagg

SEQ ID NO: 103613 - RNA, 22 nt, Homo sapiens
uucccuugcaggaugaucugga

SEQ ID NO: 103614 - RNA, 22 nt, Homo sapiens
uucccuuuuuucuaguagguag

SEQ ID NO: 103615 - RNA, 22 nt, Homo sapiens
uuccuacuguucaucaggaacc

SEQ ID NO: 103616 - RNA, 22 nt, Homo sapiens
uucuacaggcuguucaagaagc

SEQ ID NO: 103617 - RNA, 22 nt, Homo sapiens
uucuacagugacugcagccaua

SEQ ID NO: 103618 - RNA, 23 nt, Homo sapiens
uucuaucaggcccaggagcccug

SEQ ID NO: 103619 - RNA, 22 nt, Homo sapiens
uucugugguugaaaggagagau

SEQ ID NO: 103620 - RNA, 22 nt, Homo sapiens
uugaaagaaaggagacugaguu

SEQ ID NO: 103621 - RNA, 22 nt, Homo sapiens
uugaaaguaaacaucacaaaga

SEQ ID NO: 103622 - RNA, 22 nt, Homo sapiens
uugaaagucuaggcuuacagua

SEQ ID NO: 103623 - RNA, 22 nt, Homo sapiens
cuggaaucuauggauaacaucg

SEQ ID NO: 103624 - RNA, 22 nt, Homo sapiens
cuuccaaguggggcacgugcca

SEQ ID NO: 103625 - RNA, 22 nt, Homo sapiens
cuugggauauguguuacucugu

SEQ ID NO: 103626 - RNA, 21 nt, Homo sapiens
cuuugcacugcuccucagcuc

SEQ ID NO: 103627 - RNA, 22 nt, Homo sapiens
cuuuggcaaugucauuuucaau

SEQ ID NO: 103628 - RNA, 22 nt, Homo sapiens
cuuuguaugucaugacaacugu

SEQ ID NO: 103629 - RNA, 22 nt, Homo sapiens
auauaguguuuuuugguacgcu

SEQ ID NO: 103630 - RNA, 22 nt, Homo sapiens
auauuggacugugcuaguuaga

SEQ ID NO: 103631 - RNA, 22 nt, Homo sapiens
aucacauuuauaguggcacgca

SEQ ID NO: 103632 - RNA, 22 nt, Homo sapiens
aucacuuucuauuucugugcca

SEQ ID NO: 103633 - RNA, 22 nt, Homo sapiens
aucugcaaagcugggcugagac

SEQ ID NO: 103634 - RNA, 22 nt, Homo sapiens
augaaaguguguggaaacuuga

SEQ ID NO: 103635 - RNA, 23 nt, Homo sapiens
augaauguaaggaguguaagaaa

SEQ ID NO: 103636 - RNA, 22 nt, Homo sapiens
augagggagggguggugccgca

SEQ ID NO: 103637 - RNA, 22 nt, Homo sapiens
auggaaggagaggaaugaauga

SEQ ID NO: 103638 - RNA, 22 nt, Homo sapiens
auggagagaauuauucucucag

SEQ ID NO: 103639 - RNA, 22 nt, Homo sapiens
auggcaaaauguuccuaguggu

SEQ ID NO: 103640 - RNA, 22 nt, Homo sapiens
auggcccuguguggagcugcug

SEQ ID NO: 103641 - RNA, 22 nt, Homo sapiens
auggccugaugcaccuguccca

SEQ ID NO: 103642 - RNA, 22 nt, Homo sapiens
auggccuuguauaccuggcaaa

SEQ ID NO: 103643 - RNA, 22 nt, Homo sapiens
auggcuuuaagagugucugaau

SEQ ID NO: 103644 - RNA, 22 nt, Homo sapiens
auggucuuuucccuggauuaua

SEQ ID NO: 103645 - RNA, 22 nt, Homo sapiens
auguaacaguauuuggagaugu

SEQ ID NO: 103646 - RNA, 22 nt, Homo sapiens
augugcaaagcacuguucagca

SEQ ID NO: 103647 - RNA, 20 nt, Homo sapiens
augugcuaauauuaauaugu

SEQ ID NO: 103648 - RNA, 22 nt, Homo sapiens
auguguucaucacagcacaauu

SEQ ID NO: 103649 - RNA, 22 nt, Homo sapiens
auucaucagggauauuggucug

SEQ ID NO: 103650 - RNA, 22 nt, Homo sapiens
auugacuugauauauagcugau

SEQ ID NO: 103651 - RNA, 22 nt, Homo sapiens
auugcacuccagccugggcagc

SEQ ID NO: 103652 - RNA, 22 nt, Homo sapiens
auugcacuccagucugggcaac

SEQ ID NO: 103653 - RNA, 22 nt, Homo sapiens
auugcacuggggguuagaauuu

SEQ ID NO: 103654 - RNA, 22 nt, Homo sapiens
caaagugcugaaagaggccagg

SEQ ID NO: 103655 - RNA, 22 nt, Homo sapiens
caaagugcugggaugggccagg

SEQ ID NO: 103656 - RNA, 22 nt, Homo sapiens
caaauugcuugucuguagugga

SEQ ID NO: 103657 - RNA, 22 nt, Homo sapiens
cacauguuuuagcauggcuguu

SEQ ID NO: 103658 - RNA, 22 nt, Homo sapiens
cacauugcaggaaaguucauua

SEQ ID NO: 103659 - RNA, 22 nt, Homo sapiens
cacugcacuccagccuaagagg

SEQ ID NO: 103660 - RNA, 22 nt, Homo sapiens
cacuggucucauggcaugagag

SEQ ID NO: 103661 - RNA, 22 nt, Homo sapiens
cagcgaggucugcgucacauug

SEQ ID NO: 103662 - RNA, 22 nt, Homo sapiens
caugccauugcucuccugggug

SEQ ID NO: 103663 - RNA, 22 nt, Homo sapiens
cauuccacauguaggacaauuu

SEQ ID NO: 103664 - RNA, 22 nt, Homo sapiens
cauugcaugcauauggcuuggu

SEQ ID NO: 103665 - RNA, 22 nt, Homo sapiens
ccacccuuccauucuuccucuu

SEQ ID NO: 103666 - RNA, 22 nt, Homo sapiens
cccagugugcugggugacagcu

SEQ ID NO: 103667 - RNA, 22 nt, Homo sapiens
ccucauggagaacaucugcuag

SEQ ID NO: 103668 - RNA, 22 nt, Homo sapiens
ccuuuuuguaguggaaguagga

SEQ ID NO: 103669 - RNA, 16 nt, Homo sapiens
cuaaaaugucuacuug

SEQ ID NO: 103670 - RNA, 22 nt, Homo sapiens
cuacagcacugagcugugugca

SEQ ID NO: 103671 - RNA, 20 nt, Homo sapiens
cucagauuauucugaagcaa

SEQ ID NO: 103672 - RNA, 22 nt, Homo sapiens
cucauggauggucuggcagcca

SEQ ID NO: 103673 - RNA, 22 nt, Homo sapiens
cugaaagagcauguaacacagu

SEQ ID NO: 103674 - RNA, 22 nt, Homo sapiens
cugacugugcaugcccagcccc

SEQ ID NO: 103675 - RNA, 22 nt, Homo sapiens
cugagcaaaaugaagacacgau

SEQ ID NO: 103676 - RNA, 22 nt, Homo sapiens
cugagcaauauagugagaucuu

SEQ ID NO: 103677 - RNA, 22 nt, Homo sapiens
cugauuguagagccccagggcu

SEQ ID NO: 103678 - RNA, 22 nt, Homo sapiens
cugcaagaaucguaguauuuga

SEQ ID NO: 103679 - RNA, 22 nt, Homo sapiens
cuggaauguuccuaaagauuca

SEQ ID NO: 103680 - RNA, 22 nt, Homo sapiens
cuggcaaauaguagagccagga

SEQ ID NO: 103681 - RNA, 22 nt, Homo sapiens
cuggcacagugucagaaacaca

SEQ ID NO: 103682 - RNA, 22 nt, Homo sapiens
cugugcaaguuauaggccaggu

SEQ ID NO: 103683 - RNA, 22 nt, Homo sapiens
cuugccuuugucuucaaaggcu

SEQ ID NO: 103684 - RNA, 22 nt, Homo sapiens
cuuuuguggaucuucuguugcu

SEQ ID NO: 103685 - RNA, 22 nt, Homo sapiens
gaaagacuuucugcuguggaua

SEQ ID NO: 103686 - RNA, 22 nt, Homo sapiens
gaaaugcucagggguuuuccag

SEQ ID NO: 103687 - RNA, 22 nt, Homo sapiens
gaaaugucugagauguggcuca

SEQ ID NO: 103688 - RNA, 22 nt, Homo sapiens
gaagauucaaccaaaccagaac

SEQ ID NO: 103689 - RNA, 22 nt, Homo sapiens
gaaugcaugaggggaucagaug

SEQ ID NO: 103690 - RNA, 20 nt, Homo sapiens
gacauguugguuugcugcac

SEQ ID NO: 103691 - RNA, 22 nt, Homo sapiens
gacauguuuacaguguugagag

SEQ ID NO: 103692 - RNA, 18 nt, Homo sapiens
gacucaguuucuaaggca

SEQ ID NO: 103693 - RNA, 22 nt, Homo sapiens
gacugaggaagcgcucucuccu

SEQ ID NO: 103694 - RNA, 22 nt, Homo sapiens
gacuucaucauacuaugugugg

SEQ ID NO: 103695 - RNA, 22 nt, Homo sapiens
gagagcauuaagccaucaucau

SEQ ID NO: 103696 - RNA, 22 nt, Homo sapiens
gagaucauguacuagaacaccu

SEQ ID NO: 103697 - RNA, 22 nt, Homo sapiens
gagccuguaggaggagaggugg

SEQ ID NO: 103698 - RNA, 22 nt, Homo sapiens
gagcuguugguuugaaagaauu

SEQ ID NO: 103699 - RNA, 22 nt, Homo sapiens
gauauguaaaaauuauaucuga

SEQ ID NO: 103700 - RNA, 22 nt, Homo sapiens
gauauguaguaguugaaaaaga

SEQ ID NO: 103701 - RNA, 22 nt, Homo sapiens
gaugccuuuuuguccucaguua

SEQ ID NO: 103702 - RNA, 20 nt, Homo sapiens
gcaguacuuuuaguucuaag

SEQ ID NO: 103703 - RNA, 22 nt, Homo sapiens
gcaguguugugauccaggucuu

SEQ ID NO: 103704 - RNA, 22 nt, Homo sapiens
gccaagaucugaauaauuaaga

SEQ ID NO: 103705 - RNA, 22 nt, Homo sapiens
gccaagauuuaauucaucaguu

SEQ ID NO: 103706 - RNA, 22 nt, Homo sapiens
gcugauggugcaguucuagccu

SEQ ID NO: 103707 - RNA, 22 nt, Homo sapiens
ggaaagacaccuuacuauguua

SEQ ID NO: 103708 - RNA, 22 nt, Homo sapiens
ggagucugacuuauaggaaccu

SEQ ID NO: 103709 - RNA, 22 nt, Homo sapiens
ggauauguagggcauaucuaca

SEQ ID NO: 103710 - RNA, 22 nt, Homo sapiens
ggugucaguuggccccuacugg

SEQ ID NO: 103711 - RNA, 22 nt, Homo sapiens
guaacacucuaaagggaugcac

SEQ ID NO: 103712 - RNA, 22 nt, Homo sapiens
guacaguuuucaguguucacug

SEQ ID NO: 103713 - RNA, 22 nt, Homo sapiens
guacauagucacacauauacau

SEQ ID NO: 103714 - RNA, 22 nt, Homo sapiens
uggaagacaggcuguauuuuaa

SEQ ID NO: 103715 - RNA, 21 nt, Homo sapiens
uggaaucuauagaggcaguag

SEQ ID NO: 103716 - RNA, 22 nt, Homo sapiens
uggagcccuaguuccucauaac

SEQ ID NO: 103717 - RNA, 18 nt, Homo sapiens
uggauuggaaaaguuccu

SEQ ID NO: 103718 - RNA, 22 nt, Homo sapiens
uggcaggugcacuggcuuugaa

SEQ ID NO: 103719 - RNA, 22 nt, Homo sapiens
uggcuuuuccuugaaucugccu

SEQ ID NO: 103720 - RNA, 22 nt, Homo sapiens
ugggaagcugcugaacuacagu

SEQ ID NO: 103721 - RNA, 22 nt, Homo sapiens
ugggaaugaaauuacauagcuu

SEQ ID NO: 103722 - RNA, 22 nt, Homo sapiens
ugggaugaugcuugagaauauc

SEQ ID NO: 103723 - RNA, 23 nt, Homo sapiens
ugucaucaagaugaggucacacu

SEQ ID NO: 103724 - RNA, 22 nt, Homo sapiens
ugucaugucuuuguguaucaau

SEQ ID NO: 103725 - RNA, 22 nt, Homo sapiens
ugugaacagaauuagucaccua

SEQ ID NO: 103726 - RNA, 22 nt, Homo sapiens
ugugcacaacaugcagguuugu

SEQ ID NO: 103727 - RNA, 22 nt, Homo sapiens
ugugcacauaacauuuuuuuag

SEQ ID NO: 103728 - RNA, 22 nt, Homo sapiens
ugugcacaugauauaucacaua

SEQ ID NO: 103729 - RNA, 23 nt, Homo sapiens
ugugcacauuuacauauauacac

SEQ ID NO: 103730 - RNA, 22 nt, Homo sapiens
ugugcaccucuucacacaggga

SEQ ID NO: 103731 - RNA, 22 nt, Homo sapiens
uguuucuacugucucuguagua

SEQ ID NO: 103732 - RNA, 22 nt, Homo sapiens
uuaacacugccauugauacugu

SEQ ID NO: 103733 - RNA, 22 nt, Homo sapiens
uuaaugcuuuugggauauuucu

SEQ ID NO: 103734 - RNA, 22 nt, Homo sapiens
uuaauguaauugauugauugac

SEQ ID NO: 103735 - RNA, 22 nt, Homo sapiens
uuaauguaucuaucacaucaca

SEQ ID NO: 103736 - RNA, 22 nt, Homo sapiens
uuaauuguaucuauagauguca

SEQ ID NO: 103737 - RNA, 22 nt, Homo sapiens
uuaccucuguggcucucggacu

SEQ ID NO: 103738 - RNA, 22 nt, Homo sapiens
uucaauaugucauuggcaggca

SEQ ID NO: 103739 - RNA, 22 nt, Homo sapiens
uucaccuggaguucaggauaag

SEQ ID NO: 103740 - RNA, 22 nt, Homo sapiens
uucacugcacuccagccugggu

SEQ ID NO: 103741 - RNA, 22 nt, Homo sapiens
uucacugcauuucagccugggc

SEQ ID NO: 103742 - RNA, 22 nt, Homo sapiens
uucagggacuuuagacaagaga

SEQ ID NO: 103743 - RNA, 22 nt, Homo sapiens
uucaguggagaggcugaguggu

SEQ ID NO: 103744 - RNA, 22 nt, Homo sapiens
uucaguggguggaugaauauga

SEQ ID NO: 103745 - RNA, 22 nt, Homo sapiens
uucauagaggacauuacuggag

SEQ ID NO: 103746 - RNA, 22 nt, Homo sapiens
uucauaguauuuuucuccaaau

SEQ ID NO: 103747 - RNA, 22 nt, Homo sapiens
uucauggaugcauuugaggggu

SEQ ID NO: 103748 - RNA, 22 nt, Homo sapiens
uucauggauggaaaugauuuug

SEQ ID NO: 103749 - RNA, 22 nt, Homo sapiens
uuccaauguuccguguugcagu

SEQ ID NO: 103750 - RNA, 22 nt, Homo sapiens
uucuaaacaucuuacaaugcau

SEQ ID NO: 103751 - RNA, 22 nt, Homo sapiens
uucuaaguaauuuugcaugccu

SEQ ID NO: 103752 - RNA, 22 nt, Homo sapiens
uucugugcugaaucaaagacug

SEQ ID NO: 103753 - RNA, 22 nt, Homo sapiens
uugaaagcuaucagagauucca

SEQ ID NO: 103754 - RNA, 22 nt, Homo sapiens
uugagaaucuuucgaauguucu

SEQ ID NO: 103755 - RNA, 22 nt, Homo sapiens
uugauaguccuguaucuauuuu

SEQ ID NO: 103756 - RNA, 22 nt, Homo sapiens
uugcacagucuagcuccaccuu

SEQ ID NO: 103757 - RNA, 22 nt, Homo sapiens
uugcacagugcuuucuuugccc

SEQ ID NO: 103758 - RNA, 22 nt, Homo sapiens
uugcuccucugccaggaccugu

SEQ ID NO: 103759 - RNA, 22 nt, Homo sapiens
uuggaauauaaccuguuucuaa

SEQ ID NO: 103760 - RNA, 22 nt, Homo sapiens
uuggaaugcacacugagccugc

SEQ ID NO: 103761 - RNA, 22 nt, Homo sapiens
uuggagagugauauucagaugc

SEQ ID NO: 103762 - RNA, 22 nt, Homo sapiens
uuguauguugaaugaugguaua

SEQ ID NO: 103763 - RNA, 22 nt, Homo sapiens
uuguauguuucugugcacauga

SEQ ID NO: 103764 - RNA, 22 nt, Homo sapiens
uuguccuggagguucuugcaag

SEQ ID NO: 103765 - RNA, 22 nt, Homo sapiens
uugugcaugaugcauacauggu

SEQ ID NO: 103766 - RNA, 22 nt, Homo sapiens
uuucauagccuucuaaugaguu

SEQ ID NO: 103767 - RNA, 22 nt, Homo sapiens
uuucauggacgcaaugccuuuu

SEQ ID NO: 103768 - RNA, 22 nt, Homo sapiens
uuuggcauauuuuaagcugguu

SEQ ID NO: 103769 - RNA, 22 nt, Homo sapiens
uuuuaguggacaaagguauuua

SEQ ID NO: 103770 - RNA, 22 nt, Homo sapiens
uuuugguaaugaacuuaggaag

SEQ ID NO: 103771 - RNA, 22 nt, Homo sapiens
uuuugugcauggcccaguggua

SEQ ID NO: 103772 - RNA, 22 nt, Homo sapiens
uuuuugugguauauugcaacaa

SEQ ID NO: 103773 - RNA, 23 nt, Homo sapiens
uuuuuguguuucauggaaauagg

SEQ ID NO: 103774 - RNA, 22 nt, Homo sapiens
uucauacaguggcugcacucca

SEQ ID NO: 103775 - RNA, 22 nt, Homo sapiens
uucauggugguacaaaagcaau

SEQ ID NO: 103776 - RNA, 22 nt, Homo sapiens
uucauguaauauuucacagcuu

SEQ ID NO: 103777 - RNA, 22 nt, Homo sapiens
uucccuagaacacauggaggga

SEQ ID NO: 103778 - RNA, 22 nt, Homo sapiens
uuccuacugcccauuaaaaugg

SEQ ID NO: 103779 - RNA, 22 nt, Homo sapiens
uuccuaguccugagucucugcg

SEQ ID NO: 103780 - RNA, 22 nt, Homo sapiens
uuccuuguuuauuuacaggagg

SEQ ID NO: 103781 - RNA, 20 nt, Homo sapiens
uucuacagucacaggaagau

SEQ ID NO: 103782 - RNA, 22 nt, Homo sapiens
uucuaugguuuuuaugguguua

SEQ ID NO: 103783 - RNA, 22 nt, Homo sapiens
uugaaagacaucaccuacugcu

SEQ ID NO: 103784 - RNA, 22 nt, Homo sapiens
uugaaggaggugcucacucucg

SEQ ID NO: 103785 - RNA, 22 nt, Homo sapiens
uugaaguauagaguuuaagaac

SEQ ID NO: 103786 - RNA, 22 nt, Homo sapiens
uugagauacauaauuaugaaug

SEQ ID NO: 103787 - RNA, 22 nt, Homo sapiens
uugagcaaaacauuaauauuag

SEQ ID NO: 103788 - RNA, 22 nt, Homo sapiens
uugauaguuuuaaaauuaaucu

SEQ ID NO: 103789 - RNA, 22 nt, Homo sapiens
uugcaacauuguaaguuuauau

SEQ ID NO: 103790 - RNA, 22 nt, Homo sapiens
uuggcaaguuucugucagcaaa

SEQ ID NO: 103791 - RNA, 22 nt, Homo sapiens
uuggcagaaaaggucggggguu

SEQ ID NO: 103792 - RNA, 22 nt, Homo sapiens
uugggcuugagggugcccaguc

SEQ ID NO: 103793 - RNA, 22 nt, Homo sapiens
uuggucaggcuaaucucgaacg

SEQ ID NO: 103794 - RNA, 22 nt, Homo sapiens
uuguauguaaccauuuggcaaa

SEQ ID NO: 103795 - RNA, 22 nt, Homo sapiens
uuguauguuuguucuuucagau

SEQ ID NO: 103796 - RNA, 22 nt, Homo sapiens
uugugcaaaaguaauugcgguu

SEQ ID NO: 103797 - RNA, 22 nt, Homo sapiens
uuguggcuuaucucauuuagcg

SEQ ID NO: 103798 - RNA, 22 nt, Homo sapiens
uuuaauguuacaguauugguau

SEQ ID NO: 103799 - RNA, 22 nt, Homo sapiens
uuucauggaggauuugcuucuu

SEQ ID NO: 103800 - RNA, 22 nt, Homo sapiens
uuucuacagggcuugccaggua

SEQ ID NO: 103801 - RNA, 22 nt, Homo sapiens
uuucugaggccucaccagaagc

SEQ ID NO: 103802 - RNA, 23 nt, Homo sapiens
uuucuugggcaugcuaugucagu

SEQ ID NO: 103803 - RNA, 22 nt, Homo sapiens
uuugugcaugaagagggggugc

SEQ ID NO: 103804 - RNA, 22 nt, Homo sapiens
uuuuccagugggacucccauua

SEQ ID NO: 103805 - RNA, 22 nt, Homo sapiens
uuuuggacuucaauuugacacu

SEQ ID NO: 103806 - RNA, 18 nt, Homo sapiens
aaacagugucucuuucug

SEQ ID NO: 103807 - RNA, 22 nt, Homo sapiens
aaagugccuucuauuuuaguga

SEQ ID NO: 103808 - RNA, 22 nt, Homo sapiens
aaaugcugucugugagccucau

SEQ ID NO: 103809 - RNA, 22 nt, Homo sapiens
aaaugcuguuccaggaccuauc

SEQ ID NO: 103810 - RNA, 22 nt, Homo sapiens
aaauucauuucagcucugggua

SEQ ID NO: 103811 - RNA, 22 nt, Homo sapiens
aacacuguuuccagucaugauc

SEQ ID NO: 103812 - RNA, 21 nt, Homo sapiens
aacagugcugaacagacaccu

SEQ ID NO: 103813 - RNA, 22 nt, Homo sapiens
aacagugcuguuauaaauguac

SEQ ID NO: 103814 - RNA, 22 nt, Homo sapiens
aagagguuguaccuaaaguguu

SEQ ID NO: 103815 - RNA, 22 nt, Homo sapiens
aaggugcucucuuauguagaaa

SEQ ID NO: 103816 - RNA, 22 nt, Homo sapiens
aaguaaacauugagagacaaga

SEQ ID NO: 103817 - RNA, 22 nt, Homo sapiens
aaguaauugagguuuuugcugu

SEQ ID NO: 103818 - RNA, 22 nt, Homo sapiens
aauaaugucacaggggguuagc

SEQ ID NO: 103819 - RNA, 22 nt, Homo sapiens
aaugucaucuucaguuguacag

SEQ ID NO: 103820 - RNA, 22 nt, Homo sapiens
acacaugugaaaaaaauguuac

SEQ ID NO: 103821 - RNA, 22 nt, Homo sapiens
acagugcuucugauaugaugcc

SEQ ID NO: 103822 - RNA, 22 nt, Homo sapiens
acucagagugggccccuagaua

SEQ ID NO: 103823 - RNA, 22 nt, Homo sapiens
acugagacugagaauguuucuu

SEQ ID NO: 103824 - RNA, 22 nt, Homo sapiens
acugcacuccagccuccugaca

SEQ ID NO: 103825 - RNA, 22 nt, Homo sapiens
acugcacuccagccugaugaaa

SEQ ID NO: 103826 - RNA, 22 nt, Homo sapiens
acugcacuccaguuugggcagc

SEQ ID NO: 103827 - RNA, 22 nt, Homo sapiens
acugcacuccggccuggcaaca

SEQ ID NO: 103828 - RNA, 22 nt, Homo sapiens
acuguacuccagccugggcaac

SEQ ID NO: 103829 - RNA, 22 nt, Homo sapiens
acuguacucuacccugggcaac

SEQ ID NO: 103830 - RNA, 22 nt, Homo sapiens
agagcaaugggugaauauuaaa

SEQ ID NO: 103831 - RNA, 22 nt, Homo sapiens
agagcacuguggguccaaauau

SEQ ID NO: 103832 - RNA, 23 nt, Homo sapiens
agagugcaauggugccaucucgg

SEQ ID NO: 103833 - RNA, 22 nt, Homo sapiens
agauauguuauugauguuaaug

SEQ ID NO: 103834 - RNA, 22 nt, Homo sapiens
agauauguuuaguuucaaaaug

SEQ ID NO: 103835 - RNA, 22 nt, Homo sapiens
agcaccacaauuuccugccuaa

SEQ ID NO: 103836 - RNA, 22 nt, Homo sapiens
agccgguguccacgaagaagag

SEQ ID NO: 103837 - RNA, 18 nt, Homo sapiens
aggaaugguaauacuuca

SEQ ID NO: 103838 - RNA, 22 nt, Homo sapiens
aggagcacuggccuuggaguca

SEQ ID NO: 103839 - RNA, 22 nt, Homo sapiens
aguaaauuucugugcuuucaua

SEQ ID NO: 103840 - RNA, 22 nt, Homo sapiens
agucaagaugagauuugggugg

SEQ ID NO: 103841 - RNA, 22 nt, Homo sapiens
agugcaauggugccaucauagc

SEQ ID NO: 103842 - RNA, 23 nt, Homo sapiens
agugccuaguauauaggaggcgc

SEQ ID NO: 103843 - RNA, 22 nt, Homo sapiens
aguggaauuaagaaacugaauu

SEQ ID NO: 103844 - RNA, 22 nt, Homo sapiens
auaaaugcuuccagucauuaaa

SEQ ID NO: 103845 - RNA, 22 nt, Homo sapiens
auaauguuugauugagcagaua

SEQ ID NO: 103846 - RNA, 22 nt, Homo sapiens
auauaugcuaagugcuaauaaa

SEQ ID NO: 103847 - RNA, 17 nt, Homo sapiens
auaugaauuuuggagau

SEQ ID NO: 103848 - RNA, 22 nt, Homo sapiens
aucccaguucagccucugacac

SEQ ID NO: 103849 - RNA, 22 nt, Homo sapiens
auccugaagcuuuacugaauuc

SEQ ID NO: 103850 - RNA, 22 nt, Homo sapiens
aucuacagccagucugguuugu

SEQ ID NO: 103851 - RNA, 22 nt, Homo sapiens
aucugcaaauaaugaagauugg

SEQ ID NO: 103852 - RNA, 22 nt, Homo sapiens
augacauugaugcucuggcugg

SEQ ID NO: 103853 - RNA, 22 nt, Homo sapiens
augagauacuacaaaugaguuu

SEQ ID NO: 103854 - RNA, 22 nt, Homo sapiens
augagauuguuuguacuccaca

SEQ ID NO: 103855 - RNA, 22 nt, Homo sapiens
augagauuguuugugugaaaua

SEQ ID NO: 103856 - RNA, 22 nt, Homo sapiens
augagcucauaaagagugauuu

SEQ ID NO: 103857 - RNA, 17 nt, Homo sapiens
augagcucaucauuuuu

SEQ ID NO: 103858 - RNA, 22 nt, Homo sapiens
augauggaggccgugauggacg

SEQ ID NO: 103859 - RNA, 22 nt, Homo sapiens
augauggagguagauuguccau

SEQ ID NO: 103860 - RNA, 22 nt, Homo sapiens
augcauauuccugggccucacu

SEQ ID NO: 103861 - RNA, 22 nt, Homo sapiens
augcauggucugaagucaaccu

SEQ ID NO: 103862 - RNA, 22 nt, Homo sapiens
auggcacuuuggacugcuagau

SEQ ID NO: 103863 - RNA, 22 nt, Homo sapiens
auggccuuucuggcacauuucc

SEQ ID NO: 103864 - RNA, 22 nt, Homo sapiens
auguagugugauuuucacuaga

SEQ ID NO: 103865 - RNA, 22 nt, Homo sapiens
augucacagguccuagccaagu

SEQ ID NO: 103866 - RNA, 22 nt, Homo sapiens
augugacagugguuuuaagcgu

SEQ ID NO: 103867 - RNA, 22 nt, Homo sapiens
augugcacauucugguaaauau

SEQ ID NO: 103868 - RNA, 22 nt, Homo sapiens
auuacauagucaaggugucuca

SEQ ID NO: 103869 - RNA, 22 nt, Homo sapiens
auuccacaguuaacacagaccg

SEQ ID NO: 103870 - RNA, 21 nt, Homo sapiens
auuccacuuuuccuucaggga

SEQ ID NO: 103871 - RNA, 22 nt, Homo sapiens
acccaguagucauucaggagca

SEQ ID NO: 103872 - RNA, 22 nt, Homo sapiens
acccucagaccaguuucccugg

SEQ ID NO: 103873 - RNA, 22 nt, Homo sapiens
acugcacuccaccuugggcaac

SEQ ID NO: 103874 - RNA, 22 nt, Homo sapiens
acugcacugcagccuggccaac

SEQ ID NO: 103875 - RNA, 22 nt, Homo sapiens
acuggcuuuugagaaaaacacu

SEQ ID NO: 103876 - RNA, 22 nt, Homo sapiens
acuguauagauggaguugauuu

SEQ ID NO: 103877 - RNA, 21 nt, Homo sapiens
acuuucuguggcaguccauuc

SEQ ID NO: 103878 - RNA, 22 nt, Homo sapiens
acuuuuugauggggagaacauu

SEQ ID NO: 103879 - RNA, 22 nt, Homo sapiens
agaacuguccauucagcaugaa

SEQ ID NO: 103880 - RNA, 22 nt, Homo sapiens
agaguacugacguuugcaaauu

SEQ ID NO: 103881 - RNA, 22 nt, Homo sapiens
agcacagugguuaaguuucuua

SEQ ID NO: 103882 - RNA, 19 nt, Homo sapiens
agcagaacaaauguguggg

SEQ ID NO: 103883 - RNA, 23 nt, Homo sapiens
agccuguugccuaggcagcucau

SEQ ID NO: 103884 - RNA, 20 nt, Homo sapiens
agcuccauuccugaaggcug

SEQ ID NO: 103885 - RNA, 22 nt, Homo sapiens
agcuccauuguaaucaccuggu

SEQ ID NO: 103886 - RNA, 22 nt, Homo sapiens
agcuccuacuguuacaucauug

SEQ ID NO: 103887 - RNA, 22 nt, Homo sapiens
agcugcaauguuuaguauaaua

SEQ ID NO: 103888 - RNA, 22 nt, Homo sapiens
agcugccagucuuguaaggccu

SEQ ID NO: 103889 - RNA, 22 nt, Homo sapiens
aggaauggaaacuuuugauggu

SEQ ID NO: 103890 - RNA, 22 nt, Homo sapiens
aggagcacaauggucaugugga

SEQ ID NO: 103891 - RNA, 22 nt, Homo sapiens
aggcaacaugguaaaacccugu

SEQ ID NO: 103892 - RNA, 21 nt, Homo sapiens
agucauaggaguacauaaugc

SEQ ID NO: 103893 - RNA, 22 nt, Homo sapiens
agugccacugcacucuagccug

SEQ ID NO: 103894 - RNA, 22 nt, Homo sapiens
aguggaaucuguuauacuaacu

SEQ ID NO: 103895 - RNA, 19 nt, Homo sapiens
auaaaugccuacaagggug

SEQ ID NO: 103896 - RNA, 22 nt, Homo sapiens
auaaauucauuuaagcuccuua

SEQ ID NO: 103897 - RNA, 19 nt, Homo sapiens
auacacguguauacauaca

SEQ ID NO: 103898 - RNA, 22 nt, Homo sapiens
auacaugugccaugcuggugug

SEQ ID NO: 103899 - RNA, 21 nt, Homo sapiens
auagcacuucacuugguuaga

SEQ ID NO: 103900 - RNA, 22 nt, Homo sapiens
auagcuguccuuacuagcuagg

SEQ ID NO: 103901 - RNA, 19 nt, Homo sapiens
auaguguaggaaaacagcu

SEQ ID NO: 103902 - RNA, 22 nt, Homo sapiens
auauggcauucagaacuguaua

SEQ ID NO: 103903 - RNA, 22 nt, Homo sapiens
aucccaguaaaaauggcuucua

SEQ ID NO: 103904 - RNA, 22 nt, Homo sapiens
aucccgagacuuugcugaaguu

SEQ ID NO: 103905 - RNA, 22 nt, Homo sapiens
aucccuuucugauacuuucccu

SEQ ID NO: 103906 - RNA, 22 nt, Homo sapiens
auccuacaguccauucuuugug

SEQ ID NO: 103907 - RNA, 22 nt, Homo sapiens
aucuuugauuguagguacaaug

SEQ ID NO: 103908 - RNA, 22 nt, Homo sapiens
augagauauuuuauaagaucau

SEQ ID NO: 103909 - RNA, 22 nt, Homo sapiens
augagggcggacgcccuggaga

SEQ ID NO: 103910 - RNA, 22 nt, Homo sapiens
augaggugaggucaguaaggua

SEQ ID NO: 103911 - RNA, 20 nt, Homo sapiens
augagguguaugacacugaa

SEQ ID NO: 103912 - RNA, 19 nt, Homo sapiens
augauugucuauggaggaa

SEQ ID NO: 103913 - RNA, 19 nt, Homo sapiens
augccacagugaggucaga

SEQ ID NO: 103914 - RNA, 22 nt, Homo sapiens
augcuuguguuggggcagugga

SEQ ID NO: 103915 - RNA, 22 nt, Homo sapiens
auggacagaaaaaaauagaugu

SEQ ID NO: 103916 - RNA, 22 nt, Homo sapiens
auggaggaggaagcugaaacaa

SEQ ID NO: 103917 - RNA, 22 nt, Homo sapiens
auggcaagaagagcaauuauuu

SEQ ID NO: 103918 - RNA, 22 nt, Homo sapiens
auggcccugaguucaauauauu

SEQ ID NO: 103919 - RNA, 22 nt, Homo sapiens
auggcuuugggcugcucugccc

SEQ ID NO: 103920 - RNA, 22 nt, Homo sapiens
auguaugagaguuccagcugau

SEQ ID NO: 103921 - RNA, 22 nt, Homo sapiens
augugcacaugcuuacauguga

SEQ ID NO: 103922 - RNA, 22 nt, Homo sapiens
augugcauaugaagcacagaca

SEQ ID NO: 103923 - RNA, 22 nt, Homo sapiens
augugucaaaucuaggccaaag

SEQ ID NO: 103924 - RNA, 22 nt, Homo sapiens
auguugcuugaaggcauuuugu

SEQ ID NO: 103925 - RNA, 22 nt, Homo sapiens
auuacacuuucuauucaaugag

SEQ ID NO: 103926 - RNA, 18 nt, Homo sapiens
auucuacaggccuuuuga

SEQ ID NO: 103927 - RNA, 22 nt, Homo sapiens
auugacaguuggccaguaagug

SEQ ID NO: 103928 - RNA, 22 nt, Homo sapiens
auugcacuccagccuggcaaua

SEQ ID NO: 103929 - RNA, 21 nt, Homo sapiens
auugcacuccagccugggcga

SEQ ID NO: 103930 - RNA, 22 nt, Homo sapiens
caaagcacuuggcuuggaagau

SEQ ID NO: 103931 - RNA, 22 nt, Homo sapiens
caaugugcuuggggcacaugag

SEQ ID NO: 103932 - RNA, 22 nt, Homo sapiens
cacaguagaauagagcacuagg

SEQ ID NO: 103933 - RNA, 22 nt, Homo sapiens
cacugaaugugagguuggggag

SEQ ID NO: 103934 - RNA, 22 nt, Homo sapiens
cagagaaugucuuuuuuaacca

SEQ ID NO: 103935 - RNA, 22 nt, Homo sapiens
caggaaugugaggguucccugc

SEQ ID NO: 103936 - RNA, 22 nt, Homo sapiens
cauacaagcuacaaucacaaag

SEQ ID NO: 103937 - RNA, 22 nt, Homo sapiens
caucagcaauguaugaggguuc

SEQ ID NO: 103938 - RNA, 22 nt, Homo sapiens
ccacccuuccacacccugggua

SEQ ID NO: 103939 - RNA, 22 nt, Homo sapiens
ccuuuuugaguugccagaguuc

SEQ ID NO: 103940 - RNA, 23 nt, Homo sapiens
cuaaagucugucacugaggacuu

SEQ ID NO: 103941 - RNA, 22 nt, Homo sapiens
cuaaggaaggacugaaaggaca

SEQ ID NO: 103942 - RNA, 22 nt, Homo sapiens
cuaagugaguauaauuuuaaga

SEQ ID NO: 103943 - RNA, 23 nt, Homo sapiens
cuacagugccugucucuuuggcc

SEQ ID NO: 103944 - RNA, 22 nt, Homo sapiens
cuauggcagccacggccuggag

SEQ ID NO: 103945 - RNA, 22 nt, Homo sapiens
cucagugguugauuuauuuauc

SEQ ID NO: 103946 - RNA, 22 nt, Homo sapiens
cucaguuuugccuuguuuaagg

SEQ ID NO: 103947 - RNA, 22 nt, Homo sapiens
cucauggagaacaucugcuagg

SEQ ID NO: 103948 - RNA, 22 nt, Homo sapiens
cucauggagaaccucugcuagg

SEQ ID NO: 103949 - RNA, 19 nt, Homo sapiens
cucauggagaaggagaaua

SEQ ID NO: 103950 - RNA, 22 nt, Homo sapiens
cucugacagugguuagcacugu

SEQ ID NO: 103951 - RNA, 22 nt, Homo sapiens
cucuuugcuucuggcaucauug

SEQ ID NO: 103952 - RNA, 22 nt, Homo sapiens
cugagacacucuuaucugcaua

SEQ ID NO: 103953 - RNA, 22 nt, Homo sapiens
cugagaguugaugaaauauggu

SEQ ID NO: 103954 - RNA, 22 nt, Homo sapiens
cugcagucaucugaagauuuug

SEQ ID NO: 103955 - RNA, 20 nt, Homo sapiens
cuuuuagcagcagcaagaga

SEQ ID NO: 103956 - RNA, 22 nt, Homo sapiens
cuuuugugauucuucaguugcu

SEQ ID NO: 103957 - RNA, 22 nt, Homo sapiens
gaaaacugcuucucuggguuuc

SEQ ID NO: 103958 - RNA, 22 nt, Homo sapiens
gaagaaguacaagacaaauuuu

SEQ ID NO: 103959 - RNA, 23 nt, Homo sapiens
gaaguaauaaauggauucuuaac

SEQ ID NO: 103960 - RNA, 22 nt, Homo sapiens
gaauaaacuagagaggacugag

SEQ ID NO: 103961 - RNA, 22 nt, Homo sapiens
gagguggugguggaggcauagc

SEQ ID NO: 103962 - RNA, 22 nt, Homo sapiens
gauauguacagcucucuaggau

SEQ ID NO: 103963 - RNA, 22 nt, Homo sapiens
gaucacauggccauuucuagcu

SEQ ID NO: 103964 - RNA, 22 nt, Homo sapiens
gcaccccuuaccgggcuggguu

SEQ ID NO: 103965 - RNA, 22 nt, Homo sapiens
gcccaguagcaguacaucccuu

SEQ ID NO: 103966 - RNA, 22 nt, Homo sapiens
gcugcuuuugaugacaaaaaca

SEQ ID NO: 103967 - RNA, 22 nt, Homo sapiens
gcuggcaagaugcugaugcaac

SEQ ID NO: 103968 - RNA, 22 nt, Homo sapiens
gcugguguucaggcccucaguc

SEQ ID NO: 103969 - RNA, 22 nt, Homo sapiens
gcugguguugugaaucaggccg

SEQ ID NO: 103970 - RNA, 22 nt, Homo sapiens
gcuuuguuaaaacacagccaca

SEQ ID NO: 103971 - RNA, 22 nt, Homo sapiens
ggaaagaucagcuaaauguaag

SEQ ID NO: 103972 - RNA, 22 nt, Homo sapiens
ggagucugauguucuaaggcag

SEQ ID NO: 103973 - RNA, 22 nt, Homo sapiens
gggaaauguaaagucauaagau

SEQ ID NO: 103974 - RNA, 18 nt, Homo sapiens
gggaauauggggaguuga

SEQ ID NO: 103975 - RNA, 22 nt, Homo sapiens
gggagguaggaguuauuauuuu

SEQ ID NO: 103976 - RNA, 19 nt, Homo sapiens
ggugagaaauuaugggucu

SEQ ID NO: 103977 - RNA, 22 nt, Homo sapiens
ggugagguaguaagguacaaua

SEQ ID NO: 103978 - RNA, 19 nt, Homo sapiens
ggugcuugaauauuccucc

SEQ ID NO: 103979 - RNA, 22 nt, Homo sapiens
guaacacaugcugcucucuggu

SEQ ID NO: 103980 - RNA, 22 nt, Homo sapiens
guauacuucugaaaauagcuau

SEQ ID NO: 103981 - RNA, 22 nt, Homo sapiens
guauggcacuauccucucugau

SEQ ID NO: 103982 - RNA, 21 nt, Homo sapiens
guauggcauugauuaguuacu

SEQ ID NO: 103983 - RNA, 22 nt, Homo sapiens
guauggcauuuguggauuggcc

SEQ ID NO: 103984 - RNA, 22 nt, Homo sapiens
gucacaguggccagugauguuc

SEQ ID NO: 103985 - RNA, 22 nt, Homo sapiens
gucaguggauacugucucuguc

SEQ ID NO: 103986 - RNA, 22 nt, Homo sapiens
gucauuguguggacauggagaa

SEQ ID NO: 103987 - RNA, 22 nt, Homo sapiens
gucugguuccugggagauuucu

SEQ ID NO: 103988 - RNA, 20 nt, Homo sapiens
gucuugcuccguugcccagg

SEQ ID NO: 103989 - RNA, 22 nt, Homo sapiens
gugaaagacagcauuaauggcu

SEQ ID NO: 103990 - RNA, 22 nt, Homo sapiens
gugaacaagcaaaggcaggagg

SEQ ID NO: 103991 - RNA, 22 nt, Homo sapiens
gugagacugaguuucgcucuug

SEQ ID NO: 103992 - RNA, 22 nt, Homo sapiens
gugaggcuuuuccuguuagacu

SEQ ID NO: 103993 - RNA, 22 nt, Homo sapiens
gugcacaacgugcagguuaguu

SEQ ID NO: 103994 - RNA, 22 nt, Homo sapiens
gugccacaguguuaagggauuc

SEQ ID NO: 103995 - RNA, 22 nt, Homo sapiens
guggaagaccagacuuuccaac

SEQ ID NO: 103996 - RNA, 22 nt, Homo sapiens
guggaauggaaugauuguguau

SEQ ID NO: 103997 - RNA, 22 nt, Homo sapiens
guguaaguccugaguuuggaua

SEQ ID NO: 103998 - RNA, 22 nt, Homo sapiens
guguaugguuguuguagagaga

SEQ ID NO: 103999 - RNA, 22 nt, Homo sapiens
guguaugugagaaugcucaugu

SEQ ID NO: 104000 - RNA, 22 nt, Homo sapiens
gugucuccuguggagcuaugua

SEQ ID NO: 104001 - RNA, 22 nt, Homo sapiens
guguuugguugauagagccacu

SEQ ID NO: 104002 - RNA, 22 nt, Homo sapiens
uaaagccuagaacuuucagccc

SEQ ID NO: 104003 - RNA, 20 nt, Homo sapiens
uaaaugccucaugcuuuauu

SEQ ID NO: 104004 - RNA, 22 nt, Homo sapiens
uaaauugcauaaguacaaauga

SEQ ID NO: 104005 - RNA, 22 nt, Homo sapiens
uaacuacuucugcuucagagua

SEQ ID NO: 104006 - RNA, 22 nt, Homo sapiens
uaaguaaaugaaagguugauuu

SEQ ID NO: 104007 - RNA, 22 nt, Homo sapiens
uaagugaauuugacagguaaug

SEQ ID NO: 104008 - RNA, 22 nt, Homo sapiens
uaagugcaugauuacaugcaua

SEQ ID NO: 104009 - RNA, 22 nt, Homo sapiens
uacaaguauuuuuauuagugcc

SEQ ID NO: 104010 - RNA, 16 nt, Homo sapiens
uacaauguagaaaaca

SEQ ID NO: 104011 - RNA, 22 nt, Homo sapiens
uaccacugccgagaaaacagau

SEQ ID NO: 104012 - RNA, 22 nt, Homo sapiens
uaccagcauuucucuuuaagua

SEQ ID NO: 104013 - RNA, 22 nt, Homo sapiens
uacguuaucagguaugcaagag

SEQ ID NO: 104014 - RNA, 22 nt, Homo sapiens
uacuguacugcaguucugcaaa

SEQ ID NO: 104015 - RNA, 22 nt, Homo sapiens
uagagcaaugacucuggaaacc

SEQ ID NO: 104016 - RNA, 22 nt, Homo sapiens
uagcauaauuuguagaaaauca

SEQ ID NO: 104017 - RNA, 22 nt, Homo sapiens
uagcuggaauuacuugcaccug

SEQ ID NO: 104018 - RNA, 22 nt, Homo sapiens
uagguugucucuucacucugau

SEQ ID NO: 104019 - RNA, 22 nt, Homo sapiens
uaguucguguuugaacuagauc

SEQ ID NO: 104020 - RNA, 22 nt, Homo sapiens
uaugaauuuuauccaggauaua

SEQ ID NO: 104021 - RNA, 22 nt, Homo sapiens
uauggauuugccuauucuguau

SEQ ID NO: 104022 - RNA, 22 nt, Homo sapiens
uauggcauuauuuugauagaca

SEQ ID NO: 104023 - RNA, 22 nt, Homo sapiens
uauggcauuguuggugaugaua

SEQ ID NO: 104024 - RNA, 22 nt, Homo sapiens
uauggcuacuacgaauaaugcu

SEQ ID NO: 104025 - RNA, 22 nt, Homo sapiens
uaugguuuuaagguuaaggacu

SEQ ID NO: 104026 - RNA, 22 nt, Homo sapiens
uauucacuguaucauugauggg

SEQ ID NO: 104027 - RNA, 22 nt, Homo sapiens
uauugcaauuggggaaacuggg

SEQ ID NO: 104028 - RNA, 22 nt, Homo sapiens
ucaaggcacauuugacauuuuc

SEQ ID NO: 104029 - RNA, 22 nt, Homo sapiens
ucacagucaaaguaaucauaga

SEQ ID NO: 104030 - RNA, 22 nt, Homo sapiens
ucacaguccuguuuaggagagg

SEQ ID NO: 104031 - RNA, 22 nt, Homo sapiens
ucacaugugacauauauauuug

SEQ ID NO: 104032 - RNA, 22 nt, Homo sapiens
ucaccuggagccuucacauucu

SEQ ID NO: 104033 - RNA, 22 nt, Homo sapiens
auugcacuccagccugggcaac

SEQ ID NO: 104034 - RNA, 22 nt, Homo sapiens
auugcacuccauccugggcaau

SEQ ID NO: 104035 - RNA, 19 nt, Homo sapiens
caaaguguucuucuuugcc

SEQ ID NO: 104036 - RNA, 22 nt, Homo sapiens
caaauugcuuguggaggauaau

SEQ ID NO: 104037 - RNA, 22 nt, Homo sapiens
caagaucauuuaugcuaaaauu

SEQ ID NO: 104038 - RNA, 22 nt, Homo sapiens
cacaguguuccagcuauuugaa

SEQ ID NO: 104039 - RNA, 21 nt, Homo sapiens
cacauggaggcagagagugua

SEQ ID NO: 104040 - RNA, 22 nt, Homo sapiens
cacucaguuugugguacuuugu

SEQ ID NO: 104041 - RNA, 22 nt, Homo sapiens
cauuccacuggauaaacaaggu

SEQ ID NO: 104042 - RNA, 19 nt, Homo sapiens
ccauggcaaugaucugaug

SEQ ID NO: 104043 - RNA, 22 nt, Homo sapiens
cccaguaaucuugccaguuuuc

SEQ ID NO: 104044 - RNA, 22 nt, Homo sapiens
cccugagcagccugaguuuccc

SEQ ID NO: 104045 - RNA, 22 nt, Homo sapiens
cccuugcacuucagagcugcau

SEQ ID NO: 104046 - RNA, 22 nt, Homo sapiens
ccucauggagaaccucugcuag

SEQ ID NO: 104047 - RNA, 22 nt, Homo sapiens
ccucuguaguccugcaagagga

SEQ ID NO: 104048 - RNA, 22 nt, Homo sapiens
ccuucuuuuguaaggcugaaua

SEQ ID NO: 104049 - RNA, 22 nt, Homo sapiens
ccuuggcaauggcuggggcuga

SEQ ID NO: 104050 - RNA, 22 nt, Homo sapiens
cuacagcagcccaguccccgaa

SEQ ID NO: 104051 - RNA, 22 nt, Homo sapiens
cuauaacagugugguuuggaga

SEQ ID NO: 104052 - RNA, 22 nt, Homo sapiens
cuauguaccuggaacuguauua

SEQ ID NO: 104053 - RNA, 22 nt, Homo sapiens
cugagagugguauguuuaagug

SEQ ID NO: 104054 - RNA, 22 nt, Homo sapiens
cugagcaaagaagugauaauga

SEQ ID NO: 104055 - RNA, 22 nt, Homo sapiens
cugagcccauucuggggagaag

SEQ ID NO: 104056 - RNA, 22 nt, Homo sapiens
cugcaagaugcauaggaauuuu

SEQ ID NO: 104057 - RNA, 21 nt, Homo sapiens
cugcauccauuucugagugau

SEQ ID NO: 104058 - RNA, 22 nt, Homo sapiens
cuggaaaguagacaaucuaaaa

SEQ ID NO: 104059 - RNA, 22 nt, Homo sapiens
cuguaugugagaaauaauaagu

SEQ ID NO: 104060 - RNA, 22 nt, Homo sapiens
cuguauguuucuaugaauguga

SEQ ID NO: 104061 - RNA, 22 nt, Homo sapiens
cuucaaguguggccaccugacc

SEQ ID NO: 104062 - RNA, 22 nt, Homo sapiens
cuuucacacuguuggugggaau

SEQ ID NO: 104063 - RNA, 23 nt, Homo sapiens
gaaaugucuuagugaaauugcuu

SEQ ID NO: 104064 - RNA, 22 nt, Homo sapiens
gaagguaguuuauagauguggu

SEQ ID NO: 104065 - RNA, 22 nt, Homo sapiens
gacauguuucucucuguuuacu

SEQ ID NO: 104066 - RNA, 22 nt, Homo sapiens
gagaaugaacagacugccucuu

SEQ ID NO: 104067 - RNA, 22 nt, Homo sapiens
gagggcacugcuuuccuuucaa

SEQ ID NO: 104068 - RNA, 22 nt, Homo sapiens
gaucacauuguuucauacauau

SEQ ID NO: 104069 - RNA, 22 nt, Homo sapiens
gaugaggcuagagacaugugua

SEQ ID NO: 104070 - RNA, 22 nt, Homo sapiens
gauggaauuaaaaucagaauca

SEQ ID NO: 104071 - RNA, 22 nt, Homo sapiens
gauggauuuuaagugaaugaaa

SEQ ID NO: 104072 - RNA, 22 nt, Homo sapiens
gauuuguuggccugugagcuag

SEQ ID NO: 104073 - RNA, 22 nt, Homo sapiens
gcaagaauggaacaggagagcc

SEQ ID NO: 104074 - RNA, 22 nt, Homo sapiens
gcaagacaugucuaagguuuaa

SEQ ID NO: 104075 - RNA, 22 nt, Homo sapiens
gcagaauugacucuguuuuuuc

SEQ ID NO: 104076 - RNA, 22 nt, Homo sapiens
gcagaauugguuucuucuaagg

SEQ ID NO: 104077 - RNA, 23 nt, Homo sapiens
gcagcaaugucacagggguccgg

SEQ ID NO: 104078 - RNA, 22 nt, Homo sapiens
gcaguguucaaaucaugcccau

SEQ ID NO: 104079 - RNA, 22 nt, Homo sapiens
gccaagaugcugcccacagaca

SEQ ID NO: 104080 - RNA, 22 nt, Homo sapiens
gccaagauugguuuaauauucc

SEQ ID NO: 104081 - RNA, 22 nt, Homo sapiens
gccauggaggauuuauagaggc

SEQ ID NO: 104082 - RNA, 21 nt, Homo sapiens
ggaauuuagggaaugauuuag

SEQ ID NO: 104083 - RNA, 20 nt, Homo sapiens
ggagguuguauaaguacauc

SEQ ID NO: 104084 - RNA, 23 nt, Homo sapiens
ggauucaucuguuuguucgcugu

SEQ ID NO: 104085 - RNA, 21 nt, Homo sapiens
ggcaagagaauacaacauaaa

SEQ ID NO: 104086 - RNA, 22 nt, Homo sapiens
gggagugugcacacaugguaua

SEQ ID NO: 104087 - RNA, 22 nt, Homo sapiens
gguauguagcaaaagaggugcu

SEQ ID NO: 104088 - RNA, 22 nt, Homo sapiens
gguauguagugugaaguaggga

SEQ ID NO: 104089 - RNA, 22 nt, Homo sapiens
gucagggagggauagaugauua

SEQ ID NO: 104090 - RNA, 22 nt, Homo sapiens
gucugguuggaguaguuuucag

SEQ ID NO: 104091 - RNA, 22 nt, Homo sapiens
gucugguuuuuuauauccucac

SEQ ID NO: 104092 - RNA, 22 nt, Homo sapiens
gucuuugcauguauguucauga

SEQ ID NO: 104093 - RNA, 22 nt, Homo sapiens
gugacagucaaagacaugacuu

SEQ ID NO: 104094 - RNA, 22 nt, Homo sapiens
gugcacaaaucuuaaauguaca

SEQ ID NO: 104095 - RNA, 22 nt, Homo sapiens
guggaaucuagagaggcaguag

SEQ ID NO: 104096 - RNA, 22 nt, Homo sapiens
guggacagagacuaaauguugu

SEQ ID NO: 104097 - RNA, 22 nt, Homo sapiens
guggcaagaugacuacucacug

SEQ ID NO: 104098 - RNA, 22 nt, Homo sapiens
guggcagagucagagggaaaug

SEQ ID NO: 104099 - RNA, 22 nt, Homo sapiens
uaaggcuaggaauucucugaag

SEQ ID NO: 104100 - RNA, 22 nt, Homo sapiens
uaagugcaacauaaguguuaaa

SEQ ID NO: 104101 - RNA, 22 nt, Homo sapiens
uaaguucauucaugaaacuuag

SEQ ID NO: 104102 - RNA, 22 nt, Homo sapiens
uaauugcaguucuguguuauau

SEQ ID NO: 104103 - RNA, 22 nt, Homo sapiens
uacaagcaggaaaugguauaug

SEQ ID NO: 104104 - RNA, 22 nt, Homo sapiens
uagacaacugaaacacugugca

SEQ ID NO: 104105 - RNA, 22 nt, Homo sapiens
uagaguacucugguaaguucuu

SEQ ID NO: 104106 - RNA, 19 nt, Homo sapiens
uagcacagggucccagacu

SEQ ID NO: 104107 - RNA, 22 nt, Homo sapiens
uagcuccacagcuauauauaau

SEQ ID NO: 104108 - RNA, 22 nt, Homo sapiens
uagguaguugugggcuugaaug

SEQ ID NO: 104109 - RNA, 22 nt, Homo sapiens
uauaguguuuucaaaaguaugu

SEQ ID NO: 104110 - RNA, 22 nt, Homo sapiens
uaucagcagagucauacuucaa

SEQ ID NO: 104111 - RNA, 22 nt, Homo sapiens
uauggcuucuauaaggaagcuu

SEQ ID NO: 104112 - RNA, 22 nt, Homo sapiens
uauuacauccauaggcucugcu

SEQ ID NO: 104113 - RNA, 22 nt, Homo sapiens
uauuacuugucugugucucaau

SEQ ID NO: 104114 - RNA, 22 nt, Homo sapiens
ucaaacacuccauaucgcgauu

SEQ ID NO: 104115 - RNA, 22 nt, Homo sapiens
ucaacugcuugagaucacaaau

SEQ ID NO: 104116 - RNA, 22 nt, Homo sapiens
ucacaaguguauagacaugucc

SEQ ID NO: 104117 - RNA, 22 nt, Homo sapiens
ucacagaggagaagaccuuuaa

SEQ ID NO: 104118 - RNA, 22 nt, Homo sapiens
ucacagugaguggaguggggug

SEQ ID NO: 104119 - RNA, 22 nt, Homo sapiens
ucacauguguaaauugguguaa

SEQ ID NO: 104120 - RNA, 22 nt, Homo sapiens
ucacugaaaccgccuccaccuc

SEQ ID NO: 104121 - RNA, 22 nt, Homo sapiens
ucacugaaacuguccuggguua

SEQ ID NO: 104122 - RNA, 20 nt, Homo sapiens
ucacugagugguccacagua

SEQ ID NO: 104123 - RNA, 23 nt, Homo sapiens
ucaguagucauugggaaagugug

SEQ ID NO: 104124 - RNA, 22 nt, Homo sapiens
ucauacaguaguccucacuugu

SEQ ID NO: 104125 - RNA, 22 nt, Homo sapiens
ucauaguacuuuguuuugaaaa

SEQ ID NO: 104126 - RNA, 22 nt, Homo sapiens
ucauggcacugaugagaguuuc

SEQ ID NO: 104127 - RNA, 22 nt, Homo sapiens
ucaugucuuguuguauuuauuu

SEQ ID NO: 104128 - RNA, 19 nt, Homo sapiens
ucccaagaugcucauacau

SEQ ID NO: 104129 - RNA, 22 nt, Homo sapiens
ucccugacagggucugagcuuu

SEQ ID NO: 104130 - RNA, 22 nt, Homo sapiens
uccuuuaguuaauaaagacaag

SEQ ID NO: 104131 - RNA, 22 nt, Homo sapiens
ucgcaccauugcacuccagcca

SEQ ID NO: 104132 - RNA, 22 nt, Homo sapiens
ucgcauuucccucuguagcuuc

SEQ ID NO: 104133 - RNA, 22 nt, Homo sapiens
ucuacagccaguucaggaagaa

SEQ ID NO: 104134 - RNA, 22 nt, Homo sapiens
ucuauggauaaaaugcccucau

SEQ ID NO: 104135 - RNA, 20 nt, Homo sapiens
ucucauggagggaaagagca

SEQ ID NO: 104136 - RNA, 22 nt, Homo sapiens
ucucccauccaugaacuucugu

SEQ ID NO: 104137 - RNA, 17 nt, Homo sapiens
ucucccaucccuuucuc

SEQ ID NO: 104138 - RNA, 22 nt, Homo sapiens
ucucccauccguacacggauug

SEQ ID NO: 104139 - RNA, 22 nt, Homo sapiens
ucuggagugugaaguggauaug

SEQ ID NO: 104140 - RNA, 22 nt, Homo sapiens
ucuugguuaggggaaauaggca

SEQ ID NO: 104141 - RNA, 22 nt, Homo sapiens
ugaaaugauuauaugguguuug

SEQ ID NO: 104142 - RNA, 22 nt, Homo sapiens
ugacauugggagugaagugaag

SEQ ID NO: 104143 - RNA, 22 nt, Homo sapiens
ugagaaugaugauugguaaacc

SEQ ID NO: 104144 - RNA, 22 nt, Homo sapiens
ugagagcugcauucuugaaagc

SEQ ID NO: 104145 - RNA, 22 nt, Homo sapiens
ugagaugaucaaaguauaggcu

SEQ ID NO: 104146 - RNA, 22 nt, Homo sapiens
ugagccaaguucacaccauugc

SEQ ID NO: 104147 - RNA, 22 nt, Homo sapiens
ugagguguauugggggaaauuc

SEQ ID NO: 104148 - RNA, 23 nt, Homo sapiens
ugagguguuaagcagacuugucu

SEQ ID NO: 104149 - RNA, 22 nt, Homo sapiens
ugagguuauuuguucaagaagu

SEQ ID NO: 104150 - RNA, 22 nt, Homo sapiens
ugaguggagacuguguguagag

SEQ ID NO: 104151 - RNA, 22 nt, Homo sapiens
ugauauguaugugaccuagaaa

SEQ ID NO: 104152 - RNA, 22 nt, Homo sapiens
ugauaugucacuugaucauggu

SEQ ID NO: 104153 - RNA, 22 nt, Homo sapiens
ugcaaauguuaggugucauuau

SEQ ID NO: 104154 - RNA, 21 nt, Homo sapiens
ugcauggagaacacugagggu

SEQ ID NO: 104155 - RNA, 22 nt, Homo sapiens
ugcauggauguuugaacacacu

SEQ ID NO: 104156 - RNA, 22 nt, Homo sapiens
ugcauuaucagauguuugcuuu

SEQ ID NO: 104157 - RNA, 22 nt, Homo sapiens
ugccaagaacauuuucuguuuu

SEQ ID NO: 104158 - RNA, 22 nt, Homo sapiens
ugccuaggcuggaaugcagugg

SEQ ID NO: 104159 - RNA, 22 nt, Homo sapiens
ugccuaggcuggaguguagugg

SEQ ID NO: 104160 - RNA, 22 nt, Homo sapiens
ugcuggugauucagauucaaau

SEQ ID NO: 104161 - RNA, 22 nt, Homo sapiens
uggaagacuuuagaggcuuaua

SEQ ID NO: 104162 - RNA, 22 nt, Homo sapiens
uggaauguaacuugaaacuuuu

SEQ ID NO: 104163 - RNA, 22 nt, Homo sapiens
uggacaagugcccuccaccuca

SEQ ID NO: 104164 - RNA, 22 nt, Homo sapiens
uggauugaaagcuuuaauauug

SEQ ID NO: 104165 - RNA, 22 nt, Homo sapiens
uggcaauguggaaugguccagg

SEQ ID NO: 104166 - RNA, 22 nt, Homo sapiens
uggcauguaaugcagaaguugc

SEQ ID NO: 104167 - RNA, 22 nt, Homo sapiens
uggcuuuuccaggcauuacgau

SEQ ID NO: 104168 - RNA, 22 nt, Homo sapiens
uggcuuuuguuauuuggaagcu

SEQ ID NO: 104169 - RNA, 22 nt, Homo sapiens
ugggaagcugcauuuuaacaag

SEQ ID NO: 104170 - RNA, 22 nt, Homo sapiens
ugggaauaugauacaggucuuu

SEQ ID NO: 104171 - RNA, 22 nt, Homo sapiens
ugguaagaggcccugaguuugu

SEQ ID NO: 104172 - RNA, 22 nt, Homo sapiens
uggucaguugaguccuugccaa

SEQ ID NO: 104173 - RNA, 21 nt, Homo sapiens
uggucaguuuucucacuagga

SEQ ID NO: 104174 - RNA, 22 nt, Homo sapiens
uguagauaucuaucaggucaau

SEQ ID NO: 104175 - RNA, 22 nt, Homo sapiens
uguagcuuuugagauuuauauu

SEQ ID NO: 104176 - RNA, 21 nt, Homo sapiens
uguauauguuuauacacacac

SEQ ID NO: 104177 - RNA, 22 nt, Homo sapiens
uguauguaauugaaguuaaguu

SEQ ID NO: 104178 - RNA, 22 nt, Homo sapiens
ugucaaagagacaucugcacuc

SEQ ID NO: 104179 - RNA, 22 nt, Homo sapiens
ugucaaugggaauuuguuuuag

SEQ ID NO: 104180 - RNA, 18 nt, Homo sapiens
ugucuuagagcuugaccc

SEQ ID NO: 104181 - RNA, 22 nt, Homo sapiens
ugugaacauuuuguauauauua

SEQ ID NO: 104182 - RNA, 22 nt, Homo sapiens
ugugagaucucagaauugaacu

SEQ ID NO: 104183 - RNA, 22 nt, Homo sapiens
uccuucaugcaucaauguaucc

SEQ ID NO: 104184 - RNA, 22 nt, Homo sapiens
uccuucauuugucaacucuagu

SEQ ID NO: 104185 - RNA, 22 nt, Homo sapiens
ucgugcaaacguaauugugguu

SEQ ID NO: 104186 - RNA, 19 nt, Homo sapiens
ucucaguguuggucaggug

SEQ ID NO: 104187 - RNA, 22 nt, Homo sapiens
ucuccggguggcggcgaaggga

SEQ ID NO: 104188 - RNA, 22 nt, Homo sapiens
ucucugagaccacuccaaacuc

SEQ ID NO: 104189 - RNA, 23 nt, Homo sapiens
ucuugguuauagaaaaauaguug

SEQ ID NO: 104190 - RNA, 22 nt, Homo sapiens
ucuugguugaaaauucauaaua

SEQ ID NO: 104191 - RNA, 20 nt, Homo sapiens
ucuuuuuguggccccagagu

SEQ ID NO: 104192 - RNA, 22 nt, Homo sapiens
ugaaaugaucaguuugguuacu

SEQ ID NO: 104193 - RNA, 22 nt, Homo sapiens
ugaauagacacuaaagacugua

SEQ ID NO: 104194 - RNA, 22 nt, Homo sapiens
ugaauauuugcuacucacucuu

SEQ ID NO: 104195 - RNA, 22 nt, Homo sapiens
ugaauucuguccaaaauaacug

SEQ ID NO: 104196 - RNA, 22 nt, Homo sapiens
ugacaagugauuaaggcauauu

SEQ ID NO: 104197 - RNA, 22 nt, Homo sapiens
ugacaguaaacagucuugauua

SEQ ID NO: 104198 - RNA, 22 nt, Homo sapiens
ugagaauauuugaagauguuag

SEQ ID NO: 104199 - RNA, 22 nt, Homo sapiens
ugagaauauuuuccaugucuca

SEQ ID NO: 104200 - RNA, 22 nt, Homo sapiens
ugagauaaucaugugauuucau

SEQ ID NO: 104201 - RNA, 22 nt, Homo sapiens
ugagauauugggaguaauguca

SEQ ID NO: 104202 - RNA, 22 nt, Homo sapiens
ugagaugaugggauaagagggc

SEQ ID NO: 104203 - RNA, 22 nt, Homo sapiens
ugagcagaaguuuugauuggcg

SEQ ID NO: 104204 - RNA, 22 nt, Homo sapiens
ugagcagagggagaaguaaauu

SEQ ID NO: 104205 - RNA, 22 nt, Homo sapiens
ugagggaugcguacccuaugcc

SEQ ID NO: 104206 - RNA, 20 nt, Homo sapiens
ugaggucaggaguuacagac

SEQ ID NO: 104207 - RNA, 22 nt, Homo sapiens
ugagucagucucacucugcugc

SEQ ID NO: 104208 - RNA, 22 nt, Homo sapiens
ugagugaggcugggcagucccu

SEQ ID NO: 104209 - RNA, 22 nt, Homo sapiens
ugauaugucccucgacaucagg

SEQ ID NO: 104210 - RNA, 22 nt, Homo sapiens
ugaugguuuuaaaaagaggagu

SEQ ID NO: 104211 - RNA, 22 nt, Homo sapiens
ugcaaagucgaaacugcaguuu

SEQ ID NO: 104212 - RNA, 22 nt, Homo sapiens
ugcaaaugcugcuauuucucuu

SEQ ID NO: 104213 - RNA, 22 nt, Homo sapiens
ugcaagaaacauauuccacaag

SEQ ID NO: 104214 - RNA, 22 nt, Homo sapiens
ugcaagacaucguauuuugguc

SEQ ID NO: 104215 - RNA, 22 nt, Homo sapiens
ugcaauauccucuacuauaggu

SEQ ID NO: 104216 - RNA, 22 nt, Homo sapiens
ugcaaucauuuggaggagaaga

SEQ ID NO: 104217 - RNA, 21 nt, Homo sapiens
ugcaugguagucacaugauuc

SEQ ID NO: 104218 - RNA, 22 nt, Homo sapiens
ugccaguauuuuacugaggauu

SEQ ID NO: 104219 - RNA, 22 nt, Homo sapiens
ugcucaguuuaaaacuuuugag

SEQ ID NO: 104220 - RNA, 22 nt, Homo sapiens
uggaaaauuaggggagguuaua

SEQ ID NO: 104221 - RNA, 20 nt, Homo sapiens
uggaaucuaggcggagguuu

SEQ ID NO: 104222 - RNA, 22 nt, Homo sapiens
uggagagucauuuauaguauuu

SEQ ID NO: 104223 - RNA, 22 nt, Homo sapiens
uggauagauacuauccaggacu

SEQ ID NO: 104224 - RNA, 22 nt, Homo sapiens
uggcaagaaggauuuauuccuu

SEQ ID NO: 104225 - RNA, 22 nt, Homo sapiens
uggcaguuucacauggcucaac

SEQ ID NO: 104226 - RNA, 22 nt, Homo sapiens
uggcaugauccuagauucaaca

SEQ ID NO: 104227 - RNA, 22 nt, Homo sapiens
uggcuuuucauccugggacauu

SEQ ID NO: 104228 - RNA, 22 nt, Homo sapiens
ugggaaauguagccuagcugug

SEQ ID NO: 104229 - RNA, 22 nt, Homo sapiens
ugguaagaucagaacuggaguc

SEQ ID NO: 104230 - RNA, 22 nt, Homo sapiens
ugguaaguuuaacaugcauccc

SEQ ID NO: 104231 - RNA, 22 nt, Homo sapiens
uguauguaaagacaggauaaca

SEQ ID NO: 104232 - RNA, 22 nt, Homo sapiens
ugucauauagaauguucuauga

SEQ ID NO: 104233 - RNA, 19 nt, Homo sapiens
ugucccagccauagaggca

SEQ ID NO: 104234 - RNA, 22 nt, Homo sapiens
ugucuuggagaauccuggguuu

SEQ ID NO: 104235 - RNA, 22 nt, Homo sapiens
ugugcacaacgugcagguuugu

SEQ ID NO: 104236 - RNA, 22 nt, Homo sapiens
ugugcacaaugugcagguuugu

SEQ ID NO: 104237 - RNA, 22 nt, Homo sapiens
ugugcacauugugcagguugau

SEQ ID NO: 104238 - RNA, 22 nt, Homo sapiens
ugugccacugcacuccugccug

SEQ ID NO: 104239 - RNA, 22 nt, Homo sapiens
uguggucaucacuugaagguaa

SEQ ID NO: 104240 - RNA, 22 nt, Homo sapiens
uguguaaauaugauagaggaau

SEQ ID NO: 104241 - RNA, 22 nt, Homo sapiens
ugugucuuuuaucacacaaugu

SEQ ID NO: 104242 - RNA, 22 nt, Homo sapiens
uguucaugaguucucauuuuua

SEQ ID NO: 104243 - RNA, 22 nt, Homo sapiens
uguucuggagaguuuagucugg

SEQ ID NO: 104244 - RNA, 22 nt, Homo sapiens
uuaacagucacuuagcucauuu

SEQ ID NO: 104245 - RNA, 22 nt, Homo sapiens
uuacauguuguggguuguggcc

SEQ ID NO: 104246 - RNA, 22 nt, Homo sapiens
uuauacuacuauaaagagguag

SEQ ID NO: 104247 - RNA, 22 nt, Homo sapiens
uuauggauuuauauucuguagu

SEQ ID NO: 104248 - RNA, 22 nt, Homo sapiens
uuauggcaaugccccacuccua

SEQ ID NO: 104249 - RNA, 22 nt, Homo sapiens
uuauguguuuaauguuucugaa

SEQ ID NO: 104250 - RNA, 22 nt, Homo sapiens
uucacacugggccuacucugug

SEQ ID NO: 104251 - RNA, 22 nt, Homo sapiens
uucaccuguagcaugcccuugg

SEQ ID NO: 104252 - RNA, 22 nt, Homo sapiens
uucacugcacuccagccugagc

SEQ ID NO: 104253 - RNA, 22 nt, Homo sapiens
uucagaguggacagaaauuaag

SEQ ID NO: 104254 - RNA, 22 nt, Homo sapiens
uucaguaguacauucccguguu

SEQ ID NO: 104255 - RNA, 18 nt, Homo sapiens
uucauaguagcaugauuu

SEQ ID NO: 104256 - RNA, 22 nt, Homo sapiens
uucauaguucuuuuagucauua

SEQ ID NO: 104257 - RNA, 22 nt, Homo sapiens
auaacauccuuucuuaucguug

SEQ ID NO: 104258 - RNA, 22 nt, Homo sapiens
auacaagcaguccaacuccaua

SEQ ID NO: 104259 - RNA, 22 nt, Homo sapiens
auacaugugugagcgaagaugu

SEQ ID NO: 104260 - RNA, 22 nt, Homo sapiens
auacauguucaagggcauauau

SEQ ID NO: 104261 - RNA, 22 nt, Homo sapiens
auagcacaguguguguacacca

SEQ ID NO: 104262 - RNA, 22 nt, Homo sapiens
auaucacaaacaagucuguacu

SEQ ID NO: 104263 - RNA, 22 nt, Homo sapiens
auaucacucccaauaucgcagg

SEQ ID NO: 104264 - RNA, 22 nt, Homo sapiens
auaucagugucuuacuguuuuu

SEQ ID NO: 104265 - RNA, 20 nt, Homo sapiens
auaugcauguguuuucacuu

SEQ ID NO: 104266 - RNA, 21 nt, Homo sapiens
auaugugcuguggaagucagc

SEQ ID NO: 104267 - RNA, 22 nt, Homo sapiens
auauucacagguaucagagauu

SEQ ID NO: 104268 - RNA, 22 nt, Homo sapiens
aucaaaguaucucaauauggua

SEQ ID NO: 104269 - RNA, 22 nt, Homo sapiens
aucauauccuagauauaacuuc

SEQ ID NO: 104270 - RNA, 22 nt, Homo sapiens
aucccuuccuagcacuuggugu

SEQ ID NO: 104271 - RNA, 22 nt, Homo sapiens
aucgcaccauugcacuccagca

SEQ ID NO: 104272 - RNA, 22 nt, Homo sapiens
aucgcgccauuguacuccagcc

SEQ ID NO: 104273 - RNA, 22 nt, Homo sapiens
aucucaguucaggcuggccaca

SEQ ID NO: 104274 - RNA, 22 nt, Homo sapiens
augacauugaaaagcaagugga

SEQ ID NO: 104275 - RNA, 22 nt, Homo sapiens
augagauuauguaaagagacca

SEQ ID NO: 104276 - RNA, 22 nt, Homo sapiens
augaugaaguaagugcuuagga

SEQ ID NO: 104277 - RNA, 22 nt, Homo sapiens
augauuguucucacucaagaga

SEQ ID NO: 104278 - RNA, 22 nt, Homo sapiens
augcaaaucuuaaguaugugug

SEQ ID NO: 104279 - RNA, 22 nt, Homo sapiens
augcacaguccagcccaugugg

SEQ ID NO: 104280 - RNA, 22 nt, Homo sapiens
augcagaucacauuuuucuguc

SEQ ID NO: 104281 - RNA, 22 nt, Homo sapiens
auggcaaaaaaugcaauuacuu

SEQ ID NO: 104282 - RNA, 22 nt, Homo sapiens
auggcaauguaagucagaaaaa

SEQ ID NO: 104283 - RNA, 22 nt, Homo sapiens
auggcuuuggucucccagugau

SEQ ID NO: 104284 - RNA, 22 nt, Homo sapiens
auggcuuuguguucagagcuga

SEQ ID NO: 104285 - RNA, 22 nt, Homo sapiens
augguuuauuuguaagcagagu

SEQ ID NO: 104286 - RNA, 22 nt, Homo sapiens
augguuuuacugcaaaauggga

SEQ ID NO: 104287 - RNA, 22 nt, Homo sapiens
auguaacugggacacaagccuc

SEQ ID NO: 104288 - RNA, 22 nt, Homo sapiens
augugcuuuuuaaacagaugcu

SEQ ID NO: 104289 - RNA, 22 nt, Homo sapiens
auuaaguaaugguuccaauaau

SEQ ID NO: 104290 - RNA, 22 nt, Homo sapiens
auuaauguaauuaguaaaguug

SEQ ID NO: 104291 - RNA, 22 nt, Homo sapiens
auuauguuguauuuccuugcag

SEQ ID NO: 104292 - RNA, 22 nt, Homo sapiens
auuccacuuccacuaguuucuc

SEQ ID NO: 104293 - RNA, 22 nt, Homo sapiens
auugcacuccacccugggcaac

SEQ ID NO: 104294 - RNA, 22 nt, Homo sapiens
auugcacugcagccugggcaac

SEQ ID NO: 104295 - RNA, 22 nt, Homo sapiens
auugcucuuagaaauauuucuu

SEQ ID NO: 104296 - RNA, 22 nt, Homo sapiens
auugugauggucaaaggaaaua

SEQ ID NO: 104297 - RNA, 22 nt, Homo sapiens
auuuagcaauggagguagugua

SEQ ID NO: 104298 - RNA, 22 nt, Homo sapiens
caaaagugguucuuauccuuuu

SEQ ID NO: 104299 - RNA, 22 nt, Homo sapiens
caacagucagcccauccacaga

SEQ ID NO: 104300 - RNA, 22 nt, Homo sapiens
cacauguucaggagcacuuaga

SEQ ID NO: 104301 - RNA, 22 nt, Homo sapiens
cacauguuugcuacauuuuucu

SEQ ID NO: 104302 - RNA, 22 nt, Homo sapiens
caccagguuggagugcaguggu

SEQ ID NO: 104303 - RNA, 22 nt, Homo sapiens
cagucacagugacaggaugugg

SEQ ID NO: 104304 - RNA, 22 nt, Homo sapiens
cagugaauuucaggucaagagu

SEQ ID NO: 104305 - RNA, 22 nt, Homo sapiens
cagugcaaccuccaucucucgg

SEQ ID NO: 104306 - RNA, 22 nt, Homo sapiens
cauauaguaguacuguuagguu

SEQ ID NO: 104307 - RNA, 21 nt, Homo sapiens
caugucacugcacucuagccu

SEQ ID NO: 104308 - RNA, 22 nt, Homo sapiens
cauugcacuuagacaacuuuug

SEQ ID NO: 104309 - RNA, 22 nt, Homo sapiens
cauuugguggcuacagaguaac

SEQ ID NO: 104310 - RNA, 22 nt, Homo sapiens
ccaaggcacugauucuguacuc

SEQ ID NO: 104311 - RNA, 22 nt, Homo sapiens
ccagucuuggugucuguagcac

SEQ ID NO: 104312 - RNA, 18 nt, Homo sapiens
ccagugcaaggaaagccc

SEQ ID NO: 104313 - RNA, 22 nt, Homo sapiens
ccaucccuuucugagcaguucc

SEQ ID NO: 104314 - RNA, 19 nt, Homo sapiens
cccagugucagagaagggu

SEQ ID NO: 104315 - RNA, 19 nt, Homo sapiens
cccuggcacauggaaaaug

SEQ ID NO: 104316 - RNA, 21 nt, Homo sapiens
ccucuuugagggaagaaaggg

SEQ ID NO: 104317 - RNA, 22 nt, Homo sapiens
cggcaguggguaagccaagcuu

SEQ ID NO: 104318 - RNA, 22 nt, Homo sapiens
cuacacaugcaggcucccugcc

SEQ ID NO: 104319 - RNA, 22 nt, Homo sapiens
cuagcccagugcuccuggauca

SEQ ID NO: 104320 - RNA, 22 nt, Homo sapiens
cuagguagcuuuucugucaugu

SEQ ID NO: 104321 - RNA, 22 nt, Homo sapiens
cucacaguucuaaaggcaagaa

SEQ ID NO: 104322 - RNA, 22 nt, Homo sapiens
cucaguggauuagauaaugcac

SEQ ID NO: 104323 - RNA, 22 nt, Homo sapiens
cucaguguuucagcugcucaga

SEQ ID NO: 104324 - RNA, 22 nt, Homo sapiens
cucauggaauacuucacagcca

SEQ ID NO: 104325 - RNA, 22 nt, Homo sapiens
cucccauugcaaacaacagaag

SEQ ID NO: 104326 - RNA, 22 nt, Homo sapiens
cuggaaucuagaaaagguaagg

SEQ ID NO: 104327 - RNA, 22 nt, Homo sapiens
cugggaucaguucuagucagaa

SEQ ID NO: 104328 - RNA, 21 nt, Homo sapiens
cugguguuagcacuucuuccc

SEQ ID NO: 104329 - RNA, 22 nt, Homo sapiens
cuuaaguaguuguggaaugaau

SEQ ID NO: 104330 - RNA, 22 nt, Homo sapiens
cuucugauugaaaauggaguag

SEQ ID NO: 104331 - RNA, 22 nt, Homo sapiens
cuuuacaguuggacucacgagg

SEQ ID NO: 104332 - RNA, 17 nt, Homo sapiens
gacgaucaucaggaggc

SEQ ID NO: 104333 - RNA, 22 nt, Homo sapiens
gagagugcuuuggguguaggcc

SEQ ID NO: 104334 - RNA, 22 nt, Homo sapiens
gagcaaaaguauguauugguua

SEQ ID NO: 104335 - RNA, 22 nt, Homo sapiens
gagucagugucuugcucuguca

SEQ ID NO: 104336 - RNA, 22 nt, Homo sapiens
gauaaaucuuggcuagucuaag

SEQ ID NO: 104337 - RNA, 20 nt, Homo sapiens
gcaaauggaucccacaagcc

SEQ ID NO: 104338 - RNA, 22 nt, Homo sapiens
gcaguguucugggcaggaagaa

SEQ ID NO: 104339 - RNA, 22 nt, Homo sapiens
gcaguguuggggccggaggcug

SEQ ID NO: 104340 - RNA, 22 nt, Homo sapiens
gccccaguacaggcuccuuaga

SEQ ID NO: 104341 - RNA, 22 nt, Homo sapiens
ggaaagacuauuguaaaggaug

SEQ ID NO: 104342 - RNA, 22 nt, Homo sapiens
ggaguaggcuguccggcaccca

SEQ ID NO: 104343 - RNA, 22 nt, Homo sapiens
ggauugugauaauuguugcaaa

SEQ ID NO: 104344 - RNA, 21 nt, Homo sapiens
uggcaacauggauggauucug

SEQ ID NO: 104345 - RNA, 22 nt, Homo sapiens
uggcaagaacgaaauguagggu

SEQ ID NO: 104346 - RNA, 22 nt, Homo sapiens
uggcaagaagagcaugagacca

SEQ ID NO: 104347 - RNA, 22 nt, Homo sapiens
uggcaagagcugcauucaucug

SEQ ID NO: 104348 - RNA, 22 nt, Homo sapiens
aaagaagucagccuguccuuug

SEQ ID NO: 104349 - RNA, 22 nt, Homo sapiens
aaagagcugagaccugguggag

SEQ ID NO: 104350 - RNA, 22 nt, Homo sapiens
aaagcagcaggugguuuucaau

SEQ ID NO: 104351 - RNA, 22 nt, Homo sapiens
aaagugccugacucauaguuag

SEQ ID NO: 104352 - RNA, 20 nt, Homo sapiens
aaaugcuguaauguuuggga

SEQ ID NO: 104353 - RNA, 22 nt, Homo sapiens
aaaugcugucaaauuguguucu

SEQ ID NO: 104354 - RNA, 22 nt, Homo sapiens
aaaugguguuaguagaucuuua

SEQ ID NO: 104355 - RNA, 22 nt, Homo sapiens
aaaugucauggaguguuucccc

SEQ ID NO: 104356 - RNA, 19 nt, Homo sapiens
aaaugugcacuguuuucca

SEQ ID NO: 104357 - RNA, 22 nt, Homo sapiens
aaauugcaguuaggaugauggu

SEQ ID NO: 104358 - RNA, 18 nt, Homo sapiens
aagagcucagcacagguu

SEQ ID NO: 104359 - RNA, 22 nt, Homo sapiens
aagaucauucagggaaggcuga

SEQ ID NO: 104360 - RNA, 22 nt, Homo sapiens
aaggagcuuaagugacuuguac

SEQ ID NO: 104361 - RNA, 22 nt, Homo sapiens
aaguaaacauuuuguacaauaa

SEQ ID NO: 104362 - RNA, 22 nt, Homo sapiens
aaguaauggaguuauuuuauga

SEQ ID NO: 104363 - RNA, 19 nt, Homo sapiens
aaguaguugugacagaugc

SEQ ID NO: 104364 - RNA, 22 nt, Homo sapiens
aagugcuuuacacaugcaugau

SEQ ID NO: 104365 - RNA, 22 nt, Homo sapiens
aaguuaauguuuaagacuccua

SEQ ID NO: 104366 - RNA, 22 nt, Homo sapiens
aauucacuucuuuuaggcaggg

SEQ ID NO: 104367 - RNA, 22 nt, Homo sapiens
aauugcuucuguauuuuggaca

SEQ ID NO: 104368 - RNA, 17 nt, Homo sapiens
acaaauugccagcuagg

SEQ ID NO: 104369 - RNA, 22 nt, Homo sapiens
acaauguauauuuuacuguagg

SEQ ID NO: 104370 - RNA, 22 nt, Homo sapiens
acaguguagugacugccaacuu

SEQ ID NO: 104371 - RNA, 22 nt, Homo sapiens
acaucacuguuugauugauuga

SEQ ID NO: 104372 - RNA, 22 nt, Homo sapiens
aaagugcaguacuucguauauu

SEQ ID NO: 104373 - RNA, 22 nt, Homo sapiens
aaaugacuuuuuaugcagagua

SEQ ID NO: 104374 - RNA, 22 nt, Homo sapiens
aaaugcugcuuuggccucuucu

SEQ ID NO: 104375 - RNA, 22 nt, Homo sapiens
aaauucaucaaaugguuuguau

SEQ ID NO: 104376 - RNA, 22 nt, Homo sapiens
aaccuguaaccauaugaucagu

SEQ ID NO: 104377 - RNA, 22 nt, Homo sapiens
aagacuguaauccaucuugagu

SEQ ID NO: 104378 - RNA, 22 nt, Homo sapiens
aagagccgcaagggugaagggu

SEQ ID NO: 104379 - RNA, 22 nt, Homo sapiens
aagaucaucauagagggcauga

SEQ ID NO: 104380 - RNA, 22 nt, Homo sapiens
aagcaggugugggaggaaaugg

SEQ ID NO: 104381 - RNA, 22 nt, Homo sapiens
aagccacuguaccugucucuua

SEQ ID NO: 104382 - RNA, 22 nt, Homo sapiens
aagcuccauuucugccaugaga

SEQ ID NO: 104383 - RNA, 22 nt, Homo sapiens
aaguagcagaggcaagacuuga

SEQ ID NO: 104384 - RNA, 22 nt, Homo sapiens
aauggcacuuuauaaauguuaa

SEQ ID NO: 104385 - RNA, 22 nt, Homo sapiens
aaugucacugugguccuccagu

SEQ ID NO: 104386 - RNA, 22 nt, Homo sapiens
acacuguagcugagggcaugcg

SEQ ID NO: 104387 - RNA, 22 nt, Homo sapiens
acuacaugugaugucaguauau

SEQ ID NO: 104388 - RNA, 22 nt, Homo sapiens
acuauacugaagcaaauuaaca

SEQ ID NO: 104389 - RNA, 22 nt, Homo sapiens
acugcacuccagccucggcaau

SEQ ID NO: 104390 - RNA, 22 nt, Homo sapiens
acugcacuccagccuuggcaac

SEQ ID NO: 104391 - RNA, 22 nt, Homo sapiens
acugggucaaaguagaaaacua

SEQ ID NO: 104392 - RNA, 22 nt, Homo sapiens
agaauguaacucuaugaaggca

SEQ ID NO: 104393 - RNA, 22 nt, Homo sapiens
agacacuguugaaaaggcccca

SEQ ID NO: 104394 - RNA, 22 nt, Homo sapiens
agagcaaugacaugcuaugugg

SEQ ID NO: 104395 - RNA, 22 nt, Homo sapiens
agaugauguuuacugagcauca

SEQ ID NO: 104396 - RNA, 21 nt, Homo sapiens
agccugugggucauaguugcc

SEQ ID NO: 104397 - RNA, 22 nt, Homo sapiens
agcuccaucuucagggguucag

SEQ ID NO: 104398 - RNA, 22 nt, Homo sapiens
agcuccaugauaguaugucugu

SEQ ID NO: 104399 - RNA, 22 nt, Homo sapiens
agcugguauuuugucgaggacu

SEQ ID NO: 104400 - RNA, 22 nt, Homo sapiens
aggacacugauguaugcugugg

SEQ ID NO: 104401 - RNA, 22 nt, Homo sapiens
agguuuucagccccagccuagg

SEQ ID NO: 104402 - RNA, 22 nt, Homo sapiens
aguaaucaucugagggcagaaa

SEQ ID NO: 104403 - RNA, 22 nt, Homo sapiens
aguauguagugcaaucagucag

SEQ ID NO: 104404 - RNA, 22 nt, Homo sapiens
agucaagugggguuagauaguu

SEQ ID NO: 104405 - RNA, 22 nt, Homo sapiens
agucacaugcauuuucuucaau

SEQ ID NO: 104406 - RNA, 22 nt, Homo sapiens
agugcacuccagccugggcaac

SEQ ID NO: 104407 - RNA, 22 nt, Homo sapiens
aguugcaagucuugaguaaaga

SEQ ID NO: 104408 - RNA, 22 nt, Homo sapiens
auaaagcaagucucuggccuca

SEQ ID NO: 104409 - RNA, 22 nt, Homo sapiens
auaaaugcaaugguauuuuuga

SEQ ID NO: 104410 - RNA, 22 nt, Homo sapiens
auacaguaucuucuggcaagca

SEQ ID NO: 104411 - RNA, 22 nt, Homo sapiens
auacaugugcaggucagguuac

SEQ ID NO: 104412 - RNA, 22 nt, Homo sapiens
auacuaugagauaauaaagacu

SEQ ID NO: 104413 - RNA, 22 nt, Homo sapiens
gucacauugaugcccauggugg

SEQ ID NO: 104414 - RNA, 22 nt, Homo sapiens
gucacugccugaggcugaugca

SEQ ID NO: 104415 - RNA, 22 nt, Homo sapiens
gucagguaccugaaagcagcca

SEQ ID NO: 104416 - RNA, 22 nt, Homo sapiens
gucagugcauguaaacauaaaa

SEQ ID NO: 104417 - RNA, 22 nt, Homo sapiens
gucaguuucacucagcuggaac

SEQ ID NO: 104418 - RNA, 22 nt, Homo sapiens
gucaguuugguuaaucauucca

SEQ ID NO: 104419 - RNA, 22 nt, Homo sapiens
gugaccagaugggcaggggugu

SEQ ID NO: 104420 - RNA, 22 nt, Homo sapiens
gugagaagaaaaauauggcugu

SEQ ID NO: 104421 - RNA, 22 nt, Homo sapiens
gugcaagagugacugcaguuuu

SEQ ID NO: 104422 - RNA, 22 nt, Homo sapiens
gugcaagagugauugcaguuuu

SEQ ID NO: 104423 - RNA, 21 nt, Homo sapiens
gugcacaguaguguuuaauag

SEQ ID NO: 104424 - RNA, 22 nt, Homo sapiens
gugcauacucuggagacauugu

SEQ ID NO: 104425 - RNA, 18 nt, Homo sapiens
gugcauagccauggcagc

SEQ ID NO: 104426 - RNA, 22 nt, Homo sapiens
guggaaugaaaacucucucaca

SEQ ID NO: 104427 - RNA, 22 nt, Homo sapiens
guggaaugcaguguugauucaa

SEQ ID NO: 104428 - RNA, 22 nt, Homo sapiens
guggcaaguguuccaagaggcg

SEQ ID NO: 104429 - RNA, 22 nt, Homo sapiens
guggcuuuauuuagaagcaggg

SEQ ID NO: 104430 - RNA, 22 nt, Homo sapiens
guguauguuguccauggaugcg

SEQ ID NO: 104431 - RNA, 22 nt, Homo sapiens
guguauguuucucccugucccu

SEQ ID NO: 104432 - RNA, 21 nt, Homo sapiens
gugucacagacaugacagaug

SEQ ID NO: 104433 - RNA, 22 nt, Homo sapiens
gugucccagugugcauacaggu

SEQ ID NO: 104434 - RNA, 22 nt, Homo sapiens
guuuggauauuaggcaagagua

SEQ ID NO: 104435 - RNA, 21 nt, Homo sapiens
uaaaugucauacaaagcaaug

SEQ ID NO: 104436 - RNA, 22 nt, Homo sapiens
uaacaguguauuccuuuggaca

SEQ ID NO: 104437 - RNA, 22 nt, Homo sapiens
uaacauagucauauacuugcuu

SEQ ID NO: 104438 - RNA, 22 nt, Homo sapiens
uaaggcuagcaagaugagaaua

SEQ ID NO: 104439 - RNA, 22 nt, Homo sapiens
uaaugugcuucucuaccauagg

SEQ ID NO: 104440 - RNA, 17 nt, Homo sapiens
uagcucuauuucuagcc

SEQ ID NO: 104441 - RNA, 22 nt, Homo sapiens
uauagcuugaaggaauggucau

SEQ ID NO: 104442 - RNA, 22 nt, Homo sapiens
uaucagcacaguggguucaugg

SEQ ID NO: 104443 - RNA, 21 nt, Homo sapiens
uauccacuugcaacagagaag

SEQ ID NO: 104444 - RNA, 22 nt, Homo sapiens
uaucugcaucccauuuuuauca

SEQ ID NO: 104445 - RNA, 22 nt, Homo sapiens
uauggcaaugcauaggaaggaa

SEQ ID NO: 104446 - RNA, 20 nt, Homo sapiens
uauucacucuccagucuugc

SEQ ID NO: 104447 - RNA, 22 nt, Homo sapiens
uauuccacucuguuggagguaa

SEQ ID NO: 104448 - RNA, 22 nt, Homo sapiens
uauuccacuuacaugagguauc

SEQ ID NO: 104449 - RNA, 22 nt, Homo sapiens
uauuccuuuugcauuuccacau

SEQ ID NO: 104450 - RNA, 22 nt, Homo sapiens
uauuguacauguuauagauuuu

SEQ ID NO: 104451 - RNA, 22 nt, Homo sapiens
ucaaguaguaacuaacugugac

SEQ ID NO: 104452 - RNA, 22 nt, Homo sapiens
ucaaguagugacucgaguuauu

SEQ ID NO: 104453 - RNA, 22 nt, Homo sapiens
ucaauguaucuccaagaauuga

SEQ ID NO: 104454 - RNA, 22 nt, Homo sapiens
ucacaaagcuuggccugcuucu

SEQ ID NO: 104455 - RNA, 22 nt, Homo sapiens
ucacaugugcguuuuggcaugu

SEQ ID NO: 104456 - RNA, 22 nt, Homo sapiens
ucaccaccuuccaggaccacug

SEQ ID NO: 104457 - RNA, 22 nt, Homo sapiens
ucacugaaaccacugccuccug

SEQ ID NO: 104458 - RNA, 22 nt, Homo sapiens
ucacugaaaccuccgccuucug

SEQ ID NO: 104459 - RNA, 22 nt, Homo sapiens
ucacugcacuagguaaugccac

SEQ ID NO: 104460 - RNA, 22 nt, Homo sapiens
ucacugcacucuccgccuugcg

SEQ ID NO: 104461 - RNA, 22 nt, Homo sapiens
ucagucauugauggaguagguc

SEQ ID NO: 104462 - RNA, 22 nt, Homo sapiens
ucagucuuuuuuuggcaagcau

SEQ ID NO: 104463 - RNA, 22 nt, Homo sapiens
ucagugccucaguuuuuaaaga

SEQ ID NO: 104464 - RNA, 22 nt, Homo sapiens
ucaguuuagguguaacggccac

SEQ ID NO: 104465 - RNA, 22 nt, Homo sapiens
ucaugaaguaguuaacugguug

SEQ ID NO: 104466 - RNA, 22 nt, Homo sapiens
uccacuuuugugcugaauugga

SEQ ID NO: 104467 - RNA, 22 nt, Homo sapiens
uccauaguugcacucuggagcc

SEQ ID NO: 104468 - RNA, 22 nt, Homo sapiens
uccauggagacacauuuuauau

SEQ ID NO: 104469 - RNA, 22 nt, Homo sapiens
uccauuuguagguagugagaca

SEQ ID NO: 104470 - RNA, 17 nt, Homo sapiens
ucccauguuucuucuac

SEQ ID NO: 104471 - RNA, 18 nt, Homo sapiens
ucccucagaauuauagaa

SEQ ID NO: 104472 - RNA, 19 nt, Homo sapiens
ucccuuuguauggacauac

SEQ ID NO: 104473 - RNA, 20 nt, Homo sapiens
ucgcaccacuauacuccagc

SEQ ID NO: 104474 - RNA, 17 nt, Homo sapiens
ucuaauaauaugcauuu

SEQ ID NO: 104475 - RNA, 22 nt, Homo sapiens
ucuauguuuuugcuaguagugu

SEQ ID NO: 104476 - RNA, 22 nt, Homo sapiens
ucucaguguuaucuaucugccu

SEQ ID NO: 104477 - RNA, 20 nt, Homo sapiens
ucucauggagguagagaaua

SEQ ID NO: 104478 - RNA, 22 nt, Homo sapiens
ucucauggagguagagaguaaa

SEQ ID NO: 104479 - RNA, 22 nt, Homo sapiens
ucuuuuugagucaguuucggua

SEQ ID NO: 104480 - RNA, 22 nt, Homo sapiens
ugaaacacacauugcccuuuau

SEQ ID NO: 104481 - RNA, 21 nt, Homo sapiens
ugaacacuggacugagugucc

SEQ ID NO: 104482 - RNA, 22 nt, Homo sapiens
ugacaggagauuaugugauguu

SEQ ID NO: 104483 - RNA, 22 nt, Homo sapiens
ugacuauaggauaacaugcauu

SEQ ID NO: 104484 - RNA, 22 nt, Homo sapiens
ugagaacagauggcuuuauuau

SEQ ID NO: 104485 - RNA, 22 nt, Homo sapiens
ugagaagugauauagaaguuaa

SEQ ID NO: 104486 - RNA, 22 nt, Homo sapiens
ugagagucauacaaauaaaaau

SEQ ID NO: 104487 - RNA, 22 nt, Homo sapiens
ugagaugaagcuagaagaaugg

SEQ ID NO: 104488 - RNA, 22 nt, Homo sapiens
ugagguguuauccagaguucuu

SEQ ID NO: 104489 - RNA, 22 nt, Homo sapiens
ugauaguguccugugccacauu

SEQ ID NO: 104490 - RNA, 19 nt, Homo sapiens
ugcaaauucuaaaaacuga

SEQ ID NO: 104491 - RNA, 21 nt, Homo sapiens
ugcauaucucuaaugaccagu

SEQ ID NO: 104492 - RNA, 22 nt, Homo sapiens
ugcauggucauacauggcaccc

SEQ ID NO: 104493 - RNA, 19 nt, Homo sapiens
ugccaagaaagucagcuua

SEQ ID NO: 104494 - RNA, 22 nt, Homo sapiens
ugccaguauuuuauugaagauu

SEQ ID NO: 104495 - RNA, 22 nt, Homo sapiens
ugccaguauuuuauugaggauu

SEQ ID NO: 104496 - RNA, 22 nt, Homo sapiens
ugccuaggcuggagugcagugg

SEQ ID NO: 104497 - RNA, 22 nt, Homo sapiens
ugcugguggucccauaugauua

SEQ ID NO: 104498 - RNA, 22 nt, Homo sapiens
ugcuuuguugaaaaucauuugg

SEQ ID NO: 104499 - RNA, 18 nt, Homo sapiens
aaaaagugcucaggccua

SEQ ID NO: 104500 - RNA, 22 nt, Homo sapiens
aaaagugguguuguuucuaaau

SEQ ID NO: 104501 - RNA, 18 nt, Homo sapiens
aaacugcuuccuuggccu

SEQ ID NO: 104502 - RNA, 22 nt, Homo sapiens
aaagaguucagguagauuucaa

SEQ ID NO: 104503 - RNA, 22 nt, Homo sapiens
aaaguacugggauuggccgggu

SEQ ID NO: 104504 - RNA, 22 nt, Homo sapiens
aaauucaugucaccucuaggua

SEQ ID NO: 104505 - RNA, 22 nt, Homo sapiens
aacucacauucuuucuugguac

SEQ ID NO: 104506 - RNA, 20 nt, Homo sapiens
aagacacuguccccacugga

SEQ ID NO: 104507 - RNA, 22 nt, Homo sapiens
aagaggcuguaggauaaugccu

SEQ ID NO: 104508 - RNA, 22 nt, Homo sapiens
aagcugcauuuucuagaugcuu

SEQ ID NO: 104509 - RNA, 22 nt, Homo sapiens
aagggagcugcauaaucuugug

SEQ ID NO: 104510 - RNA, 22 nt, Homo sapiens
aagguaguuagaaaauauaacu

SEQ ID NO: 104511 - RNA, 22 nt, Homo sapiens
aagucaugaagaggaaaggaca

SEQ ID NO: 104512 - RNA, 22 nt, Homo sapiens
aagugcucuugaaacugucuua

SEQ ID NO: 104513 - RNA, 22 nt, Homo sapiens
aauaaagucugaagugugcuua

SEQ ID NO: 104514 - RNA, 22 nt, Homo sapiens
aauaauggcaccaaagcacaag

SEQ ID NO: 104515 - RNA, 22 nt, Homo sapiens
aauagcuguuuuuaauuccugc

SEQ ID NO: 104516 - RNA, 22 nt, Homo sapiens
aauaucacaggguguacacuca

SEQ ID NO: 104517 - RNA, 22 nt, Homo sapiens
aauucacuuguggcagauccuu

SEQ ID NO: 104518 - RNA, 22 nt, Homo sapiens
aauugcauugaauuuguagcuu

SEQ ID NO: 104519 - RNA, 22 nt, Homo sapiens
acacagugucuguguauuuaaa

SEQ ID NO: 104520 - RNA, 22 nt, Homo sapiens
acacauacacauaugguguaua

SEQ ID NO: 104521 - RNA, 22 nt, Homo sapiens
acagugcugucugcuuuggcua

SEQ ID NO: 104522 - RNA, 22 nt, Homo sapiens
accauugcacuccagccugggc

SEQ ID NO: 104523 - RNA, 22 nt, Homo sapiens
acuauacuguaacuguauucag

SEQ ID NO: 104524 - RNA, 22 nt, Homo sapiens
acucagagaacauucccagucu

SEQ ID NO: 104525 - RNA, 22 nt, Homo sapiens
acugcacuccacccuuggcagc

SEQ ID NO: 104526 - RNA, 18 nt, Homo sapiens
acugcacuccaccuuggg

SEQ ID NO: 104527 - RNA, 22 nt, Homo sapiens
acugcacucuagccuuggcaac

SEQ ID NO: 104528 - RNA, 23 nt, Homo sapiens
agaaaugucuauucagggucccu

SEQ ID NO: 104529 - RNA, 22 nt, Homo sapiens
agaaugucaguauuggcuaaaa

SEQ ID NO: 104530 - RNA, 19 nt, Homo sapiens
agagacucauuguagcauu

SEQ ID NO: 104531 - RNA, 22 nt, Homo sapiens
agauucauccaaguuguugcau

SEQ ID NO: 104532 - RNA, 22 nt, Homo sapiens
agcacaguuaaaugaggcuucu

SEQ ID NO: 104533 - RNA, 17 nt, Homo sapiens
agcaccacacucucuug

SEQ ID NO: 104534 - RNA, 21 nt, Homo sapiens
agccaguguuccuuguggcuc

SEQ ID NO: 104535 - RNA, 22 nt, Homo sapiens
agcugcaaagggagagaugauu

SEQ ID NO: 104536 - RNA, 22 nt, Homo sapiens
agcugcauucguaucauauugu

SEQ ID NO: 104537 - RNA, 22 nt, Homo sapiens
agcugguaguuuucuaguguuu

SEQ ID NO: 104538 - RNA, 22 nt, Homo sapiens
agcuguuguuuuaagauacuaa

SEQ ID NO: 104539 - RNA, 22 nt, Homo sapiens
agguguuguugaggagauuuca

SEQ ID NO: 104540 - RNA, 20 nt, Homo sapiens
agguuauuauaauuagaaga

SEQ ID NO: 104541 - RNA, 22 nt, Homo sapiens
agucaugggagagaugugaucg

SEQ ID NO: 104542 - RNA, 22 nt, Homo sapiens
agugucaggagacagguagcug

SEQ ID NO: 104543 - RNA, 22 nt, Homo sapiens
aguguuuuucaugggauacuuu

SEQ ID NO: 104544 - RNA, 22 nt, Homo sapiens
ggcaaggauguuuuucuggcaa

SEQ ID NO: 104545 - RNA, 22 nt, Homo sapiens
ggcauguuuaguagaauguggu

SEQ ID NO: 104546 - RNA, 22 nt, Homo sapiens
gggaagauauaggcugggcacc

SEQ ID NO: 104547 - RNA, 22 nt, Homo sapiens
gggaauguagcaaaucugcaau

SEQ ID NO: 104548 - RNA, 22 nt, Homo sapiens
gggagguagguauuagcuuuuc

SEQ ID NO: 104549 - RNA, 22 nt, Homo sapiens
gguauguaggucuacgguacaa

SEQ ID NO: 104550 - RNA, 22 nt, Homo sapiens
guacacauacauauaugugugu

SEQ ID NO: 104551 - RNA, 22 nt, Homo sapiens
guauggcaugcaugagaauuuc

SEQ ID NO: 104552 - RNA, 22 nt, Homo sapiens
gucacugagcagaaggaagcga

SEQ ID NO: 104553 - RNA, 22 nt, Homo sapiens
gucagggagucucuaucagugg

SEQ ID NO: 104554 - RNA, 22 nt, Homo sapiens
gucaguggagaaaaggacaugu

SEQ ID NO: 104555 - RNA, 22 nt, Homo sapiens
gucccugcgauugugggauccu

SEQ ID NO: 104556 - RNA, 22 nt, Homo sapiens
gugaggucagggcuguggacag

SEQ ID NO: 104557 - RNA, 22 nt, Homo sapiens
gugagucagucuguguagggcu

SEQ ID NO: 104558 - RNA, 20 nt, Homo sapiens
gugagucauuaguaaccaaa

SEQ ID NO: 104559 - RNA, 22 nt, Homo sapiens
guggaauauaaagcaucgugua

SEQ ID NO: 104560 - RNA, 22 nt, Homo sapiens
guggaguaugaaaacugacuuu

SEQ ID NO: 104561 - RNA, 22 nt, Homo sapiens
guggcuuuaaguacgauugagg

SEQ ID NO: 104562 - RNA, 22 nt, Homo sapiens
guucagguauucuggaacagag

SEQ ID NO: 104563 - RNA, 22 nt, Homo sapiens
guuggugaccugaagagaguaa

SEQ ID NO: 104564 - RNA, 21 nt, Homo sapiens
uaaaacuguaacuuuguccug

SEQ ID NO: 104565 - RNA, 22 nt, Homo sapiens
uaacaagagagucagucagucc

SEQ ID NO: 104566 - RNA, 22 nt, Homo sapiens
uaacaguguauuuacuacuucc

SEQ ID NO: 104567 - RNA, 22 nt, Homo sapiens
uaagacacuuaaaauguuacau

SEQ ID NO: 104568 - RNA, 22 nt, Homo sapiens
uaccaaaguuucggccucuguu

SEQ ID NO: 104569 - RNA, 22 nt, Homo sapiens
uagaagcacuaucccuccuagu

SEQ ID NO: 104570 - RNA, 22 nt, Homo sapiens
uagcacaugucagguaauuugc

SEQ ID NO: 104571 - RNA, 22 nt, Homo sapiens
uagguugucuguucacucugau

SEQ ID NO: 104572 - RNA, 22 nt, Homo sapiens
uauacagcaaguuacugugcug

SEQ ID NO: 104573 - RNA, 22 nt, Homo sapiens
uaucucuguggguagugcugaa

SEQ ID NO: 104574 - RNA, 20 nt, Homo sapiens
uaugacacugucauaaaaau

SEQ ID NO: 104575 - RNA, 22 nt, Homo sapiens
uauuccacaauaugauuuuuaa

SEQ ID NO: 104576 - RNA, 22 nt, Homo sapiens
ucaaaugguccacgugaacauu

SEQ ID NO: 104577 - RNA, 22 nt, Homo sapiens
ucaaggcacuagcugagcugca

SEQ ID NO: 104578 - RNA, 22 nt, Homo sapiens
ucacaugucagccguggggaag

SEQ ID NO: 104579 - RNA, 22 nt, Homo sapiens
ucacuagggaucacuuuacccg

SEQ ID NO: 104580 - RNA, 22 nt, Homo sapiens
ucacugaaaccuccaccucucg

SEQ ID NO: 104581 - RNA, 22 nt, Homo sapiens
ucacuggucuaaguggaggggg

SEQ ID NO: 104582 - RNA, 22 nt, Homo sapiens
ucagugcaggaauuuccuuaga

SEQ ID NO: 104583 - RNA, 17 nt, Homo sapiens
ucagugcauuuaagaga

SEQ ID NO: 104584 - RNA, 22 nt, Homo sapiens
ucauaguagucacuuaauaaau

SEQ ID NO: 104585 - RNA, 21 nt, Homo sapiens
ucauauguaucuuugugccuc

SEQ ID NO: 104586 - RNA, 22 nt, Homo sapiens
ucccaguauucauuuacagaag

SEQ ID NO: 104587 - RNA, 22 nt, Homo sapiens
ucccaguggucuugaaacaggg

SEQ ID NO: 104588 - RNA, 22 nt, Homo sapiens
ucccauguagcuaggauuacag

SEQ ID NO: 104589 - RNA, 22 nt, Homo sapiens
ucucagcacaaacaaaauugcu

SEQ ID NO: 104590 - RNA, 22 nt, Homo sapiens
ucucauggagucaggagcagaa

SEQ ID NO: 104591 - RNA, 22 nt, Homo sapiens
ucucuuggugacuuaaaauguu

SEQ ID NO: 104592 - RNA, 22 nt, Homo sapiens
ucugacacuucugcagaauuga

SEQ ID NO: 104593 - RNA, 20 nt, Homo sapiens
ucuugggaauguagccuagg

SEQ ID NO: 104594 - RNA, 22 nt, Homo sapiens
ucuuuagguguuauaguucaag

SEQ ID NO: 104595 - RNA, 22 nt, Homo sapiens
ucuuugauguucugaaagaugg

SEQ ID NO: 104596 - RNA, 22 nt, Homo sapiens
ucuuugauuuuguuacuaagac

SEQ ID NO: 104597 - RNA, 22 nt, Homo sapiens
ucuuugccuaacccaaggucau

SEQ ID NO: 104598 - RNA, 22 nt, Homo sapiens
ugaaauacuuuggcucuuuguu

SEQ ID NO: 104599 - RNA, 22 nt, Homo sapiens
ugaagacucaauuauuaugaac

SEQ ID NO: 104600 - RNA, 22 nt, Homo sapiens
ugacaaguaaacagucagcacc

SEQ ID NO: 104601 - RNA, 22 nt, Homo sapiens
ugacacagcaagauggaaccau

SEQ ID NO: 104602 - RNA, 22 nt, Homo sapiens
ugacagaggucuuuuaauagcu

SEQ ID NO: 104603 - RNA, 22 nt, Homo sapiens
ugacauggagguggaggaagau

SEQ ID NO: 104604 - RNA, 22 nt, Homo sapiens
ugagaacugguagcacuuguga

SEQ ID NO: 104605 - RNA, 22 nt, Homo sapiens
ugagagucacugaccugguaua

SEQ ID NO: 104606 - RNA, 22 nt, Homo sapiens
ugagaugauagauauguuaauu

SEQ ID NO: 104607 - RNA, 21 nt, Homo sapiens
ugagaugauccugcaugcaug

SEQ ID NO: 104608 - RNA, 22 nt, Homo sapiens
ugaggcaaggcugaaugaaggc

SEQ ID NO: 104609 - RNA, 22 nt, Homo sapiens
ugagggaugccugguuuguuuu

SEQ ID NO: 104610 - RNA, 22 nt, Homo sapiens
ugaggucacuuguuuuaugcuu

SEQ ID NO: 104611 - RNA, 21 nt, Homo sapiens
ugaggucaugaugcugcuucc

SEQ ID NO: 104612 - RNA, 22 nt, Homo sapiens
ugaggucauguucugucagguu

SEQ ID NO: 104613 - RNA, 22 nt, Homo sapiens
ugaguucauggucauuugucac

SEQ ID NO: 104614 - RNA, 22 nt, Homo sapiens
ugauagugccuuuuauaucucu

SEQ ID NO: 104615 - RNA, 23 nt, Homo sapiens
ugauguccacuuagggucuaggu

SEQ ID NO: 104616 - RNA, 22 nt, Homo sapiens
ugcaaaguccucauucuuaccc

SEQ ID NO: 104617 - RNA, 22 nt, Homo sapiens
ugcaagauaggcaguuugcacu

SEQ ID NO: 104618 - RNA, 22 nt, Homo sapiens
ugcaaucaucgcuguuggccac

SEQ ID NO: 104619 - RNA, 22 nt, Homo sapiens
ugcacaguccagugcccacuga

SEQ ID NO: 104620 - RNA, 19 nt, Homo sapiens
ugcagcaauguaaaagaca

SEQ ID NO: 104621 - RNA, 22 nt, Homo sapiens
ugccaguauuuuauugagcauu

SEQ ID NO: 104622 - RNA, 22 nt, Homo sapiens
ugccaguauuuuguugaagauu

SEQ ID NO: 104623 - RNA, 22 nt, Homo sapiens
ugccaguauuuuguugaggauu

SEQ ID NO: 104624 - RNA, 22 nt, Homo sapiens
ugccuaggcccaguccucagaa

SEQ ID NO: 104625 - RNA, 21 nt, Homo sapiens
ugcuccauuuucuagccugaa

SEQ ID NO: 104626 - RNA, 21 nt, Homo sapiens
ugcuuacugaauguuaauuuc

SEQ ID NO: 104627 - RNA, 19 nt, Homo sapiens
uggaacugauucaguucug

SEQ ID NO: 104628 - RNA, 22 nt, Homo sapiens
uggacagacaagguuauagauc

SEQ ID NO: 104629 - RNA, 22 nt, Homo sapiens
uggagcccuaaacuucuaauau

SEQ ID NO: 104630 - RNA, 22 nt, Homo sapiens
uggcaaagugugacgugggggu

SEQ ID NO: 104631 - RNA, 22 nt, Homo sapiens
uugagggagcauuuguuuugag

SEQ ID NO: 104632 - RNA, 21 nt, Homo sapiens
uugcaaaugcugcugccugau

SEQ ID NO: 104633 - RNA, 22 nt, Homo sapiens
uugcaacauguauucuggugau

SEQ ID NO: 104634 - RNA, 20 nt, Homo sapiens
uugcacagagaaggaggcag

SEQ ID NO: 104635 - RNA, 22 nt, Homo sapiens
uugcacagugguuuagagccug

SEQ ID NO: 104636 - RNA, 22 nt, Homo sapiens
uugcacuucauguaggccaaag

SEQ ID NO: 104637 - RNA, 20 nt, Homo sapiens
uuggcagagucuuuagggua

SEQ ID NO: 104638 - RNA, 22 nt, Homo sapiens
uuggucaucucccuccuuuuag

SEQ ID NO: 104639 - RNA, 22 nt, Homo sapiens
uugguucucuuagccaucuuaa

SEQ ID NO: 104640 - RNA, 22 nt, Homo sapiens
uugguuuccuuccugcuuaacu

SEQ ID NO: 104641 - RNA, 22 nt, Homo sapiens
uuguauguuguuugucagagaa

SEQ ID NO: 104642 - RNA, 22 nt, Homo sapiens
uugugauugagugauccuuguu

SEQ ID NO: 104643 - RNA, 22 nt, Homo sapiens
uuucaucaagcacagaguagau

SEQ ID NO: 104644 - RNA, 22 nt, Homo sapiens
uuucuacagugaacgauuucua

SEQ ID NO: 104645 - RNA, 16 nt, Homo sapiens
uuucuauguuuuacua

SEQ ID NO: 104646 - RNA, 22 nt, Homo sapiens
uuucuugguuguauuuagacuu

SEQ ID NO: 104647 - RNA, 21 nt, Homo sapiens
uuugaucauuaaaagugaauc

SEQ ID NO: 104648 - RNA, 22 nt, Homo sapiens
uuugauugguguaccugaaagu

SEQ ID NO: 104649 - RNA, 22 nt, Homo sapiens
uuuggucacugccgccgccagc

SEQ ID NO: 104650 - RNA, 22 nt, Homo sapiens
uuugucacccugaauguaagau

SEQ ID NO: 104651 - RNA, 22 nt, Homo sapiens
uuugugcaaacuaggauugcga

SEQ ID NO: 104652 - RNA, 22 nt, Homo sapiens
uuuugggggugauucacacagu

SEQ ID NO: 104653 - RNA, 21 nt, Homo sapiens
uuuugugcaugugcagccugc

SEQ ID NO: 104654 - RNA, 22 nt, Homo sapiens
uggcaguuucauaugguucaac

SEQ ID NO: 104655 - RNA, 22 nt, Homo sapiens
uggcaguuuuaugugguucaac

SEQ ID NO: 104656 - RNA, 20 nt, Homo sapiens
uggcuaaaugaaugauagca

SEQ ID NO: 104657 - RNA, 22 nt, Homo sapiens
uggcuuuuaucuacucucaacu

SEQ ID NO: 104658 - RNA, 22 nt, Homo sapiens
uggcuuuuauuauguugaggua

SEQ ID NO: 104659 - RNA, 20 nt, Homo sapiens
ugggaaauguccaggacaua

SEQ ID NO: 104660 - RNA, 22 nt, Homo sapiens
ugggcaagugacuuggcuucuc

SEQ ID NO: 104661 - RNA, 22 nt, Homo sapiens
ugggguaggcuguauacucugu

SEQ ID NO: 104662 - RNA, 22 nt, Homo sapiens
ugguguccugucucugcgcuug

SEQ ID NO: 104663 - RNA, 22 nt, Homo sapiens
uguauaggcaaauuuccucaug

SEQ ID NO: 104664 - RNA, 22 nt, Homo sapiens
uguauguagugaccagggccag

SEQ ID NO: 104665 - RNA, 22 nt, Homo sapiens
ugucauagauugcuuggaaaaa

SEQ ID NO: 104666 - RNA, 22 nt, Homo sapiens
ugucauguggcuaacgauucau

SEQ ID NO: 104667 - RNA, 22 nt, Homo sapiens
ugucucaguucccuucucugga

SEQ ID NO: 104668 - RNA, 22 nt, Homo sapiens
ugugcacaauguacagguuagu

SEQ ID NO: 104669 - RNA, 22 nt, Homo sapiens
uguggcucuucuguucuccacu

SEQ ID NO: 104670 - RNA, 22 nt, Homo sapiens
uguggcuucuuugguucaguau

SEQ ID NO: 104671 - RNA, 22 nt, Homo sapiens
uuaaggaaagcauuuaauucag

SEQ ID NO: 104672 - RNA, 22 nt, Homo sapiens
uuaaguaaucagagaagagaac

SEQ ID NO: 104673 - RNA, 22 nt, Homo sapiens
uuagcagugugagcacagacua

SEQ ID NO: 104674 - RNA, 22 nt, Homo sapiens
uuaguaguagugcuguaauuuu

SEQ ID NO: 104675 - RNA, 22 nt, Homo sapiens
uuaguaguaguuugcauuuacc

SEQ ID NO: 104676 - RNA, 22 nt, Homo sapiens
uuauagcuaacaucugugaaaa

SEQ ID NO: 104677 - RNA, 22 nt, Homo sapiens
uuauguaaaucaaucuggaauc

SEQ ID NO: 104678 - RNA, 22 nt, Homo sapiens
uucaccuggguuggccaucauu

SEQ ID NO: 104679 - RNA, 22 nt, Homo sapiens
uucaguggacuuaguagugcuu

SEQ ID NO: 104680 - RNA, 18 nt, Homo sapiens
uucaguuuguaucugggg

SEQ ID NO: 104681 - RNA, 22 nt, Homo sapiens
uucauagucacauucgaugucu

SEQ ID NO: 104682 - RNA, 22 nt, Homo sapiens
uucauagucuaugcaaguaaga

SEQ ID NO: 104683 - RNA, 22 nt, Homo sapiens
uucaucuggcaauucagagauu

SEQ ID NO: 104684 - RNA, 22 nt, Homo sapiens
uucccgggguggaaugcaguga

SEQ ID NO: 104685 - RNA, 22 nt, Homo sapiens
uucucacaguacagggagcucu

SEQ ID NO: 104686 - RNA, 22 nt, Homo sapiens
uucucugggacauaggucgggu

SEQ ID NO: 104687 - RNA, 22 nt, Homo sapiens
uugaaagucauuucuucuaagu

SEQ ID NO: 104688 - RNA, 22 nt, Homo sapiens
uugagauaggagcuguuguucu

SEQ ID NO: 104689 - RNA, 22 nt, Homo sapiens
uugauaguuuaauuaaugcuag

SEQ ID NO: 104690 - RNA, 22 nt, Homo sapiens
uugcaaaucucuuguguuuggu

SEQ ID NO: 104691 - RNA, 18 nt, Homo sapiens
uugcaaauucuucccugu

SEQ ID NO: 104692 - RNA, 22 nt, Homo sapiens
uugcacaguguguacagcacca

SEQ ID NO: 104693 - RNA, 22 nt, Homo sapiens
uuggaaggcuccuaaugaaugg

SEQ ID NO: 104694 - RNA, 23 nt, Homo sapiens
uuggaaugagaccuaagaguuuu

SEQ ID NO: 104695 - RNA, 22 nt, Homo sapiens
uuggcaaagaggaaugccacuu

SEQ ID NO: 104696 - RNA, 22 nt, Homo sapiens
uuggcccugcugaccauucccu

SEQ ID NO: 104697 - RNA, 22 nt, Homo sapiens
uugguaaaaugaccacagacau

SEQ ID NO: 104698 - RNA, 22 nt, Homo sapiens
uugguaagguggaugaugaaua

SEQ ID NO: 104699 - RNA, 22 nt, Homo sapiens
uuguaugucuucauuugaaaaa

SEQ ID NO: 104700 - RNA, 22 nt, Homo sapiens
uugugcaaaguugugguuucug

SEQ ID NO: 104701 - RNA, 22 nt, Homo sapiens
uuguuauguaucucaagauaaa

SEQ ID NO: 104702 - RNA, 22 nt, Homo sapiens
uuuaacauuggaugagaucguc

SEQ ID NO: 104703 - RNA, 22 nt, Homo sapiens
uuucaucagccagggucagucu

SEQ ID NO: 104704 - RNA, 22 nt, Homo sapiens
uuugaugcaucucuacuuuguu

SEQ ID NO: 104705 - RNA, 22 nt, Homo sapiens
uuuggucagcugcgggucagcu

SEQ ID NO: 104706 - RNA, 19 nt, Homo sapiens
uuuuccccuuucuuaagac

SEQ ID NO: 104707 - RNA, 22 nt, Homo sapiens
ugugcacaaccugcagguuugu

SEQ ID NO: 104708 - RNA, 22 nt, Homo sapiens
ugugcacaaugugcagguuuga

SEQ ID NO: 104709 - RNA, 22 nt, Homo sapiens
ugugccacugcacucccgccug

SEQ ID NO: 104710 - RNA, 22 nt, Homo sapiens
uguggcuuuuucuuggcugagg

SEQ ID NO: 104711 - RNA, 22 nt, Homo sapiens
uguucuggagccgguucaaaug

SEQ ID NO: 104712 - RNA, 19 nt, Homo sapiens
uuaagguacuuagaugugu

SEQ ID NO: 104713 - RNA, 21 nt, Homo sapiens
uuaaguaauuacccaacucuc

SEQ ID NO: 104714 - RNA, 22 nt, Homo sapiens
uuaauacugcuuaacuuuagga

SEQ ID NO: 104715 - RNA, 22 nt, Homo sapiens
uuacagcagugccccacuccca

SEQ ID NO: 104716 - RNA, 22 nt, Homo sapiens
uuauaacagagacuccugugcu

SEQ ID NO: 104717 - RNA, 17 nt, Homo sapiens
uuauugcuauaagcuga

SEQ ID NO: 104718 - RNA, 22 nt, Homo sapiens
uucaaaguaaaaauguguucac

SEQ ID NO: 104719 - RNA, 23 nt, Homo sapiens
uucaccugguuauuaauagccuc

SEQ ID NO: 104720 - RNA, 22 nt, Homo sapiens
uucacugugcuuaaauucugcu

SEQ ID NO: 104721 - RNA, 22 nt, Homo sapiens
uucagauugcauaccgaaagua

SEQ ID NO: 104722 - RNA, 22 nt, Homo sapiens
uucaggcuccugugagaaucua

SEQ ID NO: 104723 - RNA, 22 nt, Homo sapiens
uucaggcuuuuauuuacugaua

SEQ ID NO: 104724 - RNA, 22 nt, Homo sapiens
uucagugguuauuugugagauu

SEQ ID NO: 104725 - RNA, 22 nt, Homo sapiens
aaaagugguguuguuucuaaau

SEQ ID NO: 104726 - RNA, 18 nt, Homo sapiens
aaacagugucucuuucug

SEQ ID NO: 104727 - RNA, 22 nt, Homo sapiens
aaagagaucuaugggcacuaug

SEQ ID NO: 104728 - RNA, 22 nt, Homo sapiens
aaagguaguacuucuagaaggg

SEQ ID NO: 104729 - RNA, 22 nt, Homo sapiens
aaauccauuuguucagcuaugc

SEQ ID NO: 104730 - RNA, 22 nt, Homo sapiens
aaaugcacaaagauuuugcacu

SEQ ID NO: 104731 - RNA, 22 nt, Homo sapiens
aacacuguuuccagucaugauc

SEQ ID NO: 104732 - RNA, 22 nt, Homo sapiens
aacagacugucacauaaaauug

SEQ ID NO: 104733 - RNA, 20 nt, Homo sapiens
aacagcacugucugaagcuu

SEQ ID NO: 104734 - RNA, 22 nt, Homo sapiens
aacaguaucuaacgagugauga

SEQ ID NO: 104735 - RNA, 21 nt, Homo sapiens
aacagugcugaacagacaccu

SEQ ID NO: 104736 - RNA, 22 nt, Homo sapiens
aaccuuuagucagcucuuagga

SEQ ID NO: 104737 - RNA, 22 nt, Homo sapiens
aacugcacuaggacagguuuuu

SEQ ID NO: 104738 - RNA, 21 nt, Homo sapiens
aacuggugugagaugguaugu

SEQ ID NO: 104739 - RNA, 20 nt, Homo sapiens
aagacacuguccccacugga

SEQ ID NO: 104740 - RNA, 20 nt, Homo sapiens
aagagcucaccagaauaucu

SEQ ID NO: 104741 - RNA, 22 nt, Homo sapiens
aagagguuguaccuaaaguguu

SEQ ID NO: 104742 - RNA, 22 nt, Homo sapiens
aagaucauucagggaaggcuga

SEQ ID NO: 104743 - RNA, 22 nt, Homo sapiens
aagcaggugugggaggaaaugg

SEQ ID NO: 104744 - RNA, 22 nt, Homo sapiens
aagcaucacuggaggcagccau

SEQ ID NO: 104745 - RNA, 20 nt, Homo sapiens
aagcauggguuuuaggguca

SEQ ID NO: 104746 - RNA, 22 nt, Homo sapiens
aagcugccuugcugaggagaaa

SEQ ID NO: 104747 - RNA, 22 nt, Homo sapiens
aagcuggauuuaguguggagca

SEQ ID NO: 104748 - RNA, 22 nt, Homo sapiens
aagcuggauuucgcauccuguu

SEQ ID NO: 104749 - RNA, 22 nt, Homo sapiens
aagcuguugguggaucuaccau

SEQ ID NO: 104750 - RNA, 22 nt, Homo sapiens
aaggaaguaauuugguuuauag

SEQ ID NO: 104751 - RNA, 22 nt, Homo sapiens
aaggaguagaggaauagcaaug

SEQ ID NO: 104752 - RNA, 22 nt, Homo sapiens
aaggagugugauucuucaguuu

SEQ ID NO: 104753 - RNA, 22 nt, Homo sapiens
aaguagcagaggcaagacuuga

SEQ ID NO: 104754 - RNA, 22 nt, Homo sapiens
aaguagcuggaugcaguggcac

SEQ ID NO: 104755 - RNA, 22 nt, Homo sapiens
aaguaucaggaauaguuauugg

SEQ ID NO: 104756 - RNA, 22 nt, Homo sapiens
aaguauuaagacuaagaggcuu

SEQ ID NO: 104757 - RNA, 18 nt, Homo sapiens
aaaaagugcucaggccua

SEQ ID NO: 104758 - RNA, 22 nt, Homo sapiens
aaagcugucaaggcaggaggcu

SEQ ID NO: 104759 - RNA, 22 nt, Homo sapiens
aaaguggugugaguauguaucu

SEQ ID NO: 104760 - RNA, 22 nt, Homo sapiens
aaaugcaucauuaggugauuuu

SEQ ID NO: 104761 - RNA, 22 nt, Homo sapiens
aaaugcucuuuaugaaguugga

SEQ ID NO: 104762 - RNA, 22 nt, Homo sapiens
aaaugcugcuuuggccucuucu

SEQ ID NO: 104763 - RNA, 22 nt, Homo sapiens
aaauggcaccggcucuucccuc

SEQ ID NO: 104764 - RNA, 22 nt, Homo sapiens
aaauggcuuugaggguaggaca

SEQ ID NO: 104765 - RNA, 22 nt, Homo sapiens
aacagaccuagauaguauaguc

SEQ ID NO: 104766 - RNA, 22 nt, Homo sapiens
aacauguuuagcagauaccugu

SEQ ID NO: 104767 - RNA, 22 nt, Homo sapiens
aacucacauucuuucuugguac

SEQ ID NO: 104768 - RNA, 21 nt, Homo sapiens
aagaaagcuggacuugccgcu

SEQ ID NO: 104769 - RNA, 22 nt, Homo sapiens
aagagguaggaaauggucauuu

SEQ ID NO: 104770 - RNA, 22 nt, Homo sapiens
aagaucaucauagagggcauga

SEQ ID NO: 104771 - RNA, 22 nt, Homo sapiens
aagcaucacauaauggaucaug

SEQ ID NO: 104772 - RNA, 21 nt, Homo sapiens
aagcaugguguaucuuuccau

SEQ ID NO: 104773 - RNA, 22 nt, Homo sapiens
aagcuccauuucugccaugaga

SEQ ID NO: 104774 - RNA, 22 nt, Homo sapiens
aagcugccaggcaugguggcug

SEQ ID NO: 104775 - RNA, 22 nt, Homo sapiens
aagcugccuugugaaggcauuc

SEQ ID NO: 104776 - RNA, 22 nt, Homo sapiens
aagcuggagugcaguggugcga

SEQ ID NO: 104777 - RNA, 22 nt, Homo sapiens
aaggaguagacaacauggcgcc

SEQ ID NO: 104778 - RNA, 22 nt, Homo sapiens
aaggaguaucuguuuucucacc

SEQ ID NO: 104779 - RNA, 22 nt, Homo sapiens
aaggaguauugaaugaccaagu

SEQ ID NO: 104780 - RNA, 22 nt, Homo sapiens
aaggcaacgugaguuguugauu

SEQ ID NO: 104781 - RNA, 22 nt, Homo sapiens
aaggcaguggcagaagauguca

SEQ ID NO: 104782 - RNA, 22 nt, Homo sapiens
aaguaauugagguuuuugcugu

SEQ ID NO: 104783 - RNA, 22 nt, Homo sapiens
aaguauuagcuaauugugcuua

SEQ ID NO: 104784 - RNA, 22 nt, Homo sapiens
aagucaugaagaggaaaggaca

SEQ ID NO: 104785 - RNA, 22 nt, Homo sapiens
aagucauggagaagguggaggu

SEQ ID NO: 104786 - RNA, 20 nt, Homo sapiens
aagugcuuccuuuuagaggg

SEQ ID NO: 104787 - RNA, 23 nt, Homo sapiens
aaguucaugcucaucuguuacac

SEQ ID NO: 104788 - RNA, 22 nt, Homo sapiens
aauaaagucugaagugugcuua

SEQ ID NO: 104789 - RNA, 22 nt, Homo sapiens
aauggcacaagacaugaagaag

SEQ ID NO: 104790 - RNA, 22 nt, Homo sapiens
aaugguguuuccguuaagcuga

SEQ ID NO: 104791 - RNA, 22 nt, Homo sapiens
aauugcacuacugcacucccac

SEQ ID NO: 104792 - RNA, 22 nt, Homo sapiens
aauugcauugaauuuguagcuu

SEQ ID NO: 104793 - RNA, 22 nt, Homo sapiens
acacaaugguaaguguuugugu

SEQ ID NO: 104794 - RNA, 22 nt, Homo sapiens
acacuggguaacauaucuguua

SEQ ID NO: 104795 - RNA, 20 nt, Homo sapiens
acacugugcuaaggauuuuc

SEQ ID NO: 104796 - RNA, 22 nt, Homo sapiens
acacuugcuugcaauagccucc

SEQ ID NO: 104797 - RNA, 22 nt, Homo sapiens
acaguacuuuuggauuugugaa

SEQ ID NO: 104798 - RNA, 19 nt, Homo sapiens
acaguauugugcacagguu

SEQ ID NO: 104799 - RNA, 22 nt, Homo sapiens
acaucacuguuugauugauuga

SEQ ID NO: 104800 - RNA, 22 nt, Homo sapiens
accauugcacuccagccugggc

SEQ ID NO: 104801 - RNA, 22 nt, Homo sapiens
accccauuugcacugagcccuu

SEQ ID NO: 104802 - RNA, 22 nt, Homo sapiens
acccuggagagugcuguaguaa

SEQ ID NO: 104803 - RNA, 22 nt, Homo sapiens
acccugucaaaauggaccaauc

SEQ ID NO: 104804 - RNA, 22 nt, Homo sapiens
acuauacugaagcaaauuaaca

SEQ ID NO: 104805 - RNA, 22 nt, Homo sapiens
acugaaucaucagguguguuug

SEQ ID NO: 104806 - RNA, 19 nt, Homo sapiens
acugagcuaccugggggca

SEQ ID NO: 104807 - RNA, 20 nt, Homo sapiens
acugauauguuccuguucuc

SEQ ID NO: 104808 - RNA, 22 nt, Homo sapiens
acugcacuccacccuuggcagc

SEQ ID NO: 104809 - RNA, 22 nt, Homo sapiens
uggauagauacuauccaggacu

SEQ ID NO: 104810 - RNA, 21 nt, Homo sapiens
uggcaacauggauggauucug

SEQ ID NO: 104811 - RNA, 22 nt, Homo sapiens
uggcaagcuuuaauugacucuu

SEQ ID NO: 104812 - RNA, 22 nt, Homo sapiens
uggcagaugggugagcuggaga

SEQ ID NO: 104813 - RNA, 22 nt, Homo sapiens
uggcucuguuuguuaacuagac

SEQ ID NO: 104814 - RNA, 22 nt, Homo sapiens
ugggaagcugcugaacuacagu

SEQ ID NO: 104815 - RNA, 22 nt, Homo sapiens
ugggguaggcuguauacucugu

SEQ ID NO: 104816 - RNA, 20 nt, Homo sapiens
ugguaauguaagagaggaga

SEQ ID NO: 104817 - RNA, 22 nt, Homo sapiens
ugguaugucuagauggggaagu

SEQ ID NO: 104818 - RNA, 19 nt, Homo sapiens
uggugccuuguucuuggau

SEQ ID NO: 104819 - RNA, 17 nt, Homo sapiens
uggugcuugaaaguugc

SEQ ID NO: 104820 - RNA, 20 nt, Homo sapiens
uguaaaggagauugcagcug

SEQ ID NO: 104821 - RNA, 22 nt, Homo sapiens
uguagguguacauacaugguua

SEQ ID NO: 104822 - RNA, 22 nt, Homo sapiens
uguaugagagacauggcugcuu

SEQ ID NO: 104823 - RNA, 22 nt, Homo sapiens
ugucacagagauuuugguaugu

SEQ ID NO: 104824 - RNA, 22 nt, Homo sapiens
ugucacauccaagaaggugcag

SEQ ID NO: 104825 - RNA, 18 nt, Homo sapiens
ugucacuggauaaugguc

SEQ ID NO: 104826 - RNA, 22 nt, Homo sapiens
ugucauauagaauguucuauga

SEQ ID NO: 104827 - RNA, 21 nt, Homo sapiens
ugucugagagaggagaucuac

SEQ ID NO: 104828 - RNA, 22 nt, Homo sapiens
ugugacagcacgguucaacugc

SEQ ID NO: 104829 - RNA, 22 nt, Homo sapiens
ugugaucaugugugccuuaguc

SEQ ID NO: 104830 - RNA, 22 nt, Homo sapiens
ugugcaguuuugagugaauuuc

SEQ ID NO: 104831 - RNA, 22 nt, Homo sapiens
ugugcauauaaguguguauaua

SEQ ID NO: 104832 - RNA, 22 nt, Homo sapiens
uguggcuucuuugguucaguau

SEQ ID NO: 104833 - RNA, 22 nt, Homo sapiens
ugugguuuuaguaaaacuaugu

SEQ ID NO: 104834 - RNA, 22 nt, Homo sapiens
uguguaauacucuaaugaugca

SEQ ID NO: 104835 - RNA, 22 nt, Homo sapiens
uguuacacugugcacuaaauuu

SEQ ID NO: 104836 - RNA, 21 nt, Homo sapiens
uguuuuugcuguguaucucuc

SEQ ID NO: 104837 - RNA, 22 nt, Homo sapiens
uuaaaugcucacauaaagguag

SEQ ID NO: 104838 - RNA, 22 nt, Homo sapiens
uuaacagucacuuagcucauuu

SEQ ID NO: 104839 - RNA, 22 nt, Homo sapiens
uuaagugaauuaucuaacaugu

SEQ ID NO: 104840 - RNA, 22 nt, Homo sapiens
uuaauagcaaagaguuuagacu

SEQ ID NO: 104841 - RNA, 22 nt, Homo sapiens
uuaaugaacuuuauuuuguaga

SEQ ID NO: 104842 - RNA, 22 nt, Homo sapiens
uuaauuguccaaguucaucucu

SEQ ID NO: 104843 - RNA, 22 nt, Homo sapiens
uuacagcagugccccacuccca

SEQ ID NO: 104844 - RNA, 20 nt, Homo sapiens
uuacagugggaccuuccuga

SEQ ID NO: 104845 - RNA, 22 nt, Homo sapiens
uuacaguggugaccuuguauug

SEQ ID NO: 104846 - RNA, 22 nt, Homo sapiens
uuacauugcuucaaauucagug

SEQ ID NO: 104847 - RNA, 22 nt, Homo sapiens
uuaccuuuuuaagacagguuag

SEQ ID NO: 104848 - RNA, 22 nt, Homo sapiens
uuacuguauagaaucaucuuga

SEQ ID NO: 104849 - RNA, 21 nt, Homo sapiens
uuaggcagugucagaggugag

SEQ ID NO: 104850 - RNA, 16 nt, Homo sapiens
uuaggcagugugauac

SEQ ID NO: 104851 - RNA, 22 nt, Homo sapiens
uuauaaacaugaagauuugggg

SEQ ID NO: 104852 - RNA, 22 nt, Homo sapiens
uuauauguuucuuagggacaga

SEQ ID NO: 104853 - RNA, 22 nt, Homo sapiens
uuauguguuuaauguuucugaa

SEQ ID NO: 104854 - RNA, 22 nt, Homo sapiens
uuauuagguugguggaaaagua

SEQ ID NO: 104855 - RNA, 22 nt, Homo sapiens
uucacaguacucccuggaauua

SEQ ID NO: 104856 - RNA, 21 nt, Homo sapiens
uucaucagccagaaaucaagc

SEQ ID NO: 104857 - RNA, 22 nt, Homo sapiens
uucaucaggaauauugaccugu

SEQ ID NO: 104858 - RNA, 22 nt, Homo sapiens
uucaucagggguauuggccaau

SEQ ID NO: 104859 - RNA, 22 nt, Homo sapiens
uucaucuggcaauucagagauu

SEQ ID NO: 104860 - RNA, 22 nt, Homo sapiens
uucauggaguugagaaggcuaa

SEQ ID NO: 104861 - RNA, 22 nt, Homo sapiens
uuccacuuuuuccuugugcucc

SEQ ID NO: 104862 - RNA, 22 nt, Homo sapiens
uucccugugguauagaagccgu

SEQ ID NO: 104863 - RNA, 23 nt, Homo sapiens
uucuaucaggcccaggagcccug

SEQ ID NO: 104864 - RNA, 22 nt, Homo sapiens
uucucugggacauaggucgggu

SEQ ID NO: 104865 - RNA, 22 nt, Homo sapiens
uucugcuagucugucagaucuu

SEQ ID NO: 104866 - RNA, 22 nt, Homo sapiens
uucuggccuccauuuuucuccu

SEQ ID NO: 104867 - RNA, 22 nt, Homo sapiens
uucuuugcuuggaagcggggga

SEQ ID NO: 104868 - RNA, 22 nt, Homo sapiens
uucuuugguacaagggccgacc

SEQ ID NO: 104869 - RNA, 22 nt, Homo sapiens
uugaaagucuaggcuuacagua

SEQ ID NO: 104870 - RNA, 22 nt, Homo sapiens
uugagauggagccucacucugc

SEQ ID NO: 104871 - RNA, 22 nt, Homo sapiens
uugagauggagucucacucuug

SEQ ID NO: 104872 - RNA, 22 nt, Homo sapiens
uugagauggagucucacugugu

SEQ ID NO: 104873 - RNA, 22 nt, Homo sapiens
uugagauggagucucgcugugu

SEQ ID NO: 104874 - RNA, 22 nt, Homo sapiens
uugagauggagucuugcucuug

SEQ ID NO: 104875 - RNA, 22 nt, Homo sapiens
uugagauggaguucauuuuugu

SEQ ID NO: 104876 - RNA, 22 nt, Homo sapiens
uugagauggaguuucacucucg

SEQ ID NO: 104877 - RNA, 22 nt, Homo sapiens
uugagauggaguuucacucuug

SEQ ID NO: 104878 - RNA, 22 nt, Homo sapiens
uugagauggaguuucgcucuug

SEQ ID NO: 104879 - RNA, 22 nt, Homo sapiens
uugagauggaguuuugcucuug

SEQ ID NO: 104880 - RNA, 22 nt, Homo sapiens
uugagauguaguuucacuccug

SEQ ID NO: 104881 - RNA, 19 nt, Homo sapiens
uugagaugugaacucacac

SEQ ID NO: 104882 - RNA, 22 nt, Homo sapiens
uugaggaaugucauuuguguuu

SEQ ID NO: 104883 - RNA, 22 nt, Homo sapiens
uugagggagccuguuagucccg

SEQ ID NO: 104884 - RNA, 20 nt, Homo sapiens
uugauucccucuaaacucgc

SEQ ID NO: 104885 - RNA, 22 nt, Homo sapiens
uugcacuguaauuuauuuaugu

SEQ ID NO: 104886 - RNA, 19 nt, Homo sapiens
uugcauauguugaaccagg

SEQ ID NO: 104887 - RNA, 22 nt, Homo sapiens
uugcauugacacaugaagcuca

SEQ ID NO: 104888 - RNA, 22 nt, Homo sapiens
uugcuccucugccaggaccugu

SEQ ID NO: 104889 - RNA, 22 nt, Homo sapiens
uugcugagucuuucuagguugc

SEQ ID NO: 104890 - RNA, 22 nt, Homo sapiens
uuggaaacaccuggugagguua

SEQ ID NO: 104891 - RNA, 22 nt, Homo sapiens
uuggagagugauauucagaugc

SEQ ID NO: 104892 - RNA, 22 nt, Homo sapiens
uuguacuagaaaauuauucuuu

SEQ ID NO: 104893 - RNA, 22 nt, Homo sapiens
uuguagcaaauguguaaacaaa

SEQ ID NO: 104894 - RNA, 21 nt, Homo sapiens
uuguagcagcauaaucccaga

SEQ ID NO: 104895 - RNA, 22 nt, Homo sapiens
uugucauuuucagaguguuacg

SEQ ID NO: 104896 - RNA, 22 nt, Homo sapiens
uugugcaugaugcauacauggu

SEQ ID NO: 104897 - RNA, 22 nt, Homo sapiens
uuuaauguuacaguauugguau

SEQ ID NO: 104898 - RNA, 22 nt, Homo sapiens
uuuauucggcuaggagcuucgg

SEQ ID NO: 104899 - RNA, 23 nt, Homo sapiens
uuucuugggcaugcuaugucagu

SEQ ID NO: 104900 - RNA, 22 nt, Homo sapiens
uuugaguuugaggugcugauga

SEQ ID NO: 104901 - RNA, 21 nt, Homo sapiens
uuugcauauguugaaccagcc

SEQ ID NO: 104902 - RNA, 22 nt, Homo sapiens
uuccuucaugcuugaaggguau

SEQ ID NO: 104903 - RNA, 22 nt, Homo sapiens
uucucaaggagccuucguaacu

SEQ ID NO: 104904 - RNA, 20 nt, Homo sapiens
uucuugaguuaacaaguuac

SEQ ID NO: 104905 - RNA, 18 nt, Homo sapiens
uucuuguguugauauuuu

SEQ ID NO: 104906 - RNA, 22 nt, Homo sapiens
uucuuuggaaacaguacuaauu

SEQ ID NO: 104907 - RNA, 22 nt, Homo sapiens
uucuuuggauaaaguuuuaugc

SEQ ID NO: 104908 - RNA, 22 nt, Homo sapiens
uugaaagacaucaccuacugcu

SEQ ID NO: 104909 - RNA, 22 nt, Homo sapiens
uugaaaguaaacaucacaaaga

SEQ ID NO: 104910 - RNA, 22 nt, Homo sapiens
uugagagaaaaggccaugccuu

SEQ ID NO: 104911 - RNA, 20 nt, Homo sapiens
uugagaucuguaucugguuu

SEQ ID NO: 104912 - RNA, 22 nt, Homo sapiens
uugagaugaagucuugcucucu

SEQ ID NO: 104913 - RNA, 22 nt, Homo sapiens
uugagaugaaguuuugcucuuu

SEQ ID NO: 104914 - RNA, 22 nt, Homo sapiens
uugagauggaaucucgcuuugu

SEQ ID NO: 104915 - RNA, 22 nt, Homo sapiens
uugagauggagucucacuccuu

SEQ ID NO: 104916 - RNA, 22 nt, Homo sapiens
uugagauggagucucacucugc

SEQ ID NO: 104917 - RNA, 22 nt, Homo sapiens
uugagauggagucucacucugu

SEQ ID NO: 104918 - RNA, 22 nt, Homo sapiens
uugagauggagucucgcacugu

SEQ ID NO: 104919 - RNA, 22 nt, Homo sapiens
uugagauggagucucgcucugu

SEQ ID NO: 104920 - RNA, 22 nt, Homo sapiens
uugagauggagucucguucugu

SEQ ID NO: 104921 - RNA, 22 nt, Homo sapiens
uugagauggagucuugcgcugu

SEQ ID NO: 104922 - RNA, 22 nt, Homo sapiens
uugagauggaguuucacucugu

SEQ ID NO: 104923 - RNA, 22 nt, Homo sapiens
uugagauggauagacauagcau

SEQ ID NO: 104924 - RNA, 22 nt, Homo sapiens
uugagauggugccacuguacuc

SEQ ID NO: 104925 - RNA, 22 nt, Homo sapiens
uugauagacaucugaguuguug

SEQ ID NO: 104926 - RNA, 22 nt, Homo sapiens
uugauagaucagggauuugauu

SEQ ID NO: 104927 - RNA, 22 nt, Homo sapiens
uugcaaagaccucuucacuucc

SEQ ID NO: 104928 - RNA, 22 nt, Homo sapiens
uugcaacauuguaaguuuauau

SEQ ID NO: 104929 - RNA, 22 nt, Homo sapiens
uugcacaauggaauuuaucuuu

SEQ ID NO: 104930 - RNA, 22 nt, Homo sapiens
uugcacugagauuuugcuuaca

SEQ ID NO: 104931 - RNA, 19 nt, Homo sapiens
uugcauagguugaaccagc

SEQ ID NO: 104932 - RNA, 22 nt, Homo sapiens
uugcauauguugaaccaagcgu

SEQ ID NO: 104933 - RNA, 22 nt, Homo sapiens
uugcaucagcuccugauguacu

SEQ ID NO: 104934 - RNA, 22 nt, Homo sapiens
uugcauuuucuaggagggcaaa

SEQ ID NO: 104935 - RNA, 22 nt, Homo sapiens
uugccacuucucuugccccauu

SEQ ID NO: 104936 - RNA, 22 nt, Homo sapiens
uuggaaaccucugcagguguuu

SEQ ID NO: 104937 - RNA, 22 nt, Homo sapiens
uuggaauauaaccuguuucuaa

SEQ ID NO: 104938 - RNA, 22 nt, Homo sapiens
uuggaauuuuacuucuguaaga

SEQ ID NO: 104939 - RNA, 22 nt, Homo sapiens
uugggccacuuuaguuuccuua

SEQ ID NO: 104940 - RNA, 22 nt, Homo sapiens
uuggguccucugguccuugguu

SEQ ID NO: 104941 - RNA, 22 nt, Homo sapiens
uugguaaugggcugguauaacc

SEQ ID NO: 104942 - RNA, 22 nt, Homo sapiens
uugugaaaucuaggcagagguu

SEQ ID NO: 104943 - RNA, 22 nt, Homo sapiens
uugugcuuuuuaaauagcuucc

SEQ ID NO: 104944 - RNA, 22 nt, Homo sapiens
uuuaaagcuaaaauauguuuau

SEQ ID NO: 104945 - RNA, 22 nt, Homo sapiens
uuuaaugcaucccaaaauguag

SEQ ID NO: 104946 - RNA, 22 nt, Homo sapiens
uuuaaugcgucucugaguuuug

SEQ ID NO: 104947 - RNA, 17 nt, Homo sapiens
uuuaaugcuaggacucu

SEQ ID NO: 104948 - RNA, 22 nt, Homo sapiens
uuuaaugcugcccagucauggg

SEQ ID NO: 104949 - RNA, 22 nt, Homo sapiens
uuuagcacugugauugacaaaa

SEQ ID NO: 104950 - RNA, 22 nt, Homo sapiens
uuuagguaauauuaaguagcug

SEQ ID NO: 104951 - RNA, 22 nt, Homo sapiens
uuucauggaggauuugcuucuu

SEQ ID NO: 104952 - RNA, 22 nt, Homo sapiens
uuuccagguggccaacauuuua

SEQ ID NO: 104953 - RNA, 19 nt, Homo sapiens
uuucccugcagaccuacua

SEQ ID NO: 104954 - RNA, 16 nt, Homo sapiens
uuucuauguuuuacua

SEQ ID NO: 104955 - RNA, 22 nt, Homo sapiens
uuucugagaccaaaacuuguaa

SEQ ID NO: 104956 - RNA, 22 nt, Homo sapiens
uuugauuguacuaaaauuguac

SEQ ID NO: 104957 - RNA, 23 nt, Homo sapiens
uuugcacuugcuccuucuauggc

SEQ ID NO: 104958 - RNA, 22 nt, Homo sapiens
uuugccaauauuuuauugagga

SEQ ID NO: 104959 - RNA, 22 nt, Homo sapiens
uuuggcauuaagaugcuguauc

SEQ ID NO: 104960 - RNA, 22 nt, Homo sapiens
uuugggacuguauuaaaugccu

SEQ ID NO: 104961 - RNA, 18 nt, Homo sapiens
uuugguccuuuauaaaca

SEQ ID NO: 104962 - RNA, 22 nt, Homo sapiens
uuuugcucuugguaaugaaaga

SEQ ID NO: 104963 - RNA, 18 nt, Homo sapiens
uuuugcuuaacugcgcca

SEQ ID NO: 104964 - RNA, 22 nt, Homo sapiens
uuuugguauacacaaggguccu

SEQ ID NO: 104965 - RNA, 22 nt, Homo sapiens
uuuugguauaugcaggggucuu

SEQ ID NO: 104966 - RNA, 22 nt, Homo sapiens
uuuugugacuauuguaaauggg

SEQ ID NO: 104967 - RNA, 22 nt, Homo sapiens
uuuugugcauggcccaguggua

SEQ ID NO: 104968 - RNA, 22 nt, Homo sapiens
uuuuugaguaaauauaaauugu

SEQ ID NO: 104969 - RNA, 21 nt, Homo sapiens
uuuuugguggucauggauaga

SEQ ID NO: 104970 - RNA, 22 nt, Homo sapiens
agcauagugccuugaaaacaau

SEQ ID NO: 104971 - RNA, 22 nt, Homo sapiens
agcaucauguuuucgagguuca

SEQ ID NO: 104972 - RNA, 19 nt, Homo sapiens
agcaucauuauuguuuugg

SEQ ID NO: 104973 - RNA, 21 nt, Homo sapiens
agccaguguuccuuguggcuc

SEQ ID NO: 104974 - RNA, 22 nt, Homo sapiens
agcuccaugauaguaugucugu

SEQ ID NO: 104975 - RNA, 22 nt, Homo sapiens
agcugccagucuuguaaggccu

SEQ ID NO: 104976 - RNA, 22 nt, Homo sapiens
agcuggauguggaugacccugu

SEQ ID NO: 104977 - RNA, 20 nt, Homo sapiens
agcuggguguguuggugcau

SEQ ID NO: 104978 - RNA, 22 nt, Homo sapiens
agcuguguugucugaagucaga

SEQ ID NO: 104979 - RNA, 22 nt, Homo sapiens
aggaagcuagcauuuguucagu

SEQ ID NO: 104980 - RNA, 22 nt, Homo sapiens
aggaaguaauaaguuugguucu

SEQ ID NO: 104981 - RNA, 18 nt, Homo sapiens
aggaaugguaauacuuca

SEQ ID NO: 104982 - RNA, 22 nt, Homo sapiens
aggaauguuaguacuucuuagu

SEQ ID NO: 104983 - RNA, 22 nt, Homo sapiens
aggaccauuguguagcagacau

SEQ ID NO: 104984 - RNA, 22 nt, Homo sapiens
aggagcacuggccuuggaguca

SEQ ID NO: 104985 - RNA, 22 nt, Homo sapiens
aggcaaaugccagcaaucacac

SEQ ID NO: 104986 - RNA, 22 nt, Homo sapiens
aggcaacaugguaaaacccugu

SEQ ID NO: 104987 - RNA, 22 nt, Homo sapiens
agguuguguuugugauuagaua

SEQ ID NO: 104988 - RNA, 22 nt, Homo sapiens
aguaaauuucugugcuuucaua

SEQ ID NO: 104989 - RNA, 22 nt, Homo sapiens
aguaagauggcaacucuccaca

SEQ ID NO: 104990 - RNA, 23 nt, Homo sapiens
aguacuguaguaauugaggggaa

SEQ ID NO: 104991 - RNA, 22 nt, Homo sapiens
aguagguguugguagagguuuc

SEQ ID NO: 104992 - RNA, 22 nt, Homo sapiens
agucacaugcauuuucuucaau

SEQ ID NO: 104993 - RNA, 22 nt, Homo sapiens
agucacaugccagcacacccag

SEQ ID NO: 104994 - RNA, 22 nt, Homo sapiens
agugcacuccagccugggcaac

SEQ ID NO: 104995 - RNA, 23 nt, Homo sapiens
agugccuaguauauaggaggcgc

SEQ ID NO: 104996 - RNA, 22 nt, Homo sapiens
aguggcaaugugauguccugaa

SEQ ID NO: 104997 - RNA, 22 nt, Homo sapiens
aguggcacuauucucagaguca

SEQ ID NO: 104998 - RNA, 20 nt, Homo sapiens
agugguuuucaaauaugucu

SEQ ID NO: 104999 - RNA, 22 nt, Homo sapiens
auaagagcaggcuucuggccag

SEQ ID NO: 105000 - RNA, 23 nt, Homo sapiens
auaaugcaaguggugguaaucug

SEQ ID NO: 105001 - RNA, 22 nt, Homo sapiens
auacaguaaugucuuaggcugu

SEQ ID NO: 105002 - RNA, 22 nt, Homo sapiens
auacaguguucugggaagaagu

SEQ ID NO: 105003 - RNA, 22 nt, Homo sapiens
auacaugugcaggucagguuac

SEQ ID NO: 105004 - RNA, 22 nt, Homo sapiens
auacaugugugagcgaagaugu

SEQ ID NO: 105005 - RNA, 22 nt, Homo sapiens
auagugcugcaacaaauauacg

SEQ ID NO: 105006 - RNA, 22 nt, Homo sapiens
auagugcuggaauaaauauacg

SEQ ID NO: 105007 - RNA, 22 nt, Homo sapiens
auauagcaaugaaagagaugaa

SEQ ID NO: 105008 - RNA, 22 nt, Homo sapiens
auaucagugucuuacuguuuuu

SEQ ID NO: 105009 - RNA, 22 nt, Homo sapiens
auauguauuuuaacguguaagg

SEQ ID NO: 105010 - RNA, 22 nt, Homo sapiens
auaugugacuucaugcaaggcu

SEQ ID NO: 105011 - RNA, 18 nt, Homo sapiens
auauugccuucagacuag

SEQ ID NO: 105012 - RNA, 22 nt, Homo sapiens
aucaaauugucauuuuaaggau

SEQ ID NO: 105013 - RNA, 22 nt, Homo sapiens
aucacuggccuuuuuaaaugcu

SEQ ID NO: 105014 - RNA, 22 nt, Homo sapiens
aucacuuucuauuucugugcca

SEQ ID NO: 105015 - RNA, 22 nt, Homo sapiens
aucccuuccuagcacuuggugu

SEQ ID NO: 105016 - RNA, 22 nt, Homo sapiens
auccuacaguccauucuuugug

SEQ ID NO: 105017 - RNA, 22 nt, Homo sapiens
auccucugagaucuaggcagag

SEQ ID NO: 105018 - RNA, 22 nt, Homo sapiens
aucgcaccauugcacuccagca

SEQ ID NO: 105019 - RNA, 22 nt, Homo sapiens
aucgcgccauuguacuccagcc

SEQ ID NO: 105020 - RNA, 22 nt, Homo sapiens
aucucuugccagucagaauggu

SEQ ID NO: 105021 - RNA, 22 nt, Homo sapiens
augaagaucaugaagacggcuu

SEQ ID NO: 105022 - RNA, 19 nt, Homo sapiens
augagaacagacuccauuu

SEQ ID NO: 105023 - RNA, 22 nt, Homo sapiens
augagacuagaagagaauaaua

SEQ ID NO: 105024 - RNA, 22 nt, Homo sapiens
augagauauuuuauaagaucau

SEQ ID NO: 105025 - RNA, 21 nt, Homo sapiens
augagauguuagacuuuagac

SEQ ID NO: 105026 - RNA, 22 nt, Homo sapiens
augaggaaggagccuuugucug

SEQ ID NO: 105027 - RNA, 22 nt, Homo sapiens
augauacuggcuucauagaaug

SEQ ID NO: 105028 - RNA, 22 nt, Homo sapiens
augcagagaaaucuaaaauaug

SEQ ID NO: 105029 - RNA, 22 nt, Homo sapiens
augcagagucccagccccuagc

SEQ ID NO: 105030 - RNA, 22 nt, Homo sapiens
augcagaucacauuuuucuguc

SEQ ID NO: 105031 - RNA, 22 nt, Homo sapiens
auggaaaugaagggcuggcccu

SEQ ID NO: 105032 - RNA, 22 nt, Homo sapiens
auggaacauuauagauguaaaa

SEQ ID NO: 105033 - RNA, 22 nt, Homo sapiens
auggaacugaagugcugcccuu

SEQ ID NO: 105034 - RNA, 19 nt, Homo sapiens
auggauacauuuucugcua

SEQ ID NO: 105035 - RNA, 22 nt, Homo sapiens
auggcaaaaaaugcaauuacuu

SEQ ID NO: 105036 - RNA, 22 nt, Homo sapiens
auggcacugaagcguauugaca

SEQ ID NO: 105037 - RNA, 22 nt, Homo sapiens
auggcagcaccccacucuacug

SEQ ID NO: 105038 - RNA, 20 nt, Homo sapiens
auguaauguaugauauguac

SEQ ID NO: 105039 - RNA, 22 nt, Homo sapiens
augucacagguccuagccaagu

SEQ ID NO: 105040 - RNA, 22 nt, Homo sapiens
augugacagugguuuuaagcgu

SEQ ID NO: 105041 - RNA, 22 nt, Homo sapiens
augugucaaaucuaggccaaag

SEQ ID NO: 105042 - RNA, 22 nt, Homo sapiens
augugugcuugauguaaaaagu

SEQ ID NO: 105043 - RNA, 22 nt, Homo sapiens
aauggcagaugaaauugucauu

SEQ ID NO: 105044 - RNA, 23 nt, Homo sapiens
aauugcacauuccuugcuggcag

SEQ ID NO: 105045 - RNA, 22 nt, Homo sapiens
aauugcauaaaauucaacucug

SEQ ID NO: 105046 - RNA, 22 nt, Homo sapiens
acaagacuucuuguauucuagu

SEQ ID NO: 105047 - RNA, 22 nt, Homo sapiens
acaagcacaaauuuaauccugu

SEQ ID NO: 105048 - RNA, 22 nt, Homo sapiens
acacaugugaaaaaaauguuac

SEQ ID NO: 105049 - RNA, 22 nt, Homo sapiens
acacauuagcaagugcuguuau

SEQ ID NO: 105050 - RNA, 22 nt, Homo sapiens
acacuggaguuaaaggugauuu

SEQ ID NO: 105051 - RNA, 22 nt, Homo sapiens
acagaacugggcuugcuuuugg

SEQ ID NO: 105052 - RNA, 20 nt, Homo sapiens
acagcacugguuucaagcaa

SEQ ID NO: 105053 - RNA, 22 nt, Homo sapiens
acaggagugggauuugaguccu

SEQ ID NO: 105054 - RNA, 18 nt, Homo sapiens
acaguguguaaggguucu

SEQ ID NO: 105055 - RNA, 22 nt, Homo sapiens
acaguguguguguucaccuaga

SEQ ID NO: 105056 - RNA, 17 nt, Homo sapiens
acaugagacuggauucu

SEQ ID NO: 105057 - RNA, 22 nt, Homo sapiens
acaugagacuggguuuguaggg

SEQ ID NO: 105058 - RNA, 23 nt, Homo sapiens
acauguauagacuuuuuuuccuu

SEQ ID NO: 105059 - RNA, 22 nt, Homo sapiens
acccuggaguaguaggaaucug

SEQ ID NO: 105060 - RNA, 22 nt, Homo sapiens
acccugucaaaauagaccaauc

SEQ ID NO: 105061 - RNA, 22 nt, Homo sapiens
acuauacuguaacuguauucag

SEQ ID NO: 105062 - RNA, 18 nt, Homo sapiens
acugcacuccaccuuggg

SEQ ID NO: 105063 - RNA, 22 nt, Homo sapiens
acugcacuccagccugcccaac

SEQ ID NO: 105064 - RNA, 22 nt, Homo sapiens
acugcacugcagccuggccaac

SEQ ID NO: 105065 - RNA, 20 nt, Homo sapiens
acuggcacugguaggugugg

SEQ ID NO: 105066 - RNA, 19 nt, Homo sapiens
acuuuggugauuagaggga

SEQ ID NO: 105067 - RNA, 22 nt, Homo sapiens
agaagaacauagggugacugaa

SEQ ID NO: 105068 - RNA, 21 nt, Homo sapiens
agagucaucucuaucuguacc

SEQ ID NO: 105069 - RNA, 22 nt, Homo sapiens
agauaugucugcuauuugcugu

SEQ ID NO: 105070 - RNA, 22 nt, Homo sapiens
agaugcuguuaucaacuguagc

SEQ ID NO: 105071 - RNA, 22 nt, Homo sapiens
agcaagaaugaacucucccaga

SEQ ID NO: 105072 - RNA, 22 nt, Homo sapiens
agcaagauuguucccauuuucu

SEQ ID NO: 105073 - RNA, 22 nt, Homo sapiens
agcaccaugggcugaguaagug

SEQ ID NO: 105074 - RNA, 22 nt, Homo sapiens
agcaccauuucucuaaagcacu

SEQ ID NO: 105075 - RNA, 21 nt, Homo sapiens
agcagcuuugguugaagcaga

SEQ ID NO: 105076 - RNA, 22 nt, Homo sapiens
agcaucauaccaaucugguccu

SEQ ID NO: 105077 - RNA, 22 nt, Homo sapiens
agccaguuuggcuaauuuuggc

SEQ ID NO: 105078 - RNA, 22 nt, Homo sapiens
agccccauuuguugaaaagacg

SEQ ID NO: 105079 - RNA, 22 nt, Homo sapiens
agcuauauugaggaugccauuc

SEQ ID NO: 105080 - RNA, 22 nt, Homo sapiens
agcuccuacuguuacaucauug

SEQ ID NO: 105081 - RNA, 21 nt, Homo sapiens
agcugguuuccacagugugcu

SEQ ID NO: 105082 - RNA, 19 nt, Homo sapiens
agcuguguugccugugaga

SEQ ID NO: 105083 - RNA, 21 nt, Homo sapiens
agcuuguguguaucacagugu

SEQ ID NO: 105084 - RNA, 22 nt, Homo sapiens
aggaccccucaucagcaccagu

SEQ ID NO: 105085 - RNA, 22 nt, Homo sapiens
aggagguagaacauugccauuu

SEQ ID NO: 105086 - RNA, 21 nt, Homo sapiens
aggcaaaugaagcagccgcuc

SEQ ID NO: 105087 - RNA, 22 nt, Homo sapiens
aggcaugaguucagaggguaug

SEQ ID NO: 105088 - RNA, 22 nt, Homo sapiens
agggaagugugcuaugcauuua

SEQ ID NO: 105089 - RNA, 22 nt, Homo sapiens
agguagcauagcgggaauauca

SEQ ID NO: 105090 - RNA, 22 nt, Homo sapiens
aggugguguuggguuccagccc

SEQ ID NO: 105091 - RNA, 22 nt, Homo sapiens
agguuuucagccccagccuagg

SEQ ID NO: 105092 - RNA, 20 nt, Homo sapiens
agucaguuuauuuucucucu

SEQ ID NO: 105093 - RNA, 22 nt, Homo sapiens
agugcaauaaggauguagaacu

SEQ ID NO: 105094 - RNA, 22 nt, Homo sapiens
aguggaauuaagaaacugaauu

SEQ ID NO: 105095 - RNA, 22 nt, Homo sapiens
aguggcacaauuuugacucccc

SEQ ID NO: 105096 - RNA, 22 nt, Homo sapiens
agugggccccuagaggugaggu

SEQ ID NO: 105097 - RNA, 22 nt, Homo sapiens
auaacagcauuauugcauacgu

SEQ ID NO: 105098 - RNA, 22 nt, Homo sapiens
auaacauccuuucuuaucguug

SEQ ID NO: 105099 - RNA, 22 nt, Homo sapiens
auacaagcaguccaacuccaua

SEQ ID NO: 105100 - RNA, 22 nt, Homo sapiens
auacacuggagcaaaccuggag

SEQ ID NO: 105101 - RNA, 22 nt, Homo sapiens
auacugucucuugcuccugccc

SEQ ID NO: 105102 - RNA, 22 nt, Homo sapiens
auagaagcuauguauaggggcc

SEQ ID NO: 105103 - RNA, 22 nt, Homo sapiens
auagcaggagaauggucauggg

SEQ ID NO: 105104 - RNA, 22 nt, Homo sapiens
auaggcacauuaggaacuuuug

SEQ ID NO: 105105 - RNA, 22 nt, Homo sapiens
auauaugcacacgugugcauau

SEQ ID NO: 105106 - RNA, 22 nt, Homo sapiens
auauauguuuucugggaagaaa

SEQ ID NO: 105107 - RNA, 22 nt, Homo sapiens
auaucacucccaauaucgcagg

SEQ ID NO: 105108 - RNA, 22 nt, Homo sapiens
auauucacagguaucagagauu

SEQ ID NO: 105109 - RNA, 22 nt, Homo sapiens
aucacagauauggguuuaaauc

SEQ ID NO: 105110 - RNA, 22 nt, Homo sapiens
aucacugggagcagccauuaau

SEQ ID NO: 105111 - RNA, 22 nt, Homo sapiens
aucacugggcaagauaucauga

SEQ ID NO: 105112 - RNA, 22 nt, Homo sapiens
aucacugugauuucuacugugc

SEQ ID NO: 105113 - RNA, 22 nt, Homo sapiens
aucagaaucucuagugggacca

SEQ ID NO: 105114 - RNA, 22 nt, Homo sapiens
aucagaaucucuugagaguguu

SEQ ID NO: 105115 - RNA, 22 nt, Homo sapiens
aucagucuguuggaauaucgcu

SEQ ID NO: 105116 - RNA, 22 nt, Homo sapiens
aucagugcagugggaacuagaa

SEQ ID NO: 105117 - RNA, 22 nt, Homo sapiens
aucauggaguauuugcaagucu

SEQ ID NO: 105118 - RNA, 22 nt, Homo sapiens
aucccugugauccaaucacuuc

SEQ ID NO: 105119 - RNA, 22 nt, Homo sapiens
aucccuguguccagcaccugug

SEQ ID NO: 105120 - RNA, 22 nt, Homo sapiens
auccuuuagacuguccaguuga

SEQ ID NO: 105121 - RNA, 22 nt, Homo sapiens
aucucauggagguagagaguaa

SEQ ID NO: 105122 - RNA, 22 nt, Homo sapiens
aucugcauuagggugaagaccu

SEQ ID NO: 105123 - RNA, 22 nt, Homo sapiens
aucugugguuguaugcauauua

SEQ ID NO: 105124 - RNA, 22 nt, Homo sapiens
augaacagagccuugagaaccu

SEQ ID NO: 105125 - RNA, 22 nt, Homo sapiens
augaauccauuccugccacaga

SEQ ID NO: 105126 - RNA, 22 nt, Homo sapiens
augaaugcuuuuggauguaucu

SEQ ID NO: 105127 - RNA, 22 nt, Homo sapiens
augacaaugaaucccuguuuca

SEQ ID NO: 105128 - RNA, 22 nt, Homo sapiens
augacuagaggagggauggcca

SEQ ID NO: 105129 - RNA, 22 nt, Homo sapiens
augagaaugauucuguuauggu

SEQ ID NO: 105130 - RNA, 22 nt, Homo sapiens
augagauaggaacaaacuuaca

SEQ ID NO: 105131 - RNA, 22 nt, Homo sapiens
augagaugaauaccgacgaugu

SEQ ID NO: 105132 - RNA, 22 nt, Homo sapiens
augagaugaggaauggcccucc

SEQ ID NO: 105133 - RNA, 22 nt, Homo sapiens
augagauuguuuguacuccaca

SEQ ID NO: 105134 - RNA, 22 nt, Homo sapiens
augagcuguuuggaagacacuu

SEQ ID NO: 105135 - RNA, 22 nt, Homo sapiens
gaagaacuaggugagaucuaga

SEQ ID NO: 105136 - RNA, 22 nt, Homo sapiens
gacagacacaauugauccauga

SEQ ID NO: 105137 - RNA, 20 nt, Homo sapiens
gacauaggcugguaucuggc

SEQ ID NO: 105138 - RNA, 22 nt, Homo sapiens
gacugcauuugccccaucgaau

SEQ ID NO: 105139 - RNA, 22 nt, Homo sapiens
gagacauugacuuuguuccaga

SEQ ID NO: 105140 - RNA, 22 nt, Homo sapiens
gagauaacuacuggauuaaguu

SEQ ID NO: 105141 - RNA, 22 nt, Homo sapiens
gagccauggagaaaacagcuau

SEQ ID NO: 105142 - RNA, 22 nt, Homo sapiens
gagcugccuugccuaugcaaga

SEQ ID NO: 105143 - RNA, 22 nt, Homo sapiens
gaggaguagggcacaaagccuu

SEQ ID NO: 105144 - RNA, 22 nt, Homo sapiens
gaggaguauuuugucgaauguc

SEQ ID NO: 105145 - RNA, 22 nt, Homo sapiens
gagguggugguggaggcauagc

SEQ ID NO: 105146 - RNA, 22 nt, Homo sapiens
gaguaaauguccuagcuucuug

SEQ ID NO: 105147 - RNA, 22 nt, Homo sapiens
gauauguaguaguugaaaaaga

SEQ ID NO: 105148 - RNA, 22 nt, Homo sapiens
gaucacaguuccucacgggcau

SEQ ID NO: 105149 - RNA, 22 nt, Homo sapiens
gcaaaauugagaagggaauaua

SEQ ID NO: 105150 - RNA, 22 nt, Homo sapiens
gcaccauugacaagaaauaggu

SEQ ID NO: 105151 - RNA, 22 nt, Homo sapiens
gcagcacaugacuguauguaua

SEQ ID NO: 105152 - RNA, 22 nt, Homo sapiens
gcagcagugcccuggauggaaa

SEQ ID NO: 105153 - RNA, 22 nt, Homo sapiens
gcagguguuaugcaaacaacug

SEQ ID NO: 105154 - RNA, 22 nt, Homo sapiens
gcagugcaugacgguauauaua

SEQ ID NO: 105155 - RNA, 22 nt, Homo sapiens
gcagugugaucacagcuuacug

SEQ ID NO: 105156 - RNA, 20 nt, Homo sapiens
gcauaugucuuuauagcaga

SEQ ID NO: 105157 - RNA, 22 nt, Homo sapiens
gcauggaaggcgcuuugugacu

SEQ ID NO: 105158 - RNA, 22 nt, Homo sapiens
gcauggaguggaaauucuuggg

SEQ ID NO: 105159 - RNA, 22 nt, Homo sapiens
gccaagaucugaauaauuaaga

SEQ ID NO: 105160 - RNA, 22 nt, Homo sapiens
gccauggaggauuuauagaggc

SEQ ID NO: 105161 - RNA, 22 nt, Homo sapiens
gcccacuguuaaauuuguuuua

SEQ ID NO: 105162 - RNA, 16 nt, Homo sapiens
gcucuuguucucuguu

SEQ ID NO: 105163 - RNA, 22 nt, Homo sapiens
gcuuuggauaaaugucaguuua

SEQ ID NO: 105164 - RNA, 22 nt, Homo sapiens
ggaaagaucagcuaaauguaag

SEQ ID NO: 105165 - RNA, 22 nt, Homo sapiens
ggaaguauaaacuuaguggagu

SEQ ID NO: 105166 - RNA, 21 nt, Homo sapiens
ggaauuuagggaaugauuuag

SEQ ID NO: 105167 - RNA, 22 nt, Homo sapiens
ggacauguauauauaugugugu

SEQ ID NO: 105168 - RNA, 22 nt, Homo sapiens
ggagaauguaauugguauuuug

SEQ ID NO: 105169 - RNA, 22 nt, Homo sapiens
ggagcucaucuagcauagaggu

SEQ ID NO: 105170 - RNA, 22 nt, Homo sapiens
ggagggugagaucaauuuggga

SEQ ID NO: 105171 - RNA, 21 nt, Homo sapiens
ggauucaucccucaugaauuu

SEQ ID NO: 105172 - RNA, 22 nt, Homo sapiens
ggcaaagagacaugcaucgggg

SEQ ID NO: 105173 - RNA, 22 nt, Homo sapiens
ggcacugugaugugagggggua

SEQ ID NO: 105174 - RNA, 19 nt, Homo sapiens
ggcacugugugagugagga

SEQ ID NO: 105175 - RNA, 22 nt, Homo sapiens
ggccagaugaucuaugaaggaa

SEQ ID NO: 105176 - RNA, 22 nt, Homo sapiens
ggccuguaggguauugguaggg

SEQ ID NO: 105177 - RNA, 22 nt, Homo sapiens
ggcuagauauucacauauggcu

SEQ ID NO: 105178 - RNA, 22 nt, Homo sapiens
ggcucagugaucuguuucugua

SEQ ID NO: 105179 - RNA, 18 nt, Homo sapiens
gggaauauggggaguuga

SEQ ID NO: 105180 - RNA, 22 nt, Homo sapiens
gguggucuuccccuggaguucg

SEQ ID NO: 105181 - RNA, 22 nt, Homo sapiens
guacaguaguaaaagugaauga

SEQ ID NO: 105182 - RNA, 22 nt, Homo sapiens
guacaugcauaguuuauuucug

SEQ ID NO: 105183 - RNA, 22 nt, Homo sapiens
guagcagcuacuaaguugcugu

SEQ ID NO: 105184 - RNA, 22 nt, Homo sapiens
guauacacccugugauauuauu

SEQ ID NO: 105185 - RNA, 18 nt, Homo sapiens
guaugcacaugccccugc

SEQ ID NO: 105186 - RNA, 22 nt, Homo sapiens
guauuuguugcagcagcacuau

SEQ ID NO: 105187 - RNA, 22 nt, Homo sapiens
gucacaguggccagugauguuc

SEQ ID NO: 105188 - RNA, 22 nt, Homo sapiens
gucacugagauugguauuaaug

SEQ ID NO: 105189 - RNA, 22 nt, Homo sapiens
gucaguuugguuaaucauucca

SEQ ID NO: 105190 - RNA, 22 nt, Homo sapiens
gucauuguguggacauggagaa

SEQ ID NO: 105191 - RNA, 22 nt, Homo sapiens
gucccugcgauugugggauccu

SEQ ID NO: 105192 - RNA, 22 nt, Homo sapiens
guccuggagaagcguggaccgg

SEQ ID NO: 105193 - RNA, 22 nt, Homo sapiens
gucuggagacuugggucaucaa

SEQ ID NO: 105194 - RNA, 22 nt, Homo sapiens
gucugguuccugggagauuucu

SEQ ID NO: 105195 - RNA, 20 nt, Homo sapiens
gucuuguagcucaaguuauu

SEQ ID NO: 105196 - RNA, 22 nt, Homo sapiens
gugaaauacauaaucccaagug

SEQ ID NO: 105197 - RNA, 22 nt, Homo sapiens
gugaagaucccuguccuguucc

SEQ ID NO: 105198 - RNA, 22 nt, Homo sapiens
gugaagaugugcaucagaucca

SEQ ID NO: 105199 - RNA, 22 nt, Homo sapiens
gugaaugaaugggugaauacau

SEQ ID NO: 105200 - RNA, 22 nt, Homo sapiens
gugagacugaguuucgcucuug

SEQ ID NO: 105201 - RNA, 22 nt, Homo sapiens
gugaggcuuuuccuguuagacu

SEQ ID NO: 105202 - RNA, 22 nt, Homo sapiens
gugcacaaaucuuaaauguaca

SEQ ID NO: 105203 - RNA, 22 nt, Homo sapiens
gugccuucuagcuaugguuggc

SEQ ID NO: 105204 - RNA, 20 nt, Homo sapiens
guggaagauaaguagccuga

SEQ ID NO: 105205 - RNA, 22 nt, Homo sapiens
guggaguaugaaaacugacuuu

SEQ ID NO: 105206 - RNA, 22 nt, Homo sapiens
guggcaagaugacuacucacug

SEQ ID NO: 105207 - RNA, 22 nt, Homo sapiens
guggcaaggaaaugcugcucac

SEQ ID NO: 105208 - RNA, 19 nt, Homo sapiens
gugguauuaccuuuugauu

SEQ ID NO: 105209 - RNA, 22 nt, Homo sapiens
guguaugugagaaugcucaugu

SEQ ID NO: 105210 - RNA, 22 nt, Homo sapiens
guuauguguuuccuuaauugcu

SEQ ID NO: 105211 - RNA, 20 nt, Homo sapiens
guucccuguaggugugcgga

SEQ ID NO: 105212 - RNA, 22 nt, Homo sapiens
guuugcagaucaugaagaaccc

SEQ ID NO: 105213 - RNA, 22 nt, Homo sapiens
uaacaguggucugugguaucug

SEQ ID NO: 105214 - RNA, 22 nt, Homo sapiens
uaacaguguauuuacuacuucc

SEQ ID NO: 105215 - RNA, 22 nt, Homo sapiens
uaacugcaaccuccgccucccg

SEQ ID NO: 105216 - RNA, 22 nt, Homo sapiens
uaagagcuaggauuuuaaauca

SEQ ID NO: 105217 - RNA, 22 nt, Homo sapiens
uaaggauuuuggugauuacacu

SEQ ID NO: 105218 - RNA, 22 nt, Homo sapiens
uaaggcacucuucugugugccu

SEQ ID NO: 105219 - RNA, 22 nt, Homo sapiens
uaagucuuuuuggaguuuauaa

SEQ ID NO: 105220 - RNA, 22 nt, Homo sapiens
uaauagcaguguuacuaggacu

SEQ ID NO: 105221 - RNA, 22 nt, Homo sapiens
uaaucacagagguuuggccuca

SEQ ID NO: 105222 - RNA, 22 nt, Homo sapiens
uaaugcucauuagcaggccaau

SEQ ID NO: 105223 - RNA, 22 nt, Homo sapiens
uaauugcaguucuguguuauau

SEQ ID NO: 105224 - RNA, 22 nt, Homo sapiens
uacaacacugguucgacaugug

SEQ ID NO: 105225 - RNA, 22 nt, Homo sapiens
uacagcacaggugcagguguug

SEQ ID NO: 105226 - RNA, 22 nt, Homo sapiens
uacaguauuaugagugauugaa

SEQ ID NO: 105227 - RNA, 22 nt, Homo sapiens
uucauguagucaucauccugcu

SEQ ID NO: 105228 - RNA, 23 nt, Homo sapiens
uuccaccauugacuaguuacaua

SEQ ID NO: 105229 - RNA, 22 nt, Homo sapiens
uuccccgugaaacuuucucauu

SEQ ID NO: 105230 - RNA, 22 nt, Homo sapiens
uucccuguaucuucugccaugu

SEQ ID NO: 105231 - RNA, 22 nt, Homo sapiens
uucccugugggaguaggaaagu

SEQ ID NO: 105232 - RNA, 22 nt, Homo sapiens
uucccugugggcuggugcucca

SEQ ID NO: 105233 - RNA, 22 nt, Homo sapiens
uucccuuugaaacuaaacuugc

SEQ ID NO: 105234 - RNA, 22 nt, Homo sapiens
uucuaaacaucuuacaaugcau

SEQ ID NO: 105235 - RNA, 22 nt, Homo sapiens
uucucagcccccugacagucag

SEQ ID NO: 105236 - RNA, 22 nt, Homo sapiens
uucugcuugaucuaguguguug

SEQ ID NO: 105237 - RNA, 22 nt, Homo sapiens
uucuggccccucccaaucucau

SEQ ID NO: 105238 - RNA, 22 nt, Homo sapiens
uugaaagucauuucuucuaagu

SEQ ID NO: 105239 - RNA, 22 nt, Homo sapiens
uugaaugaaauuggugugggga

SEQ ID NO: 105240 - RNA, 22 nt, Homo sapiens
uugacauaguuucugaaauaga

SEQ ID NO: 105241 - RNA, 22 nt, Homo sapiens
uugaccaaagaagagucauugc

SEQ ID NO: 105242 - RNA, 22 nt, Homo sapiens
uugacuuuuauucacucugcua

SEQ ID NO: 105243 - RNA, 22 nt, Homo sapiens
uugagaaucuuucgaauguucu

SEQ ID NO: 105244 - RNA, 22 nt, Homo sapiens
uugagauggagcuucacucuug

SEQ ID NO: 105245 - RNA, 22 nt, Homo sapiens
uugagauggagucucacgcauu

SEQ ID NO: 105246 - RNA, 22 nt, Homo sapiens
uugagauggagucucacucuuu

SEQ ID NO: 105247 - RNA, 22 nt, Homo sapiens
uugagauggagucucgcucuuu

SEQ ID NO: 105248 - RNA, 22 nt, Homo sapiens
uugagauggaguuucgcucuuu

SEQ ID NO: 105249 - RNA, 22 nt, Homo sapiens
uugagauguggcaguuuaugag

SEQ ID NO: 105250 - RNA, 22 nt, Homo sapiens
uugagauguggguuggugacuu

SEQ ID NO: 105251 - RNA, 22 nt, Homo sapiens
uugagcaaaacauuaauauuag

SEQ ID NO: 105252 - RNA, 22 nt, Homo sapiens
uugaggaggcagucuucccauu

SEQ ID NO: 105253 - RNA, 22 nt, Homo sapiens
uugaggaguacugauuagguau

SEQ ID NO: 105254 - RNA, 23 nt, Homo sapiens
uugaggcauguaccaucaauauc

SEQ ID NO: 105255 - RNA, 22 nt, Homo sapiens
uugagggaggcagggcuugucu

SEQ ID NO: 105256 - RNA, 22 nt, Homo sapiens
uugcaacauguauucuggugau

SEQ ID NO: 105257 - RNA, 22 nt, Homo sapiens
uugcagcaaagagggaggggca

SEQ ID NO: 105258 - RNA, 19 nt, Homo sapiens
uugcauauguugaaccagc

SEQ ID NO: 105259 - RNA, 22 nt, Homo sapiens
uugcauauguugaaccagccuu

SEQ ID NO: 105260 - RNA, 22 nt, Homo sapiens
uugcaucagcaggcauaauugg

SEQ ID NO: 105261 - RNA, 22 nt, Homo sapiens
uugguaaucccuagugucuaga

SEQ ID NO: 105262 - RNA, 22 nt, Homo sapiens
uugugaauggugccacaauaaa

SEQ ID NO: 105263 - RNA, 22 nt, Homo sapiens
uugugcaaaguugugguuucug

SEQ ID NO: 105264 - RNA, 22 nt, Homo sapiens
uugugcuugcuguguucuaugc

SEQ ID NO: 105265 - RNA, 22 nt, Homo sapiens
uuguugcacugcuuuccuggcc

SEQ ID NO: 105266 - RNA, 22 nt, Homo sapiens
uuuaaacugucuuggguuugga

SEQ ID NO: 105267 - RNA, 22 nt, Homo sapiens
uuuaaugcacuaggugguguuc

SEQ ID NO: 105268 - RNA, 22 nt, Homo sapiens
uuuaggcaugcaguucuauuua

SEQ ID NO: 105269 - RNA, 22 nt, Homo sapiens
uuuaguucauuaaggaaucucc

SEQ ID NO: 105270 - RNA, 22 nt, Homo sapiens
uuuauugcucuaaaguugccau

SEQ ID NO: 105271 - RNA, 22 nt, Homo sapiens
uuucacaguguucucccccaga

SEQ ID NO: 105272 - RNA, 22 nt, Homo sapiens
uuucauggacgcaaugccuuuu

SEQ ID NO: 105273 - RNA, 22 nt, Homo sapiens
uuucauggcgaggcuucauggg

SEQ ID NO: 105274 - RNA, 18 nt, Homo sapiens
uuucauugagugugauau

SEQ ID NO: 105275 - RNA, 22 nt, Homo sapiens
uuucccagugguacaguuuaua

SEQ ID NO: 105276 - RNA, 22 nt, Homo sapiens
uuucuugguuguauuuagacuu

SEQ ID NO: 105277 - RNA, 22 nt, Homo sapiens
uuugcauaauaagauuagggug

SEQ ID NO: 105278 - RNA, 19 nt, Homo sapiens
uuugcauagugagaauaua

SEQ ID NO: 105279 - RNA, 22 nt, Homo sapiens
uuugcauauguugaaccagccu

SEQ ID NO: 105280 - RNA, 22 nt, Homo sapiens
uuugccaaugggaauuuuccua

SEQ ID NO: 105281 - RNA, 22 nt, Homo sapiens
uuugcuuaguaaauguagaaaa

SEQ ID NO: 105282 - RNA, 22 nt, Homo sapiens
uuuggcaguuauuuacucagug

SEQ ID NO: 105283 - RNA, 22 nt, Homo sapiens
uuuggcaugggcuauuugcuuu

SEQ ID NO: 105284 - RNA, 22 nt, Homo sapiens
uuugguguauauguaaacuaug

SEQ ID NO: 105285 - RNA, 22 nt, Homo sapiens
uuugguuauuugaaacuagcau

SEQ ID NO: 105286 - RNA, 22 nt, Homo sapiens
uuuguaauccuauuccaaagga

SEQ ID NO: 105287 - RNA, 22 nt, Homo sapiens
uuugucacccugaauguaagau

SEQ ID NO: 105288 - RNA, 22 nt, Homo sapiens
uuugugaaugucauaagcucca

SEQ ID NO: 105289 - RNA, 22 nt, Homo sapiens
uuuguguccccacccaaacauc

SEQ ID NO: 105290 - RNA, 22 nt, Homo sapiens
uuuguguccccacccaaaucuc

SEQ ID NO: 105291 - RNA, 22 nt, Homo sapiens
uuuuacacuucgguugugugca

SEQ ID NO: 105292 - RNA, 22 nt, Homo sapiens
uuuuaguugcucagguauucuc

SEQ ID NO: 105293 - RNA, 22 nt, Homo sapiens
uuuuggacuucaauuugacacu

SEQ ID NO: 105294 - RNA, 22 nt, Homo sapiens
uuuugucccaugggcuguuccc

SEQ ID NO: 105295 - RNA, 22 nt, Homo sapiens
augccaguguccagaguggguu

SEQ ID NO: 105296 - RNA, 22 nt, Homo sapiens
auggaaacauaagaguauagau

SEQ ID NO: 105297 - RNA, 17 nt, Homo sapiens
aaguggcuuguucacca

SEQ ID NO: 105298 - RNA, 22 nt, Homo sapiens
aagugucuuaccgggagggagu

SEQ ID NO: 105299 - RNA, 22 nt, Homo sapiens
uagagguagguguaugaacuag

SEQ ID NO: 105300 - RNA, 22 nt, Homo sapiens
uagagguauaccaaaaaggcau

SEQ ID NO: 105301 - RNA, 19 nt, Homo sapiens
uagagguuuaagaaaagaa

SEQ ID NO: 105302 - RNA, 22 nt, Homo sapiens
uagaguacucugguaaguucuu

SEQ ID NO: 105303 - RNA, 21 nt, Homo sapiens
uagauacuguauuaaaccuag

SEQ ID NO: 105304 - RNA, 22 nt, Homo sapiens
uagcacaucccuaaaaugcugu

SEQ ID NO: 105305 - RNA, 22 nt, Homo sapiens
uagcacaugucagguaauuugc

SEQ ID NO: 105306 - RNA, 22 nt, Homo sapiens
uagcacuauguuaucacauacu

SEQ ID NO: 105307 - RNA, 22 nt, Homo sapiens
uagcuccagugggguuacugcu

SEQ ID NO: 105308 - RNA, 19 nt, Homo sapiens
uaggacccugguggccccc

SEQ ID NO: 105309 - RNA, 22 nt, Homo sapiens
uaggcagccagcuguggauuga

SEQ ID NO: 105310 - RNA, 22 nt, Homo sapiens
uagguaguugugggcuugaaug

SEQ ID NO: 105311 - RNA, 19 nt, Homo sapiens
uaggugguuuuccccucac

SEQ ID NO: 105312 - RNA, 21 nt, Homo sapiens
uagugcagugggguaugacuu

SEQ ID NO: 105313 - RNA, 22 nt, Homo sapiens
uaguucauuauguguugcucag

SEQ ID NO: 105314 - RNA, 22 nt, Homo sapiens
uauaagacuagcagcugaauug

SEQ ID NO: 105315 - RNA, 21 nt, Homo sapiens
uauagcagcacgauuuauagu

SEQ ID NO: 105316 - RNA, 22 nt, Homo sapiens
uauaguguuuucaaaaguaugu

SEQ ID NO: 105317 - RNA, 22 nt, Homo sapiens
uaucacuguuguuuguuuaagg

SEQ ID NO: 105318 - RNA, 21 nt, Homo sapiens
uauccacuugcaacagagaag

SEQ ID NO: 105319 - RNA, 22 nt, Homo sapiens
uauggauuugccuauucuguau

SEQ ID NO: 105320 - RNA, 22 nt, Homo sapiens
uauggcaaugcauaggaaggaa

SEQ ID NO: 105321 - RNA, 22 nt, Homo sapiens
uauggcauuguuggugaugaua

SEQ ID NO: 105322 - RNA, 22 nt, Homo sapiens
uauggcuacuacgaauaaugcu

SEQ ID NO: 105323 - RNA, 22 nt, Homo sapiens
uaugguuuuaagguuaaggacu

SEQ ID NO: 105324 - RNA, 22 nt, Homo sapiens
uauugaauuugagcugucucuu

SEQ ID NO: 105325 - RNA, 22 nt, Homo sapiens
uauugaauuuuuaagcccuuug

SEQ ID NO: 105326 - RNA, 22 nt, Homo sapiens
uauugcaauuggggaaacuggg

SEQ ID NO: 105327 - RNA, 22 nt, Homo sapiens
uauugcagaaugugaguuggca

SEQ ID NO: 105328 - RNA, 22 nt, Homo sapiens
uauugcuuuacucucuuauccu

SEQ ID NO: 105329 - RNA, 22 nt, Homo sapiens
uauugucaccaucccuguuuua

SEQ ID NO: 105330 - RNA, 22 nt, Homo sapiens
ucaaggcaguggccuuccuucu

SEQ ID NO: 105331 - RNA, 22 nt, Homo sapiens
ucaauugcuuaugaagauacau

SEQ ID NO: 105332 - RNA, 22 nt, Homo sapiens
ucacacuguuuugauuauuaua

SEQ ID NO: 105333 - RNA, 22 nt, Homo sapiens
ucacagucaaaguaaucauaga

SEQ ID NO: 105334 - RNA, 22 nt, Homo sapiens
ucacagucuccucuagggaggg

SEQ ID NO: 105335 - RNA, 22 nt, Homo sapiens
ucacagugaguggaguggggug

SEQ ID NO: 105336 - RNA, 22 nt, Homo sapiens
ucacauggaggugauaguugaa

SEQ ID NO: 105337 - RNA, 18 nt, Homo sapiens
ucacauggccgagagaga

SEQ ID NO: 105338 - RNA, 22 nt, Homo sapiens
ucacauggggaagggacuagcu

SEQ ID NO: 105339 - RNA, 22 nt, Homo sapiens
ucacauuaagcuguuauuucuu

SEQ ID NO: 105340 - RNA, 22 nt, Homo sapiens
ucaccuggagagcuugcuaaua

SEQ ID NO: 105341 - RNA, 22 nt, Homo sapiens
ucacgugguucauaaggcagaa

SEQ ID NO: 105342 - RNA, 20 nt, Homo sapiens
ucacugagugguccacagua

SEQ ID NO: 105343 - RNA, 22 nt, Homo sapiens
ucacuggagguuccugaaguuc

SEQ ID NO: 105344 - RNA, 22 nt, Homo sapiens
ucacugggagaccaaagccauc

SEQ ID NO: 105345 - RNA, 20 nt, Homo sapiens
ucacugugaacuucuugagg

SEQ ID NO: 105346 - RNA, 22 nt, Homo sapiens
ucacugugcaugaaggaugcug

SEQ ID NO: 105347 - RNA, 22 nt, Homo sapiens
ucacuguggaacucaaaaagcu

SEQ ID NO: 105348 - RNA, 22 nt, Homo sapiens
ucacugugguuggaaggcuuaa

SEQ ID NO: 105349 - RNA, 22 nt, Homo sapiens
ucacugugguuuugaugugcau

SEQ ID NO: 105350 - RNA, 22 nt, Homo sapiens
ucacuguguauguauaugcagg

SEQ ID NO: 105351 - RNA, 22 nt, Homo sapiens
ucagagcaaagacacuuuauca

SEQ ID NO: 105352 - RNA, 22 nt, Homo sapiens
ucagaguagcugucugaggugc

SEQ ID NO: 105353 - RNA, 22 nt, Homo sapiens
ucagcagugagagaccucaccc

SEQ ID NO: 105354 - RNA, 22 nt, Homo sapiens
ucagggacgcuugacacaagcc

SEQ ID NO: 105355 - RNA, 22 nt, Homo sapiens
ucagguaguuugugggagauga

SEQ ID NO: 105356 - RNA, 22 nt, Homo sapiens
ucauaguacuuuguuuugaaaa

SEQ ID NO: 105357 - RNA, 23 nt, Homo sapiens
ucaugaggccauucaaauccauu

SEQ ID NO: 105358 - RNA, 22 nt, Homo sapiens
ucauggcacugaugagaguuuc

SEQ ID NO: 105359 - RNA, 19 nt, Homo sapiens
ucauggcuuuuucagcugu

SEQ ID NO: 105360 - RNA, 22 nt, Homo sapiens
ucauggggugagcuacaggcac

SEQ ID NO: 105361 - RNA, 22 nt, Homo sapiens
ucauucauucuucaguggguac

SEQ ID NO: 105362 - RNA, 22 nt, Homo sapiens
uccacaauggcugaacuagauu

SEQ ID NO: 105363 - RNA, 19 nt, Homo sapiens
ucccaagaugcucauacau

SEQ ID NO: 105364 - RNA, 19 nt, Homo sapiens
uccccgggucuagugcagc

SEQ ID NO: 105365 - RNA, 22 nt, Homo sapiens
uccuucaugcaucaauguaucc

SEQ ID NO: 105366 - RNA, 22 nt, Homo sapiens
ucgcaccauugcacuccagcca

SEQ ID NO: 105367 - RNA, 19 nt, Homo sapiens
ucucaguguuggucaggug

SEQ ID NO: 105368 - RNA, 22 nt, Homo sapiens
ucucaugaagauagagaauaga

SEQ ID NO: 105369 - RNA, 22 nt, Homo sapiens
ucucccauccaugaacuucugu

SEQ ID NO: 105370 - RNA, 22 nt, Homo sapiens
ucucuguuugucuguuacuggu

SEQ ID NO: 105371 - RNA, 22 nt, Homo sapiens
ucugaguggcagaaugagcuga

SEQ ID NO: 105372 - RNA, 22 nt, Homo sapiens
ucuggccuacaucauuuuuccg

SEQ ID NO: 105373 - RNA, 22 nt, Homo sapiens
ucugguggugaugagagacagu

SEQ ID NO: 105374 - RNA, 22 nt, Homo sapiens
ucugugcuugucauaugcuuug

SEQ ID NO: 105375 - RNA, 22 nt, Homo sapiens
ucuguguugaucacacugggag

SEQ ID NO: 105376 - RNA, 22 nt, Homo sapiens
ucuguguugaugcucauuaauu

SEQ ID NO: 105377 - RNA, 22 nt, Homo sapiens
ucuuuagugacaguugugcaag

SEQ ID NO: 105378 - RNA, 22 nt, Homo sapiens
ucuuugccuaacccaaggucau

SEQ ID NO: 105379 - RNA, 22 nt, Homo sapiens
ucuuuggauggaaauuggaguc

SEQ ID NO: 105380 - RNA, 22 nt, Homo sapiens
ugaaaaguuguugaaggcuuca

SEQ ID NO: 105381 - RNA, 22 nt, Homo sapiens
ugaaaugaucaguuugguuacu

SEQ ID NO: 105382 - RNA, 22 nt, Homo sapiens
cuuuuguggaucuucuguugcu

SEQ ID NO: 105383 - RNA, 22 nt, Homo sapiens
gaaacugcauuucuaacaagcu

SEQ ID NO: 105384 - RNA, 22 nt, Homo sapiens
gaagauucaaccaaaccagaac

SEQ ID NO: 105385 - RNA, 23 nt, Homo sapiens
gaaguaauaaauggauucuuaac

SEQ ID NO: 105386 - RNA, 22 nt, Homo sapiens
gagagguaguuuuuuggucguc

SEQ ID NO: 105387 - RNA, 22 nt, Homo sapiens
gagauucaucuagguccagaga

SEQ ID NO: 105388 - RNA, 22 nt, Homo sapiens
gagcaacaguggcagugguggg

SEQ ID NO: 105389 - RNA, 22 nt, Homo sapiens
gagguaugugggcagacauuua

SEQ ID NO: 105390 - RNA, 19 nt, Homo sapiens
gaguugggguuuacuguaa

SEQ ID NO: 105391 - RNA, 22 nt, Homo sapiens
gauaaaucuuggcuagucuaag

SEQ ID NO: 105392 - RNA, 22 nt, Homo sapiens
gauaagagaugauuuugccaug

SEQ ID NO: 105393 - RNA, 22 nt, Homo sapiens
gauauguaaaaauuauaucuga

SEQ ID NO: 105394 - RNA, 22 nt, Homo sapiens
gauauguguuuuagucaggguu

SEQ ID NO: 105395 - RNA, 22 nt, Homo sapiens
gaugugaaaucauaguuucuag

SEQ ID NO: 105396 - RNA, 22 nt, Homo sapiens
gauuccauugcgaauuuucaga

SEQ ID NO: 105397 - RNA, 22 nt, Homo sapiens
gcacaguaggugguaggacuuu

SEQ ID NO: 105398 - RNA, 22 nt, Homo sapiens
gcacauggccacuaggaauaaa

SEQ ID NO: 105399 - RNA, 22 nt, Homo sapiens
gcacugggccacauuuauuuuc

SEQ ID NO: 105400 - RNA, 19 nt, Homo sapiens
gcaguauugaaggccaguc

SEQ ID NO: 105401 - RNA, 22 nt, Homo sapiens
gcaguauuguugaaauguccau

SEQ ID NO: 105402 - RNA, 22 nt, Homo sapiens
gcagugugauguuuuaaucuau

SEQ ID NO: 105403 - RNA, 22 nt, Homo sapiens
gcaguguggguagagggcaaga

SEQ ID NO: 105404 - RNA, 16 nt, Homo sapiens
gcaguguguuuaauag

SEQ ID NO: 105405 - RNA, 22 nt, Homo sapiens
gcuuuguuguugaugggaaauc

SEQ ID NO: 105406 - RNA, 22 nt, Homo sapiens
ggaaaucaucauucucgguaua

SEQ ID NO: 105407 - RNA, 22 nt, Homo sapiens
ggacagugaaugccacuccucc

SEQ ID NO: 105408 - RNA, 19 nt, Homo sapiens
ggacugucauggaguaguu

SEQ ID NO: 105409 - RNA, 22 nt, Homo sapiens
ggagguaauaaguuccagugua

SEQ ID NO: 105410 - RNA, 20 nt, Homo sapiens
ggagguguuggauuucuagu

SEQ ID NO: 105411 - RNA, 22 nt, Homo sapiens
ggauugugauaauuguugcaaa

SEQ ID NO: 105412 - RNA, 21 nt, Homo sapiens
ggcaagagaauacaacauaaa

SEQ ID NO: 105413 - RNA, 22 nt, Homo sapiens
ggcagcacaauuuucugaugga

SEQ ID NO: 105414 - RNA, 22 nt, Homo sapiens
ggcaguuuguucuugcuccuuu

SEQ ID NO: 105415 - RNA, 22 nt, Homo sapiens
ggcauguuuaguagaauguggu

SEQ ID NO: 105416 - RNA, 22 nt, Homo sapiens
ggccagaugcaguggcucacac

SEQ ID NO: 105417 - RNA, 22 nt, Homo sapiens
ggcucagugggguccugguucu

SEQ ID NO: 105418 - RNA, 22 nt, Homo sapiens
ggcucaguuuccuccgucugcu

SEQ ID NO: 105419 - RNA, 22 nt, Homo sapiens
ggcuguguguuaaaauaggcuu

SEQ ID NO: 105420 - RNA, 22 nt, Homo sapiens
gggaagugugcagaguucucuu

SEQ ID NO: 105421 - RNA, 22 nt, Homo sapiens
gggaaugaagagaaccuuccca

SEQ ID NO: 105422 - RNA, 22 nt, Homo sapiens
gggaguguguaggacccagugu

SEQ ID NO: 105423 - RNA, 22 nt, Homo sapiens
guaaugaacuugaaagccuguu

SEQ ID NO: 105424 - RNA, 22 nt, Homo sapiens
guagaagcacagggccuguauu

SEQ ID NO: 105425 - RNA, 22 nt, Homo sapiens
guaguuuaucagaaagaauagg

SEQ ID NO: 105426 - RNA, 22 nt, Homo sapiens
guauacaugucaaaacucacau

SEQ ID NO: 105427 - RNA, 22 nt, Homo sapiens
guaucauuggcauguaaccaga

SEQ ID NO: 105428 - RNA, 22 nt, Homo sapiens
guauggcauuuguggauuggcc

SEQ ID NO: 105429 - RNA, 22 nt, Homo sapiens
gucacugagcagaaggaagcga

SEQ ID NO: 105430 - RNA, 22 nt, Homo sapiens
gucauauaggguuuaccuguau

SEQ ID NO: 105431 - RNA, 22 nt, Homo sapiens
gucaucaggacgggucaucugc

SEQ ID NO: 105432 - RNA, 22 nt, Homo sapiens
gucccugugucuuuauguggcc

SEQ ID NO: 105433 - RNA, 22 nt, Homo sapiens
gucucuuguuaucauuucugag

SEQ ID NO: 105434 - RNA, 22 nt, Homo sapiens
gucugguuuuuuauauccucac

SEQ ID NO: 105435 - RNA, 22 nt, Homo sapiens
gucugucuuuugucuuugaaau

SEQ ID NO: 105436 - RNA, 22 nt, Homo sapiens
gugaccaaagauagcucaaguu

SEQ ID NO: 105437 - RNA, 22 nt, Homo sapiens
gugagaugaggucucacucugu

SEQ ID NO: 105438 - RNA, 22 nt, Homo sapiens
gugagaugugacuucugccucu

SEQ ID NO: 105439 - RNA, 22 nt, Homo sapiens
gugagggaugugaaaaagguca

SEQ ID NO: 105440 - RNA, 22 nt, Homo sapiens
gugaguaaagguucauugaauu

SEQ ID NO: 105441 - RNA, 16 nt, Homo sapiens
gugcuguguuguuagg

SEQ ID NO: 105442 - RNA, 22 nt, Homo sapiens
guggaaucuagagaggcaguag

SEQ ID NO: 105443 - RNA, 22 nt, Homo sapiens
guggacggagguugcagugagc

SEQ ID NO: 105444 - RNA, 22 nt, Homo sapiens
guggagacaaaggcugagugag

SEQ ID NO: 105445 - RNA, 22 nt, Homo sapiens
guggcaaguguuccaagaggcg

SEQ ID NO: 105446 - RNA, 22 nt, Homo sapiens
guggcauuucccaaaguauucu

SEQ ID NO: 105447 - RNA, 22 nt, Homo sapiens
guggcuuuaaguacgauugagg

SEQ ID NO: 105448 - RNA, 22 nt, Homo sapiens
gugggguaggcaauuccuagug

SEQ ID NO: 105449 - RNA, 22 nt, Homo sapiens
guguaauaaucguggacuaugu

SEQ ID NO: 105450 - RNA, 22 nt, Homo sapiens
guguaauacauuagcaaaccaa

SEQ ID NO: 105451 - RNA, 19 nt, Homo sapiens
gugugcauaucacagagca

SEQ ID NO: 105452 - RNA, 22 nt, Homo sapiens
gugugcauggagggggcaguga

SEQ ID NO: 105453 - RNA, 22 nt, Homo sapiens
guucacaguuaggacaacugcu

SEQ ID NO: 105454 - RNA, 22 nt, Homo sapiens
guucagguauucuggaacagag

SEQ ID NO: 105455 - RNA, 17 nt, Homo sapiens
guucccaguggcauuug

SEQ ID NO: 105456 - RNA, 22 nt, Homo sapiens
guucccaguugaaaugauuagu

SEQ ID NO: 105457 - RNA, 22 nt, Homo sapiens
guugcuuauuccuguaauccca

SEQ ID NO: 105458 - RNA, 22 nt, Homo sapiens
uaaacugcuugaaaugguguca

SEQ ID NO: 105459 - RNA, 22 nt, Homo sapiens
uaaaugacugucaguagaugaa

SEQ ID NO: 105460 - RNA, 18 nt, Homo sapiens
uaacagucucucaggauc

SEQ ID NO: 105461 - RNA, 22 nt, Homo sapiens
uaacaguguauuccuuuggaca

SEQ ID NO: 105462 - RNA, 22 nt, Homo sapiens
uaacugcaaccucugccugcug

SEQ ID NO: 105463 - RNA, 22 nt, Homo sapiens
uaagacacuuaaaauguuacau

SEQ ID NO: 105464 - RNA, 22 nt, Homo sapiens
uaauaguuggcacuggagaaag

SEQ ID NO: 105465 - RNA, 19 nt, Homo sapiens
uaaugccacugccuggcau

SEQ ID NO: 105466 - RNA, 22 nt, Homo sapiens
uaaugcuccauggguuauuaaa

SEQ ID NO: 105467 - RNA, 21 nt, Homo sapiens
uaauggcaugaucucggcuca

SEQ ID NO: 105468 - RNA, 22 nt, Homo sapiens
ugaaggacauaaggcagaguga

SEQ ID NO: 105469 - RNA, 22 nt, Homo sapiens
ugaaggccgggcaugguggcuc

SEQ ID NO: 105470 - RNA, 22 nt, Homo sapiens
ugaauacagcacacccaugggu

SEQ ID NO: 105471 - RNA, 22 nt, Homo sapiens
ugaauagaaguggcaggaguag

SEQ ID NO: 105472 - RNA, 22 nt, Homo sapiens
ugacuagucauaggcauggggg

SEQ ID NO: 105473 - RNA, 22 nt, Homo sapiens
ugacuagugcccuuugcugccu

SEQ ID NO: 105474 - RNA, 22 nt, Homo sapiens
ugagaacagauggcuuuauuau

SEQ ID NO: 105475 - RNA, 16 nt, Homo sapiens
ugagaacaugugacau

SEQ ID NO: 105476 - RNA, 19 nt, Homo sapiens
ugagaacaugugguauuug

SEQ ID NO: 105477 - RNA, 22 nt, Homo sapiens
ugagaauauuugaagauguuag

SEQ ID NO: 105478 - RNA, 22 nt, Homo sapiens
ugagaugauagauauguuaauu

SEQ ID NO: 105479 - RNA, 22 nt, Homo sapiens
uucacagucacccuucuccaug

SEQ ID NO: 105480 - RNA, 22 nt, Homo sapiens
uucaccuggaguucaggauaag

SEQ ID NO: 105481 - RNA, 22 nt, Homo sapiens
uucaccuggguuggccaucauu

SEQ ID NO: 105482 - RNA, 22 nt, Homo sapiens
uucaccuguagcaugcccuugg

SEQ ID NO: 105483 - RNA, 22 nt, Homo sapiens
uucacugcauuucagccugggc

SEQ ID NO: 105484 - RNA, 22 nt, Homo sapiens
uucaggcuuuuauuuacugaua

SEQ ID NO: 105485 - RNA, 22 nt, Homo sapiens
uucagggagaaggcaaacguug

SEQ ID NO: 105486 - RNA, 18 nt, Homo sapiens
uucaguuuguaucugggg

SEQ ID NO: 105487 - RNA, 22 nt, Homo sapiens
uucauagucuaugcaaguaaga

SEQ ID NO: 105488 - RNA, 22 nt, Homo sapiens
uucaucagcuguagaugucaug

SEQ ID NO: 105489 - RNA, 22 nt, Homo sapiens
uucauggaugcauuugaggggu

SEQ ID NO: 105490 - RNA, 22 nt, Homo sapiens
uuccacagggauuugcauugau

SEQ ID NO: 105491 - RNA, 22 nt, Homo sapiens
uuccagcugggggcaacucugc

SEQ ID NO: 105492 - RNA, 22 nt, Homo sapiens
uuuguaauaccugaggcugggu

SEQ ID NO: 105493 - RNA, 21 nt, Homo sapiens
uuuguguccccacccaaaucu

SEQ ID NO: 105494 - RNA, 23 nt, Homo sapiens
uuuguguccccacccaaaucuca

SEQ ID NO: 105495 - RNA, 22 nt, Homo sapiens
uuuguguccccacccacaucuc

SEQ ID NO: 105496 - RNA, 22 nt, Homo sapiens
uuuuacacaucaccgcucgugu

SEQ ID NO: 105497 - RNA, 22 nt, Homo sapiens
uuuuacacuguugguuggaaug

SEQ ID NO: 105498 - RNA, 22 nt, Homo sapiens
uuuuaguggacaaagguauuua

SEQ ID NO: 105499 - RNA, 22 nt, Homo sapiens
uuuugcuugugaauagccacau

SEQ ID NO: 105500 - RNA, 21 nt, Homo sapiens
uuuugugcaugugcagccugc

SEQ ID NO: 105501 - RNA, 22 nt, Homo sapiens
uuuuuauggccaauccucagaa

SEQ ID NO: 105502 - RNA, 23 nt, Homo sapiens
uuuuuguguuucauggaaauagg

SEQ ID NO: 105503 - RNA, 22 nt, Homo sapiens
uauuguuuuucccaggagucua

SEQ ID NO: 105504 - RNA, 22 nt, Homo sapiens
ucaaggcacauuugacauuuuc

SEQ ID NO: 105505 - RNA, 20 nt, Homo sapiens
ucaaggcacgaauaaaaguu

SEQ ID NO: 105506 - RNA, 20 nt, Homo sapiens
ucaaggcaggaacuguacau

SEQ ID NO: 105507 - RNA, 22 nt, Homo sapiens
ucaauugcaucaacaguguaca

SEQ ID NO: 105508 - RNA, 22 nt, Homo sapiens
ucacaagugagaggaauuagau

SEQ ID NO: 105509 - RNA, 20 nt, Homo sapiens
ucacagucacacauaauccu

SEQ ID NO: 105510 - RNA, 22 nt, Homo sapiens
ucacauggcagagaagaagcuc

SEQ ID NO: 105511 - RNA, 22 nt, Homo sapiens
ucacaugucagccguggggaag

SEQ ID NO: 105512 - RNA, 22 nt, Homo sapiens
ucaccuggggcacagcugaaga

SEQ ID NO: 105513 - RNA, 20 nt, Homo sapiens
ucacuggguucuugaagucu

SEQ ID NO: 105514 - RNA, 22 nt, Homo sapiens
ucacugugcacauaugauaggu

SEQ ID NO: 105515 - RNA, 21 nt, Homo sapiens
ucagaagcucccagggaggac

SEQ ID NO: 105516 - RNA, 22 nt, Homo sapiens
ucagucauugauggaguagguc

SEQ ID NO: 105517 - RNA, 21 nt, Homo sapiens
ucaucaagcuguagacaugau

SEQ ID NO: 105518 - RNA, 22 nt, Homo sapiens
ucaucaguuuuuuauaugugau

SEQ ID NO: 105519 - RNA, 22 nt, Homo sapiens
ucaugggagcccccaucaugag

SEQ ID NO: 105520 - RNA, 23 nt, Homo sapiens
ucauguauucccuguaaugggua

SEQ ID NO: 105521 - RNA, 22 nt, Homo sapiens
ucaugucuuguuguauuuauuu

SEQ ID NO: 105522 - RNA, 22 nt, Homo sapiens
uccaauguaaucaucauugaau

SEQ ID NO: 105523 - RNA, 21 nt, Homo sapiens
uccagcuuugagaguuguggu

SEQ ID NO: 105524 - RNA, 22 nt, Homo sapiens
uccauggagacacauuuuauau

SEQ ID NO: 105525 - RNA, 22 nt, Homo sapiens
uccauuuguagguagugagaca

SEQ ID NO: 105526 - RNA, 17 nt, Homo sapiens
ucccauguuucuucuac

SEQ ID NO: 105527 - RNA, 22 nt, Homo sapiens
ucccuggacagccuugccuggg

SEQ ID NO: 105528 - RNA, 19 nt, Homo sapiens
ucuaaaucucuugauagac

SEQ ID NO: 105529 - RNA, 15 nt, Homo sapiens
ucuaguuuugaagac

SEQ ID NO: 105530 - RNA, 22 nt, Homo sapiens
ucucaauuugauuacauucaua

SEQ ID NO: 105531 - RNA, 22 nt, Homo sapiens
ucucacagaguugaacuuucuu

SEQ ID NO: 105532 - RNA, 17 nt, Homo sapiens
ucucccaucccuuucuc

SEQ ID NO: 105533 - RNA, 22 nt, Homo sapiens
ucucccauccguacacggauug

SEQ ID NO: 105534 - RNA, 22 nt, Homo sapiens
ucucuggauaucuacuuauguu

SEQ ID NO: 105535 - RNA, 22 nt, Homo sapiens
ucuggagugugaaguggauaug

SEQ ID NO: 105536 - RNA, 22 nt, Homo sapiens
ucuggccuacaaguaauuuuau

SEQ ID NO: 105537 - RNA, 22 nt, Homo sapiens
ucugugcugagaguugaaaguu

SEQ ID NO: 105538 - RNA, 22 nt, Homo sapiens
ucuguugguucuuugaggagga

SEQ ID NO: 105539 - RNA, 22 nt, Homo sapiens
ucuuggccaugaauggcaaggc

SEQ ID NO: 105540 - RNA, 22 nt, Homo sapiens
ucuuugggauauucugaaaggg

SEQ ID NO: 105541 - RNA, 22 nt, Homo sapiens
ucuuuggguguauuucacagcc

SEQ ID NO: 105542 - RNA, 22 nt, Homo sapiens
ucuuugguauugugaauagugu

SEQ ID NO: 105543 - RNA, 22 nt, Homo sapiens
ucuuugguugcacugcaggugu

SEQ ID NO: 105544 - RNA, 22 nt, Homo sapiens
ucuuuuguaaaaugaggaggug

SEQ ID NO: 105545 - RNA, 22 nt, Homo sapiens
ugaagugggaaaugaguauuaa

SEQ ID NO: 105546 - RNA, 22 nt, Homo sapiens
ugaauauagacagggguagaga

SEQ ID NO: 105547 - RNA, 22 nt, Homo sapiens
ugagaacagcagcuugggacac

SEQ ID NO: 105548 - RNA, 16 nt, Homo sapiens
ugagaacaugcagcau

SEQ ID NO: 105549 - RNA, 16 nt, Homo sapiens
ugagaacaugggguau

SEQ ID NO: 105550 - RNA, 16 nt, Homo sapiens
ugagaacaugugauau

SEQ ID NO: 105551 - RNA, 22 nt, Homo sapiens
ugagaacauuccucuuccuggc

SEQ ID NO: 105552 - RNA, 22 nt, Homo sapiens
ugagacugaaauuaggaaacug

SEQ ID NO: 105553 - RNA, 22 nt, Homo sapiens
ugagagaugaacucugauaugu

SEQ ID NO: 105554 - RNA, 22 nt, Homo sapiens
ugagauaguacuuuuuuaaagg

SEQ ID NO: 105555 - RNA, 22 nt, Homo sapiens
ugagaugagggcugcacucaaa

SEQ ID NO: 105556 - RNA, 21 nt, Homo sapiens
ugagaugcaaucaccagggag

SEQ ID NO: 105557 - RNA, 22 nt, Homo sapiens
ugagauggagucuugucgccua

SEQ ID NO: 105558 - RNA, 22 nt, Homo sapiens
ugagauggaucuuggauuugaa

SEQ ID NO: 105559 - RNA, 22 nt, Homo sapiens
ugagauguuuguuucagugccu

SEQ ID NO: 105560 - RNA, 22 nt, Homo sapiens
ugagcaacauuucaaaacucca

SEQ ID NO: 105561 - RNA, 20 nt, Homo sapiens
ugagccccuggacucaagcg

SEQ ID NO: 105562 - RNA, 22 nt, Homo sapiens
ugaggcacucccuagcggggug

SEQ ID NO: 105563 - RNA, 22 nt, Homo sapiens
ugaggucacuuguuuuaugcuu

SEQ ID NO: 105564 - RNA, 22 nt, Homo sapiens
ugaggucauguucugucagguu

SEQ ID NO: 105565 - RNA, 22 nt, Homo sapiens
ugaguggagacuguguguagag

SEQ ID NO: 105566 - RNA, 22 nt, Homo sapiens
ugagugugaggaagaauuagaa

SEQ ID NO: 105567 - RNA, 22 nt, Homo sapiens
ugaguguguaugugcauacaca

SEQ ID NO: 105568 - RNA, 22 nt, Homo sapiens
ugaguucauggucauuugucac

SEQ ID NO: 105569 - RNA, 22 nt, Homo sapiens
ugauaucucuugccuccaaaug

SEQ ID NO: 105570 - RNA, 22 nt, Homo sapiens
ugauaugaaguuagcuggcugu

SEQ ID NO: 105571 - RNA, 21 nt, Homo sapiens
ugaucacaugaaaaccaugca

SEQ ID NO: 105572 - RNA, 22 nt, Homo sapiens
ugauggcauuucauguuuguaa

SEQ ID NO: 105573 - RNA, 21 nt, Homo sapiens
ugcagccauucagcccuaugc

SEQ ID NO: 105574 - RNA, 22 nt, Homo sapiens
ugccaaaaugggcuuuauaccg

SEQ ID NO: 105575 - RNA, 22 nt, Homo sapiens
ugccaacaugccuggcuguuuu

SEQ ID NO: 105576 - RNA, 22 nt, Homo sapiens
ugccaguauuuuacugaggauu

SEQ ID NO: 105577 - RNA, 22 nt, Homo sapiens
ugccaguguugccuuucacuag

SEQ ID NO: 105578 - RNA, 19 nt, Homo sapiens
ugccauguagcacaugguc

SEQ ID NO: 105579 - RNA, 22 nt, Homo sapiens
uggaaauaaaauagaguuugcc

SEQ ID NO: 105580 - RNA, 22 nt, Homo sapiens
uggaagauggaguuuuaucauu

SEQ ID NO: 105581 - RNA, 21 nt, Homo sapiens
uggaaguguacaauuauaccc

SEQ ID NO: 105582 - RNA, 22 nt, Homo sapiens
uggaauaugagacgggguuguc

SEQ ID NO: 105583 - RNA, 21 nt, Homo sapiens
uggaauuaauggagagguguu

SEQ ID NO: 105584 - RNA, 22 nt, Homo sapiens
uggacaagugcccuccaccuca

SEQ ID NO: 105585 - RNA, 20 nt, Homo sapiens
uggaccagagagguggggac

SEQ ID NO: 105586 - RNA, 22 nt, Homo sapiens
uggagacaaagauagaaaagca

SEQ ID NO: 105587 - RNA, 22 nt, Homo sapiens
uggagagucauuuauaguauuu

SEQ ID NO: 105588 - RNA, 22 nt, Homo sapiens
uggaguaggccuaagaaugaca

SEQ ID NO: 105589 - RNA, 22 nt, Homo sapiens
ugagauggguaauuaaauggug

SEQ ID NO: 105590 - RNA, 22 nt, Homo sapiens
ugagauggguucugguccccug

SEQ ID NO: 105591 - RNA, 22 nt, Homo sapiens
ugagccaaguucacaccauugc

SEQ ID NO: 105592 - RNA, 22 nt, Homo sapiens
ugaggacugagaggcacugugg

SEQ ID NO: 105593 - RNA, 22 nt, Homo sapiens
ugagguaaaacaaggauuggau

SEQ ID NO: 105594 - RNA, 22 nt, Homo sapiens
ugagguaauagauaauauuuuu

SEQ ID NO: 105595 - RNA, 22 nt, Homo sapiens
ugagguuauuuguucaagaagu

SEQ ID NO: 105596 - RNA, 22 nt, Homo sapiens
ugaguaugaguucaggaaaggc

SEQ ID NO: 105597 - RNA, 22 nt, Homo sapiens
ugagugaggcugggcagucccu

SEQ ID NO: 105598 - RNA, 22 nt, Homo sapiens
ugaguucuuuguagauucugug

SEQ ID NO: 105599 - RNA, 20 nt, Homo sapiens
ugaugcaaaucuuuaaaagu

SEQ ID NO: 105600 - RNA, 23 nt, Homo sapiens
ugauguccacuuagggucuaggu

SEQ ID NO: 105601 - RNA, 19 nt, Homo sapiens
ugcaaauucuaaaaacuga

SEQ ID NO: 105602 - RNA, 22 nt, Homo sapiens
ugcaagacacuguccugggcau

SEQ ID NO: 105603 - RNA, 22 nt, Homo sapiens
ugcaccacugcacuccacccug

SEQ ID NO: 105604 - RNA, 22 nt, Homo sapiens
ugcagcacuguucacaauagcc

SEQ ID NO: 105605 - RNA, 22 nt, Homo sapiens
ugcagguacuugacaacuuggg

SEQ ID NO: 105606 - RNA, 22 nt, Homo sapiens
ugcagugcaugacuguguuaug

SEQ ID NO: 105607 - RNA, 22 nt, Homo sapiens
ugcauauucgaguuauuuuggg

SEQ ID NO: 105608 - RNA, 22 nt, Homo sapiens
ugcaugaugcugagauuuggga

SEQ ID NO: 105609 - RNA, 22 nt, Homo sapiens
ugcauggaagggagggaaagag

SEQ ID NO: 105610 - RNA, 21 nt, Homo sapiens
ugcauggagaacacugagggu

SEQ ID NO: 105611 - RNA, 22 nt, Homo sapiens
ugcauguucuuacucauacaug

SEQ ID NO: 105612 - RNA, 22 nt, Homo sapiens
ugccaaggagucagucccuaga

SEQ ID NO: 105613 - RNA, 20 nt, Homo sapiens
ugccagugugucaauuuaua

SEQ ID NO: 105614 - RNA, 22 nt, Homo sapiens
ugccaguguuuuguugaagauu

SEQ ID NO: 105615 - RNA, 22 nt, Homo sapiens
ugccugagccagguuuuaggag

SEQ ID NO: 105616 - RNA, 16 nt, Homo sapiens
ugccuucuucuguauu

SEQ ID NO: 105617 - RNA, 22 nt, Homo sapiens
ugcugguguuuaggaauaagaa

SEQ ID NO: 105618 - RNA, 22 nt, Homo sapiens
gcaagaauggaacaggagagcc

SEQ ID NO: 105619 - RNA, 22 nt, Homo sapiens
gcacaggguuacauucuaaggu

SEQ ID NO: 105620 - RNA, 22 nt, Homo sapiens
gcacaguguuacuugauauauu

SEQ ID NO: 105621 - RNA, 22 nt, Homo sapiens
gcacauggccccaucgugccga

SEQ ID NO: 105622 - RNA, 22 nt, Homo sapiens
gcagcacauggcagaacauauu

SEQ ID NO: 105623 - RNA, 22 nt, Homo sapiens
gcagugugugaggaauuugggu

SEQ ID NO: 105624 - RNA, 20 nt, Homo sapiens
gcaugagucuuuauaguaga

SEQ ID NO: 105625 - RNA, 22 nt, Homo sapiens
gccaagaugcugcccacagaca

SEQ ID NO: 105626 - RNA, 22 nt, Homo sapiens
gccauugcacucuagccugagc

SEQ ID NO: 105627 - RNA, 22 nt, Homo sapiens
gccccgggugaugcagccguca

SEQ ID NO: 105628 - RNA, 22 nt, Homo sapiens
gccccugagacuugccucgggc

SEQ ID NO: 105629 - RNA, 22 nt, Homo sapiens
gcugguguucaggcccucaguc

SEQ ID NO: 105630 - RNA, 22 nt, Homo sapiens
gcugguguugugaaucaggccg

SEQ ID NO: 105631 - RNA, 22 nt, Homo sapiens
ggaaaguaacccauucucuuac

SEQ ID NO: 105632 - RNA, 22 nt, Homo sapiens
ggaagccugcacucgggcaggg

SEQ ID NO: 105633 - RNA, 17 nt, Homo sapiens
ggaaugaauuccagccc

SEQ ID NO: 105634 - RNA, 22 nt, Homo sapiens
ggacaagagacugggacacuga

SEQ ID NO: 105635 - RNA, 20 nt, Homo sapiens
ggagguguugauuuuucuuu

SEQ ID NO: 105636 - RNA, 22 nt, Homo sapiens
ggaguguguaggagaaagguaa

SEQ ID NO: 105637 - RNA, 22 nt, Homo sapiens
ggcaagugucagcagcaacacc

SEQ ID NO: 105638 - RNA, 22 nt, Homo sapiens
ggcaaugucagcuaaugaugga

SEQ ID NO: 105639 - RNA, 22 nt, Homo sapiens
ggcagaucauuggccucaguuu

SEQ ID NO: 105640 - RNA, 22 nt, Homo sapiens
ggcagcuguguccuucguaagg

SEQ ID NO: 105641 - RNA, 22 nt, Homo sapiens
ggcaugaggccauaaaaguaag

SEQ ID NO: 105642 - RNA, 22 nt, Homo sapiens
ggcauugugauccaccagccuu

SEQ ID NO: 105643 - RNA, 22 nt, Homo sapiens
ggcuagagacaaguugcugaga

SEQ ID NO: 105644 - RNA, 22 nt, Homo sapiens
ggcucaguugcaaaucaguuca

SEQ ID NO: 105645 - RNA, 22 nt, Homo sapiens
gggcacgugugugcugugcuca

SEQ ID NO: 105646 - RNA, 22 nt, Homo sapiens
gggguauguaagugagugagug

SEQ ID NO: 105647 - RNA, 22 nt, Homo sapiens
ggucagauggcagcugggccug

SEQ ID NO: 105648 - RNA, 22 nt, Homo sapiens
ggucauagagaauucaccagga

SEQ ID NO: 105649 - RNA, 23 nt, Homo sapiens
ggugaggaguacagagucuucau

SEQ ID NO: 105650 - RNA, 22 nt, Homo sapiens
ggugcuugaggaacggaggcug

SEQ ID NO: 105651 - RNA, 22 nt, Homo sapiens
guaagacuuauuuucuuuauca

SEQ ID NO: 105652 - RNA, 22 nt, Homo sapiens
guacaagugcaguuucguuaca

SEQ ID NO: 105653 - RNA, 22 nt, Homo sapiens
guacacauacauauaugugugu

SEQ ID NO: 105654 - RNA, 22 nt, Homo sapiens
guauacuucugaaaauagcuau

SEQ ID NO: 105655 - RNA, 22 nt, Homo sapiens
guauggcacuauccucucugau

SEQ ID NO: 105656 - RNA, 22 nt, Homo sapiens
guaugugacuggaacaguagga

SEQ ID NO: 105657 - RNA, 22 nt, Homo sapiens
gucaccagcuguguuagccccu

SEQ ID NO: 105658 - RNA, 22 nt, Homo sapiens
gucauaugcucggaaaauguua

SEQ ID NO: 105659 - RNA, 22 nt, Homo sapiens
gucauugucaauugacaauugu

SEQ ID NO: 105660 - RNA, 22 nt, Homo sapiens
gucugguuggaguaguuuucag

SEQ ID NO: 105661 - RNA, 20 nt, Homo sapiens
gucugucuccgaguagaauu

SEQ ID NO: 105662 - RNA, 22 nt, Homo sapiens
gucuuuugcuagccagagagcu

SEQ ID NO: 105663 - RNA, 22 nt, Homo sapiens
gugaauugagagaacuguguua

SEQ ID NO: 105664 - RNA, 22 nt, Homo sapiens
gugacugcauccauccaggcuu

SEQ ID NO: 105665 - RNA, 22 nt, Homo sapiens
gugagauggagucuugcuuugu

SEQ ID NO: 105666 - RNA, 22 nt, Homo sapiens
gugagaugguaucucauugugg

SEQ ID NO: 105667 - RNA, 17 nt, Homo sapiens
gugagguggguaguauc

SEQ ID NO: 105668 - RNA, 22 nt, Homo sapiens
gugauagguugucacugucacu

SEQ ID NO: 105669 - RNA, 22 nt, Homo sapiens
gugccacaguguuaagggauuc

SEQ ID NO: 105670 - RNA, 23 nt, Homo sapiens
gugccuucugagccuagucucca

SEQ ID NO: 105671 - RNA, 22 nt, Homo sapiens
guggcuagaaugaagguagcug

SEQ ID NO: 105672 - RNA, 22 nt, Homo sapiens
gugggguaggugacuugaugag

SEQ ID NO: 105673 - RNA, 22 nt, Homo sapiens
guguaaguccugaguuuggaua

SEQ ID NO: 105674 - RNA, 22 nt, Homo sapiens
guguaauacacacauauaugca

SEQ ID NO: 105675 - RNA, 22 nt, Homo sapiens
gugugcauaugucuuuauagua

SEQ ID NO: 105676 - RNA, 22 nt, Homo sapiens
guguucaaagcugauugagauu

SEQ ID NO: 105677 - RNA, 22 nt, Homo sapiens
guuuaacugguacuucaagucu

SEQ ID NO: 105678 - RNA, 22 nt, Homo sapiens
uaacauugucuugcuuaguuuu

SEQ ID NO: 105679 - RNA, 23 nt, Homo sapiens
uaagacacuaacuuuaugcuuug

SEQ ID NO: 105680 - RNA, 22 nt, Homo sapiens
uaaggcacuacuuuaggcuuuc

SEQ ID NO: 105681 - RNA, 20 nt, Homo sapiens
uaagugcuuuauauugauua

SEQ ID NO: 105682 - RNA, 22 nt, Homo sapiens
uaaguguaaugucugaaguuug

SEQ ID NO: 105683 - RNA, 22 nt, Homo sapiens
uaaguucauucaugaaacuuag

SEQ ID NO: 105684 - RNA, 22 nt, Homo sapiens
uaaguuguagaacguuuucuua

SEQ ID NO: 105685 - RNA, 22 nt, Homo sapiens
uaauccuagcacuuuggaagac

SEQ ID NO: 105686 - RNA, 22 nt, Homo sapiens
uacacaugugaguucuuuucua

SEQ ID NO: 105687 - RNA, 22 nt, Homo sapiens
uacagucauaaugccuagugac

SEQ ID NO: 105688 - RNA, 22 nt, Homo sapiens
uacauugcacuuuauuagauac

SEQ ID NO: 105689 - RNA, 22 nt, Homo sapiens
uacguuaucagguaugcaagag

SEQ ID NO: 105690 - RNA, 22 nt, Homo sapiens
uacuacuuucugacaucuuuaa

SEQ ID NO: 105691 - RNA, 22 nt, Homo sapiens
uacugcacauaugaagguuccc

SEQ ID NO: 105692 - RNA, 20 nt, Homo sapiens
uacugcacuccaaccuaggc

SEQ ID NO: 105693 - RNA, 22 nt, Homo sapiens
uacugcacuccaaccugagaga

SEQ ID NO: 105694 - RNA, 22 nt, Homo sapiens
uacugcacuccacccuggguga

SEQ ID NO: 105695 - RNA, 22 nt, Homo sapiens
uacugcacuccagccuggguga

SEQ ID NO: 105696 - RNA, 22 nt, Homo sapiens
uacugcacuccagcuuaggaga

SEQ ID NO: 105697 - RNA, 19 nt, Homo sapiens
uacugcacuccagucuggg

SEQ ID NO: 105698 - RNA, 22 nt, Homo sapiens
uacugcacuugaccuccugggc

SEQ ID NO: 105699 - RNA, 23 nt, Homo sapiens
uacugcauccuccgccucuaggg

SEQ ID NO: 105700 - RNA, 22 nt, Homo sapiens
uacugcaucuacuuagagccag

SEQ ID NO: 105701 - RNA, 22 nt, Homo sapiens
uacugcauucuccgccuccggg

SEQ ID NO: 105702 - RNA, 22 nt, Homo sapiens
uacugcauuucacuguuaaaga

SEQ ID NO: 105703 - RNA, 22 nt, Homo sapiens
uagaaagcaugaccuucagaua

SEQ ID NO: 105704 - RNA, 22 nt, Homo sapiens
uagaagcacuaucccuccuagu

SEQ ID NO: 105705 - RNA, 22 nt, Homo sapiens
uagacugguuuagcacugaaua

SEQ ID NO: 105706 - RNA, 22 nt, Homo sapiens
uagagcaaugacucuggaaacc

SEQ ID NO: 105707 - RNA, 22 nt, Homo sapiens
uagagguauuaacaguagaaga

SEQ ID NO: 105708 - RNA, 17 nt, Homo sapiens
uagcacagugccuggua

SEQ ID NO: 105709 - RNA, 22 nt, Homo sapiens
cacagugaacugguggguuuuu

SEQ ID NO: 105710 - RNA, 22 nt, Homo sapiens
cacauguuuuagcauggcuguu

SEQ ID NO: 105711 - RNA, 22 nt, Homo sapiens
cacauugcaggaaaguucauua

SEQ ID NO: 105712 - RNA, 22 nt, Homo sapiens
cacucaguuugugguacuuugu

SEQ ID NO: 105713 - RNA, 22 nt, Homo sapiens
cacugcacuccagucugacgac

SEQ ID NO: 105714 - RNA, 22 nt, Homo sapiens
cacugcacuccagucuggcgac

SEQ ID NO: 105715 - RNA, 22 nt, Homo sapiens
cacugcauccuccaccugccag

SEQ ID NO: 105716 - RNA, 22 nt, Homo sapiens
cacugcauucuccaccucccag

SEQ ID NO: 105717 - RNA, 22 nt, Homo sapiens
cagguaguauuugguuacauaa

SEQ ID NO: 105718 - RNA, 23 nt, Homo sapiens
cagugguguuagagaaaucuuuu

SEQ ID NO: 105719 - RNA, 22 nt, Homo sapiens
cagugucugcauuuggaacuca

SEQ ID NO: 105720 - RNA, 22 nt, Homo sapiens
cauacaguaggcacuauuugua

SEQ ID NO: 105721 - RNA, 22 nt, Homo sapiens
cauauucacuuuacagagcugu

SEQ ID NO: 105722 - RNA, 22 nt, Homo sapiens
caugacacauguuuaccuaugu

SEQ ID NO: 105723 - RNA, 22 nt, Homo sapiens
caugccauugcucuccugggug

SEQ ID NO: 105724 - RNA, 22 nt, Homo sapiens
cauggagcuaggcuugaucccu

SEQ ID NO: 105725 - RNA, 22 nt, Homo sapiens
ccacagucuaugcaacaagguc

SEQ ID NO: 105726 - RNA, 22 nt, Homo sapiens
ccaggguugagacccacugacu

SEQ ID NO: 105727 - RNA, 22 nt, Homo sapiens
ccaguauugaacacaaugaaag

SEQ ID NO: 105728 - RNA, 23 nt, Homo sapiens
ccaguauuuauguaaggaagugu

SEQ ID NO: 105729 - RNA, 22 nt, Homo sapiens
ccauggcaauggucagucuauu

SEQ ID NO: 105730 - RNA, 22 nt, Homo sapiens
ccauggcuauucuguaaggguu

SEQ ID NO: 105731 - RNA, 22 nt, Homo sapiens
ccauggcuucugcauucuguca

SEQ ID NO: 105732 - RNA, 20 nt, Homo sapiens
ccccuggaguggggcugcuu

SEQ ID NO: 105733 - RNA, 22 nt, Homo sapiens
cccuucauucaaggguugugag

SEQ ID NO: 105734 - RNA, 22 nt, Homo sapiens
ccuaggcacugggguccagccc

SEQ ID NO: 105735 - RNA, 22 nt, Homo sapiens
ccuucauucauuaauuuagccc

SEQ ID NO: 105736 - RNA, 22 nt, Homo sapiens
cuaaggaaggacugaaaggaca

SEQ ID NO: 105737 - RNA, 17 nt, Homo sapiens
cuaaggcaagagucugc

SEQ ID NO: 105738 - RNA, 22 nt, Homo sapiens
cuacagcagcccaguccccgaa

SEQ ID NO: 105739 - RNA, 23 nt, Homo sapiens
cuacagugccugucucuuuggcc

SEQ ID NO: 105740 - RNA, 22 nt, Homo sapiens
cuaucucauugguuuuugaaag

SEQ ID NO: 105741 - RNA, 22 nt, Homo sapiens
cucacaguucuaaaggcaagaa

SEQ ID NO: 105742 - RNA, 22 nt, Homo sapiens
cucauggagaaccucugcuagg

SEQ ID NO: 105743 - RNA, 22 nt, Homo sapiens
cucauggauggucuggcagcca

SEQ ID NO: 105744 - RNA, 22 nt, Homo sapiens
cucucaguugucuaauuaguuu

SEQ ID NO: 105745 - RNA, 21 nt, Homo sapiens
cucucugcuuaugaauaguga

SEQ ID NO: 105746 - RNA, 22 nt, Homo sapiens
cugacagaugacugccacugua

SEQ ID NO: 105747 - RNA, 22 nt, Homo sapiens
cugagagaggagcuaaaacugc

SEQ ID NO: 105748 - RNA, 22 nt, Homo sapiens
cugagcaaaaugaagacacgau

SEQ ID NO: 105749 - RNA, 22 nt, Homo sapiens
cugagcaagucauuuuguuaaa

SEQ ID NO: 105750 - RNA, 22 nt, Homo sapiens
cugagcaauauagugagaucuu

SEQ ID NO: 105751 - RNA, 22 nt, Homo sapiens
cugaggguagaaggaucacuug

SEQ ID NO: 105752 - RNA, 22 nt, Homo sapiens
cugauuuguccccagccucaug

SEQ ID NO: 105753 - RNA, 22 nt, Homo sapiens
cuggaaacaucuuaggaaugca

SEQ ID NO: 105754 - RNA, 22 nt, Homo sapiens
cugugaucuuuuuucauguggu

SEQ ID NO: 105755 - RNA, 22 nt, Homo sapiens
cuguuuguuuaggguacucaga

SEQ ID NO: 105756 - RNA, 22 nt, Homo sapiens
cuuccagcuggguucagucagu

SEQ ID NO: 105757 - RNA, 22 nt, Homo sapiens
cuucuugcuguguccucacaug

SEQ ID NO: 105758 - RNA, 22 nt, Homo sapiens
cuugccuuugucuucaaaggcu

SEQ ID NO: 105759 - RNA, 20 nt, Homo sapiens
cuugcuccccuuguucuaga

SEQ ID NO: 105760 - RNA, 21 nt, Homo sapiens
cuuuaugcuguguuagaaaag

SEQ ID NO: 105761 - RNA, 22 nt, Homo sapiens
cuuugauuauaaaaggguguuu

SEQ ID NO: 105762 - RNA, 22 nt, Homo sapiens
cuuuggcaaugucauuuucaau

SEQ ID NO: 105763 - RNA, 23 nt, Homo sapiens
cuuugguaggaaauuugaauuau

SEQ ID NO: 105764 - RNA, 22 nt, Homo sapiens
cuuuguaugucaugacaacugu

SEQ ID NO: 105765 - RNA, 22 nt, Homo sapiens
cuuuguguaggugccucuggcu

SEQ ID NO: 105766 - RNA, 20 nt, Homo sapiens
cuuuuagcagcagcaagaga

SEQ ID NO: 105767 - RNA, 22 nt, Homo sapiens
cuuuuggucuaucagagaagca

SEQ ID NO: 105768 - RNA, 22 nt, Homo sapiens
gaaugcaugaggggaucagaug

SEQ ID NO: 105769 - RNA, 22 nt, Homo sapiens
gacacuggguguuuguuggcgu

SEQ ID NO: 105770 - RNA, 17 nt, Homo sapiens
gacauaggaaaaggaga

SEQ ID NO: 105771 - RNA, 18 nt, Homo sapiens
gacucaguuucuaaggca

SEQ ID NO: 105772 - RNA, 22 nt, Homo sapiens
gagaaccauuuggagaaaaagu

SEQ ID NO: 105773 - RNA, 22 nt, Homo sapiens
gagagcaugugcuggcaucagu

SEQ ID NO: 105774 - RNA, 22 nt, Homo sapiens
gagaugguacacauacgauucu

SEQ ID NO: 105775 - RNA, 22 nt, Homo sapiens
gagauuaauacacaucaaaugc

SEQ ID NO: 105776 - RNA, 22 nt, Homo sapiens
gaggugauaucucauugugguu

SEQ ID NO: 105777 - RNA, 22 nt, Homo sapiens
gaguauauuugcacuguuaugu

SEQ ID NO: 105778 - RNA, 18 nt, Homo sapiens
gaguggugcuucccuugu

SEQ ID NO: 105779 - RNA, 22 nt, Homo sapiens
gauuccacuuacuuagcauucc

SEQ ID NO: 105780 - RNA, 22 nt, Homo sapiens
uagcagcauuuuuguagaguau

SEQ ID NO: 105781 - RNA, 22 nt, Homo sapiens
uagcaggaaaccuguguugagg

SEQ ID NO: 105782 - RNA, 22 nt, Homo sapiens
uagcauggaggcggccauagug

SEQ ID NO: 105783 - RNA, 22 nt, Homo sapiens
uagcauggagucaugcacggcu

SEQ ID NO: 105784 - RNA, 22 nt, Homo sapiens
uaggcgagauguguguuucaug

SEQ ID NO: 105785 - RNA, 22 nt, Homo sapiens
uaguaacacauugaacgaucgc

SEQ ID NO: 105786 - RNA, 22 nt, Homo sapiens
uaguucguguuugaacuagauc

SEQ ID NO: 105787 - RNA, 22 nt, Homo sapiens
uaguuuaucuucuggauggaca

SEQ ID NO: 105788 - RNA, 22 nt, Homo sapiens
uauacaugugggcaucaggaga

SEQ ID NO: 105789 - RNA, 22 nt, Homo sapiens
uauagcagugugagaacagacu

SEQ ID NO: 105790 - RNA, 22 nt, Homo sapiens
uauagcuuaaaguuuagauccu

SEQ ID NO: 105791 - RNA, 23 nt, Homo sapiens
uauaugugucuaggagcuauggu

SEQ ID NO: 105792 - RNA, 22 nt, Homo sapiens
uaucucaguguacaggaugaua

SEQ ID NO: 105793 - RNA, 22 nt, Homo sapiens
uauggcauuauuuugauagaca

SEQ ID NO: 105794 - RNA, 22 nt, Homo sapiens
uaugucuuuugcuugcaaauag

SEQ ID NO: 105795 - RNA, 22 nt, Homo sapiens
uauuacugucaauaucacagaa

SEQ ID NO: 105796 - RNA, 22 nt, Homo sapiens
uauuacuugucugugucucaau

SEQ ID NO: 105797 - RNA, 22 nt, Homo sapiens
uauucacuguaucauugauggg

SEQ ID NO: 105798 - RNA, 20 nt, Homo sapiens
uauugcacuccagucugggc

SEQ ID NO: 105799 - RNA, 22 nt, Homo sapiens
uauugcagugagauccaucugg

SEQ ID NO: 105800 - RNA, 22 nt, Homo sapiens
ucaaggcacuagcugagcugca

SEQ ID NO: 105801 - RNA, 22 nt, Homo sapiens
ucaauguaucuccaagaauuga

SEQ ID NO: 105802 - RNA, 22 nt, Homo sapiens
ucacagacugagccaaauagag

SEQ ID NO: 105803 - RNA, 22 nt, Homo sapiens
ucacagauaaauaaagaugauu

SEQ ID NO: 105804 - RNA, 18 nt, Homo sapiens
ucacagguaauuaggauu

SEQ ID NO: 105805 - RNA, 22 nt, Homo sapiens
ucacaguccuguuuaggagagg

SEQ ID NO: 105806 - RNA, 21 nt, Homo sapiens
ucacauggccagaguaggaac

SEQ ID NO: 105807 - RNA, 22 nt, Homo sapiens
ucacaugggugcaauauaauca

SEQ ID NO: 105808 - RNA, 22 nt, Homo sapiens
ucacaugugcguuuuggcaugu

SEQ ID NO: 105809 - RNA, 22 nt, Homo sapiens
ucacauguguaaauugguguaa

SEQ ID NO: 105810 - RNA, 22 nt, Homo sapiens
ucaccuggagacaugaagacug

SEQ ID NO: 105811 - RNA, 22 nt, Homo sapiens
ucacugugugucucuguaucug

SEQ ID NO: 105812 - RNA, 22 nt, Homo sapiens
ucaggcacuaguaagaaaaagg

SEQ ID NO: 105813 - RNA, 22 nt, Homo sapiens
ucaggcaugcagcaaugcagug

SEQ ID NO: 105814 - RNA, 22 nt, Homo sapiens
ucagggacuuacaaaccagaag

SEQ ID NO: 105815 - RNA, 22 nt, Homo sapiens
ucaguagcauugcuuauacagu

SEQ ID NO: 105816 - RNA, 21 nt, Homo sapiens
ucauauguaucuuugugccuc

SEQ ID NO: 105817 - RNA, 22 nt, Homo sapiens
ucauauguaugugcaauuuugu

SEQ ID NO: 105818 - RNA, 22 nt, Homo sapiens
ucaucagaaucccuuagggaug

SEQ ID NO: 105819 - RNA, 22 nt, Homo sapiens
ucaugagacacacuggaaagga

SEQ ID NO: 105820 - RNA, 22 nt, Homo sapiens
ucauggggugcuuugcuagauu

SEQ ID NO: 105821 - RNA, 22 nt, Homo sapiens
ucauguaauuuugugucuauga

SEQ ID NO: 105822 - RNA, 22 nt, Homo sapiens
ucauucauucauccagcuugag

SEQ ID NO: 105823 - RNA, 20 nt, Homo sapiens
uccacugagcgucacggcag

SEQ ID NO: 105824 - RNA, 22 nt, Homo sapiens
uccauagugagcagucaaugua

SEQ ID NO: 105825 - RNA, 22 nt, Homo sapiens
uccauaguugcacucuggagcc

SEQ ID NO: 105826 - RNA, 22 nt, Homo sapiens
ucccacugucuucucgugcucg

SEQ ID NO: 105827 - RNA, 22 nt, Homo sapiens
ucccuuucuggaguuucccaag

SEQ ID NO: 105828 - RNA, 22 nt, Homo sapiens
uccugagacucacaggcucccc

SEQ ID NO: 105829 - RNA, 22 nt, Homo sapiens
uccuuuaguuaauaaagacaag

SEQ ID NO: 105830 - RNA, 22 nt, Homo sapiens
ucuaaugcucugagaacagugc

SEQ ID NO: 105831 - RNA, 22 nt, Homo sapiens
ucucagcacaaacaaaauugcu

SEQ ID NO: 105832 - RNA, 22 nt, Homo sapiens
ucucagcacagucagggcgccu

SEQ ID NO: 105833 - RNA, 22 nt, Homo sapiens
ucucuguuuagagccagcaauu

SEQ ID NO: 105834 - RNA, 22 nt, Homo sapiens
ucugacaaugaacaaucuauag

SEQ ID NO: 105835 - RNA, 22 nt, Homo sapiens
ucugccuuuucaugugggaugg

SEQ ID NO: 105836 - RNA, 22 nt, Homo sapiens
ucuggcauuuucucugcuugca

SEQ ID NO: 105837 - RNA, 22 nt, Homo sapiens
ucuggccuccuaugagaaucga

SEQ ID NO: 105838 - RNA, 22 nt, Homo sapiens
ucugguguuauucauguaguuu

SEQ ID NO: 105839 - RNA, 19 nt, Homo sapiens
ucugugcuugucccccugu

SEQ ID NO: 105840 - RNA, 22 nt, Homo sapiens
ucuucagucauauuggccugga

SEQ ID NO: 105841 - RNA, 22 nt, Homo sapiens
ucuugguuaggggaaauaggca

SEQ ID NO: 105842 - RNA, 23 nt, Homo sapiens
ucuugguuauagaaaaauaguug

SEQ ID NO: 105843 - RNA, 22 nt, Homo sapiens
ucuugguugaaaauucauaaua

SEQ ID NO: 105844 - RNA, 22 nt, Homo sapiens
ucuuugguaauggaugucugau

SEQ ID NO: 105845 - RNA, 22 nt, Homo sapiens
ucuuugucuacauccuguuaaa

SEQ ID NO: 105846 - RNA, 22 nt, Homo sapiens
ucuuuugugagucagccucucc

SEQ ID NO: 105847 - RNA, 22 nt, Homo sapiens
ucuuuuguucuauucaggccuu

SEQ ID NO: 105848 - RNA, 20 nt, Homo sapiens
ucuuuuuguggccccagagu

SEQ ID NO: 105849 - RNA, 22 nt, Homo sapiens
ugaaaagucuaagauuaagguu

SEQ ID NO: 105850 - RNA, 22 nt, Homo sapiens
ugaauauuugcuacucacucuu

SEQ ID NO: 105851 - RNA, 21 nt, Homo sapiens
ugaaugcuuuaaauauuagaa

SEQ ID NO: 105852 - RNA, 22 nt, Homo sapiens
ugacagguugauaggugcagca

SEQ ID NO: 105853 - RNA, 17 nt, Homo sapiens
ugacuagugcccuuauu

SEQ ID NO: 105854 - RNA, 22 nt, Homo sapiens
ugacuagugugauguaguaaau

SEQ ID NO: 105855 - RNA, 22 nt, Homo sapiens
ugacuaguuugaggacauuaua

SEQ ID NO: 105856 - RNA, 18 nt, Homo sapiens
ugacuguccagguggacc

SEQ ID NO: 105857 - RNA, 21 nt, Homo sapiens
ugagaacaacaggucaagcag

SEQ ID NO: 105858 - RNA, 22 nt, Homo sapiens
ugagaacaugugauauuuggug

SEQ ID NO: 105859 - RNA, 17 nt, Homo sapiens
ugagaacaugugguauu

SEQ ID NO: 105860 - RNA, 18 nt, Homo sapiens
ugagaacauguguacaca

SEQ ID NO: 105861 - RNA, 22 nt, Homo sapiens
ugagaagcauaccagugucugu

SEQ ID NO: 105862 - RNA, 22 nt, Homo sapiens
ugagaccaacagauuccaguuc

SEQ ID NO: 105863 - RNA, 22 nt, Homo sapiens
ugagacgaagucuugcucuguu

SEQ ID NO: 105864 - RNA, 22 nt, Homo sapiens
ugagacugguaauguguagggc

SEQ ID NO: 105865 - RNA, 22 nt, Homo sapiens
ugagagacaguuucgucggagg

SEQ ID NO: 105866 - RNA, 22 nt, Homo sapiens
ugagaggugauaaagcaagggu

SEQ ID NO: 105867 - RNA, 22 nt, Homo sapiens
ugagaugacgacacaccucagu

SEQ ID NO: 105868 - RNA, 22 nt, Homo sapiens
ugagaugagagaaugcuugccu

SEQ ID NO: 105869 - RNA, 22 nt, Homo sapiens
ugagauggaguuucgcuuuugu

SEQ ID NO: 105870 - RNA, 22 nt, Homo sapiens
ugagauggcuuuauugcugaau

SEQ ID NO: 105871 - RNA, 22 nt, Homo sapiens
auggaauguaaguuauguuugc

SEQ ID NO: 105872 - RNA, 22 nt, Homo sapiens
auggauuuugaacuugagaguu

SEQ ID NO: 105873 - RNA, 22 nt, Homo sapiens
auggcaauaauagcuaccauuu

SEQ ID NO: 105874 - RNA, 22 nt, Homo sapiens
auggcacagaguagaugcucaa

SEQ ID NO: 105875 - RNA, 22 nt, Homo sapiens
auggcaguuucagcuauaguuu

SEQ ID NO: 105876 - RNA, 22 nt, Homo sapiens
auggcccccuguuugugaacau

SEQ ID NO: 105877 - RNA, 22 nt, Homo sapiens
augguuuuacugcaaaauggga

SEQ ID NO: 105878 - RNA, 22 nt, Homo sapiens
auguaacaguauuuggagaugu

SEQ ID NO: 105879 - RNA, 22 nt, Homo sapiens
auguaauguuaaauugcuaauu

SEQ ID NO: 105880 - RNA, 22 nt, Homo sapiens
auguaguagcagaaaauauuuu

SEQ ID NO: 105881 - RNA, 22 nt, Homo sapiens
augucaaggugggugauaguuu

SEQ ID NO: 105882 - RNA, 20 nt, Homo sapiens
augugcaguguggcaaccaa

SEQ ID NO: 105883 - RNA, 20 nt, Homo sapiens
augugcuaauauuaauaugu

SEQ ID NO: 105884 - RNA, 22 nt, Homo sapiens
auguguucaucacagcacaauu

SEQ ID NO: 105885 - RNA, 22 nt, Homo sapiens
auuaauguaauuaguaaaguug

SEQ ID NO: 105886 - RNA, 22 nt, Homo sapiens
auuccacuuccacuaguuucuc

SEQ ID NO: 105887 - RNA, 22 nt, Homo sapiens
auucuauaguccuaggauuggg

SEQ ID NO: 105888 - RNA, 22 nt, Homo sapiens
auugcacuccagccuggcaaua

SEQ ID NO: 105889 - RNA, 22 nt, Homo sapiens
auugcacuccagccugggcaac

SEQ ID NO: 105890 - RNA, 22 nt, Homo sapiens
auugcacuccagccugggcagc

SEQ ID NO: 105891 - RNA, 22 nt, Homo sapiens
auugcacuggggguuagaauuu

SEQ ID NO: 105892 - RNA, 22 nt, Homo sapiens
auugcuuuuacugggagcuuug

SEQ ID NO: 105893 - RNA, 22 nt, Homo sapiens
auuggcauauccacgacaaugc

SEQ ID NO: 105894 - RNA, 22 nt, Homo sapiens
auuuggcaauuuugaagaugcc

SEQ ID NO: 105895 - RNA, 22 nt, Homo sapiens
auuugguagaguucgauaccug

SEQ ID NO: 105896 - RNA, 22 nt, Homo sapiens
caaccaguagcugaguucaaaa

SEQ ID NO: 105897 - RNA, 22 nt, Homo sapiens
caacucuguaggauccaggugg

SEQ ID NO: 105898 - RNA, 22 nt, Homo sapiens
caauggcacgaucucgucucac

SEQ ID NO: 105899 - RNA, 21 nt, Homo sapiens
caauggcacgaucuuggcuca

SEQ ID NO: 105900 - RNA, 22 nt, Homo sapiens
cacacugucuuucagaaugguu

SEQ ID NO: 105901 - RNA, 22 nt, Homo sapiens
cacaggaagaggcacggucccu

SEQ ID NO: 105902 - RNA, 22 nt, Homo sapiens
cacugcacuccagcuugugggc

SEQ ID NO: 105903 - RNA, 22 nt, Homo sapiens
cacugcacuccaguuucgguaa

SEQ ID NO: 105904 - RNA, 22 nt, Homo sapiens
cacugcacuccaguuuggauga

SEQ ID NO: 105905 - RNA, 21 nt, Homo sapiens
cacugcacuugccuucugggu

SEQ ID NO: 105906 - RNA, 22 nt, Homo sapiens
cacugcauggucuagcuggguu

SEQ ID NO: 105907 - RNA, 22 nt, Homo sapiens
cacugcauuacucaugagcaug

SEQ ID NO: 105908 - RNA, 22 nt, Homo sapiens
cacugcauuggaugguuccucc

SEQ ID NO: 105909 - RNA, 22 nt, Homo sapiens
cacugggccaucacuuaauauu

SEQ ID NO: 105910 - RNA, 17 nt, Homo sapiens
cacugggugcaagagga

SEQ ID NO: 105911 - RNA, 21 nt, Homo sapiens
cacugguguugcuauaucaaa

SEQ ID NO: 105912 - RNA, 22 nt, Homo sapiens
cagagguauugcaaaagccuag

SEQ ID NO: 105913 - RNA, 22 nt, Homo sapiens
cagcuguguuauaaacuaccau

SEQ ID NO: 105914 - RNA, 23 nt, Homo sapiens
cagcuucauugaacauaacuccu

SEQ ID NO: 105915 - RNA, 19 nt, Homo sapiens
cagguagugugcugacaug

SEQ ID NO: 105916 - RNA, 18 nt, Homo sapiens
cagugcaauacaggagag

SEQ ID NO: 105917 - RNA, 22 nt, Homo sapiens
cauagcacugagcucuacccuc

SEQ ID NO: 105918 - RNA, 21 nt, Homo sapiens
caucacauuacucaaaguccu

SEQ ID NO: 105919 - RNA, 22 nt, Homo sapiens
caucccauucgaggggcacagc

SEQ ID NO: 105920 - RNA, 22 nt, Homo sapiens
caugaaagugagaaacuccugg

SEQ ID NO: 105921 - RNA, 22 nt, Homo sapiens
cauggcccuggguccauaggaa

SEQ ID NO: 105922 - RNA, 22 nt, Homo sapiens
cauuacacuccagccuggguga

SEQ ID NO: 105923 - RNA, 22 nt, Homo sapiens
cauuacacuuguaagguuuuuc

SEQ ID NO: 105924 - RNA, 22 nt, Homo sapiens
cauugcauuccagucugggcaa

SEQ ID NO: 105925 - RNA, 22 nt, Homo sapiens
ccaaguguuuucauuguuccau

SEQ ID NO: 105926 - RNA, 22 nt, Homo sapiens
ccaguauuuuauugaggguuuu

SEQ ID NO: 105927 - RNA, 21 nt, Homo sapiens
ccauggcaaugguaaacugac

SEQ ID NO: 105928 - RNA, 19 nt, Homo sapiens
ccccuguggauaccgaggg

SEQ ID NO: 105929 - RNA, 22 nt, Homo sapiens
ccuggguuacaggugugagcca

SEQ ID NO: 105930 - RNA, 23 nt, Homo sapiens
cuaaagucugucacugaggacuu

SEQ ID NO: 105931 - RNA, 22 nt, Homo sapiens
cuaauacguaguauauccauga

SEQ ID NO: 105932 - RNA, 22 nt, Homo sapiens
cuaaugcagucaggagaaggaa

SEQ ID NO: 105933 - RNA, 22 nt, Homo sapiens
cuacauuguagguauucaaacu

SEQ ID NO: 105934 - RNA, 22 nt, Homo sapiens
cuagaauguauaaaaccaagcu

SEQ ID NO: 105935 - RNA, 22 nt, Homo sapiens
cuauggcuguaaggauaguaac

SEQ ID NO: 105936 - RNA, 22 nt, Homo sapiens
cuauucacaggcaauauguaca

SEQ ID NO: 105937 - RNA, 22 nt, Homo sapiens
cucacagucucucccuaauuuu

SEQ ID NO: 105938 - RNA, 17 nt, Homo sapiens
cucacugagaacagcua

SEQ ID NO: 105939 - RNA, 22 nt, Homo sapiens
cucagcaguggauuuaccacca

SEQ ID NO: 105940 - RNA, 22 nt, Homo sapiens
cucagucuaugauacuuugcua

SEQ ID NO: 105941 - RNA, 22 nt, Homo sapiens
cucauggaauacuucacagcca

SEQ ID NO: 105942 - RNA, 22 nt, Homo sapiens
cucauggagaacaucugcuagg

SEQ ID NO: 105943 - RNA, 19 nt, Homo sapiens
cucauggagaaggagaaua

SEQ ID NO: 105944 - RNA, 22 nt, Homo sapiens
cuccauuuaucugaaauuuuau

SEQ ID NO: 105945 - RNA, 22 nt, Homo sapiens
cuccuaaccagggcuguuaguc

SEQ ID NO: 105946 - RNA, 22 nt, Homo sapiens
cuccuggugauuggagugugaa

SEQ ID NO: 105947 - RNA, 22 nt, Homo sapiens
cucuuugcuucuggcaucauug

SEQ ID NO: 105948 - RNA, 22 nt, Homo sapiens
cugacauuguugaucacagcca

SEQ ID NO: 105949 - RNA, 22 nt, Homo sapiens
cugacuaguuuuaaugcagauu

SEQ ID NO: 105950 - RNA, 22 nt, Homo sapiens
cugagauggagucucgcauugu

SEQ ID NO: 105951 - RNA, 22 nt, Homo sapiens
cugaggcacggcgaccuuaagu

SEQ ID NO: 105952 - RNA, 21 nt, Homo sapiens
cugcauccauuucugagugau

SEQ ID NO: 105953 - RNA, 22 nt, Homo sapiens
cuggucaagagcaaaggccagg

SEQ ID NO: 105954 - RNA, 23 nt, Homo sapiens
cuguacacauauacaucuaagua

SEQ ID NO: 105955 - RNA, 22 nt, Homo sapiens
cugugcaugcgcggagcugaaa

SEQ ID NO: 105956 - RNA, 23 nt, Homo sapiens
cuguggugaggcccuagaaucug

SEQ ID NO: 105957 - RNA, 22 nt, Homo sapiens
cuguucaaauuguuugugaagu

SEQ ID NO: 105958 - RNA, 22 nt, Homo sapiens
cuuaaguaguuguggaaugaau

SEQ ID NO: 105959 - RNA, 22 nt, Homo sapiens
cuugcauagaguuauugcccuu

SEQ ID NO: 105960 - RNA, 22 nt, Homo sapiens
cuuugcacaucucugcuuuccc

SEQ ID NO: 105961 - RNA, 22 nt, Homo sapiens
cuuugggaccgcgguuuauacu

SEQ ID NO: 105962 - RNA, 20 nt, Homo sapiens
cuuuguccuccugcugugcu

SEQ ID NO: 105963 - RNA, 22 nt, Homo sapiens
cuuuuggugguucugaugcagg

SEQ ID NO: 105964 - RNA, 22 nt, Homo sapiens
cuuuuggugugaagaagcucuu

SEQ ID NO: 105965 - RNA, 22 nt, Homo sapiens
aaacucuguagcagagacagau

SEQ ID NO: 105966 - RNA, 22 nt, Homo sapiens
aaacugaucugaaggccaggcu

SEQ ID NO: 105967 - RNA, 22 nt, Homo sapiens
aaagaguucagguagauuucaa

SEQ ID NO: 105968 - RNA, 22 nt, Homo sapiens
aaagcagcaggugguuuucaau

SEQ ID NO: 105969 - RNA, 19 nt, Homo sapiens
aaagguaguaaccucugau

SEQ ID NO: 105970 - RNA, 22 nt, Homo sapiens
aaauucaucaaaugguuuguau

SEQ ID NO: 105971 - RNA, 22 nt, Homo sapiens
aaauuguccuacugguuugagu

SEQ ID NO: 105972 - RNA, 22 nt, Homo sapiens
aaauuguccuauugguuuaagc

SEQ ID NO: 105973 - RNA, 22 nt, Homo sapiens
aacaccuugcgugggcgucaau

SEQ ID NO: 105974 - RNA, 22 nt, Homo sapiens
aacagcacacccgcugcuucca

SEQ ID NO: 105975 - RNA, 22 nt, Homo sapiens
aacagugcuguuauaaauguac

SEQ ID NO: 105976 - RNA, 22 nt, Homo sapiens
aacugcauuuucugauugugug

SEQ ID NO: 105977 - RNA, 22 nt, Homo sapiens
aacuggccuggcgugcagaggg

SEQ ID NO: 105978 - RNA, 19 nt, Homo sapiens
aacuggugugagaugguau

SEQ ID NO: 105979 - RNA, 22 nt, Homo sapiens
aagacuguaauccaucuugagu

SEQ ID NO: 105980 - RNA, 18 nt, Homo sapiens
aagagcucagcacagguu

SEQ ID NO: 105981 - RNA, 22 nt, Homo sapiens
aagagcucucuguagcauguga

SEQ ID NO: 105982 - RNA, 21 nt, Homo sapiens
aagcacauugaguguguguga

SEQ ID NO: 105983 - RNA, 22 nt, Homo sapiens
aagcaugguuuccaggggucac

SEQ ID NO: 105984 - RNA, 23 nt, Homo sapiens
aaggacacugaacacuucccagc

SEQ ID NO: 105985 - RNA, 22 nt, Homo sapiens
aaggagcuuaagugacuuguac

SEQ ID NO: 105986 - RNA, 22 nt, Homo sapiens
aaggaguagaauagaugcaccu

SEQ ID NO: 105987 - RNA, 22 nt, Homo sapiens
aaggcaagguggauaaugaagc

SEQ ID NO: 105988 - RNA, 22 nt, Homo sapiens
aagguaguuuucuuuaaugcug

SEQ ID NO: 105989 - RNA, 22 nt, Homo sapiens
aaguauuagugaggauauggaa

SEQ ID NO: 105990 - RNA, 23 nt, Homo sapiens
aagugagcuccaauugggugaga

SEQ ID NO: 105991 - RNA, 22 nt, Homo sapiens
aauauagcuauguacaugucca

SEQ ID NO: 105992 - RNA, 22 nt, Homo sapiens
aauaugguuuuaugaagcaauu

SEQ ID NO: 105993 - RNA, 22 nt, Homo sapiens
aaugacccugauuggcaaguug

SEQ ID NO: 105994 - RNA, 22 nt, Homo sapiens
aaugccacugugccugccaagg

SEQ ID NO: 105995 - RNA, 22 nt, Homo sapiens
aauucacuucuuuuaggcaggg

SEQ ID NO: 105996 - RNA, 22 nt, Homo sapiens
aauugaaugauaugggacauuu

SEQ ID NO: 105997 - RNA, 23 nt, Homo sapiens
aauugcuuuugaggacuuaguug

SEQ ID NO: 105998 - RNA, 22 nt, Homo sapiens
acaagcacaaaugcauagaugg

SEQ ID NO: 105999 - RNA, 22 nt, Homo sapiens
acaauguauauuuuacuguagg

SEQ ID NO: 106000 - RNA, 22 nt, Homo sapiens
acacauacacauaugguguaua

SEQ ID NO: 106001 - RNA, 22 nt, Homo sapiens
acagcacugccaagugacccau

SEQ ID NO: 106002 - RNA, 22 nt, Homo sapiens
acaucccuuucccacccuucac

SEQ ID NO: 106003 - RNA, 22 nt, Homo sapiens
acauggcacugcgggcuucuug

SEQ ID NO: 106004 - RNA, 22 nt, Homo sapiens
acauggcuuaugaauuuggaga

SEQ ID NO: 106005 - RNA, 22 nt, Homo sapiens
caaagugcugaaagaggccagg

SEQ ID NO: 106006 - RNA, 19 nt, Homo sapiens
caaaguguucuucuuugcc

SEQ ID NO: 106007 - RNA, 22 nt, Homo sapiens
cacagcuagucaaugguagaca

SEQ ID NO: 106008 - RNA, 22 nt, Homo sapiens
cacagucugggcuuguuuguac

SEQ ID NO: 106009 - RNA, 22 nt, Homo sapiens
cacugcacuccagccuaagagg

SEQ ID NO: 106010 - RNA, 22 nt, Homo sapiens
cacugcacuccagcuuugguga

SEQ ID NO: 106011 - RNA, 22 nt, Homo sapiens
cacugcacucuucuucugggca

SEQ ID NO: 106012 - RNA, 21 nt, Homo sapiens
cacugcaucacaggacagcau

SEQ ID NO: 106013 - RNA, 22 nt, Homo sapiens
cacugcauccuccaccuccugg

SEQ ID NO: 106014 - RNA, 22 nt, Homo sapiens
cacugcauccuccauauccugg

SEQ ID NO: 106015 - RNA, 22 nt, Homo sapiens
cacugcauccucugccuggcgg

SEQ ID NO: 106016 - RNA, 22 nt, Homo sapiens
cacugcauggccacccauguua

SEQ ID NO: 106017 - RNA, 22 nt, Homo sapiens
cacuggacauguugaagcuuuu

SEQ ID NO: 106018 - RNA, 21 nt, Homo sapiens
cacuggguucaggcuugugga

SEQ ID NO: 106019 - RNA, 22 nt, Homo sapiens
cagcaaaucauccuauuugagc

SEQ ID NO: 106020 - RNA, 20 nt, Homo sapiens
cagcacgcacaugagacugu

SEQ ID NO: 106021 - RNA, 22 nt, Homo sapiens
cagcuggugcugcaccaguggg

SEQ ID NO: 106022 - RNA, 22 nt, Homo sapiens
cagugcaaccuccaucucucgg

SEQ ID NO: 106023 - RNA, 22 nt, Homo sapiens
cauagcacugcacuucagccug

SEQ ID NO: 106024 - RNA, 22 nt, Homo sapiens
cauggcacugagcagguaugca

SEQ ID NO: 106025 - RNA, 22 nt, Homo sapiens
cauggcuuuauuuucagcuucu

SEQ ID NO: 106026 - RNA, 22 nt, Homo sapiens
caugggacugucuuggcuauac

SEQ ID NO: 106027 - RNA, 22 nt, Homo sapiens
cauugcaguuuuugguguaucu

SEQ ID NO: 106028 - RNA, 22 nt, Homo sapiens
ccaaggcacugauucuguacuc

SEQ ID NO: 106029 - RNA, 22 nt, Homo sapiens
ccaggguuccacgccuggcugu

SEQ ID NO: 106030 - RNA, 18 nt, Homo sapiens
ccagugcaaggaaagccc

SEQ ID NO: 106031 - RNA, 22 nt, Homo sapiens
ccagugcauggaucccaggggg

SEQ ID NO: 106032 - RNA, 22 nt, Homo sapiens
ccaguuuuucauuuauacuagu

SEQ ID NO: 106033 - RNA, 22 nt, Homo sapiens
ccaucacacugugauuauuauc

SEQ ID NO: 106034 - RNA, 22 nt, Homo sapiens
cccugaagaaagccuaggacau

SEQ ID NO: 106035 - RNA, 22 nt, Homo sapiens
cccuggacacacacuuuuauuc

SEQ ID NO: 106036 - RNA, 22 nt, Homo sapiens
ccucccuuuguugcaagggaaa

SEQ ID NO: 106037 - RNA, 22 nt, Homo sapiens
ccugucuugauuaaauuacuua

SEQ ID NO: 106038 - RNA, 22 nt, Homo sapiens
ccuucauugcaucuuuaagaga

SEQ ID NO: 106039 - RNA, 22 nt, Homo sapiens
ccuuuuuguaguggaaguagga

SEQ ID NO: 106040 - RNA, 16 nt, Homo sapiens
cuaaaaugucuacuug

SEQ ID NO: 106041 - RNA, 22 nt, Homo sapiens
cuaaaguauugagugguaaaga

SEQ ID NO: 106042 - RNA, 22 nt, Homo sapiens
cuaagauugucuuaguguguug

SEQ ID NO: 106043 - RNA, 22 nt, Homo sapiens
cuacaguagagaggauguagaa

SEQ ID NO: 106044 - RNA, 22 nt, Homo sapiens
cuagaagcauauucagaacaga

SEQ ID NO: 106045 - RNA, 22 nt, Homo sapiens
cuaggaaguauguguuauugcu

SEQ ID NO: 106046 - RNA, 22 nt, Homo sapiens
cuaugcuucuuaaauuaguuau

SEQ ID NO: 106047 - RNA, 20 nt, Homo sapiens
cucagguauuugaggcugca

SEQ ID NO: 106048 - RNA, 22 nt, Homo sapiens
cucaguggauuagauaaugcac

SEQ ID NO: 106049 - RNA, 22 nt, Homo sapiens
cuccauagucuucgaagaauga

SEQ ID NO: 106050 - RNA, 22 nt, Homo sapiens
cuccauuuaguccuuuuagaag

SEQ ID NO: 106051 - RNA, 22 nt, Homo sapiens
cucccuuugcugaauguuuuuc

SEQ ID NO: 106052 - RNA, 22 nt, Homo sapiens
cugagaagaaacagguaaggac

SEQ ID NO: 106053 - RNA, 22 nt, Homo sapiens
cugcauuugaugacguauggug

SEQ ID NO: 106054 - RNA, 22 nt, Homo sapiens
cugccacugacaccucaaggac

SEQ ID NO: 106055 - RNA, 22 nt, Homo sapiens
cuggaaagcaaagggugcauug

SEQ ID NO: 106056 - RNA, 22 nt, Homo sapiens
cuggaaucuagaaaagguaagg

SEQ ID NO: 106057 - RNA, 22 nt, Homo sapiens
cugucuguuucaaaagugguua

SEQ ID NO: 106058 - RNA, 22 nt, Homo sapiens
cugugcauucuuaaaucaggaa

SEQ ID NO: 106059 - RNA, 22 nt, Homo sapiens
cuucaaguguggccaccugacc

SEQ ID NO: 106060 - RNA, 18 nt, Homo sapiens
cuucauugcuguuuugcu

SEQ ID NO: 106061 - RNA, 22 nt, Homo sapiens
cuuccaaguggggcacgugcca

SEQ ID NO: 106062 - RNA, 22 nt, Homo sapiens
cuugacacugguuuucugaaua

SEQ ID NO: 106063 - RNA, 22 nt, Homo sapiens
cuugagcauauucuauauuaaa

SEQ ID NO: 106064 - RNA, 22 nt, Homo sapiens
cuuguguuacauauuuaagaga

SEQ ID NO: 106065 - RNA, 22 nt, Homo sapiens
cuuuacacauccuaaccagugu

SEQ ID NO: 106066 - RNA, 22 nt, Homo sapiens
cuuucugaggagaauagagaac

SEQ ID NO: 106067 - RNA, 21 nt, Homo sapiens
cuuugguagaguuuuuagggu

SEQ ID NO: 106068 - RNA, 19 nt, Homo sapiens
cuuugguugagcguguugg

SEQ ID NO: 106069 - RNA, 22 nt, Homo sapiens
cuuuuacacuguuagugggaau

SEQ ID NO: 106070 - RNA, 22 nt, Homo sapiens
cuuuugugauucuucaguugcu

SEQ ID NO: 106071 - RNA, 22 nt, Homo sapiens
gaaagguaggaacagggugcag

SEQ ID NO: 106072 - RNA, 22 nt, Homo sapiens
gaagaaguacaagacaaauuuu

SEQ ID NO: 106073 - RNA, 22 nt, Homo sapiens
gaagguaguuuauagauguggu

SEQ ID NO: 106074 - RNA, 22 nt, Homo sapiens
gacacugucuucugcucuuaaa

SEQ ID NO: 106075 - RNA, 22 nt, Homo sapiens
gacuaguuaggucucucacaga

SEQ ID NO: 106076 - RNA, 22 nt, Homo sapiens
gacucagucuuggauuuuuaau

SEQ ID NO: 106077 - RNA, 22 nt, Homo sapiens
gacugaggaagcgcucucuccu

SEQ ID NO: 106078 - RNA, 22 nt, Homo sapiens
gacuucaucauacuaugugugg

SEQ ID NO: 106079 - RNA, 22 nt, Homo sapiens
gagauaggauucacuuucaugu

SEQ ID NO: 106080 - RNA, 22 nt, Homo sapiens
gagauucuucaauauuuauucu

SEQ ID NO: 106081 - RNA, 22 nt, Homo sapiens
gagcaaaaguauguauugguua

SEQ ID NO: 106082 - RNA, 22 nt, Homo sapiens
gagcacugaauacugugguggu

SEQ ID NO: 106083 - RNA, 22 nt, Homo sapiens
gaggcuagauggggaugugucc

SEQ ID NO: 106084 - RNA, 22 nt, Homo sapiens
gagguaagaguuuuccauuucu

SEQ ID NO: 106085 - RNA, 22 nt, Homo sapiens
gagguaugauugacauauaaaa

SEQ ID NO: 106086 - RNA, 22 nt, Homo sapiens
gaggugguagguucacagcagc

SEQ ID NO: 106087 - RNA, 22 nt, Homo sapiens
gaguaaaugucacuguugcugu

SEQ ID NO: 106088 - RNA, 22 nt, Homo sapiens
gaguaacagcauaaauuuguga

SEQ ID NO: 106089 - RNA, 23 nt, Homo sapiens
gaguacauuaaaagcccagacug

SEQ ID NO: 106090 - RNA, 22 nt, Homo sapiens
gagugcuguuagcccuggguuu

SEQ ID NO: 106091 - RNA, 23 nt, Homo sapiens
gaguggagacucauugauuuccu

SEQ ID NO: 106092 - RNA, 22 nt, Homo sapiens
gauaugugauaagaguuaucuu

SEQ ID NO: 106093 - RNA, 22 nt, Homo sapiens
gauauguguaucuauguacaug

SEQ ID NO: 106094 - RNA, 22 nt, Homo sapiens
gauuagaacagaagucagauua

SEQ ID NO: 106095 - RNA, 22 nt, Homo sapiens
gauuuguuggccugugagcuag

SEQ ID NO: 106096 - RNA, 22 nt, Homo sapiens
gauuuuuggggaagccucuuau

SEQ ID NO: 106097 - RNA, 22 nt, Homo sapiens
gcagguaguuucugacuuuuac

SEQ ID NO: 106098 - RNA, 20 nt, Homo sapiens
gcaguacuuuuaguucuaag

SEQ ID NO: 106099 - RNA, 22 nt, Homo sapiens
gcauggagcauacauuucuguu

SEQ ID NO: 106100 - RNA, 22 nt, Homo sapiens
gccaagauugguuuaauauucc

SEQ ID NO: 106101 - RNA, 22 nt, Homo sapiens
gccaagauuuaauucaucaguu

SEQ ID NO: 106102 - RNA, 22 nt, Homo sapiens
gccauugcacuccagccugagc

SEQ ID NO: 106103 - RNA, 20 nt, Homo sapiens
gcugugcuuaauacacuuuc

SEQ ID NO: 106104 - RNA, 19 nt, Homo sapiens
gcuucuugaggacgaugac

SEQ ID NO: 106105 - RNA, 22 nt, Homo sapiens
gcuuuguugauggugagucugu

SEQ ID NO: 106106 - RNA, 22 nt, Homo sapiens
ggaaagauguaauauuaucuaa

SEQ ID NO: 106107 - RNA, 22 nt, Homo sapiens
ggaagguaauuggguaaugaga

SEQ ID NO: 106108 - RNA, 22 nt, Homo sapiens
ggaauauaaaaagccccagaau

SEQ ID NO: 106109 - RNA, 19 nt, Homo sapiens
ggaaugcuauucaaccuuu

SEQ ID NO: 106110 - RNA, 22 nt, Homo sapiens
ggacugucagggcuauuaguca

SEQ ID NO: 106111 - RNA, 20 nt, Homo sapiens
ggagguuguauaaguacauc

SEQ ID NO: 106112 - RNA, 22 nt, Homo sapiens
ggaguaaaagaguaggaggaau

SEQ ID NO: 106113 - RNA, 22 nt, Homo sapiens
ggaguaggaaggaaauguuaaa

SEQ ID NO: 106114 - RNA, 23 nt, Homo sapiens
ggauucaucuguuuguucgcugu

SEQ ID NO: 106115 - RNA, 22 nt, Homo sapiens
ggcaaaugaagauggagaggcu

SEQ ID NO: 106116 - RNA, 22 nt, Homo sapiens
ggcaaguauguuuuaggaugcu

SEQ ID NO: 106117 - RNA, 19 nt, Homo sapiens
ggcaccuuuuccaaaaaug

SEQ ID NO: 106118 - RNA, 22 nt, Homo sapiens
ggccagaugcgguggcucacac

SEQ ID NO: 106119 - RNA, 22 nt, Homo sapiens
ggcuagagaauagugccacuaa

SEQ ID NO: 106120 - RNA, 22 nt, Homo sapiens
ggcuagaugcuagagauaucau

SEQ ID NO: 106121 - RNA, 19 nt, Homo sapiens
ggcucagucaacugacugu

SEQ ID NO: 106122 - RNA, 22 nt, Homo sapiens
gggaagugugguuucuuuacag

SEQ ID NO: 106123 - RNA, 22 nt, Homo sapiens
gggaugaagaagaauaguucgu

SEQ ID NO: 106124 - RNA, 20 nt, Homo sapiens
gggaugugagguacacucuu

SEQ ID NO: 106125 - RNA, 22 nt, Homo sapiens
gggggagugugguacccagcau

SEQ ID NO: 106126 - RNA, 22 nt, Homo sapiens
ggucaggagaaugguaacugag

SEQ ID NO: 106127 - RNA, 22 nt, Homo sapiens
ggugaggaaaguugaguuucua

SEQ ID NO: 106128 - RNA, 22 nt, Homo sapiens
ggugagguaguaagguacaaua

SEQ ID NO: 106129 - RNA, 19 nt, Homo sapiens
ggugcuugaauauuccucc

SEQ ID NO: 106130 - RNA, 22 nt, Homo sapiens
guaagauaguauguuuaaccca

SEQ ID NO: 106131 - RNA, 22 nt, Homo sapiens
guaaugcacucccaaagaucca

SEQ ID NO: 106132 - RNA, 22 nt, Homo sapiens
guacauggaaugaaauucaaaa

SEQ ID NO: 106133 - RNA, 22 nt, Homo sapiens
guagaagcacaggugaguuggu

SEQ ID NO: 106134 - RNA, 22 nt, Homo sapiens
guaugcacauauguguauguau

SEQ ID NO: 106135 - RNA, 22 nt, Homo sapiens
guauggcaugcaugagaauuuc

SEQ ID NO: 106136 - RNA, 21 nt, Homo sapiens
guauggcauugauuaguuacu

SEQ ID NO: 106137 - RNA, 22 nt, Homo sapiens
gucucuugguuuagagcauuua

SEQ ID NO: 106138 - RNA, 22 nt, Homo sapiens
gugaacaagcaaaggcaggagg

SEQ ID NO: 106139 - RNA, 22 nt, Homo sapiens
gugagaagaaaaauauggcugu

SEQ ID NO: 106140 - RNA, 22 nt, Homo sapiens
gugagaugauggguauguuaau

SEQ ID NO: 106141 - RNA, 22 nt, Homo sapiens
gugagauggaguuggugucuuu

SEQ ID NO: 106142 - RNA, 22 nt, Homo sapiens
gugagauuaccauuuaaaucag

SEQ ID NO: 106143 - RNA, 22 nt, Homo sapiens
gugaggucagggcuguggacag

SEQ ID NO: 106144 - RNA, 22 nt, Homo sapiens
gugcaagagugacugcaguuuu

SEQ ID NO: 106145 - RNA, 22 nt, Homo sapiens
gugcaagagugauugcaguuuu

SEQ ID NO: 106146 - RNA, 21 nt, Homo sapiens
guggaaauggaauuuacuaau

SEQ ID NO: 106147 - RNA, 22 nt, Homo sapiens
guggaagaccagacuuuccaac

SEQ ID NO: 106148 - RNA, 22 nt, Homo sapiens
guggaauauaaagcaucgugua

SEQ ID NO: 106149 - RNA, 22 nt, Homo sapiens
guggaauggaaugauuguguau

SEQ ID NO: 106150 - RNA, 22 nt, Homo sapiens
guggcacgaugaucugggcuca

SEQ ID NO: 106151 - RNA, 22 nt, Homo sapiens
guggcaugaaagcagauaccac

SEQ ID NO: 106152 - RNA, 22 nt, Homo sapiens
guggcuuuauuuagaagcaggg

SEQ ID NO: 106153 - RNA, 22 nt, Homo sapiens
gugggcucguucguguuagaca

SEQ ID NO: 106154 - RNA, 22 nt, Homo sapiens
guguagagaaaaguaccauuuu

SEQ ID NO: 106155 - RNA, 22 nt, Homo sapiens
guguauguuguccauggaugcg

SEQ ID NO: 106156 - RNA, 22 nt, Homo sapiens
guguccucgaguacacaucagg

SEQ ID NO: 106157 - RNA, 22 nt, Homo sapiens
gugugcaugucuuuuuaguagg

SEQ ID NO: 106158 - RNA, 20 nt, Homo sapiens
gugugcauuucagauuuugg

SEQ ID NO: 106159 - RNA, 21 nt, Homo sapiens
uaaaacuguaacuuuguccug

SEQ ID NO: 106160 - RNA, 22 nt, Homo sapiens
uaaacugcuugaggguaaguac

SEQ ID NO: 106161 - RNA, 22 nt, Homo sapiens
uaaagccauugucaaguuugua

SEQ ID NO: 106162 - RNA, 22 nt, Homo sapiens
uaacaagagagucagucagucc

SEQ ID NO: 106163 - RNA, 22 nt, Homo sapiens
uaagacacauguguucccaggc

SEQ ID NO: 106164 - RNA, 22 nt, Homo sapiens
uaagcuauagugaauaaauugc

SEQ ID NO: 106165 - RNA, 22 nt, Homo sapiens
uaaggcacauaggccuggaaac

SEQ ID NO: 106166 - RNA, 22 nt, Homo sapiens
uaaggcacccuucugaguagag

SEQ ID NO: 106167 - RNA, 22 nt, Homo sapiens
uaaguaaaugaaagguugauuu

SEQ ID NO: 106168 - RNA, 22 nt, Homo sapiens
uaagugcuugacuuugauguuu

SEQ ID NO: 106169 - RNA, 22 nt, Homo sapiens
uaaugcaucagugguaguucuu

SEQ ID NO: 106170 - RNA, 22 nt, Homo sapiens
uaaugcaucaugguuggcaaac

SEQ ID NO: 106171 - RNA, 22 nt, Homo sapiens
uacaaaguaacaguuccuguau

SEQ ID NO: 106172 - RNA, 22 nt, Homo sapiens
uacaguguuuugguauuccaca

SEQ ID NO: 106173 - RNA, 22 nt, Homo sapiens
uacugcacuccagccugccaac

SEQ ID NO: 106174 - RNA, 22 nt, Homo sapiens
uacugcacuccaggcucaccug

SEQ ID NO: 106175 - RNA, 22 nt, Homo sapiens
uacugcacucuagccuggguga

SEQ ID NO: 106176 - RNA, 18 nt, Homo sapiens
uacugcacucuccagccu

SEQ ID NO: 106177 - RNA, 22 nt, Homo sapiens
uacuguacugcaguucugcaaa

SEQ ID NO: 106178 - RNA, 22 nt, Homo sapiens
uacuuuguuauagcagcaggaa

SEQ ID NO: 106179 - RNA, 22 nt, Homo sapiens
uagauucauuuuagcaaaaguu

SEQ ID NO: 106180 - RNA, 22 nt, Homo sapiens
uagcagcaaagcaggaucugcu

SEQ ID NO: 106181 - RNA, 22 nt, Homo sapiens
uagcagcaucucuggcuucuac

SEQ ID NO: 106182 - RNA, 22 nt, Homo sapiens
uagcagcuuuauugagguaaau

SEQ ID NO: 106183 - RNA, 22 nt, Homo sapiens
uagcccagugagguugauuugg

SEQ ID NO: 106184 - RNA, 22 nt, Homo sapiens
uagcuggaauuacuugcaccug

SEQ ID NO: 106185 - RNA, 22 nt, Homo sapiens
uagcuggaguuuuuguuauagg

SEQ ID NO: 106186 - RNA, 23 nt, Homo sapiens
uagguuauuugguaaauauaugu

SEQ ID NO: 106187 - RNA, 22 nt, Homo sapiens
uaguaucacauggucuuaauua

SEQ ID NO: 106188 - RNA, 22 nt, Homo sapiens
uagugcuguaauucuaaugaaa

SEQ ID NO: 106189 - RNA, 22 nt, Homo sapiens
uagugguaguagcaguaauauu

SEQ ID NO: 106190 - RNA, 21 nt, Homo sapiens
uauagcagcacgauuuauaau

SEQ ID NO: 106191 - RNA, 21 nt, Homo sapiens
uaucacauuggugauuaaguu

SEQ ID NO: 106192 - RNA, 22 nt, Homo sapiens
uaucacugucaggcccucauau

SEQ ID NO: 106193 - RNA, 22 nt, Homo sapiens
uaucagcacaguggguucaugg

SEQ ID NO: 106194 - RNA, 22 nt, Homo sapiens
uaugagagcugguagguagaga

SEQ ID NO: 106195 - RNA, 22 nt, Homo sapiens
uaugaggaguauaacccgguga

SEQ ID NO: 106196 - RNA, 22 nt, Homo sapiens
uauuacauccauaggcucugcu

SEQ ID NO: 106197 - RNA, 22 nt, Homo sapiens
uauuagugucuuuugguuagaa

SEQ ID NO: 106198 - RNA, 22 nt, Homo sapiens
uauucacaggugugggacaaag

SEQ ID NO: 106199 - RNA, 20 nt, Homo sapiens
uauucacucuccagucuugc

SEQ ID NO: 106200 - RNA, 22 nt, Homo sapiens
uauugcagauacccaggaaguu

SEQ ID NO: 106201 - RNA, 22 nt, Homo sapiens
uauugucacuaaaggaagcugg

SEQ ID NO: 106202 - RNA, 22 nt, Homo sapiens
uacaagcaggaaaugguauaug

SEQ ID NO: 106203 - RNA, 23 nt, Homo sapiens
uacagcacacugaugggucuuga

SEQ ID NO: 106204 - RNA, 22 nt, Homo sapiens
uacagcacugugcauagugguu

SEQ ID NO: 106205 - RNA, 22 nt, Homo sapiens
uacagucuggaggccuguguug

SEQ ID NO: 106206 - RNA, 22 nt, Homo sapiens
uacaucagccugaaagagcucg

SEQ ID NO: 106207 - RNA, 19 nt, Homo sapiens
uacugcaccucaaccuggg

SEQ ID NO: 106208 - RNA, 22 nt, Homo sapiens
uacugcacuccagccuugccaa

SEQ ID NO: 106209 - RNA, 22 nt, Homo sapiens
uacugcauuccaaucugggcga

SEQ ID NO: 106210 - RNA, 22 nt, Homo sapiens
ugagaugaugggauaagagggc

SEQ ID NO: 106211 - RNA, 22 nt, Homo sapiens
ugagauggaguuucacuuuugu

SEQ ID NO: 106212 - RNA, 22 nt, Homo sapiens
ugagaugguaaauuuuuguugu

SEQ ID NO: 106213 - RNA, 19 nt, Homo sapiens
ugagauuguaugaggagau

SEQ ID NO: 106214 - RNA, 22 nt, Homo sapiens
ugagcagagggagaaguaaauu

SEQ ID NO: 106215 - RNA, 22 nt, Homo sapiens
ugaggcaaggcugaaugaaggc

SEQ ID NO: 106216 - RNA, 22 nt, Homo sapiens
ugagguaacaaacuaugaguua

SEQ ID NO: 106217 - RNA, 22 nt, Homo sapiens
ugagguaagauguucauuuuuc

SEQ ID NO: 106218 - RNA, 22 nt, Homo sapiens
ugagguaaugcuguagcuguga

SEQ ID NO: 106219 - RNA, 22 nt, Homo sapiens
ugagguaggugaagaaugcacg

SEQ ID NO: 106220 - RNA, 22 nt, Homo sapiens
ugagguugaaggacauuuuuau

SEQ ID NO: 106221 - RNA, 19 nt, Homo sapiens
ugaguaucuuuacacaucu

SEQ ID NO: 106222 - RNA, 22 nt, Homo sapiens
ugagucauguaauaaugcugcu

SEQ ID NO: 106223 - RNA, 22 nt, Homo sapiens
ugaguuaauuuuuguaucaugu

SEQ ID NO: 106224 - RNA, 22 nt, Homo sapiens
ugauagugccuuuuauaucucu

SEQ ID NO: 106225 - RNA, 22 nt, Homo sapiens
ugauaugugaguauaugguuau

SEQ ID NO: 106226 - RNA, 22 nt, Homo sapiens
ugauggcauuuggaguugggac

SEQ ID NO: 106227 - RNA, 22 nt, Homo sapiens
ugcaagaaacauauuccacaag

SEQ ID NO: 106228 - RNA, 22 nt, Homo sapiens
ugcagcacugaacuucugggcu

SEQ ID NO: 106229 - RNA, 19 nt, Homo sapiens
ugccaagaaagucagcuua

SEQ ID NO: 106230 - RNA, 22 nt, Homo sapiens
ugccuggagagcuccuacauau

SEQ ID NO: 106231 - RNA, 22 nt, Homo sapiens
ugccuucuguuaaacgaggaug

SEQ ID NO: 106232 - RNA, 22 nt, Homo sapiens
ugcgauaguuugcugguaaauu

SEQ ID NO: 106233 - RNA, 22 nt, Homo sapiens
ugcuguuguuugaugaaguaau

SEQ ID NO: 106234 - RNA, 22 nt, Homo sapiens
uggaaaauuaggggagguuaua

SEQ ID NO: 106235 - RNA, 22 nt, Homo sapiens
uggaaaguaguucuaaucuaag

SEQ ID NO: 106236 - RNA, 22 nt, Homo sapiens
uggaagugaacaaccaaggcag

SEQ ID NO: 106237 - RNA, 22 nt, Homo sapiens
uggaagugucugugcccagcuc

SEQ ID NO: 106238 - RNA, 22 nt, Homo sapiens
uggagagcaaaaucaauccaaa

SEQ ID NO: 106239 - RNA, 22 nt, Homo sapiens
uggagcccuaguuccucauaac

SEQ ID NO: 106240 - RNA, 22 nt, Homo sapiens
uggagguagacauugggaagag

SEQ ID NO: 106241 - RNA, 22 nt, Homo sapiens
uggagguaggugauauguagca

SEQ ID NO: 106242 - RNA, 21 nt, Homo sapiens
uggauugagaaccccaggagg

SEQ ID NO: 106243 - RNA, 22 nt, Homo sapiens
uggcaaagugugacgugggggu

SEQ ID NO: 106244 - RNA, 22 nt, Homo sapiens
uggcagauaggauacaggacua

SEQ ID NO: 106245 - RNA, 22 nt, Homo sapiens
uggcaguuuuaugugguucaac

SEQ ID NO: 106246 - RNA, 22 nt, Homo sapiens
uggcauguguuugaaugaguau

SEQ ID NO: 106247 - RNA, 23 nt, Homo sapiens
uggcauuuuaguuagcuucagug

SEQ ID NO: 106248 - RNA, 22 nt, Homo sapiens
uggcuuuuaucuacucucaacu

SEQ ID NO: 106249 - RNA, 22 nt, Homo sapiens
uggcuuuuccaggcauuacgau

SEQ ID NO: 106250 - RNA, 22 nt, Homo sapiens
ugggaaugaaauuacauagcuu

SEQ ID NO: 106251 - RNA, 22 nt, Homo sapiens
ugggcauuguuccuaguuaucu

SEQ ID NO: 106252 - RNA, 22 nt, Homo sapiens
ugggcuagaugcuuugggguca

SEQ ID NO: 106253 - RNA, 22 nt, Homo sapiens
uggucaugaggugaggcuucuc

SEQ ID NO: 106254 - RNA, 22 nt, Homo sapiens
uggugcccuguccuucuguggc

SEQ ID NO: 106255 - RNA, 22 nt, Homo sapiens
uggugcuuaaauaaggcuuuca

SEQ ID NO: 106256 - RNA, 22 nt, Homo sapiens
uggugcuugaugaggguggagc

SEQ ID NO: 106257 - RNA, 22 nt, Homo sapiens
uguaaaaagcccagccgcugag

SEQ ID NO: 106258 - RNA, 20 nt, Homo sapiens
uguagguguacaguaaggag

SEQ ID NO: 106259 - RNA, 22 nt, Homo sapiens
ugucaugucuuuguguaucaau

SEQ ID NO: 106260 - RNA, 22 nt, Homo sapiens
ugucuaaagaauggcagacuca

SEQ ID NO: 106261 - RNA, 22 nt, Homo sapiens
ugugaaaucagauagccuuuuu

SEQ ID NO: 106262 - RNA, 22 nt, Homo sapiens
ugugaacagaauuagucaccua

SEQ ID NO: 106263 - RNA, 22 nt, Homo sapiens
ugugcauaugucuuuauaguag

SEQ ID NO: 106264 - RNA, 22 nt, Homo sapiens
ugugccugagguuaacauuguu

SEQ ID NO: 106265 - RNA, 22 nt, Homo sapiens
uguggaaauaaaagaaagguua

SEQ ID NO: 106266 - RNA, 22 nt, Homo sapiens
uguggaaauggugcuacgaaca

SEQ ID NO: 106267 - RNA, 22 nt, Homo sapiens
uguggucaucacuugaagguaa

SEQ ID NO: 106268 - RNA, 19 nt, Homo sapiens
uguggucauccugggacga

SEQ ID NO: 106269 - RNA, 22 nt, Homo sapiens
uguguagagaaauauuacuuau

SEQ ID NO: 106270 - RNA, 22 nt, Homo sapiens
uguuaucauuacguucuuaguu

SEQ ID NO: 106271 - RNA, 22 nt, Homo sapiens
uuaagcaguaguuaaggagagg

SEQ ID NO: 106272 - RNA, 22 nt, Homo sapiens
uuaaggaaagcauuuaauucag

SEQ ID NO: 106273 - RNA, 22 nt, Homo sapiens
uuacaaccucagcagugcaaag

SEQ ID NO: 106274 - RNA, 22 nt, Homo sapiens
uuacaguauugcaaggacuagg

SEQ ID NO: 106275 - RNA, 23 nt, Homo sapiens
uuacaguggcaugaucucugcuc

SEQ ID NO: 106276 - RNA, 22 nt, Homo sapiens
uuacaguguuuguucuguuacu

SEQ ID NO: 106277 - RNA, 22 nt, Homo sapiens
uuagcacaucuuucuauguaag

SEQ ID NO: 106278 - RNA, 22 nt, Homo sapiens
uuaggcaguuuauugauuuuca

SEQ ID NO: 106279 - RNA, 22 nt, Homo sapiens
uuaggcuuuucagacacuucau

SEQ ID NO: 106280 - RNA, 22 nt, Homo sapiens
uuaguaguagugcuguaauuuu

SEQ ID NO: 106281 - RNA, 22 nt, Homo sapiens
uuagugaaugggugugauuugu

SEQ ID NO: 106282 - RNA, 19 nt, Homo sapiens
uuauacuguauuguuuagg

SEQ ID NO: 106283 - RNA, 22 nt, Homo sapiens
uuauauguuacucccucuagca

SEQ ID NO: 106284 - RNA, 22 nt, Homo sapiens
uuauauguuagacauggugggu

SEQ ID NO: 106285 - RNA, 22 nt, Homo sapiens
uuauggcaaugccccacuccua

SEQ ID NO: 106286 - RNA, 22 nt, Homo sapiens
uuauuagguuaaccuauagcua

SEQ ID NO: 106287 - RNA, 16 nt, Homo sapiens
uuauugcauucuucuc

SEQ ID NO: 106288 - RNA, 22 nt, Homo sapiens
uuauugcucauuugggcauucu

SEQ ID NO: 106289 - RNA, 22 nt, Homo sapiens
uucaaaguguugguuuugggcu

SEQ ID NO: 106290 - RNA, 22 nt, Homo sapiens
aaagcacuggagucaucaucua

SEQ ID NO: 106291 - RNA, 22 nt, Homo sapiens
aaauaacugucagguucuggaa

SEQ ID NO: 106292 - RNA, 22 nt, Homo sapiens
aaauucaugucaccucuaggua

SEQ ID NO: 106293 - RNA, 22 nt, Homo sapiens
aacacuggcugcucgaguucuc

SEQ ID NO: 106294 - RNA, 22 nt, Homo sapiens
aacagugccugucauuuaguag

SEQ ID NO: 106295 - RNA, 22 nt, Homo sapiens
aacugcacauauuuguaugggu

SEQ ID NO: 106296 - RNA, 22 nt, Homo sapiens
aacuggcauagccagacuucuc

SEQ ID NO: 106297 - RNA, 22 nt, Homo sapiens
aagagagccagcugguauauuu

SEQ ID NO: 106298 - RNA, 22 nt, Homo sapiens
aagagagcuaugugcauaauua

SEQ ID NO: 106299 - RNA, 22 nt, Homo sapiens
aagagcucauccauaguuguca

SEQ ID NO: 106300 - RNA, 23 nt, Homo sapiens
aagagguaugacuaugaagugga

SEQ ID NO: 106301 - RNA, 22 nt, Homo sapiens
aagccacuguaccugucucuua

SEQ ID NO: 106302 - RNA, 22 nt, Homo sapiens
aagcuggagugcaguggugcaa

SEQ ID NO: 106303 - RNA, 22 nt, Homo sapiens
aaggcucuuucaacguaaauua

SEQ ID NO: 106304 - RNA, 22 nt, Homo sapiens
aaguaaacauugagagacaaga

SEQ ID NO: 106305 - RNA, 22 nt, Homo sapiens
aaguaaacauuuuguacaauaa

SEQ ID NO: 106306 - RNA, 22 nt, Homo sapiens
aaguaauggaguuauuuuauga

SEQ ID NO: 106307 - RNA, 22 nt, Homo sapiens
aaguauuaugaguccuuguuuu

SEQ ID NO: 106308 - RNA, 23 nt, Homo sapiens
aagucauggaaucaaaugaggug

SEQ ID NO: 106309 - RNA, 22 nt, Homo sapiens
aagugaguaauacgucaguugu

SEQ ID NO: 106310 - RNA, 20 nt, Homo sapiens
aagugcaucguugugucugc

SEQ ID NO: 106311 - RNA, 22 nt, Homo sapiens
aaguggaauguuuguggcacaa

SEQ ID NO: 106312 - RNA, 22 nt, Homo sapiens
aaguguaaguuaauguuuaggu

SEQ ID NO: 106313 - RNA, 22 nt, Homo sapiens
aauaucacaguggguguacacc

SEQ ID NO: 106314 - RNA, 22 nt, Homo sapiens
aaucccugagcuagacacaaag

SEQ ID NO: 106315 - RNA, 22 nt, Homo sapiens
aaucucagcauuuugggcugag

SEQ ID NO: 106316 - RNA, 22 nt, Homo sapiens
aauggcacaccuagcccuaacc

SEQ ID NO: 106317 - RNA, 22 nt, Homo sapiens
augaggaagucaggcccagggg

SEQ ID NO: 106318 - RNA, 22 nt, Homo sapiens
augagggcggacgcccuggaga

SEQ ID NO: 106319 - RNA, 22 nt, Homo sapiens
augagguauccaagcccagaaa

SEQ ID NO: 106320 - RNA, 22 nt, Homo sapiens
augccaagagacaaagggaauc

SEQ ID NO: 106321 - RNA, 22 nt, Homo sapiens
augcuacugaccccuacuuaca

SEQ ID NO: 106322 - RNA, 22 nt, Homo sapiens
augcuacugauaagcaaucauu

SEQ ID NO: 106323 - RNA, 22 nt, Homo sapiens
augcuacuggacaauggugacu

SEQ ID NO: 106324 - RNA, 22 nt, Homo sapiens
augcuacuggauuuguauaaau

SEQ ID NO: 106325 - RNA, 22 nt, Homo sapiens
auggaacauaacuauuugggga

SEQ ID NO: 106326 - RNA, 22 nt, Homo sapiens
auggcaagaagagcaauuauuu

SEQ ID NO: 106327 - RNA, 22 nt, Homo sapiens
augguauggaaggucuggagga

SEQ ID NO: 106328 - RNA, 22 nt, Homo sapiens
augguuuauuuguaagcagagu

SEQ ID NO: 106329 - RNA, 22 nt, Homo sapiens
auguaugagaguuccagcugau

SEQ ID NO: 106330 - RNA, 22 nt, Homo sapiens
augucaacauagacaguagagu

SEQ ID NO: 106331 - RNA, 22 nt, Homo sapiens
augucuagagcaagagaugcug

SEQ ID NO: 106332 - RNA, 22 nt, Homo sapiens
augugcaauggugucaccacau

SEQ ID NO: 106333 - RNA, 22 nt, Homo sapiens
augugcaauguguacguagccc

SEQ ID NO: 106334 - RNA, 22 nt, Homo sapiens
augugggaggacuuggcuguug

SEQ ID NO: 106335 - RNA, 22 nt, Homo sapiens
auuauauguguaugugcauacc

SEQ ID NO: 106336 - RNA, 22 nt, Homo sapiens
auuauguuguauuuccuugcag

SEQ ID NO: 106337 - RNA, 22 nt, Homo sapiens
auuccacaguuaacacagaccg

SEQ ID NO: 106338 - RNA, 18 nt, Homo sapiens
auucuacaggccuuuuga

SEQ ID NO: 106339 - RNA, 22 nt, Homo sapiens
auugaacuguuggagagguuuu

SEQ ID NO: 106340 - RNA, 21 nt, Homo sapiens
auugcacuccagccugggcga

SEQ ID NO: 106341 - RNA, 22 nt, Homo sapiens
auugcacuccagucugggcaac

SEQ ID NO: 106342 - RNA, 22 nt, Homo sapiens
auugcauaaacacauuucuuau

SEQ ID NO: 106343 - RNA, 22 nt, Homo sapiens
auugcucaaaucaguacuugag

SEQ ID NO: 106344 - RNA, 22 nt, Homo sapiens
auuguaccccaauguacaauau

SEQ ID NO: 106345 - RNA, 22 nt, Homo sapiens
auuguucuuacaugcugucauc

SEQ ID NO: 106346 - RNA, 22 nt, Homo sapiens
auuguucuuguguccuuuuccu

SEQ ID NO: 106347 - RNA, 20 nt, Homo sapiens
auuugcauuauggagcaccc

SEQ ID NO: 106348 - RNA, 22 nt, Homo sapiens
auuuugguuacauaguugagcu

SEQ ID NO: 106349 - RNA, 22 nt, Homo sapiens
caaaagugauugcgguuuuugc

SEQ ID NO: 106350 - RNA, 22 nt, Homo sapiens
caaaagugguucuuauccuuuu

SEQ ID NO: 106351 - RNA, 22 nt, Homo sapiens
caaagugcugggaugggccagg

SEQ ID NO: 106352 - RNA, 22 nt, Homo sapiens
caaaugacaucauuucauucaa

SEQ ID NO: 106353 - RNA, 22 nt, Homo sapiens
caagaucauuuaugcuaaaauu

SEQ ID NO: 106354 - RNA, 21 nt, Homo sapiens
caauggcacaaucucugcuca

SEQ ID NO: 106355 - RNA, 22 nt, Homo sapiens
cacacugucuucauuacuguag

SEQ ID NO: 106356 - RNA, 22 nt, Homo sapiens
cacaggccugucucuuucuaac

SEQ ID NO: 106357 - RNA, 21 nt, Homo sapiens
cacauggaggcagagagugua

SEQ ID NO: 106358 - RNA, 22 nt, Homo sapiens
cacugcacuccagucccgucuc

SEQ ID NO: 106359 - RNA, 22 nt, Homo sapiens
cacugcauccuugaccuucugg

SEQ ID NO: 106360 - RNA, 22 nt, Homo sapiens
cacuguggauggaacuauguga

SEQ ID NO: 106361 - RNA, 22 nt, Homo sapiens
cagcugaugucgaaugcacucu

SEQ ID NO: 106362 - RNA, 22 nt, Homo sapiens
cagcugguggcaagaagacaga

SEQ ID NO: 106363 - RNA, 23 nt, Homo sapiens
cagguaguucuuuauaguagugu

SEQ ID NO: 106364 - RNA, 22 nt, Homo sapiens
cagucacagugacaggaugugg

SEQ ID NO: 106365 - RNA, 22 nt, Homo sapiens
caguguaugcuucuauuuuugg

SEQ ID NO: 106366 - RNA, 18 nt, Homo sapiens
cauagcacuucagcacau

SEQ ID NO: 106367 - RNA, 22 nt, Homo sapiens
caucagcaauguaugaggguuc

SEQ ID NO: 106368 - RNA, 22 nt, Homo sapiens
caugccacugcacgccauccug

SEQ ID NO: 106369 - RNA, 22 nt, Homo sapiens
cauggcacuguaugaaaugugc

SEQ ID NO: 106370 - RNA, 22 nt, Homo sapiens
cauuugcacugagacucagcuu

SEQ ID NO: 106371 - RNA, 22 nt, Homo sapiens
ccaagccucaguuucccucugu

SEQ ID NO: 106372 - RNA, 22 nt, Homo sapiens
ccacugggcaguuuauuaucag

SEQ ID NO: 106373 - RNA, 22 nt, Homo sapiens
ccacugggcuagguguuuugga

SEQ ID NO: 106374 - RNA, 22 nt, Homo sapiens
ccacugugguaucugauacugg

SEQ ID NO: 106375 - RNA, 22 nt, Homo sapiens
ccaggguugcuuuagauucuga

SEQ ID NO: 106376 - RNA, 22 nt, Homo sapiens
ccaucacaggccucagugggaa

SEQ ID NO: 106377 - RNA, 22 nt, Homo sapiens
ccaucccuuucugagcaguucc

SEQ ID NO: 106378 - RNA, 21 nt, Homo sapiens
ccaugggacggaaugaauaca

SEQ ID NO: 106379 - RNA, 23 nt, Homo sapiens
cccucagaagugcagggagagaa

SEQ ID NO: 106380 - RNA, 22 nt, Homo sapiens
cccuggacauucaucauuaugu

SEQ ID NO: 106381 - RNA, 19 nt, Homo sapiens
ccucaaguacuaauauguu

SEQ ID NO: 106382 - RNA, 22 nt, Homo sapiens
ccuuggcacuacugacauugua

SEQ ID NO: 106383 - RNA, 22 nt, Homo sapiens
ccuuuuugaguugccagaguuc

SEQ ID NO: 106384 - RNA, 22 nt, Homo sapiens
cgccugagcugaggaagcugca

SEQ ID NO: 106385 - RNA, 22 nt, Homo sapiens
cuaauucuguaccuggcacaua

SEQ ID NO: 106386 - RNA, 22 nt, Homo sapiens
cuacacaugcaggcucccugcc

SEQ ID NO: 106387 - RNA, 22 nt, Homo sapiens
cuauauacugccugcugauuag

SEQ ID NO: 106388 - RNA, 22 nt, Homo sapiens
cuauaugucuguuuugguacca

SEQ ID NO: 106389 - RNA, 22 nt, Homo sapiens
cuauggcagccacggccuggag

SEQ ID NO: 106390 - RNA, 22 nt, Homo sapiens
cucaaaguguggucuguggguu

SEQ ID NO: 106391 - RNA, 22 nt, Homo sapiens
cucaugcugucuucugggguaa

SEQ ID NO: 106392 - RNA, 17 nt, Homo sapiens
cucucugguuuaaagca

SEQ ID NO: 106393 - RNA, 22 nt, Homo sapiens
cucugacagugguuagcacugu

SEQ ID NO: 106394 - RNA, 19 nt, Homo sapiens
cucuuuggugucucuucuu

SEQ ID NO: 106395 - RNA, 22 nt, Homo sapiens
cugagacacucuuaucugcaua

SEQ ID NO: 106396 - RNA, 22 nt, Homo sapiens
cugagagaugagaccucucacu

SEQ ID NO: 106397 - RNA, 22 nt, Homo sapiens
cugagcaaagaagugauaauga

SEQ ID NO: 106398 - RNA, 22 nt, Homo sapiens
cugagcaaaguucuauuuaugg

SEQ ID NO: 106399 - RNA, 22 nt, Homo sapiens
cugagguacugggggccaggau

SEQ ID NO: 106400 - RNA, 22 nt, Homo sapiens
cugagguauuuaggugaaagaa

SEQ ID NO: 106401 - RNA, 19 nt, Homo sapiens
cugcaugagacaguugguu

SEQ ID NO: 106402 - RNA, 22 nt, Homo sapiens
cuggaaucuauggauaacaucg

SEQ ID NO: 106403 - RNA, 22 nt, Homo sapiens
cuggcaaauaguagagccagga

SEQ ID NO: 106404 - RNA, 22 nt, Homo sapiens
cuggcgagacagcuccaucacu

SEQ ID NO: 106405 - RNA, 22 nt, Homo sapiens
cugucaucauuucuaugugcca

SEQ ID NO: 106406 - RNA, 22 nt, Homo sapiens
cuugacacugcaguuuuccugg

SEQ ID NO: 106407 - RNA, 22 nt, Homo sapiens
cuuucacacuguuggugggaau

SEQ ID NO: 106408 - RNA, 20 nt, Homo sapiens
cuuuggcaaugagaacaggg

SEQ ID NO: 106409 - RNA, 22 nt, Homo sapiens
uacagugcuugguaucuaguaa

SEQ ID NO: 106410 - RNA, 19 nt, Homo sapiens
uacccagaagcagcauugu

SEQ ID NO: 106411 - RNA, 22 nt, Homo sapiens
uacugcacuccagccucgguga

SEQ ID NO: 106412 - RNA, 22 nt, Homo sapiens
uacugcacuccagccugggaga

SEQ ID NO: 106413 - RNA, 20 nt, Homo sapiens
uacugcacuccauccugggu

SEQ ID NO: 106414 - RNA, 22 nt, Homo sapiens
uacugcacuggaggccucagau

SEQ ID NO: 106415 - RNA, 20 nt, Homo sapiens
uacugcacuuuccucauggu

SEQ ID NO: 106416 - RNA, 22 nt, Homo sapiens
uacugcaucgaaaugcuuuuau

SEQ ID NO: 106417 - RNA, 18 nt, Homo sapiens
uagaauauaggucauucu

SEQ ID NO: 106418 - RNA, 22 nt, Homo sapiens
uagaaugaaacaagcugugccu

SEQ ID NO: 106419 - RNA, 22 nt, Homo sapiens
uagagcacaagguagauuucua

SEQ ID NO: 106420 - RNA, 22 nt, Homo sapiens
uagauucaucuguuccuuuuga

SEQ ID NO: 106421 - RNA, 22 nt, Homo sapiens
uagcaggaaaggggucagaucu

SEQ ID NO: 106422 - RNA, 22 nt, Homo sapiens
uagcauaauuuguagaaaauca

SEQ ID NO: 106423 - RNA, 22 nt, Homo sapiens
uagcugcccagcacgaaguugg

SEQ ID NO: 106424 - RNA, 22 nt, Homo sapiens
uaggauaguccuccugagaccu

SEQ ID NO: 106425 - RNA, 22 nt, Homo sapiens
uaggcacacaucuacuacaaau

SEQ ID NO: 106426 - RNA, 22 nt, Homo sapiens
uaguagcauaccuaaguauacu

SEQ ID NO: 106427 - RNA, 22 nt, Homo sapiens
uauagcaaugugccacucucug

SEQ ID NO: 106428 - RNA, 22 nt, Homo sapiens
uauagcuugaaggaauggucau

SEQ ID NO: 106429 - RNA, 22 nt, Homo sapiens
uauaugcauugugggguacuga

SEQ ID NO: 106430 - RNA, 22 nt, Homo sapiens
uaucacagcauugucuauaaua

SEQ ID NO: 106431 - RNA, 22 nt, Homo sapiens
uaucacagcgggguguacaccc

SEQ ID NO: 106432 - RNA, 22 nt, Homo sapiens
uaucacaguugcauauuuaagg

SEQ ID NO: 106433 - RNA, 22 nt, Homo sapiens
uaucacuuugauaguuuaaaug

SEQ ID NO: 106434 - RNA, 20 nt, Homo sapiens
uaugaaacaguguagagcaa

SEQ ID NO: 106435 - RNA, 22 nt, Homo sapiens
uaugaugcuguuuagaaucucu

SEQ ID NO: 106436 - RNA, 19 nt, Homo sapiens
uaugcaacuuauagugcug

SEQ ID NO: 106437 - RNA, 22 nt, Homo sapiens
uaugccuuuuggcucaagaaac

SEQ ID NO: 106438 - RNA, 22 nt, Homo sapiens
uaugcuuauuaaaacagugugu

SEQ ID NO: 106439 - RNA, 22 nt, Homo sapiens
uauggauguuaagguucacagc

SEQ ID NO: 106440 - RNA, 17 nt, Homo sapiens
uauguaguacuuauaaa

SEQ ID NO: 106441 - RNA, 22 nt, Homo sapiens
uauuacacuuuagugucuucca

SEQ ID NO: 106442 - RNA, 22 nt, Homo sapiens
uauugcuugaggaaaugguaau

SEQ ID NO: 106443 - RNA, 18 nt, Homo sapiens
uauugcuugguuuggaga

SEQ ID NO: 106444 - RNA, 22 nt, Homo sapiens
uauuugcacucccaucauggug

SEQ ID NO: 106445 - RNA, 22 nt, Homo sapiens
ucaagaccucacauagaggaga

SEQ ID NO: 106446 - RNA, 19 nt, Homo sapiens
ucacacuguggcuucuuua

SEQ ID NO: 106447 - RNA, 22 nt, Homo sapiens
ucacagacauugaggggaccuu

SEQ ID NO: 106448 - RNA, 22 nt, Homo sapiens
ucacaugugacauauauauuug

SEQ ID NO: 106449 - RNA, 22 nt, Homo sapiens
ucaccuggggaucuuguuuaca

SEQ ID NO: 106450 - RNA, 23 nt, Homo sapiens
ucacuagaguccuggaguuugag

SEQ ID NO: 106451 - RNA, 22 nt, Homo sapiens
ucacugcacuucaggcuuucuc

SEQ ID NO: 106452 - RNA, 22 nt, Homo sapiens
ucacugggagcauuugagccuu

SEQ ID NO: 106453 - RNA, 22 nt, Homo sapiens
ucacugugagaguuuauccugu

SEQ ID NO: 106454 - RNA, 22 nt, Homo sapiens
ucacugugguuugggaaagugc

SEQ ID NO: 106455 - RNA, 18 nt, Homo sapiens
ucacugugugucuugggu

SEQ ID NO: 106456 - RNA, 22 nt, Homo sapiens
ucaggguacuuguggccaaagu

SEQ ID NO: 106457 - RNA, 22 nt, Homo sapiens
ucauaguagucacuuaauaaau

SEQ ID NO: 106458 - RNA, 22 nt, Homo sapiens
ucauaugucauaguaugaucuu

SEQ ID NO: 106459 - RNA, 22 nt, Homo sapiens
ucaucagaguuuacaagcucag

SEQ ID NO: 106460 - RNA, 21 nt, Homo sapiens
ucaucagucaaagacaauggu

SEQ ID NO: 106461 - RNA, 22 nt, Homo sapiens
ucaucagugcuugcaaauuauu

SEQ ID NO: 106462 - RNA, 22 nt, Homo sapiens
ucauggcuuuuauuauguugag

SEQ ID NO: 106463 - RNA, 22 nt, Homo sapiens
ucaugugaggauaacaauagug

SEQ ID NO: 106464 - RNA, 23 nt, Homo sapiens
uccccgggagcaccagcuuguug

SEQ ID NO: 106465 - RNA, 22 nt, Homo sapiens
ucccuggagcaagagaagaagg

SEQ ID NO: 106466 - RNA, 22 nt, Homo sapiens
ucccuguguccugggggcaccu

SEQ ID NO: 106467 - RNA, 22 nt, Homo sapiens
uccugagagcagacccucuaua

SEQ ID NO: 106468 - RNA, 22 nt, Homo sapiens
uccuucauuugucaacucuagu

SEQ ID NO: 106469 - RNA, 20 nt, Homo sapiens
ucgcaccacuauacuccagc

SEQ ID NO: 106470 - RNA, 21 nt, Homo sapiens
ucucauagaguuucacuuucu

SEQ ID NO: 106471 - RNA, 22 nt, Homo sapiens
ucucaugaagguggagaguagg

SEQ ID NO: 106472 - RNA, 20 nt, Homo sapiens
ucucccaaacagcaggcccu

SEQ ID NO: 106473 - RNA, 22 nt, Homo sapiens
ucuggccuagaacaauuaauua

SEQ ID NO: 106474 - RNA, 22 nt, Homo sapiens
ucugucaaaucuuauguuguag

SEQ ID NO: 106475 - RNA, 22 nt, Homo sapiens
ucuuuggguagauauguagcug

SEQ ID NO: 106476 - RNA, 22 nt, Homo sapiens
ucuuugguagaagcuauuuuau

SEQ ID NO: 106477 - RNA, 22 nt, Homo sapiens
ucuuuuugagucaguuucggua

SEQ ID NO: 106478 - RNA, 22 nt, Homo sapiens
ugaagacucaauuauuaugaac

SEQ ID NO: 106479 - RNA, 22 nt, Homo sapiens
ugaagugaagcaguaguguggg

SEQ ID NO: 106480 - RNA, 21 nt, Homo sapiens
ugaauauuuggguugugucca

SEQ ID NO: 106481 - RNA, 22 nt, Homo sapiens
ugaauguauuuauuaccauuca

SEQ ID NO: 106482 - RNA, 22 nt, Homo sapiens
ugacacagugggggauccuuuu

SEQ ID NO: 106483 - RNA, 22 nt, Homo sapiens
ugacuaguuggauaaccuagga

SEQ ID NO: 106484 - RNA, 22 nt, Homo sapiens
ugacuaguuuugcuguuguuau

SEQ ID NO: 106485 - RNA, 22 nt, Homo sapiens
ugacugucuagauagagcuugg

SEQ ID NO: 106486 - RNA, 22 nt, Homo sapiens
ugagaacaugcacuugagguug

SEQ ID NO: 106487 - RNA, 22 nt, Homo sapiens
ugagaacauggagaacccccca

SEQ ID NO: 106488 - RNA, 20 nt, Homo sapiens
ugagaacauguggcauuugg

SEQ ID NO: 106489 - RNA, 20 nt, Homo sapiens
ugagaacaugugguauuugg

SEQ ID NO: 106490 - RNA, 22 nt, Homo sapiens
ugagaauauuuuccaugucuca

SEQ ID NO: 106491 - RNA, 22 nt, Homo sapiens
ugagaaugaugauugguaaacc

SEQ ID NO: 106492 - RNA, 22 nt, Homo sapiens
ugagaggugaauggcaggcuca

SEQ ID NO: 106493 - RNA, 22 nt, Homo sapiens
ugagauaaucaugugauuucau

SEQ ID NO: 106494 - RNA, 22 nt, Homo sapiens
ugagaugaagucuugcucuguu

SEQ ID NO: 106495 - RNA, 22 nt, Homo sapiens
ugagauggaguuucgcccuugu

SEQ ID NO: 106496 - RNA, 22 nt, Homo sapiens
ugagauggaguuucgcucuugu

SEQ ID NO: 106497 - RNA, 22 nt, Homo sapiens
ugagauggcugaauucagaaua

SEQ ID NO: 106498 - RNA, 18 nt, Homo sapiens
ugaggaaaggguuugcua

SEQ ID NO: 106499 - RNA, 22 nt, Homo sapiens
ugaggaaugaccccgugugguc

SEQ ID NO: 106500 - RNA, 20 nt, Homo sapiens
ugaggucaggaguuacagac

SEQ ID NO: 106501 - RNA, 21 nt, Homo sapiens
ugaggucaugaugcugcuucc

SEQ ID NO: 106502 - RNA, 20 nt, Homo sapiens
ugaggucugagaaagaauga

SEQ ID NO: 106503 - RNA, 22 nt, Homo sapiens
ugagguuggggucagggcuagc

SEQ ID NO: 106504 - RNA, 22 nt, Homo sapiens
ugaguagagaauucagcuaagg

SEQ ID NO: 106505 - RNA, 22 nt, Homo sapiens
ugagucaugcuggagucauggc

SEQ ID NO: 106506 - RNA, 22 nt, Homo sapiens
ugaguggagaucgcaccauugc

SEQ ID NO: 106507 - RNA, 22 nt, Homo sapiens
ugaguguccaccccuuucacag

SEQ ID NO: 106508 - RNA, 22 nt, Homo sapiens
ugauaauguuaggcuuuauuca

SEQ ID NO: 106509 - RNA, 22 nt, Homo sapiens
ugaugacacugauuucuucaau

SEQ ID NO: 106510 - RNA, 22 nt, Homo sapiens
ugcaccacugcaccccagucug

SEQ ID NO: 106511 - RNA, 22 nt, Homo sapiens
ugcagguaggcaguaucauuua

SEQ ID NO: 106512 - RNA, 19 nt, Homo sapiens
ugcauaggguuacauacuc

SEQ ID NO: 106513 - RNA, 22 nt, Homo sapiens
ugcauauucuaggauuuuguau

SEQ ID NO: 106514 - RNA, 22 nt, Homo sapiens
ugcauggagcucucuuuggacu

SEQ ID NO: 106515 - RNA, 22 nt, Homo sapiens
ugccaagaacauuuucuguuuu

SEQ ID NO: 106516 - RNA, 22 nt, Homo sapiens
ugccuacuuugcaucugucagg

SEQ ID NO: 106517 - RNA, 22 nt, Homo sapiens
ugccugagcccagcccuguagu

SEQ ID NO: 106518 - RNA, 22 nt, Homo sapiens
ugcuagaagaucacacacauca

SEQ ID NO: 106519 - RNA, 22 nt, Homo sapiens
ugcuugagacacauaugaauuu

SEQ ID NO: 106520 - RNA, 22 nt, Homo sapiens
uggaaaguacuugaguuuguau

SEQ ID NO: 106521 - RNA, 22 nt, Homo sapiens
uggaaauaaaugugccaagauc

SEQ ID NO: 106522 - RNA, 22 nt, Homo sapiens
uggacugagauuucagcugcca

SEQ ID NO: 106523 - RNA, 22 nt, Homo sapiens
uggacuguaaauuggggacucu

SEQ ID NO: 106524 - RNA, 23 nt, Homo sapiens
uggaggacaagcauggauaguga

SEQ ID NO: 106525 - RNA, 19 nt, Homo sapiens
uggagucaucaugcugcua

SEQ ID NO: 106526 - RNA, 22 nt, Homo sapiens
uggagugcaauggugagaucuu

SEQ ID NO: 106527 - RNA, 20 nt, Homo sapiens
uggagugcuguguugagaag

SEQ ID NO: 106528 - RNA, 22 nt, Homo sapiens
uggauggagaggcuugugaugc

SEQ ID NO: 106529 - RNA, 22 nt, Homo sapiens
uggcaaaugaaagaaagccagu

SEQ ID NO: 106530 - RNA, 22 nt, Homo sapiens
uggcaaaugaagucagcuguac

SEQ ID NO: 106531 - RNA, 22 nt, Homo sapiens
uggcaagaagagcaugagacca

SEQ ID NO: 106532 - RNA, 23 nt, Homo sapiens
uggcaagauuuguauugccugga

SEQ ID NO: 106533 - RNA, 22 nt, Homo sapiens
uggcaagugggaccuaguuaaa

SEQ ID NO: 106534 - RNA, 21 nt, Homo sapiens
uggcacuauucacaauagcaa

SEQ ID NO: 106535 - RNA, 22 nt, Homo sapiens
uggcaggugcacuggcuuugaa

SEQ ID NO: 106536 - RNA, 22 nt, Homo sapiens
uggcaguuucacauggcucaac

SEQ ID NO: 106537 - RNA, 22 nt, Homo sapiens
uggcaguuucauaugguucaac

SEQ ID NO: 106538 - RNA, 22 nt, Homo sapiens
uggcauaugguauuugauaucu

SEQ ID NO: 106539 - RNA, 22 nt, Homo sapiens
uggccagugucggaggccagga

SEQ ID NO: 106540 - RNA, 22 nt, Homo sapiens
uggcuuuucauccugggacauu

SEQ ID NO: 106541 - RNA, 22 nt, Homo sapiens
uggcuuuuccuugaaucugccu

SEQ ID NO: 106542 - RNA, 22 nt, Homo sapiens
ugggaauaugauacaggucuuu

SEQ ID NO: 106543 - RNA, 21 nt, Homo sapiens
ugggccccuuccuuacaucau

SEQ ID NO: 106544 - RNA, 22 nt, Homo sapiens
uggguaaaucucuguucagggc

SEQ ID NO: 106545 - RNA, 22 nt, Homo sapiens
uggguaggcccucauuggacag

SEQ ID NO: 106546 - RNA, 22 nt, Homo sapiens
uggucauggaaauagaaugcac

SEQ ID NO: 106547 - RNA, 22 nt, Homo sapiens
uguauacauauguauguuuugu

SEQ ID NO: 106548 - RNA, 22 nt, Homo sapiens
ugucaaaugcagugauauuuga

SEQ ID NO: 106549 - RNA, 22 nt, Homo sapiens
ugucaaguugugguucaauuuu

SEQ ID NO: 106550 - RNA, 22 nt, Homo sapiens
ugucauucaggaaauucuaagu

SEQ ID NO: 106551 - RNA, 19 nt, Homo sapiens
ugucccagccauagaggca

SEQ ID NO: 106552 - RNA, 22 nt, Homo sapiens
ugugaacagcuccaaaugugga

SEQ ID NO: 106553 - RNA, 22 nt, Homo sapiens
ugugaauggugcugcaaugaac

SEQ ID NO: 106554 - RNA, 22 nt, Homo sapiens
ugugaucaaccugcagggcugg

SEQ ID NO: 106555 - RNA, 22 nt, Homo sapiens
ugugaucaugguauuaaucugc

SEQ ID NO: 106556 - RNA, 22 nt, Homo sapiens
ugugcuugcuucuucuccuagu

SEQ ID NO: 106557 - RNA, 22 nt, Homo sapiens
ugugggaggugcuaauguaaau

SEQ ID NO: 106558 - RNA, 22 nt, Homo sapiens
uguguaauaccuuugacuauau

SEQ ID NO: 106559 - RNA, 22 nt, Homo sapiens
ugugucuuuuaucacacaaugu

SEQ ID NO: 106560 - RNA, 22 nt, Homo sapiens
uguucacaguguuucuuugaga

SEQ ID NO: 106561 - RNA, 22 nt, Homo sapiens
uguucuggagaguuuagucugg

SEQ ID NO: 106562 - RNA, 22 nt, Homo sapiens
uguugcauuugucaaggucaag

SEQ ID NO: 106563 - RNA, 22 nt, Homo sapiens
uguuucuacugucucuguagua

SEQ ID NO: 106564 - RNA, 22 nt, Homo sapiens
uuaaaggcauguacacuagagu

SEQ ID NO: 106565 - RNA, 22 nt, Homo sapiens
uuaaaugcauagaauguguagu

SEQ ID NO: 106566 - RNA, 22 nt, Homo sapiens
uuaauguaauugauugauugac

SEQ ID NO: 106567 - RNA, 22 nt, Homo sapiens
uuagcacuugggaguauuuauu

SEQ ID NO: 106568 - RNA, 21 nt, Homo sapiens
uuagcauccauguucaucaac

SEQ ID NO: 106569 - RNA, 22 nt, Homo sapiens
uuaguaguaguuugcauuuacc

SEQ ID NO: 106570 - RNA, 22 nt, Homo sapiens
uuagugcugaguggaauguucu

SEQ ID NO: 106571 - RNA, 22 nt, Homo sapiens
uuaguuuaucagugguuucuga

SEQ ID NO: 106572 - RNA, 22 nt, Homo sapiens
uuauauguuucuguuuggaggc

SEQ ID NO: 106573 - RNA, 22 nt, Homo sapiens
uuauggauuuauauucuguagu

SEQ ID NO: 106574 - RNA, 22 nt, Homo sapiens
uuauuagguuagugcaaaaguu

SEQ ID NO: 106575 - RNA, 22 nt, Homo sapiens
uuauucugucuuuggucucaau

SEQ ID NO: 106576 - RNA, 22 nt, Homo sapiens
uuauugcacuccagccugggua

SEQ ID NO: 106577 - RNA, 22 nt, Homo sapiens
uucaauuaauauuauacucuca

SEQ ID NO: 106578 - RNA, 22 nt, Homo sapiens
uucacagagagaacucaaacca

SEQ ID NO: 106579 - RNA, 23 nt, Homo sapiens
uucaccugguuauuaauagccuc

SEQ ID NO: 106580 - RNA, 19 nt, Homo sapiens
uucacguaggagaaagaag

SEQ ID NO: 106581 - RNA, 22 nt, Homo sapiens
uucacugcacuccagccugggu

SEQ ID NO: 106582 - RNA, 22 nt, Homo sapiens
uucacuguagcuuggauguuua

SEQ ID NO: 106583 - RNA, 22 nt, Homo sapiens
uucacuguuaagcaguuaaacu

SEQ ID NO: 106584 - RNA, 22 nt, Homo sapiens
uucaggguggagaguaugaggu

SEQ ID NO: 106585 - RNA, 22 nt, Homo sapiens
uucauagaggacauuacuggag

SEQ ID NO: 106586 - RNA, 18 nt, Homo sapiens
uucauaguagcaugauuu

SEQ ID NO: 106587 - RNA, 22 nt, Homo sapiens
uucauaguauuuuucuccaaau

SEQ ID NO: 106588 - RNA, 20 nt, Homo sapiens
uucaucaggauauuggucua

SEQ ID NO: 106589 - RNA, 22 nt, Homo sapiens
uucaucagggagaaauaauuuc

SEQ ID NO: 106590 - RNA, 22 nt, Homo sapiens
uucaucaguuauauuggccuga

SEQ ID NO: 106591 - RNA, 22 nt, Homo sapiens
uucaucaguugagcugguugcu

SEQ ID NO: 106592 - RNA, 22 nt, Homo sapiens
uucauggauggaaaugauuuug

SEQ ID NO: 106593 - RNA, 22 nt, Homo sapiens
uucauggugguacaaaagcaau

SEQ ID NO: 106594 - RNA, 21 nt, Homo sapiens
ugcuuacugaauguuaauuuc

SEQ ID NO: 106595 - RNA, 18 nt, Homo sapiens
ugcuuagucauuuucaau

SEQ ID NO: 106596 - RNA, 22 nt, Homo sapiens
ugcuuagucuugcuuuagcuau

SEQ ID NO: 106597 - RNA, 22 nt, Homo sapiens
ugcuuaguuguauguuccacau

SEQ ID NO: 106598 - RNA, 22 nt, Homo sapiens
uggaagacuuuagaggcuuaua

SEQ ID NO: 106599 - RNA, 22 nt, Homo sapiens
uggaagcauagcagcgugugug

SEQ ID NO: 106600 - RNA, 22 nt, Homo sapiens
uggacaugaagggcacaggagg

SEQ ID NO: 106601 - RNA, 22 nt, Homo sapiens
uggacauguacauauguguaug

SEQ ID NO: 106602 - RNA, 22 nt, Homo sapiens
uggagguaggacgaagaacucu

SEQ ID NO: 106603 - RNA, 22 nt, Homo sapiens
uggcaaauuccaaaguuaauuc

SEQ ID NO: 106604 - RNA, 22 nt, Homo sapiens
uggcaacaucuggggacauguu

SEQ ID NO: 106605 - RNA, 18 nt, Homo sapiens
uggcaauaugguucuacc

SEQ ID NO: 106606 - RNA, 22 nt, Homo sapiens
uggcagaugcucuuggugccca

SEQ ID NO: 106607 - RNA, 22 nt, Homo sapiens
uggcauguaaugcagaaguugc

SEQ ID NO: 106608 - RNA, 23 nt, Homo sapiens
uggcauuuuuggcaaugccuucu

SEQ ID NO: 106609 - RNA, 22 nt, Homo sapiens
uggccagagggcaauuagcugu

SEQ ID NO: 106610 - RNA, 20 nt, Homo sapiens
uggcuaaaugaaugauagca

SEQ ID NO: 106611 - RNA, 22 nt, Homo sapiens
uggcuaagaugcacacuucacu

SEQ ID NO: 106612 - RNA, 22 nt, Homo sapiens
uggcuuuuauuauguugaggua

SEQ ID NO: 106613 - RNA, 22 nt, Homo sapiens
uggcuuuuguuauuuggaagcu

SEQ ID NO: 106614 - RNA, 22 nt, Homo sapiens
ugggaagcugcauuuuaacaag

SEQ ID NO: 106615 - RNA, 22 nt, Homo sapiens
ugggaugaaaauagcuucuucc

SEQ ID NO: 106616 - RNA, 22 nt, Homo sapiens
ugguaaguuuaacaugcauccc

SEQ ID NO: 106617 - RNA, 22 nt, Homo sapiens
uguaagugugcaauucagugau

SEQ ID NO: 106618 - RNA, 22 nt, Homo sapiens
uguaaugaucaaaucagaguaa

SEQ ID NO: 106619 - RNA, 22 nt, Homo sapiens
ugucacaguuuguacuuuauag

SEQ ID NO: 106620 - RNA, 22 nt, Homo sapiens
ugucauguggcuaacgauucau

SEQ ID NO: 106621 - RNA, 22 nt, Homo sapiens
ugucccugagccuggauuccug

SEQ ID NO: 106622 - RNA, 18 nt, Homo sapiens
ugucccuuugcuguucau

SEQ ID NO: 106623 - RNA, 22 nt, Homo sapiens
ugugcauagugugugcggggcg

SEQ ID NO: 106624 - RNA, 22 nt, Homo sapiens
ugugccacuccaaccuggguga

SEQ ID NO: 106625 - RNA, 22 nt, Homo sapiens
uguggaaauuguuguauuuaau

SEQ ID NO: 106626 - RNA, 22 nt, Homo sapiens
uguggcuuuuucuuggcugagg

SEQ ID NO: 106627 - RNA, 22 nt, Homo sapiens
uguguaaauaugauagaggaau

SEQ ID NO: 106628 - RNA, 22 nt, Homo sapiens
ugugucacugcacuccagccug

SEQ ID NO: 106629 - RNA, 22 nt, Homo sapiens
uguucuggagccgguucaaaug

SEQ ID NO: 106630 - RNA, 22 nt, Homo sapiens
uuaaaugcacauacuugagaaa

SEQ ID NO: 106631 - RNA, 22 nt, Homo sapiens
uuaaaugcuagaauuuucuuug

SEQ ID NO: 106632 - RNA, 19 nt, Homo sapiens
uuaagguacuuagaugugu

SEQ ID NO: 106633 - RNA, 22 nt, Homo sapiens
uuaaguaaucagagaagagaac

SEQ ID NO: 106634 - RNA, 21 nt, Homo sapiens
uuaaguaauuacccaacucuc

SEQ ID NO: 106635 - RNA, 22 nt, Homo sapiens
uuaaucaggccguuuccuaaga

SEQ ID NO: 106636 - RNA, 22 nt, Homo sapiens
uuaauguaucuaucacaucaca

SEQ ID NO: 106637 - RNA, 22 nt, Homo sapiens
uuaauuguaucuauagauguca

SEQ ID NO: 106638 - RNA, 22 nt, Homo sapiens
uuacagauggauggcagcuggc

SEQ ID NO: 106639 - RNA, 22 nt, Homo sapiens
uuaccacagugccugucuaaug

SEQ ID NO: 106640 - RNA, 22 nt, Homo sapiens
uuaccagagaagacgaggggga

SEQ ID NO: 106641 - RNA, 22 nt, Homo sapiens
uuagcacaguucauucauguua

SEQ ID NO: 106642 - RNA, 22 nt, Homo sapiens
uuagcagugugagcacagacua

SEQ ID NO: 106643 - RNA, 22 nt, Homo sapiens
uuaggcaggauaguuacauauu

SEQ ID NO: 106644 - RNA, 22 nt, Homo sapiens
uuauaacagagacuccugugcu

SEQ ID NO: 106645 - RNA, 22 nt, Homo sapiens
uuauauguuuguacuuaggccu

SEQ ID NO: 106646 - RNA, 23 nt, Homo sapiens
uucaaauguucucugguugucag

SEQ ID NO: 106647 - RNA, 22 nt, Homo sapiens
uucacugagccagacuaagaca

SEQ ID NO: 106648 - RNA, 22 nt, Homo sapiens
uucacugggugugguggcucac

SEQ ID NO: 106649 - RNA, 22 nt, Homo sapiens
uucacuguaaaaugaagagggu

SEQ ID NO: 106650 - RNA, 22 nt, Homo sapiens
uucacugugcuuaaauucugcu

SEQ ID NO: 106651 - RNA, 22 nt, Homo sapiens
uucaggcuccugugagaaucua

SEQ ID NO: 106652 - RNA, 22 nt, Homo sapiens
uucaguaguacauucccguguu

SEQ ID NO: 106653 - RNA, 22 nt, Homo sapiens
uucauagucacauucgaugucu

SEQ ID NO: 106654 - RNA, 23 nt, Homo sapiens
uucaucagggauauuggccugaa

SEQ ID NO: 106655 - RNA, 18 nt, Homo sapiens
uucaucaguccucagcug

SEQ ID NO: 106656 - RNA, 22 nt, Homo sapiens
uucauggaauauugaccauuuu

SEQ ID NO: 106657 - RNA, 20 nt, Homo sapiens
uucaugggagcaaagaggcc

SEQ ID NO: 106658 - RNA, 22 nt, Homo sapiens
uucauguaauauuucacagcuu

SEQ ID NO: 106659 - RNA, 22 nt, Homo sapiens
uucauugaaugauuuuuagaag

SEQ ID NO: 106660 - RNA, 22 nt, Homo sapiens
uucccugugugcagaugggugu

SEQ ID NO: 106661 - RNA, 22 nt, Homo sapiens
uucccuuuuuucuaguagguag

SEQ ID NO: 106662 - RNA, 22 nt, Homo sapiens
uuccuaguccugagucucugcg

SEQ ID NO: 106663 - RNA, 22 nt, Homo sapiens
uuccugugacccccaagcccac

SEQ ID NO: 106664 - RNA, 22 nt, Homo sapiens
uuccuuguuuauuuacaggagg

SEQ ID NO: 106665 - RNA, 22 nt, Homo sapiens
uucuaugguuuuuaugguguua

SEQ ID NO: 106666 - RNA, 22 nt, Homo sapiens
uucucuguggauugggugagag

SEQ ID NO: 106667 - RNA, 22 nt, Homo sapiens
uucuugcugaauugugcccuuc

SEQ ID NO: 106668 - RNA, 22 nt, Homo sapiens
uugaaggaggugcucacucucg

SEQ ID NO: 106669 - RNA, 22 nt, Homo sapiens
uugaaugaaaugaugucauuug

SEQ ID NO: 106670 - RNA, 22 nt, Homo sapiens
uugagagagaacauuuguuaca

SEQ ID NO: 106671 - RNA, 22 nt, Homo sapiens
uugagaugauggauaugcuaau

SEQ ID NO: 106672 - RNA, 22 nt, Homo sapiens
uugagauggagucucacucuuc

SEQ ID NO: 106673 - RNA, 22 nt, Homo sapiens
uugagauggagucuugcacugu

SEQ ID NO: 106674 - RNA, 22 nt, Homo sapiens
uugagauggagucuugcucucu

SEQ ID NO: 106675 - RNA, 22 nt, Homo sapiens
uugagauggagucuugcucugu

SEQ ID NO: 106676 - RNA, 22 nt, Homo sapiens
uugagauggagucuuguucucu

SEQ ID NO: 106677 - RNA, 22 nt, Homo sapiens
uugagauggagucuuguucuuu

SEQ ID NO: 106678 - RNA, 22 nt, Homo sapiens
uugagauggaguguugcucugu

SEQ ID NO: 106679 - RNA, 22 nt, Homo sapiens
uugagauggaguuucaauauug

SEQ ID NO: 106680 - RNA, 22 nt, Homo sapiens
uugagauguaagauguuaauau

SEQ ID NO: 106681 - RNA, 22 nt, Homo sapiens
uugagauguauguauauaaugu

SEQ ID NO: 106682 - RNA, 22 nt, Homo sapiens
uugaggacugcuaagcauuuga

SEQ ID NO: 106683 - RNA, 22 nt, Homo sapiens
uugaggaggcagucucuccauu

SEQ ID NO: 106684 - RNA, 22 nt, Homo sapiens
uugagggaagccagaggucugc

SEQ ID NO: 106685 - RNA, 22 nt, Homo sapiens
uugagggaggccucaguuuaca

SEQ ID NO: 106686 - RNA, 22 nt, Homo sapiens
uugaguauuugcagucugaaca

SEQ ID NO: 106687 - RNA, 22 nt, Homo sapiens
uugcauauucucugaggcagga

SEQ ID NO: 106688 - RNA, 18 nt, Homo sapiens
uugcaucauuuuguuguu

SEQ ID NO: 106689 - RNA, 22 nt, Homo sapiens
uugccaacauggugaacuccca

SEQ ID NO: 106690 - RNA, 22 nt, Homo sapiens
uugcucaggcuggaguacaaug

SEQ ID NO: 106691 - RNA, 22 nt, Homo sapiens
uuggaaacauuuaugguaacag

SEQ ID NO: 106692 - RNA, 22 nt, Homo sapiens
uuggaaacgucaccuuuuccuu

SEQ ID NO: 106693 - RNA, 22 nt, Homo sapiens
uuggcagcuguggaaucugggc

SEQ ID NO: 106694 - RNA, 22 nt, Homo sapiens
uuggucaaaucugaugggagaa

SEQ ID NO: 106695 - RNA, 23 nt, Homo sapiens
uuguaacuggagaguaacauucc

SEQ ID NO: 106696 - RNA, 22 nt, Homo sapiens
uuguacccuuucuaugaggcca

SEQ ID NO: 106697 - RNA, 22 nt, Homo sapiens
uugugaaaaaccucucguggaa

SEQ ID NO: 106698 - RNA, 22 nt, Homo sapiens
uugugauugagugauccuuguu

SEQ ID NO: 106699 - RNA, 22 nt, Homo sapiens
uugugcaaaaguaauugcgguu

SEQ ID NO: 106700 - RNA, 21 nt, Homo sapiens
uugugccaaacccuggaggga

SEQ ID NO: 106701 - RNA, 22 nt, Homo sapiens
uugugguuuucagcuuauauau

SEQ ID NO: 106702 - RNA, 22 nt, Homo sapiens
uuuacccugaggaaucuauuuu

SEQ ID NO: 106703 - RNA, 22 nt, Homo sapiens
uuuagcaaagcaauuuacacca

SEQ ID NO: 106704 - RNA, 22 nt, Homo sapiens
uuuauguggagcacuugacaca

SEQ ID NO: 106705 - RNA, 22 nt, Homo sapiens
uuucccauuguucugcucugug

SEQ ID NO: 106706 - RNA, 22 nt, Homo sapiens
uuucccugaaggcucugaaguc

SEQ ID NO: 106707 - RNA, 22 nt, Homo sapiens
uuucugggggugcugauggaaa

SEQ ID NO: 106708 - RNA, 22 nt, Homo sapiens
uuugacaaugugugcuuguauu

SEQ ID NO: 106709 - RNA, 22 nt, Homo sapiens
uuugacuuuuagaauaugaguu

SEQ ID NO: 106710 - RNA, 22 nt, Homo sapiens
uuugcacuggagauucaauggg

SEQ ID NO: 106711 - RNA, 22 nt, Homo sapiens
uuuggaaugugcacucagauug

SEQ ID NO: 106712 - RNA, 23 nt, Homo sapiens
uuuggcauuccagaaauuuucau

SEQ ID NO: 106713 - RNA, 22 nt, Homo sapiens
uuugguaauguuucauugcaga

SEQ ID NO: 106714 - RNA, 22 nt, Homo sapiens
uuugguguauaaaaaugcuagu

SEQ ID NO: 106715 - RNA, 22 nt, Homo sapiens
uuugguuauauauauacacucu

SEQ ID NO: 106716 - RNA, 22 nt, Homo sapiens
uuugucauagcagcaggaaugg

SEQ ID NO: 106717 - RNA, 22 nt, Homo sapiens
uuugugcaaacuaggauugcga

SEQ ID NO: 106718 - RNA, 22 nt, Homo sapiens
uuugugcaugaagagggggugc

SEQ ID NO: 106719 - RNA, 22 nt, Homo sapiens
uuugugucccuacccgaaucuc

SEQ ID NO: 106720 - RNA, 22 nt, Homo sapiens
uuugugucccucuaaaauuuau

SEQ ID NO: 106721 - RNA, 23 nt, Homo sapiens
uuugugucccucuagaauucaug

SEQ ID NO: 106722 - RNA, 22 nt, Homo sapiens
uuuugcuuuuccucggucccac

SEQ ID NO: 106723 - RNA, 22 nt, Homo sapiens
uuuugggggugauucacacagu

SEQ ID NO: 106724 - RNA, 22 nt, Homo sapiens
uuuugguaaugaacuuaggaag

SEQ ID NO: 106725 - RNA, 22 nt, Homo sapiens
uuuugguauauacggggguccu

SEQ ID NO: 106726 - RNA, 22 nt, Homo sapiens
uuuuugguugguaggcuauuaa

SEQ ID NO: 106727 - RNA, 22 nt, Homo sapiens
uuuuugugguauauugcaacaa

SEQ ID NO: 106728 - RNA, 22 nt, Homo sapiens
aauaagaaguggaagggaccgg

SEQ ID NO: 106729 - RNA, 19 nt, Homo sapiens
aauaaugccagaugucugu

SEQ ID NO: 106730 - RNA, 22 nt, Homo sapiens
aauaaugucacaggggguuagc

SEQ ID NO: 106731 - RNA, 19 nt, Homo sapiens
aauauugacaguggugucu

SEQ ID NO: 106732 - RNA, 22 nt, Homo sapiens
aaugucaucuucaguuguacag

SEQ ID NO: 106733 - RNA, 22 nt, Homo sapiens
aauucacuuguggcagauccuu

SEQ ID NO: 106734 - RNA, 22 nt, Homo sapiens
acacagugucuguguauuuaaa

SEQ ID NO: 106735 - RNA, 22 nt, Homo sapiens
acaccauugcauuccagccugg

SEQ ID NO: 106736 - RNA, 22 nt, Homo sapiens
acagagcaaugagcuacggucu

SEQ ID NO: 106737 - RNA, 22 nt, Homo sapiens
acagcagugccccacucuacug

SEQ ID NO: 106738 - RNA, 22 nt, Homo sapiens
acagugcugucugcuuuggcua

SEQ ID NO: 106739 - RNA, 22 nt, Homo sapiens
acagugcuucugauaugaugcc

SEQ ID NO: 106740 - RNA, 22 nt, Homo sapiens
acagugcuuggcacacaguaau

SEQ ID NO: 106741 - RNA, 22 nt, Homo sapiens
acauguauauaaugcauagcga

SEQ ID NO: 106742 - RNA, 22 nt, Homo sapiens
accaguguuuaccaaguagcau

SEQ ID NO: 106743 - RNA, 17 nt, Homo sapiens
accccuaccucagaagc

SEQ ID NO: 106744 - RNA, 22 nt, Homo sapiens
acccucagaccaguuucccugg

SEQ ID NO: 106745 - RNA, 22 nt, Homo sapiens
acccuggaggucuacagugcag

SEQ ID NO: 106746 - RNA, 22 nt, Homo sapiens
acccuggauucguggccuugaa

SEQ ID NO: 106747 - RNA, 22 nt, Homo sapiens
acccugucaaaacggaccaauc

SEQ ID NO: 106748 - RNA, 21 nt, Homo sapiens
accugauguuucaguuggagu

SEQ ID NO: 106749 - RNA, 23 nt, Homo sapiens
accugauguuucuguggggagcc

SEQ ID NO: 106750 - RNA, 22 nt, Homo sapiens
acugagccuuuaaaugacuuca

SEQ ID NO: 106751 - RNA, 22 nt, Homo sapiens
acugcacuccaccuugggcaac

SEQ ID NO: 106752 - RNA, 22 nt, Homo sapiens
acuguacucuacccugggcaac

SEQ ID NO: 106753 - RNA, 22 nt, Homo sapiens
acuuuuugauggggagaacauu

SEQ ID NO: 106754 - RNA, 22 nt, Homo sapiens
agaacccuuugaaauguguuug

SEQ ID NO: 106755 - RNA, 22 nt, Homo sapiens
agaauguaacucuaugaaggca

SEQ ID NO: 106756 - RNA, 22 nt, Homo sapiens
agacacugaaauguauugaaga

SEQ ID NO: 106757 - RNA, 19 nt, Homo sapiens
agagacucauuguagcauu

SEQ ID NO: 106758 - RNA, 22 nt, Homo sapiens
agagcaaugggugaauauuaaa

SEQ ID NO: 106759 - RNA, 22 nt, Homo sapiens
agaugauguuuacugagcauca

SEQ ID NO: 106760 - RNA, 22 nt, Homo sapiens
agaugauguuucuggcacauga

SEQ ID NO: 106761 - RNA, 22 nt, Homo sapiens
agcagcaauuuuguaugguuua

SEQ ID NO: 106762 - RNA, 22 nt, Homo sapiens
agcagcuuugcauggccugugg

SEQ ID NO: 106763 - RNA, 22 nt, Homo sapiens
agcagguauucgggucaugggg

SEQ ID NO: 106764 - RNA, 20 nt, Homo sapiens
agcaucauugcaauuuguca

SEQ ID NO: 106765 - RNA, 22 nt, Homo sapiens
agcaucauuugauguucccgag

SEQ ID NO: 106766 - RNA, 19 nt, Homo sapiens
agccaguuuucccagcacc

SEQ ID NO: 106767 - RNA, 22 nt, Homo sapiens
agcccauguggcugaggcuucu

SEQ ID NO: 106768 - RNA, 20 nt, Homo sapiens
agccccauguaaaccacaug

SEQ ID NO: 106769 - RNA, 22 nt, Homo sapiens
agcggcuguuccccuggucuau

SEQ ID NO: 106770 - RNA, 22 nt, Homo sapiens
agcuccuuugcuuuuuccagga

SEQ ID NO: 106771 - RNA, 22 nt, Homo sapiens
agcugcacaaauggaugugagg

SEQ ID NO: 106772 - RNA, 22 nt, Homo sapiens
agcuucauuccaacuuccuucu

SEQ ID NO: 106773 - RNA, 23 nt, Homo sapiens
aggaaguaacuaucuuuucuguc

SEQ ID NO: 106774 - RNA, 22 nt, Homo sapiens
aggagaauugguucuucuugau

SEQ ID NO: 106775 - RNA, 22 nt, Homo sapiens
aggagcacaggacuuugauuau

SEQ ID NO: 106776 - RNA, 23 nt, Homo sapiens
aggagcuuagaaguugccauugc

SEQ ID NO: 106777 - RNA, 22 nt, Homo sapiens
aggagguagggugugaaacagc

SEQ ID NO: 106778 - RNA, 22 nt, Homo sapiens
aggcuagaaucuuccaucuugg

SEQ ID NO: 106779 - RNA, 22 nt, Homo sapiens
aggcuagacuuugagaauuuuu

SEQ ID NO: 106780 - RNA, 22 nt, Homo sapiens
agggcuuguuuaacuaucauua

SEQ ID NO: 106781 - RNA, 22 nt, Homo sapiens
agguauguauguaugggagaaa

SEQ ID NO: 106782 - RNA, 21 nt, Homo sapiens
aggucaugaagauguucuaau

SEQ ID NO: 106783 - RNA, 20 nt, Homo sapiens
agguuauuauaauuagaaga

SEQ ID NO: 106784 - RNA, 20 nt, Homo sapiens
aguauucacuuuuuucaugg

SEQ ID NO: 106785 - RNA, 22 nt, Homo sapiens
agucaagugggguuagauaguu

SEQ ID NO: 106786 - RNA, 22 nt, Homo sapiens
agucagauuggcauuuguuggg

SEQ ID NO: 106787 - RNA, 21 nt, Homo sapiens
agucauaggaguacauaaugc

SEQ ID NO: 106788 - RNA, 22 nt, Homo sapiens
agucaugggagagaugugaucg

SEQ ID NO: 106789 - RNA, 17 nt, Homo sapiens
agugagaucauggcuua

SEQ ID NO: 106790 - RNA, 22 nt, Homo sapiens
aguggaaucuguuauacuaacu

SEQ ID NO: 106791 - RNA, 23 nt, Homo sapiens
aguggucuccugggcccagcugu

SEQ ID NO: 106792 - RNA, 22 nt, Homo sapiens
aguguuuuucaugggauacuuu

SEQ ID NO: 106793 - RNA, 22 nt, Homo sapiens
auaaaugcuuccagucauuaaa

SEQ ID NO: 106794 - RNA, 20 nt, Homo sapiens
auaaauguauagguguacau

SEQ ID NO: 106795 - RNA, 22 nt, Homo sapiens
auacaugugccaugcuggugug

SEQ ID NO: 106796 - RNA, 22 nt, Homo sapiens
auacauguucaagggcauauau

SEQ ID NO: 106797 - RNA, 22 nt, Homo sapiens
auagcagcaccccacuaccuca

SEQ ID NO: 106798 - RNA, 22 nt, Homo sapiens
auauaccuaggcuacaugguuu

SEQ ID NO: 106799 - RNA, 22 nt, Homo sapiens
auauggcauucagaacuguaua

SEQ ID NO: 106800 - RNA, 22 nt, Homo sapiens
auauggcuaugugagcauacca

SEQ ID NO: 106801 - RNA, 22 nt, Homo sapiens
auauuacagagaggaccuggga

SEQ ID NO: 106802 - RNA, 22 nt, Homo sapiens
aucaaguaaucugaguaagagu

SEQ ID NO: 106803 - RNA, 22 nt, Homo sapiens
aucacagaguuaaaacuuucuu

SEQ ID NO: 106804 - RNA, 22 nt, Homo sapiens
aucacauggccagguaguaauc

SEQ ID NO: 106805 - RNA, 22 nt, Homo sapiens
aucagaaucucuagaggacugu

SEQ ID NO: 106806 - RNA, 22 nt, Homo sapiens
auccaucagacggcaggcguug

SEQ ID NO: 106807 - RNA, 22 nt, Homo sapiens
aucccuguaacuagcagccccu

SEQ ID NO: 106808 - RNA, 22 nt, Homo sapiens
aucccugugacgagcaucccua

SEQ ID NO: 106809 - RNA, 22 nt, Homo sapiens
augaaaacaugauuugccuguu

SEQ ID NO: 106810 - RNA, 22 nt, Homo sapiens
augaagugcaugauaguugguu

SEQ ID NO: 106811 - RNA, 22 nt, Homo sapiens
augaauacugcugcaaugaaca

SEQ ID NO: 106812 - RNA, 22 nt, Homo sapiens
augagacaguucccuuuaucuu

SEQ ID NO: 106813 - RNA, 22 nt, Homo sapiens
augagagcaacaccuucacuug

SEQ ID NO: 106814 - RNA, 22 nt, Homo sapiens
augagagugagagcagccccuu

SEQ ID NO: 106815 - RNA, 22 nt, Homo sapiens
augagaugcaagauuagauggg

SEQ ID NO: 106816 - RNA, 22 nt, Homo sapiens
augagcagaugcuccugccucu

SEQ ID NO: 106817 - RNA, 22 nt, Homo sapiens
augagggagggcaccugaccuu

SEQ ID NO: 106818 - RNA, 22 nt, Homo sapiens
augauauggucacccuuaugaa

SEQ ID NO: 106819 - RNA, 22 nt, Homo sapiens
uuugccaauauuuuacugagga

SEQ ID NO: 106820 - RNA, 22 nt, Homo sapiens
uuugccaaucagaggcaucuug

SEQ ID NO: 106821 - RNA, 22 nt, Homo sapiens
uuugcuuaaaucuuaaucagau

SEQ ID NO: 106822 - RNA, 22 nt, Homo sapiens
uuugcuucacuguuuggcaaaa

SEQ ID NO: 106823 - RNA, 22 nt, Homo sapiens
acccagaagucauucaggaaca

SEQ ID NO: 106824 - RNA, 22 nt, Homo sapiens
acccgcccagguguggccggga

SEQ ID NO: 106825 - RNA, 22 nt, Homo sapiens
acuaugcuuuucuuagaauuaa

SEQ ID NO: 106826 - RNA, 22 nt, Homo sapiens
acugcacuccagccuccugaca

SEQ ID NO: 106827 - RNA, 22 nt, Homo sapiens
acugcacuccagccucggcaau

SEQ ID NO: 106828 - RNA, 22 nt, Homo sapiens
acugcacuccagccugaugaaa

SEQ ID NO: 106829 - RNA, 22 nt, Homo sapiens
acugcacuccagccugccgaca

SEQ ID NO: 106830 - RNA, 18 nt, Homo sapiens
acugcacuccauccuagg

SEQ ID NO: 106831 - RNA, 22 nt, Homo sapiens
acugcacucuagccuuggcaac

SEQ ID NO: 106832 - RNA, 22 nt, Homo sapiens
acuguacuccagccugggcaac

SEQ ID NO: 106833 - RNA, 22 nt, Homo sapiens
acugugcuguuuuaauuauuga

SEQ ID NO: 106834 - RNA, 22 nt, Homo sapiens
acuucauucucuggaucagaau

SEQ ID NO: 106835 - RNA, 22 nt, Homo sapiens
acuuuuguuauacagugugaua

SEQ ID NO: 106836 - RNA, 22 nt, Homo sapiens
agaaccauuagagggagauauu

SEQ ID NO: 106837 - RNA, 20 nt, Homo sapiens
agaagcauugcucucuucag

SEQ ID NO: 106838 - RNA, 22 nt, Homo sapiens
agacuagaaaucauuuguugag

SEQ ID NO: 106839 - RNA, 22 nt, Homo sapiens
agacuuagagagucuauucuau

SEQ ID NO: 106840 - RNA, 22 nt, Homo sapiens
agagaacuggcuucaccauucu

SEQ ID NO: 106841 - RNA, 22 nt, Homo sapiens
agagacauugcuccaacucacc

SEQ ID NO: 106842 - RNA, 22 nt, Homo sapiens
agagguaagcaguggcaagugc

SEQ ID NO: 106843 - RNA, 22 nt, Homo sapiens
agauacaucuaugugucugugu

SEQ ID NO: 106844 - RNA, 22 nt, Homo sapiens
agcaaccuugaauagcccuuuc

SEQ ID NO: 106845 - RNA, 22 nt, Homo sapiens
agcacagugaaugguuuacuca

SEQ ID NO: 106846 - RNA, 22 nt, Homo sapiens
agcacaguuaaaugaggcuucu

SEQ ID NO: 106847 - RNA, 19 nt, Homo sapiens
agcagaacaaauguguggg

SEQ ID NO: 106848 - RNA, 22 nt, Homo sapiens
agcagcuuugcauggccuguga

SEQ ID NO: 106849 - RNA, 22 nt, Homo sapiens
agcaucaugcaguugcuauuca

SEQ ID NO: 106850 - RNA, 17 nt, Homo sapiens
agcauguguuugagauu

SEQ ID NO: 106851 - RNA, 17 nt, Homo sapiens
agccccauuagcuaguu

SEQ ID NO: 106852 - RNA, 23 nt, Homo sapiens
agccugguuucccugcuucuccc

SEQ ID NO: 106853 - RNA, 21 nt, Homo sapiens
aggaagacuaugaucaauugg

SEQ ID NO: 106854 - RNA, 22 nt, Homo sapiens
aggaagugucuucuuuuaggca

SEQ ID NO: 106855 - RNA, 22 nt, Homo sapiens
aggaagugugcaauuaauuucu

SEQ ID NO: 106856 - RNA, 23 nt, Homo sapiens
aggaauggaaaaccaaguaucau

SEQ ID NO: 106857 - RNA, 21 nt, Homo sapiens
aggagcauuguugugguggag

SEQ ID NO: 106858 - RNA, 22 nt, Homo sapiens
aggagguagucugucccuuagc

SEQ ID NO: 106859 - RNA, 22 nt, Homo sapiens
aggcaagcaucuugcucccuuc

SEQ ID NO: 106860 - RNA, 22 nt, Homo sapiens
aggugcugagcagagaauccug

SEQ ID NO: 106861 - RNA, 22 nt, Homo sapiens
aggugguuuugaugagcaggua

SEQ ID NO: 106862 - RNA, 22 nt, Homo sapiens
aguaacaggauccaaagaaugu

SEQ ID NO: 106863 - RNA, 22 nt, Homo sapiens
aguauuaggugaguguauuuca

SEQ ID NO: 106864 - RNA, 22 nt, Homo sapiens
agucaguguguauugauggcac

SEQ ID NO: 106865 - RNA, 22 nt, Homo sapiens
aguccagguuuuguaauggcaa

SEQ ID NO: 106866 - RNA, 22 nt, Homo sapiens
aguguaaugauauuuggagagg

SEQ ID NO: 106867 - RNA, 22 nt, Homo sapiens
agugucaggagacagguagcug

SEQ ID NO: 106868 - RNA, 22 nt, Homo sapiens
aguugcaagucuugaguaaaga

SEQ ID NO: 106869 - RNA, 22 nt, Homo sapiens
auaaagcaagucucuggccuca

SEQ ID NO: 106870 - RNA, 22 nt, Homo sapiens
auaaauucauuuaagcuccuua

SEQ ID NO: 106871 - RNA, 22 nt, Homo sapiens
auaacaggaaauacagggcuuu

SEQ ID NO: 106872 - RNA, 22 nt, Homo sapiens
auaauguuugauugagcagaua

SEQ ID NO: 106873 - RNA, 22 nt, Homo sapiens
auacuguacugaaguacccauu

SEQ ID NO: 106874 - RNA, 22 nt, Homo sapiens
auagaagcugccaacguuucag

SEQ ID NO: 106875 - RNA, 19 nt, Homo sapiens
auaguguaggaaaacagcu

SEQ ID NO: 106876 - RNA, 21 nt, Homo sapiens
auauggaacuggugacguguu

SEQ ID NO: 106877 - RNA, 22 nt, Homo sapiens
auaugucuauuauuagggcagg

SEQ ID NO: 106878 - RNA, 21 nt, Homo sapiens
auaugugcuguggaagucagc

SEQ ID NO: 106879 - RNA, 23 nt, Homo sapiens
aucagauaguuguagguaugugg

SEQ ID NO: 106880 - RNA, 22 nt, Homo sapiens
aucagauggcuaaaacagaaga

SEQ ID NO: 106881 - RNA, 22 nt, Homo sapiens
aucauauccuagauauaacuuc

SEQ ID NO: 106882 - RNA, 22 nt, Homo sapiens
aucaucacaguuguguguaaug

SEQ ID NO: 106883 - RNA, 22 nt, Homo sapiens
aucauguaguaagacacauuua

SEQ ID NO: 106884 - RNA, 22 nt, Homo sapiens
aucccuguaguaauauucuagc

SEQ ID NO: 106885 - RNA, 22 nt, Homo sapiens
aucccuuucugauacuuucccu

SEQ ID NO: 106886 - RNA, 22 nt, Homo sapiens
aucuugcauuugcuaaaaugca

SEQ ID NO: 106887 - RNA, 22 nt, Homo sapiens
augaauucaucugguuuuggga

SEQ ID NO: 106888 - RNA, 23 nt, Homo sapiens
augacacuguccuugaccauuuc

SEQ ID NO: 106889 - RNA, 22 nt, Homo sapiens
augagaugauaggcguucuaac

SEQ ID NO: 106890 - RNA, 23 nt, Homo sapiens
augagguaucugagcccagaaau

SEQ ID NO: 106891 - RNA, 20 nt, Homo sapiens
augagguguaugacacugaa

SEQ ID NO: 106892 - RNA, 19 nt, Homo sapiens
augaguuaggggaaauuuc

SEQ ID NO: 106893 - RNA, 22 nt, Homo sapiens
augauacuguucuaagauuuuu

SEQ ID NO: 106894 - RNA, 22 nt, Homo sapiens
augcacauggcuaacuuuuuuc

SEQ ID NO: 106895 - RNA, 22 nt, Homo sapiens
augccaagaugagcacgcgucu

SEQ ID NO: 106896 - RNA, 22 nt, Homo sapiens
augccacugcacuucagccugc

SEQ ID NO: 106897 - RNA, 22 nt, Homo sapiens
augccacugcacuucagccugg

SEQ ID NO: 106898 - RNA, 22 nt, Homo sapiens
auggcucuggauagaaugcagg

SEQ ID NO: 106899 - RNA, 22 nt, Homo sapiens
augggcacugauguauucugug

SEQ ID NO: 106900 - RNA, 22 nt, Homo sapiens
auguaacugggacacaagccuc

SEQ ID NO: 106901 - RNA, 21 nt, Homo sapiens
auguaaugaagaagccacugg

SEQ ID NO: 106902 - RNA, 22 nt, Homo sapiens
auguaguagauauuuauggaaa

SEQ ID NO: 106903 - RNA, 22 nt, Homo sapiens
augugcauaugaagcacagaca

SEQ ID NO: 106904 - RNA, 22 nt, Homo sapiens
augugcuuuuuaaacagaugcu

SEQ ID NO: 106905 - RNA, 22 nt, Homo sapiens
auuaaauguuggacguauacau

SEQ ID NO: 106906 - RNA, 22 nt, Homo sapiens
auuccauuuguuaucacacccg

SEQ ID NO: 106907 - RNA, 22 nt, Homo sapiens
auucccuguagaauaaggaugg

SEQ ID NO: 106908 - RNA, 22 nt, Homo sapiens
auugcacuccagccuugugaca

SEQ ID NO: 106909 - RNA, 22 nt, Homo sapiens
auugcacugcagccugggcaac

SEQ ID NO: 106910 - RNA, 22 nt, Homo sapiens
auugcccaggcuggagugcagu

SEQ ID NO: 106911 - RNA, 22 nt, Homo sapiens
auugucauuuauaacuguguag

SEQ ID NO: 106912 - RNA, 21 nt, Homo sapiens
auuugguggcugugugacacu

SEQ ID NO: 106913 - RNA, 22 nt, Homo sapiens
auuuuugguugguaggcuauua

SEQ ID NO: 106914 - RNA, 22 nt, Homo sapiens
caaagucuucucauuaugucuu

SEQ ID NO: 106915 - RNA, 22 nt, Homo sapiens
acugcacuccagccuccugggu

SEQ ID NO: 106916 - RNA, 22 nt, Homo sapiens
acugcacuccagccuuggcaac

SEQ ID NO: 106917 - RNA, 22 nt, Homo sapiens
acugcacuccaguuugggcagc

SEQ ID NO: 106918 - RNA, 22 nt, Homo sapiens
acugcacuccggccuggcaaca

SEQ ID NO: 106919 - RNA, 21 nt, Homo sapiens
acuuucuguggcaguccauuc

SEQ ID NO: 106920 - RNA, 22 nt, Homo sapiens
agacacuguugaaaaggcccca

SEQ ID NO: 106921 - RNA, 22 nt, Homo sapiens
agacuagacagaugaacagcac

SEQ ID NO: 106922 - RNA, 19 nt, Homo sapiens
agacuggcccaggcgggug

SEQ ID NO: 106923 - RNA, 22 nt, Homo sapiens
agagcaaugacaugcuaugugg

SEQ ID NO: 106924 - RNA, 21 nt, Homo sapiens
agaggacugaccacagcccua

SEQ ID NO: 106925 - RNA, 22 nt, Homo sapiens
agaggaguacuacuccaagucu

SEQ ID NO: 106926 - RNA, 22 nt, Homo sapiens
agagguagaagauaggcuacag

SEQ ID NO: 106927 - RNA, 22 nt, Homo sapiens
agauucauccaaguuguugcau

SEQ ID NO: 106928 - RNA, 22 nt, Homo sapiens
agcacagugguuaaguuucuua

SEQ ID NO: 106929 - RNA, 22 nt, Homo sapiens
agcagauguuuagugagcgccu

SEQ ID NO: 106930 - RNA, 22 nt, Homo sapiens
agcagcgacacccuguggugag

SEQ ID NO: 106931 - RNA, 22 nt, Homo sapiens
agcagcuuugaucugaaugauu

SEQ ID NO: 106932 - RNA, 22 nt, Homo sapiens
agcaggacaauaugggaucagg

SEQ ID NO: 106933 - RNA, 22 nt, Homo sapiens
auguugcuugaaggcauuuugu

SEQ ID NO: 106934 - RNA, 22 nt, Homo sapiens
auuaaguaaugguuccaauaau

SEQ ID NO: 106935 - RNA, 22 nt, Homo sapiens
auuacacuuucuauucaaugag

SEQ ID NO: 106936 - RNA, 22 nt, Homo sapiens
auuauaugucaucacagacacc

SEQ ID NO: 106937 - RNA, 22 nt, Homo sapiens
auucacuuuuauagacaggucu

SEQ ID NO: 106938 - RNA, 22 nt, Homo sapiens
auuccacagccgauaccaugac

SEQ ID NO: 106939 - RNA, 22 nt, Homo sapiens
auuccagguggcgccauucaca

SEQ ID NO: 106940 - RNA, 22 nt, Homo sapiens
auugcacuccacccugggcaac

SEQ ID NO: 106941 - RNA, 22 nt, Homo sapiens
auugcacuccauccugggcaau

SEQ ID NO: 106942 - RNA, 22 nt, Homo sapiens
auugcagcccacccugggugau

SEQ ID NO: 106943 - RNA, 22 nt, Homo sapiens
auugcauugugaucuucccaga

SEQ ID NO: 106944 - RNA, 22 nt, Homo sapiens
auuguaauuuuagagaaagugg

SEQ ID NO: 106945 - RNA, 22 nt, Homo sapiens
auugucauuuucugagaaguaa

SEQ ID NO: 106946 - RNA, 22 nt, Homo sapiens
auuguguuugaaugaggcucca

SEQ ID NO: 106947 - RNA, 22 nt, Homo sapiens
auuugguaauauuuaaggacuu

SEQ ID NO: 106948 - RNA, 22 nt, Homo sapiens
auuugguuauucaguuguucag

SEQ ID NO: 106949 - RNA, 22 nt, Homo sapiens
caaaggcuuccacugcauccuu

SEQ ID NO: 106950 - RNA, 22 nt, Homo sapiens
caaagugguuuauacaugauug

SEQ ID NO: 106951 - RNA, 22 nt, Homo sapiens
caaauccucaccucaucaugaa

SEQ ID NO: 106952 - RNA, 22 nt, Homo sapiens
caaugcagcuuuuggagagaaa

SEQ ID NO: 106953 - RNA, 22 nt, Homo sapiens
uuauuguccaaguuucccuuug

SEQ ID NO: 106954 - RNA, 22 nt, Homo sapiens
uuauuugguuauuguaauuggg

SEQ ID NO: 106955 - RNA, 22 nt, Homo sapiens
uucaaaguaaaaauguguucac

SEQ ID NO: 106956 - RNA, 22 nt, Homo sapiens
uucaaaguguugguuuugggcu

SEQ ID NO: 106957 - RNA, 22 nt, Homo sapiens
uucaaaguuggaggacaaacug

SEQ ID NO: 106958 - RNA, 22 nt, Homo sapiens
uucaagcugggcaaauaagggg

SEQ ID NO: 106959 - RNA, 22 nt, Homo sapiens
uucacagacaacuggucccuua

SEQ ID NO: 106960 - RNA, 22 nt, Homo sapiens
uucacagagagaacucaaacca

SEQ ID NO: 106961 - RNA, 22 nt, Homo sapiens
uucacaguacucccuggaauua

SEQ ID NO: 106962 - RNA, 22 nt, Homo sapiens
uucaccagggaagucucaacuc

SEQ ID NO: 106963 - RNA, 20 nt, Homo sapiens
uucagcaaaggaaugggagu

SEQ ID NO: 106964 - RNA, 22 nt, Homo sapiens
uucaguacuucaaaaucuuuaa

SEQ ID NO: 106965 - RNA, 18 nt, Homo sapiens
uucaguuuguaucugggg

SEQ ID NO: 106966 - RNA, 22 nt, Homo sapiens
uucaucagcuguagaugucaug

SEQ ID NO: 106967 - RNA, 22 nt, Homo sapiens
uuccaguguguucauccucaga

SEQ ID NO: 106968 - RNA, 22 nt, Homo sapiens
uuccaguguuugacucaccuuu

SEQ ID NO: 106969 - RNA, 22 nt, Homo sapiens
uucccuagaacacauggaggga

SEQ ID NO: 106970 - RNA, 22 nt, Homo sapiens
uucccugagcaucuguugagcc

SEQ ID NO: 106971 - RNA, 22 nt, Homo sapiens
uucccuguaucuucugccaugu

SEQ ID NO: 106972 - RNA, 22 nt, Homo sapiens
uuccugagagggcugggugcag

SEQ ID NO: 106973 - RNA, 22 nt, Homo sapiens
uuccugcacuugcuugccuaug

SEQ ID NO: 106974 - RNA, 22 nt, Homo sapiens
uucuccugguggacccuaaacg

SEQ ID NO: 106975 - RNA, 22 nt, Homo sapiens
uucugacuggugugagauggua

SEQ ID NO: 106976 - RNA, 22 nt, Homo sapiens
uucugagguuauauucucucaa

SEQ ID NO: 106977 - RNA, 22 nt, Homo sapiens
uucugguuaauacuugcaaaaa

SEQ ID NO: 106978 - RNA, 22 nt, Homo sapiens
uugaaauguuuagaaguuugga

SEQ ID NO: 106979 - RNA, 22 nt, Homo sapiens
uugaagacuaccuaccauacuu

SEQ ID NO: 106980 - RNA, 22 nt, Homo sapiens
uugaaggaggugcucacucucg

SEQ ID NO: 106981 - RNA, 22 nt, Homo sapiens
uugaagugaagaacaauaucac

SEQ ID NO: 106982 - RNA, 22 nt, Homo sapiens
uugacaaggagccauugcaucu

SEQ ID NO: 106983 - RNA, 19 nt, Homo sapiens
uugagaugugaacucacac

SEQ ID NO: 106984 - RNA, 22 nt, Homo sapiens
uugagcaaugucacugaggcuu

SEQ ID NO: 106985 - RNA, 22 nt, Homo sapiens
uugagcucuuccagccuggagc

SEQ ID NO: 106986 - RNA, 22 nt, Homo sapiens
uugaggaaugugauuucaaaua

SEQ ID NO: 106987 - RNA, 22 nt, Homo sapiens
uugagggagcacagauucuuau

SEQ ID NO: 106988 - RNA, 22 nt, Homo sapiens
uugagggcugaauaccaaucag

SEQ ID NO: 106989 - RNA, 22 nt, Homo sapiens
uugagguaguacuuauuauugg

SEQ ID NO: 106990 - RNA, 22 nt, Homo sapiens
uugaugauguuucugccuugcc

SEQ ID NO: 106991 - RNA, 22 nt, Homo sapiens
uugcaaugugaugugauuugga

SEQ ID NO: 106992 - RNA, 22 nt, Homo sapiens
uugcagagaaauuucugguuua

SEQ ID NO: 106993 - RNA, 22 nt, Homo sapiens
uugcagagccccacacugggcu

SEQ ID NO: 106994 - RNA, 22 nt, Homo sapiens
uugcaugggagcugggugaagc

SEQ ID NO: 106995 - RNA, 22 nt, Homo sapiens
uugccaacauggugaacuccca

SEQ ID NO: 106996 - RNA, 22 nt, Homo sapiens
uugcuggugguucgagcaacac

SEQ ID NO: 106997 - RNA, 22 nt, Homo sapiens
uuggaaaugguaaaggguuaau

SEQ ID NO: 106998 - RNA, 20 nt, Homo sapiens
uuggaaaugugaauugggag

SEQ ID NO: 106999 - RNA, 22 nt, Homo sapiens
uuggaaauguguuugcauucag

SEQ ID NO: 107000 - RNA, 22 nt, Homo sapiens
uuggaagacauucugucugcua

SEQ ID NO: 107001 - RNA, 22 nt, Homo sapiens
uuggaagauuacuuaguuuucu

SEQ ID NO: 107002 - RNA, 22 nt, Homo sapiens
uuggaaggcuccuaaugaaugg

SEQ ID NO: 107003 - RNA, 22 nt, Homo sapiens
uuggaaggcugaauggccucuc

SEQ ID NO: 107004 - RNA, 22 nt, Homo sapiens
uuggaaugcacacugagccugc

SEQ ID NO: 107005 - RNA, 22 nt, Homo sapiens
uuggaauguauggcaucuugcg

SEQ ID NO: 107006 - RNA, 22 nt, Homo sapiens
uuggaaugugacugauaauauu

SEQ ID NO: 107007 - RNA, 22 nt, Homo sapiens
uuggagcccuaacucucaguac

SEQ ID NO: 107008 - RNA, 22 nt, Homo sapiens
uuggcaaagaggaaugccacuu

SEQ ID NO: 107009 - RNA, 22 nt, Homo sapiens
uuggccgugucauuugcuuuga

SEQ ID NO: 107010 - RNA, 22 nt, Homo sapiens
uuggccuccuggucauauccag

SEQ ID NO: 107011 - RNA, 23 nt, Homo sapiens
uugggcaaaucacuaacgucucc

SEQ ID NO: 107012 - RNA, 22 nt, Homo sapiens
uuguaaagaucauaugcuguuc

SEQ ID NO: 107013 - RNA, 22 nt, Homo sapiens
uuguccacugcuagccucugca

SEQ ID NO: 107014 - RNA, 22 nt, Homo sapiens
uugucccauggggucuuccuuu

SEQ ID NO: 107015 - RNA, 22 nt, Homo sapiens
uuguccuggagguucuugcaag

SEQ ID NO: 107016 - RNA, 22 nt, Homo sapiens
uugugaucauugucaaauagug

SEQ ID NO: 107017 - RNA, 20 nt, Homo sapiens
uugugcauugggccauuggg

SEQ ID NO: 107018 - RNA, 22 nt, Homo sapiens
uugugggaggugauuagaucau

SEQ ID NO: 107019 - RNA, 22 nt, Homo sapiens
uuguguuugaugcugacacgca

SEQ ID NO: 107020 - RNA, 22 nt, Homo sapiens
uuuaaagcuaaaauauguuuau

SEQ ID NO: 107021 - RNA, 20 nt, Homo sapiens
uuuaagacaugcugaauuga

SEQ ID NO: 107022 - RNA, 23 nt, Homo sapiens
uuuaagcuucauguccuaacauc

SEQ ID NO: 107023 - RNA, 22 nt, Homo sapiens
uuuaauguuacaguauugguau

SEQ ID NO: 107024 - RNA, 22 nt, Homo sapiens
uuuacagucuuuugugugaguc

SEQ ID NO: 107025 - RNA, 22 nt, Homo sapiens
uuuccagguggccaacauuuua

SEQ ID NO: 107026 - RNA, 22 nt, Homo sapiens
uuucugugguccucuugaaggu

SEQ ID NO: 107027 - RNA, 23 nt, Homo sapiens
uuugagugugauaaacacuguca

SEQ ID NO: 107028 - RNA, 22 nt, Homo sapiens
gagauacacccagugcagaggc

SEQ ID NO: 107029 - RNA, 22 nt, Homo sapiens
gagaugaaaucuugcucuguca

SEQ ID NO: 107030 - RNA, 22 nt, Homo sapiens
gagauggagucuuuuucuguca

SEQ ID NO: 107031 - RNA, 22 nt, Homo sapiens
gagaugguguuccacugccagu

SEQ ID NO: 107032 - RNA, 22 nt, Homo sapiens
gagcuggacuucuuaccuuuuc

SEQ ID NO: 107033 - RNA, 22 nt, Homo sapiens
gagcugguccuuuaaggaugca

SEQ ID NO: 107034 - RNA, 22 nt, Homo sapiens
gagcuguugguuugaaagaauu

SEQ ID NO: 107035 - RNA, 22 nt, Homo sapiens
gaggaguagggcacaaagccuu

SEQ ID NO: 107036 - RNA, 22 nt, Homo sapiens
gagguaaguggauuaugagguc

SEQ ID NO: 107037 - RNA, 22 nt, Homo sapiens
gagguagaauguuuuucagcug

SEQ ID NO: 107038 - RNA, 22 nt, Homo sapiens
gaggucauguggcaggcagcca

SEQ ID NO: 107039 - RNA, 22 nt, Homo sapiens
gaggucauucugugguacccag

SEQ ID NO: 107040 - RNA, 22 nt, Homo sapiens
gaggucuuacauuuuaauauuu

SEQ ID NO: 107041 - RNA, 22 nt, Homo sapiens
gaggugaaggucucaauaaaua

SEQ ID NO: 107042 - RNA, 22 nt, Homo sapiens
gagugcaauggcaagaucuugg

SEQ ID NO: 107043 - RNA, 18 nt, Homo sapiens
gauaacaguggacuaugc

SEQ ID NO: 107044 - RNA, 22 nt, Homo sapiens
gaucacaguuccucacgggcau

SEQ ID NO: 107045 - RNA, 22 nt, Homo sapiens
gauggaauuaaaaucagaauca

SEQ ID NO: 107046 - RNA, 22 nt, Homo sapiens
gaugguuuuuuaagaagagccu

SEQ ID NO: 107047 - RNA, 22 nt, Homo sapiens
gcaaaugcuacaccauuuugua

SEQ ID NO: 107048 - RNA, 22 nt, Homo sapiens
gcaagagguaucuuauuuuccc

SEQ ID NO: 107049 - RNA, 22 nt, Homo sapiens
gcacccugucaaaauggaccaa

SEQ ID NO: 107050 - RNA, 22 nt, Homo sapiens
gcaucacagcuccugugcuggc

SEQ ID NO: 107051 - RNA, 19 nt, Homo sapiens
gcaucauuaguugcuuuuc

SEQ ID NO: 107052 - RNA, 22 nt, Homo sapiens
gccaaaaugcugggauuacagg

SEQ ID NO: 107053 - RNA, 22 nt, Homo sapiens
gcccuuugugucuggcuggggu

SEQ ID NO: 107054 - RNA, 22 nt, Homo sapiens
gccuagggacaaaccguccgac

SEQ ID NO: 107055 - RNA, 22 nt, Homo sapiens
gcuaaaucuguaaaaugaggag

SEQ ID NO: 107056 - RNA, 22 nt, Homo sapiens
gcuaaggcagggcaaucauuug

SEQ ID NO: 107057 - RNA, 22 nt, Homo sapiens
gcuggguucagagugggcugcg

SEQ ID NO: 107058 - RNA, 22 nt, Homo sapiens
gcuguaguugaggauuuuaaga

SEQ ID NO: 107059 - RNA, 22 nt, Homo sapiens
gcuguauuguugaaggaaaugu

SEQ ID NO: 107060 - RNA, 22 nt, Homo sapiens
gcuuguguucaagucacccuua

SEQ ID NO: 107061 - RNA, 22 nt, Homo sapiens
ggaagaauauuaggggauuucg

SEQ ID NO: 107062 - RNA, 22 nt, Homo sapiens
ggaagccugcacucgggcaggg

SEQ ID NO: 107063 - RNA, 22 nt, Homo sapiens
ggaagccuggaaaaaauuguga

SEQ ID NO: 107064 - RNA, 22 nt, Homo sapiens
ggaaucugaaccaugggaaugg

SEQ ID NO: 107065 - RNA, 23 nt, Homo sapiens
ggaaugaaaccugguuaugauau

SEQ ID NO: 107066 - RNA, 22 nt, Homo sapiens
ggaaugggauuugaagucuggc

SEQ ID NO: 107067 - RNA, 22 nt, Homo sapiens
ggagggugagaucaauuuggga

SEQ ID NO: 107068 - RNA, 22 nt, Homo sapiens
ggaguaggcuguccggcaccca

SEQ ID NO: 107069 - RNA, 22 nt, Homo sapiens
ggagugucccaaucucagcuca

SEQ ID NO: 107070 - RNA, 22 nt, Homo sapiens
ggagugugauuguucucuguua

SEQ ID NO: 107071 - RNA, 23 nt, Homo sapiens
ggauggaaaguuuugagggccac

SEQ ID NO: 107072 - RNA, 22 nt, Homo sapiens
ggcaagauagauaucaguguca

SEQ ID NO: 107073 - RNA, 22 nt, Homo sapiens
ggcaagaucuuggcucacugaa

SEQ ID NO: 107074 - RNA, 22 nt, Homo sapiens
ggcaaggaggggcacuuucacu

SEQ ID NO: 107075 - RNA, 19 nt, Homo sapiens
ggcaauacuuucuuguugg

SEQ ID NO: 107076 - RNA, 23 nt, Homo sapiens
ggcacggaauucaaagaggcauu

SEQ ID NO: 107077 - RNA, 22 nt, Homo sapiens
ggcagcauugccuuugcaguga

SEQ ID NO: 107078 - RNA, 22 nt, Homo sapiens
ggcaguguuauuauauuuuugg

SEQ ID NO: 107079 - RNA, 22 nt, Homo sapiens
ggcuagaauagggauagaccuu

SEQ ID NO: 107080 - RNA, 18 nt, Homo sapiens
ggcugguguuuuaguaua

SEQ ID NO: 107081 - RNA, 22 nt, Homo sapiens
gggaagaaggagugguuuacuc

SEQ ID NO: 107082 - RNA, 22 nt, Homo sapiens
gggaauguagcaaaucugcaau

SEQ ID NO: 107083 - RNA, 21 nt, Homo sapiens
gggcaaaucuuuauccuaagc

SEQ ID NO: 107084 - RNA, 23 nt, Homo sapiens
gggcuagaugagagcuuccuggg

SEQ ID NO: 107085 - RNA, 22 nt, Homo sapiens
ggugagauguucagacgaacug

SEQ ID NO: 107086 - RNA, 23 nt, Homo sapiens
ggugaggaguacagagucuucau

SEQ ID NO: 107087 - RNA, 22 nt, Homo sapiens
ggugcagcacaccaacauggca

SEQ ID NO: 107088 - RNA, 22 nt, Homo sapiens
guaaucucaccuacuugggagg

SEQ ID NO: 107089 - RNA, 22 nt, Homo sapiens
guaaucucagcuacucaggagg

SEQ ID NO: 107090 - RNA, 22 nt, Homo sapiens
guacaguacugaaugaauguau

SEQ ID NO: 107091 - RNA, 22 nt, Homo sapiens
guagaagcacagggccuguauu

SEQ ID NO: 107092 - RNA, 22 nt, Homo sapiens
guagcagcuacuaaguugcugu

SEQ ID NO: 107093 - RNA, 22 nt, Homo sapiens
guauaguaguacaaaaguuuuu

SEQ ID NO: 107094 - RNA, 22 nt, Homo sapiens
guauccugaaguucucagcacu

SEQ ID NO: 107095 - RNA, 22 nt, Homo sapiens
guaugguuuauagggaaauugu

SEQ ID NO: 107096 - RNA, 22 nt, Homo sapiens
guaugugacuggaacaguagga

SEQ ID NO: 107097 - RNA, 19 nt, Homo sapiens
gucaaagucgguauucaaa

SEQ ID NO: 107098 - RNA, 22 nt, Homo sapiens
gucaccagcuguguuagccccu

SEQ ID NO: 107099 - RNA, 22 nt, Homo sapiens
gucagggagggauagaugauua

SEQ ID NO: 107100 - RNA, 22 nt, Homo sapiens
gucauguuuaacuucuugagga

SEQ ID NO: 107101 - RNA, 22 nt, Homo sapiens
guccaaagugggagaggugggg

SEQ ID NO: 107102 - RNA, 22 nt, Homo sapiens
gucuaugguucaggguggagug

SEQ ID NO: 107103 - RNA, 22 nt, Homo sapiens
gucucccagccuacaucuuucu

SEQ ID NO: 107104 - RNA, 22 nt, Homo sapiens
gucugguugacagcauguggcc

SEQ ID NO: 107105 - RNA, 22 nt, Homo sapiens
gucuuccagccuccaucuuucu

SEQ ID NO: 107106 - RNA, 22 nt, Homo sapiens
gucuuggagaacucagcuuggc

SEQ ID NO: 107107 - RNA, 22 nt, Homo sapiens
gugagcauauuaguauugcacu

SEQ ID NO: 107108 - RNA, 22 nt, Homo sapiens
gugaucuucauggaaggugaaa

SEQ ID NO: 107109 - RNA, 22 nt, Homo sapiens
gugaugacauucagagaugaag

SEQ ID NO: 107110 - RNA, 22 nt, Homo sapiens
gugauuauuaugcacugcaugc

SEQ ID NO: 107111 - RNA, 21 nt, Homo sapiens
gugcaaacaucauagaaugua

SEQ ID NO: 107112 - RNA, 22 nt, Homo sapiens
gugcaagagugacugcaguuuu

SEQ ID NO: 107113 - RNA, 22 nt, Homo sapiens
gugcacaaaucuuaaauguaca

SEQ ID NO: 107114 - RNA, 22 nt, Homo sapiens
gugcacaacgugcaggcuuguu

SEQ ID NO: 107115 - RNA, 22 nt, Homo sapiens
gugcacaacguguagguuuguu

SEQ ID NO: 107116 - RNA, 22 nt, Homo sapiens
gugcacaaugugcagguuuguu

SEQ ID NO: 107117 - RNA, 22 nt, Homo sapiens
gugcauacucuggagacauugu

SEQ ID NO: 107118 - RNA, 22 nt, Homo sapiens
gugccuucuagcuaugguuggc

SEQ ID NO: 107119 - RNA, 22 nt, Homo sapiens
guggaaggucaugaauguucuu

SEQ ID NO: 107120 - RNA, 22 nt, Homo sapiens
guggaaugaaaacucucucaca

SEQ ID NO: 107121 - RNA, 22 nt, Homo sapiens
guggcagaaaagagaagcaaug

SEQ ID NO: 107122 - RNA, 22 nt, Homo sapiens
gugguuuuacaaagagaaagau

SEQ ID NO: 107123 - RNA, 22 nt, Homo sapiens
uagguuaugauccaucuuggcu

SEQ ID NO: 107124 - RNA, 22 nt, Homo sapiens
uagguugucaucagucuccacu

SEQ ID NO: 107125 - RNA, 22 nt, Homo sapiens
uaguccauuuucaugcugcuau

SEQ ID NO: 107126 - RNA, 22 nt, Homo sapiens
uaguguuuuucauuggcagagg

SEQ ID NO: 107127 - RNA, 22 nt, Homo sapiens
uaguucauuuuucuugcuuaga

SEQ ID NO: 107128 - RNA, 22 nt, Homo sapiens
uauauguuuucauaaggcuaga

SEQ ID NO: 107129 - RNA, 22 nt, Homo sapiens
uaucagagcugucagccuaccu

SEQ ID NO: 107130 - RNA, 22 nt, Homo sapiens
uaucagaguuacacugaagacu

SEQ ID NO: 107131 - RNA, 22 nt, Homo sapiens
uaucaguauggauucauggauu

SEQ ID NO: 107132 - RNA, 21 nt, Homo sapiens
uaucccagucacaucuaccca

SEQ ID NO: 107133 - RNA, 22 nt, Homo sapiens
uaugaaagcuacuucucacaau

SEQ ID NO: 107134 - RNA, 22 nt, Homo sapiens
uaugcaugucucuguacacgug

SEQ ID NO: 107135 - RNA, 22 nt, Homo sapiens
uauggcacuaguacuggaaagc

SEQ ID NO: 107136 - RNA, 22 nt, Homo sapiens
uauggcuuucuacuugaguucu

SEQ ID NO: 107137 - RNA, 22 nt, Homo sapiens
uauggguuuauuucuggucuca

SEQ ID NO: 107138 - RNA, 22 nt, Homo sapiens
uaugucuucuuuagagaaaugu

SEQ ID NO: 107139 - RNA, 22 nt, Homo sapiens
uauugcagauacccaggaaguu

SEQ ID NO: 107140 - RNA, 22 nt, Homo sapiens
uauugcagugagauccaucugg

SEQ ID NO: 107141 - RNA, 22 nt, Homo sapiens
uauuugcacucccaucauggug

SEQ ID NO: 107142 - RNA, 22 nt, Homo sapiens
ucaaaugauucuccugccucag

SEQ ID NO: 107143 - RNA, 22 nt, Homo sapiens
ucaaaugcuguauuguaguaau

SEQ ID NO: 107144 - RNA, 22 nt, Homo sapiens
ucaaaugguccacgugaacauu

SEQ ID NO: 107145 - RNA, 22 nt, Homo sapiens
ucaacauugcugucaggcaucu

SEQ ID NO: 107146 - RNA, 18 nt, Homo sapiens
ucacaaccacagugcugu

SEQ ID NO: 107147 - RNA, 22 nt, Homo sapiens
ucacaauguaaaugaggguugg

SEQ ID NO: 107148 - RNA, 22 nt, Homo sapiens
ucacacugaauuugaagcaaug

SEQ ID NO: 107149 - RNA, 19 nt, Homo sapiens
ucacacuguggcuucuuua

SEQ ID NO: 107150 - RNA, 22 nt, Homo sapiens
ucacacuguuuugauuauuaua

SEQ ID NO: 107151 - RNA, 21 nt, Homo sapiens
ucacagccuaggaccugaaga

SEQ ID NO: 107152 - RNA, 22 nt, Homo sapiens
ucacagcuaaaaugaaaguagu

SEQ ID NO: 107153 - RNA, 22 nt, Homo sapiens
ucacagucuccucuagggaggg

SEQ ID NO: 107154 - RNA, 22 nt, Homo sapiens
ucacagucugcgugaugagaca

SEQ ID NO: 107155 - RNA, 23 nt, Homo sapiens
ucacaguggcugcuuaauuguga

SEQ ID NO: 107156 - RNA, 22 nt, Homo sapiens
ucacaguucagcauggcugagg

SEQ ID NO: 107157 - RNA, 22 nt, Homo sapiens
ucacauguguaugagcuuugau

SEQ ID NO: 107158 - RNA, 22 nt, Homo sapiens
ucacauuguguagccugcucac

SEQ ID NO: 107159 - RNA, 22 nt, Homo sapiens
ucaccuggagaagauggaucau

SEQ ID NO: 107160 - RNA, 22 nt, Homo sapiens
ucaccuggagacaugaagacug

SEQ ID NO: 107161 - RNA, 22 nt, Homo sapiens
ucaccuugcacaguuguguggg

SEQ ID NO: 107162 - RNA, 23 nt, Homo sapiens
ucacggagaccugcaagaccaau

SEQ ID NO: 107163 - RNA, 22 nt, Homo sapiens
ucacucagaccuggugauaugc

SEQ ID NO: 107164 - RNA, 22 nt, Homo sapiens
ucacugcacucuccgccuugcg

SEQ ID NO: 107165 - RNA, 22 nt, Homo sapiens
ucacuggacagaaauaaaggug

SEQ ID NO: 107166 - RNA, 22 nt, Homo sapiens
ucacuguggaacucaaaaagcu

SEQ ID NO: 107167 - RNA, 22 nt, Homo sapiens
ucagaccauuucauuacagacu

SEQ ID NO: 107168 - RNA, 22 nt, Homo sapiens
ucagaugauucuguuguugugu

SEQ ID NO: 107169 - RNA, 22 nt, Homo sapiens
ucagcaaugaccuaagcaaaua

SEQ ID NO: 107170 - RNA, 23 nt, Homo sapiens
ucagugaaggaacaacuaaauag

SEQ ID NO: 107171 - RNA, 17 nt, Homo sapiens
ucagugcauuuaagaga

SEQ ID NO: 107172 - RNA, 22 nt, Homo sapiens
ucagugccauugccauaugagu

SEQ ID NO: 107173 - RNA, 22 nt, Homo sapiens
ucaguggagagcuuccaggauu

SEQ ID NO: 107174 - RNA, 20 nt, Homo sapiens
ucauagcuuuuuccacuuua

SEQ ID NO: 107175 - RNA, 23 nt, Homo sapiens
ucaugaggccauucaaauccauu

SEQ ID NO: 107176 - RNA, 22 nt, Homo sapiens
ucauggcauuguuaaggguuuu

SEQ ID NO: 107177 - RNA, 19 nt, Homo sapiens
ucauggcuuuuucagcugu

SEQ ID NO: 107178 - RNA, 22 nt, Homo sapiens
ucauugguugcguaauuugauu

SEQ ID NO: 107179 - RNA, 22 nt, Homo sapiens
uccaguuuuguuaacauauggu

SEQ ID NO: 107180 - RNA, 18 nt, Homo sapiens
ucccucagaauuauagaa

SEQ ID NO: 107181 - RNA, 19 nt, Homo sapiens
ucccuguagaccacagugc

SEQ ID NO: 107182 - RNA, 22 nt, Homo sapiens
ucccuguguuccuuuugaauug

SEQ ID NO: 107183 - RNA, 22 nt, Homo sapiens
ucccuuucuggaguuucccaag

SEQ ID NO: 107184 - RNA, 18 nt, Homo sapiens
ucccuuuguagaugaccc

SEQ ID NO: 107185 - RNA, 22 nt, Homo sapiens
ucccuuuguccaacggauccac

SEQ ID NO: 107186 - RNA, 22 nt, Homo sapiens
uccucugaacuccagacccaua

SEQ ID NO: 107187 - RNA, 22 nt, Homo sapiens
uccuugaaacaggaagaauuca

SEQ ID NO: 107188 - RNA, 22 nt, Homo sapiens
uccuugguugauccugugcaga

SEQ ID NO: 107189 - RNA, 22 nt, Homo sapiens
uccuuuaguuaauaaagacaag

SEQ ID NO: 107190 - RNA, 22 nt, Homo sapiens
ucgcgccauucuccugccucag

SEQ ID NO: 107191 - RNA, 22 nt, Homo sapiens
ucucagugaauugguuuugucu

SEQ ID NO: 107192 - RNA, 22 nt, Homo sapiens
ucuccauuguccagaugaggaa

SEQ ID NO: 107193 - RNA, 22 nt, Homo sapiens
ucugagucaucacaaaugaugc

SEQ ID NO: 107194 - RNA, 22 nt, Homo sapiens
ucuggccuacaaguaauuuuau

SEQ ID NO: 107195 - RNA, 22 nt, Homo sapiens
ucugucuuugccuaaguuuguc

SEQ ID NO: 107196 - RNA, 17 nt, Homo sapiens
ucuucuguuacuguggc

SEQ ID NO: 107197 - RNA, 22 nt, Homo sapiens
ucuuggguuguuggcuucuccu

SEQ ID NO: 107198 - RNA, 22 nt, Homo sapiens
ucuuggguuugccuugcugcug

SEQ ID NO: 107199 - RNA, 22 nt, Homo sapiens
ucuugguugaaaauucauaaua

SEQ ID NO: 107200 - RNA, 22 nt, Homo sapiens
ucuuuugguuucuagaggccgc

SEQ ID NO: 107201 - RNA, 22 nt, Homo sapiens
ugaagacauuuuugggugugua

SEQ ID NO: 107202 - RNA, 22 nt, Homo sapiens
ugaauagaaguggcaggaguag

SEQ ID NO: 107203 - RNA, 22 nt, Homo sapiens
ugaaugguuuuuagagaacaau

SEQ ID NO: 107204 - RNA, 22 nt, Homo sapiens
ugaaugugauggguuucaugug

SEQ ID NO: 107205 - RNA, 20 nt, Homo sapiens
ugacaagugagaauuauggg

SEQ ID NO: 107206 - RNA, 22 nt, Homo sapiens
ugacaugaugagcaauaauggc

SEQ ID NO: 107207 - RNA, 22 nt, Homo sapiens
ugacccauagaaauguggauaa

SEQ ID NO: 107208 - RNA, 22 nt, Homo sapiens
ugaccuguuugaaauugccaau

SEQ ID NO: 107209 - RNA, 22 nt, Homo sapiens
ugacuauaucucuguauaaacu

SEQ ID NO: 107210 - RNA, 22 nt, Homo sapiens
ugagaacaugcacuugagguug

SEQ ID NO: 107211 - RNA, 22 nt, Homo sapiens
ugagaacauggagaacccccca

SEQ ID NO: 107212 - RNA, 18 nt, Homo sapiens
ugagaacauguguacaca

SEQ ID NO: 107213 - RNA, 22 nt, Homo sapiens
ugagaacucaugaaucuuucca

SEQ ID NO: 107214 - RNA, 22 nt, Homo sapiens
ugagaauauuuuccaugucuca

SEQ ID NO: 107215 - RNA, 22 nt, Homo sapiens
ugagaaugcagaaucucgugca

SEQ ID NO: 107216 - RNA, 23 nt, Homo sapiens
ugagacauuggaaaguuaggcag

SEQ ID NO: 107217 - RNA, 22 nt, Homo sapiens
ugagacugagucucccucuguc

SEQ ID NO: 107218 - RNA, 19 nt, Homo sapiens
ugagaucuuuacuggguuu

SEQ ID NO: 107219 - RNA, 22 nt, Homo sapiens
ugagaugaagucucacucuguc

SEQ ID NO: 107220 - RNA, 22 nt, Homo sapiens
ugagaugauagauauguuaauu

SEQ ID NO: 107221 - RNA, 22 nt, Homo sapiens
ugagaugaucaaaguauaggcu

SEQ ID NO: 107222 - RNA, 22 nt, Homo sapiens
ugagauaacuaaaaacauuuug

SEQ ID NO: 107223 - RNA, 22 nt, Homo sapiens
ugagaugagggaagccuaggca

SEQ ID NO: 107224 - RNA, 22 nt, Homo sapiens
ugagaugauaucuuauuguaau

SEQ ID NO: 107225 - RNA, 22 nt, Homo sapiens
ugagauuaaucuuuaaguaaga

SEQ ID NO: 107226 - RNA, 22 nt, Homo sapiens
ugagcagaguuguuucuccuga

SEQ ID NO: 107227 - RNA, 22 nt, Homo sapiens
ugagcauuguguuugacuguga

SEQ ID NO: 107228 - RNA, 22 nt, Homo sapiens
ugaggaaugaccccgugugguc

SEQ ID NO: 107229 - RNA, 22 nt, Homo sapiens
ugaggaguguauuucauucgcu

SEQ ID NO: 107230 - RNA, 22 nt, Homo sapiens
ugaggauaguguugaaggcagg

SEQ ID NO: 107231 - RNA, 17 nt, Homo sapiens
ugagggaugccugguuc

SEQ ID NO: 107232 - RNA, 22 nt, Homo sapiens
ugagguagguaccauuaucacu

SEQ ID NO: 107233 - RNA, 22 nt, Homo sapiens
ugagguaucauugcccaggcug

SEQ ID NO: 107234 - RNA, 22 nt, Homo sapiens
ugaggugcagcaauccucaugu

SEQ ID NO: 107235 - RNA, 23 nt, Homo sapiens
ugagguguuaagcagacuugucu

SEQ ID NO: 107236 - RNA, 22 nt, Homo sapiens
ugaguauguaggaugugucuua

SEQ ID NO: 107237 - RNA, 22 nt, Homo sapiens
ugagugugacuuagcagaagga

SEQ ID NO: 107238 - RNA, 20 nt, Homo sapiens
ugaguuccuuguucagaagc

SEQ ID NO: 107239 - RNA, 22 nt, Homo sapiens
ugauaacauuucuucugguaca

SEQ ID NO: 107240 - RNA, 22 nt, Homo sapiens
ugauaugaaguucaaaccaggu

SEQ ID NO: 107241 - RNA, 22 nt, Homo sapiens
ugauaugcuuugaacucucugg

SEQ ID NO: 107242 - RNA, 22 nt, Homo sapiens
ugaugcuaccuaaagcaaccau

SEQ ID NO: 107243 - RNA, 22 nt, Homo sapiens
ugauggcacagugaguuccagg

SEQ ID NO: 107244 - RNA, 22 nt, Homo sapiens
ugaugguuuuauaagggagagu

SEQ ID NO: 107245 - RNA, 20 nt, Homo sapiens
ugauguccaggcagagguuu

SEQ ID NO: 107246 - RNA, 19 nt, Homo sapiens
ugcaaagucagugaagggu

SEQ ID NO: 107247 - RNA, 22 nt, Homo sapiens
ugcaaaugcugcuauuucucuu

SEQ ID NO: 107248 - RNA, 22 nt, Homo sapiens
ugcaaauguuaggugucauuau

SEQ ID NO: 107249 - RNA, 22 nt, Homo sapiens
ugcaauauccucuacuauaggu

SEQ ID NO: 107250 - RNA, 22 nt, Homo sapiens
ugcacaguccagugcccacuga

SEQ ID NO: 107251 - RNA, 22 nt, Homo sapiens
ugcaguaggcccagcgggaggc

SEQ ID NO: 107252 - RNA, 22 nt, Homo sapiens
ugcauaugucuuuauagcagca

SEQ ID NO: 107253 - RNA, 22 nt, Homo sapiens
ugcauauguucaaaguauucug

SEQ ID NO: 107254 - RNA, 18 nt, Homo sapiens
ugcauauguugaaccagc

SEQ ID NO: 107255 - RNA, 22 nt, Homo sapiens
ugcauauguugaaccaggcuug

SEQ ID NO: 107256 - RNA, 22 nt, Homo sapiens
ugcauauguugagaugcauauu

SEQ ID NO: 107257 - RNA, 22 nt, Homo sapiens
ugcccuuugucagaugaguagg

SEQ ID NO: 107258 - RNA, 22 nt, Homo sapiens
ugccuaggcuggaaugcagugg

SEQ ID NO: 107259 - RNA, 22 nt, Homo sapiens
ugccuuuguucuggaaugggaa

SEQ ID NO: 107260 - RNA, 22 nt, Homo sapiens
ugcugcaaacaugagaggaagu

SEQ ID NO: 107261 - RNA, 22 nt, Homo sapiens
uggaagaugggaccucaguuuu

SEQ ID NO: 107262 - RNA, 22 nt, Homo sapiens
uggaagcaugcaaucugugggg

SEQ ID NO: 107263 - RNA, 21 nt, Homo sapiens
uggaaugaauggccaacaugg

SEQ ID NO: 107264 - RNA, 17 nt, Homo sapiens
uggaaugucuaagccug

SEQ ID NO: 107265 - RNA, 22 nt, Homo sapiens
uggaaugucuauguuuuugauu

SEQ ID NO: 107266 - RNA, 22 nt, Homo sapiens
uggaauguggacucuuaugggg

SEQ ID NO: 107267 - RNA, 22 nt, Homo sapiens
uggaauuaauuaaaauauacug

SEQ ID NO: 107268 - RNA, 22 nt, Homo sapiens
uggagagcaaagaauuuguuag

SEQ ID NO: 107269 - RNA, 22 nt, Homo sapiens
uggagcccuaaacuucuaauau

SEQ ID NO: 107270 - RNA, 22 nt, Homo sapiens
uggaguaggccuaagaaugaca

SEQ ID NO: 107271 - RNA, 22 nt, Homo sapiens
uggaguguaaauuaguucagcc

SEQ ID NO: 107272 - RNA, 22 nt, Homo sapiens
uggauggucagaggguuucugu

SEQ ID NO: 107273 - RNA, 22 nt, Homo sapiens
uggauuuuaauuauucugucau

SEQ ID NO: 107274 - RNA, 22 nt, Homo sapiens
uggcaaaugugagaugagaacu

SEQ ID NO: 107275 - RNA, 21 nt, Homo sapiens
uggcaacauggauggauucug

SEQ ID NO: 107276 - RNA, 22 nt, Homo sapiens
uggcacaaugacccuugugggc

SEQ ID NO: 107277 - RNA, 22 nt, Homo sapiens
uggcagcugcuucaugggaugc

SEQ ID NO: 107278 - RNA, 22 nt, Homo sapiens
uggccuguaacgcugucucagc

SEQ ID NO: 107279 - RNA, 22 nt, Homo sapiens
uggcuacuguacuugagcuauu

SEQ ID NO: 107280 - RNA, 22 nt, Homo sapiens
uggcucuguuuguuaacuagac

SEQ ID NO: 107281 - RNA, 22 nt, Homo sapiens
uggcuguguccucucccaaauc

SEQ ID NO: 107282 - RNA, 22 nt, Homo sapiens
uggcuguuuauuucacgugggu

SEQ ID NO: 107283 - RNA, 22 nt, Homo sapiens
ugggaagcugcauuuuaacaag

SEQ ID NO: 107284 - RNA, 22 nt, Homo sapiens
ugggaagcugcugaacuacagu

SEQ ID NO: 107285 - RNA, 22 nt, Homo sapiens
ugggagcauugcauuagaagcc

SEQ ID NO: 107286 - RNA, 22 nt, Homo sapiens
ugggaugaauacaaugggauca

SEQ ID NO: 107287 - RNA, 22 nt, Homo sapiens
uggguagagaaucaggaucuua

SEQ ID NO: 107288 - RNA, 22 nt, Homo sapiens
uggucaaaucugaugugagaaa

SEQ ID NO: 107289 - RNA, 22 nt, Homo sapiens
uggucauggggcagcugacacu

SEQ ID NO: 107290 - RNA, 22 nt, Homo sapiens
ugguucaguugcacaggcuguu

SEQ ID NO: 107291 - RNA, 23 nt, Homo sapiens
ugguuuguaagagauggacugga

SEQ ID NO: 107292 - RNA, 23 nt, Homo sapiens
uguauacacccugugcaucuggg

SEQ ID NO: 107293 - RNA, 22 nt, Homo sapiens
ugucaaggaaugucauugguuu

SEQ ID NO: 107294 - RNA, 22 nt, Homo sapiens
ugucaccauuuguaggugagga

SEQ ID NO: 107295 - RNA, 22 nt, Homo sapiens
ugucaucauuccaucagggcuu

SEQ ID NO: 107296 - RNA, 18 nt, Homo sapiens
ugugacauugagcauguc

SEQ ID NO: 107297 - RNA, 16 nt, Homo sapiens
ugugaucuuuuuucuu

SEQ ID NO: 107298 - RNA, 22 nt, Homo sapiens
ugugauuauuuauagacaguca

SEQ ID NO: 107299 - RNA, 22 nt, Homo sapiens
uaugcuuauaaacauuugucag

SEQ ID NO: 107300 - RNA, 22 nt, Homo sapiens
uauggcaaugcauaggaaggaa

SEQ ID NO: 107301 - RNA, 22 nt, Homo sapiens
uauggguuuuugucuguuuacu

SEQ ID NO: 107302 - RNA, 22 nt, Homo sapiens
uaugucuuuugcuugcaaauag

SEQ ID NO: 107303 - RNA, 22 nt, Homo sapiens
uauugaacgugggauauugaag

SEQ ID NO: 107304 - RNA, 22 nt, Homo sapiens
uauuucaguugugcagguaguu

SEQ ID NO: 107305 - RNA, 22 nt, Homo sapiens
ucaaaguauucuucugagaacc

SEQ ID NO: 107306 - RNA, 22 nt, Homo sapiens
ucaaagugagcuccuucucacu

SEQ ID NO: 107307 - RNA, 21 nt, Homo sapiens
ucaaaguguucuuuuguugaa

SEQ ID NO: 107308 - RNA, 22 nt, Homo sapiens
ucacaaagcuuggccugcuucu

SEQ ID NO: 107309 - RNA, 22 nt, Homo sapiens
ucacaguaaauccagaagaaau

SEQ ID NO: 107310 - RNA, 22 nt, Homo sapiens
ucacagucaaaguaaucauaga

SEQ ID NO: 107311 - RNA, 20 nt, Homo sapiens
ucacagucacacauaauccu

SEQ ID NO: 107312 - RNA, 22 nt, Homo sapiens
ucacagucacugucacguugaa

SEQ ID NO: 107313 - RNA, 22 nt, Homo sapiens
ucacagucggugacuucuugcu

SEQ ID NO: 107314 - RNA, 22 nt, Homo sapiens
ucacauuguuauguaaauguuu

SEQ ID NO: 107315 - RNA, 22 nt, Homo sapiens
ucaccaccugcugaucauagag

SEQ ID NO: 107316 - RNA, 21 nt, Homo sapiens
ucaccuguagcugcauguucu

SEQ ID NO: 107317 - RNA, 21 nt, Homo sapiens
ucaccuguugcgaugaagcug

SEQ ID NO: 107318 - RNA, 22 nt, Homo sapiens
ucacugcacuccagccuuuaug

SEQ ID NO: 107319 - RNA, 22 nt, Homo sapiens
ucacugggagaccaaagccauc

SEQ ID NO: 107320 - RNA, 22 nt, Homo sapiens
ucacugugugucucuguaucug

SEQ ID NO: 107321 - RNA, 18 nt, Homo sapiens
ucacugugugucuugggu

SEQ ID NO: 107322 - RNA, 22 nt, Homo sapiens
ucacuuggccgcagccuucucu

SEQ ID NO: 107323 - RNA, 22 nt, Homo sapiens
ucacuuugacggccaacuucua

SEQ ID NO: 107324 - RNA, 22 nt, Homo sapiens
ucagacacuguggccuuuggac

SEQ ID NO: 107325 - RNA, 22 nt, Homo sapiens
ucagaucauuaagguagguuua

SEQ ID NO: 107326 - RNA, 22 nt, Homo sapiens
ucagcaaugcugcacucuacug

SEQ ID NO: 107327 - RNA, 22 nt, Homo sapiens
ucagcagugugaaaacaaacua

SEQ ID NO: 107328 - RNA, 21 nt, Homo sapiens
ucaggcuuuuugagugccaau

SEQ ID NO: 107329 - RNA, 22 nt, Homo sapiens
ucagggacgcuugacacaagcc

SEQ ID NO: 107330 - RNA, 22 nt, Homo sapiens
ucagugggcuauguaauuaacu

SEQ ID NO: 107331 - RNA, 23 nt, Homo sapiens
ucagugucuggauccugcucagu

SEQ ID NO: 107332 - RNA, 22 nt, Homo sapiens
ucauauugguuaaaauaguggg

SEQ ID NO: 107333 - RNA, 22 nt, Homo sapiens
ucaucaggcucauucaagcuga

SEQ ID NO: 107334 - RNA, 22 nt, Homo sapiens
ucaucagguaugucagcggagu

SEQ ID NO: 107335 - RNA, 21 nt, Homo sapiens
ucauugggugcagcccacccu

SEQ ID NO: 107336 - RNA, 22 nt, Homo sapiens
uccaauguaaucaucauugaau

SEQ ID NO: 107337 - RNA, 22 nt, Homo sapiens
uccacaauggcugaacuagauu

SEQ ID NO: 107338 - RNA, 18 nt, Homo sapiens
uccacgugcuuuccagau

SEQ ID NO: 107339 - RNA, 22 nt, Homo sapiens
uccacguggucuaucuguccuu

SEQ ID NO: 107340 - RNA, 17 nt, Homo sapiens
uccagauuucaauugaa

SEQ ID NO: 107341 - RNA, 21 nt, Homo sapiens
uccagcuuugagaguuguggu

SEQ ID NO: 107342 - RNA, 22 nt, Homo sapiens
uccagguuuugugaguuuaaau

SEQ ID NO: 107343 - RNA, 22 nt, Homo sapiens
uccaguacaggucucucauuuc

SEQ ID NO: 107344 - RNA, 22 nt, Homo sapiens
uccaugaguccauuagaaaaaa

SEQ ID NO: 107345 - RNA, 22 nt, Homo sapiens
uccccugagaacuugcuagaaa

SEQ ID NO: 107346 - RNA, 22 nt, Homo sapiens
uccccugagucaccugcuucuc

SEQ ID NO: 107347 - RNA, 22 nt, Homo sapiens
ucccuggacagccuugccuggg

SEQ ID NO: 107348 - RNA, 22 nt, Homo sapiens
ucccuugguaauucuguuccuu

SEQ ID NO: 107349 - RNA, 19 nt, Homo sapiens
ucccuuuguauggacauac

SEQ ID NO: 107350 - RNA, 22 nt, Homo sapiens
uccugagagcagacccucuaua

SEQ ID NO: 107351 - RNA, 22 nt, Homo sapiens
uccugcauucauccugguguug

SEQ ID NO: 107352 - RNA, 23 nt, Homo sapiens
ucgcagcauucaauaccaggcag

SEQ ID NO: 107353 - RNA, 19 nt, Homo sapiens
ucgcgccauucuccugccu

SEQ ID NO: 107354 - RNA, 22 nt, Homo sapiens
ucguggccugugaguccucccc

SEQ ID NO: 107355 - RNA, 19 nt, Homo sapiens
ucuaaaucucuugauagac

SEQ ID NO: 107356 - RNA, 22 nt, Homo sapiens
ucuauugguaggggcugaggca

SEQ ID NO: 107357 - RNA, 22 nt, Homo sapiens
ucucacagccauuucucccucu

SEQ ID NO: 107358 - RNA, 22 nt, Homo sapiens
ucucauggagucaggagcagaa

SEQ ID NO: 107359 - RNA, 20 nt, Homo sapiens
ucucccaaacagcaggcccu

SEQ ID NO: 107360 - RNA, 22 nt, Homo sapiens
ucucugguuaugucauuaagca

SEQ ID NO: 107361 - RNA, 22 nt, Homo sapiens
ucugacaaugaacaaucuauag

SEQ ID NO: 107362 - RNA, 22 nt, Homo sapiens
ucugagcaauagauguggauau

SEQ ID NO: 107363 - RNA, 19 nt, Homo sapiens
ucuguaguuagggcuacag

SEQ ID NO: 107364 - RNA, 19 nt, Homo sapiens
ucugucacuggggguauuc

SEQ ID NO: 107365 - RNA, 22 nt, Homo sapiens
ucugucuugugguuugagugcc

SEQ ID NO: 107366 - RNA, 22 nt, Homo sapiens
ucugugguuguugcauggaaug

SEQ ID NO: 107367 - RNA, 22 nt, Homo sapiens
ucuuugauguucugaaagaugg

SEQ ID NO: 107368 - RNA, 22 nt, Homo sapiens
ugaaagacugaagaauaggcau

SEQ ID NO: 107369 - RNA, 22 nt, Homo sapiens
ugaacacaucuccugguaccug

SEQ ID NO: 107370 - RNA, 22 nt, Homo sapiens
ugaagggcauuguuuugccaaa

SEQ ID NO: 107371 - RNA, 18 nt, Homo sapiens
ugaauacagcguugggaa

SEQ ID NO: 107372 - RNA, 19 nt, Homo sapiens
ugaaugacaucuaaagucc

SEQ ID NO: 107373 - RNA, 22 nt, Homo sapiens
ugaaugguaaagaaaagcacug

SEQ ID NO: 107374 - RNA, 22 nt, Homo sapiens
ugacaacugauuaacuccuuua

SEQ ID NO: 107375 - RNA, 19 nt, Homo sapiens
ugacacuguuggugggagg

SEQ ID NO: 107376 - RNA, 22 nt, Homo sapiens
ugacagcugaagauguugaacc

SEQ ID NO: 107377 - RNA, 22 nt, Homo sapiens
ugacuauaggauaacaugcauu

SEQ ID NO: 107378 - RNA, 22 nt, Homo sapiens
ugacuccagagacugugcuguc

SEQ ID NO: 107379 - RNA, 22 nt, Homo sapiens
ugacuggaacuuuagugagucu

SEQ ID NO: 107380 - RNA, 22 nt, Homo sapiens
ugacuggagucuugcucugucg

SEQ ID NO: 107381 - RNA, 22 nt, Homo sapiens
gucaucaucaguccucugugca

SEQ ID NO: 107382 - RNA, 22 nt, Homo sapiens
gucaugucuugaaauucaguuu

SEQ ID NO: 107383 - RNA, 22 nt, Homo sapiens
gucccugcgauugugggauccu

SEQ ID NO: 107384 - RNA, 22 nt, Homo sapiens
gucuggagacuugggucaucaa

SEQ ID NO: 107385 - RNA, 22 nt, Homo sapiens
gucugguuccugggagauuucu

SEQ ID NO: 107386 - RNA, 22 nt, Homo sapiens
gucugugguuccuaugucaccu

SEQ ID NO: 107387 - RNA, 22 nt, Homo sapiens
gucuuuggaaagacaaaguuca

SEQ ID NO: 107388 - RNA, 22 nt, Homo sapiens
gugaauguaaagucaugugacu

SEQ ID NO: 107389 - RNA, 22 nt, Homo sapiens
gugaauguuuucuuacauggua

SEQ ID NO: 107390 - RNA, 22 nt, Homo sapiens
gugacauuuuuacugaugagag

SEQ ID NO: 107391 - RNA, 22 nt, Homo sapiens
gugaccucuguugcugucacua

SEQ ID NO: 107392 - RNA, 22 nt, Homo sapiens
gugagauggagucuugcuuugu

SEQ ID NO: 107393 - RNA, 19 nt, Homo sapiens
gugagcacagacaauacaa

SEQ ID NO: 107394 - RNA, 22 nt, Homo sapiens
gugagcacugaaagaaggcaag

SEQ ID NO: 107395 - RNA, 22 nt, Homo sapiens
gugagggaugugaaaaagguca

SEQ ID NO: 107396 - RNA, 22 nt, Homo sapiens
gugagguugaaaauaauggaaa

SEQ ID NO: 107397 - RNA, 22 nt, Homo sapiens
gugcaaaucucugaguaucuuu

SEQ ID NO: 107398 - RNA, 22 nt, Homo sapiens
gugcaaauuccagcucaacucc

SEQ ID NO: 107399 - RNA, 22 nt, Homo sapiens
gugcaagagugauugcaguuuu

SEQ ID NO: 107400 - RNA, 22 nt, Homo sapiens
gugcacaacgugcagguuuguu

SEQ ID NO: 107401 - RNA, 22 nt, Homo sapiens
gugcacaaucgugcauuccuug

SEQ ID NO: 107402 - RNA, 22 nt, Homo sapiens
gugccacugcaccuggccuaag

SEQ ID NO: 107403 - RNA, 22 nt, Homo sapiens
gugcuuuguuguggcaguggca

SEQ ID NO: 107404 - RNA, 22 nt, Homo sapiens
guggaagcacaggccuccugga

SEQ ID NO: 107405 - RNA, 22 nt, Homo sapiens
guggaagguaaugcagcuuacu

SEQ ID NO: 107406 - RNA, 22 nt, Homo sapiens
guggaauacuaugaugguggau

SEQ ID NO: 107407 - RNA, 22 nt, Homo sapiens
guggaaugauaucucauugugg

SEQ ID NO: 107408 - RNA, 22 nt, Homo sapiens
guggacguguguccccauggcu

SEQ ID NO: 107409 - RNA, 22 nt, Homo sapiens
guggagacaaaggcugagugag

SEQ ID NO: 107410 - RNA, 22 nt, Homo sapiens
guggaggagaaagaagcauuuc

SEQ ID NO: 107411 - RNA, 18 nt, Homo sapiens
guggagugucuuccugga

SEQ ID NO: 107412 - RNA, 22 nt, Homo sapiens
guggcagagucagagggaaaug

SEQ ID NO: 107413 - RNA, 22 nt, Homo sapiens
guggguaaaucucuggggcucu

SEQ ID NO: 107414 - RNA, 22 nt, Homo sapiens
guggguaaaucucuguuugagg

SEQ ID NO: 107415 - RNA, 22 nt, Homo sapiens
gugguuuuaauauucagucuag

SEQ ID NO: 107416 - RNA, 22 nt, Homo sapiens
gugguuuuuagauuucuacagu

SEQ ID NO: 107417 - RNA, 22 nt, Homo sapiens
gugucaugagggggacaggaag

SEQ ID NO: 107418 - RNA, 22 nt, Homo sapiens
guguccucgaguacacaucagg

SEQ ID NO: 107419 - RNA, 22 nt, Homo sapiens
gugugacagcuauagacaugau

SEQ ID NO: 107420 - RNA, 22 nt, Homo sapiens
gugugcucaucacaugcaauag

SEQ ID NO: 107421 - RNA, 21 nt, Homo sapiens
gugugcuugagugaugggauu

SEQ ID NO: 107422 - RNA, 22 nt, Homo sapiens
guuaagaaguguaacuuaaguu

SEQ ID NO: 107423 - RNA, 22 nt, Homo sapiens
guuacagucuuguguaagguua

SEQ ID NO: 107424 - RNA, 22 nt, Homo sapiens
guuacugucuuccugauugcuu

SEQ ID NO: 107425 - RNA, 22 nt, Homo sapiens
guucacaguucagccuguaaca

SEQ ID NO: 107426 - RNA, 22 nt, Homo sapiens
guugcugagucccaucaccaga

SEQ ID NO: 107427 - RNA, 22 nt, Homo sapiens
uaaagaugcugggaaggcuagg

SEQ ID NO: 107428 - RNA, 22 nt, Homo sapiens
uaaagcuacaguauaugguauu

SEQ ID NO: 107429 - RNA, 21 nt, Homo sapiens
uaaagcuagaaccuuagcuuu

SEQ ID NO: 107430 - RNA, 20 nt, Homo sapiens
uaaagcugcucagggggcuc

SEQ ID NO: 107431 - RNA, 21 nt, Homo sapiens
uaaaugucauacaaagcaaug

SEQ ID NO: 107432 - RNA, 22 nt, Homo sapiens
uaacauagucauauacuugcuu

SEQ ID NO: 107433 - RNA, 22 nt, Homo sapiens
uaagcuaauguguuuucucuua

SEQ ID NO: 107434 - RNA, 22 nt, Homo sapiens
uaagcuauagugaauaaauugc

SEQ ID NO: 107435 - RNA, 22 nt, Homo sapiens
uaaggcuugcuucagucuugaa

SEQ ID NO: 107436 - RNA, 22 nt, Homo sapiens
uaagguuacaaaggacuucaua

SEQ ID NO: 107437 - RNA, 22 nt, Homo sapiens
uaaguaauuguuaauagggaag

SEQ ID NO: 107438 - RNA, 22 nt, Homo sapiens
uaaguacugucagaauuggacu

SEQ ID NO: 107439 - RNA, 22 nt, Homo sapiens
uaagugaaggaaguguguuuac

SEQ ID NO: 107440 - RNA, 22 nt, Homo sapiens
uaagugaauauggacaguuagc

SEQ ID NO: 107441 - RNA, 22 nt, Homo sapiens
uaagugaauguuggcuacugaa

SEQ ID NO: 107442 - RNA, 22 nt, Homo sapiens
uaagugcuugacuuugauguuu

SEQ ID NO: 107443 - RNA, 20 nt, Homo sapiens
uaagugcuugagacuucuga

SEQ ID NO: 107444 - RNA, 22 nt, Homo sapiens
uaauacauucaaggugguaguu

SEQ ID NO: 107445 - RNA, 22 nt, Homo sapiens
uaauacuugucauaaaggcauu

SEQ ID NO: 107446 - RNA, 22 nt, Homo sapiens
uaaugcauacagaagguguuuu

SEQ ID NO: 107447 - RNA, 22 nt, Homo sapiens
uaaugcaucaugguuggcaaac

SEQ ID NO: 107448 - RNA, 22 nt, Homo sapiens
uaaugcuugguuguuuggaaaa

SEQ ID NO: 107449 - RNA, 22 nt, Homo sapiens
uacaagcuaaaauggaagauca

SEQ ID NO: 107450 - RNA, 22 nt, Homo sapiens
uacagugggcacuggcgcccug

SEQ ID NO: 107451 - RNA, 22 nt, Homo sapiens
uacaguggugugaucucagcuc

SEQ ID NO: 107452 - RNA, 19 nt, Homo sapiens
uacccagaagcagcauugu

SEQ ID NO: 107453 - RNA, 22 nt, Homo sapiens
uacuuaguagcuuauccugugg

SEQ ID NO: 107454 - RNA, 22 nt, Homo sapiens
uagacacugcauauuuuuuuaa

SEQ ID NO: 107455 - RNA, 22 nt, Homo sapiens
uagaccaauuggcauauaguaa

SEQ ID NO: 107456 - RNA, 22 nt, Homo sapiens
uagcagacuauuuugugauaau

SEQ ID NO: 107457 - RNA, 20 nt, Homo sapiens
uagcagcagacagagggagg

SEQ ID NO: 107458 - RNA, 22 nt, Homo sapiens
uagcagcaucucuggcuucuac

SEQ ID NO: 107459 - RNA, 22 nt, Homo sapiens
uagcagccaggaagggcuggcu

SEQ ID NO: 107460 - RNA, 22 nt, Homo sapiens
uagcagcuuuauugagguaaau

SEQ ID NO: 107461 - RNA, 22 nt, Homo sapiens
uagcugcugcuaggcuaaggau

SEQ ID NO: 107462 - RNA, 22 nt, Homo sapiens
uaggucaguuuuggcuuggcuu

SEQ ID NO: 107463 - RNA, 22 nt, Homo sapiens
uaggucuuuuaugaaauauauu

SEQ ID NO: 107464 - RNA, 22 nt, Homo sapiens
uaggugaaugcuggaagaaaug

SEQ ID NO: 107465 - RNA, 22 nt, Homo sapiens
uagguuauucauucaucauuua

SEQ ID NO: 107466 - RNA, 22 nt, Homo sapiens
aaagcacugaauaaauuugcuu

SEQ ID NO: 107467 - RNA, 19 nt, Homo sapiens
aaaguacucugaugccucu

SEQ ID NO: 107468 - RNA, 18 nt, Homo sapiens
aaagugaugucauucuuu

SEQ ID NO: 107469 - RNA, 22 nt, Homo sapiens
aaagugcugagacagacuggga

SEQ ID NO: 107470 - RNA, 22 nt, Homo sapiens
aaagugcuuacuaaguugccaa

SEQ ID NO: 107471 - RNA, 22 nt, Homo sapiens
aaauaacugucagguucuggaa

SEQ ID NO: 107472 - RNA, 22 nt, Homo sapiens
aaaugcaucauuaggugauuuu

SEQ ID NO: 107473 - RNA, 22 nt, Homo sapiens
aaauggauuaaguucacuugcu

SEQ ID NO: 107474 - RNA, 22 nt, Homo sapiens
aaauucaugucaccucuaggua

SEQ ID NO: 107475 - RNA, 22 nt, Homo sapiens
aaauucauuucagcucugggua

SEQ ID NO: 107476 - RNA, 22 nt, Homo sapiens
aacaggcuccuaggggugcacc

SEQ ID NO: 107477 - RNA, 22 nt, Homo sapiens
aacaggguguuugcaguuucuu

SEQ ID NO: 107478 - RNA, 22 nt, Homo sapiens
aacugcacauauuuguaugggu

SEQ ID NO: 107479 - RNA, 20 nt, Homo sapiens
aagacacuguccccacugga

SEQ ID NO: 107480 - RNA, 22 nt, Homo sapiens
aagagaacugacaguaccuggg

SEQ ID NO: 107481 - RNA, 22 nt, Homo sapiens
aagagagcuaugugcauaauua

SEQ ID NO: 107482 - RNA, 22 nt, Homo sapiens
aagagcauuauuuaguaauuuc

SEQ ID NO: 107483 - RNA, 22 nt, Homo sapiens
aagagguaggaaauggucauuu

SEQ ID NO: 107484 - RNA, 22 nt, Homo sapiens
aagauauguuaguuauaaacuc

SEQ ID NO: 107485 - RNA, 22 nt, Homo sapiens
aagcuggauuuaguguggagca

SEQ ID NO: 107486 - RNA, 22 nt, Homo sapiens
aagcuguuguucauccugaauu

SEQ ID NO: 107487 - RNA, 22 nt, Homo sapiens
aaggagcuuaagugacuuguac

SEQ ID NO: 107488 - RNA, 22 nt, Homo sapiens
aaggcucuuucaacguaaauua

SEQ ID NO: 107489 - RNA, 22 nt, Homo sapiens
aaggcuuuuugcugacguccuu

SEQ ID NO: 107490 - RNA, 22 nt, Homo sapiens
aagggaauguuguggcugguug

SEQ ID NO: 107491 - RNA, 22 nt, Homo sapiens
aaggugguuuucucuuggaguc

SEQ ID NO: 107492 - RNA, 22 nt, Homo sapiens
aaguagcuggaugcaguggcac

SEQ ID NO: 107493 - RNA, 22 nt, Homo sapiens
aagucacugagacuuguggcug

SEQ ID NO: 107494 - RNA, 22 nt, Homo sapiens
aagugcucuugaaacugccuua

SEQ ID NO: 107495 - RNA, 22 nt, Homo sapiens
aagugcuucagaagacaauauu

SEQ ID NO: 107496 - RNA, 22 nt, Homo sapiens
aagugcuuccuuucagaggguu

SEQ ID NO: 107497 - RNA, 22 nt, Homo sapiens
aagugcuucuuuccucgagaag

SEQ ID NO: 107498 - RNA, 22 nt, Homo sapiens
aagugcuuuguacagggguuga

SEQ ID NO: 107499 - RNA, 22 nt, Homo sapiens
aagugguguuuguauuuaugca

SEQ ID NO: 107500 - RNA, 22 nt, Homo sapiens
aauaaaguaggaggugaggaaa

SEQ ID NO: 107501 - RNA, 20 nt, Homo sapiens
aauaacagccccagggaggu

SEQ ID NO: 107502 - RNA, 22 nt, Homo sapiens
aaucagagcccucugagcuuca

SEQ ID NO: 107503 - RNA, 17 nt, Homo sapiens
aaucagauuucugagga

SEQ ID NO: 107504 - RNA, 22 nt, Homo sapiens
aaucauauugucugccaagagg

SEQ ID NO: 107505 - RNA, 22 nt, Homo sapiens
aaucugucuuuuguuauugagg

SEQ ID NO: 107506 - RNA, 22 nt, Homo sapiens
aaugccuagugugugacaggug

SEQ ID NO: 107507 - RNA, 22 nt, Homo sapiens
aaugcuaucuggaacauuguug

SEQ ID NO: 107508 - RNA, 22 nt, Homo sapiens
aauggcaagagccacagaggcg

SEQ ID NO: 107509 - RNA, 21 nt, Homo sapiens
aaugguguugccaacaaggug

SEQ ID NO: 107510 - RNA, 22 nt, Homo sapiens
aauuacauggcaauugggaaau

SEQ ID NO: 107511 - RNA, 22 nt, Homo sapiens
acaaagugccuccuuuuagagu

SEQ ID NO: 107512 - RNA, 22 nt, Homo sapiens
acacucucucauuacuuguuug

SEQ ID NO: 107513 - RNA, 19 nt, Homo sapiens
acaguauugugcacagguu

SEQ ID NO: 107514 - RNA, 22 nt, Homo sapiens
acagucacaauuuguaccuuuu

SEQ ID NO: 107515 - RNA, 22 nt, Homo sapiens
acagugcuuucaauguucagua

SEQ ID NO: 107516 - RNA, 22 nt, Homo sapiens
acagugcuuuuguuccucuccu

SEQ ID NO: 107517 - RNA, 22 nt, Homo sapiens
acaucaggcuugugaugauuac

SEQ ID NO: 107518 - RNA, 22 nt, Homo sapiens
acaucccaugccuggguacucc

SEQ ID NO: 107519 - RNA, 22 nt, Homo sapiens
acaucccuuucccacccuucac

SEQ ID NO: 107520 - RNA, 22 nt, Homo sapiens
acaucuguacaguggguguggu

SEQ ID NO: 107521 - RNA, 22 nt, Homo sapiens
acaugcaucauuaggugguuua

SEQ ID NO: 107522 - RNA, 22 nt, Homo sapiens
acaugcauggcaugcauuguac

SEQ ID NO: 107523 - RNA, 19 nt, Homo sapiens
acauggauuuugugcaaac

SEQ ID NO: 107524 - RNA, 21 nt, Homo sapiens
acccccacaccuccuuaguuc

SEQ ID NO: 107525 - RNA, 22 nt, Homo sapiens
acccgcccagguguggccggga

SEQ ID NO: 107526 - RNA, 22 nt, Homo sapiens
acccugcuaaacagcccccugc

SEQ ID NO: 107527 - RNA, 22 nt, Homo sapiens
acuauacugaagcaaauuaaca

SEQ ID NO: 107528 - RNA, 22 nt, Homo sapiens
acucacagcaaccuccgccucc

SEQ ID NO: 107529 - RNA, 22 nt, Homo sapiens
acugaauguaaacacggagugu

SEQ ID NO: 107530 - RNA, 22 nt, Homo sapiens
acugcacuccaaccuuggugac

SEQ ID NO: 107531 - RNA, 18 nt, Homo sapiens
acugcacuccaccuuggg

SEQ ID NO: 107532 - RNA, 22 nt, Homo sapiens
acugcacuccagccuccugaca

SEQ ID NO: 107533 - RNA, 22 nt, Homo sapiens
acugcacuccagccucgcaaca

SEQ ID NO: 107534 - RNA, 22 nt, Homo sapiens
acugcacuccagccucguggac

SEQ ID NO: 107535 - RNA, 22 nt, Homo sapiens
acugcacuccagccugcccaac

SEQ ID NO: 107536 - RNA, 22 nt, Homo sapiens
acugcacuccagccugcuggca

SEQ ID NO: 107537 - RNA, 22 nt, Homo sapiens
acugcacuccagccuggaccac

SEQ ID NO: 107538 - RNA, 22 nt, Homo sapiens
acugcacuccagccugugagac

SEQ ID NO: 107539 - RNA, 22 nt, Homo sapiens
acugcacuccagccuugugaca

SEQ ID NO: 107540 - RNA, 22 nt, Homo sapiens
acugcacucuagcauggguaau

SEQ ID NO: 107541 - RNA, 22 nt, Homo sapiens
acugcacugcagccuggccaac

SEQ ID NO: 107542 - RNA, 22 nt, Homo sapiens
acuggguuaauuugaagguuga

SEQ ID NO: 107543 - RNA, 22 nt, Homo sapiens
agacacugaaauguauugaaga

SEQ ID NO: 107544 - RNA, 22 nt, Homo sapiens
agagagguggguggagccccca

SEQ ID NO: 107545 - RNA, 22 nt, Homo sapiens
agagguauuggaaggaguguca

SEQ ID NO: 107546 - RNA, 22 nt, Homo sapiens
agagguuuugcccucgagauaa

SEQ ID NO: 107547 - RNA, 21 nt, Homo sapiens
agagucaucucuaucuguacc

SEQ ID NO: 107548 - RNA, 23 nt, Homo sapiens
agagugcaauggugccaucucgg

SEQ ID NO: 107549 - RNA, 22 nt, Homo sapiens
agauggguuuucacauguuggc

SEQ ID NO: 107550 - RNA, 22 nt, Homo sapiens
agauggugauaaaugugguacc

SEQ ID NO: 107551 - RNA, 22 nt, Homo sapiens
agaugguguuggcugaguguau

SEQ ID NO: 107552 - RNA, 23 nt, Homo sapiens
agcaaaugcucuagcacuccaac

SEQ ID NO: 107553 - RNA, 22 nt, Homo sapiens
agcaagauccagucgcacagga

SEQ ID NO: 107554 - RNA, 22 nt, Homo sapiens
agcagagcaguggauuuuguga

SEQ ID NO: 107555 - RNA, 22 nt, Homo sapiens
agcagcaugcaaauggacuaau

SEQ ID NO: 107556 - RNA, 22 nt, Homo sapiens
agcagcauuaguggaaucuugu

SEQ ID NO: 107557 - RNA, 22 nt, Homo sapiens
agcaguguggccuuagacccgg

SEQ ID NO: 107558 - RNA, 18 nt, Homo sapiens
agcaucacugaucauccu

SEQ ID NO: 107559 - RNA, 22 nt, Homo sapiens
agccaguauuuccacagagugg

SEQ ID NO: 107560 - RNA, 22 nt, Homo sapiens
agccccauuuguugaaaagacg

SEQ ID NO: 107561 - RNA, 21 nt, Homo sapiens
agcuaaauuggaaauuucugu

SEQ ID NO: 107562 - RNA, 22 nt, Homo sapiens
agcuaguguucaccagagguca

SEQ ID NO: 107563 - RNA, 22 nt, Homo sapiens
agcuccauuguaaucaccuggu

SEQ ID NO: 107564 - RNA, 22 nt, Homo sapiens
agcuccuuugcuuuuuccagga

SEQ ID NO: 107565 - RNA, 22 nt, Homo sapiens
agcugcauucguaucauauugu

SEQ ID NO: 107566 - RNA, 22 nt, Homo sapiens
agcugcauuuacuuuugcacaa

SEQ ID NO: 107567 - RNA, 20 nt, Homo sapiens
agcuggguguguuggugcau

SEQ ID NO: 107568 - RNA, 22 nt, Homo sapiens
agcuggucuacguguguaugag

SEQ ID NO: 107569 - RNA, 22 nt, Homo sapiens
agcugugucuucuuaaagauuu

SEQ ID NO: 107570 - RNA, 22 nt, Homo sapiens
agcuguuguacacuuuaccuuu

SEQ ID NO: 107571 - RNA, 20 nt, Homo sapiens
agcuguuguuaugagguuua

SEQ ID NO: 107572 - RNA, 22 nt, Homo sapiens
agcuugugcuguaugaagggcc

SEQ ID NO: 107573 - RNA, 22 nt, Homo sapiens
aggaaucuaagguaucagguua

SEQ ID NO: 107574 - RNA, 22 nt, Homo sapiens
aggaauggaaacuuuugauggu

SEQ ID NO: 107575 - RNA, 22 nt, Homo sapiens
aggacacugauguaugcugugg

SEQ ID NO: 107576 - RNA, 21 nt, Homo sapiens
aggcaagacuuuuagguuugu

SEQ ID NO: 107577 - RNA, 22 nt, Homo sapiens
aggcuuuauuacagggucucag

SEQ ID NO: 107578 - RNA, 22 nt, Homo sapiens
agggaagugugcuaugcauuua

SEQ ID NO: 107579 - RNA, 23 nt, Homo sapiens
agggcacuauagauguuauucua

SEQ ID NO: 107580 - RNA, 22 nt, Homo sapiens
agggcuuuugagcugagauggu

SEQ ID NO: 107581 - RNA, 22 nt, Homo sapiens
cucucaguguggaggccagaaa

SEQ ID NO: 107582 - RNA, 22 nt, Homo sapiens
cugacauuguugaucacagcca

SEQ ID NO: 107583 - RNA, 22 nt, Homo sapiens
cugacuuuagaacccaaaaagu

SEQ ID NO: 107584 - RNA, 22 nt, Homo sapiens
cugagauaauuucuagguguca

SEQ ID NO: 107585 - RNA, 20 nt, Homo sapiens
cugauacagccugagcucuc

SEQ ID NO: 107586 - RNA, 22 nt, Homo sapiens
cugaugaaguauuuguucugga

SEQ ID NO: 107587 - RNA, 21 nt, Homo sapiens
cugcauccauuucugagugau

SEQ ID NO: 107588 - RNA, 22 nt, Homo sapiens
cugcauuagucuguuuaguguu

SEQ ID NO: 107589 - RNA, 22 nt, Homo sapiens
cuggaaugugagccccaaaaag

SEQ ID NO: 107590 - RNA, 22 nt, Homo sapiens
cuggcaagaggauaaaguccua

SEQ ID NO: 107591 - RNA, 22 nt, Homo sapiens
cuggcagucugccucuucacug

SEQ ID NO: 107592 - RNA, 22 nt, Homo sapiens
cugggcaaugcggcuggauaga

SEQ ID NO: 107593 - RNA, 22 nt, Homo sapiens
cuguaauguaaugagacuacau

SEQ ID NO: 107594 - RNA, 17 nt, Homo sapiens
cugugaugaucuugucu

SEQ ID NO: 107595 - RNA, 22 nt, Homo sapiens
cuuaaagcgaauauugguggua

SEQ ID NO: 107596 - RNA, 18 nt, Homo sapiens
cuuaacauugggaugaua

SEQ ID NO: 107597 - RNA, 22 nt, Homo sapiens
cuucaccaguuuggcagucuca

SEQ ID NO: 107598 - RNA, 18 nt, Homo sapiens
cuuccuuagucugguuaa

SEQ ID NO: 107599 - RNA, 22 nt, Homo sapiens
cuuggcauugccccuggaauuu

SEQ ID NO: 107600 - RNA, 22 nt, Homo sapiens
cuuuggcauuagccuguauaga

SEQ ID NO: 107601 - RNA, 22 nt, Homo sapiens
cuuuggccauagcuaaaugauu

SEQ ID NO: 107602 - RNA, 23 nt, Homo sapiens
cuuuguccccacccaaaucucau

SEQ ID NO: 107603 - RNA, 22 nt, Homo sapiens
cuuuuugcugcagcaauacugg

SEQ ID NO: 107604 - RNA, 22 nt, Homo sapiens
gacaaguuugauuuauuccaag

SEQ ID NO: 107605 - RNA, 22 nt, Homo sapiens
gacaucauuaugagauuuaaac

SEQ ID NO: 107606 - RNA, 21 nt, Homo sapiens
gacauggcgauacuccgucuc

SEQ ID NO: 107607 - RNA, 22 nt, Homo sapiens
gacucuguagacaaucacaucu

SEQ ID NO: 107608 - RNA, 22 nt, Homo sapiens
gacuucaucauacuaugugugg

SEQ ID NO: 107609 - RNA, 22 nt, Homo sapiens
gagacauugacuuuguuccaga

SEQ ID NO: 107610 - RNA, 22 nt, Homo sapiens
gagagaguacuugauauaauuu

SEQ ID NO: 107611 - RNA, 22 nt, Homo sapiens
gagaugaugagauguucacagu

SEQ ID NO: 107612 - RNA, 22 nt, Homo sapiens
gagauuauugucucccucacca

SEQ ID NO: 107613 - RNA, 22 nt, Homo sapiens
gagcaccagucccugucagugc

SEQ ID NO: 107614 - RNA, 22 nt, Homo sapiens
gagcagacaugaggaccgcugg

SEQ ID NO: 107615 - RNA, 22 nt, Homo sapiens
gagcugaauugcugccauuugc

SEQ ID NO: 107616 - RNA, 22 nt, Homo sapiens
gagcugaucuuuucugauucca

SEQ ID NO: 107617 - RNA, 22 nt, Homo sapiens
gagcugccuugccuaugcaaga

SEQ ID NO: 107618 - RNA, 22 nt, Homo sapiens
gagcuguuuuucacuagaccaa

SEQ ID NO: 107619 - RNA, 22 nt, Homo sapiens
gaggagucagacugugcaaggu

SEQ ID NO: 107620 - RNA, 22 nt, Homo sapiens
gaggaucucuugagcccagaag

SEQ ID NO: 107621 - RNA, 22 nt, Homo sapiens
gaggcggugugaugucacaugc

SEQ ID NO: 107622 - RNA, 22 nt, Homo sapiens
gagggcacugcuuuccuuucaa

SEQ ID NO: 107623 - RNA, 22 nt, Homo sapiens
gagguagggucccacuauguug

SEQ ID NO: 107624 - RNA, 22 nt, Homo sapiens
gagguguaaggacaacagagac

SEQ ID NO: 107625 - RNA, 22 nt, Homo sapiens
gaguucauaucuaugagugugc

SEQ ID NO: 107626 - RNA, 22 nt, Homo sapiens
gaguuuguacuaauuuguugua

SEQ ID NO: 107627 - RNA, 22 nt, Homo sapiens
gauaacagauaaugucaguuau

SEQ ID NO: 107628 - RNA, 21 nt, Homo sapiens
gauaucuuuauucccaagagc

SEQ ID NO: 107629 - RNA, 22 nt, Homo sapiens
gaucccauuggcugccaugugg

SEQ ID NO: 107630 - RNA, 22 nt, Homo sapiens
gaucugugugauuggaugcauu

SEQ ID NO: 107631 - RNA, 22 nt, Homo sapiens
gaugauguuggaaacuuggugc

SEQ ID NO: 107632 - RNA, 22 nt, Homo sapiens
gaugcaguaagaaugcauagcg

SEQ ID NO: 107633 - RNA, 21 nt, Homo sapiens
gcaaaguggcuaccuugcucc

SEQ ID NO: 107634 - RNA, 20 nt, Homo sapiens
gcaaaguuuagcucccacua

SEQ ID NO: 107635 - RNA, 22 nt, Homo sapiens
gcaaaugcuaugccauuuuaua

SEQ ID NO: 107636 - RNA, 22 nt, Homo sapiens
gcaagauguuaccauuagggaa

SEQ ID NO: 107637 - RNA, 23 nt, Homo sapiens
gcagcaaugucacagggguccgg

SEQ ID NO: 107638 - RNA, 22 nt, Homo sapiens
gcaguguucugggcaggaagaa

SEQ ID NO: 107639 - RNA, 22 nt, Homo sapiens
gcaguguugugauccaggucuu

SEQ ID NO: 107640 - RNA, 22 nt, Homo sapiens
gcaugacaaugauugcucuuca

SEQ ID NO: 107641 - RNA, 22 nt, Homo sapiens
gcauggaguggaaauucuuggg

SEQ ID NO: 107642 - RNA, 22 nt, Homo sapiens
gcccagcguucagggaggggcu

SEQ ID NO: 107643 - RNA, 17 nt, Homo sapiens
gcccuuugugccucuuc

SEQ ID NO: 107644 - RNA, 22 nt, Homo sapiens
gccuagagaguuaucaggcugu

SEQ ID NO: 107645 - RNA, 22 nt, Homo sapiens
gccuuuggugacaggcaugugu

SEQ ID NO: 107646 - RNA, 22 nt, Homo sapiens
gcuaggagaucugcugcucucu

SEQ ID NO: 107647 - RNA, 22 nt, Homo sapiens
gcugcuuuugaugacaaaaaca

SEQ ID NO: 107648 - RNA, 22 nt, Homo sapiens
gcuguauugacuuuguaucaua

SEQ ID NO: 107649 - RNA, 19 nt, Homo sapiens
gcuucuugaggacgaugac

SEQ ID NO: 107650 - RNA, 19 nt, Homo sapiens
gcuuguccacgugagauaa

SEQ ID NO: 107651 - RNA, 22 nt, Homo sapiens
ggaaagauguaauauuaucuaa

SEQ ID NO: 107652 - RNA, 17 nt, Homo sapiens
ggaaugaauuccagccc

SEQ ID NO: 107653 - RNA, 22 nt, Homo sapiens
ggaauguuaaagacuacacuga

SEQ ID NO: 107654 - RNA, 22 nt, Homo sapiens
ggacugagaggacuacagugua

SEQ ID NO: 107655 - RNA, 22 nt, Homo sapiens
ggagaucuuugaaguguugugc

SEQ ID NO: 107656 - RNA, 22 nt, Homo sapiens
ggcaaauucuuguaugccuacu

SEQ ID NO: 107657 - RNA, 21 nt, Homo sapiens
ggcaagaaacacaaucaagua

SEQ ID NO: 107658 - RNA, 22 nt, Homo sapiens
ggcaagaggagauucugcuccc

SEQ ID NO: 107659 - RNA, 19 nt, Homo sapiens
ggcaagaguuguucugugu

SEQ ID NO: 107660 - RNA, 22 nt, Homo sapiens
ggcacuguugccggccugaauu

SEQ ID NO: 107661 - RNA, 22 nt, Homo sapiens
ggccggguggccauggcugccc

SEQ ID NO: 107662 - RNA, 22 nt, Homo sapiens
ggcuacauuguuacaauuagua

SEQ ID NO: 107663 - RNA, 22 nt, Homo sapiens
ggcuuuggucacacaggggcaa

SEQ ID NO: 107664 - RNA, 22 nt, Homo sapiens
gggagcacaagaaauguuucau

SEQ ID NO: 107665 - RNA, 22 nt, Homo sapiens
gggauguaugauauauguuggu

SEQ ID NO: 107666 - RNA, 22 nt, Homo sapiens
gggcuagaauccgcgucucuug

SEQ ID NO: 107667 - RNA, 22 nt, Homo sapiens
gggguauguaagugagugagug

SEQ ID NO: 107668 - RNA, 19 nt, Homo sapiens
ggucauggagguuguguga

SEQ ID NO: 107669 - RNA, 22 nt, Homo sapiens
ggucauggauugucuuuucuug

SEQ ID NO: 107670 - RNA, 22 nt, Homo sapiens
aggugcuugagggaagaaauua

SEQ ID NO: 107671 - RNA, 22 nt, Homo sapiens
agucacagccuuuuacuuuaga

SEQ ID NO: 107672 - RNA, 22 nt, Homo sapiens
agucagugucuguaaggagaac

SEQ ID NO: 107673 - RNA, 22 nt, Homo sapiens
agugaaaucugaagaaggucau

SEQ ID NO: 107674 - RNA, 22 nt, Homo sapiens
agugaauguuggaaaguuauuu

SEQ ID NO: 107675 - RNA, 22 nt, Homo sapiens
aguggcaaugugauguccugaa

SEQ ID NO: 107676 - RNA, 19 nt, Homo sapiens
aguggguguuuucuguuug

SEQ ID NO: 107677 - RNA, 23 nt, Homo sapiens
aguggucuccugggcccagcugu

SEQ ID NO: 107678 - RNA, 22 nt, Homo sapiens
aguggugucugaguggccaggg

SEQ ID NO: 107679 - RNA, 22 nt, Homo sapiens
agugucaggagacagguagcug

SEQ ID NO: 107680 - RNA, 22 nt, Homo sapiens
auaaguagaaugauggucaaaa

SEQ ID NO: 107681 - RNA, 22 nt, Homo sapiens
auaaguauuuggacuuuacugu

SEQ ID NO: 107682 - RNA, 22 nt, Homo sapiens
auaauugcuaagugaagauggu

SEQ ID NO: 107683 - RNA, 19 nt, Homo sapiens
auacacguguauacauaca

SEQ ID NO: 107684 - RNA, 22 nt, Homo sapiens
auacaguaucuucuggcaagca

SEQ ID NO: 107685 - RNA, 22 nt, Homo sapiens
auacaguugccauuucuugugc

SEQ ID NO: 107686 - RNA, 22 nt, Homo sapiens
auacuccugucucagcugagau

SEQ ID NO: 107687 - RNA, 21 nt, Homo sapiens
auagcacuucacuugguuaga

SEQ ID NO: 107688 - RNA, 22 nt, Homo sapiens
auagguuauuagagcaaagcuu

SEQ ID NO: 107689 - RNA, 22 nt, Homo sapiens
auaugcacuauacacacguaua

SEQ ID NO: 107690 - RNA, 22 nt, Homo sapiens
auaugcauacauguaugcagga

SEQ ID NO: 107691 - RNA, 22 nt, Homo sapiens
auaugguguuugcuauucagcu

SEQ ID NO: 107692 - RNA, 22 nt, Homo sapiens
aucacaggcaaaauuccuucuc

SEQ ID NO: 107693 - RNA, 22 nt, Homo sapiens
aucacaguuaagaggugaugaa

SEQ ID NO: 107694 - RNA, 22 nt, Homo sapiens
aucacauggccuagccuaaccu

SEQ ID NO: 107695 - RNA, 22 nt, Homo sapiens
aucaccuggaggugaucacuug

SEQ ID NO: 107696 - RNA, 22 nt, Homo sapiens
aucaccuggaguagcccguccc

SEQ ID NO: 107697 - RNA, 22 nt, Homo sapiens
aucacuagaucauagguaaaca

SEQ ID NO: 107698 - RNA, 22 nt, Homo sapiens
aucacuguuuugaugcucggac

SEQ ID NO: 107699 - RNA, 22 nt, Homo sapiens
aucagauggcuaaaacagaaga

SEQ ID NO: 107700 - RNA, 22 nt, Homo sapiens
aucagcacugaucauacagcuu

SEQ ID NO: 107701 - RNA, 22 nt, Homo sapiens
aucagcagcaugaaaacaggcu

SEQ ID NO: 107702 - RNA, 22 nt, Homo sapiens
aucccuugacguggagucucug

SEQ ID NO: 107703 - RNA, 22 nt, Homo sapiens
aucucuugccagucagaauggu

SEQ ID NO: 107704 - RNA, 22 nt, Homo sapiens
aucuggcuucuuuuaguccaca

SEQ ID NO: 107705 - RNA, 22 nt, Homo sapiens
aucuguagauucagcacaagcu

SEQ ID NO: 107706 - RNA, 22 nt, Homo sapiens
aucugugaaugaaguuauuuug

SEQ ID NO: 107707 - RNA, 22 nt, Homo sapiens
augaaaacaugauuugccuguu

SEQ ID NO: 107708 - RNA, 22 nt, Homo sapiens
augaaagugauaaaugucucua

SEQ ID NO: 107709 - RNA, 22 nt, Homo sapiens
aaggagugugauucuucaguuu

SEQ ID NO: 107710 - RNA, 22 nt, Homo sapiens
aaggcaauuuguugugaggauu

SEQ ID NO: 107711 - RNA, 22 nt, Homo sapiens
aagggaaugcgcugccuguguu

SEQ ID NO: 107712 - RNA, 22 nt, Homo sapiens
aaggugcuguaagcauccaugu

SEQ ID NO: 107713 - RNA, 22 nt, Homo sapiens
aaguaauggaguuauuuuauga

SEQ ID NO: 107714 - RNA, 22 nt, Homo sapiens
aaguauuaugaguccuuguuuu

SEQ ID NO: 107715 - RNA, 22 nt, Homo sapiens
aagucaguuugggagaagcuau

SEQ ID NO: 107716 - RNA, 22 nt, Homo sapiens
aagugaaugaugugaaguguaa

SEQ ID NO: 107717 - RNA, 22 nt, Homo sapiens
aagugagaugcaguggaguucc

SEQ ID NO: 107718 - RNA, 22 nt, Homo sapiens
aagugaguaauacgucaguugu

SEQ ID NO: 107719 - RNA, 22 nt, Homo sapiens
aagugcuuacagggaacaugau

SEQ ID NO: 107720 - RNA, 22 nt, Homo sapiens
aauaagcugagagaauucuaca

SEQ ID NO: 107721 - RNA, 22 nt, Homo sapiens
aauacugaaaguauuuucaaau

SEQ ID NO: 107722 - RNA, 22 nt, Homo sapiens
aauacugagaugugagguacua

SEQ ID NO: 107723 - RNA, 22 nt, Homo sapiens
aauacugugauaucgagcgauu

SEQ ID NO: 107724 - RNA, 22 nt, Homo sapiens
aauaucacaguggguguacacc

SEQ ID NO: 107725 - RNA, 22 nt, Homo sapiens
aaucacacuugauguugagcaa

SEQ ID NO: 107726 - RNA, 22 nt, Homo sapiens
aaucacaggucuuggcugcaug

SEQ ID NO: 107727 - RNA, 22 nt, Homo sapiens
aauccaugugcuuuaccauuuu

SEQ ID NO: 107728 - RNA, 22 nt, Homo sapiens
aaugacagccagauucuucucu

SEQ ID NO: 107729 - RNA, 22 nt, Homo sapiens
aaugcaucuagaaaggugaauu

SEQ ID NO: 107730 - RNA, 22 nt, Homo sapiens
aauggcaaauguuuucuguuga

SEQ ID NO: 107731 - RNA, 22 nt, Homo sapiens
aauggcauugguccuuuuggau

SEQ ID NO: 107732 - RNA, 22 nt, Homo sapiens
aaugucaugaguccaaccagaa

SEQ ID NO: 107733 - RNA, 22 nt, Homo sapiens
aauuaggcuagaauguuauuaa

SEQ ID NO: 107734 - RNA, 22 nt, Homo sapiens
aauuaguugucgugagaguggu

SEQ ID NO: 107735 - RNA, 22 nt, Homo sapiens
acaaagcgcuucucuuuagagu

SEQ ID NO: 107736 - RNA, 22 nt, Homo sapiens
acaaagcuagggaauccaucuu

SEQ ID NO: 107737 - RNA, 22 nt, Homo sapiens
acaaaguguuuucugaaggccu

SEQ ID NO: 107738 - RNA, 22 nt, Homo sapiens
acaccuguggucccaguaacuu

SEQ ID NO: 107739 - RNA, 22 nt, Homo sapiens
acacugucaugucucacaggca

SEQ ID NO: 107740 - RNA, 22 nt, Homo sapiens
acacugucugaugaaaguaguu

SEQ ID NO: 107741 - RNA, 20 nt, Homo sapiens
acagcauagccuuuuaaagc

SEQ ID NO: 107742 - RNA, 22 nt, Homo sapiens
acaggugaaguauuacacuaag

SEQ ID NO: 107743 - RNA, 22 nt, Homo sapiens
acaguaaugggccccuuuuccu

SEQ ID NO: 107744 - RNA, 22 nt, Homo sapiens
acaguacaugauaaauaaggua

SEQ ID NO: 107745 - RNA, 22 nt, Homo sapiens
acaguagugggcuacagaauca

SEQ ID NO: 107746 - RNA, 18 nt, Homo sapiens
acagugcuggcaugagau

SEQ ID NO: 107747 - RNA, 22 nt, Homo sapiens
acagugcuguuguguuuucacg

SEQ ID NO: 107748 - RNA, 22 nt, Homo sapiens
acauaaagaagcaggacauugu

SEQ ID NO: 107749 - RNA, 22 nt, Homo sapiens
acaugcauauguuggaagaaag

SEQ ID NO: 107750 - RNA, 22 nt, Homo sapiens
acauggcacugcgggcuucuug

SEQ ID NO: 107751 - RNA, 22 nt, Homo sapiens
acccuggaguaguaggaaucug

SEQ ID NO: 107752 - RNA, 22 nt, Homo sapiens
acccuuugucaaucaguacuaa

SEQ ID NO: 107753 - RNA, 22 nt, Homo sapiens
acgugccuuguuguucauauga

SEQ ID NO: 107754 - RNA, 19 nt, Homo sapiens
acugagcuaccugggggca

SEQ ID NO: 107755 - RNA, 21 nt, Homo sapiens
acugcacuccaaccucaacag

SEQ ID NO: 107756 - RNA, 22 nt, Homo sapiens
acugcacuccaaccuguugggc

SEQ ID NO: 107757 - RNA, 22 nt, Homo sapiens
acugcacuccacccuuggcagc

SEQ ID NO: 107758 - RNA, 22 nt, Homo sapiens
acugcacuccaccuugggcaac

SEQ ID NO: 107759 - RNA, 22 nt, Homo sapiens
acugcacuccagcccgggugac

SEQ ID NO: 107760 - RNA, 22 nt, Homo sapiens
acugcacuccagccuccugggu

SEQ ID NO: 107761 - RNA, 22 nt, Homo sapiens
acugcacuccagccugcuggau

SEQ ID NO: 107762 - RNA, 22 nt, Homo sapiens
acugcacuccagccuggacgaa

SEQ ID NO: 107763 - RNA, 22 nt, Homo sapiens
acugcacuccagccuguugaca

SEQ ID NO: 107764 - RNA, 22 nt, Homo sapiens
acugcacuccagccuucggaca

SEQ ID NO: 107765 - RNA, 22 nt, Homo sapiens
acugcacuccagccuucgugac

SEQ ID NO: 107766 - RNA, 22 nt, Homo sapiens
acugcacuccagccuugcgaca

SEQ ID NO: 107767 - RNA, 22 nt, Homo sapiens
acugcacuccagccuuggcggc

SEQ ID NO: 107768 - RNA, 22 nt, Homo sapiens
acugcacuccagcuugggugac

SEQ ID NO: 107769 - RNA, 22 nt, Homo sapiens
acugcacuccagcuuuggguga

SEQ ID NO: 107770 - RNA, 18 nt, Homo sapiens
acugcacuccauccuagg

SEQ ID NO: 107771 - RNA, 22 nt, Homo sapiens
acugcacucccgcccgggugac

SEQ ID NO: 107772 - RNA, 22 nt, Homo sapiens
acugcacuccggccuggcaaca

SEQ ID NO: 107773 - RNA, 22 nt, Homo sapiens
acugcacuccuccuugggugac

SEQ ID NO: 107774 - RNA, 22 nt, Homo sapiens
acugcacucuagccccugcgac

SEQ ID NO: 107775 - RNA, 22 nt, Homo sapiens
acugcacuuauccuccaauguu

SEQ ID NO: 107776 - RNA, 20 nt, Homo sapiens
acugcacuucagccugcugg

SEQ ID NO: 107777 - RNA, 22 nt, Homo sapiens
acugcacuucagccuuggcuac

SEQ ID NO: 107778 - RNA, 22 nt, Homo sapiens
acugcacuucagccuuggggac

SEQ ID NO: 107779 - RNA, 22 nt, Homo sapiens
agaacacugaguucagggucag

SEQ ID NO: 107780 - RNA, 22 nt, Homo sapiens
agaauaauguccccccaaggga

SEQ ID NO: 107781 - RNA, 22 nt, Homo sapiens
agacagcugguagcacuuccug

SEQ ID NO: 107782 - RNA, 18 nt, Homo sapiens
agagcacugaguuuuaga

SEQ ID NO: 107783 - RNA, 22 nt, Homo sapiens
agagcauugaguuaaugguuca

SEQ ID NO: 107784 - RNA, 22 nt, Homo sapiens
agagguaagcaguggcaagugc

SEQ ID NO: 107785 - RNA, 22 nt, Homo sapiens
agcaacauuguucauaauagcu

SEQ ID NO: 107786 - RNA, 22 nt, Homo sapiens
agcaauaugacauugcuacauc

SEQ ID NO: 107787 - RNA, 22 nt, Homo sapiens
agcacagccuuguguuuucuug

SEQ ID NO: 107788 - RNA, 22 nt, Homo sapiens
agcagguguccacaauguuugc

SEQ ID NO: 107789 - RNA, 22 nt, Homo sapiens
agcagugugagaauggacuaau

SEQ ID NO: 107790 - RNA, 23 nt, Homo sapiens
agccuguugccuaggcagcucau

SEQ ID NO: 107791 - RNA, 22 nt, Homo sapiens
agcgccacugcacuccagccug

SEQ ID NO: 107792 - RNA, 22 nt, Homo sapiens
agcuauauugaggaugccauuc

SEQ ID NO: 107793 - RNA, 20 nt, Homo sapiens
agcugcagauauaaauccgc

SEQ ID NO: 107794 - RNA, 22 nt, Homo sapiens
agcugguuuaauaugcugucug

SEQ ID NO: 107795 - RNA, 22 nt, Homo sapiens
agcugguuuauuucucacaaca

SEQ ID NO: 107796 - RNA, 22 nt, Homo sapiens
agcuugugauuuagagugagag

SEQ ID NO: 107797 - RNA, 22 nt, Homo sapiens
aggaaugcuaaguuuuccuccu

SEQ ID NO: 107798 - RNA, 22 nt, Homo sapiens
aggacacugagcaugggagguu

SEQ ID NO: 107799 - RNA, 22 nt, Homo sapiens
aggcaaaugccagcaaucacac

SEQ ID NO: 107800 - RNA, 22 nt, Homo sapiens
aggcaggugaaagauaguuuua

SEQ ID NO: 107801 - RNA, 22 nt, Homo sapiens
agggcuuaucuguguagaguuc

SEQ ID NO: 107802 - RNA, 22 nt, Homo sapiens
agguagaguguuuuguucuucu

SEQ ID NO: 107803 - RNA, 22 nt, Homo sapiens
agguauuuucaacuuagaaugg

SEQ ID NO: 107804 - RNA, 23 nt, Homo sapiens
agguuaugauuauagagcgagga

SEQ ID NO: 107805 - RNA, 22 nt, Homo sapiens
agcagcacaucccuuucuggcc

SEQ ID NO: 107806 - RNA, 22 nt, Homo sapiens
agcaucacaugggcugcuuggg

SEQ ID NO: 107807 - RNA, 17 nt, Homo sapiens
agcauguguuugagauu

SEQ ID NO: 107808 - RNA, 17 nt, Homo sapiens
agccccauuagcuaguu

SEQ ID NO: 107809 - RNA, 23 nt, Homo sapiens
agccugguuucccugcuucuccc

SEQ ID NO: 107810 - RNA, 22 nt, Homo sapiens
agcuagcauucauaguuugagg

SEQ ID NO: 107811 - RNA, 22 nt, Homo sapiens
agcucuuguuaguauuagcagu

SEQ ID NO: 107812 - RNA, 22 nt, Homo sapiens
agcugccagucuuguaaggccu

SEQ ID NO: 107813 - RNA, 22 nt, Homo sapiens
agcuguaguuugguggauguaa

SEQ ID NO: 107814 - RNA, 22 nt, Homo sapiens
agcuucauucugaauagguuga

SEQ ID NO: 107815 - RNA, 21 nt, Homo sapiens
agcuuguguguaucacagugu

SEQ ID NO: 107816 - RNA, 22 nt, Homo sapiens
agcuuuuugggcagcuauugac

SEQ ID NO: 107817 - RNA, 22 nt, Homo sapiens
aggaagacugaaauugcuguuc

SEQ ID NO: 107818 - RNA, 22 nt, Homo sapiens
aggagaugaagcuuuaucuaaa

SEQ ID NO: 107819 - RNA, 23 nt, Homo sapiens
aggagcuuagaaguugccauugc

SEQ ID NO: 107820 - RNA, 22 nt, Homo sapiens
aggcaaugugagaguuuauuca

SEQ ID NO: 107821 - RNA, 22 nt, Homo sapiens
aggcaugugugcagacugucug

SEQ ID NO: 107822 - RNA, 22 nt, Homo sapiens
aggugaaugcucacauucuaau

SEQ ID NO: 107823 - RNA, 22 nt, Homo sapiens
aggugcuaucugguuuuauagu

SEQ ID NO: 107824 - RNA, 22 nt, Homo sapiens
agucacaugccagcacacccag

SEQ ID NO: 107825 - RNA, 22 nt, Homo sapiens
agucagugcauaagaaugaagu

SEQ ID NO: 107826 - RNA, 22 nt, Homo sapiens
agugacaugggaucaaaucuga

SEQ ID NO: 107827 - RNA, 22 nt, Homo sapiens
agugccacugcacucuagccug

SEQ ID NO: 107828 - RNA, 22 nt, Homo sapiens
agugguuugaucacagcucacu

SEQ ID NO: 107829 - RNA, 22 nt, Homo sapiens
aguuagcaaaacucccaaaggu

SEQ ID NO: 107830 - RNA, 22 nt, Homo sapiens
auaaaugcaaugguauuuuuga

SEQ ID NO: 107831 - RNA, 22 nt, Homo sapiens
auaagaucauuugcuaagaggg

SEQ ID NO: 107832 - RNA, 22 nt, Homo sapiens
auaagugagugauucaguguua

SEQ ID NO: 107833 - RNA, 22 nt, Homo sapiens
auaauagcugaucauuuagaag

SEQ ID NO: 107834 - RNA, 22 nt, Homo sapiens
auacagugaauacuuacagugu

SEQ ID NO: 107835 - RNA, 23 nt, Homo sapiens
auagagcuaggaugcagacagau

SEQ ID NO: 107836 - RNA, 22 nt, Homo sapiens
auagcacuuaccacaggcugca

SEQ ID NO: 107837 - RNA, 22 nt, Homo sapiens
auagcacuuauagauuuggucu

SEQ ID NO: 107838 - RNA, 22 nt, Homo sapiens
auagggcacgagaugugagccu

SEQ ID NO: 107839 - RNA, 22 nt, Homo sapiens
auauucacagguaucagagauu

SEQ ID NO: 107840 - RNA, 22 nt, Homo sapiens
auauuggucuucaagaccugug

SEQ ID NO: 107841 - RNA, 22 nt, Homo sapiens
aucaaaguaggcauauguuuuu

SEQ ID NO: 107842 - RNA, 22 nt, Homo sapiens
aucaaaguaucucaauauggua

SEQ ID NO: 107843 - RNA, 22 nt, Homo sapiens
aucaaagugaauuaaugagaau

SEQ ID NO: 107844 - RNA, 22 nt, Homo sapiens
aucacagagucacgggcaacuu

SEQ ID NO: 107845 - RNA, 22 nt, Homo sapiens
aucacagaguuaaaacuuucuu

SEQ ID NO: 107846 - RNA, 22 nt, Homo sapiens
aucacagguacuauggcugaca

SEQ ID NO: 107847 - RNA, 22 nt, Homo sapiens
aucaccugagcaguauacacug

SEQ ID NO: 107848 - RNA, 22 nt, Homo sapiens
aucagaaucucuugagaguguu

SEQ ID NO: 107849 - RNA, 22 nt, Homo sapiens
aucauccugucaggagcuguga

SEQ ID NO: 107850 - RNA, 22 nt, Homo sapiens
aucaugucuucccagugauucu

SEQ ID NO: 107851 - RNA, 22 nt, Homo sapiens
auccacaugcaguuggaaacag

SEQ ID NO: 107852 - RNA, 22 nt, Homo sapiens
aucccagaaacucggguuucuc

SEQ ID NO: 107853 - RNA, 22 nt, Homo sapiens
aucccugugacgagcaucccua

SEQ ID NO: 107854 - RNA, 22 nt, Homo sapiens
auccugaugacacagugcugca

SEQ ID NO: 107855 - RNA, 22 nt, Homo sapiens
aucuacagccagucugguuugu

SEQ ID NO: 107856 - RNA, 22 nt, Homo sapiens
aucucaguuaauuccaucuuuc

SEQ ID NO: 107857 - RNA, 22 nt, Homo sapiens
aucugcaaagcugggcugagac

SEQ ID NO: 107858 - RNA, 22 nt, Homo sapiens
aucuuguguugaauggugcaga

SEQ ID NO: 107859 - RNA, 22 nt, Homo sapiens
augaaagguugucuuaagccau

SEQ ID NO: 107860 - RNA, 22 nt, Homo sapiens
augaaaguguguggaaacuuga

SEQ ID NO: 107861 - RNA, 22 nt, Homo sapiens
augaaaugcauguuaaguccgu

SEQ ID NO: 107862 - RNA, 22 nt, Homo sapiens
augaagauguugccuuuuuaau

SEQ ID NO: 107863 - RNA, 22 nt, Homo sapiens
augacauugaaaagcaagugga

SEQ ID NO: 107864 - RNA, 19 nt, Homo sapiens
augacauuuggggguggac

SEQ ID NO: 107865 - RNA, 22 nt, Homo sapiens
augacuauugcacuuuccuggu

SEQ ID NO: 107866 - RNA, 22 nt, Homo sapiens
augacugucuugcagaggcuau

SEQ ID NO: 107867 - RNA, 22 nt, Homo sapiens
augagcagaagagauacacugu

SEQ ID NO: 107868 - RNA, 22 nt, Homo sapiens
augaggaagucaggcccagggg

SEQ ID NO: 107869 - RNA, 22 nt, Homo sapiens
augagggcggacgcccuggaga

SEQ ID NO: 107870 - RNA, 22 nt, Homo sapiens
augaggugcagaggaaaugagu

SEQ ID NO: 107871 - RNA, 22 nt, Homo sapiens
augauggagguagauuguccau

SEQ ID NO: 107872 - RNA, 22 nt, Homo sapiens
augcaaaucuuaaguaugugug

SEQ ID NO: 107873 - RNA, 22 nt, Homo sapiens
augcagaucacauuuuucuguc

SEQ ID NO: 107874 - RNA, 22 nt, Homo sapiens
augcagcugaggguaguggagc

SEQ ID NO: 107875 - RNA, 22 nt, Homo sapiens
augcccauuuguuuucugaaag

SEQ ID NO: 107876 - RNA, 19 nt, Homo sapiens
augcugguguugcucaaac

SEQ ID NO: 107877 - RNA, 22 nt, Homo sapiens
auggaauguaaguuauguuugc

SEQ ID NO: 107878 - RNA, 22 nt, Homo sapiens
auggaauguauagucauguagg

SEQ ID NO: 107879 - RNA, 22 nt, Homo sapiens
auggauguucuagggaugugau

SEQ ID NO: 107880 - RNA, 22 nt, Homo sapiens
auggcacagacucuuggucaag

SEQ ID NO: 107881 - RNA, 22 nt, Homo sapiens
auggcacagaguagaugcucaa

SEQ ID NO: 107882 - RNA, 22 nt, Homo sapiens
auggcccugcuaccacuuuucu

SEQ ID NO: 107883 - RNA, 20 nt, Homo sapiens
auggcccugcugggaguguc

SEQ ID NO: 107884 - RNA, 22 nt, Homo sapiens
auggccuuucuggcacauuucc

SEQ ID NO: 107885 - RNA, 22 nt, Homo sapiens
auggcuagaaccuguauauuca

SEQ ID NO: 107886 - RNA, 22 nt, Homo sapiens
auggcucuguuccaugugucuu

SEQ ID NO: 107887 - RNA, 22 nt, Homo sapiens
auggcucuuauuauuugaggua

SEQ ID NO: 107888 - RNA, 22 nt, Homo sapiens
auggcucuuauuauuuugaggu

SEQ ID NO: 107889 - RNA, 22 nt, Homo sapiens
auggcuuugggcugcucugccc

SEQ ID NO: 107890 - RNA, 22 nt, Homo sapiens
auggcuuuguguucagagcuga

SEQ ID NO: 107891 - RNA, 22 nt, Homo sapiens
auggcuuuuauuguguugaggu

SEQ ID NO: 107892 - RNA, 22 nt, Homo sapiens
augggagugugguuagagaccu

SEQ ID NO: 107893 - RNA, 22 nt, Homo sapiens
augguuuauuuguaagcagagu

SEQ ID NO: 107894 - RNA, 22 nt, Homo sapiens
auguaauguuaaauugcuaauu

SEQ ID NO: 107895 - RNA, 22 nt, Homo sapiens
auguggaaagcagcaugauaug

SEQ ID NO: 107896 - RNA, 22 nt, Homo sapiens
augugggaggacuuggcuguug

SEQ ID NO: 107897 - RNA, 22 nt, Homo sapiens
auguugcaguuuaauuauccua

SEQ ID NO: 107898 - RNA, 22 nt, Homo sapiens
auuaacaucuagaguuuuggug

SEQ ID NO: 107899 - RNA, 22 nt, Homo sapiens
auuagguuaggcaaacuucugu

SEQ ID NO: 107900 - RNA, 22 nt, Homo sapiens
uggaaucuagagaaaugcaaac

SEQ ID NO: 107901 - RNA, 20 nt, Homo sapiens
uggaaucugaagaucucagu

SEQ ID NO: 107902 - RNA, 22 nt, Homo sapiens
uggaauguagcguugacacgag

SEQ ID NO: 107903 - RNA, 18 nt, Homo sapiens
uggaauguuuggguuaau

SEQ ID NO: 107904 - RNA, 22 nt, Homo sapiens
uggagugauaugguuauauggg

SEQ ID NO: 107905 - RNA, 22 nt, Homo sapiens
uggaguuugacaugccuuuggg

SEQ ID NO: 107906 - RNA, 22 nt, Homo sapiens
uggcaaaauggaauauguuggg

SEQ ID NO: 107907 - RNA, 22 nt, Homo sapiens
uggcaaagugugacgugggggu

SEQ ID NO: 107908 - RNA, 22 nt, Homo sapiens
uggcaaaucagaggcauggaca

SEQ ID NO: 107909 - RNA, 22 nt, Homo sapiens
uggcacuggagauacauuaaua

SEQ ID NO: 107910 - RNA, 22 nt, Homo sapiens
uggcagugggagauauuuuauu

SEQ ID NO: 107911 - RNA, 22 nt, Homo sapiens
uggcauuuuguuuuagaauuag

SEQ ID NO: 107912 - RNA, 22 nt, Homo sapiens
uggccaagagcacagauauugg

SEQ ID NO: 107913 - RNA, 21 nt, Homo sapiens
uggcuauuucuguggcauaca

SEQ ID NO: 107914 - RNA, 22 nt, Homo sapiens
uggcucuuucuagacuuaauua

SEQ ID NO: 107915 - RNA, 20 nt, Homo sapiens
uggcucuuugcugcuaaagu

SEQ ID NO: 107916 - RNA, 22 nt, Homo sapiens
uggcuuuuauuauguugaggua

SEQ ID NO: 107917 - RNA, 22 nt, Homo sapiens
ugggaagagggagcgauuuugg

SEQ ID NO: 107918 - RNA, 22 nt, Homo sapiens
ugggagacuacauuuuuaacaa

SEQ ID NO: 107919 - RNA, 22 nt, Homo sapiens
ugggauccaugugguuuaagca

SEQ ID NO: 107920 - RNA, 22 nt, Homo sapiens
ugggcaaauugugagggaggua

SEQ ID NO: 107921 - RNA, 22 nt, Homo sapiens
ugggcaagugacuuggcuucuc

SEQ ID NO: 107922 - RNA, 22 nt, Homo sapiens
uggugccgugguccuggggcca

SEQ ID NO: 107923 - RNA, 15 nt, Homo sapiens
uggugguguugagac

SEQ ID NO: 107924 - RNA, 22 nt, Homo sapiens
uguaacaggaggaaaaugugaa

SEQ ID NO: 107925 - RNA, 18 nt, Homo sapiens
uguagcaccuuucuugug

SEQ ID NO: 107926 - RNA, 22 nt, Homo sapiens
ugucaaagagacaucugcacuc

SEQ ID NO: 107927 - RNA, 22 nt, Homo sapiens
ugucacaguuuguacuuuauag

SEQ ID NO: 107928 - RNA, 22 nt, Homo sapiens
ugucagaaucuagaggcugcua

SEQ ID NO: 107929 - RNA, 22 nt, Homo sapiens
ugucaugguguuaauuuuccug

SEQ ID NO: 107930 - RNA, 22 nt, Homo sapiens
ugucauguaaagaguaaauggu

SEQ ID NO: 107931 - RNA, 22 nt, Homo sapiens
ugucaugucuuuguguaucaau

SEQ ID NO: 107932 - RNA, 16 nt, Homo sapiens
uguccaaauaaauaca

SEQ ID NO: 107933 - RNA, 22 nt, Homo sapiens
uguccaaaucagagguaccaaa

SEQ ID NO: 107934 - RNA, 22 nt, Homo sapiens
uguccugcagagguguuugccu

SEQ ID NO: 107935 - RNA, 22 nt, Homo sapiens
ugucuaguuuugaaguauagca

SEQ ID NO: 107936 - RNA, 22 nt, Homo sapiens
ugucucaguuucuguggguuag

SEQ ID NO: 107937 - RNA, 22 nt, Homo sapiens
ugucuuguagacaauguauagu

SEQ ID NO: 107938 - RNA, 22 nt, Homo sapiens
ugugaacauuuuguauauauua

SEQ ID NO: 107939 - RNA, 19 nt, Homo sapiens
ugugacugggccagccuag

SEQ ID NO: 107940 - RNA, 20 nt, Homo sapiens
ugugagacugguuuugaacu

SEQ ID NO: 107941 - RNA, 22 nt, Homo sapiens
ugugagaucucagaauugaacu

SEQ ID NO: 107942 - RNA, 22 nt, Homo sapiens
ugugaugugaugagaaguuccu

SEQ ID NO: 107943 - RNA, 22 nt, Homo sapiens
ugugauuauuuaaauaggacag

SEQ ID NO: 107944 - RNA, 22 nt, Homo sapiens
ugugccacugcacuccugccug

SEQ ID NO: 107945 - RNA, 22 nt, Homo sapiens
ugugccacugcacuccugggug

SEQ ID NO: 107946 - RNA, 22 nt, Homo sapiens
ugugccacugcacuucagccug

SEQ ID NO: 107947 - RNA, 22 nt, Homo sapiens
ugugccuacugugggagcguca

SEQ ID NO: 107948 - RNA, 22 nt, Homo sapiens
ugugcuauguuauucacauggg

SEQ ID NO: 107949 - RNA, 22 nt, Homo sapiens
ugugcuugcuucuucuccuagu

SEQ ID NO: 107950 - RNA, 22 nt, Homo sapiens
uguggcuuuuucuuggcugagg

SEQ ID NO: 107951 - RNA, 21 nt, Homo sapiens
uguuuuugcuguguaucucuc

SEQ ID NO: 107952 - RNA, 22 nt, Homo sapiens
uuaaaaguauaggccuggcaua

SEQ ID NO: 107953 - RNA, 22 nt, Homo sapiens
uuaaaguaauugaaauggccuu

SEQ ID NO: 107954 - RNA, 22 nt, Homo sapiens
uuaaagugcuguuuuugccggg

SEQ ID NO: 107955 - RNA, 22 nt, Homo sapiens
uuaaaguguuugcagacaggug

SEQ ID NO: 107956 - RNA, 22 nt, Homo sapiens
uuaaauacagcaugguguuucu

SEQ ID NO: 107957 - RNA, 22 nt, Homo sapiens
uuaaaugcucacauaaagguag

SEQ ID NO: 107958 - RNA, 22 nt, Homo sapiens
uuaacagucacuuagcucauuu

SEQ ID NO: 107959 - RNA, 22 nt, Homo sapiens
uuaacaguugcaugagacugag

SEQ ID NO: 107960 - RNA, 22 nt, Homo sapiens
uuaagaagugauuuuccucauu

SEQ ID NO: 107961 - RNA, 22 nt, Homo sapiens
uuaaggcuuguacuuguuuucu

SEQ ID NO: 107962 - RNA, 22 nt, Homo sapiens
uuaaggcuuuaaguaaacacag

SEQ ID NO: 107963 - RNA, 22 nt, Homo sapiens
uuaagugcucaguuacucaguu

SEQ ID NO: 107964 - RNA, 22 nt, Homo sapiens
uuacaguaugaguaagaguucu

SEQ ID NO: 107965 - RNA, 22 nt, Homo sapiens
uuacaucaucacauuaguuugc

SEQ ID NO: 107966 - RNA, 22 nt, Homo sapiens
uugaaaguaaacaucacaaaga

SEQ ID NO: 107967 - RNA, 22 nt, Homo sapiens
uugaaaucuuccacagcccaag

SEQ ID NO: 107968 - RNA, 22 nt, Homo sapiens
uugaauagacagccagcuuuaa

SEQ ID NO: 107969 - RNA, 18 nt, Homo sapiens
uugaauagagccaagcac

SEQ ID NO: 107970 - RNA, 22 nt, Homo sapiens
uugacagagaaaagugugacuu

SEQ ID NO: 107971 - RNA, 22 nt, Homo sapiens
uugacauaaucauuucacagug

SEQ ID NO: 107972 - RNA, 22 nt, Homo sapiens
uugacauauguguguccacaua

SEQ ID NO: 107973 - RNA, 22 nt, Homo sapiens
uugagagaaaaaauuuauuggu

SEQ ID NO: 107974 - RNA, 22 nt, Homo sapiens
uugagaucaugcuacugcacuc

SEQ ID NO: 107975 - RNA, 22 nt, Homo sapiens
uugagaucuacuacuguaggag

SEQ ID NO: 107976 - RNA, 22 nt, Homo sapiens
uugagcacauguguuaaggggu

SEQ ID NO: 107977 - RNA, 22 nt, Homo sapiens
uugagcucaucaagauagagaa

SEQ ID NO: 107978 - RNA, 22 nt, Homo sapiens
uugaggaggcagucuucccauu

SEQ ID NO: 107979 - RNA, 22 nt, Homo sapiens
uugaguaguaaggauauuaucu

SEQ ID NO: 107980 - RNA, 20 nt, Homo sapiens
uugcagagcccaacccugga

SEQ ID NO: 107981 - RNA, 22 nt, Homo sapiens
uugcuauguugcccagucugga

SEQ ID NO: 107982 - RNA, 22 nt, Homo sapiens
uugcugguuuucauaugagcag

SEQ ID NO: 107983 - RNA, 22 nt, Homo sapiens
uugcuuaggcuggagugcagug

SEQ ID NO: 107984 - RNA, 22 nt, Homo sapiens
uugcuucauucaacauugaggg

SEQ ID NO: 107985 - RNA, 22 nt, Homo sapiens
uugcuucuuucgucuggcccca

SEQ ID NO: 107986 - RNA, 22 nt, Homo sapiens
uuggaagacaaugcugauucuc

SEQ ID NO: 107987 - RNA, 23 nt, Homo sapiens
uuggaaugagaccuaagaguuuu

SEQ ID NO: 107988 - RNA, 22 nt, Homo sapiens
uuggagagugauauucagaugc

SEQ ID NO: 107989 - RNA, 22 nt, Homo sapiens
uuggauuuuaacaaacuaggug

SEQ ID NO: 107990 - RNA, 22 nt, Homo sapiens
uuggcaacauagugagaccccc

SEQ ID NO: 107991 - RNA, 22 nt, Homo sapiens
uuggcaaguccccaccucucuc

SEQ ID NO: 107992 - RNA, 22 nt, Homo sapiens
uuggcauagaggcucucaagcu

SEQ ID NO: 107993 - RNA, 22 nt, Homo sapiens
uuggccccuccaaaucucaugu

SEQ ID NO: 107994 - RNA, 22 nt, Homo sapiens
uuggccccucccaaauuucaug

SEQ ID NO: 107995 - RNA, 22 nt, Homo sapiens
uuggccccuuucauccacagcu

SEQ ID NO: 107996 - RNA, 22 nt, Homo sapiens
uuggcuuuuaugcagcuuaggu

SEQ ID NO: 107997 - RNA, 22 nt, Homo sapiens
uugggacuggaaggaguaaggg

SEQ ID NO: 107998 - RNA, 22 nt, Homo sapiens
uuggguaguauagaagcaacaa

SEQ ID NO: 107999 - RNA, 22 nt, Homo sapiens
uuggguagugaguuccuccagg

SEQ ID NO: 108000 - RNA, 23 nt, Homo sapiens
uuggucucccaaaguguugagau

SEQ ID NO: 108001 - RNA, 22 nt, Homo sapiens
uuguaaaguucuuaggaagcuc

SEQ ID NO: 108002 - RNA, 22 nt, Homo sapiens
uuguacuagucauauuuugaaa

SEQ ID NO: 108003 - RNA, 22 nt, Homo sapiens
uugucuccuagacgaccaggcg

SEQ ID NO: 108004 - RNA, 22 nt, Homo sapiens
uugugagggagcuaagaugagu

SEQ ID NO: 108005 - RNA, 21 nt, Homo sapiens
uugugccaaacccuggaggga

SEQ ID NO: 108006 - RNA, 23 nt, Homo sapiens
uugugucccuacccaaaucucau

SEQ ID NO: 108007 - RNA, 22 nt, Homo sapiens
uuuaaagcaugacgagaagaag

SEQ ID NO: 108008 - RNA, 22 nt, Homo sapiens
uuuaaagcuccaagcaugucug

SEQ ID NO: 108009 - RNA, 22 nt, Homo sapiens
uuuaaaguuagaaggaaagggc

SEQ ID NO: 108010 - RNA, 22 nt, Homo sapiens
uuuaaugcaucccaaaauguag

SEQ ID NO: 108011 - RNA, 22 nt, Homo sapiens
uuuaaugcgucucugaguuuug

SEQ ID NO: 108012 - RNA, 22 nt, Homo sapiens
uuuacagucucauagguggaag

SEQ ID NO: 108013 - RNA, 22 nt, Homo sapiens
uuuacccugaggaaucuauuuu

SEQ ID NO: 108014 - RNA, 22 nt, Homo sapiens
uuuagcagcaaagagcuguguu

SEQ ID NO: 108015 - RNA, 22 nt, Homo sapiens
uuuaucaggccuuuggaaaaau

SEQ ID NO: 108016 - RNA, 19 nt, Homo sapiens
uuucaauguaaggauggag

SEQ ID NO: 108017 - RNA, 22 nt, Homo sapiens
uuucacaguguucucccccaga

SEQ ID NO: 108018 - RNA, 22 nt, Homo sapiens
uuucagagucaucugcccaagu

SEQ ID NO: 108019 - RNA, 22 nt, Homo sapiens
uuucccuuuagcuuagugauuu

SEQ ID NO: 108020 - RNA, 22 nt, Homo sapiens
uuucgugucuggucugugaugg

SEQ ID NO: 108021 - RNA, 22 nt, Homo sapiens
uuugaggaaaggcauaaguagg

SEQ ID NO: 108022 - RNA, 22 nt, Homo sapiens
uuugaguuugaggugcugauga

SEQ ID NO: 108023 - RNA, 22 nt, Homo sapiens
uuugcugagucauuccaugcug

SEQ ID NO: 108024 - RNA, 22 nt, Homo sapiens
uuuggcauuuaaauaugcaugg

SEQ ID NO: 108025 - RNA, 22 nt, Homo sapiens
uuuggcuuugagaagcagugga

SEQ ID NO: 108026 - RNA, 22 nt, Homo sapiens
uuugggaaaugaaguugguaga

SEQ ID NO: 108027 - RNA, 22 nt, Homo sapiens
uuugggaaugguuugucuccca

SEQ ID NO: 108028 - RNA, 22 nt, Homo sapiens
uuugggccaugcuucccgguca

SEQ ID NO: 108029 - RNA, 22 nt, Homo sapiens
uuucuacagggcuugccaggua

SEQ ID NO: 108030 - RNA, 22 nt, Homo sapiens
uuugagaaugcuaccagagaag

SEQ ID NO: 108031 - RNA, 22 nt, Homo sapiens
uuugagauaucuuccaucagua

SEQ ID NO: 108032 - RNA, 22 nt, Homo sapiens
uuugagaucuuuagaaucaggc

SEQ ID NO: 108033 - RNA, 22 nt, Homo sapiens
uuugcuauagugaauagugcug

SEQ ID NO: 108034 - RNA, 22 nt, Homo sapiens
uuuggauagugugguccuuuua

SEQ ID NO: 108035 - RNA, 22 nt, Homo sapiens
uuuggcaugggcuauuugcuuu

SEQ ID NO: 108036 - RNA, 22 nt, Homo sapiens
uuuggcuuuuguaauaacugcc

SEQ ID NO: 108037 - RNA, 22 nt, Homo sapiens
uuuguacucccuuuagauaaaa

SEQ ID NO: 108038 - RNA, 22 nt, Homo sapiens
uuugucauagcagcaggaaugg

SEQ ID NO: 108039 - RNA, 22 nt, Homo sapiens
uuugucccccguaguucauaua

SEQ ID NO: 108040 - RNA, 22 nt, Homo sapiens
uuugucccucucaccaacgggg

SEQ ID NO: 108041 - RNA, 22 nt, Homo sapiens
uuugugagguggauagauugca

SEQ ID NO: 108042 - RNA, 22 nt, Homo sapiens
uuuuagcagccaugacaaagau

SEQ ID NO: 108043 - RNA, 22 nt, Homo sapiens
uuuugguuguuggguaagagua

SEQ ID NO: 108044 - RNA, 22 nt, Homo sapiens
ugggaagauucuguguuuuucc

SEQ ID NO: 108045 - RNA, 22 nt, Homo sapiens
uggggugugagggagaaagaaa

SEQ ID NO: 108046 - RNA, 22 nt, Homo sapiens
uggguagauaucauaguugccc

SEQ ID NO: 108047 - RNA, 22 nt, Homo sapiens
ugguauuuaauauaugagaguu

SEQ ID NO: 108048 - RNA, 22 nt, Homo sapiens
ugguccaguucugugauauugc

SEQ ID NO: 108049 - RNA, 22 nt, Homo sapiens
uggucuucuggccuccagaacc

SEQ ID NO: 108050 - RNA, 22 nt, Homo sapiens
ugguguuugagaagcugauguc

SEQ ID NO: 108051 - RNA, 22 nt, Homo sapiens
uguaaaucugguuaauuggaua

SEQ ID NO: 108052 - RNA, 22 nt, Homo sapiens
uguaauaguaggcucacauuug

SEQ ID NO: 108053 - RNA, 22 nt, Homo sapiens
uguauauguuuguacauauguc

SEQ ID NO: 108054 - RNA, 22 nt, Homo sapiens
ugucaucauuggaaucugccuc

SEQ ID NO: 108055 - RNA, 22 nt, Homo sapiens
ugucaucauuugagagaagaaa

SEQ ID NO: 108056 - RNA, 20 nt, Homo sapiens
ugucccaaccccauggguuc

SEQ ID NO: 108057 - RNA, 22 nt, Homo sapiens
ugucuggaaggguggccuccug

SEQ ID NO: 108058 - RNA, 19 nt, Homo sapiens
ugugaagaaaugcugcaag

SEQ ID NO: 108059 - RNA, 22 nt, Homo sapiens
ugugacacugaauggcagaacu

SEQ ID NO: 108060 - RNA, 19 nt, Homo sapiens
ugugacugguugucucgcu

SEQ ID NO: 108061 - RNA, 22 nt, Homo sapiens
ugugagacugacagggcagggu

SEQ ID NO: 108062 - RNA, 22 nt, Homo sapiens
ugugagcuauggaguuguagag

SEQ ID NO: 108063 - RNA, 22 nt, Homo sapiens
ugugcaaucagcuucauuacau

SEQ ID NO: 108064 - RNA, 23 nt, Homo sapiens
ugugcacauuuacauauauacac

SEQ ID NO: 108065 - RNA, 22 nt, Homo sapiens
ugugccacuccaggaggcuguu

SEQ ID NO: 108066 - RNA, 22 nt, Homo sapiens
ugugcuugaauuuaguagcuua

SEQ ID NO: 108067 - RNA, 22 nt, Homo sapiens
uguggcuuuguaaccauggguc

SEQ ID NO: 108068 - RNA, 22 nt, Homo sapiens
ugugguuuuuuucuccaauagg

SEQ ID NO: 108069 - RNA, 22 nt, Homo sapiens
ugugucuuuuaucacacaaugu

SEQ ID NO: 108070 - RNA, 22 nt, Homo sapiens
uguuacagugacuaauguuuua

SEQ ID NO: 108071 - RNA, 22 nt, Homo sapiens
uguucuugagccuuuagaccua

SEQ ID NO: 108072 - RNA, 20 nt, Homo sapiens
uuaaaucuagugcagacuca

SEQ ID NO: 108073 - RNA, 22 nt, Homo sapiens
uuaaaugcacauacuugagaaa

SEQ ID NO: 108074 - RNA, 22 nt, Homo sapiens
uuaaaugcuagaauuuucuuug

SEQ ID NO: 108075 - RNA, 22 nt, Homo sapiens
uuaaggcuuucccuauguaaaa

SEQ ID NO: 108076 - RNA, 22 nt, Homo sapiens
uuaaguuaggcuucagcagucu

SEQ ID NO: 108077 - RNA, 22 nt, Homo sapiens
uuacaccuguaauccagcacuu

SEQ ID NO: 108078 - RNA, 22 nt, Homo sapiens
uuacagcugggugugucuggua

SEQ ID NO: 108079 - RNA, 17 nt, Homo sapiens
uuacaggugcugagagu

SEQ ID NO: 108080 - RNA, 22 nt, Homo sapiens
uuacaguauugcaaggacuagg

SEQ ID NO: 108081 - RNA, 19 nt, Homo sapiens
uuacauccauugcauuuca

SEQ ID NO: 108082 - RNA, 22 nt, Homo sapiens
uuaccagucugauaaacagaaa

SEQ ID NO: 108083 - RNA, 20 nt, Homo sapiens
uuacuccuuaaugagguuuu

SEQ ID NO: 108084 - RNA, 18 nt, Homo sapiens
uuagagugcauuacuuug

SEQ ID NO: 108085 - RNA, 22 nt, Homo sapiens
uuagaucaacauggaacucuau

SEQ ID NO: 108086 - RNA, 22 nt, Homo sapiens
uuagcagugugagcacagacua

SEQ ID NO: 108087 - RNA, 22 nt, Homo sapiens
uuauacucgucugaaugauucu

SEQ ID NO: 108088 - RNA, 20 nt, Homo sapiens
uuauagcuacaucuugacug

SEQ ID NO: 108089 - RNA, 19 nt, Homo sapiens
uuauauaguuucugaggcu

SEQ ID NO: 108090 - RNA, 22 nt, Homo sapiens
uucaagaauuaaaguggcuuuu

SEQ ID NO: 108091 - RNA, 22 nt, Homo sapiens
uucacagcuuaauaaggcucag

SEQ ID NO: 108092 - RNA, 22 nt, Homo sapiens
uucacagucacccuucuccaug

SEQ ID NO: 108093 - RNA, 22 nt, Homo sapiens
uucacaguguuucucacgguua

SEQ ID NO: 108094 - RNA, 22 nt, Homo sapiens
uucacaugguugccuuuugauc

SEQ ID NO: 108095 - RNA, 22 nt, Homo sapiens
uucaccuguagcaugcccuugg

SEQ ID NO: 108096 - RNA, 22 nt, Homo sapiens
uucagcaguggccaguggaaau

SEQ ID NO: 108097 - RNA, 22 nt, Homo sapiens
uucaggcaccauggucauugau

SEQ ID NO: 108098 - RNA, 22 nt, Homo sapiens
uucagggacuuuagacaagaga

SEQ ID NO: 108099 - RNA, 22 nt, Homo sapiens
uucaguacacguguucucauuu

SEQ ID NO: 108100 - RNA, 22 nt, Homo sapiens
uucaucuggcaauucagagauu

SEQ ID NO: 108101 - RNA, 22 nt, Homo sapiens
uucauggaacaaguggguucaa

SEQ ID NO: 108102 - RNA, 22 nt, Homo sapiens
uucauggacucaauaguuucgc

SEQ ID NO: 108103 - RNA, 22 nt, Homo sapiens
uuccacaauggcugaacuaguu

SEQ ID NO: 108104 - RNA, 20 nt, Homo sapiens
uuccagcacauuagggaagc

SEQ ID NO: 108105 - RNA, 22 nt, Homo sapiens
uuccaguggaguaaauggacaa

SEQ ID NO: 108106 - RNA, 22 nt, Homo sapiens
uucccuuucugccuugaaucuu

SEQ ID NO: 108107 - RNA, 22 nt, Homo sapiens
uuccuagagauuagcaagcugc

SEQ ID NO: 108108 - RNA, 22 nt, Homo sapiens
uuccuggaggggaaguguccaa

SEQ ID NO: 108109 - RNA, 22 nt, Homo sapiens
uucugugcuuguggaugaagug

SEQ ID NO: 108110 - RNA, 22 nt, Homo sapiens
uugaaauguguaagcuccgaaa

SEQ ID NO: 108111 - RNA, 22 nt, Homo sapiens
uugaauaggcucaugcuuauca

SEQ ID NO: 108112 - RNA, 22 nt, Homo sapiens
uugaauggaauguuggaacuau

SEQ ID NO: 108113 - RNA, 22 nt, Homo sapiens
uugacaaggagugggguugaga

SEQ ID NO: 108114 - RNA, 22 nt, Homo sapiens
uugacuuuuaggaggaaaauga

SEQ ID NO: 108115 - RNA, 22 nt, Homo sapiens
uugagauggagucucacugugu

SEQ ID NO: 108116 - RNA, 22 nt, Homo sapiens
uugagcacaguagguuguggcu

SEQ ID NO: 108117 - RNA, 22 nt, Homo sapiens
uugaggguggcauauauugauu

SEQ ID NO: 108118 - RNA, 22 nt, Homo sapiens
uugaguauuggacugguaucuu

SEQ ID NO: 108119 - RNA, 22 nt, Homo sapiens
uugaguauuugcagucugaaca

SEQ ID NO: 108120 - RNA, 22 nt, Homo sapiens
uugagugaaggcuguguucuug

SEQ ID NO: 108121 - RNA, 22 nt, Homo sapiens
uugcaccuuaugucuguucucu

SEQ ID NO: 108122 - RNA, 22 nt, Homo sapiens
uugcacugagauuuugcuuaca

SEQ ID NO: 108123 - RNA, 22 nt, Homo sapiens
uugcaugggagcugggugaggc

SEQ ID NO: 108124 - RNA, 22 nt, Homo sapiens
uugcaugguuuuuaucugaaau

SEQ ID NO: 108125 - RNA, 20 nt, Homo sapiens
uugcugguguuagaggaggc

SEQ ID NO: 108126 - RNA, 22 nt, Homo sapiens
uuggaagguaaucaaaaguucu

SEQ ID NO: 108127 - RNA, 22 nt, Homo sapiens
uuggaauuuuaaaauaggcaac

SEQ ID NO: 108128 - RNA, 22 nt, Homo sapiens
uuggcaaaugucacaaaucagg

SEQ ID NO: 108129 - RNA, 22 nt, Homo sapiens
uugguuaucaucauuucagcaa

SEQ ID NO: 108130 - RNA, 22 nt, Homo sapiens
uuguacaggaguguaagcuuca

SEQ ID NO: 108131 - RNA, 22 nt, Homo sapiens
uuguccaagucccauuuguuga

SEQ ID NO: 108132 - RNA, 22 nt, Homo sapiens
uugugaaaaaccucucguggaa

SEQ ID NO: 108133 - RNA, 22 nt, Homo sapiens
uugugaucuucagaaaguggcu

SEQ ID NO: 108134 - RNA, 22 nt, Homo sapiens
uugugcuucaucaccuagcaga

SEQ ID NO: 108135 - RNA, 22 nt, Homo sapiens
uuuagcaaugcuguggggaagu

SEQ ID NO: 108136 - RNA, 22 nt, Homo sapiens
uuuauccagccucuagcaaggu

SEQ ID NO: 108137 - RNA, 17 nt, Homo sapiens
uuucagaguggaagugu

SEQ ID NO: 108138 - RNA, 22 nt, Homo sapiens
uuucauguuuuucugugaggca

SEQ ID NO: 108139 - RNA, 22 nt, Homo sapiens
ucagucuuuuuuuggcaagcau

SEQ ID NO: 108140 - RNA, 22 nt, Homo sapiens
ucaguguugauggcugcugacu

SEQ ID NO: 108141 - RNA, 22 nt, Homo sapiens
ucaguuuagguguaacggccac

SEQ ID NO: 108142 - RNA, 22 nt, Homo sapiens
ucauacaguaguccucacuugu

SEQ ID NO: 108143 - RNA, 21 nt, Homo sapiens
ucaucaagcuguagacaugau

SEQ ID NO: 108144 - RNA, 22 nt, Homo sapiens
ucaucagaguuuacaagcucag

SEQ ID NO: 108145 - RNA, 22 nt, Homo sapiens
ucaucaggaaacuuaugcagug

SEQ ID NO: 108146 - RNA, 22 nt, Homo sapiens
ucauggcacugaugagaguuuc

SEQ ID NO: 108147 - RNA, 22 nt, Homo sapiens
ucauucauuugcucacuccaca

SEQ ID NO: 108148 - RNA, 22 nt, Homo sapiens
uccacaauggagaagaguauga

SEQ ID NO: 108149 - RNA, 19 nt, Homo sapiens
ucccaagaugcucauacau

SEQ ID NO: 108150 - RNA, 22 nt, Homo sapiens
ucccaguuuuucugaauaguca

SEQ ID NO: 108151 - RNA, 20 nt, Homo sapiens
ucccucaaacuuuuccacug

SEQ ID NO: 108152 - RNA, 22 nt, Homo sapiens
ucccugaguaucuaauguguuu

SEQ ID NO: 108153 - RNA, 20 nt, Homo sapiens
uccugagauucccaguucuc

SEQ ID NO: 108154 - RNA, 22 nt, Homo sapiens
uccuucaguccaguggguuuug

SEQ ID NO: 108155 - RNA, 22 nt, Homo sapiens
uccuuuggguagcuguucagau

SEQ ID NO: 108156 - RNA, 22 nt, Homo sapiens
ucuaaagcauccagauugcuuc

SEQ ID NO: 108157 - RNA, 17 nt, Homo sapiens
ucuaauaauaugcauuu

SEQ ID NO: 108158 - RNA, 22 nt, Homo sapiens
ucuauggaguuugaaugagaaa

SEQ ID NO: 108159 - RNA, 22 nt, Homo sapiens
ucucaguguuaucuaucugccu

SEQ ID NO: 108160 - RNA, 20 nt, Homo sapiens
ucucauagagguagagaaua

SEQ ID NO: 108161 - RNA, 22 nt, Homo sapiens
ucucugauuauugcauuucauu

SEQ ID NO: 108162 - RNA, 22 nt, Homo sapiens
ucucuguuuagagccagcaauu

SEQ ID NO: 108163 - RNA, 22 nt, Homo sapiens
ucucuugguugaacaguuugga

SEQ ID NO: 108164 - RNA, 22 nt, Homo sapiens
ucuggcaagagccgagggcagu

SEQ ID NO: 108165 - RNA, 22 nt, Homo sapiens
ucuggcaagauauccauugcuu

SEQ ID NO: 108166 - RNA, 22 nt, Homo sapiens
ucugucacugaaucccugucac

SEQ ID NO: 108167 - RNA, 22 nt, Homo sapiens
ucugucacugguggacgaucac

SEQ ID NO: 108168 - RNA, 22 nt, Homo sapiens
ucugucuuguccucacccuaga

SEQ ID NO: 108169 - RNA, 22 nt, Homo sapiens
ucuguguugaugcucauuaauu

SEQ ID NO: 108170 - RNA, 20 nt, Homo sapiens
ucuugggaauguagccuagg

SEQ ID NO: 108171 - RNA, 22 nt, Homo sapiens
ucuuggguggauucauucuuuc

SEQ ID NO: 108172 - RNA, 22 nt, Homo sapiens
ucuuugagugcccugagucccu

SEQ ID NO: 108173 - RNA, 22 nt, Homo sapiens
ucuuugauaagauccagaagaa

SEQ ID NO: 108174 - RNA, 22 nt, Homo sapiens
ugaaaaguuguugaaggcuuca

SEQ ID NO: 108175 - RNA, 22 nt, Homo sapiens
ugaaacacaccuccucuccauc

SEQ ID NO: 108176 - RNA, 22 nt, Homo sapiens
ugaaagcuacagucuccuagga

SEQ ID NO: 108177 - RNA, 22 nt, Homo sapiens
ugaaaugaucaguuugguuacu

SEQ ID NO: 108178 - RNA, 22 nt, Homo sapiens
ugaaaugauuauaugguguuug

SEQ ID NO: 108179 - RNA, 22 nt, Homo sapiens
ugaaauguguuaucugggccug

SEQ ID NO: 108180 - RNA, 20 nt, Homo sapiens
ugaaggaggucauuuauacc

SEQ ID NO: 108181 - RNA, 22 nt, Homo sapiens
ugaaggccgggcaugguggcuc

SEQ ID NO: 108182 - RNA, 22 nt, Homo sapiens
ugaagugaaugguaaguaugcc

SEQ ID NO: 108183 - RNA, 22 nt, Homo sapiens
ugaauagacacuaaagacugua

SEQ ID NO: 108184 - RNA, 22 nt, Homo sapiens
ugaauaguuugacagaacucuu

SEQ ID NO: 108185 - RNA, 22 nt, Homo sapiens
ugaccacugucuaagauaggug

SEQ ID NO: 108186 - RNA, 16 nt, Homo sapiens
ugagaacaugcagcau

SEQ ID NO: 108187 - RNA, 17 nt, Homo sapiens
ugagaacaugugguauu

SEQ ID NO: 108188 - RNA, 22 nt, Homo sapiens
ugagaacuuauggugauuuuuu

SEQ ID NO: 108189 - RNA, 22 nt, Homo sapiens
ugagaagcauaccagugucugu

SEQ ID NO: 108190 - RNA, 22 nt, Homo sapiens
ugagacauacuuacaggggaug

SEQ ID NO: 108191 - RNA, 22 nt, Homo sapiens
ugagacugagucucgcucuauu

SEQ ID NO: 108192 - RNA, 22 nt, Homo sapiens
ugagacugagucuugcucuauu

SEQ ID NO: 108193 - RNA, 22 nt, Homo sapiens
ugagacugaguuucacuuuugu

SEQ ID NO: 108194 - RNA, 22 nt, Homo sapiens
ugagacugaguuuccaucuugu

SEQ ID NO: 108195 - RNA, 22 nt, Homo sapiens
ugagacugaguuuugcucguug

SEQ ID NO: 108196 - RNA, 22 nt, Homo sapiens
ugagagaugaacuauucuugaa

SEQ ID NO: 108197 - RNA, 22 nt, Homo sapiens
ugagagaugauaaaauguuugu

SEQ ID NO: 108198 - RNA, 19 nt, Homo sapiens
ugagagcacaacugaacaa

SEQ ID NO: 108199 - RNA, 22 nt, Homo sapiens
ugagaguagggguugggauugg

SEQ ID NO: 108200 - RNA, 21 nt, Homo sapiens
ugagaguaguguauuauucuc

SEQ ID NO: 108201 - RNA, 22 nt, Homo sapiens
ugagauaaugcaugugaagauc

SEQ ID NO: 108202 - RNA, 22 nt, Homo sapiens
ugagauaauuuacuuguugagg

SEQ ID NO: 108203 - RNA, 18 nt, Homo sapiens
ugagauacuagaauaggu

SEQ ID NO: 108204 - RNA, 22 nt, Homo sapiens
ugagauauugggaguaauguca

SEQ ID NO: 108205 - RNA, 22 nt, Homo sapiens
ugagaugaagcuagaagaaugg

SEQ ID NO: 108206 - RNA, 22 nt, Homo sapiens
ugagaugaagucuugcucuguu

SEQ ID NO: 108207 - RNA, 22 nt, Homo sapiens
ugagaugagaaucaguucuaau

SEQ ID NO: 108208 - RNA, 22 nt, Homo sapiens
ugagaugaugggauaagagggc

SEQ ID NO: 108209 - RNA, 21 nt, Homo sapiens
ugagaugcaaucaccagggag

SEQ ID NO: 108210 - RNA, 22 nt, Homo sapiens
ugaggaauguguguuaaagaua

SEQ ID NO: 108211 - RNA, 22 nt, Homo sapiens
ugaggaguauguucuguagacc

SEQ ID NO: 108212 - RNA, 22 nt, Homo sapiens
ugaggagugagaaauugguuuc

SEQ ID NO: 108213 - RNA, 22 nt, Homo sapiens
ugaggcaaggcugaaugaaggc

SEQ ID NO: 108214 - RNA, 22 nt, Homo sapiens
ugaggucauguucugucagguu

SEQ ID NO: 108215 - RNA, 22 nt, Homo sapiens
ugaguagaacaucaagucauac

SEQ ID NO: 108216 - RNA, 22 nt, Homo sapiens
ugaguaugaguucaggaaaggc

SEQ ID NO: 108217 - RNA, 22 nt, Homo sapiens
ugaguauguuuagaaguaaagg

SEQ ID NO: 108218 - RNA, 22 nt, Homo sapiens
ugauaagugagauagcaaguga

SEQ ID NO: 108219 - RNA, 22 nt, Homo sapiens
ugauaggucuguuuugaaaagg

SEQ ID NO: 108220 - RNA, 22 nt, Homo sapiens
ugauauguuagaaucuugcaag

SEQ ID NO: 108221 - RNA, 22 nt, Homo sapiens
ugauccuguccuuaugauguua

SEQ ID NO: 108222 - RNA, 20 nt, Homo sapiens
ugauuaguccacuuggcucu

SEQ ID NO: 108223 - RNA, 22 nt, Homo sapiens
ugcaaugugaaauaagcacauc

SEQ ID NO: 108224 - RNA, 22 nt, Homo sapiens
ugcauacacaagcauacaugua

SEQ ID NO: 108225 - RNA, 22 nt, Homo sapiens
ugcauauguugaaccagccuug

SEQ ID NO: 108226 - RNA, 22 nt, Homo sapiens
ugcauauuuuauaaagauggaa

SEQ ID NO: 108227 - RNA, 22 nt, Homo sapiens
ugcauccauucuagacucaucu

SEQ ID NO: 108228 - RNA, 22 nt, Homo sapiens
ugccaggaugaggucaauguuu

SEQ ID NO: 108229 - RNA, 22 nt, Homo sapiens
ugccuaggcuggagugcagugg

SEQ ID NO: 108230 - RNA, 22 nt, Homo sapiens
ugcuaugucagccaggcugguc

SEQ ID NO: 108231 - RNA, 21 nt, Homo sapiens
ugcuauguuguccaggcuggc

SEQ ID NO: 108232 - RNA, 22 nt, Homo sapiens
ugcugaguguuaccggacaccg

SEQ ID NO: 108233 - RNA, 20 nt, Homo sapiens
ugcugcacuuaagcaugggc

SEQ ID NO: 108234 - RNA, 19 nt, Homo sapiens
ugcugcauugugaccuugc

SEQ ID NO: 108235 - RNA, 22 nt, Homo sapiens
ugcugguuuucaucaucagugg

SEQ ID NO: 108236 - RNA, 22 nt, Homo sapiens
ugcuguguugcuggcuuaaaga

SEQ ID NO: 108237 - RNA, 22 nt, Homo sapiens
uggaagacacauaccugauaac

SEQ ID NO: 108238 - RNA, 22 nt, Homo sapiens
cucaaagugcugggauuggcca

SEQ ID NO: 108239 - RNA, 18 nt, Homo sapiens
cucaaccucaugcagggc

SEQ ID NO: 108240 - RNA, 20 nt, Homo sapiens
cucacagacagcuucuuucu

SEQ ID NO: 108241 - RNA, 22 nt, Homo sapiens
cucaugcugucuucugggguaa

SEQ ID NO: 108242 - RNA, 22 nt, Homo sapiens
cucauggauggucuggcagcca

SEQ ID NO: 108243 - RNA, 22 nt, Homo sapiens
cuccacugagcaggugggaggc

SEQ ID NO: 108244 - RNA, 22 nt, Homo sapiens
auggaaugguugggucauaagg

SEQ ID NO: 108245 - RNA, 22 nt, Homo sapiens
auggcacugccuggcuucaugg

SEQ ID NO: 108246 - RNA, 22 nt, Homo sapiens
auggcccaguuugcuaucccua

SEQ ID NO: 108247 - RNA, 22 nt, Homo sapiens
auggcccccuguuugugaacau

SEQ ID NO: 108248 - RNA, 22 nt, Homo sapiens
auggcucuggauagaaugcagg

SEQ ID NO: 108249 - RNA, 22 nt, Homo sapiens
auggcuuuaagagugucugaau

SEQ ID NO: 108250 - RNA, 22 nt, Homo sapiens
auggcuuuugaccugguaggau

SEQ ID NO: 108251 - RNA, 22 nt, Homo sapiens
augggugaguaugaguugacuu

SEQ ID NO: 108252 - RNA, 22 nt, Homo sapiens
auggucuuuucccuggauuaua

SEQ ID NO: 108253 - RNA, 22 nt, Homo sapiens
augguuuuacugcaaaauggga

SEQ ID NO: 108254 - RNA, 22 nt, Homo sapiens
augucuagagugauacugaagc

SEQ ID NO: 108255 - RNA, 22 nt, Homo sapiens
augugcaaaguuaagaucccag

SEQ ID NO: 108256 - RNA, 22 nt, Homo sapiens
augugcaacugcuggaacaguc

SEQ ID NO: 108257 - RNA, 22 nt, Homo sapiens
augugccaauuaggauuccaag

SEQ ID NO: 108258 - RNA, 22 nt, Homo sapiens
augugcuuauagguguauguuu

SEQ ID NO: 108259 - RNA, 22 nt, Homo sapiens
augugcuugagggaaaucaguu

SEQ ID NO: 108260 - RNA, 20 nt, Homo sapiens
auguucuggaggacagaagc

SEQ ID NO: 108261 - RNA, 22 nt, Homo sapiens
auuacauagucaaggugucuca

SEQ ID NO: 108262 - RNA, 22 nt, Homo sapiens
auuccacaguuaacacagaccg

SEQ ID NO: 108263 - RNA, 22 nt, Homo sapiens
auuccagauggaguugaggguu

SEQ ID NO: 108264 - RNA, 22 nt, Homo sapiens
auucuauaguccuaggauuggg

SEQ ID NO: 108265 - RNA, 22 nt, Homo sapiens
auucuugcuugaacuuggugca

SEQ ID NO: 108266 - RNA, 22 nt, Homo sapiens
auugaguaaaugaaaauugccu

SEQ ID NO: 108267 - RNA, 22 nt, Homo sapiens
auugcucaaaucaguacuugag

SEQ ID NO: 108268 - RNA, 22 nt, Homo sapiens
auugugcuaaaguaauaaguca

SEQ ID NO: 108269 - RNA, 22 nt, Homo sapiens
auuuagcaauggagguagugua

SEQ ID NO: 108270 - RNA, 22 nt, Homo sapiens
auuuggccuuuguaugcaguau

SEQ ID NO: 108271 - RNA, 22 nt, Homo sapiens
auuuugcauugcuguaaaggaa

SEQ ID NO: 108272 - RNA, 18 nt, Homo sapiens
auuuuugcaguccacaug

SEQ ID NO: 108273 - RNA, 22 nt, Homo sapiens
auuuuugguugguaggcuauua

SEQ ID NO: 108274 - RNA, 22 nt, Homo sapiens
caaaagugauugcgguuuuugc

SEQ ID NO: 108275 - RNA, 22 nt, Homo sapiens
caaaggauucauuuccaggagu

SEQ ID NO: 108276 - RNA, 22 nt, Homo sapiens
caaaggugcuuuccagguccaa

SEQ ID NO: 108277 - RNA, 22 nt, Homo sapiens
caaagucuucaguugauucuga

SEQ ID NO: 108278 - RNA, 19 nt, Homo sapiens
caacccugcagagaaagga

SEQ ID NO: 108279 - RNA, 22 nt, Homo sapiens
caagaucauuuaugcuaaaauu

SEQ ID NO: 108280 - RNA, 22 nt, Homo sapiens
caaggugcugagacaggagccc

SEQ ID NO: 108281 - RNA, 22 nt, Homo sapiens
caagugcuugaugaaugaucaa

SEQ ID NO: 108282 - RNA, 22 nt, Homo sapiens
caagugcuuucuuggggauuua

SEQ ID NO: 108283 - RNA, 19 nt, Homo sapiens
caauacuucuuggcauaca

SEQ ID NO: 108284 - RNA, 22 nt, Homo sapiens
caaugcauuauucucccacuuc

SEQ ID NO: 108285 - RNA, 21 nt, Homo sapiens
caauggcacaaucucugcuca

SEQ ID NO: 108286 - RNA, 22 nt, Homo sapiens
cacagaauucauuggauuaccu

SEQ ID NO: 108287 - RNA, 22 nt, Homo sapiens
cacagucugggcuuguuuguac

SEQ ID NO: 108288 - RNA, 22 nt, Homo sapiens
cacauguuugcuacauuuuucu

SEQ ID NO: 108289 - RNA, 22 nt, Homo sapiens
cacauugcaggaaaguucauua

SEQ ID NO: 108290 - RNA, 22 nt, Homo sapiens
caccgagguuggagugcagugg

SEQ ID NO: 108291 - RNA, 22 nt, Homo sapiens
cacugcacuccagucccgucuc

SEQ ID NO: 108292 - RNA, 22 nt, Homo sapiens
cacugcaguaaauugcgucggu

SEQ ID NO: 108293 - RNA, 22 nt, Homo sapiens
cacugcauggucuagcuggguu

SEQ ID NO: 108294 - RNA, 22 nt, Homo sapiens
cacugcauuacucaugagcaug

SEQ ID NO: 108295 - RNA, 22 nt, Homo sapiens
cacugcauuggaugguuccucc

SEQ ID NO: 108296 - RNA, 22 nt, Homo sapiens
cacugggugccauauguuugcu

SEQ ID NO: 108297 - RNA, 22 nt, Homo sapiens
cacuggguuagaacaugcuccu

SEQ ID NO: 108298 - RNA, 22 nt, Homo sapiens
cacuggucucauggcaugagag

SEQ ID NO: 108299 - RNA, 22 nt, Homo sapiens
cagagaacauucagagcuguag

SEQ ID NO: 108300 - RNA, 22 nt, Homo sapiens
cagagaacugaguuauuuucuu

SEQ ID NO: 108301 - RNA, 22 nt, Homo sapiens
cagagcacuaaagguaaaaggc

SEQ ID NO: 108302 - RNA, 22 nt, Homo sapiens
caggcagucuggcucccaagug

SEQ ID NO: 108303 - RNA, 22 nt, Homo sapiens
caggcauuguccaugcugaagg

SEQ ID NO: 108304 - RNA, 22 nt, Homo sapiens
caggcuuuuccacacauggguu

SEQ ID NO: 108305 - RNA, 22 nt, Homo sapiens
caggugcuuacuuaauagccau

SEQ ID NO: 108306 - RNA, 22 nt, Homo sapiens
cagugucugcauuuggaacuca

SEQ ID NO: 108307 - RNA, 22 nt, Homo sapiens
cauaaaucuuguugaauagcac

SEQ ID NO: 108308 - RNA, 19 nt, Homo sapiens
caucacagagucuuccauu

SEQ ID NO: 108309 - RNA, 22 nt, Homo sapiens
caugccacugcacgccauccug

SEQ ID NO: 108310 - RNA, 19 nt, Homo sapiens
caugccacugcacuugagu

SEQ ID NO: 108311 - RNA, 21 nt, Homo sapiens
caugucacugcacucuagccu

SEQ ID NO: 108312 - RNA, 22 nt, Homo sapiens
cauugcacuccauccuuggcaa

SEQ ID NO: 108313 - RNA, 22 nt, Homo sapiens
cauugcaguaagagugggcucu

SEQ ID NO: 108314 - RNA, 22 nt, Homo sapiens
cauugcaguggaguggggaaga

SEQ ID NO: 108315 - RNA, 22 nt, Homo sapiens
cauugcaguuuuugguguaucu

SEQ ID NO: 108316 - RNA, 22 nt, Homo sapiens
cauugcaugccagccugggcaa

SEQ ID NO: 108317 - RNA, 22 nt, Homo sapiens
ccaccuguacuuaagucacuuu

SEQ ID NO: 108318 - RNA, 22 nt, Homo sapiens
ccaggguuccacgccuggcugu

SEQ ID NO: 108319 - RNA, 20 nt, Homo sapiens
ccaguguuauuuauguucua

SEQ ID NO: 108320 - RNA, 19 nt, Homo sapiens
ccauggcaaugaucugaug

SEQ ID NO: 108321 - RNA, 22 nt, Homo sapiens
ccauuucacucuuccugaagga

SEQ ID NO: 108322 - RNA, 22 nt, Homo sapiens
cccaguuuugcuucucaugagg

SEQ ID NO: 108323 - RNA, 22 nt, Homo sapiens
ccccauuugaacuccuucaacu

SEQ ID NO: 108324 - RNA, 17 nt, Homo sapiens
ccccugagcgaugcagu

SEQ ID NO: 108325 - RNA, 22 nt, Homo sapiens
cccucgagaaaccaucugcuga

SEQ ID NO: 108326 - RNA, 22 nt, Homo sapiens
cccugagaugugaauuucagag

SEQ ID NO: 108327 - RNA, 22 nt, Homo sapiens
ccucacaaccuuuauugaagag

SEQ ID NO: 108328 - RNA, 21 nt, Homo sapiens
ccucuuugagggaagaaaggg

SEQ ID NO: 108329 - RNA, 22 nt, Homo sapiens
ccucuuuguugagacuucacca

SEQ ID NO: 108330 - RNA, 22 nt, Homo sapiens
ccugagaucauacuguuaguaa

SEQ ID NO: 108331 - RNA, 22 nt, Homo sapiens
ccuggaagaaaggugcuaaaua

SEQ ID NO: 108332 - RNA, 22 nt, Homo sapiens
ccuggguuacaggugugagcca

SEQ ID NO: 108333 - RNA, 22 nt, Homo sapiens
ccuucacaggcacugguucaga

SEQ ID NO: 108334 - RNA, 22 nt, Homo sapiens
cuaagauugucuuaguguguug

SEQ ID NO: 108335 - RNA, 22 nt, Homo sapiens
cuagccuggagugcaguggugc

SEQ ID NO: 108336 - RNA, 21 nt, Homo sapiens
cucaaaguacugauauuacag

SEQ ID NO: 108337 - RNA, 22 nt, Homo sapiens
cucaaaguacuuugguuauugu

SEQ ID NO: 108338 - RNA, 22 nt, Homo sapiens
cucaaagugcuaagauuaggcu

SEQ ID NO: 108339 - RNA, 20 nt, Homo sapiens
agguuauuauaauuagaaga

SEQ ID NO: 108340 - RNA, 22 nt, Homo sapiens
aguacacuguuaaaaagaagug

SEQ ID NO: 108341 - RNA, 22 nt, Homo sapiens
aguacaucuggcuggauagaua

SEQ ID NO: 108342 - RNA, 22 nt, Homo sapiens
aguaucacaggcaaaacagaau

SEQ ID NO: 108343 - RNA, 22 nt, Homo sapiens
agucaaaugcuuauguauaaag

SEQ ID NO: 108344 - RNA, 22 nt, Homo sapiens
agucacagugaccuugucugac

SEQ ID NO: 108345 - RNA, 22 nt, Homo sapiens
agucaugggagagaugugaucg

SEQ ID NO: 108346 - RNA, 22 nt, Homo sapiens
aguccauuugaugaugauucca

SEQ ID NO: 108347 - RNA, 22 nt, Homo sapiens
agucugguguucucacacuagu

SEQ ID NO: 108348 - RNA, 17 nt, Homo sapiens
agugagaucauggcuua

SEQ ID NO: 108349 - RNA, 22 nt, Homo sapiens
agugcaguggcacaaucuuggc

SEQ ID NO: 108350 - RNA, 22 nt, Homo sapiens
agugcagugguuaggagccagg

SEQ ID NO: 108351 - RNA, 22 nt, Homo sapiens
aguuggcacugagcugugauug

SEQ ID NO: 108352 - RNA, 22 nt, Homo sapiens
auaaagcaagucucuggccuca

SEQ ID NO: 108353 - RNA, 22 nt, Homo sapiens
auaaagccaugagcuugagaug

SEQ ID NO: 108354 - RNA, 22 nt, Homo sapiens
auaaauaguaguugugguggcc

SEQ ID NO: 108355 - RNA, 22 nt, Homo sapiens
auaacauggaguuugucauuua

SEQ ID NO: 108356 - RNA, 22 nt, Homo sapiens
auaaggcuaaggacuugaguua

SEQ ID NO: 108357 - RNA, 22 nt, Homo sapiens
auaauugcaacacagggcuuug

SEQ ID NO: 108358 - RNA, 22 nt, Homo sapiens
auacaguaaugucuuaggcugu

SEQ ID NO: 108359 - RNA, 22 nt, Homo sapiens
auacaguauggagggcccagcu

SEQ ID NO: 108360 - RNA, 22 nt, Homo sapiens
auacuguuuuacaucauugccu

SEQ ID NO: 108361 - RNA, 20 nt, Homo sapiens
auagaagacuagugcagcag

SEQ ID NO: 108362 - RNA, 22 nt, Homo sapiens
auagaaucaucugugcacuagu

SEQ ID NO: 108363 - RNA, 22 nt, Homo sapiens
auaucaagugacuggaguucca

SEQ ID NO: 108364 - RNA, 17 nt, Homo sapiens
auaugaauuuuggagau

SEQ ID NO: 108365 - RNA, 22 nt, Homo sapiens
auauguauuuuaacguguaagg

SEQ ID NO: 108366 - RNA, 22 nt, Homo sapiens
auauucacuauaugcagaacca

SEQ ID NO: 108367 - RNA, 22 nt, Homo sapiens
aucaaagugaaauauuaguuau

SEQ ID NO: 108368 - RNA, 22 nt, Homo sapiens
aucaaaguuucccagaaguugu

SEQ ID NO: 108369 - RNA, 22 nt, Homo sapiens
aucacauuuauaguggcacgca

SEQ ID NO: 108370 - RNA, 20 nt, Homo sapiens
aucacuggagaaggaaaccu

SEQ ID NO: 108371 - RNA, 22 nt, Homo sapiens
aucacugggauggaacugcuga

SEQ ID NO: 108372 - RNA, 22 nt, Homo sapiens
aucacuguaaguuuacacuuug

SEQ ID NO: 108373 - RNA, 22 nt, Homo sapiens
aucagaaucucuagaggacugu

SEQ ID NO: 108374 - RNA, 22 nt, Homo sapiens
aucagaaucucuagugggacca

SEQ ID NO: 108375 - RNA, 22 nt, Homo sapiens
aucaggaaccuuuuuggugugu

SEQ ID NO: 108376 - RNA, 22 nt, Homo sapiens
aucauagcucacugcagccucg

SEQ ID NO: 108377 - RNA, 22 nt, Homo sapiens
aucaucaugcacuacagccugg

SEQ ID NO: 108378 - RNA, 22 nt, Homo sapiens
auccccugcacggggugucauu

SEQ ID NO: 108379 - RNA, 22 nt, Homo sapiens
aucccuagaaaaaucagcacau

SEQ ID NO: 108380 - RNA, 22 nt, Homo sapiens
aucccuguguccagcaccugug

SEQ ID NO: 108381 - RNA, 22 nt, Homo sapiens
aucgcgccauuguacuccagcc

SEQ ID NO: 108382 - RNA, 22 nt, Homo sapiens
aucucaguucaggcuggccaca

SEQ ID NO: 108383 - RNA, 22 nt, Homo sapiens
aucugggguuggcaaaguuugg

SEQ ID NO: 108384 - RNA, 21 nt, Homo sapiens
aucugugagaccuuggggguu

SEQ ID NO: 108385 - RNA, 22 nt, Homo sapiens
augaaacuggcuaauuuuugua

SEQ ID NO: 108386 - RNA, 20 nt, Homo sapiens
augaaggcaggugugaguuu

SEQ ID NO: 108387 - RNA, 22 nt, Homo sapiens
augagauacuacaaaugaguuu

SEQ ID NO: 108388 - RNA, 22 nt, Homo sapiens
augagaucaaauuuaagcuguu

SEQ ID NO: 108389 - RNA, 22 nt, Homo sapiens
augagcagaugcuccugccucu

SEQ ID NO: 108390 - RNA, 22 nt, Homo sapiens
augagcucauaaagagugauuu

SEQ ID NO: 108391 - RNA, 22 nt, Homo sapiens
augaggugggagaaucacuuga

SEQ ID NO: 108392 - RNA, 22 nt, Homo sapiens
augauacuggcuucauagaaug

SEQ ID NO: 108393 - RNA, 22 nt, Homo sapiens
augaugucauuuuaauuucuaa

SEQ ID NO: 108394 - RNA, 22 nt, Homo sapiens
augcacuguuuucuugaugaga

SEQ ID NO: 108395 - RNA, 22 nt, Homo sapiens
augcauggagucuuucacaagu

SEQ ID NO: 108396 - RNA, 22 nt, Homo sapiens
augcauggucugaagucaaccu

SEQ ID NO: 108397 - RNA, 21 nt, Homo sapiens
auggaaagacugccucuucaa

SEQ ID NO: 108398 - RNA, 22 nt, Homo sapiens
auggaagaaacgauuuucugga

SEQ ID NO: 108399 - RNA, 22 nt, Homo sapiens
auggaagcauaguauucuauug

SEQ ID NO: 108400 - RNA, 22 nt, Homo sapiens
auggaaugccauuuauaaugga

SEQ ID NO: 108401 - RNA, 22 nt, Homo sapiens
auggaauguggaaugguaagua

SEQ ID NO: 108402 - RNA, 22 nt, Homo sapiens
auggccgggugcgguggcucac

SEQ ID NO: 108403 - RNA, 22 nt, Homo sapiens
auggcuuuuccugucuugcaug

SEQ ID NO: 108404 - RNA, 22 nt, Homo sapiens
augggcuaguaaagacaaacuu

SEQ ID NO: 108405 - RNA, 21 nt, Homo sapiens
auggugagaaaguagugucaa

SEQ ID NO: 108406 - RNA, 22 nt, Homo sapiens
augugaugguuaauuuuaugug

SEQ ID NO: 108407 - RNA, 22 nt, Homo sapiens
augugcacaugcuuacauguga

SEQ ID NO: 108408 - RNA, 21 nt, Homo sapiens
augugcacuaugucauuuaau

SEQ ID NO: 108409 - RNA, 22 nt, Homo sapiens
augugcagauguuacaaauugu

SEQ ID NO: 108410 - RNA, 22 nt, Homo sapiens
augugccauucucauggcgcuu

SEQ ID NO: 108411 - RNA, 22 nt, Homo sapiens
auguguauuaccucgauuguga

SEQ ID NO: 108412 - RNA, 22 nt, Homo sapiens
auuaaguugugccugaaaacuu

SEQ ID NO: 108413 - RNA, 22 nt, Homo sapiens
auuaaucaggcaaugcuugcua

SEQ ID NO: 108414 - RNA, 22 nt, Homo sapiens
auuacaugucuauccaugaaca

SEQ ID NO: 108415 - RNA, 22 nt, Homo sapiens
auuagguuggugcaaaacuuuc

SEQ ID NO: 108416 - RNA, 22 nt, Homo sapiens
auuauaguguauacuugaaauu

SEQ ID NO: 108417 - RNA, 22 nt, Homo sapiens
auuauugacucauagaaaggau

SEQ ID NO: 108418 - RNA, 22 nt, Homo sapiens
auuccaguggguuuacauccca

SEQ ID NO: 108419 - RNA, 22 nt, Homo sapiens
auucccuuggucaacggaugca

SEQ ID NO: 108420 - RNA, 22 nt, Homo sapiens
auugaacaugccauauguacca

SEQ ID NO: 108421 - RNA, 22 nt, Homo sapiens
auugagcaaggucuccuaguau

SEQ ID NO: 108422 - RNA, 22 nt, Homo sapiens
auugcacaaagagggaaacuga

SEQ ID NO: 108423 - RNA, 22 nt, Homo sapiens
auugcacacagaaucaggguaa

SEQ ID NO: 108424 - RNA, 22 nt, Homo sapiens
auugcacaucugcacuacagcc

SEQ ID NO: 108425 - RNA, 22 nt, Homo sapiens
auugcacuccagccuuggggau

SEQ ID NO: 108426 - RNA, 22 nt, Homo sapiens
auugcccaggcuggagugcagu

SEQ ID NO: 108427 - RNA, 22 nt, Homo sapiens
auuggcuauuuggugagugauu

SEQ ID NO: 108428 - RNA, 22 nt, Homo sapiens
auuguaauuuuagagaaagugg

SEQ ID NO: 108429 - RNA, 22 nt, Homo sapiens
auuuaacuggucuaggggccca

SEQ ID NO: 108430 - RNA, 19 nt, Homo sapiens
auuugaucaucaggcacag

SEQ ID NO: 108431 - RNA, 22 nt, Homo sapiens
caaaggcuguuauaggccagga

SEQ ID NO: 108432 - RNA, 22 nt, Homo sapiens
caaaguaauuacgguuuuggcc

SEQ ID NO: 108433 - RNA, 22 nt, Homo sapiens
caaaguaauugcuguuuugcca

SEQ ID NO: 108434 - RNA, 22 nt, Homo sapiens
caaagugcuggccgggcgcagu

SEQ ID NO: 108435 - RNA, 22 nt, Homo sapiens
gacagugugauacuuagucuca

SEQ ID NO: 108436 - RNA, 18 nt, Homo sapiens
gacaguguggcgauuccu

SEQ ID NO: 108437 - RNA, 22 nt, Homo sapiens
gacaguuucucaggcuuccuua

SEQ ID NO: 108438 - RNA, 22 nt, Homo sapiens
gacaguuuggugaggaagacga

SEQ ID NO: 108439 - RNA, 22 nt, Homo sapiens
gaccugagagguacauguauuu

SEQ ID NO: 108440 - RNA, 22 nt, Homo sapiens
gagaacagagauaauuuuacuu

SEQ ID NO: 108441 - RNA, 22 nt, Homo sapiens
gagaacauacggcauuugguuu

SEQ ID NO: 108442 - RNA, 22 nt, Homo sapiens
gagaacauuuaagccacucagg

SEQ ID NO: 108443 - RNA, 22 nt, Homo sapiens
gagaacuggcugauucaaggac

SEQ ID NO: 108444 - RNA, 21 nt, Homo sapiens
gagaaucaucauggcugcaua

SEQ ID NO: 108445 - RNA, 21 nt, Homo sapiens
gagaaucuuuucagggcaaac

SEQ ID NO: 108446 - RNA, 22 nt, Homo sapiens
gagaaugagaggggaaggccac

SEQ ID NO: 108447 - RNA, 22 nt, Homo sapiens
gagacauguuugcuuaucugag

SEQ ID NO: 108448 - RNA, 23 nt, Homo sapiens
gagaccagcuucagaaagcacga

SEQ ID NO: 108449 - RNA, 21 nt, Homo sapiens
gagaggauucgccagccucuu

SEQ ID NO: 108450 - RNA, 22 nt, Homo sapiens
gagaucacuguuuauauucucu

SEQ ID NO: 108451 - RNA, 22 nt, Homo sapiens
gagauggaguuucacuucgcuc

SEQ ID NO: 108452 - RNA, 22 nt, Homo sapiens
gagaugugugugauuauauaau

SEQ ID NO: 108453 - RNA, 22 nt, Homo sapiens
gagcccauuucacuuguccagc

SEQ ID NO: 108454 - RNA, 22 nt, Homo sapiens
gagcugaaguuuccauuuguac

SEQ ID NO: 108455 - RNA, 22 nt, Homo sapiens
gagguaagagaauaaacaguuu

SEQ ID NO: 108456 - RNA, 22 nt, Homo sapiens
gagugcaaagguccugaggugg

SEQ ID NO: 108457 - RNA, 23 nt, Homo sapiens
gaguggagacucauugauuuccu

SEQ ID NO: 108458 - RNA, 22 nt, Homo sapiens
gauauguguaucuauguacaug

SEQ ID NO: 108459 - RNA, 22 nt, Homo sapiens
gauauguuagggggagaaguua

SEQ ID NO: 108460 - RNA, 22 nt, Homo sapiens
gaucugagaaagugucauaaca

SEQ ID NO: 108461 - RNA, 22 nt, Homo sapiens
gaugaggcuagagacaugugua

SEQ ID NO: 108462 - RNA, 22 nt, Homo sapiens
gaugcagcuaggauuugugaca

SEQ ID NO: 108463 - RNA, 22 nt, Homo sapiens
gauggcacuaagccauguagga

SEQ ID NO: 108464 - RNA, 22 nt, Homo sapiens
gauggcacuuaagagcaagagc

SEQ ID NO: 108465 - RNA, 22 nt, Homo sapiens
gauggguuuuuugaagacagca

SEQ ID NO: 108466 - RNA, 22 nt, Homo sapiens
gauguguuuguuucuggaggag

SEQ ID NO: 108467 - RNA, 22 nt, Homo sapiens
gauuagugacguugagcacugu

SEQ ID NO: 108468 - RNA, 22 nt, Homo sapiens
gauuuguauuaaaagugugacg

SEQ ID NO: 108469 - RNA, 22 nt, Homo sapiens
gcacaguggcucccgucuauaa

SEQ ID NO: 108470 - RNA, 22 nt, Homo sapiens
gcagcauuaccaagacauggca

SEQ ID NO: 108471 - RNA, 22 nt, Homo sapiens
gcaguguggguagagggcaaga

SEQ ID NO: 108472 - RNA, 20 nt, Homo sapiens
gcaguguucacuguauuccu

SEQ ID NO: 108473 - RNA, 22 nt, Homo sapiens
gccaagaugcugcccacagaca

SEQ ID NO: 108474 - RNA, 22 nt, Homo sapiens
gccagugugaugugaucauggc

SEQ ID NO: 108475 - RNA, 22 nt, Homo sapiens
gcugagcuaugccauauaugcc

SEQ ID NO: 108476 - RNA, 22 nt, Homo sapiens
gcugcacuuuaaggcauccccu

SEQ ID NO: 108477 - RNA, 22 nt, Homo sapiens
gcugcuguuuaguuucuccugg

SEQ ID NO: 108478 - RNA, 22 nt, Homo sapiens
gcugcuguuucucuuucagcau

SEQ ID NO: 108479 - RNA, 22 nt, Homo sapiens
gcuuguguuugcuccccagaau

SEQ ID NO: 108480 - RNA, 22 nt, Homo sapiens
ggaaagaucagcuaaauguaag

SEQ ID NO: 108481 - RNA, 22 nt, Homo sapiens
ggaaaucaucauucucgguaua

SEQ ID NO: 108482 - RNA, 22 nt, Homo sapiens
ggaagaauaaugggccuuagag

SEQ ID NO: 108483 - RNA, 22 nt, Homo sapiens
ggaagacaguguggugauuccu

SEQ ID NO: 108484 - RNA, 20 nt, Homo sapiens
ggaagagugacacaagguau

SEQ ID NO: 108485 - RNA, 18 nt, Homo sapiens
ggaagccuauuuaguaac

SEQ ID NO: 108486 - RNA, 20 nt, Homo sapiens
ggaauguuaaucuccaugau

SEQ ID NO: 108487 - RNA, 23 nt, Homo sapiens
ggacuguaagggauauaaagguu

SEQ ID NO: 108488 - RNA, 22 nt, Homo sapiens
ggagauuauugaaucaugaggg

SEQ ID NO: 108489 - RNA, 22 nt, Homo sapiens
ggagucugauguucuaaggcag

SEQ ID NO: 108490 - RNA, 22 nt, Homo sapiens
ggaucacuugagaccaggaguu

SEQ ID NO: 108491 - RNA, 23 nt, Homo sapiens
ggcaagaucucagcucacugcaa

SEQ ID NO: 108492 - RNA, 17 nt, Homo sapiens
ggcaggaauuaauguca

SEQ ID NO: 108493 - RNA, 22 nt, Homo sapiens
ggcauguguggguuauuaaaga

SEQ ID NO: 108494 - RNA, 22 nt, Homo sapiens
ggcucguguuuucuguccaguu

SEQ ID NO: 108495 - RNA, 20 nt, Homo sapiens
gggaaugcaaauucucaucc

SEQ ID NO: 108496 - RNA, 22 nt, Homo sapiens
gggaggucauuguaaggucuua

SEQ ID NO: 108497 - RNA, 22 nt, Homo sapiens
gggaugaagaagaauaguucgu

SEQ ID NO: 108498 - RNA, 22 nt, Homo sapiens
gggcaaaacuguacugccaagg

SEQ ID NO: 108499 - RNA, 22 nt, Homo sapiens
ggguucccuucuggcucagggu

SEQ ID NO: 108500 - RNA, 22 nt, Homo sapiens
ggucagaaagacaggcauucag

SEQ ID NO: 108501 - RNA, 21 nt, Homo sapiens
ggugagaaaggagacauagac

SEQ ID NO: 108502 - RNA, 22 nt, Homo sapiens
ggugagguaguaagguacaaua

SEQ ID NO: 108503 - RNA, 22 nt, Homo sapiens
gguggugguauuucagaaaaug

SEQ ID NO: 108504 - RNA, 22 nt, Homo sapiens
guaagguuguauuucaagaaac

SEQ ID NO: 108505 - RNA, 22 nt, Homo sapiens
guaaucucagcuacuugggagg

SEQ ID NO: 108506 - RNA, 19 nt, Homo sapiens
guaaugugcuucaguagca

SEQ ID NO: 108507 - RNA, 22 nt, Homo sapiens
guacaguauaguaauaggauuu

SEQ ID NO: 108508 - RNA, 22 nt, Homo sapiens
guagaggaauggcuccaccaua

SEQ ID NO: 108509 - RNA, 22 nt, Homo sapiens
guaugcaagugauaugacauau

SEQ ID NO: 108510 - RNA, 22 nt, Homo sapiens
gucaaagucuauuggcuaauuc

SEQ ID NO: 108511 - RNA, 22 nt, Homo sapiens
gucacaguggccagugauguuc

SEQ ID NO: 108512 - RNA, 22 nt, Homo sapiens
gucaggcaccgauacaguuuuu

SEQ ID NO: 108513 - RNA, 22 nt, Homo sapiens
gucaugggguacuacacauggg

SEQ ID NO: 108514 - RNA, 22 nt, Homo sapiens
guccaagacuaggaguuggcag

SEQ ID NO: 108515 - RNA, 22 nt, Homo sapiens
guccaguguuggagguuuuacc

SEQ ID NO: 108516 - RNA, 22 nt, Homo sapiens
guccauuuguuuccagagcacu

SEQ ID NO: 108517 - RNA, 22 nt, Homo sapiens
gucucccaaccccugugcccag

SEQ ID NO: 108518 - RNA, 22 nt, Homo sapiens
gucuccggcuguccuuugaggu

SEQ ID NO: 108519 - RNA, 22 nt, Homo sapiens
gucucuugguuuagagcauuua

SEQ ID NO: 108520 - RNA, 22 nt, Homo sapiens
gucucuuguuaucauuucugag

SEQ ID NO: 108521 - RNA, 22 nt, Homo sapiens
gucuggcaauggcagacuggca

SEQ ID NO: 108522 - RNA, 22 nt, Homo sapiens
gucuguuuggggaccuguggcc

SEQ ID NO: 108523 - RNA, 22 nt, Homo sapiens
gugaaugcauuaagaaggggga

SEQ ID NO: 108524 - RNA, 22 nt, Homo sapiens
gugacauuauuucagcuacaug

SEQ ID NO: 108525 - RNA, 22 nt, Homo sapiens
gugaccagaugggcaggggugu

SEQ ID NO: 108526 - RNA, 20 nt, Homo sapiens
gugagaacaugugguauuug

SEQ ID NO: 108527 - RNA, 22 nt, Homo sapiens
gugagcauaggaggcuucuguu

SEQ ID NO: 108528 - RNA, 22 nt, Homo sapiens
gugagcuccucuucugcugcag

SEQ ID NO: 108529 - RNA, 22 nt, Homo sapiens
gugaguuauuauuuauguaaac

SEQ ID NO: 108530 - RNA, 22 nt, Homo sapiens
gugcacaacaugcaguuuuguu

SEQ ID NO: 108531 - RNA, 22 nt, Homo sapiens
ucauccauacaguuagcaaagg

SEQ ID NO: 108532 - RNA, 22 nt, Homo sapiens
ucaucuggcgaaugugaagagu

SEQ ID NO: 108533 - RNA, 22 nt, Homo sapiens
ucaugggagcccccaucaugag

SEQ ID NO: 108534 - RNA, 22 nt, Homo sapiens
ucauggggugagcuacaggcac

SEQ ID NO: 108535 - RNA, 22 nt, Homo sapiens
ucauguguugcacugaggaccu

SEQ ID NO: 108536 - RNA, 22 nt, Homo sapiens
ucauucauucauccagcuugag

SEQ ID NO: 108537 - RNA, 22 nt, Homo sapiens
uccaaaucucuggcacugggau

SEQ ID NO: 108538 - RNA, 22 nt, Homo sapiens
uccacagugguggaauuguuca

SEQ ID NO: 108539 - RNA, 22 nt, Homo sapiens
uccacagugguugaacuaguaa

SEQ ID NO: 108540 - RNA, 22 nt, Homo sapiens
uccacagugguugaacuaguuu

SEQ ID NO: 108541 - RNA, 22 nt, Homo sapiens
uccagugugcaggcaaguuuga

SEQ ID NO: 108542 - RNA, 22 nt, Homo sapiens
uccaguguuccucagucacccc

SEQ ID NO: 108543 - RNA, 22 nt, Homo sapiens
uccaguuuggaggcuugaugug

SEQ ID NO: 108544 - RNA, 18 nt, Homo sapiens
uccaguuuucccagcauc

SEQ ID NO: 108545 - RNA, 20 nt, Homo sapiens
uccaguuuuggagacauucu

SEQ ID NO: 108546 - RNA, 22 nt, Homo sapiens
ucccuagacuccugccuuucag

SEQ ID NO: 108547 - RNA, 22 nt, Homo sapiens
ucccuuaaugaugaacaaugag

SEQ ID NO: 108548 - RNA, 19 nt, Homo sapiens
ucccuuuguagguaaccug

SEQ ID NO: 108549 - RNA, 22 nt, Homo sapiens
uccugagaauagaguugcaugu

SEQ ID NO: 108550 - RNA, 22 nt, Homo sapiens
uccugagacucacaggcucccc

SEQ ID NO: 108551 - RNA, 22 nt, Homo sapiens
ucucaaccuccacacuacaaua

SEQ ID NO: 108552 - RNA, 22 nt, Homo sapiens
ucucauggcucacccugcauag

SEQ ID NO: 108553 - RNA, 21 nt, Homo sapiens
ucucucaaccaggaagugggc

SEQ ID NO: 108554 - RNA, 22 nt, Homo sapiens
ucucugagaaaaguuucuccca

SEQ ID NO: 108555 - RNA, 22 nt, Homo sapiens
ucucugagaccacuccaaacuc

SEQ ID NO: 108556 - RNA, 22 nt, Homo sapiens
ucucugauuaaacaagauagug

SEQ ID NO: 108557 - RNA, 23 nt, Homo sapiens
ucuggaucauucguagugccagc

SEQ ID NO: 108558 - RNA, 21 nt, Homo sapiens
ucuggcuuucauuccccuucu

SEQ ID NO: 108559 - RNA, 19 nt, Homo sapiens
ucugugcuugucccccugu

SEQ ID NO: 108560 - RNA, 22 nt, Homo sapiens
ucuguggucagaguccuuggcc

SEQ ID NO: 108561 - RNA, 22 nt, Homo sapiens
ucuuugauuaugcagauggguu

SEQ ID NO: 108562 - RNA, 22 nt, Homo sapiens
ucuuugauuuuguuacuaagac

SEQ ID NO: 108563 - RNA, 22 nt, Homo sapiens
ucuuuuggguauggagccauca

SEQ ID NO: 108564 - RNA, 22 nt, Homo sapiens
ucuuuuguaaaaugaggaggug

SEQ ID NO: 108565 - RNA, 22 nt, Homo sapiens
ugaaauguuaaacaaguggcuc

SEQ ID NO: 108566 - RNA, 22 nt, Homo sapiens
ugaaggaguauggauaagucgu

SEQ ID NO: 108567 - RNA, 21 nt, Homo sapiens
ugaaugucuaggcagaaguuu

SEQ ID NO: 108568 - RNA, 22 nt, Homo sapiens
ugacaugauuguauauuuagaa

SEQ ID NO: 108569 - RNA, 22 nt, Homo sapiens
ugacuauugauuuagacgugcu

SEQ ID NO: 108570 - RNA, 22 nt, Homo sapiens
ugacuggagaccucaguagggu

SEQ ID NO: 108571 - RNA, 22 nt, Homo sapiens
ugacugugcagcuccaucaggg

SEQ ID NO: 108572 - RNA, 20 nt, Homo sapiens
ugagaacauguggcauuugg

SEQ ID NO: 108573 - RNA, 22 nt, Homo sapiens
ugagaacugccuguauuuaucu

SEQ ID NO: 108574 - RNA, 22 nt, Homo sapiens
ugagacacugaauccggccuga

SEQ ID NO: 108575 - RNA, 22 nt, Homo sapiens
ugagacugaguuucucucuugu

SEQ ID NO: 108576 - RNA, 22 nt, Homo sapiens
ugagacugaguuuugccuuugu

SEQ ID NO: 108577 - RNA, 22 nt, Homo sapiens
ugagacugaguuuugcucuugu

SEQ ID NO: 108578 - RNA, 22 nt, Homo sapiens
ugagagaugaacucugauaugu

SEQ ID NO: 108579 - RNA, 22 nt, Homo sapiens
ugagagcugguuguuuaaagga

SEQ ID NO: 108580 - RNA, 22 nt, Homo sapiens
ugagauaaagcauguacugugu

SEQ ID NO: 108581 - RNA, 22 nt, Homo sapiens
ugagauaucauuucacacccag

SEQ ID NO: 108582 - RNA, 22 nt, Homo sapiens
ugagaucaagguuaauauaauc

SEQ ID NO: 108583 - RNA, 22 nt, Homo sapiens
ugagauccugugacuacacuga

SEQ ID NO: 108584 - RNA, 22 nt, Homo sapiens
ugagaugaaagcagaaagacuu

SEQ ID NO: 108585 - RNA, 22 nt, Homo sapiens
ugagaugagggcugcacucaaa

SEQ ID NO: 108586 - RNA, 22 nt, Homo sapiens
ugagaugaggucucacucuguu

SEQ ID NO: 108587 - RNA, 22 nt, Homo sapiens
ugagaugaguugcuggcucuga

SEQ ID NO: 108588 - RNA, 22 nt, Homo sapiens
ugagcacauuuacaucaguucc

SEQ ID NO: 108589 - RNA, 21 nt, Homo sapiens
ugagcauuaguacaguaggga

SEQ ID NO: 108590 - RNA, 22 nt, Homo sapiens
ugagcauuguuuggacuuggau

SEQ ID NO: 108591 - RNA, 22 nt, Homo sapiens
ugagcccauuguccugguuuau

SEQ ID NO: 108592 - RNA, 22 nt, Homo sapiens
ugaggacugagaggcacugugg

SEQ ID NO: 108593 - RNA, 22 nt, Homo sapiens
ugaggagugaacuauuucugau

SEQ ID NO: 108594 - RNA, 22 nt, Homo sapiens
ugagguguuauccagaguucuu

SEQ ID NO: 108595 - RNA, 22 nt, Homo sapiens
ugagguuggggucagggcuagc

SEQ ID NO: 108596 - RNA, 19 nt, Homo sapiens
ugaguauauuguauucauu

SEQ ID NO: 108597 - RNA, 22 nt, Homo sapiens
ugaguuagguaauaauaaauau

SEQ ID NO: 108598 - RNA, 22 nt, Homo sapiens
ugauaugaaagggaaauaagug

SEQ ID NO: 108599 - RNA, 22 nt, Homo sapiens
ugaucucagcucacugguugaa

SEQ ID NO: 108600 - RNA, 22 nt, Homo sapiens
ugaucucauuagcaccuuuagc

SEQ ID NO: 108601 - RNA, 22 nt, Homo sapiens
ugaugcugaugccugccagaag

SEQ ID NO: 108602 - RNA, 22 nt, Homo sapiens
ugaugguuuuaaaaagaggagu

SEQ ID NO: 108603 - RNA, 22 nt, Homo sapiens
ugauguauuauuaagaccuggc

SEQ ID NO: 108604 - RNA, 22 nt, Homo sapiens
ugauguugacuguaggcagaga

SEQ ID NO: 108605 - RNA, 22 nt, Homo sapiens
ugcaaagaaauuuuggugacca

SEQ ID NO: 108606 - RNA, 22 nt, Homo sapiens
ugcaaagucgaaacugcaguuu

SEQ ID NO: 108607 - RNA, 19 nt, Homo sapiens
ugcaaagucuuuuccuauu

SEQ ID NO: 108608 - RNA, 22 nt, Homo sapiens
ugcaagaggagacuguacucag

SEQ ID NO: 108609 - RNA, 18 nt, Homo sapiens
ugcagcuuugugauuggc

SEQ ID NO: 108610 - RNA, 22 nt, Homo sapiens
ugcagugcaugacuguguuaug

SEQ ID NO: 108611 - RNA, 22 nt, Homo sapiens
ugcagugugaaagagccugaca

SEQ ID NO: 108612 - RNA, 22 nt, Homo sapiens
ugcauaugcagcauuuaugauu

SEQ ID NO: 108613 - RNA, 22 nt, Homo sapiens
ugcauaugucuuuauaguagca

SEQ ID NO: 108614 - RNA, 19 nt, Homo sapiens
ugcauugucugggaaaugg

SEQ ID NO: 108615 - RNA, 22 nt, Homo sapiens
ugccaacaugccuggcuguuuu

SEQ ID NO: 108616 - RNA, 22 nt, Homo sapiens
ugccaacugguuucuuuuaguu

SEQ ID NO: 108617 - RNA, 23 nt, Homo sapiens
ugccuagaugcugcccugggaca

SEQ ID NO: 108618 - RNA, 22 nt, Homo sapiens
ugccuaguagaaggugaacaug

SEQ ID NO: 108619 - RNA, 21 nt, Homo sapiens
ugcgauccucaauccucuguu

SEQ ID NO: 108620 - RNA, 22 nt, Homo sapiens
ugcgccauugcauuccagccug

SEQ ID NO: 108621 - RNA, 21 nt, Homo sapiens
ugcuacugucacuuccuuugu

SEQ ID NO: 108622 - RNA, 22 nt, Homo sapiens
uggaaaacaugcacauuggauu

SEQ ID NO: 108623 - RNA, 22 nt, Homo sapiens
uggaagacucuagucucuugag

SEQ ID NO: 108624 - RNA, 22 nt, Homo sapiens
uggaagcauagcagcgugugug

SEQ ID NO: 108625 - RNA, 22 nt, Homo sapiens
uggaagugaacaaccaaggcag

SEQ ID NO: 108626 - RNA, 22 nt, Homo sapiens
uggaaucuacuaaagcaaaauc

SEQ ID NO: 108627 - RNA, 22 nt, Homo sapiens
uuccuugugacuaguagugacc

SEQ ID NO: 108628 - RNA, 22 nt, Homo sapiens
uucgucaugagacagaugcuga

SEQ ID NO: 108629 - RNA, 22 nt, Homo sapiens
uucucagugaaguuuagaacau

SEQ ID NO: 108630 - RNA, 22 nt, Homo sapiens
uucucgcuuuuuccaccuguau

SEQ ID NO: 108631 - RNA, 23 nt, Homo sapiens
uucugccacugaaaaugccucag

SEQ ID NO: 108632 - RNA, 22 nt, Homo sapiens
uucugugguugaaaggagagau

SEQ ID NO: 108633 - RNA, 22 nt, Homo sapiens
uugaaagcuaucucaaaucgcu

SEQ ID NO: 108634 - RNA, 22 nt, Homo sapiens
uugaaaguguucacaaugguau

SEQ ID NO: 108635 - RNA, 22 nt, Homo sapiens
uugaagagaaccgcggcuuauu

SEQ ID NO: 108636 - RNA, 19 nt, Homo sapiens
uugaaggccgccuugcaga

SEQ ID NO: 108637 - RNA, 22 nt, Homo sapiens
uugaaguagaaagacgaaauuu

SEQ ID NO: 108638 - RNA, 22 nt, Homo sapiens
uugaaugaaaugaugucauuug

SEQ ID NO: 108639 - RNA, 22 nt, Homo sapiens
uugacauaguuucugaaauaga

SEQ ID NO: 108640 - RNA, 22 nt, Homo sapiens
uugacauauuugugcuuaagaa

SEQ ID NO: 108641 - RNA, 22 nt, Homo sapiens
uugacauugcuguaguguccag

SEQ ID NO: 108642 - RNA, 22 nt, Homo sapiens
uugacuguaagauggcuauuac

SEQ ID NO: 108643 - RNA, 22 nt, Homo sapiens
uugacuucagagcugauucaag

SEQ ID NO: 108644 - RNA, 22 nt, Homo sapiens
uugagauaggaacucacuaugc

SEQ ID NO: 108645 - RNA, 22 nt, Homo sapiens
uugagauggagucucgcugugu

SEQ ID NO: 108646 - RNA, 22 nt, Homo sapiens
uugagcccuggagguggaggcu

SEQ ID NO: 108647 - RNA, 22 nt, Homo sapiens
uugaggaggcagucucuccauu

SEQ ID NO: 108648 - RNA, 22 nt, Homo sapiens
uugcaacauuguaaguuuauau

SEQ ID NO: 108649 - RNA, 22 nt, Homo sapiens
uugcacuguaauuuauuuaugu

SEQ ID NO: 108650 - RNA, 22 nt, Homo sapiens
uugcaugguggaacuuggagcu

SEQ ID NO: 108651 - RNA, 22 nt, Homo sapiens
uugcccuuuagguaacuauaua

SEQ ID NO: 108652 - RNA, 22 nt, Homo sapiens
uugcgcuuuuccuauguugccc

SEQ ID NO: 108653 - RNA, 22 nt, Homo sapiens
uugcucaggcuagaguucagcu

SEQ ID NO: 108654 - RNA, 22 nt, Homo sapiens
uugcuuagucaugaaucacuga

SEQ ID NO: 108655 - RNA, 22 nt, Homo sapiens
uuggaaugcaacagaaggauaa

SEQ ID NO: 108656 - RNA, 22 nt, Homo sapiens
uuggaauguacucuagccuaug

SEQ ID NO: 108657 - RNA, 22 nt, Homo sapiens
uuggaccacuugauuucugguc

SEQ ID NO: 108658 - RNA, 22 nt, Homo sapiens
uuggcaaauagguuuuauugca

SEQ ID NO: 108659 - RNA, 22 nt, Homo sapiens
uuggccauaugacuugcuuugg

SEQ ID NO: 108660 - RNA, 23 nt, Homo sapiens
uuggccuccuugugucuagggcu

SEQ ID NO: 108661 - RNA, 21 nt, Homo sapiens
uuggccuggaggccugaaugu

SEQ ID NO: 108662 - RNA, 22 nt, Homo sapiens
uugguuauccugucgguaauuc

SEQ ID NO: 108663 - RNA, 22 nt, Homo sapiens
uuguauaggcucaguaagaauc

SEQ ID NO: 108664 - RNA, 22 nt, Homo sapiens
uugucucacuggaguuuaguaa

SEQ ID NO: 108665 - RNA, 22 nt, Homo sapiens
uugucuugcagcuuaggcauca

SEQ ID NO: 108666 - RNA, 22 nt, Homo sapiens
uugugccacugaagcccuccag

SEQ ID NO: 108667 - RNA, 22 nt, Homo sapiens
uugugccauucuucugccucag

SEQ ID NO: 108668 - RNA, 22 nt, Homo sapiens
uugugcuugauuugccuagcug

SEQ ID NO: 108669 - RNA, 22 nt, Homo sapiens
uugugcuuuugagcugagauga

SEQ ID NO: 108670 - RNA, 18 nt, Homo sapiens
uuguggccccuacaaauu

SEQ ID NO: 108671 - RNA, 19 nt, Homo sapiens
uugugggaggacagagggg

SEQ ID NO: 108672 - RNA, 22 nt, Homo sapiens
uugugguaaucugugacagcag

SEQ ID NO: 108673 - RNA, 22 nt, Homo sapiens
uugugguuuuuaaaacuaggug

SEQ ID NO: 108674 - RNA, 19 nt, Homo sapiens
uuguguccccacaaaauuc

SEQ ID NO: 108675 - RNA, 22 nt, Homo sapiens
uuguguuuuuaguagggaaggg

SEQ ID NO: 108676 - RNA, 22 nt, Homo sapiens
uuuaaagcacggaguuuguggc

SEQ ID NO: 108677 - RNA, 22 nt, Homo sapiens
uuuaacauuggaugagaucguc

SEQ ID NO: 108678 - RNA, 22 nt, Homo sapiens
uuuaaggcaugccuguacaugc

SEQ ID NO: 108679 - RNA, 18 nt, Homo sapiens
uuuacaguagaaggacuu

SEQ ID NO: 108680 - RNA, 22 nt, Homo sapiens
uuuacaguuuucuaggcuacca

SEQ ID NO: 108681 - RNA, 22 nt, Homo sapiens
uuuagcagcaaagagccaugcu

SEQ ID NO: 108682 - RNA, 18 nt, Homo sapiens
uuucaagucuuaggugac

SEQ ID NO: 108683 - RNA, 18 nt, Homo sapiens
uuucauugagugugauau

SEQ ID NO: 108684 - RNA, 22 nt, Homo sapiens
uuucugcuugagagaauugcug

SEQ ID NO: 108685 - RNA, 22 nt, Homo sapiens
uuugaagcuaaggugcuugguu

SEQ ID NO: 108686 - RNA, 22 nt, Homo sapiens
uuugacuuuuagaauaugaguu

SEQ ID NO: 108687 - RNA, 22 nt, Homo sapiens
uuugauguugagacuauaaagc

SEQ ID NO: 108688 - RNA, 22 nt, Homo sapiens
uuugauguugauacuaccuuca

SEQ ID NO: 108689 - RNA, 19 nt, Homo sapiens
uuugcauagugagaauaua

SEQ ID NO: 108690 - RNA, 22 nt, Homo sapiens
uuugcaucuuagaaaguucucc

SEQ ID NO: 108691 - RNA, 22 nt, Homo sapiens
uuugcaucuuuugcuuccugga

SEQ ID NO: 108692 - RNA, 22 nt, Homo sapiens
uuugcaugcuccuuaugagaau

SEQ ID NO: 108693 - RNA, 22 nt, Homo sapiens
uuugccuuugugauauggucua

SEQ ID NO: 108694 - RNA, 22 nt, Homo sapiens
uuugcugagucugacuucaugg

SEQ ID NO: 108695 - RNA, 22 nt, Homo sapiens
uuuggaagaugccacuguauca

SEQ ID NO: 108696 - RNA, 22 nt, Homo sapiens
uuuggcaacguuggaucccuca

SEQ ID NO: 108697 - RNA, 22 nt, Homo sapiens
uuuggcccugagggauggcaua

SEQ ID NO: 108698 - RNA, 18 nt, Homo sapiens
uuuggcuguucaugacuc

SEQ ID NO: 108699 - RNA, 22 nt, Homo sapiens
uuuggcuuaagauugacugcaa

SEQ ID NO: 108700 - RNA, 22 nt, Homo sapiens
uuugggaaugaguuuaucauuu

SEQ ID NO: 108701 - RNA, 22 nt, Homo sapiens
uuuggucuuuuguaaguuaucu

SEQ ID NO: 108702 - RNA, 22 nt, Homo sapiens
uuugguguauaaaaaugcuagu

SEQ ID NO: 108703 - RNA, 22 nt, Homo sapiens
uuuguacuugguguucuggaaa

SEQ ID NO: 108704 - RNA, 21 nt, Homo sapiens
uuuguaguagcaugauuuaua

SEQ ID NO: 108705 - RNA, 22 nt, Homo sapiens
uuugugcuccuaugagaaucua

SEQ ID NO: 108706 - RNA, 22 nt, Homo sapiens
uuugugcuccugugagaaucua

SEQ ID NO: 108707 - RNA, 22 nt, Homo sapiens
uuugugcuccuguugagaaucu

SEQ ID NO: 108708 - RNA, 19 nt, Homo sapiens
uuuuccccuuucuuaagac

SEQ ID NO: 108709 - RNA, 22 nt, Homo sapiens
uuuugcaguuacagagagugag

SEQ ID NO: 108710 - RNA, 22 nt, Homo sapiens
uuuuugagaauuggugaaacac

SEQ ID NO: 108711 - RNA, 22 nt, Homo sapiens
uuuuugaguaaauauaaauugu

SEQ ID NO: 108712 - RNA, 22 nt, Homo sapiens
uuuuugaguagcuggagagcag

SEQ ID NO: 108713 - RNA, 16 nt, Homo sapiens
uuuuugcagaaaugac

SEQ ID NO: 108714 - RNA, 22 nt, Homo sapiens
uuugccaauauuuuacugagga

SEQ ID NO: 108715 - RNA, 22 nt, Homo sapiens
uuuggcaaagaucaacauguua

SEQ ID NO: 108716 - RNA, 22 nt, Homo sapiens
uuuggcccccagcucaggacau

SEQ ID NO: 108717 - RNA, 22 nt, Homo sapiens
uuuggcucugugucccacccaa

SEQ ID NO: 108718 - RNA, 21 nt, Homo sapiens
uuuggcuucucugcugcagcc

SEQ ID NO: 108719 - RNA, 22 nt, Homo sapiens
uuugguuuuuguuaucacucau

SEQ ID NO: 108720 - RNA, 22 nt, Homo sapiens
uuuguccccgcccagaucucau

SEQ ID NO: 108721 - RNA, 18 nt, Homo sapiens
uuuuugaggcacagggga

SEQ ID NO: 108722 - RNA, 22 nt, Homo sapiens
augaaaucuuuggcagaucuua

SEQ ID NO: 108723 - RNA, 22 nt, Homo sapiens
augaaauguaugagucuggguu

SEQ ID NO: 108724 - RNA, 22 nt, Homo sapiens
augaagugcaugauaguugguu

SEQ ID NO: 108725 - RNA, 23 nt, Homo sapiens
augacacuccugugcgcacccug

SEQ ID NO: 108726 - RNA, 22 nt, Homo sapiens
augacauguauuuccaggauuu

SEQ ID NO: 108727 - RNA, 22 nt, Homo sapiens
augacauugaugcucuggcugg

SEQ ID NO: 108728 - RNA, 22 nt, Homo sapiens
augagacaguucccuuuaucuu

SEQ ID NO: 108729 - RNA, 22 nt, Homo sapiens
augagauaggaacaaacuuaca

SEQ ID NO: 108730 - RNA, 22 nt, Homo sapiens
augagauauguuaaaaguuaaa

SEQ ID NO: 108731 - RNA, 22 nt, Homo sapiens
augaggcaggaaaggcguaucu

SEQ ID NO: 108732 - RNA, 22 nt, Homo sapiens
augaguaguugcuaaauauuga

SEQ ID NO: 108733 - RNA, 22 nt, Homo sapiens
augaguaugagaauacauuaag

SEQ ID NO: 108734 - RNA, 22 nt, Homo sapiens
augagucacuuauuauuggggu

SEQ ID NO: 108735 - RNA, 22 nt, Homo sapiens
augauauguuuguagcuaucuc

SEQ ID NO: 108736 - RNA, 22 nt, Homo sapiens
augcacauggcuaacuuuuuuc

SEQ ID NO: 108737 - RNA, 22 nt, Homo sapiens
augcauauuccugggccucacu

SEQ ID NO: 108738 - RNA, 18 nt, Homo sapiens
augcauauuuuaaguugu

SEQ ID NO: 108739 - RNA, 22 nt, Homo sapiens
augcauggcagagucaggguac

SEQ ID NO: 108740 - RNA, 22 nt, Homo sapiens
augcaugucaaauuuguagguu

SEQ ID NO: 108741 - RNA, 22 nt, Homo sapiens
augccacagaaauaaccaaaau

SEQ ID NO: 108742 - RNA, 22 nt, Homo sapiens
auggaaggagaauggucuuuga

SEQ ID NO: 108743 - RNA, 22 nt, Homo sapiens
auggaaggagaggaaugaauga

SEQ ID NO: 108744 - RNA, 22 nt, Homo sapiens
auggaauggcacuuugaagauu

SEQ ID NO: 108745 - RNA, 22 nt, Homo sapiens
auggaggaggaagcugaaacaa

SEQ ID NO: 108746 - RNA, 22 nt, Homo sapiens
auggauuuuggggccagaggca

SEQ ID NO: 108747 - RNA, 22 nt, Homo sapiens
auggccuuguauaccuggcaaa

SEQ ID NO: 108748 - RNA, 22 nt, Homo sapiens
auggcucuguuuuuuaugcucu

SEQ ID NO: 108749 - RNA, 22 nt, Homo sapiens
auggcuuuggucucccagugau

SEQ ID NO: 108750 - RNA, 22 nt, Homo sapiens
auggcuuuuuaaaucauguugu

SEQ ID NO: 108751 - RNA, 21 nt, Homo sapiens
augguacugucucuggagaua

SEQ ID NO: 108752 - RNA, 20 nt, Homo sapiens
augucagaguguggguacgg

SEQ ID NO: 108753 - RNA, 22 nt, Homo sapiens
auguggcacuugacuuucucgc

SEQ ID NO: 108754 - RNA, 22 nt, Homo sapiens
augugggaggaauguguuucca

SEQ ID NO: 108755 - RNA, 22 nt, Homo sapiens
auguuaacaucuuaguuuucau

SEQ ID NO: 108756 - RNA, 22 nt, Homo sapiens
auuagguacugugguuuccaga

SEQ ID NO: 108757 - RNA, 22 nt, Homo sapiens
auucaaagugcauguucccacu

SEQ ID NO: 108758 - RNA, 22 nt, Homo sapiens
auucacagcuuuaaaaggcgug

SEQ ID NO: 108759 - RNA, 22 nt, Homo sapiens
auucacuguggguccuuuggau

SEQ ID NO: 108760 - RNA, 22 nt, Homo sapiens
auugcaaugggaaacuaugaaa

SEQ ID NO: 108761 - RNA, 22 nt, Homo sapiens
auugcagaaaugacagagcgcc

SEQ ID NO: 108762 - RNA, 22 nt, Homo sapiens
auugcagcccacccugggugau

SEQ ID NO: 108763 - RNA, 22 nt, Homo sapiens
auugcagcuugcagggugugua

SEQ ID NO: 108764 - RNA, 22 nt, Homo sapiens
auuguguagucuuacugcuugc

SEQ ID NO: 108765 - RNA, 22 nt, Homo sapiens
auuugucacuauguggcuaaua

SEQ ID NO: 108766 - RNA, 22 nt, Homo sapiens
caaaagugguucuuauccuuuu

SEQ ID NO: 108767 - RNA, 22 nt, Homo sapiens
caaaggcuuccacugcauccuu

SEQ ID NO: 108768 - RNA, 22 nt, Homo sapiens
caaaggcuucugaaacugcaga

SEQ ID NO: 108769 - RNA, 22 nt, Homo sapiens
caaaguaauugugguuuugcca

SEQ ID NO: 108770 - RNA, 22 nt, Homo sapiens
caaagucuauucuacccuuacc

SEQ ID NO: 108771 - RNA, 22 nt, Homo sapiens
caaauacuuucauguugucuug

SEQ ID NO: 108772 - RNA, 22 nt, Homo sapiens
cacaaaguagauuagucuucca

SEQ ID NO: 108773 - RNA, 22 nt, Homo sapiens
cacagggcuaacauuuuugccc

SEQ ID NO: 108774 - RNA, 22 nt, Homo sapiens
cacauguucaggagcacuuaga

SEQ ID NO: 108775 - RNA, 22 nt, Homo sapiens
caccuguagucccagcugaggc

SEQ ID NO: 108776 - RNA, 22 nt, Homo sapiens
cacugcacuccagccuaagagg

SEQ ID NO: 108777 - RNA, 22 nt, Homo sapiens
cacugcauggccacccauguua

SEQ ID NO: 108778 - RNA, 21 nt, Homo sapiens
cacuggguucaggcuugugga

SEQ ID NO: 108779 - RNA, 22 nt, Homo sapiens
cacuguggauggaacuauguga

SEQ ID NO: 108780 - RNA, 22 nt, Homo sapiens
cagagguaagcaagucagcauu

SEQ ID NO: 108781 - RNA, 22 nt, Homo sapiens
cagcaagucucuaagaguucau

SEQ ID NO: 108782 - RNA, 22 nt, Homo sapiens
cagcaucauucaucugggguaa

SEQ ID NO: 108783 - RNA, 22 nt, Homo sapiens
caguagcaugccucagaaugag

SEQ ID NO: 108784 - RNA, 20 nt, Homo sapiens
cagucaugaagaacugugag

SEQ ID NO: 108785 - RNA, 20 nt, Homo sapiens
cagugcacuuucccacuggu

SEQ ID NO: 108786 - RNA, 22 nt, Homo sapiens
cagugcuuguuauuguucuauu

SEQ ID NO: 108787 - RNA, 21 nt, Homo sapiens
caucaaauugucauggugggu

SEQ ID NO: 108788 - RNA, 22 nt, Homo sapiens
caucacaucugcaugguaagua

SEQ ID NO: 108789 - RNA, 22 nt, Homo sapiens
caucacauucugagauacugag

SEQ ID NO: 108790 - RNA, 19 nt, Homo sapiens
caucccugagcugaagugg

SEQ ID NO: 108791 - RNA, 22 nt, Homo sapiens
caucccugucgucaagucucug

SEQ ID NO: 108792 - RNA, 22 nt, Homo sapiens
caugacacauguuuaccuaugu

SEQ ID NO: 108793 - RNA, 22 nt, Homo sapiens
caugacacuggcauguuucuuu

SEQ ID NO: 108794 - RNA, 22 nt, Homo sapiens
cauggccuuuggaaugugucua

SEQ ID NO: 108795 - RNA, 22 nt, Homo sapiens
cauggcucuuugcugcuaaagu

SEQ ID NO: 108796 - RNA, 23 nt, Homo sapiens
cauggcuguuaacacuguuugag

SEQ ID NO: 108797 - RNA, 22 nt, Homo sapiens
caugucuuuuauucugugugau

SEQ ID NO: 108798 - RNA, 22 nt, Homo sapiens
cauugcacuccagccuuggcaa

SEQ ID NO: 108799 - RNA, 22 nt, Homo sapiens
cauugcauuccagucugggcaa

SEQ ID NO: 108800 - RNA, 22 nt, Homo sapiens
cauuggugauuagugaaugaac

SEQ ID NO: 108801 - RNA, 22 nt, Homo sapiens
cauuuugcaguuucugucucca

SEQ ID NO: 108802 - RNA, 22 nt, Homo sapiens
ccaaaucucauguugaaaugug

SEQ ID NO: 108803 - RNA, 22 nt, Homo sapiens
ccaagccucaguuucccucugu

SEQ ID NO: 108804 - RNA, 22 nt, Homo sapiens
ccaaguguucucauuguucaau

SEQ ID NO: 108805 - RNA, 22 nt, Homo sapiens
ccacacugucuuggugggaaac

SEQ ID NO: 108806 - RNA, 22 nt, Homo sapiens
ccacaguggauuaaaguuacug

SEQ ID NO: 108807 - RNA, 22 nt, Homo sapiens
ccacugugguaucugauacugg

SEQ ID NO: 108808 - RNA, 22 nt, Homo sapiens
ccaguuuucaagauaaugguuu

SEQ ID NO: 108809 - RNA, 22 nt, Homo sapiens
ccaucccuuucugagcaguucc

SEQ ID NO: 108810 - RNA, 22 nt, Homo sapiens
ccauggcaauggucagucuauu

SEQ ID NO: 108811 - RNA, 22 nt, Homo sapiens
ccauggcuucugcauucuguca

SEQ ID NO: 108812 - RNA, 22 nt, Homo sapiens
cccagaguucuuaaauacugag

SEQ ID NO: 108813 - RNA, 21 nt, Homo sapiens
cccagguucucugaggguaga

SEQ ID NO: 108814 - RNA, 22 nt, Homo sapiens
cccaguguuuauuuugagccaa

SEQ ID NO: 108815 - RNA, 20 nt, Homo sapiens
ccccaguuuuucuauuagcu

SEQ ID NO: 108816 - RNA, 22 nt, Homo sapiens
cccugagagcagggucuuucuc

SEQ ID NO: 108817 - RNA, 22 nt, Homo sapiens
ccugguguuuugauggucgggu

SEQ ID NO: 108818 - RNA, 21 nt, Homo sapiens
ccuugagaacaucaauuugcu

SEQ ID NO: 108819 - RNA, 22 nt, Homo sapiens
ccuuggcacuacugacauugua

SEQ ID NO: 108820 - RNA, 22 nt, Homo sapiens
cuaagugaguauaauuuuaaga

SEQ ID NO: 108821 - RNA, 22 nt, Homo sapiens
cuacaguagagaggauguagaa

SEQ ID NO: 108822 - RNA, 22 nt, Homo sapiens
cuacaguaugaaaccuuuacuc

SEQ ID NO: 108823 - RNA, 22 nt, Homo sapiens
cuagcuuuugauguaaagugag

SEQ ID NO: 108824 - RNA, 22 nt, Homo sapiens
cuauggcagccacggccuggag

SEQ ID NO: 108825 - RNA, 22 nt, Homo sapiens
cucaaagugcugggacuggcug

SEQ ID NO: 108826 - RNA, 18 nt, Homo sapiens
cucacacccuaaucagga

SEQ ID NO: 108827 - RNA, 22 nt, Homo sapiens
cucacugggaccacucugaagu

SEQ ID NO: 108828 - RNA, 23 nt, Homo sapiens
cuccaugagccguccagggccug

SEQ ID NO: 108829 - RNA, 22 nt, Homo sapiens
cucccugagccagggcuuugac

SEQ ID NO: 108830 - RNA, 22 nt, Homo sapiens
cucucuguuugucuguuauugg

SEQ ID NO: 108831 - RNA, 22 nt, Homo sapiens
cucugauggagauauacaagga

SEQ ID NO: 108832 - RNA, 22 nt, Homo sapiens
cucuuggguagauuuugcagag

SEQ ID NO: 108833 - RNA, 22 nt, Homo sapiens
cucuuuuguuuagcugagaggg

SEQ ID NO: 108834 - RNA, 22 nt, Homo sapiens
cugaaaguuauucaggggcaag

SEQ ID NO: 108835 - RNA, 22 nt, Homo sapiens
cugaauguccaggcagagguuu

SEQ ID NO: 108836 - RNA, 22 nt, Homo sapiens
cugagauacacuaauagucucu

SEQ ID NO: 108837 - RNA, 22 nt, Homo sapiens
cugaggguagaaggaucacuug

SEQ ID NO: 108838 - RNA, 19 nt, Homo sapiens
cugcacugagaaaaggagg

SEQ ID NO: 108839 - RNA, 22 nt, Homo sapiens
cugcccuuucuauaugauguaa

SEQ ID NO: 108840 - RNA, 18 nt, Homo sapiens
cuggaaggcuacuacagu

SEQ ID NO: 108841 - RNA, 19 nt, Homo sapiens
cuggcaaaugcuuuggcca

SEQ ID NO: 108842 - RNA, 22 nt, Homo sapiens
cuggugagaugucuuuccucuu

SEQ ID NO: 108843 - RNA, 22 nt, Homo sapiens
cuguaaagaucacagagcuggu

SEQ ID NO: 108844 - RNA, 22 nt, Homo sapiens
cuguaaggcacuaagcauaugu

SEQ ID NO: 108845 - RNA, 22 nt, Homo sapiens
cuguagacauuaggccugcacu

SEQ ID NO: 108846 - RNA, 22 nt, Homo sapiens
cugucacugggaggggcagcag

SEQ ID NO: 108847 - RNA, 22 nt, Homo sapiens
cugugacugcagggcauauuug

SEQ ID NO: 108848 - RNA, 22 nt, Homo sapiens
cugugaucuuuuuucauguggu

SEQ ID NO: 108849 - RNA, 22 nt, Homo sapiens
cugugcaaagcgcucucggggu

SEQ ID NO: 108850 - RNA, 19 nt, Homo sapiens
cuguggucauuauuuugcu

SEQ ID NO: 108851 - RNA, 22 nt, Homo sapiens
cuuacagucuaucagccacaac

SEQ ID NO: 108852 - RNA, 21 nt, Homo sapiens
cuucuuggggcagggcagggu

SEQ ID NO: 108853 - RNA, 22 nt, Homo sapiens
cuuuugugauuccucaguuacu

SEQ ID NO: 108854 - RNA, 22 nt, Homo sapiens
cuuuugugauucuucaguuacu

SEQ ID NO: 108855 - RNA, 22 nt, Homo sapiens
cuuuuugcaaauacaacucuga

SEQ ID NO: 108856 - RNA, 22 nt, Homo sapiens
gaaauggaucagagcaagcuuu

SEQ ID NO: 108857 - RNA, 22 nt, Homo sapiens
gaacccuggaggcggagguugc

SEQ ID NO: 108858 - RNA, 22 nt, Homo sapiens
gaagagacagguucccacaaaa

SEQ ID NO: 108859 - RNA, 22 nt, Homo sapiens
gaaguaguaaaauuuauugcag

SEQ ID NO: 108860 - RNA, 22 nt, Homo sapiens
gaauaaacuagagaggacugag

SEQ ID NO: 108861 - RNA, 22 nt, Homo sapiens
gaaucacaguuauuagagcagc

SEQ ID NO: 108862 - RNA, 22 nt, Homo sapiens
gaaucacugugguaucccaugc

SEQ ID NO: 108863 - RNA, 22 nt, Homo sapiens
gaaucauuguuucuaaguuugu

SEQ ID NO: 108864 - RNA, 22 nt, Homo sapiens
gaaugguuuacaaguguaaucu

SEQ ID NO: 108865 - RNA, 22 nt, Homo sapiens
gaaugucuuauugcucguugua

SEQ ID NO: 108866 - RNA, 22 nt, Homo sapiens
gacacuggguguuuguuggcgu

SEQ ID NO: 108867 - RNA, 22 nt, Homo sapiens
gacacugucuucugcucuuaaa

SEQ ID NO: 108868 - RNA, 19 nt, Homo sapiens
gacuccagaguugugugcu

SEQ ID NO: 108869 - RNA, 16 nt, Homo sapiens
gacugggcugaggaau

SEQ ID NO: 108870 - RNA, 22 nt, Homo sapiens
gagaacagaagcauuccuaauu

SEQ ID NO: 108871 - RNA, 22 nt, Homo sapiens
gagaacaguguuguauuuuuuc

SEQ ID NO: 108872 - RNA, 22 nt, Homo sapiens
gagaacugagauaagugauauu

SEQ ID NO: 108873 - RNA, 22 nt, Homo sapiens
gugguuuuaucccagaaauuaa

SEQ ID NO: 108874 - RNA, 22 nt, Homo sapiens
gugguuuucaacuccaccugca

SEQ ID NO: 108875 - RNA, 22 nt, Homo sapiens
gugguuuuuuucugccuuauag

SEQ ID NO: 108876 - RNA, 22 nt, Homo sapiens
guguaaaucaaucuguugucuu

SEQ ID NO: 108877 - RNA, 22 nt, Homo sapiens
gugucccagugugcauacaggu

SEQ ID NO: 108878 - RNA, 18 nt, Homo sapiens
gugucugguuaugggagu

SEQ ID NO: 108879 - RNA, 22 nt, Homo sapiens
gugugauggcgcacacagggug

SEQ ID NO: 108880 - RNA, 21 nt, Homo sapiens
gugugcuugaauucagcuguc

SEQ ID NO: 108881 - RNA, 22 nt, Homo sapiens
guucacagugguugccuuccag

SEQ ID NO: 108882 - RNA, 22 nt, Homo sapiens
guuccuuguagaugcuggauau

SEQ ID NO: 108883 - RNA, 22 nt, Homo sapiens
guucuggagauaaagccaaggu

SEQ ID NO: 108884 - RNA, 22 nt, Homo sapiens
uaaagccauugucaaguuugua

SEQ ID NO: 108885 - RNA, 22 nt, Homo sapiens
uaaauugcauaaguacaaauga

SEQ ID NO: 108886 - RNA, 18 nt, Homo sapiens
uaaauugcuucaccugag

SEQ ID NO: 108887 - RNA, 22 nt, Homo sapiens
uaagagagcuccaucuuuuccu

SEQ ID NO: 108888 - RNA, 16 nt, Homo sapiens
uaagccccacgugcau

SEQ ID NO: 108889 - RNA, 21 nt, Homo sapiens
uaagcuaaacauucaguuaac

SEQ ID NO: 108890 - RNA, 22 nt, Homo sapiens
uaaggcuuaugguaaaguccug

SEQ ID NO: 108891 - RNA, 22 nt, Homo sapiens
uaaggcuuugcuggacucaguc

SEQ ID NO: 108892 - RNA, 22 nt, Homo sapiens
uaaggcuuugguagguuugguc

SEQ ID NO: 108893 - RNA, 22 nt, Homo sapiens
uaaggcuuuuguucagcguggg

SEQ ID NO: 108894 - RNA, 22 nt, Homo sapiens
uaagugaauuugacagguaaug

SEQ ID NO: 108895 - RNA, 18 nt, Homo sapiens
uaagugcuuuaaacacau

SEQ ID NO: 108896 - RNA, 20 nt, Homo sapiens
uaagugcuuuauauugauua

SEQ ID NO: 108897 - RNA, 18 nt, Homo sapiens
uaauaacugugaccuuga

SEQ ID NO: 108898 - RNA, 22 nt, Homo sapiens
uaauagagucauuauuauuguu

SEQ ID NO: 108899 - RNA, 22 nt, Homo sapiens
uaauugaaugcagacaccaggg

SEQ ID NO: 108900 - RNA, 21 nt, Homo sapiens
uacaaugcacaggagagccuc

SEQ ID NO: 108901 - RNA, 22 nt, Homo sapiens
uacagaauucugucccuugagu

SEQ ID NO: 108902 - RNA, 23 nt, Homo sapiens
uacagcugcagaaucaggcuaag

SEQ ID NO: 108903 - RNA, 19 nt, Homo sapiens
uacaggacugagcugaggu

SEQ ID NO: 108904 - RNA, 22 nt, Homo sapiens
uacagugcuugguaucuaguaa

SEQ ID NO: 108905 - RNA, 22 nt, Homo sapiens
uacauccauccugcugggcagu

SEQ ID NO: 108906 - RNA, 22 nt, Homo sapiens
uaccaaaguuucggccucuguu

SEQ ID NO: 108907 - RNA, 22 nt, Homo sapiens
uacugagagaggaauauugaaa

SEQ ID NO: 108908 - RNA, 22 nt, Homo sapiens
uagaaagcaugaccuucagaua

SEQ ID NO: 108909 - RNA, 22 nt, Homo sapiens
uagagcuugacacuuuccaugg

SEQ ID NO: 108910 - RNA, 22 nt, Homo sapiens
uagaggaaugaauuuggccaga

SEQ ID NO: 108911 - RNA, 22 nt, Homo sapiens
uagauucauuuuagcaaaaguu

SEQ ID NO: 108912 - RNA, 21 nt, Homo sapiens
uagcaaauugcuauuaaggca

SEQ ID NO: 108913 - RNA, 22 nt, Homo sapiens
uagcaccacaaucaagauacag

SEQ ID NO: 108914 - RNA, 22 nt, Homo sapiens
uagcaccucuuuggccuuucgu

SEQ ID NO: 108915 - RNA, 22 nt, Homo sapiens
uagcagcaccccacucuacugg

SEQ ID NO: 108916 - RNA, 22 nt, Homo sapiens
uagcagcagugguguauuuaga

SEQ ID NO: 108917 - RNA, 19 nt, Homo sapiens
uagcagcaugauuuauaau

SEQ ID NO: 108918 - RNA, 22 nt, Homo sapiens
uagccucacaaagugcuuaaga

SEQ ID NO: 108919 - RNA, 22 nt, Homo sapiens
uagcugcuguauguacacggau

SEQ ID NO: 108920 - RNA, 19 nt, Homo sapiens
uagggcacgaggcagaguc

SEQ ID NO: 108921 - RNA, 18 nt, Homo sapiens
aaaaagugcucaggccua

SEQ ID NO: 108922 - RNA, 22 nt, Homo sapiens
aaacauugaccucauccuggca

SEQ ID NO: 108923 - RNA, 22 nt, Homo sapiens
aaagcuaagguagcauuggaga

SEQ ID NO: 108924 - RNA, 22 nt, Homo sapiens
aaagucacuggagaaggaauau

SEQ ID NO: 108925 - RNA, 22 nt, Homo sapiens
aaagugcaguacuucguauauu

SEQ ID NO: 108926 - RNA, 22 nt, Homo sapiens
aaagugcugagaguucuaacuu

SEQ ID NO: 108927 - RNA, 22 nt, Homo sapiens
aaagugcuguagacugggcgca

SEQ ID NO: 108928 - RNA, 22 nt, Homo sapiens
aaagugcuucucuuuggugggu

SEQ ID NO: 108929 - RNA, 22 nt, Homo sapiens
aaagugucuguuccuagcauga

SEQ ID NO: 108930 - RNA, 22 nt, Homo sapiens
aaaugcagauuccuaggcccca

SEQ ID NO: 108931 - RNA, 22 nt, Homo sapiens
aaaugcagcacucaagugggaa

SEQ ID NO: 108932 - RNA, 22 nt, Homo sapiens
aaaugcugcuuuggccucuucu

SEQ ID NO: 108933 - RNA, 22 nt, Homo sapiens
aaaugcuucuauguggcauguu

SEQ ID NO: 108934 - RNA, 22 nt, Homo sapiens
aaaugcuuucuuggaccauuug

SEQ ID NO: 108935 - RNA, 22 nt, Homo sapiens
aaaugggacugggguccuuuga

SEQ ID NO: 108936 - RNA, 22 nt, Homo sapiens
aaaugguguuaguagaucuuua

SEQ ID NO: 108937 - RNA, 22 nt, Homo sapiens
aaauugcaguuaggaugauggu

SEQ ID NO: 108938 - RNA, 22 nt, Homo sapiens
aacccugacacaagcagaauuu

SEQ ID NO: 108939 - RNA, 22 nt, Homo sapiens
aacucacauucuuucuugguac

SEQ ID NO: 108940 - RNA, 22 nt, Homo sapiens
aagaggccuaggaaucuguauu

SEQ ID NO: 108941 - RNA, 22 nt, Homo sapiens
aagcuggagugcaguggugcaa

SEQ ID NO: 108942 - RNA, 22 nt, Homo sapiens
aagcuggagugcaguggugcga

SEQ ID NO: 108943 - RNA, 22 nt, Homo sapiens
aaggaacuggaauauuuugaac

SEQ ID NO: 108944 - RNA, 22 nt, Homo sapiens
aaggaauacuggugguugcuau

SEQ ID NO: 108945 - RNA, 22 nt, Homo sapiens
aaggaguguggugaucuugggc

SEQ ID NO: 108946 - RNA, 22 nt, Homo sapiens
aaggcagugugcacauaacacu

SEQ ID NO: 108947 - RNA, 20 nt, Homo sapiens
aaggcuuucgaguuccaggg

SEQ ID NO: 108948 - RNA, 22 nt, Homo sapiens
aagggaaugcuuccaguuugug

SEQ ID NO: 108949 - RNA, 22 nt, Homo sapiens
aagggaauguuguggcugguuu

SEQ ID NO: 108950 - RNA, 17 nt, Homo sapiens
aaggugcuucgaccucc

SEQ ID NO: 108951 - RNA, 23 nt, Homo sapiens
aagucauggaaucaaaugaggug

SEQ ID NO: 108952 - RNA, 20 nt, Homo sapiens
aagugcuuccuuuuagaggg

SEQ ID NO: 108953 - RNA, 22 nt, Homo sapiens
aauaaagucugaagugugcuua

SEQ ID NO: 108954 - RNA, 21 nt, Homo sapiens
aauacucuagguuaagagagc

SEQ ID NO: 108955 - RNA, 22 nt, Homo sapiens
aauagcacugcuaugguuugaa

SEQ ID NO: 108956 - RNA, 22 nt, Homo sapiens
aaucacguagcaguagggagaa

SEQ ID NO: 108957 - RNA, 22 nt, Homo sapiens
aaucacuuugcuacaaggcagu

SEQ ID NO: 108958 - RNA, 22 nt, Homo sapiens
aaucccuuuguccagucucuuu

SEQ ID NO: 108959 - RNA, 22 nt, Homo sapiens
aaugacuaagaugguacauuuu

SEQ ID NO: 108960 - RNA, 22 nt, Homo sapiens
aauggcuucuuauugugguuca

SEQ ID NO: 108961 - RNA, 22 nt, Homo sapiens
aaugugcacuauuagggugaua

SEQ ID NO: 108962 - RNA, 22 nt, Homo sapiens
aauugaaugauaugggacauuu

SEQ ID NO: 108963 - RNA, 22 nt, Homo sapiens
aauuggugaccaagggaaggac

SEQ ID NO: 108964 - RNA, 21 nt, Homo sapiens
acaaagcuggagggagacugc

SEQ ID NO: 108965 - RNA, 22 nt, Homo sapiens
acacagugucuguguauuuaaa

SEQ ID NO: 108966 - RNA, 22 nt, Homo sapiens
acacaugcuccacuguggccuc

SEQ ID NO: 108967 - RNA, 22 nt, Homo sapiens
acacuggaguuaaaggugauuu

SEQ ID NO: 108968 - RNA, 22 nt, Homo sapiens
acacuuucuggagcugcacaua

SEQ ID NO: 108969 - RNA, 18 nt, Homo sapiens
acagugcugucacugcuu

SEQ ID NO: 108970 - RNA, 22 nt, Homo sapiens
acagugcuucugauaugaugcc

SEQ ID NO: 108971 - RNA, 22 nt, Homo sapiens
acaguggugcgaucucggcuca

SEQ ID NO: 108972 - RNA, 22 nt, Homo sapiens
acaguguuacuugauaguguau

SEQ ID NO: 108973 - RNA, 22 nt, Homo sapiens
acauaguagacacugaaaauau

SEQ ID NO: 108974 - RNA, 22 nt, Homo sapiens
acauauaaggagacuagggcau

SEQ ID NO: 108975 - RNA, 18 nt, Homo sapiens
acaucccaugcuggggug

SEQ ID NO: 108976 - RNA, 22 nt, Homo sapiens
acccaguagccagauguagcug

SEQ ID NO: 108977 - RNA, 22 nt, Homo sapiens
acccgugcucacugccucugcc

SEQ ID NO: 108978 - RNA, 22 nt, Homo sapiens
acccugucagcuggccugggca

SEQ ID NO: 108979 - RNA, 22 nt, Homo sapiens
acccugucauccacauggugcu

SEQ ID NO: 108980 - RNA, 18 nt, Homo sapiens
acccuucagcacugggcc

SEQ ID NO: 108981 - RNA, 22 nt, Homo sapiens
accugcacagccgaacauagac

SEQ ID NO: 108982 - RNA, 22 nt, Homo sapiens
accugggugcugaugggcuuua

SEQ ID NO: 108983 - RNA, 22 nt, Homo sapiens
accuggguguauguucaguuug

SEQ ID NO: 108984 - RNA, 22 nt, Homo sapiens
acuauacuguaacuguauucag

SEQ ID NO: 108985 - RNA, 22 nt, Homo sapiens
acuccauuuggacucugggagg

SEQ ID NO: 108986 - RNA, 20 nt, Homo sapiens
acugcacuccaaccuuugug

SEQ ID NO: 108987 - RNA, 22 nt, Homo sapiens
acugcacuccagacucugucuc

SEQ ID NO: 108988 - RNA, 22 nt, Homo sapiens
acugcacuccagcccaggugac

SEQ ID NO: 108989 - RNA, 22 nt, Homo sapiens
acugcacuccagccucaugaca

SEQ ID NO: 108990 - RNA, 22 nt, Homo sapiens
acugcacuccagccucggugac

SEQ ID NO: 108991 - RNA, 22 nt, Homo sapiens
acugcacuccagccucgugaca

SEQ ID NO: 108992 - RNA, 22 nt, Homo sapiens
acugcacuccagccugaugaaa

SEQ ID NO: 108993 - RNA, 22 nt, Homo sapiens
acugcacuccagccugccgaca

SEQ ID NO: 108994 - RNA, 22 nt, Homo sapiens
acugcacuccagccuggcggac

SEQ ID NO: 108995 - RNA, 22 nt, Homo sapiens
acugcacuccagccuuggccac

SEQ ID NO: 108996 - RNA, 22 nt, Homo sapiens
acugcacuccagccuuugcgau

SEQ ID NO: 108997 - RNA, 22 nt, Homo sapiens
acugcacuccagcuccagggug

SEQ ID NO: 108998 - RNA, 22 nt, Homo sapiens
acugcacuccaguuccgggcaa

SEQ ID NO: 108999 - RNA, 22 nt, Homo sapiens
acugcacucuagccuuggcaac

SEQ ID NO: 109000 - RNA, 22 nt, Homo sapiens
acugcacuguccuagaguccuc

SEQ ID NO: 109001 - RNA, 22 nt, Homo sapiens
acugcacuucagccuugggaaa

SEQ ID NO: 109002 - RNA, 22 nt, Homo sapiens
acugcacuucagccuugugaca

SEQ ID NO: 109003 - RNA, 22 nt, Homo sapiens
acugccuaaugacuuauguuuu

SEQ ID NO: 109004 - RNA, 18 nt, Homo sapiens
uaguacuguucucaugau

SEQ ID NO: 109005 - RNA, 22 nt, Homo sapiens
uauagcagccugaacaaaguaa

SEQ ID NO: 109006 - RNA, 22 nt, Homo sapiens
uauagcuaugggauguauuugc

SEQ ID NO: 109007 - RNA, 22 nt, Homo sapiens
uauaucuagagcggaccaggcu

SEQ ID NO: 109008 - RNA, 22 nt, Homo sapiens
uaucacacgccuugcuucauuu

SEQ ID NO: 109009 - RNA, 23 nt, Homo sapiens
uaucacacuuucucugugccaca

SEQ ID NO: 109010 - RNA, 22 nt, Homo sapiens
uaucaucauuggcaggugagaa

SEQ ID NO: 109011 - RNA, 22 nt, Homo sapiens
uaucccaguggauguaccccau

SEQ ID NO: 109012 - RNA, 23 nt, Homo sapiens
uaucucaaugcacagagaggaaa

SEQ ID NO: 109013 - RNA, 22 nt, Homo sapiens
uaucucaguguacaggaugaua

SEQ ID NO: 109014 - RNA, 19 nt, Homo sapiens
uaugagcuaugacaugcau

SEQ ID NO: 109015 - RNA, 22 nt, Homo sapiens
uaugcacacacguguuuaugug

SEQ ID NO: 109016 - RNA, 19 nt, Homo sapiens
uaugcuagagagggaagcu

SEQ ID NO: 109017 - RNA, 21 nt, Homo sapiens
ugagaacaacaggucaagcag

SEQ ID NO: 109018 - RNA, 19 nt, Homo sapiens
ugagaacaugugguauuug

SEQ ID NO: 109019 - RNA, 22 nt, Homo sapiens
ugagaacauuccucuuccuggc

SEQ ID NO: 109020 - RNA, 22 nt, Homo sapiens
ugagaacuaaaaugugguauau

SEQ ID NO: 109021 - RNA, 22 nt, Homo sapiens
ugagaacuuugucuuuuacucu

SEQ ID NO: 109022 - RNA, 22 nt, Homo sapiens
ugagaaugacugggcaugcugc

SEQ ID NO: 109023 - RNA, 22 nt, Homo sapiens
ugagaauguagggcucucccag

SEQ ID NO: 109024 - RNA, 22 nt, Homo sapiens
ugagacaaaguuguuggauguu

SEQ ID NO: 109025 - RNA, 21 nt, Homo sapiens
ugagacaauccuggucaauau

SEQ ID NO: 109026 - RNA, 22 nt, Homo sapiens
ugagacacuucccagaucccuu

SEQ ID NO: 109027 - RNA, 22 nt, Homo sapiens
ugagacauauuauacugcuuuu

SEQ ID NO: 109028 - RNA, 22 nt, Homo sapiens
ugagaccaacagauuccaguuc

SEQ ID NO: 109029 - RNA, 22 nt, Homo sapiens
ugagacggagucucgcucucua

SEQ ID NO: 109030 - RNA, 22 nt, Homo sapiens
ugagacggaguuucacucuugu

SEQ ID NO: 109031 - RNA, 22 nt, Homo sapiens
ugagacugagucucgcucuugu

SEQ ID NO: 109032 - RNA, 22 nt, Homo sapiens
ugagacugagucuugcucuugu

SEQ ID NO: 109033 - RNA, 22 nt, Homo sapiens
ugagacugaguuucgcucuugu

SEQ ID NO: 109034 - RNA, 22 nt, Homo sapiens
ugagaggugaauggcaggcuca

SEQ ID NO: 109035 - RNA, 22 nt, Homo sapiens
aaaugcauggacagcuggucuu

SEQ ID NO: 109036 - RNA, 22 nt, Homo sapiens
aaaugcugucugugagccucau

SEQ ID NO: 109037 - RNA, 22 nt, Homo sapiens
aaauugcaaugcgaggcagagg

SEQ ID NO: 109038 - RNA, 22 nt, Homo sapiens
aaauugcacaaguggugauuug

SEQ ID NO: 109039 - RNA, 22 nt, Homo sapiens
aacacuguuuccagucaugauc

SEQ ID NO: 109040 - RNA, 22 nt, Homo sapiens
aacccugagucaugagucuaga

SEQ ID NO: 109041 - RNA, 21 nt, Homo sapiens
aacuggugugagaugguaugu

SEQ ID NO: 109042 - RNA, 22 nt, Homo sapiens
aagagaugaagguccugacugu

SEQ ID NO: 109043 - RNA, 20 nt, Homo sapiens
aagagcucaccagaauaucu

SEQ ID NO: 109044 - RNA, 22 nt, Homo sapiens
aagaugauguucuuuuucuuag

SEQ ID NO: 109045 - RNA, 22 nt, Homo sapiens
aagcaucauuuggaauuugaga

SEQ ID NO: 109046 - RNA, 21 nt, Homo sapiens
aagcaugguguaucuuuccau

SEQ ID NO: 109047 - RNA, 22 nt, Homo sapiens
aagcugugucuugucagcuacc

SEQ ID NO: 109048 - RNA, 21 nt, Homo sapiens
aaggugguggugauugagaug

SEQ ID NO: 109049 - RNA, 22 nt, Homo sapiens
aagguggugucagagagcuuau

SEQ ID NO: 109050 - RNA, 22 nt, Homo sapiens
aaguacuguuuaaauugcagaa

SEQ ID NO: 109051 - RNA, 22 nt, Homo sapiens
auugccacaucucagaggcaga

SEQ ID NO: 109052 - RNA, 22 nt, Homo sapiens
auugcugagacauugcuaaucu

SEQ ID NO: 109053 - RNA, 22 nt, Homo sapiens
auuguacuccagccuuggggac

SEQ ID NO: 109054 - RNA, 22 nt, Homo sapiens
auugucauuuucugagaaguaa

SEQ ID NO: 109055 - RNA, 22 nt, Homo sapiens
auugucccucuuaaucccagca

SEQ ID NO: 109056 - RNA, 22 nt, Homo sapiens
auugugauggucaaaggaaaua

SEQ ID NO: 109057 - RNA, 22 nt, Homo sapiens
auuugacacugagagccucagu

SEQ ID NO: 109058 - RNA, 20 nt, Homo sapiens
auuugcauuauggagcaccc

SEQ ID NO: 109059 - RNA, 22 nt, Homo sapiens
auuugucacuuaacagccauua

SEQ ID NO: 109060 - RNA, 22 nt, Homo sapiens
caaagucuucucauuaugucuu

SEQ ID NO: 109061 - RNA, 22 nt, Homo sapiens
caaaugaucugcuggccucagc

SEQ ID NO: 109062 - RNA, 22 nt, Homo sapiens
caaaugcuucuauggacugucu

SEQ ID NO: 109063 - RNA, 22 nt, Homo sapiens
caacacuguuuauuggauagcc

SEQ ID NO: 109064 - RNA, 22 nt, Homo sapiens
caagagagcugaugguuuuaaa

SEQ ID NO: 109065 - RNA, 22 nt, Homo sapiens
caagaggcuguguauaaagcca

SEQ ID NO: 109066 - RNA, 22 nt, Homo sapiens
caagugaauaguugcucucaga

SEQ ID NO: 109067 - RNA, 21 nt, Homo sapiens
caagugaugcuucugcuuuaa

SEQ ID NO: 109068 - RNA, 22 nt, Homo sapiens
caagugcucuaggauccugagu

SEQ ID NO: 109069 - RNA, 22 nt, Homo sapiens
caaucugucuuuuagggggcca

SEQ ID NO: 109070 - RNA, 22 nt, Homo sapiens
uuugguaguuuguugggaccca

SEQ ID NO: 109071 - RNA, 22 nt, Homo sapiens
uuugguuauauauauacacucu

SEQ ID NO: 109072 - RNA, 22 nt, Homo sapiens
uuuguagcucacucugagcuga

SEQ ID NO: 109073 - RNA, 22 nt, Homo sapiens
uuugucccuuugcaguggcaca

SEQ ID NO: 109074 - RNA, 21 nt, Homo sapiens
uuugugguuacugugugagcu

SEQ ID NO: 109075 - RNA, 22 nt, Homo sapiens
uuuguguggccuuggccuggca

SEQ ID NO: 109076 - RNA, 23 nt, Homo sapiens
uuuugcaauaagucacuggaaua

SEQ ID NO: 109077 - RNA, 22 nt, Homo sapiens
uuuugcaccauccuaauaguau

SEQ ID NO: 109078 - RNA, 22 nt, Homo sapiens
uuuugcacuagaaccagagguu

SEQ ID NO: 109079 - RNA, 19 nt, Homo sapiens
uuuuggaaaugugaacagc

SEQ ID NO: 109080 - RNA, 22 nt, Homo sapiens
uuuuugagguauaguguggcua

SEQ ID NO: 109081 - RNA, 18 nt, Homo sapiens
gacaguguggcaauuccu

SEQ ID NO: 109082 - RNA, 22 nt, Homo sapiens
gacaguguggcgauuccucaag

SEQ ID NO: 109083 - RNA, 22 nt, Homo sapiens
gacauagcuagauaaccucaug

SEQ ID NO: 109084 - RNA, 22 nt, Homo sapiens
gagaacauuaauaguuaauuuu

SEQ ID NO: 109085 - RNA, 22 nt, Homo sapiens
gagaucuuuaagaacuacugcu

SEQ ID NO: 109086 - RNA, 22 nt, Homo sapiens
gagaugaaguuaaggaucuuua

SEQ ID NO: 109087 - RNA, 22 nt, Homo sapiens
gagcacauguggagagucuggg

SEQ ID NO: 109088 - RNA, 22 nt, Homo sapiens
gagcuagguuuugaauccagac

SEQ ID NO: 109089 - RNA, 22 nt, Homo sapiens
gagguagagaguuuugauucug

SEQ ID NO: 109090 - RNA, 22 nt, Homo sapiens
gagguauagaacaccuuucaag

SEQ ID NO: 109091 - RNA, 22 nt, Homo sapiens
gaggucaugucgggccccagga

SEQ ID NO: 109092 - RNA, 22 nt, Homo sapiens
gagugcauaugggccuguguca

SEQ ID NO: 109093 - RNA, 22 nt, Homo sapiens
gauaaaguauuggguacuaugc

SEQ ID NO: 109094 - RNA, 21 nt, Homo sapiens
gauaaguuggcagccagcacc

SEQ ID NO: 109095 - RNA, 22 nt, Homo sapiens
gauaucuuuuguauggugagcu

SEQ ID NO: 109096 - RNA, 17 nt, Homo sapiens
gaucacagucgucuccu

SEQ ID NO: 109097 - RNA, 22 nt, Homo sapiens
gcaaaguguuuuccaacuuggu

SEQ ID NO: 109098 - RNA, 22 nt, Homo sapiens
gcaaaguguuuuuaggaagucu

SEQ ID NO: 109099 - RNA, 22 nt, Homo sapiens
gcacaggguuacauucuaaggu

SEQ ID NO: 109100 - RNA, 22 nt, Homo sapiens
gcacaguguuacuugauauauu

SEQ ID NO: 109101 - RNA, 22 nt, Homo sapiens
gcacugggccacauuuauuuuc

SEQ ID NO: 109102 - RNA, 22 nt, Homo sapiens
gcagagaaacaggucuaaggag

SEQ ID NO: 109103 - RNA, 22 nt, Homo sapiens
gcaggcaugacauuucacucuu

SEQ ID NO: 109104 - RNA, 22 nt, Homo sapiens
gcagguguuaugcaaacaacug

SEQ ID NO: 109105 - RNA, 22 nt, Homo sapiens
gcaguagugugaucuuggcuca

SEQ ID NO: 109106 - RNA, 22 nt, Homo sapiens
gcaugcauuuuccuaacuagaa

SEQ ID NO: 109107 - RNA, 22 nt, Homo sapiens
gcauggccuuuaaaugucacag

SEQ ID NO: 109108 - RNA, 22 nt, Homo sapiens
gccccgggugaugcagccguca

SEQ ID NO: 109109 - RNA, 22 nt, Homo sapiens
gcuaggagauccacugcucucu

SEQ ID NO: 109110 - RNA, 22 nt, Homo sapiens
gcucaguuuccucagcugcaaa

SEQ ID NO: 109111 - RNA, 22 nt, Homo sapiens
gcuccauuuuccauuucucuaa

SEQ ID NO: 109112 - RNA, 22 nt, Homo sapiens
gcuggcuuucuccugaucucag

SEQ ID NO: 109113 - RNA, 22 nt, Homo sapiens
gcuuguguauuaaaccuugcag

SEQ ID NO: 109114 - RNA, 22 nt, Homo sapiens
gcuuuguugauggugagucugu

SEQ ID NO: 109115 - RNA, 21 nt, Homo sapiens
gcuuuuucggaagucuuuggc

SEQ ID NO: 109116 - RNA, 22 nt, Homo sapiens
ggaaaguaacccauucucuuac

SEQ ID NO: 109117 - RNA, 22 nt, Homo sapiens
ggaaauguuuagcauccacuuu

SEQ ID NO: 109118 - RNA, 17 nt, Homo sapiens
ggaagccuuugguuuaa

SEQ ID NO: 109119 - RNA, 22 nt, Homo sapiens
ggacagugaaugccacuccucc

SEQ ID NO: 109120 - RNA, 22 nt, Homo sapiens
ggagaugaaaugagcuacuuaa

SEQ ID NO: 109121 - RNA, 22 nt, Homo sapiens
ggagaugauuaugaaucacuua

SEQ ID NO: 109122 - RNA, 22 nt, Homo sapiens
ggagauuauuaguguuucaugc

SEQ ID NO: 109123 - RNA, 22 nt, Homo sapiens
ggagcugugauuugaguccaga

SEQ ID NO: 109124 - RNA, 20 nt, Homo sapiens
ggagguguugauuuuucuuu

SEQ ID NO: 109125 - RNA, 23 nt, Homo sapiens
ggaguguaaauuauuucaaccau

SEQ ID NO: 109126 - RNA, 22 nt, Homo sapiens
ggcaaaaucgcaauuacuuuug

SEQ ID NO: 109127 - RNA, 22 nt, Homo sapiens
ggcaaaauggccagugggucac

SEQ ID NO: 109128 - RNA, 22 nt, Homo sapiens
ggcaacaaagacauuucaacau

SEQ ID NO: 109129 - RNA, 22 nt, Homo sapiens
ggcaaggugaugaaugucuaca

SEQ ID NO: 109130 - RNA, 22 nt, Homo sapiens
ggcaaugucagcuaaugaugga

SEQ ID NO: 109131 - RNA, 22 nt, Homo sapiens
ggcacugugaugugagggggua

SEQ ID NO: 109132 - RNA, 22 nt, Homo sapiens
ggcacuguggcucaagccugua

SEQ ID NO: 109133 - RNA, 19 nt, Homo sapiens
ggcacugugugagugagga

SEQ ID NO: 109134 - RNA, 22 nt, Homo sapiens
ggcagcuguguccuucguaagg

SEQ ID NO: 109135 - RNA, 22 nt, Homo sapiens
ggcaugguggugugugccuaua

SEQ ID NO: 109136 - RNA, 22 nt, Homo sapiens
gggaugaaguugauguagaaag

SEQ ID NO: 109137 - RNA, 22 nt, Homo sapiens
gggauguuuuauacugagccug

SEQ ID NO: 109138 - RNA, 22 nt, Homo sapiens
ggggaauguuaaagaauuugca

SEQ ID NO: 109139 - RNA, 22 nt, Homo sapiens
gguaggcacuggugggaagaga

SEQ ID NO: 109140 - RNA, 22 nt, Homo sapiens
gguauuauuugccuuuuacuga

SEQ ID NO: 109141 - RNA, 22 nt, Homo sapiens
ggucauggagcuuuacuuuaug

SEQ ID NO: 109142 - RNA, 22 nt, Homo sapiens
ggugacugguuuaucuggcagu

SEQ ID NO: 109143 - RNA, 22 nt, Homo sapiens
guaauaacuguggaaaaagguu

SEQ ID NO: 109144 - RNA, 22 nt, Homo sapiens
guaaucucagcuacucgggaga

SEQ ID NO: 109145 - RNA, 22 nt, Homo sapiens
guaaucucagcuucuugggagg

SEQ ID NO: 109146 - RNA, 22 nt, Homo sapiens
guacaguaguaaaagugaauga

SEQ ID NO: 109147 - RNA, 22 nt, Homo sapiens
guacugagagacaguuacuguu

SEQ ID NO: 109148 - RNA, 22 nt, Homo sapiens
guaugacacaggaagcuuaacc

SEQ ID NO: 109149 - RNA, 22 nt, Homo sapiens
guauuuguugcagcagcacuau

SEQ ID NO: 109150 - RNA, 22 nt, Homo sapiens
gucacaguguuuguucauccca

SEQ ID NO: 109151 - RNA, 22 nt, Homo sapiens
gucacauugaugcccauggugg

SEQ ID NO: 109152 - RNA, 22 nt, Homo sapiens
gucacuguuuccuauuauauuu

SEQ ID NO: 109153 - RNA, 22 nt, Homo sapiens
gucagaaucucagaugacaacg

SEQ ID NO: 109154 - RNA, 22 nt, Homo sapiens
gucagcaucaccaugucuauga

SEQ ID NO: 109155 - RNA, 22 nt, Homo sapiens
gucagugauugauuuaaagacg

SEQ ID NO: 109156 - RNA, 17 nt, Homo sapiens
acuuuuugaggaggcau

SEQ ID NO: 109157 - RNA, 23 nt, Homo sapiens
agaaaugucuauucagggucccu

SEQ ID NO: 109158 - RNA, 22 nt, Homo sapiens
agaaauguuuauucaaacccgu

SEQ ID NO: 109159 - RNA, 22 nt, Homo sapiens
agaaccaaucccacauggauac

SEQ ID NO: 109160 - RNA, 22 nt, Homo sapiens
agacaguauuggcaaagugugu

SEQ ID NO: 109161 - RNA, 22 nt, Homo sapiens
agacuuagagagucuauucuau

SEQ ID NO: 109162 - RNA, 22 nt, Homo sapiens
agagacauugcuccaacucacc

SEQ ID NO: 109163 - RNA, 22 nt, Homo sapiens
agagcacuguggguccaaauau

SEQ ID NO: 109164 - RNA, 20 nt, Homo sapiens
agagguuuugauagguucug

SEQ ID NO: 109165 - RNA, 22 nt, Homo sapiens
agaguaguuuauuaugcuaagg

SEQ ID NO: 109166 - RNA, 19 nt, Homo sapiens
agaguauugaauuugcccu

SEQ ID NO: 109167 - RNA, 22 nt, Homo sapiens
agagugcuauagauuagauuuc

SEQ ID NO: 109168 - RNA, 22 nt, Homo sapiens
agauacaucuaugugucugugu

SEQ ID NO: 109169 - RNA, 22 nt, Homo sapiens
agaugauguuuacugagcauca

SEQ ID NO: 109170 - RNA, 22 nt, Homo sapiens
agauggugugcuaggaaaugua

SEQ ID NO: 109171 - RNA, 22 nt, Homo sapiens
agcaaaucuaugaauguauauu

SEQ ID NO: 109172 - RNA, 22 nt, Homo sapiens
agcacagugguuaaguuucuua

SEQ ID NO: 109173 - RNA, 22 nt, Homo sapiens
agcagugugaaaauggacuaau

SEQ ID NO: 109174 - RNA, 20 nt, Homo sapiens
agcaucauugcaauuuguca

SEQ ID NO: 109175 - RNA, 22 nt, Homo sapiens
agccaagacucuguuccccuug

SEQ ID NO: 109176 - RNA, 22 nt, Homo sapiens
agccuucauucugacaguagga

SEQ ID NO: 109177 - RNA, 22 nt, Homo sapiens
agcuccaucuucagggguucag

SEQ ID NO: 109178 - RNA, 20 nt, Homo sapiens
agcuccauuccugaaggcug

SEQ ID NO: 109179 - RNA, 22 nt, Homo sapiens
agcugcacgugguaaauguaaa

SEQ ID NO: 109180 - RNA, 22 nt, Homo sapiens
agcuggaauuuaagguagauag

SEQ ID NO: 109181 - RNA, 22 nt, Homo sapiens
agcuggauguauguuaagugaa

SEQ ID NO: 109182 - RNA, 19 nt, Homo sapiens
agcuguguugccugugaga

SEQ ID NO: 109183 - RNA, 22 nt, Homo sapiens
agcuucauuguuaugaauguca

SEQ ID NO: 109184 - RNA, 19 nt, Homo sapiens
aggacuaaagacuagaagu

SEQ ID NO: 109185 - RNA, 21 nt, Homo sapiens
aggagcauucaugacgagguu

SEQ ID NO: 109186 - RNA, 22 nt, Homo sapiens
aggcuagacuuugagaauuuuu

SEQ ID NO: 109187 - RNA, 22 nt, Homo sapiens
agggaauguaaguuuuaugaga

SEQ ID NO: 109188 - RNA, 22 nt, Homo sapiens
agggagcaaaguggucuuucuc

SEQ ID NO: 109189 - RNA, 22 nt, Homo sapiens
aggugguuuuaggcagagacau

SEQ ID NO: 109190 - RNA, 22 nt, Homo sapiens
aggugguuuugaugagcaggua

SEQ ID NO: 109191 - RNA, 22 nt, Homo sapiens
agucacagguucuugggauuag

SEQ ID NO: 109192 - RNA, 22 nt, Homo sapiens
aguccagguuuuguaauggcaa

SEQ ID NO: 109193 - RNA, 22 nt, Homo sapiens
agugaaaugucaccuuuuagga

SEQ ID NO: 109194 - RNA, 22 nt, Homo sapiens
agugguguugccuguugaccua

SEQ ID NO: 109195 - RNA, 22 nt, Homo sapiens
agugguuuuaaguagagcauac

SEQ ID NO: 109196 - RNA, 19 nt, Homo sapiens
auaaacuagaacugucccc

SEQ ID NO: 109197 - RNA, 22 nt, Homo sapiens
auaaaugcuuccagucauuaaa

SEQ ID NO: 109198 - RNA, 22 nt, Homo sapiens
auaacaggaaauacagggcuuu

SEQ ID NO: 109199 - RNA, 22 nt, Homo sapiens
auaagucaauggaacagauuaa

SEQ ID NO: 109200 - RNA, 22 nt, Homo sapiens
auaauaccugccacauuugaau

SEQ ID NO: 109201 - RNA, 22 nt, Homo sapiens
auacuagucaagaauguaugag

SEQ ID NO: 109202 - RNA, 22 nt, Homo sapiens
auagcacugguuuuucuugguu

SEQ ID NO: 109203 - RNA, 22 nt, Homo sapiens
auagcaucauuucuugaaaaga

SEQ ID NO: 109204 - RNA, 22 nt, Homo sapiens
auagccaguagagagcuguuag

SEQ ID NO: 109205 - RNA, 22 nt, Homo sapiens
auagcugcucaggcuuuccuca

SEQ ID NO: 109206 - RNA, 19 nt, Homo sapiens
auaguguaggaaaacagcu

SEQ ID NO: 109207 - RNA, 22 nt, Homo sapiens
auaugguuuuuggaagcauauc

SEQ ID NO: 109208 - RNA, 18 nt, Homo sapiens
auauugccuucagacuag

SEQ ID NO: 109209 - RNA, 22 nt, Homo sapiens
auauugguuaaauauuauguga

SEQ ID NO: 109210 - RNA, 22 nt, Homo sapiens
aucaaaugcuggcagagugccu

SEQ ID NO: 109211 - RNA, 22 nt, Homo sapiens
aucacauggccagguaguaauc

SEQ ID NO: 109212 - RNA, 22 nt, Homo sapiens
aucacuguccacucaucuuucu

SEQ ID NO: 109213 - RNA, 22 nt, Homo sapiens
aucacugugauuucuacugugc

SEQ ID NO: 109214 - RNA, 22 nt, Homo sapiens
aucagcauucccaaaugaugug

SEQ ID NO: 109215 - RNA, 22 nt, Homo sapiens
aucaggcacacauuggaguuug

SEQ ID NO: 109216 - RNA, 22 nt, Homo sapiens
aucauacuguuuugauuacugu

SEQ ID NO: 109217 - RNA, 22 nt, Homo sapiens
aucauauccuagauauaacuuc

SEQ ID NO: 109218 - RNA, 22 nt, Homo sapiens
auccacagugucaauguuguga

SEQ ID NO: 109219 - RNA, 22 nt, Homo sapiens
auccaucagacggcaggcguug

SEQ ID NO: 109220 - RNA, 22 nt, Homo sapiens
aucccaguucagccucugacac

SEQ ID NO: 109221 - RNA, 22 nt, Homo sapiens
aucccuguaacuagcagccccu

SEQ ID NO: 109222 - RNA, 22 nt, Homo sapiens
aucccuuucugauacuuucccu

SEQ ID NO: 109223 - RNA, 22 nt, Homo sapiens
auccugagacuuuucugaaguu

SEQ ID NO: 109224 - RNA, 22 nt, Homo sapiens
aucucugagauguucugauuuu

SEQ ID NO: 109225 - RNA, 22 nt, Homo sapiens
aucugcacaucuguguuuuugu

SEQ ID NO: 109226 - RNA, 22 nt, Homo sapiens
aucugguguauuggugcugggu

SEQ ID NO: 109227 - RNA, 22 nt, Homo sapiens
aucuuuaguggcuguuuucaga

SEQ ID NO: 109228 - RNA, 22 nt, Homo sapiens
augaaagguauguuuucuguga

SEQ ID NO: 109229 - RNA, 22 nt, Homo sapiens
augaagacaucgucugggauua

SEQ ID NO: 109230 - RNA, 22 nt, Homo sapiens
augaaguuagcucauuucuuuu

SEQ ID NO: 109231 - RNA, 22 nt, Homo sapiens
augaauacugcugcaaugaaca

SEQ ID NO: 109232 - RNA, 22 nt, Homo sapiens
augacauuccacagccguagag

SEQ ID NO: 109233 - RNA, 21 nt, Homo sapiens
augacccuggguguccuuucc

SEQ ID NO: 109234 - RNA, 22 nt, Homo sapiens
augacguugugggcucucaagc

SEQ ID NO: 109235 - RNA, 22 nt, Homo sapiens
augacugucagggcagucauug

SEQ ID NO: 109236 - RNA, 22 nt, Homo sapiens
augagaauguaaguuaaugaaa

SEQ ID NO: 109237 - RNA, 22 nt, Homo sapiens
augagacauuaaaguguguuug

SEQ ID NO: 109238 - RNA, 22 nt, Homo sapiens
augagagcugacuuuaaggcaa

SEQ ID NO: 109239 - RNA, 22 nt, Homo sapiens
augagauauuuuauaagaucau

SEQ ID NO: 109240 - RNA, 22 nt, Homo sapiens
augagcaaagagaugagacccu

SEQ ID NO: 109241 - RNA, 22 nt, Homo sapiens
augagcugauuuccuuaccaua

SEQ ID NO: 109242 - RNA, 22 nt, Homo sapiens
augaggaaggagccuuugucug

SEQ ID NO: 109243 - RNA, 22 nt, Homo sapiens
augauagguuuagguuuagaca

SEQ ID NO: 109244 - RNA, 19 nt, Homo sapiens
augcaaugucacaggcugc

SEQ ID NO: 109245 - RNA, 22 nt, Homo sapiens
augcacuguauaggaucuugcg

SEQ ID NO: 109246 - RNA, 22 nt, Homo sapiens
augcacuguuguuauuggauaa

SEQ ID NO: 109247 - RNA, 22 nt, Homo sapiens
augcacuuggcaggaugauucc

SEQ ID NO: 109248 - RNA, 19 nt, Homo sapiens
augccacagugaggucaga

SEQ ID NO: 109249 - RNA, 19 nt, Homo sapiens
augccuggagaugguuaua

SEQ ID NO: 109250 - RNA, 22 nt, Homo sapiens
auggaacauuauagauguaaaa

SEQ ID NO: 109251 - RNA, 22 nt, Homo sapiens
aaaaggcuagcuaguaacagaa

SEQ ID NO: 109252 - RNA, 22 nt, Homo sapiens
aaaagucuguagugaaagguga

SEQ ID NO: 109253 - RNA, 22 nt, Homo sapiens
aaaaguucuuugagccuugaca

SEQ ID NO: 109254 - RNA, 22 nt, Homo sapiens
aaaccaccauuacuuuugcacc

SEQ ID NO: 109255 - RNA, 22 nt, Homo sapiens
aaacugccuuccuuguaggugc

SEQ ID NO: 109256 - RNA, 22 nt, Homo sapiens
aaagagcugagaccugguggag

SEQ ID NO: 109257 - RNA, 22 nt, Homo sapiens
aaagucuagaggaucaugugug

SEQ ID NO: 109258 - RNA, 22 nt, Homo sapiens
aaagugcugagauuguaggcau

SEQ ID NO: 109259 - RNA, 22 nt, Homo sapiens
aaagugcugagucuaggcgggg

SEQ ID NO: 109260 - RNA, 22 nt, Homo sapiens
aaagugcugggauuaggccagg

SEQ ID NO: 109261 - RNA, 22 nt, Homo sapiens
aaagugcugggauuggccgggc

SEQ ID NO: 109262 - RNA, 22 nt, Homo sapiens
aaagugcugggauuggcugggc

SEQ ID NO: 109263 - RNA, 22 nt, Homo sapiens
aaagugcugggauuuuaggcau

SEQ ID NO: 109264 - RNA, 22 nt, Homo sapiens
aaagugcuuccuuuuugagggu

SEQ ID NO: 109265 - RNA, 22 nt, Homo sapiens
aaaugcaugaauaagcucgugu

SEQ ID NO: 109266 - RNA, 22 nt, Homo sapiens
aaaugcaugaggugggaagaaa

SEQ ID NO: 109267 - RNA, 22 nt, Homo sapiens
aaaugcauugagggaaaaggca

SEQ ID NO: 109268 - RNA, 22 nt, Homo sapiens
aaaugccucccauucuacugac

SEQ ID NO: 109269 - RNA, 22 nt, Homo sapiens
aaaugucauggaguguuucccc

SEQ ID NO: 109270 - RNA, 22 nt, Homo sapiens
aacagucuccaguuguauccau

SEQ ID NO: 109271 - RNA, 22 nt, Homo sapiens
aagcacaauuucaccuucuugu

SEQ ID NO: 109272 - RNA, 22 nt, Homo sapiens
aagccagugugacaggaaacuu

SEQ ID NO: 109273 - RNA, 22 nt, Homo sapiens
aagcuccauuucugccaugaga

SEQ ID NO: 109274 - RNA, 22 nt, Homo sapiens
aagcuggauuucgcauccuguu

SEQ ID NO: 109275 - RNA, 22 nt, Homo sapiens
aagcuguguguaagcucucaca

SEQ ID NO: 109276 - RNA, 22 nt, Homo sapiens
ugugccaaucauagggcuuggu

SEQ ID NO: 109277 - RNA, 22 nt, Homo sapiens
ugugccacuccaaccuggguga

SEQ ID NO: 109278 - RNA, 22 nt, Homo sapiens
ugugccacugcacucuggccug

SEQ ID NO: 109279 - RNA, 22 nt, Homo sapiens
uguggucaucacuugaagguaa

SEQ ID NO: 109280 - RNA, 22 nt, Homo sapiens
uguguaaauacaagugcuugaa

SEQ ID NO: 109281 - RNA, 22 nt, Homo sapiens
ugugucuccugaaaauucacau

SEQ ID NO: 109282 - RNA, 22 nt, Homo sapiens
ugugucuugagagucucgagaa

SEQ ID NO: 109283 - RNA, 22 nt, Homo sapiens
ugugucuuguuuuuucccaggc

SEQ ID NO: 109284 - RNA, 22 nt, Homo sapiens
uguucuugaguugggaguacaa

SEQ ID NO: 109285 - RNA, 22 nt, Homo sapiens
uguugcaccugccuugcuuuag

SEQ ID NO: 109286 - RNA, 22 nt, Homo sapiens
uuaaugaacuuuauuuuguaga

SEQ ID NO: 109287 - RNA, 22 nt, Homo sapiens
uuaauguaauugauugauugac

SEQ ID NO: 109288 - RNA, 22 nt, Homo sapiens
uuaauguaucuaucacaucaca

SEQ ID NO: 109289 - RNA, 21 nt, Homo sapiens
uuacaauggcuccuugaaggu

SEQ ID NO: 109290 - RNA, 22 nt, Homo sapiens
uuacacaguugguaggggcaga

SEQ ID NO: 109291 - RNA, 22 nt, Homo sapiens
uuacagugguugcuauugugaa

SEQ ID NO: 109292 - RNA, 22 nt, Homo sapiens
uuagaacaguguuugccucgcu

SEQ ID NO: 109293 - RNA, 22 nt, Homo sapiens
uuagcacaguucauucauguua

SEQ ID NO: 109294 - RNA, 22 nt, Homo sapiens
uuagggaggcucaggacaagag

SEQ ID NO: 109295 - RNA, 22 nt, Homo sapiens
uuaucauagugcaguuuucuga

SEQ ID NO: 109296 - RNA, 21 nt, Homo sapiens
ugagaugauccugcaugcaug

SEQ ID NO: 109297 - RNA, 22 nt, Homo sapiens
ugagaugauuuaauggagccca

SEQ ID NO: 109298 - RNA, 22 nt, Homo sapiens
ugagcugagauuaagcugcugc

SEQ ID NO: 109299 - RNA, 22 nt, Homo sapiens
ugaggaacuagcuacccuaaua

SEQ ID NO: 109300 - RNA, 22 nt, Homo sapiens
ugaggaucucuaggaauuuauc

SEQ ID NO: 109301 - RNA, 22 nt, Homo sapiens
ugagguagaaugauucuaauau

SEQ ID NO: 109302 - RNA, 22 nt, Homo sapiens
ugaggugaggguaucaaaugcu

SEQ ID NO: 109303 - RNA, 22 nt, Homo sapiens
ugagguuauuuguucaagaagu

SEQ ID NO: 109304 - RNA, 22 nt, Homo sapiens
ugaguagaacuagucuagagcu

SEQ ID NO: 109305 - RNA, 22 nt, Homo sapiens
ugaguagagaauucagcuaagg

SEQ ID NO: 109306 - RNA, 22 nt, Homo sapiens
ugagucuguuccaaagaaauaa

SEQ ID NO: 109307 - RNA, 22 nt, Homo sapiens
ugaguuccuugugugaccuugc

SEQ ID NO: 109308 - RNA, 22 nt, Homo sapiens
ugaguuccuuucccaguccagu

SEQ ID NO: 109309 - RNA, 17 nt, Homo sapiens
ugauaagugugagguga

SEQ ID NO: 109310 - RNA, 22 nt, Homo sapiens
ugauauauugaaugaugaaaca

SEQ ID NO: 109311 - RNA, 22 nt, Homo sapiens
ugauaugaaguuagcuggcugu

SEQ ID NO: 109312 - RNA, 22 nt, Homo sapiens
ugauauuuuugauccuuaaguu

SEQ ID NO: 109313 - RNA, 22 nt, Homo sapiens
ugaugucuugcaggcacgagau

SEQ ID NO: 109314 - RNA, 17 nt, Homo sapiens
ugcagcacacugauggg

SEQ ID NO: 109315 - RNA, 20 nt, Homo sapiens
ugcagcacgggcccuuucca

SEQ ID NO: 109316 - RNA, 22 nt, Homo sapiens
ugcauauguauacaugugccau

SEQ ID NO: 109317 - RNA, 22 nt, Homo sapiens
ugcauggauguuugaacacacu

SEQ ID NO: 109318 - RNA, 19 nt, Homo sapiens
ugccaagaaagucagcuua

SEQ ID NO: 109319 - RNA, 22 nt, Homo sapiens
ugccauugcacuccagccuggg

SEQ ID NO: 109320 - RNA, 21 nt, Homo sapiens
ugccuuuguaguaggugucuu

SEQ ID NO: 109321 - RNA, 22 nt, Homo sapiens
ugcgccauugcacuccagccug

SEQ ID NO: 109322 - RNA, 21 nt, Homo sapiens
ugcuccauuuucuagccugaa

SEQ ID NO: 109323 - RNA, 22 nt, Homo sapiens
uggaacaccaggcuggcguggc

SEQ ID NO: 109324 - RNA, 20 nt, Homo sapiens
uggaaggcaucugcauuauu

SEQ ID NO: 109325 - RNA, 21 nt, Homo sapiens
uggaaucuauagaggcaguag

SEQ ID NO: 109326 - RNA, 21 nt, Homo sapiens
uggaaucuauuauuccaguuu

SEQ ID NO: 109327 - RNA, 22 nt, Homo sapiens
uggaaucuuaggugaaggcuuu

SEQ ID NO: 109328 - RNA, 20 nt, Homo sapiens
uggaccagagagguggggac

SEQ ID NO: 109329 - RNA, 22 nt, Homo sapiens
uggacuguaaauuggggacucu

SEQ ID NO: 109330 - RNA, 22 nt, Homo sapiens
uggagaacauucauuugcaaga

SEQ ID NO: 109331 - RNA, 22 nt, Homo sapiens
uggagauguuuaaaauccacug

SEQ ID NO: 109332 - RNA, 22 nt, Homo sapiens
uggagcccuaguuccucauaac

SEQ ID NO: 109333 - RNA, 22 nt, Homo sapiens
uggagucuugaugauuuucaaa

SEQ ID NO: 109334 - RNA, 22 nt, Homo sapiens
uggcaaaaaaacgcaauuacgu

SEQ ID NO: 109335 - RNA, 22 nt, Homo sapiens
uggcaaaauauuuugguuucug

SEQ ID NO: 109336 - RNA, 22 nt, Homo sapiens
uggcaagauuguuccgguuugg

SEQ ID NO: 109337 - RNA, 22 nt, Homo sapiens
uggcaccauccaggugucucua

SEQ ID NO: 109338 - RNA, 22 nt, Homo sapiens
uggccuguaacccucucauagg

SEQ ID NO: 109339 - RNA, 22 nt, Homo sapiens
aaacugaucugaaggccaggcu

SEQ ID NO: 109340 - RNA, 22 nt, Homo sapiens
aaagaguucagguagauuucaa

SEQ ID NO: 109341 - RNA, 22 nt, Homo sapiens
aaaggcuucggaucagaaggua

SEQ ID NO: 109342 - RNA, 22 nt, Homo sapiens
aaagggcacugugcuuuggcaa

SEQ ID NO: 109343 - RNA, 22 nt, Homo sapiens
aaagugauguccaggcuuucag

SEQ ID NO: 109344 - RNA, 22 nt, Homo sapiens
aaagugccugacucauaguuag

SEQ ID NO: 109345 - RNA, 22 nt, Homo sapiens
aaagugcuaggauuaccugggg

SEQ ID NO: 109346 - RNA, 22 nt, Homo sapiens
aaagugcugggaucacacugaa

SEQ ID NO: 109347 - RNA, 22 nt, Homo sapiens
aaaguggugggauuccaggcau

SEQ ID NO: 109348 - RNA, 22 nt, Homo sapiens
aaaugcacaaagauuuugcacu

SEQ ID NO: 109349 - RNA, 22 nt, Homo sapiens
aaaugcauaucaagauugcccu

SEQ ID NO: 109350 - RNA, 22 nt, Homo sapiens
caauggcacgaucucgucucac

SEQ ID NO: 109351 - RNA, 22 nt, Homo sapiens
caaugguccccauuggcaggaa

SEQ ID NO: 109352 - RNA, 22 nt, Homo sapiens
cacacugucuucauuacuguag

SEQ ID NO: 109353 - RNA, 22 nt, Homo sapiens
cacacuguuuuccauggggguu

SEQ ID NO: 109354 - RNA, 22 nt, Homo sapiens
cacagugaaugucaucauugcc

SEQ ID NO: 109355 - RNA, 22 nt, Homo sapiens
cacaguguucauagccaucagg

SEQ ID NO: 109356 - RNA, 22 nt, Homo sapiens
cacauguuuuagcauggcuguu

SEQ ID NO: 109357 - RNA, 19 nt, Homo sapiens
caccagugcaugcuacuau

SEQ ID NO: 109358 - RNA, 22 nt, Homo sapiens
cacugcauucuccaccucccag

SEQ ID NO: 109359 - RNA, 22 nt, Homo sapiens
cacugcgaccuccaccucccgg

SEQ ID NO: 109360 - RNA, 22 nt, Homo sapiens
cagacagugucccgagucccug

SEQ ID NO: 109361 - RNA, 20 nt, Homo sapiens
cagcaaccugcucucuuccu

SEQ ID NO: 109362 - RNA, 22 nt, Homo sapiens
cagcagguuuuuaucaguuaag

SEQ ID NO: 109363 - RNA, 22 nt, Homo sapiens
cagggcaugugggucuauuggc

SEQ ID NO: 109364 - RNA, 22 nt, Homo sapiens
cagugcauaggaucuaaaauuu

SEQ ID NO: 109365 - RNA, 22 nt, Homo sapiens
cagugcuuuaucaaguccucca

SEQ ID NO: 109366 - RNA, 21 nt, Homo sapiens
cauaaugcuacuuauuuuaug

SEQ ID NO: 109367 - RNA, 22 nt, Homo sapiens
cauauucacuuuacagagcugu

SEQ ID NO: 109368 - RNA, 22 nt, Homo sapiens
caucagcaauguaugaggguuc

SEQ ID NO: 109369 - RNA, 21 nt, Homo sapiens
cauccccugccauuguggucu

SEQ ID NO: 109370 - RNA, 22 nt, Homo sapiens
caucccugaaccccagaaaucu

SEQ ID NO: 109371 - RNA, 22 nt, Homo sapiens
caugcacugaguccaccucugg

SEQ ID NO: 109372 - RNA, 22 nt, Homo sapiens
cauggcccugggcugggcgaac

SEQ ID NO: 109373 - RNA, 22 nt, Homo sapiens
caugguguuaggcacugggaau

SEQ ID NO: 109374 - RNA, 22 nt, Homo sapiens
caugucacuuccucucugaugg

SEQ ID NO: 109375 - RNA, 22 nt, Homo sapiens
caugucuuuuaaacauucaacu

SEQ ID NO: 109376 - RNA, 22 nt, Homo sapiens
cauugcccuccagccugggcaa

SEQ ID NO: 109377 - RNA, 22 nt, Homo sapiens
ccacccuggagaauuugagguc

SEQ ID NO: 109378 - RNA, 22 nt, Homo sapiens
ccagauguuuucauucagcaag

SEQ ID NO: 109379 - RNA, 21 nt, Homo sapiens
ccauggcaaugguaaacugac

SEQ ID NO: 109380 - RNA, 22 nt, Homo sapiens
cccugaagauacagaguuuggg

SEQ ID NO: 109381 - RNA, 22 nt, Homo sapiens
cccugagaugcuguuaaucugu

SEQ ID NO: 109382 - RNA, 21 nt, Homo sapiens
ccugaugaccucugagaguua

SEQ ID NO: 109383 - RNA, 22 nt, Homo sapiens
ccuuggcaauggcuggggcuga

SEQ ID NO: 109384 - RNA, 22 nt, Homo sapiens
ccuuuuugaguugccagaguuc

SEQ ID NO: 109385 - RNA, 22 nt, Homo sapiens
cgaggaguaucuuugugguguu

SEQ ID NO: 109386 - RNA, 22 nt, Homo sapiens
cgugaggaaaacagaggguguu

SEQ ID NO: 109387 - RNA, 22 nt, Homo sapiens
cuaauccugugguagcacucaa

SEQ ID NO: 109388 - RNA, 23 nt, Homo sapiens
cuacuagucaagucuuuuccagu

SEQ ID NO: 109389 - RNA, 22 nt, Homo sapiens
cuagacuagacccaaauugaag

SEQ ID NO: 109390 - RNA, 22 nt, Homo sapiens
cuagcagaacaauacaauucgg

SEQ ID NO: 109391 - RNA, 22 nt, Homo sapiens
cuagcagacaugggcugaacca

SEQ ID NO: 109392 - RNA, 22 nt, Homo sapiens
cuauucacaggcaauauguaca

SEQ ID NO: 109393 - RNA, 22 nt, Homo sapiens
cucaaaguguggucuguggguu

SEQ ID NO: 109394 - RNA, 22 nt, Homo sapiens
cucaaaugguccagcuaguggu

SEQ ID NO: 109395 - RNA, 22 nt, Homo sapiens
cucaaguacaugggauuacagg

SEQ ID NO: 109396 - RNA, 22 nt, Homo sapiens
cucacaugcucaccugguguuc

SEQ ID NO: 109397 - RNA, 22 nt, Homo sapiens
cucaccuugugauccacccacc

SEQ ID NO: 109398 - RNA, 22 nt, Homo sapiens
cucaguacuugcacagaagaac

SEQ ID NO: 109399 - RNA, 22 nt, Homo sapiens
cucaguagaaaauacauggacu

SEQ ID NO: 109400 - RNA, 22 nt, Homo sapiens
cucaguggauuagauaaugcac

SEQ ID NO: 109401 - RNA, 22 nt, Homo sapiens
cucaguguuucagcugcucaga

SEQ ID NO: 109402 - RNA, 22 nt, Homo sapiens
cucauugcaaucuccaccuccc

SEQ ID NO: 109403 - RNA, 22 nt, Homo sapiens
cucccacccucauuuuuaggca

SEQ ID NO: 109404 - RNA, 22 nt, Homo sapiens
cugaaggcagguagaauagaga

SEQ ID NO: 109405 - RNA, 22 nt, Homo sapiens
cugacagucucauugauuugcu

SEQ ID NO: 109406 - RNA, 22 nt, Homo sapiens
cugagauaggacucugcuggcu

SEQ ID NO: 109407 - RNA, 22 nt, Homo sapiens
cugaggacaucagggaagcauc

SEQ ID NO: 109408 - RNA, 22 nt, Homo sapiens
cugaggugauauauacauauuu

SEQ ID NO: 109409 - RNA, 22 nt, Homo sapiens
cugaggugggagaaucacauaa

SEQ ID NO: 109410 - RNA, 22 nt, Homo sapiens
cugcacugagacccucuuugcu

SEQ ID NO: 109411 - RNA, 22 nt, Homo sapiens
cugcauaaucaucucucugcau

SEQ ID NO: 109412 - RNA, 22 nt, Homo sapiens
cugccacugacaccucaaggac

SEQ ID NO: 109413 - RNA, 22 nt, Homo sapiens
cuggaauauuagcuggucuuaa

SEQ ID NO: 109414 - RNA, 22 nt, Homo sapiens
cuggaaugcagcuuuaggggcu

SEQ ID NO: 109415 - RNA, 22 nt, Homo sapiens
cuggagcaaaggugacucuugu

SEQ ID NO: 109416 - RNA, 22 nt, Homo sapiens
cuggaguaugaaccauguauca

SEQ ID NO: 109417 - RNA, 22 nt, Homo sapiens
cuggcacagugucagaaacaca

SEQ ID NO: 109418 - RNA, 22 nt, Homo sapiens
cuggccagagacauucauuaaa

SEQ ID NO: 109419 - RNA, 22 nt, Homo sapiens
cuggcccaguucugcguuuugc

SEQ ID NO: 109420 - RNA, 22 nt, Homo sapiens
cugggaugugacuguugccccc

SEQ ID NO: 109421 - RNA, 22 nt, Homo sapiens
cuguagcuuuuauaugcuuagc

SEQ ID NO: 109422 - RNA, 22 nt, Homo sapiens
cugugccaagcuugcgaugugc

SEQ ID NO: 109423 - RNA, 22 nt, Homo sapiens
cugugguuacguucuuugugcu

SEQ ID NO: 109424 - RNA, 22 nt, Homo sapiens
cuucaaaguuggcuaggagaca

SEQ ID NO: 109425 - RNA, 17 nt, Homo sapiens
cuucaaauaauuucccc

SEQ ID NO: 109426 - RNA, 22 nt, Homo sapiens
cuucaugagacuuuuggaaggc

SEQ ID NO: 109427 - RNA, 22 nt, Homo sapiens
cuuccauaguuacacccaggga

SEQ ID NO: 109428 - RNA, 22 nt, Homo sapiens
cuugcacucagaagauucaguu

SEQ ID NO: 109429 - RNA, 19 nt, Homo sapiens
cuugccccauucauccucu

SEQ ID NO: 109430 - RNA, 22 nt, Homo sapiens
cuugugcaugaccccagguggg

SEQ ID NO: 109431 - RNA, 22 nt, Homo sapiens
cuuguuguggaggggagugcag

SEQ ID NO: 109432 - RNA, 22 nt, Homo sapiens
cuuucacacuguuggugggaau

SEQ ID NO: 109433 - RNA, 22 nt, Homo sapiens
cuuugcaaauggccuuuccaag

SEQ ID NO: 109434 - RNA, 22 nt, Homo sapiens
cuuuggagaaaaguucuugggc

SEQ ID NO: 109435 - RNA, 20 nt, Homo sapiens
cuuuuugcugugcugggagc

SEQ ID NO: 109436 - RNA, 22 nt, Homo sapiens
gaaauguauuaaugaguugaaa

SEQ ID NO: 109437 - RNA, 22 nt, Homo sapiens
gaaaugucugagauguggcuca

SEQ ID NO: 109438 - RNA, 22 nt, Homo sapiens
gaacuguaaagaaauucuaagg

SEQ ID NO: 109439 - RNA, 18 nt, Homo sapiens
gaagaaguaggcauggca

SEQ ID NO: 109440 - RNA, 22 nt, Homo sapiens
gaaggcacugugugccacccug

SEQ ID NO: 109441 - RNA, 22 nt, Homo sapiens
gaaggugcuuggugaaugcauu

SEQ ID NO: 109442 - RNA, 22 nt, Homo sapiens
gaagugcuuuuggacuaacagu

SEQ ID NO: 109443 - RNA, 22 nt, Homo sapiens
gaaugaauguuuauccuuagau

SEQ ID NO: 109444 - RNA, 22 nt, Homo sapiens
gaauuguacugcaaucagggga

SEQ ID NO: 109445 - RNA, 22 nt, Homo sapiens
gacaagagaacacugcuauauu

SEQ ID NO: 109446 - RNA, 18 nt, Homo sapiens
uuagaugguuuuaaaacu

SEQ ID NO: 109447 - RNA, 22 nt, Homo sapiens
uuagcacugucuacucuggauu

SEQ ID NO: 109448 - RNA, 18 nt, Homo sapiens
uuauacuccccaggcaau

SEQ ID NO: 109449 - RNA, 22 nt, Homo sapiens
uuauagcuaacaucugugaaaa

SEQ ID NO: 109450 - RNA, 22 nt, Homo sapiens
uuaugguuuuuagcagaguaau

SEQ ID NO: 109451 - RNA, 22 nt, Homo sapiens
uuaugguuuuucugugagaugg

SEQ ID NO: 109452 - RNA, 22 nt, Homo sapiens
uucaauuaauauuauacucuca

SEQ ID NO: 109453 - RNA, 22 nt, Homo sapiens
uucacacugggccuacucugug

SEQ ID NO: 109454 - RNA, 22 nt, Homo sapiens
uucacugugugacccugggcca

SEQ ID NO: 109455 - RNA, 22 nt, Homo sapiens
uucagcaaugacagccuauaua

SEQ ID NO: 109456 - RNA, 22 nt, Homo sapiens
uucagcacaguguggaucauuc

SEQ ID NO: 109457 - RNA, 22 nt, Homo sapiens
uucagcaggccaggcccugacu

SEQ ID NO: 109458 - RNA, 22 nt, Homo sapiens
uucaucaggaauauugaccugu

SEQ ID NO: 109459 - RNA, 23 nt, Homo sapiens
uucaucagggauauuggccugaa

SEQ ID NO: 109460 - RNA, 22 nt, Homo sapiens
uucauccccuccaaaucucaug

SEQ ID NO: 109461 - RNA, 21 nt, Homo sapiens
uucaucuggccguauuccagg

SEQ ID NO: 109462 - RNA, 22 nt, Homo sapiens
uucauggaauauugaccauuuu

SEQ ID NO: 109463 - RNA, 22 nt, Homo sapiens
uucauuggacuuguguucuuga

SEQ ID NO: 109464 - RNA, 22 nt, Homo sapiens
uuccacaaugguugaacuagcu

SEQ ID NO: 109465 - RNA, 22 nt, Homo sapiens
uuccacaaugguugaacuaguu

SEQ ID NO: 109466 - RNA, 16 nt, Homo sapiens
uuccacagucgaggug

SEQ ID NO: 109467 - RNA, 22 nt, Homo sapiens
uuccaguggacuacuucauccu

SEQ ID NO: 109468 - RNA, 22 nt, Homo sapiens
uucccagagccugggagugagg

SEQ ID NO: 109469 - RNA, 22 nt, Homo sapiens
uucccugugggaguaggaaagu

SEQ ID NO: 109470 - RNA, 22 nt, Homo sapiens
uuccuugagaaaguacaaggcu

SEQ ID NO: 109471 - RNA, 22 nt, Homo sapiens
uucuagcaauggcagagugucu

SEQ ID NO: 109472 - RNA, 17 nt, Homo sapiens
uucucaguucugaucuc

SEQ ID NO: 109473 - RNA, 22 nt, Homo sapiens
uucucauggugauggcaaaauc

SEQ ID NO: 109474 - RNA, 22 nt, Homo sapiens
uucucuguggauugggugagag

SEQ ID NO: 109475 - RNA, 22 nt, Homo sapiens
uucugugcugaaucaaagacug

SEQ ID NO: 109476 - RNA, 22 nt, Homo sapiens
uucuugcacuuaacugacauuc

SEQ ID NO: 109477 - RNA, 22 nt, Homo sapiens
uugaaagacagaggggcaaguu

SEQ ID NO: 109478 - RNA, 22 nt, Homo sapiens
aaguauuagcuaauugugcuua

SEQ ID NO: 109479 - RNA, 19 nt, Homo sapiens
aagugaaugcuuuguucac

SEQ ID NO: 109480 - RNA, 22 nt, Homo sapiens
aagugaaugugcuggaauagcu

SEQ ID NO: 109481 - RNA, 22 nt, Homo sapiens
aagugaauucauuguguuauau

SEQ ID NO: 109482 - RNA, 20 nt, Homo sapiens
aagugaguguuaaacugaac

SEQ ID NO: 109483 - RNA, 20 nt, Homo sapiens
aagugcaucguugugucugc

SEQ ID NO: 109484 - RNA, 22 nt, Homo sapiens
aagugccauguggaugggcccu

SEQ ID NO: 109485 - RNA, 22 nt, Homo sapiens
aagugcuuaggauagugugugg

SEQ ID NO: 109486 - RNA, 22 nt, Homo sapiens
aagugcuuuacacaugcaugau

SEQ ID NO: 109487 - RNA, 22 nt, Homo sapiens
aagugcuuuuuagauaugguuu

SEQ ID NO: 109488 - RNA, 22 nt, Homo sapiens
aauaaguugagaugaggucaua

SEQ ID NO: 109489 - RNA, 22 nt, Homo sapiens
aauaucacaguuggguguacac

SEQ ID NO: 109490 - RNA, 22 nt, Homo sapiens
aaugcacauauauuuccuuauu

SEQ ID NO: 109491 - RNA, 18 nt, Homo sapiens
aaugggacuacaaagcca

SEQ ID NO: 109492 - RNA, 22 nt, Homo sapiens
aaugguguuuccguuaagcuga

SEQ ID NO: 109493 - RNA, 22 nt, Homo sapiens
aaugugcacuuggagccuugcu

SEQ ID NO: 109494 - RNA, 22 nt, Homo sapiens
aauugguuaagauaagaucaua

SEQ ID NO: 109495 - RNA, 20 nt, Homo sapiens
acaaaugcauucugugacau

SEQ ID NO: 109496 - RNA, 22 nt, Homo sapiens
acacucuaguguucuuaaucag

SEQ ID NO: 109497 - RNA, 20 nt, Homo sapiens
acacuggaguaucaaggccc

SEQ ID NO: 109498 - RNA, 22 nt, Homo sapiens
acacugucucuugcugaccaug

SEQ ID NO: 109499 - RNA, 20 nt, Homo sapiens
acacugugcuaaggauuuuc

SEQ ID NO: 109500 - RNA, 19 nt, Homo sapiens
acagcugguuuugguuucu

SEQ ID NO: 109501 - RNA, 23 nt, Homo sapiens
acaguggugugaucuuggcucag

SEQ ID NO: 109502 - RNA, 22 nt, Homo sapiens
acaguguagugacugccaacuu

SEQ ID NO: 109503 - RNA, 22 nt, Homo sapiens
acaguguguguguucaccuaga

SEQ ID NO: 109504 - RNA, 22 nt, Homo sapiens
acaucacuguuugauugauuga

SEQ ID NO: 109505 - RNA, 22 nt, Homo sapiens
acaucccuugcucggggccccu

SEQ ID NO: 109506 - RNA, 22 nt, Homo sapiens
accaguuuuuuauacaucuucu

SEQ ID NO: 109507 - RNA, 22 nt, Homo sapiens
acccagaauucagucuuaggcc

SEQ ID NO: 109508 - RNA, 22 nt, Homo sapiens
accucagcccggggaaguugag

SEQ ID NO: 109509 - RNA, 22 nt, Homo sapiens
accuggacacuuugggcuccuc

SEQ ID NO: 109510 - RNA, 22 nt, Homo sapiens
acugaucaauguuaaggcuuau

SEQ ID NO: 109511 - RNA, 19 nt, Homo sapiens
acugcacuccaaccuccug

SEQ ID NO: 109512 - RNA, 22 nt, Homo sapiens
acugcacuccagccuaggcgac

SEQ ID NO: 109513 - RNA, 22 nt, Homo sapiens
acugcacuccagccucccgucu

SEQ ID NO: 109514 - RNA, 22 nt, Homo sapiens
acugcacuccagccucggcaau

SEQ ID NO: 109515 - RNA, 22 nt, Homo sapiens
acugcacuccagccucggggac

SEQ ID NO: 109516 - RNA, 22 nt, Homo sapiens
acugcacuccagccugagccug

SEQ ID NO: 109517 - RNA, 22 nt, Homo sapiens
acugcacuccagccugcugaca

SEQ ID NO: 109518 - RNA, 22 nt, Homo sapiens
acugcacuccagccugcugggu

SEQ ID NO: 109519 - RNA, 22 nt, Homo sapiens
acugcacuccagccuggacgac

SEQ ID NO: 109520 - RNA, 22 nt, Homo sapiens
acugcacuccagccugugcgua

SEQ ID NO: 109521 - RNA, 22 nt, Homo sapiens
acugcacuccagccuuagugac

SEQ ID NO: 109522 - RNA, 22 nt, Homo sapiens
acugcacuccagccuucaggac

SEQ ID NO: 109523 - RNA, 20 nt, Homo sapiens
acugcacuccagccuuccag

SEQ ID NO: 109524 - RNA, 22 nt, Homo sapiens
acugcacuccagccuugagagc

SEQ ID NO: 109525 - RNA, 22 nt, Homo sapiens
acugcacuccagccuugauggc

SEQ ID NO: 109526 - RNA, 22 nt, Homo sapiens
acugcacuccagccuuggagac

SEQ ID NO: 109527 - RNA, 22 nt, Homo sapiens
acugcacuccagccuuggcaac

SEQ ID NO: 109528 - RNA, 22 nt, Homo sapiens
acugcacuccagcuuuggugac

SEQ ID NO: 109529 - RNA, 20 nt, Homo sapiens
acugcacuccaggcugccca

SEQ ID NO: 109530 - RNA, 20 nt, Homo sapiens
acugcacuccagucucuggg

SEQ ID NO: 109531 - RNA, 22 nt, Homo sapiens
acugcacuccaguuugggcagc

SEQ ID NO: 109532 - RNA, 22 nt, Homo sapiens
acugcacuccaucuuagguggc

SEQ ID NO: 109533 - RNA, 22 nt, Homo sapiens
acugcacuccggccucgugaca

SEQ ID NO: 109534 - RNA, 19 nt, Homo sapiens
acugcacuccuccuugggu

SEQ ID NO: 109535 - RNA, 22 nt, Homo sapiens
acugcacucuagcuugggugac

SEQ ID NO: 109536 - RNA, 22 nt, Homo sapiens
acugcacugucaaccuccuggg

SEQ ID NO: 109537 - RNA, 22 nt, Homo sapiens
acugcacuucaaccucauugac

SEQ ID NO: 109538 - RNA, 22 nt, Homo sapiens
acugcacuucagccuguugaca

SEQ ID NO: 109539 - RNA, 22 nt, Homo sapiens
acugcauuugguaaagucaaga

SEQ ID NO: 109540 - RNA, 22 nt, Homo sapiens
acuguacugucuggggcagucu

SEQ ID NO: 109541 - RNA, 22 nt, Homo sapiens
acuuuuugcaaccauuuggacc

SEQ ID NO: 109542 - RNA, 22 nt, Homo sapiens
agaaagugcuucccuuugguga

SEQ ID NO: 109543 - RNA, 20 nt, Homo sapiens
agaaccuguaguguagaggg

SEQ ID NO: 109544 - RNA, 22 nt, Homo sapiens
agaaugucaguauuggcuaaaa

SEQ ID NO: 109545 - RNA, 22 nt, Homo sapiens
agacacuguugaaaaggcccca

SEQ ID NO: 109546 - RNA, 21 nt, Homo sapiens
agacacuuggaagguuuuaga

SEQ ID NO: 109547 - RNA, 22 nt, Homo sapiens
agagagcuugggguguuaaauu

SEQ ID NO: 109548 - RNA, 22 nt, Homo sapiens
agagauuauccuggcuucucug

SEQ ID NO: 109549 - RNA, 22 nt, Homo sapiens
agaguaguaggaugaauggacu

SEQ ID NO: 109550 - RNA, 22 nt, Homo sapiens
agagucacaugaggcccuucau

SEQ ID NO: 109551 - RNA, 22 nt, Homo sapiens
agagugaagcuuuuuauauucu

SEQ ID NO: 109552 - RNA, 22 nt, Homo sapiens
agagugcaauggcaccaucucg

SEQ ID NO: 109553 - RNA, 20 nt, Homo sapiens
agagugcugucuguccugag

SEQ ID NO: 109554 - RNA, 22 nt, Homo sapiens
agaucacagucuuugguuuuag

SEQ ID NO: 109555 - RNA, 22 nt, Homo sapiens
agcaagauugauggccugcagg

SEQ ID NO: 109556 - RNA, 22 nt, Homo sapiens
agcacgaaaccaaauucuguga

SEQ ID NO: 109557 - RNA, 22 nt, Homo sapiens
ggucugguguugaaauucuuca

SEQ ID NO: 109558 - RNA, 22 nt, Homo sapiens
gguggcuuuuugugauggcuga

SEQ ID NO: 109559 - RNA, 22 nt, Homo sapiens
guaaaucucuguuuucauggac

SEQ ID NO: 109560 - RNA, 22 nt, Homo sapiens
guaaucucagcuacucgggagg

SEQ ID NO: 109561 - RNA, 22 nt, Homo sapiens
guaaucucagcuacuugggagc

SEQ ID NO: 109562 - RNA, 22 nt, Homo sapiens
guaaucucagcuacuugggagu

SEQ ID NO: 109563 - RNA, 22 nt, Homo sapiens
guaguggcaugaucuuggcuca

SEQ ID NO: 109564 - RNA, 22 nt, Homo sapiens
guauugaguaaauguuuauugg

SEQ ID NO: 109565 - RNA, 22 nt, Homo sapiens
gucaaagugauuguaauuaggu

SEQ ID NO: 109566 - RNA, 22 nt, Homo sapiens
gucagcuuuuccuuacuuuagg

SEQ ID NO: 109567 - RNA, 22 nt, Homo sapiens
gucagugucuuugcagcucaga

SEQ ID NO: 109568 - RNA, 22 nt, Homo sapiens
gucagugugauaucugcagggg

SEQ ID NO: 109569 - RNA, 22 nt, Homo sapiens
gucccagagauauugugucuuu

SEQ ID NO: 109570 - RNA, 22 nt, Homo sapiens
gucucagugcgaaucucaaaga

SEQ ID NO: 109571 - RNA, 22 nt, Homo sapiens
gucucccagccuacauauuucu

SEQ ID NO: 109572 - RNA, 21 nt, Homo sapiens
gucugguguuuuaaugaggac

SEQ ID NO: 109573 - RNA, 22 nt, Homo sapiens
gucugguuggaguaguuuucag

SEQ ID NO: 109574 - RNA, 22 nt, Homo sapiens
gucugguuuuuuauauccucac

SEQ ID NO: 109575 - RNA, 20 nt, Homo sapiens
gucuugcuccguugcccagg

SEQ ID NO: 109576 - RNA, 22 nt, Homo sapiens
gugaacagaaccugggaucgaa

SEQ ID NO: 109577 - RNA, 22 nt, Homo sapiens
gugagauaaugucucauugugg

SEQ ID NO: 109578 - RNA, 22 nt, Homo sapiens
gugagaugguaucucauugugg

SEQ ID NO: 109579 - RNA, 22 nt, Homo sapiens
gugagauuaccauuuaaaucag

SEQ ID NO: 109580 - RNA, 22 nt, Homo sapiens
gugaggcacugcugcuuuccag

SEQ ID NO: 109581 - RNA, 21 nt, Homo sapiens
gugaggucauugggcuuucug

SEQ ID NO: 109582 - RNA, 21 nt, Homo sapiens
gugaucaugucacugcacucc

SEQ ID NO: 109583 - RNA, 22 nt, Homo sapiens
gugaucuuucaggcuugaccau

SEQ ID NO: 109584 - RNA, 22 nt, Homo sapiens
gugaugguaguuuguauuucug

SEQ ID NO: 109585 - RNA, 22 nt, Homo sapiens
gugauuauccacgucuuuguga

SEQ ID NO: 109586 - RNA, 22 nt, Homo sapiens
gugcacaacaugcagguuuguu

SEQ ID NO: 109587 - RNA, 22 nt, Homo sapiens
gugcacuguagaacccuuuguu

SEQ ID NO: 109588 - RNA, 22 nt, Homo sapiens
gugggauggagagaagguauga

SEQ ID NO: 109589 - RNA, 22 nt, Homo sapiens
gugguuuuuaaaguaccugugg

SEQ ID NO: 109590 - RNA, 22 nt, Homo sapiens
gugucucagcccagaccuauuu

SEQ ID NO: 109591 - RNA, 22 nt, Homo sapiens
gugucuccugccuucaugcagc

SEQ ID NO: 109592 - RNA, 22 nt, Homo sapiens
gugucuccuguggagcuaugua

SEQ ID NO: 109593 - RNA, 22 nt, Homo sapiens
guucacaguuaggacaacugcu

SEQ ID NO: 109594 - RNA, 22 nt, Homo sapiens
guucccaguugaaaugauuagu

SEQ ID NO: 109595 - RNA, 22 nt, Homo sapiens
guuggcaaguggcugagcuggg

SEQ ID NO: 109596 - RNA, 22 nt, Homo sapiens
guuggguaauggggcgcaccgu

SEQ ID NO: 109597 - RNA, 22 nt, Homo sapiens
guuuaacugguacuucaagucu

SEQ ID NO: 109598 - RNA, 17 nt, Homo sapiens
guuuggguacuggguaa

SEQ ID NO: 109599 - RNA, 22 nt, Homo sapiens
uaaaagucaucacaacuggagu

SEQ ID NO: 109600 - RNA, 22 nt, Homo sapiens
uaaagcuauuauaguuauguuu

SEQ ID NO: 109601 - RNA, 22 nt, Homo sapiens
uaaagcugaaaugauuaugaca

SEQ ID NO: 109602 - RNA, 22 nt, Homo sapiens
uaaaugcuuaauugaaugugga

SEQ ID NO: 109603 - RNA, 22 nt, Homo sapiens
uaacaggcaaggucacaccuug

SEQ ID NO: 109604 - RNA, 20 nt, Homo sapiens
uaaggcacugugcuuuuagg

SEQ ID NO: 109605 - RNA, 22 nt, Homo sapiens
uaaggcauuuuuuugaguugca

SEQ ID NO: 109606 - RNA, 22 nt, Homo sapiens
uaaggcuucuuggaauacugca

SEQ ID NO: 109607 - RNA, 22 nt, Homo sapiens
uaaggcuugaucuuggugagau

SEQ ID NO: 109608 - RNA, 22 nt, Homo sapiens
uaaguaauugcagcaauuugcc

SEQ ID NO: 109609 - RNA, 22 nt, Homo sapiens
uaaguauuaugugcugcauuuu

SEQ ID NO: 109610 - RNA, 22 nt, Homo sapiens
uaagugcuguguuguuaccuaa

SEQ ID NO: 109611 - RNA, 20 nt, Homo sapiens
uaagugcuugaugaaugaac

SEQ ID NO: 109612 - RNA, 22 nt, Homo sapiens
uaauucacauaaagcacuuaga

SEQ ID NO: 109613 - RNA, 22 nt, Homo sapiens
uacagccacauaauguaugauu

SEQ ID NO: 109614 - RNA, 22 nt, Homo sapiens
uacagcuaugugcaugcaugcu

SEQ ID NO: 109615 - RNA, 22 nt, Homo sapiens
uacaguggaaguuaaccccauu

SEQ ID NO: 109616 - RNA, 22 nt, Homo sapiens
uacauacuucacagacuuuaaa

SEQ ID NO: 109617 - RNA, 22 nt, Homo sapiens
uaccaaguauuuucacaugaac

SEQ ID NO: 109618 - RNA, 22 nt, Homo sapiens
uacgccuguaauaucagcauuu

SEQ ID NO: 109619 - RNA, 22 nt, Homo sapiens
uacugcacuggaggccucagau

SEQ ID NO: 109620 - RNA, 21 nt, Homo sapiens
uacuggagauacagucugcaa

SEQ ID NO: 109621 - RNA, 22 nt, Homo sapiens
uagagguucuaagauucucaga

SEQ ID NO: 109622 - RNA, 22 nt, Homo sapiens
uagaucauauacuugccaugac

SEQ ID NO: 109623 - RNA, 22 nt, Homo sapiens
uagcaaaucaauggaauugaag

SEQ ID NO: 109624 - RNA, 22 nt, Homo sapiens
uagcacuauuuuucacuauccu

SEQ ID NO: 109625 - RNA, 18 nt, Homo sapiens
uagcagacaucauugggg

SEQ ID NO: 109626 - RNA, 22 nt, Homo sapiens
uagcagcauuuuuguagaguau

SEQ ID NO: 109627 - RNA, 22 nt, Homo sapiens
uagcagguguuccacaaauauu

SEQ ID NO: 109628 - RNA, 22 nt, Homo sapiens
uagcaguaucccaccaucuggu

SEQ ID NO: 109629 - RNA, 18 nt, Homo sapiens
uagcaugaugcugagugc

SEQ ID NO: 109630 - RNA, 23 nt, Homo sapiens
uagcuucucccagaccugcuccc

SEQ ID NO: 109631 - RNA, 22 nt, Homo sapiens
uaggcuuuuggacccugucucu

SEQ ID NO: 109632 - RNA, 22 nt, Homo sapiens
uaggugcacaguaaauauaugu

SEQ ID NO: 109633 - RNA, 20 nt, Homo sapiens
uauaacaguuuggacccagu

SEQ ID NO: 109634 - RNA, 22 nt, Homo sapiens
uauauaagcugaugagccacaa

SEQ ID NO: 109635 - RNA, 22 nt, Homo sapiens
uaucacagaggguauccuagag

SEQ ID NO: 109636 - RNA, 22 nt, Homo sapiens
uaucacagauauuaugggccaa

SEQ ID NO: 109637 - RNA, 22 nt, Homo sapiens
uaucacagcgggguguacaccc

SEQ ID NO: 109638 - RNA, 20 nt, Homo sapiens
uaucacaguucaggaacucu

SEQ ID NO: 109639 - RNA, 21 nt, Homo sapiens
uaucagagacauugagaggca

SEQ ID NO: 109640 - RNA, 22 nt, Homo sapiens
uaucagugaaucuuauuuugcc

SEQ ID NO: 109641 - RNA, 22 nt, Homo sapiens
uaucccuuagagcggggugguu

SEQ ID NO: 109642 - RNA, 23 nt, Homo sapiens
uaucccuugccuuaugaugugag

SEQ ID NO: 109643 - RNA, 22 nt, Homo sapiens
uaugagaugaggccacugggua

SEQ ID NO: 109644 - RNA, 22 nt, Homo sapiens
uaugcacaugcaugcuugaaua

SEQ ID NO: 109645 - RNA, 22 nt, Homo sapiens
uaugcacuauggaaguagcuca

SEQ ID NO: 109646 - RNA, 22 nt, Homo sapiens
uaugccuuuuggcucaagaaac

SEQ ID NO: 109647 - RNA, 22 nt, Homo sapiens
uauggauuuuuuugacaagagc

SEQ ID NO: 109648 - RNA, 22 nt, Homo sapiens
uauggcugcuuucacacuacaa

SEQ ID NO: 109649 - RNA, 22 nt, Homo sapiens
uaugggauuucauuaagugucu

SEQ ID NO: 109650 - RNA, 20 nt, Homo sapiens
uauuacagaguaauggugga

SEQ ID NO: 109651 - RNA, 20 nt, Homo sapiens
uauucacucuccagucuugc

SEQ ID NO: 109652 - RNA, 22 nt, Homo sapiens
uauuccacacuguuggugggau

SEQ ID NO: 109653 - RNA, 22 nt, Homo sapiens
uauuccauuugggucaggauga

SEQ ID NO: 109654 - RNA, 22 nt, Homo sapiens
uauugcagaaugugaguuggca

SEQ ID NO: 109655 - RNA, 22 nt, Homo sapiens
uauuuggauagucuggaaaaaa

SEQ ID NO: 109656 - RNA, 20 nt, Homo sapiens
uauuugguuauuuccauggu

SEQ ID NO: 109657 - RNA, 22 nt, Homo sapiens
ucaaagucuucucaaguaacau

SEQ ID NO: 109658 - RNA, 22 nt, Homo sapiens
ucaaagugacaaaguugcagca

SEQ ID NO: 109659 - RNA, 22 nt, Homo sapiens
ucaaagugcuauggcucagguu

SEQ ID NO: 109660 - RNA, 22 nt, Homo sapiens
ucaaaugcacguagagaaaaua

SEQ ID NO: 109661 - RNA, 17 nt, Homo sapiens
ucaaaugcucccaguga

SEQ ID NO: 109662 - RNA, 22 nt, Homo sapiens
ucaaaugcucuuugcagagagg

SEQ ID NO: 109663 - RNA, 21 nt, Homo sapiens
ucaaauugaaauuaggucauu

SEQ ID NO: 109664 - RNA, 22 nt, Homo sapiens
ucacacgugaacucaucacaga

SEQ ID NO: 109665 - RNA, 22 nt, Homo sapiens
ucacacugaaacuaggguguga

SEQ ID NO: 109666 - RNA, 22 nt, Homo sapiens
ucacagauaaauaaagaugauu

SEQ ID NO: 109667 - RNA, 22 nt, Homo sapiens
ucacagaugcuugacccauuuc

SEQ ID NO: 109668 - RNA, 22 nt, Homo sapiens
ucacagccuaguuuuauacauu

SEQ ID NO: 109669 - RNA, 22 nt, Homo sapiens
ucacaggguguuauuagaauua

SEQ ID NO: 109670 - RNA, 19 nt, Homo sapiens
ucacaggguugacuugagg

SEQ ID NO: 109671 - RNA, 22 nt, Homo sapiens
ucacaguaucaugggggacaga

SEQ ID NO: 109672 - RNA, 22 nt, Homo sapiens
ucacaugaagauuuuaguauac

SEQ ID NO: 109673 - RNA, 22 nt, Homo sapiens
ucacauuguauauguaccuauc

SEQ ID NO: 109674 - RNA, 22 nt, Homo sapiens
ucaccuggggcacagcugaaga

SEQ ID NO: 109675 - RNA, 22 nt, Homo sapiens
ucacugaaacuguccuggguua

SEQ ID NO: 109676 - RNA, 20 nt, Homo sapiens
ucacuggagcucauuugauu

SEQ ID NO: 109677 - RNA, 22 nt, Homo sapiens
ucacugugguuuugaugugcau

SEQ ID NO: 109678 - RNA, 22 nt, Homo sapiens
ucacuguguauguauaugcagg

SEQ ID NO: 109679 - RNA, 22 nt, Homo sapiens
ucagacacugagcaaacgacua

SEQ ID NO: 109680 - RNA, 22 nt, Homo sapiens
ucagacacugcccuccaccugu

SEQ ID NO: 109681 - RNA, 22 nt, Homo sapiens
ucagaugauuccguugacgaga

SEQ ID NO: 109682 - RNA, 22 nt, Homo sapiens
ucagcgggaguggaaagucaga

SEQ ID NO: 109683 - RNA, 22 nt, Homo sapiens
ucaggcacucagcuuagagucu

SEQ ID NO: 109684 - RNA, 20 nt, Homo sapiens
ucaggcuccgcauuaacuua

SEQ ID NO: 109685 - RNA, 22 nt, Homo sapiens
ucagggacuuacaaaccagaag

SEQ ID NO: 109686 - RNA, 22 nt, Homo sapiens
ucaguagagacaggauuucacc

SEQ ID NO: 109687 - RNA, 22 nt, Homo sapiens
caaagugcugggaugggccagg

SEQ ID NO: 109688 - RNA, 22 nt, Homo sapiens
caaauugcuuguggaggauaau

SEQ ID NO: 109689 - RNA, 22 nt, Homo sapiens
caacauccaccuccuggguuca

SEQ ID NO: 109690 - RNA, 22 nt, Homo sapiens
caagggguggaaaugguagugu

SEQ ID NO: 109691 - RNA, 22 nt, Homo sapiens
caagugcuacagagaaaucuuu

SEQ ID NO: 109692 - RNA, 22 nt, Homo sapiens
caaguguuggcuuguauacaaa

SEQ ID NO: 109693 - RNA, 22 nt, Homo sapiens
cacacugucuucaauggguggu

SEQ ID NO: 109694 - RNA, 22 nt, Homo sapiens
cacacugucuuucagaaugguu

SEQ ID NO: 109695 - RNA, 22 nt, Homo sapiens
cacagagugagacccugucucu

SEQ ID NO: 109696 - RNA, 22 nt, Homo sapiens
cacagucuugcaauauugagau

SEQ ID NO: 109697 - RNA, 22 nt, Homo sapiens
cacaguguuacugguaugaagu

SEQ ID NO: 109698 - RNA, 22 nt, Homo sapiens
cacaguguuccagcuauuugaa

SEQ ID NO: 109699 - RNA, 22 nt, Homo sapiens
cacaguugccuaucuccugaag

SEQ ID NO: 109700 - RNA, 21 nt, Homo sapiens
cacugcaucacaggacagcau

SEQ ID NO: 109701 - RNA, 22 nt, Homo sapiens
cacugcauccuccaccugccag

SEQ ID NO: 109702 - RNA, 17 nt, Homo sapiens
cacugggugcaagagga

SEQ ID NO: 109703 - RNA, 22 nt, Homo sapiens
cacuuugguucaccugaguuuc

SEQ ID NO: 109704 - RNA, 22 nt, Homo sapiens
cagagaaugucuuuuuuaacca

SEQ ID NO: 109705 - RNA, 22 nt, Homo sapiens
cagagguauugcaaaagccuag

SEQ ID NO: 109706 - RNA, 22 nt, Homo sapiens
cagccgggugagguggcuuguu

SEQ ID NO: 109707 - RNA, 22 nt, Homo sapiens
cagcugcuuuggaaaauauuuu

SEQ ID NO: 109708 - RNA, 22 nt, Homo sapiens
cagcuguguuauaaacuaccau

SEQ ID NO: 109709 - RNA, 22 nt, Homo sapiens
cagggaauguuauuuaauagca

SEQ ID NO: 109710 - RNA, 22 nt, Homo sapiens
cagggcauuggcugguaccugg

SEQ ID NO: 109711 - RNA, 22 nt, Homo sapiens
cagugaauuucaggucaagagu

SEQ ID NO: 109712 - RNA, 22 nt, Homo sapiens
cagugcaaccuccaucucucgg

SEQ ID NO: 109713 - RNA, 20 nt, Homo sapiens
cagugcauugcuucugauuu

SEQ ID NO: 109714 - RNA, 22 nt, Homo sapiens
cagugguuuuuagcuugcuggg

SEQ ID NO: 109715 - RNA, 22 nt, Homo sapiens
cauacaagcuacaaucacaaag

SEQ ID NO: 109716 - RNA, 22 nt, Homo sapiens
cauccccugcaccaaccuuuac

SEQ ID NO: 109717 - RNA, 22 nt, Homo sapiens
cauggcucuuguuuacucccag

SEQ ID NO: 109718 - RNA, 20 nt, Homo sapiens
cauuccacuuuccugucagu

SEQ ID NO: 109719 - RNA, 22 nt, Homo sapiens
cauugcagauccuucaaaugac

SEQ ID NO: 109720 - RNA, 22 nt, Homo sapiens
cauuugcacugagacucagcuu

SEQ ID NO: 109721 - RNA, 22 nt, Homo sapiens
ccagaguggagccuuugcgagg

SEQ ID NO: 109722 - RNA, 22 nt, Homo sapiens
ccaguguucuggaaggcugagu

SEQ ID NO: 109723 - RNA, 22 nt, Homo sapiens
ccauggcuauucuguaaggguu

SEQ ID NO: 109724 - RNA, 22 nt, Homo sapiens
cccagagacagaaugauaaacu

SEQ ID NO: 109725 - RNA, 22 nt, Homo sapiens
cccagugugcugggugacagcu

SEQ ID NO: 109726 - RNA, 22 nt, Homo sapiens
cccaguguuacgugacagccug

SEQ ID NO: 109727 - RNA, 22 nt, Homo sapiens
cccugagaaaacuuuguccuua

SEQ ID NO: 109728 - RNA, 19 nt, Homo sapiens
cccuggcacauggaaaaug

SEQ ID NO: 109729 - RNA, 22 nt, Homo sapiens
cccuguguuuagcugaagguuu

SEQ ID NO: 109730 - RNA, 22 nt, Homo sapiens
ccugucuugauuaaauuacuua

SEQ ID NO: 109731 - RNA, 22 nt, Homo sapiens
ccuuuuuguaguggaaguagga

SEQ ID NO: 109732 - RNA, 22 nt, Homo sapiens
cggcaguggguaagccaagcuu

SEQ ID NO: 109733 - RNA, 22 nt, Homo sapiens
cuacaguguauuuauggagggu

SEQ ID NO: 109734 - RNA, 22 nt, Homo sapiens
cuagcagacaggcugggagcag

SEQ ID NO: 109735 - RNA, 22 nt, Homo sapiens
cuauucacaauagccaagauuu

SEQ ID NO: 109736 - RNA, 22 nt, Homo sapiens
cucaaagucaagggaaagcagg

SEQ ID NO: 109737 - RNA, 19 nt, Homo sapiens
cucaaagugguauuuggag

SEQ ID NO: 109738 - RNA, 22 nt, Homo sapiens
cucaaguaauccucccgccuug

SEQ ID NO: 109739 - RNA, 22 nt, Homo sapiens
cucacugugguguccuuaggua

SEQ ID NO: 109740 - RNA, 22 nt, Homo sapiens
cucaggcacucugauuccagug

SEQ ID NO: 109741 - RNA, 19 nt, Homo sapiens
cucauggagaaggagaaua

SEQ ID NO: 109742 - RNA, 22 nt, Homo sapiens
cucauugcaaucucugccuccc

SEQ ID NO: 109743 - RNA, 22 nt, Homo sapiens
cuccauuuggaacagauguccu

SEQ ID NO: 109744 - RNA, 22 nt, Homo sapiens
cucccagagccaguuauaggcu

SEQ ID NO: 109745 - RNA, 22 nt, Homo sapiens
cuccuggugauuggagugugaa

SEQ ID NO: 109746 - RNA, 22 nt, Homo sapiens
cuccuugauuagaguauagagu

SEQ ID NO: 109747 - RNA, 22 nt, Homo sapiens
cucucugagccauggcugcccu

SEQ ID NO: 109748 - RNA, 22 nt, Homo sapiens
cucugagccugagguuccuacu

SEQ ID NO: 109749 - RNA, 22 nt, Homo sapiens
cucugagguuauucguaauauu

SEQ ID NO: 109750 - RNA, 22 nt, Homo sapiens
cugaaagguauacgcuuguuau

SEQ ID NO: 109751 - RNA, 22 nt, Homo sapiens
cugagacacucuuaucugcaua

SEQ ID NO: 109752 - RNA, 22 nt, Homo sapiens
cugagaguugaugaaauauggu

SEQ ID NO: 109753 - RNA, 20 nt, Homo sapiens
cugaggugggagaaucgcuu

SEQ ID NO: 109754 - RNA, 22 nt, Homo sapiens
cugagguuaggaguuugagacc

SEQ ID NO: 109755 - RNA, 20 nt, Homo sapiens
cugcacauccacucuacuuc

SEQ ID NO: 109756 - RNA, 22 nt, Homo sapiens
cugcagucaucugaagauuuug

SEQ ID NO: 109757 - RNA, 20 nt, Homo sapiens
cugcuccccuacaaaucuca

SEQ ID NO: 109758 - RNA, 22 nt, Homo sapiens
cuggaaagcaaagggugcauug

SEQ ID NO: 109759 - RNA, 22 nt, Homo sapiens
cuggaaggaaaaacaaccacag

SEQ ID NO: 109760 - RNA, 22 nt, Homo sapiens
cuggaauguuccuaaagauuca

SEQ ID NO: 109761 - RNA, 22 nt, Homo sapiens
cugggaugauguaaauaggcua

SEQ ID NO: 109762 - RNA, 22 nt, Homo sapiens
cugucacaguuuuggaggccag

SEQ ID NO: 109763 - RNA, 22 nt, Homo sapiens
cugucacuggggcacauguccc

SEQ ID NO: 109764 - RNA, 22 nt, Homo sapiens
cuguccugcagagucagaauga

SEQ ID NO: 109765 - RNA, 22 nt, Homo sapiens
cugucuguuucaaaagugguua

SEQ ID NO: 109766 - RNA, 22 nt, Homo sapiens
cugugguauuauuagaaauauc

SEQ ID NO: 109767 - RNA, 20 nt, Homo sapiens
cuucacagaaguggaaucau

SEQ ID NO: 109768 - RNA, 22 nt, Homo sapiens
cuucacuggagucccuggauuc

SEQ ID NO: 109769 - RNA, 22 nt, Homo sapiens
cuucaucugguuugugaacuuu

SEQ ID NO: 109770 - RNA, 18 nt, Homo sapiens
cuucauugcuguuuugcu

SEQ ID NO: 109771 - RNA, 22 nt, Homo sapiens
cuugauagugguaaucauuuuu

SEQ ID NO: 109772 - RNA, 22 nt, Homo sapiens
cuugcacauuacagaucugcau

SEQ ID NO: 109773 - RNA, 22 nt, Homo sapiens
cuugccuaaucugcaugauuuu

SEQ ID NO: 109774 - RNA, 22 nt, Homo sapiens
cuuuaguugucuccucaagggu

SEQ ID NO: 109775 - RNA, 22 nt, Homo sapiens
cuuuccauuguuggagcauaaa

SEQ ID NO: 109776 - RNA, 22 nt, Homo sapiens
cuuugguguauuuucagagacc

SEQ ID NO: 109777 - RNA, 22 nt, Homo sapiens
cuuuguaugucaugacaacugu

SEQ ID NO: 109778 - RNA, 22 nt, Homo sapiens
gaaagcugguauagauacauua

SEQ ID NO: 109779 - RNA, 23 nt, Homo sapiens
gaaaugucuuagugaaauugcuu

SEQ ID NO: 109780 - RNA, 22 nt, Homo sapiens
gaagcauugauccacaggcgug

SEQ ID NO: 109781 - RNA, 22 nt, Homo sapiens
gaaucauuggguugauucaaga

SEQ ID NO: 109782 - RNA, 22 nt, Homo sapiens
gaauucugucgcuuacuagaug

SEQ ID NO: 109783 - RNA, 23 nt, Homo sapiens
gugcaguggcgagauuucggcuc

SEQ ID NO: 109784 - RNA, 22 nt, Homo sapiens
gugccacugcacuccggccugg

SEQ ID NO: 109785 - RNA, 22 nt, Homo sapiens
guggaagaccagacuuuccaac

SEQ ID NO: 109786 - RNA, 22 nt, Homo sapiens
guggaaugcaguguugauucaa

SEQ ID NO: 109787 - RNA, 22 nt, Homo sapiens
guggaauggaaugauuguguau

SEQ ID NO: 109788 - RNA, 17 nt, Homo sapiens
guggaaugucaugucaa

SEQ ID NO: 109789 - RNA, 22 nt, Homo sapiens
guggagcuguguggccuugggc

SEQ ID NO: 109790 - RNA, 22 nt, Homo sapiens
guggcagugugaggauccugcu

SEQ ID NO: 109791 - RNA, 22 nt, Homo sapiens
guggguaaaucucuguucgagg

SEQ ID NO: 109792 - RNA, 22 nt, Homo sapiens
gugugacugcucuauuagggcg

SEQ ID NO: 109793 - RNA, 22 nt, Homo sapiens
guguuugguugauagagccacu

SEQ ID NO: 109794 - RNA, 20 nt, Homo sapiens
guucacagagguuaugauua

SEQ ID NO: 109795 - RNA, 17 nt, Homo sapiens
guugaguuugagucaag

SEQ ID NO: 109796 - RNA, 22 nt, Homo sapiens
guuugcacuccuaugagaaucu

SEQ ID NO: 109797 - RNA, 22 nt, Homo sapiens
uaaagcgaggucuccuacaaga

SEQ ID NO: 109798 - RNA, 22 nt, Homo sapiens
uaaagcuaucacauuggugauu

SEQ ID NO: 109799 - RNA, 22 nt, Homo sapiens
uaacaggcuacucuugcauugc

SEQ ID NO: 109800 - RNA, 22 nt, Homo sapiens
uaacauucacaugcugcaaaaa

SEQ ID NO: 109801 - RNA, 22 nt, Homo sapiens
uaagcaguguggauccaccuug

SEQ ID NO: 109802 - RNA, 22 nt, Homo sapiens
uaaggcucuuguuauuuugagg

SEQ ID NO: 109803 - RNA, 22 nt, Homo sapiens
uaaggcuuugucuuaggacuuu

SEQ ID NO: 109804 - RNA, 22 nt, Homo sapiens
uaaguacuuuacagacauuauc

SEQ ID NO: 109805 - RNA, 22 nt, Homo sapiens
uaagucuuuuuggaguuuauaa

SEQ ID NO: 109806 - RNA, 22 nt, Homo sapiens
uaagugaauuucacuacugagu

SEQ ID NO: 109807 - RNA, 22 nt, Homo sapiens
uaaguucauucaugaaacuuag

SEQ ID NO: 109808 - RNA, 22 nt, Homo sapiens
uaaugcauguaaugggcugaua

SEQ ID NO: 109809 - RNA, 22 nt, Homo sapiens
uaaugcuguggucuaaugggga

SEQ ID NO: 109810 - RNA, 22 nt, Homo sapiens
uaaugcuguggucugguuuaaa

SEQ ID NO: 109811 - RNA, 22 nt, Homo sapiens
uaauuggaucucaaaaaagugu

SEQ ID NO: 109812 - RNA, 22 nt, Homo sapiens
uacaaaguaacaguuccuguau

SEQ ID NO: 109813 - RNA, 22 nt, Homo sapiens
uacaaguaauaagggaagaauu

SEQ ID NO: 109814 - RNA, 22 nt, Homo sapiens
uacaguagagaucagcaaacua

SEQ ID NO: 109815 - RNA, 22 nt, Homo sapiens
uacaugcaugggcaugugugca

SEQ ID NO: 109816 - RNA, 22 nt, Homo sapiens
uacauugucauauucucucucu

SEQ ID NO: 109817 - RNA, 16 nt, Homo sapiens
uacauuuguuacaugg

SEQ ID NO: 109818 - RNA, 22 nt, Homo sapiens
uacccucuggauacccuuguuc

SEQ ID NO: 109819 - RNA, 22 nt, Homo sapiens
uaccucuguaaguaaagauuca

SEQ ID NO: 109820 - RNA, 22 nt, Homo sapiens
uaccugagaaagaaagcccucg

SEQ ID NO: 109821 - RNA, 22 nt, Homo sapiens
uaccugagcccucugcugaguu

SEQ ID NO: 109822 - RNA, 22 nt, Homo sapiens
uacugcagucagacuccugggc

SEQ ID NO: 109823 - RNA, 22 nt, Homo sapiens
uacuguacugcaguucugcaaa

SEQ ID NO: 109824 - RNA, 22 nt, Homo sapiens
uagaacauuccaggugauguug

SEQ ID NO: 109825 - RNA, 22 nt, Homo sapiens
uagaauggaaggcauguuugcc

SEQ ID NO: 109826 - RNA, 22 nt, Homo sapiens
uagaauguaaauuccaagggca

SEQ ID NO: 109827 - RNA, 22 nt, Homo sapiens
uagacacuagauaugugacuga

SEQ ID NO: 109828 - RNA, 22 nt, Homo sapiens
uagagaucuuauauuuuaugac

SEQ ID NO: 109829 - RNA, 22 nt, Homo sapiens
uagaucauauucagugcuuacu

SEQ ID NO: 109830 - RNA, 22 nt, Homo sapiens
uagcaccuuagcauuucuagug

SEQ ID NO: 109831 - RNA, 22 nt, Homo sapiens
uagcagcaaagcaggaucugcu

SEQ ID NO: 109832 - RNA, 22 nt, Homo sapiens
uagcagcauaaauggacuaaga

SEQ ID NO: 109833 - RNA, 22 nt, Homo sapiens
uagcaguauacguacugggucc

SEQ ID NO: 109834 - RNA, 22 nt, Homo sapiens
uagcuucuccauagcuccaugu

SEQ ID NO: 109835 - RNA, 22 nt, Homo sapiens
uaggagcacagcagcauguggg

SEQ ID NO: 109836 - RNA, 22 nt, Homo sapiens
uaggcaguguucucacuuguaa

SEQ ID NO: 109837 - RNA, 22 nt, Homo sapiens
uaggcuuuucugggaugugggc

SEQ ID NO: 109838 - RNA, 22 nt, Homo sapiens
uaggucuuuuagcauaggagcu

SEQ ID NO: 109839 - RNA, 22 nt, Homo sapiens
uagguuaucucaaguguaauuu

SEQ ID NO: 109840 - RNA, 22 nt, Homo sapiens
uauaucuguccauggcccugcu

SEQ ID NO: 109841 - RNA, 22 nt, Homo sapiens
uaucugcacuucugucuagguc

SEQ ID NO: 109842 - RNA, 22 nt, Homo sapiens
uaugcuuauugucucauccacu

SEQ ID NO: 109843 - RNA, 22 nt, Homo sapiens
uauggcuuuuauuauguuguag

SEQ ID NO: 109844 - RNA, 22 nt, Homo sapiens
uauggguuucagagggugauag

SEQ ID NO: 109845 - RNA, 22 nt, Homo sapiens
uaugugguuaauaggaauuugu

SEQ ID NO: 109846 - RNA, 22 nt, Homo sapiens
uauugcauguugagcaguaccu

SEQ ID NO: 109847 - RNA, 22 nt, Homo sapiens
uauugcuuaugaugcugaauua

SEQ ID NO: 109848 - RNA, 22 nt, Homo sapiens
uauuucaguugcguuucccgag

SEQ ID NO: 109849 - RNA, 21 nt, Homo sapiens
ucaacccuugcgucaccaagc

SEQ ID NO: 109850 - RNA, 22 nt, Homo sapiens
ucaaggcacuagcugagcugca

SEQ ID NO: 109851 - RNA, 22 nt, Homo sapiens
ucacaagugagaggaauuagau

SEQ ID NO: 109852 - RNA, 21 nt, Homo sapiens
ucacaaugaacagcagcagaa

SEQ ID NO: 109853 - RNA, 22 nt, Homo sapiens
ucacacucucaccaacauuugg

SEQ ID NO: 109854 - RNA, 22 nt, Homo sapiens
ucacacugcaucuguuggaauu

SEQ ID NO: 109855 - RNA, 22 nt, Homo sapiens
ucacacugucuugguuacucuu

SEQ ID NO: 109856 - RNA, 22 nt, Homo sapiens
ucacaguccuguuuaggagagg

SEQ ID NO: 109857 - RNA, 22 nt, Homo sapiens
ucacagugcaggaucaguuaau

SEQ ID NO: 109858 - RNA, 22 nt, Homo sapiens
ucacaguguuaaaccuuucuuu

SEQ ID NO: 109859 - RNA, 17 nt, Homo sapiens
ucacaguguuaggauga

SEQ ID NO: 109860 - RNA, 22 nt, Homo sapiens
ucacaucucagguuucuugaca

SEQ ID NO: 109861 - RNA, 22 nt, Homo sapiens
ucacauggcagagaagaagcuc

SEQ ID NO: 109862 - RNA, 22 nt, Homo sapiens
ucacauuguacaaacagguaag

SEQ ID NO: 109863 - RNA, 22 nt, Homo sapiens
ucaccuguagcuaagaccuaau

SEQ ID NO: 109864 - RNA, 22 nt, Homo sapiens
ucacuaaagaaaauggcaugga

SEQ ID NO: 109865 - RNA, 22 nt, Homo sapiens
ucacuagggagaaacugaggcu

SEQ ID NO: 109866 - RNA, 22 nt, Homo sapiens
ucacugggagcauuugagccuu

SEQ ID NO: 109867 - RNA, 20 nt, Homo sapiens
ucacugugaacuucuugagg

SEQ ID NO: 109868 - RNA, 22 nt, Homo sapiens
ucagauacuggugacaugaaug

SEQ ID NO: 109869 - RNA, 20 nt, Homo sapiens
ucagcagucuggagcagagg

SEQ ID NO: 109870 - RNA, 22 nt, Homo sapiens
ucaggcaccuuccucuuaucug

SEQ ID NO: 109871 - RNA, 22 nt, Homo sapiens
ucaggcaugcagcaaugcagug

SEQ ID NO: 109872 - RNA, 22 nt, Homo sapiens
ucagguauuuauagcaaugcaa

SEQ ID NO: 109873 - RNA, 22 nt, Homo sapiens
ucagguccuuacugugcucccu

SEQ ID NO: 109874 - RNA, 22 nt, Homo sapiens
ucaguagcaugaaaacagacua

SEQ ID NO: 109875 - RNA, 18 nt, Homo sapiens
ucagucacugccuggcuu

SEQ ID NO: 109876 - RNA, 22 nt, Homo sapiens
ucagugccucaguuuuuaaaga

SEQ ID NO: 109877 - RNA, 21 nt, Homo sapiens
ucaguuacugagagagaagug

SEQ ID NO: 109878 - RNA, 22 nt, Homo sapiens
ucauaucauuagaucuacugua

SEQ ID NO: 109879 - RNA, 20 nt, Homo sapiens
uggaaucuaggcggagguuu

SEQ ID NO: 109880 - RNA, 22 nt, Homo sapiens
uggaauguauaucguuuuuugu

SEQ ID NO: 109881 - RNA, 22 nt, Homo sapiens
uggaauguuauggcuuuaaucu

SEQ ID NO: 109882 - RNA, 22 nt, Homo sapiens
uggacuguaagugccuugagua

SEQ ID NO: 109883 - RNA, 22 nt, Homo sapiens
uggacuguaauagagaacagaa

SEQ ID NO: 109884 - RNA, 22 nt, Homo sapiens
uggacuguaauuuuauaggcau

SEQ ID NO: 109885 - RNA, 22 nt, Homo sapiens
uggaggacugcagaacugaggc

SEQ ID NO: 109886 - RNA, 22 nt, Homo sapiens
uggagucuugcucuguugccca

SEQ ID NO: 109887 - RNA, 20 nt, Homo sapiens
uggaguuugaguucuuggag

SEQ ID NO: 109888 - RNA, 22 nt, Homo sapiens
uggcaaauagcaauaggagggu

SEQ ID NO: 109889 - RNA, 22 nt, Homo sapiens
uggcaacaucuggggacauguu

SEQ ID NO: 109890 - RNA, 23 nt, Homo sapiens
uggcaagaauucuuaccgugugg

SEQ ID NO: 109891 - RNA, 22 nt, Homo sapiens
uggcaagaccccaucucuacaa

SEQ ID NO: 109892 - RNA, 22 nt, Homo sapiens
uggcaagagauaugugucuaua

SEQ ID NO: 109893 - RNA, 23 nt, Homo sapiens
uggcauuuuaguuagcuucagug

SEQ ID NO: 109894 - RNA, 22 nt, Homo sapiens
uggccagugucggaggccagga

SEQ ID NO: 109895 - RNA, 20 nt, Homo sapiens
ugggaacaugugguauaugg

SEQ ID NO: 109896 - RNA, 22 nt, Homo sapiens
ugggaagaugcugcuucuuccu

SEQ ID NO: 109897 - RNA, 22 nt, Homo sapiens
ugggaaugaaauuacauagcuu

SEQ ID NO: 109898 - RNA, 22 nt, Homo sapiens
ugggaucauuaugcauagugua

SEQ ID NO: 109899 - RNA, 22 nt, Homo sapiens
ugggaugaugcuugagaauauc

SEQ ID NO: 109900 - RNA, 22 nt, Homo sapiens
ugggcauuguuccuaguuaucu

SEQ ID NO: 109901 - RNA, 22 nt, Homo sapiens
uggguagagcacugggggcgag

SEQ ID NO: 109902 - RNA, 22 nt, Homo sapiens
uggguagaugaauccauuccaa

SEQ ID NO: 109903 - RNA, 19 nt, Homo sapiens
uggguagugaugagacaua

SEQ ID NO: 109904 - RNA, 22 nt, Homo sapiens
uggguccccuacucuuuccaca

SEQ ID NO: 109905 - RNA, 23 nt, Homo sapiens
uggguucauucuugaagucagug

SEQ ID NO: 109906 - RNA, 22 nt, Homo sapiens
uggucaugaggugaggcuucuc

SEQ ID NO: 109907 - RNA, 23 nt, Homo sapiens
uggucccguguucuggcuuuagg

SEQ ID NO: 109908 - RNA, 20 nt, Homo sapiens
uggugguuuuaugugguuua

SEQ ID NO: 109909 - RNA, 22 nt, Homo sapiens
uguaaugaucaaaucagaguaa

SEQ ID NO: 109910 - RNA, 22 nt, Homo sapiens
uguagacagcacguaguugagu

SEQ ID NO: 109911 - RNA, 22 nt, Homo sapiens
uguagggagagggaguugcacc

SEQ ID NO: 109912 - RNA, 22 nt, Homo sapiens
uguauguugggucaaaguacau

SEQ ID NO: 109913 - RNA, 22 nt, Homo sapiens
ugucacagagauuuugguaugu

SEQ ID NO: 109914 - RNA, 22 nt, Homo sapiens
ugucacugugcagucaugcauu

SEQ ID NO: 109915 - RNA, 22 nt, Homo sapiens
uguccaaauugaaucaucuggu

SEQ ID NO: 109916 - RNA, 16 nt, Homo sapiens
ugucuguuugggcaca

SEQ ID NO: 109917 - RNA, 22 nt, Homo sapiens
ugugaagaugagaugacgcccu

SEQ ID NO: 109918 - RNA, 22 nt, Homo sapiens
ugugaagauggacuaauauagu

SEQ ID NO: 109919 - RNA, 22 nt, Homo sapiens
ugugaagauguuucuuaauuga

SEQ ID NO: 109920 - RNA, 22 nt, Homo sapiens
ugugagacugguucugaaccca

SEQ ID NO: 109921 - RNA, 22 nt, Homo sapiens
ugugccacuccagcucuagcuu

SEQ ID NO: 109922 - RNA, 22 nt, Homo sapiens
ugugccacugcacucccgccug

SEQ ID NO: 109923 - RNA, 22 nt, Homo sapiens
ugugccacugcacucugggcaa

SEQ ID NO: 109924 - RNA, 22 nt, Homo sapiens
ugugccacuguucuguaaagug

SEQ ID NO: 109925 - RNA, 22 nt, Homo sapiens
ugugccuucuaagaaggagucu

SEQ ID NO: 109926 - RNA, 22 nt, Homo sapiens
ugugcucaucucagucaacugu

SEQ ID NO: 109927 - RNA, 22 nt, Homo sapiens
ugugcuugaaauucaguuuuga

SEQ ID NO: 109928 - RNA, 22 nt, Homo sapiens
ugugguuuuaguaaaacuaugu

SEQ ID NO: 109929 - RNA, 22 nt, Homo sapiens
uguuaacauggucucagucugu

SEQ ID NO: 109930 - RNA, 22 nt, Homo sapiens
uguucuggagaggcaggccaca

SEQ ID NO: 109931 - RNA, 18 nt, Homo sapiens
uguugguguucacucacu

SEQ ID NO: 109932 - RNA, 22 nt, Homo sapiens
uguuugcuuaacguggagccag

SEQ ID NO: 109933 - RNA, 22 nt, Homo sapiens
uuaaagcuggcguuacaguuug

SEQ ID NO: 109934 - RNA, 22 nt, Homo sapiens
uuaaagugaucauaaggauagu

SEQ ID NO: 109935 - RNA, 22 nt, Homo sapiens
uuaaaugcauagaauguguagu

SEQ ID NO: 109936 - RNA, 22 nt, Homo sapiens
uuaaggcuccuguuggcuuuua

SEQ ID NO: 109937 - RNA, 23 nt, Homo sapiens
uuaaggugaugucuuugugccuc

SEQ ID NO: 109938 - RNA, 22 nt, Homo sapiens
uuaaucaggccguuuccuaaga

SEQ ID NO: 109939 - RNA, 22 nt, Homo sapiens
uuacagauggauggcagcuggc

SEQ ID NO: 109940 - RNA, 22 nt, Homo sapiens
uuacaguagaugaggguauaau

SEQ ID NO: 109941 - RNA, 22 nt, Homo sapiens
uuacaugcaugacaaggugcca

SEQ ID NO: 109942 - RNA, 22 nt, Homo sapiens
uuaccaguggugcuguaaacuu

SEQ ID NO: 109943 - RNA, 22 nt, Homo sapiens
uuaccuuuuuaagacagguuag

SEQ ID NO: 109944 - RNA, 22 nt, Homo sapiens
uuagcaauagccugcaucugca

SEQ ID NO: 109945 - RNA, 22 nt, Homo sapiens
uuagcaguggauggguggagaa

SEQ ID NO: 109946 - RNA, 22 nt, Homo sapiens
uuaggcaguuuauugauuuuca

SEQ ID NO: 109947 - RNA, 22 nt, Homo sapiens
uuagguaauauauugcugcuuu

SEQ ID NO: 109948 - RNA, 22 nt, Homo sapiens
uuagguagucucugucagaggg

SEQ ID NO: 109949 - RNA, 22 nt, Homo sapiens
uuauuugguugcugacuuggaa

SEQ ID NO: 109950 - RNA, 22 nt, Homo sapiens
uucaaaguaaagggauggagac

SEQ ID NO: 109951 - RNA, 22 nt, Homo sapiens
uucaauacuguugauccuuaug

SEQ ID NO: 109952 - RNA, 22 nt, Homo sapiens
uucacagccgcaccccaucacu

SEQ ID NO: 109953 - RNA, 22 nt, Homo sapiens
uucacagugugaucuaugggca

SEQ ID NO: 109954 - RNA, 22 nt, Homo sapiens
uucacaguguguacaccagggg

SEQ ID NO: 109955 - RNA, 22 nt, Homo sapiens
uucaccuggaguucaggauaag

SEQ ID NO: 109956 - RNA, 22 nt, Homo sapiens
uucacugugaacucauauucag

SEQ ID NO: 109957 - RNA, 22 nt, Homo sapiens
uucacugugcuuaaauucugcu

SEQ ID NO: 109958 - RNA, 22 nt, Homo sapiens
uucaggcaccauugucauugau

SEQ ID NO: 109959 - RNA, 22 nt, Homo sapiens
uucaguccauuuccuuggucac

SEQ ID NO: 109960 - RNA, 22 nt, Homo sapiens
uucagugucauuaacacaguag

SEQ ID NO: 109961 - RNA, 20 nt, Homo sapiens
uucaucaggauauuggucua

SEQ ID NO: 109962 - RNA, 22 nt, Homo sapiens
uucaucaguuauauuggccuga

SEQ ID NO: 109963 - RNA, 22 nt, Homo sapiens
uucaucaguugagcugguugcu

SEQ ID NO: 109964 - RNA, 22 nt, Homo sapiens
uuccacaaugguugaacuaauu

SEQ ID NO: 109965 - RNA, 22 nt, Homo sapiens
uuccacaggguugaacuaguuu

SEQ ID NO: 109966 - RNA, 21 nt, Homo sapiens
uuccagugagccuagaugccu

SEQ ID NO: 109967 - RNA, 22 nt, Homo sapiens
uuccagugggacgagaugugga

SEQ ID NO: 109968 - RNA, 22 nt, Homo sapiens
uuccaugagaugcaucaaagcu

SEQ ID NO: 109969 - RNA, 22 nt, Homo sapiens
uucccugugguauagaagccgu

SEQ ID NO: 109970 - RNA, 22 nt, Homo sapiens
uucccuugcaggaugaucugga

SEQ ID NO: 109971 - RNA, 22 nt, Homo sapiens
uuccugagccuuguaucuagua

SEQ ID NO: 109972 - RNA, 22 nt, Homo sapiens
uuccugaggccuccccagaagc

SEQ ID NO: 109973 - RNA, 22 nt, Homo sapiens
uuccugucuuccaagagagauu

SEQ ID NO: 109974 - RNA, 22 nt, Homo sapiens
uuccuugagaaaggcacaaguu

SEQ ID NO: 109975 - RNA, 22 nt, Homo sapiens
aagcaugguuuccaggggucac

SEQ ID NO: 109976 - RNA, 22 nt, Homo sapiens
aagcugguguugcugcucuguu

SEQ ID NO: 109977 - RNA, 22 nt, Homo sapiens
aagggaauguugugguugguuu

SEQ ID NO: 109978 - RNA, 22 nt, Homo sapiens
aaguaagcauccaauaaauguu

SEQ ID NO: 109979 - RNA, 22 nt, Homo sapiens
aagucacugagacuuguggcug

SEQ ID NO: 109980 - RNA, 22 nt, Homo sapiens
aagugccauguggaugggcccu

SEQ ID NO: 109981 - RNA, 22 nt, Homo sapiens
aagugcuggccuacucaaucga

SEQ ID NO: 109982 - RNA, 22 nt, Homo sapiens
aaguuguuggaguuccauuguu

SEQ ID NO: 109983 - RNA, 21 nt, Homo sapiens
aaucacaguuguucugccuuc

SEQ ID NO: 109984 - RNA, 22 nt, Homo sapiens
aauuguacucccaucauuccua

SEQ ID NO: 109985 - RNA, 22 nt, Homo sapiens
acagauagacauauauagcuca

SEQ ID NO: 109986 - RNA, 22 nt, Homo sapiens
acagugcuguuguguuuucacg

SEQ ID NO: 109987 - RNA, 22 nt, Homo sapiens
acaguguguguguucaccuaga

SEQ ID NO: 109988 - RNA, 22 nt, Homo sapiens
acccagaguuccuugucuuuca

SEQ ID NO: 109989 - RNA, 22 nt, Homo sapiens
acccaguguucaacauucacau

SEQ ID NO: 109990 - RNA, 22 nt, Homo sapiens
accgaguuagccaggauggucu

SEQ ID NO: 109991 - RNA, 22 nt, Homo sapiens
acucauugcucauaccuuaucu

SEQ ID NO: 109992 - RNA, 22 nt, Homo sapiens
acugcaaugucgaauagagaug

SEQ ID NO: 109993 - RNA, 22 nt, Homo sapiens
acugcacuccagccugaugaaa

SEQ ID NO: 109994 - RNA, 22 nt, Homo sapiens
agaugguguuuucucaccagau

SEQ ID NO: 109995 - RNA, 21 nt, Homo sapiens
agcagcuuugguugaagcaga

SEQ ID NO: 109996 - RNA, 22 nt, Homo sapiens
agcaggucuuaacuugugaggu

SEQ ID NO: 109997 - RNA, 21 nt, Homo sapiens
aggcuguuguuuugggaugga

SEQ ID NO: 109998 - RNA, 22 nt, Homo sapiens
agguauuuucaacuuagaaugg

SEQ ID NO: 109999 - RNA, 22 nt, Homo sapiens
aggugacugguuuaucuggcag

SEQ ID NO: 110000 - RNA, 22 nt, Homo sapiens
aguauuaggugaguguauuuca

SEQ ID NO: 110001 - RNA, 22 nt, Homo sapiens
aguauuuguuggaauaccuguu

SEQ ID NO: 110002 - RNA, 22 nt, Homo sapiens
agucacaugcauuuucuucaau

SEQ ID NO: 110003 - RNA, 22 nt, Homo sapiens
agucagugucuguaaggagaac

SEQ ID NO: 110004 - RNA, 22 nt, Homo sapiens
agucaguguguauugauggcac

SEQ ID NO: 110005 - RNA, 22 nt, Homo sapiens
agugaauuguucaacaggagga

SEQ ID NO: 110006 - RNA, 19 nt, Homo sapiens
agugagccaagauccuacc

SEQ ID NO: 110007 - RNA, 22 nt, Homo sapiens
agugcauugcaucucugcuuca

SEQ ID NO: 110008 - RNA, 22 nt, Homo sapiens
agugccacugcacucuagccug

SEQ ID NO: 110009 - RNA, 22 nt, Homo sapiens
aguggugucugaguggccaggg

SEQ ID NO: 110010 - RNA, 22 nt, Homo sapiens
agugguuuuaaguagagcauac

SEQ ID NO: 110011 - RNA, 22 nt, Homo sapiens
aguugcaagucuugaguaaaga

SEQ ID NO: 110012 - RNA, 22 nt, Homo sapiens
auaacauggaguuugucauuua

SEQ ID NO: 110013 - RNA, 23 nt, Homo sapiens
auaaugcaaguggugguaaucug

SEQ ID NO: 110014 - RNA, 22 nt, Homo sapiens
auacaaggaaugaagagauuug

SEQ ID NO: 110015 - RNA, 22 nt, Homo sapiens
auagcacaguguguguacacca

SEQ ID NO: 110016 - RNA, 22 nt, Homo sapiens
auagguaguugaggagauuuca

SEQ ID NO: 110017 - RNA, 22 nt, Homo sapiens
auaucccuguauaagugaaugu

SEQ ID NO: 110018 - RNA, 19 nt, Homo sapiens
aucaaacugcucuuugagg

SEQ ID NO: 110019 - RNA, 22 nt, Homo sapiens
aucaagcuggcauauguaguuc

SEQ ID NO: 110020 - RNA, 22 nt, Homo sapiens
aucauacuguuuugauuacugu

SEQ ID NO: 110021 - RNA, 22 nt, Homo sapiens
auccacagugucaauguuguga

SEQ ID NO: 110022 - RNA, 22 nt, Homo sapiens
aucccugaggaauuucugcacu

SEQ ID NO: 110023 - RNA, 22 nt, Homo sapiens
aucuccaggugccagcugcgcc

SEQ ID NO: 110024 - RNA, 22 nt, Homo sapiens
aucugacuuuuaauuugaaaac

SEQ ID NO: 110025 - RNA, 22 nt, Homo sapiens
augaagugcaugauaguugguu

SEQ ID NO: 110026 - RNA, 22 nt, Homo sapiens
augaaguuagcucauuucuuuu

SEQ ID NO: 110027 - RNA, 22 nt, Homo sapiens
augagauaggaacaaacuuaca

SEQ ID NO: 110028 - RNA, 22 nt, Homo sapiens
augagauauguuaaaaguuaaa

SEQ ID NO: 110029 - RNA, 22 nt, Homo sapiens
augagauauuuuauaagaucau

SEQ ID NO: 110030 - RNA, 22 nt, Homo sapiens
augcuguuuuguagcucccucu

SEQ ID NO: 110031 - RNA, 22 nt, Homo sapiens
augcuuguguuggggcagugga

SEQ ID NO: 110032 - RNA, 22 nt, Homo sapiens
auguaacacagugcggcugggc

SEQ ID NO: 110033 - RNA, 22 nt, Homo sapiens
augucaaggugggugauaguuu

SEQ ID NO: 110034 - RNA, 22 nt, Homo sapiens
augugacugauguaaucagaca

SEQ ID NO: 110035 - RNA, 18 nt, Homo sapiens
augugcaauuuuguauuu

SEQ ID NO: 110036 - RNA, 22 nt, Homo sapiens
auguugcaguuuaauuauccua

SEQ ID NO: 110037 - RNA, 22 nt, Homo sapiens
auuaaguuaggauuuugagaua

SEQ ID NO: 110038 - RNA, 22 nt, Homo sapiens
auuccagauggaguugaggguu

SEQ ID NO: 110039 - RNA, 22 nt, Homo sapiens
auugcaacaguguugagaggug

SEQ ID NO: 110040 - RNA, 22 nt, Homo sapiens
auugcaacuuccgccuccuggg

SEQ ID NO: 110041 - RNA, 22 nt, Homo sapiens
auugcaaugggaaacuaugaaa

SEQ ID NO: 110042 - RNA, 22 nt, Homo sapiens
auugcacuccagccccggggac

SEQ ID NO: 110043 - RNA, 22 nt, Homo sapiens
auugcacuccagccuggccaac

SEQ ID NO: 110044 - RNA, 22 nt, Homo sapiens
auugcacuccagccugggugag

SEQ ID NO: 110045 - RNA, 22 nt, Homo sapiens
auugcacuccggccugggugac

SEQ ID NO: 110046 - RNA, 22 nt, Homo sapiens
auugcauuuucagguuggucug

SEQ ID NO: 110047 - RNA, 22 nt, Homo sapiens
auugcuuaagucccuguauuag

SEQ ID NO: 110048 - RNA, 22 nt, Homo sapiens
auugcuuacccuguauuagauc

SEQ ID NO: 110049 - RNA, 22 nt, Homo sapiens
auuguacugccccccuguugcu

SEQ ID NO: 110050 - RNA, 20 nt, Homo sapiens
auuguccuugauuacacaga

SEQ ID NO: 110051 - RNA, 22 nt, Homo sapiens
auuuuugguugucagcacuagg

SEQ ID NO: 110052 - RNA, 22 nt, Homo sapiens
caaguacugggcuauggauauu

SEQ ID NO: 110053 - RNA, 22 nt, Homo sapiens
caccgagguuggagugcagugg

SEQ ID NO: 110054 - RNA, 22 nt, Homo sapiens
cacugcaguaaauugcgucggu

SEQ ID NO: 110055 - RNA, 22 nt, Homo sapiens
cagauacuggaguccugaaguu

SEQ ID NO: 110056 - RNA, 22 nt, Homo sapiens
cagcaaaucauccuauuugagc

SEQ ID NO: 110057 - RNA, 22 nt, Homo sapiens
caggaaugugaggguucccugc

SEQ ID NO: 110058 - RNA, 22 nt, Homo sapiens
caggcacgcuugggagacacac

SEQ ID NO: 110059 - RNA, 22 nt, Homo sapiens
caggcagucuggggguguaucc

SEQ ID NO: 110060 - RNA, 22 nt, Homo sapiens
cagugcauagaugugccacauu

SEQ ID NO: 110061 - RNA, 22 nt, Homo sapiens
cagugcuuguuauuguucuauu

SEQ ID NO: 110062 - RNA, 22 nt, Homo sapiens
cauacaugugcuugucuuaugc

SEQ ID NO: 110063 - RNA, 22 nt, Homo sapiens
cauaugguuuuauguucuucau

SEQ ID NO: 110064 - RNA, 22 nt, Homo sapiens
cauugcaugccagccugggcaa

SEQ ID NO: 110065 - RNA, 22 nt, Homo sapiens
ccagugguucccuguggccuga

SEQ ID NO: 110066 - RNA, 22 nt, Homo sapiens
ccaguguucuggaaggcugagu

SEQ ID NO: 110067 - RNA, 22 nt, Homo sapiens
acccaguguucagacuaccugu

SEQ ID NO: 110068 - RNA, 21 nt, Homo sapiens
acccccacaccuccuuaguuc

SEQ ID NO: 110069 - RNA, 22 nt, Homo sapiens
accuuguagcaaaccuaacaua

SEQ ID NO: 110070 - RNA, 22 nt, Homo sapiens
agaacccuuugaaauguguuug

SEQ ID NO: 110071 - RNA, 20 nt, Homo sapiens
agacagcugcagcccacauc

SEQ ID NO: 110072 - RNA, 22 nt, Homo sapiens
agacuguaaugcauaauuuacu

SEQ ID NO: 110073 - RNA, 22 nt, Homo sapiens
agagaccuguaaaguucaggca

SEQ ID NO: 110074 - RNA, 22 nt, Homo sapiens
agagccacacucuccuaacuca

SEQ ID NO: 110075 - RNA, 22 nt, Homo sapiens
agaguacugacguuugcaaauu

SEQ ID NO: 110076 - RNA, 22 nt, Homo sapiens
agaguaguuucuauauucuuca

SEQ ID NO: 110077 - RNA, 22 nt, Homo sapiens
agauggguuuucacauguuggc

SEQ ID NO: 110078 - RNA, 22 nt, Homo sapiens
agcacagugaaugguuuacuca

SEQ ID NO: 110079 - RNA, 22 nt, Homo sapiens
agcagcucaugccuuugggagg

SEQ ID NO: 110080 - RNA, 17 nt, Homo sapiens
agccccauuagcuaguu

SEQ ID NO: 110081 - RNA, 22 nt, Homo sapiens
agcuccuacuguuacaucauug

SEQ ID NO: 110082 - RNA, 22 nt, Homo sapiens
aggaauguuaguacuucuuagu

SEQ ID NO: 110083 - RNA, 21 nt, Homo sapiens
aggagcauuguugugguggag

SEQ ID NO: 110084 - RNA, 22 nt, Homo sapiens
aggcaaaugccagcaaucacac

SEQ ID NO: 110085 - RNA, 22 nt, Homo sapiens
agguagcauagcgggaauauca

SEQ ID NO: 110086 - RNA, 22 nt, Homo sapiens
agguauauuggacagauguaaa

SEQ ID NO: 110087 - RNA, 22 nt, Homo sapiens
agucaguggaguaaauguaauu

SEQ ID NO: 110088 - RNA, 21 nt, Homo sapiens
agucauaggaguacauaaugc

SEQ ID NO: 110089 - RNA, 22 nt, Homo sapiens
agugauggagccaggauuuaau

SEQ ID NO: 110090 - RNA, 22 nt, Homo sapiens
agugcaguggcacaaucuuggc

SEQ ID NO: 110091 - RNA, 22 nt, Homo sapiens
auaaaguagaggugaggugcau

SEQ ID NO: 110092 - RNA, 22 nt, Homo sapiens
auaauaguguuuagauuuggga

SEQ ID NO: 110093 - RNA, 21 nt, Homo sapiens
auagcacaucagauuuuauua

SEQ ID NO: 110094 - RNA, 22 nt, Homo sapiens
auaugcaaauccauagagacag

SEQ ID NO: 110095 - RNA, 22 nt, Homo sapiens
auaugugacuucaugcaaggcu

SEQ ID NO: 110096 - RNA, 22 nt, Homo sapiens
auauuacuggcuauaucgcaag

SEQ ID NO: 110097 - RNA, 18 nt, Homo sapiens
auauugcauuggauggau

SEQ ID NO: 110098 - RNA, 22 nt, Homo sapiens
auauuguuggcugcuggcugau

SEQ ID NO: 110099 - RNA, 22 nt, Homo sapiens
aucaaaguaggcauauguuuuu

SEQ ID NO: 110100 - RNA, 22 nt, Homo sapiens
aucaaaucuccagaaccugucu

SEQ ID NO: 110101 - RNA, 22 nt, Homo sapiens
aucaccgugggagauccugccu

SEQ ID NO: 110102 - RNA, 22 nt, Homo sapiens
aucccagaaacucggguuucuc

SEQ ID NO: 110103 - RNA, 22 nt, Homo sapiens
auccucaguggcuuaaguauag

SEQ ID NO: 110104 - RNA, 22 nt, Homo sapiens
aucuaaaucucauaugggcaca

SEQ ID NO: 110105 - RNA, 19 nt, Homo sapiens
aucuggaguuccuggggcu

SEQ ID NO: 110106 - RNA, 22 nt, Homo sapiens
augaaaguguguggaaacuuga

SEQ ID NO: 110107 - RNA, 20 nt, Homo sapiens
augaauguccuugauggcau

SEQ ID NO: 110108 - RNA, 21 nt, Homo sapiens
augagguguacuguggugaaa

SEQ ID NO: 110109 - RNA, 22 nt, Homo sapiens
augauuagaacucauuuccagg

SEQ ID NO: 110110 - RNA, 22 nt, Homo sapiens
augcaauucuagauugauagua

SEQ ID NO: 110111 - RNA, 22 nt, Homo sapiens
augcuuguugcagccugagccu

SEQ ID NO: 110112 - RNA, 22 nt, Homo sapiens
auggaaaugaagggcuggcccu

SEQ ID NO: 110113 - RNA, 22 nt, Homo sapiens
auggcaauguaagucagaaaaa

SEQ ID NO: 110114 - RNA, 22 nt, Homo sapiens
auggcacugauggaaguaccuu

SEQ ID NO: 110115 - RNA, 22 nt, Homo sapiens
auggcagugagucucuaguauu

SEQ ID NO: 110116 - RNA, 22 nt, Homo sapiens
auggcaguuuauucuaaaucaa

SEQ ID NO: 110117 - RNA, 22 nt, Homo sapiens
auggcauugaagaguugucccu

SEQ ID NO: 110118 - RNA, 22 nt, Homo sapiens
auggcucuguuccaugugucuu

SEQ ID NO: 110119 - RNA, 22 nt, Homo sapiens
auggcuuuuuaaaucauguugu

SEQ ID NO: 110120 - RNA, 22 nt, Homo sapiens
auggcuuuuuucuugggcacuc

SEQ ID NO: 110121 - RNA, 22 nt, Homo sapiens
auguaaacauuuggucuaaauu

SEQ ID NO: 110122 - RNA, 22 nt, Homo sapiens
auguaguugcucugccuguuuu

SEQ ID NO: 110123 - RNA, 23 nt, Homo sapiens
augugugcuuggagagcaggaug

SEQ ID NO: 110124 - RNA, 22 nt, Homo sapiens
auuacauagucaaggugucuca

SEQ ID NO: 110125 - RNA, 22 nt, Homo sapiens
auuccuuaggcccuuugguuag

SEQ ID NO: 110126 - RNA, 22 nt, Homo sapiens
auugcaaagcguagacucuaaa

SEQ ID NO: 110127 - RNA, 22 nt, Homo sapiens
auugcaauuaguccauagaguu

SEQ ID NO: 110128 - RNA, 22 nt, Homo sapiens
auugcaguuucaacuccagggc

SEQ ID NO: 110129 - RNA, 22 nt, Homo sapiens
auuggcaauccauauauuuucu

SEQ ID NO: 110130 - RNA, 22 nt, Homo sapiens
auuguacuuaagccugggugaa

SEQ ID NO: 110131 - RNA, 22 nt, Homo sapiens
auuucacuucgcaugguguccg

SEQ ID NO: 110132 - RNA, 20 nt, Homo sapiens
auuuggcauaguuuaagcaa

SEQ ID NO: 110133 - RNA, 22 nt, Homo sapiens
auuuuuggauauagggaaggau

SEQ ID NO: 110134 - RNA, 22 nt, Homo sapiens
auuuuugguuucaccugcacgc

SEQ ID NO: 110135 - RNA, 22 nt, Homo sapiens
caacugcucacuccuggguuca

SEQ ID NO: 110136 - RNA, 22 nt, Homo sapiens
caagugcuuucuuggggauuua

SEQ ID NO: 110137 - RNA, 22 nt, Homo sapiens
cacaguguucauagccaucagg

SEQ ID NO: 110138 - RNA, 22 nt, Homo sapiens
cagcuguuguuaugucugcagg

SEQ ID NO: 110139 - RNA, 22 nt, Homo sapiens
cagucacagugacaggaugugg

SEQ ID NO: 110140 - RNA, 22 nt, Homo sapiens
caugccauugcucuccugggug

SEQ ID NO: 110141 - RNA, 22 nt, Homo sapiens
ccacagucuaugcaacaagguc

SEQ ID NO: 110142 - RNA, 22 nt, Homo sapiens
ccaguguuuuugaauuccagga

SEQ ID NO: 110143 - RNA, 22 nt, Homo sapiens
ccaguuuuucauuuauacuagu

SEQ ID NO: 110144 - RNA, 22 nt, Homo sapiens
ccaguuuuuggcaaugaugaau

SEQ ID NO: 110145 - RNA, 22 nt, Homo sapiens
ccauugcacuccagccuaggca

SEQ ID NO: 110146 - RNA, 22 nt, Homo sapiens
ccauugcacuccauccugggca

SEQ ID NO: 110147 - RNA, 22 nt, Homo sapiens
ccccaguguguaaaggccuugc

SEQ ID NO: 110148 - RNA, 17 nt, Homo sapiens
cccuaguagcugggacu

SEQ ID NO: 110149 - RNA, 22 nt, Homo sapiens
ccuuggcacuuugccacagugc

SEQ ID NO: 110150 - RNA, 22 nt, Homo sapiens
cuaaaguauugagugguaaaga

SEQ ID NO: 110151 - RNA, 22 nt, Homo sapiens
cuaacacagagguuuauuucuc

SEQ ID NO: 110152 - RNA, 22 nt, Homo sapiens
cucagggugguggacucuaaua

SEQ ID NO: 110153 - RNA, 18 nt, Homo sapiens
cugccagugugcucuccg

SEQ ID NO: 110154 - RNA, 21 nt, Homo sapiens
cuuaagccacuaaguuuugga

SEQ ID NO: 110155 - RNA, 22 nt, Homo sapiens
cuuaaggccagauaauuucuau

SEQ ID NO: 110156 - RNA, 19 nt, Homo sapiens
cuuaggugaccaguuccca

SEQ ID NO: 110157 - RNA, 22 nt, Homo sapiens
cuucaguucuguaaggacagca

SEQ ID NO: 110158 - RNA, 22 nt, Homo sapiens
gaaagacuuucugcuguggaua

SEQ ID NO: 110159 - RNA, 22 nt, Homo sapiens
uccaguacaggucucucauuuc

SEQ ID NO: 110160 - RNA, 22 nt, Homo sapiens
uccaguggacagacauaccaug

SEQ ID NO: 110161 - RNA, 22 nt, Homo sapiens
ucccaguggucuugaaacaggg

SEQ ID NO: 110162 - RNA, 22 nt, Homo sapiens
uccugcauucugacuugcuuuc

SEQ ID NO: 110163 - RNA, 22 nt, Homo sapiens
uccuucacucuacaucuuuguu

SEQ ID NO: 110164 - RNA, 22 nt, Homo sapiens
ucuacagccaguucaggaagaa

SEQ ID NO: 110165 - RNA, 22 nt, Homo sapiens
ucucacagaguugaauguuucu

SEQ ID NO: 110166 - RNA, 22 nt, Homo sapiens
ucucagugaauguggaaaaagc

SEQ ID NO: 110167 - RNA, 22 nt, Homo sapiens
ucucaguguuaucuaucugccu

SEQ ID NO: 110168 - RNA, 22 nt, Homo sapiens
ucucuugguugaacaguuugga

SEQ ID NO: 110169 - RNA, 19 nt, Homo sapiens
ucugucacuggggguauuc

SEQ ID NO: 110170 - RNA, 22 nt, Homo sapiens
ucugucacugguggacgaucac

SEQ ID NO: 110171 - RNA, 22 nt, Homo sapiens
ucuuaguuuagauuagcaauuc

SEQ ID NO: 110172 - RNA, 17 nt, Homo sapiens
ucuucuguuacuguggc

SEQ ID NO: 110173 - RNA, 22 nt, Homo sapiens
ucuugcacaaauuauuuuaacu

SEQ ID NO: 110174 - RNA, 22 nt, Homo sapiens
ucuugguuuauugauggagagg

SEQ ID NO: 110175 - RNA, 22 nt, Homo sapiens
ugaaaugauuauaugguguuug

SEQ ID NO: 110176 - RNA, 22 nt, Homo sapiens
ugaaaugcugucuaggggaaau

SEQ ID NO: 110177 - RNA, 20 nt, Homo sapiens
ugacaaggugcaaagaauca

SEQ ID NO: 110178 - RNA, 22 nt, Homo sapiens
ugacagcugaagauguugaacc

SEQ ID NO: 110179 - RNA, 22 nt, Homo sapiens
ugagacgaagucuugcucuguu

SEQ ID NO: 110180 - RNA, 22 nt, Homo sapiens
ugagauaguacuuuuuuaaagg

SEQ ID NO: 110181 - RNA, 22 nt, Homo sapiens
ugagaugaagucucacucuguc

SEQ ID NO: 110182 - RNA, 22 nt, Homo sapiens
ugagaugaagucuugcucuguu

SEQ ID NO: 110183 - RNA, 22 nt, Homo sapiens
ugagaugagucucgcucuguca

SEQ ID NO: 110184 - RNA, 22 nt, Homo sapiens
ugagcaauaaaguuacacaguu

SEQ ID NO: 110185 - RNA, 20 nt, Homo sapiens
ugagcucaauuguugcaagu

SEQ ID NO: 110186 - RNA, 22 nt, Homo sapiens
ugauuagagcccaagcuuugaa

SEQ ID NO: 110187 - RNA, 20 nt, Homo sapiens
ugcaaguugccuuuggaggc

SEQ ID NO: 110188 - RNA, 22 nt, Homo sapiens
ugcaauauccucuacuauaggu

SEQ ID NO: 110189 - RNA, 22 nt, Homo sapiens
ugcauauucuaggauuuuguau

SEQ ID NO: 110190 - RNA, 21 nt, Homo sapiens
ugcaugguagucacaugauuc

SEQ ID NO: 110191 - RNA, 22 nt, Homo sapiens
ugccaaggagucagucccuaga

SEQ ID NO: 110192 - RNA, 22 nt, Homo sapiens
ugccaggaugaggucaauguuu

SEQ ID NO: 110193 - RNA, 22 nt, Homo sapiens
ugcugcauuggggauuaaguuu

SEQ ID NO: 110194 - RNA, 22 nt, Homo sapiens
uggaaaguacuugaguuuguau

SEQ ID NO: 110195 - RNA, 22 nt, Homo sapiens
uggacauguacauauguguaug

SEQ ID NO: 110196 - RNA, 22 nt, Homo sapiens
uggcacuggagauacauuaaua

SEQ ID NO: 110197 - RNA, 22 nt, Homo sapiens
uggcauuuugugugaauuagaa

SEQ ID NO: 110198 - RNA, 22 nt, Homo sapiens
ugggcauggaguggccuuaugu

SEQ ID NO: 110199 - RNA, 22 nt, Homo sapiens
ugguauuuaauauaugagaguu

SEQ ID NO: 110200 - RNA, 21 nt, Homo sapiens
uggucaguuuucucacuagga

SEQ ID NO: 110201 - RNA, 22 nt, Homo sapiens
uggucaugaggugaggcuucuc

SEQ ID NO: 110202 - RNA, 22 nt, Homo sapiens
ugguucaguugcacaggcuguu

SEQ ID NO: 110203 - RNA, 22 nt, Homo sapiens
uguaauuuaaaugauccuugga

SEQ ID NO: 110204 - RNA, 22 nt, Homo sapiens
uguauugcuugaagagugaauu

SEQ ID NO: 110205 - RNA, 22 nt, Homo sapiens
ugugaacaaaauuuguugcaua

SEQ ID NO: 110206 - RNA, 22 nt, Homo sapiens
ugugacugguugucccgcuuuc

SEQ ID NO: 110207 - RNA, 22 nt, Homo sapiens
ugugucuuguuuauagcuuucu

SEQ ID NO: 110208 - RNA, 22 nt, Homo sapiens
uguuggcauugcugcugacccu

SEQ ID NO: 110209 - RNA, 22 nt, Homo sapiens
uuaaagcuggcguuacaguuug

SEQ ID NO: 110210 - RNA, 20 nt, Homo sapiens
uuaagugcuuucugcuuaga

SEQ ID NO: 110211 - RNA, 22 nt, Homo sapiens
uuaaugcuuuugggauauuucu

SEQ ID NO: 110212 - RNA, 22 nt, Homo sapiens
uuuaaugcaucccaaaauguag

SEQ ID NO: 110213 - RNA, 22 nt, Homo sapiens
uuuagcaaagcaauuuacacca

SEQ ID NO: 110214 - RNA, 22 nt, Homo sapiens
uuuagcaauucauuuugugucu

SEQ ID NO: 110215 - RNA, 22 nt, Homo sapiens
uuuagguaauauuaaguagcug

SEQ ID NO: 110216 - RNA, 22 nt, Homo sapiens
uuuaucuguuuaaaacuguuca

SEQ ID NO: 110217 - RNA, 22 nt, Homo sapiens
uuuauguggagcacuugacaca

SEQ ID NO: 110218 - RNA, 22 nt, Homo sapiens
uuucauccggcuguguauuaug

SEQ ID NO: 110219 - RNA, 23 nt, Homo sapiens
uuucauggggauuuacucauucc

SEQ ID NO: 110220 - RNA, 22 nt, Homo sapiens
uuugaguuugaggugcugauga

SEQ ID NO: 110221 - RNA, 16 nt, Homo sapiens
uuugcaagaucagaag

SEQ ID NO: 110222 - RNA, 23 nt, Homo sapiens
uuugcacuugcuccuucuauggc

SEQ ID NO: 110223 - RNA, 22 nt, Homo sapiens
uuuggcauauuuuaagcugguu

SEQ ID NO: 110224 - RNA, 22 nt, Homo sapiens
uuugguuuuuguuaucacucau

SEQ ID NO: 110225 - RNA, 22 nt, Homo sapiens
uuuguaauccuauuccaaagga

SEQ ID NO: 110226 - RNA, 18 nt, Homo sapiens
uuuguacuuuuucuaaug

SEQ ID NO: 110227 - RNA, 21 nt, Homo sapiens
uuuguccaccuguguucacca

SEQ ID NO: 110228 - RNA, 22 nt, Homo sapiens
uuuugcaccauccuaauaguau

SEQ ID NO: 110229 - RNA, 20 nt, Homo sapiens
uuuugcacuccuacuaaggu

SEQ ID NO: 110230 - RNA, 22 nt, Homo sapiens
uuuugcacuguuuuaucugaca

SEQ ID NO: 110231 - RNA, 22 nt, Homo sapiens
uuuuggcuuuuccucagcaagc

SEQ ID NO: 110232 - RNA, 21 nt, Homo sapiens
uuuuugguggucauggauaga

SEQ ID NO: 110233 - RNA, 22 nt, Homo sapiens
augguauuuugugauaccuugu

SEQ ID NO: 110234 - RNA, 22 nt, Homo sapiens
auuaaguugugccugaaaacuu

SEQ ID NO: 110235 - RNA, 22 nt, Homo sapiens
auugcacucuagccugggugac

SEQ ID NO: 110236 - RNA, 22 nt, Homo sapiens
auuguacuccagccugggugac

SEQ ID NO: 110237 - RNA, 22 nt, Homo sapiens
auuugacacugagagccucagu

SEQ ID NO: 110238 - RNA, 22 nt, Homo sapiens
auuuuugguugguaggcuauua

SEQ ID NO: 110239 - RNA, 22 nt, Homo sapiens
caaaggcuucugaaacugcaga

SEQ ID NO: 110240 - RNA, 22 nt, Homo sapiens
cagauaguuguagauaugcagc

SEQ ID NO: 110241 - RNA, 22 nt, Homo sapiens
cauggccuuuggaaugugucua

SEQ ID NO: 110242 - RNA, 22 nt, Homo sapiens
cauugcaaugaggucuugcagu

SEQ ID NO: 110243 - RNA, 22 nt, Homo sapiens
cauugguuccaguuuguccuua

SEQ ID NO: 110244 - RNA, 22 nt, Homo sapiens
cauugguuggacaguucucucu

SEQ ID NO: 110245 - RNA, 22 nt, Homo sapiens
ccaagugcuuaaaauuucauuu

SEQ ID NO: 110246 - RNA, 22 nt, Homo sapiens
ccaguuuucaagauaaugguuu

SEQ ID NO: 110247 - RNA, 22 nt, Homo sapiens
cccagugguuacauaaggagua

SEQ ID NO: 110248 - RNA, 22 nt, Homo sapiens
cuaacacagggcaagucaggcu

SEQ ID NO: 110249 - RNA, 22 nt, Homo sapiens
cuagauuauccaacuuauuagc

SEQ ID NO: 110250 - RNA, 18 nt, Homo sapiens
cuaugccacuuuauauca

SEQ ID NO: 110251 - RNA, 19 nt, Homo sapiens
cuauugcacauagcugaag

SEQ ID NO: 110252 - RNA, 22 nt, Homo sapiens
cucaaagugcuaagauuaggcu

SEQ ID NO: 110253 - RNA, 20 nt, Homo sapiens
cucagugcacccccauaaaa

SEQ ID NO: 110254 - RNA, 22 nt, Homo sapiens
cucauugcaaucucugccuccc

SEQ ID NO: 110255 - RNA, 22 nt, Homo sapiens
cugacuuuagaacccaaaaagu

SEQ ID NO: 110256 - RNA, 22 nt, Homo sapiens
cugagaauguaaaugaagcuuu

SEQ ID NO: 110257 - RNA, 22 nt, Homo sapiens
cuggacguugaggcugcaguga

SEQ ID NO: 110258 - RNA, 22 nt, Homo sapiens
cuggagauauuggaagaaagaa

SEQ ID NO: 110259 - RNA, 22 nt, Homo sapiens
cuggagaucuugacauugaagu

SEQ ID NO: 110260 - RNA, 22 nt, Homo sapiens
cugucaucauuucuaugugcca

SEQ ID NO: 110261 - RNA, 22 nt, Homo sapiens
cuguuuguuuaggguacucaga

SEQ ID NO: 110262 - RNA, 22 nt, Homo sapiens
cuucuguuaguucugauaacuu

SEQ ID NO: 110263 - RNA, 21 nt, Homo sapiens
cuucuuggggcagggcagggu

SEQ ID NO: 110264 - RNA, 22 nt, Homo sapiens
cuugggcagugugcauguguau

SEQ ID NO: 110265 - RNA, 22 nt, Homo sapiens
cuuguuguggaggggagugcag

SEQ ID NO: 110266 - RNA, 22 nt, Homo sapiens
cuuuacacauccuaaccagugu

SEQ ID NO: 110267 - RNA, 20 nt, Homo sapiens
cuuuuagcagcagcaagaga

SEQ ID NO: 110268 - RNA, 20 nt, Homo sapiens
gaacugguguauguuuaacu

SEQ ID NO: 110269 - RNA, 22 nt, Homo sapiens
gaaucauuguuucuaaguuugu

SEQ ID NO: 110270 - RNA, 22 nt, Homo sapiens
gagaacauuuaagccacucagg

SEQ ID NO: 110271 - RNA, 22 nt, Homo sapiens
gagacggagucucgcucugucg

SEQ ID NO: 110272 - RNA, 22 nt, Homo sapiens
gagacggagucuugcucuguug

SEQ ID NO: 110273 - RNA, 23 nt, Homo sapiens
gagugcaaugacaugaucucgga

SEQ ID NO: 110274 - RNA, 22 nt, Homo sapiens
gagugcaauggcaagaucuugg

SEQ ID NO: 110275 - RNA, 22 nt, Homo sapiens
gaugcagcuaggauuugugaca

SEQ ID NO: 110276 - RNA, 22 nt, Homo sapiens
gauuccauuuguggcuauuuac

SEQ ID NO: 110277 - RNA, 22 nt, Homo sapiens
gauugcaauuuaggugagagag

SEQ ID NO: 110278 - RNA, 22 nt, Homo sapiens
gcacaaugccugacgaguccug

SEQ ID NO: 110279 - RNA, 22 nt, Homo sapiens
gcagucacagggagauggugac

SEQ ID NO: 110280 - RNA, 22 nt, Homo sapiens
gcccagauguuuggggucaugg

SEQ ID NO: 110281 - RNA, 22 nt, Homo sapiens
gcuaaggcaggagcauugcuug

SEQ ID NO: 110282 - RNA, 23 nt, Homo sapiens
gcuaggagagaugaaacacaggu

SEQ ID NO: 110283 - RNA, 22 nt, Homo sapiens
gcugguauuacaggcaugagcc

SEQ ID NO: 110284 - RNA, 22 nt, Homo sapiens
gcuguauugacuuuguaucaua

SEQ ID NO: 110285 - RNA, 22 nt, Homo sapiens
ggcacgguggcucacaccugua

SEQ ID NO: 110286 - RNA, 22 nt, Homo sapiens
gggcagaugucuggacaccuca

SEQ ID NO: 110287 - RNA, 22 nt, Homo sapiens
ccaguuuucccagcaccauuaa

SEQ ID NO: 110288 - RNA, 17 nt, Homo sapiens
ccaguuuucccucagug

SEQ ID NO: 110289 - RNA, 22 nt, Homo sapiens
ccaguuuucucacuguugcagu

SEQ ID NO: 110290 - RNA, 22 nt, Homo sapiens
ccauugcacuccagccucggca

SEQ ID NO: 110291 - RNA, 21 nt, Homo sapiens
cccugguguuuggaguuugag

SEQ ID NO: 110292 - RNA, 22 nt, Homo sapiens
ccuucauccuccagcaggcuag

SEQ ID NO: 110293 - RNA, 22 nt, Homo sapiens
cuaaagauagugacaugauuug

SEQ ID NO: 110294 - RNA, 22 nt, Homo sapiens
cuaaaguagccaggacugcagg

SEQ ID NO: 110295 - RNA, 22 nt, Homo sapiens
cuacaguuauguuuuaaaugug

SEQ ID NO: 110296 - RNA, 22 nt, Homo sapiens
cuacaguucuuaauuaaguagu

SEQ ID NO: 110297 - RNA, 22 nt, Homo sapiens
cuacccuuaaguuucugugggg

SEQ ID NO: 110298 - RNA, 22 nt, Homo sapiens
cucaggcacucugauuccagug

SEQ ID NO: 110299 - RNA, 22 nt, Homo sapiens
cucaguuuugccuuguuuaagg

SEQ ID NO: 110300 - RNA, 20 nt, Homo sapiens
cuccuucauuccuuuggacc

SEQ ID NO: 110301 - RNA, 22 nt, Homo sapiens
cugaauagagcacacugauggg

SEQ ID NO: 110302 - RNA, 18 nt, Homo sapiens
cugagucauuccuggguc

SEQ ID NO: 110303 - RNA, 22 nt, Homo sapiens
cuggcagugcuuguuauccugg

SEQ ID NO: 110304 - RNA, 22 nt, Homo sapiens
cuggcucugagguguuuagggc

SEQ ID NO: 110305 - RNA, 22 nt, Homo sapiens
cuggugagaugucuuuccucuu

SEQ ID NO: 110306 - RNA, 22 nt, Homo sapiens
cuuaaagcgaauauugguggua

SEQ ID NO: 110307 - RNA, 20 nt, Homo sapiens
cuuaaugcagcauuucucag

SEQ ID NO: 110308 - RNA, 22 nt, Homo sapiens
cuuggcauuguguugauagaag

SEQ ID NO: 110309 - RNA, 22 nt, Homo sapiens
cuuugauuauaaaaggguguuu

SEQ ID NO: 110310 - RNA, 22 nt, Homo sapiens
cuuugcacaucucugcuuuccc

SEQ ID NO: 110311 - RNA, 22 nt, Homo sapiens
cuuuggagaaaaguucuugggc

SEQ ID NO: 110312 - RNA, 22 nt, Homo sapiens
cuuugguugugcucuccacuuu

SEQ ID NO: 110313 - RNA, 22 nt, Homo sapiens
cuuuuugguagagcaggugugc

SEQ ID NO: 110314 - RNA, 22 nt, Homo sapiens
gaaaugcucauuuuggauccuu

SEQ ID NO: 110315 - RNA, 22 nt, Homo sapiens
gaaggagcuuaucugccauuuc

SEQ ID NO: 110316 - RNA, 22 nt, Homo sapiens
gaaucauuggguugauucaaga

SEQ ID NO: 110317 - RNA, 22 nt, Homo sapiens
gacagugugauacuuagucuca

SEQ ID NO: 110318 - RNA, 19 nt, Homo sapiens
gacuccagaguugugugcu

SEQ ID NO: 110319 - RNA, 22 nt, Homo sapiens
gagaacauuaauaguuaauuuu

SEQ ID NO: 110320 - RNA, 22 nt, Homo sapiens
gagacggagucucgcucuguca

SEQ ID NO: 110321 - RNA, 22 nt, Homo sapiens
gagauaaauaggucacaguucu

SEQ ID NO: 110322 - RNA, 22 nt, Homo sapiens
gagugcaauggcagaucuccgc

SEQ ID NO: 110323 - RNA, 22 nt, Homo sapiens
gagugcaauggcgcgaucucgg

SEQ ID NO: 110324 - RNA, 22 nt, Homo sapiens
gaguucaaaucucagcucuguu

SEQ ID NO: 110325 - RNA, 22 nt, Homo sapiens
gcaauacugacagcauuaguuu

SEQ ID NO: 110326 - RNA, 22 nt, Homo sapiens
gcaccguggaguauggggagga

SEQ ID NO: 110327 - RNA, 22 nt, Homo sapiens
gcagugugauguuuuaaucuau

SEQ ID NO: 110328 - RNA, 22 nt, Homo sapiens
gcaucacagcuccugugcuggc

SEQ ID NO: 110329 - RNA, 22 nt, Homo sapiens
gccaagaugcugcccacagaca

SEQ ID NO: 110330 - RNA, 22 nt, Homo sapiens
gccaagauugguuuaauauucc

SEQ ID NO: 110331 - RNA, 22 nt, Homo sapiens
gcuuuggauaaaugucaguuua

SEQ ID NO: 110332 - RNA, 22 nt, Homo sapiens
ggaguaaaagaguaggaggaau

SEQ ID NO: 110333 - RNA, 22 nt, Homo sapiens
ggcaaguucuaaugauuagaau

SEQ ID NO: 110334 - RNA, 22 nt, Homo sapiens
ggcaaguugcuauucuuuaaug

SEQ ID NO: 110335 - RNA, 22 nt, Homo sapiens
ggguucccuucuggcucagggu

SEQ ID NO: 110336 - RNA, 22 nt, Homo sapiens
guaagagcauguaguggcucua

SEQ ID NO: 110337 - RNA, 22 nt, Homo sapiens
guauacuucugaaaauagcuau

SEQ ID NO: 110338 - RNA, 22 nt, Homo sapiens
guaucauuggcauguaaccaga

SEQ ID NO: 110339 - RNA, 22 nt, Homo sapiens
guauuguacuacaagcucuuua

SEQ ID NO: 110340 - RNA, 22 nt, Homo sapiens
gucagcuuuuccuuacuuuagg

SEQ ID NO: 110341 - RNA, 22 nt, Homo sapiens
gucucauugcaguuagaccugu

SEQ ID NO: 110342 - RNA, 22 nt, Homo sapiens
guggaaaaguaguugcgguuuu

SEQ ID NO: 110343 - RNA, 22 nt, Homo sapiens
guggagacaaaggcugagugag

SEQ ID NO: 110344 - RNA, 22 nt, Homo sapiens
guggcauuucccaaaguauucu

SEQ ID NO: 110345 - RNA, 19 nt, Homo sapiens
gugguauuaccuuuugauu

SEQ ID NO: 110346 - RNA, 22 nt, Homo sapiens
guguaaaucugcugugaacauu

SEQ ID NO: 110347 - RNA, 21 nt, Homo sapiens
gugucaugguugacuuuggca

SEQ ID NO: 110348 - RNA, 22 nt, Homo sapiens
guguugcacauucuguggaugu

SEQ ID NO: 110349 - RNA, 22 nt, Homo sapiens
guuauguuaaauuguuguaugc

SEQ ID NO: 110350 - RNA, 22 nt, Homo sapiens
guucaucagggauacuggccug

SEQ ID NO: 110351 - RNA, 22 nt, Homo sapiens
guugcaaaguaauugugguuuu

SEQ ID NO: 110352 - RNA, 22 nt, Homo sapiens
guugccuaggcuggagugcagu

SEQ ID NO: 110353 - RNA, 22 nt, Homo sapiens
uaaaagucaucacaacuggagu

SEQ ID NO: 110354 - RNA, 22 nt, Homo sapiens
uaaaccacguuuacauuugaga

SEQ ID NO: 110355 - RNA, 22 nt, Homo sapiens
uaaagcuagagcuggaguggca

SEQ ID NO: 110356 - RNA, 21 nt, Homo sapiens
uaaagcuuagcuauaguggcu

SEQ ID NO: 110357 - RNA, 22 nt, Homo sapiens
uaaaugcuuaauugaaugugga

SEQ ID NO: 110358 - RNA, 22 nt, Homo sapiens
uaacuaaagagaagucaauguc

SEQ ID NO: 110359 - RNA, 22 nt, Homo sapiens
uaagacuguguaauuuaugaag

SEQ ID NO: 110360 - RNA, 22 nt, Homo sapiens
uaagguuacaaaggacuucaua

SEQ ID NO: 110361 - RNA, 23 nt, Homo sapiens
uaaguucaucucuaauaggugga

SEQ ID NO: 110362 - RNA, 22 nt, Homo sapiens
uaauacuagugaauagcaggau

SEQ ID NO: 110363 - RNA, 22 nt, Homo sapiens
uacauagucuucuuuugguuau

SEQ ID NO: 110364 - RNA, 22 nt, Homo sapiens
uacuuuguagagugugagaauu

SEQ ID NO: 110365 - RNA, 18 nt, Homo sapiens
uagaauauaggucauucu

SEQ ID NO: 110366 - RNA, 22 nt, Homo sapiens
uagcagucaagauagucauuau

SEQ ID NO: 110367 - RNA, 21 nt, Homo sapiens
uagcugcacccaggccuccuu

SEQ ID NO: 110368 - RNA, 22 nt, Homo sapiens
uagcugcacuuacaagugagaa

SEQ ID NO: 110369 - RNA, 22 nt, Homo sapiens
uaggacauugcccuuguggaga

SEQ ID NO: 110370 - RNA, 22 nt, Homo sapiens
uagguaguugugggcuugaaug

SEQ ID NO: 110371 - RNA, 22 nt, Homo sapiens
uaguaaacauuuuucuaucauu

SEQ ID NO: 110372 - RNA, 22 nt, Homo sapiens
uagugcuguaauucuaaugaaa

SEQ ID NO: 110373 - RNA, 22 nt, Homo sapiens
uagugcugugauuaacauaaug

SEQ ID NO: 110374 - RNA, 22 nt, Homo sapiens
uaguggucccccagucccagcu

SEQ ID NO: 110375 - RNA, 22 nt, Homo sapiens
uaucacagcaaggacccauuau

SEQ ID NO: 110376 - RNA, 22 nt, Homo sapiens
uaucagagcugucagccuaccu

SEQ ID NO: 110377 - RNA, 22 nt, Homo sapiens
uaucagaguuacacugaagacu

SEQ ID NO: 110378 - RNA, 20 nt, Homo sapiens
uaugacaaagccuagugagu

SEQ ID NO: 110379 - RNA, 22 nt, Homo sapiens
uaugacuuuugaauacagaugg

SEQ ID NO: 110380 - RNA, 22 nt, Homo sapiens
uaugagcacauauguaucuaug

SEQ ID NO: 110381 - RNA, 22 nt, Homo sapiens
uauggauuuucagauucuuauc

SEQ ID NO: 110382 - RNA, 22 nt, Homo sapiens
uauugcaaauggugaucccagg

SEQ ID NO: 110383 - RNA, 22 nt, Homo sapiens
uauugcaauuggcagagugcua

SEQ ID NO: 110384 - RNA, 22 nt, Homo sapiens
uauugccugucuccaaaaauca

SEQ ID NO: 110385 - RNA, 22 nt, Homo sapiens
uauugcucaugcauuuaauuuc

SEQ ID NO: 110386 - RNA, 22 nt, Homo sapiens
uauugcuggcucugucuucauu

SEQ ID NO: 110387 - RNA, 22 nt, Homo sapiens
uauuugcacucccaucauggug

SEQ ID NO: 110388 - RNA, 22 nt, Homo sapiens
ucaaugcaugugacaaagagua

SEQ ID NO: 110389 - RNA, 22 nt, Homo sapiens
ucaccgugaauuaacaacacuu

SEQ ID NO: 110390 - RNA, 22 nt, Homo sapiens
ucaccguguaucauuucauccg

SEQ ID NO: 110391 - RNA, 22 nt, Homo sapiens
ucacugcacucuccgccuugcg

SEQ ID NO: 110392 - RNA, 22 nt, Homo sapiens
ucaguagagacaggauuucacc

SEQ ID NO: 110393 - RNA, 22 nt, Homo sapiens
ucagugggcuauguaauuaacu

SEQ ID NO: 110394 - RNA, 22 nt, Homo sapiens
ucauugguagcucauggaaccg

SEQ ID NO: 110395 - RNA, 18 nt, Homo sapiens
ucauuggugagcaccucc

SEQ ID NO: 110396 - RNA, 22 nt, Homo sapiens
ucauugguucuggguguuguug

SEQ ID NO: 110397 - RNA, 22 nt, Homo sapiens
uccagaguggugaugcuggggc

SEQ ID NO: 110398 - RNA, 22 nt, Homo sapiens
ucccacugucuucucgugcucg

SEQ ID NO: 110399 - RNA, 22 nt, Homo sapiens
ucccagugaaaccccaccuuca

SEQ ID NO: 110400 - RNA, 22 nt, Homo sapiens
ucccagugcuaugcaaaagccu

SEQ ID NO: 110401 - RNA, 22 nt, Homo sapiens
ucccauguagcuaggauuacag

SEQ ID NO: 110402 - RNA, 18 nt, Homo sapiens
ucccuuuguagaugaccc

SEQ ID NO: 110403 - RNA, 22 nt, Homo sapiens
uccugcauucauccugguguug

SEQ ID NO: 110404 - RNA, 22 nt, Homo sapiens
ucucacagaguugaacuuucuu

SEQ ID NO: 110405 - RNA, 18 nt, Homo sapiens
ucucacagcaaucuguca

SEQ ID NO: 110406 - RNA, 22 nt, Homo sapiens
ucugagucaucacaaaugaugc

SEQ ID NO: 110407 - RNA, 23 nt, Homo sapiens
ucugauguuauaaaauucuuugg

SEQ ID NO: 110408 - RNA, 22 nt, Homo sapiens
ucugucuuguccucacccuaga

SEQ ID NO: 110409 - RNA, 22 nt, Homo sapiens
ucuuuguugcauaggcuuguuc

SEQ ID NO: 110410 - RNA, 22 nt, Homo sapiens
ucuuuugggccucuugucagac

SEQ ID NO: 110411 - RNA, 22 nt, Homo sapiens
ugaaaugaucaguuugguuacu

SEQ ID NO: 110412 - RNA, 22 nt, Homo sapiens
ugaaaugccuuuaaugaauuua

SEQ ID NO: 110413 - RNA, 22 nt, Homo sapiens
ugaaguaauguuuuauucuauu

SEQ ID NO: 110414 - RNA, 21 nt, Homo sapiens
ugacagaaaauugaguuugcu

SEQ ID NO: 110415 - RNA, 22 nt, Homo sapiens
ugacaggagauuaugugauguu

SEQ ID NO: 110416 - RNA, 22 nt, Homo sapiens
ugacaucugcuugugcccagga

SEQ ID NO: 110417 - RNA, 22 nt, Homo sapiens
ugaccacagaaagugagggagc

SEQ ID NO: 110418 - RNA, 22 nt, Homo sapiens
ugacuauaucucuguauaaacu

SEQ ID NO: 110419 - RNA, 22 nt, Homo sapiens
ugacucuagagcugccuguggc

SEQ ID NO: 110420 - RNA, 20 nt, Homo sapiens
ugagaacaugugguauuugg

SEQ ID NO: 110421 - RNA, 22 nt, Homo sapiens
ugagacggagucucgcucucua

SEQ ID NO: 110422 - RNA, 22 nt, Homo sapiens
ugagacggagucucgcucuguu

SEQ ID NO: 110423 - RNA, 22 nt, Homo sapiens
ugagacggagucucgcuguguc

SEQ ID NO: 110424 - RNA, 22 nt, Homo sapiens
ugagacggagucuugcucuguc

SEQ ID NO: 110425 - RNA, 22 nt, Homo sapiens
ugagaugaacuugauuguuuua

SEQ ID NO: 110426 - RNA, 22 nt, Homo sapiens
ugagaugaguugcgcucugucg

SEQ ID NO: 110427 - RNA, 22 nt, Homo sapiens
ugagaugaguugcuggcucuga

SEQ ID NO: 110428 - RNA, 22 nt, Homo sapiens
ugagauggaguuucgcucuugu

SEQ ID NO: 110429 - RNA, 22 nt, Homo sapiens
ugagcucagcuuucuuuuucac

SEQ ID NO: 110430 - RNA, 18 nt, Homo sapiens
ugaggaaaggguuugcua

SEQ ID NO: 110431 - RNA, 22 nt, Homo sapiens
ugaguuagguguuuuaaauaua

SEQ ID NO: 110432 - RNA, 22 nt, Homo sapiens
ugauaagugagauagcaaguga

SEQ ID NO: 110433 - RNA, 22 nt, Homo sapiens
ugauaauguuaggcuuuauuca

SEQ ID NO: 110434 - RNA, 20 nt, Homo sapiens
ugaugcaaaucuuuaaaagu

SEQ ID NO: 110435 - RNA, 22 nt, Homo sapiens
ugcaacacauugccccugcucu

SEQ ID NO: 110436 - RNA, 18 nt, Homo sapiens
ugcauauguugaaccagc

SEQ ID NO: 110437 - RNA, 22 nt, Homo sapiens
ugcugcaaucucggcacuuugg

SEQ ID NO: 110438 - RNA, 19 nt, Homo sapiens
ugcugcauugugaccuugc

SEQ ID NO: 110439 - RNA, 22 nt, Homo sapiens
uggcaccugacuccgagaugca

SEQ ID NO: 110440 - RNA, 22 nt, Homo sapiens
uggcagauaggauacaggacua

SEQ ID NO: 110441 - RNA, 22 nt, Homo sapiens
uggcagaugagccgcgcuccaa

SEQ ID NO: 110442 - RNA, 22 nt, Homo sapiens
uggcagaugggugagcuggaga

SEQ ID NO: 110443 - RNA, 23 nt, Homo sapiens
uggcauuuuaguuagcuucagug

SEQ ID NO: 110444 - RNA, 22 nt, Homo sapiens
uggcucuguuuguuaacuagac

SEQ ID NO: 110445 - RNA, 22 nt, Homo sapiens
ugggaagcugcauuuuaacaag

SEQ ID NO: 110446 - RNA, 22 nt, Homo sapiens
ugggaagcugcugaacuacagu

SEQ ID NO: 110447 - RNA, 22 nt, Homo sapiens
ugggaugaugaaaaggcuuucu

SEQ ID NO: 110448 - RNA, 22 nt, Homo sapiens
ugggcaagugacuuggcuucuc

SEQ ID NO: 110449 - RNA, 22 nt, Homo sapiens
uggggcaaugaacauuuuugca

SEQ ID NO: 110450 - RNA, 22 nt, Homo sapiens
uggucagaaaauuacuugauau

SEQ ID NO: 110451 - RNA, 22 nt, Homo sapiens
uggucaguugaguccuugccaa

SEQ ID NO: 110452 - RNA, 22 nt, Homo sapiens
uggucauggggcagcugacacu

SEQ ID NO: 110453 - RNA, 20 nt, Homo sapiens
uggugucuuggaaagagcuc

SEQ ID NO: 110454 - RNA, 21 nt, Homo sapiens
uguagcagcaugauucauagu

SEQ ID NO: 110455 - RNA, 20 nt, Homo sapiens
uguagguguacaguaaggag

SEQ ID NO: 110456 - RNA, 22 nt, Homo sapiens
uguagguguacauacaugguua

SEQ ID NO: 110457 - RNA, 22 nt, Homo sapiens
ugucaaagagacaucugcacuc

SEQ ID NO: 110458 - RNA, 22 nt, Homo sapiens
ugucaguggacugugaaaggca

SEQ ID NO: 110459 - RNA, 22 nt, Homo sapiens
ugucaguguaugagccccggau

SEQ ID NO: 110460 - RNA, 19 nt, Homo sapiens
ugugaacaucacagagugu

SEQ ID NO: 110461 - RNA, 22 nt, Homo sapiens
ugugaacauuuuguauauauua

SEQ ID NO: 110462 - RNA, 22 nt, Homo sapiens
ugugacugguugucccacuuuc

SEQ ID NO: 110463 - RNA, 22 nt, Homo sapiens
ugugaucaugguauuaaucugc

SEQ ID NO: 110464 - RNA, 22 nt, Homo sapiens
ugugucacugcacuccagccug

SEQ ID NO: 110465 - RNA, 22 nt, Homo sapiens
uguucuugagccuuuagaccua

SEQ ID NO: 110466 - RNA, 22 nt, Homo sapiens
uguuugcuguuuucuccaauga

SEQ ID NO: 110467 - RNA, 22 nt, Homo sapiens
uuaagaagugauuuuccucauu

SEQ ID NO: 110468 - RNA, 21 nt, Homo sapiens
uuaaguaauuacccaacucuc

SEQ ID NO: 110469 - RNA, 21 nt, Homo sapiens
uuaaugcuaugcagaaaaucu

SEQ ID NO: 110470 - RNA, 22 nt, Homo sapiens
uuaauguaucuaucacaucaca

SEQ ID NO: 110471 - RNA, 22 nt, Homo sapiens
uuagaacaguguuugccucgcu

SEQ ID NO: 110472 - RNA, 22 nt, Homo sapiens
aaaaguucuuugagccuugaca

SEQ ID NO: 110473 - RNA, 19 nt, Homo sapiens
aaaguacucugaugccucu

SEQ ID NO: 110474 - RNA, 22 nt, Homo sapiens
aaaugcacaaagauuuugcacu

SEQ ID NO: 110475 - RNA, 18 nt, Homo sapiens
aaauucugucccuucuuc

SEQ ID NO: 110476 - RNA, 22 nt, Homo sapiens
aaauugcauugagcugcuuauu

SEQ ID NO: 110477 - RNA, 22 nt, Homo sapiens
aacacuggcugcucgaguucuc

SEQ ID NO: 110478 - RNA, 20 nt, Homo sapiens
aacaguguguaaguuuccuu

SEQ ID NO: 110479 - RNA, 22 nt, Homo sapiens
aagcaaacaucagcuugguuaa

SEQ ID NO: 110480 - RNA, 22 nt, Homo sapiens
aagcacaauuucaccuucuugu

SEQ ID NO: 110481 - RNA, 20 nt, Homo sapiens
aagcauggguuuuaggguca

SEQ ID NO: 110482 - RNA, 22 nt, Homo sapiens
aaggcuguuguguaauaggauu

SEQ ID NO: 110483 - RNA, 22 nt, Homo sapiens
aagugaauucauuguguuauau

SEQ ID NO: 110484 - RNA, 22 nt, Homo sapiens
aagugcuguaugggagccuagg

SEQ ID NO: 110485 - RNA, 21 nt, Homo sapiens
aauaaagcaaccuuaugccau

SEQ ID NO: 110486 - RNA, 22 nt, Homo sapiens
aauaaagcauggcuacuccaua

SEQ ID NO: 110487 - RNA, 22 nt, Homo sapiens
aauacugaaaguauuuucaaau

SEQ ID NO: 110488 - RNA, 22 nt, Homo sapiens
aauuacauggcaauugggaaau

SEQ ID NO: 110489 - RNA, 22 nt, Homo sapiens
acaagacuucuuguauucuagu

SEQ ID NO: 110490 - RNA, 22 nt, Homo sapiens
acaguacuguuguuugcugcca

SEQ ID NO: 110491 - RNA, 22 nt, Homo sapiens
acaguagaaaacaauggauuug

SEQ ID NO: 110492 - RNA, 22 nt, Homo sapiens
acagugcuuucaauguucagua

SEQ ID NO: 110493 - RNA, 22 nt, Homo sapiens
acauugcauauggcacccucuu

SEQ ID NO: 110494 - RNA, 22 nt, Homo sapiens
acauugcucuuaccaaguuugu

SEQ ID NO: 110495 - RNA, 22 nt, Homo sapiens
gaaucacaguuauuagagcagc

SEQ ID NO: 110496 - RNA, 22 nt, Homo sapiens
gacaccugguguggaacuggag

SEQ ID NO: 110497 - RNA, 22 nt, Homo sapiens
gacagacacaauugauccauga

SEQ ID NO: 110498 - RNA, 22 nt, Homo sapiens
gagauaggauucacuuucaugu

SEQ ID NO: 110499 - RNA, 22 nt, Homo sapiens
gagcaguugagagugcuggcca

SEQ ID NO: 110500 - RNA, 22 nt, Homo sapiens
gaggacauuaugcuaaguggaa

SEQ ID NO: 110501 - RNA, 22 nt, Homo sapiens
gagugcaauggcgcgaucuggg

SEQ ID NO: 110502 - RNA, 22 nt, Homo sapiens
gagugcaauggugccaucucgg

SEQ ID NO: 110503 - RNA, 22 nt, Homo sapiens
gagugcaauggugcuaucucgg

SEQ ID NO: 110504 - RNA, 22 nt, Homo sapiens
gauaaaguauuggguacuaugc

SEQ ID NO: 110505 - RNA, 22 nt, Homo sapiens
gauuuguuggccugugagcuag

SEQ ID NO: 110506 - RNA, 21 nt, Homo sapiens
gcaaacauccuuugaugccag

SEQ ID NO: 110507 - RNA, 22 nt, Homo sapiens
gcagcacaugacuguauguaua

SEQ ID NO: 110508 - RNA, 22 nt, Homo sapiens
gcucaguuuccucagcugcaaa

SEQ ID NO: 110509 - RNA, 21 nt, Homo sapiens
ggaaaguuaaggaaauacccc

SEQ ID NO: 110510 - RNA, 22 nt, Homo sapiens
ggaaugggauuugaagucuggc

SEQ ID NO: 110511 - RNA, 22 nt, Homo sapiens
ggcacgguggcucacgccugua

SEQ ID NO: 110512 - RNA, 22 nt, Homo sapiens
gggaaaaugucuauugaaugaa

SEQ ID NO: 110513 - RNA, 22 nt, Homo sapiens
gggggagugugguacccagcau

SEQ ID NO: 110514 - RNA, 22 nt, Homo sapiens
ggguucccugaugagaguuagu

SEQ ID NO: 110515 - RNA, 22 nt, Homo sapiens
gguauuuaaaguaccugucugc

SEQ ID NO: 110516 - RNA, 22 nt, Homo sapiens
ggucagugcauucuaaaggcaa

SEQ ID NO: 110517 - RNA, 22 nt, Homo sapiens
ggugaauuguaccccauaggau

SEQ ID NO: 110518 - RNA, 18 nt, Homo sapiens
guaaauguaucuauugcc

SEQ ID NO: 110519 - RNA, 22 nt, Homo sapiens
guagguaaguacuucuggugag

SEQ ID NO: 110520 - RNA, 22 nt, Homo sapiens
guauacaugucaaaacucacau

SEQ ID NO: 110521 - RNA, 22 nt, Homo sapiens
guauagaucguagaccaauaaa

SEQ ID NO: 110522 - RNA, 21 nt, Homo sapiens
guauggcauugauuaguuacu

SEQ ID NO: 110523 - RNA, 22 nt, Homo sapiens
gucaagagaacuuucuaucacu

SEQ ID NO: 110524 - RNA, 22 nt, Homo sapiens
gucacugccugaggcugaugca

SEQ ID NO: 110525 - RNA, 22 nt, Homo sapiens
gucuguuugauccagaucaaaa

SEQ ID NO: 110526 - RNA, 20 nt, Homo sapiens
gucuugcuccguugcccagg

SEQ ID NO: 110527 - RNA, 22 nt, Homo sapiens
gucuuggcaugugcagcuggga

SEQ ID NO: 110528 - RNA, 22 nt, Homo sapiens
gugaaaugaaucuggaaauauu

SEQ ID NO: 110529 - RNA, 22 nt, Homo sapiens
gugagggaugugaaaaagguca

SEQ ID NO: 110530 - RNA, 22 nt, Homo sapiens
gugcaaccaucaccacugacuc

SEQ ID NO: 110531 - RNA, 22 nt, Homo sapiens
gugcaaguguaauacagcuagg

SEQ ID NO: 110532 - RNA, 22 nt, Homo sapiens
gugcuuguauuuaaaucaugug

SEQ ID NO: 110533 - RNA, 22 nt, Homo sapiens
guggaaguuaagugacuuucug

SEQ ID NO: 110534 - RNA, 22 nt, Homo sapiens
guggucagaaaucucaguggca

SEQ ID NO: 110535 - RNA, 22 nt, Homo sapiens
gugucaugggcauguccuuaac

SEQ ID NO: 110536 - RNA, 21 nt, Homo sapiens
gugugcuugaauucagcuguc

SEQ ID NO: 110537 - RNA, 22 nt, Homo sapiens
guuagguagaaguuuacuuuga

SEQ ID NO: 110538 - RNA, 22 nt, Homo sapiens
guuauuguccauuuauuuagca

SEQ ID NO: 110539 - RNA, 22 nt, Homo sapiens
guucacucuggagaauauugac

SEQ ID NO: 110540 - RNA, 22 nt, Homo sapiens
guucaguuuuaaagggaaauug

SEQ ID NO: 110541 - RNA, 23 nt, Homo sapiens
guucaucagggauauuggccuga

SEQ ID NO: 110542 - RNA, 22 nt, Homo sapiens
guugccuaggcuggcgugcagu

SEQ ID NO: 110543 - RNA, 22 nt, Homo sapiens
guugcucaggcuggagugcagu

SEQ ID NO: 110544 - RNA, 22 nt, Homo sapiens
guuuuuggggucacuauuaccg

SEQ ID NO: 110545 - RNA, 22 nt, Homo sapiens
uaaagccagugauuaugucucu

SEQ ID NO: 110546 - RNA, 22 nt, Homo sapiens
uaaagcugaaaugauuaugaca

SEQ ID NO: 110547 - RNA, 22 nt, Homo sapiens
uaacagcauuugugucuaguag

SEQ ID NO: 110548 - RNA, 22 nt, Homo sapiens
uaacauugucuugcuuaguuuu

SEQ ID NO: 110549 - RNA, 22 nt, Homo sapiens
uaagacugccccagacagcaag

SEQ ID NO: 110550 - RNA, 22 nt, Homo sapiens
uaagacuguuggcaauuuuugc

SEQ ID NO: 110551 - RNA, 22 nt, Homo sapiens
uaaguacuuuacagacauuauc

SEQ ID NO: 110552 - RNA, 22 nt, Homo sapiens
aaagcuaccagauucuguugga

SEQ ID NO: 110553 - RNA, 20 nt, Homo sapiens
aaaggcugugagaacgagau

SEQ ID NO: 110554 - RNA, 22 nt, Homo sapiens
aaaguaauugcaguuuuugcaa

SEQ ID NO: 110555 - RNA, 22 nt, Homo sapiens
aaaguacucaguucaguuccgu

SEQ ID NO: 110556 - RNA, 22 nt, Homo sapiens
aaaguacugggauuggccgggu

SEQ ID NO: 110557 - RNA, 22 nt, Homo sapiens
aaaguucugcguuagggcuaaa

SEQ ID NO: 110558 - RNA, 22 nt, Homo sapiens
aaaguucuguugauagugcuga

SEQ ID NO: 110559 - RNA, 22 nt, Homo sapiens
aaaguucuugcugaaggauuau

SEQ ID NO: 110560 - RNA, 22 nt, Homo sapiens
aaaugcaucauuaggugauuuu

SEQ ID NO: 110561 - RNA, 22 nt, Homo sapiens
aaauugcacaaguggugauuug

SEQ ID NO: 110562 - RNA, 22 nt, Homo sapiens
aacagucaauugcugaugaccu

SEQ ID NO: 110563 - RNA, 22 nt, Homo sapiens
aacaguguuuuggguuuucugg

SEQ ID NO: 110564 - RNA, 22 nt, Homo sapiens
aagaggccuaggaaucuguauu

SEQ ID NO: 110565 - RNA, 22 nt, Homo sapiens
aagaggcuguaggauaaugccu

SEQ ID NO: 110566 - RNA, 21 nt, Homo sapiens
aagcaugguguaucuuuccau

SEQ ID NO: 110567 - RNA, 22 nt, Homo sapiens
aaggaauucaaauuuucucugg

SEQ ID NO: 110568 - RNA, 22 nt, Homo sapiens
aaggcauucucaaacuaguucu

SEQ ID NO: 110569 - RNA, 22 nt, Homo sapiens
aagggaauguuguggcugguug

SEQ ID NO: 110570 - RNA, 22 nt, Homo sapiens
aagguucuugcuugcaugacug

SEQ ID NO: 110571 - RNA, 19 nt, Homo sapiens
aaguacuugucuuuugaag

SEQ ID NO: 110572 - RNA, 22 nt, Homo sapiens
aaguauuagugaggauauggaa

SEQ ID NO: 110573 - RNA, 22 nt, Homo sapiens
aauaaagcuuugagcuuugcug

SEQ ID NO: 110574 - RNA, 22 nt, Homo sapiens
aauugguuaagauaagaucaua

SEQ ID NO: 110575 - RNA, 22 nt, Homo sapiens
acaaagugccuccuuuuagagu

SEQ ID NO: 110576 - RNA, 22 nt, Homo sapiens
acacaaugguaaguguuugugu

SEQ ID NO: 110577 - RNA, 20 nt, Homo sapiens
acaguagaagggauuucaaa

SEQ ID NO: 110578 - RNA, 19 nt, Homo sapiens
acagugcuuugucagaagc

SEQ ID NO: 110579 - RNA, 22 nt, Homo sapiens
acaguguuacuugauaguguau

SEQ ID NO: 110580 - RNA, 22 nt, Homo sapiens
acccaguguugggcagaacugu

SEQ ID NO: 110581 - RNA, 22 nt, Homo sapiens
accucagcccggggaaguugag

SEQ ID NO: 110582 - RNA, 22 nt, Homo sapiens
agaaccaaucccacauggauac

SEQ ID NO: 110583 - RNA, 22 nt, Homo sapiens
agagugcaauggcaccaucucg

SEQ ID NO: 110584 - RNA, 23 nt, Homo sapiens
agagugcaauggugccaucucgg

SEQ ID NO: 110585 - RNA, 22 nt, Homo sapiens
agauauguuuaguuucaaaaug

SEQ ID NO: 110586 - RNA, 22 nt, Homo sapiens
agaugauguuucuggcacauga

SEQ ID NO: 110587 - RNA, 22 nt, Homo sapiens
agauguuguucaucugauuguu

SEQ ID NO: 110588 - RNA, 22 nt, Homo sapiens
agcaagauuguucccauuuucu

SEQ ID NO: 110589 - RNA, 22 nt, Homo sapiens
agcagcaauuuuguaugguuua

SEQ ID NO: 110590 - RNA, 19 nt, Homo sapiens
agcaguguggagauuucuc

SEQ ID NO: 110591 - RNA, 22 nt, Homo sapiens
agccccauuuguugaaaagacg

SEQ ID NO: 110592 - RNA, 20 nt, Homo sapiens
agcugcagauauaaauccgc

SEQ ID NO: 110593 - RNA, 22 nt, Homo sapiens
aggacacugagcaugggagguu

SEQ ID NO: 110594 - RNA, 22 nt, Homo sapiens
aggacacugauagucuuuggca

SEQ ID NO: 110595 - RNA, 22 nt, Homo sapiens
aggcagucugaguuuugaaagg

SEQ ID NO: 110596 - RNA, 22 nt, Homo sapiens
aguaacauuucuaguagagagu

SEQ ID NO: 110597 - RNA, 22 nt, Homo sapiens
aguauugcuaauaagagauuug

SEQ ID NO: 110598 - RNA, 22 nt, Homo sapiens
agucagugcauaagaaugaagu

SEQ ID NO: 110599 - RNA, 22 nt, Homo sapiens
agugcaauggcgugaucuuggc

SEQ ID NO: 110600 - RNA, 22 nt, Homo sapiens
agugcacucuuuccucucuuac

SEQ ID NO: 110601 - RNA, 22 nt, Homo sapiens
aguucaaugcucuuucuacuau

SEQ ID NO: 110602 - RNA, 22 nt, Homo sapiens
auaaaguucugcuggcauauau

SEQ ID NO: 110603 - RNA, 22 nt, Homo sapiens
auaaaugcuuccagucauuaaa

SEQ ID NO: 110604 - RNA, 22 nt, Homo sapiens
auaagagcaggcuucuggccag

SEQ ID NO: 110605 - RNA, 22 nt, Homo sapiens
auagaaucaucugugcacuagu

SEQ ID NO: 110606 - RNA, 23 nt, Homo sapiens
auauaguagaugugcaguaacau

SEQ ID NO: 110607 - RNA, 22 nt, Homo sapiens
auaugcuaauuuuuagucgagc

SEQ ID NO: 110608 - RNA, 22 nt, Homo sapiens
aucaagcugcuuguuugaaucu

SEQ ID NO: 110609 - RNA, 22 nt, Homo sapiens
aucagagugaauaaugacaaaa

SEQ ID NO: 110610 - RNA, 22 nt, Homo sapiens
aucauguaguaagacacauuua

SEQ ID NO: 110611 - RNA, 22 nt, Homo sapiens
augaaaucacugugaugcccua

SEQ ID NO: 110612 - RNA, 22 nt, Homo sapiens
augaaauugcuaucgcaguacu

SEQ ID NO: 110613 - RNA, 22 nt, Homo sapiens
augaagauguugccuuuuuaau

SEQ ID NO: 110614 - RNA, 22 nt, Homo sapiens
augagcaucaccagaaucaaua

SEQ ID NO: 110615 - RNA, 22 nt, Homo sapiens
augagcuccucaaggucagaga

SEQ ID NO: 110616 - RNA, 22 nt, Homo sapiens
augaggaaggagccuuugucug

SEQ ID NO: 110617 - RNA, 22 nt, Homo sapiens
auggauauugccuaggguagua

SEQ ID NO: 110618 - RNA, 22 nt, Homo sapiens
auggcauuuuuagggcugggug

SEQ ID NO: 110619 - RNA, 22 nt, Homo sapiens
auggccuuucuggcacauuucc

SEQ ID NO: 110620 - RNA, 22 nt, Homo sapiens
auggcuguuuaagaguuucauu

SEQ ID NO: 110621 - RNA, 22 nt, Homo sapiens
auggcuuugggcugcucugccc

SEQ ID NO: 110622 - RNA, 22 nt, Homo sapiens
auggcuuuuccugucuugcaug

SEQ ID NO: 110623 - RNA, 22 nt, Homo sapiens
auguaaacagaugugcagcuug

SEQ ID NO: 110624 - RNA, 22 nt, Homo sapiens
auguaguagcagaaaauauuuu

SEQ ID NO: 110625 - RNA, 22 nt, Homo sapiens
augugcaagaucauuaaagcuc

SEQ ID NO: 110626 - RNA, 22 nt, Homo sapiens
auguguauuaccucgauuguga

SEQ ID NO: 110627 - RNA, 22 nt, Homo sapiens
auguugcuugaaggcauuuugu

SEQ ID NO: 110628 - RNA, 22 nt, Homo sapiens
auguuuagagagggugucaaau

SEQ ID NO: 110629 - RNA, 22 nt, Homo sapiens
auuagugaaugugaugucuuga

SEQ ID NO: 110630 - RNA, 22 nt, Homo sapiens
auuauaguguauacuugaaauu

SEQ ID NO: 110631 - RNA, 22 nt, Homo sapiens
auuauaugucaucacagacacc

SEQ ID NO: 110632 - RNA, 22 nt, Homo sapiens
auuccauagugucuguggcaga

SEQ ID NO: 110633 - RNA, 22 nt, Homo sapiens
auucuauaguccuaggauuggg

SEQ ID NO: 110634 - RNA, 22 nt, Homo sapiens
auugcacuccagcccgggugac

SEQ ID NO: 110635 - RNA, 22 nt, Homo sapiens
uagcaagaugaauuugugcaaa

SEQ ID NO: 110636 - RNA, 23 nt, Homo sapiens
uagguuauuugguaaauauaugu

SEQ ID NO: 110637 - RNA, 22 nt, Homo sapiens
uaguagagauggggcacaugcc

SEQ ID NO: 110638 - RNA, 22 nt, Homo sapiens
uaguaucacauggucuuaauua

SEQ ID NO: 110639 - RNA, 22 nt, Homo sapiens
uaguucauuauguguugcucag

SEQ ID NO: 110640 - RNA, 22 nt, Homo sapiens
uauacaugugggcaucaggaga

SEQ ID NO: 110641 - RNA, 22 nt, Homo sapiens
uauaucacaugcacucauuuuc

SEQ ID NO: 110642 - RNA, 20 nt, Homo sapiens
uaucacaggucagaaacccu

SEQ ID NO: 110643 - RNA, 22 nt, Homo sapiens
uaucacaguagaacucuuucca

SEQ ID NO: 110644 - RNA, 22 nt, Homo sapiens
uaugacuuuggaaaaauuacuu

SEQ ID NO: 110645 - RNA, 22 nt, Homo sapiens
uauggcuucuauaaggaagcuu

SEQ ID NO: 110646 - RNA, 22 nt, Homo sapiens
uauggguaguacaaaguguaua

SEQ ID NO: 110647 - RNA, 17 nt, Homo sapiens
uauguaguacuuauaaa

SEQ ID NO: 110648 - RNA, 22 nt, Homo sapiens
uauugauuuucaguguucagcu

SEQ ID NO: 110649 - RNA, 22 nt, Homo sapiens
uauuugauugacuuuagcagga

SEQ ID NO: 110650 - RNA, 22 nt, Homo sapiens
ucaaacauccccaccagggacu

SEQ ID NO: 110651 - RNA, 22 nt, Homo sapiens
ucaaagucuucucaaguaacau

SEQ ID NO: 110652 - RNA, 21 nt, Homo sapiens
ucacaaugaacagcagcagaa

SEQ ID NO: 110653 - RNA, 22 nt, Homo sapiens
ucacaauggagacucgggcgga

SEQ ID NO: 110654 - RNA, 22 nt, Homo sapiens
ucacagucugcgugaugagaca

SEQ ID NO: 110655 - RNA, 22 nt, Homo sapiens
ucacaugugcguuuuggcaugu

SEQ ID NO: 110656 - RNA, 22 nt, Homo sapiens
ucaccuggagagcuugcuaaua

SEQ ID NO: 110657 - RNA, 22 nt, Homo sapiens
ucaccuggggaucuuguuuaca

SEQ ID NO: 110658 - RNA, 22 nt, Homo sapiens
ucaccuggggcacagcugaaga

SEQ ID NO: 110659 - RNA, 22 nt, Homo sapiens
ucaggcaccuuccucuuaucug

SEQ ID NO: 110660 - RNA, 22 nt, Homo sapiens
ucagugccauugccauaugagu

SEQ ID NO: 110661 - RNA, 22 nt, Homo sapiens
ucauaucauuagaucuacugua

SEQ ID NO: 110662 - RNA, 22 nt, Homo sapiens
ucauugcaaucucugccucccg

SEQ ID NO: 110663 - RNA, 22 nt, Homo sapiens
ucauugguugcguaauuugauu

SEQ ID NO: 110664 - RNA, 22 nt, Homo sapiens
uccaagaugcuggcagcuacag

SEQ ID NO: 110665 - RNA, 22 nt, Homo sapiens
ucccaguguguagcuugucucu

SEQ ID NO: 110666 - RNA, 22 nt, Homo sapiens
uccuacaugcaguacauucaaa

SEQ ID NO: 110667 - RNA, 22 nt, Homo sapiens
uccuggcuccacuguuuauucc

SEQ ID NO: 110668 - RNA, 22 nt, Homo sapiens
ucucacagccauuucucccucu

SEQ ID NO: 110669 - RNA, 19 nt, Homo sapiens
ucucacagcucuacuaugu

SEQ ID NO: 110670 - RNA, 22 nt, Homo sapiens
ucucacaggguuauugaggggg

SEQ ID NO: 110671 - RNA, 22 nt, Homo sapiens
ucucugacacugaccccaaaaa

SEQ ID NO: 110672 - RNA, 22 nt, Homo sapiens
ucugaguggcagaaugagcuga

SEQ ID NO: 110673 - RNA, 22 nt, Homo sapiens
ucuggccuacaaguaauuuuau

SEQ ID NO: 110674 - RNA, 22 nt, Homo sapiens
ucuggccuagaacaauuaauua

SEQ ID NO: 110675 - RNA, 17 nt, Homo sapiens
ucuggcuuucacaccug

SEQ ID NO: 110676 - RNA, 22 nt, Homo sapiens
ucuggcuuuuaacaucuauaaa

SEQ ID NO: 110677 - RNA, 22 nt, Homo sapiens
ucugucacugaaucccugucac

SEQ ID NO: 110678 - RNA, 21 nt, Homo sapiens
ucuguguugaucucacuggga

SEQ ID NO: 110679 - RNA, 22 nt, Homo sapiens
ucuuggccaugaauggcaaggc

SEQ ID NO: 110680 - RNA, 22 nt, Homo sapiens
ucuugguaaugucacauuuccu

SEQ ID NO: 110681 - RNA, 22 nt, Homo sapiens
ugaauacuucguucaaagauaa

SEQ ID NO: 110682 - RNA, 22 nt, Homo sapiens
ugacaagugauuaaggcauauu

SEQ ID NO: 110683 - RNA, 19 nt, Homo sapiens
ugagaacaugugguauuug

SEQ ID NO: 110684 - RNA, 22 nt, Homo sapiens
ugagaucgagucucgcucuguc

SEQ ID NO: 110685 - RNA, 22 nt, Homo sapiens
ugagaugagagaaugcuugccu

SEQ ID NO: 110686 - RNA, 22 nt, Homo sapiens
ugagaugaguucucgcucuguc

SEQ ID NO: 110687 - RNA, 22 nt, Homo sapiens
ugagcucaguauuucauaaaca

SEQ ID NO: 110688 - RNA, 22 nt, Homo sapiens
ugagugaggcugggcagucccu

SEQ ID NO: 110689 - RNA, 22 nt, Homo sapiens
ugaugcugaguggcuauuugaa

SEQ ID NO: 110690 - RNA, 22 nt, Homo sapiens
ugauugcacaccugcacucaag

SEQ ID NO: 110691 - RNA, 22 nt, Homo sapiens
ugcaaguaauuccagcuacuga

SEQ ID NO: 110692 - RNA, 22 nt, Homo sapiens
ugcagcacaguagguuugcaau

SEQ ID NO: 110693 - RNA, 22 nt, Homo sapiens
ugcaggguccauugucccaagu

SEQ ID NO: 110694 - RNA, 22 nt, Homo sapiens
ugcaguagugugaucuuggcuc

SEQ ID NO: 110695 - RNA, 22 nt, Homo sapiens
ugcauauucgaguuauuuuggg

SEQ ID NO: 110696 - RNA, 22 nt, Homo sapiens
ugccaagauuucaggaauuaag

SEQ ID NO: 110697 - RNA, 22 nt, Homo sapiens
ugccauagagauuuguggaacu

SEQ ID NO: 110698 - RNA, 22 nt, Homo sapiens
ugcugcacaguucuuaagauua

SEQ ID NO: 110699 - RNA, 22 nt, Homo sapiens
ugcugcacuuauggcucugagg

SEQ ID NO: 110700 - RNA, 22 nt, Homo sapiens
ugcugcuguuaucauuuuacca

SEQ ID NO: 110701 - RNA, 22 nt, Homo sapiens
ugcugcuguuguuguuacuagc

SEQ ID NO: 110702 - RNA, 22 nt, Homo sapiens
ugcuggugauuaaauccugaag

SEQ ID NO: 110703 - RNA, 22 nt, Homo sapiens
ugcugguggucccauaugauua

SEQ ID NO: 110704 - RNA, 22 nt, Homo sapiens
uggaaaauuaggggagguuaua

SEQ ID NO: 110705 - RNA, 22 nt, Homo sapiens
uggaaaguacugagguccaccu

SEQ ID NO: 110706 - RNA, 20 nt, Homo sapiens
uggaacuuaauugauggaca

SEQ ID NO: 110707 - RNA, 21 nt, Homo sapiens
uggaauuaauggagagguguu

SEQ ID NO: 110708 - RNA, 22 nt, Homo sapiens
uggcagauggugacaccauuag

SEQ ID NO: 110709 - RNA, 22 nt, Homo sapiens
uggcauuuucucuguucuuaga

SEQ ID NO: 110710 - RNA, 22 nt, Homo sapiens
uggcauuuuguuuuagaauuag

SEQ ID NO: 110711 - RNA, 22 nt, Homo sapiens
uggcucuuucuagacuuaauua

SEQ ID NO: 110712 - RNA, 22 nt, Homo sapiens
ugggaucauucaaugacgaaau

SEQ ID NO: 110713 - RNA, 22 nt, Homo sapiens
ugguaucuaagaugcacguugu

SEQ ID NO: 110714 - RNA, 22 nt, Homo sapiens
uggucagaugcugaguggaucu

SEQ ID NO: 110715 - RNA, 22 nt, Homo sapiens
ugguccucugcuuccagaauuc

SEQ ID NO: 110716 - RNA, 22 nt, Homo sapiens
ugguguccugucucugcgcuug

SEQ ID NO: 110717 - RNA, 22 nt, Homo sapiens
uguagcaaauaaaagucuggau

SEQ ID NO: 110718 - RNA, 22 nt, Homo sapiens
uguagcagccauaaacacagug

SEQ ID NO: 110719 - RNA, 22 nt, Homo sapiens
uguagcuuuugagauuuauauu

SEQ ID NO: 110720 - RNA, 22 nt, Homo sapiens
uguauguugauguuauauucug

SEQ ID NO: 110721 - RNA, 16 nt, Homo sapiens
uguauugcuaaaaaga

SEQ ID NO: 110722 - RNA, 22 nt, Homo sapiens
ugucagggaggcucggccgcac

SEQ ID NO: 110723 - RNA, 22 nt, Homo sapiens
ugucaguggucuggaugcagcc

SEQ ID NO: 110724 - RNA, 22 nt, Homo sapiens
ugucaguguacuguaagaauua

SEQ ID NO: 110725 - RNA, 22 nt, Homo sapiens
ugucaugguguuaauuuuccug

SEQ ID NO: 110726 - RNA, 22 nt, Homo sapiens
auugcacuccagccugggugac

SEQ ID NO: 110727 - RNA, 22 nt, Homo sapiens
auugcagauucgcuuuguguug

SEQ ID NO: 110728 - RNA, 22 nt, Homo sapiens
auugccuagccuggucucaaaa

SEQ ID NO: 110729 - RNA, 22 nt, Homo sapiens
auuggucuugaaaccagagaga

SEQ ID NO: 110730 - RNA, 22 nt, Homo sapiens
auuguacucuagccucugggca

SEQ ID NO: 110731 - RNA, 22 nt, Homo sapiens
caaggaauucucaauagaguua

SEQ ID NO: 110732 - RNA, 22 nt, Homo sapiens
cacaaaguagauuagucuucca

SEQ ID NO: 110733 - RNA, 22 nt, Homo sapiens
cacugcaauuacuuuugcacca

SEQ ID NO: 110734 - RNA, 22 nt, Homo sapiens
cagauacuccuggucucaggag

SEQ ID NO: 110735 - RNA, 19 nt, Homo sapiens
cagguagugugcugacaug

SEQ ID NO: 110736 - RNA, 22 nt, Homo sapiens
cagguaguguguagcacagcag

SEQ ID NO: 110737 - RNA, 22 nt, Homo sapiens
cagucacugggauuauggucau

SEQ ID NO: 110738 - RNA, 22 nt, Homo sapiens
caguguuuuuaacaggugcccg

SEQ ID NO: 110739 - RNA, 22 nt, Homo sapiens
cauugcaacuucugccucccag

SEQ ID NO: 110740 - RNA, 22 nt, Homo sapiens
cauugcaauccagccugggcaa

SEQ ID NO: 110741 - RNA, 22 nt, Homo sapiens
ccaaaucucauguugaaaugug

SEQ ID NO: 110742 - RNA, 19 nt, Homo sapiens
ccacaaugguugaacuaga

SEQ ID NO: 110743 - RNA, 23 nt, Homo sapiens
ccacaaugguugaacuagauuac

SEQ ID NO: 110744 - RNA, 22 nt, Homo sapiens
ccagugauuguauggugaaggu

SEQ ID NO: 110745 - RNA, 19 nt, Homo sapiens
ccaguguucugauugcacu

SEQ ID NO: 110746 - RNA, 22 nt, Homo sapiens
ccaguguuuggauuagggaugc

SEQ ID NO: 110747 - RNA, 18 nt, Homo sapiens
ccauucaacagauuuguc

SEQ ID NO: 110748 - RNA, 22 nt, Homo sapiens
ccauugcacucuggccuaggug

SEQ ID NO: 110749 - RNA, 22 nt, Homo sapiens
ccauugcacuucagccuaggug

SEQ ID NO: 110750 - RNA, 22 nt, Homo sapiens
ccccagugguugcaacagcaga

SEQ ID NO: 110751 - RNA, 22 nt, Homo sapiens
cuaaucuagccuuauaaguauu

SEQ ID NO: 110752 - RNA, 22 nt, Homo sapiens
cuagaggcacagccuaggcacu

SEQ ID NO: 110753 - RNA, 22 nt, Homo sapiens
cuagcacauaguuauucacuca

SEQ ID NO: 110754 - RNA, 22 nt, Homo sapiens
cuauucacaggcaauauguaca

SEQ ID NO: 110755 - RNA, 22 nt, Homo sapiens
cugaaauggaaugugugcacag

SEQ ID NO: 110756 - RNA, 20 nt, Homo sapiens
cugcacauccacucuacuuc

SEQ ID NO: 110757 - RNA, 22 nt, Homo sapiens
cuguugcaguuauggcugcagg

SEQ ID NO: 110758 - RNA, 22 nt, Homo sapiens
cuguugguuaaauuccaugcag

SEQ ID NO: 110759 - RNA, 22 nt, Homo sapiens
cuuagcaaugucguguacucac

SEQ ID NO: 110760 - RNA, 19 nt, Homo sapiens
cuugccccauucauccucu

SEQ ID NO: 110761 - RNA, 22 nt, Homo sapiens
gaaagcugguauagauacauua

SEQ ID NO: 110762 - RNA, 22 nt, Homo sapiens
gaaggugcuuggugaaugcauu

SEQ ID NO: 110763 - RNA, 22 nt, Homo sapiens
gacugaguaagcagaagcaauu

SEQ ID NO: 110764 - RNA, 22 nt, Homo sapiens
gagaacauacggcauuugguuu

SEQ ID NO: 110765 - RNA, 22 nt, Homo sapiens
gagaaccauuuggagaaaaagu

SEQ ID NO: 110766 - RNA, 20 nt, Homo sapiens
gagaccugagauucacucaa

SEQ ID NO: 110767 - RNA, 22 nt, Homo sapiens
gauaaagauagcaauagggaca

SEQ ID NO: 110768 - RNA, 22 nt, Homo sapiens
gauaacagauaaugucaguuau

SEQ ID NO: 110769 - RNA, 22 nt, Homo sapiens
gauuucaucuuuagaggaagga

SEQ ID NO: 110770 - RNA, 22 nt, Homo sapiens
gcagugcaguggcgcgaucucg

SEQ ID NO: 110771 - RNA, 22 nt, Homo sapiens
gcaguggugugugccagccuag

SEQ ID NO: 110772 - RNA, 22 nt, Homo sapiens
gcaguguucugggcaggaagaa

SEQ ID NO: 110773 - RNA, 22 nt, Homo sapiens
gccaagaucugaauaauuaaga

SEQ ID NO: 110774 - RNA, 22 nt, Homo sapiens
gccaagauuuaauucaucaguu

SEQ ID NO: 110775 - RNA, 20 nt, Homo sapiens
gccacaguuaagcuucugcc

SEQ ID NO: 110776 - RNA, 22 nt, Homo sapiens
gccuuuggugacaggcaugugu

SEQ ID NO: 110777 - RNA, 22 nt, Homo sapiens
ggcccaguugcgggugguaccg

SEQ ID NO: 110778 - RNA, 22 nt, Homo sapiens
ggugacugguuuaucuggcagu

SEQ ID NO: 110779 - RNA, 22 nt, Homo sapiens
guagcagaacauguuccuugua

SEQ ID NO: 110780 - RNA, 22 nt, Homo sapiens
guaguggcaugaucuuggcuca

SEQ ID NO: 110781 - RNA, 22 nt, Homo sapiens
guaguuuaucagaaagaauagg

SEQ ID NO: 110782 - RNA, 22 nt, Homo sapiens
guauaaguugacucaaucuuug

SEQ ID NO: 110783 - RNA, 22 nt, Homo sapiens
gucagugccugucccaggcuuu

SEQ ID NO: 110784 - RNA, 22 nt, Homo sapiens
gucaguggauacugucucuguc

SEQ ID NO: 110785 - RNA, 22 nt, Homo sapiens
gucucacaggcaugaugccagc

SEQ ID NO: 110786 - RNA, 22 nt, Homo sapiens
gucuguuuggggaccuguggcc

SEQ ID NO: 110787 - RNA, 22 nt, Homo sapiens
gucuuccagccuccaucuuucu

SEQ ID NO: 110788 - RNA, 21 nt, Homo sapiens
gugaggucauugggcuuucug

SEQ ID NO: 110789 - RNA, 22 nt, Homo sapiens
gugcucauuuagagagaagcac

SEQ ID NO: 110790 - RNA, 22 nt, Homo sapiens
guggaaaacauaugcuuguuga

SEQ ID NO: 110791 - RNA, 22 nt, Homo sapiens
guggaggacuggauaaagaaaa

SEQ ID NO: 110792 - RNA, 19 nt, Homo sapiens
gugugcauaucacagagca

SEQ ID NO: 110793 - RNA, 22 nt, Homo sapiens
guuaaagacauccacauaggag

SEQ ID NO: 110794 - RNA, 22 nt, Homo sapiens
guucaguuugcugaugcguuga

SEQ ID NO: 110795 - RNA, 22 nt, Homo sapiens
guucaguuuugaaauguuaauu

SEQ ID NO: 110796 - RNA, 22 nt, Homo sapiens
guucaucagggauacuggccuu

SEQ ID NO: 110797 - RNA, 22 nt, Homo sapiens
guucaucagggauacuggcuua

SEQ ID NO: 110798 - RNA, 22 nt, Homo sapiens
guugcucaggccggagugcagu

SEQ ID NO: 110799 - RNA, 22 nt, Homo sapiens
guugcucaggcugaagugcagu

SEQ ID NO: 110800 - RNA, 22 nt, Homo sapiens
guugguauuacagaaauuaguu

SEQ ID NO: 110801 - RNA, 22 nt, Homo sapiens
uaaagcuauuauaguuauguuu

SEQ ID NO: 110802 - RNA, 20 nt, Homo sapiens
uaaagcugcucagggggcuc

SEQ ID NO: 110803 - RNA, 21 nt, Homo sapiens
uaaaugucauacaaagcaaug

SEQ ID NO: 110804 - RNA, 22 nt, Homo sapiens
uaacaacauucuaacugacggc

SEQ ID NO: 110805 - RNA, 23 nt, Homo sapiens
uaacauugcaugauuaccugcau

SEQ ID NO: 110806 - RNA, 22 nt, Homo sapiens
uaacauugcuggacuaccugcu

SEQ ID NO: 110807 - RNA, 22 nt, Homo sapiens
uaaggcuucuuggaauacugca

SEQ ID NO: 110808 - RNA, 22 nt, Homo sapiens
uaaguacugucagaauuggacu

SEQ ID NO: 110809 - RNA, 22 nt, Homo sapiens
uaagugcuugacuuugauguuu

SEQ ID NO: 110810 - RNA, 22 nt, Homo sapiens
uaauauguauacagacagauac

SEQ ID NO: 110811 - RNA, 22 nt, Homo sapiens
uacaacacugguucgacaugug

SEQ ID NO: 110812 - RNA, 22 nt, Homo sapiens
uacaaccucugccucccaaguu

SEQ ID NO: 110813 - RNA, 22 nt, Homo sapiens
uacaagcaggaaaugguauaug

SEQ ID NO: 110814 - RNA, 22 nt, Homo sapiens
uacacagucaaaaauuuccagg

SEQ ID NO: 110815 - RNA, 22 nt, Homo sapiens
uacaccaauuuaaucaaaagca

SEQ ID NO: 110816 - RNA, 22 nt, Homo sapiens
uacauuggcuagguuuggaggc

SEQ ID NO: 110817 - RNA, 22 nt, Homo sapiens
aaaagucuguagugaaagguga

SEQ ID NO: 110818 - RNA, 22 nt, Homo sapiens
aaagucacuggagaaggaauau

SEQ ID NO: 110819 - RNA, 22 nt, Homo sapiens
aaagugcugagaguucuaacuu

SEQ ID NO: 110820 - RNA, 19 nt, Homo sapiens
aaaguucuucccuuuggag

SEQ ID NO: 110821 - RNA, 22 nt, Homo sapiens
aaauaacugucagguucuggaa

SEQ ID NO: 110822 - RNA, 22 nt, Homo sapiens
aaaugacuuuuuaugcagagua

SEQ ID NO: 110823 - RNA, 22 nt, Homo sapiens
aacaguaucuaacgagugauga

SEQ ID NO: 110824 - RNA, 21 nt, Homo sapiens
aacuggugugagaugguaugu

SEQ ID NO: 110825 - RNA, 22 nt, Homo sapiens
aagcaccaauaggagauuuguc

SEQ ID NO: 110826 - RNA, 22 nt, Homo sapiens
uucaucacagucuccgaugccc

SEQ ID NO: 110827 - RNA, 22 nt, Homo sapiens
uucaucagggguauuggccaau

SEQ ID NO: 110828 - RNA, 22 nt, Homo sapiens
uucccagugguuagcucugguc

SEQ ID NO: 110829 - RNA, 22 nt, Homo sapiens
uucuacagugacugcagccaua

SEQ ID NO: 110830 - RNA, 21 nt, Homo sapiens
uucuauggucagaauucaaua

SEQ ID NO: 110831 - RNA, 22 nt, Homo sapiens
uucucagcccccugacagucag

SEQ ID NO: 110832 - RNA, 22 nt, Homo sapiens
uucucaguuccuacuuugguga

SEQ ID NO: 110833 - RNA, 22 nt, Homo sapiens
uucuccugguggacccuaaacg

SEQ ID NO: 110834 - RNA, 22 nt, Homo sapiens
uucugugguuucauuuaccugu

SEQ ID NO: 110835 - RNA, 22 nt, Homo sapiens
uucuugguuggcaaccaacagu

SEQ ID NO: 110836 - RNA, 22 nt, Homo sapiens
uugaaagucauuucuucuaagu

SEQ ID NO: 110837 - RNA, 22 nt, Homo sapiens
uugaaauguuuagaaguuugga

SEQ ID NO: 110838 - RNA, 22 nt, Homo sapiens
uugacauaguuucugaaauaga

SEQ ID NO: 110839 - RNA, 22 nt, Homo sapiens
uugacuuuuauucacucugcua

SEQ ID NO: 110840 - RNA, 21 nt, Homo sapiens
uugagacggagucucacucug

SEQ ID NO: 110841 - RNA, 22 nt, Homo sapiens
uugagacggaguuuugcucuug

SEQ ID NO: 110842 - RNA, 22 nt, Homo sapiens
uugagauggagucucgcucugu

SEQ ID NO: 110843 - RNA, 22 nt, Homo sapiens
uugagauggaguuucgcucuug

SEQ ID NO: 110844 - RNA, 22 nt, Homo sapiens
uugagguaguacuuauuauugg

SEQ ID NO: 110845 - RNA, 22 nt, Homo sapiens
uugcaagaaaucagagccuucc

SEQ ID NO: 110846 - RNA, 22 nt, Homo sapiens
uugcaagauguuaacauuggag

SEQ ID NO: 110847 - RNA, 22 nt, Homo sapiens
uugcacaauggaauuuaucuuu

SEQ ID NO: 110848 - RNA, 22 nt, Homo sapiens
uugcaccuuaugucuguucucu

SEQ ID NO: 110849 - RNA, 22 nt, Homo sapiens
uugcucaccugagaagaauaga

SEQ ID NO: 110850 - RNA, 22 nt, Homo sapiens
uuggaaaaauccaccuugaucu

SEQ ID NO: 110851 - RNA, 22 nt, Homo sapiens
uuggagcacuggggcacugaca

SEQ ID NO: 110852 - RNA, 21 nt, Homo sapiens
uuggcacucuucucuccuuau

SEQ ID NO: 110853 - RNA, 22 nt, Homo sapiens
uuggcacuugauaauauucugg

SEQ ID NO: 110854 - RNA, 20 nt, Homo sapiens
uuggcauuuagacaagaguu

SEQ ID NO: 110855 - RNA, 22 nt, Homo sapiens
uuggccauggagcacuuuucua

SEQ ID NO: 110856 - RNA, 22 nt, Homo sapiens
uugguuaucaucauuucagcaa

SEQ ID NO: 110857 - RNA, 22 nt, Homo sapiens
uuguagaucuucaguugcuaca

SEQ ID NO: 110858 - RNA, 20 nt, Homo sapiens
uuuaagacaugcugaauuga

SEQ ID NO: 110859 - RNA, 22 nt, Homo sapiens
uuuaaggcaugccuguacaugc

SEQ ID NO: 110860 - RNA, 22 nt, Homo sapiens
uuuaauguuacaguauugguau

SEQ ID NO: 110861 - RNA, 22 nt, Homo sapiens
uuucacagagggcuucuuucua

SEQ ID NO: 110862 - RNA, 21 nt, Homo sapiens
uuucacugugaguuuuucugu

SEQ ID NO: 110863 - RNA, 16 nt, Homo sapiens
uuucuauguuuuacua

SEQ ID NO: 110864 - RNA, 23 nt, Homo sapiens
uuucuugggcaugcuaugucagu

SEQ ID NO: 110865 - RNA, 22 nt, Homo sapiens
uuugcaagaugaaaaaguucua

SEQ ID NO: 110866 - RNA, 20 nt, Homo sapiens
uuugcagaaucuaagaagag

SEQ ID NO: 110867 - RNA, 22 nt, Homo sapiens
uuugcuuaaaucuuaaucagau

SEQ ID NO: 110868 - RNA, 22 nt, Homo sapiens
uuuggcaaagaucaacauguua

SEQ ID NO: 110869 - RNA, 22 nt, Homo sapiens
uuugucauagcagcaggaaugg

SEQ ID NO: 110870 - RNA, 22 nt, Homo sapiens
uuugugcuauguuauauauucu

SEQ ID NO: 110871 - RNA, 22 nt, Homo sapiens
uuuuaguugcucagguauucuc

SEQ ID NO: 110872 - RNA, 22 nt, Homo sapiens
uuuuggcucuugguaggucaga

SEQ ID NO: 110873 - RNA, 22 nt, Homo sapiens
uuuuugugguauauugcaacaa

SEQ ID NO: 110874 - RNA, 22 nt, Homo sapiens
aaaaggcuagcuaguaacagaa

SEQ ID NO: 110875 - RNA, 18 nt, Homo sapiens
aaacagugucucuuucug

SEQ ID NO: 110876 - RNA, 22 nt, Homo sapiens
aaacauugaccucauccuggca

SEQ ID NO: 110877 - RNA, 22 nt, Homo sapiens
aaagucuagaggaucaugugug

SEQ ID NO: 110878 - RNA, 22 nt, Homo sapiens
aaagucuguuacagcuauuucu

SEQ ID NO: 110879 - RNA, 22 nt, Homo sapiens
aaauggauuaaguucacuugcu

SEQ ID NO: 110880 - RNA, 22 nt, Homo sapiens
aaccuuuagucagcucuuagga

SEQ ID NO: 110881 - RNA, 22 nt, Homo sapiens
aacugguauugaauuuaggaag

SEQ ID NO: 110882 - RNA, 21 nt, Homo sapiens
aagaaagcuggacuugccgcu

SEQ ID NO: 110883 - RNA, 22 nt, Homo sapiens
aagcugcauuuucuagaugcuu

SEQ ID NO: 110884 - RNA, 22 nt, Homo sapiens
aagcuuucaacuguuugccauu

SEQ ID NO: 110885 - RNA, 22 nt, Homo sapiens
aaggaagcuagcaggaauuggu

SEQ ID NO: 110886 - RNA, 23 nt, Homo sapiens
aaggacacugaacacuucccagc

SEQ ID NO: 110887 - RNA, 22 nt, Homo sapiens
aaggcaagagaaaauuucgagu

SEQ ID NO: 110888 - RNA, 22 nt, Homo sapiens
aaggcuguucauuuagcacagu

SEQ ID NO: 110889 - RNA, 22 nt, Homo sapiens
aagggaauguuguggcugguuu

SEQ ID NO: 110890 - RNA, 22 nt, Homo sapiens
aagguagcugagugaagugguu

SEQ ID NO: 110891 - RNA, 18 nt, Homo sapiens
aaggugcuucuguucuga

SEQ ID NO: 110892 - RNA, 22 nt, Homo sapiens
aaguagugcuugugcucaucuc

SEQ ID NO: 110893 - RNA, 22 nt, Homo sapiens
aaguaucaggaauaguuauugg

SEQ ID NO: 110894 - RNA, 20 nt, Homo sapiens
aagugcuuccuuuuagaggg

SEQ ID NO: 110895 - RNA, 22 nt, Homo sapiens
aauaaagcaggguccuugcacu

SEQ ID NO: 110896 - RNA, 22 nt, Homo sapiens
aauauugucaaaauggauucca

SEQ ID NO: 110897 - RNA, 22 nt, Homo sapiens
aauccauuugccgucuauccau

SEQ ID NO: 110898 - RNA, 22 nt, Homo sapiens
aaucugauguuaucagcuuaag

SEQ ID NO: 110899 - RNA, 22 nt, Homo sapiens
aaugauauguuauguuuagguu

SEQ ID NO: 110900 - RNA, 22 nt, Homo sapiens
aaugcaagauguuaauuauagg

SEQ ID NO: 110901 - RNA, 22 nt, Homo sapiens
aaugccaucagagaaaacucuu

SEQ ID NO: 110902 - RNA, 22 nt, Homo sapiens
aauugcaauggacaaugcagca

SEQ ID NO: 110903 - RNA, 22 nt, Homo sapiens
acaguguuccuuuguugugacu

SEQ ID NO: 110904 - RNA, 22 nt, Homo sapiens
acaucccaugccuggguacucc

SEQ ID NO: 110905 - RNA, 22 nt, Homo sapiens
acccaguagccagauguagcug

SEQ ID NO: 110906 - RNA, 22 nt, Homo sapiens
acccugguagcuaugaagucuu

SEQ ID NO: 110907 - RNA, 22 nt, Homo sapiens
acucacagcaaccuccgccucc

SEQ ID NO: 110908 - RNA, 20 nt, Homo sapiens
acugcacuccaaccuuugug

SEQ ID NO: 110909 - RNA, 22 nt, Homo sapiens
acugcacuccagccucaugaca

SEQ ID NO: 110910 - RNA, 22 nt, Homo sapiens
acugcacuccagccugcccaac

SEQ ID NO: 110911 - RNA, 22 nt, Homo sapiens
acugggauauuauugguaauau

SEQ ID NO: 110912 - RNA, 21 nt, Homo sapiens
acuuuguugggggcugaggca

SEQ ID NO: 110913 - RNA, 20 nt, Homo sapiens
agagaucaguaauucaucaa

SEQ ID NO: 110914 - RNA, 22 nt, Homo sapiens
agagauccucauuuuauagaca

SEQ ID NO: 110915 - RNA, 22 nt, Homo sapiens
agagugcaaagguuggggcugg

SEQ ID NO: 110916 - RNA, 22 nt, Homo sapiens
agauauguuauugauguuaaug

SEQ ID NO: 110917 - RNA, 22 nt, Homo sapiens
agcagcauuaugauauaucuua

SEQ ID NO: 110918 - RNA, 22 nt, Homo sapiens
agcauagugccuugaaaacaau

SEQ ID NO: 110919 - RNA, 23 nt, Homo sapiens
agccuguugccuaggcagcucau

SEQ ID NO: 110920 - RNA, 22 nt, Homo sapiens
agcuaguguucaccagagguca

SEQ ID NO: 110921 - RNA, 22 nt, Homo sapiens
agcuauauugaggaugccauuc

SEQ ID NO: 110922 - RNA, 22 nt, Homo sapiens
aggcagaugagguccucagcug

SEQ ID NO: 110923 - RNA, 22 nt, Homo sapiens
aggcagcuguuauauacugagu

SEQ ID NO: 110924 - RNA, 22 nt, Homo sapiens
aggcagucucugccggcugagg

SEQ ID NO: 110925 - RNA, 22 nt, Homo sapiens
agguccacuuacuacuccuguu

SEQ ID NO: 110926 - RNA, 22 nt, Homo sapiens
aguagguguugguagagguuuc

SEQ ID NO: 110927 - RNA, 22 nt, Homo sapiens
aguggcacaauuuugacucccc

SEQ ID NO: 110928 - RNA, 23 nt, Homo sapiens
aguggucuccugggcccagcugu

SEQ ID NO: 110929 - RNA, 22 nt, Homo sapiens
aguguuuuuaacaagaaagggu

SEQ ID NO: 110930 - RNA, 22 nt, Homo sapiens
auaaaagcaggucuaggucagg

SEQ ID NO: 110931 - RNA, 22 nt, Homo sapiens
auaaaugcuuagaucuguauau

SEQ ID NO: 110932 - RNA, 22 nt, Homo sapiens
auagcaaugccccacuccuugg

SEQ ID NO: 110933 - RNA, 22 nt, Homo sapiens
auaucacaaacaagucuguacu

SEQ ID NO: 110934 - RNA, 22 nt, Homo sapiens
auaugguuuuuggaagcauauc

SEQ ID NO: 110935 - RNA, 22 nt, Homo sapiens
auauguauuuuaacguguaagg

SEQ ID NO: 110936 - RNA, 22 nt, Homo sapiens
auauuacuggccauaucgcagg

SEQ ID NO: 110937 - RNA, 22 nt, Homo sapiens
aucaaagugaauuaaugagaau

SEQ ID NO: 110938 - RNA, 22 nt, Homo sapiens
aucaccauguguacauuagacc

SEQ ID NO: 110939 - RNA, 22 nt, Homo sapiens
aucagauaccuguugggaaaug

SEQ ID NO: 110940 - RNA, 22 nt, Homo sapiens
aucaugucuucccagugauucu

SEQ ID NO: 110941 - RNA, 22 nt, Homo sapiens
auccugaagcuuuacugaauuc

SEQ ID NO: 110942 - RNA, 22 nt, Homo sapiens
aucuucucuugaagggugggga

SEQ ID NO: 110943 - RNA, 22 nt, Homo sapiens
augaaacuggcuaauuuuugua

SEQ ID NO: 110944 - RNA, 20 nt, Homo sapiens
augaagugaaguuagggaac

SEQ ID NO: 110945 - RNA, 22 nt, Homo sapiens
augaauccauuccugccacaga

SEQ ID NO: 110946 - RNA, 22 nt, Homo sapiens
augacuuuucugaaaaccacca

SEQ ID NO: 110947 - RNA, 20 nt, Homo sapiens
augcaaacccugcuuugugg

SEQ ID NO: 110948 - RNA, 22 nt, Homo sapiens
augcuacuggacaauggugacu

SEQ ID NO: 110949 - RNA, 22 nt, Homo sapiens
auggcucaauucuuucccugaa

SEQ ID NO: 110950 - RNA, 22 nt, Homo sapiens
augguauuuaacagucuuucua

SEQ ID NO: 110951 - RNA, 22 nt, Homo sapiens
uaaugcuugguuguuuggaaaa

SEQ ID NO: 110952 - RNA, 22 nt, Homo sapiens
uacaccugaguuugugguuuuc

SEQ ID NO: 110953 - RNA, 22 nt, Homo sapiens
uacaccugcacucuagccuggg

SEQ ID NO: 110954 - RNA, 19 nt, Homo sapiens
uacccagaagcagcauugu

SEQ ID NO: 110955 - RNA, 22 nt, Homo sapiens
uagaaaguagggaagguaggau

SEQ ID NO: 110956 - RNA, 22 nt, Homo sapiens
uagcagcaccccacucuacugg

SEQ ID NO: 110957 - RNA, 22 nt, Homo sapiens
uaggcuguguggccguggggcu

SEQ ID NO: 110958 - RNA, 22 nt, Homo sapiens
uagguaguuagcauacuacaca

SEQ ID NO: 110959 - RNA, 22 nt, Homo sapiens
uaggucaguuuuggcuuggcuu

SEQ ID NO: 110960 - RNA, 22 nt, Homo sapiens
uagguugucaucagucuccacu

SEQ ID NO: 110961 - RNA, 22 nt, Homo sapiens
uauacaugugccauguuggugu

SEQ ID NO: 110962 - RNA, 19 nt, Homo sapiens
uaucaaguaugcacuguac

SEQ ID NO: 110963 - RNA, 21 nt, Homo sapiens
uauggauuugccuauucugga

SEQ ID NO: 110964 - RNA, 22 nt, Homo sapiens
uauggauuugccuauucuguau

SEQ ID NO: 110965 - RNA, 22 nt, Homo sapiens
uauuacagaccauaucgccggg

SEQ ID NO: 110966 - RNA, 22 nt, Homo sapiens
uauugauuaauugugauuaggc

SEQ ID NO: 110967 - RNA, 22 nt, Homo sapiens
uauugcaauuggggaaacuggg

SEQ ID NO: 110968 - RNA, 22 nt, Homo sapiens
uauugcuacuuugccuuccaaa

SEQ ID NO: 110969 - RNA, 22 nt, Homo sapiens
uauugcuuuacucucuuauccu

SEQ ID NO: 110970 - RNA, 22 nt, Homo sapiens
uauugucaccaucccuguuuua

SEQ ID NO: 110971 - RNA, 22 nt, Homo sapiens
ucaaaucaucuuuuccaaagcu

SEQ ID NO: 110972 - RNA, 22 nt, Homo sapiens
ucaacugcuugagaucacaaau

SEQ ID NO: 110973 - RNA, 22 nt, Homo sapiens
ucacaaagcuuggccugcuucu

SEQ ID NO: 110974 - RNA, 22 nt, Homo sapiens
ucacaaggcaggaaugaaaggg

SEQ ID NO: 110975 - RNA, 22 nt, Homo sapiens
ucacaauguaaaugaggguugg

SEQ ID NO: 110976 - RNA, 22 nt, Homo sapiens
ucacacugaauuugaagcaaug

SEQ ID NO: 110977 - RNA, 22 nt, Homo sapiens
ucacagucacugucacguugaa

SEQ ID NO: 110978 - RNA, 22 nt, Homo sapiens
ucacagucggugacuucuugcu

SEQ ID NO: 110979 - RNA, 23 nt, Homo sapiens
ucacaguuacuuuugcaucaacc

SEQ ID NO: 110980 - RNA, 22 nt, Homo sapiens
ucacugaaaccuccaccucucg

SEQ ID NO: 110981 - RNA, 22 nt, Homo sapiens
ucaggcaugcagcaaugcagug

SEQ ID NO: 110982 - RNA, 22 nt, Homo sapiens
ucaggucauuccaggagggcca

SEQ ID NO: 110983 - RNA, 22 nt, Homo sapiens
ucagguugcuaaguauaauauu

SEQ ID NO: 110984 - RNA, 22 nt, Homo sapiens
ucagugguuaaaagauucuaga

SEQ ID NO: 110985 - RNA, 22 nt, Homo sapiens
ucauaugucauaguaugaucuu

SEQ ID NO: 110986 - RNA, 22 nt, Homo sapiens
ucauucacucccuugaaguuag

SEQ ID NO: 110987 - RNA, 21 nt, Homo sapiens
ucauugguuggcugcccugua

SEQ ID NO: 110988 - RNA, 22 nt, Homo sapiens
uccacaguggugaggugcagca

SEQ ID NO: 110989 - RNA, 22 nt, Homo sapiens
uuaauuguccaaguucaucucu

SEQ ID NO: 110990 - RNA, 22 nt, Homo sapiens
uuaguagagacgagcguuccac

SEQ ID NO: 110991 - RNA, 22 nt, Homo sapiens
uuauauguuacucccucuagca

SEQ ID NO: 110992 - RNA, 22 nt, Homo sapiens
uuauuagagauauuugguuagg

SEQ ID NO: 110993 - RNA, 22 nt, Homo sapiens
uuauuagcacccuaccaugugg

SEQ ID NO: 110994 - RNA, 22 nt, Homo sapiens
uucaaaaccucugcuuaagccc

SEQ ID NO: 110995 - RNA, 22 nt, Homo sapiens
uucaaaguuggaggacaaacug

SEQ ID NO: 110996 - RNA, 22 nt, Homo sapiens
uucaagcugggcaaauaagggg

SEQ ID NO: 110997 - RNA, 22 nt, Homo sapiens
uucacacugggccuacucugug

SEQ ID NO: 110998 - RNA, 22 nt, Homo sapiens
uucaccaguuuugucacgaaug

SEQ ID NO: 110999 - RNA, 22 nt, Homo sapiens
uucagagagggagggauaccua

SEQ ID NO: 111000 - RNA, 18 nt, Homo sapiens
uucaucaguccucagcug

SEQ ID NO: 111001 - RNA, 23 nt, Homo sapiens
uuccaccauugacuaguuacaua

SEQ ID NO: 111002 - RNA, 22 nt, Homo sapiens
uuccugcacuugcuugccuaug

SEQ ID NO: 111003 - RNA, 22 nt, Homo sapiens
uuccuugguucagggaaggucc

SEQ ID NO: 111004 - RNA, 21 nt, Homo sapiens
uucuaaguaaauguuggacau

SEQ ID NO: 111005 - RNA, 22 nt, Homo sapiens
uucucaguaauuccagauuuuu

SEQ ID NO: 111006 - RNA, 17 nt, Homo sapiens
uucucaguucugaucuc

SEQ ID NO: 111007 - RNA, 22 nt, Homo sapiens
uucugaguggcuuucaacacug

SEQ ID NO: 111008 - RNA, 22 nt, Homo sapiens
uucugguuaauacuugcaaaaa

SEQ ID NO: 111009 - RNA, 22 nt, Homo sapiens
uucuugaggcaugccgcuggga

SEQ ID NO: 111010 - RNA, 22 nt, Homo sapiens
uugaaagcuaucagagauucca

SEQ ID NO: 111011 - RNA, 22 nt, Homo sapiens
uugacuuuuaggaggaaaauga

SEQ ID NO: 111012 - RNA, 22 nt, Homo sapiens
uugagacggagucucacucugu

SEQ ID NO: 111013 - RNA, 22 nt, Homo sapiens
uugauuuguagaaugccccaac

SEQ ID NO: 111014 - RNA, 22 nt, Homo sapiens
uugcaaguggagcuuccagggc

SEQ ID NO: 111015 - RNA, 22 nt, Homo sapiens
uugcauagaccgaugucuugga

SEQ ID NO: 111016 - RNA, 22 nt, Homo sapiens
uugccuuuguuggaaacaagug

SEQ ID NO: 111017 - RNA, 22 nt, Homo sapiens
uuggauuuugguggcaacucau

SEQ ID NO: 111018 - RNA, 22 nt, Homo sapiens
uuggcaguaucuacuacagcua

SEQ ID NO: 111019 - RNA, 22 nt, Homo sapiens
uuggcagugcccgaugcugggg

SEQ ID NO: 111020 - RNA, 22 nt, Homo sapiens
uuggcauugccaaacugucaac

SEQ ID NO: 111021 - RNA, 22 nt, Homo sapiens
uuggcauuguggauggaaucau

SEQ ID NO: 111022 - RNA, 22 nt, Homo sapiens
uuggcauuuauucuaaggucaa

SEQ ID NO: 111023 - RNA, 22 nt, Homo sapiens
uugguuauccugucgguaauuc

SEQ ID NO: 111024 - RNA, 22 nt, Homo sapiens
uugucaaacucauucuccaucc

SEQ ID NO: 111025 - RNA, 22 nt, Homo sapiens
uuguccccaucugcugccagaa

SEQ ID NO: 111026 - RNA, 22 nt, Homo sapiens
uugucuagugaauacauuaaug

SEQ ID NO: 111027 - RNA, 22 nt, Homo sapiens
uuguugcacugcuuuccuggcc

SEQ ID NO: 111028 - RNA, 22 nt, Homo sapiens
uuuaaagcuccaagcaugucug

SEQ ID NO: 111029 - RNA, 23 nt, Homo sapiens
uuuaagcuucauguccuaacauc

SEQ ID NO: 111030 - RNA, 22 nt, Homo sapiens
uuagguaggugcuuuuuucaca

SEQ ID NO: 111031 - RNA, 22 nt, Homo sapiens
uucacuguagccucagccucuu

SEQ ID NO: 111032 - RNA, 22 nt, Homo sapiens
uucaucaguugagcugguugcu

SEQ ID NO: 111033 - RNA, 22 nt, Homo sapiens
uuccacuuuuuccuugugcucc

SEQ ID NO: 111034 - RNA, 22 nt, Homo sapiens
uuccauuuguucggugucgcca

SEQ ID NO: 111035 - RNA, 22 nt, Homo sapiens
uucccagucaaacgaaggacuu

SEQ ID NO: 111036 - RNA, 22 nt, Homo sapiens
uucccucagaaacacacagccc

SEQ ID NO: 111037 - RNA, 22 nt, Homo sapiens
uucccuuugaaacuaaacuugc

SEQ ID NO: 111038 - RNA, 22 nt, Homo sapiens
uucuacuccucauggcagguug

SEQ ID NO: 111039 - RNA, 22 nt, Homo sapiens
uucuguguuuaggucacggcua

SEQ ID NO: 111040 - RNA, 22 nt, Homo sapiens
uucuuagucaaguuguauuuca

SEQ ID NO: 111041 - RNA, 22 nt, Homo sapiens
uucuucugguuaugaaauuuga

SEQ ID NO: 111042 - RNA, 22 nt, Homo sapiens
uucuugguguaguaguugaaaa

SEQ ID NO: 111043 - RNA, 22 nt, Homo sapiens
uugaaguaugaccgcugagaau

SEQ ID NO: 111044 - RNA, 20 nt, Homo sapiens
uugacagagggaaaguugcu

SEQ ID NO: 111045 - RNA, 22 nt, Homo sapiens
uugacaguggcuuaaauugguu

SEQ ID NO: 111046 - RNA, 22 nt, Homo sapiens
uugagaagugucuguucauguc

SEQ ID NO: 111047 - RNA, 22 nt, Homo sapiens
uugagacgaagucucacucuug

SEQ ID NO: 111048 - RNA, 22 nt, Homo sapiens
uugauauuacucaguaacagau

SEQ ID NO: 111049 - RNA, 22 nt, Homo sapiens
uugcaagugccguaacuaccaa

SEQ ID NO: 111050 - RNA, 22 nt, Homo sapiens
uugcacagugcuuucuuugccc

SEQ ID NO: 111051 - RNA, 22 nt, Homo sapiens
uugcaggcaugagccaccgugc

SEQ ID NO: 111052 - RNA, 22 nt, Homo sapiens
uugcuuuguugucuggggaaua

SEQ ID NO: 111053 - RNA, 22 nt, Homo sapiens
uuggcaaagugucuggcauuua

SEQ ID NO: 111054 - RNA, 22 nt, Homo sapiens
uuggcagucugaggcacagacu

SEQ ID NO: 111055 - RNA, 22 nt, Homo sapiens
uuggccuccuggucauauccag

SEQ ID NO: 111056 - RNA, 22 nt, Homo sapiens
uuggcuacagauuaugaauuuc

SEQ ID NO: 111057 - RNA, 22 nt, Homo sapiens
uuguaaacaucuguacauugcu

SEQ ID NO: 111058 - RNA, 22 nt, Homo sapiens
uuguauguuguuugucagagaa

SEQ ID NO: 111059 - RNA, 22 nt, Homo sapiens
uugucauggucuugauccauua

SEQ ID NO: 111060 - RNA, 22 nt, Homo sapiens
uugucaugguuaauuuuaugua

SEQ ID NO: 111061 - RNA, 21 nt, Homo sapiens
uugucuagagaaauauaucuc

SEQ ID NO: 111062 - RNA, 21 nt, Homo sapiens
uugugccaaacccuggaggga

SEQ ID NO: 111063 - RNA, 22 nt, Homo sapiens
uuuaaaguuagaaggaaagggc

SEQ ID NO: 111064 - RNA, 22 nt, Homo sapiens
uuuaaugcgucucugaguuuug

SEQ ID NO: 111065 - RNA, 22 nt, Homo sapiens
uuuagcaaugcuguggggaagu

SEQ ID NO: 111066 - RNA, 22 nt, Homo sapiens
uuuagcaauggagggugacuuu

SEQ ID NO: 111067 - RNA, 22 nt, Homo sapiens
uuuagcacugugauugacaaaa

SEQ ID NO: 111068 - RNA, 22 nt, Homo sapiens
uuuauagucaggaacuugagga

SEQ ID NO: 111069 - RNA, 22 nt, Homo sapiens
uuucauggaggcauuuuagauu

SEQ ID NO: 111070 - RNA, 22 nt, Homo sapiens
uuucucaguguuucaggguagg

SEQ ID NO: 111071 - RNA, 22 nt, Homo sapiens
uuucuuggagcucuuagggucg

SEQ ID NO: 111072 - RNA, 22 nt, Homo sapiens
uuucuugguuguauuuagacuu

SEQ ID NO: 111073 - RNA, 22 nt, Homo sapiens
uuugagaaugcuaccagagaag

SEQ ID NO: 111074 - RNA, 22 nt, Homo sapiens
uuugguguauauguaaacuaug

SEQ ID NO: 111075 - RNA, 22 nt, Homo sapiens
uuuguacucccuuuagauaaaa

SEQ ID NO: 111076 - RNA, 22 nt, Homo sapiens
uuugugcuaaugcuagauuacu

SEQ ID NO: 111077 - RNA, 20 nt, Homo sapiens
uuuuagcacuuguuauggug

SEQ ID NO: 111078 - RNA, 22 nt, Homo sapiens
uuuuaugggcuauuugcauuag

SEQ ID NO: 111079 - RNA, 19 nt, Homo sapiens
uuuuccccuuucuuaagac

SEQ ID NO: 111080 - RNA, 19 nt, Homo sapiens
uuuuggaaaugugaacagc

SEQ ID NO: 111081 - RNA, 17 nt, Homo sapiens
uuuuggauuagaaaucc

SEQ ID NO: 111082 - RNA, 22 nt, Homo sapiens
uuuuuggguaaugauuaucaau

SEQ ID NO: 111083 - RNA, 22 nt, Homo sapiens
uuuuuugguaauugaacaauga

SEQ ID NO: 111084 - RNA, 15 nt, Homo sapiens
ggguccucucccaaa

SEQ ID NO: 111085 - RNA, 22 nt, Homo sapiens
ggucaguguuaucaccgaagga

SEQ ID NO: 111086 - RNA, 22 nt, Homo sapiens
guaaaguaaagcacaucaaggu

SEQ ID NO: 111087 - RNA, 22 nt, Homo sapiens
guaucaucauguuggccaggcu

SEQ ID NO: 111088 - RNA, 22 nt, Homo sapiens
guaugugacuggaacaguagga

SEQ ID NO: 111089 - RNA, 22 nt, Homo sapiens
guauuagaugguauuugaagau

SEQ ID NO: 111090 - RNA, 22 nt, Homo sapiens
gucaaguaaauguuaugguuau

SEQ ID NO: 111091 - RNA, 22 nt, Homo sapiens
gugcaacaugccuggcuaauuu

SEQ ID NO: 111092 - RNA, 22 nt, Homo sapiens
guggaaaauuauugcuguuuuu

SEQ ID NO: 111093 - RNA, 22 nt, Homo sapiens
gugucaugagggggacaggaag

SEQ ID NO: 111094 - RNA, 22 nt, Homo sapiens
gugugcauaugucuuuauagua

SEQ ID NO: 111095 - RNA, 20 nt, Homo sapiens
gugugcauuucagauuuugg

SEQ ID NO: 111096 - RNA, 22 nt, Homo sapiens
guguucaaacccaggucugucu

SEQ ID NO: 111097 - RNA, 20 nt, Homo sapiens
guucccuguaggugugcgga

SEQ ID NO: 111098 - RNA, 22 nt, Homo sapiens
guugcccuuagcacuucagccu

SEQ ID NO: 111099 - RNA, 22 nt, Homo sapiens
guuuacagucgacuugggaaua

SEQ ID NO: 111100 - RNA, 15 nt, Homo sapiens
guuuuuggauacaau

SEQ ID NO: 111101 - RNA, 22 nt, Homo sapiens
uaaagcauguaauuagguuaga

SEQ ID NO: 111102 - RNA, 22 nt, Homo sapiens
uaaagugaggauggcaguaggu

SEQ ID NO: 111103 - RNA, 22 nt, Homo sapiens
uaacauuguugauuauacuaag

SEQ ID NO: 111104 - RNA, 22 nt, Homo sapiens
uaaggcuugcuucagucuugaa

SEQ ID NO: 111105 - RNA, 22 nt, Homo sapiens
uaaggcuuugguagguuugguc

SEQ ID NO: 111106 - RNA, 22 nt, Homo sapiens
uaaguagaggaaucauuuugug

SEQ ID NO: 111107 - RNA, 23 nt, Homo sapiens
uaagucacacagauuaauuuauu

SEQ ID NO: 111108 - RNA, 22 nt, Homo sapiens
uaagugcaacauaaguguuaaa

SEQ ID NO: 111109 - RNA, 22 nt, Homo sapiens
uaagugcuguguuguuaccuaa

SEQ ID NO: 111110 - RNA, 22 nt, Homo sapiens
uaaucucagcugagcugagauu

SEQ ID NO: 111111 - RNA, 22 nt, Homo sapiens
uacagaguauccauuugaguuc

SEQ ID NO: 111112 - RNA, 22 nt, Homo sapiens
uacauccauccugcugggcagu

SEQ ID NO: 111113 - RNA, 20 nt, Homo sapiens
uagaaaguagaguggugguu

SEQ ID NO: 111114 - RNA, 22 nt, Homo sapiens
uagaacauuccaggugauguug

SEQ ID NO: 111115 - RNA, 22 nt, Homo sapiens
uagagaucuuauauuuuaugac

SEQ ID NO: 111116 - RNA, 22 nt, Homo sapiens
uagauuaucauucauacaggga

SEQ ID NO: 111117 - RNA, 22 nt, Homo sapiens
uagcaguaucccaccaucuggu

SEQ ID NO: 111118 - RNA, 22 nt, Homo sapiens
uagcugcaaaauauagacuucu

SEQ ID NO: 111119 - RNA, 22 nt, Homo sapiens
uagcugcauccugugcacucaa

SEQ ID NO: 111120 - RNA, 22 nt, Homo sapiens
uagcugcugcuaggcuaaggau

SEQ ID NO: 111121 - RNA, 22 nt, Homo sapiens
ugugaauggugcugcaaugaac

SEQ ID NO: 111122 - RNA, 19 nt, Homo sapiens
ugugacugguugucucgcu

SEQ ID NO: 111123 - RNA, 22 nt, Homo sapiens
uguucacaguguuucuuugaga

SEQ ID NO: 111124 - RNA, 22 nt, Homo sapiens
uguuuuguuagcacucugggaa

SEQ ID NO: 111125 - RNA, 22 nt, Homo sapiens
uuaaaguaauugaaauggccuu

SEQ ID NO: 111126 - RNA, 22 nt, Homo sapiens
uuaaaguauaguuccucugguu

SEQ ID NO: 111127 - RNA, 22 nt, Homo sapiens
uuaagagcauggugccagguug

SEQ ID NO: 111128 - RNA, 23 nt, Homo sapiens
uuaagcaacggcugcuuuucaga

SEQ ID NO: 111129 - RNA, 22 nt, Homo sapiens
uuaaguacuucccuguuggaca

SEQ ID NO: 111130 - RNA, 22 nt, Homo sapiens
uuaauacugcuuaacuuuagga

SEQ ID NO: 111131 - RNA, 22 nt, Homo sapiens
uuaaugcuuggggaguaguucu

SEQ ID NO: 111132 - RNA, 22 nt, Homo sapiens
uuacagcagugccccacuccca

SEQ ID NO: 111133 - RNA, 22 nt, Homo sapiens
uuacaugagacugucgcuaguu

SEQ ID NO: 111134 - RNA, 22 nt, Homo sapiens
uuagaacagugcucaccacaaa

SEQ ID NO: 111135 - RNA, 22 nt, Homo sapiens
uuaggcuaguugauauaguuug

SEQ ID NO: 111136 - RNA, 22 nt, Homo sapiens
uuagguaauauauugcugcuuu

SEQ ID NO: 111137 - RNA, 22 nt, Homo sapiens
uuaugucauuuuuggauguuaa

SEQ ID NO: 111138 - RNA, 22 nt, Homo sapiens
uuauuacuccuauuuuguagau

SEQ ID NO: 111139 - RNA, 16 nt, Homo sapiens
uuauugcauucuucuc

SEQ ID NO: 111140 - RNA, 22 nt, Homo sapiens
uuauuugguuauuguaauuggg

SEQ ID NO: 111141 - RNA, 22 nt, Homo sapiens
uuauuugguugcugacuuggaa

SEQ ID NO: 111142 - RNA, 22 nt, Homo sapiens
uucauggugguacaaaagcaau

SEQ ID NO: 111143 - RNA, 22 nt, Homo sapiens
uuccaguuuuauggguauagag

SEQ ID NO: 111144 - RNA, 22 nt, Homo sapiens
uucuuaguggcaccacuuuuuu

SEQ ID NO: 111145 - RNA, 22 nt, Homo sapiens
uugaaaguguucacaaugguau

SEQ ID NO: 111146 - RNA, 22 nt, Homo sapiens
uugagacggagucuugcucuuu

SEQ ID NO: 111147 - RNA, 22 nt, Homo sapiens
uugagauggagucucgcucuuu

SEQ ID NO: 111148 - RNA, 22 nt, Homo sapiens
uugagauggaguuucgcucuuu

SEQ ID NO: 111149 - RNA, 22 nt, Homo sapiens
uugagcaacauagugagacugu

SEQ ID NO: 111150 - RNA, 22 nt, Homo sapiens
uugccauagugcugccagauau

SEQ ID NO: 111151 - RNA, 22 nt, Homo sapiens
uugcuucauucaacauugaggg

SEQ ID NO: 111152 - RNA, 22 nt, Homo sapiens
uugcuuuguuacugcaguuucc

SEQ ID NO: 111153 - RNA, 22 nt, Homo sapiens
uuggcauugaguuucaaaucau

SEQ ID NO: 111154 - RNA, 22 nt, Homo sapiens
uuggcauuuuggacacccagga

SEQ ID NO: 111155 - RNA, 22 nt, Homo sapiens
uuggcauuuuuagucaugggaa

SEQ ID NO: 111156 - RNA, 22 nt, Homo sapiens
uuggucucuuaaucacacuuuu

SEQ ID NO: 111157 - RNA, 22 nt, Homo sapiens
uuguaaagaucauaugcuguuc

SEQ ID NO: 111158 - RNA, 22 nt, Homo sapiens
uuguagcaaauguguaaacaaa

SEQ ID NO: 111159 - RNA, 22 nt, Homo sapiens
uugugguuuucagcuuauauau

SEQ ID NO: 111160 - RNA, 22 nt, Homo sapiens
uuuaauacugcaucuuuacucu

SEQ ID NO: 111161 - RNA, 22 nt, Homo sapiens
uuucaccguguuggccaggcug

SEQ ID NO: 111162 - RNA, 22 nt, Homo sapiens
uuucccuuugcuuugucagcca

SEQ ID NO: 111163 - RNA, 22 nt, Homo sapiens
uuucuauguugaccagucuaga

SEQ ID NO: 111164 - RNA, 22 nt, Homo sapiens
uuucugguuaauuucuaagagc

SEQ ID NO: 111165 - RNA, 21 nt, Homo sapiens
uuugcauauguugaaccagcc

SEQ ID NO: 111166 - RNA, 22 nt, Homo sapiens
uuugccaaugggaauuuuccua

SEQ ID NO: 111167 - RNA, 22 nt, Homo sapiens
uuugccuuugugauauggucua

SEQ ID NO: 111168 - RNA, 22 nt, Homo sapiens
uuugcugagucugacuucaugg

SEQ ID NO: 111169 - RNA, 22 nt, Homo sapiens
uuugcuuaguaaauguagaaaa

SEQ ID NO: 111170 - RNA, 22 nt, Homo sapiens
uuugguugccucuaugagccug

SEQ ID NO: 111171 - RNA, 22 nt, Homo sapiens
uuugugcugcaauuaauuuccc

SEQ ID NO: 111172 - RNA, 22 nt, Homo sapiens
uuuuagcaaagagacugguggc

SEQ ID NO: 111173 - RNA, 22 nt, Homo sapiens
uuuuagcagccaugacaaagau

SEQ ID NO: 111174 - RNA, 22 nt, Homo sapiens
uuuuaguggaauauuuacaguu

SEQ ID NO: 111175 - RNA, 23 nt, Homo sapiens
uuuugcaauaagucacuggaaua

SEQ ID NO: 111176 - RNA, 22 nt, Homo sapiens
uuuugcauuggcugaggagugu

SEQ ID NO: 111177 - RNA, 22 nt, Homo sapiens
uuuuggcuagaaauauaccucc

SEQ ID NO: 111178 - RNA, 22 nt, Homo sapiens
uuuugucccaugggcuguuccc

SEQ ID NO: 111179 - RNA, 22 nt, Homo sapiens
uuuuuauggccaauccucagaa

SEQ ID NO: 111180 - RNA, 22 nt, Homo sapiens
ugucauuggacuucuuucaugg

SEQ ID NO: 111181 - RNA, 22 nt, Homo sapiens
uguccugcagagguguuugccu

SEQ ID NO: 111182 - RNA, 22 nt, Homo sapiens
ugucuuuguuaguuguccuagu

SEQ ID NO: 111183 - RNA, 22 nt, Homo sapiens
ugugaagaugagaugacgcccu

SEQ ID NO: 111184 - RNA, 19 nt, Homo sapiens
ugugacugggccagccuag

SEQ ID NO: 111185 - RNA, 22 nt, Homo sapiens
uguguaaauauauacacacgug

SEQ ID NO: 111186 - RNA, 22 nt, Homo sapiens
ugugucuuuuaucacacaaugu

SEQ ID NO: 111187 - RNA, 22 nt, Homo sapiens
uguuauugagguuacuuauaag

SEQ ID NO: 111188 - RNA, 22 nt, Homo sapiens
uguucuggagaggcaggccaca

SEQ ID NO: 111189 - RNA, 22 nt, Homo sapiens
uguucuugaguugggaguacaa

SEQ ID NO: 111190 - RNA, 22 nt, Homo sapiens
uguuuaguuaagacauagaauu

SEQ ID NO: 111191 - RNA, 22 nt, Homo sapiens
uguuugcuuaacguggagccag

SEQ ID NO: 111192 - RNA, 21 nt, Homo sapiens
uguuuuugcuguguaucucuc

SEQ ID NO: 111193 - RNA, 22 nt, Homo sapiens
uuaaggcuccuguuggcuuuua

SEQ ID NO: 111194 - RNA, 22 nt, Homo sapiens
uuaaggcuuuaaguaaacacag

SEQ ID NO: 111195 - RNA, 22 nt, Homo sapiens
uuaaggcuuucccuauguaaaa

SEQ ID NO: 111196 - RNA, 22 nt, Homo sapiens
uuaaguaaucagagaagagaac

SEQ ID NO: 111197 - RNA, 21 nt, Homo sapiens
uuaagugcuuuguaugcacua

SEQ ID NO: 111198 - RNA, 22 nt, Homo sapiens
uuaauguaauugauugauugac

SEQ ID NO: 111199 - RNA, 22 nt, Homo sapiens
uuaauuguaucuauagauguca

SEQ ID NO: 111200 - RNA, 22 nt, Homo sapiens
uuaauuguccauuauucuguuc

SEQ ID NO: 111201 - RNA, 22 nt, Homo sapiens
uuacaaguggcaucucucugga

SEQ ID NO: 111202 - RNA, 22 nt, Homo sapiens
uuagcacaucuuucuauguaag

SEQ ID NO: 111203 - RNA, 22 nt, Homo sapiens
uuauagcuaacaucugugaaaa

SEQ ID NO: 111204 - RNA, 20 nt, Homo sapiens
uuauagcuacaucuugacug

SEQ ID NO: 111205 - RNA, 22 nt, Homo sapiens
uuaugacauugacaguuuuuag

SEQ ID NO: 111206 - RNA, 22 nt, Homo sapiens
uuaugccagugauuauaagggc

SEQ ID NO: 111207 - RNA, 22 nt, Homo sapiens
uuauugcacuccagccugggua

SEQ ID NO: 111208 - RNA, 23 nt, Homo sapiens
uucaccguguuggccaggcuggu

SEQ ID NO: 111209 - RNA, 22 nt, Homo sapiens
uucagguaucccuugucuauag

SEQ ID NO: 111210 - RNA, 22 nt, Homo sapiens
uaggcuuuucugggaugugggc

SEQ ID NO: 111211 - RNA, 22 nt, Homo sapiens
uaguucauuuuucuugcuuaga

SEQ ID NO: 111212 - RNA, 22 nt, Homo sapiens
uauagcuuuuuagggaauuugg

SEQ ID NO: 111213 - RNA, 22 nt, Homo sapiens
uaucaaguguuagggagaugug

SEQ ID NO: 111214 - RNA, 22 nt, Homo sapiens
uaucaaguuggaagagaaguaa

SEQ ID NO: 111215 - RNA, 22 nt, Homo sapiens
uaucacaaacuuagcaguuuaa

SEQ ID NO: 111216 - RNA, 22 nt, Homo sapiens
uaucacaggucaggaaucuugc

SEQ ID NO: 111217 - RNA, 22 nt, Homo sapiens
uaucacaguugcauauuuaagg

SEQ ID NO: 111218 - RNA, 22 nt, Homo sapiens
uaucaccuugcaguggaugcua

SEQ ID NO: 111219 - RNA, 22 nt, Homo sapiens
uaugagcaaaaugaggguuagu

SEQ ID NO: 111220 - RNA, 22 nt, Homo sapiens
uauggauuuuggaauauguggg

SEQ ID NO: 111221 - RNA, 18 nt, Homo sapiens
uauuaagcuagauauuau

SEQ ID NO: 111222 - RNA, 22 nt, Homo sapiens
uauuaguuuucuguggauuaca

SEQ ID NO: 111223 - RNA, 22 nt, Homo sapiens
uauugcaacagaagaaagaguc

SEQ ID NO: 111224 - RNA, 22 nt, Homo sapiens
uauugcacuccagccuuggcaa

SEQ ID NO: 111225 - RNA, 22 nt, Homo sapiens
uauugcauuugagguugguuga

SEQ ID NO: 111226 - RNA, 22 nt, Homo sapiens
uauugcugaaaaugcuaaugau

SEQ ID NO: 111227 - RNA, 22 nt, Homo sapiens
ucaaaguaaagccucaggaugg

SEQ ID NO: 111228 - RNA, 22 nt, Homo sapiens
ucacaauggcugaacuaauuua

SEQ ID NO: 111229 - RNA, 22 nt, Homo sapiens
ucacaauucucaauuugugaaa

SEQ ID NO: 111230 - RNA, 22 nt, Homo sapiens
ucacacugucuugguuacucuu

SEQ ID NO: 111231 - RNA, 22 nt, Homo sapiens
ucacaucucagguuucuugaca

SEQ ID NO: 111232 - RNA, 21 nt, Homo sapiens
ucaccuguugcgaugaagcug

SEQ ID NO: 111233 - RNA, 22 nt, Homo sapiens
ucaggcacuaguaagaaaaagg

SEQ ID NO: 111234 - RNA, 22 nt, Homo sapiens
ucaggcacucagcuuagagucu

SEQ ID NO: 111235 - RNA, 22 nt, Homo sapiens
ucaguaaauguuaggacauuuc

SEQ ID NO: 111236 - RNA, 22 nt, Homo sapiens
ucagugccucaguuuuuaaaga

SEQ ID NO: 111237 - RNA, 21 nt, Homo sapiens
ucagugcugugggcaaggugc

SEQ ID NO: 111238 - RNA, 21 nt, Homo sapiens
ucauauguaucuuugugccuc

SEQ ID NO: 111239 - RNA, 22 nt, Homo sapiens
ucauugcauguuaauuaaacag

SEQ ID NO: 111240 - RNA, 22 nt, Homo sapiens
ucauugguagcuugaaggggau

SEQ ID NO: 111241 - RNA, 22 nt, Homo sapiens
ucccugagguccuggauuauug

SEQ ID NO: 111242 - RNA, 22 nt, Homo sapiens
uccuuuggucaguauucuuuug

SEQ ID NO: 111243 - RNA, 22 nt, Homo sapiens
ucucugguuuucaaagcaguau

SEQ ID NO: 111244 - RNA, 22 nt, Homo sapiens
ucugcauaucaugcagaacuau

SEQ ID NO: 111245 - RNA, 22 nt, Homo sapiens
ucuggccuacaucauuuuuccg

SEQ ID NO: 111246 - RNA, 22 nt, Homo sapiens
ucuggccuccuaugagaaucga

SEQ ID NO: 111247 - RNA, 22 nt, Homo sapiens
ucuuauuuggggaaaggguccu

SEQ ID NO: 111248 - RNA, 22 nt, Homo sapiens
ucuugguuaggggaaauaggca

SEQ ID NO: 111249 - RNA, 23 nt, Homo sapiens
ucuugguuauagaaaaauaguug

SEQ ID NO: 111250 - RNA, 22 nt, Homo sapiens
ugaaaaguuguugaaggcuuca

SEQ ID NO: 111251 - RNA, 22 nt, Homo sapiens
ugaaaucuaaaauguuccaaga

SEQ ID NO: 111252 - RNA, 22 nt, Homo sapiens
ugaaggcaggagggagaaaagu

SEQ ID NO: 111253 - RNA, 22 nt, Homo sapiens
ugaaggccgggcaugguggcuc

SEQ ID NO: 111254 - RNA, 22 nt, Homo sapiens
ugaauauguuucuaaaagugca

SEQ ID NO: 111255 - RNA, 22 nt, Homo sapiens
ugaccucugauagcaguaggug

SEQ ID NO: 111256 - RNA, 22 nt, Homo sapiens
ugacuccagagacugugcuguc

SEQ ID NO: 111257 - RNA, 17 nt, Homo sapiens
ugagaacaugugguauu

SEQ ID NO: 111258 - RNA, 22 nt, Homo sapiens
ugagaacugccuguauuuaucu

SEQ ID NO: 111259 - RNA, 22 nt, Homo sapiens
ugagacggagucucacucuguu

SEQ ID NO: 111260 - RNA, 22 nt, Homo sapiens
ugagacggagucucgcucuguc

SEQ ID NO: 111261 - RNA, 22 nt, Homo sapiens
ugagacggaguuucgcucuugu

SEQ ID NO: 111262 - RNA, 22 nt, Homo sapiens
ugagacugaguuucucucuugu

SEQ ID NO: 111263 - RNA, 22 nt, Homo sapiens
ugagauaucauuucacacccag

SEQ ID NO: 111264 - RNA, 22 nt, Homo sapiens
ugagaugagaaucaguucuaau

SEQ ID NO: 111265 - RNA, 22 nt, Homo sapiens
ugagaugaggucucacucuguu

SEQ ID NO: 111266 - RNA, 22 nt, Homo sapiens
ugagaugaggucucgcucuguc

SEQ ID NO: 111267 - RNA, 22 nt, Homo sapiens
ugagauggagucuugucgccua

SEQ ID NO: 111268 - RNA, 22 nt, Homo sapiens
ugagcucaugcauucuugagga

SEQ ID NO: 111269 - RNA, 22 nt, Homo sapiens
ugagucagucucacucugcugc

SEQ ID NO: 111270 - RNA, 22 nt, Homo sapiens
ugagugagguucuacucuguga

SEQ ID NO: 111271 - RNA, 18 nt, Homo sapiens
ugauaucaaugauagcca

SEQ ID NO: 111272 - RNA, 20 nt, Homo sapiens
ugauauuucuggaaguggag

SEQ ID NO: 111273 - RNA, 20 nt, Homo sapiens
ugauauuuucugagcaggaa

SEQ ID NO: 111274 - RNA, 22 nt, Homo sapiens
ugauuuguuucaggaguuuucu

SEQ ID NO: 111275 - RNA, 22 nt, Homo sapiens
ugcaccacugcacugccugggu

SEQ ID NO: 111276 - RNA, 22 nt, Homo sapiens
ugcaccacugcuagccugggua

SEQ ID NO: 111277 - RNA, 19 nt, Homo sapiens
ugcagcaauguaaaagaca

SEQ ID NO: 111278 - RNA, 22 nt, Homo sapiens
ugcagcauguaggcacguuauu

SEQ ID NO: 111279 - RNA, 22 nt, Homo sapiens
ugcagugcaugacuguguuaug

SEQ ID NO: 111280 - RNA, 22 nt, Homo sapiens
ugcccaguggacagaaagucau

SEQ ID NO: 111281 - RNA, 21 nt, Homo sapiens
ugcccaguggcuuggggucag

SEQ ID NO: 111282 - RNA, 22 nt, Homo sapiens
ugccuucuguuaaacgaggaug

SEQ ID NO: 111283 - RNA, 22 nt, Homo sapiens
ugcuauguaacacauuaccuuu

SEQ ID NO: 111284 - RNA, 22 nt, Homo sapiens
ugcuggugucaucaaggcuuug

SEQ ID NO: 111285 - RNA, 22 nt, Homo sapiens
ugcugguguggucuagccgcuu

SEQ ID NO: 111286 - RNA, 22 nt, Homo sapiens
ugcuuuguugaaaaucauuugg

SEQ ID NO: 111287 - RNA, 22 nt, Homo sapiens
uggaaaacaugcacauuggauu

SEQ ID NO: 111288 - RNA, 22 nt, Homo sapiens
uggaagucuauggcauuugagu

SEQ ID NO: 111289 - RNA, 22 nt, Homo sapiens
uggacaugaagggcacaggagg

SEQ ID NO: 111290 - RNA, 22 nt, Homo sapiens
uggauugaaagcuuuaauauug

SEQ ID NO: 111291 - RNA, 22 nt, Homo sapiens
uggcagauagaaaugugguuaa

SEQ ID NO: 111292 - RNA, 22 nt, Homo sapiens
uggcagaugcucuuggugccca

SEQ ID NO: 111293 - RNA, 23 nt, Homo sapiens
uggcauuuuuggcaaugccuucu

SEQ ID NO: 111294 - RNA, 22 nt, Homo sapiens
ugggaaauguagccuagcugug

SEQ ID NO: 111295 - RNA, 22 nt, Homo sapiens
uggucuucuggccuccagaacc

SEQ ID NO: 111296 - RNA, 22 nt, Homo sapiens
uggugcuuaaauaaggcuuuca

SEQ ID NO: 111297 - RNA, 20 nt, Homo sapiens
uguaacaaucuggauguugc

SEQ ID NO: 111298 - RNA, 22 nt, Homo sapiens
uguaauguuucaucauuauuaa

SEQ ID NO: 111299 - RNA, 22 nt, Homo sapiens
uguaugucugcucuuuggaacu

SEQ ID NO: 111300 - RNA, 22 nt, Homo sapiens
ugucaccuugcucauccucgga

SEQ ID NO: 111301 - RNA, 22 nt, Homo sapiens
acccuuaagcacuaguucagcu

SEQ ID NO: 111302 - RNA, 22 nt, Homo sapiens
accuggacacuuugggcuccuc

SEQ ID NO: 111303 - RNA, 22 nt, Homo sapiens
acuacauaugacaucuucuuua

SEQ ID NO: 111304 - RNA, 22 nt, Homo sapiens
acucagagagaacugucauuug

SEQ ID NO: 111305 - RNA, 20 nt, Homo sapiens
acuggcacugguaggugugg

SEQ ID NO: 111306 - RNA, 22 nt, Homo sapiens
agacacuguugaaaaggcccca

SEQ ID NO: 111307 - RNA, 22 nt, Homo sapiens
agagagcuugggguguuaaauu

SEQ ID NO: 111308 - RNA, 22 nt, Homo sapiens
agagagcuuuaacuacccauuu

SEQ ID NO: 111309 - RNA, 22 nt, Homo sapiens
agagugaagcuuuuuauauucu

SEQ ID NO: 111310 - RNA, 18 nt, Homo sapiens
agaugguguugcuucugu

SEQ ID NO: 111311 - RNA, 22 nt, Homo sapiens
agcaccauuguacuccagccug

SEQ ID NO: 111312 - RNA, 22 nt, Homo sapiens
agcaccguucaaacccagguua

SEQ ID NO: 111313 - RNA, 22 nt, Homo sapiens
agcaguagugaaaguagacuua

SEQ ID NO: 111314 - RNA, 22 nt, Homo sapiens
agcaucauguuuucgagguuca

SEQ ID NO: 111315 - RNA, 22 nt, Homo sapiens
agcuggcuguagcugcaagucu

SEQ ID NO: 111316 - RNA, 20 nt, Homo sapiens
agcuugguuuggaugaucac

SEQ ID NO: 111317 - RNA, 22 nt, Homo sapiens
aggaagugugcaauuaauuucu

SEQ ID NO: 111318 - RNA, 23 nt, Homo sapiens
aggaauggaaaaccaaguaucau

SEQ ID NO: 111319 - RNA, 21 nt, Homo sapiens
aggagcauuguugugguggag

SEQ ID NO: 111320 - RNA, 22 nt, Homo sapiens
aggaggauugcuuucaucuuuu

SEQ ID NO: 111321 - RNA, 22 nt, Homo sapiens
agggaagugugcuaugcauuua

SEQ ID NO: 111322 - RNA, 22 nt, Homo sapiens
aggguuuuuauuuauguggcau

SEQ ID NO: 111323 - RNA, 22 nt, Homo sapiens
aggugcuugaaucuaugagcuc

SEQ ID NO: 111324 - RNA, 22 nt, Homo sapiens
agugauggagccaggauuuaau

SEQ ID NO: 111325 - RNA, 22 nt, Homo sapiens
agugggccccuagaggugaggu

SEQ ID NO: 111326 - RNA, 22 nt, Homo sapiens
agugguuugaucacagcucacu

SEQ ID NO: 111327 - RNA, 21 nt, Homo sapiens
aguucacauggcuccuguguu

SEQ ID NO: 111328 - RNA, 18 nt, Homo sapiens
aguuguuuuauccugccc

SEQ ID NO: 111329 - RNA, 22 nt, Homo sapiens
auaacaggaaauacagggcuuu

SEQ ID NO: 111330 - RNA, 22 nt, Homo sapiens
auaagaucauuugcuaagaggg

SEQ ID NO: 111331 - RNA, 23 nt, Homo sapiens
auagagcuaggaugcagacagau

SEQ ID NO: 111332 - RNA, 22 nt, Homo sapiens
auagcaauuugggaaucagacu

SEQ ID NO: 111333 - RNA, 22 nt, Homo sapiens
auagcagcagcuaguagugaua

SEQ ID NO: 111334 - RNA, 22 nt, Homo sapiens
auaggagcacgaacucuagugu

SEQ ID NO: 111335 - RNA, 22 nt, Homo sapiens
auagguauuuuuaaaugacugu

SEQ ID NO: 111336 - RNA, 22 nt, Homo sapiens
auauaugcuaagugcuaauaaa

SEQ ID NO: 111337 - RNA, 22 nt, Homo sapiens
auaucagugucuuacuguuuuu

SEQ ID NO: 111338 - RNA, 20 nt, Homo sapiens
aucacuggagaaggaaaccu

SEQ ID NO: 111339 - RNA, 22 nt, Homo sapiens
augaagcuagcugauugcugau

SEQ ID NO: 111340 - RNA, 20 nt, Homo sapiens
augaauguccuugauggcau

SEQ ID NO: 111341 - RNA, 22 nt, Homo sapiens
augacuggaacggcacuuuaca

SEQ ID NO: 111342 - RNA, 22 nt, Homo sapiens
augacuuuucugaaaaccacca

SEQ ID NO: 111343 - RNA, 21 nt, Homo sapiens
augagguguacuguggugaaa

SEQ ID NO: 111344 - RNA, 22 nt, Homo sapiens
augauguaggccauggguuucu

SEQ ID NO: 111345 - RNA, 22 nt, Homo sapiens
augccacugcacuucagccugg

SEQ ID NO: 111346 - RNA, 22 nt, Homo sapiens
augccucugacaauuggauucu

SEQ ID NO: 111347 - RNA, 22 nt, Homo sapiens
auggagguguggggagugaguu

SEQ ID NO: 111348 - RNA, 22 nt, Homo sapiens
auggcuuguuaugcauuaguac

SEQ ID NO: 111349 - RNA, 18 nt, Homo sapiens
auggguguuggaaaauga

SEQ ID NO: 111350 - RNA, 21 nt, Homo sapiens
auggugagaaaguagugucaa

SEQ ID NO: 111351 - RNA, 22 nt, Homo sapiens
augguugguuaaaucuguguau

SEQ ID NO: 111352 - RNA, 22 nt, Homo sapiens
auguggcuuuucaacuguguga

SEQ ID NO: 111353 - RNA, 23 nt, Homo sapiens
augugguuuuagguguugaacug

SEQ ID NO: 111354 - RNA, 22 nt, Homo sapiens
auuaagugcuugcagaagucca

SEQ ID NO: 111355 - RNA, 22 nt, Homo sapiens
auuauauguguaugugcauacc

SEQ ID NO: 111356 - RNA, 22 nt, Homo sapiens
auuauguuguauuuccuugcag

SEQ ID NO: 111357 - RNA, 23 nt, Homo sapiens
auucaaguagugagagugguuau

SEQ ID NO: 111358 - RNA, 22 nt, Homo sapiens
auugcaacuuccgccuccuggg

SEQ ID NO: 111359 - RNA, 22 nt, Homo sapiens
auugcccaggcuggagugcagu

SEQ ID NO: 111360 - RNA, 22 nt, Homo sapiens
auugcuuaagucccuguauuag

SEQ ID NO: 111361 - RNA, 22 nt, Homo sapiens
auuucacugagacaugugccca

SEQ ID NO: 111362 - RNA, 22 nt, Homo sapiens
auuuggccuuuguaugcaguau

SEQ ID NO: 111363 - RNA, 22 nt, Homo sapiens
caaaggugcuuuccagguccaa

SEQ ID NO: 111364 - RNA, 22 nt, Homo sapiens
caagugaauaguugcucucaga

SEQ ID NO: 111365 - RNA, 21 nt, Homo sapiens
caaugacacuguagcugugcu

SEQ ID NO: 111366 - RNA, 22 nt, Homo sapiens
cacugcauccucugccuggcgg

SEQ ID NO: 111367 - RNA, 22 nt, Homo sapiens
cacugcauccuugaccuucugg

SEQ ID NO: 111368 - RNA, 22 nt, Homo sapiens
cacugcauggccacccauguua

SEQ ID NO: 111369 - RNA, 22 nt, Homo sapiens
cagauacuggaguccugaaguu

SEQ ID NO: 111370 - RNA, 22 nt, Homo sapiens
caucccugaaccccagaaaucu

SEQ ID NO: 111371 - RNA, 18 nt, Homo sapiens
ccagugcaaggaaagccc

SEQ ID NO: 111372 - RNA, 21 nt, Homo sapiens
ccagugguuggaaacuauggg

SEQ ID NO: 111373 - RNA, 22 nt, Homo sapiens
ccccagguuucaauaaagccca

SEQ ID NO: 111374 - RNA, 22 nt, Homo sapiens
ccugcauaguucaccgcugaua

SEQ ID NO: 111375 - RNA, 22 nt, Homo sapiens
ccuguguuaugguuucuaaugu

SEQ ID NO: 111376 - RNA, 22 nt, Homo sapiens
ccuuuguuaguuugcugagaau

SEQ ID NO: 111377 - RNA, 23 nt, Homo sapiens
cuaaagucugucacugaggacuu

SEQ ID NO: 111378 - RNA, 18 nt, Homo sapiens
cuaauacuauucaacaag

SEQ ID NO: 111379 - RNA, 20 nt, Homo sapiens
cuaaucaucccagaagaaau

SEQ ID NO: 111380 - RNA, 21 nt, Homo sapiens
cuaggaccaguucuguaauuc

SEQ ID NO: 111381 - RNA, 22 nt, Homo sapiens
cucaccuugugauccaccggcc

SEQ ID NO: 111382 - RNA, 22 nt, Homo sapiens
cucacugcauuucaguuuuguu

SEQ ID NO: 111383 - RNA, 20 nt, Homo sapiens
cucagguauuugaggcugca

SEQ ID NO: 111384 - RNA, 22 nt, Homo sapiens
cuccaugagauuguugaaguag

SEQ ID NO: 111385 - RNA, 23 nt, Homo sapiens
cuccaugagccguccagggccug

SEQ ID NO: 111386 - RNA, 22 nt, Homo sapiens
cucucaguugucuaauuaguuu

SEQ ID NO: 111387 - RNA, 22 nt, Homo sapiens
cugaaaagcaucugcauagcug

SEQ ID NO: 111388 - RNA, 22 nt, Homo sapiens
cugaagugcuugccacauaaaa

SEQ ID NO: 111389 - RNA, 22 nt, Homo sapiens
cuggaaagaaacccuuaauucu

SEQ ID NO: 111390 - RNA, 22 nt, Homo sapiens
cuggaaagaaucaggcuaaacu

SEQ ID NO: 111391 - RNA, 22 nt, Homo sapiens
cuggaagaaaaucacgccaucu

SEQ ID NO: 111392 - RNA, 22 nt, Homo sapiens
cuggaguuugaggcugcaguga

SEQ ID NO: 111393 - RNA, 22 nt, Homo sapiens
cugugcacaucuggcggcccga

SEQ ID NO: 111394 - RNA, 22 nt, Homo sapiens
aaggcagugugcacauaacacu

SEQ ID NO: 111395 - RNA, 22 nt, Homo sapiens
aaggugcucucuuauguagaaa

SEQ ID NO: 111396 - RNA, 22 nt, Homo sapiens
aagugaauucauuguguuauau

SEQ ID NO: 111397 - RNA, 22 nt, Homo sapiens
aagugguagggucaggauugga

SEQ ID NO: 111398 - RNA, 21 nt, Homo sapiens
aauaaagcaaccuuaugccau

SEQ ID NO: 111399 - RNA, 22 nt, Homo sapiens
aauaucacaguuggguguacac

SEQ ID NO: 111400 - RNA, 22 nt, Homo sapiens
aaucaccaugcacuacagccuu

SEQ ID NO: 111401 - RNA, 22 nt, Homo sapiens
aaugacugugauauuuuucuuc

SEQ ID NO: 111402 - RNA, 22 nt, Homo sapiens
aaugaucaauguuugaggugau

SEQ ID NO: 111403 - RNA, 22 nt, Homo sapiens
aaugccacugugccugccaagg

SEQ ID NO: 111404 - RNA, 22 nt, Homo sapiens
aaugucaucuucaguuguacag

SEQ ID NO: 111405 - RNA, 22 nt, Homo sapiens
aaugucaugaguccaaccagaa

SEQ ID NO: 111406 - RNA, 22 nt, Homo sapiens
aaugugcuucuggcugugguca

SEQ ID NO: 111407 - RNA, 22 nt, Homo sapiens
aauuacauggcaauugggaaau

SEQ ID NO: 111408 - RNA, 23 nt, Homo sapiens
aauugcuuuugaggacuuaguug

SEQ ID NO: 111409 - RNA, 22 nt, Homo sapiens
aauuguacucccauaauucccu

SEQ ID NO: 111410 - RNA, 22 nt, Homo sapiens
acaagacuucuuguauucuagu

SEQ ID NO: 111411 - RNA, 22 nt, Homo sapiens
acaauguauauuuuacuguagg

SEQ ID NO: 111412 - RNA, 22 nt, Homo sapiens
acacauuagcaagugcuguuau

SEQ ID NO: 111413 - RNA, 18 nt, Homo sapiens
acaucccaugcuggggug

SEQ ID NO: 111414 - RNA, 22 nt, Homo sapiens
accaugcaguccaauaugcaca

SEQ ID NO: 111415 - RNA, 22 nt, Homo sapiens
acccacuagaugccaguggcac

SEQ ID NO: 111416 - RNA, 22 nt, Homo sapiens
acccgcccagguguggccggga

SEQ ID NO: 111417 - RNA, 22 nt, Homo sapiens
acccuggaguaguaggaaucug

SEQ ID NO: 111418 - RNA, 22 nt, Homo sapiens
acccuggauucguggccuugaa

SEQ ID NO: 111419 - RNA, 22 nt, Homo sapiens
acccuugaguguguuucaggca

SEQ ID NO: 111420 - RNA, 22 nt, Homo sapiens
accucagcccggggaaguugag

SEQ ID NO: 111421 - RNA, 22 nt, Homo sapiens
acucagagaacauucccagucu

SEQ ID NO: 111422 - RNA, 22 nt, Homo sapiens
acugcauuugucugucucaauu

SEQ ID NO: 111423 - RNA, 22 nt, Homo sapiens
acuggacuuaaugaugaauugu

SEQ ID NO: 111424 - RNA, 22 nt, Homo sapiens
acuggcuuauuucacuuagcau

SEQ ID NO: 111425 - RNA, 22 nt, Homo sapiens
acuguacugucuggggcagucu

SEQ ID NO: 111426 - RNA, 22 nt, Homo sapiens
acuuuguuauggcaacccuaag

SEQ ID NO: 111427 - RNA, 20 nt, Homo sapiens
agaagcauugcucucuucag

SEQ ID NO: 111428 - RNA, 19 nt, Homo sapiens
agacuggcccaggcgggug

SEQ ID NO: 111429 - RNA, 22 nt, Homo sapiens
agagugcuauagauuagauuuc

SEQ ID NO: 111430 - RNA, 20 nt, Homo sapiens
agagugcuggacugaggagc

SEQ ID NO: 111431 - RNA, 22 nt, Homo sapiens
agcaagaugaaguugagcuagg

SEQ ID NO: 111432 - RNA, 22 nt, Homo sapiens
agcaccaugggcugaguaagug

SEQ ID NO: 111433 - RNA, 21 nt, Homo sapiens
agcagaguggcagcucuuuug

SEQ ID NO: 111434 - RNA, 22 nt, Homo sapiens
agcagcauuccaaaaaucugcu

SEQ ID NO: 111435 - RNA, 22 nt, Homo sapiens
agcagugugaaaugauuuaagg

SEQ ID NO: 111436 - RNA, 22 nt, Homo sapiens
agcuccuuugcuuuuuccagga

SEQ ID NO: 111437 - RNA, 22 nt, Homo sapiens
agcugcaauguuuaguauaaua

SEQ ID NO: 111438 - RNA, 22 nt, Homo sapiens
agcugcacaaauggaugugagg

SEQ ID NO: 111439 - RNA, 22 nt, Homo sapiens
agcugguuuaauaugcugucug

SEQ ID NO: 111440 - RNA, 22 nt, Homo sapiens
aggaauggaaacuuuugauggu

SEQ ID NO: 111441 - RNA, 22 nt, Homo sapiens
aggagguaggaauugugcuagg

SEQ ID NO: 111442 - RNA, 22 nt, Homo sapiens
aggcauguggcucuguucugac

SEQ ID NO: 111443 - RNA, 22 nt, Homo sapiens
aggccaguuuuuggagggaaac

SEQ ID NO: 111444 - RNA, 22 nt, Homo sapiens
agggcaagacuuguuaagaaca

SEQ ID NO: 111445 - RNA, 22 nt, Homo sapiens
aggugguguuggguuccagccc

SEQ ID NO: 111446 - RNA, 22 nt, Homo sapiens
aggugguuuuaggcagagacau

SEQ ID NO: 111447 - RNA, 22 nt, Homo sapiens
aggugguuuugaugagcaggua

SEQ ID NO: 111448 - RNA, 22 nt, Homo sapiens
aguaucaagccacacaugguca

SEQ ID NO: 111449 - RNA, 22 nt, Homo sapiens
agugaacacagcuucuuugguu

SEQ ID NO: 111450 - RNA, 22 nt, Homo sapiens
agugcaguggcacaaucuuggc

SEQ ID NO: 111451 - RNA, 17 nt, Homo sapiens
auaaacucaucauuuuu

SEQ ID NO: 111452 - RNA, 22 nt, Homo sapiens
auaauaucagguugugaugaug

SEQ ID NO: 111453 - RNA, 22 nt, Homo sapiens
auaaucaugucugaaaccuuug

SEQ ID NO: 111454 - RNA, 22 nt, Homo sapiens
auacaguugccauuucuugugc

SEQ ID NO: 111455 - RNA, 22 nt, Homo sapiens
auagacacugaaaucccugcca

SEQ ID NO: 111456 - RNA, 22 nt, Homo sapiens
auagcagaauuuggucaagucu

SEQ ID NO: 111457 - RNA, 19 nt, Homo sapiens
auaguguaggaaaacagcu

SEQ ID NO: 111458 - RNA, 22 nt, Homo sapiens
auauugcuugaggccaggaggu

SEQ ID NO: 111459 - RNA, 22 nt, Homo sapiens
aucaaaguaggcauauguuuuu

SEQ ID NO: 111460 - RNA, 22 nt, Homo sapiens
aucacugggauggaacugcuga

SEQ ID NO: 111461 - RNA, 22 nt, Homo sapiens
aucagagccugugugcccugaa

SEQ ID NO: 111462 - RNA, 22 nt, Homo sapiens
aucagcacugaucauacagcuu

SEQ ID NO: 111463 - RNA, 22 nt, Homo sapiens
aucagugaaagugaaaucuccg

SEQ ID NO: 111464 - RNA, 21 nt, Homo sapiens
auccuucuuuuucaaccugug

SEQ ID NO: 111465 - RNA, 22 nt, Homo sapiens
augaaguauuaggacacauuua

SEQ ID NO: 111466 - RNA, 22 nt, Homo sapiens
augacaaugaaucccuguuuca

SEQ ID NO: 111467 - RNA, 22 nt, Homo sapiens
augacaguaugacuccaaaagu

SEQ ID NO: 111468 - RNA, 17 nt, Homo sapiens
augacuucuucagugug

SEQ ID NO: 111469 - RNA, 22 nt, Homo sapiens
augaguugaagcuacaagaggc

SEQ ID NO: 111470 - RNA, 22 nt, Homo sapiens
augaucuguuuggugaucuugu

SEQ ID NO: 111471 - RNA, 22 nt, Homo sapiens
augcacuguuuucuugaugaga

SEQ ID NO: 111472 - RNA, 22 nt, Homo sapiens
augcacuuggcaggaugauucc

SEQ ID NO: 111473 - RNA, 22 nt, Homo sapiens
auggagugagaauggagguucc

SEQ ID NO: 111474 - RNA, 22 nt, Homo sapiens
auggaguguaauauugagagcu

SEQ ID NO: 111475 - RNA, 22 nt, Homo sapiens
auggaguuuacuuaguguaaua

SEQ ID NO: 111476 - RNA, 22 nt, Homo sapiens
auggugugugaauuaaauguua

SEQ ID NO: 111477 - RNA, 22 nt, Homo sapiens
augucaacauagacaguagagu

SEQ ID NO: 111478 - RNA, 22 nt, Homo sapiens
augugcuugagggaaaucaguu

SEQ ID NO: 111479 - RNA, 22 nt, Homo sapiens
augugcuuuuuaaacagaugcu

SEQ ID NO: 111480 - RNA, 22 nt, Homo sapiens
auuaauguaauuaguaaaguug

SEQ ID NO: 111481 - RNA, 22 nt, Homo sapiens
auuauaugucaucacagacacc

SEQ ID NO: 111482 - RNA, 22 nt, Homo sapiens
auuauuaguuguugaaugaagu

SEQ ID NO: 111483 - RNA, 22 nt, Homo sapiens
auuggcaauagcuuucuuacua

SEQ ID NO: 111484 - RNA, 22 nt, Homo sapiens
auuggcaauccauauauuuucu

SEQ ID NO: 111485 - RNA, 22 nt, Homo sapiens
caaaugacaucauuucauucaa

SEQ ID NO: 111486 - RNA, 20 nt, Homo sapiens
aaacucugucuucuuuauca

SEQ ID NO: 111487 - RNA, 22 nt, Homo sapiens
aaagaagucagccuguccuuug

SEQ ID NO: 111488 - RNA, 22 nt, Homo sapiens
aaaggcacugaucuuauccagu

SEQ ID NO: 111489 - RNA, 22 nt, Homo sapiens
aaaugcacgcuacccagcuaga

SEQ ID NO: 111490 - RNA, 22 nt, Homo sapiens
aaauucauuucagcucugggua

SEQ ID NO: 111491 - RNA, 22 nt, Homo sapiens
aaauugcuuuugaagacuuagu

SEQ ID NO: 111492 - RNA, 22 nt, Homo sapiens
aacugccucugacauaggcagg

SEQ ID NO: 111493 - RNA, 22 nt, Homo sapiens
aacuggcauaugaacuuguucu

SEQ ID NO: 111494 - RNA, 19 nt, Homo sapiens
aacuggugugagaugguau

SEQ ID NO: 111495 - RNA, 20 nt, Homo sapiens
aagagcucaccagaauaucu

SEQ ID NO: 111496 - RNA, 23 nt, Homo sapiens
aagagguaugacuaugaagugga

SEQ ID NO: 111497 - RNA, 22 nt, Homo sapiens
aagauaguaaacauuuucugcu

SEQ ID NO: 111498 - RNA, 22 nt, Homo sapiens
aaggaaguaauuugguuuauag

SEQ ID NO: 111499 - RNA, 22 nt, Homo sapiens
aaggagcuuaagugacuuguac

SEQ ID NO: 111500 - RNA, 17 nt, Homo sapiens
aaggugcuucgaccucc

SEQ ID NO: 111501 - RNA, 18 nt, Homo sapiens
aaggugcuucuguucuga

SEQ ID NO: 111502 - RNA, 22 nt, Homo sapiens
aaguaaacauuuuguacaauaa

SEQ ID NO: 111503 - RNA, 22 nt, Homo sapiens
aagucauggagaagguggaggu

SEQ ID NO: 111504 - RNA, 22 nt, Homo sapiens
aagugagaugcaguggaguucc

SEQ ID NO: 111505 - RNA, 22 nt, Homo sapiens
aauaaagccugucucuuuagag

SEQ ID NO: 111506 - RNA, 22 nt, Homo sapiens
aauacagcacacagaugggucu

SEQ ID NO: 111507 - RNA, 22 nt, Homo sapiens
aaucaacauuguuuuaagucaa

SEQ ID NO: 111508 - RNA, 22 nt, Homo sapiens
aauggcacaccuagcccuaacc

SEQ ID NO: 111509 - RNA, 22 nt, Homo sapiens
aaugugcuguucagaggagucc

SEQ ID NO: 111510 - RNA, 22 nt, Homo sapiens
aauuacucgugucuuuacugcu

SEQ ID NO: 111511 - RNA, 22 nt, Homo sapiens
acaagugcuuuuccuggagaca

SEQ ID NO: 111512 - RNA, 22 nt, Homo sapiens
acacuggaguuaaaggugauuu

SEQ ID NO: 111513 - RNA, 22 nt, Homo sapiens
acagagcaaugagcuacggucu

SEQ ID NO: 111514 - RNA, 22 nt, Homo sapiens
acaggagugggauuugaguccu

SEQ ID NO: 111515 - RNA, 22 nt, Homo sapiens
acaguggugcgaucucggcuca

SEQ ID NO: 111516 - RNA, 23 nt, Homo sapiens
acaguggugugaucuuggcucag

SEQ ID NO: 111517 - RNA, 21 nt, Homo sapiens
acccucuaguuuucaacaggc

SEQ ID NO: 111518 - RNA, 22 nt, Homo sapiens
acccugucaaaauagaccaauc

SEQ ID NO: 111519 - RNA, 22 nt, Homo sapiens
caaaugaucugcuggccucagc

SEQ ID NO: 111520 - RNA, 22 nt, Homo sapiens
caauacuguuaccugaaauagg

SEQ ID NO: 111521 - RNA, 22 nt, Homo sapiens
cacagagugagacccugucucu

SEQ ID NO: 111522 - RNA, 22 nt, Homo sapiens
cacugcauucuccaccucccag

SEQ ID NO: 111523 - RNA, 22 nt, Homo sapiens
cacuguggauggaacuauguga

SEQ ID NO: 111524 - RNA, 22 nt, Homo sapiens
cagagguaagcaagucagcauu

SEQ ID NO: 111525 - RNA, 22 nt, Homo sapiens
cagagugcauguuuagaugagu

SEQ ID NO: 111526 - RNA, 22 nt, Homo sapiens
cagauacuggccuggagcugug

SEQ ID NO: 111527 - RNA, 23 nt, Homo sapiens
cagcucauuuggguccccuuguc

SEQ ID NO: 111528 - RNA, 22 nt, Homo sapiens
cagcugcuuuggaaaauauuuu

SEQ ID NO: 111529 - RNA, 18 nt, Homo sapiens
cagugcaauacaggagag

SEQ ID NO: 111530 - RNA, 22 nt, Homo sapiens
cagugcauguggcacucuccag

SEQ ID NO: 111531 - RNA, 22 nt, Homo sapiens
caucacagcaaguagggagugg

SEQ ID NO: 111532 - RNA, 22 nt, Homo sapiens
cauggcucuuguuuacucccag

SEQ ID NO: 111533 - RNA, 22 nt, Homo sapiens
cauggcuuuaagcaacaccaag

SEQ ID NO: 111534 - RNA, 22 nt, Homo sapiens
caugugcaugcuuucuuaugug

SEQ ID NO: 111535 - RNA, 22 nt, Homo sapiens
ccaagccucaguuucccucugu

SEQ ID NO: 111536 - RNA, 22 nt, Homo sapiens
ccagucuuggugucuguagcac

SEQ ID NO: 111537 - RNA, 22 nt, Homo sapiens
ccauggcaauggucagucuauu

SEQ ID NO: 111538 - RNA, 21 nt, Homo sapiens
ccaugggacggaaugaauaca

SEQ ID NO: 111539 - RNA, 22 nt, Homo sapiens
cccagugguuacauaaggagua

SEQ ID NO: 111540 - RNA, 22 nt, Homo sapiens
ccccagugguugcaacagcaga

SEQ ID NO: 111541 - RNA, 22 nt, Homo sapiens
cccugaagauacagaguuuggg

SEQ ID NO: 111542 - RNA, 19 nt, Homo sapiens
ccucaaguacuaauauguu

SEQ ID NO: 111543 - RNA, 22 nt, Homo sapiens
ccucuuuguugagacuucacca

SEQ ID NO: 111544 - RNA, 23 nt, Homo sapiens
ccuguagaaugucugugauacuu

SEQ ID NO: 111545 - RNA, 22 nt, Homo sapiens
ccuucuuuuguaaggcugaaua

SEQ ID NO: 111546 - RNA, 22 nt, Homo sapiens
ccuugcacuucccaggugaggc

SEQ ID NO: 111547 - RNA, 22 nt, Homo sapiens
cgacuggccuagacuaguguuu

SEQ ID NO: 111548 - RNA, 22 nt, Homo sapiens
cuaaagugcuuaaaaucucauu

SEQ ID NO: 111549 - RNA, 22 nt, Homo sapiens
cuagacacugacguuccuccga

SEQ ID NO: 111550 - RNA, 22 nt, Homo sapiens
cuagcacauaguuauucacuca

SEQ ID NO: 111551 - RNA, 21 nt, Homo sapiens
cucaaaguacugauauuacag

SEQ ID NO: 111552 - RNA, 22 nt, Homo sapiens
cucacaaccuuaugaagcauga

SEQ ID NO: 111553 - RNA, 18 nt, Homo sapiens
cucacacccuaaucagga

SEQ ID NO: 111554 - RNA, 22 nt, Homo sapiens
cucacuaguaaggcuguuuagu

SEQ ID NO: 111555 - RNA, 22 nt, Homo sapiens
cucagugucuggcacacagaaa

SEQ ID NO: 111556 - RNA, 20 nt, Homo sapiens
cucccugacaaauguggaaa

SEQ ID NO: 111557 - RNA, 20 nt, Homo sapiens
cucuaguaauaaaguuuccc

SEQ ID NO: 111558 - RNA, 22 nt, Homo sapiens
cugggaucaguucuagucagaa

SEQ ID NO: 111559 - RNA, 22 nt, Homo sapiens
cuggucguuauuuaucuucuca

SEQ ID NO: 111560 - RNA, 22 nt, Homo sapiens
cugugaucuuuuuucauguggu

SEQ ID NO: 111561 - RNA, 22 nt, Homo sapiens
cugugguauuauuagaaauauc

SEQ ID NO: 111562 - RNA, 22 nt, Homo sapiens
cuucaugggagaaccacaggua

SEQ ID NO: 111563 - RNA, 18 nt, Homo sapiens
cuucauugcuguuuugcu

SEQ ID NO: 111564 - RNA, 22 nt, Homo sapiens
cuuccagcuggguucagucagu

SEQ ID NO: 111565 - RNA, 22 nt, Homo sapiens
cuugagcuugagauccuuucug

SEQ ID NO: 111566 - RNA, 22 nt, Homo sapiens
cuugugauugcacggcugccug

SEQ ID NO: 111567 - RNA, 22 nt, Homo sapiens
cuuugggaccgcgguuuauacu

SEQ ID NO: 111568 - RNA, 22 nt, Homo sapiens
cuuuggucaauugcugugggga

SEQ ID NO: 111569 - RNA, 22 nt, Homo sapiens
cuuuuacacugguggugggaau

SEQ ID NO: 111570 - RNA, 23 nt, Homo sapiens
cuuuugcaaugugaucuugccac

SEQ ID NO: 111571 - RNA, 22 nt, Homo sapiens
gacacugucuucugcucuuaaa

SEQ ID NO: 111572 - RNA, 22 nt, Homo sapiens
gacaguuuggugaggaagacga

SEQ ID NO: 111573 - RNA, 19 nt, Homo sapiens
gacuccagaguugugugcu

SEQ ID NO: 111574 - RNA, 22 nt, Homo sapiens
gacugcauuugccccaucgaau

SEQ ID NO: 111575 - RNA, 22 nt, Homo sapiens
gacuggagcuguaugugguuac

SEQ ID NO: 111576 - RNA, 22 nt, Homo sapiens
gacuggcuguuuucuuuauuau

SEQ ID NO: 111577 - RNA, 22 nt, Homo sapiens
gagaacagagauaauuuuacuu

SEQ ID NO: 111578 - RNA, 22 nt, Homo sapiens
gagauacacccagugcagaggc

SEQ ID NO: 111579 - RNA, 22 nt, Homo sapiens
gagaugaagugucaauaaggau

SEQ ID NO: 111580 - RNA, 22 nt, Homo sapiens
gagcuguugguuugaaagaauu

SEQ ID NO: 111581 - RNA, 22 nt, Homo sapiens
gagcuguuuuucacuagaccaa

SEQ ID NO: 111582 - RNA, 18 nt, Homo sapiens
gaguggugcuucccuugu

SEQ ID NO: 111583 - RNA, 22 nt, Homo sapiens
gaguggugguucugaaacuuuu

SEQ ID NO: 111584 - RNA, 22 nt, Homo sapiens
gauagcagccauucuuuuuauu

SEQ ID NO: 111585 - RNA, 22 nt, Homo sapiens
gauauguaaaaauuauaucuga

SEQ ID NO: 111586 - RNA, 22 nt, Homo sapiens
gaugacagugaguaaccccaac

SEQ ID NO: 111587 - RNA, 22 nt, Homo sapiens
gaugagaucauaaguguggagc

SEQ ID NO: 111588 - RNA, 22 nt, Homo sapiens
gaugguuuuuuaagaagagccu

SEQ ID NO: 111589 - RNA, 22 nt, Homo sapiens
gccccugagacuugccucgggc

SEQ ID NO: 111590 - RNA, 22 nt, Homo sapiens
gcucaaguaauggcaguuuugc

SEQ ID NO: 111591 - RNA, 22 nt, Homo sapiens
gcuguguguuaucagaaauugc

SEQ ID NO: 111592 - RNA, 22 nt, Homo sapiens
ggaaugcuaaaauaggaugcug

SEQ ID NO: 111593 - RNA, 19 nt, Homo sapiens
ggacugucauggaguaguu

SEQ ID NO: 111594 - RNA, 22 nt, Homo sapiens
ggcacugugaugugagggggua

SEQ ID NO: 111595 - RNA, 22 nt, Homo sapiens
ggcacuguggcucaagccugua

SEQ ID NO: 111596 - RNA, 22 nt, Homo sapiens
ggcaguuuguucuugcuccuuu

SEQ ID NO: 111597 - RNA, 22 nt, Homo sapiens
ggcgccauugcacuccagccug

SEQ ID NO: 111598 - RNA, 22 nt, Homo sapiens
ggcucaguuuccuccgucugcu

SEQ ID NO: 111599 - RNA, 22 nt, Homo sapiens
ggcuuuggucacacaggggcaa

SEQ ID NO: 111600 - RNA, 22 nt, Homo sapiens
gggaaauguaaagucauaagau

SEQ ID NO: 111601 - RNA, 22 nt, Homo sapiens
gggaugaaguugauguagaaag

SEQ ID NO: 111602 - RNA, 22 nt, Homo sapiens
guaagugguagagcugggcuau

SEQ ID NO: 111603 - RNA, 22 nt, Homo sapiens
guacaggcagcaaacaccauaa

SEQ ID NO: 111604 - RNA, 22 nt, Homo sapiens
gucacugagcagaaggaagcga

SEQ ID NO: 111605 - RNA, 22 nt, Homo sapiens
gucagagcacugaguugugggc

SEQ ID NO: 111606 - RNA, 22 nt, Homo sapiens
gucagugucuuugcagcucaga

SEQ ID NO: 111607 - RNA, 22 nt, Homo sapiens
gucaugaaguuuugaaugaaau

SEQ ID NO: 111608 - RNA, 22 nt, Homo sapiens
guccaaagugggagaggugggg

SEQ ID NO: 111609 - RNA, 22 nt, Homo sapiens
guccaaauccaugggauguaca

SEQ ID NO: 111610 - RNA, 22 nt, Homo sapiens
guccaugagaugaauccacaca

SEQ ID NO: 111611 - RNA, 21 nt, Homo sapiens
uuuuugguggucauggauaga

SEQ ID NO: 111612 - RNA, 22 nt, Homo sapiens
uuaguagcacagaguaucagca

SEQ ID NO: 111613 - RNA, 22 nt, Homo sapiens
uuauauguuucuguuuggaggc

SEQ ID NO: 111614 - RNA, 22 nt, Homo sapiens
uuauccugucaguaaauauuuu

SEQ ID NO: 111615 - RNA, 22 nt, Homo sapiens
uucaaguaguucucaugccuca

SEQ ID NO: 111616 - RNA, 20 nt, Homo sapiens
uucagugcagguaacaaucc

SEQ ID NO: 111617 - RNA, 22 nt, Homo sapiens
uucauagucuaugcaaguaaga

SEQ ID NO: 111618 - RNA, 22 nt, Homo sapiens
uucauugaaugauuuuuagaag

SEQ ID NO: 111619 - RNA, 22 nt, Homo sapiens
uuccugagagggcugggugcag

SEQ ID NO: 111620 - RNA, 22 nt, Homo sapiens
uuccugaggccuccccagaagc

SEQ ID NO: 111621 - RNA, 23 nt, Homo sapiens
uucugccacugaaaaugccucag

SEQ ID NO: 111622 - RNA, 22 nt, Homo sapiens
uucugugcugaaucaaagacug

SEQ ID NO: 111623 - RNA, 21 nt, Homo sapiens
uucuucaggcagaaggauuau

SEQ ID NO: 111624 - RNA, 22 nt, Homo sapiens
uugaaagucuaggcuuacagua

SEQ ID NO: 111625 - RNA, 22 nt, Homo sapiens
uugaauagaagguuuuuuguuc

SEQ ID NO: 111626 - RNA, 22 nt, Homo sapiens
uugacaaugcacugugcuaagu

SEQ ID NO: 111627 - RNA, 22 nt, Homo sapiens
uugacacuuuguaagaaagggg

SEQ ID NO: 111628 - RNA, 22 nt, Homo sapiens
uugaccaaagaagagucauugc

SEQ ID NO: 111629 - RNA, 22 nt, Homo sapiens
uugacuuagacauucaguugga

SEQ ID NO: 111630 - RNA, 22 nt, Homo sapiens
uugacuuuuauucacucugcua

SEQ ID NO: 111631 - RNA, 22 nt, Homo sapiens
uugagacugagucucgcccugu

SEQ ID NO: 111632 - RNA, 17 nt, Homo sapiens
uugagaguauaucuuac

SEQ ID NO: 111633 - RNA, 22 nt, Homo sapiens
uugagauggagucucacgcauu

SEQ ID NO: 111634 - RNA, 22 nt, Homo sapiens
uugagauggagucucacucugc

SEQ ID NO: 111635 - RNA, 22 nt, Homo sapiens
uugagauggagucucacucuuu

SEQ ID NO: 111636 - RNA, 22 nt, Homo sapiens
uugagauggaguuucacucuug

SEQ ID NO: 111637 - RNA, 22 nt, Homo sapiens
uugagcucaucuucagggguga

SEQ ID NO: 111638 - RNA, 23 nt, Homo sapiens
uugaggcauguaccaucaauauc

SEQ ID NO: 111639 - RNA, 22 nt, Homo sapiens
uugagguagcuuugauggaggu

SEQ ID NO: 111640 - RNA, 22 nt, Homo sapiens
uugaggugaauuugcaggaugc

SEQ ID NO: 111641 - RNA, 22 nt, Homo sapiens
uugaguaguaagugguucaccg

SEQ ID NO: 111642 - RNA, 22 nt, Homo sapiens
uugcacuucauguaggccaaag

SEQ ID NO: 111643 - RNA, 22 nt, Homo sapiens
uugcaugucugcuucuccuccu

SEQ ID NO: 111644 - RNA, 22 nt, Homo sapiens
uugcauuagugugguacauuug

SEQ ID NO: 111645 - RNA, 22 nt, Homo sapiens
uugccauggaguagaauugaag

SEQ ID NO: 111646 - RNA, 22 nt, Homo sapiens
uugcuuagagccaaucuugauu

SEQ ID NO: 111647 - RNA, 22 nt, Homo sapiens
uuggaaaguuguuguaguuauu

SEQ ID NO: 111648 - RNA, 21 nt, Homo sapiens
uuggccuggaggccugaaugu

SEQ ID NO: 111649 - RNA, 22 nt, Homo sapiens
uugggcuuuuagguccuuaaca

SEQ ID NO: 111650 - RNA, 22 nt, Homo sapiens
uuggguaguauagaagcaacaa

SEQ ID NO: 111651 - RNA, 22 nt, Homo sapiens
uuggguagugaguuccuccagg

SEQ ID NO: 111652 - RNA, 22 nt, Homo sapiens
uugguaugaaaaggaauuagac

SEQ ID NO: 111653 - RNA, 21 nt, Homo sapiens
uugguucccucugacaggucu

SEQ ID NO: 111654 - RNA, 19 nt, Homo sapiens
uugguugguuauuucuuac

SEQ ID NO: 111655 - RNA, 22 nt, Homo sapiens
uuguaauguuaccaaauggugu

SEQ ID NO: 111656 - RNA, 22 nt, Homo sapiens
uugucaacaugaaacuguguuu

SEQ ID NO: 111657 - RNA, 22 nt, Homo sapiens
uugucacuauaaauaagcauuu

SEQ ID NO: 111658 - RNA, 22 nt, Homo sapiens
uugucuccuagacgaccaggcg

SEQ ID NO: 111659 - RNA, 22 nt, Homo sapiens
uugugaauggugccacaauaaa

SEQ ID NO: 111660 - RNA, 18 nt, Homo sapiens
uuguggccccuacaaauu

SEQ ID NO: 111661 - RNA, 22 nt, Homo sapiens
uugugguaaucugugacagcag

SEQ ID NO: 111662 - RNA, 22 nt, Homo sapiens
uugugguaggaguugccauguu

SEQ ID NO: 111663 - RNA, 22 nt, Homo sapiens
uugugguagugaaugagucuca

SEQ ID NO: 111664 - RNA, 19 nt, Homo sapiens
uuguguccccacaaaauuc

SEQ ID NO: 111665 - RNA, 23 nt, Homo sapiens
uugugucccuacccaaaucucau

SEQ ID NO: 111666 - RNA, 22 nt, Homo sapiens
uuuaaaguuagaaggaaagggc

SEQ ID NO: 111667 - RNA, 20 nt, Homo sapiens
uuuaagacaugcugaauuga

SEQ ID NO: 111668 - RNA, 19 nt, Homo sapiens
uuuagaucuuuuaugcagc

SEQ ID NO: 111669 - RNA, 19 nt, Homo sapiens
uuucaauguaaggauggag

SEQ ID NO: 111670 - RNA, 17 nt, Homo sapiens
uuucagaguggaagugu

SEQ ID NO: 111671 - RNA, 22 nt, Homo sapiens
uuucauggacgcaaugccuuuu

SEQ ID NO: 111672 - RNA, 22 nt, Homo sapiens
uuuccagguggccaacauuuua

SEQ ID NO: 111673 - RNA, 22 nt, Homo sapiens
uuuccauguuggugaaaugagg

SEQ ID NO: 111674 - RNA, 22 nt, Homo sapiens
uuugaauguaaugagcaggaag

SEQ ID NO: 111675 - RNA, 22 nt, Homo sapiens
uuugagcuugacucagcuggag

SEQ ID NO: 111676 - RNA, 22 nt, Homo sapiens
uuugcaugcuccuuaugagaau

SEQ ID NO: 111677 - RNA, 22 nt, Homo sapiens
uuugccuuugugauauggucua

SEQ ID NO: 111678 - RNA, 22 nt, Homo sapiens
uagggaguuuuggggugcagaa

SEQ ID NO: 111679 - RNA, 21 nt, Homo sapiens
uagugcagugggguaugacuu

SEQ ID NO: 111680 - RNA, 22 nt, Homo sapiens
uagugguaguagcaguaauauu

SEQ ID NO: 111681 - RNA, 22 nt, Homo sapiens
uauaugauugguagacccugca

SEQ ID NO: 111682 - RNA, 22 nt, Homo sapiens
uaucaaggccacucauuuuaug

SEQ ID NO: 111683 - RNA, 22 nt, Homo sapiens
uaucagugaaucuuauuuugcc

SEQ ID NO: 111684 - RNA, 22 nt, Homo sapiens
uaucuuggaguuugacaaccaa

SEQ ID NO: 111685 - RNA, 22 nt, Homo sapiens
uaugacuuuggaaaaauuacuu

SEQ ID NO: 111686 - RNA, 22 nt, Homo sapiens
uauggauuucauuagacuugag

SEQ ID NO: 111687 - RNA, 22 nt, Homo sapiens
uauuccauuugggucaggauga

SEQ ID NO: 111688 - RNA, 22 nt, Homo sapiens
ucaaaaucucuuagcugugucu

SEQ ID NO: 111689 - RNA, 22 nt, Homo sapiens
ucaaguaagaagugggcauaaa

SEQ ID NO: 111690 - RNA, 22 nt, Homo sapiens
ucaagugauucuugugccuuag

SEQ ID NO: 111691 - RNA, 22 nt, Homo sapiens
ucacagaggagaagaccuuuaa

SEQ ID NO: 111692 - RNA, 20 nt, Homo sapiens
ucacugugaacuucuugagg

SEQ ID NO: 111693 - RNA, 22 nt, Homo sapiens
ucacugugguuggaaggcuuaa

SEQ ID NO: 111694 - RNA, 22 nt, Homo sapiens
ucacuuuguuuuuggauaaguu

SEQ ID NO: 111695 - RNA, 21 nt, Homo sapiens
ucagcucaucacugccuggag

SEQ ID NO: 111696 - RNA, 22 nt, Homo sapiens
ucaggcacuaguaagaaaaagg

SEQ ID NO: 111697 - RNA, 20 nt, Homo sapiens
ucaggcuccgcauuaacuua

SEQ ID NO: 111698 - RNA, 22 nt, Homo sapiens
ucaggucauuccaggagggcca

SEQ ID NO: 111699 - RNA, 22 nt, Homo sapiens
ucaggugcaguggcucugaccu

SEQ ID NO: 111700 - RNA, 22 nt, Homo sapiens
ucagugguuaaaagauucuaga

SEQ ID NO: 111701 - RNA, 22 nt, Homo sapiens
ucauagucuaagguucuuuugc

SEQ ID NO: 111702 - RNA, 22 nt, Homo sapiens
uccaauguaaucaucauugaau

SEQ ID NO: 111703 - RNA, 22 nt, Homo sapiens
uccccggaugacggccgcuuca

SEQ ID NO: 111704 - RNA, 22 nt, Homo sapiens
uccccugagaccccucagcacu

SEQ ID NO: 111705 - RNA, 22 nt, Homo sapiens
ucucaguggcuuccucacuuuu

SEQ ID NO: 111706 - RNA, 22 nt, Homo sapiens
ucugagguuaaauuuuauaguu

SEQ ID NO: 111707 - RNA, 22 nt, Homo sapiens
ucugucacugguggacgaucac

SEQ ID NO: 111708 - RNA, 22 nt, Homo sapiens
ucuuaguuuagauuagcaauuc

SEQ ID NO: 111709 - RNA, 22 nt, Homo sapiens
ucuuugauuaugcagauggguu

SEQ ID NO: 111710 - RNA, 22 nt, Homo sapiens
ucuuuggucuacuuucauaugu

SEQ ID NO: 111711 - RNA, 22 nt, Homo sapiens
ucuuuguuagaacccucuccuu

SEQ ID NO: 111712 - RNA, 22 nt, Homo sapiens
ugaaggccgggcaugguggcuc

SEQ ID NO: 111713 - RNA, 22 nt, Homo sapiens
ugaagugggaaaugaguauuaa

SEQ ID NO: 111714 - RNA, 22 nt, Homo sapiens
ugaauagacacuaaagacugua

SEQ ID NO: 111715 - RNA, 22 nt, Homo sapiens
ugacagcugaagauguugaacc

SEQ ID NO: 111716 - RNA, 22 nt, Homo sapiens
ugacucagauagguguguauuc

SEQ ID NO: 111717 - RNA, 22 nt, Homo sapiens
ugacuugauacauguuuuugaa

SEQ ID NO: 111718 - RNA, 22 nt, Homo sapiens
ugagacugauaggacauuuucu

SEQ ID NO: 111719 - RNA, 22 nt, Homo sapiens
ugagaggugaauggcaggcuca

SEQ ID NO: 111720 - RNA, 22 nt, Homo sapiens
ugagauaguuguagauguacau

SEQ ID NO: 111721 - RNA, 22 nt, Homo sapiens
ugagaugaagucucacucuguc

SEQ ID NO: 111722 - RNA, 22 nt, Homo sapiens
ugagaugaggucucacucuguu

SEQ ID NO: 111723 - RNA, 22 nt, Homo sapiens
ugaggugcagcaauccucaugu

SEQ ID NO: 111724 - RNA, 22 nt, Homo sapiens
ugagguugguauuacugucucu

SEQ ID NO: 111725 - RNA, 22 nt, Homo sapiens
ugagugaaggggcucuguugug

SEQ ID NO: 111726 - RNA, 21 nt, Homo sapiens
ugagugcugagugaggguuga

SEQ ID NO: 111727 - RNA, 18 nt, Homo sapiens
ugauugacuuauuuaggu

SEQ ID NO: 111728 - RNA, 22 nt, Homo sapiens
ugcaaagaaauuuuggugacca

SEQ ID NO: 111729 - RNA, 19 nt, Homo sapiens
ugcagcaauguaaaagaca

SEQ ID NO: 111730 - RNA, 18 nt, Homo sapiens
ugcagcuuugugauuggc

SEQ ID NO: 111731 - RNA, 23 nt, Homo sapiens
ugcaguagugagaucuaggcuca

SEQ ID NO: 111732 - RNA, 22 nt, Homo sapiens
ugcagugcaugacuguguuaug

SEQ ID NO: 111733 - RNA, 17 nt, Homo sapiens
ugcauagugggaggaga

SEQ ID NO: 111734 - RNA, 21 nt, Homo sapiens
ugcauuggagaauguuucuca

SEQ ID NO: 111735 - RNA, 22 nt, Homo sapiens
ugcuguguugcuggcuuaaaga

SEQ ID NO: 111736 - RNA, 22 nt, Homo sapiens
ugcuucauuggccaccaggaag

SEQ ID NO: 111737 - RNA, 20 nt, Homo sapiens
uggaccagagagguggggac

SEQ ID NO: 111738 - RNA, 22 nt, Homo sapiens
uggagacaaagauagaaaagca

SEQ ID NO: 111739 - RNA, 22 nt, Homo sapiens
uggaguaggccuaagaaugaca

SEQ ID NO: 111740 - RNA, 22 nt, Homo sapiens
uggaguguaaauuaguucagcc

SEQ ID NO: 111741 - RNA, 20 nt, Homo sapiens
uggaguuguggcaguuugga

SEQ ID NO: 111742 - RNA, 19 nt, Homo sapiens
uggcacuugacguccggau

SEQ ID NO: 111743 - RNA, 22 nt, Homo sapiens
uuggagagagaggacucccggc

SEQ ID NO: 111744 - RNA, 22 nt, Homo sapiens
uuggccccucccaaauuucaug

SEQ ID NO: 111745 - RNA, 22 nt, Homo sapiens
uugggccacuuuaguuuccuua

SEQ ID NO: 111746 - RNA, 22 nt, Homo sapiens
uugguaaugggcugguauaacc

SEQ ID NO: 111747 - RNA, 22 nt, Homo sapiens
uugguccccuucaaccagcugu

SEQ ID NO: 111748 - RNA, 20 nt, Homo sapiens
uuggugaccuacagaugugg

SEQ ID NO: 111749 - RNA, 22 nt, Homo sapiens
uuguacuucagacaugccaaag

SEQ ID NO: 111750 - RNA, 22 nt, Homo sapiens
uuguacuuuuaguagagacggg

SEQ ID NO: 111751 - RNA, 22 nt, Homo sapiens
uugucccauggggucuuccuuu

SEQ ID NO: 111752 - RNA, 22 nt, Homo sapiens
uugugauugagugauccuuguu

SEQ ID NO: 111753 - RNA, 22 nt, Homo sapiens
uugugcuuuugagcugagauga

SEQ ID NO: 111754 - RNA, 22 nt, Homo sapiens
uuuaugucuguacaucgggcgg

SEQ ID NO: 111755 - RNA, 22 nt, Homo sapiens
uuucauguuuuucugugaggca

SEQ ID NO: 111756 - RNA, 22 nt, Homo sapiens
uuugagauaucuuccaucagua

SEQ ID NO: 111757 - RNA, 22 nt, Homo sapiens
uuugcuucacuguuuggcaaaa

SEQ ID NO: 111758 - RNA, 22 nt, Homo sapiens
uuuggcccugagggauggcaua

SEQ ID NO: 111759 - RNA, 22 nt, Homo sapiens
uuugggccaugcuucccgguca

SEQ ID NO: 111760 - RNA, 22 nt, Homo sapiens
uuugguaguuuguugggaccca

SEQ ID NO: 111761 - RNA, 22 nt, Homo sapiens
uuuuaacagccaggggacggcc

SEQ ID NO: 111762 - RNA, 22 nt, Homo sapiens
uuuuccagugggacucccauua

SEQ ID NO: 111763 - RNA, 22 nt, Homo sapiens
uuuugcaauauguuccugaaua

SEQ ID NO: 111764 - RNA, 18 nt, Homo sapiens
uuuuugaggcacagggga

SEQ ID NO: 111765 - RNA, 22 nt, Homo sapiens
aaagucuagaggaucaugugug

SEQ ID NO: 111766 - RNA, 22 nt, Homo sapiens
aaaguggacuaagugaauauga

SEQ ID NO: 111767 - RNA, 22 nt, Homo sapiens
aacagagcuggugacuccaggu

SEQ ID NO: 111768 - RNA, 22 nt, Homo sapiens
aacuggcauagccagacuucuc

SEQ ID NO: 111769 - RNA, 22 nt, Homo sapiens
aacuggcauauucugguugcgg

SEQ ID NO: 111770 - RNA, 22 nt, Homo sapiens
aacuggcauguuuuaaggcuua

SEQ ID NO: 111771 - RNA, 22 nt, Homo sapiens
aacuggccuccuugggaaauua

SEQ ID NO: 111772 - RNA, 22 nt, Homo sapiens
aagagguuuaacugacucacag

SEQ ID NO: 111773 - RNA, 22 nt, Homo sapiens
aagcacccagccucacgccugc

SEQ ID NO: 111774 - RNA, 22 nt, Homo sapiens
aagcuccauuucugccaugaga

SEQ ID NO: 111775 - RNA, 22 nt, Homo sapiens
aagcuggauuucgcauccuguu

SEQ ID NO: 111776 - RNA, 22 nt, Homo sapiens
aaguaaacauugagagacaaga

SEQ ID NO: 111777 - RNA, 22 nt, Homo sapiens
aaguauuaugaguccuuguuuu

SEQ ID NO: 111778 - RNA, 22 nt, Homo sapiens
aaguccaugaagucuugugggu

SEQ ID NO: 111779 - RNA, 22 nt, Homo sapiens
aagugcaaauucccaggcucug

SEQ ID NO: 111780 - RNA, 22 nt, Homo sapiens
aagugguguuuguauuuaugca

SEQ ID NO: 111781 - RNA, 22 nt, Homo sapiens
aauaauggcaccaaagcacaag

SEQ ID NO: 111782 - RNA, 22 nt, Homo sapiens
aauacugugauaucgagcgauu

SEQ ID NO: 111783 - RNA, 22 nt, Homo sapiens
aaucacaggucuuggcugcaug

SEQ ID NO: 111784 - RNA, 22 nt, Homo sapiens
aaucacauugaaucugcuaccu

SEQ ID NO: 111785 - RNA, 22 nt, Homo sapiens
aaugcacauauauuuccuuauu

SEQ ID NO: 111786 - RNA, 22 nt, Homo sapiens
aaugugcacuauuagggugaua

SEQ ID NO: 111787 - RNA, 22 nt, Homo sapiens
aauuaguugucgugagaguggu

SEQ ID NO: 111788 - RNA, 22 nt, Homo sapiens
acacauacacauaugguguaua

SEQ ID NO: 111789 - RNA, 20 nt, Homo sapiens
acacugugcuaaggauuuuc

SEQ ID NO: 111790 - RNA, 22 nt, Homo sapiens
acccuggaggucuacagugcag

SEQ ID NO: 111791 - RNA, 22 nt, Homo sapiens
acucagagugggccccuagaua

SEQ ID NO: 111792 - RNA, 22 nt, Homo sapiens
acugagccuuuaaaugacuuca

SEQ ID NO: 111793 - RNA, 22 nt, Homo sapiens
acugaucaauguuaaggcuuau

SEQ ID NO: 111794 - RNA, 22 nt, Homo sapiens
acugcacuccagccucccgucu

SEQ ID NO: 111795 - RNA, 20 nt, Homo sapiens
acugcacuucagccugcugg

SEQ ID NO: 111796 - RNA, 22 nt, Homo sapiens
acuguacuacagccugggugac

SEQ ID NO: 111797 - RNA, 22 nt, Homo sapiens
acuguacuccagccugggcaac

SEQ ID NO: 111798 - RNA, 22 nt, Homo sapiens
acuguacucuacccugggcaac

SEQ ID NO: 111799 - RNA, 22 nt, Homo sapiens
acuuauuguggcugacccaaac

SEQ ID NO: 111800 - RNA, 21 nt, Homo sapiens
acuuuguugggggcugaggca

SEQ ID NO: 111801 - RNA, 22 nt, Homo sapiens
agaagaacauagggugacugaa

SEQ ID NO: 111802 - RNA, 22 nt, Homo sapiens
agacacugaaauguauugaaga

SEQ ID NO: 111803 - RNA, 22 nt, Homo sapiens
agacagcugggaaauggagugu

SEQ ID NO: 111804 - RNA, 21 nt, Homo sapiens
ccugaugaccucugagaguua

SEQ ID NO: 111805 - RNA, 22 nt, Homo sapiens
ccuggcacugagcaguguucua

SEQ ID NO: 111806 - RNA, 22 nt, Homo sapiens
ccuucauugcaucuuuaagaga

SEQ ID NO: 111807 - RNA, 22 nt, Homo sapiens
ccuugcacuucccaagugaggc

SEQ ID NO: 111808 - RNA, 22 nt, Homo sapiens
ccuuuguuuaguugaauuguau

SEQ ID NO: 111809 - RNA, 22 nt, Homo sapiens
cuagcagcaugagaauggacca

SEQ ID NO: 111810 - RNA, 22 nt, Homo sapiens
cuauacuguacacugaaugagg

SEQ ID NO: 111811 - RNA, 22 nt, Homo sapiens
cucagagcacaguuuaugacag

SEQ ID NO: 111812 - RNA, 22 nt, Homo sapiens
cucagauacuugggagguugag

SEQ ID NO: 111813 - RNA, 22 nt, Homo sapiens
cucaguacuugcacagaagaac

SEQ ID NO: 111814 - RNA, 22 nt, Homo sapiens
cucaguguucccauucuaccuu

SEQ ID NO: 111815 - RNA, 22 nt, Homo sapiens
cucaguguuucagcugcucaga

SEQ ID NO: 111816 - RNA, 22 nt, Homo sapiens
cuccaggugucauccaccuccu

SEQ ID NO: 111817 - RNA, 19 nt, Homo sapiens
cucuuuggugucucuucuu

SEQ ID NO: 111818 - RNA, 19 nt, Homo sapiens
cugaaacacagagagggcu

SEQ ID NO: 111819 - RNA, 22 nt, Homo sapiens
cugagguuguucuucucagugg

SEQ ID NO: 111820 - RNA, 22 nt, Homo sapiens
cugauaugaugggugauuuuca

SEQ ID NO: 111821 - RNA, 22 nt, Homo sapiens
cugaugaaguauuuguucugga

SEQ ID NO: 111822 - RNA, 20 nt, Homo sapiens
cugcacauccacucuacuuc

SEQ ID NO: 111823 - RNA, 20 nt, Homo sapiens
cugcuccccuacaaaucuca

SEQ ID NO: 111824 - RNA, 22 nt, Homo sapiens
cuggaaagcaaagggugcauug

SEQ ID NO: 111825 - RNA, 22 nt, Homo sapiens
cuggaaaguagacaaucuaaaa

SEQ ID NO: 111826 - RNA, 22 nt, Homo sapiens
cuggacguugaggcugcaguga

SEQ ID NO: 111827 - RNA, 22 nt, Homo sapiens
cuggugagaugucuuuccucuu

SEQ ID NO: 111828 - RNA, 22 nt, Homo sapiens
cuggugauugguuucauucagu

SEQ ID NO: 111829 - RNA, 21 nt, Homo sapiens
cugguguuagcacuucuuccc

SEQ ID NO: 111830 - RNA, 22 nt, Homo sapiens
cugucaucauuucuaugugcca

SEQ ID NO: 111831 - RNA, 23 nt, Homo sapiens
cuguggugaggcccuagaaucug

SEQ ID NO: 111832 - RNA, 22 nt, Homo sapiens
cuugacaaugcuucaggcugaa

SEQ ID NO: 111833 - RNA, 22 nt, Homo sapiens
cuuuaguugucuccucaagggu

SEQ ID NO: 111834 - RNA, 22 nt, Homo sapiens
cuuuggagaaaaguucuugggc

SEQ ID NO: 111835 - RNA, 22 nt, Homo sapiens
cuuuggucaauugcugcgggga

SEQ ID NO: 111836 - RNA, 22 nt, Homo sapiens
cuuugguucuguuuauaugcug

SEQ ID NO: 111837 - RNA, 22 nt, Homo sapiens
cuuuguguggacauuucaggca

SEQ ID NO: 111838 - RNA, 22 nt, Homo sapiens
cuuuuacacugcuggugggaau

SEQ ID NO: 111839 - RNA, 22 nt, Homo sapiens
cuuuuacacuguuggugggaau

SEQ ID NO: 111840 - RNA, 22 nt, Homo sapiens
gaaagauuuuaacugggagacu

SEQ ID NO: 111841 - RNA, 22 nt, Homo sapiens
gaaagcugguauagauacauua

SEQ ID NO: 111842 - RNA, 22 nt, Homo sapiens
gaaaguaauuaacgauuguugc

SEQ ID NO: 111843 - RNA, 17 nt, Homo sapiens
gaaguguuucagcagcu

SEQ ID NO: 111844 - RNA, 22 nt, Homo sapiens
gaauagugcugcaagaaacaua

SEQ ID NO: 111845 - RNA, 22 nt, Homo sapiens
gaaucacugugguaucccaugc

SEQ ID NO: 111846 - RNA, 22 nt, Homo sapiens
gacaccugguguggaacuggag

SEQ ID NO: 111847 - RNA, 22 nt, Homo sapiens
gacuagggaaaauuauuuuguu

SEQ ID NO: 111848 - RNA, 23 nt, Homo sapiens
gaguggagacucauugauuuccu

SEQ ID NO: 111849 - RNA, 22 nt, Homo sapiens
gauacuguauccuaaaagcuuu

SEQ ID NO: 111850 - RNA, 22 nt, Homo sapiens
gauauguaguaguugaaaaaga

SEQ ID NO: 111851 - RNA, 22 nt, Homo sapiens
gaugccuauugcuaguccuaaa

SEQ ID NO: 111852 - RNA, 22 nt, Homo sapiens
gauuagugacguugagcacugu

SEQ ID NO: 111853 - RNA, 22 nt, Homo sapiens
gauuccauugcgaauuuucaga

SEQ ID NO: 111854 - RNA, 22 nt, Homo sapiens
gcaccguggaguauggggagga

SEQ ID NO: 111855 - RNA, 22 nt, Homo sapiens
gcagcacaugacuguauguaua

SEQ ID NO: 111856 - RNA, 20 nt, Homo sapiens
gcagcaccauauuucuaaga

SEQ ID NO: 111857 - RNA, 22 nt, Homo sapiens
gcagcagugcccuggauggaaa

SEQ ID NO: 111858 - RNA, 22 nt, Homo sapiens
gccugagaggauaugauccccu

SEQ ID NO: 111859 - RNA, 22 nt, Homo sapiens
gcucguuuuugccucugguugc

SEQ ID NO: 111860 - RNA, 22 nt, Homo sapiens
gcugcuuuugaugacaaaaaca

SEQ ID NO: 111861 - RNA, 22 nt, Homo sapiens
gcuggcuuucuccugaucucag

SEQ ID NO: 111862 - RNA, 22 nt, Homo sapiens
gcuucauggaggcugggcgcag

SEQ ID NO: 111863 - RNA, 22 nt, Homo sapiens
gcuuuguuaaaacacagccaca

SEQ ID NO: 111864 - RNA, 22 nt, Homo sapiens
ggaaagcuagguguggguguac

SEQ ID NO: 111865 - RNA, 22 nt, Homo sapiens
ggacagugaaugccacuccucc

SEQ ID NO: 111866 - RNA, 22 nt, Homo sapiens
ggagcuuugaaaguuuccgguu

SEQ ID NO: 111867 - RNA, 22 nt, Homo sapiens
ggcaagaaccagggauuugcgu

SEQ ID NO: 111868 - RNA, 22 nt, Homo sapiens
ggccagaugcaguggcucacac

SEQ ID NO: 111869 - RNA, 22 nt, Homo sapiens
ggccagaugcgguggcucacac

SEQ ID NO: 111870 - RNA, 22 nt, Homo sapiens
ggcccugauacaaguaaggucu

SEQ ID NO: 111871 - RNA, 22 nt, Homo sapiens
ggcucguguuuucuguccaguu

SEQ ID NO: 111872 - RNA, 22 nt, Homo sapiens
gggaaaaugucuauugaaugaa

SEQ ID NO: 111873 - RNA, 22 nt, Homo sapiens
gggaagugugguuucuuuacag

SEQ ID NO: 111874 - RNA, 22 nt, Homo sapiens
gggaguguguaggacccagugu

SEQ ID NO: 111875 - RNA, 22 nt, Homo sapiens
gggaugaagcccuaggguuggu

SEQ ID NO: 111876 - RNA, 22 nt, Homo sapiens
gggcauguggacuuguauguuu

SEQ ID NO: 111877 - RNA, 22 nt, Homo sapiens
gggggagugugguacccagcau

SEQ ID NO: 111878 - RNA, 21 nt, Homo sapiens
ggugagaaaggagacauagac

SEQ ID NO: 111879 - RNA, 22 nt, Homo sapiens
guaaaguaaagcacaucaaggu

SEQ ID NO: 111880 - RNA, 22 nt, Homo sapiens
guauuaguuaucuacugcugug

SEQ ID NO: 111881 - RNA, 22 nt, Homo sapiens
gucacugagcaauagaaaguuu

SEQ ID NO: 111882 - RNA, 22 nt, Homo sapiens
gucaugcaggguucgccagccc

SEQ ID NO: 111883 - RNA, 22 nt, Homo sapiens
guccauuuguuuccagagcacu

SEQ ID NO: 111884 - RNA, 22 nt, Homo sapiens
gucucugguugcuuuuguacca

SEQ ID NO: 111885 - RNA, 17 nt, Homo sapiens
gucuuugguugaguuua

SEQ ID NO: 111886 - RNA, 22 nt, Homo sapiens
gugagguagagcaugugaaaga

SEQ ID NO: 111887 - RNA, 21 nt, Homo sapiens
gugaggucauugggcuuucug

SEQ ID NO: 111888 - RNA, 22 nt, Homo sapiens
gugaguggacgugaccaauaaa

SEQ ID NO: 111889 - RNA, 22 nt, Homo sapiens
gugaucuucauggaaggugaaa

SEQ ID NO: 111890 - RNA, 21 nt, Homo sapiens
gugcaacucccucucccuaca

SEQ ID NO: 111891 - RNA, 23 nt, Homo sapiens
gugcaguggcgagauuucggcuc

SEQ ID NO: 111892 - RNA, 22 nt, Homo sapiens
guggaaagaacacaaaauuagg

SEQ ID NO: 111893 - RNA, 22 nt, Homo sapiens
gugggaagcuggaacucccucc

SEQ ID NO: 111894 - RNA, 22 nt, Homo sapiens
guguaaaucaaucuguugucuu

SEQ ID NO: 111895 - RNA, 22 nt, Homo sapiens
guguauauccuauuaguucugu

SEQ ID NO: 111896 - RNA, 22 nt, Homo sapiens
gugugguaggauugguuacuca

SEQ ID NO: 111897 - RNA, 22 nt, Homo sapiens
ugacuugaucacccccuaaggg

SEQ ID NO: 111898 - RNA, 22 nt, Homo sapiens
ugagaagacaucuuugcuuugu

SEQ ID NO: 111899 - RNA, 22 nt, Homo sapiens
ugagaagaugaacuccuugguc

SEQ ID NO: 111900 - RNA, 22 nt, Homo sapiens
ugagacugaguuucucucuugu

SEQ ID NO: 111901 - RNA, 22 nt, Homo sapiens
ugagagcugguuguuuaaagga

SEQ ID NO: 111902 - RNA, 22 nt, Homo sapiens
ugagaugaguucucgcucuguc

SEQ ID NO: 111903 - RNA, 20 nt, Homo sapiens
ugagaugcauugggauguuu

SEQ ID NO: 111904 - RNA, 22 nt, Homo sapiens
ugagauguagauauggauuaga

SEQ ID NO: 111905 - RNA, 22 nt, Homo sapiens
ugagauguuccaaugacuauua

SEQ ID NO: 111906 - RNA, 22 nt, Homo sapiens
ugagauuacguucggcccacuu

SEQ ID NO: 111907 - RNA, 22 nt, Homo sapiens
ugagcuccuucauaaaaaggca

SEQ ID NO: 111908 - RNA, 22 nt, Homo sapiens
ugagcugagaucaugcuauugu

SEQ ID NO: 111909 - RNA, 22 nt, Homo sapiens
ugagcugguacuaauauuauca

SEQ ID NO: 111910 - RNA, 22 nt, Homo sapiens
ugagucagucucacucugcugc

SEQ ID NO: 111911 - RNA, 22 nt, Homo sapiens
ugaguguccaaguaaggugaaa

SEQ ID NO: 111912 - RNA, 22 nt, Homo sapiens
ugauagugccuuuuauaucucu

SEQ ID NO: 111913 - RNA, 22 nt, Homo sapiens
ugcaauauccucuacuauaggu

SEQ ID NO: 111914 - RNA, 22 nt, Homo sapiens
ugcacugucuugucgcauagca

SEQ ID NO: 111915 - RNA, 22 nt, Homo sapiens
ugcacuguggucugagagacag

SEQ ID NO: 111916 - RNA, 22 nt, Homo sapiens
ugcagcucaaauuccuaacaag

SEQ ID NO: 111917 - RNA, 23 nt, Homo sapiens
ugcuccccucauggaugaauaaa

SEQ ID NO: 111918 - RNA, 22 nt, Homo sapiens
uggaaaacaugcacauuggauu

SEQ ID NO: 111919 - RNA, 22 nt, Homo sapiens
uggaaauaaaauagaguuugcc

SEQ ID NO: 111920 - RNA, 22 nt, Homo sapiens
uggaagugaacaaccaaggcag

SEQ ID NO: 111921 - RNA, 22 nt, Homo sapiens
uggagacugaucccucuuuccu

SEQ ID NO: 111922 - RNA, 19 nt, Homo sapiens
uggagauauccccuucaca

SEQ ID NO: 111923 - RNA, 22 nt, Homo sapiens
uggagugaaaacacacuaaucu

SEQ ID NO: 111924 - RNA, 22 nt, Homo sapiens
uggauagugauaagguagauga

SEQ ID NO: 111925 - RNA, 22 nt, Homo sapiens
uggcauguagucugggaccugg

SEQ ID NO: 111926 - RNA, 22 nt, Homo sapiens
uggcaugucagguuucuggguu

SEQ ID NO: 111927 - RNA, 22 nt, Homo sapiens
uggcauguuggguguugacucc

SEQ ID NO: 111928 - RNA, 20 nt, Homo sapiens
uggcauguugguaugcaccc

SEQ ID NO: 111929 - RNA, 22 nt, Homo sapiens
uggccaguuuuuaauugggucu

SEQ ID NO: 111930 - RNA, 22 nt, Homo sapiens
ugggaagaagguuuacuugcca

SEQ ID NO: 111931 - RNA, 22 nt, Homo sapiens
ugggcaaaacuaagagcugugg

SEQ ID NO: 111932 - RNA, 22 nt, Homo sapiens
ugggcuagaugcuuugggguca

SEQ ID NO: 111933 - RNA, 22 nt, Homo sapiens
uggguagagaaucaggaucuua

SEQ ID NO: 111934 - RNA, 22 nt, Homo sapiens
uggguaguguaaagcacuccag

SEQ ID NO: 111935 - RNA, 23 nt, Homo sapiens
uggguucccuaagcgcaugcugc

SEQ ID NO: 111936 - RNA, 22 nt, Homo sapiens
uggucuggagagucccgcccag

SEQ ID NO: 111937 - RNA, 21 nt, Homo sapiens
uguaacugcaaaccucagauu

SEQ ID NO: 111938 - RNA, 22 nt, Homo sapiens
uguauguaaagacaggauaaca

SEQ ID NO: 111939 - RNA, 22 nt, Homo sapiens
uguaugucuucuuuagauaagu

SEQ ID NO: 111940 - RNA, 22 nt, Homo sapiens
ugucaaagagacaucugcacuc

SEQ ID NO: 111941 - RNA, 18 nt, Homo sapiens
ugucacuggauaaugguc

SEQ ID NO: 111942 - RNA, 23 nt, Homo sapiens
ugucaucaagaugaggucacacu

SEQ ID NO: 111943 - RNA, 22 nt, Homo sapiens
ugucauggauucugagucuggg

SEQ ID NO: 111944 - RNA, 16 nt, Homo sapiens
uguccaaauaaauaca

SEQ ID NO: 111945 - RNA, 22 nt, Homo sapiens
ugucucaguuucuguggguuag

SEQ ID NO: 111946 - RNA, 19 nt, Homo sapiens
ugugaacaucacagagugu

SEQ ID NO: 111947 - RNA, 22 nt, Homo sapiens
ugugacacugaauggcagaacu

SEQ ID NO: 111948 - RNA, 16 nt, Homo sapiens
ugugaucuuuuuucuu

SEQ ID NO: 111949 - RNA, 22 nt, Homo sapiens
ugugaugguuuggaagcuucuu

SEQ ID NO: 111950 - RNA, 22 nt, Homo sapiens
ugugccacuccagcucuagcuu

SEQ ID NO: 111951 - RNA, 22 nt, Homo sapiens
ugugccacugcacucugggcaa

SEQ ID NO: 111952 - RNA, 22 nt, Homo sapiens
ugugccugagguuaacauuguu

SEQ ID NO: 111953 - RNA, 22 nt, Homo sapiens
ugugggaggugcuaauguaaau

SEQ ID NO: 111954 - RNA, 22 nt, Homo sapiens
uguguaauaccuuugacuauau

SEQ ID NO: 111955 - RNA, 22 nt, Homo sapiens
uuaaauacagcaugguguuucu

SEQ ID NO: 111956 - RNA, 22 nt, Homo sapiens
uuaaaugcuagaauuuucuuug

SEQ ID NO: 111957 - RNA, 22 nt, Homo sapiens
uuaaaugcucacauaaagguag

SEQ ID NO: 111958 - RNA, 22 nt, Homo sapiens
uuaaguagcugggcaugguggu

SEQ ID NO: 111959 - RNA, 22 nt, Homo sapiens
uuaauacucuucuaaguagucc

SEQ ID NO: 111960 - RNA, 22 nt, Homo sapiens
uuaaucacagcugaacucaaac

SEQ ID NO: 111961 - RNA, 22 nt, Homo sapiens
uuaauuguccauuauucuguuc

SEQ ID NO: 111962 - RNA, 22 nt, Homo sapiens
uuagcagcacaaaagcagacua

SEQ ID NO: 111963 - RNA, 22 nt, Homo sapiens
uuauauguuacucccucuagca

SEQ ID NO: 111964 - RNA, 22 nt, Homo sapiens
uuauauguuucuuagggacaga

SEQ ID NO: 111965 - RNA, 22 nt, Homo sapiens
uuaucagcagcaugaaaauaga

SEQ ID NO: 111966 - RNA, 22 nt, Homo sapiens
uuauucagcaccugcuguguuc

SEQ ID NO: 111967 - RNA, 22 nt, Homo sapiens
uucaagaauuaaaguggcuuuu

SEQ ID NO: 111968 - RNA, 22 nt, Homo sapiens
uucaauuaauauuauacucuca

SEQ ID NO: 111969 - RNA, 22 nt, Homo sapiens
uucagagcauugguuuuuugaa

SEQ ID NO: 111970 - RNA, 18 nt, Homo sapiens
uucauaguagcaugauuu

SEQ ID NO: 111971 - RNA, 22 nt, Homo sapiens
uuccaguguguucauccucaga

SEQ ID NO: 111972 - RNA, 22 nt, Homo sapiens
uucccagagccugggagugagg

SEQ ID NO: 111973 - RNA, 22 nt, Homo sapiens
uucccugaaguguuacucuaga

SEQ ID NO: 111974 - RNA, 22 nt, Homo sapiens
uuccugagaucagaauucaaau

SEQ ID NO: 111975 - RNA, 22 nt, Homo sapiens
uuccugugacuguguggcaccc

SEQ ID NO: 111976 - RNA, 22 nt, Homo sapiens
uucuacaggcuguucaagaagc

SEQ ID NO: 111977 - RNA, 22 nt, Homo sapiens
uucuaugguuuuuaugguguua

SEQ ID NO: 111978 - RNA, 17 nt, Homo sapiens
uucucaguucugaucuc

SEQ ID NO: 111979 - RNA, 22 nt, Homo sapiens
uucuuagucauguaauagucca

SEQ ID NO: 111980 - RNA, 22 nt, Homo sapiens
uucuucaguuacaacaaggggg

SEQ ID NO: 111981 - RNA, 22 nt, Homo sapiens
uugaaagcuaucucaaaucgcu

SEQ ID NO: 111982 - RNA, 22 nt, Homo sapiens
uugaaguguguauacauugugg

SEQ ID NO: 111983 - RNA, 22 nt, Homo sapiens
uugaauagcauguuuagugcau

SEQ ID NO: 111984 - RNA, 22 nt, Homo sapiens
uugaauguacuuguucucacua

SEQ ID NO: 111985 - RNA, 22 nt, Homo sapiens
uugagacggagucucacucugu

SEQ ID NO: 111986 - RNA, 22 nt, Homo sapiens
uugagauggagucucacucugu

SEQ ID NO: 111987 - RNA, 22 nt, Homo sapiens
uugagauggagucucacucuug

SEQ ID NO: 111988 - RNA, 22 nt, Homo sapiens
uugagauggaguuucacucucg

SEQ ID NO: 111989 - RNA, 22 nt, Homo sapiens
uugaggugggaggaucacuuga

SEQ ID NO: 111990 - RNA, 22 nt, Homo sapiens
uugaguagugugaugcaugucu

SEQ ID NO: 111991 - RNA, 22 nt, Homo sapiens
acaucauugggggcuacaggug

SEQ ID NO: 111992 - RNA, 22 nt, Homo sapiens
acccuggagagugcuguaguaa

SEQ ID NO: 111993 - RNA, 22 nt, Homo sapiens
acccugucacucccaucaauuu

SEQ ID NO: 111994 - RNA, 22 nt, Homo sapiens
acucagagauuagcacauguuu

SEQ ID NO: 111995 - RNA, 22 nt, Homo sapiens
acuccacuuucaccacagcgga

SEQ ID NO: 111996 - RNA, 21 nt, Homo sapiens
acugcacuccaaccucaacag

SEQ ID NO: 111997 - RNA, 22 nt, Homo sapiens
acuguacuccagccugggugac

SEQ ID NO: 111998 - RNA, 19 nt, Homo sapiens
acuguacuccagucugggc

SEQ ID NO: 111999 - RNA, 22 nt, Homo sapiens
acuguacuccauccugggugac

SEQ ID NO: 112000 - RNA, 22 nt, Homo sapiens
acugugcuguuuuaauuauuga

SEQ ID NO: 112001 - RNA, 22 nt, Homo sapiens
acuugacacuuauauuacucac

SEQ ID NO: 112002 - RNA, 22 nt, Homo sapiens
agaaagcgcuucccuuugcugg

SEQ ID NO: 112003 - RNA, 22 nt, Homo sapiens
agagugcuuuauuagauguagc

SEQ ID NO: 112004 - RNA, 22 nt, Homo sapiens
agcacaguuaaaugaggcuucu

SEQ ID NO: 112005 - RNA, 22 nt, Homo sapiens
agcaccauugcacuccagccug

SEQ ID NO: 112006 - RNA, 22 nt, Homo sapiens
agcaggacaauaugggaucagg

SEQ ID NO: 112007 - RNA, 22 nt, Homo sapiens
agcagguauucgggucaugggg

SEQ ID NO: 112008 - RNA, 22 nt, Homo sapiens
agcagguguccacaauguuugc

SEQ ID NO: 112009 - RNA, 22 nt, Homo sapiens
agccaagacucuguuccccuug

SEQ ID NO: 112010 - RNA, 22 nt, Homo sapiens
agcccagagacuguguaaauuu

SEQ ID NO: 112011 - RNA, 23 nt, Homo sapiens
agccugguuucccugcuucuccc

SEQ ID NO: 112012 - RNA, 22 nt, Homo sapiens
agcugcacugguauaggagaaa

SEQ ID NO: 112013 - RNA, 22 nt, Homo sapiens
agcugguauuuugucaaggaua

SEQ ID NO: 112014 - RNA, 22 nt, Homo sapiens
agcugguuuauuucucacaaca

SEQ ID NO: 112015 - RNA, 22 nt, Homo sapiens
agcuuguguuugucugccuggg

SEQ ID NO: 112016 - RNA, 22 nt, Homo sapiens
aggagguagaacauugccauuu

SEQ ID NO: 112017 - RNA, 21 nt, Homo sapiens
aggcaagacuuuuagguuugu

SEQ ID NO: 112018 - RNA, 22 nt, Homo sapiens
aggcaagcaucuugcucccuuc

SEQ ID NO: 112019 - RNA, 22 nt, Homo sapiens
aggcauguugcuucgggcuuug

SEQ ID NO: 112020 - RNA, 22 nt, Homo sapiens
aggcugguauuuacaaaagcuc

SEQ ID NO: 112021 - RNA, 21 nt, Homo sapiens
aggcuguuguuuugggaugga

SEQ ID NO: 112022 - RNA, 22 nt, Homo sapiens
agguccauugguauuauagcau

SEQ ID NO: 112023 - RNA, 22 nt, Homo sapiens
aggugcaugcuucacuggauau

SEQ ID NO: 112024 - RNA, 22 nt, Homo sapiens
aggugguauuuaaaauuauuug

SEQ ID NO: 112025 - RNA, 23 nt, Homo sapiens
aguacuguaguaauugaggggaa

SEQ ID NO: 112026 - RNA, 22 nt, Homo sapiens
agugacaugggaucaaaucuga

SEQ ID NO: 112027 - RNA, 22 nt, Homo sapiens
auacaguguauguauaguacau

SEQ ID NO: 112028 - RNA, 22 nt, Homo sapiens
auacaucugccauguuggugug

SEQ ID NO: 112029 - RNA, 22 nt, Homo sapiens
auacugguuuuugucaugugga

SEQ ID NO: 112030 - RNA, 22 nt, Homo sapiens
auagaagcugccaacguuucag

SEQ ID NO: 112031 - RNA, 22 nt, Homo sapiens
auagccucauucuucagaugag

SEQ ID NO: 112032 - RNA, 22 nt, Homo sapiens
auagcugcucaggcuuuccuca

SEQ ID NO: 112033 - RNA, 22 nt, Homo sapiens
auauauguuuucugggaagaaa

SEQ ID NO: 112034 - RNA, 22 nt, Homo sapiens
cccugagaugugaauuucagag

SEQ ID NO: 112035 - RNA, 22 nt, Homo sapiens
cccugagcagccugaguuuccc

SEQ ID NO: 112036 - RNA, 19 nt, Homo sapiens
ccugcuguucuuuugcacc

SEQ ID NO: 112037 - RNA, 22 nt, Homo sapiens
ccugucuugaagagauccuccu

SEQ ID NO: 112038 - RNA, 22 nt, Homo sapiens
ccuuggcacuuugccacagugc

SEQ ID NO: 112039 - RNA, 22 nt, Homo sapiens
cgaggaguaucuuugugguguu

SEQ ID NO: 112040 - RNA, 22 nt, Homo sapiens
cgcuggugucuaagcgacagcu

SEQ ID NO: 112041 - RNA, 22 nt, Homo sapiens
cuaaaacuuucugagugcagca

SEQ ID NO: 112042 - RNA, 22 nt, Homo sapiens
cuagcagcauaagaaucaccaa

SEQ ID NO: 112043 - RNA, 22 nt, Homo sapiens
cucaauuuggaauugucaguaa

SEQ ID NO: 112044 - RNA, 17 nt, Homo sapiens
cucacugagaacagcua

SEQ ID NO: 112045 - RNA, 22 nt, Homo sapiens
cucacuggguguaaaacaugua

SEQ ID NO: 112046 - RNA, 22 nt, Homo sapiens
cucaggguacuucuccuuugcu

SEQ ID NO: 112047 - RNA, 22 nt, Homo sapiens
cucagggugguggacucuaaua

SEQ ID NO: 112048 - RNA, 22 nt, Homo sapiens
cucccacccucauuuuuaggca

SEQ ID NO: 112049 - RNA, 22 nt, Homo sapiens
cugaauagucaacgauggacug

SEQ ID NO: 112050 - RNA, 22 nt, Homo sapiens
cugcaagaugcauaggaauuuu

SEQ ID NO: 112051 - RNA, 22 nt, Homo sapiens
cuggaaagcaaguccauugcuc

SEQ ID NO: 112052 - RNA, 22 nt, Homo sapiens
cuggagauauuggaagaaagaa

SEQ ID NO: 112053 - RNA, 22 nt, Homo sapiens
cugggaugauguaaauaggcua

SEQ ID NO: 112054 - RNA, 22 nt, Homo sapiens
cugugcaaagcgcucucggggu

SEQ ID NO: 112055 - RNA, 22 nt, Homo sapiens
cugugcauggauuuuaagauug

SEQ ID NO: 112056 - RNA, 22 nt, Homo sapiens
cugugcauucuuaaaucaggaa

SEQ ID NO: 112057 - RNA, 22 nt, Homo sapiens
cuuagguuaugauaaauuuagu

SEQ ID NO: 112058 - RNA, 17 nt, Homo sapiens
cuucaaauaauuucccc

SEQ ID NO: 112059 - RNA, 22 nt, Homo sapiens
cuucuugagggccugcugggaa

SEQ ID NO: 112060 - RNA, 22 nt, Homo sapiens
cuugcacuagugcagaggcgcu

SEQ ID NO: 112061 - RNA, 19 nt, Homo sapiens
cuugccccauucauccucu

SEQ ID NO: 112062 - RNA, 22 nt, Homo sapiens
cuugucacuguuggcuuuagaa

SEQ ID NO: 112063 - RNA, 18 nt, Homo sapiens
cuuugcagcuuccagagg

SEQ ID NO: 112064 - RNA, 23 nt, Homo sapiens
cuuuguccccacccaaaucucau

SEQ ID NO: 112065 - RNA, 22 nt, Homo sapiens
gaaagacuuucugcuguggaua

SEQ ID NO: 112066 - RNA, 22 nt, Homo sapiens
gaacuggcuuagugaaacuucc

SEQ ID NO: 112067 - RNA, 22 nt, Homo sapiens
gacuugaagaaucuaagggagg

SEQ ID NO: 112068 - RNA, 22 nt, Homo sapiens
gagagugcuuuggguguaggcc

SEQ ID NO: 112069 - RNA, 22 nt, Homo sapiens
gagauaauuugaaucauggggg

SEQ ID NO: 112070 - RNA, 22 nt, Homo sapiens
gagaugugugugauuauauaau

SEQ ID NO: 112071 - RNA, 18 nt, Homo sapiens
gagcaccuuuuuugcaga

SEQ ID NO: 112072 - RNA, 22 nt, Homo sapiens
gagcacugaauacugugguggu

SEQ ID NO: 112073 - RNA, 22 nt, Homo sapiens
gagcuaguagagugcacccggc

SEQ ID NO: 112074 - RNA, 22 nt, Homo sapiens
gagcugaucuuuucugauucca

SEQ ID NO: 112075 - RNA, 22 nt, Homo sapiens
gagcugccuugccuaugcaaga

SEQ ID NO: 112076 - RNA, 22 nt, Homo sapiens
gagcugguccuuuaaggaugca

SEQ ID NO: 112077 - RNA, 21 nt, Homo sapiens
gaggauauuuuuauguuugga

SEQ ID NO: 112078 - RNA, 22 nt, Homo sapiens
gauaaaguauuggguacuaugc

SEQ ID NO: 112079 - RNA, 22 nt, Homo sapiens
aaacugaucugaaggccaggcu

SEQ ID NO: 112080 - RNA, 22 nt, Homo sapiens
aaauucaucaaaugguuuguau

SEQ ID NO: 112081 - RNA, 22 nt, Homo sapiens
aacaccauucucuguaacaaga

SEQ ID NO: 112082 - RNA, 22 nt, Homo sapiens
aacacuguuuccagucaugauc

SEQ ID NO: 112083 - RNA, 22 nt, Homo sapiens
aacagacugucacauaaaauug

SEQ ID NO: 112084 - RNA, 22 nt, Homo sapiens
aacuggcacuacaucaagagcu

SEQ ID NO: 112085 - RNA, 22 nt, Homo sapiens
aacuggccuggcgugcagaggg

SEQ ID NO: 112086 - RNA, 22 nt, Homo sapiens
aagaugauguucuuuuucuuag

SEQ ID NO: 112087 - RNA, 22 nt, Homo sapiens
aagaugcagucauacuggagga

SEQ ID NO: 112088 - RNA, 22 nt, Homo sapiens
aagaugcagucauacuggagua

SEQ ID NO: 112089 - RNA, 20 nt, Homo sapiens
aagcugaguguuuuuuuaau

SEQ ID NO: 112090 - RNA, 22 nt, Homo sapiens
aaggagugugauucuucaguuu

SEQ ID NO: 112091 - RNA, 22 nt, Homo sapiens
aaggcacugaacuuaaauucug

SEQ ID NO: 112092 - RNA, 22 nt, Homo sapiens
ugauaucugaauagauacacaa

SEQ ID NO: 112093 - RNA, 22 nt, Homo sapiens
ugauccagugcucaguuggagu

SEQ ID NO: 112094 - RNA, 22 nt, Homo sapiens
ugaugacucuguggccccaggc

SEQ ID NO: 112095 - RNA, 20 nt, Homo sapiens
ugauuaguccacuuggcucu

SEQ ID NO: 112096 - RNA, 22 nt, Homo sapiens
ugcaagaaucagccuaucauua

SEQ ID NO: 112097 - RNA, 22 nt, Homo sapiens
ugcaccaucuugcuucuguggu

SEQ ID NO: 112098 - RNA, 21 nt, Homo sapiens
ugcagccauucagcccuaugc

SEQ ID NO: 112099 - RNA, 18 nt, Homo sapiens
ugcuccccugggugagca

SEQ ID NO: 112100 - RNA, 20 nt, Homo sapiens
uggaaaguaagucaugauau

SEQ ID NO: 112101 - RNA, 22 nt, Homo sapiens
uggaagcauagcagcgugugug

SEQ ID NO: 112102 - RNA, 21 nt, Homo sapiens
uggaaguguacaauuauaccc

SEQ ID NO: 112103 - RNA, 22 nt, Homo sapiens
uggaagugucugugcccagcuc

SEQ ID NO: 112104 - RNA, 22 nt, Homo sapiens
uggaaguuaaaugacucuuucu

SEQ ID NO: 112105 - RNA, 22 nt, Homo sapiens
uggacuguaaauuggggacucu

SEQ ID NO: 112106 - RNA, 22 nt, Homo sapiens
uggacuguaagugccuugagua

SEQ ID NO: 112107 - RNA, 22 nt, Homo sapiens
uggagagugagggccuccuuaa

SEQ ID NO: 112108 - RNA, 18 nt, Homo sapiens
uggagauaagaagaacuu

SEQ ID NO: 112109 - RNA, 22 nt, Homo sapiens
uggauggagaggcuugugaugc

SEQ ID NO: 112110 - RNA, 22 nt, Homo sapiens
uggcaagaaggauuuauuccuu

SEQ ID NO: 112111 - RNA, 22 nt, Homo sapiens
uggcaagagaacaacaucucuc

SEQ ID NO: 112112 - RNA, 22 nt, Homo sapiens
uggcaguuucacauggcucaac

SEQ ID NO: 112113 - RNA, 22 nt, Homo sapiens
uggcaugugugaagugcccagc

SEQ ID NO: 112114 - RNA, 22 nt, Homo sapiens
uggccagugucggaggccagga

SEQ ID NO: 112115 - RNA, 22 nt, Homo sapiens
uggccaguguuuuuccugggcu

SEQ ID NO: 112116 - RNA, 22 nt, Homo sapiens
uggccuguaacgcugucucagc

SEQ ID NO: 112117 - RNA, 21 nt, Homo sapiens
ugggccccuuccuuacaucau

SEQ ID NO: 112118 - RNA, 22 nt, Homo sapiens
uggguagagcacugggggcgag

SEQ ID NO: 112119 - RNA, 22 nt, Homo sapiens
uggguagaugaauccauuccaa

SEQ ID NO: 112120 - RNA, 22 nt, Homo sapiens
uggguccccuacucuuuccaca

SEQ ID NO: 112121 - RNA, 22 nt, Homo sapiens
ugguguccugucucugcgcuug

SEQ ID NO: 112122 - RNA, 22 nt, Homo sapiens
uguaugcuuuugagagauauuu

SEQ ID NO: 112123 - RNA, 22 nt, Homo sapiens
ugucauggugcucugggcccug

SEQ ID NO: 112124 - RNA, 22 nt, Homo sapiens
uguccaaaucagagguaccaaa

SEQ ID NO: 112125 - RNA, 22 nt, Homo sapiens
uguccauuuuuaugcuuauggu

SEQ ID NO: 112126 - RNA, 22 nt, Homo sapiens
ugugaccaaaaucaacauaccu

SEQ ID NO: 112127 - RNA, 22 nt, Homo sapiens
ugugccacuccaggaggcuguu

SEQ ID NO: 112128 - RNA, 22 nt, Homo sapiens
uguuacacugugcacuaaauuu

SEQ ID NO: 112129 - RNA, 22 nt, Homo sapiens
uguuuguuugauaugggauaaa

SEQ ID NO: 112130 - RNA, 22 nt, Homo sapiens
uuacacaguugguaggggcaga

SEQ ID NO: 112131 - RNA, 22 nt, Homo sapiens
uuagcagccuucaagcuccaag

SEQ ID NO: 112132 - RNA, 22 nt, Homo sapiens
uuauagacacguuguaacaaac

SEQ ID NO: 112133 - RNA, 22 nt, Homo sapiens
uuauauguuagacauggugggu

SEQ ID NO: 112134 - RNA, 22 nt, Homo sapiens
uuauuugguugcugacuuggaa

SEQ ID NO: 112135 - RNA, 22 nt, Homo sapiens
uucaacugcuucagccucccaa

SEQ ID NO: 112136 - RNA, 22 nt, Homo sapiens
uucaaguaagaaagacaucagg

SEQ ID NO: 112137 - RNA, 22 nt, Homo sapiens
uucacaugguugccuuuugauc

SEQ ID NO: 112138 - RNA, 22 nt, Homo sapiens
uucauggugguacaaaagcaau

SEQ ID NO: 112139 - RNA, 22 nt, Homo sapiens
uuccaauguuccguguugcagu

SEQ ID NO: 112140 - RNA, 22 nt, Homo sapiens
uuccagcugggggcaacucugc

SEQ ID NO: 112141 - RNA, 22 nt, Homo sapiens
uucccagugccaggcacuggga

SEQ ID NO: 112142 - RNA, 22 nt, Homo sapiens
uugauguccaucucuagguaaa

SEQ ID NO: 112143 - RNA, 22 nt, Homo sapiens
uugcacuuccgccugggugaca

SEQ ID NO: 112144 - RNA, 22 nt, Homo sapiens
uugcagcaaagagggaggggca

SEQ ID NO: 112145 - RNA, 22 nt, Homo sapiens
uugcuccucugccaggaccugu

SEQ ID NO: 112146 - RNA, 22 nt, Homo sapiens
uuggacuucuaacugacaugga

SEQ ID NO: 112147 - RNA, 22 nt, Homo sapiens
uuggagcccuaacucucaguac

SEQ ID NO: 112148 - RNA, 22 nt, Homo sapiens
uuggcaagaaccuucuuccaag

SEQ ID NO: 112149 - RNA, 22 nt, Homo sapiens
uuggccccuuucauccacagcu

SEQ ID NO: 112150 - RNA, 22 nt, Homo sapiens
uuggccgugucauuugcuuuga

SEQ ID NO: 112151 - RNA, 22 nt, Homo sapiens
uuggccuccuggucauauccag

SEQ ID NO: 112152 - RNA, 21 nt, Homo sapiens
uuggggaauggagagguuuuc

SEQ ID NO: 112153 - RNA, 22 nt, Homo sapiens
uuggguccucugguccuugguu

SEQ ID NO: 112154 - RNA, 22 nt, Homo sapiens
uuggucaggcuaaucucgaacg

SEQ ID NO: 112155 - RNA, 22 nt, Homo sapiens
uugguccucccaugcucaagag

SEQ ID NO: 112156 - RNA, 22 nt, Homo sapiens
uugucacccuacauaacaggga

SEQ ID NO: 112157 - RNA, 22 nt, Homo sapiens
uugucacccucucuuggugucu

SEQ ID NO: 112158 - RNA, 22 nt, Homo sapiens
uuguccaagucccauuuguuga

SEQ ID NO: 112159 - RNA, 22 nt, Homo sapiens
uugugguaggaugaagagauga

SEQ ID NO: 112160 - RNA, 22 nt, Homo sapiens
uugugguaggcauguaagauga

SEQ ID NO: 112161 - RNA, 22 nt, Homo sapiens
uugugguuuuagcacuguggau

SEQ ID NO: 112162 - RNA, 22 nt, Homo sapiens
uuuaaagcaugacgagaagaag

SEQ ID NO: 112163 - RNA, 22 nt, Homo sapiens
uuuaauagcagggacuuccggg

SEQ ID NO: 112164 - RNA, 22 nt, Homo sapiens
uuuauagucaggaacuugagga

SEQ ID NO: 112165 - RNA, 22 nt, Homo sapiens
uuuaucuguuuaaaacuguuca

SEQ ID NO: 112166 - RNA, 22 nt, Homo sapiens
uuucaccguguuggccaggcug

SEQ ID NO: 112167 - RNA, 22 nt, Homo sapiens
uuucaguguggcaggcauagcu

SEQ ID NO: 112168 - RNA, 19 nt, Homo sapiens
uuucauguuuuuggugaga

SEQ ID NO: 112169 - RNA, 22 nt, Homo sapiens
uuugaagcuaaggugcuugguu

SEQ ID NO: 112170 - RNA, 22 nt, Homo sapiens
uuugaaguguggcacugaguuu

SEQ ID NO: 112171 - RNA, 22 nt, Homo sapiens
uuugacaaugugugcuuguauu

SEQ ID NO: 112172 - RNA, 22 nt, Homo sapiens
uuugccaauauuuuacugagga

SEQ ID NO: 112173 - RNA, 22 nt, Homo sapiens
uuugccaaugggaauuuuccua

SEQ ID NO: 112174 - RNA, 22 nt, Homo sapiens
uuugcuuaaaucuuaaucagau

SEQ ID NO: 112175 - RNA, 22 nt, Homo sapiens
uuugggaaaugaaguugguaga

SEQ ID NO: 112176 - RNA, 22 nt, Homo sapiens
uuugggccauggcuuuuccacg

SEQ ID NO: 112177 - RNA, 22 nt, Homo sapiens
uuuguaagaugcauagauugca

SEQ ID NO: 112178 - RNA, 22 nt, Homo sapiens
uuuguacucccuuuagauaaaa

SEQ ID NO: 112179 - RNA, 22 nt, Homo sapiens
uuuguagcucacucugagcuga

SEQ ID NO: 112180 - RNA, 21 nt, Homo sapiens
uuuguaguagcaugauuuaua

SEQ ID NO: 112181 - RNA, 22 nt, Homo sapiens
uuugugugugauuauaaaaggu

SEQ ID NO: 112182 - RNA, 16 nt, Homo sapiens
uuuuugcagaaaugac

SEQ ID NO: 112183 - RNA, 22 nt, Homo sapiens
ugaacacaucuccugguaccug

SEQ ID NO: 112184 - RNA, 22 nt, Homo sapiens
ugaacacuggauaaggagucag

SEQ ID NO: 112185 - RNA, 22 nt, Homo sapiens
ugaauaguaauguguuuggucu

SEQ ID NO: 112186 - RNA, 22 nt, Homo sapiens
ugaaugguuuuuagagaacaau

SEQ ID NO: 112187 - RNA, 22 nt, Homo sapiens
ugaauguccauugauguuuuga

SEQ ID NO: 112188 - RNA, 22 nt, Homo sapiens
ugacagagcaggacuucaucuc

SEQ ID NO: 112189 - RNA, 22 nt, Homo sapiens
ugacagcugaggcccagaguac

SEQ ID NO: 112190 - RNA, 22 nt, Homo sapiens
ugacagcuguugaggcauuuau

SEQ ID NO: 112191 - RNA, 22 nt, Homo sapiens
ugacugugcagcuccaucaggg

SEQ ID NO: 112192 - RNA, 22 nt, Homo sapiens
ugacuugauccauggggcucca

SEQ ID NO: 112193 - RNA, 22 nt, Homo sapiens
ugagacaucucuccugagacag

SEQ ID NO: 112194 - RNA, 22 nt, Homo sapiens
ugagacugagucucccucuguc

SEQ ID NO: 112195 - RNA, 22 nt, Homo sapiens
ugagacugaguuuugccuuugu

SEQ ID NO: 112196 - RNA, 22 nt, Homo sapiens
ugagacugguaauguguagggc

SEQ ID NO: 112197 - RNA, 22 nt, Homo sapiens
ugagauaaucaugugauuucau

SEQ ID NO: 112198 - RNA, 22 nt, Homo sapiens
ugagaugugaucaccugaaggg

SEQ ID NO: 112199 - RNA, 22 nt, Homo sapiens
ugagcugagaucgugccauugu

SEQ ID NO: 112200 - RNA, 22 nt, Homo sapiens
ugaggacugagaggcacugugg

SEQ ID NO: 112201 - RNA, 22 nt, Homo sapiens
ugaggaguauguucuguagacc

SEQ ID NO: 112202 - RNA, 22 nt, Homo sapiens
ugaguagaacaucaagucauac

SEQ ID NO: 112203 - RNA, 23 nt, Homo sapiens
ugauaugccuaggaguauauuuu

SEQ ID NO: 112204 - RNA, 20 nt, Homo sapiens
ugauguccaggcagagguuu

SEQ ID NO: 112205 - RNA, 22 nt, Homo sapiens
uggaaauuaagucuuuccugag

SEQ ID NO: 112206 - RNA, 22 nt, Homo sapiens
uggaaguuaaauuaguugauga

SEQ ID NO: 112207 - RNA, 22 nt, Homo sapiens
uggaccccugcucgggagcccu

SEQ ID NO: 112208 - RNA, 22 nt, Homo sapiens
uggagagucauuuauaguauuu

SEQ ID NO: 112209 - RNA, 22 nt, Homo sapiens
uggcaagaacaacaauuacuuu

SEQ ID NO: 112210 - RNA, 22 nt, Homo sapiens
uggcaagaaccacaauuacuuu

SEQ ID NO: 112211 - RNA, 22 nt, Homo sapiens
uggcaagaaccacaguuacuuu

SEQ ID NO: 112212 - RNA, 22 nt, Homo sapiens
uggcaagaagagcaugagacca

SEQ ID NO: 112213 - RNA, 22 nt, Homo sapiens
uggcaagagcugcauucaucug

SEQ ID NO: 112214 - RNA, 22 nt, Homo sapiens
uggcaagaucacaauuacuuuu

SEQ ID NO: 112215 - RNA, 22 nt, Homo sapiens
uggcauauaaagauguguucaa

SEQ ID NO: 112216 - RNA, 22 nt, Homo sapiens
uggcauguguuugaaugaguau

SEQ ID NO: 112217 - RNA, 22 nt, Homo sapiens
uggccagugucuauugguuucc

SEQ ID NO: 112218 - RNA, 22 nt, Homo sapiens
uggccuguaacccucucauagg

SEQ ID NO: 112219 - RNA, 22 nt, Homo sapiens
uggcuguguccucucccaaauc

SEQ ID NO: 112220 - RNA, 22 nt, Homo sapiens
uggguagauaucauaguugccc

SEQ ID NO: 112221 - RNA, 22 nt, Homo sapiens
ugguauguaugauuaacaugga

SEQ ID NO: 112222 - RNA, 22 nt, Homo sapiens
uggucaugaggugaggcuucuc

SEQ ID NO: 112223 - RNA, 22 nt, Homo sapiens
ugguccacuaacccucaguauc

SEQ ID NO: 112224 - RNA, 23 nt, Homo sapiens
uggucccguguucuggcuuuagg

SEQ ID NO: 112225 - RNA, 22 nt, Homo sapiens
uguaaacauguauguguuuaug

SEQ ID NO: 112226 - RNA, 22 nt, Homo sapiens
uguaacugcuuagaagguuuua

SEQ ID NO: 112227 - RNA, 22 nt, Homo sapiens
ugucaaacauuaugaugcucua

SEQ ID NO: 112228 - RNA, 20 nt, Homo sapiens
ugucaagaaacauuacuuau

SEQ ID NO: 112229 - RNA, 22 nt, Homo sapiens
ugucaccauuuguaggugagga

SEQ ID NO: 112230 - RNA, 22 nt, Homo sapiens
ugucaguuuuaacuagggaaua

SEQ ID NO: 112231 - RNA, 22 nt, Homo sapiens
ugucauguugguguacugcacc

SEQ ID NO: 112232 - RNA, 22 nt, Homo sapiens
uguccaaauugaaucaucuggu

SEQ ID NO: 112233 - RNA, 22 nt, Homo sapiens
ugucuaguuuugaaguauagca

SEQ ID NO: 112234 - RNA, 22 nt, Homo sapiens
ugucucaguuacggcaauucca

SEQ ID NO: 112235 - RNA, 23 nt, Homo sapiens
ugugacacuuccgucaguucauu

SEQ ID NO: 112236 - RNA, 22 nt, Homo sapiens
ugugaguguguacuaguuauca

SEQ ID NO: 112237 - RNA, 22 nt, Homo sapiens
ugugauggaguuucauggacug

SEQ ID NO: 112238 - RNA, 22 nt, Homo sapiens
uuaaagcuggcguuacaguuug

SEQ ID NO: 112239 - RNA, 22 nt, Homo sapiens
uuaaugacaucauaggugaagu

SEQ ID NO: 112240 - RNA, 22 nt, Homo sapiens
uuauucauuaacagggaccaaa

SEQ ID NO: 112241 - RNA, 22 nt, Homo sapiens
uuauucauuaauugcuaagguu

SEQ ID NO: 112242 - RNA, 22 nt, Homo sapiens
uuauuugguuauuguaauuggg

SEQ ID NO: 112243 - RNA, 22 nt, Homo sapiens
uucaagugguucagaagucuga

SEQ ID NO: 112244 - RNA, 22 nt, Homo sapiens
uucacaaugccuuguugauggu

SEQ ID NO: 112245 - RNA, 22 nt, Homo sapiens
uucacagcuuaauaaggcucag

SEQ ID NO: 112246 - RNA, 23 nt, Homo sapiens
uucaccguguuggccaggcuggu

SEQ ID NO: 112247 - RNA, 22 nt, Homo sapiens
uucagacugggugaagagggua

SEQ ID NO: 112248 - RNA, 22 nt, Homo sapiens
uucagugucauuaacacaguag

SEQ ID NO: 112249 - RNA, 22 nt, Homo sapiens
uucauggacucaauaguuucgc

SEQ ID NO: 112250 - RNA, 22 nt, Homo sapiens
uuccaugagaugcaucaaagcu

SEQ ID NO: 112251 - RNA, 22 nt, Homo sapiens
uuccauguugauacgugaaguu

SEQ ID NO: 112252 - RNA, 19 nt, Homo sapiens
uuccugagaacaagggcuu

SEQ ID NO: 112253 - RNA, 22 nt, Homo sapiens
uucuucaggccacaaaaauggu

SEQ ID NO: 112254 - RNA, 22 nt, Homo sapiens
uugaaguagcauuucaugucua

SEQ ID NO: 112255 - RNA, 22 nt, Homo sapiens
uugaauagacagccagcuuuaa

SEQ ID NO: 112256 - RNA, 22 nt, Homo sapiens
uugaauaggcucaugcuuauca

SEQ ID NO: 112257 - RNA, 22 nt, Homo sapiens
uugaauagugacuuugauucug

SEQ ID NO: 112258 - RNA, 22 nt, Homo sapiens
uugacauaaucauuucacagug

SEQ ID NO: 112259 - RNA, 22 nt, Homo sapiens
uugacauaguuucugaaauaga

SEQ ID NO: 112260 - RNA, 22 nt, Homo sapiens
uugacauauguguguccacaua

SEQ ID NO: 112261 - RNA, 22 nt, Homo sapiens
uugacauauuugugcuuaagaa

SEQ ID NO: 112262 - RNA, 22 nt, Homo sapiens
uugagauggaguuucacucugu

SEQ ID NO: 112263 - RNA, 22 nt, Homo sapiens
uugagauggugccacuguacuc

SEQ ID NO: 112264 - RNA, 22 nt, Homo sapiens
uugaggaaugugauuucaaaua

SEQ ID NO: 112265 - RNA, 22 nt, Homo sapiens
uugaggacugcuaagcauuuga

SEQ ID NO: 112266 - RNA, 22 nt, Homo sapiens
uugagggaagccagaggucugc

SEQ ID NO: 112267 - RNA, 22 nt, Homo sapiens
uugaucaauagaauacaacaga

SEQ ID NO: 112268 - RNA, 22 nt, Homo sapiens
uugcaccacugcguuccagccu

SEQ ID NO: 112269 - RNA, 22 nt, Homo sapiens
uugcuucauucaacauugaggg

SEQ ID NO: 112270 - RNA, 22 nt, Homo sapiens
uugcuucuuucgucuggcccca

SEQ ID NO: 112271 - RNA, 22 nt, Homo sapiens
uuggaagacaaugcugauucuc

SEQ ID NO: 112272 - RNA, 22 nt, Homo sapiens
uuggaagagaagggagauaaac

SEQ ID NO: 112273 - RNA, 19 nt, Homo sapiens
uuggaauuuuagaguuuga

SEQ ID NO: 112274 - RNA, 22 nt, Homo sapiens
uuggagagaaaggcaguuccug

SEQ ID NO: 112275 - RNA, 22 nt, Homo sapiens
gucuuggagaacucagcuuggc

SEQ ID NO: 112276 - RNA, 22 nt, Homo sapiens
gugaccauuugacauauccuug

SEQ ID NO: 112277 - RNA, 22 nt, Homo sapiens
gugacuggacucugaagaaaau

SEQ ID NO: 112278 - RNA, 22 nt, Homo sapiens
gugagcauaacaacagaguuua

SEQ ID NO: 112279 - RNA, 22 nt, Homo sapiens
gugagcauuacucaugggauca

SEQ ID NO: 112280 - RNA, 17 nt, Homo sapiens
gugagguggguaguauc

SEQ ID NO: 112281 - RNA, 22 nt, Homo sapiens
gugaucuuucaggcuugaccau

SEQ ID NO: 112282 - RNA, 18 nt, Homo sapiens
gugcaaugaauagcagag

SEQ ID NO: 112283 - RNA, 22 nt, Homo sapiens
guggaaugauaucucauugugg

SEQ ID NO: 112284 - RNA, 22 nt, Homo sapiens
guggcagagucagagggaaaug

SEQ ID NO: 112285 - RNA, 22 nt, Homo sapiens
guggcagugugaggauccugcu

SEQ ID NO: 112286 - RNA, 22 nt, Homo sapiens
gugggaugcaaguaaaauuguc

SEQ ID NO: 112287 - RNA, 22 nt, Homo sapiens
gugggguagcaggcuccuaucu

SEQ ID NO: 112288 - RNA, 22 nt, Homo sapiens
gugggguaggcaauuccuagug

SEQ ID NO: 112289 - RNA, 22 nt, Homo sapiens
guguagagaaaaguaccauuuu

SEQ ID NO: 112290 - RNA, 22 nt, Homo sapiens
gugucacuguugagaaguccac

SEQ ID NO: 112291 - RNA, 22 nt, Homo sapiens
gugucccagugugcauacaggu

SEQ ID NO: 112292 - RNA, 22 nt, Homo sapiens
guguuugguugauagagccacu

SEQ ID NO: 112293 - RNA, 22 nt, Homo sapiens
guucacacuugcaaccccagca

SEQ ID NO: 112294 - RNA, 22 nt, Homo sapiens
guucuggagauaaagccaaggu

SEQ ID NO: 112295 - RNA, 22 nt, Homo sapiens
uaaacugucuugcaguuacaug

SEQ ID NO: 112296 - RNA, 20 nt, Homo sapiens
uaaaugccucaugcuuuauu

SEQ ID NO: 112297 - RNA, 22 nt, Homo sapiens
uaacaggcaaggucacaccuug

SEQ ID NO: 112298 - RNA, 22 nt, Homo sapiens
uaacccuuaguaucuguggguu

SEQ ID NO: 112299 - RNA, 22 nt, Homo sapiens
uaagacuuuuugggaauauaga

SEQ ID NO: 112300 - RNA, 20 nt, Homo sapiens
uaagccacacagucuaaggu

SEQ ID NO: 112301 - RNA, 22 nt, Homo sapiens
uaagcucauuccagccaugucc

SEQ ID NO: 112302 - RNA, 22 nt, Homo sapiens
uaaggcacccuucugaguagag

SEQ ID NO: 112303 - RNA, 22 nt, Homo sapiens
uaagugaauauggacaguuagc

SEQ ID NO: 112304 - RNA, 22 nt, Homo sapiens
uaaugcauguaaugggcugaua

SEQ ID NO: 112305 - RNA, 22 nt, Homo sapiens
uacaauagugacaaaucagcau

SEQ ID NO: 112306 - RNA, 22 nt, Homo sapiens
uacaccugcacucuagccuggg

SEQ ID NO: 112307 - RNA, 22 nt, Homo sapiens
uacagaguauccauuugaguuc

SEQ ID NO: 112308 - RNA, 22 nt, Homo sapiens
uacaguggaaguuaaccccauu

SEQ ID NO: 112309 - RNA, 22 nt, Homo sapiens
uacaguggcaugucaggugcuu

SEQ ID NO: 112310 - RNA, 22 nt, Homo sapiens
uacugcacuccacccuggguga

SEQ ID NO: 112311 - RNA, 22 nt, Homo sapiens
uacugcaucgaaaugcuuuuau

SEQ ID NO: 112312 - RNA, 22 nt, Homo sapiens
uacugcauucuccgccuccggg

SEQ ID NO: 112313 - RNA, 22 nt, Homo sapiens
uacugcauuucacuguuaaaga

SEQ ID NO: 112314 - RNA, 22 nt, Homo sapiens
uagaccauucuauuuccuaugc

SEQ ID NO: 112315 - RNA, 22 nt, Homo sapiens
uagagccauugcagauguuuga

SEQ ID NO: 112316 - RNA, 22 nt, Homo sapiens
uagauuaucccugauuugucca

SEQ ID NO: 112317 - RNA, 19 nt, Homo sapiens
uagcacagggucccagacu

SEQ ID NO: 112318 - RNA, 22 nt, Homo sapiens
uagcaccugugcacaccaggca

SEQ ID NO: 112319 - RNA, 22 nt, Homo sapiens
uagcuucuccauagcuccaugu

SEQ ID NO: 112320 - RNA, 22 nt, Homo sapiens
uauacaugugccauguuggugu

SEQ ID NO: 112321 - RNA, 22 nt, Homo sapiens
uauacaugugggcaucaggaga

SEQ ID NO: 112322 - RNA, 22 nt, Homo sapiens
uauacuguuuucuauaguggcu

SEQ ID NO: 112323 - RNA, 22 nt, Homo sapiens
uaugucauggguaaagugcccu

SEQ ID NO: 112324 - RNA, 20 nt, Homo sapiens
uauucacucuccagucuugc

SEQ ID NO: 112325 - RNA, 22 nt, Homo sapiens
uauugcuugaggaaaugguaau

SEQ ID NO: 112326 - RNA, 22 nt, Homo sapiens
ucacagcuaaaaugaaaguagu

SEQ ID NO: 112327 - RNA, 19 nt, Homo sapiens
ucacaggguugacuugagg

SEQ ID NO: 112328 - RNA, 22 nt, Homo sapiens
ucacaguccuguuuaggagagg

SEQ ID NO: 112329 - RNA, 22 nt, Homo sapiens
ucacauguguaaauugguguaa

SEQ ID NO: 112330 - RNA, 22 nt, Homo sapiens
ucaccaccuuccaggaccacug

SEQ ID NO: 112331 - RNA, 22 nt, Homo sapiens
ucaccucgugaucugcccacuu

SEQ ID NO: 112332 - RNA, 22 nt, Homo sapiens
ucacugugagaguuuauccugu

SEQ ID NO: 112333 - RNA, 22 nt, Homo sapiens
ucacugugcacauaugauaggu

SEQ ID NO: 112334 - RNA, 22 nt, Homo sapiens
ucacugugguuugggaaagugc

SEQ ID NO: 112335 - RNA, 22 nt, Homo sapiens
ucacuguguauguauaugcagg

SEQ ID NO: 112336 - RNA, 22 nt, Homo sapiens
ucacuuugacggccaacuucua

SEQ ID NO: 112337 - RNA, 18 nt, Homo sapiens
ucagagugcagacuauac

SEQ ID NO: 112338 - RNA, 22 nt, Homo sapiens
ucagagugcagggaguagcagc

SEQ ID NO: 112339 - RNA, 22 nt, Homo sapiens
ucaggugcagagaagaaauggg

SEQ ID NO: 112340 - RNA, 22 nt, Homo sapiens
ucaguggagccucacucugugg

SEQ ID NO: 112341 - RNA, 22 nt, Homo sapiens
ucaucagaguuuacaagcucag

SEQ ID NO: 112342 - RNA, 22 nt, Homo sapiens
ucaugggagcccccaucaugag

SEQ ID NO: 112343 - RNA, 19 nt, Homo sapiens
uccaugagcccacagugau

SEQ ID NO: 112344 - RNA, 22 nt, Homo sapiens
uccaugaguccauuagaaaaaa

SEQ ID NO: 112345 - RNA, 22 nt, Homo sapiens
uccauguagaagacaggggaga

SEQ ID NO: 112346 - RNA, 22 nt, Homo sapiens
ucccauguagcuaggauuacag

SEQ ID NO: 112347 - RNA, 23 nt, Homo sapiens
uccccgggagcaccagcuuguug

SEQ ID NO: 112348 - RNA, 19 nt, Homo sapiens
uccccuguggauaccaaga

SEQ ID NO: 112349 - RNA, 20 nt, Homo sapiens
ucccucaaacuuuuccacug

SEQ ID NO: 112350 - RNA, 22 nt, Homo sapiens
ucucaaguggucgcaguuagau

SEQ ID NO: 112351 - RNA, 22 nt, Homo sapiens
ucucagcacaaacaaaauugcu

SEQ ID NO: 112352 - RNA, 22 nt, Homo sapiens
ucucagcacagucagggcgccu

SEQ ID NO: 112353 - RNA, 22 nt, Homo sapiens
ucucauggcucacccugcauag

SEQ ID NO: 112354 - RNA, 22 nt, Homo sapiens
ucucuggauaucuacuuauguu

SEQ ID NO: 112355 - RNA, 22 nt, Homo sapiens
ucugagguuacugcuuuguaga

SEQ ID NO: 112356 - RNA, 22 nt, Homo sapiens
ucuggugugcucuggacuugca

SEQ ID NO: 112357 - RNA, 22 nt, Homo sapiens
ucuguacugccaaguuucuuua

SEQ ID NO: 112358 - RNA, 22 nt, Homo sapiens
ucuguacuuccguaccuaaagu

SEQ ID NO: 112359 - RNA, 22 nt, Homo sapiens
ucugugaaaucauuuccuguaa

SEQ ID NO: 112360 - RNA, 22 nt, Homo sapiens
ucugugcugagaguugaaaguu

SEQ ID NO: 112361 - RNA, 22 nt, Homo sapiens
ucuugcuuuugcagagcuucuc

SEQ ID NO: 112362 - RNA, 22 nt, Homo sapiens
ucuuuggugaauggucauccag

SEQ ID NO: 112363 - RNA, 22 nt, Homo sapiens
ucuuugguucuguuuauguaau

SEQ ID NO: 112364 - RNA, 22 nt, Homo sapiens
ucuuuguuggaguccaaggaua

SEQ ID NO: 112365 - RNA, 22 nt, Homo sapiens
ucuuuugugagucagccucucc

SEQ ID NO: 112366 - RNA, 22 nt, Homo sapiens
ugaaaugaucaguuugguuacu

SEQ ID NO: 112367 - RNA, 22 nt, Homo sapiens
uuccugagccuuguaucuagua

SEQ ID NO: 112368 - RNA, 22 nt, Homo sapiens
uuccugucuuccaagagagauu

SEQ ID NO: 112369 - RNA, 22 nt, Homo sapiens
uuccugugacccccaagcccac

SEQ ID NO: 112370 - RNA, 22 nt, Homo sapiens
uucuggccccucccaaucucau

SEQ ID NO: 112371 - RNA, 22 nt, Homo sapiens
uucuucaggcauucccagaagc

SEQ ID NO: 112372 - RNA, 19 nt, Homo sapiens
uucuuuguugugggggcug

SEQ ID NO: 112373 - RNA, 22 nt, Homo sapiens
uugaaagcuaucagagauucca

SEQ ID NO: 112374 - RNA, 22 nt, Homo sapiens
uugacuacaccaugccaggaac

SEQ ID NO: 112375 - RNA, 22 nt, Homo sapiens
uugagacgaagucucacucuug

SEQ ID NO: 112376 - RNA, 21 nt, Homo sapiens
uugagacggagucucacucug

SEQ ID NO: 112377 - RNA, 22 nt, Homo sapiens
uugagacugaacauuuguguac

SEQ ID NO: 112378 - RNA, 22 nt, Homo sapiens
uugagauggagccucacucugc

SEQ ID NO: 112379 - RNA, 22 nt, Homo sapiens
uugagauggagcuucacucuug

SEQ ID NO: 112380 - RNA, 22 nt, Homo sapiens
uugagauggagucucacucuuc

SEQ ID NO: 112381 - RNA, 22 nt, Homo sapiens
uugagauggagucucacugugu

SEQ ID NO: 112382 - RNA, 22 nt, Homo sapiens
uugagcucaucaagauagagaa

SEQ ID NO: 112383 - RNA, 22 nt, Homo sapiens
uugagggaaacauucacaucau

SEQ ID NO: 112384 - RNA, 22 nt, Homo sapiens
uugauagaucagggauuugauu

SEQ ID NO: 112385 - RNA, 22 nt, Homo sapiens
uugauaguccuguaucuauuuu

SEQ ID NO: 112386 - RNA, 22 nt, Homo sapiens
uugaucaaaucugagugagaau

SEQ ID NO: 112387 - RNA, 22 nt, Homo sapiens
uugcaaaguuugccuccuguag

SEQ ID NO: 112388 - RNA, 22 nt, Homo sapiens
uugcacucuccagccucggcaa

SEQ ID NO: 112389 - RNA, 22 nt, Homo sapiens
uugcacuugcugaggagugauu

SEQ ID NO: 112390 - RNA, 22 nt, Homo sapiens
uugcagagaaauuucugguuua

SEQ ID NO: 112391 - RNA, 22 nt, Homo sapiens
uuggccauaugacuugcuuugg

SEQ ID NO: 112392 - RNA, 22 nt, Homo sapiens
uuggccauggagcacuuuucua

SEQ ID NO: 112393 - RNA, 22 nt, Homo sapiens
uuggccccuccaaaucucaugu

SEQ ID NO: 112394 - RNA, 22 nt, Homo sapiens
uuggcccugcugaccauucccu

SEQ ID NO: 112395 - RNA, 22 nt, Homo sapiens
uuuaauguuacaguauugguau

SEQ ID NO: 112396 - RNA, 22 nt, Homo sapiens
uuucauagccuucuaaugaguu

SEQ ID NO: 112397 - RNA, 19 nt, Homo sapiens
uuuccaguaaucuuaugug

SEQ ID NO: 112398 - RNA, 22 nt, Homo sapiens
uuucugagaccaaaacuuguaa

SEQ ID NO: 112399 - RNA, 22 nt, Homo sapiens
uuugacuagaguguuuuacaac

SEQ ID NO: 112400 - RNA, 22 nt, Homo sapiens
uuugacuuuuagaauaugaguu

SEQ ID NO: 112401 - RNA, 22 nt, Homo sapiens
uuugccaaucagaggcaucuug

SEQ ID NO: 112402 - RNA, 22 nt, Homo sapiens
uuugcuuaaaguccuuguggga

SEQ ID NO: 112403 - RNA, 22 nt, Homo sapiens
uuuggcccccagcucaggacau

SEQ ID NO: 112404 - RNA, 22 nt, Homo sapiens
uuuggucagcugcgggucagcu

SEQ ID NO: 112405 - RNA, 22 nt, Homo sapiens
uuuguguggccuuggccuggca

SEQ ID NO: 112406 - RNA, 22 nt, Homo sapiens
uuuugcucuucggaagagcuug

SEQ ID NO: 112407 - RNA, 22 nt, Homo sapiens
uuuuugaguagcuggagagcag

SEQ ID NO: 112408 - RNA, 22 nt, Homo sapiens
uuuuuggaggagguuagaucau

SEQ ID NO: 112409 - RNA, 22 nt, Homo sapiens
agagagcuuuugguugcccuaa

SEQ ID NO: 112410 - RNA, 20 nt, Homo sapiens
agagguuuugauagguucug

SEQ ID NO: 112411 - RNA, 20 nt, Homo sapiens
agagugcugucuguccugag

SEQ ID NO: 112412 - RNA, 22 nt, Homo sapiens
agcaccauuagcguugggccgg

SEQ ID NO: 112413 - RNA, 22 nt, Homo sapiens
agcagcauggguauaaaucucc

SEQ ID NO: 112414 - RNA, 22 nt, Homo sapiens
agcagcauuaugauauaucuua

SEQ ID NO: 112415 - RNA, 22 nt, Homo sapiens
agcccauguggcugaggcuucu

SEQ ID NO: 112416 - RNA, 22 nt, Homo sapiens
agcgccacugcacuccagccug

SEQ ID NO: 112417 - RNA, 22 nt, Homo sapiens
agcuccauuguaaucaccuggu

SEQ ID NO: 112418 - RNA, 22 nt, Homo sapiens
agcugcacgugguaaauguaaa

SEQ ID NO: 112419 - RNA, 22 nt, Homo sapiens
aggaagugucuucuuuuaggca

SEQ ID NO: 112420 - RNA, 22 nt, Homo sapiens
aggcagcuguuauauacugagu

SEQ ID NO: 112421 - RNA, 22 nt, Homo sapiens
aggcaugugugcagacugucug

SEQ ID NO: 112422 - RNA, 23 nt, Homo sapiens
aggccaguuuuuccugcuugcug

SEQ ID NO: 112423 - RNA, 22 nt, Homo sapiens
agguagaguguuuuguucuucu

SEQ ID NO: 112424 - RNA, 22 nt, Homo sapiens
agguauuuucaacuuagaaugg

SEQ ID NO: 112425 - RNA, 22 nt, Homo sapiens
aggugcuugagggaagaaauua

SEQ ID NO: 112426 - RNA, 22 nt, Homo sapiens
aguaacacaccugcauggugug

SEQ ID NO: 112427 - RNA, 22 nt, Homo sapiens
agucaguguguauugauggcac

SEQ ID NO: 112428 - RNA, 22 nt, Homo sapiens
agucgguguuacugacagaaug

SEQ ID NO: 112429 - RNA, 22 nt, Homo sapiens
agugaaaugucaccuuuuagga

SEQ ID NO: 112430 - RNA, 22 nt, Homo sapiens
agugguuuuaaguagagcauac

SEQ ID NO: 112431 - RNA, 22 nt, Homo sapiens
agugucaggagacagguagcug

SEQ ID NO: 112432 - RNA, 22 nt, Homo sapiens
auaacagcugcaaggcaaaagc

SEQ ID NO: 112433 - RNA, 22 nt, Homo sapiens
auaauaccugccacauuugaau

SEQ ID NO: 112434 - RNA, 19 nt, Homo sapiens
auaauuagcagugaggaca

SEQ ID NO: 112435 - RNA, 22 nt, Homo sapiens
auacuccugucucagcugagau

SEQ ID NO: 112436 - RNA, 21 nt, Homo sapiens
auacuugcauccuuggagaga

SEQ ID NO: 112437 - RNA, 22 nt, Homo sapiens
auagccaguagagagcuguuag

SEQ ID NO: 112438 - RNA, 22 nt, Homo sapiens
auaggagugugcacagaguagg

SEQ ID NO: 112439 - RNA, 20 nt, Homo sapiens
auaugcagacacauacauac

SEQ ID NO: 112440 - RNA, 22 nt, Homo sapiens
aucacacuguuauuuuaguuaa

SEQ ID NO: 112441 - RNA, 22 nt, Homo sapiens
aucacagauauggguuuaaauc

SEQ ID NO: 112442 - RNA, 20 nt, Homo sapiens
aucagagccggugaaagggc

SEQ ID NO: 112443 - RNA, 22 nt, Homo sapiens
aucagauaccuguugggaaaug

SEQ ID NO: 112444 - RNA, 22 nt, Homo sapiens
aucauccagccccagaagggag

SEQ ID NO: 112445 - RNA, 22 nt, Homo sapiens
auccugagacuuuucugaaguu

SEQ ID NO: 112446 - RNA, 22 nt, Homo sapiens
aucugcacaucuguguuuuugu

SEQ ID NO: 112447 - RNA, 22 nt, Homo sapiens
aucugugaaugaaguuauuuug

SEQ ID NO: 112448 - RNA, 22 nt, Homo sapiens
augaaaagcauaaacgcugaag

SEQ ID NO: 112449 - RNA, 22 nt, Homo sapiens
augacccugaccuaagccaauc

SEQ ID NO: 112450 - RNA, 20 nt, Homo sapiens
augaccuauggugguauaag

SEQ ID NO: 112451 - RNA, 22 nt, Homo sapiens
augacugucagggcagucauug

SEQ ID NO: 112452 - RNA, 22 nt, Homo sapiens
augagagcuaacuguggguaca

SEQ ID NO: 112453 - RNA, 22 nt, Homo sapiens
augagauacuacaaaugaguuu

SEQ ID NO: 112454 - RNA, 22 nt, Homo sapiens
augauguguucuguguucccau

SEQ ID NO: 112455 - RNA, 22 nt, Homo sapiens
augcacuguuguuauuggauaa

SEQ ID NO: 112456 - RNA, 22 nt, Homo sapiens
augcagagaaaucuaaaauaug

SEQ ID NO: 112457 - RNA, 22 nt, Homo sapiens
augccagggagaauuguucaag

SEQ ID NO: 112458 - RNA, 22 nt, Homo sapiens
auggccauuacuaagaauguuu

SEQ ID NO: 112459 - RNA, 22 nt, Homo sapiens
augggcacugauguauucugug

SEQ ID NO: 112460 - RNA, 22 nt, Homo sapiens
augggguaggcuugcuguagua

SEQ ID NO: 112461 - RNA, 22 nt, Homo sapiens
augucauagauaaggaagugga

SEQ ID NO: 112462 - RNA, 22 nt, Homo sapiens
auguggcuuuccuagaucuuag

SEQ ID NO: 112463 - RNA, 22 nt, Homo sapiens
augugguaguuauagugauaag

SEQ ID NO: 112464 - RNA, 22 nt, Homo sapiens
auguuguaguaugagucaaaau

SEQ ID NO: 112465 - RNA, 22 nt, Homo sapiens
auuauuagucggccagcuguua

SEQ ID NO: 112466 - RNA, 22 nt, Homo sapiens
auucaucagggauauugguuga

SEQ ID NO: 112467 - RNA, 22 nt, Homo sapiens
auugcuaacugaaauaagacca

SEQ ID NO: 112468 - RNA, 19 nt, Homo sapiens
auuugaucaucaggcacag

SEQ ID NO: 112469 - RNA, 22 nt, Homo sapiens
caaaggauucauuuccaggagu

SEQ ID NO: 112470 - RNA, 22 nt, Homo sapiens
caaauacuuucauguugucuug

SEQ ID NO: 112471 - RNA, 22 nt, Homo sapiens
caacacagugaaacccgucucu

SEQ ID NO: 112472 - RNA, 22 nt, Homo sapiens
caacauccaccuccuggguuca

SEQ ID NO: 112473 - RNA, 22 nt, Homo sapiens
caaguguuuccuuaaauacuug

SEQ ID NO: 112474 - RNA, 22 nt, Homo sapiens
cacaaugucuaagauguuucua

SEQ ID NO: 112475 - RNA, 21 nt, Homo sapiens
cacauggaggcagagagugua

SEQ ID NO: 112476 - RNA, 22 nt, Homo sapiens
cacccaguaagcaugaggcccu

SEQ ID NO: 112477 - RNA, 22 nt, Homo sapiens
caccuugugauccacccgccuu

SEQ ID NO: 112478 - RNA, 22 nt, Homo sapiens
cacugcaauuacuuuugcacca

SEQ ID NO: 112479 - RNA, 21 nt, Homo sapiens
cacugcaucacaggacagcau

SEQ ID NO: 112480 - RNA, 22 nt, Homo sapiens
cacugcauccuccaccugccag

SEQ ID NO: 112481 - RNA, 22 nt, Homo sapiens
cacugcauccuccauauccugg

SEQ ID NO: 112482 - RNA, 22 nt, Homo sapiens
cacugcauggucuagcuggguu

SEQ ID NO: 112483 - RNA, 22 nt, Homo sapiens
cacugcauuacucaugagcaug

SEQ ID NO: 112484 - RNA, 22 nt, Homo sapiens
cacugcauuggaugguuccucc

SEQ ID NO: 112485 - RNA, 20 nt, Homo sapiens
cagcuagugguaggagucgg

SEQ ID NO: 112486 - RNA, 22 nt, Homo sapiens
caggaccucuugccuggaagcc

SEQ ID NO: 112487 - RNA, 20 nt, Homo sapiens
cagggcaaugaggagguaaa

SEQ ID NO: 112488 - RNA, 22 nt, Homo sapiens
cagggcauuggcugguaccugg

SEQ ID NO: 112489 - RNA, 22 nt, Homo sapiens
caggugcuuacuuaauagccau

SEQ ID NO: 112490 - RNA, 22 nt, Homo sapiens
caguacaauguggaaaaggagu

SEQ ID NO: 112491 - RNA, 22 nt, Homo sapiens
cagugauaggugguuguuggca

SEQ ID NO: 112492 - RNA, 19 nt, Homo sapiens
caucacagagucuuccauu

SEQ ID NO: 112493 - RNA, 22 nt, Homo sapiens
caucagcaauguaugaggguuc

SEQ ID NO: 112494 - RNA, 19 nt, Homo sapiens
caucccugagcugaagugg

SEQ ID NO: 112495 - RNA, 22 nt, Homo sapiens
cauggcccugggcugggcgaac

SEQ ID NO: 112496 - RNA, 22 nt, Homo sapiens
ccacacugucuuggugggaaac

SEQ ID NO: 112497 - RNA, 22 nt, Homo sapiens
ccaccgggucccagcucugcuc

SEQ ID NO: 112498 - RNA, 22 nt, Homo sapiens
ccaccuguacuuaagucacuuu

SEQ ID NO: 112499 - RNA, 22 nt, Homo sapiens
ccacugugguaucugauacugg

SEQ ID NO: 112500 - RNA, 20 nt, Homo sapiens
cccuaagccagaugcugggg

SEQ ID NO: 112501 - RNA, 22 nt, Homo sapiens
cccugaagaaagccuaggacau

SEQ ID NO: 112502 - RNA, 22 nt, Homo sapiens
ccugaugacacgggagauguac

SEQ ID NO: 112503 - RNA, 23 nt, Homo sapiens
gugugguaggcuauaccaucuag

SEQ ID NO: 112504 - RNA, 22 nt, Homo sapiens
guguucaaagcugauugagauu

SEQ ID NO: 112505 - RNA, 18 nt, Homo sapiens
guugagcuuuuccuuuag

SEQ ID NO: 112506 - RNA, 22 nt, Homo sapiens
guuggguaauggggcgcaccgu

SEQ ID NO: 112507 - RNA, 22 nt, Homo sapiens
uaaauggauaaaugaauaccua

SEQ ID NO: 112508 - RNA, 22 nt, Homo sapiens
uaagacacuuaaaauguuacau

SEQ ID NO: 112509 - RNA, 22 nt, Homo sapiens
uaagccaccgugccuggccuaa

SEQ ID NO: 112510 - RNA, 18 nt, Homo sapiens
uaaggcacuauaggcauu

SEQ ID NO: 112511 - RNA, 22 nt, Homo sapiens
uaaugcuugguuguuuggaaaa

SEQ ID NO: 112512 - RNA, 22 nt, Homo sapiens
uacaaccucugccucccaaguu

SEQ ID NO: 112513 - RNA, 22 nt, Homo sapiens
uacagcuaugugcaugcaugcu

SEQ ID NO: 112514 - RNA, 22 nt, Homo sapiens
uaccaaaguuucggccucuguu

SEQ ID NO: 112515 - RNA, 22 nt, Homo sapiens
uacuacuuucugacaucuuuaa

SEQ ID NO: 112516 - RNA, 22 nt, Homo sapiens
uacugagagaggaauauugaaa

SEQ ID NO: 112517 - RNA, 22 nt, Homo sapiens
uacugcacuccagccucgguga

SEQ ID NO: 112518 - RNA, 20 nt, Homo sapiens
uacugcacuccauccugggu

SEQ ID NO: 112519 - RNA, 22 nt, Homo sapiens
uacugcacuugaccuccugggc

SEQ ID NO: 112520 - RNA, 22 nt, Homo sapiens
uacugcaucuacuuagagccag

SEQ ID NO: 112521 - RNA, 22 nt, Homo sapiens
uacugcauuccaaucugggcga

SEQ ID NO: 112522 - RNA, 19 nt, Homo sapiens
uacuggcucgggaauuuuc

SEQ ID NO: 112523 - RNA, 19 nt, Homo sapiens
uagagguuuaagaaaagaa

SEQ ID NO: 112524 - RNA, 22 nt, Homo sapiens
uagauuaucuguaugugcucuu

SEQ ID NO: 112525 - RNA, 22 nt, Homo sapiens
uagauucaucuguuccuuuuga

SEQ ID NO: 112526 - RNA, 21 nt, Homo sapiens
uagcaaauugcuauuaaggca

SEQ ID NO: 112527 - RNA, 22 nt, Homo sapiens
uagcacagggaauugguucucu

SEQ ID NO: 112528 - RNA, 22 nt, Homo sapiens
uagcacagugucauucuaggua

SEQ ID NO: 112529 - RNA, 22 nt, Homo sapiens
uagcacaucuucuuggccugca

SEQ ID NO: 112530 - RNA, 22 nt, Homo sapiens
uagcagcaccccacucuacugg

SEQ ID NO: 112531 - RNA, 22 nt, Homo sapiens
uagcaggaaaccuguguugagg

SEQ ID NO: 112532 - RNA, 22 nt, Homo sapiens
uagcuccagugggguuacugcu

SEQ ID NO: 112533 - RNA, 22 nt, Homo sapiens
uagcugagacuacaguaggugc

SEQ ID NO: 112534 - RNA, 22 nt, Homo sapiens
uagcugcuguauguacacggau

SEQ ID NO: 112535 - RNA, 23 nt, Homo sapiens
uagcuucucccagaccugcuccc

SEQ ID NO: 112536 - RNA, 22 nt, Homo sapiens
uagggcuuuccggccugucaga

SEQ ID NO: 112537 - RNA, 22 nt, Homo sapiens
uagguaagauguuaacagcuga

SEQ ID NO: 112538 - RNA, 22 nt, Homo sapiens
uaguaacacauugaacgaucgc

SEQ ID NO: 112539 - RNA, 22 nt, Homo sapiens
uaguaccauucccaaaccaacu

SEQ ID NO: 112540 - RNA, 22 nt, Homo sapiens
uauaugucugagacugggggau

SEQ ID NO: 112541 - RNA, 18 nt, Homo sapiens
uauugcuugguuuggaga

SEQ ID NO: 112542 - RNA, 22 nt, Homo sapiens
uauuucaguugugcagguaguu

SEQ ID NO: 112543 - RNA, 22 nt, Homo sapiens
ucaaagucuucucaaguaacau

SEQ ID NO: 112544 - RNA, 20 nt, Homo sapiens
ucaaauucuuggccuccagc

SEQ ID NO: 112545 - RNA, 21 nt, Homo sapiens
ucaacccuugcgucaccaagc

SEQ ID NO: 112546 - RNA, 20 nt, Homo sapiens
ucaaggcaggaacuguacau

SEQ ID NO: 112547 - RNA, 22 nt, Homo sapiens
ucaaguaauacucccaucuugg

SEQ ID NO: 112548 - RNA, 22 nt, Homo sapiens
ucaagugcauugauucaguauu

SEQ ID NO: 112549 - RNA, 22 nt, Homo sapiens
ucacaaagcuuggccugcuucu

SEQ ID NO: 112550 - RNA, 22 nt, Homo sapiens
ucacaauucucaauuugugaaa

SEQ ID NO: 112551 - RNA, 22 nt, Homo sapiens
ucacacugaauuugaagcaaug

SEQ ID NO: 112552 - RNA, 22 nt, Homo sapiens
ucacaugugaagauugggagua

SEQ ID NO: 112553 - RNA, 22 nt, Homo sapiens
ucaccuggagaagauggaucau

SEQ ID NO: 112554 - RNA, 23 nt, Homo sapiens
ucacuagaguccuggaguuugag

SEQ ID NO: 112555 - RNA, 22 nt, Homo sapiens
ucacuagaucaagggagagaaa

SEQ ID NO: 112556 - RNA, 22 nt, Homo sapiens
ucacugaaaccgccuccaccuc

SEQ ID NO: 112557 - RNA, 22 nt, Homo sapiens
ucacugcgaccuccgccucccg

SEQ ID NO: 112558 - RNA, 22 nt, Homo sapiens
ucacuggagguuccugaaguuc

SEQ ID NO: 112559 - RNA, 22 nt, Homo sapiens
ucagagucuagaucacucacug

SEQ ID NO: 112560 - RNA, 22 nt, Homo sapiens
ucagaguggccucucuugaaga

SEQ ID NO: 112561 - RNA, 22 nt, Homo sapiens
ucagagugguuguaccauuuga

SEQ ID NO: 112562 - RNA, 22 nt, Homo sapiens
ucagcacauucaaggccugccu

SEQ ID NO: 112563 - RNA, 20 nt, Homo sapiens
ucagcagucuggagcagagg

SEQ ID NO: 112564 - RNA, 22 nt, Homo sapiens
ucagugucugcauucuuauugu

SEQ ID NO: 112565 - RNA, 23 nt, Homo sapiens
ucagugucuggauccugcucagu

SEQ ID NO: 112566 - RNA, 22 nt, Homo sapiens
ucaguguuuggaaucucaauuu

SEQ ID NO: 112567 - RNA, 22 nt, Homo sapiens
ucaucagguaugucagcggagu

SEQ ID NO: 112568 - RNA, 22 nt, Homo sapiens
ucaugacacuggcaggagcuaa

SEQ ID NO: 112569 - RNA, 19 nt, Homo sapiens
uccaccgcgugcaccucua

SEQ ID NO: 112570 - RNA, 22 nt, Homo sapiens
uccaugagaauaguuaggcucu

SEQ ID NO: 112571 - RNA, 22 nt, Homo sapiens
uccaugaggcuacaguaaucuc

SEQ ID NO: 112572 - RNA, 18 nt, Homo sapiens
uccauugcagcauuauuu

SEQ ID NO: 112573 - RNA, 22 nt, Homo sapiens
uccccaguaggcaauuaacacc

SEQ ID NO: 112574 - RNA, 19 nt, Homo sapiens
uccccgggucuagugcagc

SEQ ID NO: 112575 - RNA, 22 nt, Homo sapiens
uccccugagaacuugcuagaaa

SEQ ID NO: 112576 - RNA, 22 nt, Homo sapiens
uccugcauucauccugguguug

SEQ ID NO: 112577 - RNA, 22 nt, Homo sapiens
uccuucauuugucaacucuagu

SEQ ID NO: 112578 - RNA, 22 nt, Homo sapiens
ucguucuugucaguuuauaaag

SEQ ID NO: 112579 - RNA, 22 nt, Homo sapiens
ucucagagccuaggguuuuuca

SEQ ID NO: 112580 - RNA, 22 nt, Homo sapiens
ucuggcacugaugugggaugcu

SEQ ID NO: 112581 - RNA, 22 nt, Homo sapiens
ucuggcuccacacuuuauuaac

SEQ ID NO: 112582 - RNA, 22 nt, Homo sapiens
ucugguggugaugagagacagu

SEQ ID NO: 112583 - RNA, 22 nt, Homo sapiens
ucuguacuccuugaguagugcu

SEQ ID NO: 112584 - RNA, 22 nt, Homo sapiens
ucugugaaugaacacuugaaaa

SEQ ID NO: 112585 - RNA, 22 nt, Homo sapiens
ucugugcuugucauaugcuuug

SEQ ID NO: 112586 - RNA, 19 nt, Homo sapiens
ucugugcuugucccccugu

SEQ ID NO: 112587 - RNA, 22 nt, Homo sapiens
ucuuugguaggaguaggaggcc

SEQ ID NO: 112588 - RNA, 22 nt, Homo sapiens
ucuuugguuagguuuaguugau

SEQ ID NO: 112589 - RNA, 22 nt, Homo sapiens
ucuuuguugcauaggcuuguuc

SEQ ID NO: 112590 - RNA, 22 nt, Homo sapiens
ugaaagcuacagucuccuagga

SEQ ID NO: 112591 - RNA, 22 nt, Homo sapiens
ugacauguagagaacuucucau

SEQ ID NO: 112592 - RNA, 22 nt, Homo sapiens
ugacauugggagugaagugaag

SEQ ID NO: 112593 - RNA, 22 nt, Homo sapiens
ugaccacagaaagugagggagc

SEQ ID NO: 112594 - RNA, 22 nt, Homo sapiens
ugacucaguuucucagguagua

SEQ ID NO: 112595 - RNA, 22 nt, Homo sapiens
ugacuugaggcucgcacaaguu

SEQ ID NO: 112596 - RNA, 22 nt, Homo sapiens
ugacuugaguaacuggcucagg

SEQ ID NO: 112597 - RNA, 22 nt, Homo sapiens
uggcccccucccaaaucucaua

SEQ ID NO: 112598 - RNA, 22 nt, Homo sapiens
ugggaaugaaauuacauagcuu

SEQ ID NO: 112599 - RNA, 22 nt, Homo sapiens
uggugagaaaagaugucuuugu

SEQ ID NO: 112600 - RNA, 22 nt, Homo sapiens
uggugccgugguccuggggcca

SEQ ID NO: 112601 - RNA, 19 nt, Homo sapiens
uggugccuuguucuuggau

SEQ ID NO: 112602 - RNA, 21 nt, Homo sapiens
ugguugauccuccuagugccu

SEQ ID NO: 112603 - RNA, 22 nt, Homo sapiens
uguaaaaagcccagccgcugag

SEQ ID NO: 112604 - RNA, 22 nt, Homo sapiens
uguaauguuugguagguuaggu

SEQ ID NO: 112605 - RNA, 22 nt, Homo sapiens
ugucacuuugccuucuggacuu

SEQ ID NO: 112606 - RNA, 22 nt, Homo sapiens
uguccugcagagguguuugccu

SEQ ID NO: 112607 - RNA, 22 nt, Homo sapiens
ugucucaguucccuucucugga

SEQ ID NO: 112608 - RNA, 22 nt, Homo sapiens
ugugaaaucagauagccuuuuu

SEQ ID NO: 112609 - RNA, 22 nt, Homo sapiens
ugugcaaucagcuucauuacau

SEQ ID NO: 112610 - RNA, 22 nt, Homo sapiens
ugugccaaaucccauaauaaau

SEQ ID NO: 112611 - RNA, 22 nt, Homo sapiens
ugugccaaucauagggcuuggu

SEQ ID NO: 112612 - RNA, 22 nt, Homo sapiens
ugugccacugcacucuggccug

SEQ ID NO: 112613 - RNA, 22 nt, Homo sapiens
uguggcagugcuuuaugaaacc

SEQ ID NO: 112614 - RNA, 22 nt, Homo sapiens
uguuacagcagaauugaaagag

SEQ ID NO: 112615 - RNA, 21 nt, Homo sapiens
uuaacagacaagugucuuccc

SEQ ID NO: 112616 - RNA, 22 nt, Homo sapiens
uuaaguguaaguggugugggac

SEQ ID NO: 112617 - RNA, 19 nt, Homo sapiens
uuaagugugauaucucagu

SEQ ID NO: 112618 - RNA, 22 nt, Homo sapiens
uuacacaguaggucccuaguaa

SEQ ID NO: 112619 - RNA, 22 nt, Homo sapiens
uuacagauggcacacucaaggg

SEQ ID NO: 112620 - RNA, 22 nt, Homo sapiens
uuacccauuagagaauuuaaga

SEQ ID NO: 112621 - RNA, 22 nt, Homo sapiens
uuacccuuuaacccuuuaaagu

SEQ ID NO: 112622 - RNA, 20 nt, Homo sapiens
uuacuccuuaaugagguuuu

SEQ ID NO: 112623 - RNA, 22 nt, Homo sapiens
uuagauguuuagaagugggcca

SEQ ID NO: 112624 - RNA, 22 nt, Homo sapiens
uuaggcuuuauugaaaacaaua

SEQ ID NO: 112625 - RNA, 22 nt, Homo sapiens
cugugcuugauuauaugagugu

SEQ ID NO: 112626 - RNA, 20 nt, Homo sapiens
cugugguagggaccaggaau

SEQ ID NO: 112627 - RNA, 20 nt, Homo sapiens
cuuaucaguggcaaguauaa

SEQ ID NO: 112628 - RNA, 22 nt, Homo sapiens
cuucaugucuucaauggggggg

SEQ ID NO: 112629 - RNA, 22 nt, Homo sapiens
cuucuugagacuuaggcuuugg

SEQ ID NO: 112630 - RNA, 22 nt, Homo sapiens
cuuugauuauaaaaggguguuu

SEQ ID NO: 112631 - RNA, 22 nt, Homo sapiens
cuuugguugugcucuccacuuu

SEQ ID NO: 112632 - RNA, 22 nt, Homo sapiens
cuuuuacacuguuagugggaau

SEQ ID NO: 112633 - RNA, 22 nt, Homo sapiens
cuuuuacacuguuggcaggauu

SEQ ID NO: 112634 - RNA, 22 nt, Homo sapiens
gaaauggaucagagcaagcuuu

SEQ ID NO: 112635 - RNA, 22 nt, Homo sapiens
gaacugggguuggguugcgaua

SEQ ID NO: 112636 - RNA, 22 nt, Homo sapiens
gaagagacagguucccacaaaa

SEQ ID NO: 112637 - RNA, 18 nt, Homo sapiens
gacaguguggugauuccu

SEQ ID NO: 112638 - RNA, 22 nt, Homo sapiens
gacaguuucucaggcuuccuua

SEQ ID NO: 112639 - RNA, 21 nt, Homo sapiens
gaccacagcagggaaugucag

SEQ ID NO: 112640 - RNA, 22 nt, Homo sapiens
gagaagugcgucguuugaugau

SEQ ID NO: 112641 - RNA, 22 nt, Homo sapiens
gagaucaguuaaugaagugagc

SEQ ID NO: 112642 - RNA, 22 nt, Homo sapiens
gagaugaaaucuugcucuguca

SEQ ID NO: 112643 - RNA, 22 nt, Homo sapiens
gagcuuggguuaaaguugccuu

SEQ ID NO: 112644 - RNA, 22 nt, Homo sapiens
gagguaagagaauaaacaguuu

SEQ ID NO: 112645 - RNA, 22 nt, Homo sapiens
gauaguugugagaacucuuacu

SEQ ID NO: 112646 - RNA, 22 nt, Homo sapiens
gauaucuuuuguauggugagcu

SEQ ID NO: 112647 - RNA, 22 nt, Homo sapiens
gaucuggagguuuuccucauga

SEQ ID NO: 112648 - RNA, 22 nt, Homo sapiens
gaugaucucuggugguaaagac

SEQ ID NO: 112649 - RNA, 22 nt, Homo sapiens
gauggguuuuuugaagacagca

SEQ ID NO: 112650 - RNA, 22 nt, Homo sapiens
gauguaggugcauuugcacgug

SEQ ID NO: 112651 - RNA, 22 nt, Homo sapiens
gcaccaugguagaauaauggua

SEQ ID NO: 112652 - RNA, 22 nt, Homo sapiens
gcagcacauggcagaacauauu

SEQ ID NO: 112653 - RNA, 22 nt, Homo sapiens
gcauggccuuuaaaugucacag

SEQ ID NO: 112654 - RNA, 22 nt, Homo sapiens
gcccagauguuuggggucaugg

SEQ ID NO: 112655 - RNA, 22 nt, Homo sapiens
gccccgggugaugcagccguca

SEQ ID NO: 112656 - RNA, 22 nt, Homo sapiens
gccuagagaguuaucaggcugu

SEQ ID NO: 112657 - RNA, 22 nt, Homo sapiens
gcugcuguaccagaugugguua

SEQ ID NO: 112658 - RNA, 20 nt, Homo sapiens
gcugugcuuaauacacuuuc

SEQ ID NO: 112659 - RNA, 22 nt, Homo sapiens
gcuuguguuugcuccccagaau

SEQ ID NO: 112660 - RNA, 22 nt, Homo sapiens
gcuuuguugauggugagucugu

SEQ ID NO: 112661 - RNA, 22 nt, Homo sapiens
ggaaggucaaagggaaagcaga

SEQ ID NO: 112662 - RNA, 22 nt, Homo sapiens
ggaauggaacaaagucuugaaa

SEQ ID NO: 112663 - RNA, 22 nt, Homo sapiens
ggacaagaucuuccaccauuca

SEQ ID NO: 112664 - RNA, 22 nt, Homo sapiens
ggagaugaaaugagcuacuuaa

SEQ ID NO: 112665 - RNA, 22 nt, Homo sapiens
ggauaucauuauuucuagggcu

SEQ ID NO: 112666 - RNA, 22 nt, Homo sapiens
ggcaaggaggggcacuuucacu

SEQ ID NO: 112667 - RNA, 22 nt, Homo sapiens
ggcucagugggguccugguucu

SEQ ID NO: 112668 - RNA, 22 nt, Homo sapiens
ggguucccuucuggcucagggu

SEQ ID NO: 112669 - RNA, 22 nt, Homo sapiens
ggucaggagaaugguaacugag

SEQ ID NO: 112670 - RNA, 22 nt, Homo sapiens
guaaauaccaguuucuggaaca

SEQ ID NO: 112671 - RNA, 22 nt, Homo sapiens
guaguggcaugaucuuggcuca

SEQ ID NO: 112672 - RNA, 22 nt, Homo sapiens
guauuuguugcagcagcacuau

SEQ ID NO: 112673 - RNA, 22 nt, Homo sapiens
gucaaaugcacagaaccauuaa

SEQ ID NO: 112674 - RNA, 22 nt, Homo sapiens
gucauauaggguuuaccuguau

SEQ ID NO: 112675 - RNA, 22 nt, Homo sapiens
gucaugaacuguacuacuccua

SEQ ID NO: 112676 - RNA, 22 nt, Homo sapiens
gucuggagacuugggucaucaa

SEQ ID NO: 112677 - RNA, 22 nt, Homo sapiens
gucuuuguuauuaugaaucaac

SEQ ID NO: 112678 - RNA, 22 nt, Homo sapiens
gugagcuaagcaaauaugagcc

SEQ ID NO: 112679 - RNA, 22 nt, Homo sapiens
gugagucaaucugagggguuca

SEQ ID NO: 112680 - RNA, 22 nt, Homo sapiens
guggaaaauuauugcuguuuuu

SEQ ID NO: 112681 - RNA, 22 nt, Homo sapiens
guggaagaccagacuuuccaac

SEQ ID NO: 112682 - RNA, 20 nt, Homo sapiens
guggaagauaaguagccuga

SEQ ID NO: 112683 - RNA, 22 nt, Homo sapiens
guggagacaaaggcugagugag

SEQ ID NO: 112684 - RNA, 22 nt, Homo sapiens
gugguagaaauguagaugcuag

SEQ ID NO: 112685 - RNA, 22 nt, Homo sapiens
guguauacauagaauuguguau

SEQ ID NO: 112686 - RNA, 22 nt, Homo sapiens
gugugucuugaccaggaucgga

SEQ ID NO: 112687 - RNA, 22 nt, Homo sapiens
guugcuuauuccuguaauccca

SEQ ID NO: 112688 - RNA, 22 nt, Homo sapiens
guuggugaccugaagagaguaa

SEQ ID NO: 112689 - RNA, 22 nt, Homo sapiens
uaaagcugaaaugauuaugaca

SEQ ID NO: 112690 - RNA, 20 nt, Homo sapiens
uaaagcugcucagggggcuc

SEQ ID NO: 112691 - RNA, 22 nt, Homo sapiens
uaaagcuuggauuuaggcuaau

SEQ ID NO: 112692 - RNA, 22 nt, Homo sapiens
uaacaggcuacucuugcauugc

SEQ ID NO: 112693 - RNA, 22 nt, Homo sapiens
uaacugcaaccuccgccucccg

SEQ ID NO: 112694 - RNA, 22 nt, Homo sapiens
uaacugucucaggccaugggcg

SEQ ID NO: 112695 - RNA, 22 nt, Homo sapiens
uaaguaaaugaaagguugauuu

SEQ ID NO: 112696 - RNA, 22 nt, Homo sapiens
uaaucucagcuacucaggaggc

SEQ ID NO: 112697 - RNA, 22 nt, Homo sapiens
uacagaguagaagauuugcaga

SEQ ID NO: 112698 - RNA, 22 nt, Homo sapiens
uacagcacugugcauagugguu

SEQ ID NO: 112699 - RNA, 22 nt, Homo sapiens
uacugcacuccagccuggguga

SEQ ID NO: 112700 - RNA, 22 nt, Homo sapiens
uacugcacucuagccuggguga

SEQ ID NO: 112701 - RNA, 23 nt, Homo sapiens
uacugcauccuccgccucuaggg

SEQ ID NO: 112702 - RNA, 22 nt, Homo sapiens
uacuuuguagagugugagaauu

SEQ ID NO: 112703 - RNA, 22 nt, Homo sapiens
uacuuuguagauuguuuccuuu

SEQ ID NO: 112704 - RNA, 22 nt, Homo sapiens
uagaauggaaggcauguuugcc

SEQ ID NO: 112705 - RNA, 22 nt, Homo sapiens
uagacuguaagauccaggagag

SEQ ID NO: 112706 - RNA, 22 nt, Homo sapiens
uagaggaaugaauuuggccaga

SEQ ID NO: 112707 - RNA, 22 nt, Homo sapiens
uagagguauaccaaaaaggcau

SEQ ID NO: 112708 - RNA, 21 nt, Homo sapiens
uagauacuguauuaaaccuag

SEQ ID NO: 112709 - RNA, 22 nt, Homo sapiens
uagauuaucauucauacaggga

SEQ ID NO: 112710 - RNA, 22 nt, Homo sapiens
uagcaccucuuuggccuuucgu

SEQ ID NO: 112711 - RNA, 22 nt, Homo sapiens
uagcagcaucucuggcuucuac

SEQ ID NO: 112712 - RNA, 22 nt, Homo sapiens
uagcagcauuuuuguagaguau

SEQ ID NO: 112713 - RNA, 22 nt, Homo sapiens
uagcccagugagguugauuugg

SEQ ID NO: 112714 - RNA, 22 nt, Homo sapiens
uagcucagcccagcuaagcuca

SEQ ID NO: 112715 - RNA, 22 nt, Homo sapiens
uagcugcugcuaggcuaaggau

SEQ ID NO: 112716 - RNA, 20 nt, Homo sapiens
uaggagcaaugagaguagaa

SEQ ID NO: 112717 - RNA, 22 nt, Homo sapiens
uuugcuuaguaaauguagaaaa

SEQ ID NO: 112718 - RNA, 22 nt, Homo sapiens
uuugggaaugaguuuaucauuu

SEQ ID NO: 112719 - RNA, 22 nt, Homo sapiens
uuugucauagcagcaggaaugg

SEQ ID NO: 112720 - RNA, 22 nt, Homo sapiens
uuuugcaggcauuggaaguuua

SEQ ID NO: 112721 - RNA, 19 nt, Homo sapiens
uuuugcucuuuauaccuau

SEQ ID NO: 112722 - RNA, 22 nt, Homo sapiens
aaaggaccacauauaugguggc

SEQ ID NO: 112723 - RNA, 22 nt, Homo sapiens
aaaguaauugcaguuuuugcaa

SEQ ID NO: 112724 - RNA, 22 nt, Homo sapiens
aaaucccuugcucucucagacc

SEQ ID NO: 112725 - RNA, 22 nt, Homo sapiens
aaaugcaguugguggggauaug

SEQ ID NO: 112726 - RNA, 22 nt, Homo sapiens
aaaugucauggaguguuucccc

SEQ ID NO: 112727 - RNA, 22 nt, Homo sapiens
aaauucaugucaccucuaggua

SEQ ID NO: 112728 - RNA, 22 nt, Homo sapiens
aaauugcaguuaggaugauggu

SEQ ID NO: 112729 - RNA, 22 nt, Homo sapiens
aacugcauuuucugauugugug

SEQ ID NO: 112730 - RNA, 22 nt, Homo sapiens
aacugguauuucccaugaauuu

SEQ ID NO: 112731 - RNA, 22 nt, Homo sapiens
aagaggcuguaggauaaugccu

SEQ ID NO: 112732 - RNA, 22 nt, Homo sapiens
aagcuggagugcaguggugcaa

SEQ ID NO: 112733 - RNA, 22 nt, Homo sapiens
aagcuggagugcaguggugcga

SEQ ID NO: 112734 - RNA, 22 nt, Homo sapiens
aaggcaacgugaguuguugauu

SEQ ID NO: 112735 - RNA, 22 nt, Homo sapiens
aaggcaguggcagaagauguca

SEQ ID NO: 112736 - RNA, 22 nt, Homo sapiens
aaggugcuguaagcauccaugu

SEQ ID NO: 112737 - RNA, 22 nt, Homo sapiens
aagugaccuaacaaugaaggcc

SEQ ID NO: 112738 - RNA, 22 nt, Homo sapiens
aagugcaaaucuguggcugaaa

SEQ ID NO: 112739 - RNA, 22 nt, Homo sapiens
aagugguguuugggagcuggac

SEQ ID NO: 112740 - RNA, 22 nt, Homo sapiens
aaguguaaguuaauguuuaggu

SEQ ID NO: 112741 - RNA, 22 nt, Homo sapiens
aaguguaugaaacaguccaugg

SEQ ID NO: 112742 - RNA, 23 nt, Homo sapiens
aaguucaugcucaucuguuacac

SEQ ID NO: 112743 - RNA, 22 nt, Homo sapiens
aaguugcuuuagguaagucaau

SEQ ID NO: 112744 - RNA, 22 nt, Homo sapiens
aaucacaguguucuugugaggg

SEQ ID NO: 112745 - RNA, 21 nt, Homo sapiens
aaucacugucuguuuccccuu

SEQ ID NO: 112746 - RNA, 22 nt, Homo sapiens
aaucagcacacugugcuuucca

SEQ ID NO: 112747 - RNA, 22 nt, Homo sapiens
aauccaugugcuuuaccauuuu

SEQ ID NO: 112748 - RNA, 22 nt, Homo sapiens
aaugacuaagaugguacauuuu

SEQ ID NO: 112749 - RNA, 22 nt, Homo sapiens
aaugcaucuagaaaggugaauu

SEQ ID NO: 112750 - RNA, 22 nt, Homo sapiens
aauggcauuugccagggcaaag

SEQ ID NO: 112751 - RNA, 22 nt, Homo sapiens
acaccaugucuguuucugguuu

SEQ ID NO: 112752 - RNA, 22 nt, Homo sapiens
auauugcuccuaauaccacggu

SEQ ID NO: 112753 - RNA, 22 nt, Homo sapiens
aucaaauugucauuuuaaggau

SEQ ID NO: 112754 - RNA, 22 nt, Homo sapiens
aucaaguaaucugaguaagagu

SEQ ID NO: 112755 - RNA, 22 nt, Homo sapiens
aucacauggccuagccuaaccu

SEQ ID NO: 112756 - RNA, 22 nt, Homo sapiens
aucacuggucaugagagaagua

SEQ ID NO: 112757 - RNA, 22 nt, Homo sapiens
auccugagacuuugcugaaguu

SEQ ID NO: 112758 - RNA, 22 nt, Homo sapiens
auccugaugacacagugcugca

SEQ ID NO: 112759 - RNA, 23 nt, Homo sapiens
augaauguaaggaguguaagaaa

SEQ ID NO: 112760 - RNA, 23 nt, Homo sapiens
augacacuccugugcgcacccug

SEQ ID NO: 112761 - RNA, 22 nt, Homo sapiens
augacuaaaggguuuauguuga

SEQ ID NO: 112762 - RNA, 22 nt, Homo sapiens
augacuggauaauggacacaca

SEQ ID NO: 112763 - RNA, 22 nt, Homo sapiens
augacugucuugcagaggcuau

SEQ ID NO: 112764 - RNA, 22 nt, Homo sapiens
augagauauguuaaaaguuaaa

SEQ ID NO: 112765 - RNA, 19 nt, Homo sapiens
augagcaauaguuuuaauc

SEQ ID NO: 112766 - RNA, 22 nt, Homo sapiens
augagcugauuuccuuaccaua

SEQ ID NO: 112767 - RNA, 22 nt, Homo sapiens
augaggugaggucaguaaggua

SEQ ID NO: 112768 - RNA, 22 nt, Homo sapiens
augcaauggaaaggacaauuac

SEQ ID NO: 112769 - RNA, 22 nt, Homo sapiens
augccaagaugagcacgcgucu

SEQ ID NO: 112770 - RNA, 22 nt, Homo sapiens
augccacugcacuucagccugc

SEQ ID NO: 112771 - RNA, 22 nt, Homo sapiens
auggaaagcuguuccuacacaa

SEQ ID NO: 112772 - RNA, 22 nt, Homo sapiens
auggacagacacuggccuucug

SEQ ID NO: 112773 - RNA, 22 nt, Homo sapiens
auggcagugucuagggguguuu

SEQ ID NO: 112774 - RNA, 22 nt, Homo sapiens
augugacagugguuuuaagcgu

SEQ ID NO: 112775 - RNA, 22 nt, Homo sapiens
augugacuuuuuccugugccuu

SEQ ID NO: 112776 - RNA, 22 nt, Homo sapiens
augugguaggcccaugagucau

SEQ ID NO: 112777 - RNA, 22 nt, Homo sapiens
auuaagagcacauguucugggu

SEQ ID NO: 112778 - RNA, 22 nt, Homo sapiens
auuacaugucuauccaugaaca

SEQ ID NO: 112779 - RNA, 22 nt, Homo sapiens
auuccauagugucuguggcaga

SEQ ID NO: 112780 - RNA, 22 nt, Homo sapiens
auugcuuacccuguauuagauc

SEQ ID NO: 112781 - RNA, 22 nt, Homo sapiens
auugcuuacuaaucaucuucag

SEQ ID NO: 112782 - RNA, 22 nt, Homo sapiens
auuuuugguuucaccugcacgc

SEQ ID NO: 112783 - RNA, 22 nt, Homo sapiens
caccgagguuggagugcagugg

SEQ ID NO: 112784 - RNA, 22 nt, Homo sapiens
cacugcauccuccaccuccugg

SEQ ID NO: 112785 - RNA, 21 nt, Homo sapiens
cacugguguugcuauaucaaa

SEQ ID NO: 112786 - RNA, 22 nt, Homo sapiens
cagcuaaauuguuaaauccaag

SEQ ID NO: 112787 - RNA, 22 nt, Homo sapiens
cagcuugugguauugcugguug

SEQ ID NO: 112788 - RNA, 22 nt, Homo sapiens
cagguacuucugggcugagcag

SEQ ID NO: 112789 - RNA, 22 nt, Homo sapiens
caguaaauaucugagcgagguc

SEQ ID NO: 112790 - RNA, 22 nt, Homo sapiens
caguacaauguugauuagaagu

SEQ ID NO: 112791 - RNA, 23 nt, Homo sapiens
cagugguguuagagaaaucuuuu

SEQ ID NO: 112792 - RNA, 21 nt, Homo sapiens
cauaaugcuacuuauuuuaug

SEQ ID NO: 112793 - RNA, 22 nt, Homo sapiens
cauacaagcuacaaucacaaag

SEQ ID NO: 112794 - RNA, 22 nt, Homo sapiens
cauacagcuaguaaguguaaga

SEQ ID NO: 112795 - RNA, 22 nt, Homo sapiens
cauggucaccuuccaaguuauu

SEQ ID NO: 112796 - RNA, 22 nt, Homo sapiens
ccagaguggagccuuugcgagg

SEQ ID NO: 112797 - RNA, 22 nt, Homo sapiens
ccaggguuccacgccuggcugu

SEQ ID NO: 112798 - RNA, 22 nt, Homo sapiens
ccaggguugcuuuagauucuga

SEQ ID NO: 112799 - RNA, 22 nt, Homo sapiens
ccagugauuguauggugaaggu

SEQ ID NO: 112800 - RNA, 22 nt, Homo sapiens
cccucgagaaaccaucugcuga

SEQ ID NO: 112801 - RNA, 21 nt, Homo sapiens
gauaucuuuauucccaagagc

SEQ ID NO: 112802 - RNA, 22 nt, Homo sapiens
gauuccauuuguggcuauuuac

SEQ ID NO: 112803 - RNA, 22 nt, Homo sapiens
gcacaggguuacauucuaaggu

SEQ ID NO: 112804 - RNA, 22 nt, Homo sapiens
gcacccugucaaaauggaccaa

SEQ ID NO: 112805 - RNA, 18 nt, Homo sapiens
gccaacauguaaacaggu

SEQ ID NO: 112806 - RNA, 22 nt, Homo sapiens
gccauugcacuccagccugagc

SEQ ID NO: 112807 - RNA, 22 nt, Homo sapiens
gccauugcacucuagccugagc

SEQ ID NO: 112808 - RNA, 22 nt, Homo sapiens
gcccagcguucagggaggggcu

SEQ ID NO: 112809 - RNA, 22 nt, Homo sapiens
gccccaguacaggcuccuuaga

SEQ ID NO: 112810 - RNA, 22 nt, Homo sapiens
gccucaguuguggccagggauu

SEQ ID NO: 112811 - RNA, 22 nt, Homo sapiens
gcugcuguuuaguuucuccugg

SEQ ID NO: 112812 - RNA, 22 nt, Homo sapiens
gcuugguccccacccaaaucgc

SEQ ID NO: 112813 - RNA, 22 nt, Homo sapiens
gcuuguguucaagucacccuua

SEQ ID NO: 112814 - RNA, 22 nt, Homo sapiens
gcuuuguuguugaugggaaauc

SEQ ID NO: 112815 - RNA, 22 nt, Homo sapiens
ggaaaguccuucuguaggcucc

SEQ ID NO: 112816 - RNA, 22 nt, Homo sapiens
ggaauaguauaaauaccacaaa

SEQ ID NO: 112817 - RNA, 20 nt, Homo sapiens
ggaauagucuacacucugac

SEQ ID NO: 112818 - RNA, 22 nt, Homo sapiens
ggacaagagacugggacacuga

SEQ ID NO: 112819 - RNA, 22 nt, Homo sapiens
ggagaugauuaugaaucacuua

SEQ ID NO: 112820 - RNA, 23 nt, Homo sapiens
ggauggaaaguuuugagggccac

SEQ ID NO: 112821 - RNA, 22 nt, Homo sapiens
ggcaaaaucgcaauuacuuuug

SEQ ID NO: 112822 - RNA, 22 nt, Homo sapiens
ggcaagaaagaaaucaucuguc

SEQ ID NO: 112823 - RNA, 19 nt, Homo sapiens
ggcacugugugagugagga

SEQ ID NO: 112824 - RNA, 22 nt, Homo sapiens
gggaagugugcagaguucucuu

SEQ ID NO: 112825 - RNA, 22 nt, Homo sapiens
gggguauguaagugagugagug

SEQ ID NO: 112826 - RNA, 22 nt, Homo sapiens
ggugagaaagggauuccuguuc

SEQ ID NO: 112827 - RNA, 22 nt, Homo sapiens
guaaacuuccccucaugaauga

SEQ ID NO: 112828 - RNA, 22 nt, Homo sapiens
guacuuuguuauaacccacagg

SEQ ID NO: 112829 - RNA, 22 nt, Homo sapiens
guagaaagcauuucagauuugc

SEQ ID NO: 112830 - RNA, 21 nt, Homo sapiens
guaugguugaagugacaagcc

SEQ ID NO: 112831 - RNA, 22 nt, Homo sapiens
gucaccagcuguguuagccccu

SEQ ID NO: 112832 - RNA, 22 nt, Homo sapiens
gucaggugcuuacgcggagauc

SEQ ID NO: 112833 - RNA, 22 nt, Homo sapiens
gucauccaggcuggagugaagc

SEQ ID NO: 112834 - RNA, 22 nt, Homo sapiens
gucaugggguacuacacauggg

SEQ ID NO: 112835 - RNA, 22 nt, Homo sapiens
gucccugcgauugugggauccu

SEQ ID NO: 112836 - RNA, 22 nt, Homo sapiens
gucuccgagccguguggagccg

SEQ ID NO: 112837 - RNA, 22 nt, Homo sapiens
gucuccggcuguccuuugaggu

SEQ ID NO: 112838 - RNA, 22 nt, Homo sapiens
gucugugguuccuaugucaccu

SEQ ID NO: 112839 - RNA, 22 nt, Homo sapiens
gucuuuguuuggucuguaucag

SEQ ID NO: 112840 - RNA, 22 nt, Homo sapiens
gugagccaugauuuuaccacug

SEQ ID NO: 112841 - RNA, 22 nt, Homo sapiens
gugauuuaguagaugcuaguua

SEQ ID NO: 112842 - RNA, 16 nt, Homo sapiens
gugcuguguuguuagg

SEQ ID NO: 112843 - RNA, 22 nt, Homo sapiens
guggaaaacauaugcuuguuga

SEQ ID NO: 112844 - RNA, 21 nt, Homo sapiens
guggaaauggaauuuacuaau

SEQ ID NO: 112845 - RNA, 22 nt, Homo sapiens
guggaggagaaagaagcauuuc

SEQ ID NO: 112846 - RNA, 22 nt, Homo sapiens
guggcaaggaaaugcugcucac

SEQ ID NO: 112847 - RNA, 22 nt, Homo sapiens
guggcaguuuuaaauaugaaaa

SEQ ID NO: 112848 - RNA, 22 nt, Homo sapiens
gugggguaggaggaguacuucc

SEQ ID NO: 112849 - RNA, 22 nt, Homo sapiens
gugugguauuauaacuagguau

SEQ ID NO: 112850 - RNA, 22 nt, Homo sapiens
guuauguuauguuauguuaugu

SEQ ID NO: 112851 - RNA, 22 nt, Homo sapiens
guucccaguugaaaugauuagu

SEQ ID NO: 112852 - RNA, 22 nt, Homo sapiens
guugaggcaggagaauuacuug

SEQ ID NO: 112853 - RNA, 17 nt, Homo sapiens
uaaagccagucaaguca

SEQ ID NO: 112854 - RNA, 22 nt, Homo sapiens
uaaagccagugauuaugucucu

SEQ ID NO: 112855 - RNA, 22 nt, Homo sapiens
uaaagccauugucaaguuugua

SEQ ID NO: 112856 - RNA, 22 nt, Homo sapiens
uaacagucaagguuugaccagg

SEQ ID NO: 112857 - RNA, 22 nt, Homo sapiens
uaacccuuacaacuacacucgu

SEQ ID NO: 112858 - RNA, 22 nt, Homo sapiens
uaacugcaaccucugccugcug

SEQ ID NO: 112859 - RNA, 20 nt, Homo sapiens
uaaggcacugugcuuuuagg

SEQ ID NO: 112860 - RNA, 22 nt, Homo sapiens
uaagugaauuugacagguaaug

SEQ ID NO: 112861 - RNA, 22 nt, Homo sapiens
uaauacauucaaggugguaguu

SEQ ID NO: 112862 - RNA, 22 nt, Homo sapiens
uaaugcucauuagcaggccaau

SEQ ID NO: 112863 - RNA, 22 nt, Homo sapiens
uacaggcaccuggcuaauuuuu

SEQ ID NO: 112864 - RNA, 22 nt, Homo sapiens
uacaggcagguguucccugguu

SEQ ID NO: 112865 - RNA, 22 nt, Homo sapiens
uacaguggugugaucucagcuc

SEQ ID NO: 112866 - RNA, 19 nt, Homo sapiens
uacaugcagcaggcacgca

SEQ ID NO: 112867 - RNA, 16 nt, Homo sapiens
uacauuuguuacaugg

SEQ ID NO: 112868 - RNA, 22 nt, Homo sapiens
uacccuguaaucugaaacauga

SEQ ID NO: 112869 - RNA, 22 nt, Homo sapiens
uacuccccuuguucugugagcu

SEQ ID NO: 112870 - RNA, 22 nt, Homo sapiens
uacuguacugcaguucugcaaa

SEQ ID NO: 112871 - RNA, 22 nt, Homo sapiens
uacuuuguuauagcagcaggaa

SEQ ID NO: 112872 - RNA, 22 nt, Homo sapiens
uagcaccuuagcauuucuagug

SEQ ID NO: 112873 - RNA, 22 nt, Homo sapiens
uagcaggaaaggggucagaucu

SEQ ID NO: 112874 - RNA, 21 nt, Homo sapiens
uagcucagugguguugccaua

SEQ ID NO: 112875 - RNA, 22 nt, Homo sapiens
uagcuccacagcuauauauaau

SEQ ID NO: 112876 - RNA, 22 nt, Homo sapiens
uaggagcacagcagcauguggg

SEQ ID NO: 112877 - RNA, 22 nt, Homo sapiens
uaggcacuguguuuguaggagu

SEQ ID NO: 112878 - RNA, 22 nt, Homo sapiens
uaguugcaucuuaggucuguga

SEQ ID NO: 112879 - RNA, 22 nt, Homo sapiens
uauacugucuuuguaugccuag

SEQ ID NO: 112880 - RNA, 22 nt, Homo sapiens
uaucacaguugcauauuuaagg

SEQ ID NO: 112881 - RNA, 20 nt, Homo sapiens
uaugacaaagccuagugagu

SEQ ID NO: 112882 - RNA, 22 nt, Homo sapiens
uauggauuuuuuugacaagagc

SEQ ID NO: 112883 - RNA, 22 nt, Homo sapiens
uaugucaugggguuuuugagau

SEQ ID NO: 112884 - RNA, 22 nt, Homo sapiens
uauuccauuugugaaaggaagu

SEQ ID NO: 112885 - RNA, 22 nt, Homo sapiens
uauugcuuuacucucuuauccu

SEQ ID NO: 112886 - RNA, 22 nt, Homo sapiens
uauugcuuuugauucaaggcag

SEQ ID NO: 112887 - RNA, 22 nt, Homo sapiens
uauuguccaauaggauguuccu

SEQ ID NO: 112888 - RNA, 20 nt, Homo sapiens
ucaaaguaugcucugcacua

SEQ ID NO: 112889 - RNA, 22 nt, Homo sapiens
ucaaauguucccuguacuggcc

SEQ ID NO: 112890 - RNA, 22 nt, Homo sapiens
ucaaauguuuguuuaaggcuua

SEQ ID NO: 112891 - RNA, 20 nt, Homo sapiens
ucaaggcacgaauaaaaguu

SEQ ID NO: 112892 - RNA, 22 nt, Homo sapiens
ucacaggguguuauuagaauua

SEQ ID NO: 112893 - RNA, 22 nt, Homo sapiens
ucaccuggagccuucacauucu

SEQ ID NO: 112894 - RNA, 22 nt, Homo sapiens
ucacuggacagaaauaaaggug

SEQ ID NO: 112895 - RNA, 22 nt, Homo sapiens
ucacugugcaugaaggaugcug

SEQ ID NO: 112896 - RNA, 22 nt, Homo sapiens
ucacuguggaacucaaaaagcu

SEQ ID NO: 112897 - RNA, 22 nt, Homo sapiens
ucacugugguuuugaugugcau

SEQ ID NO: 112898 - RNA, 22 nt, Homo sapiens
ucacugugugucucuguaucug

SEQ ID NO: 112899 - RNA, 18 nt, Homo sapiens
ucacugugugucuugggu

SEQ ID NO: 112900 - RNA, 22 nt, Homo sapiens
ucagauacuggugacaugaaug

SEQ ID NO: 112901 - RNA, 22 nt, Homo sapiens
ucagaugcauccauaccccacu

SEQ ID NO: 112902 - RNA, 22 nt, Homo sapiens
ucagggacuuacaaaccagaag

SEQ ID NO: 112903 - RNA, 22 nt, Homo sapiens
ucagugcaggaaucucuagcca

SEQ ID NO: 112904 - RNA, 22 nt, Homo sapiens
ucauacaggccaccagggaagu

SEQ ID NO: 112905 - RNA, 22 nt, Homo sapiens
ucauguaauuuugugucuauga

SEQ ID NO: 112906 - RNA, 22 nt, Homo sapiens
uccagguacucagggggcugag

SEQ ID NO: 112907 - RNA, 16 nt, Homo sapiens
ucccaccauugcuugu

SEQ ID NO: 112908 - RNA, 22 nt, Homo sapiens
uccuugagucuuugcucagaug

SEQ ID NO: 112909 - RNA, 22 nt, Homo sapiens
ucgcaccauugcacuccagcca

SEQ ID NO: 112910 - RNA, 22 nt, Homo sapiens
ucguggccugugaguccucccc

SEQ ID NO: 112911 - RNA, 22 nt, Homo sapiens
ucuaaaacuagauugugaugau

SEQ ID NO: 112912 - RNA, 22 nt, Homo sapiens
ucucaaccuccacacuacaaua

SEQ ID NO: 112913 - RNA, 22 nt, Homo sapiens
ucucaaccucccaaguagcugg

SEQ ID NO: 112914 - RNA, 22 nt, Homo sapiens
ucucaaguaacugggacaauaa

SEQ ID NO: 112915 - RNA, 22 nt, Homo sapiens
ucucacacugaauguguguggg

SEQ ID NO: 112916 - RNA, 22 nt, Homo sapiens
ucuccauuguccagaugaggaa

SEQ ID NO: 112917 - RNA, 22 nt, Homo sapiens
ucucugagaaaaguuucuccca

SEQ ID NO: 112918 - RNA, 22 nt, Homo sapiens
ucuucaugcuugaaauaauagc

SEQ ID NO: 112919 - RNA, 17 nt, Homo sapiens
ucuucuguuacuguggc

SEQ ID NO: 112920 - RNA, 22 nt, Homo sapiens
ucuugcaccuacaugcuuuguc

SEQ ID NO: 112921 - RNA, 22 nt, Homo sapiens
ucuuugauaagauccagaagaa

SEQ ID NO: 112922 - RNA, 22 nt, Homo sapiens
ucuuugguuguuuagggugcau

SEQ ID NO: 112923 - RNA, 22 nt, Homo sapiens
ucuuuguucaggagccaacucc

SEQ ID NO: 112924 - RNA, 22 nt, Homo sapiens
ucuuuguuuucugauccugaag

SEQ ID NO: 112925 - RNA, 18 nt, Homo sapiens
ugaaacacauuuuuuccu

SEQ ID NO: 112926 - RNA, 22 nt, Homo sapiens
ugaaagcuacaggaaaguauuu

SEQ ID NO: 112927 - RNA, 22 nt, Homo sapiens
ugaaucaugcugcuauaaagac

SEQ ID NO: 112928 - RNA, 21 nt, Homo sapiens
ugacauguugguguucugcac

SEQ ID NO: 112929 - RNA, 22 nt, Homo sapiens
ugaccacugucuaagauaggug

SEQ ID NO: 112930 - RNA, 23 nt, Homo sapiens
ugacugaguauauguuuggugcu

SEQ ID NO: 112931 - RNA, 20 nt, Homo sapiens
ugagaacauguggcauuugg

SEQ ID NO: 112932 - RNA, 22 nt, Homo sapiens
ugagaagacaucagcuuucgga

SEQ ID NO: 112933 - RNA, 22 nt, Homo sapiens
ugagacggagucucacucuguu

SEQ ID NO: 112934 - RNA, 22 nt, Homo sapiens
ugagacugaguuucacuuuugu

SEQ ID NO: 112935 - RNA, 22 nt, Homo sapiens
ugagacugaguuuccaucuugu

SEQ ID NO: 112936 - RNA, 18 nt, Homo sapiens
ugagauacuagaauaggu

SEQ ID NO: 112937 - RNA, 22 nt, Homo sapiens
ugagauaggaucuugcucuguu

SEQ ID NO: 112938 - RNA, 22 nt, Homo sapiens
ugagaugaggucucgcucuguc

SEQ ID NO: 112939 - RNA, 17 nt, Homo sapiens
ugagcuaugauccuguc

SEQ ID NO: 112940 - RNA, 22 nt, Homo sapiens
ugagcugagauuaagcugcugc

SEQ ID NO: 112941 - RNA, 22 nt, Homo sapiens
ugagguacaacauggacugaag

SEQ ID NO: 112942 - RNA, 22 nt, Homo sapiens
cuugcacuugaaauuccaguuu

SEQ ID NO: 112943 - RNA, 22 nt, Homo sapiens
cuugccuuugucuucaaaggcu

SEQ ID NO: 112944 - RNA, 22 nt, Homo sapiens
cuuggcacugcucacccuccuu

SEQ ID NO: 112945 - RNA, 22 nt, Homo sapiens
cuuuuggcuuaagauugucuug

SEQ ID NO: 112946 - RNA, 22 nt, Homo sapiens
gaagaacuaggugagaucuaga

SEQ ID NO: 112947 - RNA, 22 nt, Homo sapiens
gacaaguuugauuuauuccaag

SEQ ID NO: 112948 - RNA, 22 nt, Homo sapiens
gagagcuaggccacuggggcuu

SEQ ID NO: 112949 - RNA, 22 nt, Homo sapiens
gagcaguugagagugcuggcca

SEQ ID NO: 112950 - RNA, 22 nt, Homo sapiens
gagcugaucuuuucugauucca

SEQ ID NO: 112951 - RNA, 22 nt, Homo sapiens
gaggcagucugacccuuagcag

SEQ ID NO: 112952 - RNA, 22 nt, Homo sapiens
gaguucaaaucucagcucuguu

SEQ ID NO: 112953 - RNA, 22 nt, Homo sapiens
gauggaguugucgccugggcug

SEQ ID NO: 112954 - RNA, 22 nt, Homo sapiens
gauggcucugcaggugagggua

SEQ ID NO: 112955 - RNA, 22 nt, Homo sapiens
gcaagaaucugggaguaaaauu

SEQ ID NO: 112956 - RNA, 18 nt, Homo sapiens
gccaacauguaaacaggu

SEQ ID NO: 112957 - RNA, 22 nt, Homo sapiens
gccaagauuuaauucaucaguu

SEQ ID NO: 112958 - RNA, 22 nt, Homo sapiens
gcuggucugccguaguaggugc

SEQ ID NO: 112959 - RNA, 22 nt, Homo sapiens
ggagagugacauauuucuaggc

SEQ ID NO: 112960 - RNA, 22 nt, Homo sapiens
ggcaugauggcugaggcuucug

SEQ ID NO: 112961 - RNA, 22 nt, Homo sapiens
ggcuuggaggaaugugagggcu

SEQ ID NO: 112962 - RNA, 22 nt, Homo sapiens
gucuggagacuugggucaucaa

SEQ ID NO: 112963 - RNA, 17 nt, Homo sapiens
gugaaaucaucauuuuu

SEQ ID NO: 112964 - RNA, 18 nt, Homo sapiens
gugagaaugacuguucug

SEQ ID NO: 112965 - RNA, 22 nt, Homo sapiens
gugagaugugacuucugccucu

SEQ ID NO: 112966 - RNA, 21 nt, Homo sapiens
gugaggaguuacuggcuuuga

SEQ ID NO: 112967 - RNA, 17 nt, Homo sapiens
gugagguggguaguauc

SEQ ID NO: 112968 - RNA, 22 nt, Homo sapiens
gugaggugguacaauauuaacu

SEQ ID NO: 112969 - RNA, 22 nt, Homo sapiens
gugcacaaucgugcauuccuug

SEQ ID NO: 112970 - RNA, 23 nt, Homo sapiens
gugccuucugagccuagucucca

SEQ ID NO: 112971 - RNA, 22 nt, Homo sapiens
guggagcuguguggccuugggc

SEQ ID NO: 112972 - RNA, 22 nt, Homo sapiens
guggcaaggaaaugcugcucac

SEQ ID NO: 112973 - RNA, 22 nt, Homo sapiens
guguaaaucaaucuguugucuu

SEQ ID NO: 112974 - RNA, 22 nt, Homo sapiens
uaagagcuaggauuuuaaauca

SEQ ID NO: 112975 - RNA, 22 nt, Homo sapiens
uaagcucauuccagccaugucc

SEQ ID NO: 112976 - RNA, 22 nt, Homo sapiens
uaauagcucggauaaacaugau

SEQ ID NO: 112977 - RNA, 22 nt, Homo sapiens
uacaugcaugggcaugugugca

SEQ ID NO: 112978 - RNA, 22 nt, Homo sapiens
uaccucaguucaauaacagaua

SEQ ID NO: 112979 - RNA, 21 nt, Homo sapiens
uacuugagacagggucuugcu

SEQ ID NO: 112980 - RNA, 22 nt, Homo sapiens
uagaguguuuuguuaggcagca

SEQ ID NO: 112981 - RNA, 22 nt, Homo sapiens
uagcacaugucagguaauuugc

SEQ ID NO: 112982 - RNA, 21 nt, Homo sapiens
uagcugcacccaggccuccuu

SEQ ID NO: 112983 - RNA, 18 nt, Homo sapiens
uaggaacauugauuggag

SEQ ID NO: 112984 - RNA, 22 nt, Homo sapiens
uaguucauuauguguugcucag

SEQ ID NO: 112985 - RNA, 22 nt, Homo sapiens
uaguucauuuuucuugcuuaga

SEQ ID NO: 112986 - RNA, 20 nt, Homo sapiens
uaugacaaagccuagugagu

SEQ ID NO: 112987 - RNA, 22 nt, Homo sapiens
uauuucccuuaacuuuccugca

SEQ ID NO: 112988 - RNA, 22 nt, Homo sapiens
ucaaauguuuguuuaaggcuua

SEQ ID NO: 112989 - RNA, 22 nt, Homo sapiens
ucagacacugcccuccaccugu

SEQ ID NO: 112990 - RNA, 22 nt, Homo sapiens
ucagagcaaagacacuuuauca

SEQ ID NO: 112991 - RNA, 22 nt, Homo sapiens
ucagaguggagucugcagccuu

SEQ ID NO: 112992 - RNA, 21 nt, Homo sapiens
ucaguuacugagagagaagug

SEQ ID NO: 112993 - RNA, 22 nt, Homo sapiens
ucaucucaguuucuugccguac

SEQ ID NO: 112994 - RNA, 22 nt, Homo sapiens
uccaagaugcuggcagcuacag

SEQ ID NO: 112995 - RNA, 22 nt, Homo sapiens
uccacuuuugugcugaauugga

SEQ ID NO: 112996 - RNA, 22 nt, Homo sapiens
ucccagugcuaugcaaaagccu

SEQ ID NO: 112997 - RNA, 22 nt, Homo sapiens
ucccaguggucuugaaacaggg

SEQ ID NO: 112998 - RNA, 23 nt, Homo sapiens
ugggauguuuuuggaaacuucug

SEQ ID NO: 112999 - RNA, 22 nt, Homo sapiens
ugguccuuuccauuggagacac

SEQ ID NO: 113000 - RNA, 22 nt, Homo sapiens
ugguggcuuuucguagguucac

SEQ ID NO: 113001 - RNA, 22 nt, Homo sapiens
ugugaaaucagauagccuuuuu

SEQ ID NO: 113002 - RNA, 18 nt, Homo sapiens
ugugcaauauuaaccacc

SEQ ID NO: 113003 - RNA, 22 nt, Homo sapiens
uuaccucagaccugcucugugu

SEQ ID NO: 113004 - RNA, 22 nt, Homo sapiens
uuauagcacuaagaagguaaua

SEQ ID NO: 113005 - RNA, 22 nt, Homo sapiens
uucagcaguggccaguggaaau

SEQ ID NO: 113006 - RNA, 22 nt, Homo sapiens
uucaucagggagaaauaauuuc

SEQ ID NO: 113007 - RNA, 22 nt, Homo sapiens
uucaugugagucuguauuaacu

SEQ ID NO: 113008 - RNA, 22 nt, Homo sapiens
uucauugaaugauuuuuagaag

SEQ ID NO: 113009 - RNA, 22 nt, Homo sapiens
uucccaguuggggaaagcgacc

SEQ ID NO: 113010 - RNA, 22 nt, Homo sapiens
uucccuguaucuucugccaugu

SEQ ID NO: 113011 - RNA, 22 nt, Homo sapiens
uuccuugugacuaguagugacc

SEQ ID NO: 113012 - RNA, 20 nt, Homo sapiens
uucuacagucacaggaagau

SEQ ID NO: 113013 - RNA, 22 nt, Homo sapiens
uucucagugcuaucuuuuaugc

SEQ ID NO: 113014 - RNA, 22 nt, Homo sapiens
uucucaguuccuacuuugguga

SEQ ID NO: 113015 - RNA, 22 nt, Homo sapiens
uucuccugguggacccuaaacg

SEQ ID NO: 113016 - RNA, 22 nt, Homo sapiens
uucucugggacauaggucgggu

SEQ ID NO: 113017 - RNA, 22 nt, Homo sapiens
uucugugcugaaucaaagacug

SEQ ID NO: 113018 - RNA, 22 nt, Homo sapiens
uugacaaugcacugugcuaagu

SEQ ID NO: 113019 - RNA, 22 nt, Homo sapiens
uugacauaguuucugaaauaga

SEQ ID NO: 113020 - RNA, 22 nt, Homo sapiens
uugagauggaaucucgcuuugu

SEQ ID NO: 113021 - RNA, 22 nt, Homo sapiens
uugagauggagucucacucuuc

SEQ ID NO: 113022 - RNA, 22 nt, Homo sapiens
uugagauggagucucacucuuu

SEQ ID NO: 113023 - RNA, 22 nt, Homo sapiens
uugagauggaguuucacucuug

SEQ ID NO: 113024 - RNA, 22 nt, Homo sapiens
uugagauggaguuuugcucuug

SEQ ID NO: 113025 - RNA, 22 nt, Homo sapiens
uugagcucaucaagauagagaa

SEQ ID NO: 113026 - RNA, 22 nt, Homo sapiens
uugagcuccucucaaccuaagg

SEQ ID NO: 113027 - RNA, 22 nt, Homo sapiens
uugagggaggcagggcuugucu

SEQ ID NO: 113028 - RNA, 22 nt, Homo sapiens
uugcacuccagccuggaugaca

SEQ ID NO: 113029 - RNA, 22 nt, Homo sapiens
uugcacuccagcucgggugaca

SEQ ID NO: 113030 - RNA, 22 nt, Homo sapiens
uugcacuccauccuggguugac

SEQ ID NO: 113031 - RNA, 22 nt, Homo sapiens
uugcacucuccagccucggcaa

SEQ ID NO: 113032 - RNA, 22 nt, Homo sapiens
uugcacucugaagaccuacugu

SEQ ID NO: 113033 - RNA, 22 nt, Homo sapiens
uugcaggcaugagccaccgugc

SEQ ID NO: 113034 - RNA, 22 nt, Homo sapiens
uugcucaggcuagaguucagcu

SEQ ID NO: 113035 - RNA, 22 nt, Homo sapiens
uuggagcccuaacucucaguac

SEQ ID NO: 113036 - RNA, 22 nt, Homo sapiens
uuguaugucuucauuugaaaaa

SEQ ID NO: 113037 - RNA, 22 nt, Homo sapiens
uuucacagagggcuucuuucua

SEQ ID NO: 113038 - RNA, 22 nt, Homo sapiens
uuucccugaaggcucugaaguc

SEQ ID NO: 113039 - RNA, 22 nt, Homo sapiens
uuugcacuugaaaacacucuca

SEQ ID NO: 113040 - RNA, 22 nt, Homo sapiens
uuuggucacugccgccgccagc

SEQ ID NO: 113041 - RNA, 22 nt, Homo sapiens
uuugguugcauucacauauuuc

SEQ ID NO: 113042 - RNA, 22 nt, Homo sapiens
uuuguaagaugcauagauugca

SEQ ID NO: 113043 - RNA, 22 nt, Homo sapiens
uuuuggcucugucuguaucuuu

SEQ ID NO: 113044 - RNA, 22 nt, Homo sapiens
aaaagagcugagagguauucuu

SEQ ID NO: 113045 - RNA, 22 nt, Homo sapiens
aaacaccacgcggucccucgga

SEQ ID NO: 113046 - RNA, 22 nt, Homo sapiens
aaagagcugagaccugguggag

SEQ ID NO: 113047 - RNA, 22 nt, Homo sapiens
aaauucaugucaccucuaggua

SEQ ID NO: 113048 - RNA, 21 nt, Homo sapiens
aagcacauugaguguguguga

SEQ ID NO: 113049 - RNA, 18 nt, Homo sapiens
aaggugcuucuguucuga

SEQ ID NO: 113050 - RNA, 22 nt, Homo sapiens
aauaagcugagagaauucuaca

SEQ ID NO: 113051 - RNA, 23 nt, Homo sapiens
acagucuaguuugaagucaggua

SEQ ID NO: 113052 - RNA, 22 nt, Homo sapiens
acccaguagccagauguagcug

SEQ ID NO: 113053 - RNA, 22 nt, Homo sapiens
acccaguguugggcagaacugu

SEQ ID NO: 113054 - RNA, 22 nt, Homo sapiens
acucagagauuagcacauguuu

SEQ ID NO: 113055 - RNA, 20 nt, Homo sapiens
agaagcauugcucucuucag

SEQ ID NO: 113056 - RNA, 22 nt, Homo sapiens
agacuuagagagucuauucuau

SEQ ID NO: 113057 - RNA, 22 nt, Homo sapiens
agaugcuguuaucaacuguagc

SEQ ID NO: 113058 - RNA, 22 nt, Homo sapiens
agaugguguuuucucaccagau

SEQ ID NO: 113059 - RNA, 22 nt, Homo sapiens
agauucauccaaguuguugcau

SEQ ID NO: 113060 - RNA, 22 nt, Homo sapiens
agcaacaucagcagcaggaaaa

SEQ ID NO: 113061 - RNA, 22 nt, Homo sapiens
agcaacauuguucauaauagcu

SEQ ID NO: 113062 - RNA, 22 nt, Homo sapiens
agcagcauggguauaaaucucc

SEQ ID NO: 113063 - RNA, 20 nt, Homo sapiens
agcuccauuccugaaggcug

SEQ ID NO: 113064 - RNA, 22 nt, Homo sapiens
agcugcacaaauggaugugagg

SEQ ID NO: 113065 - RNA, 17 nt, Homo sapiens
agcuggaauuacgggag

SEQ ID NO: 113066 - RNA, 22 nt, Homo sapiens
uggauggucagaggguuucugu

SEQ ID NO: 113067 - RNA, 19 nt, Homo sapiens
uggcacauguauacauaug

SEQ ID NO: 113068 - RNA, 22 nt, Homo sapiens
uggccaguuuuuaauugggucu

SEQ ID NO: 113069 - RNA, 22 nt, Homo sapiens
uggugcaaugaagugaucucaa

SEQ ID NO: 113070 - RNA, 22 nt, Homo sapiens
uguaaaucuauuuuuaguguuu

SEQ ID NO: 113071 - RNA, 22 nt, Homo sapiens
uguaguuugaaagcucccucug

SEQ ID NO: 113072 - RNA, 22 nt, Homo sapiens
ugucacccuuuauccauuuccu

SEQ ID NO: 113073 - RNA, 22 nt, Homo sapiens
ugugaagauguuucuuaauuga

SEQ ID NO: 113074 - RNA, 18 nt, Homo sapiens
ugugacauugagcauguc

SEQ ID NO: 113075 - RNA, 22 nt, Homo sapiens
uguggcucuucuguucuccacu

SEQ ID NO: 113076 - RNA, 22 nt, Homo sapiens
uguuauuuuguguuagggcaca

SEQ ID NO: 113077 - RNA, 22 nt, Homo sapiens
uguucuugaguugggaguacaa

SEQ ID NO: 113078 - RNA, 22 nt, Homo sapiens
uguuggcauugcugcugacccu

SEQ ID NO: 113079 - RNA, 22 nt, Homo sapiens
uguuuugguugucccuggccag

SEQ ID NO: 113080 - RNA, 22 nt, Homo sapiens
uucacccugguuguagauggac

SEQ ID NO: 113081 - RNA, 22 nt, Homo sapiens
uucaggguggagaguaugaggu

SEQ ID NO: 113082 - RNA, 22 nt, Homo sapiens
uucaguucugcacugaucuuag

SEQ ID NO: 113083 - RNA, 22 nt, Homo sapiens
uuccaguuauuauaccucuuaa

SEQ ID NO: 113084 - RNA, 22 nt, Homo sapiens
uucccagagccugggagugagg

SEQ ID NO: 113085 - RNA, 22 nt, Homo sapiens
uucccaguggaacauguaguca

SEQ ID NO: 113086 - RNA, 20 nt, Homo sapiens
uucccucagccuugagggua

SEQ ID NO: 113087 - RNA, 22 nt, Homo sapiens
uuccugagagggcugggugcag

SEQ ID NO: 113088 - RNA, 17 nt, Homo sapiens
uucucaguucugaucuc

SEQ ID NO: 113089 - RNA, 22 nt, Homo sapiens
uugagauggagccucacucugc

SEQ ID NO: 113090 - RNA, 22 nt, Homo sapiens
uugagauggagcuucacucuug

SEQ ID NO: 113091 - RNA, 22 nt, Homo sapiens
uugagauggagucucgcucugu

SEQ ID NO: 113092 - RNA, 22 nt, Homo sapiens
uugagauggagucuugcucuug

SEQ ID NO: 113093 - RNA, 22 nt, Homo sapiens
uugagauggaguuucgcucuuu

SEQ ID NO: 113094 - RNA, 22 nt, Homo sapiens
uugcacuccagcucuaggugac

SEQ ID NO: 113095 - RNA, 22 nt, Homo sapiens
uugcacuccggccuggguaaca

SEQ ID NO: 113096 - RNA, 22 nt, Homo sapiens
uugcacucuagccugggugaca

SEQ ID NO: 113097 - RNA, 22 nt, Homo sapiens
uugccacuucucuugccccauu

SEQ ID NO: 113098 - RNA, 22 nt, Homo sapiens
uugccuuuguuggaaacaagug

SEQ ID NO: 113099 - RNA, 22 nt, Homo sapiens
uuggauugugaaaguauucucu

SEQ ID NO: 113100 - RNA, 22 nt, Homo sapiens
uuggccccuuucauccacagcu

SEQ ID NO: 113101 - RNA, 22 nt, Homo sapiens
uuguagaucuucaguugcuaca

SEQ ID NO: 113102 - RNA, 22 nt, Homo sapiens
uuuaucaggccuuuggaaaaau

SEQ ID NO: 113103 - RNA, 17 nt, Homo sapiens
uuucagaguggaagugu

SEQ ID NO: 113104 - RNA, 18 nt, Homo sapiens
uuucauugagugugauau

SEQ ID NO: 113105 - RNA, 22 nt, Homo sapiens
uuucuuggagcucuuagggucg

SEQ ID NO: 113106 - RNA, 22 nt, Homo sapiens
uuugcacuggagauucaauggg

SEQ ID NO: 113107 - RNA, 22 nt, Homo sapiens
uuugcacuucugagugugacau

SEQ ID NO: 113108 - RNA, 22 nt, Homo sapiens
uuugcacuuuaauauaauguga

SEQ ID NO: 113109 - RNA, 22 nt, Homo sapiens
uuugcacuuuuguaauaugguu

SEQ ID NO: 113110 - RNA, 22 nt, Homo sapiens
uuuggcagaugacccucaaguu

SEQ ID NO: 113111 - RNA, 22 nt, Homo sapiens
uuuggcauuagagagacuugca

SEQ ID NO: 113112 - RNA, 22 nt, Homo sapiens
uuuggcauuuuacuacucaaau

SEQ ID NO: 113113 - RNA, 22 nt, Homo sapiens
uuugugaaugucauaagcucca

SEQ ID NO: 113114 - RNA, 22 nt, Homo sapiens
uuuuccagugggacucccauua

SEQ ID NO: 113115 - RNA, 20 nt, Homo sapiens
uuuuggacuaaaggcauccc

SEQ ID NO: 113116 - RNA, 22 nt, Homo sapiens
uuuuggacuucaauuugacacu

SEQ ID NO: 113117 - RNA, 22 nt, Homo sapiens
augugcaagaucauuaaagcuc

SEQ ID NO: 113118 - RNA, 22 nt, Homo sapiens
auguguaaagcuuuucuuuguu

SEQ ID NO: 113119 - RNA, 22 nt, Homo sapiens
auuaaguuaggauuuugagaua

SEQ ID NO: 113120 - RNA, 22 nt, Homo sapiens
auuccacaguuaacacagaccg

SEQ ID NO: 113121 - RNA, 23 nt, Homo sapiens
auugcacuccagccuaccugggc

SEQ ID NO: 113122 - RNA, 22 nt, Homo sapiens
auugcacuccagccuaggcaac

SEQ ID NO: 113123 - RNA, 22 nt, Homo sapiens
auugcacuccagccuagguaac

SEQ ID NO: 113124 - RNA, 22 nt, Homo sapiens
auugcacuccagccuggaugac

SEQ ID NO: 113125 - RNA, 22 nt, Homo sapiens
auugcacuccagccuggccgag

SEQ ID NO: 113126 - RNA, 21 nt, Homo sapiens
auugcacuccagccugggcga

SEQ ID NO: 113127 - RNA, 22 nt, Homo sapiens
auugcacuccagccuggggaac

SEQ ID NO: 113128 - RNA, 22 nt, Homo sapiens
auugcacuccagccugggggac

SEQ ID NO: 113129 - RNA, 22 nt, Homo sapiens
auugcacuccagccuugacaca

SEQ ID NO: 113130 - RNA, 22 nt, Homo sapiens
auugcacuccagccuugggcaa

SEQ ID NO: 113131 - RNA, 22 nt, Homo sapiens
auugcacuccagcuuaggcgac

SEQ ID NO: 113132 - RNA, 22 nt, Homo sapiens
auugcacuccauccuaggugac

SEQ ID NO: 113133 - RNA, 22 nt, Homo sapiens
auugcacuccauccugggcaau

SEQ ID NO: 113134 - RNA, 22 nt, Homo sapiens
auugcacucuagccugggugac

SEQ ID NO: 113135 - RNA, 22 nt, Homo sapiens
auugcacugcagccugggcaac

SEQ ID NO: 113136 - RNA, 22 nt, Homo sapiens
auuuuuggauauagggaaggau

SEQ ID NO: 113137 - RNA, 22 nt, Homo sapiens
auuuuugguugguaggcuauua

SEQ ID NO: 113138 - RNA, 22 nt, Homo sapiens
cacaggaagaggcacggucccu

SEQ ID NO: 113139 - RNA, 22 nt, Homo sapiens
cacuggcacuguguuuagaugg

SEQ ID NO: 113140 - RNA, 22 nt, Homo sapiens
cagcuguuguuccagucuuuua

SEQ ID NO: 113141 - RNA, 22 nt, Homo sapiens
caucacaugcuuauuuuccuca

SEQ ID NO: 113142 - RNA, 19 nt, Homo sapiens
cauggcuuauaauuuuaau

SEQ ID NO: 113143 - RNA, 22 nt, Homo sapiens
cauggcuuguauaagauucuca

SEQ ID NO: 113144 - RNA, 22 nt, Homo sapiens
ccaguuuucaagauaaugguuu

SEQ ID NO: 113145 - RNA, 19 nt, Homo sapiens
ccccuguggauaccgaggg

SEQ ID NO: 113146 - RNA, 22 nt, Homo sapiens
cuaaaugucucuacuaaguuua

SEQ ID NO: 113147 - RNA, 22 nt, Homo sapiens
cucaggguacuucuccuuugcu

SEQ ID NO: 113148 - RNA, 22 nt, Homo sapiens
cucagggugguggacucuaaua

SEQ ID NO: 113149 - RNA, 22 nt, Homo sapiens
cucccagagccaguuauaggcu

SEQ ID NO: 113150 - RNA, 23 nt, Homo sapiens
cucccugaacaugacacaccaga

SEQ ID NO: 113151 - RNA, 20 nt, Homo sapiens
cuccuucauuccuuuggacc

SEQ ID NO: 113152 - RNA, 22 nt, Homo sapiens
cugaggugggaggauuggcuug

SEQ ID NO: 113153 - RNA, 22 nt, Homo sapiens
cugcagguaggggcagcuuugg

SEQ ID NO: 113154 - RNA, 22 nt, Homo sapiens
cuuccagcuggguucagucagu

SEQ ID NO: 113155 - RNA, 22 nt, Homo sapiens
cuucggugaguagauggguuaa

SEQ ID NO: 113156 - RNA, 22 nt, Homo sapiens
agcuuguguuuuucuaaguauc

SEQ ID NO: 113157 - RNA, 22 nt, Homo sapiens
aggagguagggugugaaacagc

SEQ ID NO: 113158 - RNA, 22 nt, Homo sapiens
aggcaguuucagugagagguga

SEQ ID NO: 113159 - RNA, 22 nt, Homo sapiens
aggugcuugaaucuaugagcuc

SEQ ID NO: 113160 - RNA, 22 nt, Homo sapiens
agguuuucagccccagccuagg

SEQ ID NO: 113161 - RNA, 22 nt, Homo sapiens
auaagucaauggaacagauuaa

SEQ ID NO: 113162 - RNA, 20 nt, Homo sapiens
auagcauugauggacucaaa

SEQ ID NO: 113163 - RNA, 22 nt, Homo sapiens
aucccaguucagccucugacac

SEQ ID NO: 113164 - RNA, 22 nt, Homo sapiens
augagcucauaaagagugauuu

SEQ ID NO: 113165 - RNA, 22 nt, Homo sapiens
augccacuucucuaagucaugu

SEQ ID NO: 113166 - RNA, 22 nt, Homo sapiens
auggagguguggggagugaguu

SEQ ID NO: 113167 - RNA, 22 nt, Homo sapiens
auugcacuccacccugggcaac

SEQ ID NO: 113168 - RNA, 22 nt, Homo sapiens
auugcacuccagcccgggugac

SEQ ID NO: 113169 - RNA, 22 nt, Homo sapiens
auugcacuccagccuagucaac

SEQ ID NO: 113170 - RNA, 22 nt, Homo sapiens
auugcacuccagccucggugac

SEQ ID NO: 113171 - RNA, 22 nt, Homo sapiens
auugcacuccagccugagcaaa

SEQ ID NO: 113172 - RNA, 22 nt, Homo sapiens
auugcacuccagccugcggaac

SEQ ID NO: 113173 - RNA, 22 nt, Homo sapiens
auugcacuccagccuggcaaua

SEQ ID NO: 113174 - RNA, 22 nt, Homo sapiens
auugcacuccagccugggcgac

SEQ ID NO: 113175 - RNA, 22 nt, Homo sapiens
auugcacuccagccugggcuag

SEQ ID NO: 113176 - RNA, 22 nt, Homo sapiens
auugcacuccagccuggugaca

SEQ ID NO: 113177 - RNA, 22 nt, Homo sapiens
auugcacuccagccuugugaca

SEQ ID NO: 113178 - RNA, 22 nt, Homo sapiens
auugcacuccagcuugggugac

SEQ ID NO: 113179 - RNA, 22 nt, Homo sapiens
auugcacucuaaccuaggugac

SEQ ID NO: 113180 - RNA, 22 nt, Homo sapiens
auugcacucuagccuuggcgac

SEQ ID NO: 113181 - RNA, 22 nt, Homo sapiens
auugcacucugaucugcacucc

SEQ ID NO: 113182 - RNA, 22 nt, Homo sapiens
auugcagauucgcuuuguguug

SEQ ID NO: 113183 - RNA, 22 nt, Homo sapiens
auuguguagucuuacugcuugc

SEQ ID NO: 113184 - RNA, 22 nt, Homo sapiens
auuugguugggugcgguggcuu

SEQ ID NO: 113185 - RNA, 22 nt, Homo sapiens
auuuuugguugucagcacuagg

SEQ ID NO: 113186 - RNA, 22 nt, Homo sapiens
cacacugucuucauuacuguag

SEQ ID NO: 113187 - RNA, 22 nt, Homo sapiens
cagcuugugguauugcugguug

SEQ ID NO: 113188 - RNA, 22 nt, Homo sapiens
cauugcaugcauauggcuuggu

SEQ ID NO: 113189 - RNA, 22 nt, Homo sapiens
cccugagaaaacuuuguccuua

SEQ ID NO: 113190 - RNA, 22 nt, Homo sapiens
cccugagagcagggucuuucuc

SEQ ID NO: 113191 - RNA, 22 nt, Homo sapiens
ccucauggagaacuucugcuag

SEQ ID NO: 113192 - RNA, 21 nt, Homo sapiens
ccugaagaagugaccucugag

SEQ ID NO: 113193 - RNA, 22 nt, Homo sapiens
ccuugcacuucccaagugaggc

SEQ ID NO: 113194 - RNA, 22 nt, Homo sapiens
cuagccuggagugcaguggugc

SEQ ID NO: 113195 - RNA, 22 nt, Homo sapiens
cucaguguuucagcugcucaga

SEQ ID NO: 113196 - RNA, 22 nt, Homo sapiens
cucauggaauacuucacagcca

SEQ ID NO: 113197 - RNA, 20 nt, Homo sapiens
cucccugacaaauguggaaa

SEQ ID NO: 113198 - RNA, 22 nt, Homo sapiens
cugagcuagaccacuuggcucc

SEQ ID NO: 113199 - RNA, 22 nt, Homo sapiens
cugagcuaugccuggaaaggca

SEQ ID NO: 113200 - RNA, 22 nt, Homo sapiens
cuggaauuacaggguugagcua

SEQ ID NO: 113201 - RNA, 22 nt, Homo sapiens
cuggacaaaucuggaaagaacc

SEQ ID NO: 113202 - RNA, 22 nt, Homo sapiens
cuuagcaaugucguguacucac

SEQ ID NO: 113203 - RNA, 22 nt, Homo sapiens
ucccaguguguagcuugucucu

SEQ ID NO: 113204 - RNA, 18 nt, Homo sapiens
ucccucagaauuauagaa

SEQ ID NO: 113205 - RNA, 22 nt, Homo sapiens
ucuccggguggcggcgaaggga

SEQ ID NO: 113206 - RNA, 22 nt, Homo sapiens
ucugacucuggagucucagguu

SEQ ID NO: 113207 - RNA, 22 nt, Homo sapiens
ucugagcaauagauguggauau

SEQ ID NO: 113208 - RNA, 22 nt, Homo sapiens
ucugagcaugcaucuugccugg

SEQ ID NO: 113209 - RNA, 22 nt, Homo sapiens
ucugucuuugccuaaguuuguc

SEQ ID NO: 113210 - RNA, 22 nt, Homo sapiens
ucuguuguuaucauaauauuga

SEQ ID NO: 113211 - RNA, 22 nt, Homo sapiens
ucuugcacacaguaaguguuuu

SEQ ID NO: 113212 - RNA, 22 nt, Homo sapiens
ucuuuguucaggagccaacucc

SEQ ID NO: 113213 - RNA, 22 nt, Homo sapiens
ugaaaugcagaacuuuaggucu

SEQ ID NO: 113214 - RNA, 22 nt, Homo sapiens
ugacucaguuguuagucuucau

SEQ ID NO: 113215 - RNA, 22 nt, Homo sapiens
ugagacugaguuuugccuuugu

SEQ ID NO: 113216 - RNA, 22 nt, Homo sapiens
ugagauuaucuugaucuugaaa

SEQ ID NO: 113217 - RNA, 22 nt, Homo sapiens
ugagcucaugcauucuugagga

SEQ ID NO: 113218 - RNA, 22 nt, Homo sapiens
ugagggcguauccuucauuaag

SEQ ID NO: 113219 - RNA, 22 nt, Homo sapiens
ugagguaaaacaaggauuggau

SEQ ID NO: 113220 - RNA, 22 nt, Homo sapiens
ugagugugacuuagcagaagga

SEQ ID NO: 113221 - RNA, 22 nt, Homo sapiens
ugaguguguaugugcauacaca

SEQ ID NO: 113222 - RNA, 22 nt, Homo sapiens
ugaguucaauuguauuuuauua

SEQ ID NO: 113223 - RNA, 22 nt, Homo sapiens
ugaguucauggucauuugucac

SEQ ID NO: 113224 - RNA, 22 nt, Homo sapiens
ugcaagacacuguccugggcau

SEQ ID NO: 113225 - RNA, 22 nt, Homo sapiens
ugcaccacugcacuccagcuug

SEQ ID NO: 113226 - RNA, 22 nt, Homo sapiens
ugcauaggagcagggucuaugu

SEQ ID NO: 113227 - RNA, 20 nt, Homo sapiens
ugccaagaaaugaggguauu

SEQ ID NO: 113228 - RNA, 22 nt, Homo sapiens
ugccaagauuucaggaauuaag

SEQ ID NO: 113229 - RNA, 22 nt, Homo sapiens
ugcugcacaguucuuaagauua

SEQ ID NO: 113230 - RNA, 20 nt, Homo sapiens
ugcugcacuuaagcaugggc

SEQ ID NO: 113231 - RNA, 22 nt, Homo sapiens
ugcuuguguucagguaaccuuu

SEQ ID NO: 113232 - RNA, 22 nt, Homo sapiens
uggagauguuuaaaauccacug

SEQ ID NO: 113233 - RNA, 22 nt, Homo sapiens
uggcaagaacaacaauuacuuu

SEQ ID NO: 113234 - RNA, 22 nt, Homo sapiens
uggcaagaaccacaauuacuuu

SEQ ID NO: 113235 - RNA, 22 nt, Homo sapiens
uggcaagagcaaaauguacagu

SEQ ID NO: 113236 - RNA, 22 nt, Homo sapiens
uggcaauaaggacuccuuaggu

SEQ ID NO: 113237 - RNA, 22 nt, Homo sapiens
uggccaguguuuuuccugggcu

SEQ ID NO: 113238 - RNA, 22 nt, Homo sapiens
uggcuuuuguuauuuggaagcu

SEQ ID NO: 113239 - RNA, 22 nt, Homo sapiens
ugggaugaaaauagcuucuucc

SEQ ID NO: 113240 - RNA, 22 nt, Homo sapiens
aaaguacucaguucaguuccgu

SEQ ID NO: 113241 - RNA, 22 nt, Homo sapiens
aacagacugucacauaaaauug

SEQ ID NO: 113242 - RNA, 22 nt, Homo sapiens
aagagcucucuguagcauguga

SEQ ID NO: 113243 - RNA, 22 nt, Homo sapiens
aagcuggagugcaguggugcaa

SEQ ID NO: 113244 - RNA, 22 nt, Homo sapiens
aagcuguuguucauccugaauu

SEQ ID NO: 113245 - RNA, 22 nt, Homo sapiens
acacuguuuuaguuauuauagc

SEQ ID NO: 113246 - RNA, 22 nt, Homo sapiens
acacuugcuugcaauagccucc

SEQ ID NO: 113247 - RNA, 22 nt, Homo sapiens
acucagagugggccccuagaua

SEQ ID NO: 113248 - RNA, 22 nt, Homo sapiens
acuguauagauggaguugauuu

SEQ ID NO: 113249 - RNA, 22 nt, Homo sapiens
acuuuuugaugaggucguuugu

SEQ ID NO: 113250 - RNA, 20 nt, Homo sapiens
agagaucaguaauucaucaa

SEQ ID NO: 113251 - RNA, 22 nt, Homo sapiens
agagcauugaguuaaugguuca

SEQ ID NO: 113252 - RNA, 22 nt, Homo sapiens
agauggugugcuaggaaaugua

SEQ ID NO: 113253 - RNA, 22 nt, Homo sapiens
agcaacauagugagacccccau

SEQ ID NO: 113254 - RNA, 22 nt, Homo sapiens
agcaacauggaguuugugcgca

SEQ ID NO: 113255 - RNA, 22 nt, Homo sapiens
agcaacauugagacugcaguug

SEQ ID NO: 113256 - RNA, 22 nt, Homo sapiens
agcaacauuuuugaccuuucuu

SEQ ID NO: 113257 - RNA, 22 nt, Homo sapiens
agcacagugguuaaguuucuua

SEQ ID NO: 113258 - RNA, 19 nt, Homo sapiens
agccaguuuucccagcacc

SEQ ID NO: 113259 - RNA, 22 nt, Homo sapiens
agcccugugauuacuuuuauaa

SEQ ID NO: 113260 - RNA, 22 nt, Homo sapiens
agcugcacugguauaggagaaa

SEQ ID NO: 113261 - RNA, 21 nt, Homo sapiens
agcugcguuuaggcauuuucc

SEQ ID NO: 113262 - RNA, 22 nt, Homo sapiens
agcuugugauuuagagugagag

SEQ ID NO: 113263 - RNA, 22 nt, Homo sapiens
agcuuguguuugucugccuggg

SEQ ID NO: 113264 - RNA, 22 nt, Homo sapiens
agcuuguuuuauagaaagucaa

SEQ ID NO: 113265 - RNA, 22 nt, Homo sapiens
aggaagcuagcauuuguucagu

SEQ ID NO: 113266 - RNA, 21 nt, Homo sapiens
aggagcauucucuugcuuugu

SEQ ID NO: 113267 - RNA, 23 nt, Homo sapiens
aggagcuuagaaguugccauugc

SEQ ID NO: 113268 - RNA, 22 nt, Homo sapiens
aggcagcuguuauauacugagu

SEQ ID NO: 113269 - RNA, 22 nt, Homo sapiens
aggugacugguuuaucuggcag

SEQ ID NO: 113270 - RNA, 22 nt, Homo sapiens
auaacauggaguuugucauuua

SEQ ID NO: 113271 - RNA, 22 nt, Homo sapiens
auacacuggagcaaaccuggag

SEQ ID NO: 113272 - RNA, 22 nt, Homo sapiens
auacaugugcaggucagguuac

SEQ ID NO: 113273 - RNA, 22 nt, Homo sapiens
auagaauguauuaguaaauuug

SEQ ID NO: 113274 - RNA, 22 nt, Homo sapiens
auagauucauuugaggagauuu

SEQ ID NO: 113275 - RNA, 22 nt, Homo sapiens
auagcaagaugauugauccauu

SEQ ID NO: 113276 - RNA, 21 nt, Homo sapiens
auagcacaucagauuuuauua

SEQ ID NO: 113277 - RNA, 22 nt, Homo sapiens
aucagauuccacauuuuaucag

SEQ ID NO: 113278 - RNA, 22 nt, Homo sapiens
aucccuguguccagcaccugug

SEQ ID NO: 113279 - RNA, 19 nt, Homo sapiens
aucuggaguuccuggggcu

SEQ ID NO: 113280 - RNA, 22 nt, Homo sapiens
aucugguguuuccuucacauug

SEQ ID NO: 113281 - RNA, 22 nt, Homo sapiens
aucugugguuguaugcauauua

SEQ ID NO: 113282 - RNA, 22 nt, Homo sapiens
augaaacuggcuaauuuuugua

SEQ ID NO: 113283 - RNA, 22 nt, Homo sapiens
augagacuagaagagaauaaua

SEQ ID NO: 113284 - RNA, 22 nt, Homo sapiens
augagcuccucaaggucagaga

SEQ ID NO: 113285 - RNA, 22 nt, Homo sapiens
augcacauggcuaacuuuuuuc

SEQ ID NO: 113286 - RNA, 22 nt, Homo sapiens
augccauugcacuccagccugg

SEQ ID NO: 113287 - RNA, 22 nt, Homo sapiens
auggaacauaacuauuugggga

SEQ ID NO: 113288 - RNA, 22 nt, Homo sapiens
auggacguagauucucaaggau

SEQ ID NO: 113289 - RNA, 22 nt, Homo sapiens
augguguccuguuuccccagga

SEQ ID NO: 113290 - RNA, 22 nt, Homo sapiens
augugggaggacuuggcuguug

SEQ ID NO: 113291 - RNA, 22 nt, Homo sapiens
auuagugaaugugaugucuuga

SEQ ID NO: 113292 - RNA, 22 nt, Homo sapiens
auuccaguggguuuacauccca

SEQ ID NO: 113293 - RNA, 22 nt, Homo sapiens
auugcacuccagcccugcugac

SEQ ID NO: 113294 - RNA, 22 nt, Homo sapiens
auugcacuccagccuggccaac

SEQ ID NO: 113295 - RNA, 22 nt, Homo sapiens
auugcacuccagccugggugac

SEQ ID NO: 113296 - RNA, 22 nt, Homo sapiens
auugcacuccagccugggugag

SEQ ID NO: 113297 - RNA, 22 nt, Homo sapiens
auugcacuccggccugggugac

SEQ ID NO: 113298 - RNA, 18 nt, Homo sapiens
auugcacuccugccuggg

SEQ ID NO: 113299 - RNA, 22 nt, Homo sapiens
auugucauuuauaacuguguag

SEQ ID NO: 113300 - RNA, 22 nt, Homo sapiens
auuuuugguuucaccugcacgc

SEQ ID NO: 113301 - RNA, 22 nt, Homo sapiens
cacagcacaggcaugaguguca

SEQ ID NO: 113302 - RNA, 22 nt, Homo sapiens
cacagugaacugguggguuuuu

SEQ ID NO: 113303 - RNA, 22 nt, Homo sapiens
cacagugaaugucaucauugcc

SEQ ID NO: 113304 - RNA, 22 nt, Homo sapiens
cagagagcuugcccuuguauau

SEQ ID NO: 113305 - RNA, 22 nt, Homo sapiens
cagauacuggaguccugaaguu

SEQ ID NO: 113306 - RNA, 22 nt, Homo sapiens
cagauggucuuaaggcagccuu

SEQ ID NO: 113307 - RNA, 22 nt, Homo sapiens
cagcagguuuuuaucaguuaag

SEQ ID NO: 113308 - RNA, 22 nt, Homo sapiens
cagcuguuguuaugucugcagg

SEQ ID NO: 113309 - RNA, 22 nt, Homo sapiens
cauacaugugcuugucuuaugc

SEQ ID NO: 113310 - RNA, 22 nt, Homo sapiens
cauuccacuggauaaacaaggu

SEQ ID NO: 113311 - RNA, 22 nt, Homo sapiens
cauugcacuccagccugaguga

SEQ ID NO: 113312 - RNA, 22 nt, Homo sapiens
cauugcacuccauccuuggcaa

SEQ ID NO: 113313 - RNA, 22 nt, Homo sapiens
ccaguuuucucacuguugcagu

SEQ ID NO: 113314 - RNA, 22 nt, Homo sapiens
cccagugugaacuuggcauuuu

SEQ ID NO: 113315 - RNA, 22 nt, Homo sapiens
cccugagaugugaauuucagag

SEQ ID NO: 113316 - RNA, 22 nt, Homo sapiens
ccucauggagaacaucugcuag

SEQ ID NO: 113317 - RNA, 22 nt, Homo sapiens
ccuugcacuucccaggugaggc

SEQ ID NO: 113318 - RNA, 22 nt, Homo sapiens
cuacauuguagguauucaaacu

SEQ ID NO: 113319 - RNA, 22 nt, Homo sapiens
cuaguaaugucugucuuaugga

SEQ ID NO: 113320 - RNA, 22 nt, Homo sapiens
cugagaagaaacagguaaggac

SEQ ID NO: 113321 - RNA, 22 nt, Homo sapiens
cugagugcaagugauccuccca

SEQ ID NO: 113322 - RNA, 22 nt, Homo sapiens
cuggagcaaaggugacucuugu

SEQ ID NO: 113323 - RNA, 22 nt, Homo sapiens
cuggagcauugguggauuuguu

SEQ ID NO: 113324 - RNA, 22 nt, Homo sapiens
cugugcauaugacuuuauugga

SEQ ID NO: 113325 - RNA, 22 nt, Homo sapiens
cugugcuugagagaugacacag

SEQ ID NO: 113326 - RNA, 22 nt, Homo sapiens
cuucaguucuguaaggacagca

SEQ ID NO: 113327 - RNA, 22 nt, Homo sapiens
cuugauagugguaaucauuuuu

SEQ ID NO: 113328 - RNA, 22 nt, Homo sapiens
cuuuccauuguuggagcauaaa

SEQ ID NO: 113329 - RNA, 22 nt, Homo sapiens
cuuuuugcuagagucuaggguc

SEQ ID NO: 113330 - RNA, 22 nt, Homo sapiens
gacagagcaagacccuauuuaa

SEQ ID NO: 113331 - RNA, 22 nt, Homo sapiens
gagauauuuagaaauguguucu

SEQ ID NO: 113332 - RNA, 22 nt, Homo sapiens
gagaugugugugauuauauaau

SEQ ID NO: 113333 - RNA, 22 nt, Homo sapiens
gagcaucaguggccucaucuca

SEQ ID NO: 113334 - RNA, 22 nt, Homo sapiens
gagcucaccuuaccucuggagc

SEQ ID NO: 113335 - RNA, 22 nt, Homo sapiens
gaggcagucuguccauucucag

SEQ ID NO: 113336 - RNA, 22 nt, Homo sapiens
gaggcagucugucccuuagcag

SEQ ID NO: 113337 - RNA, 22 nt, Homo sapiens
gaucaauuggcugaagacacgu

SEQ ID NO: 113338 - RNA, 22 nt, Homo sapiens
gauggaguaauguaaucuugag

SEQ ID NO: 113339 - RNA, 22 nt, Homo sapiens
gcacaggguuacauucuaaggu

SEQ ID NO: 113340 - RNA, 22 nt, Homo sapiens
gcacauuacaaguauuagcuca

SEQ ID NO: 113341 - RNA, 22 nt, Homo sapiens
gcauggaaggcgcuuugugacu

SEQ ID NO: 113342 - RNA, 22 nt, Homo sapiens
gcugagaucucuugccugaacu

SEQ ID NO: 113343 - RNA, 22 nt, Homo sapiens
gcugcuguuuaguuucuccugg

SEQ ID NO: 113344 - RNA, 22 nt, Homo sapiens
gcuggcuuucuccugaucucag

SEQ ID NO: 113345 - RNA, 22 nt, Homo sapiens
gcugguguucaggcccucaguc

SEQ ID NO: 113346 - RNA, 22 nt, Homo sapiens
ggacaagagacugggacacuga

SEQ ID NO: 113347 - RNA, 22 nt, Homo sapiens
ggagugugauucaguauaauau

SEQ ID NO: 113348 - RNA, 22 nt, Homo sapiens
ggcaacauggugaaacucuguc

SEQ ID NO: 113349 - RNA, 22 nt, Homo sapiens
ggcaagaaagaaaucaucuguc

SEQ ID NO: 113350 - RNA, 19 nt, Homo sapiens
ggugcuugaauauuccucc

SEQ ID NO: 113351 - RNA, 22 nt, Homo sapiens
gguggcuuuuugugauggcuga

SEQ ID NO: 113352 - RNA, 22 nt, Homo sapiens
guaugacacaggaagcuuaacc

SEQ ID NO: 113353 - RNA, 22 nt, Homo sapiens
gucccaguggaaccuccaagcu

SEQ ID NO: 113354 - RNA, 22 nt, Homo sapiens
gucuugcacuuaccuaagaacu

SEQ ID NO: 113355 - RNA, 22 nt, Homo sapiens
gugaaaugaaacgcuaugucuu

SEQ ID NO: 113356 - RNA, 22 nt, Homo sapiens
gugagcauaggaggcuucuguu

SEQ ID NO: 113357 - RNA, 22 nt, Homo sapiens
gugagcuaguuucuuugcugug

SEQ ID NO: 113358 - RNA, 22 nt, Homo sapiens
gugagguaauuagcucccuuag

SEQ ID NO: 113359 - RNA, 22 nt, Homo sapiens
gugagguguuaaccaaccugug

SEQ ID NO: 113360 - RNA, 22 nt, Homo sapiens
gugucuccugccuucaugcagc

SEQ ID NO: 113361 - RNA, 19 nt, Homo sapiens
uacccagaagcagcauugu

SEQ ID NO: 113362 - RNA, 22 nt, Homo sapiens
uaccucagccaaugcccagaag

SEQ ID NO: 113363 - RNA, 22 nt, Homo sapiens
uagagcacagugauuagaccua

SEQ ID NO: 113364 - RNA, 22 nt, Homo sapiens
uagauuguaauaugcagaaugg

SEQ ID NO: 113365 - RNA, 19 nt, Homo sapiens
uagcagcaugauuuauaau

SEQ ID NO: 113366 - RNA, 22 nt, Homo sapiens
uaguagcauaccuaaguauacu

SEQ ID NO: 113367 - RNA, 22 nt, Homo sapiens
uauagcuuaaaguuuagauccu

SEQ ID NO: 113368 - RNA, 22 nt, Homo sapiens
uaucucagagaaucagauuuac

SEQ ID NO: 113369 - RNA, 22 nt, Homo sapiens
uauuaugcacuuuauaaaaauu

SEQ ID NO: 113370 - RNA, 22 nt, Homo sapiens
ucaagcaauucugcugccucag

SEQ ID NO: 113371 - RNA, 22 nt, Homo sapiens
ucacugaaaccacugccuccug

SEQ ID NO: 113372 - RNA, 22 nt, Homo sapiens
ucauggcuuuuauuauguugag

SEQ ID NO: 113373 - RNA, 22 nt, Homo sapiens
ucauucauuugcucacuccaca

SEQ ID NO: 113374 - RNA, 22 nt, Homo sapiens
ucauugcaaucucugccucccg

SEQ ID NO: 113375 - RNA, 22 nt, Homo sapiens
ucccagugaaaccccaccuuca

SEQ ID NO: 113376 - RNA, 19 nt, Homo sapiens
ucccugagucuuagcuuga

SEQ ID NO: 113377 - RNA, 22 nt, Homo sapiens
uccuugagccucccagacucag

SEQ ID NO: 113378 - RNA, 22 nt, Homo sapiens
ucgcaguuaauaaugaugugcg

SEQ ID NO: 113379 - RNA, 22 nt, Homo sapiens
ucgugccacugcacuccagccu

SEQ ID NO: 113380 - RNA, 20 nt, Homo sapiens
ucucccaaacagcaggcccu

SEQ ID NO: 113381 - RNA, 18 nt, Homo sapiens
ucuggcuucuuuguucca

SEQ ID NO: 113382 - RNA, 23 nt, Homo sapiens
ucuggcuuugggaugcucaaggg

SEQ ID NO: 113383 - RNA, 22 nt, Homo sapiens
ucuguacugccaaguuucuuua

SEQ ID NO: 113384 - RNA, 22 nt, Homo sapiens
ucugucuugugguuugagugcc

SEQ ID NO: 113385 - RNA, 22 nt, Homo sapiens
uagugaauguuggcuauuaaua

SEQ ID NO: 113386 - RNA, 22 nt, Homo sapiens
uauagcuugauuauggugaugg

SEQ ID NO: 113387 - RNA, 22 nt, Homo sapiens
uauagcuuuuuagggaauuugg

SEQ ID NO: 113388 - RNA, 22 nt, Homo sapiens
uaugaaagcuacuucucacaau

SEQ ID NO: 113389 - RNA, 20 nt, Homo sapiens
uauuacagaguaauggugga

SEQ ID NO: 113390 - RNA, 22 nt, Homo sapiens
ucaagaccucacauagaggaga

SEQ ID NO: 113391 - RNA, 22 nt, Homo sapiens
ucaagcaauucuccugccucag

SEQ ID NO: 113392 - RNA, 19 nt, Homo sapiens
ucaagcuauucuccugccu

SEQ ID NO: 113393 - RNA, 18 nt, Homo sapiens
ucaagcuauugucaugcc

SEQ ID NO: 113394 - RNA, 22 nt, Homo sapiens
ucacugggagcauuugagccuu

SEQ ID NO: 113395 - RNA, 22 nt, Homo sapiens
ucagaguggccucucuugaaga

SEQ ID NO: 113396 - RNA, 22 nt, Homo sapiens
ucaguucauggaggugucugcu

SEQ ID NO: 113397 - RNA, 22 nt, Homo sapiens
ucauucauucauccagcuugag

SEQ ID NO: 113398 - RNA, 22 nt, Homo sapiens
ucauucauucuucaguggguac

SEQ ID NO: 113399 - RNA, 22 nt, Homo sapiens
ucauuguccaacuucuuucagu

SEQ ID NO: 113400 - RNA, 19 nt, Homo sapiens
ucccaauguuuccaggcag

SEQ ID NO: 113401 - RNA, 23 nt, Homo sapiens
uccccgggagcaccagcuuguug

SEQ ID NO: 113402 - RNA, 19 nt, Homo sapiens
uccccgggucuagugcagc

SEQ ID NO: 113403 - RNA, 22 nt, Homo sapiens
ucucaaccucccaaguagcugg

SEQ ID NO: 113404 - RNA, 21 nt, Homo sapiens
ucugagucauucaguggccug

SEQ ID NO: 113405 - RNA, 22 nt, Homo sapiens
ugaaauacuuaauuucuccaug

SEQ ID NO: 113406 - RNA, 22 nt, Homo sapiens
ugaaaugccuuuaaugaauuua

SEQ ID NO: 113407 - RNA, 22 nt, Homo sapiens
ugaacagcacguuuauucagaa

SEQ ID NO: 113408 - RNA, 22 nt, Homo sapiens
ugacaacugauuaacuccuuua

SEQ ID NO: 113409 - RNA, 22 nt, Homo sapiens
ugacagcuguugaggcauuuau

SEQ ID NO: 113410 - RNA, 22 nt, Homo sapiens
ugacauguagagaacuucucau

SEQ ID NO: 113411 - RNA, 22 nt, Homo sapiens
ugacucagauagguguguauuc

SEQ ID NO: 113412 - RNA, 22 nt, Homo sapiens
ugacugguguuuaaugagucaa

SEQ ID NO: 113413 - RNA, 22 nt, Homo sapiens
ugacuuuagaauuuuauccaga

SEQ ID NO: 113414 - RNA, 22 nt, Homo sapiens
ugagacugagucucccucuguc

SEQ ID NO: 113415 - RNA, 22 nt, Homo sapiens
ugagacugauaggacauuuucu

SEQ ID NO: 113416 - RNA, 19 nt, Homo sapiens
ugagagcacaacugaacaa

SEQ ID NO: 113417 - RNA, 22 nt, Homo sapiens
ugagcaucucuaaaaggagcaa

SEQ ID NO: 113418 - RNA, 22 nt, Homo sapiens
ugagcauuguguuugacuguga

SEQ ID NO: 113419 - RNA, 17 nt, Homo sapiens
ugagcuaugauccuguc

SEQ ID NO: 113420 - RNA, 22 nt, Homo sapiens
ugaggugaaguaauauucuaag

SEQ ID NO: 113421 - RNA, 22 nt, Homo sapiens
ugaggugcagcaauccucaugu

SEQ ID NO: 113422 - RNA, 22 nt, Homo sapiens
ugagugugaggaagaauuagaa

SEQ ID NO: 113423 - RNA, 23 nt, Homo sapiens
ugauguccacuuagggucuaggu

SEQ ID NO: 113424 - RNA, 20 nt, Homo sapiens
ugauguccaggcagagguuu

SEQ ID NO: 113425 - RNA, 20 nt, Homo sapiens
ugauuaguccacuuggcucu

SEQ ID NO: 113426 - RNA, 22 nt, Homo sapiens
ugcagcauguaggcacguuauu

SEQ ID NO: 113427 - RNA, 22 nt, Homo sapiens
ugcugcacuuauggcucugagg

SEQ ID NO: 113428 - RNA, 22 nt, Homo sapiens
uggagucuugcucuguugccca

SEQ ID NO: 113429 - RNA, 22 nt, Homo sapiens
uggagugagaacuucaaugaug

SEQ ID NO: 113430 - RNA, 22 nt, Homo sapiens
agcuggcuguagcugcaagucu

SEQ ID NO: 113431 - RNA, 22 nt, Homo sapiens
agcuguuguacacuuuaccuuu

SEQ ID NO: 113432 - RNA, 21 nt, Homo sapiens
agcuuguguguaucacagugu

SEQ ID NO: 113433 - RNA, 21 nt, Homo sapiens
aggagcauucaugacgagguu

SEQ ID NO: 113434 - RNA, 20 nt, Homo sapiens
agucaguuuauuuucucucu

SEQ ID NO: 113435 - RNA, 22 nt, Homo sapiens
agugaaaucugaagaaggucau

SEQ ID NO: 113436 - RNA, 22 nt, Homo sapiens
agugaaaugucaccuuuuagga

SEQ ID NO: 113437 - RNA, 22 nt, Homo sapiens
aguuuugguugaguuacuagca

SEQ ID NO: 113438 - RNA, 22 nt, Homo sapiens
auauagcaaugaaagagaugaa

SEQ ID NO: 113439 - RNA, 22 nt, Homo sapiens
auaucacaaacaagucuguacu

SEQ ID NO: 113440 - RNA, 22 nt, Homo sapiens
auccaguuuuaggagauuucua

SEQ ID NO: 113441 - RNA, 22 nt, Homo sapiens
aucccaguaaaaauggcuucua

SEQ ID NO: 113442 - RNA, 22 nt, Homo sapiens
augaaauugcuaucgcaguacu

SEQ ID NO: 113443 - RNA, 22 nt, Homo sapiens
augagcucauugggugacuggg

SEQ ID NO: 113444 - RNA, 22 nt, Homo sapiens
augaugcugcaguuguugccaa

SEQ ID NO: 113445 - RNA, 22 nt, Homo sapiens
augcuguuuuguagcucccucu

SEQ ID NO: 113446 - RNA, 22 nt, Homo sapiens
auggaguguaauauugagagcu

SEQ ID NO: 113447 - RNA, 22 nt, Homo sapiens
auggcacagacucuuggucaag

SEQ ID NO: 113448 - RNA, 22 nt, Homo sapiens
auggcuugugggaacuuuuaaa

SEQ ID NO: 113449 - RNA, 22 nt, Homo sapiens
augugcaaauuuccaaacucuu

SEQ ID NO: 113450 - RNA, 22 nt, Homo sapiens
augugggaggaauguguuucca

SEQ ID NO: 113451 - RNA, 22 nt, Homo sapiens
auucagaggggcagcugucuug

SEQ ID NO: 113452 - RNA, 19 nt, Homo sapiens
auugcacuccaaccugggu

SEQ ID NO: 113453 - RNA, 22 nt, Homo sapiens
auugcacuccagccccggggac

SEQ ID NO: 113454 - RNA, 22 nt, Homo sapiens
auugcacuccagccuggcagca

SEQ ID NO: 113455 - RNA, 22 nt, Homo sapiens
auugcacuccagccugggcaac

SEQ ID NO: 113456 - RNA, 22 nt, Homo sapiens
auugcacuccagccugggcagc

SEQ ID NO: 113457 - RNA, 22 nt, Homo sapiens
auugcacuccagccuuggggau

SEQ ID NO: 113458 - RNA, 22 nt, Homo sapiens
auugcacuccagucucaccagg

SEQ ID NO: 113459 - RNA, 22 nt, Homo sapiens
auugcacuccagucugggcaac

SEQ ID NO: 113460 - RNA, 22 nt, Homo sapiens
auugcacuggggguuagaauuu

SEQ ID NO: 113461 - RNA, 22 nt, Homo sapiens
cacauguuugcuacauuuuucu

SEQ ID NO: 113462 - RNA, 22 nt, Homo sapiens
cacauugaauuucugaugacaa

SEQ ID NO: 113463 - RNA, 22 nt, Homo sapiens
caccaaccucaguagcaucugu

SEQ ID NO: 113464 - RNA, 22 nt, Homo sapiens
caggcagucuggcucccaagug

SEQ ID NO: 113465 - RNA, 22 nt, Homo sapiens
cagugguuuuuagcuugcuggg

SEQ ID NO: 113466 - RNA, 22 nt, Homo sapiens
caguucaugguaggcaccauag

SEQ ID NO: 113467 - RNA, 22 nt, Homo sapiens
caugucacuuccucucugaugg

SEQ ID NO: 113468 - RNA, 22 nt, Homo sapiens
cauugcacuccagccuuggcaa

SEQ ID NO: 113469 - RNA, 22 nt, Homo sapiens
ccacaaccucaacagcaucuau

SEQ ID NO: 113470 - RNA, 22 nt, Homo sapiens
ccauugcacuccauccugggca

SEQ ID NO: 113471 - RNA, 22 nt, Homo sapiens
ccccagugguugcaacagcaga

SEQ ID NO: 113472 - RNA, 22 nt, Homo sapiens
ccccaguguguaaaggccuugc

SEQ ID NO: 113473 - RNA, 22 nt, Homo sapiens
cccugaagacuccaccgucaug

SEQ ID NO: 113474 - RNA, 22 nt, Homo sapiens
cccugugaauauuaccuuauuu

SEQ ID NO: 113475 - RNA, 22 nt, Homo sapiens
ccuucuuuuguaaggcugaaua

SEQ ID NO: 113476 - RNA, 22 nt, Homo sapiens
cuacugcacaucaucugaguua

SEQ ID NO: 113477 - RNA, 20 nt, Homo sapiens
cucaccagguguaggcugag

SEQ ID NO: 113478 - RNA, 22 nt, Homo sapiens
cucagauacuugggagguugag

SEQ ID NO: 113479 - RNA, 22 nt, Homo sapiens
cuccacugagcaggugggaggc

SEQ ID NO: 113480 - RNA, 22 nt, Homo sapiens
cucccagugacccaggaacagg

SEQ ID NO: 113481 - RNA, 22 nt, Homo sapiens
cugaggcacggcgaccuuaagu

SEQ ID NO: 113482 - RNA, 22 nt, Homo sapiens
cuggcucauuucauuuagcaua

SEQ ID NO: 113483 - RNA, 22 nt, Homo sapiens
cugucuguuucaaaagugguua

SEQ ID NO: 113484 - RNA, 22 nt, Homo sapiens
cuucuguuaguucugauaacuu

SEQ ID NO: 113485 - RNA, 21 nt, Homo sapiens
cuucuuggggcagggcagggu

SEQ ID NO: 113486 - RNA, 22 nt, Homo sapiens
cuugcacuagugcagaggcgcu

SEQ ID NO: 113487 - RNA, 22 nt, Homo sapiens
cuugcacucagaagauucaguu

SEQ ID NO: 113488 - RNA, 22 nt, Homo sapiens
cuugcacuguuguaagggacuu

SEQ ID NO: 113489 - RNA, 22 nt, Homo sapiens
cuuugguuuacuuggugcuagu

SEQ ID NO: 113490 - RNA, 22 nt, Homo sapiens
cuuuuggcuuagaauugucuug

SEQ ID NO: 113491 - RNA, 18 nt, Homo sapiens
gacucaguuucuaaggca

SEQ ID NO: 113492 - RNA, 19 nt, Homo sapiens
gacuccagaguugugugcu

SEQ ID NO: 113493 - RNA, 22 nt, Homo sapiens
gagagugugucagaggcugcga

SEQ ID NO: 113494 - RNA, 22 nt, Homo sapiens
gagaugaugagauguucacagu

SEQ ID NO: 113495 - RNA, 22 nt, Homo sapiens
gagaugugguucaaggguguuu

SEQ ID NO: 113496 - RNA, 22 nt, Homo sapiens
gagcagacaugaggaccgcugg

SEQ ID NO: 113497 - RNA, 22 nt, Homo sapiens
uucccaguaaacucuaucccuc

SEQ ID NO: 113498 - RNA, 22 nt, Homo sapiens
uucccagugccaggcacuggga

SEQ ID NO: 113499 - RNA, 22 nt, Homo sapiens
uucccugugguauagaagccgu

SEQ ID NO: 113500 - RNA, 22 nt, Homo sapiens
uuccugucuuccaagagagauu

SEQ ID NO: 113501 - RNA, 22 nt, Homo sapiens
uucuacaggcuguucaagaagc

SEQ ID NO: 113502 - RNA, 22 nt, Homo sapiens
uucuacagugacugcagccaua

SEQ ID NO: 113503 - RNA, 22 nt, Homo sapiens
uugagagaaaaaauuuauuggu

SEQ ID NO: 113504 - RNA, 22 nt, Homo sapiens
uugagaugaagucuugcucucu

SEQ ID NO: 113505 - RNA, 22 nt, Homo sapiens
uugagaugaaguuuugcucuuu

SEQ ID NO: 113506 - RNA, 22 nt, Homo sapiens
uugagauggagucucacucugc

SEQ ID NO: 113507 - RNA, 22 nt, Homo sapiens
uugagauggagucuugcucucu

SEQ ID NO: 113508 - RNA, 22 nt, Homo sapiens
uugagauggagucuugcucugu

SEQ ID NO: 113509 - RNA, 22 nt, Homo sapiens
uugagauggaguguugcucugu

SEQ ID NO: 113510 - RNA, 22 nt, Homo sapiens
uugagauggaguuucacucugu

SEQ ID NO: 113511 - RNA, 22 nt, Homo sapiens
uugagauggaguuucgcucuug

SEQ ID NO: 113512 - RNA, 22 nt, Homo sapiens
uugagggaagccagaggucugc

SEQ ID NO: 113513 - RNA, 22 nt, Homo sapiens
uugauaacauucugcauccuau

SEQ ID NO: 113514 - RNA, 22 nt, Homo sapiens
uugaugauguuucugccuugcc

SEQ ID NO: 113515 - RNA, 22 nt, Homo sapiens
uugcaaugugaugugauuugga

SEQ ID NO: 113516 - RNA, 22 nt, Homo sapiens
uugcacuccagccugggugaca

SEQ ID NO: 113517 - RNA, 22 nt, Homo sapiens
uugcacuccagccuuggggaga

SEQ ID NO: 113518 - RNA, 22 nt, Homo sapiens
uugcacuccagucuggggggca

SEQ ID NO: 113519 - RNA, 22 nt, Homo sapiens
ucuguuguuguuuuaagagaca

SEQ ID NO: 113520 - RNA, 22 nt, Homo sapiens
ucuugcaccuacaugcuuuguc

SEQ ID NO: 113521 - RNA, 22 nt, Homo sapiens
ugaauguauuuauuaccauuca

SEQ ID NO: 113522 - RNA, 22 nt, Homo sapiens
ugacuuaugcaacucugaugug

SEQ ID NO: 113523 - RNA, 22 nt, Homo sapiens
ugagaagacaucuuugcuuugu

SEQ ID NO: 113524 - RNA, 22 nt, Homo sapiens
ugagacugaaauuaggaaacug

SEQ ID NO: 113525 - RNA, 22 nt, Homo sapiens
ugagacugguaauguguagggc

SEQ ID NO: 113526 - RNA, 22 nt, Homo sapiens
ugagagacagacauuaucuuau

SEQ ID NO: 113527 - RNA, 22 nt, Homo sapiens
ugagaggugaauggcaggcuca

SEQ ID NO: 113528 - RNA, 22 nt, Homo sapiens
ugagaguagggguugggauugg

SEQ ID NO: 113529 - RNA, 22 nt, Homo sapiens
ugagauuaucguaauguaucuc

SEQ ID NO: 113530 - RNA, 22 nt, Homo sapiens
ugagcacauuuacaucaguucc

SEQ ID NO: 113531 - RNA, 21 nt, Homo sapiens
ugagcauuaguacaguaggga

SEQ ID NO: 113532 - RNA, 22 nt, Homo sapiens
ugagcauuguuuggacuuggau

SEQ ID NO: 113533 - RNA, 22 nt, Homo sapiens
ugagcucagcuaguugaggugu

SEQ ID NO: 113534 - RNA, 22 nt, Homo sapiens
ugaggcaggagaacggcuugaa

SEQ ID NO: 113535 - RNA, 22 nt, Homo sapiens
ugauguccaguucauagaaacu

SEQ ID NO: 113536 - RNA, 22 nt, Homo sapiens
ugcaacauguguaccacucugu

SEQ ID NO: 113537 - RNA, 21 nt, Homo sapiens
ugcauugucuugaguuuaaau

SEQ ID NO: 113538 - RNA, 19 nt, Homo sapiens
ugccaagaaagucagcuua

SEQ ID NO: 113539 - RNA, 22 nt, Homo sapiens
ugccaagaacauuuucuguuuu

SEQ ID NO: 113540 - RNA, 21 nt, Homo sapiens
ugcugcacuucuuuugcugug

SEQ ID NO: 113541 - RNA, 22 nt, Homo sapiens
uggagguagagaugggaucucc

SEQ ID NO: 113542 - RNA, 20 nt, Homo sapiens
uggagugaagguucuggacc

SEQ ID NO: 113543 - RNA, 22 nt, Homo sapiens
uggcaagaaccacaguuacuuu

SEQ ID NO: 113544 - RNA, 22 nt, Homo sapiens
uggcagcugcuucaugggaugc

SEQ ID NO: 113545 - RNA, 22 nt, Homo sapiens
uggcuuuucauccugggacauu

SEQ ID NO: 113546 - RNA, 22 nt, Homo sapiens
ugugaaauguuaucccgucgug

SEQ ID NO: 113547 - RNA, 22 nt, Homo sapiens
ugugccuucuaagaaggagucu

SEQ ID NO: 113548 - RNA, 22 nt, Homo sapiens
uguggcauuuucagaaaggaug

SEQ ID NO: 113549 - RNA, 22 nt, Homo sapiens
uuauagacacguuguaacaaac

SEQ ID NO: 113550 - RNA, 22 nt, Homo sapiens
uucaccuggguuggccaucauu

SEQ ID NO: 113551 - RNA, 22 nt, Homo sapiens
uucaguucugcucugaucuuag

SEQ ID NO: 113552 - RNA, 22 nt, Homo sapiens
uuccacuuuuuccuugugcucc

SEQ ID NO: 113553 - RNA, 22 nt, Homo sapiens
uuccaguugugagcuauccggg

SEQ ID NO: 113554 - RNA, 22 nt, Homo sapiens
uucccagucaaacgaaggacuu

SEQ ID NO: 113555 - RNA, 22 nt, Homo sapiens
uucccagugguuagcucugguc

SEQ ID NO: 113556 - RNA, 22 nt, Homo sapiens
uuccuuguagcaaaugcgauga

SEQ ID NO: 113557 - RNA, 22 nt, Homo sapiens
uucucuggucagaggggagguu

SEQ ID NO: 113558 - RNA, 22 nt, Homo sapiens
uucugacuggugugagauggua

SEQ ID NO: 113559 - RNA, 22 nt, Homo sapiens
uugaaguguguauacauugugg

SEQ ID NO: 113560 - RNA, 22 nt, Homo sapiens
uugacuuagacauucaguugga

SEQ ID NO: 113561 - RNA, 22 nt, Homo sapiens
uugagagagaacauuuguuaca

SEQ ID NO: 113562 - RNA, 22 nt, Homo sapiens
uugagauggagucucacucugu

SEQ ID NO: 113563 - RNA, 22 nt, Homo sapiens
uugagauggagucucacucuug

SEQ ID NO: 113564 - RNA, 22 nt, Homo sapiens
uugagauggagucucgcucuuu

SEQ ID NO: 113565 - RNA, 22 nt, Homo sapiens
uugagauggaguuucacucucg

SEQ ID NO: 113566 - RNA, 22 nt, Homo sapiens
uugaggaggcagucugcccauu

SEQ ID NO: 113567 - RNA, 22 nt, Homo sapiens
uuggagagucacuaguuagugc

SEQ ID NO: 113568 - RNA, 22 nt, Homo sapiens
uuggagcacuggggcacugaca

SEQ ID NO: 113569 - RNA, 22 nt, Homo sapiens
uuggucaucucccuccuuuuag

SEQ ID NO: 113570 - RNA, 22 nt, Homo sapiens
uuguauaguucuauguguuuug

SEQ ID NO: 113571 - RNA, 22 nt, Homo sapiens
uuguauguaaccauuuggcaaa

SEQ ID NO: 113572 - RNA, 22 nt, Homo sapiens
uugucaguguucacucaaagcu

SEQ ID NO: 113573 - RNA, 22 nt, Homo sapiens
uugugaaaucuaggcagagguu

SEQ ID NO: 113574 - RNA, 22 nt, Homo sapiens
uugugaauggugccacaauaaa

SEQ ID NO: 113575 - RNA, 22 nt, Homo sapiens
uuguguuugaugcugacacgca

SEQ ID NO: 113576 - RNA, 19 nt, Homo sapiens
uuuccaguaaucuuaugug

SEQ ID NO: 113577 - RNA, 22 nt, Homo sapiens
uuuccuggagaaucuuaacaaa

SEQ ID NO: 113578 - RNA, 21 nt, Homo sapiens
uuuccuggagcguauggcuuc

SEQ ID NO: 113579 - RNA, 23 nt, Homo sapiens
uuugcacuugcuccuucuauggc

SEQ ID NO: 113580 - RNA, 21 nt, Homo sapiens
uuugcacuuugcaaaucccua

SEQ ID NO: 113581 - RNA, 22 nt, Homo sapiens
uuuggccauaauuuuaauuggc

SEQ ID NO: 113582 - RNA, 22 nt, Homo sapiens
uuuucaguggccauaguggaga

SEQ ID NO: 113583 - RNA, 22 nt, Homo sapiens
uuuuggacuugcuccccugucc

SEQ ID NO: 113584 - RNA, 22 nt, Homo sapiens
uuuuggcucuugguaggucaga

SEQ ID NO: 113585 - RNA, 21 nt, Homo sapiens
uuuuugguggucauggauaga

SEQ ID NO: 113586 - RNA, 22 nt, Homo sapiens
uuuuuugguaauugaacaauga

SEQ ID NO: 113587 - RNA, 22 nt, Homo sapiens
aaagcacuggagucaucaucua

SEQ ID NO: 113588 - RNA, 21 nt, Homo sapiens
aacagugcugaacagacaccu

SEQ ID NO: 113589 - RNA, 22 nt, Homo sapiens
aacagugcuucauucacacauu

SEQ ID NO: 113590 - RNA, 22 nt, Homo sapiens
aacugcacuaggacagguuuuu

SEQ ID NO: 113591 - RNA, 22 nt, Homo sapiens
aagcuggagugcaguggugcga

SEQ ID NO: 113592 - RNA, 22 nt, Homo sapiens
aauagcuguuuuuaauuccugc

SEQ ID NO: 113593 - RNA, 22 nt, Homo sapiens
aauggcuuuuaauauccauaau

SEQ ID NO: 113594 - RNA, 22 nt, Homo sapiens
aauuaguugaaagucugcuuuu

SEQ ID NO: 113595 - RNA, 22 nt, Homo sapiens
acacauacacauaugguguaua

SEQ ID NO: 113596 - RNA, 22 nt, Homo sapiens
acaggagugggauuugaguccu

SEQ ID NO: 113597 - RNA, 23 nt, Homo sapiens
acaguggugugaucuuggcucag

SEQ ID NO: 113598 - RNA, 22 nt, Homo sapiens
acaucacuguuugauugauuga

SEQ ID NO: 113599 - RNA, 20 nt, Homo sapiens
acccucuaggaugauuucuu

SEQ ID NO: 113600 - RNA, 22 nt, Homo sapiens
accucagcccggggaaguugag

SEQ ID NO: 113601 - RNA, 22 nt, Homo sapiens
agaacuguccauucagcaugaa

SEQ ID NO: 113602 - RNA, 18 nt, Homo sapiens
agaugguguugcuucugu

SEQ ID NO: 113603 - RNA, 22 nt, Homo sapiens
agaugguguuggcugaguguau

SEQ ID NO: 113604 - RNA, 22 nt, Homo sapiens
agcaagauccagucgcacagga

SEQ ID NO: 113605 - RNA, 23 nt, Homo sapiens
agcccugugacucgaacgaggag

SEQ ID NO: 113606 - RNA, 22 nt, Homo sapiens
agcuggucucaggugcccugcu

SEQ ID NO: 113607 - RNA, 22 nt, Homo sapiens
agcuucauuguuaugaauguca

SEQ ID NO: 113608 - RNA, 22 nt, Homo sapiens
agcuugugauucuccaucaugu

SEQ ID NO: 113609 - RNA, 22 nt, Homo sapiens
agcuugugcuguaugaagggcc

SEQ ID NO: 113610 - RNA, 22 nt, Homo sapiens
cuugcacuccacuguucuccug

SEQ ID NO: 113611 - RNA, 22 nt, Homo sapiens
cuuggcuugguaucaaauaacc

SEQ ID NO: 113612 - RNA, 22 nt, Homo sapiens
cuuuuugguagagcaggugugc

SEQ ID NO: 113613 - RNA, 22 nt, Homo sapiens
gaaagacuuucugcuguggaua

SEQ ID NO: 113614 - RNA, 22 nt, Homo sapiens
gaaagcugguauagauacauua

SEQ ID NO: 113615 - RNA, 22 nt, Homo sapiens
gaagcauugauccacaggcgug

SEQ ID NO: 113616 - RNA, 22 nt, Homo sapiens
gacauagcuagauaaccucaug

SEQ ID NO: 113617 - RNA, 22 nt, Homo sapiens
gagauauuauuucccuuucaca

SEQ ID NO: 113618 - RNA, 22 nt, Homo sapiens
gagcuaguguuuacuugccacu

SEQ ID NO: 113619 - RNA, 22 nt, Homo sapiens
gagcuguuuuucacuagaccaa

SEQ ID NO: 113620 - RNA, 22 nt, Homo sapiens
gaggcaguguguccguucucgg

SEQ ID NO: 113621 - RNA, 22 nt, Homo sapiens
gcaguguucugggcaggaagaa

SEQ ID NO: 113622 - RNA, 22 nt, Homo sapiens
gcccugagauucuuggauucug

SEQ ID NO: 113623 - RNA, 22 nt, Homo sapiens
gcugauguugaccuugaucacc

SEQ ID NO: 113624 - RNA, 22 nt, Homo sapiens
gcuguguguuaucagaaauugc

SEQ ID NO: 113625 - RNA, 22 nt, Homo sapiens
ggaacaccauuuuuccugccuu

SEQ ID NO: 113626 - RNA, 22 nt, Homo sapiens
ggaaugcuaaaauaggaugcug

SEQ ID NO: 113627 - RNA, 22 nt, Homo sapiens
ggagucuugcuauguugccaag

SEQ ID NO: 113628 - RNA, 22 nt, Homo sapiens
ggagugugauuguucucuguua

SEQ ID NO: 113629 - RNA, 22 nt, Homo sapiens
ggcaagaacuucacucacuuuu

SEQ ID NO: 113630 - RNA, 22 nt, Homo sapiens
ggcaagugggagggaguguuuc

SEQ ID NO: 113631 - RNA, 22 nt, Homo sapiens
ggcaguuucucaggcaggggua

SEQ ID NO: 113632 - RNA, 22 nt, Homo sapiens
ggcaguuuggcaguuucauaaa

SEQ ID NO: 113633 - RNA, 22 nt, Homo sapiens
ggcaguuuguuugugaggucca

SEQ ID NO: 113634 - RNA, 22 nt, Homo sapiens
gggaggucauuguucaaugcug

SEQ ID NO: 113635 - RNA, 23 nt, Homo sapiens
gggauuguaaaauaugagggcag

SEQ ID NO: 113636 - RNA, 22 nt, Homo sapiens
guacaggcagcaaacaccauaa

SEQ ID NO: 113637 - RNA, 22 nt, Homo sapiens
gucaguuugguuaaucauucca

SEQ ID NO: 113638 - RNA, 22 nt, Homo sapiens
gucauucauucagcaagcacug

SEQ ID NO: 113639 - RNA, 22 nt, Homo sapiens
gucucugguugcuuuuguacca

SEQ ID NO: 113640 - RNA, 22 nt, Homo sapiens
gugagacugaguuucgcucuug

SEQ ID NO: 113641 - RNA, 22 nt, Homo sapiens
gugagaugguaucucauugugg

SEQ ID NO: 113642 - RNA, 22 nt, Homo sapiens
gugaguuauuauuuauguaaac

SEQ ID NO: 113643 - RNA, 22 nt, Homo sapiens
gugauuuaguagaugcuaguua

SEQ ID NO: 113644 - RNA, 22 nt, Homo sapiens
gugcacauuguuuaugucuguu

SEQ ID NO: 113645 - RNA, 22 nt, Homo sapiens
gugcuuguauuuaaaucaugug

SEQ ID NO: 113646 - RNA, 22 nt, Homo sapiens
guggagacaaaggcugagugag

SEQ ID NO: 113647 - RNA, 21 nt, Homo sapiens
gugugcuugaauucagcuguc

SEQ ID NO: 113648 - RNA, 22 nt, Homo sapiens
guucaucaggcuuucucuagag

SEQ ID NO: 113649 - RNA, 15 nt, Homo sapiens
guuuuuggauacaau

SEQ ID NO: 113650 - RNA, 22 nt, Homo sapiens
guuuuuggggucacuauuaccg

SEQ ID NO: 113651 - RNA, 22 nt, Homo sapiens
uacaugugcaggucuguggggg

SEQ ID NO: 113652 - RNA, 22 nt, Homo sapiens
uacaugugccauguugguuugc

SEQ ID NO: 113653 - RNA, 22 nt, Homo sapiens
uaccacccuuuuuccagaagcc

SEQ ID NO: 113654 - RNA, 20 nt, Homo sapiens
uacugcacuccaaccuaggc

SEQ ID NO: 113655 - RNA, 22 nt, Homo sapiens
uagcacaucccuaaaaugcugu

SEQ ID NO: 113656 - RNA, 22 nt, Homo sapiens
uagcagguggugaccacauuuu

SEQ ID NO: 113657 - RNA, 22 nt, Homo sapiens
uaggacaaugguacagcagaaa

SEQ ID NO: 113658 - RNA, 22 nt, Homo sapiens
gagcuuguagugugaaugguau

SEQ ID NO: 113659 - RNA, 22 nt, Homo sapiens
gagcuuguggucuucguguuau

SEQ ID NO: 113660 - RNA, 22 nt, Homo sapiens
gaugagcuaaguucucacagca

SEQ ID NO: 113661 - RNA, 22 nt, Homo sapiens
gaugaugcuagguguuagggcu

SEQ ID NO: 113662 - RNA, 22 nt, Homo sapiens
gauggaguugacuaagacaaca

SEQ ID NO: 113663 - RNA, 22 nt, Homo sapiens
gcaguagugugaucuuggcuca

SEQ ID NO: 113664 - RNA, 22 nt, Homo sapiens
gccaagaagugucuaagcagga

SEQ ID NO: 113665 - RNA, 22 nt, Homo sapiens
gccaagaucugaauaauuaaga

SEQ ID NO: 113666 - RNA, 22 nt, Homo sapiens
gccaagaugcugcccacagaca

SEQ ID NO: 113667 - RNA, 22 nt, Homo sapiens
gccaagauugguuuaauauucc

SEQ ID NO: 113668 - RNA, 22 nt, Homo sapiens
gccccugagacuugccucgggc

SEQ ID NO: 113669 - RNA, 22 nt, Homo sapiens
ggaguguguaggagaaagguaa

SEQ ID NO: 113670 - RNA, 22 nt, Homo sapiens
ggaguguguuuuccaacuuggu

SEQ ID NO: 113671 - RNA, 22 nt, Homo sapiens
ggcaacaugaugaaaugccauc

SEQ ID NO: 113672 - RNA, 22 nt, Homo sapiens
ggcaacaugccgaaaccacguc

SEQ ID NO: 113673 - RNA, 22 nt, Homo sapiens
ggcagcuguguccuucguaagg

SEQ ID NO: 113674 - RNA, 22 nt, Homo sapiens
ggcaguguaauaauuuauuaau

SEQ ID NO: 113675 - RNA, 22 nt, Homo sapiens
ggcaguuuguucuugcuccuuu

SEQ ID NO: 113676 - RNA, 22 nt, Homo sapiens
gggcauugugggcagagggcag

SEQ ID NO: 113677 - RNA, 22 nt, Homo sapiens
gucauccaggcuggagugaagc

SEQ ID NO: 113678 - RNA, 22 nt, Homo sapiens
gucuguuuggggaccuguggcc

SEQ ID NO: 113679 - RNA, 22 nt, Homo sapiens
gugaaaugaaucuggaaauauu

SEQ ID NO: 113680 - RNA, 22 nt, Homo sapiens
gugagaggaggcagcuuuuaca

SEQ ID NO: 113681 - RNA, 22 nt, Homo sapiens
gugagaugaggucucacucugu

SEQ ID NO: 113682 - RNA, 22 nt, Homo sapiens
gugagauggaguuggugucuuu

SEQ ID NO: 113683 - RNA, 22 nt, Homo sapiens
gugagauuaccauuuaaaucag

SEQ ID NO: 113684 - RNA, 22 nt, Homo sapiens
gugagauuagcugagauccuug

SEQ ID NO: 113685 - RNA, 22 nt, Homo sapiens
gugaucaugauccugaagcauu

SEQ ID NO: 113686 - RNA, 22 nt, Homo sapiens
guggcagugugaggauccugcu

SEQ ID NO: 113687 - RNA, 22 nt, Homo sapiens
guggggucaucucauuugugga

SEQ ID NO: 113688 - RNA, 22 nt, Homo sapiens
gugguuuuuaaaguaccugugg

SEQ ID NO: 113689 - RNA, 22 nt, Homo sapiens
guucaagcaauucugcugccuc

SEQ ID NO: 113690 - RNA, 22 nt, Homo sapiens
guucuggagauaaagccaaggu

SEQ ID NO: 113691 - RNA, 22 nt, Homo sapiens
guugguuuccuguaacuggaca

SEQ ID NO: 113692 - RNA, 22 nt, Homo sapiens
uaaaugcucuuuaaaagugcuu

SEQ ID NO: 113693 - RNA, 22 nt, Homo sapiens
uaacccagugucugugaugggu

SEQ ID NO: 113694 - RNA, 22 nt, Homo sapiens
uacaugugcacaacgugcaggu

SEQ ID NO: 113695 - RNA, 22 nt, Homo sapiens
uacuuuguagauuguuuccuuu

SEQ ID NO: 113696 - RNA, 22 nt, Homo sapiens
uagaauguaacaguuaaaagca

SEQ ID NO: 113697 - RNA, 18 nt, Homo sapiens
uagagcacaagcuuuggc

SEQ ID NO: 113698 - RNA, 22 nt, Homo sapiens
uagagcacauuaucauuuccaa

SEQ ID NO: 113699 - RNA, 22 nt, Homo sapiens
uagcaagaugaauuugugcaaa

SEQ ID NO: 113700 - RNA, 22 nt, Homo sapiens
uagcugcaaaauauagacuucu

SEQ ID NO: 113701 - RNA, 20 nt, Homo sapiens
uauagcaauuuuuuucuccu

SEQ ID NO: 113702 - RNA, 22 nt, Homo sapiens
uauagcuugaaggaauggucau

SEQ ID NO: 113703 - RNA, 22 nt, Homo sapiens
uauuacagaccauaucgccggg

SEQ ID NO: 113704 - RNA, 22 nt, Homo sapiens
uauuauagugauaggucuacug

SEQ ID NO: 113705 - RNA, 18 nt, Homo sapiens
ucacaaccacagugcugu

SEQ ID NO: 113706 - RNA, 22 nt, Homo sapiens
ucacauggggaagggacuagcu

SEQ ID NO: 113707 - RNA, 22 nt, Homo sapiens
ucacugaaaccuccaccucucg

SEQ ID NO: 113708 - RNA, 22 nt, Homo sapiens
ucacugggagaccaaagccauc

SEQ ID NO: 113709 - RNA, 21 nt, Homo sapiens
ucauaagcucaacaucuguag

SEQ ID NO: 113710 - RNA, 22 nt, Homo sapiens
uccagaguggugaugcuggggc

SEQ ID NO: 113711 - RNA, 22 nt, Homo sapiens
uccaguuuggaggcuugaugug

SEQ ID NO: 113712 - RNA, 22 nt, Homo sapiens
ucugagcaauaaacaacauauu

SEQ ID NO: 113713 - RNA, 22 nt, Homo sapiens
ucugaguggcagaaugagcuga

SEQ ID NO: 113714 - RNA, 22 nt, Homo sapiens
ucugugguuguugcauggaaug

SEQ ID NO: 113715 - RNA, 22 nt, Homo sapiens
ucuugcacaaauuauuuuaacu

SEQ ID NO: 113716 - RNA, 19 nt, Homo sapiens
ucuugcacaugugaacuca

SEQ ID NO: 113717 - RNA, 22 nt, Homo sapiens
ucuuuugggccucuugucagac

SEQ ID NO: 113718 - RNA, 22 nt, Homo sapiens
ucuuuugguuucuagaggccgc

SEQ ID NO: 113719 - RNA, 22 nt, Homo sapiens
ugaaauacuuuggcucuuuguu

SEQ ID NO: 113720 - RNA, 22 nt, Homo sapiens
ugaaaugccuugagauuuugac

SEQ ID NO: 113721 - RNA, 21 nt, Homo sapiens
ugacauuauuucaugucagua

SEQ ID NO: 113722 - RNA, 22 nt, Homo sapiens
ugacucaguuucucagguagua

SEQ ID NO: 113723 - RNA, 22 nt, Homo sapiens
ugacuucauuugguaauugggu

SEQ ID NO: 113724 - RNA, 22 nt, Homo sapiens
ugagacugaguuucacuuuugu

SEQ ID NO: 113725 - RNA, 22 nt, Homo sapiens
ugagacugaguuuccaucuugu

SEQ ID NO: 113726 - RNA, 22 nt, Homo sapiens
ugagaggugauaaagcaagggu

SEQ ID NO: 113727 - RNA, 22 nt, Homo sapiens
ugagauaaucaugugguuuuug

SEQ ID NO: 113728 - RNA, 22 nt, Homo sapiens
ugagauuaaucuuuaaguaaga

SEQ ID NO: 113729 - RNA, 23 nt, Homo sapiens
ugagauuauaaucuuuuacuucu

SEQ ID NO: 113730 - RNA, 22 nt, Homo sapiens
ugagcaacauuucaaaacucca

SEQ ID NO: 113731 - RNA, 20 nt, Homo sapiens
ugagcucaauuguugcaagu

SEQ ID NO: 113732 - RNA, 22 nt, Homo sapiens
ugagcugagaaaugcagcagcu

SEQ ID NO: 113733 - RNA, 20 nt, Homo sapiens
ugagcuuguaaacacuguuu

SEQ ID NO: 113734 - RNA, 22 nt, Homo sapiens
ugaggaacuagcuacccuaaua

SEQ ID NO: 113735 - RNA, 22 nt, Homo sapiens
ugagucaugcuggagucauggc

SEQ ID NO: 113736 - RNA, 22 nt, Homo sapiens
ugagucauguaauaaugcugcu

SEQ ID NO: 113737 - RNA, 17 nt, Homo sapiens
ugaguuaaucuuugugc

SEQ ID NO: 113738 - RNA, 20 nt, Homo sapiens
ugccaagaugacuauagcuc

SEQ ID NO: 113739 - RNA, 22 nt, Homo sapiens
ugcuuaguuguauguuccacau

SEQ ID NO: 113740 - RNA, 22 nt, Homo sapiens
uggacagaaacauguuuucagu

SEQ ID NO: 113741 - RNA, 22 nt, Homo sapiens
uggaguguuggggcaggaucuc

SEQ ID NO: 113742 - RNA, 21 nt, Homo sapiens
uggaugccuaggcagaaguuu

SEQ ID NO: 113743 - RNA, 22 nt, Homo sapiens
ugggauguagccuucuauuuuc

SEQ ID NO: 113744 - RNA, 19 nt, Homo sapiens
uggugccuuguucuuggau

SEQ ID NO: 113745 - RNA, 21 nt, Homo sapiens
ugugaaaucuaggcagagguu

SEQ ID NO: 113746 - RNA, 22 nt, Homo sapiens
ugugagaucucagaauugaacu

SEQ ID NO: 113747 - RNA, 22 nt, Homo sapiens
ugugcaaucagcuucauuacau

SEQ ID NO: 113748 - RNA, 20 nt, Homo sapiens
uguugcacucuagccugggu

SEQ ID NO: 113749 - RNA, 22 nt, Homo sapiens
uuacauugcuucaaauucagug

SEQ ID NO: 113750 - RNA, 22 nt, Homo sapiens
uuagugaaugcaccacuucuga

SEQ ID NO: 113751 - RNA, 22 nt, Homo sapiens
uucaucagcuguagaugucaug

SEQ ID NO: 113752 - RNA, 22 nt, Homo sapiens
uucaucaggaauauugaccugu

SEQ ID NO: 113753 - RNA, 18 nt, Homo sapiens
uugcacuccugccugggu

SEQ ID NO: 113754 - RNA, 22 nt, Homo sapiens
uuggagagugauauucagaugc

SEQ ID NO: 113755 - RNA, 22 nt, Homo sapiens
uuggagugugagagcagccugg

SEQ ID NO: 113756 - RNA, 22 nt, Homo sapiens
uuguauaggcucaguaagaauc

SEQ ID NO: 113757 - RNA, 22 nt, Homo sapiens
uugugaaaaaccucucguggaa

SEQ ID NO: 113758 - RNA, 22 nt, Homo sapiens
uuuaaagcuaaaauauguuuau

SEQ ID NO: 113759 - RNA, 22 nt, Homo sapiens
uuucagagucaucugcccaagu

SEQ ID NO: 113760 - RNA, 22 nt, Homo sapiens
uuucccagugguacaguuuaua

SEQ ID NO: 113761 - RNA, 22 nt, Homo sapiens
uuucugcuugagagaauugcug

SEQ ID NO: 113762 - RNA, 22 nt, Homo sapiens
uuugcacucaguaagugggagc

SEQ ID NO: 113763 - RNA, 22 nt, Homo sapiens
uuugguugccucuaugagccug

SEQ ID NO: 113764 - RNA, 22 nt, Homo sapiens
uuugguugucacaacuggggga

SEQ ID NO: 113765 - RNA, 22 nt, Homo sapiens
uuuucaguuuuccagguagccg

SEQ ID NO: 113766 - RNA, 21 nt, Homo sapiens
uuuuggucauucaggaagaaa

SEQ ID NO: 113767 - RNA, 22 nt, Homo sapiens
aaaugcacaaagauuuugcacu

SEQ ID NO: 113768 - RNA, 22 nt, Homo sapiens
aaauugcuuuugaagacuuagu

SEQ ID NO: 113769 - RNA, 22 nt, Homo sapiens
aacagagcuggugacuccaggu

SEQ ID NO: 113770 - RNA, 20 nt, Homo sapiens
aacagcacugucugaagcuu

SEQ ID NO: 113771 - RNA, 22 nt, Homo sapiens
aacuggugauccacccgccuca

SEQ ID NO: 113772 - RNA, 22 nt, Homo sapiens
aauauagcuauguacaugucca

SEQ ID NO: 113773 - RNA, 19 nt, Homo sapiens
aauauugacaguggugucu

SEQ ID NO: 113774 - RNA, 22 nt, Homo sapiens
aauggcacuuuauaaauguuaa

SEQ ID NO: 113775 - RNA, 22 nt, Homo sapiens
acaauguauauuuuacuguagg

SEQ ID NO: 113776 - RNA, 22 nt, Homo sapiens
acaugcauggcaugcauuguac

SEQ ID NO: 113777 - RNA, 22 nt, Homo sapiens
acauucagcuguuguuucaaug

SEQ ID NO: 113778 - RNA, 22 nt, Homo sapiens
accacaggguaaaguuagauau

SEQ ID NO: 113779 - RNA, 22 nt, Homo sapiens
acccagaauucagucuuaggcc

SEQ ID NO: 113780 - RNA, 22 nt, Homo sapiens
acccaguguucaacauucacau

SEQ ID NO: 113781 - RNA, 22 nt, Homo sapiens
acccaguguucagacuaccugu

SEQ ID NO: 113782 - RNA, 22 nt, Homo sapiens
acccucagaccaguuucccugg

SEQ ID NO: 113783 - RNA, 22 nt, Homo sapiens
acccuggagagugcuguaguaa

SEQ ID NO: 113784 - RNA, 23 nt, Homo sapiens
acugagcaauguuuacauacuug

SEQ ID NO: 113785 - RNA, 19 nt, Homo sapiens
agagacucauuguagcauu

SEQ ID NO: 113786 - RNA, 22 nt, Homo sapiens
agagagguggguggagccccca

SEQ ID NO: 113787 - RNA, 22 nt, Homo sapiens
agagaucauuuuguuucaaauc

SEQ ID NO: 113788 - RNA, 18 nt, Homo sapiens
agagcacugaguuuuaga

SEQ ID NO: 113789 - RNA, 22 nt, Homo sapiens
agaugauguuucuggcacauga

SEQ ID NO: 113790 - RNA, 22 nt, Homo sapiens
agcaacauagaaauuugggugg

SEQ ID NO: 113791 - RNA, 22 nt, Homo sapiens
agcaucacaugggcugcuuggg

SEQ ID NO: 113792 - RNA, 22 nt, Homo sapiens
agcaucaugcaguugcuauuca

SEQ ID NO: 113793 - RNA, 22 nt, Homo sapiens
agccaagacucuguuccccuug

SEQ ID NO: 113794 - RNA, 22 nt, Homo sapiens
agcuccuuugcuuuuuccagga

SEQ ID NO: 113795 - RNA, 22 nt, Homo sapiens
agcugauuuuaaguccuugucc

SEQ ID NO: 113796 - RNA, 22 nt, Homo sapiens
agcugcacgugguaaauguaaa

SEQ ID NO: 113797 - RNA, 16 nt, Homo sapiens
agcuggaauuacaggc

SEQ ID NO: 113798 - RNA, 22 nt, Homo sapiens
agcuuguccuccacccacacug

SEQ ID NO: 113799 - RNA, 22 nt, Homo sapiens
agcuuguggugaauacugcuag

SEQ ID NO: 113800 - RNA, 22 nt, Homo sapiens
aggagguaggaauugugcuagg

SEQ ID NO: 113801 - RNA, 22 nt, Homo sapiens
aggcaacaugguaaaacccugu

SEQ ID NO: 113802 - RNA, 22 nt, Homo sapiens
aggucccauguccucccugacc

SEQ ID NO: 113803 - RNA, 22 nt, Homo sapiens
agugggccccuagaggugaggu

SEQ ID NO: 113804 - RNA, 22 nt, Homo sapiens
auagcuguugaauggaauauuc

SEQ ID NO: 113805 - RNA, 22 nt, Homo sapiens
auauagcucuggcuggaugacu

SEQ ID NO: 113806 - RNA, 18 nt, Homo sapiens
auauugccuucagacuag

SEQ ID NO: 113807 - RNA, 22 nt, Homo sapiens
aucacauggccagguaguaauc

SEQ ID NO: 113808 - RNA, 22 nt, Homo sapiens
aucccuguaacuagcagccccu

SEQ ID NO: 113809 - RNA, 22 nt, Homo sapiens
aucucagcaacuaaagauccuu

SEQ ID NO: 113810 - RNA, 22 nt, Homo sapiens
aucugacuuuuaauuugaaaac

SEQ ID NO: 113811 - RNA, 22 nt, Homo sapiens
augaaagguauguuuucuguga

SEQ ID NO: 113812 - RNA, 22 nt, Homo sapiens
augacaaugaaucccuguuuca

SEQ ID NO: 113813 - RNA, 22 nt, Homo sapiens
augagaaugauucuguuauggu

SEQ ID NO: 113814 - RNA, 22 nt, Homo sapiens
augagaauguaaguuaaugaaa

SEQ ID NO: 113815 - RNA, 22 nt, Homo sapiens
augaugcugagguuugggguau

SEQ ID NO: 113816 - RNA, 22 nt, Homo sapiens
augcacauauguacugcccuau

SEQ ID NO: 113817 - RNA, 22 nt, Homo sapiens
augccauugcacuccagccuag

SEQ ID NO: 113818 - RNA, 22 nt, Homo sapiens
auggcuuuaagagugucugaau

SEQ ID NO: 113819 - RNA, 17 nt, Homo sapiens
augugaauguucaaaua

SEQ ID NO: 113820 - RNA, 22 nt, Homo sapiens
uauugacauuacagugggucuu

SEQ ID NO: 113821 - RNA, 22 nt, Homo sapiens
uauugcacuuuuccauaggagu

SEQ ID NO: 113822 - RNA, 22 nt, Homo sapiens
uauugcuaaauucuuuuccuag

SEQ ID NO: 113823 - RNA, 22 nt, Homo sapiens
uauuuguccccuccaaaaguca

SEQ ID NO: 113824 - RNA, 22 nt, Homo sapiens
ucaaagucuucucaaguaacau

SEQ ID NO: 113825 - RNA, 22 nt, Homo sapiens
ucaaaucaucuuuuccaaagcu

SEQ ID NO: 113826 - RNA, 22 nt, Homo sapiens
ucaacaggucaauugcauagaa

SEQ ID NO: 113827 - RNA, 22 nt, Homo sapiens
ucaaggcaguggccuuccuucu

SEQ ID NO: 113828 - RNA, 22 nt, Homo sapiens
ucaauguaucuccaagaauuga

SEQ ID NO: 113829 - RNA, 22 nt, Homo sapiens
ucacagaugcuugacccauuuc

SEQ ID NO: 113830 - RNA, 22 nt, Homo sapiens
ucacagcuaaaaugaaaguagu

SEQ ID NO: 113831 - RNA, 22 nt, Homo sapiens
ucacaguagagcuucuuucaga

SEQ ID NO: 113832 - RNA, 22 nt, Homo sapiens
ucacagucggugacuucuugcu

SEQ ID NO: 113833 - RNA, 22 nt, Homo sapiens
ucacagucuccucuagggaggg

SEQ ID NO: 113834 - RNA, 22 nt, Homo sapiens
ucacagugaguggaguggggug

SEQ ID NO: 113835 - RNA, 22 nt, Homo sapiens
ucacaugcacaucucuggaacc

SEQ ID NO: 113836 - RNA, 22 nt, Homo sapiens
ucacauggaggugauaguugaa

SEQ ID NO: 113837 - RNA, 22 nt, Homo sapiens
ucaccuggagaagauggaucau

SEQ ID NO: 113838 - RNA, 18 nt, Homo sapiens
ucacggggagcagcagcc

SEQ ID NO: 113839 - RNA, 22 nt, Homo sapiens
ucacuagggagaaacugaggcu

SEQ ID NO: 113840 - RNA, 22 nt, Homo sapiens
ucacucagaccuggugauaugc

SEQ ID NO: 113841 - RNA, 22 nt, Homo sapiens
ucacugcacuucaggcuuucuc

SEQ ID NO: 113842 - RNA, 22 nt, Homo sapiens
ucacuggagauagcaaucuggu

SEQ ID NO: 113843 - RNA, 22 nt, Homo sapiens
ucacugugcaugaaggaugcug

SEQ ID NO: 113844 - RNA, 22 nt, Homo sapiens
ucacugugguuugggaaagugc

SEQ ID NO: 113845 - RNA, 22 nt, Homo sapiens
ucagaguagaaacacuuccaua

SEQ ID NO: 113846 - RNA, 22 nt, Homo sapiens
ucagaguagcugucugaggugc

SEQ ID NO: 113847 - RNA, 22 nt, Homo sapiens
ucagagugcagggaguagcagc

SEQ ID NO: 113848 - RNA, 22 nt, Homo sapiens
ucagcagucacuccuaugacaa

SEQ ID NO: 113849 - RNA, 22 nt, Homo sapiens
ucagcagugugaaaacaaacua

SEQ ID NO: 113850 - RNA, 22 nt, Homo sapiens
ucagcagugugaaaauggacua

SEQ ID NO: 113851 - RNA, 22 nt, Homo sapiens
ucaggcacuaguaagaaaaagg

SEQ ID NO: 113852 - RNA, 22 nt, Homo sapiens
ucagggacgcuugacacaagcc

SEQ ID NO: 113853 - RNA, 22 nt, Homo sapiens
ucagggacuuacaaaccagaag

SEQ ID NO: 113854 - RNA, 22 nt, Homo sapiens
ucagguagcuagauuaugugag

SEQ ID NO: 113855 - RNA, 22 nt, Homo sapiens
ucagguaguuugugggagauga

SEQ ID NO: 113856 - RNA, 22 nt, Homo sapiens
ucaggucauuccaggagggcca

SEQ ID NO: 113857 - RNA, 23 nt, Homo sapiens
ucagugaaggaacaacuaaauag

SEQ ID NO: 113858 - RNA, 22 nt, Homo sapiens
ucagugaauguuggccacuacu

SEQ ID NO: 113859 - RNA, 22 nt, Homo sapiens
ucagugacuggguauuaaauca

SEQ ID NO: 113860 - RNA, 20 nt, Homo sapiens
ucagugauugguuuaguuau

SEQ ID NO: 113861 - RNA, 23 nt, Homo sapiens
ucaucacagcauuuccugguauu

SEQ ID NO: 113862 - RNA, 22 nt, Homo sapiens
ucauguaauuuugugucuauga

SEQ ID NO: 113863 - RNA, 22 nt, Homo sapiens
ucauucacucccuugaaguuag

SEQ ID NO: 113864 - RNA, 22 nt, Homo sapiens
uccaaaucucuggcacugggau

SEQ ID NO: 113865 - RNA, 22 nt, Homo sapiens
uccaaguaauuggcggggaguu

SEQ ID NO: 113866 - RNA, 22 nt, Homo sapiens
uccacaguaaggacccugccuu

SEQ ID NO: 113867 - RNA, 22 nt, Homo sapiens
uccagaguggugaugcuggggc

SEQ ID NO: 113868 - RNA, 22 nt, Homo sapiens
uccaguagaauuuuauucaaca

SEQ ID NO: 113869 - RNA, 20 nt, Homo sapiens
uccaguuuuggagacauucu

SEQ ID NO: 113870 - RNA, 22 nt, Homo sapiens
uccauaguugcacucuggagcc

SEQ ID NO: 113871 - RNA, 22 nt, Homo sapiens
uccauggagacacauuuuauau

SEQ ID NO: 113872 - RNA, 22 nt, Homo sapiens
uccccugagaacuugcuagaaa

SEQ ID NO: 113873 - RNA, 20 nt, Homo sapiens
ucccuaagagccuuuccuuc

SEQ ID NO: 113874 - RNA, 22 nt, Homo sapiens
ucccugaaagcugagauuggaa

SEQ ID NO: 113875 - RNA, 16 nt, Homo sapiens
ucccugugacaugugc

SEQ ID NO: 113876 - RNA, 22 nt, Homo sapiens
ucccuguguccugggggcaccu

SEQ ID NO: 113877 - RNA, 22 nt, Homo sapiens
ucccuuaaugaugaacaaugag

SEQ ID NO: 113878 - RNA, 22 nt, Homo sapiens
uccugagagcagacccucuaua

SEQ ID NO: 113879 - RNA, 22 nt, Homo sapiens
uccuucauuugucaacucuagu

SEQ ID NO: 113880 - RNA, 22 nt, Homo sapiens
uccuugagccucccagacucag

SEQ ID NO: 113881 - RNA, 22 nt, Homo sapiens
uccuuuaguuaauaaagacaag

SEQ ID NO: 113882 - RNA, 22 nt, Homo sapiens
ucgcugggaaccagagguaaag

SEQ ID NO: 113883 - RNA, 22 nt, Homo sapiens
ucuaaaacuagauugugaugau

SEQ ID NO: 113884 - RNA, 22 nt, Homo sapiens
ucuacagccaguucaggaagaa

SEQ ID NO: 113885 - RNA, 15 nt, Homo sapiens
ucuaguuuugaagac

SEQ ID NO: 113886 - RNA, 22 nt, Homo sapiens
ucucagagccuaggguuuuuca

SEQ ID NO: 113887 - RNA, 22 nt, Homo sapiens
ucucaguggcuuccucacuuuu

SEQ ID NO: 113888 - RNA, 20 nt, Homo sapiens
ucucauggagguagagaaua

SEQ ID NO: 113889 - RNA, 22 nt, Homo sapiens
ucucauggcucacccugcauag

SEQ ID NO: 113890 - RNA, 22 nt, Homo sapiens
ucucauugauucuggggugaug

SEQ ID NO: 113891 - RNA, 22 nt, Homo sapiens
ucucugagaaaaguuucuccca

SEQ ID NO: 113892 - RNA, 22 nt, Homo sapiens
ucucuuggcggaaguugcagug

SEQ ID NO: 113893 - RNA, 22 nt, Homo sapiens
ucugacaaugaacaaucuauag

SEQ ID NO: 113894 - RNA, 19 nt, Homo sapiens
ucugacagccccagucaac

SEQ ID NO: 113895 - RNA, 22 nt, Homo sapiens
ucugagaucaugucugugcugu

SEQ ID NO: 113896 - RNA, 22 nt, Homo sapiens
ucugagcaauagauguggauau

SEQ ID NO: 113897 - RNA, 22 nt, Homo sapiens
uuuugguauaugcaggggucuu

SEQ ID NO: 113898 - RNA, 22 nt, Homo sapiens
uuuuuauggccaauccucagaa

SEQ ID NO: 113899 - RNA, 22 nt, Homo sapiens
augugcuuuuuaaacagaugcu

SEQ ID NO: 113900 - RNA, 20 nt, Homo sapiens
auguucuggaggacagaagc

SEQ ID NO: 113901 - RNA, 20 nt, Homo sapiens
auuagagcuacauggcuaca

SEQ ID NO: 113902 - RNA, 22 nt, Homo sapiens
auuauguuguauuuccuugcag

SEQ ID NO: 113903 - RNA, 22 nt, Homo sapiens
auucaaagugcauguucccacu

SEQ ID NO: 113904 - RNA, 22 nt, Homo sapiens
auucaagugaugugauucuucu

SEQ ID NO: 113905 - RNA, 22 nt, Homo sapiens
auucacagcuuuaaaaggcgug

SEQ ID NO: 113906 - RNA, 22 nt, Homo sapiens
auucacagggggagaaggguau

SEQ ID NO: 113907 - RNA, 22 nt, Homo sapiens
auucaucagggauauuggucug

SEQ ID NO: 113908 - RNA, 20 nt, Homo sapiens
auuccacuuguuugagguac

SEQ ID NO: 113909 - RNA, 22 nt, Homo sapiens
auuccaguggguuuacauccca

SEQ ID NO: 113910 - RNA, 22 nt, Homo sapiens
auuccauuuguuaucacacccg

SEQ ID NO: 113911 - RNA, 22 nt, Homo sapiens
auucccuuggucaacggaugca

SEQ ID NO: 113912 - RNA, 21 nt, Homo sapiens
auugagcacaugaaacauggc

SEQ ID NO: 113913 - RNA, 22 nt, Homo sapiens
auugagcacugacucugugcca

SEQ ID NO: 113914 - RNA, 18 nt, Homo sapiens
auugcacaccagccuggg

SEQ ID NO: 113915 - RNA, 22 nt, Homo sapiens
auugcacaccagucugggcaaa

SEQ ID NO: 113916 - RNA, 22 nt, Homo sapiens
auugcacuccacccugggcaac

SEQ ID NO: 113917 - RNA, 22 nt, Homo sapiens
auugcacuccagccugggcagc

SEQ ID NO: 113918 - RNA, 22 nt, Homo sapiens
auugcacuccagucugggcaac

SEQ ID NO: 113919 - RNA, 22 nt, Homo sapiens
auugcacuggggguuagaauuu

SEQ ID NO: 113920 - RNA, 22 nt, Homo sapiens
auugcccaggcuggagugcagu

SEQ ID NO: 113921 - RNA, 22 nt, Homo sapiens
auuggcaauagcuuucuuacua

SEQ ID NO: 113922 - RNA, 20 nt, Homo sapiens
auuuggcauaguuuaagcaa

SEQ ID NO: 113923 - RNA, 22 nt, Homo sapiens
caaaggcuuccacugcauccuu

SEQ ID NO: 113924 - RNA, 22 nt, Homo sapiens
caaaggugcuuuccagguccaa

SEQ ID NO: 113925 - RNA, 22 nt, Homo sapiens
caaagugcugaaagaggccagg

SEQ ID NO: 113926 - RNA, 22 nt, Homo sapiens
caaagugcugggacuggccggg

SEQ ID NO: 113927 - RNA, 22 nt, Homo sapiens
caacugguuuuauacaguuuag

SEQ ID NO: 113928 - RNA, 22 nt, Homo sapiens
caagugcuugaugaaugaucaa

SEQ ID NO: 113929 - RNA, 22 nt, Homo sapiens
caaugcauuauucucccacuuc

SEQ ID NO: 113930 - RNA, 22 nt, Homo sapiens
caaugguuuuuuaguauaagua

SEQ ID NO: 113931 - RNA, 22 nt, Homo sapiens
cacaaugucuaagauguuucua

SEQ ID NO: 113932 - RNA, 22 nt, Homo sapiens
cacagaauucauuggauuaccu

SEQ ID NO: 113933 - RNA, 22 nt, Homo sapiens
cacagcuagucaaugguagaca

SEQ ID NO: 113934 - RNA, 22 nt, Homo sapiens
cacaguguuacugguaugaagu

SEQ ID NO: 113935 - RNA, 22 nt, Homo sapiens
cacccuuguaggcaaauaauuu

SEQ ID NO: 113936 - RNA, 21 nt, Homo sapiens
cacugcacuugccuucugggu

SEQ ID NO: 113937 - RNA, 22 nt, Homo sapiens
cacuggacauguugaagcuuuu

SEQ ID NO: 113938 - RNA, 22 nt, Homo sapiens
cagagaacauucagagcuguag

SEQ ID NO: 113939 - RNA, 22 nt, Homo sapiens
cagagaucaugcaacugcucgc

SEQ ID NO: 113940 - RNA, 22 nt, Homo sapiens
cagauacuggccuggagcugug

SEQ ID NO: 113941 - RNA, 22 nt, Homo sapiens
cagaugguggucccacagccca

SEQ ID NO: 113942 - RNA, 22 nt, Homo sapiens
cagcaaaucauccuauuugagc

SEQ ID NO: 113943 - RNA, 22 nt, Homo sapiens
cagcaagucucuaagaguucau

SEQ ID NO: 113944 - RNA, 22 nt, Homo sapiens
cagcagguuuuuaucaguuaag

SEQ ID NO: 113945 - RNA, 22 nt, Homo sapiens
cagcccuacacagacugacuca

SEQ ID NO: 113946 - RNA, 22 nt, Homo sapiens
cagcugcuuuggaaaauauuuu

SEQ ID NO: 113947 - RNA, 22 nt, Homo sapiens
cagcuggugggagcuggguucc

SEQ ID NO: 113948 - RNA, 22 nt, Homo sapiens
cagcugguguuacaaaccagag

SEQ ID NO: 113949 - RNA, 22 nt, Homo sapiens
caggcagucuggggguguaucc

SEQ ID NO: 113950 - RNA, 22 nt, Homo sapiens
caguaaauaucugagcgagguc

SEQ ID NO: 113951 - RNA, 22 nt, Homo sapiens
caguacaauguggaaaaggagu

SEQ ID NO: 113952 - RNA, 22 nt, Homo sapiens
cagugcaugacuguauauuauc

SEQ ID NO: 113953 - RNA, 22 nt, Homo sapiens
caguggaugaacaagaagugau

SEQ ID NO: 113954 - RNA, 22 nt, Homo sapiens
caguguaugcuucuauuuuugg

SEQ ID NO: 113955 - RNA, 21 nt, Homo sapiens
cauaaugcuacuuauuuuaug

SEQ ID NO: 113956 - RNA, 22 nt, Homo sapiens
cauacagcuaguaaguguaaga

SEQ ID NO: 113957 - RNA, 22 nt, Homo sapiens
cauacaguaggcacuauuugua

SEQ ID NO: 113958 - RNA, 22 nt, Homo sapiens
caucucauugaauugcugagca

SEQ ID NO: 113959 - RNA, 22 nt, Homo sapiens
caugaaagugagaaacuccugg

SEQ ID NO: 113960 - RNA, 22 nt, Homo sapiens
caugccacugcacuccaaccug

SEQ ID NO: 113961 - RNA, 23 nt, Homo sapiens
cauggcuguuaacacuguuugag

SEQ ID NO: 113962 - RNA, 22 nt, Homo sapiens
cauguaacaucccgcuguagga

SEQ ID NO: 113963 - RNA, 22 nt, Homo sapiens
cauugcacuccacuccugaaca

SEQ ID NO: 113964 - RNA, 22 nt, Homo sapiens
cauugcacuccagccucggcaa

SEQ ID NO: 113965 - RNA, 22 nt, Homo sapiens
cauugcacuccagccugcugac

SEQ ID NO: 113966 - RNA, 22 nt, Homo sapiens
cauugcacuccaucccgggaaa

SEQ ID NO: 113967 - RNA, 22 nt, Homo sapiens
cauugcuaaaagucauauauaa

SEQ ID NO: 113968 - RNA, 22 nt, Homo sapiens
cauuugcacugagacucagcuu

SEQ ID NO: 113969 - RNA, 22 nt, Homo sapiens
cauuugguggcuacagaguaac

SEQ ID NO: 113970 - RNA, 22 nt, Homo sapiens
ccaaaucucauguugaaaugug

SEQ ID NO: 113971 - RNA, 22 nt, Homo sapiens
ccacagucuaugcaacaagguc

SEQ ID NO: 113972 - RNA, 22 nt, Homo sapiens
ccagauguuuucauucagcaag

SEQ ID NO: 113973 - RNA, 22 nt, Homo sapiens
ccagcaccauuuguugaauagg

SEQ ID NO: 113974 - RNA, 22 nt, Homo sapiens
ccaggguuccacgccuggcugu

SEQ ID NO: 113975 - RNA, 22 nt, Homo sapiens
ccaguauugaacacaaugaaag

SEQ ID NO: 113976 - RNA, 22 nt, Homo sapiens
ccagucuuggugucuguagcac

SEQ ID NO: 113977 - RNA, 22 nt, Homo sapiens
ccagugguucccuguggccuga

SEQ ID NO: 113978 - RNA, 19 nt, Homo sapiens
ccaguguucugauugcacu

SEQ ID NO: 113979 - RNA, 19 nt, Homo sapiens
ccaguguugccagagcuga

SEQ ID NO: 113980 - RNA, 17 nt, Homo sapiens
ccaguuuucccucagug

SEQ ID NO: 113981 - RNA, 22 nt, Homo sapiens
cccagagacagaaugauaaacu

SEQ ID NO: 113982 - RNA, 19 nt, Homo sapiens
cccagugucagagaagggu

SEQ ID NO: 113983 - RNA, 22 nt, Homo sapiens
ccccauuguugugguuuuaucu

SEQ ID NO: 113984 - RNA, 22 nt, Homo sapiens
cccugagaugcuguuaaucugu

SEQ ID NO: 113985 - RNA, 22 nt, Homo sapiens
cccugagcagccugaguuuccc

SEQ ID NO: 113986 - RNA, 22 nt, Homo sapiens
cccuguguuguucaaggaucug

SEQ ID NO: 113987 - RNA, 21 nt, Homo sapiens
ccucuuugagggaagaaaggg

SEQ ID NO: 113988 - RNA, 22 nt, Homo sapiens
cgcuggugucuaagcgacagcu

SEQ ID NO: 113989 - RNA, 22 nt, Homo sapiens
cgugaauguuuuggucuuucac

SEQ ID NO: 113990 - RNA, 22 nt, Homo sapiens
cuaaaguagccaggacugcagg

SEQ ID NO: 113991 - RNA, 23 nt, Homo sapiens
cuaaagucugucacugaggacuu

SEQ ID NO: 113992 - RNA, 22 nt, Homo sapiens
cuaacacagggcaagucaggcu

SEQ ID NO: 113993 - RNA, 22 nt, Homo sapiens
cuacucugugguguauuugcau

SEQ ID NO: 113994 - RNA, 22 nt, Homo sapiens
cuagauuauccaacuuauuagc

SEQ ID NO: 113995 - RNA, 22 nt, Homo sapiens
cuagcacauuuaucuuuauaca

SEQ ID NO: 113996 - RNA, 22 nt, Homo sapiens
cuagcccagugcuccuggauca

SEQ ID NO: 113997 - RNA, 22 nt, Homo sapiens
cuagccuggagugcaguggugc

SEQ ID NO: 113998 - RNA, 22 nt, Homo sapiens
cuaggcuguagagaaguucagu

SEQ ID NO: 113999 - RNA, 22 nt, Homo sapiens
cucaaaguguggucuguggguu

SEQ ID NO: 114000 - RNA, 22 nt, Homo sapiens
cucacaguucuaaaggcaagaa

SEQ ID NO: 114001 - RNA, 20 nt, Homo sapiens
gcaaauggaucccacaagcc

SEQ ID NO: 114002 - RNA, 22 nt, Homo sapiens
gcaacugguuucaguuuuucag

SEQ ID NO: 114003 - RNA, 22 nt, Homo sapiens
gcacaguggcucccgucuauaa

SEQ ID NO: 114004 - RNA, 22 nt, Homo sapiens
gcacaguguuacuugauauauu

SEQ ID NO: 114005 - RNA, 22 nt, Homo sapiens
gcaccaugguagaauaauggua

SEQ ID NO: 114006 - RNA, 22 nt, Homo sapiens
gcaguauuguugaaauguccau

SEQ ID NO: 114007 - RNA, 17 nt, Homo sapiens
gcauauguugaaccagc

SEQ ID NO: 114008 - RNA, 17 nt, Homo sapiens
gcauauguugaaccagu

SEQ ID NO: 114009 - RNA, 22 nt, Homo sapiens
gcauauguuuggguguguauau

SEQ ID NO: 114010 - RNA, 22 nt, Homo sapiens
gcaucacagcuccugugcuggc

SEQ ID NO: 114011 - RNA, 22 nt, Homo sapiens
gcaugauuuuauaucuauguaa

SEQ ID NO: 114012 - RNA, 19 nt, Homo sapiens
gccaccuggugcguguucu

SEQ ID NO: 114013 - RNA, 22 nt, Homo sapiens
gccauugcacuccgcccugggc

SEQ ID NO: 114014 - RNA, 22 nt, Homo sapiens
gcccuacuguuuauacauagga

SEQ ID NO: 114015 - RNA, 22 nt, Homo sapiens
gccuagauccaaauauggugca

SEQ ID NO: 114016 - RNA, 22 nt, Homo sapiens
gcuagcauucaaaugugcagcc

SEQ ID NO: 114017 - RNA, 19 nt, Homo sapiens
gcucaccuugcugcuccag

SEQ ID NO: 114018 - RNA, 22 nt, Homo sapiens
gcuggaauuaacauagaugugc

SEQ ID NO: 114019 - RNA, 22 nt, Homo sapiens
gcuuuguuaaaacacagccaca

SEQ ID NO: 114020 - RNA, 22 nt, Homo sapiens
ggaaagacuauuguaaaggaug

SEQ ID NO: 114021 - RNA, 22 nt, Homo sapiens
ggaacaccauuuuuccugccuu

SEQ ID NO: 114022 - RNA, 22 nt, Homo sapiens
ggaagagugaauuaucuugacu

SEQ ID NO: 114023 - RNA, 22 nt, Homo sapiens
ggaaggucaaagggaaagcaga

SEQ ID NO: 114024 - RNA, 22 nt, Homo sapiens
ggaauguauuaaggcauugggc

SEQ ID NO: 114025 - RNA, 22 nt, Homo sapiens
ggacauguauauauaugugugu

SEQ ID NO: 114026 - RNA, 22 nt, Homo sapiens
ggagcugugauuugaguccaga

SEQ ID NO: 114027 - RNA, 22 nt, Homo sapiens
ggagucugacuuauaggaaccu

SEQ ID NO: 114028 - RNA, 22 nt, Homo sapiens
ggagugugauuguucucuguua

SEQ ID NO: 114029 - RNA, 22 nt, Homo sapiens
ggaguucaucaggugaggggua

SEQ ID NO: 114030 - RNA, 22 nt, Homo sapiens
ggcaacaugaugaaaugccauc

SEQ ID NO: 114031 - RNA, 21 nt, Homo sapiens
ggcaagagaauacaacauaaa

SEQ ID NO: 114032 - RNA, 22 nt, Homo sapiens
ggcacaguuaagugcuaccuaa

SEQ ID NO: 114033 - RNA, 19 nt, Homo sapiens
ggcacugugugagugagga

SEQ ID NO: 114034 - RNA, 22 nt, Homo sapiens
ggcagcucaggccccgcgcuga

SEQ ID NO: 114035 - RNA, 22 nt, Homo sapiens
ggcaguuuguuugugaggucca

SEQ ID NO: 114036 - RNA, 22 nt, Homo sapiens
ggcaugaggccauaaaaguaag

SEQ ID NO: 114037 - RNA, 22 nt, Homo sapiens
ggccagaugcgguggcucacac

SEQ ID NO: 114038 - RNA, 22 nt, Homo sapiens
ggcccugagacaggaaaaagcu

SEQ ID NO: 114039 - RNA, 18 nt, Homo sapiens
ggcugguguuuuaguaua

SEQ ID NO: 114040 - RNA, 22 nt, Homo sapiens
gggaaugaagagaaccuuccca

SEQ ID NO: 114041 - RNA, 22 nt, Homo sapiens
gggaauguagcaaaucugcaau

SEQ ID NO: 114042 - RNA, 22 nt, Homo sapiens
gggaugaagaagaauaguucgu

SEQ ID NO: 114043 - RNA, 22 nt, Homo sapiens
gggauguuuuauacugagccug

SEQ ID NO: 114044 - RNA, 22 nt, Homo sapiens
gggcaaauuauguaucucucag

SEQ ID NO: 114045 - RNA, 22 nt, Homo sapiens
gggcaagaagucuuguaguuuu

SEQ ID NO: 114046 - RNA, 19 nt, Homo sapiens
ggucagcaaagucuagcug

SEQ ID NO: 114047 - RNA, 22 nt, Homo sapiens
gguccgccugccuuggccuccc

SEQ ID NO: 114048 - RNA, 22 nt, Homo sapiens
ggugagcacagaaugcccugag

SEQ ID NO: 114049 - RNA, 22 nt, Homo sapiens
ggugccuacugugugucaggca

SEQ ID NO: 114050 - RNA, 22 nt, Homo sapiens
ggugucaguuggccccuacugg

SEQ ID NO: 114051 - RNA, 22 nt, Homo sapiens
guaaauaccaguuucuggaaca

SEQ ID NO: 114052 - RNA, 22 nt, Homo sapiens
guaaauguccugcuacagagug

SEQ ID NO: 114053 - RNA, 22 nt, Homo sapiens
guacacauacauauaugugugu

SEQ ID NO: 114054 - RNA, 22 nt, Homo sapiens
guacaguacugaaugaauguau

SEQ ID NO: 114055 - RNA, 22 nt, Homo sapiens
guacucuggaguaggccuaauu

SEQ ID NO: 114056 - RNA, 22 nt, Homo sapiens
guagaccauuuaucuggggagu

SEQ ID NO: 114057 - RNA, 22 nt, Homo sapiens
guagcagaacauguuccuugua

SEQ ID NO: 114058 - RNA, 22 nt, Homo sapiens
guaugacacaggaagcuuaacc

SEQ ID NO: 114059 - RNA, 22 nt, Homo sapiens
guauuaguuuccuguugcugcu

SEQ ID NO: 114060 - RNA, 22 nt, Homo sapiens
gucacaggaaacuaauaugcgc

SEQ ID NO: 114061 - RNA, 22 nt, Homo sapiens
gucacugagcaauagaaaguuu

SEQ ID NO: 114062 - RNA, 22 nt, Homo sapiens
gucacugggugcugcgccuguc

SEQ ID NO: 114063 - RNA, 22 nt, Homo sapiens
gucagcuuuuccuuacuuuagg

SEQ ID NO: 114064 - RNA, 22 nt, Homo sapiens
gucaggaugauuuggggaggug

SEQ ID NO: 114065 - RNA, 22 nt, Homo sapiens
gucaguggagaaaaggacaugu

SEQ ID NO: 114066 - RNA, 22 nt, Homo sapiens
gucaucaggacgggucaucugc

SEQ ID NO: 114067 - RNA, 22 nt, Homo sapiens
gucaugucuugaaauucaguuu

SEQ ID NO: 114068 - RNA, 22 nt, Homo sapiens
guccaguguuggagguuuuacc

SEQ ID NO: 114069 - RNA, 22 nt, Homo sapiens
gucccagagauauugugucuuu

SEQ ID NO: 114070 - RNA, 22 nt, Homo sapiens
guccugaagaccuuccucugga

SEQ ID NO: 114071 - RNA, 20 nt, Homo sapiens
gucuugcuccguugcccagg

SEQ ID NO: 114072 - RNA, 22 nt, Homo sapiens
gucuuggagacauugccauuga

SEQ ID NO: 114073 - RNA, 22 nt, Homo sapiens
gucuuuaguugaaacauguggu

SEQ ID NO: 114074 - RNA, 22 nt, Homo sapiens
gucuuuguuuggucuguaucag

SEQ ID NO: 114075 - RNA, 22 nt, Homo sapiens
gugaaagacauauaugguuuga

SEQ ID NO: 114076 - RNA, 22 nt, Homo sapiens
gugacauuauuucagcuacaug

SEQ ID NO: 114077 - RNA, 22 nt, Homo sapiens
gugaggcacugcugcuuuccag

SEQ ID NO: 114078 - RNA, 22 nt, Homo sapiens
gugaguuauuauuuauguaaac

SEQ ID NO: 114079 - RNA, 22 nt, Homo sapiens
gugauaguucuuacuccaaagu

SEQ ID NO: 114080 - RNA, 21 nt, Homo sapiens
gugaucaugucacugcacucc

SEQ ID NO: 114081 - RNA, 22 nt, Homo sapiens
gugaucuucauggaaggugaaa

SEQ ID NO: 114082 - RNA, 22 nt, Homo sapiens
gugcaaugaguguggcaaagcc

SEQ ID NO: 114083 - RNA, 22 nt, Homo sapiens
gugcacaaaucuuaaauguaca

SEQ ID NO: 114084 - RNA, 22 nt, Homo sapiens
gugcacauauggugcauaagug

SEQ ID NO: 114085 - RNA, 22 nt, Homo sapiens
gugcacaucuguguuccagcua

SEQ ID NO: 114086 - RNA, 22 nt, Homo sapiens
gugcacauuguuuaugucuguu

SEQ ID NO: 114087 - RNA, 22 nt, Homo sapiens
gugccuagugcuauugugcccu

SEQ ID NO: 114088 - RNA, 22 nt, Homo sapiens
gugccuucuagcuaugguuggc

SEQ ID NO: 114089 - RNA, 22 nt, Homo sapiens
guggagcuguguggccuugggc

SEQ ID NO: 114090 - RNA, 21 nt, Homo sapiens
guggccuuuggagcaugucag

SEQ ID NO: 114091 - RNA, 22 nt, Homo sapiens
gugggaugaucacaguucacug

SEQ ID NO: 114092 - RNA, 22 nt, Homo sapiens
gugggauggaaaugggcuucag

SEQ ID NO: 114093 - RNA, 22 nt, Homo sapiens
gugggguaggaggaguacuucc

SEQ ID NO: 114094 - RNA, 22 nt, Homo sapiens
guggggucaucucauuugugga

SEQ ID NO: 114095 - RNA, 22 nt, Homo sapiens
gugguaggaaagugcaaaugua

SEQ ID NO: 114096 - RNA, 22 nt, Homo sapiens
gugguucuagagggacagaaug

SEQ ID NO: 114097 - RNA, 22 nt, Homo sapiens
guguaacaacagcacuccacug

SEQ ID NO: 114098 - RNA, 22 nt, Homo sapiens
guguagagaaauagccugaagg

SEQ ID NO: 114099 - RNA, 22 nt, Homo sapiens
guguggcaggugggggcucaga

SEQ ID NO: 114100 - RNA, 22 nt, Homo sapiens
gugugguaggauugguuacuca

SEQ ID NO: 114101 - RNA, 22 nt, Homo sapiens
guucaaggaauguuggcuucuc

SEQ ID NO: 114102 - RNA, 20 nt, Homo sapiens
guucacagagguuaugauua

SEQ ID NO: 114103 - RNA, 20 nt, Homo sapiens
cucaccagguguaggcugag

SEQ ID NO: 114104 - RNA, 22 nt, Homo sapiens
cucagaguacuuuucccacuuc

SEQ ID NO: 114105 - RNA, 22 nt, Homo sapiens
cucauggaauacuucacagcca

SEQ ID NO: 114106 - RNA, 20 nt, Homo sapiens
cucccugacaaauguggaaa

SEQ ID NO: 114107 - RNA, 22 nt, Homo sapiens
cucucugagccccagacaccuu

SEQ ID NO: 114108 - RNA, 22 nt, Homo sapiens
cucugagccugagguuccuacu

SEQ ID NO: 114109 - RNA, 22 nt, Homo sapiens
cucugcuuaaugucccacuuga

SEQ ID NO: 114110 - RNA, 22 nt, Homo sapiens
cucuuagauuagccauccuaau

SEQ ID NO: 114111 - RNA, 22 nt, Homo sapiens
cucuuggguagauuuugcagag

SEQ ID NO: 114112 - RNA, 22 nt, Homo sapiens
cucuuugaguuccuccuggugu

SEQ ID NO: 114113 - RNA, 22 nt, Homo sapiens
cucuuuuguuuagcugagaggg

SEQ ID NO: 114114 - RNA, 22 nt, Homo sapiens
cugaaaagcaucugcauagcug

SEQ ID NO: 114115 - RNA, 22 nt, Homo sapiens
cugaaagagcauguaacacagu

SEQ ID NO: 114116 - RNA, 22 nt, Homo sapiens
cugaaaucagccaguuaguuuc

SEQ ID NO: 114117 - RNA, 22 nt, Homo sapiens
cugaauagucaacgauggacug

SEQ ID NO: 114118 - RNA, 22 nt, Homo sapiens
cugaauguuuucuucuauucug

SEQ ID NO: 114119 - RNA, 22 nt, Homo sapiens
cugacagaugacugccacugua

SEQ ID NO: 114120 - RNA, 22 nt, Homo sapiens
cugacagucucauugauuugcu

SEQ ID NO: 114121 - RNA, 22 nt, Homo sapiens
cugagaguugaugaaauauggu

SEQ ID NO: 114122 - RNA, 22 nt, Homo sapiens
cugagaucuuauuagaaaugca

SEQ ID NO: 114123 - RNA, 22 nt, Homo sapiens
cugagcaauauagugagaucuu

SEQ ID NO: 114124 - RNA, 22 nt, Homo sapiens
cugagguaggugaucagugcuu

SEQ ID NO: 114125 - RNA, 18 nt, Homo sapiens
cugagucauuccuggguc

SEQ ID NO: 114126 - RNA, 22 nt, Homo sapiens
cugcaagaaucguaguauuuga

SEQ ID NO: 114127 - RNA, 22 nt, Homo sapiens
cugcaauggagaaagugagacu

SEQ ID NO: 114128 - RNA, 19 nt, Homo sapiens
cugcaugagacaguugguu

SEQ ID NO: 114129 - RNA, 22 nt, Homo sapiens
cuggcaccauuuugaucaaagg

SEQ ID NO: 114130 - RNA, 22 nt, Homo sapiens
cugggguaggacuggcuuuuga

SEQ ID NO: 114131 - RNA, 22 nt, Homo sapiens
cugugaacaugggagaaauggc

SEQ ID NO: 114132 - RNA, 17 nt, Homo sapiens
cugugaugaucuugucu

SEQ ID NO: 114133 - RNA, 22 nt, Homo sapiens
cugugcuugauuauaugagugu

SEQ ID NO: 114134 - RNA, 23 nt, Homo sapiens
cuguggauaugaguuguaaaugg

SEQ ID NO: 114135 - RNA, 22 nt, Homo sapiens
cuguguaguacuagauugagca

SEQ ID NO: 114136 - RNA, 22 nt, Homo sapiens
cuucaagucuuuggauaauuag

SEQ ID NO: 114137 - RNA, 22 nt, Homo sapiens
cuucaugagacuuuuggaaggc

SEQ ID NO: 114138 - RNA, 22 nt, Homo sapiens
cuugaacaaagagauuccauua

SEQ ID NO: 114139 - RNA, 22 nt, Homo sapiens
cuugagacauuguuuuccaagu

SEQ ID NO: 114140 - RNA, 22 nt, Homo sapiens
cuugcauagaguuauugcccuu

SEQ ID NO: 114141 - RNA, 22 nt, Homo sapiens
cuugccuuugucuucaaaggcu

SEQ ID NO: 114142 - RNA, 22 nt, Homo sapiens
cuuguguuacauauuuaagaga

SEQ ID NO: 114143 - RNA, 22 nt, Homo sapiens
cuuuagcaaggauauggggaug

SEQ ID NO: 114144 - RNA, 22 nt, Homo sapiens
cuuuggcaaugucauuuucaau

SEQ ID NO: 114145 - RNA, 22 nt, Homo sapiens
cuuuguguggacauuucaggca

SEQ ID NO: 114146 - RNA, 20 nt, Homo sapiens
cuuuuagcagcagcaagaga

SEQ ID NO: 114147 - RNA, 22 nt, Homo sapiens
cuuuuggcuuaagauugucuug

SEQ ID NO: 114148 - RNA, 22 nt, Homo sapiens
cuuuuggcuuagaauugucuug

SEQ ID NO: 114149 - RNA, 22 nt, Homo sapiens
cuuuugugauucuucaguugcu

SEQ ID NO: 114150 - RNA, 22 nt, Homo sapiens
gaaaacugcuucucuggguuuc

SEQ ID NO: 114151 - RNA, 22 nt, Homo sapiens
gaaacugcauuucuaacaagcu

SEQ ID NO: 114152 - RNA, 21 nt, Homo sapiens
gaaauacugccuuaggagcug

SEQ ID NO: 114153 - RNA, 20 nt, Homo sapiens
gaacugguguauguuuaacu

SEQ ID NO: 114154 - RNA, 22 nt, Homo sapiens
gaacuguaaagaaauucuaagg

SEQ ID NO: 114155 - RNA, 22 nt, Homo sapiens
gaagcagcauucugguuuuugg

SEQ ID NO: 114156 - RNA, 22 nt, Homo sapiens
gaagcgaggugauuagcagaca

SEQ ID NO: 114157 - RNA, 22 nt, Homo sapiens
gaaugcaugaggggaucagaug

SEQ ID NO: 114158 - RNA, 22 nt, Homo sapiens
gacaguuucucaggcuuccuua

SEQ ID NO: 114159 - RNA, 20 nt, Homo sapiens
gacauguugguuugcugcac

SEQ ID NO: 114160 - RNA, 22 nt, Homo sapiens
gacauguuuacaguguugagag

SEQ ID NO: 114161 - RNA, 22 nt, Homo sapiens
gacccucuagagggaagcgcuu

SEQ ID NO: 114162 - RNA, 22 nt, Homo sapiens
gacuagaaauuauuuagugagc

SEQ ID NO: 114163 - RNA, 18 nt, Homo sapiens
gacuccauuucagccaga

SEQ ID NO: 114164 - RNA, 22 nt, Homo sapiens
gacugaggaagcgcucucuccu

SEQ ID NO: 114165 - RNA, 22 nt, Homo sapiens
gagaacagagauaauuuuacuu

SEQ ID NO: 114166 - RNA, 22 nt, Homo sapiens
gagaacuaaugguuugauaagg

SEQ ID NO: 114167 - RNA, 22 nt, Homo sapiens
gagaacugacauuaucguguau

SEQ ID NO: 114168 - RNA, 22 nt, Homo sapiens
gagacauguuugcuuaucugag

SEQ ID NO: 114169 - RNA, 22 nt, Homo sapiens
gagacugaguuuugcucuuguu

SEQ ID NO: 114170 - RNA, 22 nt, Homo sapiens
gagagaguacuugauauaauuu

SEQ ID NO: 114171 - RNA, 22 nt, Homo sapiens
gagagcauuaagccaucaucau

SEQ ID NO: 114172 - RNA, 22 nt, Homo sapiens
gagagugcuuuggguguaggcc

SEQ ID NO: 114173 - RNA, 22 nt, Homo sapiens
gagauaacuacuggauuaaguu

SEQ ID NO: 114174 - RNA, 22 nt, Homo sapiens
gagauauuuagaaauguguucu

SEQ ID NO: 114175 - RNA, 22 nt, Homo sapiens
gagaucaaugccuauggcuuuc

SEQ ID NO: 114176 - RNA, 22 nt, Homo sapiens
gagaucaugcugguucucucau

SEQ ID NO: 114177 - RNA, 22 nt, Homo sapiens
gagauugucaugauuacauugu

SEQ ID NO: 114178 - RNA, 22 nt, Homo sapiens
gagcacauaugacauuuucuuc

SEQ ID NO: 114179 - RNA, 22 nt, Homo sapiens
gagccauggagaaaacagcuau

SEQ ID NO: 114180 - RNA, 22 nt, Homo sapiens
gagcccauuucacuuguccagc

SEQ ID NO: 114181 - RNA, 22 nt, Homo sapiens
gagcucaccuuaccucuggagc

SEQ ID NO: 114182 - RNA, 22 nt, Homo sapiens
gagcucauuaaaguaggaccua

SEQ ID NO: 114183 - RNA, 22 nt, Homo sapiens
gagcugaauugcugccauuugc

SEQ ID NO: 114184 - RNA, 22 nt, Homo sapiens
gaggaaguuuacaaagcaucug

SEQ ID NO: 114185 - RNA, 22 nt, Homo sapiens
gaggcagucugucccuuagcag

SEQ ID NO: 114186 - RNA, 22 nt, Homo sapiens
gaggcaguguguccguucucgg

SEQ ID NO: 114187 - RNA, 22 nt, Homo sapiens
gagguagagaguuuugauucug

SEQ ID NO: 114188 - RNA, 22 nt, Homo sapiens
gaggucuuacauuuuaauauuu

SEQ ID NO: 114189 - RNA, 22 nt, Homo sapiens
gaggugauaucucauugugguu

SEQ ID NO: 114190 - RNA, 22 nt, Homo sapiens
gaguagugcugcaauaaacaua

SEQ ID NO: 114191 - RNA, 22 nt, Homo sapiens
gaguagugcugcaguaaacaca

SEQ ID NO: 114192 - RNA, 22 nt, Homo sapiens
gagugcugagcccacuuccuug

SEQ ID NO: 114193 - RNA, 22 nt, Homo sapiens
gaguucaaaucucagcucuguu

SEQ ID NO: 114194 - RNA, 22 nt, Homo sapiens
gaguucaauuuccagcuguucu

SEQ ID NO: 114195 - RNA, 22 nt, Homo sapiens
gauagcagccauucuuuuuauu

SEQ ID NO: 114196 - RNA, 22 nt, Homo sapiens
gauaguugugagaacucuuacu

SEQ ID NO: 114197 - RNA, 19 nt, Homo sapiens
gauaucuagggggagguuc

SEQ ID NO: 114198 - RNA, 22 nt, Homo sapiens
gauauguuagggggagaaguua

SEQ ID NO: 114199 - RNA, 17 nt, Homo sapiens
gaucacagucgucuccu

SEQ ID NO: 114200 - RNA, 22 nt, Homo sapiens
gaucugugugauuggaugcauu

SEQ ID NO: 114201 - RNA, 22 nt, Homo sapiens
gcaaaaaguagugcugguuagg

SEQ ID NO: 114202 - RNA, 22 nt, Homo sapiens
gcaaagaaugcagauuugccuc

SEQ ID NO: 114203 - RNA, 21 nt, Homo sapiens
gcaaaggaauugccuaagcuu

SEQ ID NO: 114204 - RNA, 22 nt, Homo sapiens
gcaaaucuuauguccucacauu

SEQ ID NO: 114205 - RNA, 22 nt, Homo sapiens
acuccauuuccagagcagcccc

SEQ ID NO: 114206 - RNA, 22 nt, Homo sapiens
acugagccuuuaaaugacuuca

SEQ ID NO: 114207 - RNA, 22 nt, Homo sapiens
acugcaaugucgaauagagaug

SEQ ID NO: 114208 - RNA, 22 nt, Homo sapiens
acugcacuccaaccuuggugac

SEQ ID NO: 114209 - RNA, 22 nt, Homo sapiens
acugcacuccacccuuggcagc

SEQ ID NO: 114210 - RNA, 22 nt, Homo sapiens
acugcacuccagccucggugac

SEQ ID NO: 114211 - RNA, 22 nt, Homo sapiens
acugcacuccagccucgugaca

SEQ ID NO: 114212 - RNA, 22 nt, Homo sapiens
acugcacuccagccugaugaaa

SEQ ID NO: 114213 - RNA, 22 nt, Homo sapiens
acugcacuccagccugcccaac

SEQ ID NO: 114214 - RNA, 22 nt, Homo sapiens
acugcacuccagccuggacgaa

SEQ ID NO: 114215 - RNA, 22 nt, Homo sapiens
acugcacuccagccuggcggac

SEQ ID NO: 114216 - RNA, 20 nt, Homo sapiens
acugcacuccagccuuccag

SEQ ID NO: 114217 - RNA, 22 nt, Homo sapiens
acugcacuccagccuucggaca

SEQ ID NO: 114218 - RNA, 22 nt, Homo sapiens
acugcacuccagccuugagagc

SEQ ID NO: 114219 - RNA, 22 nt, Homo sapiens
acugcacuccagccuugauggc

SEQ ID NO: 114220 - RNA, 22 nt, Homo sapiens
acugcacuccagccuugcgaca

SEQ ID NO: 114221 - RNA, 22 nt, Homo sapiens
acugcacuccagccuuggcggc

SEQ ID NO: 114222 - RNA, 22 nt, Homo sapiens
acugcacuccagccuugugaca

SEQ ID NO: 114223 - RNA, 18 nt, Homo sapiens
acugcacuccauccuagg

SEQ ID NO: 114224 - RNA, 22 nt, Homo sapiens
acugcacuccuccuugggugac

SEQ ID NO: 114225 - RNA, 22 nt, Homo sapiens
acugcacucuagcauggguaau

SEQ ID NO: 114226 - RNA, 22 nt, Homo sapiens
acugcacugcagccuggccaac

SEQ ID NO: 114227 - RNA, 22 nt, Homo sapiens
acugcacuucagccuuggggac

SEQ ID NO: 114228 - RNA, 21 nt, Homo sapiens
acuuuguugggggcugaggca

SEQ ID NO: 114229 - RNA, 22 nt, Homo sapiens
agaaccaaucccacauggauac

SEQ ID NO: 114230 - RNA, 22 nt, Homo sapiens
agacaagauggcuugagguuca

SEQ ID NO: 114231 - RNA, 22 nt, Homo sapiens
agacuagaaaucauuuguugag

SEQ ID NO: 114232 - RNA, 22 nt, Homo sapiens
agacuagagggaaaugaguugg

SEQ ID NO: 114233 - RNA, 22 nt, Homo sapiens
agagagguggguggagccccca

SEQ ID NO: 114234 - RNA, 22 nt, Homo sapiens
agagaucauuuuguuucaaauc

SEQ ID NO: 114235 - RNA, 20 nt, Homo sapiens
agagcaaagccgcaccccua

SEQ ID NO: 114236 - RNA, 22 nt, Homo sapiens
agaggaguacuacuccaagucu

SEQ ID NO: 114237 - RNA, 22 nt, Homo sapiens
agagguaagaauaguaguugga

SEQ ID NO: 114238 - RNA, 22 nt, Homo sapiens
agaggucuuaucaaacaugcuu

SEQ ID NO: 114239 - RNA, 22 nt, Homo sapiens
agaguacugacguuugcaaauu

SEQ ID NO: 114240 - RNA, 22 nt, Homo sapiens
agauacaucuaugugucugugu

SEQ ID NO: 114241 - RNA, 22 nt, Homo sapiens
agauauuuguuaggucugucag

SEQ ID NO: 114242 - RNA, 22 nt, Homo sapiens
agaucacagucuuugguuuuag

SEQ ID NO: 114243 - RNA, 18 nt, Homo sapiens
agaugguguugcuucugu

SEQ ID NO: 114244 - RNA, 22 nt, Homo sapiens
agaugguguuggcugaguguau

SEQ ID NO: 114245 - RNA, 22 nt, Homo sapiens
agcaaaucuaugaauguauauu

SEQ ID NO: 114246 - RNA, 22 nt, Homo sapiens
agcaacaucagcagcaggaaaa

SEQ ID NO: 114247 - RNA, 22 nt, Homo sapiens
agcaagauugauggccugcagg

SEQ ID NO: 114248 - RNA, 22 nt, Homo sapiens
agcacacuggguggcuuaaaca

SEQ ID NO: 114249 - RNA, 22 nt, Homo sapiens
agcacaguuaaaugaggcuucu

SEQ ID NO: 114250 - RNA, 22 nt, Homo sapiens
agcaccagaaucugaguuauuc

SEQ ID NO: 114251 - RNA, 20 nt, Homo sapiens
agcagccacagauuccucag

SEQ ID NO: 114252 - RNA, 21 nt, Homo sapiens
agcagcuuugguugaagcaga

SEQ ID NO: 114253 - RNA, 22 nt, Homo sapiens
agcagguauucgggucaugggg

SEQ ID NO: 114254 - RNA, 22 nt, Homo sapiens
agcaucacguagacuuuaccau

SEQ ID NO: 114255 - RNA, 22 nt, Homo sapiens
agcaucaugcaguugcuauuca

SEQ ID NO: 114256 - RNA, 22 nt, Homo sapiens
agccauacaacguaugcaugua

SEQ ID NO: 114257 - RNA, 22 nt, Homo sapiens
agcccauuuugcacugagaugc

SEQ ID NO: 114258 - RNA, 17 nt, Homo sapiens
agccccauuagcuaguu

SEQ ID NO: 114259 - RNA, 21 nt, Homo sapiens
agccugugggucauaguugcc

SEQ ID NO: 114260 - RNA, 21 nt, Homo sapiens
agcuaaauuggaaauuucugu

SEQ ID NO: 114261 - RNA, 22 nt, Homo sapiens
agcuacuguuagucuaguuagg

SEQ ID NO: 114262 - RNA, 22 nt, Homo sapiens
agcuggucuacguguguaugag

SEQ ID NO: 114263 - RNA, 22 nt, Homo sapiens
agcuggucucaggugcccugcu

SEQ ID NO: 114264 - RNA, 22 nt, Homo sapiens
agcuucauucugaauagguuga

SEQ ID NO: 114265 - RNA, 21 nt, Homo sapiens
aggaagacuaugaucaauugg

SEQ ID NO: 114266 - RNA, 23 nt, Homo sapiens
aggaaguaacuaucuuuucuguc

SEQ ID NO: 114267 - RNA, 22 nt, Homo sapiens
aggagcacuggccuuggaguca

SEQ ID NO: 114268 - RNA, 21 nt, Homo sapiens
aggcaagguguuauuauugaa

SEQ ID NO: 114269 - RNA, 22 nt, Homo sapiens
aggcaugaguucagaggguaug

SEQ ID NO: 114270 - RNA, 23 nt, Homo sapiens
aggccaguuuuuccugcuugcug

SEQ ID NO: 114271 - RNA, 22 nt, Homo sapiens
agggcaguguuaggacugucug

SEQ ID NO: 114272 - RNA, 22 nt, Homo sapiens
agggcuuuugagcugagauggu

SEQ ID NO: 114273 - RNA, 22 nt, Homo sapiens
aggugcuugagggaagaaauua

SEQ ID NO: 114274 - RNA, 21 nt, Homo sapiens
aggugucuuggguucccuggc

SEQ ID NO: 114275 - RNA, 22 nt, Homo sapiens
aguaacacaccugcauggugug

SEQ ID NO: 114276 - RNA, 22 nt, Homo sapiens
aguaagauggcaacucuccaca

SEQ ID NO: 114277 - RNA, 22 nt, Homo sapiens
agucaacaucaugaaguggaaa

SEQ ID NO: 114278 - RNA, 22 nt, Homo sapiens
agucagugucuguaaggagaac

SEQ ID NO: 114279 - RNA, 22 nt, Homo sapiens
agucaguguguauugauggcac

SEQ ID NO: 114280 - RNA, 22 nt, Homo sapiens
agucaugggagagaugugaucg

SEQ ID NO: 114281 - RNA, 22 nt, Homo sapiens
agugcuuaauagauguccagca

SEQ ID NO: 114282 - RNA, 22 nt, Homo sapiens
aguguuuuuaucaugaaagggu

SEQ ID NO: 114283 - RNA, 18 nt, Homo sapiens
aguuguuuuauccugccc

SEQ ID NO: 114284 - RNA, 22 nt, Homo sapiens
auaaagacacuuggcaugauuu

SEQ ID NO: 114285 - RNA, 22 nt, Homo sapiens
auaagguuagcucugagaaagu

SEQ ID NO: 114286 - RNA, 22 nt, Homo sapiens
cacugcauggucuagcuggguu

SEQ ID NO: 114287 - RNA, 22 nt, Homo sapiens
cacugcauuacucaugagcaug

SEQ ID NO: 114288 - RNA, 23 nt, Homo sapiens
cacugggcagcagguguucccag

SEQ ID NO: 114289 - RNA, 22 nt, Homo sapiens
cagagaacugaguuauuuucuu

SEQ ID NO: 114290 - RNA, 22 nt, Homo sapiens
cagagcaaugcuuuugcuuuga

SEQ ID NO: 114291 - RNA, 22 nt, Homo sapiens
cagauacuccuggucucaggag

SEQ ID NO: 114292 - RNA, 22 nt, Homo sapiens
cagcacauuacaaguacuuggu

SEQ ID NO: 114293 - RNA, 22 nt, Homo sapiens
cagcgaggucugcgucacauug

SEQ ID NO: 114294 - RNA, 22 nt, Homo sapiens
cagcuguuguuaugucugcagg

SEQ ID NO: 114295 - RNA, 22 nt, Homo sapiens
cagcuguuguugggguauagga

SEQ ID NO: 114296 - RNA, 22 nt, Homo sapiens
cagguaguauuugguuacauaa

SEQ ID NO: 114297 - RNA, 22 nt, Homo sapiens
caguacaauguugauuagaagu

SEQ ID NO: 114298 - RNA, 22 nt, Homo sapiens
cagugcuuuaucaaguccucca

SEQ ID NO: 114299 - RNA, 22 nt, Homo sapiens
cagugguuuucucaguucagca

SEQ ID NO: 114300 - RNA, 22 nt, Homo sapiens
cagugucugcauuuggaacuca

SEQ ID NO: 114301 - RNA, 22 nt, Homo sapiens
caguguuuuuaacaggugcccg

SEQ ID NO: 114302 - RNA, 23 nt, Homo sapiens
caucacagagccuuccuugacuc

SEQ ID NO: 114303 - RNA, 22 nt, Homo sapiens
caucacaguacuaaucgucaua

SEQ ID NO: 114304 - RNA, 22 nt, Homo sapiens
caucccugucgucaagucucug

SEQ ID NO: 114305 - RNA, 23 nt, Homo sapiens
caugaacuaguuugcagccauga

SEQ ID NO: 114306 - RNA, 22 nt, Homo sapiens
caugcagcacacaugucugugc

SEQ ID NO: 114307 - RNA, 22 nt, Homo sapiens
caugcauagccauucauucguu

SEQ ID NO: 114308 - RNA, 22 nt, Homo sapiens
cauggccuuuggaaugugucua

SEQ ID NO: 114309 - RNA, 19 nt, Homo sapiens
cauugcacuccacccuggg

SEQ ID NO: 114310 - RNA, 22 nt, Homo sapiens
cauugcacuccagccugaggga

SEQ ID NO: 114311 - RNA, 22 nt, Homo sapiens
cauugcacuccagccugaguga

SEQ ID NO: 114312 - RNA, 22 nt, Homo sapiens
cauugcacucugcauuccaguc

SEQ ID NO: 114313 - RNA, 22 nt, Homo sapiens
ccaaaguauuuucacugauauc

SEQ ID NO: 114314 - RNA, 22 nt, Homo sapiens
ccaaggaauacccucccuuuuu

SEQ ID NO: 114315 - RNA, 22 nt, Homo sapiens
ccacaguggauuaaaguuacug

SEQ ID NO: 114316 - RNA, 22 nt, Homo sapiens
ccacugcacuccagcccggcaa

SEQ ID NO: 114317 - RNA, 22 nt, Homo sapiens
ccagcaccauuuauuaaauagg

SEQ ID NO: 114318 - RNA, 20 nt, Homo sapiens
ccagcaucauuagauucugg

SEQ ID NO: 114319 - RNA, 23 nt, Homo sapiens
ccaguauuuauguaaggaagugu

SEQ ID NO: 114320 - RNA, 21 nt, Homo sapiens
ccagugguuggaaacuauggg

SEQ ID NO: 114321 - RNA, 22 nt, Homo sapiens
ccaguuuucucacuguugcagu

SEQ ID NO: 114322 - RNA, 22 nt, Homo sapiens
ccauggcuucugcauucuguca

SEQ ID NO: 114323 - RNA, 22 nt, Homo sapiens
cccaguuuugccacuuacuagc

SEQ ID NO: 114324 - RNA, 22 nt, Homo sapiens
cccaguuuugcuucucaugagg

SEQ ID NO: 114325 - RNA, 22 nt, Homo sapiens
ccccggguucugucugcccuug

SEQ ID NO: 114326 - RNA, 23 nt, Homo sapiens
cccucagaagugcagggagagaa

SEQ ID NO: 114327 - RNA, 22 nt, Homo sapiens
cccugagaaaacuuuguccuua

SEQ ID NO: 114328 - RNA, 22 nt, Homo sapiens
ccucauggagaacuucugcuag

SEQ ID NO: 114329 - RNA, 22 nt, Homo sapiens
ccugaugacacgggagauguac

SEQ ID NO: 114330 - RNA, 22 nt, Homo sapiens
ccuggcacugagcaguguucua

SEQ ID NO: 114331 - RNA, 22 nt, Homo sapiens
ccuggcacugggccccguggcu

SEQ ID NO: 114332 - RNA, 22 nt, Homo sapiens
ccuguagcauccaagaagcugc

SEQ ID NO: 114333 - RNA, 22 nt, Homo sapiens
ccugugguuaaccagcuagaug

SEQ ID NO: 114334 - RNA, 22 nt, Homo sapiens
ccuuuguuuaguugaauuguau

SEQ ID NO: 114335 - RNA, 22 nt, Homo sapiens
cgacuggccuagacuaguguuu

SEQ ID NO: 114336 - RNA, 22 nt, Homo sapiens
cuaaaacuuucugagugcagca

SEQ ID NO: 114337 - RNA, 22 nt, Homo sapiens
cuaaagucacgauuugugggua

SEQ ID NO: 114338 - RNA, 22 nt, Homo sapiens
cuaaagugcugagauuauaggu

SEQ ID NO: 114339 - RNA, 22 nt, Homo sapiens
cuaaagugcuuaaaaucucauu

SEQ ID NO: 114340 - RNA, 20 nt, Homo sapiens
cuaaucaucccagaagaaau

SEQ ID NO: 114341 - RNA, 22 nt, Homo sapiens
cuacaguuauguuuuaaaugug

SEQ ID NO: 114342 - RNA, 22 nt, Homo sapiens
cuacucuggagagugacaauca

SEQ ID NO: 114343 - RNA, 22 nt, Homo sapiens
cuagaagguaagagcuggaugc

SEQ ID NO: 114344 - RNA, 22 nt, Homo sapiens
cuagcacauaguuauucacuca

SEQ ID NO: 114345 - RNA, 22 nt, Homo sapiens
cuagcagacaggcugggagcag

SEQ ID NO: 114346 - RNA, 22 nt, Homo sapiens
cuauaacagugugguuuggaga

SEQ ID NO: 114347 - RNA, 22 nt, Homo sapiens
cuaucucauugguuuuugaaag

SEQ ID NO: 114348 - RNA, 22 nt, Homo sapiens
cucaaagucaagggaaagcagg

SEQ ID NO: 114349 - RNA, 22 nt, Homo sapiens
cucaaagugcuaagauuaggcu

SEQ ID NO: 114350 - RNA, 22 nt, Homo sapiens
cucaccuugugauccuccugcc

SEQ ID NO: 114351 - RNA, 20 nt, Homo sapiens
cucagguauuugaggcugca

SEQ ID NO: 114352 - RNA, 22 nt, Homo sapiens
cucauggagaacaucugcuagg

SEQ ID NO: 114353 - RNA, 22 nt, Homo sapiens
cucauggagaaccucugcuagg

SEQ ID NO: 114354 - RNA, 22 nt, Homo sapiens
cucauggauggucuggcagcca

SEQ ID NO: 114355 - RNA, 22 nt, Homo sapiens
cuccacgugaaugccaaguauu

SEQ ID NO: 114356 - RNA, 22 nt, Homo sapiens
cuccauguggcuaacuuuuaaa

SEQ ID NO: 114357 - RNA, 22 nt, Homo sapiens
cucccacccucauuuuuaggca

SEQ ID NO: 114358 - RNA, 22 nt, Homo sapiens
cucuggauauuccugucuaaaa

SEQ ID NO: 114359 - RNA, 22 nt, Homo sapiens
cucugguucugcagugcacccu

SEQ ID NO: 114360 - RNA, 22 nt, Homo sapiens
cucuuacaguguguggugaaag

SEQ ID NO: 114361 - RNA, 19 nt, Homo sapiens
cugaaacacagagagggcu

SEQ ID NO: 114362 - RNA, 22 nt, Homo sapiens
cugaaauggaaugugugcacag

SEQ ID NO: 114363 - RNA, 22 nt, Homo sapiens
cugaaucauugcauuaucaagg

SEQ ID NO: 114364 - RNA, 22 nt, Homo sapiens
cugacaagauucaucacucagu

SEQ ID NO: 114365 - RNA, 22 nt, Homo sapiens
cugacaugcagccacugcaccu

SEQ ID NO: 114366 - RNA, 22 nt, Homo sapiens
cugagagugguauguuuaagug

SEQ ID NO: 114367 - RNA, 22 nt, Homo sapiens
cugagaucguggggcugcuguc

SEQ ID NO: 114368 - RNA, 22 nt, Homo sapiens
cugagcaaagaagugauaauga

SEQ ID NO: 114369 - RNA, 22 nt, Homo sapiens
aaaaugcugauauugggcccca

SEQ ID NO: 114370 - RNA, 22 nt, Homo sapiens
aaacuugucuaauuauaagcau

SEQ ID NO: 114371 - RNA, 22 nt, Homo sapiens
aaagaagucagccuguccuuug

SEQ ID NO: 114372 - RNA, 22 nt, Homo sapiens
aaagagcugagaccugguggag

SEQ ID NO: 114373 - RNA, 22 nt, Homo sapiens
aaagcacugaauaaauuugcuu

SEQ ID NO: 114374 - RNA, 22 nt, Homo sapiens
aaagggcuugaauacucuuuuu

SEQ ID NO: 114375 - RNA, 22 nt, Homo sapiens
aaagucuagaggaucaugugug

SEQ ID NO: 114376 - RNA, 22 nt, Homo sapiens
aaagugauguccaggcuuucag

SEQ ID NO: 114377 - RNA, 22 nt, Homo sapiens
aaagugcugggauuggcugggc

SEQ ID NO: 114378 - RNA, 22 nt, Homo sapiens
aaagugcugggauuuuaggcau

SEQ ID NO: 114379 - RNA, 22 nt, Homo sapiens
aaagugcuguagacugggcgca

SEQ ID NO: 114380 - RNA, 19 nt, Homo sapiens
aaaguucuucccuuuggag

SEQ ID NO: 114381 - RNA, 22 nt, Homo sapiens
aaaugcagcacucaagugggaa

SEQ ID NO: 114382 - RNA, 22 nt, Homo sapiens
aaaugcauggacagcuggucuu

SEQ ID NO: 114383 - RNA, 22 nt, Homo sapiens
aaaugcugucaaauuguguucu

SEQ ID NO: 114384 - RNA, 22 nt, Homo sapiens
aaauggcuuuuugggcaaggug

SEQ ID NO: 114385 - RNA, 22 nt, Homo sapiens
aaaugguguuaguagaucuuua

SEQ ID NO: 114386 - RNA, 21 nt, Homo sapiens
aaaugugcuuuaguacccuca

SEQ ID NO: 114387 - RNA, 20 nt, Homo sapiens
aacaguguguaaguuuccuu

SEQ ID NO: 114388 - RNA, 22 nt, Homo sapiens
aaccuacauucuuaacuguugc

SEQ ID NO: 114389 - RNA, 22 nt, Homo sapiens
aacuccauuuuagacccuagau

SEQ ID NO: 114390 - RNA, 22 nt, Homo sapiens
aagagaacugacaguaccuggg

SEQ ID NO: 114391 - RNA, 22 nt, Homo sapiens
aagagagcuaugugcauaauua

SEQ ID NO: 114392 - RNA, 20 nt, Homo sapiens
aagagcucaccagaauaucu

SEQ ID NO: 114393 - RNA, 22 nt, Homo sapiens
aagauauguuaguuauaaacuc

SEQ ID NO: 114394 - RNA, 22 nt, Homo sapiens
aagcagacauguucauuuugaa

SEQ ID NO: 114395 - RNA, 20 nt, Homo sapiens
aagcagacauuuggaugaaa

SEQ ID NO: 114396 - RNA, 22 nt, Homo sapiens
aagcaucauuuggaauuugaga

SEQ ID NO: 114397 - RNA, 22 nt, Homo sapiens
aagccacuguaccugucucuua

SEQ ID NO: 114398 - RNA, 22 nt, Homo sapiens
aagcuggauuucgcauccuguu

SEQ ID NO: 114399 - RNA, 22 nt, Homo sapiens
aagcuguugguggaucuaccau

SEQ ID NO: 114400 - RNA, 22 nt, Homo sapiens
aaggagcagagagcccuguuuc

SEQ ID NO: 114401 - RNA, 22 nt, Homo sapiens
aaggaguguggugaucuugggc

SEQ ID NO: 114402 - RNA, 22 nt, Homo sapiens
aaggcaugcaaagaacauuuua

SEQ ID NO: 114403 - RNA, 22 nt, Homo sapiens
aagggaaugcgcugccuguguu

SEQ ID NO: 114404 - RNA, 22 nt, Homo sapiens
aagguggugucagagagcuuau

SEQ ID NO: 114405 - RNA, 22 nt, Homo sapiens
aaguaaacauuuuguacaauaa

SEQ ID NO: 114406 - RNA, 22 nt, Homo sapiens
aaguauuaagacuaagaggcuu

SEQ ID NO: 114407 - RNA, 22 nt, Homo sapiens
aagugaguaauacgucaguugu

SEQ ID NO: 114408 - RNA, 22 nt, Homo sapiens
aaguggaauguuuguggcacaa

SEQ ID NO: 114409 - RNA, 17 nt, Homo sapiens
aaguggcuuguucacca

SEQ ID NO: 114410 - RNA, 22 nt, Homo sapiens
aaguuaauguuuaagacuccua

SEQ ID NO: 114411 - RNA, 22 nt, Homo sapiens
aauaaagccugucucuuuagag

SEQ ID NO: 114412 - RNA, 22 nt, Homo sapiens
aauaaaguaggaggugaggaaa

SEQ ID NO: 114413 - RNA, 21 nt, Homo sapiens
aauacucuagguuaagagagc

SEQ ID NO: 114414 - RNA, 22 nt, Homo sapiens
aauagcauugaaucuaccaauu

SEQ ID NO: 114415 - RNA, 22 nt, Homo sapiens
aaucaacauuguuuuaagucaa

SEQ ID NO: 114416 - RNA, 22 nt, Homo sapiens
aaucaccaugcacuacagccuu

SEQ ID NO: 114417 - RNA, 22 nt, Homo sapiens
aaucagauuccagugguuggaa

SEQ ID NO: 114418 - RNA, 22 nt, Homo sapiens
aaucauauugucugccaagagg

SEQ ID NO: 114419 - RNA, 22 nt, Homo sapiens
aaugcauaauuuguaugaggua

SEQ ID NO: 114420 - RNA, 22 nt, Homo sapiens
aaugcuguguuauuucaugacc

SEQ ID NO: 114421 - RNA, 22 nt, Homo sapiens
aauggagcuguuuggaugacuu

SEQ ID NO: 114422 - RNA, 22 nt, Homo sapiens
aauggcagaugaaauugucauu

SEQ ID NO: 114423 - RNA, 22 nt, Homo sapiens
aaugucacugugguccuccagu

SEQ ID NO: 114424 - RNA, 22 nt, Homo sapiens
aaugugcuguucagaggagucc

SEQ ID NO: 114425 - RNA, 22 nt, Homo sapiens
aauucacuucuuuuaggcaggg

SEQ ID NO: 114426 - RNA, 22 nt, Homo sapiens
aauucacuuguggcagauccuu

SEQ ID NO: 114427 - RNA, 20 nt, Homo sapiens
acaaaugcauucugugacau

SEQ ID NO: 114428 - RNA, 22 nt, Homo sapiens
acaagcacaaauuuaauccugu

SEQ ID NO: 114429 - RNA, 22 nt, Homo sapiens
acacaguaagcacaguguagau

SEQ ID NO: 114430 - RNA, 22 nt, Homo sapiens
acacaguauaugacaaugcuuu

SEQ ID NO: 114431 - RNA, 22 nt, Homo sapiens
acaccaucuccuuauuucucuu

SEQ ID NO: 114432 - RNA, 22 nt, Homo sapiens
cugagcaagucauuuuguuaaa

SEQ ID NO: 114433 - RNA, 22 nt, Homo sapiens
cugagcuaguagcauuguguca

SEQ ID NO: 114434 - RNA, 22 nt, Homo sapiens
cugagcucauuucuuuugcuac

SEQ ID NO: 114435 - RNA, 22 nt, Homo sapiens
cugaggucugaauccagguauc

SEQ ID NO: 114436 - RNA, 22 nt, Homo sapiens
cugcauaaucaucucucugcau

SEQ ID NO: 114437 - RNA, 21 nt, Homo sapiens
cugcauccauuucugagugau

SEQ ID NO: 114438 - RNA, 22 nt, Homo sapiens
cugcuggucuuuaaggucuagg

SEQ ID NO: 114439 - RNA, 22 nt, Homo sapiens
cuggaagaaaaucacgccaucu

SEQ ID NO: 114440 - RNA, 18 nt, Homo sapiens
cuggaaggcuacuacagu

SEQ ID NO: 114441 - RNA, 22 nt, Homo sapiens
cuggaauucaaaaucugaauuu

SEQ ID NO: 114442 - RNA, 22 nt, Homo sapiens
cuggcgagacagcuccaucacu

SEQ ID NO: 114443 - RNA, 22 nt, Homo sapiens
cugucuagagggcacaugaugc

SEQ ID NO: 114444 - RNA, 22 nt, Homo sapiens
cugucucagugaauugguuuua

SEQ ID NO: 114445 - RNA, 22 nt, Homo sapiens
cugugcauucuuaaaucaggaa

SEQ ID NO: 114446 - RNA, 22 nt, Homo sapiens
cugugcuuggagucccccuagg

SEQ ID NO: 114447 - RNA, 22 nt, Homo sapiens
cugugguauuauuagaaauauc

SEQ ID NO: 114448 - RNA, 22 nt, Homo sapiens
cuguuuguuuaggguacucaga

SEQ ID NO: 114449 - RNA, 22 nt, Homo sapiens
cuuaaguaguuguggaaugaau

SEQ ID NO: 114450 - RNA, 22 nt, Homo sapiens
ggaaucugaaccaugggaaugg

SEQ ID NO: 114451 - RNA, 21 nt, Homo sapiens
ggaauguugccagcagccaga

SEQ ID NO: 114452 - RNA, 22 nt, Homo sapiens
ggagcucaucuagcauagaggu

SEQ ID NO: 114453 - RNA, 22 nt, Homo sapiens
ggaggcuaguaaaaagguagaa

SEQ ID NO: 114454 - RNA, 22 nt, Homo sapiens
ggauccaucuggaaauguggga

SEQ ID NO: 114455 - RNA, 23 nt, Homo sapiens
ggauggaaaguuuugagggccac

SEQ ID NO: 114456 - RNA, 22 nt, Homo sapiens
ggaugugugcacgcgcacaugc

SEQ ID NO: 114457 - RNA, 21 nt, Homo sapiens
ggcaagaaacacaaucaagua

SEQ ID NO: 114458 - RNA, 17 nt, Homo sapiens
ggcaagaaguggaacuc

SEQ ID NO: 114459 - RNA, 19 nt, Homo sapiens
ggcaagaguuguucugugu

SEQ ID NO: 114460 - RNA, 22 nt, Homo sapiens
ggcaauauauucugaauucagu

SEQ ID NO: 114461 - RNA, 22 nt, Homo sapiens
ggcaccauggaaggacgggagc

SEQ ID NO: 114462 - RNA, 22 nt, Homo sapiens
ggcaccauuuuacuccuucccu

SEQ ID NO: 114463 - RNA, 22 nt, Homo sapiens
ggcagcacaauuuucugaugga

SEQ ID NO: 114464 - RNA, 22 nt, Homo sapiens
ggcaguguauuacuuaggguuc

SEQ ID NO: 114465 - RNA, 22 nt, Homo sapiens
ggcaguuuguucuugcuccuuu

SEQ ID NO: 114466 - RNA, 22 nt, Homo sapiens
ggccagaugcaguggcucacac

SEQ ID NO: 114467 - RNA, 22 nt, Homo sapiens
gggaaauguaaagucauaagau

SEQ ID NO: 114468 - RNA, 22 nt, Homo sapiens
gggaacauggaaauucugcucu

SEQ ID NO: 114469 - RNA, 23 nt, Homo sapiens
gggauuguaaaauaugagggcag

SEQ ID NO: 114470 - RNA, 22 nt, Homo sapiens
gggcaacauugaguacccugaa

SEQ ID NO: 114471 - RNA, 22 nt, Homo sapiens
ggggcaaaaugccacgagucuc

SEQ ID NO: 114472 - RNA, 22 nt, Homo sapiens
ggggcauugugucuggguuccu

SEQ ID NO: 114473 - RNA, 22 nt, Homo sapiens
ggucccccuccacucucgcaaa

SEQ ID NO: 114474 - RNA, 22 nt, Homo sapiens
ggucuuggagaauuguccuggg

SEQ ID NO: 114475 - RNA, 22 nt, Homo sapiens
gguguuccccuuaccucuuggc

SEQ ID NO: 114476 - RNA, 20 nt, Homo sapiens
guaaacucucagcauagaug

SEQ ID NO: 114477 - RNA, 22 nt, Homo sapiens
guaaaucucuguuuucauggac

SEQ ID NO: 114478 - RNA, 18 nt, Homo sapiens
guaaauguaucuauugcc

SEQ ID NO: 114479 - RNA, 22 nt, Homo sapiens
guaacacucuaaagggaugcac

SEQ ID NO: 114480 - RNA, 22 nt, Homo sapiens
guaagguuguauuucaagaaac

SEQ ID NO: 114481 - RNA, 22 nt, Homo sapiens
guacaguuuagugcuuugagaa

SEQ ID NO: 114482 - RNA, 22 nt, Homo sapiens
guacauguaugcaugcaugcau

SEQ ID NO: 114483 - RNA, 22 nt, Homo sapiens
guagcagcaauuuacuccauac

SEQ ID NO: 114484 - RNA, 22 nt, Homo sapiens
guauacuucugaaaauagcuau

SEQ ID NO: 114485 - RNA, 22 nt, Homo sapiens
guauugacauuuuuaaggaacu

SEQ ID NO: 114486 - RNA, 19 nt, Homo sapiens
guauuugacuuucuuguuu

SEQ ID NO: 114487 - RNA, 19 nt, Homo sapiens
gucaaagucgguauucaaa

SEQ ID NO: 114488 - RNA, 22 nt, Homo sapiens
gucaaagugauuguaauuaggu

SEQ ID NO: 114489 - RNA, 22 nt, Homo sapiens
gucaaggaauuuauccauuucu

SEQ ID NO: 114490 - RNA, 22 nt, Homo sapiens
gucacaguguuuguucauccca

SEQ ID NO: 114491 - RNA, 22 nt, Homo sapiens
gucagaaucucagaugacaacg

SEQ ID NO: 114492 - RNA, 22 nt, Homo sapiens
gucagcuuguccagagacucug

SEQ ID NO: 114493 - RNA, 21 nt, Homo sapiens
gucauaugucucugauuagug

SEQ ID NO: 114494 - RNA, 22 nt, Homo sapiens
gucauugaaguggaaucaucca

SEQ ID NO: 114495 - RNA, 22 nt, Homo sapiens
gucauugagucagggaguaucu

SEQ ID NO: 114496 - RNA, 22 nt, Homo sapiens
guccaaagugggagaggugggg

SEQ ID NO: 114497 - RNA, 22 nt, Homo sapiens
guccaagacuaggaguuggcag

SEQ ID NO: 114498 - RNA, 22 nt, Homo sapiens
gucuaguuuuaauacauuaaga

SEQ ID NO: 114499 - RNA, 22 nt, Homo sapiens
gucuggagacuugggucaucaa

SEQ ID NO: 114500 - RNA, 22 nt, Homo sapiens
gucuggguuuguuuguacuugc

SEQ ID NO: 114501 - RNA, 22 nt, Homo sapiens
gucuuggcaugugcagcuggga

SEQ ID NO: 114502 - RNA, 22 nt, Homo sapiens
gucuuugaugucuaugugcuuc

SEQ ID NO: 114503 - RNA, 22 nt, Homo sapiens
gugaaagauuaaaccagugugu

SEQ ID NO: 114504 - RNA, 22 nt, Homo sapiens
gugaaagcaucugacugugcca

SEQ ID NO: 114505 - RNA, 22 nt, Homo sapiens
gugacagucaaagacaugacuu

SEQ ID NO: 114506 - RNA, 22 nt, Homo sapiens
gugacauuuuuacugaugagag

SEQ ID NO: 114507 - RNA, 22 nt, Homo sapiens
gugaccucuguugcugucacua

SEQ ID NO: 114508 - RNA, 22 nt, Homo sapiens
gugacugcauauaaguguaugu

SEQ ID NO: 114509 - RNA, 22 nt, Homo sapiens
gugagaggaggcagcuuuuaca

SEQ ID NO: 114510 - RNA, 22 nt, Homo sapiens
gugagcuccucucuauguguca

SEQ ID NO: 114511 - RNA, 22 nt, Homo sapiens
gugagcuccucuucugcugcag

SEQ ID NO: 114512 - RNA, 22 nt, Homo sapiens
gugaggcugguccugccuccca

SEQ ID NO: 114513 - RNA, 22 nt, Homo sapiens
gugaucauuguauugggguuau

SEQ ID NO: 114514 - RNA, 23 nt, Homo sapiens
gugaucauuguuguggguugaau

SEQ ID NO: 114515 - RNA, 22 nt, Homo sapiens
gugaucuuucaggcuugaccau

SEQ ID NO: 114516 - RNA, 22 nt, Homo sapiens
gugcaaccaucaccacugacuc

SEQ ID NO: 114517 - RNA, 21 nt, Homo sapiens
gugcacaguaguguuuaauag

SEQ ID NO: 114518 - RNA, 22 nt, Homo sapiens
gugcacaucgugcagguuuguu

SEQ ID NO: 114519 - RNA, 22 nt, Homo sapiens
gugcacgucuuaggaggucacg

SEQ ID NO: 114520 - RNA, 22 nt, Homo sapiens
gugcauauaaguuguuucuagu

SEQ ID NO: 114521 - RNA, 22 nt, Homo sapiens
gugcauaugcaugugcaugcac

SEQ ID NO: 114522 - RNA, 22 nt, Homo sapiens
gugcauguccacuaguccauau

SEQ ID NO: 114523 - RNA, 22 nt, Homo sapiens
gugccacaguguuaagggauuc

SEQ ID NO: 114524 - RNA, 21 nt, Homo sapiens
gugcuuguagccucacuucug

SEQ ID NO: 114525 - RNA, 22 nt, Homo sapiens
guggaaagaacacaaaauuagg

SEQ ID NO: 114526 - RNA, 17 nt, Homo sapiens
guggauagaacaaugaa

SEQ ID NO: 114527 - RNA, 22 nt, Homo sapiens
guggcagaaaagagaagcaaug

SEQ ID NO: 114528 - RNA, 22 nt, Homo sapiens
guggcagaacagguaggguucu

SEQ ID NO: 114529 - RNA, 22 nt, Homo sapiens
guggcagagucagagggaaaug

SEQ ID NO: 114530 - RNA, 22 nt, Homo sapiens
guggcuaaagauuuggaaucug

SEQ ID NO: 114531 - RNA, 20 nt, Homo sapiens
gugggcaaauccuuuccucu

SEQ ID NO: 114532 - RNA, 22 nt, Homo sapiens
gugggcucguucguguuagaca

SEQ ID NO: 114533 - RNA, 22 nt, Homo sapiens
gugggguaggguaggacucaac

SEQ ID NO: 114534 - RNA, 22 nt, Homo sapiens
gugguagaaauguagaugcuag

SEQ ID NO: 114535 - RNA, 22 nt, Homo sapiens
guggucagaaaucucaguggca

SEQ ID NO: 114536 - RNA, 18 nt, Homo sapiens
gugucugguuaugggagu

SEQ ID NO: 114537 - RNA, 22 nt, Homo sapiens
ucacauuaagcuguuauuucuu

SEQ ID NO: 114538 - RNA, 22 nt, Homo sapiens
ucaccaccuuccaggaccacug

SEQ ID NO: 114539 - RNA, 22 nt, Homo sapiens
ucaccuggagacaugaagacug

SEQ ID NO: 114540 - RNA, 22 nt, Homo sapiens
ucacugggagcauuugagccuu

SEQ ID NO: 114541 - RNA, 22 nt, Homo sapiens
ucacuuggugaacacauuaugu

SEQ ID NO: 114542 - RNA, 22 nt, Homo sapiens
ucagaacugauacuagaacuuu

SEQ ID NO: 114543 - RNA, 22 nt, Homo sapiens
ucagaccauuucauuacagacu

SEQ ID NO: 114544 - RNA, 22 nt, Homo sapiens
ucagagcaaagacacuuuauca

SEQ ID NO: 114545 - RNA, 22 nt, Homo sapiens
ucagaguagagcgacuucuccu

SEQ ID NO: 114546 - RNA, 18 nt, Homo sapiens
ucagagugcagacuauac

SEQ ID NO: 114547 - RNA, 22 nt, Homo sapiens
ucagauacuggugacaugaaug

SEQ ID NO: 114548 - RNA, 22 nt, Homo sapiens
ucagcaaugaccuaagcaaaua

SEQ ID NO: 114549 - RNA, 19 nt, Homo sapiens
ucagcaguaaucaacuuca

SEQ ID NO: 114550 - RNA, 22 nt, Homo sapiens
ucagguagcauuuuggaaacag

SEQ ID NO: 114551 - RNA, 22 nt, Homo sapiens
ucagguagugccaugauugauu

SEQ ID NO: 114552 - RNA, 22 nt, Homo sapiens
ucaguacuuuggagcucacaua

SEQ ID NO: 114553 - RNA, 22 nt, Homo sapiens
ucaguagcauugcuuauacagu

SEQ ID NO: 114554 - RNA, 22 nt, Homo sapiens
ucagugguuaaaagauucuaga

SEQ ID NO: 114555 - RNA, 22 nt, Homo sapiens
ucauaucauuagaucuacugua

SEQ ID NO: 114556 - RNA, 22 nt, Homo sapiens
ucaucagugcuugcaaauuauu

SEQ ID NO: 114557 - RNA, 22 nt, Homo sapiens
ucaucucaguuucuugccguac

SEQ ID NO: 114558 - RNA, 22 nt, Homo sapiens
ucaugaccaugguauagaccac

SEQ ID NO: 114559 - RNA, 19 nt, Homo sapiens
ucauggcuuuuucagcugu

SEQ ID NO: 114560 - RNA, 22 nt, Homo sapiens
ucaugucuuguuguauuuauuu

SEQ ID NO: 114561 - RNA, 22 nt, Homo sapiens
uccaauguaaucaucauugaau

SEQ ID NO: 114562 - RNA, 22 nt, Homo sapiens
uccacagugguggaauuguuca

SEQ ID NO: 114563 - RNA, 20 nt, Homo sapiens
uccacugagcgucacggcag

SEQ ID NO: 114564 - RNA, 22 nt, Homo sapiens
uccacuuuugugcugaauugga

SEQ ID NO: 114565 - RNA, 21 nt, Homo sapiens
uccagcuuugagaguuguggu

SEQ ID NO: 114566 - RNA, 22 nt, Homo sapiens
uccagguuucaugcucuuuauu

SEQ ID NO: 114567 - RNA, 19 nt, Homo sapiens
uccaugagcccacagugau

SEQ ID NO: 114568 - RNA, 22 nt, Homo sapiens
uccauugucuagauguaacaca

SEQ ID NO: 114569 - RNA, 22 nt, Homo sapiens
ucccaagaugagaugggggcug

SEQ ID NO: 114570 - RNA, 22 nt, Homo sapiens
ucccaguuuuucugaauaguca

SEQ ID NO: 114571 - RNA, 22 nt, Homo sapiens
uccccugagaccccucagcacu

SEQ ID NO: 114572 - RNA, 22 nt, Homo sapiens
uccccugagucaccugcuucuc

SEQ ID NO: 114573 - RNA, 22 nt, Homo sapiens
ucccgaggacaucugggggcaa

SEQ ID NO: 114574 - RNA, 22 nt, Homo sapiens
ucccugacagggucugagcuuu

SEQ ID NO: 114575 - RNA, 22 nt, Homo sapiens
ucccuggacagccuugccuggg

SEQ ID NO: 114576 - RNA, 22 nt, Homo sapiens
ucccuugguaauucuguuccuu

SEQ ID NO: 114577 - RNA, 22 nt, Homo sapiens
uccucauggagaaccucugcua

SEQ ID NO: 114578 - RNA, 22 nt, Homo sapiens
uccugcauucugacuugcuuuc

SEQ ID NO: 114579 - RNA, 22 nt, Homo sapiens
uccuucacucuacaucuuuguu

SEQ ID NO: 114580 - RNA, 22 nt, Homo sapiens
uccuugagucuuugcucagaug

SEQ ID NO: 114581 - RNA, 22 nt, Homo sapiens
ucgcagcacgagcaugcaaggu

SEQ ID NO: 114582 - RNA, 22 nt, Homo sapiens
ucgcugggaagacugaaguguc

SEQ ID NO: 114583 - RNA, 22 nt, Homo sapiens
ucuauugguugaaauugcuuuu

SEQ ID NO: 114584 - RNA, 22 nt, Homo sapiens
ucucagugaaauaaauuauuuu

SEQ ID NO: 114585 - RNA, 22 nt, Homo sapiens
ucucagugugguaaaaguuuuu

SEQ ID NO: 114586 - RNA, 22 nt, Homo sapiens
ucuccauugaaauggacauaau

SEQ ID NO: 114587 - RNA, 22 nt, Homo sapiens
ucucccauccaugaacuucugu

SEQ ID NO: 114588 - RNA, 22 nt, Homo sapiens
ucucugaaacucuugacauccu

SEQ ID NO: 114589 - RNA, 22 nt, Homo sapiens
ucugagcaauaaacaacauauu

SEQ ID NO: 114590 - RNA, 22 nt, Homo sapiens
ucuggccuagaacaauuaauua

SEQ ID NO: 114591 - RNA, 22 nt, Homo sapiens
ucuggccuccuaugagaaucga

SEQ ID NO: 114592 - RNA, 22 nt, Homo sapiens
ucugguguuauucauguaguuu

SEQ ID NO: 114593 - RNA, 22 nt, Homo sapiens
ucugugaaugaacacuugaaaa

SEQ ID NO: 114594 - RNA, 22 nt, Homo sapiens
ucugugcauggcagaggaauga

SEQ ID NO: 114595 - RNA, 22 nt, Homo sapiens
ucuguggugggcuccacccagu

SEQ ID NO: 114596 - RNA, 22 nt, Homo sapiens
ucuguuguuguuuuaagagaca

SEQ ID NO: 114597 - RNA, 22 nt, Homo sapiens
ucuuauuuggggaaaggguccu

SEQ ID NO: 114598 - RNA, 22 nt, Homo sapiens
ucuugcaguucccaaauucaca

SEQ ID NO: 114599 - RNA, 23 nt, Homo sapiens
ucuugguuauagaaaaauaguug

SEQ ID NO: 114600 - RNA, 22 nt, Homo sapiens
ucuuuuguucuauucaggccuu

SEQ ID NO: 114601 - RNA, 22 nt, Homo sapiens
ugaaagcuacagucuccuagga

SEQ ID NO: 114602 - RNA, 22 nt, Homo sapiens
ugaaaucauguaguuauugcaa

SEQ ID NO: 114603 - RNA, 22 nt, Homo sapiens
ugaaaucuaaaauguuccaaga

SEQ ID NO: 114604 - RNA, 22 nt, Homo sapiens
ugaaaugaucaguuugguuacu

SEQ ID NO: 114605 - RNA, 22 nt, Homo sapiens
ugaaaugccuugagauuuugac

SEQ ID NO: 114606 - RNA, 22 nt, Homo sapiens
ugaaauguaaguugucuagucu

SEQ ID NO: 114607 - RNA, 22 nt, Homo sapiens
ugaacuguugggggaaauucag

SEQ ID NO: 114608 - RNA, 22 nt, Homo sapiens
ugaaggccgggcaugguggcuc

SEQ ID NO: 114609 - RNA, 22 nt, Homo sapiens
ugaaguaauguuuuauucuauu

SEQ ID NO: 114610 - RNA, 22 nt, Homo sapiens
ugaauauuugcuacucacucuu

SEQ ID NO: 114611 - RNA, 22 nt, Homo sapiens
ugaauuguuuacgagaugugag

SEQ ID NO: 114612 - RNA, 22 nt, Homo sapiens
ugaauuguuucauucuuuacau

SEQ ID NO: 114613 - RNA, 20 nt, Homo sapiens
ugacaagugagaauuauggg

SEQ ID NO: 114614 - RNA, 22 nt, Homo sapiens
ugacacuugcccuuagaaacau

SEQ ID NO: 114615 - RNA, 17 nt, Homo sapiens
ugacagaaacuuguugu

SEQ ID NO: 114616 - RNA, 22 nt, Homo sapiens
ugacagcugaagauguugaacc

SEQ ID NO: 114617 - RNA, 22 nt, Homo sapiens
ugacagguugauaggugcagca

SEQ ID NO: 114618 - RNA, 22 nt, Homo sapiens
ugacauggagagagaagccuuu

SEQ ID NO: 114619 - RNA, 22 nt, Homo sapiens
ugacauguauuagcucagugcu

SEQ ID NO: 114620 - RNA, 21 nt, Homo sapiens
ugacauguugguguucugcac

SEQ ID NO: 114621 - RNA, 22 nt, Homo sapiens
ugacauuacagucacuugcugu

SEQ ID NO: 114622 - RNA, 22 nt, Homo sapiens
ugacuauaguaaucacuucaca

SEQ ID NO: 114623 - RNA, 22 nt, Homo sapiens
ugacuuuagaauuuuauccaga

SEQ ID NO: 114624 - RNA, 22 nt, Homo sapiens
ugagaauauuuuccaugucuca

SEQ ID NO: 114625 - RNA, 22 nt, Homo sapiens
ucuuugguaauggaugucugau

SEQ ID NO: 114626 - RNA, 21 nt, Homo sapiens
ucuuuggucaccaguuuucau

SEQ ID NO: 114627 - RNA, 22 nt, Homo sapiens
ucuuugucuacauccuguuaaa

SEQ ID NO: 114628 - RNA, 22 nt, Homo sapiens
ucuuuguuuucugauccugaag

SEQ ID NO: 114629 - RNA, 22 nt, Homo sapiens
ugaaacacaccuccucuccauc

SEQ ID NO: 114630 - RNA, 22 nt, Homo sapiens
ugaaagacugaagaauaggcau

SEQ ID NO: 114631 - RNA, 22 nt, Homo sapiens
ugaagaucuuaggagcugaggg

SEQ ID NO: 114632 - RNA, 19 nt, Homo sapiens
ugaaguauagggcuucuga

SEQ ID NO: 114633 - RNA, 22 nt, Homo sapiens
ugaauacagcacacccaugggu

SEQ ID NO: 114634 - RNA, 22 nt, Homo sapiens
ugaauauguuucuaaaagugca

SEQ ID NO: 114635 - RNA, 21 nt, Homo sapiens
ugaaugcuuuaaauauuagaa

SEQ ID NO: 114636 - RNA, 22 nt, Homo sapiens
ugaauguaacuaaaccugugaa

SEQ ID NO: 114637 - RNA, 22 nt, Homo sapiens
ugaauguaagaugucugcuggu

SEQ ID NO: 114638 - RNA, 20 nt, Homo sapiens
ugaauguaauuacagaugua

SEQ ID NO: 114639 - RNA, 22 nt, Homo sapiens
ugaauguacacgcguacuuguu

SEQ ID NO: 114640 - RNA, 22 nt, Homo sapiens
ugaauugucucucacuggguuc

SEQ ID NO: 114641 - RNA, 22 nt, Homo sapiens
ugacaagcucccucugcaccuu

SEQ ID NO: 114642 - RNA, 22 nt, Homo sapiens
ugacaagggaaaugcaaaaugu

SEQ ID NO: 114643 - RNA, 22 nt, Homo sapiens
ugacacagcaagauggaaccau

SEQ ID NO: 114644 - RNA, 21 nt, Homo sapiens
ugacagaaaauugaguuugcu

SEQ ID NO: 114645 - RNA, 22 nt, Homo sapiens
ugacagucaccaggacccacag

SEQ ID NO: 114646 - RNA, 22 nt, Homo sapiens
ugacaguguccuccuccugaga

SEQ ID NO: 114647 - RNA, 22 nt, Homo sapiens
ugacaugaaggcaccucugucc

SEQ ID NO: 114648 - RNA, 22 nt, Homo sapiens
ugacauggaaguagguauacau

SEQ ID NO: 114649 - RNA, 22 nt, Homo sapiens
ugacauguugcauuauauuucc

SEQ ID NO: 114650 - RNA, 22 nt, Homo sapiens
ugacucaguuguuagucuucau

SEQ ID NO: 114651 - RNA, 23 nt, Homo sapiens
ugacuggagacuguugauccuuu

SEQ ID NO: 114652 - RNA, 22 nt, Homo sapiens
ugacuugaucauuacacauucu

SEQ ID NO: 114653 - RNA, 22 nt, Homo sapiens
ugagaacauuccucuuccuggc

SEQ ID NO: 114654 - RNA, 22 nt, Homo sapiens
ugagaacggauacuaagggcug

SEQ ID NO: 114655 - RNA, 22 nt, Homo sapiens
ugagaaugaugauuuccaguuu

SEQ ID NO: 114656 - RNA, 22 nt, Homo sapiens
ugagaaugcagaaucucgugca

SEQ ID NO: 114657 - RNA, 22 nt, Homo sapiens
ugagaauguagggcucucccag

SEQ ID NO: 114658 - RNA, 22 nt, Homo sapiens
uggagagucauuuauaguauuu

SEQ ID NO: 114659 - RNA, 22 nt, Homo sapiens
uggagauguuuaaaauccacug

SEQ ID NO: 114660 - RNA, 22 nt, Homo sapiens
uggagggcuagucauuucuuuu

SEQ ID NO: 114661 - RNA, 22 nt, Homo sapiens
uggagugcaauggcaccaucuu

SEQ ID NO: 114662 - RNA, 22 nt, Homo sapiens
uggauagaaauguacuguuuuc

SEQ ID NO: 114663 - RNA, 22 nt, Homo sapiens
uggaucuguucuauuuaucuga

SEQ ID NO: 114664 - RNA, 22 nt, Homo sapiens
uggcaaaaaaccgcaguugccu

SEQ ID NO: 114665 - RNA, 21 nt, Homo sapiens
uggcaaaaugggcaguggguu

SEQ ID NO: 114666 - RNA, 22 nt, Homo sapiens
uggcaaagugugacgugggggu

SEQ ID NO: 114667 - RNA, 22 nt, Homo sapiens
uggcaagaacgaaauguagggu

SEQ ID NO: 114668 - RNA, 22 nt, Homo sapiens
uggcaauauccacaauuacuuu

SEQ ID NO: 114669 - RNA, 22 nt, Homo sapiens
uggcaauguggaaugguccagg

SEQ ID NO: 114670 - RNA, 19 nt, Homo sapiens
uggcacauguauacauaug

SEQ ID NO: 114671 - RNA, 19 nt, Homo sapiens
uggcacuugacguccggau

SEQ ID NO: 114672 - RNA, 22 nt, Homo sapiens
uggcaguuuacagcuuuaggag

SEQ ID NO: 114673 - RNA, 22 nt, Homo sapiens
uggccagagggcaauuagcugu

SEQ ID NO: 114674 - RNA, 22 nt, Homo sapiens
uggccagugucggaggccagga

SEQ ID NO: 114675 - RNA, 22 nt, Homo sapiens
uggccaguuuuuaauugggucu

SEQ ID NO: 114676 - RNA, 22 nt, Homo sapiens
uggcgggaaaguugggagaaga

SEQ ID NO: 114677 - RNA, 22 nt, Homo sapiens
uggcuacugacugaugauuaua

SEQ ID NO: 114678 - RNA, 22 nt, Homo sapiens
uggcuauuucgucaugcucccc

SEQ ID NO: 114679 - RNA, 22 nt, Homo sapiens
uggcuguuguuacuaacaguuc

SEQ ID NO: 114680 - RNA, 22 nt, Homo sapiens
uggcuuuuaucuacucucaacu

SEQ ID NO: 114681 - RNA, 22 nt, Homo sapiens
ugggcaaaacuaagagcugugg

SEQ ID NO: 114682 - RNA, 22 nt, Homo sapiens
ugggcuagaugcuuugggguca

SEQ ID NO: 114683 - RNA, 22 nt, Homo sapiens
uggguaauggagaaauaaaucu

SEQ ID NO: 114684 - RNA, 22 nt, Homo sapiens
uggguagagaaucaggaucuua

SEQ ID NO: 114685 - RNA, 23 nt, Homo sapiens
ugggucaguuuuucugacaucau

SEQ ID NO: 114686 - RNA, 23 nt, Homo sapiens
uggguucauucuugaagucagug

SEQ ID NO: 114687 - RNA, 22 nt, Homo sapiens
ugguacuucaugcucacagaua

SEQ ID NO: 114688 - RNA, 22 nt, Homo sapiens
uggucaccuucuugcucugucu

SEQ ID NO: 114689 - RNA, 22 nt, Homo sapiens
uggucagaugcugaguggaucu

SEQ ID NO: 114690 - RNA, 22 nt, Homo sapiens
uggucauggaaauagaaugcac

SEQ ID NO: 114691 - RNA, 22 nt, Homo sapiens
uggugcccuguccuucuguggc

SEQ ID NO: 114692 - RNA, 22 nt, Homo sapiens
uggugccgugguccuggggcca

SEQ ID NO: 114693 - RNA, 22 nt, Homo sapiens
uguaaaucuauuuuuaguguuu

SEQ ID NO: 114694 - RNA, 22 nt, Homo sapiens
uguaaugaucaaaucagaguaa

SEQ ID NO: 114695 - RNA, 22 nt, Homo sapiens
uguauacauauguauguuuugu

SEQ ID NO: 114696 - RNA, 22 nt, Homo sapiens
uguaugagagacauggcugcuu

SEQ ID NO: 114697 - RNA, 22 nt, Homo sapiens
uguaugucugcucuuuggaacu

SEQ ID NO: 114698 - RNA, 22 nt, Homo sapiens
ugucaaagagacaucugcacuc

SEQ ID NO: 114699 - RNA, 22 nt, Homo sapiens
ugucaccauuuguaggugagga

SEQ ID NO: 114700 - RNA, 22 nt, Homo sapiens
ugucagaaucuagaggcugcua

SEQ ID NO: 114701 - RNA, 22 nt, Homo sapiens
ugucagcacaacucagguuccu

SEQ ID NO: 114702 - RNA, 22 nt, Homo sapiens
ugucaggaggguccagagaaaa

SEQ ID NO: 114703 - RNA, 22 nt, Homo sapiens
ugucauuggacuucuuucaugg

SEQ ID NO: 114704 - RNA, 22 nt, Homo sapiens
uguccugcagagguguuugccu

SEQ ID NO: 114705 - RNA, 22 nt, Homo sapiens
uguccuguaggaggcagaacaa

SEQ ID NO: 114706 - RNA, 22 nt, Homo sapiens
ugucuuggacuugaaucucauu

SEQ ID NO: 114707 - RNA, 22 nt, Homo sapiens
ugugaaugaagaaugcuaaccu

SEQ ID NO: 114708 - RNA, 22 nt, Homo sapiens
ugugaauguaaccuuauuugga

SEQ ID NO: 114709 - RNA, 22 nt, Homo sapiens
ugugacagcacgguucaacugc

SEQ ID NO: 114710 - RNA, 22 nt, Homo sapiens
ugugcauaugucuuuauaguag

SEQ ID NO: 114711 - RNA, 22 nt, Homo sapiens
ugugccacugcacucugggcaa

SEQ ID NO: 114712 - RNA, 22 nt, Homo sapiens
ugugccuaguaauguguccaga

SEQ ID NO: 114713 - RNA, 22 nt, Homo sapiens
ugugcuaaaaugggacuucuaa

SEQ ID NO: 114714 - RNA, 22 nt, Homo sapiens
ugugggaggugcuaauguaaau

SEQ ID NO: 114715 - RNA, 22 nt, Homo sapiens
ugugguccucugaaggcuuuuc

SEQ ID NO: 114716 - RNA, 22 nt, Homo sapiens
uguguaaauacaagugcuugaa

SEQ ID NO: 114717 - RNA, 22 nt, Homo sapiens
uguguagagaaauauuacuuau

SEQ ID NO: 114718 - RNA, 22 nt, Homo sapiens
ugugucuacugagaugaucaug

SEQ ID NO: 114719 - RNA, 22 nt, Homo sapiens
uguguuuuuauguaaaauggaa

SEQ ID NO: 114720 - RNA, 22 nt, Homo sapiens
uguuacagcagaauugaaagag

SEQ ID NO: 114721 - RNA, 22 nt, Homo sapiens
uguuacagcagaauugauugca

SEQ ID NO: 114722 - RNA, 22 nt, Homo sapiens
uguucauggauccaguggcuuc

SEQ ID NO: 114723 - RNA, 22 nt, Homo sapiens
uguucuggagaggcaggccaca

SEQ ID NO: 114724 - RNA, 22 nt, Homo sapiens
uuaaagcuggcguuacaguuug

SEQ ID NO: 114725 - RNA, 22 nt, Homo sapiens
uuaaaggcaugguuagacaugg

SEQ ID NO: 114726 - RNA, 22 nt, Homo sapiens
uuaaauacagcaugguguuucu

SEQ ID NO: 114727 - RNA, 20 nt, Homo sapiens
uuaaaucuagugcagacuca

SEQ ID NO: 114728 - RNA, 22 nt, Homo sapiens
uuaaaugcacauacuugagaaa

SEQ ID NO: 114729 - RNA, 22 nt, Homo sapiens
uuaaaugcucacauaaagguag

SEQ ID NO: 114730 - RNA, 22 nt, Homo sapiens
uuaacagucacuuagcucauuu

SEQ ID NO: 114731 - RNA, 23 nt, Homo sapiens
uuaagcaacggcugcuuuucaga

SEQ ID NO: 114732 - RNA, 22 nt, Homo sapiens
uuaagguuuuuguagcaaggau

SEQ ID NO: 114733 - RNA, 22 nt, Homo sapiens
uuaagucacacuagacaacuga

SEQ ID NO: 114734 - RNA, 22 nt, Homo sapiens
uuaagugcucaguuacucaguu

SEQ ID NO: 114735 - RNA, 23 nt, Homo sapiens
uuaagugcuuuucugaaacucuu

SEQ ID NO: 114736 - RNA, 19 nt, Homo sapiens
uuaagugugauaucucagu

SEQ ID NO: 114737 - RNA, 22 nt, Homo sapiens
uuaauacugcuuaacuuuagga

SEQ ID NO: 114738 - RNA, 22 nt, Homo sapiens
uuacaagaugucuguccaacac

SEQ ID NO: 114739 - RNA, 21 nt, Homo sapiens
uuacaauggcuccuugaaggu

SEQ ID NO: 114740 - RNA, 22 nt, Homo sapiens
uuacagucaaguuacauuucuc

SEQ ID NO: 114741 - RNA, 20 nt, Homo sapiens
uuacagugggaccuuccuga

SEQ ID NO: 114742 - RNA, 22 nt, Homo sapiens
uuacaugcaugacaaggugcca

SEQ ID NO: 114743 - RNA, 22 nt, Homo sapiens
uuacugcuuaagugauucaaca

SEQ ID NO: 114744 - RNA, 22 nt, Homo sapiens
uuagaacagugcucaccacaaa

SEQ ID NO: 114745 - RNA, 20 nt, Homo sapiens
uuagaguaguaugauuuaua

SEQ ID NO: 114746 - RNA, 22 nt, Homo sapiens
uuagcagugucccacuccuugg

SEQ ID NO: 114747 - RNA, 22 nt, Homo sapiens
uuagcccaucuugaggaaagua

SEQ ID NO: 114748 - RNA, 22 nt, Homo sapiens
uuaggcaggauaguuacauauu

SEQ ID NO: 114749 - RNA, 21 nt, Homo sapiens
uuaggcagugucagaggugag

SEQ ID NO: 114750 - RNA, 22 nt, Homo sapiens
uuaggcaguuuauugauuuuca

SEQ ID NO: 114751 - RNA, 22 nt, Homo sapiens
uuagguagucucugucagaggg

SEQ ID NO: 114752 - RNA, 22 nt, Homo sapiens
uuaguucccucauucuugacuu

SEQ ID NO: 114753 - RNA, 22 nt, Homo sapiens
uuauagcuaacaucugugaaaa

SEQ ID NO: 114754 - RNA, 21 nt, Homo sapiens
uuauaguggcaugauuuauaa

SEQ ID NO: 114755 - RNA, 22 nt, Homo sapiens
uuauccagcgcuguuuuggaga

SEQ ID NO: 114756 - RNA, 22 nt, Homo sapiens
uuaucucagugaacugagugga

SEQ ID NO: 114757 - RNA, 22 nt, Homo sapiens
uuauuauguuggugcaaaggua

SEQ ID NO: 114758 - RNA, 17 nt, Homo sapiens
uuauugcuauaagcuga

SEQ ID NO: 114759 - RNA, 22 nt, Homo sapiens
uucaaaguguugguuuugggcu

SEQ ID NO: 114760 - RNA, 22 nt, Homo sapiens
uucacacugggccuacucugug

SEQ ID NO: 114761 - RNA, 22 nt, Homo sapiens
uucacaguacucccuggaauua

SEQ ID NO: 114762 - RNA, 22 nt, Homo sapiens
uucaccagggaagucucaacuc

SEQ ID NO: 114763 - RNA, 22 nt, Homo sapiens
uucacugcacuccagccugggu

SEQ ID NO: 114764 - RNA, 22 nt, Homo sapiens
uucaggcuccgugccagcuccg

SEQ ID NO: 114765 - RNA, 22 nt, Homo sapiens
uucagggcauuggaguuucuga

SEQ ID NO: 114766 - RNA, 22 nt, Homo sapiens
uucaggguggagaguaugaggu

SEQ ID NO: 114767 - RNA, 23 nt, Homo sapiens
uucaguauugaaugauggcgcug

SEQ ID NO: 114768 - RNA, 22 nt, Homo sapiens
uucaguucugcacugaucuuag

SEQ ID NO: 114769 - RNA, 22 nt, Homo sapiens
uucaguugcaucaguugaccag

SEQ ID NO: 114770 - RNA, 18 nt, Homo sapiens
uucaguuuguaucugggg

SEQ ID NO: 114771 - RNA, 22 nt, Homo sapiens
uucauaguucuuuuagucauua

SEQ ID NO: 114772 - RNA, 18 nt, Homo sapiens
uucauauguugaaccaga

SEQ ID NO: 114773 - RNA, 21 nt, Homo sapiens
uucaucagccagaaaucaagc

SEQ ID NO: 114774 - RNA, 22 nt, Homo sapiens
uuccacagggauuugcauugau

SEQ ID NO: 114775 - RNA, 22 nt, Homo sapiens
uuccacuuuuuccuugugcucc

SEQ ID NO: 114776 - RNA, 22 nt, Homo sapiens
uuccaguggaguaaauggacaa

SEQ ID NO: 114777 - RNA, 22 nt, Homo sapiens
uuccaguguuugacucaccuuu

SEQ ID NO: 114778 - RNA, 22 nt, Homo sapiens
uuccaugagaugcaucaaagcu

SEQ ID NO: 114779 - RNA, 22 nt, Homo sapiens
uucccauuguuggccagcaugu

SEQ ID NO: 114780 - RNA, 22 nt, Homo sapiens
uucccuugcaggaugaucugga

SEQ ID NO: 114781 - RNA, 22 nt, Homo sapiens
uucccuuugaaacuaaacuugc

SEQ ID NO: 114782 - RNA, 19 nt, Homo sapiens
uuccuagugguugggaagu

SEQ ID NO: 114783 - RNA, 22 nt, Homo sapiens
uuccugugacuguguggcaccc

SEQ ID NO: 114784 - RNA, 22 nt, Homo sapiens
uucucaguuccuacuuugguga

SEQ ID NO: 114785 - RNA, 22 nt, Homo sapiens
uucugacuggugugagauggua

SEQ ID NO: 114786 - RNA, 22 nt, Homo sapiens
uucugguuaauacuugcaaaaa

SEQ ID NO: 114787 - RNA, 22 nt, Homo sapiens
uucuguguuuaggucacggcua

SEQ ID NO: 114788 - RNA, 22 nt, Homo sapiens
uucuuagguuaaggcugagaga

SEQ ID NO: 114789 - RNA, 22 nt, Homo sapiens
uucuuagucaaguuguauuuca

SEQ ID NO: 114790 - RNA, 22 nt, Homo sapiens
auuggcaauccauauauuuucu

SEQ ID NO: 114791 - RNA, 22 nt, Homo sapiens
auuggcaauguacauaucuugc

SEQ ID NO: 114792 - RNA, 22 nt, Homo sapiens
auuggccaaugggacgucagca

SEQ ID NO: 114793 - RNA, 22 nt, Homo sapiens
auugucacuuaaaagugcaugu

SEQ ID NO: 114794 - RNA, 22 nt, Homo sapiens
auuguguagucuuacugcuugc

SEQ ID NO: 114795 - RNA, 19 nt, Homo sapiens
auuuccuggagcuggucuc

SEQ ID NO: 114796 - RNA, 22 nt, Homo sapiens
auuuggcauagaguaucauucu

SEQ ID NO: 114797 - RNA, 22 nt, Homo sapiens
auuugucacuauguggcuaaua

SEQ ID NO: 114798 - RNA, 22 nt, Homo sapiens
auuuguccugccuuuuccuccu

SEQ ID NO: 114799 - RNA, 22 nt, Homo sapiens
caaagugcugggaugggccagg

SEQ ID NO: 114800 - RNA, 22 nt, Homo sapiens
caaauccucaccucaucaugaa

SEQ ID NO: 114801 - RNA, 22 nt, Homo sapiens
caagagagcugaugguuuuaaa

SEQ ID NO: 114802 - RNA, 22 nt, Homo sapiens
caaggaauucucaauagaguua

SEQ ID NO: 114803 - RNA, 21 nt, Homo sapiens
caaugacacuguagcugugcu

SEQ ID NO: 114804 - RNA, 22 nt, Homo sapiens
caauggcaaugaaauagugaga

SEQ ID NO: 114805 - RNA, 22 nt, Homo sapiens
cacagggcuaacauuuuugccc

SEQ ID NO: 114806 - RNA, 22 nt, Homo sapiens
cacagugaacugguggguuuuu

SEQ ID NO: 114807 - RNA, 19 nt, Homo sapiens
caccagugcaugcuacuau

SEQ ID NO: 114808 - RNA, 22 nt, Homo sapiens
cacugcaauuacuuuugcacca

SEQ ID NO: 114809 - RNA, 22 nt, Homo sapiens
cacugcacuccaguuuggauga

SEQ ID NO: 114810 - RNA, 22 nt, Homo sapiens
uuugcacucaguaagugggagc

SEQ ID NO: 114811 - RNA, 22 nt, Homo sapiens
uuugcacuugaaaacacucuca

SEQ ID NO: 114812 - RNA, 22 nt, Homo sapiens
uuugcagagacuuguuaggaau

SEQ ID NO: 114813 - RNA, 22 nt, Homo sapiens
uuugcagugucagcuucugugu

SEQ ID NO: 114814 - RNA, 22 nt, Homo sapiens
uuuggcccccagcucaggacau

SEQ ID NO: 114815 - RNA, 22 nt, Homo sapiens
uuuggcucugugucccacccaa

SEQ ID NO: 114816 - RNA, 22 nt, Homo sapiens
uuugggccauggcuuuuccacg

SEQ ID NO: 114817 - RNA, 22 nt, Homo sapiens
uuuguacuaugguuuuucacua

SEQ ID NO: 114818 - RNA, 22 nt, Homo sapiens
uuuguacuucauugguucuacu

SEQ ID NO: 114819 - RNA, 22 nt, Homo sapiens
uuuguagcucacucugagcuga

SEQ ID NO: 114820 - RNA, 21 nt, Homo sapiens
uuuguaguagcaugauuuaua

SEQ ID NO: 114821 - RNA, 22 nt, Homo sapiens
uuuguccccgcccagaucucau

SEQ ID NO: 114822 - RNA, 22 nt, Homo sapiens
uuugugagguggauagauugca

SEQ ID NO: 114823 - RNA, 22 nt, Homo sapiens
uuugugcuaaugcuagauuacu

SEQ ID NO: 114824 - RNA, 21 nt, Homo sapiens
uuugugguuacugugugagcu

SEQ ID NO: 114825 - RNA, 22 nt, Homo sapiens
uuuuaagcuacaagagacauau

SEQ ID NO: 114826 - RNA, 22 nt, Homo sapiens
uuuuagcagccaugacaaagau

SEQ ID NO: 114827 - RNA, 22 nt, Homo sapiens
uuuuagcuuuucccaggacucc

SEQ ID NO: 114828 - RNA, 22 nt, Homo sapiens
uuuugcacuguuuuaucugaca

SEQ ID NO: 114829 - RNA, 22 nt, Homo sapiens
uuuugcaggucaggggcagaga

SEQ ID NO: 114830 - RNA, 22 nt, Homo sapiens
uuuugcaguuacagagagugag

SEQ ID NO: 114831 - RNA, 22 nt, Homo sapiens
uuuuggcuagaaauauaccucc

SEQ ID NO: 114832 - RNA, 22 nt, Homo sapiens
uuuuggcucuugguaggucaga

SEQ ID NO: 114833 - RNA, 22 nt, Homo sapiens
uuuugguauauacggggguccu

SEQ ID NO: 114834 - RNA, 22 nt, Homo sapiens
uuuugguuuuauccagggucuc

SEQ ID NO: 114835 - RNA, 22 nt, Homo sapiens
uuuuucacuuaaguuaggcuca

SEQ ID NO: 114836 - RNA, 22 nt, Homo sapiens
uuuuugauuaauggguagacca

SEQ ID NO: 114837 - RNA, 22 nt, Homo sapiens
uuuuuggguaaugauuaucaau

SEQ ID NO: 114838 - RNA, 22 nt, Homo sapiens
uuuuugguugguaggcuauuaa

SEQ ID NO: 114839 - RNA, 22 nt, Homo sapiens
agcagcaugcaaauggacuaau

SEQ ID NO: 114840 - RNA, 22 nt, Homo sapiens
agcagcauggguauaaaucucc

SEQ ID NO: 114841 - RNA, 22 nt, Homo sapiens
agcagcauuaguggaaucuugu

SEQ ID NO: 114842 - RNA, 22 nt, Homo sapiens
agcagcauuccaaaaaucugcu

SEQ ID NO: 114843 - RNA, 22 nt, Homo sapiens
agcagcgacacccuguggugag

SEQ ID NO: 114844 - RNA, 22 nt, Homo sapiens
agcaggauuguuacaauaguaa

SEQ ID NO: 114845 - RNA, 22 nt, Homo sapiens
agcagguauuuaagaaacucag

SEQ ID NO: 114846 - RNA, 22 nt, Homo sapiens
agcaguacauaaaaagcauccu

SEQ ID NO: 114847 - RNA, 19 nt, Homo sapiens
agcaguguggagauuucuc

SEQ ID NO: 114848 - RNA, 22 nt, Homo sapiens
agcaguguggccuuagacccgg

SEQ ID NO: 114849 - RNA, 18 nt, Homo sapiens
agcaucacugaucauccu

SEQ ID NO: 114850 - RNA, 22 nt, Homo sapiens
agccaagacucuguuccccuug

SEQ ID NO: 114851 - RNA, 19 nt, Homo sapiens
agccaguuuucccagcacc

SEQ ID NO: 114852 - RNA, 22 nt, Homo sapiens
agcccugugauuacuuuuauaa

SEQ ID NO: 114853 - RNA, 20 nt, Homo sapiens
agcuccauuccugaaggcug

SEQ ID NO: 114854 - RNA, 22 nt, Homo sapiens
agcugcauucguaucauauugu

SEQ ID NO: 114855 - RNA, 16 nt, Homo sapiens
agcuggaauuacaggc

SEQ ID NO: 114856 - RNA, 22 nt, Homo sapiens
agcuggcuguagcugcaagucu

SEQ ID NO: 114857 - RNA, 20 nt, Homo sapiens
agcuggguguguuggugcau

SEQ ID NO: 114858 - RNA, 19 nt, Homo sapiens
agcuguguugccugugaga

SEQ ID NO: 114859 - RNA, 22 nt, Homo sapiens
agcuuguuuucccauaacuaga

SEQ ID NO: 114860 - RNA, 22 nt, Homo sapiens
aggaaaucuuagcugaggggau

SEQ ID NO: 114861 - RNA, 22 nt, Homo sapiens
aggaaugucaaugguaguuuaa

SEQ ID NO: 114862 - RNA, 18 nt, Homo sapiens
aggagcauagugcuauga

SEQ ID NO: 114863 - RNA, 21 nt, Homo sapiens
aggagcauuguugugguggag

SEQ ID NO: 114864 - RNA, 21 nt, Homo sapiens
aggcaagacuuuuagguuugu

SEQ ID NO: 114865 - RNA, 22 nt, Homo sapiens
agggaagugugcuaugcauuua

SEQ ID NO: 114866 - RNA, 22 nt, Homo sapiens
agggcaagacuuguuaagaaca

SEQ ID NO: 114867 - RNA, 20 nt, Homo sapiens
agguagauagaugauagaua

SEQ ID NO: 114868 - RNA, 22 nt, Homo sapiens
agguauuuucaacuuagaaugg

SEQ ID NO: 114869 - RNA, 22 nt, Homo sapiens
aggucaccucaggaaauacuga

SEQ ID NO: 114870 - RNA, 22 nt, Homo sapiens
aggugcaugcuucacuggauau

SEQ ID NO: 114871 - RNA, 22 nt, Homo sapiens
aguaaacuucagaguucuuccu

SEQ ID NO: 114872 - RNA, 22 nt, Homo sapiens
aguauguagugcaaucagucag

SEQ ID NO: 114873 - RNA, 22 nt, Homo sapiens
agucaaaugcuuauguauaaag

SEQ ID NO: 114874 - RNA, 22 nt, Homo sapiens
agucaaguuuuuucagagaaua

SEQ ID NO: 114875 - RNA, 17 nt, Homo sapiens
agugagaucauggcuua

SEQ ID NO: 114876 - RNA, 22 nt, Homo sapiens
agugcaauaaggauguagaacu

SEQ ID NO: 114877 - RNA, 22 nt, Homo sapiens
aguggcacaauuuugacucccc

SEQ ID NO: 114878 - RNA, 22 nt, Homo sapiens
agugguaguacaggagauaccg

SEQ ID NO: 114879 - RNA, 22 nt, Homo sapiens
aguucaauggguuuucacucau

SEQ ID NO: 114880 - RNA, 22 nt, Homo sapiens
aguuggcacugagcugugauug

SEQ ID NO: 114881 - RNA, 18 nt, Homo sapiens
auaaacucaucauuuuua

SEQ ID NO: 114882 - RNA, 22 nt, Homo sapiens
auaaacugucaguggagaguaa

SEQ ID NO: 114883 - RNA, 22 nt, Homo sapiens
auaaaguucugcuggcauauau

SEQ ID NO: 114884 - RNA, 22 nt, Homo sapiens
auaaggaguaucauauuaaaac

SEQ ID NO: 114885 - RNA, 22 nt, Homo sapiens
auaagucaauggaacagauuaa

SEQ ID NO: 114886 - RNA, 18 nt, Homo sapiens
auacaagcagcagagauu

SEQ ID NO: 114887 - RNA, 22 nt, Homo sapiens
auacaguaaugucuuaggcugu

SEQ ID NO: 114888 - RNA, 22 nt, Homo sapiens
auacaguauggagggcccagcu

SEQ ID NO: 114889 - RNA, 22 nt, Homo sapiens
auacaguguauguauaguacau

SEQ ID NO: 114890 - RNA, 22 nt, Homo sapiens
auacccugucgugagucagaga

SEQ ID NO: 114891 - RNA, 22 nt, Homo sapiens
auacuguuuuacaucauugccu

SEQ ID NO: 114892 - RNA, 22 nt, Homo sapiens
auagcagcaccucacucuacug

SEQ ID NO: 114893 - RNA, 22 nt, Homo sapiens
auagcaggagaauggucauggg

SEQ ID NO: 114894 - RNA, 22 nt, Homo sapiens
auagcagugucccacuccuugg

SEQ ID NO: 114895 - RNA, 22 nt, Homo sapiens
auagcagugugaaaacagacua

SEQ ID NO: 114896 - RNA, 22 nt, Homo sapiens
auagcagugugaaaauguacua

SEQ ID NO: 114897 - RNA, 22 nt, Homo sapiens
auagcauaucccacaugucaga

SEQ ID NO: 114898 - RNA, 22 nt, Homo sapiens
auagcuguugaauggaauauuc

SEQ ID NO: 114899 - RNA, 22 nt, Homo sapiens
auagguuuucacuguagauucu

SEQ ID NO: 114900 - RNA, 22 nt, Homo sapiens
auagugcagugaugaaccuagg

SEQ ID NO: 114901 - RNA, 19 nt, Homo sapiens
auauaacauccaggagcag

SEQ ID NO: 114902 - RNA, 22 nt, Homo sapiens
auaucaagugacuggaguucca

SEQ ID NO: 114903 - RNA, 22 nt, Homo sapiens
auaugcaaauccauagagacag

SEQ ID NO: 114904 - RNA, 21 nt, Homo sapiens
auaugugcuguggaagucagc

SEQ ID NO: 114905 - RNA, 22 nt, Homo sapiens
auauuagguuggugccaaagua

SEQ ID NO: 114906 - RNA, 22 nt, Homo sapiens
auauugacuuucucuuagauca

SEQ ID NO: 114907 - RNA, 22 nt, Homo sapiens
aucaaagugaaauauuaguuau

SEQ ID NO: 114908 - RNA, 22 nt, Homo sapiens
aucaaagugaauuaaugagaau

SEQ ID NO: 114909 - RNA, 22 nt, Homo sapiens
aucaaguaguuauacguaaagg

SEQ ID NO: 114910 - RNA, 22 nt, Homo sapiens
aucacagugaaaacagucaauu

SEQ ID NO: 114911 - RNA, 22 nt, Homo sapiens
aucacaguggcucacaagagcc

SEQ ID NO: 114912 - RNA, 22 nt, Homo sapiens
aucacauggccagguaguaauc

SEQ ID NO: 114913 - RNA, 22 nt, Homo sapiens
aucacuguaaguuuacacuuug

SEQ ID NO: 114914 - RNA, 22 nt, Homo sapiens
aucagaaucucuagaggacugu

SEQ ID NO: 114915 - RNA, 21 nt, Homo sapiens
aucagagacccaggcuuccuc

SEQ ID NO: 114916 - RNA, 20 nt, Homo sapiens
aucagagacuaggauugcca

SEQ ID NO: 114917 - RNA, 20 nt, Homo sapiens
aucagagccggugaaagggc

SEQ ID NO: 114918 - RNA, 22 nt, Homo sapiens
aucagagccugugugcccugaa

SEQ ID NO: 114919 - RNA, 22 nt, Homo sapiens
aucagcagcaugaaaagcaacu

SEQ ID NO: 114920 - RNA, 22 nt, Homo sapiens
aucauauccuagauauaacuuc

SEQ ID NO: 114921 - RNA, 23 nt, Homo sapiens
auccacauucuaguccuuuaugc

SEQ ID NO: 114922 - RNA, 22 nt, Homo sapiens
auccaguuuuaggagauuucua

SEQ ID NO: 114923 - RNA, 22 nt, Homo sapiens
aucccagaaacucggguuucuc

SEQ ID NO: 114924 - RNA, 22 nt, Homo sapiens
aucccugagccugacucucaga

SEQ ID NO: 114925 - RNA, 22 nt, Homo sapiens
auccucugagagaguuucauaa

SEQ ID NO: 114926 - RNA, 22 nt, Homo sapiens
auccugaugacacagugcugca

SEQ ID NO: 114927 - RNA, 21 nt, Homo sapiens
auccuucuuuuucaaccugug

SEQ ID NO: 114928 - RNA, 22 nt, Homo sapiens
auccuuuagacuguccaguuga

SEQ ID NO: 114929 - RNA, 22 nt, Homo sapiens
aucucagcaacuaaagauccuu

SEQ ID NO: 114930 - RNA, 22 nt, Homo sapiens
aucucugagauguucugauuuu

SEQ ID NO: 114931 - RNA, 22 nt, Homo sapiens
aucuggguccguucugcuucuc

SEQ ID NO: 114932 - RNA, 22 nt, Homo sapiens
augaaaagcauaaacgcugaag

SEQ ID NO: 114933 - RNA, 22 nt, Homo sapiens
augaaagucaauccccaagugu

SEQ ID NO: 114934 - RNA, 22 nt, Homo sapiens
augaaaugcauguuaaguccgu

SEQ ID NO: 114935 - RNA, 22 nt, Homo sapiens
augaagcuagcugauugcugau

SEQ ID NO: 114936 - RNA, 22 nt, Homo sapiens
augacaaugaaucccuguuuca

SEQ ID NO: 114937 - RNA, 22 nt, Homo sapiens
augaccaaugggcagagcuaga

SEQ ID NO: 114938 - RNA, 22 nt, Homo sapiens
augaccauuucaauugauaugg

SEQ ID NO: 114939 - RNA, 22 nt, Homo sapiens
augacugucagggcagucauug

SEQ ID NO: 114940 - RNA, 22 nt, Homo sapiens
augagacuguucuuccucauug

SEQ ID NO: 114941 - RNA, 22 nt, Homo sapiens
augagaugaauaccgacgaugu

SEQ ID NO: 114942 - RNA, 22 nt, Homo sapiens
augagaugaggaauggcccucc

SEQ ID NO: 114943 - RNA, 19 nt, Homo sapiens
augagcaauaguuuuaauc

SEQ ID NO: 114944 - RNA, 22 nt, Homo sapiens
augaggcuauaauuuuuaugua

SEQ ID NO: 114945 - RNA, 22 nt, Homo sapiens
caugacacauguuuaccuaugu

SEQ ID NO: 114946 - RNA, 22 nt, Homo sapiens
caugcauuggucuauuauguga

SEQ ID NO: 114947 - RNA, 22 nt, Homo sapiens
caugugcaugagcacauacgug

SEQ ID NO: 114948 - RNA, 22 nt, Homo sapiens
cauugcacuccagcccuggcaa

SEQ ID NO: 114949 - RNA, 22 nt, Homo sapiens
cauugcacuccagcucugggcg

SEQ ID NO: 114950 - RNA, 22 nt, Homo sapiens
cauugcacucuagccucggcaa

SEQ ID NO: 114951 - RNA, 22 nt, Homo sapiens
ccaagccucaguuucccucugu

SEQ ID NO: 114952 - RNA, 22 nt, Homo sapiens
ccaaggcacugauucuguacuc

SEQ ID NO: 114953 - RNA, 23 nt, Homo sapiens
ccacacuguuuagaauggcauca

SEQ ID NO: 114954 - RNA, 22 nt, Homo sapiens
ccacauuaccuugcuugcucca

SEQ ID NO: 114955 - RNA, 22 nt, Homo sapiens
ccacugggcaguuuauuaucag

SEQ ID NO: 114956 - RNA, 22 nt, Homo sapiens
ccagugguugggccggagacgg

SEQ ID NO: 114957 - RNA, 22 nt, Homo sapiens
ccaguucaaugauauggaaacu

SEQ ID NO: 114958 - RNA, 22 nt, Homo sapiens
ccaguuuucaagauaaugguuu

SEQ ID NO: 114959 - RNA, 22 nt, Homo sapiens
ccaguuuuucauuuauacuagu

SEQ ID NO: 114960 - RNA, 22 nt, Homo sapiens
ccaucacacugugauuauuauc

SEQ ID NO: 114961 - RNA, 18 nt, Homo sapiens
ccauucaacagauuuguc

SEQ ID NO: 114962 - RNA, 22 nt, Homo sapiens
cccagugaagagaaccuuacga

SEQ ID NO: 114963 - RNA, 18 nt, Homo sapiens
cccagugacuuauggccu

SEQ ID NO: 114964 - RNA, 22 nt, Homo sapiens
ccccauguucucucugcagcuc

SEQ ID NO: 114965 - RNA, 17 nt, Homo sapiens
ccccugagcgaugcagu

SEQ ID NO: 114966 - RNA, 22 nt, Homo sapiens
cccugaagaaagccuaggacau

SEQ ID NO: 114967 - RNA, 22 nt, Homo sapiens
cccugacauucggagauguagu

SEQ ID NO: 114968 - RNA, 22 nt, Homo sapiens
cccuguguuuagcugaagguuu

SEQ ID NO: 114969 - RNA, 22 nt, Homo sapiens
ccucauggagaacaucugcuag

SEQ ID NO: 114970 - RNA, 22 nt, Homo sapiens
ccucauggagaaccucugcuag

SEQ ID NO: 114971 - RNA, 22 nt, Homo sapiens
ccugagaucauacuguuaguaa

SEQ ID NO: 114972 - RNA, 22 nt, Homo sapiens
ccuggaagaaaggugcuaaaua

SEQ ID NO: 114973 - RNA, 22 nt, Homo sapiens
cgcccuguagcuagcuagaggu

SEQ ID NO: 114974 - RNA, 22 nt, Homo sapiens
cgcuggugaucuagacccccaa

SEQ ID NO: 114975 - RNA, 22 nt, Homo sapiens
cuaaaugucucuacuaaguuua

SEQ ID NO: 114976 - RNA, 22 nt, Homo sapiens
cuaaggcaguagccugaauaau

SEQ ID NO: 114977 - RNA, 22 nt, Homo sapiens
cuacaguagagaggauguagaa

SEQ ID NO: 114978 - RNA, 22 nt, Homo sapiens
uugugcuuguaacuacauucag

SEQ ID NO: 114979 - RNA, 22 nt, Homo sapiens
uugugcuuuugagcugagauga

SEQ ID NO: 114980 - RNA, 18 nt, Homo sapiens
uuguggccccuacaaauu

SEQ ID NO: 114981 - RNA, 22 nt, Homo sapiens
uugugguaggaugaagagauga

SEQ ID NO: 114982 - RNA, 22 nt, Homo sapiens
uuguuugguugaguauggaagu

SEQ ID NO: 114983 - RNA, 22 nt, Homo sapiens
uuuaaagcuaaaauauguuuau

SEQ ID NO: 114984 - RNA, 22 nt, Homo sapiens
uuuaggcaauauauucaugucu

SEQ ID NO: 114985 - RNA, 22 nt, Homo sapiens
uuuauagucaggaacuugagga

SEQ ID NO: 114986 - RNA, 22 nt, Homo sapiens
uuucaagugcugucuuagcugu

SEQ ID NO: 114987 - RNA, 19 nt, Homo sapiens
uuucacacucgccuacuuc

SEQ ID NO: 114988 - RNA, 22 nt, Homo sapiens
uuucacagcugucuuccgucuc

SEQ ID NO: 114989 - RNA, 23 nt, Homo sapiens
uuucacaguagcuggaucagccu

SEQ ID NO: 114990 - RNA, 17 nt, Homo sapiens
uuucagaguggaagugu

SEQ ID NO: 114991 - RNA, 23 nt, Homo sapiens
uuucaguaguuguauccuguugc

SEQ ID NO: 114992 - RNA, 22 nt, Homo sapiens
uuucccauuguucugcucugug

SEQ ID NO: 114993 - RNA, 22 nt, Homo sapiens
uuucccugaaggcucugaaguc

SEQ ID NO: 114994 - RNA, 22 nt, Homo sapiens
uuuccuggagaaucuuaacaaa

SEQ ID NO: 114995 - RNA, 21 nt, Homo sapiens
uuucugggggagcauggcagg

SEQ ID NO: 114996 - RNA, 22 nt, Homo sapiens
uuugaagugugaugccuugaug

SEQ ID NO: 114997 - RNA, 23 nt, Homo sapiens
cuuuguccccacccaaaucucau

SEQ ID NO: 114998 - RNA, 22 nt, Homo sapiens
cuuuuacacugguggugggaau

SEQ ID NO: 114999 - RNA, 22 nt, Homo sapiens
gaaaauccauccccagggagua

SEQ ID NO: 115000 - RNA, 22 nt, Homo sapiens
gaaaguaauuaacgauuguugc

SEQ ID NO: 115001 - RNA, 22 nt, Homo sapiens
gaauugcacaaaaacugcuugu

SEQ ID NO: 115002 - RNA, 22 nt, Homo sapiens
gacauguuuucaagauuuauaa

SEQ ID NO: 115003 - RNA, 22 nt, Homo sapiens
gacuauguuaccuuacacauca

SEQ ID NO: 115004 - RNA, 19 nt, Homo sapiens
gacuccagaguugugugcu

SEQ ID NO: 115005 - RNA, 22 nt, Homo sapiens
gagaacauuuaagccacucagg

SEQ ID NO: 115006 - RNA, 22 nt, Homo sapiens
gagaacuaaugauguacuaggc

SEQ ID NO: 115007 - RNA, 23 nt, Homo sapiens
gagaccagcuucagaaagcacga

SEQ ID NO: 115008 - RNA, 22 nt, Homo sapiens
gagagcuaggccacuggggcuu

SEQ ID NO: 115009 - RNA, 22 nt, Homo sapiens
gagagucacagugaauguggca

SEQ ID NO: 115010 - RNA, 21 nt, Homo sapiens
gagauagguaccgaagcuuag

SEQ ID NO: 115011 - RNA, 22 nt, Homo sapiens
gagauauucugguuuacuaaau

SEQ ID NO: 115012 - RNA, 22 nt, Homo sapiens
gagaucaguuaaugaagugagc

SEQ ID NO: 115013 - RNA, 23 nt, Homo sapiens
gagaucauucuggaauuagagug

SEQ ID NO: 115014 - RNA, 22 nt, Homo sapiens
gagauggagucuuuuucuguca

SEQ ID NO: 115015 - RNA, 22 nt, Homo sapiens
gagauucuucaauauuuauucu

SEQ ID NO: 115016 - RNA, 22 nt, Homo sapiens
gagauuuucagcuugacuggga

SEQ ID NO: 115017 - RNA, 22 nt, Homo sapiens
gagcacauguggagagucuggg

SEQ ID NO: 115018 - RNA, 20 nt, Homo sapiens
gagcaucacaggccucugcu

SEQ ID NO: 115019 - RNA, 22 nt, Homo sapiens
gagcaucauucaacaaaagucu

SEQ ID NO: 115020 - RNA, 22 nt, Homo sapiens
gagcuagaauauuuuguauagu

SEQ ID NO: 115021 - RNA, 22 nt, Homo sapiens
gagcuaguagauuuuaaauauu

SEQ ID NO: 115022 - RNA, 22 nt, Homo sapiens
gagcuguuuuucacuagaccaa

SEQ ID NO: 115023 - RNA, 22 nt, Homo sapiens
gaggacauuaugcuaaguggaa

SEQ ID NO: 115024 - RNA, 22 nt, Homo sapiens
gaggaucucuugagcccagaag

SEQ ID NO: 115025 - RNA, 22 nt, Homo sapiens
gagguaagaguuuuccauuucu

SEQ ID NO: 115026 - RNA, 22 nt, Homo sapiens
gagguggauacauuaaauaaug

SEQ ID NO: 115027 - RNA, 22 nt, Homo sapiens
gagguggugguggaggcauagc

SEQ ID NO: 115028 - RNA, 22 nt, Homo sapiens
gaguaaaugucaaguacuuagg

SEQ ID NO: 115029 - RNA, 22 nt, Homo sapiens
gaguauauuugcacuguuaugu

SEQ ID NO: 115030 - RNA, 22 nt, Homo sapiens
gaguuuguaaacuauucacuaa

SEQ ID NO: 115031 - RNA, 22 nt, Homo sapiens
gauaaagauagcaauagggaca

SEQ ID NO: 115032 - RNA, 21 nt, Homo sapiens
gauaucuuuauucccaagagc

SEQ ID NO: 115033 - RNA, 22 nt, Homo sapiens
gauauguaaaaauuauaucuga

SEQ ID NO: 115034 - RNA, 22 nt, Homo sapiens
gauauguacagcucucuaggau

SEQ ID NO: 115035 - RNA, 22 nt, Homo sapiens
gaugauguuggaaacuuggugc

SEQ ID NO: 115036 - RNA, 19 nt, Homo sapiens
gaugcaaugcacugagguc

SEQ ID NO: 115037 - RNA, 22 nt, Homo sapiens
gauggaauuaaaaucagaauca

SEQ ID NO: 115038 - RNA, 22 nt, Homo sapiens
gauguguuuguuucuggaggag

SEQ ID NO: 115039 - RNA, 22 nt, Homo sapiens
gcaaaauugagaagggaauaua

SEQ ID NO: 115040 - RNA, 22 nt, Homo sapiens
gcaaaugcuacaccauuuugua

SEQ ID NO: 115041 - RNA, 22 nt, Homo sapiens
gcacagaugaggagaggucuca

SEQ ID NO: 115042 - RNA, 22 nt, Homo sapiens
gcacauuacaaguauuagcuca

SEQ ID NO: 115043 - RNA, 22 nt, Homo sapiens
gcacccugucaaaauggaccaa

SEQ ID NO: 115044 - RNA, 22 nt, Homo sapiens
gcacuacugcacuccagucuag

SEQ ID NO: 115045 - RNA, 22 nt, Homo sapiens
gcagguaguuucugacuuuuac

SEQ ID NO: 115046 - RNA, 19 nt, Homo sapiens
gcaguauugaaggccaguc

SEQ ID NO: 115047 - RNA, 22 nt, Homo sapiens
gccaagaugcugcccacagaca

SEQ ID NO: 115048 - RNA, 22 nt, Homo sapiens
gccauugcacuacagccuaggc

SEQ ID NO: 115049 - RNA, 22 nt, Homo sapiens
gccauugcacuccagccugagc

SEQ ID NO: 115050 - RNA, 22 nt, Homo sapiens
gcccauuguuccuaggcuacaa

SEQ ID NO: 115051 - RNA, 22 nt, Homo sapiens
gccccaguacaggcuccuuaga

SEQ ID NO: 115052 - RNA, 22 nt, Homo sapiens
gccccugagacuugccucgggc

SEQ ID NO: 115053 - RNA, 22 nt, Homo sapiens
gccugagaggauaugauccccu

SEQ ID NO: 115054 - RNA, 22 nt, Homo sapiens
gcuaggagaucugcugcucucu

SEQ ID NO: 115055 - RNA, 22 nt, Homo sapiens
gcucaugggcagugugauuguu

SEQ ID NO: 115056 - RNA, 22 nt, Homo sapiens
gcugaaauguuuaauuugggag

SEQ ID NO: 115057 - RNA, 22 nt, Homo sapiens
gcuggcaagaugcugaugcaac

SEQ ID NO: 115058 - RNA, 22 nt, Homo sapiens
gcuguugugaacuauacaucua

SEQ ID NO: 115059 - RNA, 19 nt, Homo sapiens
gcuuguccacgugagauaa

SEQ ID NO: 115060 - RNA, 22 nt, Homo sapiens
gcuuguguauuaaaccuugcag

SEQ ID NO: 115061 - RNA, 18 nt, Homo sapiens
ggaaaacuuuucuaagua

SEQ ID NO: 115062 - RNA, 20 nt, Homo sapiens
ggaauguuaaucuccaugau

SEQ ID NO: 115063 - RNA, 22 nt, Homo sapiens
ggacagugaaugccacuccucc

SEQ ID NO: 115064 - RNA, 22 nt, Homo sapiens
ggagaucauuuccuauuugaag

SEQ ID NO: 115065 - RNA, 22 nt, Homo sapiens
ggagaucuuuguuaucuuuuga

SEQ ID NO: 115066 - RNA, 22 nt, Homo sapiens
ggagaugugccugcucugcucu

SEQ ID NO: 115067 - RNA, 16 nt, Homo sapiens
ggaggucaucugggaa

SEQ ID NO: 115068 - RNA, 22 nt, Homo sapiens
ggaucacagccagcucccagaa

SEQ ID NO: 115069 - RNA, 22 nt, Homo sapiens
ggcaaaugaagauggagaggcu

SEQ ID NO: 115070 - RNA, 22 nt, Homo sapiens
ggcaagaaccagggauuugcgu

SEQ ID NO: 115071 - RNA, 22 nt, Homo sapiens
ggcaagaacuucacucacuuuu

SEQ ID NO: 115072 - RNA, 22 nt, Homo sapiens
ggcaaggugcuacagacaguga

SEQ ID NO: 115073 - RNA, 22 nt, Homo sapiens
ggcaaugaggcggaccagcagg

SEQ ID NO: 115074 - RNA, 22 nt, Homo sapiens
ggcaaugucagcuaaugaugga

SEQ ID NO: 115075 - RNA, 17 nt, Homo sapiens
ggcaggaauuaauguca

SEQ ID NO: 115076 - RNA, 22 nt, Homo sapiens
ggcauguugauagguagaugua

SEQ ID NO: 115077 - RNA, 22 nt, Homo sapiens
ggcccugauacaaguaaggucu

SEQ ID NO: 115078 - RNA, 22 nt, Homo sapiens
ggcuuggaggaaugugagggcu

SEQ ID NO: 115079 - RNA, 22 nt, Homo sapiens
gggaagaaggagugguuuacuc

SEQ ID NO: 115080 - RNA, 19 nt, Homo sapiens
gggaggaugcgucuucagg

SEQ ID NO: 115081 - RNA, 22 nt, Homo sapiens
ggggaguguggacaucacccug

SEQ ID NO: 115082 - RNA, 22 nt, Homo sapiens
gggguauguaagugagugagug

SEQ ID NO: 115083 - RNA, 22 nt, Homo sapiens
ggguucaaaucuuggcucuuac

SEQ ID NO: 115084 - RNA, 22 nt, Homo sapiens
gguaaacauacugcugucuucu

SEQ ID NO: 115085 - RNA, 22 nt, Homo sapiens
gguacagcuaguuaaacauuug

SEQ ID NO: 115086 - RNA, 19 nt, Homo sapiens
ggucacagggguuacaagg

SEQ ID NO: 115087 - RNA, 22 nt, Homo sapiens
gguggucuuccccuggaguucg

SEQ ID NO: 115088 - RNA, 22 nt, Homo sapiens
gguggugguauuucagaaaaug

SEQ ID NO: 115089 - RNA, 22 nt, Homo sapiens
guaaacuuccccucaugaauga

SEQ ID NO: 115090 - RNA, 20 nt, Homo sapiens
guaacagcacuuucccaaag

SEQ ID NO: 115091 - RNA, 22 nt, Homo sapiens
guaacagucucaacaguggucu

SEQ ID NO: 115092 - RNA, 22 nt, Homo sapiens
guaacucugucacuuacuaguu

SEQ ID NO: 115093 - RNA, 22 nt, Homo sapiens
guaaugcacucccaaagaucca

SEQ ID NO: 115094 - RNA, 22 nt, Homo sapiens
guacaguaguaaaagugaauga

SEQ ID NO: 115095 - RNA, 22 nt, Homo sapiens
guacaguauaguaauaggauuu

SEQ ID NO: 115096 - RNA, 22 nt, Homo sapiens
guaccugagaaguuccagggga

SEQ ID NO: 115097 - RNA, 22 nt, Homo sapiens
guauccugaaguucucagcacu

SEQ ID NO: 115098 - RNA, 22 nt, Homo sapiens
guaugaaaaucggagauugggu

SEQ ID NO: 115099 - RNA, 22 nt, Homo sapiens
uaggucuuuuagcauaggagcu

SEQ ID NO: 115100 - RNA, 22 nt, Homo sapiens
uaguaaacauuuuucuaucauu

SEQ ID NO: 115101 - RNA, 22 nt, Homo sapiens
uaguaguuuuguguauaauaau

SEQ ID NO: 115102 - RNA, 22 nt, Homo sapiens
uagucaaaucugaaggaaauuu

SEQ ID NO: 115103 - RNA, 22 nt, Homo sapiens
uagugcugugauauuuuuggcc

SEQ ID NO: 115104 - RNA, 18 nt, Homo sapiens
uagugcuguucucaugau

SEQ ID NO: 115105 - RNA, 22 nt, Homo sapiens
uaguuguugcagguaggaugua

SEQ ID NO: 115106 - RNA, 22 nt, Homo sapiens
uauagcauuuugauccuguaga

SEQ ID NO: 115107 - RNA, 23 nt, Homo sapiens
uauaugugucuaggagcuauggu

SEQ ID NO: 115108 - RNA, 22 nt, Homo sapiens
uaucaagaugacaaacuuugcu

SEQ ID NO: 115109 - RNA, 22 nt, Homo sapiens
uaucaagauggauaaggauaga

SEQ ID NO: 115110 - RNA, 22 nt, Homo sapiens
uaucacaaacuuagcaguuuaa

SEQ ID NO: 115111 - RNA, 22 nt, Homo sapiens
uaucacagauucuccaggguuu

SEQ ID NO: 115112 - RNA, 22 nt, Homo sapiens
uaucacagguggacugcacacc

SEQ ID NO: 115113 - RNA, 22 nt, Homo sapiens
uaucacaguagaacucuuucca

SEQ ID NO: 115114 - RNA, 21 nt, Homo sapiens
uaucacaguagaauaggaucu

SEQ ID NO: 115115 - RNA, 22 nt, Homo sapiens
uaucacaguaucuagcacagug

SEQ ID NO: 115116 - RNA, 22 nt, Homo sapiens
uaucacugucaggcccucauau

SEQ ID NO: 115117 - RNA, 22 nt, Homo sapiens
uaucagcacaguggguucaugg

SEQ ID NO: 115118 - RNA, 22 nt, Homo sapiens
uaucucagaguguacaagauua

SEQ ID NO: 115119 - RNA, 22 nt, Homo sapiens
uaucucuuuucauguguaaaug

SEQ ID NO: 115120 - RNA, 20 nt, Homo sapiens
uaugaaacaguguagagcaa

SEQ ID NO: 115121 - RNA, 22 nt, Homo sapiens
uaugaaagcuacuucucacaau

SEQ ID NO: 115122 - RNA, 21 nt, Homo sapiens
uaugguuucuaauucugcagg

SEQ ID NO: 115123 - RNA, 18 nt, Homo sapiens
uauuaagcuagauauuau

SEQ ID NO: 115124 - RNA, 22 nt, Homo sapiens
uauuagugccuaagucuuaggg

SEQ ID NO: 115125 - RNA, 22 nt, Homo sapiens
uauucaucuuaagcuuuggcuu

SEQ ID NO: 115126 - RNA, 18 nt, Homo sapiens
uauuccucuuccucuauc

SEQ ID NO: 115127 - RNA, 22 nt, Homo sapiens
aaaagucuguagugaaagguga

SEQ ID NO: 115128 - RNA, 22 nt, Homo sapiens
aaagcagcaggugguuuucaau

SEQ ID NO: 115129 - RNA, 22 nt, Homo sapiens
aaagcugucaaggcaggaggcu

SEQ ID NO: 115130 - RNA, 19 nt, Homo sapiens
aaagguaguaaccucugau

SEQ ID NO: 115131 - RNA, 17 nt, Homo sapiens
aaaguccuuugcuaucu

SEQ ID NO: 115132 - RNA, 22 nt, Homo sapiens
aaagugcuaggauuaccugggg

SEQ ID NO: 115133 - RNA, 22 nt, Homo sapiens
aaagugcuuccuuuuugagggu

SEQ ID NO: 115134 - RNA, 22 nt, Homo sapiens
aaaugcagauuccuaggcccca

SEQ ID NO: 115135 - RNA, 22 nt, Homo sapiens
aaaugcaugaggugggaagaaa

SEQ ID NO: 115136 - RNA, 22 nt, Homo sapiens
aaaugcuuucuuggaccauuug

SEQ ID NO: 115137 - RNA, 22 nt, Homo sapiens
aacagaauccucuuuuccuggg

SEQ ID NO: 115138 - RNA, 22 nt, Homo sapiens
aacagaccuagauaguauaguc

SEQ ID NO: 115139 - RNA, 22 nt, Homo sapiens
aacaggguguuugcaguuucuu

SEQ ID NO: 115140 - RNA, 22 nt, Homo sapiens
aacagugccugucauuuaguag

SEQ ID NO: 115141 - RNA, 22 nt, Homo sapiens
aacccugacacaagcagaauuu

SEQ ID NO: 115142 - RNA, 22 nt, Homo sapiens
aaccugaagaaaauauuugcug

SEQ ID NO: 115143 - RNA, 22 nt, Homo sapiens
aacuacaucucuuugaggcagg

SEQ ID NO: 115144 - RNA, 22 nt, Homo sapiens
aacuaugucaaauaaaaugagg

SEQ ID NO: 115145 - RNA, 22 nt, Homo sapiens
aacucacauucuuucuugguac

SEQ ID NO: 115146 - RNA, 22 nt, Homo sapiens
aacuggcauauucugguugcgg

SEQ ID NO: 115147 - RNA, 22 nt, Homo sapiens
aacugguauuucccaugaauuu

SEQ ID NO: 115148 - RNA, 19 nt, Homo sapiens
aacuggugugagaugguau

SEQ ID NO: 115149 - RNA, 21 nt, Homo sapiens
aagaaagcuggacuugccgcu

SEQ ID NO: 115150 - RNA, 22 nt, Homo sapiens
aagaccuaugcaggaagaaaug

SEQ ID NO: 115151 - RNA, 22 nt, Homo sapiens
aagauaguaaacauuuucugcu

SEQ ID NO: 115152 - RNA, 22 nt, Homo sapiens
aagccagugugacaggaaacuu

SEQ ID NO: 115153 - RNA, 22 nt, Homo sapiens
aagcccauuguaaguugaggag

SEQ ID NO: 115154 - RNA, 22 nt, Homo sapiens
aagcuggauuuaguguggagca

SEQ ID NO: 115155 - RNA, 22 nt, Homo sapiens
ccaguuuuuggcaaugaugaau

SEQ ID NO: 115156 - RNA, 22 nt, Homo sapiens
cccagaguucuuaaauacugag

SEQ ID NO: 115157 - RNA, 22 nt, Homo sapiens
cccagcguucggcauggcugag

SEQ ID NO: 115158 - RNA, 22 nt, Homo sapiens
cccagugugaacuuggcauuuu

SEQ ID NO: 115159 - RNA, 22 nt, Homo sapiens
ccccauuugaacuccuucaacu

SEQ ID NO: 115160 - RNA, 19 nt, Homo sapiens
ccccuguggauaccgaggg

SEQ ID NO: 115161 - RNA, 22 nt, Homo sapiens
cccugagagcagggucuuucuc

SEQ ID NO: 115162 - RNA, 19 nt, Homo sapiens
cccuggcacauggaaaaug

SEQ ID NO: 115163 - RNA, 22 nt, Homo sapiens
cccugugaauauuaccuuauuu

SEQ ID NO: 115164 - RNA, 22 nt, Homo sapiens
ccuaggcacugggguccagccc

SEQ ID NO: 115165 - RNA, 21 nt, Homo sapiens
ccuccauuuguauucuugccc

SEQ ID NO: 115166 - RNA, 22 nt, Homo sapiens
ccuccauuugugucaggaaguc

SEQ ID NO: 115167 - RNA, 22 nt, Homo sapiens
ccucccuuuguugcaagggaaa

SEQ ID NO: 115168 - RNA, 22 nt, Homo sapiens
ccugagacugauugacucacaa

SEQ ID NO: 115169 - RNA, 22 nt, Homo sapiens
ccuggcaagagacugaagauag

SEQ ID NO: 115170 - RNA, 22 nt, Homo sapiens
ccuugucacugaguggaaugaa

SEQ ID NO: 115171 - RNA, 22 nt, Homo sapiens
cuaaagauagugacaugauuug

SEQ ID NO: 115172 - RNA, 22 nt, Homo sapiens
cuaacacagagguuuauuucuc

SEQ ID NO: 115173 - RNA, 22 nt, Homo sapiens
cuaauccugugguagcacucaa

SEQ ID NO: 115174 - RNA, 22 nt, Homo sapiens
cuaaugcagucaggagaaggaa

SEQ ID NO: 115175 - RNA, 22 nt, Homo sapiens
cuacaguaugaaaccuuuacuc

SEQ ID NO: 115176 - RNA, 22 nt, Homo sapiens
cuagacuagacccaaauugaag

SEQ ID NO: 115177 - RNA, 22 nt, Homo sapiens
cuauggcuguaaggauaguaac

SEQ ID NO: 115178 - RNA, 22 nt, Homo sapiens
cuauguaccuggaacuguauua

SEQ ID NO: 115179 - RNA, 21 nt, Homo sapiens
cucaaaguacugauauuacag

SEQ ID NO: 115180 - RNA, 19 nt, Homo sapiens
cucaaagugguauuuggag

SEQ ID NO: 115181 - RNA, 18 nt, Homo sapiens
cucaaccucaugcagggc

SEQ ID NO: 115182 - RNA, 22 nt, Homo sapiens
cucagagcacaguuuaugacag

SEQ ID NO: 115183 - RNA, 20 nt, Homo sapiens
cucagauuauucugaagcaa

SEQ ID NO: 115184 - RNA, 22 nt, Homo sapiens
cucaggcacucugauuccagug

SEQ ID NO: 115185 - RNA, 22 nt, Homo sapiens
cuccauuuaguccuuuuagaag

SEQ ID NO: 115186 - RNA, 22 nt, Homo sapiens
cuccauuuaucugaaauuuuau

SEQ ID NO: 115187 - RNA, 22 nt, Homo sapiens
cucccauugcaaacaacagaag

SEQ ID NO: 115188 - RNA, 22 nt, Homo sapiens
cugaaagguauacgcuuguuau

SEQ ID NO: 115189 - RNA, 22 nt, Homo sapiens
cugaaauguccaucgacugaug

SEQ ID NO: 115190 - RNA, 22 nt, Homo sapiens
cugaauguucuggauggaagag

SEQ ID NO: 115191 - RNA, 22 nt, Homo sapiens
cugacaagugaucacagcagca

SEQ ID NO: 115192 - RNA, 22 nt, Homo sapiens
cugagaauguaaaugaagcuuu

SEQ ID NO: 115193 - RNA, 22 nt, Homo sapiens
cugagauaauuucuagguguca

SEQ ID NO: 115194 - RNA, 22 nt, Homo sapiens
cugagauacacuaauagucucu

SEQ ID NO: 115195 - RNA, 22 nt, Homo sapiens
cugagauaggacucugcuggcu

SEQ ID NO: 115196 - RNA, 22 nt, Homo sapiens
cugagauggagucucgcauugu

SEQ ID NO: 115197 - RNA, 22 nt, Homo sapiens
cugauugugcagagguguaauu

SEQ ID NO: 115198 - RNA, 22 nt, Homo sapiens
cugcaauguuugaaauggcaaa

SEQ ID NO: 115199 - RNA, 20 nt, Homo sapiens
cugcacauccacucuacuuc

SEQ ID NO: 115200 - RNA, 22 nt, Homo sapiens
cugcagguaggggcagcuuugg

SEQ ID NO: 115201 - RNA, 22 nt, Homo sapiens
cugcaguaaccacuguaggugu

SEQ ID NO: 115202 - RNA, 22 nt, Homo sapiens
cuggaaggaaaaacaaccacag

SEQ ID NO: 115203 - RNA, 22 nt, Homo sapiens
cuggagcauugguggauuuguu

SEQ ID NO: 115204 - RNA, 22 nt, Homo sapiens
cuggcacagugucagaaacaca

SEQ ID NO: 115205 - RNA, 22 nt, Homo sapiens
cuggcaguguuucuugugggcu

SEQ ID NO: 115206 - RNA, 22 nt, Homo sapiens
cugggucaguuucugauuauug

SEQ ID NO: 115207 - RNA, 21 nt, Homo sapiens
cugguccccuuuauguaugug

SEQ ID NO: 115208 - RNA, 22 nt, Homo sapiens
cugucacaguuuuggaggccag

SEQ ID NO: 115209 - RNA, 22 nt, Homo sapiens
cugucucagccucuccaguagc

SEQ ID NO: 115210 - RNA, 20 nt, Homo sapiens
cugugguagggaccaggaau

SEQ ID NO: 115211 - RNA, 22 nt, Homo sapiens
cuguucaggaggcauuuggugg

SEQ ID NO: 115212 - RNA, 22 nt, Homo sapiens
cuguugguguuuaaucacugca

SEQ ID NO: 115213 - RNA, 18 nt, Homo sapiens
cuuccuuagucugguuaa

SEQ ID NO: 115214 - RNA, 22 nt, Homo sapiens
cuugacacugguuuucugaaua

SEQ ID NO: 115215 - RNA, 22 nt, Homo sapiens
cuuggcuuguuguccccugcuc

SEQ ID NO: 115216 - RNA, 21 nt, Homo sapiens
cuugucuugcuuagaauagac

SEQ ID NO: 115217 - RNA, 22 nt, Homo sapiens
cuuguggugcuuuuacgugggc

SEQ ID NO: 115218 - RNA, 22 nt, Homo sapiens
cuuugcaaaacauugagaccuc

SEQ ID NO: 115219 - RNA, 20 nt, Homo sapiens
cuuuggcaaugagaacaggg

SEQ ID NO: 115220 - RNA, 22 nt, Homo sapiens
cuuuggcauuagccuguauaga

SEQ ID NO: 115221 - RNA, 22 nt, Homo sapiens
cuuugggaccgcgguuuauacu

SEQ ID NO: 115222 - RNA, 22 nt, Homo sapiens
cuuugguguauuuucagagacc

SEQ ID NO: 115223 - RNA, 22 nt, Homo sapiens
cuuugguucuguuuauaugcug

SEQ ID NO: 115224 - RNA, 22 nt, Homo sapiens
cuuuguaugucaugacaacugu

SEQ ID NO: 115225 - RNA, 22 nt, Homo sapiens
cuuuuacacugcuggugggaau

SEQ ID NO: 115226 - RNA, 22 nt, Homo sapiens
cuuuuacacuguuggugggaau

SEQ ID NO: 115227 - RNA, 22 nt, Homo sapiens
cuuuuugcaaauacaacucuga

SEQ ID NO: 115228 - RNA, 22 nt, Homo sapiens
gaaauguuuuucaugugggcaa

SEQ ID NO: 115229 - RNA, 22 nt, Homo sapiens
gaacuguuucuggugaaagagu

SEQ ID NO: 115230 - RNA, 22 nt, Homo sapiens
gaagguacgcuuaggaaaugau

SEQ ID NO: 115231 - RNA, 22 nt, Homo sapiens
gaaugcuaccagcaucuagugg

SEQ ID NO: 115232 - RNA, 22 nt, Homo sapiens
gaaugguuuacaaguguaaucu

SEQ ID NO: 115233 - RNA, 20 nt, Homo sapiens
gacauaggcugguaucuggc

SEQ ID NO: 115234 - RNA, 19 nt, Homo sapiens
gacaugagauuuggugggg

SEQ ID NO: 115235 - RNA, 22 nt, Homo sapiens
gaccaaagaggcaggcauuaga

SEQ ID NO: 115236 - RNA, 22 nt, Homo sapiens
gacucagaacuaaggguguuuc

SEQ ID NO: 115237 - RNA, 22 nt, Homo sapiens
gagaacagaagcauuccuaauu

SEQ ID NO: 115238 - RNA, 22 nt, Homo sapiens
gagaaugaacagacugccucuu

SEQ ID NO: 115239 - RNA, 22 nt, Homo sapiens
gagaaugagauuaugguuacau

SEQ ID NO: 115240 - RNA, 22 nt, Homo sapiens
gagacauugacuuuguuccaga

SEQ ID NO: 115241 - RNA, 22 nt, Homo sapiens
gagacugagucucgcucugccg

SEQ ID NO: 115242 - RNA, 22 nt, Homo sapiens
gagacugagucuugcucuguca

SEQ ID NO: 115243 - RNA, 22 nt, Homo sapiens
gagagcaugugcuggcaucagu

SEQ ID NO: 115244 - RNA, 22 nt, Homo sapiens
gagauuaauacacaucaaaugc

SEQ ID NO: 115245 - RNA, 21 nt, Homo sapiens
gagcacauuguccucuaacgc

SEQ ID NO: 115246 - RNA, 22 nt, Homo sapiens
gagcaucaauggcaugugggaa

SEQ ID NO: 115247 - RNA, 22 nt, Homo sapiens
gagcaucaguggccucaucuca

SEQ ID NO: 115248 - RNA, 22 nt, Homo sapiens
gagcaucauggggccaaagcgc

SEQ ID NO: 115249 - RNA, 22 nt, Homo sapiens
gagcugaucuuuucugauucca

SEQ ID NO: 115250 - RNA, 22 nt, Homo sapiens
gagcugguccuuuaaggaugca

SEQ ID NO: 115251 - RNA, 22 nt, Homo sapiens
gagcuguugguuugaaagaauu

SEQ ID NO: 115252 - RNA, 22 nt, Homo sapiens
gaggagucagacugugcaaggu

SEQ ID NO: 115253 - RNA, 22 nt, Homo sapiens
gaggcagucuguccauucucag

SEQ ID NO: 115254 - RNA, 22 nt, Homo sapiens
gaggcuagauggggaugugucc

SEQ ID NO: 115255 - RNA, 22 nt, Homo sapiens
gagggcacugcuuuccuuucaa

SEQ ID NO: 115256 - RNA, 22 nt, Homo sapiens
gaggugaaggucucaauaaaua

SEQ ID NO: 115257 - RNA, 22 nt, Homo sapiens
cuuagcaaugucguguacucac

SEQ ID NO: 115258 - RNA, 22 nt, Homo sapiens
cuucaccaguuuggcagucuca

SEQ ID NO: 115259 - RNA, 22 nt, Homo sapiens
cuugagcuugagauccuuucug

SEQ ID NO: 115260 - RNA, 20 nt, Homo sapiens
cuugcuccccuuguucuaga

SEQ ID NO: 115261 - RNA, 22 nt, Homo sapiens
cuuggcuucuuuauguggcuau

SEQ ID NO: 115262 - RNA, 22 nt, Homo sapiens
cuugugccugaucuuagggggc

SEQ ID NO: 115263 - RNA, 17 nt, Homo sapiens
cuuguugugguaguuug

SEQ ID NO: 115264 - RNA, 22 nt, Homo sapiens
cuuuggcacuuccuaagugcca

SEQ ID NO: 115265 - RNA, 20 nt, Homo sapiens
cuuuguccuccugcugugcu

SEQ ID NO: 115266 - RNA, 22 nt, Homo sapiens
cuuuguggggucuuuccucaaa

SEQ ID NO: 115267 - RNA, 22 nt, Homo sapiens
cuuuguguaggugccucuggcu

SEQ ID NO: 115268 - RNA, 22 nt, Homo sapiens
cuuuuacacuguuagugggaau

SEQ ID NO: 115269 - RNA, 22 nt, Homo sapiens
cuuuuguggaucuucuguugcu

SEQ ID NO: 115270 - RNA, 21 nt, Homo sapiens
cuuuuuacucguucauaugca

SEQ ID NO: 115271 - RNA, 22 nt, Homo sapiens
cuuuuugcugcagcaauacugg

SEQ ID NO: 115272 - RNA, 20 nt, Homo sapiens
cuuuuugcugugcugggagc

SEQ ID NO: 115273 - RNA, 22 nt, Homo sapiens
cuuuuugguagagcaggugugc

SEQ ID NO: 115274 - RNA, 18 nt, Homo sapiens
gaaaugccucuugcuuac

SEQ ID NO: 115275 - RNA, 22 nt, Homo sapiens
gaaauggaucagagcaagcuuu

SEQ ID NO: 115276 - RNA, 22 nt, Homo sapiens
gaaauguauuaaugaguugaaa

SEQ ID NO: 115277 - RNA, 22 nt, Homo sapiens
gaacuuguguugcuucacaugu

SEQ ID NO: 115278 - RNA, 22 nt, Homo sapiens
gaagguaguuuauagauguggu

SEQ ID NO: 115279 - RNA, 22 nt, Homo sapiens
gaaggugcuuggugaaugcauu

SEQ ID NO: 115280 - RNA, 17 nt, Homo sapiens
gaaguguuucagcagcu

SEQ ID NO: 115281 - RNA, 22 nt, Homo sapiens
gacaaguuugauuuauuccaag

SEQ ID NO: 115282 - RNA, 22 nt, Homo sapiens
gacagugagaugucaugugaaa

SEQ ID NO: 115283 - RNA, 22 nt, Homo sapiens
gacauuaucagguuuguuuucu

SEQ ID NO: 115284 - RNA, 22 nt, Homo sapiens
gaccacagacuggaaagagggc

SEQ ID NO: 115285 - RNA, 22 nt, Homo sapiens
gacccucuagauggaagcacug

SEQ ID NO: 115286 - RNA, 22 nt, Homo sapiens
gagaacaguguuguauuuuuuc

SEQ ID NO: 115287 - RNA, 21 nt, Homo sapiens
gagaaucaucauggcugcaua

SEQ ID NO: 115288 - RNA, 22 nt, Homo sapiens
gagaaugagaggggaaggccac

SEQ ID NO: 115289 - RNA, 22 nt, Homo sapiens
gagacucuuagauuggaaaucu

SEQ ID NO: 115290 - RNA, 22 nt, Homo sapiens
gagacugagucucacucuguca

SEQ ID NO: 115291 - RNA, 22 nt, Homo sapiens
gagacugagucuugcccuguca

SEQ ID NO: 115292 - RNA, 22 nt, Homo sapiens
gagacugagucuugcucugucg

SEQ ID NO: 115293 - RNA, 22 nt, Homo sapiens
gagaggucguauaugauuucug

SEQ ID NO: 115294 - RNA, 22 nt, Homo sapiens
gagauaaauaggucacaguucu

SEQ ID NO: 115295 - RNA, 22 nt, Homo sapiens
gagauggagacuuggccuuaaa

SEQ ID NO: 115296 - RNA, 22 nt, Homo sapiens
gagauggaguuucacuucgcuc

SEQ ID NO: 115297 - RNA, 22 nt, Homo sapiens
gagaugguguuccacugccagu

SEQ ID NO: 115298 - RNA, 22 nt, Homo sapiens
gagaugucuauuucagagaugu

SEQ ID NO: 115299 - RNA, 22 nt, Homo sapiens
gagcaaugagcugccugcugag

SEQ ID NO: 115300 - RNA, 22 nt, Homo sapiens
gagcaguugagagugcuggcca

SEQ ID NO: 115301 - RNA, 22 nt, Homo sapiens
gagcuccuccccuuggcuuuca

SEQ ID NO: 115302 - RNA, 22 nt, Homo sapiens
gagcuggacuucuuaccuuuuc

SEQ ID NO: 115303 - RNA, 22 nt, Homo sapiens
gaggaaguagcuacugucuuuc

SEQ ID NO: 115304 - RNA, 22 nt, Homo sapiens
gaggagauauucugcuggaugg

SEQ ID NO: 115305 - RNA, 22 nt, Homo sapiens
gaggcaagaguaguuaaguuag

SEQ ID NO: 115306 - RNA, 22 nt, Homo sapiens
gaggcaaguggccaccgagucu

SEQ ID NO: 115307 - RNA, 22 nt, Homo sapiens
gaggcagucugacccuuagcag

SEQ ID NO: 115308 - RNA, 22 nt, Homo sapiens
gaguaacagcauaaauuuguga

SEQ ID NO: 115309 - RNA, 22 nt, Homo sapiens
gaguagugcugcaguaaacaua

SEQ ID NO: 115310 - RNA, 22 nt, Homo sapiens
gaguagugcuguaauaaacaua

SEQ ID NO: 115311 - RNA, 22 nt, Homo sapiens
gagugcaauggugcuaucucgg

SEQ ID NO: 115312 - RNA, 22 nt, Homo sapiens
gagugcuguuagcccuggguuu

SEQ ID NO: 115313 - RNA, 22 nt, Homo sapiens
gaguggugguucugaaacuuuu

SEQ ID NO: 115314 - RNA, 22 nt, Homo sapiens
gaguuccuuugagccugagagg

SEQ ID NO: 115315 - RNA, 22 nt, Homo sapiens
gauauguguaucuauguacaug

SEQ ID NO: 115316 - RNA, 22 nt, Homo sapiens
gaucagagugaaccuuguuaug

SEQ ID NO: 115317 - RNA, 22 nt, Homo sapiens
gaucccauuggcugccaugugg

SEQ ID NO: 115318 - RNA, 22 nt, Homo sapiens
gaugugaaaucauaguuucuag

SEQ ID NO: 115319 - RNA, 22 nt, Homo sapiens
gauguguugggaagauuucaag

SEQ ID NO: 115320 - RNA, 22 nt, Homo sapiens
gauguguuuuaggaucucagca

SEQ ID NO: 115321 - RNA, 22 nt, Homo sapiens
gcaaaguguuuuuaggaagucu

SEQ ID NO: 115322 - RNA, 22 nt, Homo sapiens
gcaagcuugcugggccugacuc

SEQ ID NO: 115323 - RNA, 22 nt, Homo sapiens
gcacaggguuacauucuaaggu

SEQ ID NO: 115324 - RNA, 22 nt, Homo sapiens
gcacaguuaaagggucauguga

SEQ ID NO: 115325 - RNA, 22 nt, Homo sapiens
gcacauauguaaauagcugccu

SEQ ID NO: 115326 - RNA, 22 nt, Homo sapiens
gcaccacugcacucucagcuug

SEQ ID NO: 115327 - RNA, 22 nt, Homo sapiens
gcagagaaacaggucuaaggag

SEQ ID NO: 115328 - RNA, 22 nt, Homo sapiens
gcagaguauagagggcugggcc

SEQ ID NO: 115329 - RNA, 23 nt, Homo sapiens
gcagcaaugucacagggguccgg

SEQ ID NO: 115330 - RNA, 22 nt, Homo sapiens
gcagcaguggcaguuaauauuu

SEQ ID NO: 115331 - RNA, 22 nt, Homo sapiens
gcaggaaucuugagaaggauuc

SEQ ID NO: 115332 - RNA, 22 nt, Homo sapiens
gcaguggugugugccagccuag

SEQ ID NO: 115333 - RNA, 20 nt, Homo sapiens
gcaguguucacuguauuccu

SEQ ID NO: 115334 - RNA, 22 nt, Homo sapiens
gcaguguucugggcaggaagaa

SEQ ID NO: 115335 - RNA, 22 nt, Homo sapiens
gcaguguugugauccaggucuu

SEQ ID NO: 115336 - RNA, 22 nt, Homo sapiens
gcauggagaaggggacugauuc

SEQ ID NO: 115337 - RNA, 22 nt, Homo sapiens
gcaugugaauguguaagaaaau

SEQ ID NO: 115338 - RNA, 22 nt, Homo sapiens
gcauugcacuuggcauagacug

SEQ ID NO: 115339 - RNA, 22 nt, Homo sapiens
gccaguguguguuguucuccgc

SEQ ID NO: 115340 - RNA, 22 nt, Homo sapiens
gccauggaggauuuauagaggc

SEQ ID NO: 115341 - RNA, 22 nt, Homo sapiens
gccauugcacuccagccuagcg

SEQ ID NO: 115342 - RNA, 22 nt, Homo sapiens
gccauugcacuccagccuaggc

SEQ ID NO: 115343 - RNA, 22 nt, Homo sapiens
gccauugcacucuagccugagc

SEQ ID NO: 115344 - RNA, 22 nt, Homo sapiens
gcccuguguuuggguaugguca

SEQ ID NO: 115345 - RNA, 22 nt, Homo sapiens
gccgagagauuuggaaugggga

SEQ ID NO: 115346 - RNA, 22 nt, Homo sapiens
gccuagagaaguaaauauuauc

SEQ ID NO: 115347 - RNA, 22 nt, Homo sapiens
gcuccauuuuccauuucucuaa

SEQ ID NO: 115348 - RNA, 22 nt, Homo sapiens
gcucuuuugggguaauucugag

SEQ ID NO: 115349 - RNA, 22 nt, Homo sapiens
gcugcuuuugaugacaaaaaca

SEQ ID NO: 115350 - RNA, 22 nt, Homo sapiens
gcuggcuuucuccugaucucag

SEQ ID NO: 115351 - RNA, 22 nt, Homo sapiens
gcuggugacuuuaaguugaagc

SEQ ID NO: 115352 - RNA, 18 nt, Homo sapiens
gcuguugucagagcacau

SEQ ID NO: 115353 - RNA, 22 nt, Homo sapiens
gcuuguguucaaggaacaccua

SEQ ID NO: 115354 - RNA, 21 nt, Homo sapiens
gcuuuuucggaagucuuuggc

SEQ ID NO: 115355 - RNA, 23 nt, Homo sapiens
ggaaacauccagucuuucaccau

SEQ ID NO: 115356 - RNA, 22 nt, Homo sapiens
ggaaagaucagcuaaauguaag

SEQ ID NO: 115357 - RNA, 19 nt, Homo sapiens
ggaaaugucuauuaagauc

SEQ ID NO: 115358 - RNA, 22 nt, Homo sapiens
ggaagacuuagaguagcaucag

SEQ ID NO: 115359 - RNA, 22 nt, Homo sapiens
aaagcaucacuuuuccuacuuu

SEQ ID NO: 115360 - RNA, 22 nt, Homo sapiens
aaagcuaccagauucuguugga

SEQ ID NO: 115361 - RNA, 22 nt, Homo sapiens
aaaguaauugcaguuuuugcaa

SEQ ID NO: 115362 - RNA, 22 nt, Homo sapiens
aaagucuguuacagcuauuucu

SEQ ID NO: 115363 - RNA, 22 nt, Homo sapiens
aaagucuguuuugucagagacu

SEQ ID NO: 115364 - RNA, 22 nt, Homo sapiens
aaagugcaguacuucguauauu

SEQ ID NO: 115365 - RNA, 22 nt, Homo sapiens
aaagugcugagauuguaggcau

SEQ ID NO: 115366 - RNA, 22 nt, Homo sapiens
aaaguggugugaguauguaucu

SEQ ID NO: 115367 - RNA, 22 nt, Homo sapiens
aaaguguuucugcaguagguuu

SEQ ID NO: 115368 - RNA, 22 nt, Homo sapiens
aaaugcagucuuuguucugggc

SEQ ID NO: 115369 - RNA, 20 nt, Homo sapiens
aaaugcuguaauguuuggga

SEQ ID NO: 115370 - RNA, 22 nt, Homo sapiens
aaauggcacaguaagggcauuu

SEQ ID NO: 115371 - RNA, 22 nt, Homo sapiens
aacagacugucacauaaaauug

SEQ ID NO: 115372 - RNA, 22 nt, Homo sapiens
aacagagcuggugacuccaggu

SEQ ID NO: 115373 - RNA, 22 nt, Homo sapiens
aacagugcuucauucacacauu

SEQ ID NO: 115374 - RNA, 22 nt, Homo sapiens
aacauagucaugggguaauguu

SEQ ID NO: 115375 - RNA, 22 nt, Homo sapiens
aacauguuuagcagauaccugu

SEQ ID NO: 115376 - RNA, 22 nt, Homo sapiens
aaccacauggcucaguggacau

SEQ ID NO: 115377 - RNA, 20 nt, Homo sapiens
aagacacuguccccacugga

SEQ ID NO: 115378 - RNA, 22 nt, Homo sapiens
aagagcauuggauggggagauu

SEQ ID NO: 115379 - RNA, 22 nt, Homo sapiens
aagagcgcugauaacauguuug

SEQ ID NO: 115380 - RNA, 22 nt, Homo sapiens
aagcaucacauaauggaucaug

SEQ ID NO: 115381 - RNA, 22 nt, Homo sapiens
aagcuggcauucaugagauuac

SEQ ID NO: 115382 - RNA, 22 nt, Homo sapiens
aaggaacuggaauauuuugaac

SEQ ID NO: 115383 - RNA, 22 nt, Homo sapiens
aaggaguaucuguuuucucacc

SEQ ID NO: 115384 - RNA, 22 nt, Homo sapiens
aaggcaauuuguugugaggauu

SEQ ID NO: 115385 - RNA, 22 nt, Homo sapiens
aaggcacugaacuuaaauucug

SEQ ID NO: 115386 - RNA, 22 nt, Homo sapiens
aaggcuguuguguaauaggauu

SEQ ID NO: 115387 - RNA, 23 nt, Homo sapiens
aagguaagcuagaaagauguaga

SEQ ID NO: 115388 - RNA, 22 nt, Homo sapiens
aaggugcucucuuauguagaaa

SEQ ID NO: 115389 - RNA, 22 nt, Homo sapiens
aaguauuaugaguccuuguuuu

SEQ ID NO: 115390 - RNA, 22 nt, Homo sapiens
aagucacugagacuuguggcug

SEQ ID NO: 115391 - RNA, 22 nt, Homo sapiens
aagugcuguaugggagccuagg

SEQ ID NO: 115392 - RNA, 22 nt, Homo sapiens
aagugcuguccuaccuuuggga

SEQ ID NO: 115393 - RNA, 23 nt, Homo sapiens
aaguucaugcucaucuguuacac

SEQ ID NO: 115394 - RNA, 22 nt, Homo sapiens
aauacugaaaguauuuucaaau

SEQ ID NO: 115395 - RNA, 22 nt, Homo sapiens
aauaucacaguuggguguacac

SEQ ID NO: 115396 - RNA, 22 nt, Homo sapiens
aaucacaguuaguaagggagaa

SEQ ID NO: 115397 - RNA, 22 nt, Homo sapiens
aaucgcuuuugguaggcaagga

SEQ ID NO: 115398 - RNA, 22 nt, Homo sapiens
aaugccacugugccugccaagg

SEQ ID NO: 115399 - RNA, 22 nt, Homo sapiens
aaugcuaucuggaacauuguug

SEQ ID NO: 115400 - RNA, 22 nt, Homo sapiens
aauggcaagagccacagaggcg

SEQ ID NO: 115401 - RNA, 22 nt, Homo sapiens
aauggcaguagauggaugggua

SEQ ID NO: 115402 - RNA, 22 nt, Homo sapiens
aauggcuauuucaugugguagg

SEQ ID NO: 115403 - RNA, 22 nt, Homo sapiens
aauuaggcuagaauguuauuaa

SEQ ID NO: 115404 - RNA, 22 nt, Homo sapiens
agucagugcauaagaaugaagu

SEQ ID NO: 115405 - RNA, 22 nt, Homo sapiens
agucugguguucucacacuagu

SEQ ID NO: 115406 - RNA, 22 nt, Homo sapiens
agugaauguuggaaaguuauuu

SEQ ID NO: 115407 - RNA, 22 nt, Homo sapiens
agugcaauggugccaucauagc

SEQ ID NO: 115408 - RNA, 19 nt, Homo sapiens
agugcaauugccuuugugc

SEQ ID NO: 115409 - RNA, 22 nt, Homo sapiens
agugcauugcaucucugcuuca

SEQ ID NO: 115410 - RNA, 22 nt, Homo sapiens
agugggccccuagaggugaggu

SEQ ID NO: 115411 - RNA, 21 nt, Homo sapiens
aguucacauggcuccuguguu

SEQ ID NO: 115412 - RNA, 22 nt, Homo sapiens
aguuuugguugaguuacuagca

SEQ ID NO: 115413 - RNA, 22 nt, Homo sapiens
auaaaccuacauuuucacuucu

SEQ ID NO: 115414 - RNA, 22 nt, Homo sapiens
auaaagcuauuccucucuuuuu

SEQ ID NO: 115415 - RNA, 22 nt, Homo sapiens
auaaaugcuuagaucuguauau

SEQ ID NO: 115416 - RNA, 22 nt, Homo sapiens
auaaaugcuuccagucauuaaa

SEQ ID NO: 115417 - RNA, 22 nt, Homo sapiens
auaagaugaaggaagccauauc

SEQ ID NO: 115418 - RNA, 22 nt, Homo sapiens
auaaguagaaugauggucaaaa

SEQ ID NO: 115419 - RNA, 22 nt, Homo sapiens
auaaguauuuggacuuuacugu

SEQ ID NO: 115420 - RNA, 22 nt, Homo sapiens
auaaucaugucugaaaccuuug

SEQ ID NO: 115421 - RNA, 23 nt, Homo sapiens
auaaugcaaguggugguaaucug

SEQ ID NO: 115422 - RNA, 22 nt, Homo sapiens
auacaaggaaugaagagauuug

SEQ ID NO: 115423 - RNA, 22 nt, Homo sapiens
auacaguaucuucuggcaagca

SEQ ID NO: 115424 - RNA, 22 nt, Homo sapiens
auacguacauaugcacauaugg

SEQ ID NO: 115425 - RNA, 22 nt, Homo sapiens
auacugucucuugcuccugccc

SEQ ID NO: 115426 - RNA, 21 nt, Homo sapiens
auagcacaucagauuuuauua

SEQ ID NO: 115427 - RNA, 22 nt, Homo sapiens
auagcacauggcauccucucuu

SEQ ID NO: 115428 - RNA, 22 nt, Homo sapiens
auagcagaccaccucucccacu

SEQ ID NO: 115429 - RNA, 20 nt, Homo sapiens
auagcagcaugauuuauaau

SEQ ID NO: 115430 - RNA, 22 nt, Homo sapiens
auagcagugugaaaacagacug

SEQ ID NO: 115431 - RNA, 22 nt, Homo sapiens
auagcagugugaaaauggacua

SEQ ID NO: 115432 - RNA, 23 nt, Homo sapiens
auauaguagaugugcaguaacau

SEQ ID NO: 115433 - RNA, 22 nt, Homo sapiens
auauaugcacacgugugcauau

SEQ ID NO: 115434 - RNA, 22 nt, Homo sapiens
auaucccaguguguaaacacug

SEQ ID NO: 115435 - RNA, 20 nt, Homo sapiens
auaugcagacacauacauac

SEQ ID NO: 115436 - RNA, 22 nt, Homo sapiens
auaugcauacauguaugcagga

SEQ ID NO: 115437 - RNA, 22 nt, Homo sapiens
auaugcuaauuuuuagucgagc

SEQ ID NO: 115438 - RNA, 22 nt, Homo sapiens
auauuacuggcuauaucgcaag

SEQ ID NO: 115439 - RNA, 22 nt, Homo sapiens
aucaaaguaggcauauguuuuu

SEQ ID NO: 115440 - RNA, 22 nt, Homo sapiens
aucaaaguaucucaauauggua

SEQ ID NO: 115441 - RNA, 22 nt, Homo sapiens
aucaaguaaucugaguaagagu

SEQ ID NO: 115442 - RNA, 22 nt, Homo sapiens
aucacaauuguacguaggagcc

SEQ ID NO: 115443 - RNA, 22 nt, Homo sapiens
aucacagguacuauggcugaca

SEQ ID NO: 115444 - RNA, 22 nt, Homo sapiens
aucaccuggaggugaucacuug

SEQ ID NO: 115445 - RNA, 22 nt, Homo sapiens
aucacuggccuuuuuaaaugcu

SEQ ID NO: 115446 - RNA, 22 nt, Homo sapiens
aucacugggagcagccauuaau

SEQ ID NO: 115447 - RNA, 22 nt, Homo sapiens
aucacuggucaugagagaagua

SEQ ID NO: 115448 - RNA, 22 nt, Homo sapiens
aucagaaucucuugagaguguu

SEQ ID NO: 115449 - RNA, 22 nt, Homo sapiens
aucagcaugcagaagucggggg

SEQ ID NO: 115450 - RNA, 22 nt, Homo sapiens
aucagugagugguuagugaaug

SEQ ID NO: 115451 - RNA, 22 nt, Homo sapiens
aucauaucaucugcaaacaaag

SEQ ID NO: 115452 - RNA, 22 nt, Homo sapiens
aucauguuuauguguaggauau

SEQ ID NO: 115453 - RNA, 22 nt, Homo sapiens
aucauugugugaguugauggga

SEQ ID NO: 115454 - RNA, 22 nt, Homo sapiens
auccacaugcaguuggaaacag

SEQ ID NO: 115455 - RNA, 22 nt, Homo sapiens
aucccaguaaaaauggcuucua

SEQ ID NO: 115456 - RNA, 22 nt, Homo sapiens
aucccuuccuagcacuuggugu

SEQ ID NO: 115457 - RNA, 22 nt, Homo sapiens
auccucugagaucuaggcagag

SEQ ID NO: 115458 - RNA, 22 nt, Homo sapiens
auccuguaggcuaguagacagu

SEQ ID NO: 115459 - RNA, 22 nt, Homo sapiens
aucuacagccagucugguuugu

SEQ ID NO: 115460 - RNA, 22 nt, Homo sapiens
aucuagagacauaguaaagaau

SEQ ID NO: 115461 - RNA, 22 nt, Homo sapiens
aucucauuccuucugggcugau

SEQ ID NO: 115462 - RNA, 19 nt, Homo sapiens
aucuggaguuccuggggcu

SEQ ID NO: 115463 - RNA, 22 nt, Homo sapiens
uuugacuagaguguuuuacaac

SEQ ID NO: 115464 - RNA, 20 nt, Homo sapiens
uuugcagaaucuaagaagag

SEQ ID NO: 115465 - RNA, 21 nt, Homo sapiens
uuugcauauguugaaccagcc

SEQ ID NO: 115466 - RNA, 22 nt, Homo sapiens
uuugcuuaaaucuuaaucagau

SEQ ID NO: 115467 - RNA, 22 nt, Homo sapiens
uuuggaaugaaacagcagagcc

SEQ ID NO: 115468 - RNA, 22 nt, Homo sapiens
uuuggacuucuagccuccagag

SEQ ID NO: 115469 - RNA, 22 nt, Homo sapiens
uuuggcauuaagaugcuguauc

SEQ ID NO: 115470 - RNA, 22 nt, Homo sapiens
uuugggaaaugaaguugguaga

SEQ ID NO: 115471 - RNA, 22 nt, Homo sapiens
uuuggucuuuuguaaguuaucu

SEQ ID NO: 115472 - RNA, 22 nt, Homo sapiens
uuugguguauaaaaaugcuagu

SEQ ID NO: 115473 - RNA, 22 nt, Homo sapiens
uuuguacuugguguucuggaaa

SEQ ID NO: 115474 - RNA, 22 nt, Homo sapiens
uuugucacccugaauguaagau

SEQ ID NO: 115475 - RNA, 22 nt, Homo sapiens
uuugucuccuaagacucugugg

SEQ ID NO: 115476 - RNA, 20 nt, Homo sapiens
uuuuagcuuuuauugaaagc

SEQ ID NO: 115477 - RNA, 22 nt, Homo sapiens
uuuuaguggacaaagguauuua

SEQ ID NO: 115478 - RNA, 22 nt, Homo sapiens
uuuuaugggcuauuugcauuag

SEQ ID NO: 115479 - RNA, 22 nt, Homo sapiens
uuuucaguuuuccagguagccg

SEQ ID NO: 115480 - RNA, 22 nt, Homo sapiens
uuuugcacauugauuugguauc

SEQ ID NO: 115481 - RNA, 20 nt, Homo sapiens
uuuugcacuccuacuaaggu

SEQ ID NO: 115482 - RNA, 19 nt, Homo sapiens
uuuuggaaaugugaacagc

SEQ ID NO: 115483 - RNA, 22 nt, Homo sapiens
uuuuggcuuaaagagaauguau

SEQ ID NO: 115484 - RNA, 21 nt, Homo sapiens
uuuuggucauucaggaagaaa

SEQ ID NO: 115485 - RNA, 22 nt, Homo sapiens
uauuguuuuucccaggagucua

SEQ ID NO: 115486 - RNA, 22 nt, Homo sapiens
ucaaacauccccaccagggacu

SEQ ID NO: 115487 - RNA, 22 nt, Homo sapiens
ucaaagacacacaaggagaagg

SEQ ID NO: 115488 - RNA, 22 nt, Homo sapiens
ucaaaguaaagccucaggaugg

SEQ ID NO: 115489 - RNA, 18 nt, Homo sapiens
ucaaauacuuugggcagu

SEQ ID NO: 115490 - RNA, 22 nt, Homo sapiens
ucaaaugaucugcccgccuugg

SEQ ID NO: 115491 - RNA, 20 nt, Homo sapiens
ucaaggcaggaacuguacau

SEQ ID NO: 115492 - RNA, 22 nt, Homo sapiens
ucaaguacugccuugcucuggc

SEQ ID NO: 115493 - RNA, 22 nt, Homo sapiens
ucacacugaauuugaagcaaug

SEQ ID NO: 115494 - RNA, 22 nt, Homo sapiens
ucacacugucuugguuacucuu

SEQ ID NO: 115495 - RNA, 22 nt, Homo sapiens
ucacagauaaauaaagaugauu

SEQ ID NO: 115496 - RNA, 22 nt, Homo sapiens
ucacaguagccccucccaucau

SEQ ID NO: 115497 - RNA, 22 nt, Homo sapiens
ucacaguguuaaaccuuucuuu

SEQ ID NO: 115498 - RNA, 17 nt, Homo sapiens
ucacaguguuaggauga

SEQ ID NO: 115499 - RNA, 22 nt, Homo sapiens
ucacaucucagguuucuugaca

SEQ ID NO: 115500 - RNA, 22 nt, Homo sapiens
aauuaguuggcugggugcggug

SEQ ID NO: 115501 - RNA, 22 nt, Homo sapiens
aauugaaugauaugggacauuu

SEQ ID NO: 115502 - RNA, 22 nt, Homo sapiens
acaaaguaggcagugggcugga

SEQ ID NO: 115503 - RNA, 22 nt, Homo sapiens
acaagacuucuuguauucuagu

SEQ ID NO: 115504 - RNA, 23 nt, Homo sapiens
acacaguaaacuaaaagcuagcu

SEQ ID NO: 115505 - RNA, 22 nt, Homo sapiens
acacauuagcaagugcuguuau

SEQ ID NO: 115506 - RNA, 22 nt, Homo sapiens
acacuacuggguauauguguuu

SEQ ID NO: 115507 - RNA, 22 nt, Homo sapiens
acacuguuggugggaguguaaa

SEQ ID NO: 115508 - RNA, 22 nt, Homo sapiens
acagauugcugggccccagccc

SEQ ID NO: 115509 - RNA, 22 nt, Homo sapiens
acagcacugccaagugacccau

SEQ ID NO: 115510 - RNA, 22 nt, Homo sapiens
acagccauuccagccaaauacu

SEQ ID NO: 115511 - RNA, 20 nt, Homo sapiens
acaguagaagggauuucaaa

SEQ ID NO: 115512 - RNA, 18 nt, Homo sapiens
acagugcuggcaugagau

SEQ ID NO: 115513 - RNA, 22 nt, Homo sapiens
acagugcuguggucaugggucu

SEQ ID NO: 115514 - RNA, 23 nt, Homo sapiens
acaguggugugaucuuggcucag

SEQ ID NO: 115515 - RNA, 22 nt, Homo sapiens
acaguguacaauagccuuuuaa

SEQ ID NO: 115516 - RNA, 22 nt, Homo sapiens
acauaaagaagcaggacauugu

SEQ ID NO: 115517 - RNA, 22 nt, Homo sapiens
acauguaauugauuuuguguua

SEQ ID NO: 115518 - RNA, 21 nt, Homo sapiens
acauguacacauguaugcaca

SEQ ID NO: 115519 - RNA, 22 nt, Homo sapiens
accauugcacuccagcccaggc

SEQ ID NO: 115520 - RNA, 22 nt, Homo sapiens
acccaguguucaacauucacau

SEQ ID NO: 115521 - RNA, 22 nt, Homo sapiens
acccaguguucagacuaccugu

SEQ ID NO: 115522 - RNA, 22 nt, Homo sapiens
acccaguguugggcagaacugu

SEQ ID NO: 115523 - RNA, 22 nt, Homo sapiens
acccuacauaguagauccuaca

SEQ ID NO: 115524 - RNA, 22 nt, Homo sapiens
acccuggaguaguaggaaucug

SEQ ID NO: 115525 - RNA, 22 nt, Homo sapiens
accucagcccggggaaguugag

SEQ ID NO: 115526 - RNA, 22 nt, Homo sapiens
accugggugcugaugggcuuua

SEQ ID NO: 115527 - RNA, 22 nt, Homo sapiens
accuggguguauguucaguuug

SEQ ID NO: 115528 - RNA, 19 nt, Homo sapiens
accuguagaaaguacaaca

SEQ ID NO: 115529 - RNA, 22 nt, Homo sapiens
acuacugucagacugccacuga

SEQ ID NO: 115530 - RNA, 22 nt, Homo sapiens
acucacagcaaccuccgccucc

SEQ ID NO: 115531 - RNA, 22 nt, Homo sapiens
acucagagugggccccuagaua

SEQ ID NO: 115532 - RNA, 22 nt, Homo sapiens
acucugucuaguuguaaaauuu

SEQ ID NO: 115533 - RNA, 23 nt, Homo sapiens
acugagcaauguuuacauacuug

SEQ ID NO: 115534 - RNA, 22 nt, Homo sapiens
acugaucaauguuaaggcuuau

SEQ ID NO: 115535 - RNA, 22 nt, Homo sapiens
acugcaauuacuguuguaccaa

SEQ ID NO: 115536 - RNA, 21 nt, Homo sapiens
acugcacuccaaccucaacag

SEQ ID NO: 115537 - RNA, 18 nt, Homo sapiens
acugcacuccaccuuggg

SEQ ID NO: 115538 - RNA, 22 nt, Homo sapiens
acugcacuccaccuugggcaac

SEQ ID NO: 115539 - RNA, 22 nt, Homo sapiens
acugcacuccagccucaugaca

SEQ ID NO: 115540 - RNA, 22 nt, Homo sapiens
acugcacuccagccucccgucu

SEQ ID NO: 115541 - RNA, 22 nt, Homo sapiens
acugcacuccagccuccugggu

SEQ ID NO: 115542 - RNA, 22 nt, Homo sapiens
acugcacuccagccucggcaau

SEQ ID NO: 115543 - RNA, 22 nt, Homo sapiens
acugcacuccagccucguggac

SEQ ID NO: 115544 - RNA, 22 nt, Homo sapiens
acugcacuccagccugccgaca

SEQ ID NO: 115545 - RNA, 22 nt, Homo sapiens
acugcacuccagccugcugaca

SEQ ID NO: 115546 - RNA, 22 nt, Homo sapiens
acugcacuccagccuggacgac

SEQ ID NO: 115547 - RNA, 22 nt, Homo sapiens
acugcacuccagccugugcgua

SEQ ID NO: 115548 - RNA, 22 nt, Homo sapiens
acugcacuccagccuguugaca

SEQ ID NO: 115549 - RNA, 22 nt, Homo sapiens
acugcacuccagccuuagugac

SEQ ID NO: 115550 - RNA, 22 nt, Homo sapiens
acugcacuccagccuuggcaac

SEQ ID NO: 115551 - RNA, 22 nt, Homo sapiens
acugcacuccagccuuugcgau

SEQ ID NO: 115552 - RNA, 22 nt, Homo sapiens
acugcacuccaguuccgggcaa

SEQ ID NO: 115553 - RNA, 22 nt, Homo sapiens
acugcacuccaguuugggcagc

SEQ ID NO: 115554 - RNA, 22 nt, Homo sapiens
acugcacucuagccuuggcaac

SEQ ID NO: 115555 - RNA, 22 nt, Homo sapiens
acugcacugucaaccuccuggg

SEQ ID NO: 115556 - RNA, 22 nt, Homo sapiens
acugcacuguccuagaguccuc

SEQ ID NO: 115557 - RNA, 22 nt, Homo sapiens
acugcacuucagccuguugaca

SEQ ID NO: 115558 - RNA, 22 nt, Homo sapiens
acugcacuucagccuuggcuac

SEQ ID NO: 115559 - RNA, 22 nt, Homo sapiens
acuggacuuaaugaugaauugu

SEQ ID NO: 115560 - RNA, 22 nt, Homo sapiens
acuggcaauggcagaaauaguu

SEQ ID NO: 115561 - RNA, 22 nt, Homo sapiens
acuguacuccagccugggcaac

SEQ ID NO: 115562 - RNA, 22 nt, Homo sapiens
acuguauagauggaguugauuu

SEQ ID NO: 115563 - RNA, 22 nt, Homo sapiens
acuuuguuauggcaacccuaag

SEQ ID NO: 115564 - RNA, 22 nt, Homo sapiens
acuuuuguuauacagugugaua

SEQ ID NO: 115565 - RNA, 20 nt, Homo sapiens
agaagcauugcucucuucag

SEQ ID NO: 115566 - RNA, 22 nt, Homo sapiens
agaauaauguccccccaaggga

SEQ ID NO: 115567 - RNA, 22 nt, Homo sapiens
agaaugucagcuggauucagcu

SEQ ID NO: 115568 - RNA, 22 nt, Homo sapiens
agaaugugaccuuauuuggaga

SEQ ID NO: 115569 - RNA, 22 nt, Homo sapiens
agacuagacagaugaacagcac

SEQ ID NO: 115570 - RNA, 22 nt, Homo sapiens
agagaucaauaugaaggaaaug

SEQ ID NO: 115571 - RNA, 22 nt, Homo sapiens
agauaugucugcuauuugcugu

SEQ ID NO: 115572 - RNA, 22 nt, Homo sapiens
agcaagaugaaguugagcuagg

SEQ ID NO: 115573 - RNA, 22 nt, Homo sapiens
agcaagauuguucccauuuucu

SEQ ID NO: 115574 - RNA, 22 nt, Homo sapiens
agcacagugguuaaguuucuua

SEQ ID NO: 115575 - RNA, 22 nt, Homo sapiens
agcaccaauaaucagaguucuu

SEQ ID NO: 115576 - RNA, 22 nt, Homo sapiens
agcagagcaguggauuuuguga

SEQ ID NO: 115577 - RNA, 22 nt, Homo sapiens
agcagcuuugaucugaaugauu

SEQ ID NO: 115578 - RNA, 20 nt, Homo sapiens
agcaucacagagccgggugu

SEQ ID NO: 115579 - RNA, 22 nt, Homo sapiens
agcaucauaccaaucugguccu

SEQ ID NO: 115580 - RNA, 19 nt, Homo sapiens
agcaucauuauuguuuugg

SEQ ID NO: 115581 - RNA, 22 nt, Homo sapiens
agccccauuuguugaaaagacg

SEQ ID NO: 115582 - RNA, 22 nt, Homo sapiens
agccucauucuacauguuaaug

SEQ ID NO: 115583 - RNA, 23 nt, Homo sapiens
agcuagagaggcuggggauacag

SEQ ID NO: 115584 - RNA, 20 nt, Homo sapiens
agcugcagauauaaauccgc

SEQ ID NO: 115585 - RNA, 22 nt, Homo sapiens
agcugccagucuuguaaggccu

SEQ ID NO: 115586 - RNA, 22 nt, Homo sapiens
agcuggaauuuaagguagauag

SEQ ID NO: 115587 - RNA, 22 nt, Homo sapiens
agcuggauguggaugacccugu

SEQ ID NO: 115588 - RNA, 22 nt, Homo sapiens
agcuggucuuggggaagaguag

SEQ ID NO: 115589 - RNA, 21 nt, Homo sapiens
agcugguuuccacagugugcu

SEQ ID NO: 115590 - RNA, 22 nt, Homo sapiens
agcuguuuuugugggcauguga

SEQ ID NO: 115591 - RNA, 21 nt, Homo sapiens
aggagcauucaugacgagguu

SEQ ID NO: 115592 - RNA, 20 nt, Homo sapiens
aggagcauuuacauuggcuc

SEQ ID NO: 115593 - RNA, 22 nt, Homo sapiens
aggcaaugugagaguuuauuca

SEQ ID NO: 115594 - RNA, 19 nt, Homo sapiens
aggcauugugcucaucugu

SEQ ID NO: 115595 - RNA, 23 nt, Homo sapiens
agggcacuauagauguuauucua

SEQ ID NO: 115596 - RNA, 22 nt, Homo sapiens
agggccuuuguagauguacuca

SEQ ID NO: 115597 - RNA, 22 nt, Homo sapiens
agguaguguuauuugcagcuga

SEQ ID NO: 115598 - RNA, 22 nt, Homo sapiens
aggugaaugcucacauucuaau

SEQ ID NO: 115599 - RNA, 22 nt, Homo sapiens
aggugguauuucaaaguggcag

SEQ ID NO: 115600 - RNA, 22 nt, Homo sapiens
aguauuaggugaguguauuuca

SEQ ID NO: 115601 - RNA, 22 nt, Homo sapiens
agucagauuggcauuuguuggg

SEQ ID NO: 115602 - RNA, 22 nt, Homo sapiens
acaccauugcauuccagccugg

SEQ ID NO: 115603 - RNA, 22 nt, Homo sapiens
acacuggaguuaaaggugauuu

SEQ ID NO: 115604 - RNA, 19 nt, Homo sapiens
acagcugguuuugguuucu

SEQ ID NO: 115605 - RNA, 19 nt, Homo sapiens
acaguaccuggcaugaggu

SEQ ID NO: 115606 - RNA, 22 nt, Homo sapiens
acaguauaaugcuguagggaga

SEQ ID NO: 115607 - RNA, 18 nt, Homo sapiens
acagugcugucacugcuu

SEQ ID NO: 115608 - RNA, 18 nt, Homo sapiens
acagugucauggcucaau

SEQ ID NO: 115609 - RNA, 22 nt, Homo sapiens
acauaguagacacugaaaauau

SEQ ID NO: 115610 - RNA, 22 nt, Homo sapiens
acauaugaguacaugugccaug

SEQ ID NO: 115611 - RNA, 21 nt, Homo sapiens
acaucagaguugugaagguag

SEQ ID NO: 115612 - RNA, 22 nt, Homo sapiens
acaucccaugccuggguacucc

SEQ ID NO: 115613 - RNA, 22 nt, Homo sapiens
acaugcauccaugugaagagac

SEQ ID NO: 115614 - RNA, 19 nt, Homo sapiens
accagauugcauucuugga

SEQ ID NO: 115615 - RNA, 22 nt, Homo sapiens
acccagaauucagucuuaggcc

SEQ ID NO: 115616 - RNA, 22 nt, Homo sapiens
accccuuacaucagcucuggua

SEQ ID NO: 115617 - RNA, 22 nt, Homo sapiens
acccuggaggucuacagugcag

SEQ ID NO: 115618 - RNA, 22 nt, Homo sapiens
acccuggauucguggccuugaa

SEQ ID NO: 115619 - RNA, 22 nt, Homo sapiens
acccugucaaaauagaccaauc

SEQ ID NO: 115620 - RNA, 22 nt, Homo sapiens
acccugucacucccaucaauuu

SEQ ID NO: 115621 - RNA, 22 nt, Homo sapiens
acccugugaauauuuaaacuuc

SEQ ID NO: 115622 - RNA, 22 nt, Homo sapiens
acgaagacuauucaaaagguua

SEQ ID NO: 115623 - RNA, 22 nt, Homo sapiens
acuaugagacgaaugcaucagu

SEQ ID NO: 115624 - RNA, 22 nt, Homo sapiens
acuccauuucauuuuagcucuu

SEQ ID NO: 115625 - RNA, 22 nt, Homo sapiens
ugcugcaaucucggcacuuugg

SEQ ID NO: 115626 - RNA, 22 nt, Homo sapiens
ugcuggugucaucaaggcuuug

SEQ ID NO: 115627 - RNA, 22 nt, Homo sapiens
ugcugguguuuaggaauaagaa

SEQ ID NO: 115628 - RNA, 21 nt, Homo sapiens
ugcuuacugaauguuaauuuc

SEQ ID NO: 115629 - RNA, 18 nt, Homo sapiens
ugcuuagucauuuucaau

SEQ ID NO: 115630 - RNA, 21 nt, Homo sapiens
uggaacgcaaaugagaugaau

SEQ ID NO: 115631 - RNA, 22 nt, Homo sapiens
uggaaguauagauaauugaaag

SEQ ID NO: 115632 - RNA, 22 nt, Homo sapiens
uggaagugucugugcccagcuc

SEQ ID NO: 115633 - RNA, 20 nt, Homo sapiens
uggaaucugaagaucucagu

SEQ ID NO: 115634 - RNA, 22 nt, Homo sapiens
uggaauggagagagggugcacg

SEQ ID NO: 115635 - RNA, 22 nt, Homo sapiens
uggaaugugaauaacuuccuuc

SEQ ID NO: 115636 - RNA, 22 nt, Homo sapiens
uggaauguuauggcuuuaaucu

SEQ ID NO: 115637 - RNA, 22 nt, Homo sapiens
uggacaagauagguucuauauu

SEQ ID NO: 115638 - RNA, 22 nt, Homo sapiens
uggaccccugcucgggagcccu

SEQ ID NO: 115639 - RNA, 22 nt, Homo sapiens
uggagacaaagauagaaaagca

SEQ ID NO: 115640 - RNA, 22 nt, Homo sapiens
uggagagcaaaaucaauccaaa

SEQ ID NO: 115641 - RNA, 20 nt, Homo sapiens
uggagugaagguucuggacc

SEQ ID NO: 115642 - RNA, 22 nt, Homo sapiens
uggauagaacuaagugcuuaga

SEQ ID NO: 115643 - RNA, 22 nt, Homo sapiens
uggauagauacuauccaggacu

SEQ ID NO: 115644 - RNA, 22 nt, Homo sapiens
uggcaaaaaaacgcaauuacgu

SEQ ID NO: 115645 - RNA, 22 nt, Homo sapiens
uggcaugucguuuuucauagga

SEQ ID NO: 115646 - RNA, 20 nt, Homo sapiens
uggcauguugguaugcaccc

SEQ ID NO: 115647 - RNA, 22 nt, Homo sapiens
uggcuacagaaaguacuaguga

SEQ ID NO: 115648 - RNA, 18 nt, Homo sapiens
uggcuacugaacuagaug

SEQ ID NO: 115649 - RNA, 19 nt, Homo sapiens
uggcuagaggccaggcguu

SEQ ID NO: 115650 - RNA, 22 nt, Homo sapiens
uuuuggcacuuugucugauucu

SEQ ID NO: 115651 - RNA, 20 nt, Homo sapiens
uuuuggcuuaaagcagucug

SEQ ID NO: 115652 - RNA, 22 nt, Homo sapiens
uggcucuuucuagacuuaauua

SEQ ID NO: 115653 - RNA, 22 nt, Homo sapiens
uggcuuuguaagguuucauuuu

SEQ ID NO: 115654 - RNA, 22 nt, Homo sapiens
ugggaaauguagccuagcugug

SEQ ID NO: 115655 - RNA, 22 nt, Homo sapiens
ugggaacugaggugaaaagaca

SEQ ID NO: 115656 - RNA, 22 nt, Homo sapiens
ugggaagcugcauuuuaacaag

SEQ ID NO: 115657 - RNA, 22 nt, Homo sapiens
ugggagcauugcauuagaagcc

SEQ ID NO: 115658 - RNA, 22 nt, Homo sapiens
ugggauguagccuucuauuuuc

SEQ ID NO: 115659 - RNA, 22 nt, Homo sapiens
ugggaugugagucuucgcuuuc

SEQ ID NO: 115660 - RNA, 22 nt, Homo sapiens
ugggcaaauugugagggaggua

SEQ ID NO: 115661 - RNA, 22 nt, Homo sapiens
ugggcaagugacuuggcuucuc

SEQ ID NO: 115662 - RNA, 22 nt, Homo sapiens
uggucccaugaacuuuagguca

SEQ ID NO: 115663 - RNA, 22 nt, Homo sapiens
uggugcuugaugaggguggagc

SEQ ID NO: 115664 - RNA, 22 nt, Homo sapiens
ugguggcuuuucguagguucac

SEQ ID NO: 115665 - RNA, 22 nt, Homo sapiens
uguaaaccauauauguauguag

SEQ ID NO: 115666 - RNA, 22 nt, Homo sapiens
uguaaaucuuucacaguugaug

SEQ ID NO: 115667 - RNA, 22 nt, Homo sapiens
ugucaacauuuaucaaguuauu

SEQ ID NO: 115668 - RNA, 22 nt, Homo sapiens
ugucaaggaaugucauugguuu

SEQ ID NO: 115669 - RNA, 23 nt, Homo sapiens
ugucaucaagaugaggucacacu

SEQ ID NO: 115670 - RNA, 22 nt, Homo sapiens
uguccaaaucagagguaccaaa

SEQ ID NO: 115671 - RNA, 20 nt, Homo sapiens
ugucccaaccccauggguuc

SEQ ID NO: 115672 - RNA, 22 nt, Homo sapiens
ugucccugagccuggauuccug

SEQ ID NO: 115673 - RNA, 22 nt, Homo sapiens
uguccugaagcuuuguuaugua

SEQ ID NO: 115674 - RNA, 21 nt, Homo sapiens
ugugaaaucuaggcagagguu

SEQ ID NO: 115675 - RNA, 22 nt, Homo sapiens
ugugaacagaauuagucaccua

SEQ ID NO: 115676 - RNA, 20 nt, Homo sapiens
ugugaacuguagauagucuu

SEQ ID NO: 115677 - RNA, 19 nt, Homo sapiens
ugugaagaaaugcugcaag

SEQ ID NO: 115678 - RNA, 22 nt, Homo sapiens
ugugaauggugcugcaaugaac

SEQ ID NO: 115679 - RNA, 22 nt, Homo sapiens
ugugacaaauuuaguggacugu

SEQ ID NO: 115680 - RNA, 18 nt, Homo sapiens
ugugacauugagcauguc

SEQ ID NO: 115681 - RNA, 22 nt, Homo sapiens
ugugaugugaugagaaguuccu

SEQ ID NO: 115682 - RNA, 22 nt, Homo sapiens
ugugauguggagggcagaucca

SEQ ID NO: 115683 - RNA, 22 nt, Homo sapiens
ugugccacugcacuccugggug

SEQ ID NO: 115684 - RNA, 22 nt, Homo sapiens
ugugcuaauacauacagugcua

SEQ ID NO: 115685 - RNA, 22 nt, Homo sapiens
ugugcuauguuauucacauggg

SEQ ID NO: 115686 - RNA, 22 nt, Homo sapiens
ugugcucaucucagucaacugu

SEQ ID NO: 115687 - RNA, 22 nt, Homo sapiens
uguggcacuguguccagagaaa

SEQ ID NO: 115688 - RNA, 22 nt, Homo sapiens
uguggcauuuucagaaaggaug

SEQ ID NO: 115689 - RNA, 22 nt, Homo sapiens
uguggccuuuguuucaguuggg

SEQ ID NO: 115690 - RNA, 22 nt, Homo sapiens
uguggcugguggcaccuuuucc

SEQ ID NO: 115691 - RNA, 18 nt, Homo sapiens
uguggcuguuuuccaaua

SEQ ID NO: 115692 - RNA, 22 nt, Homo sapiens
uguuacagugacuaauguuuua

SEQ ID NO: 115693 - RNA, 22 nt, Homo sapiens
uguuauguuuuagagguuucaa

SEQ ID NO: 115694 - RNA, 22 nt, Homo sapiens
uguucaauucccaccuaugagu

SEQ ID NO: 115695 - RNA, 18 nt, Homo sapiens
uguugguguucacucacu

SEQ ID NO: 115696 - RNA, 22 nt, Homo sapiens
uguugguuaaaucagguuuuaa

SEQ ID NO: 115697 - RNA, 22 nt, Homo sapiens
uguuugcuguguggaguagcag

SEQ ID NO: 115698 - RNA, 22 nt, Homo sapiens
uguuugcuguuuucuccaauga

SEQ ID NO: 115699 - RNA, 22 nt, Homo sapiens
uguuuuggaggccagaagucca

SEQ ID NO: 115700 - RNA, 22 nt, Homo sapiens
uuaacacugccauugauacugu

SEQ ID NO: 115701 - RNA, 21 nt, Homo sapiens
uuaacagacaagugucuuccc

SEQ ID NO: 115702 - RNA, 22 nt, Homo sapiens
uuaagagugggaguuggccaca

SEQ ID NO: 115703 - RNA, 22 nt, Homo sapiens
uuaaggcagugucuaugccagu

SEQ ID NO: 115704 - RNA, 22 nt, Homo sapiens
uuaaggcuuucccuauguaaaa

SEQ ID NO: 115705 - RNA, 22 nt, Homo sapiens
uuaaguaaucagagaagagaac

SEQ ID NO: 115706 - RNA, 20 nt, Homo sapiens
uuaagugcuuucugcuuaga

SEQ ID NO: 115707 - RNA, 22 nt, Homo sapiens
uuaauccugccuuauuucagua

SEQ ID NO: 115708 - RNA, 22 nt, Homo sapiens
uuacaguagaugaggguauaau

SEQ ID NO: 115709 - RNA, 21 nt, Homo sapiens
uuacaguugguugugaggugg

SEQ ID NO: 115710 - RNA, 22 nt, Homo sapiens
uuacugcuagcugugugcucuu

SEQ ID NO: 115711 - RNA, 22 nt, Homo sapiens
uuacuguagugucauaucguau

SEQ ID NO: 115712 - RNA, 22 nt, Homo sapiens
uuagaacuagaggaguuugagu

SEQ ID NO: 115713 - RNA, 22 nt, Homo sapiens
uuagagcacugaucugcucuuu

SEQ ID NO: 115714 - RNA, 22 nt, Homo sapiens
uuagagguaggauuucaccaug

SEQ ID NO: 115715 - RNA, 22 nt, Homo sapiens
uuagcagcaugaaaauggacug

SEQ ID NO: 115716 - RNA, 22 nt, Homo sapiens
uuagcagugugaaaaaagacua

SEQ ID NO: 115717 - RNA, 20 nt, Homo sapiens
uuauaacuuuuguucugggg

SEQ ID NO: 115718 - RNA, 22 nt, Homo sapiens
uuauagcacuaagaagguaaua

SEQ ID NO: 115719 - RNA, 22 nt, Homo sapiens
uuaucagcagcaugaaaauaga

SEQ ID NO: 115720 - RNA, 22 nt, Homo sapiens
uuaucagcagugcgaaaacaga

SEQ ID NO: 115721 - RNA, 22 nt, Homo sapiens
uuaugaaguagguuaagagcag

SEQ ID NO: 115722 - RNA, 22 nt, Homo sapiens
uuaugcaucuuccacacucauu

SEQ ID NO: 115723 - RNA, 22 nt, Homo sapiens
uuaugcuuauugguguacggua

SEQ ID NO: 115724 - RNA, 22 nt, Homo sapiens
uuaugcuugugugaauuuuccc

SEQ ID NO: 115725 - RNA, 22 nt, Homo sapiens
uuauguaaaucaaucuggaauc

SEQ ID NO: 115726 - RNA, 22 nt, Homo sapiens
uuauuagcacccuaccaugugg

SEQ ID NO: 115727 - RNA, 22 nt, Homo sapiens
uuauuagguugguggaaaagua

SEQ ID NO: 115728 - RNA, 22 nt, Homo sapiens
uuauugcuaaaucaugaccaca

SEQ ID NO: 115729 - RNA, 22 nt, Homo sapiens
uuauugcuuuugugcaggugag

SEQ ID NO: 115730 - RNA, 22 nt, Homo sapiens
uucaaaguaaagggauggagac

SEQ ID NO: 115731 - RNA, 22 nt, Homo sapiens
uucaaaguuggaggacaaacug

SEQ ID NO: 115732 - RNA, 22 nt, Homo sapiens
ucuuuugugagucagccucucc

SEQ ID NO: 115733 - RNA, 22 nt, Homo sapiens
ucuuuuugagucaguuucggua

SEQ ID NO: 115734 - RNA, 22 nt, Homo sapiens
ugaaaaguuguugaaggcuuca

SEQ ID NO: 115735 - RNA, 21 nt, Homo sapiens
ugaaaugcaugugcacauuaa

SEQ ID NO: 115736 - RNA, 22 nt, Homo sapiens
ugaaaugucuuuaggaggcuuc

SEQ ID NO: 115737 - RNA, 22 nt, Homo sapiens
ugaaauguguuaucugggccug

SEQ ID NO: 115738 - RNA, 22 nt, Homo sapiens
ugaacucagcauccagggccaa

SEQ ID NO: 115739 - RNA, 22 nt, Homo sapiens
ugaaggaguauggauaagucgu

SEQ ID NO: 115740 - RNA, 18 nt, Homo sapiens
ugaauacagcguugggaa

SEQ ID NO: 115741 - RNA, 20 nt, Homo sapiens
ugacaaggugcaaagaauca

SEQ ID NO: 115742 - RNA, 22 nt, Homo sapiens
ugacagagaagcauugaguuca

SEQ ID NO: 115743 - RNA, 22 nt, Homo sapiens
ugacaguguccucauucccaac

SEQ ID NO: 115744 - RNA, 22 nt, Homo sapiens
ugacauguagagaacuucucau

SEQ ID NO: 115745 - RNA, 22 nt, Homo sapiens
ugacauguauaucuuacgcuau

SEQ ID NO: 115746 - RNA, 22 nt, Homo sapiens
ugaccagaaaacaaauuaguuu

SEQ ID NO: 115747 - RNA, 22 nt, Homo sapiens
ugacuaaaacugaguuucauua

SEQ ID NO: 115748 - RNA, 22 nt, Homo sapiens
ugacuacacacaauuugucaag

SEQ ID NO: 115749 - RNA, 22 nt, Homo sapiens
ugacuugaacuucuaugucacc

SEQ ID NO: 115750 - RNA, 22 nt, Homo sapiens
ugagaacuuauggugauuuuuu

SEQ ID NO: 115751 - RNA, 22 nt, Homo sapiens
ugagaaugacugggcaugcugc

SEQ ID NO: 115752 - RNA, 22 nt, Homo sapiens
ugagacugagucuugcucuugu

SEQ ID NO: 115753 - RNA, 22 nt, Homo sapiens
ugagacugaguuucucucuugu

SEQ ID NO: 115754 - RNA, 22 nt, Homo sapiens
ugagagacagacauuaucuuau

SEQ ID NO: 115755 - RNA, 22 nt, Homo sapiens
ugagagacaguuucgucggagg

SEQ ID NO: 115756 - RNA, 22 nt, Homo sapiens
ugagagaugaacucugauaugu

SEQ ID NO: 115757 - RNA, 22 nt, Homo sapiens
ugagagcuuuuuugccugguga

SEQ ID NO: 115758 - RNA, 22 nt, Homo sapiens
ugagaucaacugagucagagca

SEQ ID NO: 115759 - RNA, 22 nt, Homo sapiens
ugagaucagaaggauuucucug

SEQ ID NO: 115760 - RNA, 20 nt, Homo sapiens
ugagauccacgugaaguaug

SEQ ID NO: 115761 - RNA, 19 nt, Homo sapiens
ugagaucuuuacuggguuu

SEQ ID NO: 115762 - RNA, 22 nt, Homo sapiens
ugagaugaagucucacucuguc

SEQ ID NO: 115763 - RNA, 22 nt, Homo sapiens
ugagaugagggcugcacucaaa

SEQ ID NO: 115764 - RNA, 22 nt, Homo sapiens
ugagaugaggucucgcucuguc

SEQ ID NO: 115765 - RNA, 22 nt, Homo sapiens
ugagaugaucaaaguauaggcu

SEQ ID NO: 115766 - RNA, 22 nt, Homo sapiens
ugagaugcucgccggccagcau

SEQ ID NO: 115767 - RNA, 22 nt, Homo sapiens
ugagauucucugauuguagguc

SEQ ID NO: 115768 - RNA, 22 nt, Homo sapiens
ugagauuguucuaugucugguu

SEQ ID NO: 115769 - RNA, 22 nt, Homo sapiens
ugagcaaaauuuuggacauaga

SEQ ID NO: 115770 - RNA, 22 nt, Homo sapiens
ugagcagaaagcugcaaggucg

SEQ ID NO: 115771 - RNA, 22 nt, Homo sapiens
ugagcagaaguuuugauuggcg

SEQ ID NO: 115772 - RNA, 22 nt, Homo sapiens
ugagcagagggagaaguaaauu

SEQ ID NO: 115773 - RNA, 22 nt, Homo sapiens
ugagccaaugauuugaauagag

SEQ ID NO: 115774 - RNA, 22 nt, Homo sapiens
ugagcuaggauccugucacugu

SEQ ID NO: 115775 - RNA, 22 nt, Homo sapiens
ugagcucaugcauucuugagga

SEQ ID NO: 115776 - RNA, 18 nt, Homo sapiens
ugaggaaaggguuugcua

SEQ ID NO: 115777 - RNA, 17 nt, Homo sapiens
ugagggaugccugguuc

SEQ ID NO: 115778 - RNA, 22 nt, Homo sapiens
ugagguacaacauggacugaag

SEQ ID NO: 115779 - RNA, 21 nt, Homo sapiens
ugaggucaugaugcugcuucc

SEQ ID NO: 115780 - RNA, 22 nt, Homo sapiens
ugaguacugauuuaagauacac

SEQ ID NO: 115781 - RNA, 22 nt, Homo sapiens
ugaguaguauucuaugguaugu

SEQ ID NO: 115782 - RNA, 22 nt, Homo sapiens
ugaguagucuagaguggaaugu

SEQ ID NO: 115783 - RNA, 22 nt, Homo sapiens
ugagucagucucacucugcugc

SEQ ID NO: 115784 - RNA, 22 nt, Homo sapiens
ugagugaggcugggcagucccu

SEQ ID NO: 115785 - RNA, 22 nt, Homo sapiens
ugagugccuggagggcagggac

SEQ ID NO: 115786 - RNA, 22 nt, Homo sapiens
ugaguggagacuguguguagag

SEQ ID NO: 115787 - RNA, 22 nt, Homo sapiens
ugaguucaauguuaaugaagca

SEQ ID NO: 115788 - RNA, 22 nt, Homo sapiens
ugaguucauggucauuugucac

SEQ ID NO: 115789 - RNA, 18 nt, Homo sapiens
ugaguucauuagacuucc

SEQ ID NO: 115790 - RNA, 22 nt, Homo sapiens
ugaguuccuugugugaccuugc

SEQ ID NO: 115791 - RNA, 21 nt, Homo sapiens
ugauaugguuuggauaugugu

SEQ ID NO: 115792 - RNA, 22 nt, Homo sapiens
ugauaugucacuugaucauggu

SEQ ID NO: 115793 - RNA, 20 nt, Homo sapiens
ugauauuuucugagcaggaa

SEQ ID NO: 115794 - RNA, 22 nt, Homo sapiens
ugauguugaauuguucagcguc

SEQ ID NO: 115795 - RNA, 22 nt, Homo sapiens
ugauuagagcccaagcuuugaa

SEQ ID NO: 115796 - RNA, 22 nt, Homo sapiens
ugcaaagaaauuuuggugacca

SEQ ID NO: 115797 - RNA, 22 nt, Homo sapiens
ugcaagaaucagccuaucauua

SEQ ID NO: 115798 - RNA, 22 nt, Homo sapiens
ugcaccaauucuaaacaguucu

SEQ ID NO: 115799 - RNA, 23 nt, Homo sapiens
ugcagcuacauguggccaugugc

SEQ ID NO: 115800 - RNA, 18 nt, Homo sapiens
ugcagcuuugugauuggc

SEQ ID NO: 115801 - RNA, 21 nt, Homo sapiens
ugcagugugguugcccugcug

SEQ ID NO: 115802 - RNA, 22 nt, Homo sapiens
ugcauacacaagcauacaugua

SEQ ID NO: 115803 - RNA, 21 nt, Homo sapiens
ugcauaucucuaaugaccagu

SEQ ID NO: 115804 - RNA, 21 nt, Homo sapiens
ugcauggagaacacugagggu

SEQ ID NO: 115805 - RNA, 22 nt, Homo sapiens
ugccagagacguagggaauauu

SEQ ID NO: 115806 - RNA, 22 nt, Homo sapiens
ugccaugaagagaggaagcagu

SEQ ID NO: 115807 - RNA, 18 nt, Homo sapiens
ugccuacugggcucaagc

SEQ ID NO: 115808 - RNA, 22 nt, Homo sapiens
ugccugagcccagcccuguagu

SEQ ID NO: 115809 - RNA, 22 nt, Homo sapiens
ugccugcugucuaauauauucu

SEQ ID NO: 115810 - RNA, 22 nt, Homo sapiens
ugcucaccugcugcucaccucc

SEQ ID NO: 115811 - RNA, 23 nt, Homo sapiens
ugcuccccucauggaugaauaaa

SEQ ID NO: 115812 - RNA, 18 nt, Homo sapiens
ugcuccccugggugagca

SEQ ID NO: 115813 - RNA, 19 nt, Homo sapiens
ugcugcauugugaccuugc

SEQ ID NO: 115814 - RNA, 22 nt, Homo sapiens
ugcuggugauucagauucaaau

SEQ ID NO: 115815 - RNA, 20 nt, Homo sapiens
uggaaaguaagucaugauau

SEQ ID NO: 115816 - RNA, 20 nt, Homo sapiens
uggaagccuggugcuaucuu

SEQ ID NO: 115817 - RNA, 22 nt, Homo sapiens
uggaaucaucaacgaaugaaau

SEQ ID NO: 115818 - RNA, 21 nt, Homo sapiens
uggaaucuauuauuccaguuu

SEQ ID NO: 115819 - RNA, 22 nt, Homo sapiens
uggaaugcucuccccacggacu

SEQ ID NO: 115820 - RNA, 22 nt, Homo sapiens
uggaauuaauccuccugguuuc

SEQ ID NO: 115821 - RNA, 22 nt, Homo sapiens
uggacagaaacauguuuucagu

SEQ ID NO: 115822 - RNA, 22 nt, Homo sapiens
uggacagacaagguuauagauc

SEQ ID NO: 115823 - RNA, 21 nt, Homo sapiens
uggaccccuuccagucaucau

SEQ ID NO: 115824 - RNA, 22 nt, Homo sapiens
uggagagugagggccuccuuaa

SEQ ID NO: 115825 - RNA, 20 nt, Homo sapiens
uggaggucaucugucacuac

SEQ ID NO: 115826 - RNA, 22 nt, Homo sapiens
uggagugaaaacacacuaaucu

SEQ ID NO: 115827 - RNA, 22 nt, Homo sapiens
uggagugauaugguuauauggg

SEQ ID NO: 115828 - RNA, 22 nt, Homo sapiens
uggaguguaauuagccaucagu

SEQ ID NO: 115829 - RNA, 22 nt, Homo sapiens
uggagugucaguuuccagaguu

SEQ ID NO: 115830 - RNA, 22 nt, Homo sapiens
uggcaaaauggaauauguuggg

SEQ ID NO: 115831 - RNA, 22 nt, Homo sapiens
uggcaaaugaagucagcuguac

SEQ ID NO: 115832 - RNA, 22 nt, Homo sapiens
uggcaaauguaguacccaauag

SEQ ID NO: 115833 - RNA, 22 nt, Homo sapiens
uggcaagaagagcaugagacca

SEQ ID NO: 115834 - RNA, 22 nt, Homo sapiens
uggcaagagggaugcaagguuu

SEQ ID NO: 115835 - RNA, 18 nt, Homo sapiens
uggcaauaugguucuacc

SEQ ID NO: 115836 - RNA, 19 nt, Homo sapiens
uggcaaugucagcagagau

SEQ ID NO: 115837 - RNA, 19 nt, Homo sapiens
uggcacauguauacuuaug

SEQ ID NO: 115838 - RNA, 22 nt, Homo sapiens
uggcagcgugaauguggcugaa

SEQ ID NO: 115839 - RNA, 22 nt, Homo sapiens
uggcagcugcuucaugggaugc

SEQ ID NO: 115840 - RNA, 22 nt, Homo sapiens
uggcaguuuuugccuucaauac

SEQ ID NO: 115841 - RNA, 22 nt, Homo sapiens
uggcauggaaagcuuuucauac

SEQ ID NO: 115842 - RNA, 22 nt, Homo sapiens
uggcauggaacuacuuugaaac

SEQ ID NO: 115843 - RNA, 22 nt, Homo sapiens
uggcauggaguggauggcccca

SEQ ID NO: 115844 - RNA, 22 nt, Homo sapiens
uggcaugggguaguagcgcugg

SEQ ID NO: 115845 - RNA, 22 nt, Homo sapiens
uggcauggucugcccaaguuuc

SEQ ID NO: 115846 - RNA, 18 nt, Homo sapiens
uggccaauggcaaacaga

SEQ ID NO: 115847 - RNA, 23 nt, Homo sapiens
uggccagaaacuucuuuucaucc

SEQ ID NO: 115848 - RNA, 22 nt, Homo sapiens
uggccagugucuauugguuucc

SEQ ID NO: 115849 - RNA, 22 nt, Homo sapiens
uggccaguugaagacaaugcuc

SEQ ID NO: 115850 - RNA, 22 nt, Homo sapiens
uggccuuuuccaagaacuacua

SEQ ID NO: 115851 - RNA, 22 nt, Homo sapiens
uggcgagaugcucgugugcaga

SEQ ID NO: 115852 - RNA, 20 nt, Homo sapiens
uggcucuuugcugcuaaagu

SEQ ID NO: 115853 - RNA, 18 nt, Homo sapiens
ugggaagaaauucuucuc

SEQ ID NO: 115854 - RNA, 22 nt, Homo sapiens
ugggaagaagguuuacuugcca

SEQ ID NO: 115855 - RNA, 22 nt, Homo sapiens
ugggaagcugcugaacuacagu

SEQ ID NO: 115856 - RNA, 19 nt, Homo sapiens
ugggaauguaaauuaguuc

SEQ ID NO: 115857 - RNA, 22 nt, Homo sapiens
ugggaccccuacucuuuccaca

SEQ ID NO: 115858 - RNA, 23 nt, Homo sapiens
ugggauguuuuuggaaacuucug

SEQ ID NO: 115859 - RNA, 22 nt, Homo sapiens
ugggcaagagagcaugacccug

SEQ ID NO: 115860 - RNA, 22 nt, Homo sapiens
uggggcuuuuucuuguauucuc

SEQ ID NO: 115861 - RNA, 22 nt, Homo sapiens
ugggugaguaucuauuauucag

SEQ ID NO: 115862 - RNA, 23 nt, Homo sapiens
ugguaacauguuguggcagggga

SEQ ID NO: 115863 - RNA, 22 nt, Homo sapiens
ugguaauguaauuuggagaagg

SEQ ID NO: 115864 - RNA, 21 nt, Homo sapiens
uggucccauaagauuauaaug

SEQ ID NO: 115865 - RNA, 19 nt, Homo sapiens
uggucccccgcaaucucau

SEQ ID NO: 115866 - RNA, 22 nt, Homo sapiens
uggucccucugaaaauugggug

SEQ ID NO: 115867 - RNA, 22 nt, Homo sapiens
ugguccuuuccauuggagacac

SEQ ID NO: 115868 - RNA, 22 nt, Homo sapiens
uggucuccuuuguacccugggc

SEQ ID NO: 115869 - RNA, 22 nt, Homo sapiens
uggucuggagagucccgcccag

SEQ ID NO: 115870 - RNA, 22 nt, Homo sapiens
uggucuucuggccuccagaacc

SEQ ID NO: 115871 - RNA, 22 nt, Homo sapiens
uggugagaaacuagauauuuuu

SEQ ID NO: 115872 - RNA, 22 nt, Homo sapiens
uguaaaaagcccagccgcugag

SEQ ID NO: 115873 - RNA, 22 nt, Homo sapiens
uguaaacauguauguguuuaug

SEQ ID NO: 115874 - RNA, 22 nt, Homo sapiens
uguaacacacacuguuuacucc

SEQ ID NO: 115875 - RNA, 22 nt, Homo sapiens
uguaauuuaaaugauccuugga

SEQ ID NO: 115876 - RNA, 22 nt, Homo sapiens
uguacuagaaauuaaggcaggg

SEQ ID NO: 115877 - RNA, 22 nt, Homo sapiens
uguagacaccaaagacagcaua

SEQ ID NO: 115878 - RNA, 22 nt, Homo sapiens
uguauguugggucaaaguacau

SEQ ID NO: 115879 - RNA, 22 nt, Homo sapiens
ugucaaugggaauuuguuuuag

SEQ ID NO: 115880 - RNA, 18 nt, Homo sapiens
ugucagaguggauuguaa

SEQ ID NO: 115881 - RNA, 22 nt, Homo sapiens
ugucauacaguaacaugguugg

SEQ ID NO: 115882 - RNA, 22 nt, Homo sapiens
ugucaucauuggaaucugccuc

SEQ ID NO: 115883 - RNA, 21 nt, Homo sapiens
ugucaugcagagacccuggag

SEQ ID NO: 115884 - RNA, 22 nt, Homo sapiens
ugucauguugguguacugcacc

SEQ ID NO: 115885 - RNA, 16 nt, Homo sapiens
uguccaaauaaauaca

SEQ ID NO: 115886 - RNA, 21 nt, Homo sapiens
uguccagcuuuuggaauauaa

SEQ ID NO: 115887 - RNA, 22 nt, Homo sapiens
ugucuguuugcgaaauugcuuc

SEQ ID NO: 115888 - RNA, 22 nt, Homo sapiens
ugugaaacacgaaagucuaaaa

SEQ ID NO: 115889 - RNA, 22 nt, Homo sapiens
ugugaaacauggauagaacugg

SEQ ID NO: 115890 - RNA, 22 nt, Homo sapiens
ugugaacauuuuguauauauua

SEQ ID NO: 115891 - RNA, 22 nt, Homo sapiens
ugugaauggugcugccgugaag

SEQ ID NO: 115892 - RNA, 22 nt, Homo sapiens
ugugaauggugcuuccuagaug

SEQ ID NO: 115893 - RNA, 22 nt, Homo sapiens
ugugaauguaagaaaauccaac

SEQ ID NO: 115894 - RNA, 22 nt, Homo sapiens
ugugacagcacagcaucucuuu

SEQ ID NO: 115895 - RNA, 22 nt, Homo sapiens
ugugacagguauccuguguucu

SEQ ID NO: 115896 - RNA, 22 nt, Homo sapiens
ugugacaguguuacauuucaug

SEQ ID NO: 115897 - RNA, 22 nt, Homo sapiens
ugugaccaaaaucaacauaccu

SEQ ID NO: 115898 - RNA, 22 nt, Homo sapiens
ugugauugauuaaugugugcua

SEQ ID NO: 115899 - RNA, 22 nt, Homo sapiens
ugugccacuccaaccuggguga

SEQ ID NO: 115900 - RNA, 22 nt, Homo sapiens
ugugccugagguuaacauuguu

SEQ ID NO: 115901 - RNA, 22 nt, Homo sapiens
uguggcagugcuuuaugaaacc

SEQ ID NO: 115902 - RNA, 17 nt, Homo sapiens
uguggcucuuaugcuga

SEQ ID NO: 115903 - RNA, 19 nt, Homo sapiens
uguggucauccugggacga

SEQ ID NO: 115904 - RNA, 22 nt, Homo sapiens
uguguaaauaugauagaggaau

SEQ ID NO: 115905 - RNA, 22 nt, Homo sapiens
ugugucuuguuuuuucccaggc

SEQ ID NO: 115906 - RNA, 22 nt, Homo sapiens
ugugucuuuuaucacacaaugu

SEQ ID NO: 115907 - RNA, 22 nt, Homo sapiens
uguuaguuguucauguuaagag

SEQ ID NO: 115908 - RNA, 22 nt, Homo sapiens
uguuauuuuguguuagggcaca

SEQ ID NO: 115909 - RNA, 22 nt, Homo sapiens
uguucacaguguuucuuugaga

SEQ ID NO: 115910 - RNA, 22 nt, Homo sapiens
uguucuggagaguuuagucugg

SEQ ID NO: 115911 - RNA, 22 nt, Homo sapiens
uguucuggagccgguucaaaug

SEQ ID NO: 115912 - RNA, 22 nt, Homo sapiens
uguugcauuugucaaggucaag

SEQ ID NO: 115913 - RNA, 22 nt, Homo sapiens
uguuuuggaguggacuuugcau

SEQ ID NO: 115914 - RNA, 21 nt, Homo sapiens
uguuuuugcuguguaucucuc

SEQ ID NO: 115915 - RNA, 22 nt, Homo sapiens
uuaaaagcuaucuccaagguca

SEQ ID NO: 115916 - RNA, 22 nt, Homo sapiens
uuaaaccugucuucucacuaau

SEQ ID NO: 115917 - RNA, 22 nt, Homo sapiens
uuaaagccauaccugagagagu

SEQ ID NO: 115918 - RNA, 22 nt, Homo sapiens
uuaaaugcuagaauuuucuuug

SEQ ID NO: 115919 - RNA, 22 nt, Homo sapiens
uuaagcaguaguuaaggagagg

SEQ ID NO: 115920 - RNA, 22 nt, Homo sapiens
uuaaggcuuuaaguaaacacag

SEQ ID NO: 115921 - RNA, 22 nt, Homo sapiens
uuaaugaacuuuauuuuguaga

SEQ ID NO: 115922 - RNA, 22 nt, Homo sapiens
uuaaugcuuggggaguaguucu

SEQ ID NO: 115923 - RNA, 22 nt, Homo sapiens
uuacagucuuaggcagugcuuu

SEQ ID NO: 115924 - RNA, 22 nt, Homo sapiens
uuacaguguuuguucuguuacu

SEQ ID NO: 115925 - RNA, 22 nt, Homo sapiens
uuacaucaucacauuaguuugc

SEQ ID NO: 115926 - RNA, 22 nt, Homo sapiens
uuaccacagugccugucuaaug

SEQ ID NO: 115927 - RNA, 22 nt, Homo sapiens
uuacuguauagaaucaucuuga

SEQ ID NO: 115928 - RNA, 22 nt, Homo sapiens
uuagaaaguagaaaagcugguu

SEQ ID NO: 115929 - RNA, 22 nt, Homo sapiens
uuagcacugagaauggcuugcu

SEQ ID NO: 115930 - RNA, 22 nt, Homo sapiens
uuagcccagugggugcuucucu

SEQ ID NO: 115931 - RNA, 16 nt, Homo sapiens
uuaggcagugugauac

SEQ ID NO: 115932 - RNA, 22 nt, Homo sapiens
uuaggcuuuauugaaaacaaua

SEQ ID NO: 115933 - RNA, 22 nt, Homo sapiens
uuagguauuaggaaauaugcuu

SEQ ID NO: 115934 - RNA, 22 nt, Homo sapiens
uuaguaucauccuucugcauuc

SEQ ID NO: 115935 - RNA, 21 nt, Homo sapiens
uuagugcucaguuugacaaaa

SEQ ID NO: 115936 - RNA, 22 nt, Homo sapiens
aagcugguguguauuauucacu

SEQ ID NO: 115937 - RNA, 22 nt, Homo sapiens
aagcugguuuuauaucugugag

SEQ ID NO: 115938 - RNA, 22 nt, Homo sapiens
aagcuguuguucauccugaauu

SEQ ID NO: 115939 - RNA, 22 nt, Homo sapiens
aaggaagcuagcaggaauuggu

SEQ ID NO: 115940 - RNA, 22 nt, Homo sapiens
aaggaguagaggaauagcaaug

SEQ ID NO: 115941 - RNA, 22 nt, Homo sapiens
aaggaguauugaaugaccaagu

SEQ ID NO: 115942 - RNA, 22 nt, Homo sapiens
aaggcaagguggauaaugaagc

SEQ ID NO: 115943 - RNA, 22 nt, Homo sapiens
aaggcuuuuugcugacguccuu

SEQ ID NO: 115944 - RNA, 22 nt, Homo sapiens
aagguggaguugacaauuuuca

SEQ ID NO: 115945 - RNA, 22 nt, Homo sapiens
aaguacuguuuaaauugcagaa

SEQ ID NO: 115946 - RNA, 23 nt, Homo sapiens
aagucauggaaucaaaugaggug

SEQ ID NO: 115947 - RNA, 22 nt, Homo sapiens
aagugaaugaugugaaguguaa

SEQ ID NO: 115948 - RNA, 22 nt, Homo sapiens
aagugacuagacuaugaaaccu

SEQ ID NO: 115949 - RNA, 22 nt, Homo sapiens
aagugcaaauucccaggcucug

SEQ ID NO: 115950 - RNA, 22 nt, Homo sapiens
aagugcuggccuacucaaucga

SEQ ID NO: 115951 - RNA, 22 nt, Homo sapiens
aagugcugggauuggccgggca

SEQ ID NO: 115952 - RNA, 22 nt, Homo sapiens
aauaagcauaguaccugauagg

SEQ ID NO: 115953 - RNA, 22 nt, Homo sapiens
aauagagucaggguuucaccau

SEQ ID NO: 115954 - RNA, 22 nt, Homo sapiens
aauaucacaguggguguacacc

SEQ ID NO: 115955 - RNA, 22 nt, Homo sapiens
aauaucuguguauagauggggg

SEQ ID NO: 115956 - RNA, 22 nt, Homo sapiens
aauggagcugaguggccuuggg

SEQ ID NO: 115957 - RNA, 22 nt, Homo sapiens
aauggcacacaccuggucuaac

SEQ ID NO: 115958 - RNA, 22 nt, Homo sapiens
aaugguguuuccguuaagcuga

SEQ ID NO: 115959 - RNA, 22 nt, Homo sapiens
aauuacauggcaauugggaaau

SEQ ID NO: 115960 - RNA, 22 nt, Homo sapiens
aauugcacuaagcauaguccag

SEQ ID NO: 115961 - RNA, 22 nt, Homo sapiens
aauuguacucccaucauuccua

SEQ ID NO: 115962 - RNA, 22 nt, Homo sapiens
acaaaguauggaauguuggugu

SEQ ID NO: 115963 - RNA, 22 nt, Homo sapiens
acacugcugaguaaauaauuuu

SEQ ID NO: 115964 - RNA, 22 nt, Homo sapiens
acacuguugacauuuuguagug

SEQ ID NO: 115965 - RNA, 22 nt, Homo sapiens
acagaaccauucacuccccugg

SEQ ID NO: 115966 - RNA, 22 nt, Homo sapiens
acagagcaaugagcuacggucu

SEQ ID NO: 115967 - RNA, 19 nt, Homo sapiens
acagauagaauguucuaca

SEQ ID NO: 115968 - RNA, 22 nt, Homo sapiens
acagauagcacuaagggaucug

SEQ ID NO: 115969 - RNA, 22 nt, Homo sapiens
acagguacacagaauauccaga

SEQ ID NO: 115970 - RNA, 22 nt, Homo sapiens
acagucacaauuuguaccuuuu

SEQ ID NO: 115971 - RNA, 22 nt, Homo sapiens
acagucauagcagccuuuguua

SEQ ID NO: 115972 - RNA, 22 nt, Homo sapiens
acaguggugcgaucucggcuca

SEQ ID NO: 115973 - RNA, 22 nt, Homo sapiens
acauauaaggagacuagggcau

SEQ ID NO: 115974 - RNA, 22 nt, Homo sapiens
acaucacuguuugauugauuga

SEQ ID NO: 115975 - RNA, 22 nt, Homo sapiens
acaucccuugcucggggccccu

SEQ ID NO: 115976 - RNA, 22 nt, Homo sapiens
acaucccuuucccacccuucac

SEQ ID NO: 115977 - RNA, 17 nt, Homo sapiens
acaugagacuggauucu

SEQ ID NO: 115978 - RNA, 22 nt, Homo sapiens
acauucagcuguuguuucaaug

SEQ ID NO: 115979 - RNA, 18 nt, Homo sapiens
acauucagcuugaagaua

SEQ ID NO: 115980 - RNA, 22 nt, Homo sapiens
accagucucagguaugucuuua

SEQ ID NO: 115981 - RNA, 22 nt, Homo sapiens
accaguguuuaccaaguagcau

SEQ ID NO: 115982 - RNA, 22 nt, Homo sapiens
accauugcacuucagccuaggc

SEQ ID NO: 115983 - RNA, 22 nt, Homo sapiens
acccugacacgauucuucacuu

SEQ ID NO: 115984 - RNA, 22 nt, Homo sapiens
acccuguaggugcuggcagaga

SEQ ID NO: 115985 - RNA, 22 nt, Homo sapiens
acccugugagagaguuaauauu

SEQ ID NO: 115986 - RNA, 22 nt, Homo sapiens
acucagagauuagcacauguuu

SEQ ID NO: 115987 - RNA, 21 nt, Homo sapiens
acugagagaucuggggcacau

SEQ ID NO: 115988 - RNA, 23 nt, Homo sapiens
acugcaauuacguuugcaccaac

SEQ ID NO: 115989 - RNA, 20 nt, Homo sapiens
acugcacuccaaccuuugug

SEQ ID NO: 115990 - RNA, 22 nt, Homo sapiens
acugcacuccagccuaggcgac

SEQ ID NO: 115991 - RNA, 22 nt, Homo sapiens
acugcacuccagccuccugaca

SEQ ID NO: 115992 - RNA, 22 nt, Homo sapiens
acugcacuccagccucgcaaca

SEQ ID NO: 115993 - RNA, 22 nt, Homo sapiens
acugcacuccagccugagccug

SEQ ID NO: 115994 - RNA, 22 nt, Homo sapiens
acugcacuccagccugcuggca

SEQ ID NO: 115995 - RNA, 22 nt, Homo sapiens
acugcacuccagccugcugggu

SEQ ID NO: 115996 - RNA, 22 nt, Homo sapiens
acugcacuccagccuggaccac

SEQ ID NO: 115997 - RNA, 22 nt, Homo sapiens
acugcacuccagccugugagac

SEQ ID NO: 115998 - RNA, 22 nt, Homo sapiens
acugcacuccagccuucaggac

SEQ ID NO: 115999 - RNA, 22 nt, Homo sapiens
acugcacuccagccuucgugac

SEQ ID NO: 116000 - RNA, 22 nt, Homo sapiens
acugcacuccagccuuggagac

SEQ ID NO: 116001 - RNA, 22 nt, Homo sapiens
acugcacuccagcuuuggguga

SEQ ID NO: 116002 - RNA, 22 nt, Homo sapiens
acugcacuccagcuuuggugac

SEQ ID NO: 116003 - RNA, 20 nt, Homo sapiens
acugcacuccaggcugccca

SEQ ID NO: 116004 - RNA, 22 nt, Homo sapiens
acugcacuccaucuuagguggc

SEQ ID NO: 116005 - RNA, 19 nt, Homo sapiens
acugcacuccuccuugggu

SEQ ID NO: 116006 - RNA, 22 nt, Homo sapiens
acugcacucuagccccugcgac

SEQ ID NO: 116007 - RNA, 22 nt, Homo sapiens
acugcacucuagcuugggugac

SEQ ID NO: 116008 - RNA, 22 nt, Homo sapiens
acugcacuuauccuccaauguu

SEQ ID NO: 116009 - RNA, 22 nt, Homo sapiens
acugcacuucaaccucauugac

SEQ ID NO: 116010 - RNA, 20 nt, Homo sapiens
acugcacuucagccugcugg

SEQ ID NO: 116011 - RNA, 22 nt, Homo sapiens
acugcacuucagccuugggaaa

SEQ ID NO: 116012 - RNA, 22 nt, Homo sapiens
acugcacuucagccuugugaca

SEQ ID NO: 116013 - RNA, 22 nt, Homo sapiens
acugcauuugucccuuuugaac

SEQ ID NO: 116014 - RNA, 22 nt, Homo sapiens
acuggcuguuaggaauuaccuc

SEQ ID NO: 116015 - RNA, 22 nt, Homo sapiens
acuggcuuauuucacuuagcau

SEQ ID NO: 116016 - RNA, 22 nt, Homo sapiens
acugggauauuauugguaauau

SEQ ID NO: 116017 - RNA, 22 nt, Homo sapiens
acuguacucuacccugggcaac

SEQ ID NO: 116018 - RNA, 22 nt, Homo sapiens
acugugcuguuuuaauuauuga

SEQ ID NO: 116019 - RNA, 22 nt, Homo sapiens
acuucauucucuggaucagaau

SEQ ID NO: 116020 - RNA, 22 nt, Homo sapiens
acuuuuugauggggagaacauu

SEQ ID NO: 116021 - RNA, 22 nt, Homo sapiens
agaaagugcuucccuuugguga

SEQ ID NO: 116022 - RNA, 22 nt, Homo sapiens
agaaauguuuacucacccccuu

SEQ ID NO: 116023 - RNA, 22 nt, Homo sapiens
agaauacugucuauucauggua

SEQ ID NO: 116024 - RNA, 22 nt, Homo sapiens
agaaugauccuucucagaggca

SEQ ID NO: 116025 - RNA, 21 nt, Homo sapiens
agagaacugaaacaugugacu

SEQ ID NO: 116026 - RNA, 22 nt, Homo sapiens
agagaccuguaaaguucaggca

SEQ ID NO: 116027 - RNA, 19 nt, Homo sapiens
agagacucauuguagcauu

SEQ ID NO: 116028 - RNA, 22 nt, Homo sapiens
agagauacauucugagaagugc

SEQ ID NO: 116029 - RNA, 22 nt, Homo sapiens
agagcauugaguuaaugguuca

SEQ ID NO: 116030 - RNA, 22 nt, Homo sapiens
agagccacauuaaauaugggaa

SEQ ID NO: 116031 - RNA, 22 nt, Homo sapiens
agagcuaguauuuacggagcau

SEQ ID NO: 116032 - RNA, 22 nt, Homo sapiens
agagguaagcaguggcaagugc

SEQ ID NO: 116033 - RNA, 22 nt, Homo sapiens
agagguagaagauaggcuacag

SEQ ID NO: 116034 - RNA, 22 nt, Homo sapiens
agaguaguaggaugaauggacu

SEQ ID NO: 116035 - RNA, 19 nt, Homo sapiens
agaguauuguuacuucucu

SEQ ID NO: 116036 - RNA, 21 nt, Homo sapiens
agagucaucucuaucuguacc

SEQ ID NO: 116037 - RNA, 22 nt, Homo sapiens
agagugcuauagauuagauuuc

SEQ ID NO: 116038 - RNA, 19 nt, Homo sapiens
augauugucuauggaggaa

SEQ ID NO: 116039 - RNA, 22 nt, Homo sapiens
augcaagacaccacgugagaau

SEQ ID NO: 116040 - RNA, 22 nt, Homo sapiens
augcaagacaccgauuagcuuu

SEQ ID NO: 116041 - RNA, 22 nt, Homo sapiens
augcacuuggcaggaugauucc

SEQ ID NO: 116042 - RNA, 22 nt, Homo sapiens
augcagauauuuuugugguugc

SEQ ID NO: 116043 - RNA, 22 nt, Homo sapiens
augccacugcacuccaaccugg

SEQ ID NO: 116044 - RNA, 22 nt, Homo sapiens
augccacugcacuucagccugg

SEQ ID NO: 116045 - RNA, 22 nt, Homo sapiens
augccauugcacuccagccuag

SEQ ID NO: 116046 - RNA, 22 nt, Homo sapiens
augcuuguguuggggcagugga

SEQ ID NO: 116047 - RNA, 22 nt, Homo sapiens
auggaaacauaagaguauagau

SEQ ID NO: 116048 - RNA, 22 nt, Homo sapiens
auggaaugguugggucauaagg

SEQ ID NO: 116049 - RNA, 22 nt, Homo sapiens
auggaauguauagucauguagg

SEQ ID NO: 116050 - RNA, 22 nt, Homo sapiens
auggagaugaauaucaucuguu

SEQ ID NO: 116051 - RNA, 22 nt, Homo sapiens
auggaggacaaugucaccuuca

SEQ ID NO: 116052 - RNA, 22 nt, Homo sapiens
auggaguguaauauugagagcu

SEQ ID NO: 116053 - RNA, 22 nt, Homo sapiens
auggcaaugcgaugaugacuga

SEQ ID NO: 116054 - RNA, 22 nt, Homo sapiens
auggcagaaucaagccgacagc

SEQ ID NO: 116055 - RNA, 22 nt, Homo sapiens
auggcagcaccccacucuacug

SEQ ID NO: 116056 - RNA, 22 nt, Homo sapiens
auggccuuguauaccuggcaaa

SEQ ID NO: 116057 - RNA, 22 nt, Homo sapiens
auggcugugaaaugguaggugg

SEQ ID NO: 116058 - RNA, 22 nt, Homo sapiens
auggcuugugacccaugcuuca

SEQ ID NO: 116059 - RNA, 21 nt, Homo sapiens
auggugagaaaguagugucaa

SEQ ID NO: 116060 - RNA, 22 nt, Homo sapiens
auggugugugaauuaaauguua

SEQ ID NO: 116061 - RNA, 22 nt, Homo sapiens
augguuagauguauccuuucca

SEQ ID NO: 116062 - RNA, 22 nt, Homo sapiens
augucuagagugauacugaagc

SEQ ID NO: 116063 - RNA, 22 nt, Homo sapiens
augugcaaaguuaagaucccag

SEQ ID NO: 116064 - RNA, 20 nt, Homo sapiens
augugcaguguggcaaccaa

SEQ ID NO: 116065 - RNA, 22 nt, Homo sapiens
augugggaggaauguguuucca

SEQ ID NO: 116066 - RNA, 22 nt, Homo sapiens
augugguaggcccaugagucau

SEQ ID NO: 116067 - RNA, 22 nt, Homo sapiens
augugguaguuauagugauaag

SEQ ID NO: 116068 - RNA, 22 nt, Homo sapiens
augugugcuugauguaaaaagu

SEQ ID NO: 116069 - RNA, 23 nt, Homo sapiens
auuaagguuacuacaguaugagg

SEQ ID NO: 116070 - RNA, 22 nt, Homo sapiens
auuaaguuaggauuuugagaua

SEQ ID NO: 116071 - RNA, 22 nt, Homo sapiens
auuacuuugcaccaaccuaaua

SEQ ID NO: 116072 - RNA, 22 nt, Homo sapiens
auuagaugguuauaggugugag

SEQ ID NO: 116073 - RNA, 22 nt, Homo sapiens
auuauauguguaugugcauacc

SEQ ID NO: 116074 - RNA, 22 nt, Homo sapiens
auuaucacaguuuugcauaugg

SEQ ID NO: 116075 - RNA, 22 nt, Homo sapiens
auuauugacucauagaaaggau

SEQ ID NO: 116076 - RNA, 22 nt, Homo sapiens
auucaagggauuucaggaggcu

SEQ ID NO: 116077 - RNA, 22 nt, Homo sapiens
auucaagugaugcagcuguuuu

SEQ ID NO: 116078 - RNA, 22 nt, Homo sapiens
auuccacuuagugacucauuug

SEQ ID NO: 116079 - RNA, 19 nt, Homo sapiens
auugacauugggguguuca

SEQ ID NO: 116080 - RNA, 21 nt, Homo sapiens
auugcacaauauacccaugua

SEQ ID NO: 116081 - RNA, 22 nt, Homo sapiens
auugcacuccagccuggcaaua

SEQ ID NO: 116082 - RNA, 22 nt, Homo sapiens
auugcacuccagccuugacaca

SEQ ID NO: 116083 - RNA, 22 nt, Homo sapiens
auugcacucugaucugcacucc

SEQ ID NO: 116084 - RNA, 22 nt, Homo sapiens
auugcacugcagccugggcaac

SEQ ID NO: 116085 - RNA, 20 nt, Homo sapiens
auugcagcaugauuuauaau

SEQ ID NO: 116086 - RNA, 22 nt, Homo sapiens
auugcuuuuacugggagcuuug

SEQ ID NO: 116087 - RNA, 22 nt, Homo sapiens
auuggcuuuugaaagucugcga

SEQ ID NO: 116088 - RNA, 22 nt, Homo sapiens
auugugcuaaaguaauaaguca

SEQ ID NO: 116089 - RNA, 22 nt, Homo sapiens
auuuccuguaggggcuugcgaa

SEQ ID NO: 116090 - RNA, 22 nt, Homo sapiens
auuuggcaacguagggaggcau

SEQ ID NO: 116091 - RNA, 22 nt, Homo sapiens
auuuggcaauuuugaagaugcc

SEQ ID NO: 116092 - RNA, 22 nt, Homo sapiens
auuugucaauacacuucuucca

SEQ ID NO: 116093 - RNA, 22 nt, Homo sapiens
auuugucacuuaacagccauua

SEQ ID NO: 116094 - RNA, 22 nt, Homo sapiens
auuuugcauugcuguaaaggaa

SEQ ID NO: 116095 - RNA, 22 nt, Homo sapiens
caaaggcuguuauaggccagga

SEQ ID NO: 116096 - RNA, 22 nt, Homo sapiens
caaagucuauucuacccuuacc

SEQ ID NO: 116097 - RNA, 22 nt, Homo sapiens
caaagucuucaguugauucuga

SEQ ID NO: 116098 - RNA, 22 nt, Homo sapiens
caaagugcuggccgggcgcagu

SEQ ID NO: 116099 - RNA, 22 nt, Homo sapiens
caaagugguuuauacaugauug

SEQ ID NO: 116100 - RNA, 21 nt, Homo sapiens
caagugaugcuucugcuuuaa

SEQ ID NO: 116101 - RNA, 22 nt, Homo sapiens
caagugcuuucuuggggauuua

SEQ ID NO: 116102 - RNA, 22 nt, Homo sapiens
caauacuguguugaauaagagu

SEQ ID NO: 116103 - RNA, 22 nt, Homo sapiens
caaugugcuuggggcacaugag

SEQ ID NO: 116104 - RNA, 22 nt, Homo sapiens
cacaguugccuaucuccugaag

SEQ ID NO: 116105 - RNA, 22 nt, Homo sapiens
cacauguuugcuacauuuuucu

SEQ ID NO: 116106 - RNA, 22 nt, Homo sapiens
caccugagcgggaugcucgccu

SEQ ID NO: 116107 - RNA, 22 nt, Homo sapiens
caccuguagucccagcugaggc

SEQ ID NO: 116108 - RNA, 18 nt, Homo sapiens
cacugagcccuucacucu

SEQ ID NO: 116109 - RNA, 22 nt, Homo sapiens
cacugcacuccagcuugugggc

SEQ ID NO: 116110 - RNA, 22 nt, Homo sapiens
cacugcauccuugaccuucugg

SEQ ID NO: 116111 - RNA, 22 nt, Homo sapiens
cagagguaagcaagucagcauu

SEQ ID NO: 116112 - RNA, 22 nt, Homo sapiens
cagauacucauggaacuggguu

SEQ ID NO: 116113 - RNA, 22 nt, Homo sapiens
cagaugcaugaccugggcuugg

SEQ ID NO: 116114 - RNA, 20 nt, Homo sapiens
cagcaaccugcucucuuccu

SEQ ID NO: 116115 - RNA, 22 nt, Homo sapiens
cagcaguuguuucggauuggga

SEQ ID NO: 116116 - RNA, 22 nt, Homo sapiens
cagcuggugcugcaccaguggg

SEQ ID NO: 116117 - RNA, 22 nt, Homo sapiens
cagcuguuguuccagucuuuua

SEQ ID NO: 116118 - RNA, 22 nt, Homo sapiens
cagugcacugggauuauaagug

SEQ ID NO: 116119 - RNA, 22 nt, Homo sapiens
caguuguuuuaugacauaagau

SEQ ID NO: 116120 - RNA, 22 nt, Homo sapiens
cauaguacuugcauaguacuau

SEQ ID NO: 116121 - RNA, 22 nt, Homo sapiens
caucaaaguggagggaaggacc

SEQ ID NO: 116122 - RNA, 19 nt, Homo sapiens
caucacagagucuuccauu

SEQ ID NO: 116123 - RNA, 22 nt, Homo sapiens
caucacagcaaguagggagugg

SEQ ID NO: 116124 - RNA, 22 nt, Homo sapiens
caucccauucgaggggcacagc

SEQ ID NO: 116125 - RNA, 22 nt, Homo sapiens
caucccugaaccccagaaaucu

SEQ ID NO: 116126 - RNA, 19 nt, Homo sapiens
caucccugagcugaagugg

SEQ ID NO: 116127 - RNA, 22 nt, Homo sapiens
caugccacugcacgccauccug

SEQ ID NO: 116128 - RNA, 19 nt, Homo sapiens
caugccacugcacuugagu

SEQ ID NO: 116129 - RNA, 20 nt, Homo sapiens
cauuccacuuuccugucagu

SEQ ID NO: 116130 - RNA, 22 nt, Homo sapiens
cauugcacacauuuaccuaugu

SEQ ID NO: 116131 - RNA, 20 nt, Homo sapiens
cauugcacuccagccugcug

SEQ ID NO: 116132 - RNA, 22 nt, Homo sapiens
cauugcacuccagccuggcaac

SEQ ID NO: 116133 - RNA, 22 nt, Homo sapiens
cauuuugcaguuucugucucca

SEQ ID NO: 116134 - RNA, 22 nt, Homo sapiens
ccacacugucuuggugggaaac

SEQ ID NO: 116135 - RNA, 22 nt, Homo sapiens
ccaccuguacuuaagucacuuu

SEQ ID NO: 116136 - RNA, 22 nt, Homo sapiens
ccaguauuuuauugaggguuuu

SEQ ID NO: 116137 - RNA, 18 nt, Homo sapiens
ccagugcaaggaaagccc

SEQ ID NO: 116138 - RNA, 20 nt, Homo sapiens
ccaguguuauuuauguucua

SEQ ID NO: 116139 - RNA, 22 nt, Homo sapiens
ccaguuuucccagcaccauuaa

SEQ ID NO: 116140 - RNA, 22 nt, Homo sapiens
gugagggaugugaaaaagguca

SEQ ID NO: 116141 - RNA, 22 nt, Homo sapiens
gugagguguuaaccaaccugug

SEQ ID NO: 116142 - RNA, 22 nt, Homo sapiens
gugcaaugagaaggggcucugg

SEQ ID NO: 116143 - RNA, 22 nt, Homo sapiens
gugcagaugucuuuauaguagc

SEQ ID NO: 116144 - RNA, 22 nt, Homo sapiens
gugcagugugauccuuccguau

SEQ ID NO: 116145 - RNA, 22 nt, Homo sapiens
gugcaguguuugcauggaauca

SEQ ID NO: 116146 - RNA, 22 nt, Homo sapiens
gugccacugcaccuggccuaag

SEQ ID NO: 116147 - RNA, 22 nt, Homo sapiens
gugccacugcacuccggccugg

SEQ ID NO: 116148 - RNA, 23 nt, Homo sapiens
gugccuucugagccuagucucca

SEQ ID NO: 116149 - RNA, 22 nt, Homo sapiens
guggcacgaugaucugggcuca

SEQ ID NO: 116150 - RNA, 22 nt, Homo sapiens
guggcaguuuuaaauaugaaaa

SEQ ID NO: 116151 - RNA, 22 nt, Homo sapiens
guggcauuucccaaaguauucu

SEQ ID NO: 116152 - RNA, 22 nt, Homo sapiens
gugguacuaucuuugguuucag

SEQ ID NO: 116153 - RNA, 22 nt, Homo sapiens
gugucacuguauaauauuuauu

SEQ ID NO: 116154 - RNA, 22 nt, Homo sapiens
guguccucgaguacacaucagg

SEQ ID NO: 116155 - RNA, 22 nt, Homo sapiens
gugucucagcccagaccuauuu

SEQ ID NO: 116156 - RNA, 22 nt, Homo sapiens
gugugcauggagggggcaguga

SEQ ID NO: 116157 - RNA, 22 nt, Homo sapiens
guguucauggaauuugcaauug

SEQ ID NO: 116158 - RNA, 22 nt, Homo sapiens
guuauguuauguuauguuaugu

SEQ ID NO: 116159 - RNA, 21 nt, Homo sapiens
guucaagugauccuccugucu

SEQ ID NO: 116160 - RNA, 22 nt, Homo sapiens
guucaagugauucuacugccuc

SEQ ID NO: 116161 - RNA, 22 nt, Homo sapiens
guucaaguuuucucuugugggu

SEQ ID NO: 116162 - RNA, 22 nt, Homo sapiens
guucacacuugcaaccccagca

SEQ ID NO: 116163 - RNA, 22 nt, Homo sapiens
guucacaguucagccuguaaca

SEQ ID NO: 116164 - RNA, 22 nt, Homo sapiens
guucacaguuucuaaucccagc

SEQ ID NO: 116165 - RNA, 20 nt, Homo sapiens
guucuugcucguguaucuuc

SEQ ID NO: 116166 - RNA, 22 nt, Homo sapiens
guugcucaggccggagugcagu

SEQ ID NO: 116167 - RNA, 22 nt, Homo sapiens
guuuguaacucuagugacuaga

SEQ ID NO: 116168 - RNA, 21 nt, Homo sapiens
uaaaacuguaacuuuguccug

SEQ ID NO: 116169 - RNA, 22 nt, Homo sapiens
uaaacugucuugcaguuacaug

SEQ ID NO: 116170 - RNA, 22 nt, Homo sapiens
uaaagcugaaaugauuaugaca

SEQ ID NO: 116171 - RNA, 22 nt, Homo sapiens
uaaagugaggauggcaguaggu

SEQ ID NO: 116172 - RNA, 22 nt, Homo sapiens
uaaaugcuugagaugauggaua

SEQ ID NO: 116173 - RNA, 21 nt, Homo sapiens
uaaaugucauacaaagcaaug

SEQ ID NO: 116174 - RNA, 22 nt, Homo sapiens
uaacuccauuuggacucaguau

SEQ ID NO: 116175 - RNA, 22 nt, Homo sapiens
uaacugcaaccuccgccucccg

SEQ ID NO: 116176 - RNA, 22 nt, Homo sapiens
uaagaauucuguccgguauacu

SEQ ID NO: 116177 - RNA, 22 nt, Homo sapiens
uaagacacuuaaaauguuacau

SEQ ID NO: 116178 - RNA, 22 nt, Homo sapiens
uaagagcuaggauuuuaaauca

SEQ ID NO: 116179 - RNA, 22 nt, Homo sapiens
uaagcaguaaaugaagucuugc

SEQ ID NO: 116180 - RNA, 20 nt, Homo sapiens
uaagccacacagucuaaggu

SEQ ID NO: 116181 - RNA, 22 nt, Homo sapiens
uaagccaccgugccuggccuaa

SEQ ID NO: 116182 - RNA, 22 nt, Homo sapiens
uaaggaaccagaaguggguagc

SEQ ID NO: 116183 - RNA, 22 nt, Homo sapiens
uaaguucauucaugaaacuuag

SEQ ID NO: 116184 - RNA, 22 nt, Homo sapiens
uaauaauguuaggcuuacucaa

SEQ ID NO: 116185 - RNA, 22 nt, Homo sapiens
uaauacauucaaggugguaguu

SEQ ID NO: 116186 - RNA, 22 nt, Homo sapiens
uaauccugucuugaccaucagg

SEQ ID NO: 116187 - RNA, 21 nt, Homo sapiens
uaauggcaugaucucggcuca

SEQ ID NO: 116188 - RNA, 22 nt, Homo sapiens
uaaugugaauagugcuguaaug

SEQ ID NO: 116189 - RNA, 22 nt, Homo sapiens
uacaacacugguucgacaugug

SEQ ID NO: 116190 - RNA, 22 nt, Homo sapiens
uacaaguauuuuuauuagugcc

SEQ ID NO: 116191 - RNA, 22 nt, Homo sapiens
uacagaguauccauuugaguuc

SEQ ID NO: 116192 - RNA, 22 nt, Homo sapiens
uacaggcaccuggcuaauuuuu

SEQ ID NO: 116193 - RNA, 19 nt, Homo sapiens
uacaguacacaacaccuuu

SEQ ID NO: 116194 - RNA, 22 nt, Homo sapiens
uacagugggcacuggcgcccug

SEQ ID NO: 116195 - RNA, 22 nt, Homo sapiens
uacaugcaugggcaugugugca

SEQ ID NO: 116196 - RNA, 19 nt, Homo sapiens
uacccuaguauauacagaa

SEQ ID NO: 116197 - RNA, 22 nt, Homo sapiens
uaccucuguaaguaaagauuca

SEQ ID NO: 116198 - RNA, 22 nt, Homo sapiens
uacucuuuagcuccuuaaggaa

SEQ ID NO: 116199 - RNA, 19 nt, Homo sapiens
uagcacuacagaguuuagc

SEQ ID NO: 116200 - RNA, 22 nt, Homo sapiens
uagcagaauaacuugccagccu

SEQ ID NO: 116201 - RNA, 22 nt, Homo sapiens
uagcagucuguuaaaacuuuua

SEQ ID NO: 116202 - RNA, 22 nt, Homo sapiens
uagcccauuuguuuagggaaag

SEQ ID NO: 116203 - RNA, 17 nt, Homo sapiens
uagcucuauuucuagcc

SEQ ID NO: 116204 - RNA, 22 nt, Homo sapiens
uagcugauguuugucuaguagc

SEQ ID NO: 116205 - RNA, 22 nt, Homo sapiens
uagcuucuccauagcuccaugu

SEQ ID NO: 116206 - RNA, 22 nt, Homo sapiens
uaggagcacaaaccccauugug

SEQ ID NO: 116207 - RNA, 22 nt, Homo sapiens
uaggagugugaacccuaugaac

SEQ ID NO: 116208 - RNA, 22 nt, Homo sapiens
uaggucuuuuaugaaauauauu

SEQ ID NO: 116209 - RNA, 21 nt, Homo sapiens
uagugcugaggcaguauggga

SEQ ID NO: 116210 - RNA, 22 nt, Homo sapiens
uauacaguaggcacucaguggc

SEQ ID NO: 116211 - RNA, 22 nt, Homo sapiens
uauagcagccugaacaaaguaa

SEQ ID NO: 116212 - RNA, 22 nt, Homo sapiens
uauaggacuugguguaguuucu

SEQ ID NO: 116213 - RNA, 22 nt, Homo sapiens
uaucaaggccacucauuuuaug

SEQ ID NO: 116214 - RNA, 22 nt, Homo sapiens
uaucacagcauugucuauaaua

SEQ ID NO: 116215 - RNA, 20 nt, Homo sapiens
uaucacaguucaggaacucu

SEQ ID NO: 116216 - RNA, 22 nt, Homo sapiens
uauccugaagcuuuauuuaagu

SEQ ID NO: 116217 - RNA, 22 nt, Homo sapiens
uaucguaguguuggaaaacaag

SEQ ID NO: 116218 - RNA, 22 nt, Homo sapiens
uaucuacauguagguauguaug

SEQ ID NO: 116219 - RNA, 22 nt, Homo sapiens
uaucucagaugagacuuguaac

SEQ ID NO: 116220 - RNA, 22 nt, Homo sapiens
uaucucaguguacaggaugaua

SEQ ID NO: 116221 - RNA, 21 nt, Homo sapiens
uaucucaguuuuccuuugugg

SEQ ID NO: 116222 - RNA, 22 nt, Homo sapiens
uaucugcacuucugucuagguc

SEQ ID NO: 116223 - RNA, 22 nt, Homo sapiens
uaucugcaucccauuuuuauca

SEQ ID NO: 116224 - RNA, 22 nt, Homo sapiens
uaucugguuuuguuacagguuc

SEQ ID NO: 116225 - RNA, 22 nt, Homo sapiens
uaucuuggaguuugacaaccaa

SEQ ID NO: 116226 - RNA, 22 nt, Homo sapiens
uaugaaacucuaagauucacau

SEQ ID NO: 116227 - RNA, 22 nt, Homo sapiens
uaugaugcuguuuagaaucucu

SEQ ID NO: 116228 - RNA, 22 nt, Homo sapiens
uaugcacuaggcacuguguuug

SEQ ID NO: 116229 - RNA, 23 nt, Homo sapiens
uaugccuguuucaaacaaacuuu

SEQ ID NO: 116230 - RNA, 22 nt, Homo sapiens
uauguuaucaaaaagcuaagga

SEQ ID NO: 116231 - RNA, 22 nt, Homo sapiens
uauucacuguaucauugauggg

SEQ ID NO: 116232 - RNA, 22 nt, Homo sapiens
uauuccacuauuaguccagaug

SEQ ID NO: 116233 - RNA, 22 nt, Homo sapiens
uauuccuuuugcauuuccacau

SEQ ID NO: 116234 - RNA, 22 nt, Homo sapiens
uauugcaauuggggaaacuggg

SEQ ID NO: 116235 - RNA, 22 nt, Homo sapiens
uauugcacaugaggagacauug

SEQ ID NO: 116236 - RNA, 22 nt, Homo sapiens
uauugcccugcuuuguucuaaa

SEQ ID NO: 116237 - RNA, 20 nt, Homo sapiens
uauugccuaaauaccagaau

SEQ ID NO: 116238 - RNA, 22 nt, Homo sapiens
uauugcucugacugauuggaug

SEQ ID NO: 116239 - RNA, 22 nt, Homo sapiens
uauuucccuuaacuuuccugca

SEQ ID NO: 116240 - RNA, 22 nt, Homo sapiens
uauuugguuggugcaaaaguaa

SEQ ID NO: 116241 - RNA, 20 nt, Homo sapiens
ucaaagacauggcugucaga

SEQ ID NO: 116242 - RNA, 22 nt, Homo sapiens
aaaugcaguugguggggauaug

SEQ ID NO: 116243 - RNA, 22 nt, Homo sapiens
aaaugcauugagggaaaaggca

SEQ ID NO: 116244 - RNA, 22 nt, Homo sapiens
aaaugccucccauucuacugac

SEQ ID NO: 116245 - RNA, 22 nt, Homo sapiens
aaauugcauugagcugcuuauu

SEQ ID NO: 116246 - RNA, 22 nt, Homo sapiens
aacaccuugcagggauuaugac

SEQ ID NO: 116247 - RNA, 22 nt, Homo sapiens
aacacuaucugccuuacaggga

SEQ ID NO: 116248 - RNA, 22 nt, Homo sapiens
aacucugucuccuucaaguuca

SEQ ID NO: 116249 - RNA, 22 nt, Homo sapiens
aacuggcauaugaacuuguucu

SEQ ID NO: 116250 - RNA, 22 nt, Homo sapiens
aagagagccagcugguauauuu

SEQ ID NO: 116251 - RNA, 22 nt, Homo sapiens
aagaugcagaagcccagauguu

SEQ ID NO: 116252 - RNA, 22 nt, Homo sapiens
aagcaacacaucugccccgguu

SEQ ID NO: 116253 - RNA, 22 nt, Homo sapiens
aagcacaauuucaccuucuugu

SEQ ID NO: 116254 - RNA, 21 nt, Homo sapiens
aagcacauugaguguguguga

SEQ ID NO: 116255 - RNA, 22 nt, Homo sapiens
aagcagauguguugaaaguacu

SEQ ID NO: 116256 - RNA, 20 nt, Homo sapiens
aagcauggguuuuaggguca

SEQ ID NO: 116257 - RNA, 22 nt, Homo sapiens
aagcucuuguugaaucuuguca

SEQ ID NO: 116258 - RNA, 22 nt, Homo sapiens
aagcuggcuuucauugagugcu

SEQ ID NO: 116259 - RNA, 22 nt, Homo sapiens
aagcuguugguggauguaccau

SEQ ID NO: 116260 - RNA, 22 nt, Homo sapiens
aaggaauacuggugguugcuau

SEQ ID NO: 116261 - RNA, 22 nt, Homo sapiens
aaggcaagauacugguugcuga

SEQ ID NO: 116262 - RNA, 22 nt, Homo sapiens
aaggcagugugcacauaacacu

SEQ ID NO: 116263 - RNA, 22 nt, Homo sapiens
aagguauuuuugucuauaucuu

SEQ ID NO: 116264 - RNA, 22 nt, Homo sapiens
aaguaauugagguuuuugcugu

SEQ ID NO: 116265 - RNA, 20 nt, Homo sapiens
aagugcaucguugugucugc

SEQ ID NO: 116266 - RNA, 22 nt, Homo sapiens
aagugcauguauuaguguaguc

SEQ ID NO: 116267 - RNA, 22 nt, Homo sapiens
aagugguuuuuacaaagacaga

SEQ ID NO: 116268 - RNA, 21 nt, Homo sapiens
aauaaagcaaccuuaugccau

SEQ ID NO: 116269 - RNA, 22 nt, Homo sapiens
aauacugcuuugauguaagcua

SEQ ID NO: 116270 - RNA, 22 nt, Homo sapiens
aauaucacaggguguacacuca

SEQ ID NO: 116271 - RNA, 22 nt, Homo sapiens
aauaugucugcuaauuguuucu

SEQ ID NO: 116272 - RNA, 22 nt, Homo sapiens
aaucacaguguucuugugaggg

SEQ ID NO: 116273 - RNA, 22 nt, Homo sapiens
aaucacuaugccaugaaguaca

SEQ ID NO: 116274 - RNA, 17 nt, Homo sapiens
aaucagauuucugagga

SEQ ID NO: 116275 - RNA, 22 nt, Homo sapiens
aauccaugugcuuuaccauuuu

SEQ ID NO: 116276 - RNA, 22 nt, Homo sapiens
aaucucagcauuuugggcugag

SEQ ID NO: 116277 - RNA, 22 nt, Homo sapiens
aauggcaaauguuuucuguuga

SEQ ID NO: 116278 - RNA, 22 nt, Homo sapiens
aauggcacaagaguaaacuguu

SEQ ID NO: 116279 - RNA, 22 nt, Homo sapiens
aauggcaucuagaguggugaau

SEQ ID NO: 116280 - RNA, 22 nt, Homo sapiens
aaugugcuucuggcugugguca

SEQ ID NO: 116281 - RNA, 22 nt, Homo sapiens
aauucuguauuguuuagggacu

SEQ ID NO: 116282 - RNA, 17 nt, Homo sapiens
acaaauugccagcuagg

SEQ ID NO: 116283 - RNA, 22 nt, Homo sapiens
acaagcacaaaugcauagaugg

SEQ ID NO: 116284 - RNA, 22 nt, Homo sapiens
acacagugucuguguauuuaaa

SEQ ID NO: 116285 - RNA, 22 nt, Homo sapiens
acacaguguuuauugugguuag

SEQ ID NO: 116286 - RNA, 22 nt, Homo sapiens
acaccuguggucccaguaacuu

SEQ ID NO: 116287 - RNA, 22 nt, Homo sapiens
acacgugcguauauguacguau

SEQ ID NO: 116288 - RNA, 22 nt, Homo sapiens
acacuuucuggagcugcacaua

SEQ ID NO: 116289 - RNA, 22 nt, Homo sapiens
acagauagacauauauagcuca

SEQ ID NO: 116290 - RNA, 22 nt, Homo sapiens
acaggagugggauuugaguccu

SEQ ID NO: 116291 - RNA, 22 nt, Homo sapiens
acaggugaaguauuacacuaag

SEQ ID NO: 116292 - RNA, 22 nt, Homo sapiens
acaguacaugauaaauaaggua

SEQ ID NO: 116293 - RNA, 22 nt, Homo sapiens
acaguacuuuuggauuugugaa

SEQ ID NO: 116294 - RNA, 19 nt, Homo sapiens
acaguauugugcacagguu

SEQ ID NO: 116295 - RNA, 17 nt, Homo sapiens
acagugucuaugaaaug

SEQ ID NO: 116296 - RNA, 18 nt, Homo sapiens
acaucccaugcuggggug

SEQ ID NO: 116297 - RNA, 22 nt, Homo sapiens
acaugcauggcaugcauuguac

SEQ ID NO: 116298 - RNA, 22 nt, Homo sapiens
acaugccucccugguccgcugu

SEQ ID NO: 116299 - RNA, 22 nt, Homo sapiens
accacaggguaaaguuagauau

SEQ ID NO: 116300 - RNA, 22 nt, Homo sapiens
accaccauugcacugaacuuuc

SEQ ID NO: 116301 - RNA, 22 nt, Homo sapiens
accaguuuuuuauacaucuucu

SEQ ID NO: 116302 - RNA, 22 nt, Homo sapiens
acccagaagucauucaggaaca

SEQ ID NO: 116303 - RNA, 23 nt, Homo sapiens
accccuacaggcuuguguccugc

SEQ ID NO: 116304 - RNA, 22 nt, Homo sapiens
accccugagaucgaaucaugcu

SEQ ID NO: 116305 - RNA, 22 nt, Homo sapiens
acccugcuaaacagcccccugc

SEQ ID NO: 116306 - RNA, 22 nt, Homo sapiens
acccuuuagguuggaugaggau

SEQ ID NO: 116307 - RNA, 22 nt, Homo sapiens
accugagacuaggcauuuuaua

SEQ ID NO: 116308 - RNA, 22 nt, Homo sapiens
accuggacacuuugggcuccuc

SEQ ID NO: 116309 - RNA, 22 nt, Homo sapiens
accuggcacuuagcaaaucuga

SEQ ID NO: 116310 - RNA, 22 nt, Homo sapiens
acuagaugauuauguuccauug

SEQ ID NO: 116311 - RNA, 19 nt, Homo sapiens
acugcacuccaaccuccug

SEQ ID NO: 116312 - RNA, 22 nt, Homo sapiens
acugcacuccaaccuguugggc

SEQ ID NO: 116313 - RNA, 22 nt, Homo sapiens
acugcacuccagacucugucuc

SEQ ID NO: 116314 - RNA, 22 nt, Homo sapiens
acugcacuccagcccaggugac

SEQ ID NO: 116315 - RNA, 22 nt, Homo sapiens
acugcacuccagcccgggugac

SEQ ID NO: 116316 - RNA, 22 nt, Homo sapiens
acugcacuccagccucggggac

SEQ ID NO: 116317 - RNA, 22 nt, Homo sapiens
acugcacuccagccugcuggau

SEQ ID NO: 116318 - RNA, 22 nt, Homo sapiens
acugcacuccagccuuggccac

SEQ ID NO: 116319 - RNA, 22 nt, Homo sapiens
acugcacuccagcuccagggug

SEQ ID NO: 116320 - RNA, 22 nt, Homo sapiens
acugcacuccagcuugggugac

SEQ ID NO: 116321 - RNA, 20 nt, Homo sapiens
acugcacuccagucucuggg

SEQ ID NO: 116322 - RNA, 22 nt, Homo sapiens
acugcacucccgcccgggugac

SEQ ID NO: 116323 - RNA, 22 nt, Homo sapiens
acugcacuccggccucgugaca

SEQ ID NO: 116324 - RNA, 22 nt, Homo sapiens
acugcacuccggccuggcaaca

SEQ ID NO: 116325 - RNA, 22 nt, Homo sapiens
acuugacacuuauauuacucac

SEQ ID NO: 116326 - RNA, 22 nt, Homo sapiens
agaaacauucucuugccuccuu

SEQ ID NO: 116327 - RNA, 23 nt, Homo sapiens
agaaaugucuauucagggucccu

SEQ ID NO: 116328 - RNA, 22 nt, Homo sapiens
agaaauguuuauucaaacccgu

SEQ ID NO: 116329 - RNA, 22 nt, Homo sapiens
agaauucugucauguuuauauu

SEQ ID NO: 116330 - RNA, 22 nt, Homo sapiens
agacuagagcagagcccucucu

SEQ ID NO: 116331 - RNA, 22 nt, Homo sapiens
agagagcuuuugguugcccuaa

SEQ ID NO: 116332 - RNA, 22 nt, Homo sapiens
agagauuauccuggcuucucug

SEQ ID NO: 116333 - RNA, 22 nt, Homo sapiens
agagcaaugggugaauauuaaa

SEQ ID NO: 116334 - RNA, 22 nt, Homo sapiens
agagcaauguuaucagucucug

SEQ ID NO: 116335 - RNA, 20 nt, Homo sapiens
agagugcuggacugaggagc

SEQ ID NO: 116336 - RNA, 22 nt, Homo sapiens
agauauguuauugauguuaaug

SEQ ID NO: 116337 - RNA, 22 nt, Homo sapiens
agaucaauugcugauucgcucu

SEQ ID NO: 116338 - RNA, 22 nt, Homo sapiens
agaugauguuucuggcacauga

SEQ ID NO: 116339 - RNA, 22 nt, Homo sapiens
agaugguguuuucucaccagau

SEQ ID NO: 116340 - RNA, 23 nt, Homo sapiens
agcaaaugcucuagcacuccaac

SEQ ID NO: 116341 - RNA, 22 nt, Homo sapiens
agcaaccuugaauagcccuuuc

SEQ ID NO: 116342 - RNA, 22 nt, Homo sapiens
agcaauaugacauugcuacauc

SEQ ID NO: 116343 - RNA, 22 nt, Homo sapiens
agcagauguuuagugagcgccu

SEQ ID NO: 116344 - RNA, 22 nt, Homo sapiens
augagguccuagccaacuuuuu

SEQ ID NO: 116345 - RNA, 21 nt, Homo sapiens
augagguguacuguggugaaa

SEQ ID NO: 116346 - RNA, 22 nt, Homo sapiens
augaguaguugcuaaauauuga

SEQ ID NO: 116347 - RNA, 22 nt, Homo sapiens
augauaaguuauuagaagaaga

SEQ ID NO: 116348 - RNA, 22 nt, Homo sapiens
augaucaucugaaagcuuuuac

SEQ ID NO: 116349 - RNA, 22 nt, Homo sapiens
augauucugaucuagagcuugg

SEQ ID NO: 116350 - RNA, 22 nt, Homo sapiens
augcaauggaaaggacaauuac

SEQ ID NO: 116351 - RNA, 19 nt, Homo sapiens
augcaaugucacaggcugc

SEQ ID NO: 116352 - RNA, 22 nt, Homo sapiens
augcacaugcgaaaacuugugu

SEQ ID NO: 116353 - RNA, 19 nt, Homo sapiens
augcacgugaaaugcauuu

SEQ ID NO: 116354 - RNA, 22 nt, Homo sapiens
augcauaugucuuuauaguggc

SEQ ID NO: 116355 - RNA, 22 nt, Homo sapiens
augcauauuccugggccucacu

SEQ ID NO: 116356 - RNA, 19 nt, Homo sapiens
augccacagugaggucaga

SEQ ID NO: 116357 - RNA, 22 nt, Homo sapiens
augccacugcacuucagcuugg

SEQ ID NO: 116358 - RNA, 22 nt, Homo sapiens
augccacuguccuccugccuag

SEQ ID NO: 116359 - RNA, 22 nt, Homo sapiens
augccacuguuuaugucacuua

SEQ ID NO: 116360 - RNA, 22 nt, Homo sapiens
auggaaucauccuccugggagc

SEQ ID NO: 116361 - RNA, 22 nt, Homo sapiens
auggaauguaaguuauguuugc

SEQ ID NO: 116362 - RNA, 20 nt, Homo sapiens
auggaccuggauuaacagca

SEQ ID NO: 116363 - RNA, 18 nt, Homo sapiens
auggcagaacaauuuaca

SEQ ID NO: 116364 - RNA, 22 nt, Homo sapiens
auggcaguuuauucuaaaucaa

SEQ ID NO: 116365 - RNA, 22 nt, Homo sapiens
auggcaguuucacucugggauu

SEQ ID NO: 116366 - RNA, 22 nt, Homo sapiens
auggcaucgucaccuuuucagu

SEQ ID NO: 116367 - RNA, 22 nt, Homo sapiens
auggcccuguguggagcugcug

SEQ ID NO: 116368 - RNA, 22 nt, Homo sapiens
auggcuguuuuuuauguuacag

SEQ ID NO: 116369 - RNA, 21 nt, Homo sapiens
augggacuaacugaugggucu

SEQ ID NO: 116370 - RNA, 22 nt, Homo sapiens
augggagugugguuagagaccu

SEQ ID NO: 116371 - RNA, 22 nt, Homo sapiens
augguagacucucgggucaugg

SEQ ID NO: 116372 - RNA, 22 nt, Homo sapiens
auggucccauucauucacguau

SEQ ID NO: 116373 - RNA, 22 nt, Homo sapiens
auguaaacagaugugcagcuug

SEQ ID NO: 116374 - RNA, 22 nt, Homo sapiens
auguaaacuacagauuuugggu

SEQ ID NO: 116375 - RNA, 21 nt, Homo sapiens
auguaacugggaaugugagag

SEQ ID NO: 116376 - RNA, 22 nt, Homo sapiens
augugaacugaauuaauucaca

SEQ ID NO: 116377 - RNA, 22 nt, Homo sapiens
augugcacaugcuuacauguga

SEQ ID NO: 116378 - RNA, 22 nt, Homo sapiens
auguggaaagcagcaugauaug

SEQ ID NO: 116379 - RNA, 19 nt, Homo sapiens
augugguuagcaugacugc

SEQ ID NO: 116380 - RNA, 22 nt, Homo sapiens
auguuaacaucuuaguuuucau

SEQ ID NO: 116381 - RNA, 22 nt, Homo sapiens
auguuugguaagaauauuguua

SEQ ID NO: 116382 - RNA, 22 nt, Homo sapiens
auuaaauguuggacguauacau

SEQ ID NO: 116383 - RNA, 22 nt, Homo sapiens
auuaagagcacauguucugggu

SEQ ID NO: 116384 - RNA, 22 nt, Homo sapiens
auuaaguugugccugaaaacuu

SEQ ID NO: 116385 - RNA, 22 nt, Homo sapiens
auucaagucaucucuccgcauu

SEQ ID NO: 116386 - RNA, 22 nt, Homo sapiens
auucagaggggcagcugucuug

SEQ ID NO: 116387 - RNA, 22 nt, Homo sapiens
auucccuguagaauaaggaugg

SEQ ID NO: 116388 - RNA, 22 nt, Homo sapiens
auucuugcuugaacuuggugca

SEQ ID NO: 116389 - RNA, 22 nt, Homo sapiens
auugaacaugccauauguacca

SEQ ID NO: 116390 - RNA, 22 nt, Homo sapiens
auugagcuuuuuaaaauauagu

SEQ ID NO: 116391 - RNA, 22 nt, Homo sapiens
auugaggcaggaggaccaucua

SEQ ID NO: 116392 - RNA, 22 nt, Homo sapiens
auugcaaagcguagacucuaaa

SEQ ID NO: 116393 - RNA, 22 nt, Homo sapiens
auugcaaugggaaacuaugaaa

SEQ ID NO: 116394 - RNA, 22 nt, Homo sapiens
auugcacacagaaucaggguaa

SEQ ID NO: 116395 - RNA, 21 nt, Homo sapiens
auugcacuccagccugggcga

SEQ ID NO: 116396 - RNA, 22 nt, Homo sapiens
auugcacuccauccugggcaau

SEQ ID NO: 116397 - RNA, 22 nt, Homo sapiens
auugcaguuagaacagaagucu

SEQ ID NO: 116398 - RNA, 22 nt, Homo sapiens
auugccacaucucagaggcaga

SEQ ID NO: 116399 - RNA, 22 nt, Homo sapiens
auuggggaaugguggcuuuagu

SEQ ID NO: 116400 - RNA, 22 nt, Homo sapiens
auuguacuccagccuaggcaac

SEQ ID NO: 116401 - RNA, 22 nt, Homo sapiens
auuguacuuauugccagaauuu

SEQ ID NO: 116402 - RNA, 22 nt, Homo sapiens
auugugauggucaaaggaaaua

SEQ ID NO: 116403 - RNA, 22 nt, Homo sapiens
auuuggcaguauaaugcuuugg

SEQ ID NO: 116404 - RNA, 22 nt, Homo sapiens
auuuggcagugaagggaucaca

SEQ ID NO: 116405 - RNA, 22 nt, Homo sapiens
auuugggaaugugcauuauacu

SEQ ID NO: 116406 - RNA, 22 nt, Homo sapiens
caaagcuauagcaccagaggga

SEQ ID NO: 116407 - RNA, 22 nt, Homo sapiens
caaaguaauuacgguuuuggcc

SEQ ID NO: 116408 - RNA, 22 nt, Homo sapiens
caaaguaauugcuguuuugcca

SEQ ID NO: 116409 - RNA, 22 nt, Homo sapiens
caaaguaauugugguuuugcca

SEQ ID NO: 116410 - RNA, 22 nt, Homo sapiens
caaagucuucucauuaugucuu

SEQ ID NO: 116411 - RNA, 19 nt, Homo sapiens
caacccugcagagaaagga

SEQ ID NO: 116412 - RNA, 22 nt, Homo sapiens
caagagaccugagugucauucu

SEQ ID NO: 116413 - RNA, 22 nt, Homo sapiens
caagaggcuguguauaaagcca

SEQ ID NO: 116414 - RNA, 22 nt, Homo sapiens
caagggguggaaaugguagugu

SEQ ID NO: 116415 - RNA, 23 nt, Homo sapiens
caauacugaccucacguuaauag

SEQ ID NO: 116416 - RNA, 22 nt, Homo sapiens
caauacuguuaccugaaauagg

SEQ ID NO: 116417 - RNA, 22 nt, Homo sapiens
cacaaaguagauuagucuucca

SEQ ID NO: 116418 - RNA, 22 nt, Homo sapiens
cacagagugagacccugucucu

SEQ ID NO: 116419 - RNA, 22 nt, Homo sapiens
cacagcacaggcaugaguguca

SEQ ID NO: 116420 - RNA, 22 nt, Homo sapiens
cacagcuaacaacuguuucuuc

SEQ ID NO: 116421 - RNA, 22 nt, Homo sapiens
cacugcacuccagcuuugguga

SEQ ID NO: 116422 - RNA, 22 nt, Homo sapiens
cacugcacucuucuucugggca

SEQ ID NO: 116423 - RNA, 22 nt, Homo sapiens
cacuggguuagaacaugcuccu

SEQ ID NO: 116424 - RNA, 22 nt, Homo sapiens
cagagucaagcucuuguuccau

SEQ ID NO: 116425 - RNA, 22 nt, Homo sapiens
cagagugcauguuuagaugagu

SEQ ID NO: 116426 - RNA, 22 nt, Homo sapiens
cagauggucuuaaggcagccuu

SEQ ID NO: 116427 - RNA, 22 nt, Homo sapiens
cagauguaguauuuuagugaaa

SEQ ID NO: 116428 - RNA, 22 nt, Homo sapiens
cagcuaaauuguuaaauccaag

SEQ ID NO: 116429 - RNA, 22 nt, Homo sapiens
cagcucuuguuaaaacuaacua

SEQ ID NO: 116430 - RNA, 22 nt, Homo sapiens
cagcugaugucgaaugcacucu

SEQ ID NO: 116431 - RNA, 22 nt, Homo sapiens
caggcaacauggcgaaacucug

SEQ ID NO: 116432 - RNA, 22 nt, Homo sapiens
caggcagugggagacaaaacug

SEQ ID NO: 116433 - RNA, 22 nt, Homo sapiens
caggguccccuaccuuuugaug

SEQ ID NO: 116434 - RNA, 22 nt, Homo sapiens
cagguagucaacgggucuugga

SEQ ID NO: 116435 - RNA, 22 nt, Homo sapiens
cagugcauaggaucuaaaauuu

SEQ ID NO: 116436 - RNA, 22 nt, Homo sapiens
caguggaugauguuuucugugg

SEQ ID NO: 116437 - RNA, 22 nt, Homo sapiens
cauacaagcuacaaucacaaag

SEQ ID NO: 116438 - RNA, 22 nt, Homo sapiens
cauagcacugcacuucagccug

SEQ ID NO: 116439 - RNA, 22 nt, Homo sapiens
cauauucacuuuacagagcugu

SEQ ID NO: 116440 - RNA, 22 nt, Homo sapiens
caucacacuuggauguaagaca

SEQ ID NO: 116441 - RNA, 22 nt, Homo sapiens
caucacaucugcaugguaagua

SEQ ID NO: 116442 - RNA, 22 nt, Homo sapiens
caucacaugcuuauuuuccuca

SEQ ID NO: 116443 - RNA, 22 nt, Homo sapiens
cauccccugcaccaaccuuuac

SEQ ID NO: 116444 - RNA, 21 nt, Homo sapiens
cauccccugccauuguggucu

SEQ ID NO: 116445 - RNA, 22 nt, Homo sapiens
caugaaagacugaggaauugga

SEQ ID NO: 116446 - RNA, 22 nt, Homo sapiens
guggaaucuagagaggcaguag

SEQ ID NO: 116447 - RNA, 22 nt, Homo sapiens
guggacagagacuaaauguugu

SEQ ID NO: 116448 - RNA, 22 nt, Homo sapiens
guggcagcacauauagguuguu

SEQ ID NO: 116449 - RNA, 22 nt, Homo sapiens
guggcgagaucauagcucauug

SEQ ID NO: 116450 - RNA, 22 nt, Homo sapiens
gugggaagcuggaacucccucc

SEQ ID NO: 116451 - RNA, 22 nt, Homo sapiens
gugggaugaucgcuugagccca

SEQ ID NO: 116452 - RNA, 22 nt, Homo sapiens
gugggauggagagaagguauga

SEQ ID NO: 116453 - RNA, 22 nt, Homo sapiens
gugguguuugagcugccaggga

SEQ ID NO: 116454 - RNA, 21 nt, Homo sapiens
gugguucuagagaaacagaau

SEQ ID NO: 116455 - RNA, 22 nt, Homo sapiens
guguaauacacacauauaugca

SEQ ID NO: 116456 - RNA, 22 nt, Homo sapiens
gugucccagugugcauacaggu

SEQ ID NO: 116457 - RNA, 22 nt, Homo sapiens
gugugacagcuauagacaugau

SEQ ID NO: 116458 - RNA, 20 nt, Homo sapiens
gugugcauuucagauuuugg

SEQ ID NO: 116459 - RNA, 23 nt, Homo sapiens
gugugguaggcuauaccaucuag

SEQ ID NO: 116460 - RNA, 22 nt, Homo sapiens
gugugguauuauaacuagguau

SEQ ID NO: 116461 - RNA, 22 nt, Homo sapiens
guguucaaauucugacagagag

SEQ ID NO: 116462 - RNA, 22 nt, Homo sapiens
guuaggcagugugguauagcag

SEQ ID NO: 116463 - RNA, 22 nt, Homo sapiens
guuauguuaaauuguuguaugc

SEQ ID NO: 116464 - RNA, 22 nt, Homo sapiens
guuauguuaguuacaaggcuag

SEQ ID NO: 116465 - RNA, 22 nt, Homo sapiens
guucacagugguugccuuccag

SEQ ID NO: 116466 - RNA, 22 nt, Homo sapiens
guucacucuggagaauauugac

SEQ ID NO: 116467 - RNA, 22 nt, Homo sapiens
guucaguuugcugaugcguuga

SEQ ID NO: 116468 - RNA, 22 nt, Homo sapiens
guuggaauguauugcuacuucu

SEQ ID NO: 116469 - RNA, 22 nt, Homo sapiens
guuguggcuugugauuaagcac

SEQ ID NO: 116470 - RNA, 22 nt, Homo sapiens
uaaaccacguuuacauuugaga

SEQ ID NO: 116471 - RNA, 22 nt, Homo sapiens
uaaagaugcugggaaggcuagg

SEQ ID NO: 116472 - RNA, 22 nt, Homo sapiens
uaaagccuagaacuuucagccc

SEQ ID NO: 116473 - RNA, 20 nt, Homo sapiens
uaaagcugcucagggggcuc

SEQ ID NO: 116474 - RNA, 22 nt, Homo sapiens
uaaaguguuuguuauuaaaggu

SEQ ID NO: 116475 - RNA, 22 nt, Homo sapiens
uaaaguuauugccccucaguua

SEQ ID NO: 116476 - RNA, 22 nt, Homo sapiens
uaacaguauauuuaccaaaccu

SEQ ID NO: 116477 - RNA, 22 nt, Homo sapiens
uaacaguguagaggccuauugg

SEQ ID NO: 116478 - RNA, 22 nt, Homo sapiens
uaacuaaagagaagucaauguc

SEQ ID NO: 116479 - RNA, 22 nt, Homo sapiens
uaacuaguggaauuugauuuca

SEQ ID NO: 116480 - RNA, 22 nt, Homo sapiens
uaagacacauguguucccaggc

SEQ ID NO: 116481 - RNA, 22 nt, Homo sapiens
uaagcaguguggauccaccuug

SEQ ID NO: 116482 - RNA, 22 nt, Homo sapiens
uaaggaacucugauaucuggaa

SEQ ID NO: 116483 - RNA, 22 nt, Homo sapiens
uaaggaguagaauaguaaggca

SEQ ID NO: 116484 - RNA, 22 nt, Homo sapiens
uaaggcaaaccuuggcugcagu

SEQ ID NO: 116485 - RNA, 22 nt, Homo sapiens
uaaguaauugugguuuuugcca

SEQ ID NO: 116486 - RNA, 22 nt, Homo sapiens
uaaguaauuuguauuuuaccca

SEQ ID NO: 116487 - RNA, 22 nt, Homo sapiens
uaaguacaugcuagauggaaug

SEQ ID NO: 116488 - RNA, 22 nt, Homo sapiens
uaagucuuuuuggaguuuauaa

SEQ ID NO: 116489 - RNA, 20 nt, Homo sapiens
uaagugcuugagacuucuga

SEQ ID NO: 116490 - RNA, 22 nt, Homo sapiens
uaauccuagcacuuuggaagac

SEQ ID NO: 116491 - RNA, 22 nt, Homo sapiens
uaaugcucauuagcaggccaau

SEQ ID NO: 116492 - RNA, 22 nt, Homo sapiens
uacaaguaauaagggaagaauu

SEQ ID NO: 116493 - RNA, 22 nt, Homo sapiens
uacacagucaaaaauuuccagg

SEQ ID NO: 116494 - RNA, 22 nt, Homo sapiens
uacagcacaggugcagguguug

SEQ ID NO: 116495 - RNA, 22 nt, Homo sapiens
uacagcuaugugcaugcaugcu

SEQ ID NO: 116496 - RNA, 22 nt, Homo sapiens
uacaggcagguguucccugguu

SEQ ID NO: 116497 - RNA, 22 nt, Homo sapiens
uacauaguuacuuccauuucca

SEQ ID NO: 116498 - RNA, 22 nt, Homo sapiens
uacaucagccugaaagagcucg

SEQ ID NO: 116499 - RNA, 22 nt, Homo sapiens
uacauccauccugcugggcagu

SEQ ID NO: 116500 - RNA, 22 nt, Homo sapiens
uacauguauccauuguuuuugg

SEQ ID NO: 116501 - RNA, 22 nt, Homo sapiens
uaccaaaguuucggccucuguu

SEQ ID NO: 116502 - RNA, 22 nt, Homo sapiens
uaccugagcccucugcugaguu

SEQ ID NO: 116503 - RNA, 22 nt, Homo sapiens
uacuagaaccuuauucagagug

SEQ ID NO: 116504 - RNA, 22 nt, Homo sapiens
uacucugcagagaugcauaaca

SEQ ID NO: 116505 - RNA, 22 nt, Homo sapiens
uacugcacuccaaccugagaga

SEQ ID NO: 116506 - RNA, 20 nt, Homo sapiens
uacugcacuuuccucauggu

SEQ ID NO: 116507 - RNA, 22 nt, Homo sapiens
uacuuuguagauuguuuccuuu

SEQ ID NO: 116508 - RNA, 22 nt, Homo sapiens
uagaaucuaacucgcaugaaaa

SEQ ID NO: 116509 - RNA, 22 nt, Homo sapiens
uagacacuagauaugugacuga

SEQ ID NO: 116510 - RNA, 20 nt, Homo sapiens
uagagagauauggggguucc

SEQ ID NO: 116511 - RNA, 22 nt, Homo sapiens
uagagaucuuauauuuuaugac

SEQ ID NO: 116512 - RNA, 22 nt, Homo sapiens
uagaugauucacuuuacuucca

SEQ ID NO: 116513 - RNA, 22 nt, Homo sapiens
uagauucauuuuagcaaaaguu

SEQ ID NO: 116514 - RNA, 19 nt, Homo sapiens
uagcagcaugauuuauaau

SEQ ID NO: 116515 - RNA, 19 nt, Homo sapiens
uagcuagauuggguacuua

SEQ ID NO: 116516 - RNA, 22 nt, Homo sapiens
uaggacacaggacauauguaga

SEQ ID NO: 116517 - RNA, 22 nt, Homo sapiens
uagguaaguaauauacagauga

SEQ ID NO: 116518 - RNA, 22 nt, Homo sapiens
uagguacuuaagaucucagcua

SEQ ID NO: 116519 - RNA, 22 nt, Homo sapiens
uagguacuuuacauguuaucuc

SEQ ID NO: 116520 - RNA, 22 nt, Homo sapiens
cuaccuggguggcucaugacuu

SEQ ID NO: 116521 - RNA, 22 nt, Homo sapiens
cuagaagcauauucagaacaga

SEQ ID NO: 116522 - RNA, 21 nt, Homo sapiens
cuaggaccaguucuguaauuc

SEQ ID NO: 116523 - RNA, 22 nt, Homo sapiens
cuaggcuuuucuuggauccagg

SEQ ID NO: 116524 - RNA, 22 nt, Homo sapiens
cuagugcaguuccccugucuua

SEQ ID NO: 116525 - RNA, 22 nt, Homo sapiens
cuauuugguuggugaaaaaagu

SEQ ID NO: 116526 - RNA, 22 nt, Homo sapiens
cucaaaguacuuugguuauugu

SEQ ID NO: 116527 - RNA, 22 nt, Homo sapiens
cucaaagugcugggacuggcug

SEQ ID NO: 116528 - RNA, 22 nt, Homo sapiens
cucaaagugcugggauuggcca

SEQ ID NO: 116529 - RNA, 22 nt, Homo sapiens
cucaaaugguccagcuaguggu

SEQ ID NO: 116530 - RNA, 22 nt, Homo sapiens
cucaccuugugauccaccggcc

SEQ ID NO: 116531 - RNA, 22 nt, Homo sapiens
cucacugugguguccuuaggua

SEQ ID NO: 116532 - RNA, 22 nt, Homo sapiens
cucagcuacuugggaagcugag

SEQ ID NO: 116533 - RNA, 22 nt, Homo sapiens
cucagugucuggggccccaggg

SEQ ID NO: 116534 - RNA, 22 nt, Homo sapiens
cucaguguucccauucuaccuu

SEQ ID NO: 116535 - RNA, 22 nt, Homo sapiens
cuccaggugagguuaagggacu

SEQ ID NO: 116536 - RNA, 22 nt, Homo sapiens
cuccaggugucauccaccuccu

SEQ ID NO: 116537 - RNA, 22 nt, Homo sapiens
cuccagugcaaagucaugauca

SEQ ID NO: 116538 - RNA, 22 nt, Homo sapiens
cuccaguuucagaaucccaugu

SEQ ID NO: 116539 - RNA, 23 nt, Homo sapiens
cucccugaacaugacacaccaga

SEQ ID NO: 116540 - RNA, 22 nt, Homo sapiens
cucccugagccagggcuuugac

SEQ ID NO: 116541 - RNA, 20 nt, Homo sapiens
cuccuucauuccuuuggacc

SEQ ID NO: 116542 - RNA, 22 nt, Homo sapiens
cucucugagccauggcugcccu

SEQ ID NO: 116543 - RNA, 22 nt, Homo sapiens
cucugacagugguuagcacugu

SEQ ID NO: 116544 - RNA, 22 nt, Homo sapiens
cugaauguucuauagaagccgc

SEQ ID NO: 116545 - RNA, 22 nt, Homo sapiens
cugagaacaucauucagauauu

SEQ ID NO: 116546 - RNA, 22 nt, Homo sapiens
cugagaagaaacagguaaggac

SEQ ID NO: 116547 - RNA, 22 nt, Homo sapiens
cugagagaggagcuaaaacugc

SEQ ID NO: 116548 - RNA, 22 nt, Homo sapiens
cugagagaugagaccucucacu

SEQ ID NO: 116549 - RNA, 22 nt, Homo sapiens
cugagauuaagauauugggagu

SEQ ID NO: 116550 - RNA, 22 nt, Homo sapiens
cugagcaaaaugaagacacgau

SEQ ID NO: 116551 - RNA, 22 nt, Homo sapiens
cugagcuagaccacuuggcucc

SEQ ID NO: 116552 - RNA, 22 nt, Homo sapiens
cugagcuaugccuggaaaggca

SEQ ID NO: 116553 - RNA, 22 nt, Homo sapiens
cugaggugggagaaucacauaa

SEQ ID NO: 116554 - RNA, 21 nt, Homo sapiens
cugcaaaugcugcugccugau

SEQ ID NO: 116555 - RNA, 22 nt, Homo sapiens
cugcagaucuuggggcuugcca

SEQ ID NO: 116556 - RNA, 22 nt, Homo sapiens
cugcaguaaacuuucccauuca

SEQ ID NO: 116557 - RNA, 20 nt, Homo sapiens
cugcuccccuacaaaucuca

SEQ ID NO: 116558 - RNA, 22 nt, Homo sapiens
cuggaaucuagaaaagguaagg

SEQ ID NO: 116559 - RNA, 22 nt, Homo sapiens
cuggaaucuauggauaacaucg

SEQ ID NO: 116560 - RNA, 22 nt, Homo sapiens
cuggaauguuccuaaagauuca

SEQ ID NO: 116561 - RNA, 22 nt, Homo sapiens
cuggauagucaggagauauaua

SEQ ID NO: 116562 - RNA, 20 nt, Homo sapiens
cuggaugucgaggcagaggu

SEQ ID NO: 116563 - RNA, 18 nt, Homo sapiens
cuggaugucgaguguguu

SEQ ID NO: 116564 - RNA, 22 nt, Homo sapiens
cuggcaaaaagagggcaauaau

SEQ ID NO: 116565 - RNA, 22 nt, Homo sapiens
cuggcaaauaguagagccagga

SEQ ID NO: 116566 - RNA, 22 nt, Homo sapiens
cuggcaaauguuuucuguaaag

SEQ ID NO: 116567 - RNA, 22 nt, Homo sapiens
cuggcaauaaauuuuuguguug

SEQ ID NO: 116568 - RNA, 22 nt, Homo sapiens
cuggcaauaggcagugucccaa

SEQ ID NO: 116569 - RNA, 22 nt, Homo sapiens
cuggccagagacauucauuaaa

SEQ ID NO: 116570 - RNA, 22 nt, Homo sapiens
cuggcucuguuagaagaaccag

SEQ ID NO: 116571 - RNA, 22 nt, Homo sapiens
cugggcaaugcggcuggauaga

SEQ ID NO: 116572 - RNA, 19 nt, Homo sapiens
cugucacugaggaagacug

SEQ ID NO: 116573 - RNA, 22 nt, Homo sapiens
cugugaagaaagucauugguag

SEQ ID NO: 116574 - RNA, 22 nt, Homo sapiens
cugugacugcagggcauauuug

SEQ ID NO: 116575 - RNA, 22 nt, Homo sapiens
cuguuugguaaggaugccucag

SEQ ID NO: 116576 - RNA, 22 nt, Homo sapiens
cuguuugguuaucuuuuccugu

SEQ ID NO: 116577 - RNA, 20 nt, Homo sapiens
cuucacagaaguggaaucau

SEQ ID NO: 116578 - RNA, 22 nt, Homo sapiens
cuuccugaguccugggcucaca

SEQ ID NO: 116579 - RNA, 22 nt, Homo sapiens
cuucugauugaaaauggaguag

SEQ ID NO: 116580 - RNA, 22 nt, Homo sapiens
cuucuguuaguucugauaacuu

SEQ ID NO: 116581 - RNA, 22 nt, Homo sapiens
cuucuugcuguguccucacaug

SEQ ID NO: 116582 - RNA, 22 nt, Homo sapiens
cuuggcuccgacuccccuccaa

SEQ ID NO: 116583 - RNA, 22 nt, Homo sapiens
cuugggcagugugcauguguau

SEQ ID NO: 116584 - RNA, 19 nt, Homo sapiens
cuuguacucggcgcaguug

SEQ ID NO: 116585 - RNA, 22 nt, Homo sapiens
cuuguucuccuaagaugaaugc

SEQ ID NO: 116586 - RNA, 22 nt, Homo sapiens
cuuguuguggaggggagugcag

SEQ ID NO: 116587 - RNA, 22 nt, Homo sapiens
cuuucacacuguuggugggaau

SEQ ID NO: 116588 - RNA, 22 nt, Homo sapiens
cuuucugaggagaauagagaac

SEQ ID NO: 116589 - RNA, 22 nt, Homo sapiens
cuuugcaaauggccuuuccaag

SEQ ID NO: 116590 - RNA, 21 nt, Homo sapiens
cuuugcacugcuccucagcuc

SEQ ID NO: 116591 - RNA, 23 nt, Homo sapiens
cuuuguacagcuugacuacuggg

SEQ ID NO: 116592 - RNA, 22 nt, Homo sapiens
uucccugugguauagaagccgu

SEQ ID NO: 116593 - RNA, 22 nt, Homo sapiens
uuccugagagggcugggugcag

SEQ ID NO: 116594 - RNA, 22 nt, Homo sapiens
uuccuuguagcaaaugcgauga

SEQ ID NO: 116595 - RNA, 22 nt, Homo sapiens
uucgagagaaaaggcauauaug

SEQ ID NO: 116596 - RNA, 21 nt, Homo sapiens
uucuauggucagaauucaaua

SEQ ID NO: 116597 - RNA, 22 nt, Homo sapiens
uucucaguaauuccagauuuuu

SEQ ID NO: 116598 - RNA, 22 nt, Homo sapiens
uucuccugguggacccuaaacg

SEQ ID NO: 116599 - RNA, 19 nt, Homo sapiens
uucucugguuguacuaccc

SEQ ID NO: 116600 - RNA, 22 nt, Homo sapiens
uucugcacaucgaucacaagau

SEQ ID NO: 116601 - RNA, 22 nt, Homo sapiens
uucuggaaaucagcagagggug

SEQ ID NO: 116602 - RNA, 22 nt, Homo sapiens
uucuggccccucccaaucucau

SEQ ID NO: 116603 - RNA, 22 nt, Homo sapiens
uucuugcacuuaacugacauuc

SEQ ID NO: 116604 - RNA, 22 nt, Homo sapiens
uucuugcacuuggcccucauua

SEQ ID NO: 116605 - RNA, 22 nt, Homo sapiens
uucuuugguacaagggccgacc

SEQ ID NO: 116606 - RNA, 22 nt, Homo sapiens
uugaaaguaaacaucacaaaga

SEQ ID NO: 116607 - RNA, 22 nt, Homo sapiens
uugaaccauucuuuugauagag

SEQ ID NO: 116608 - RNA, 22 nt, Homo sapiens
uugaccacugggcacaguaagu

SEQ ID NO: 116609 - RNA, 17 nt, Homo sapiens
uugagaguauaucuuac

SEQ ID NO: 116610 - RNA, 22 nt, Homo sapiens
uugagaguggaggcuauaucuu

SEQ ID NO: 116611 - RNA, 22 nt, Homo sapiens
uugagauggagccucacucugc

SEQ ID NO: 116612 - RNA, 22 nt, Homo sapiens
uugagauggagucucacgcauu

SEQ ID NO: 116613 - RNA, 22 nt, Homo sapiens
uugagauggagucucacucuug

SEQ ID NO: 116614 - RNA, 22 nt, Homo sapiens
uugagauggagucucacucuuu

SEQ ID NO: 116615 - RNA, 22 nt, Homo sapiens
uugagauggaguuucacucucg

SEQ ID NO: 116616 - RNA, 22 nt, Homo sapiens
uugagauggaguuucacucuug

SEQ ID NO: 116617 - RNA, 22 nt, Homo sapiens
uugagauguauguauauaaugu

SEQ ID NO: 116618 - RNA, 22 nt, Homo sapiens
uugagcaacauagugagacugu

SEQ ID NO: 116619 - RNA, 22 nt, Homo sapiens
uugagcucaucaagauagagaa

SEQ ID NO: 116620 - RNA, 22 nt, Homo sapiens
uugagcucaucuucagggguga

SEQ ID NO: 116621 - RNA, 22 nt, Homo sapiens
uugagcucuuccagccuggagc

SEQ ID NO: 116622 - RNA, 22 nt, Homo sapiens
uugagcucuucuagcaauucua

SEQ ID NO: 116623 - RNA, 22 nt, Homo sapiens
uugagcuuuuuacuuguccaau

SEQ ID NO: 116624 - RNA, 22 nt, Homo sapiens
uugaggaggcagucucuccauu

SEQ ID NO: 116625 - RNA, 22 nt, Homo sapiens
uugaggaggcagucuucccauu

SEQ ID NO: 116626 - RNA, 22 nt, Homo sapiens
uugagggaggcagggcuugucu

SEQ ID NO: 116627 - RNA, 22 nt, Homo sapiens
uugagguagcuuugauggaggu

SEQ ID NO: 116628 - RNA, 20 nt, Homo sapiens
uugaggucaggaguuuggga

SEQ ID NO: 116629 - RNA, 22 nt, Homo sapiens
uugaucaucagcuuugucaucu

SEQ ID NO: 116630 - RNA, 22 nt, Homo sapiens
uugauguugaggacauaaaccu

SEQ ID NO: 116631 - RNA, 22 nt, Homo sapiens
uugcacagugguuuagagccug

SEQ ID NO: 116632 - RNA, 22 nt, Homo sapiens
uugcacaguguguacagcacca

SEQ ID NO: 116633 - RNA, 22 nt, Homo sapiens
uugcacuucauguaggccaaag

SEQ ID NO: 116634 - RNA, 22 nt, Homo sapiens
uugcagaucccacacucacccu

SEQ ID NO: 116635 - RNA, 22 nt, Homo sapiens
uugcagcaaagagggaggggca

SEQ ID NO: 116636 - RNA, 22 nt, Homo sapiens
uugcaggcaugagccaccgugc

SEQ ID NO: 116637 - RNA, 22 nt, Homo sapiens
uugcagugguuucacuggcaaa

SEQ ID NO: 116638 - RNA, 22 nt, Homo sapiens
uugcauagacaauauuaaucuu

SEQ ID NO: 116639 - RNA, 22 nt, Homo sapiens
uugcauauguugaaccaagcgu

SEQ ID NO: 116640 - RNA, 19 nt, Homo sapiens
uugcauauguugaaccagc

SEQ ID NO: 116641 - RNA, 22 nt, Homo sapiens
uugccaacauggugaacuccca

SEQ ID NO: 116642 - RNA, 21 nt, Homo sapiens
uugccugacacuggaagaaau

SEQ ID NO: 116643 - RNA, 22 nt, Homo sapiens
uugccugagaagccaagaauaa

SEQ ID NO: 116644 - RNA, 22 nt, Homo sapiens
uugcgcuuuuccuauguugccc

SEQ ID NO: 116645 - RNA, 22 nt, Homo sapiens
uugcucaggcuggaguacaaug

SEQ ID NO: 116646 - RNA, 22 nt, Homo sapiens
uugcuuaggcuggagugcagug

SEQ ID NO: 116647 - RNA, 22 nt, Homo sapiens
uuggaagcaugguuauugacgu

SEQ ID NO: 116648 - RNA, 22 nt, Homo sapiens
uuggaaggcugaauggccucuc

SEQ ID NO: 116649 - RNA, 22 nt, Homo sapiens
uuggaauuagacaagugguggu

SEQ ID NO: 116650 - RNA, 22 nt, Homo sapiens
uuggaauuuauuuggaugggag

SEQ ID NO: 116651 - RNA, 22 nt, Homo sapiens
uuggaauuuuacuucuguaaga

SEQ ID NO: 116652 - RNA, 22 nt, Homo sapiens
uuggcaacauagugagaccccc

SEQ ID NO: 116653 - RNA, 22 nt, Homo sapiens
uuggcaagaauguaugccgauc

SEQ ID NO: 116654 - RNA, 22 nt, Homo sapiens
uuggcaaucaauucugacgucu

SEQ ID NO: 116655 - RNA, 22 nt, Homo sapiens
uuggcagaauguuagaaacuua

SEQ ID NO: 116656 - RNA, 22 nt, Homo sapiens
uuggcauuuauucuaaggucaa

SEQ ID NO: 116657 - RNA, 21 nt, Homo sapiens
uuggccuggaggccugaaugu

SEQ ID NO: 116658 - RNA, 22 nt, Homo sapiens
uuggcuaagaucacgugagaau

SEQ ID NO: 116659 - RNA, 22 nt, Homo sapiens
uugggcaaguggcaugaccaug

SEQ ID NO: 116660 - RNA, 22 nt, Homo sapiens
uugggcaauaggaagcaggugg

SEQ ID NO: 116661 - RNA, 22 nt, Homo sapiens
uugggccacuuuaguuuccuua

SEQ ID NO: 116662 - RNA, 22 nt, Homo sapiens
uuggggcacggccucuguugcc

SEQ ID NO: 116663 - RNA, 22 nt, Homo sapiens
uugguaguuucugucuuuagau

SEQ ID NO: 116664 - RNA, 22 nt, Homo sapiens
uugguccccuucaaccagcugu

SEQ ID NO: 116665 - RNA, 22 nt, Homo sapiens
uugguucucuuagccaucuuaa

SEQ ID NO: 116666 - RNA, 22 nt, Homo sapiens
uuguagcaaauauauuuuggaa

SEQ ID NO: 116667 - RNA, 22 nt, Homo sapiens
uuguaguguuuauucugucaac

SEQ ID NO: 116668 - RNA, 22 nt, Homo sapiens
uuguauguaaccauuuggcaaa

SEQ ID NO: 116669 - RNA, 22 nt, Homo sapiens
uugucacucuuccuaggguagg

SEQ ID NO: 116670 - RNA, 23 nt, Homo sapiens
uuguccccuccaaagcucauguu

SEQ ID NO: 116671 - RNA, 22 nt, Homo sapiens
uugugaaaucuaggcagagguu

SEQ ID NO: 116672 - RNA, 22 nt, Homo sapiens
uugugaagaaaccagaaaaguu

SEQ ID NO: 116673 - RNA, 22 nt, Homo sapiens
uugugaucuucagaaaguggcu

SEQ ID NO: 116674 - RNA, 22 nt, Homo sapiens
uugugcauaucagagguuugcu

SEQ ID NO: 116675 - RNA, 22 nt, Homo sapiens
ugugacaguuaguuugguguua

SEQ ID NO: 116676 - RNA, 22 nt, Homo sapiens
ugugacucuggcacauggugag

SEQ ID NO: 116677 - RNA, 22 nt, Homo sapiens
ugugagaaaugcagaaucucag

SEQ ID NO: 116678 - RNA, 19 nt, Homo sapiens
ugugagcauuagcauuuag

SEQ ID NO: 116679 - RNA, 22 nt, Homo sapiens
ugugaugaagaguccaagaaca

SEQ ID NO: 116680 - RNA, 22 nt, Homo sapiens
ugugauuggccuggcguggguc

SEQ ID NO: 116681 - RNA, 22 nt, Homo sapiens
ugugcaaauuagcacaacccga

SEQ ID NO: 116682 - RNA, 22 nt, Homo sapiens
ugugcacauugugcagguugau

SEQ ID NO: 116683 - RNA, 22 nt, Homo sapiens
uguguaauacucuaaugaugca

SEQ ID NO: 116684 - RNA, 22 nt, Homo sapiens
uguuucuacugucucuguagua

SEQ ID NO: 116685 - RNA, 22 nt, Homo sapiens
uguuugcuuaacguggagccag

SEQ ID NO: 116686 - RNA, 22 nt, Homo sapiens
uguuugguggucucuucacaug

SEQ ID NO: 116687 - RNA, 22 nt, Homo sapiens
uuaagcaaagguaacaugagaa

SEQ ID NO: 116688 - RNA, 22 nt, Homo sapiens
uuaagcaguggauuagaauuuu

SEQ ID NO: 116689 - RNA, 22 nt, Homo sapiens
uuaaguacuucccuguuggaca

SEQ ID NO: 116690 - RNA, 22 nt, Homo sapiens
uuaaugacaucauaggugaagu

SEQ ID NO: 116691 - RNA, 22 nt, Homo sapiens
uuacagauggcacacucaaggg

SEQ ID NO: 116692 - RNA, 22 nt, Homo sapiens
uuacaggacuaagcagcuuugc

SEQ ID NO: 116693 - RNA, 22 nt, Homo sapiens
uuacaguaugaguaagaguucu

SEQ ID NO: 116694 - RNA, 22 nt, Homo sapiens
uuacaguauugcaaggacuagg

SEQ ID NO: 116695 - RNA, 22 nt, Homo sapiens
uuacagucucaagagugcugca

SEQ ID NO: 116696 - RNA, 23 nt, Homo sapiens
uuacaguggcaugaucucugcuc

SEQ ID NO: 116697 - RNA, 19 nt, Homo sapiens
uuacagugugcccuuuuag

SEQ ID NO: 116698 - RNA, 19 nt, Homo sapiens
uuacauccauugcauuuca

SEQ ID NO: 116699 - RNA, 22 nt, Homo sapiens
uuacauguggugugaagaagag

SEQ ID NO: 116700 - RNA, 22 nt, Homo sapiens
uuaccuugcacugagucugaaa

SEQ ID NO: 116701 - RNA, 22 nt, Homo sapiens
uuagaugaaugucucuuaaaca

SEQ ID NO: 116702 - RNA, 22 nt, Homo sapiens
uuagcagcaugagaauggacua

SEQ ID NO: 116703 - RNA, 22 nt, Homo sapiens
uuagcucaguuggugagagcgu

SEQ ID NO: 116704 - RNA, 20 nt, Homo sapiens
uuaguucauuuagaagguuu

SEQ ID NO: 116705 - RNA, 22 nt, Homo sapiens
uuauaacagagacuccugugcu

SEQ ID NO: 116706 - RNA, 22 nt, Homo sapiens
uuauauguuucuuagggacaga

SEQ ID NO: 116707 - RNA, 22 nt, Homo sapiens
uuaugacuuucagcuaggggau

SEQ ID NO: 116708 - RNA, 22 nt, Homo sapiens
uuaugguacaugugcacaaugu

SEQ ID NO: 116709 - RNA, 22 nt, Homo sapiens
uuaugucacuguucagucuccc

SEQ ID NO: 116710 - RNA, 22 nt, Homo sapiens
uuauuagagauauuugguuagg

SEQ ID NO: 116711 - RNA, 22 nt, Homo sapiens
uuauuagguuagugcaaaaguu

SEQ ID NO: 116712 - RNA, 22 nt, Homo sapiens
uuauucauuaauugcuaagguu

SEQ ID NO: 116713 - RNA, 22 nt, Homo sapiens
uucaaaggauuuagauuagcua

SEQ ID NO: 116714 - RNA, 22 nt, Homo sapiens
uucaaaguaaaaauguguucac

SEQ ID NO: 116715 - RNA, 22 nt, Homo sapiens
uucaaguaguucucaugccuca

SEQ ID NO: 116716 - RNA, 20 nt, Homo sapiens
uucaagugauucucaugccu

SEQ ID NO: 116717 - RNA, 22 nt, Homo sapiens
uucaauacuguugauccuuaug

SEQ ID NO: 116718 - RNA, 22 nt, Homo sapiens
uucacaugacagggugaagcau

SEQ ID NO: 116719 - RNA, 22 nt, Homo sapiens
uucacaugguugccuuuugauc

SEQ ID NO: 116720 - RNA, 22 nt, Homo sapiens
uucacuguuaagcaguuaaacu

SEQ ID NO: 116721 - RNA, 22 nt, Homo sapiens
uucagagcauugguuuuuugaa

SEQ ID NO: 116722 - RNA, 19 nt, Homo sapiens
uucagcagugucugcucuu

SEQ ID NO: 116723 - RNA, 22 nt, Homo sapiens
uucaggcuuuuauuuacugaua

SEQ ID NO: 116724 - RNA, 22 nt, Homo sapiens
uucaguacacguguucucauuu

SEQ ID NO: 116725 - RNA, 18 nt, Homo sapiens
uucauaguagcaugauuu

SEQ ID NO: 116726 - RNA, 22 nt, Homo sapiens
uucauagucacauucgaugucu

SEQ ID NO: 116727 - RNA, 22 nt, Homo sapiens
uucauaguguaccugaaggcac

SEQ ID NO: 116728 - RNA, 22 nt, Homo sapiens
uucaucagcuguagaugucaug

SEQ ID NO: 116729 - RNA, 22 nt, Homo sapiens
uucaucagggagaaauaauuuc

SEQ ID NO: 116730 - RNA, 21 nt, Homo sapiens
uucaucuggccguauuccagg

SEQ ID NO: 116731 - RNA, 22 nt, Homo sapiens
uucauggaguugagaaggcuaa

SEQ ID NO: 116732 - RNA, 20 nt, Homo sapiens
uucaugggagcaaagaggcc

SEQ ID NO: 116733 - RNA, 22 nt, Homo sapiens
uucauugcugcuuaucuccaga

SEQ ID NO: 116734 - RNA, 22 nt, Homo sapiens
uuccacaauggcugaacuaguu

SEQ ID NO: 116735 - RNA, 22 nt, Homo sapiens
uucccugagcaucuguugagcc

SEQ ID NO: 116736 - RNA, 22 nt, Homo sapiens
uuccuacugcccauuaaaaugg

SEQ ID NO: 116737 - RNA, 22 nt, Homo sapiens
uuccugaggccuccccagaagc

SEQ ID NO: 116738 - RNA, 22 nt, Homo sapiens
uuccuugugacuaguagugacc

SEQ ID NO: 116739 - RNA, 22 nt, Homo sapiens
uuccuuguuuauuuacaggagg

SEQ ID NO: 116740 - RNA, 22 nt, Homo sapiens
uucgucaugagacagaugcuga

SEQ ID NO: 116741 - RNA, 22 nt, Homo sapiens
uucuaaacaucuuacaaugcau

SEQ ID NO: 116742 - RNA, 22 nt, Homo sapiens
uucugcuugaucuaguguguug

SEQ ID NO: 116743 - RNA, 22 nt, Homo sapiens
uucuggcuaugggauacuaaau

SEQ ID NO: 116744 - RNA, 22 nt, Homo sapiens
uucuugguugcucacacccauc

SEQ ID NO: 116745 - RNA, 22 nt, Homo sapiens
uucuuugcaugaucucaaaguc

SEQ ID NO: 116746 - RNA, 21 nt, Homo sapiens
uucuuugcucaguguuagagu

SEQ ID NO: 116747 - RNA, 22 nt, Homo sapiens
uugaaagucauggcacaggcaa

SEQ ID NO: 116748 - RNA, 22 nt, Homo sapiens
uugaaaucuuccacagcccaag

SEQ ID NO: 116749 - RNA, 22 nt, Homo sapiens
uugaaggaggugcucacucucg

SEQ ID NO: 116750 - RNA, 22 nt, Homo sapiens
uugacaaugcacugugcuaagu

SEQ ID NO: 116751 - RNA, 22 nt, Homo sapiens
uugaccaaagaagagucauugc

SEQ ID NO: 116752 - RNA, 22 nt, Homo sapiens
uugagagaaaaaauuuauuggu

SEQ ID NO: 116753 - RNA, 22 nt, Homo sapiens
uugagauggagucucacucugc

SEQ ID NO: 116754 - RNA, 22 nt, Homo sapiens
uugagauggagucucacucuuc

SEQ ID NO: 116755 - RNA, 22 nt, Homo sapiens
uugagauggauagacauagcau

SEQ ID NO: 116756 - RNA, 22 nt, Homo sapiens
uugagauuuuccucaaauauuu

SEQ ID NO: 116757 - RNA, 22 nt, Homo sapiens
uugagcuccucucaaccuaagg

SEQ ID NO: 116758 - RNA, 22 nt, Homo sapiens
uugaggaggcagucugcccauu

SEQ ID NO: 116759 - RNA, 22 nt, Homo sapiens
uugaggcaaugaggagaagcug

SEQ ID NO: 116760 - RNA, 22 nt, Homo sapiens
uugagguaauaaacagccauuc

SEQ ID NO: 116761 - RNA, 22 nt, Homo sapiens
uugaggucuucaggaucaggcu

SEQ ID NO: 116762 - RNA, 22 nt, Homo sapiens
uugaggucuuugagcaaacgca

SEQ ID NO: 116763 - RNA, 22 nt, Homo sapiens
uugaggugaagggcagagcagc

SEQ ID NO: 116764 - RNA, 22 nt, Homo sapiens
uugauacuagagucuuucugac

SEQ ID NO: 116765 - RNA, 22 nt, Homo sapiens
uugauauguguauagcaugugg

SEQ ID NO: 116766 - RNA, 22 nt, Homo sapiens
uugaucugugucccugcccaau

SEQ ID NO: 116767 - RNA, 22 nt, Homo sapiens
uugcaacauguauucuggugau

SEQ ID NO: 116768 - RNA, 22 nt, Homo sapiens
uugcaaugugaugugauuugga

SEQ ID NO: 116769 - RNA, 22 nt, Homo sapiens
uugcacagugcuuucuuugccc

SEQ ID NO: 116770 - RNA, 22 nt, Homo sapiens
uugcacuuccgccugggugaca

SEQ ID NO: 116771 - RNA, 22 nt, Homo sapiens
uugcaggugguuuaugcaagac

SEQ ID NO: 116772 - RNA, 18 nt, Homo sapiens
uugcauaguguauccaaa

SEQ ID NO: 116773 - RNA, 19 nt, Homo sapiens
uugcauauguugaaccagg

SEQ ID NO: 116774 - RNA, 22 nt, Homo sapiens
uugcaugguuuuuaucugaaau

SEQ ID NO: 116775 - RNA, 22 nt, Homo sapiens
uugcauuagugugguacauuug

SEQ ID NO: 116776 - RNA, 22 nt, Homo sapiens
uugcccuuuagguaacuauaua

SEQ ID NO: 116777 - RNA, 22 nt, Homo sapiens
uguacaaauuucugugguggug

SEQ ID NO: 116778 - RNA, 22 nt, Homo sapiens
uguacccuuagagagugaucga

SEQ ID NO: 116779 - RNA, 18 nt, Homo sapiens
uguagcaccuuucuugug

SEQ ID NO: 116780 - RNA, 22 nt, Homo sapiens
uguauguugauguuauauucug

SEQ ID NO: 116781 - RNA, 22 nt, Homo sapiens
ugucacugugcagucaugcauu

SEQ ID NO: 116782 - RNA, 22 nt, Homo sapiens
ugucaucauuccaucagggcuu

SEQ ID NO: 116783 - RNA, 22 nt, Homo sapiens
ugucucaguuacggcaauucca

SEQ ID NO: 116784 - RNA, 22 nt, Homo sapiens
ugugaagauggacuaauauagu

SEQ ID NO: 116785 - RNA, 22 nt, Homo sapiens
ugugaaugauggagugucgaau

SEQ ID NO: 116786 - RNA, 22 nt, Homo sapiens
ugugacagguagguaauuuuug

SEQ ID NO: 116787 - RNA, 22 nt, Homo sapiens
uugccuuuguuggaaacaagug

SEQ ID NO: 116788 - RNA, 22 nt, Homo sapiens
uugcuagaugaaaaugguaccu

SEQ ID NO: 116789 - RNA, 22 nt, Homo sapiens
uuggaaaugguaaaggguuaau

SEQ ID NO: 116790 - RNA, 22 nt, Homo sapiens
uuggaaugugacugauaauauu

SEQ ID NO: 116791 - RNA, 22 nt, Homo sapiens
uuggaauuaaccuggugcugga

SEQ ID NO: 116792 - RNA, 22 nt, Homo sapiens
uuggaauuuuaaaauaggcaac

SEQ ID NO: 116793 - RNA, 19 nt, Homo sapiens
uuggaauuuuagaguuuga

SEQ ID NO: 116794 - RNA, 22 nt, Homo sapiens
uuggacaagauugcagagaauu

SEQ ID NO: 116795 - RNA, 22 nt, Homo sapiens
uuggacuucuaacugacaugga

SEQ ID NO: 116796 - RNA, 22 nt, Homo sapiens
uuggagagagaggacucccggc

SEQ ID NO: 116797 - RNA, 22 nt, Homo sapiens
uuggagagugauauucagaugc

SEQ ID NO: 116798 - RNA, 22 nt, Homo sapiens
uuggagcacuggggcacugaca

SEQ ID NO: 116799 - RNA, 22 nt, Homo sapiens
uuggagcccuaacucucaguac

SEQ ID NO: 116800 - RNA, 22 nt, Homo sapiens
uuggaguguucugguccgggcu

SEQ ID NO: 116801 - RNA, 22 nt, Homo sapiens
uuggauaguuuaugaaaaaugg

SEQ ID NO: 116802 - RNA, 22 nt, Homo sapiens
uuggcaagaaccuucuuccaag

SEQ ID NO: 116803 - RNA, 22 nt, Homo sapiens
uuggcaauauuuacugaaguug

SEQ ID NO: 116804 - RNA, 22 nt, Homo sapiens
uuggcaauucagauucuuuuau

SEQ ID NO: 116805 - RNA, 22 nt, Homo sapiens
uuggcagaaaaggucggggguu

SEQ ID NO: 116806 - RNA, 22 nt, Homo sapiens
uuggccuccuggucauauccag

SEQ ID NO: 116807 - RNA, 23 nt, Homo sapiens
uuggccuccuugugucuagggcu

SEQ ID NO: 116808 - RNA, 22 nt, Homo sapiens
uuggccuuuucaaugccucuuu

SEQ ID NO: 116809 - RNA, 22 nt, Homo sapiens
uuggcucugcgucucgcggacg

SEQ ID NO: 116810 - RNA, 22 nt, Homo sapiens
uuggcucuggcugggcuccagc

SEQ ID NO: 116811 - RNA, 22 nt, Homo sapiens
uugggacuggaaggaguaaggg

SEQ ID NO: 116812 - RNA, 22 nt, Homo sapiens
uugggagugucucuggacugca

SEQ ID NO: 116813 - RNA, 22 nt, Homo sapiens
uuggucagcuagauuauucccu

SEQ ID NO: 116814 - RNA, 22 nt, Homo sapiens
uuggucaggcuaaucucgaacg

SEQ ID NO: 116815 - RNA, 22 nt, Homo sapiens
uuggucaggcuagaguguggug

SEQ ID NO: 116816 - RNA, 19 nt, Homo sapiens
uuggucccuuuggguucuu

SEQ ID NO: 116817 - RNA, 22 nt, Homo sapiens
uugguccucccaugcucaagag

SEQ ID NO: 116818 - RNA, 22 nt, Homo sapiens
uugguucucuuuauaugcugga

SEQ ID NO: 116819 - RNA, 22 nt, Homo sapiens
uuguaaaguucucucccgaaaa

SEQ ID NO: 116820 - RNA, 22 nt, Homo sapiens
uuguaaucaacacaucauuggg

SEQ ID NO: 116821 - RNA, 22 nt, Homo sapiens
uugucccauggggucuuccuuu

SEQ ID NO: 116822 - RNA, 22 nt, Homo sapiens
uugugacacagcugggccuaua

SEQ ID NO: 116823 - RNA, 22 nt, Homo sapiens
uugugcaaaaguaauugcgguu

SEQ ID NO: 116824 - RNA, 22 nt, Homo sapiens
uugugcuccuaugagaaucuaa

SEQ ID NO: 116825 - RNA, 22 nt, Homo sapiens
uugugcuuuacuuacuaccaga

SEQ ID NO: 116826 - RNA, 22 nt, Homo sapiens
uugugggaggugauuagaucau

SEQ ID NO: 116827 - RNA, 22 nt, Homo sapiens
uugugguaaucugugacagcag

SEQ ID NO: 116828 - RNA, 22 nt, Homo sapiens
uuguguuuuuaguagggaaggg

SEQ ID NO: 116829 - RNA, 22 nt, Homo sapiens
uuguuauguuggucaguaaugu

SEQ ID NO: 116830 - RNA, 22 nt, Homo sapiens
uuuacugucuucagucccucug

SEQ ID NO: 116831 - RNA, 22 nt, Homo sapiens
uuuagcaaugcuguggggaagu

SEQ ID NO: 116832 - RNA, 22 nt, Homo sapiens
uuuagcaauucauuuugugucu

SEQ ID NO: 116833 - RNA, 22 nt, Homo sapiens
uuuagggcaggccuggugguga

SEQ ID NO: 116834 - RNA, 22 nt, Homo sapiens
uuuaucaggccuuuggaaaaau

SEQ ID NO: 116835 - RNA, 22 nt, Homo sapiens
uuuaugguuuucugggagauug

SEQ ID NO: 116836 - RNA, 22 nt, Homo sapiens
uuucacagagggcuucuuucua

SEQ ID NO: 116837 - RNA, 22 nt, Homo sapiens
uuucacagcaauugccuauugu

SEQ ID NO: 116838 - RNA, 22 nt, Homo sapiens
uuucacaguguucucccccaga

SEQ ID NO: 116839 - RNA, 22 nt, Homo sapiens
uuucaguagagacacgguuuug

SEQ ID NO: 116840 - RNA, 22 nt, Homo sapiens
uuucauggcgaggcuucauggg

SEQ ID NO: 116841 - RNA, 18 nt, Homo sapiens
uuucauugagugugauau

SEQ ID NO: 116842 - RNA, 22 nt, Homo sapiens
uuucccuuugcuuugucagcca

SEQ ID NO: 116843 - RNA, 22 nt, Homo sapiens
uuuccuguagggggcaaggccu

SEQ ID NO: 116844 - RNA, 22 nt, Homo sapiens
uuucucaguguuucaggguagg

SEQ ID NO: 116845 - RNA, 20 nt, Homo sapiens
uuucuccccuauaaaucuca

SEQ ID NO: 116846 - RNA, 22 nt, Homo sapiens
uuucugcuugagagaauugcug

SEQ ID NO: 116847 - RNA, 22 nt, Homo sapiens
uuugaauguaaugagcaggaag

SEQ ID NO: 116848 - RNA, 22 nt, Homo sapiens
uuugacuaccaggaauguucuu

SEQ ID NO: 116849 - RNA, 22 nt, Homo sapiens
uuugagauaucuuccaucagua

SEQ ID NO: 116850 - RNA, 22 nt, Homo sapiens
uuugagcuagagucucacucug

SEQ ID NO: 116851 - RNA, 22 nt, Homo sapiens
uuugaguaggcuuauauuuugg

SEQ ID NO: 116852 - RNA, 22 nt, Homo sapiens
uuugauacuggguguggacaaa

SEQ ID NO: 116853 - RNA, 22 nt, Homo sapiens
uuugaugcaucucuacuuuguu

SEQ ID NO: 116854 - RNA, 22 nt, Homo sapiens
uuugauuguacuaaaauuguac

SEQ ID NO: 116855 - RNA, 16 nt, Homo sapiens
uuugcaagaucagaag

SEQ ID NO: 116856 - RNA, 22 nt, Homo sapiens
uuugcacuggagauucaauggg

SEQ ID NO: 116857 - RNA, 22 nt, Homo sapiens
uuugcacuucugagugugacau

SEQ ID NO: 116858 - RNA, 23 nt, Homo sapiens
uuugcacuugcuccuucuauggc

SEQ ID NO: 116859 - RNA, 22 nt, Homo sapiens
uuugcacuuuaauauaauguga

SEQ ID NO: 116860 - RNA, 21 nt, Homo sapiens
uuugcacuuugcaaaucccua

SEQ ID NO: 116861 - RNA, 22 nt, Homo sapiens
uuugcagagucuuucgcugggc

SEQ ID NO: 116862 - RNA, 22 nt, Homo sapiens
uuugcaguguaguuggccagca

SEQ ID NO: 116863 - RNA, 22 nt, Homo sapiens
uuugcauauguugaaccagccu

SEQ ID NO: 116864 - RNA, 22 nt, Homo sapiens
uuugcaucuuagaaaguucucc

SEQ ID NO: 116865 - RNA, 22 nt, Homo sapiens
uuugccuguagacacuuacccu

SEQ ID NO: 116866 - RNA, 22 nt, Homo sapiens
uuugcuauagugaauagugcug

SEQ ID NO: 116867 - RNA, 22 nt, Homo sapiens
uuugcuuaaaguccuuguggga

SEQ ID NO: 116868 - RNA, 22 nt, Homo sapiens
uuugcuuaguaaauguagaaaa

SEQ ID NO: 116869 - RNA, 21 nt, Homo sapiens
uuuggcauuaugucaccagag

SEQ ID NO: 116870 - RNA, 22 nt, Homo sapiens
uuuggcauuuaaauaugcaugg

SEQ ID NO: 116871 - RNA, 22 nt, Homo sapiens
uuugggaaugaguuuaucauuu

SEQ ID NO: 116872 - RNA, 22 nt, Homo sapiens
uuugggaaugguuugucuccca

SEQ ID NO: 116873 - RNA, 22 nt, Homo sapiens
uuugggccucugauuucuuugg

SEQ ID NO: 116874 - RNA, 22 nt, Homo sapiens
uuuguacucccuuuagauaaaa

SEQ ID NO: 116875 - RNA, 18 nt, Homo sapiens
uuuguacuuuuucuaaug

SEQ ID NO: 116876 - RNA, 22 nt, Homo sapiens
uuuguagcuacaaagugagaug

SEQ ID NO: 116877 - RNA, 23 nt, Homo sapiens
uuuguaguagcaugauuuauaau

SEQ ID NO: 116878 - RNA, 19 nt, Homo sapiens
uuuguccugcccuuucuca

SEQ ID NO: 116879 - RNA, 22 nt, Homo sapiens
uuugugaggugauggauauguc

SEQ ID NO: 116880 - RNA, 22 nt, Homo sapiens
uuugugcaaacuaggauugcga

SEQ ID NO: 116881 - RNA, 22 nt, Homo sapiens
uuugugcuaacuuuaacucuua

SEQ ID NO: 116882 - RNA, 23 nt, Homo sapiens
uuugugcuaauuuaugggcucuu

SEQ ID NO: 116883 - RNA, 22 nt, Homo sapiens
uuugugcuauguuauauauucu

SEQ ID NO: 116884 - RNA, 22 nt, Homo sapiens
uuugugcugcaauuaauuuccc

SEQ ID NO: 116885 - RNA, 22 nt, Homo sapiens
uuuguucaccucaaggauggga

SEQ ID NO: 116886 - RNA, 21 nt, Homo sapiens
uuuugcacacuaugcagcuuu

SEQ ID NO: 116887 - RNA, 22 nt, Homo sapiens
uuuuugagguauaguguggcua

SEQ ID NO: 116888 - RNA, 21 nt, Homo sapiens
uuuuugggcuuucauaguguu

SEQ ID NO: 116889 - RNA, 20 nt, Homo sapiens
ucaaaguaugcucugcacua

SEQ ID NO: 116890 - RNA, 22 nt, Homo sapiens
ucaaaugauucacccaccuuug

SEQ ID NO: 116891 - RNA, 22 nt, Homo sapiens
ucaaaugcucuuugcagagagg

SEQ ID NO: 116892 - RNA, 21 nt, Homo sapiens
ucaaauugaaauuaggucauu

SEQ ID NO: 116893 - RNA, 22 nt, Homo sapiens
ucaacacaguuaaauggggaaa

SEQ ID NO: 116894 - RNA, 22 nt, Homo sapiens
ucaacagugggcacuguaaaug

SEQ ID NO: 116895 - RNA, 22 nt, Homo sapiens
ucaacauugcugucaggcaucu

SEQ ID NO: 116896 - RNA, 22 nt, Homo sapiens
ucaacugcuugagaucacaaau

SEQ ID NO: 116897 - RNA, 21 nt, Homo sapiens
ucaaggaguauacguaugcca

SEQ ID NO: 116898 - RNA, 22 nt, Homo sapiens
ucaaguacuuauuugauaauua

SEQ ID NO: 116899 - RNA, 22 nt, Homo sapiens
ucacaauucucaauuugugaaa

SEQ ID NO: 116900 - RNA, 19 nt, Homo sapiens
ucacacuguggcuucuuua

SEQ ID NO: 116901 - RNA, 22 nt, Homo sapiens
ucacagacauugaggggaccuu

SEQ ID NO: 116902 - RNA, 22 nt, Homo sapiens
ucacagacugagccaaauagag

SEQ ID NO: 116903 - RNA, 22 nt, Homo sapiens
ucacaggguguuauuagaauua

SEQ ID NO: 116904 - RNA, 22 nt, Homo sapiens
ucacaguccuguuuaggagagg

SEQ ID NO: 116905 - RNA, 22 nt, Homo sapiens
ucacagucugcgugaugagaca

SEQ ID NO: 116906 - RNA, 22 nt, Homo sapiens
ucacagugcaggaucaguuaau

SEQ ID NO: 116907 - RNA, 23 nt, Homo sapiens
ucacaguggcugcuuaauuguga

SEQ ID NO: 116908 - RNA, 21 nt, Homo sapiens
ucacauggccagaguaggaac

SEQ ID NO: 116909 - RNA, 22 nt, Homo sapiens
ucacaugugacauauauauuug

SEQ ID NO: 116910 - RNA, 22 nt, Homo sapiens
ucaccuggagagcuugcuaaua

SEQ ID NO: 116911 - RNA, 22 nt, Homo sapiens
ucaccuggggcacagcugaaga

SEQ ID NO: 116912 - RNA, 22 nt, Homo sapiens
ucacuggagguuccugaaguuc

SEQ ID NO: 116913 - RNA, 22 nt, Homo sapiens
ucacuggccaaauucuggguga

SEQ ID NO: 116914 - RNA, 20 nt, Homo sapiens
ucacuggguucuugaagucu

SEQ ID NO: 116915 - RNA, 21 nt, Homo sapiens
ucagaagcucccagggaggac

SEQ ID NO: 116916 - RNA, 22 nt, Homo sapiens
ucagagucuagaucacucacug

SEQ ID NO: 116917 - RNA, 22 nt, Homo sapiens
ucagaguguuuuccaacuuggu

SEQ ID NO: 116918 - RNA, 22 nt, Homo sapiens
ucagauuggugcaaaaguaauu

SEQ ID NO: 116919 - RNA, 22 nt, Homo sapiens
ucagcaccauguaacaauugau

SEQ ID NO: 116920 - RNA, 22 nt, Homo sapiens
ucagcagugccccacucuacug

SEQ ID NO: 116921 - RNA, 20 nt, Homo sapiens
ucaggcuccgcauuaacuua

SEQ ID NO: 116922 - RNA, 21 nt, Homo sapiens
ucagggaccugcuguacugau

SEQ ID NO: 116923 - RNA, 20 nt, Homo sapiens
ucagguagaucuuugagguc

SEQ ID NO: 116924 - RNA, 23 nt, Homo sapiens
ucagguaggccuagaguauucuu

SEQ ID NO: 116925 - RNA, 20 nt, Homo sapiens
ucagguagggcuucaacauu

SEQ ID NO: 116926 - RNA, 23 nt, Homo sapiens
ucagguaguuucagaggaccuug

SEQ ID NO: 116927 - RNA, 23 nt, Homo sapiens
ucaguacucuauaagugccagcu

SEQ ID NO: 116928 - RNA, 22 nt, Homo sapiens
ucagugacugcugcuuguauac

SEQ ID NO: 116929 - RNA, 22 nt, Homo sapiens
ucaguggagagcuuccaggauu

SEQ ID NO: 116930 - RNA, 22 nt, Homo sapiens
ucaguggagccucacucugugg

SEQ ID NO: 116931 - RNA, 22 nt, Homo sapiens
ucagugucugugauggagaggu

SEQ ID NO: 116932 - RNA, 22 nt, Homo sapiens
ucauccauacaguuagcaaagg

SEQ ID NO: 116933 - RNA, 22 nt, Homo sapiens
ucaucuggcgaaugugaagagu

SEQ ID NO: 116934 - RNA, 22 nt, Homo sapiens
ucauggcacugaugagaguuuc

SEQ ID NO: 116935 - RNA, 22 nt, Homo sapiens
ucauucauucauccagcuugag

SEQ ID NO: 116936 - RNA, 22 nt, Homo sapiens
uccacaauggcugaacuagauu

SEQ ID NO: 116937 - RNA, 22 nt, Homo sapiens
uccagcuuuuucuaauucugug

SEQ ID NO: 116938 - RNA, 22 nt, Homo sapiens
uccagguacucagggggcugag

SEQ ID NO: 116939 - RNA, 22 nt, Homo sapiens
uccagguuuugugaguuuaaau

SEQ ID NO: 116940 - RNA, 22 nt, Homo sapiens
uccaguggacagacauaccaug

SEQ ID NO: 116941 - RNA, 22 nt, Homo sapiens
uccaguuuggaggcuugaugug

SEQ ID NO: 116942 - RNA, 22 nt, Homo sapiens
uccaguuuucuuuccuagggcu

SEQ ID NO: 116943 - RNA, 22 nt, Homo sapiens
uccaguuuuguuaacauauggu

SEQ ID NO: 116944 - RNA, 22 nt, Homo sapiens
ucccaguggucuugaaacaggg

SEQ ID NO: 116945 - RNA, 22 nt, Homo sapiens
ucccauguagcuaggauuacag

SEQ ID NO: 116946 - RNA, 22 nt, Homo sapiens
ucccauugucucugaccuugcc

SEQ ID NO: 116947 - RNA, 22 nt, Homo sapiens
uccccugauaccaaccaccaug

SEQ ID NO: 116948 - RNA, 22 nt, Homo sapiens
ucccugacagucacagagcuac

SEQ ID NO: 116949 - RNA, 18 nt, Homo sapiens
ucccugacucaaauucuu

SEQ ID NO: 116950 - RNA, 22 nt, Homo sapiens
ucccugagcaaaguuuucugua

SEQ ID NO: 116951 - RNA, 22 nt, Homo sapiens
ucccugagugauugaaaauaaa

SEQ ID NO: 116952 - RNA, 22 nt, Homo sapiens
ucccuguguuccuuuugaauug

SEQ ID NO: 116953 - RNA, 22 nt, Homo sapiens
uccugagacugaggagcuuugg

SEQ ID NO: 116954 - RNA, 21 nt, Homo sapiens
uccugagagaggaguaacucu

SEQ ID NO: 116955 - RNA, 22 nt, Homo sapiens
uccugcauucauccugguguug

SEQ ID NO: 116956 - RNA, 22 nt, Homo sapiens
uccuugagaggacagagccaua

SEQ ID NO: 116957 - RNA, 22 nt, Homo sapiens
uccuugagccugggaguuauag

SEQ ID NO: 116958 - RNA, 22 nt, Homo sapiens
uccuugagccuuaaauuauaaa

SEQ ID NO: 116959 - RNA, 22 nt, Homo sapiens
uccuuugguuauaggcaccucu

SEQ ID NO: 116960 - RNA, 22 nt, Homo sapiens
uccuuuguuacaguuggcucug

SEQ ID NO: 116961 - RNA, 22 nt, Homo sapiens
ucuaaaguacuacuacuguugg

SEQ ID NO: 116962 - RNA, 22 nt, Homo sapiens
ucuaagaauucauuuauaagcc

SEQ ID NO: 116963 - RNA, 22 nt, Homo sapiens
ucuaauguaaccugcaaauauu

SEQ ID NO: 116964 - RNA, 22 nt, Homo sapiens
ucucaagaugguagaugggaau

SEQ ID NO: 116965 - RNA, 22 nt, Homo sapiens
ucucaauggguuguagacaaag

SEQ ID NO: 116966 - RNA, 23 nt, Homo sapiens
ucucauuccuugaaaauaaugac

SEQ ID NO: 116967 - RNA, 17 nt, Homo sapiens
ucucccaucccuuucuc

SEQ ID NO: 116968 - RNA, 22 nt, Homo sapiens
ucugacagugagagaaaucuga

SEQ ID NO: 116969 - RNA, 22 nt, Homo sapiens
ucugagguuacugcuuuguaga

SEQ ID NO: 116970 - RNA, 22 nt, Homo sapiens
ucugccuuuucaugugggaugg

SEQ ID NO: 116971 - RNA, 22 nt, Homo sapiens
ucuggaauguaaaguuuauggg

SEQ ID NO: 116972 - RNA, 22 nt, Homo sapiens
ucuggcaagagccgagggcagu

SEQ ID NO: 116973 - RNA, 22 nt, Homo sapiens
ucuggccuacaaguaauuuuau

SEQ ID NO: 116974 - RNA, 23 nt, Homo sapiens
ucuggcuuugggaugcucaaggg

SEQ ID NO: 116975 - RNA, 22 nt, Homo sapiens
ucugguuccugcauucauucaa

SEQ ID NO: 116976 - RNA, 22 nt, Homo sapiens
ucugguuccuuggcuucggguc

SEQ ID NO: 116977 - RNA, 22 nt, Homo sapiens
ucugucaaaucuuauguuguag

SEQ ID NO: 116978 - RNA, 22 nt, Homo sapiens
ucugugcauuguaggauguuua

SEQ ID NO: 116979 - RNA, 22 nt, Homo sapiens
ucugugcugagaguugaaaguu

SEQ ID NO: 116980 - RNA, 22 nt, Homo sapiens
ucugugguuguugcauggaaug

SEQ ID NO: 116981 - RNA, 22 nt, Homo sapiens
ucuucaugcuugaaauaauagc

SEQ ID NO: 116982 - RNA, 17 nt, Homo sapiens
ucuucuguuacuguggc

SEQ ID NO: 116983 - RNA, 21 nt, Homo sapiens
ucuugguauguauuuaggagg

SEQ ID NO: 116984 - RNA, 17 nt, Homo sapiens
ucuugugguucuugaau

SEQ ID NO: 116985 - RNA, 22 nt, Homo sapiens
ucuuucacuuagcaugauguuu

SEQ ID NO: 116986 - RNA, 19 nt, Homo sapiens
ucuuugcuuuucuaagagg

SEQ ID NO: 116987 - RNA, 19 nt, Homo sapiens
ucuuugguacgugcuuuga

SEQ ID NO: 116988 - RNA, 22 nt, Homo sapiens
ucuuuggucagaaagauuacac

SEQ ID NO: 116989 - RNA, 22 nt, Homo sapiens
ucuuuguuagaacccucuccuu

SEQ ID NO: 116990 - RNA, 22 nt, Homo sapiens
ucuuuguugcauaggcuuguuc

SEQ ID NO: 116991 - RNA, 22 nt, Homo sapiens
uuauaacucugcagccugguau

SEQ ID NO: 116992 - RNA, 20 nt, Homo sapiens
uuauagcuacaucuugacug

SEQ ID NO: 116993 - RNA, 22 nt, Homo sapiens
uuauauguuucuguuuggaggc

SEQ ID NO: 116994 - RNA, 21 nt, Homo sapiens
uuaucccagugucucugcagg

SEQ ID NO: 116995 - RNA, 22 nt, Homo sapiens
uuaucucaguguuuguaaacaa

SEQ ID NO: 116996 - RNA, 17 nt, Homo sapiens
uuaugagacuucuuagc

SEQ ID NO: 116997 - RNA, 22 nt, Homo sapiens
uuaugguuuuuagcagaguaau

SEQ ID NO: 116998 - RNA, 22 nt, Homo sapiens
uuauuacuccuauuuuguagau

SEQ ID NO: 116999 - RNA, 22 nt, Homo sapiens
uuauuagguuaaccuauagcua

SEQ ID NO: 117000 - RNA, 22 nt, Homo sapiens
uuauucauuaacagggaccaaa

SEQ ID NO: 117001 - RNA, 22 nt, Homo sapiens
uuauugaguaaaaagaaugguu

SEQ ID NO: 117002 - RNA, 22 nt, Homo sapiens
uuauugcacuccagccugggua

SEQ ID NO: 117003 - RNA, 22 nt, Homo sapiens
uuauugcuccagaggcugauuu

SEQ ID NO: 117004 - RNA, 22 nt, Homo sapiens
uucaaaaccucugcuuaagccc

SEQ ID NO: 117005 - RNA, 22 nt, Homo sapiens
uucaaaggauagauuaagauca

SEQ ID NO: 117006 - RNA, 23 nt, Homo sapiens
uucaaaggaugcuuuauggaauu

SEQ ID NO: 117007 - RNA, 22 nt, Homo sapiens
uucaaggacuaaggauuuuugg

SEQ ID NO: 117008 - RNA, 22 nt, Homo sapiens
uucaaguaagaaagacaucagg

SEQ ID NO: 117009 - RNA, 22 nt, Homo sapiens
uucaaguagguaggaccacagg

SEQ ID NO: 117010 - RNA, 22 nt, Homo sapiens
uucaagucaacaagcacuugag

SEQ ID NO: 117011 - RNA, 22 nt, Homo sapiens
uucacagaaaaaggcgaugagg

SEQ ID NO: 117012 - RNA, 22 nt, Homo sapiens
uucacagacaacuggucccuua

SEQ ID NO: 117013 - RNA, 22 nt, Homo sapiens
uucacagccgcaccccaucacu

SEQ ID NO: 117014 - RNA, 22 nt, Homo sapiens
uucacaguguguacaccagggg

SEQ ID NO: 117015 - RNA, 22 nt, Homo sapiens
uucacugcauuucagccugggc

SEQ ID NO: 117016 - RNA, 22 nt, Homo sapiens
uucacuggagcccaggaguugg

SEQ ID NO: 117017 - RNA, 22 nt, Homo sapiens
uucagacugggugaagagggua

SEQ ID NO: 117018 - RNA, 22 nt, Homo sapiens
uucagagagggagggauaccua

SEQ ID NO: 117019 - RNA, 22 nt, Homo sapiens
uucaguauugcaccuggagucc

SEQ ID NO: 117020 - RNA, 22 nt, Homo sapiens
uucaucuggcaauucagagauu

SEQ ID NO: 117021 - RNA, 22 nt, Homo sapiens
uucaugugagucuguauuaacu

SEQ ID NO: 117022 - RNA, 22 nt, Homo sapiens
uucauugaaugauuuuuagaag

SEQ ID NO: 117023 - RNA, 22 nt, Homo sapiens
uuccaagugggaaacaaaaaug

SEQ ID NO: 117024 - RNA, 22 nt, Homo sapiens
uuccacaaugguugaacuagcu

SEQ ID NO: 117025 - RNA, 22 nt, Homo sapiens
uuccaggugggcgugggccugg

SEQ ID NO: 117026 - RNA, 22 nt, Homo sapiens
uuccaguaauagcacagcauug

SEQ ID NO: 117027 - RNA, 21 nt, Homo sapiens
uuccagugagccuagaugccu

SEQ ID NO: 117028 - RNA, 22 nt, Homo sapiens
uucccaguuggggaaagcgacc

SEQ ID NO: 117029 - RNA, 22 nt, Homo sapiens
uucccuagaacacauggaggga

SEQ ID NO: 117030 - RNA, 22 nt, Homo sapiens
uucccuguaucuucugccaugu

SEQ ID NO: 117031 - RNA, 22 nt, Homo sapiens
uucccuuucugaaaaucucauu

SEQ ID NO: 117032 - RNA, 22 nt, Homo sapiens
uuccuacugugcaaaguugcaa

SEQ ID NO: 117033 - RNA, 19 nt, Homo sapiens
uuccugagaacaagggcuu

SEQ ID NO: 117034 - RNA, 22 nt, Homo sapiens
uuccuggaggggaaguguccaa

SEQ ID NO: 117035 - RNA, 22 nt, Homo sapiens
uuccugugacccccaagcccac

SEQ ID NO: 117036 - RNA, 22 nt, Homo sapiens
uuccuugaaacagucaagagaa

SEQ ID NO: 117037 - RNA, 22 nt, Homo sapiens
uuccuugagagcuugauaucac

SEQ ID NO: 117038 - RNA, 22 nt, Homo sapiens
uuccuugagucuuuuuccugag

SEQ ID NO: 117039 - RNA, 22 nt, Homo sapiens
uucucuguggauugggugagag

SEQ ID NO: 117040 - RNA, 22 nt, Homo sapiens
uucugugcugaaucaaagacug

SEQ ID NO: 117041 - RNA, 22 nt, Homo sapiens
uucugugcuuguggaugaagug

SEQ ID NO: 117042 - RNA, 22 nt, Homo sapiens
uucuucugguuaugaaauuuga

SEQ ID NO: 117043 - RNA, 22 nt, Homo sapiens
uucuugcugaauugugcccuuc

SEQ ID NO: 117044 - RNA, 22 nt, Homo sapiens
uucuuuggaaacaguacuaauu

SEQ ID NO: 117045 - RNA, 22 nt, Homo sapiens
uugacacuuuguaagaaagggg

SEQ ID NO: 117046 - RNA, 20 nt, Homo sapiens
uugacaguggguuguuaaag

SEQ ID NO: 117047 - RNA, 22 nt, Homo sapiens
uugaccccuucuaauagccuca

SEQ ID NO: 117048 - RNA, 22 nt, Homo sapiens
uugagagcugaugaaagauaaa

SEQ ID NO: 117049 - RNA, 22 nt, Homo sapiens
uugagauggagucucacucugu

SEQ ID NO: 117050 - RNA, 22 nt, Homo sapiens
uugagauggagucucgcugugu

SEQ ID NO: 117051 - RNA, 22 nt, Homo sapiens
uugagauggaguuucacucugu

SEQ ID NO: 117052 - RNA, 19 nt, Homo sapiens
uugagaugugaacucacac

SEQ ID NO: 117053 - RNA, 22 nt, Homo sapiens
uugaggacugagacagaccaag

SEQ ID NO: 117054 - RNA, 23 nt, Homo sapiens
uugaggcauguaccaucaauauc

SEQ ID NO: 117055 - RNA, 22 nt, Homo sapiens
uugagggaaacauucacaucau

SEQ ID NO: 117056 - RNA, 22 nt, Homo sapiens
uugaggguggcauauauugauu

SEQ ID NO: 117057 - RNA, 22 nt, Homo sapiens
uugauagacaucugaguuguug

SEQ ID NO: 117058 - RNA, 23 nt, Homo sapiens
uugcaaagccugaaacucuucag

SEQ ID NO: 117059 - RNA, 22 nt, Homo sapiens
uugcaaaguugccaaggaagga

SEQ ID NO: 117060 - RNA, 22 nt, Homo sapiens
uugcaagaaaugcagauucuca

SEQ ID NO: 117061 - RNA, 22 nt, Homo sapiens
uugcacaauccugugagugagu

SEQ ID NO: 117062 - RNA, 20 nt, Homo sapiens
uugcacagagaaggaggcag

SEQ ID NO: 117063 - RNA, 22 nt, Homo sapiens
uugcacagucuagcuccaccuu

SEQ ID NO: 117064 - RNA, 22 nt, Homo sapiens
uugcagagccccugcaaggguc

SEQ ID NO: 117065 - RNA, 22 nt, Homo sapiens
uugcaguagucugaaagcaaua

SEQ ID NO: 117066 - RNA, 22 nt, Homo sapiens
uugcagugugacgacuauauuu

SEQ ID NO: 117067 - RNA, 19 nt, Homo sapiens
uugcauagguugaaccagc

SEQ ID NO: 117068 - RNA, 22 nt, Homo sapiens
uugcauauguugaaccagccuu

SEQ ID NO: 117069 - RNA, 22 nt, Homo sapiens
uugcauuuucuaggagggcaaa

SEQ ID NO: 117070 - RNA, 22 nt, Homo sapiens
uugccacuucucuugccccauu

SEQ ID NO: 117071 - RNA, 22 nt, Homo sapiens
uugcgaugaagacaaaacaugc

SEQ ID NO: 117072 - RNA, 22 nt, Homo sapiens
uuggaaaaauccaccuugaucu

SEQ ID NO: 117073 - RNA, 22 nt, Homo sapiens
uuggaaaccucugcagguguuu

SEQ ID NO: 117074 - RNA, 22 nt, Homo sapiens
uuggaaagagguguuuaugacu

SEQ ID NO: 117075 - RNA, 22 nt, Homo sapiens
uuggaaauguguuugcauucag

SEQ ID NO: 117076 - RNA, 22 nt, Homo sapiens
uuggaauuaagagauauuuucu

SEQ ID NO: 117077 - RNA, 22 nt, Homo sapiens
uuggacuuuaagauagagaugu

SEQ ID NO: 117078 - RNA, 22 nt, Homo sapiens
uuggagugugucuuauuccauu

SEQ ID NO: 117079 - RNA, 22 nt, Homo sapiens
uuggauauucaguuuuuccauc

SEQ ID NO: 117080 - RNA, 22 nt, Homo sapiens
uuggauuauaaacugagauuug

SEQ ID NO: 117081 - RNA, 20 nt, Homo sapiens
uuggcagagucuuuagggua

SEQ ID NO: 117082 - RNA, 19 nt, Homo sapiens
uuggcagaguugcccccua

SEQ ID NO: 117083 - RNA, 22 nt, Homo sapiens
uuggcauugaguuucaaaucau

SEQ ID NO: 117084 - RNA, 22 nt, Homo sapiens
uuggccuuucucuaaauacuuu

SEQ ID NO: 117085 - RNA, 22 nt, Homo sapiens
uugggaauguccuaauaucucg

SEQ ID NO: 117086 - RNA, 23 nt, Homo sapiens
uugggcaaaucacugagggcaga

SEQ ID NO: 117087 - RNA, 22 nt, Homo sapiens
uuggucaggagccucccucuuu

SEQ ID NO: 117088 - RNA, 22 nt, Homo sapiens
uuggucaucucccuccuuuuag

SEQ ID NO: 117089 - RNA, 22 nt, Homo sapiens
uuggucuucuaauguaccuguu

SEQ ID NO: 117090 - RNA, 22 nt, Homo sapiens
uugguucaguuuaacgaguaau

SEQ ID NO: 117091 - RNA, 22 nt, Homo sapiens
uugguuccauuuuaccagcucu

SEQ ID NO: 117092 - RNA, 22 nt, Homo sapiens
uuguaccacagggcaugaagug

SEQ ID NO: 117093 - RNA, 22 nt, Homo sapiens
aaacugcuuuccaugguggcug

SEQ ID NO: 117094 - RNA, 22 nt, Homo sapiens
aucuugggugggaacugagaau

SEQ ID NO: 117095 - RNA, 22 nt, Homo sapiens
augaaagguugucuuaagccau

SEQ ID NO: 117096 - RNA, 22 nt, Homo sapiens
augagaacauaucaagugauug

SEQ ID NO: 117097 - RNA, 22 nt, Homo sapiens
augagagcuaacuguggguaca

SEQ ID NO: 117098 - RNA, 22 nt, Homo sapiens
augagcagaagagauacacugu

SEQ ID NO: 117099 - RNA, 17 nt, Homo sapiens
augagcucaucauuuuu

SEQ ID NO: 117100 - RNA, 22 nt, Homo sapiens
augagcuccucaaggucagaga

SEQ ID NO: 117101 - RNA, 22 nt, Homo sapiens
augagcuguuuggaagacacuu

SEQ ID NO: 117102 - RNA, 22 nt, Homo sapiens
augaugaaguaagugcuuagga

SEQ ID NO: 117103 - RNA, 22 nt, Homo sapiens
augcaaggaugguuagauauau

SEQ ID NO: 117104 - RNA, 22 nt, Homo sapiens
augcacaguccagcccaugugg

SEQ ID NO: 117105 - RNA, 22 nt, Homo sapiens
augcagagaaaucuaaaauaug

SEQ ID NO: 117106 - RNA, 22 nt, Homo sapiens
augcagcugaggguaguggagc

SEQ ID NO: 117107 - RNA, 22 nt, Homo sapiens
augcagguguuuugcacugagu

SEQ ID NO: 117108 - RNA, 22 nt, Homo sapiens
augcauauuuuaccuagaagag

SEQ ID NO: 117109 - RNA, 22 nt, Homo sapiens
augccacugcacuucagccugc

SEQ ID NO: 117110 - RNA, 22 nt, Homo sapiens
augcuacuggacaauggugacu

SEQ ID NO: 117111 - RNA, 22 nt, Homo sapiens
auggaacuggagaucauuaugu

SEQ ID NO: 117112 - RNA, 22 nt, Homo sapiens
auggaacuggagaugguuauau

SEQ ID NO: 117113 - RNA, 22 nt, Homo sapiens
auggagagaauuauucucucag

SEQ ID NO: 117114 - RNA, 22 nt, Homo sapiens
auggaguguucugaauccuuug

SEQ ID NO: 117115 - RNA, 22 nt, Homo sapiens
auggcaaaaaaugcaauuacuu

SEQ ID NO: 117116 - RNA, 22 nt, Homo sapiens
auggcaauaauagcuaccauuu

SEQ ID NO: 117117 - RNA, 22 nt, Homo sapiens
auggcaauaugaugcacuguuu

SEQ ID NO: 117118 - RNA, 22 nt, Homo sapiens
auggcaauguaagucagaaaaa

SEQ ID NO: 117119 - RNA, 22 nt, Homo sapiens
auggcagagucagaaagucagg

SEQ ID NO: 117120 - RNA, 22 nt, Homo sapiens
auggcagcugacacuuccgucu

SEQ ID NO: 117121 - RNA, 22 nt, Homo sapiens
auggcagugucuagggguguuu

SEQ ID NO: 117122 - RNA, 22 nt, Homo sapiens
auggccugaugcaccuguccca

SEQ ID NO: 117123 - RNA, 22 nt, Homo sapiens
auggcucuguuuuuuaugcucu

SEQ ID NO: 117124 - RNA, 22 nt, Homo sapiens
auggcucuuauuauuugaggua

SEQ ID NO: 117125 - RNA, 22 nt, Homo sapiens
auggcuugugggaacuuuuaaa

SEQ ID NO: 117126 - RNA, 22 nt, Homo sapiens
augguacuagaguaagaauugu

SEQ ID NO: 117127 - RNA, 22 nt, Homo sapiens
auggucccuguuccaugcuccu

SEQ ID NO: 117128 - RNA, 22 nt, Homo sapiens
auguaacaguauuuggagaugu

SEQ ID NO: 117129 - RNA, 22 nt, Homo sapiens
auguaacuaucugagccauggg

SEQ ID NO: 117130 - RNA, 20 nt, Homo sapiens
augucagaguguggguacgg

SEQ ID NO: 117131 - RNA, 22 nt, Homo sapiens
auguccuggacccagacaaagc

SEQ ID NO: 117132 - RNA, 22 nt, Homo sapiens
augugaacaucauagaaugcac

SEQ ID NO: 117133 - RNA, 22 nt, Homo sapiens
augugacugauggagaauaugu

SEQ ID NO: 117134 - RNA, 22 nt, Homo sapiens
augugaugguuaauuuuaugug

SEQ ID NO: 117135 - RNA, 22 nt, Homo sapiens
augugcuugagggaaaucaguu

SEQ ID NO: 117136 - RNA, 20 nt, Homo sapiens
guucacaggcuuccuuucag

SEQ ID NO: 117137 - RNA, 22 nt, Homo sapiens
guucaguaguucauucauuuau

SEQ ID NO: 117138 - RNA, 22 nt, Homo sapiens
guugcucaggcugaagugcagu

SEQ ID NO: 117139 - RNA, 22 nt, Homo sapiens
guugcuuauuccuguaauccca

SEQ ID NO: 117140 - RNA, 22 nt, Homo sapiens
guuggaauuaaaaggcaaguau

SEQ ID NO: 117141 - RNA, 22 nt, Homo sapiens
guuugcacuccuaugagaaucu

SEQ ID NO: 117142 - RNA, 22 nt, Homo sapiens
uaaaagucaucacaacuggagu

SEQ ID NO: 117143 - RNA, 22 nt, Homo sapiens
uaaacacucacuucauagccau

SEQ ID NO: 117144 - RNA, 22 nt, Homo sapiens
uaaacugucuuuggagcuuugc

SEQ ID NO: 117145 - RNA, 22 nt, Homo sapiens
uaaagcacaaguaaagaauacu

SEQ ID NO: 117146 - RNA, 22 nt, Homo sapiens
uaacugcaaccucugccugcug

SEQ ID NO: 117147 - RNA, 18 nt, Homo sapiens
uaacuggugugagauggu

SEQ ID NO: 117148 - RNA, 23 nt, Homo sapiens
uaagacacuaacuuuaugcuuug

SEQ ID NO: 117149 - RNA, 20 nt, Homo sapiens
uaagacaugguccacaugcc

SEQ ID NO: 117150 - RNA, 22 nt, Homo sapiens
uaaggaaggcugugugcuuuua

SEQ ID NO: 117151 - RNA, 22 nt, Homo sapiens
uaaggcaaucagucaugguguu

SEQ ID NO: 117152 - RNA, 22 nt, Homo sapiens
uaaguaguauaagguuuuuuga

SEQ ID NO: 117153 - RNA, 22 nt, Homo sapiens
uaauacuguaauggugguuccg

SEQ ID NO: 117154 - RNA, 22 nt, Homo sapiens
uaauagagucauuauuauuguu

SEQ ID NO: 117155 - RNA, 22 nt, Homo sapiens
uaauauguuuugaaaucaggaa

SEQ ID NO: 117156 - RNA, 22 nt, Homo sapiens
uaaugcuugguuguuuggaaaa

SEQ ID NO: 117157 - RNA, 22 nt, Homo sapiens
uaauucuguauguaucagaguu

SEQ ID NO: 117158 - RNA, 22 nt, Homo sapiens
uacaaagcuacucgagggcagg

SEQ ID NO: 117159 - RNA, 22 nt, Homo sapiens
uacaaagugggaaacgaagguu

SEQ ID NO: 117160 - RNA, 22 nt, Homo sapiens
uacacaugugaguucuuuucua

SEQ ID NO: 117161 - RNA, 21 nt, Homo sapiens
uacacuacugguggaaaugca

SEQ ID NO: 117162 - RNA, 22 nt, Homo sapiens
uacagaauauuucugcccugag

SEQ ID NO: 117163 - RNA, 22 nt, Homo sapiens
uacagaauugcagguguggcag

SEQ ID NO: 117164 - RNA, 22 nt, Homo sapiens
uacagaguagaagauuugcaga

SEQ ID NO: 117165 - RNA, 22 nt, Homo sapiens
uacagguaugugucuauauaca

SEQ ID NO: 117166 - RNA, 22 nt, Homo sapiens
uacaguaauguuaaucuuugug

SEQ ID NO: 117167 - RNA, 22 nt, Homo sapiens
uacaguccaugcauuauccucc

SEQ ID NO: 117168 - RNA, 22 nt, Homo sapiens
uacagucuagaggagaaucagg

SEQ ID NO: 117169 - RNA, 22 nt, Homo sapiens
uacaguguuuugguauuccaca

SEQ ID NO: 117170 - RNA, 22 nt, Homo sapiens
uacauugucauauucucucucu

SEQ ID NO: 117171 - RNA, 22 nt, Homo sapiens
uaccacccuuuuuccagaagcc

SEQ ID NO: 117172 - RNA, 22 nt, Homo sapiens
uacccucuggauacccuuguuc

SEQ ID NO: 117173 - RNA, 22 nt, Homo sapiens
uaccugagaaagaaagcccucg

SEQ ID NO: 117174 - RNA, 22 nt, Homo sapiens
uacucugcagccauaaaacaga

SEQ ID NO: 117175 - RNA, 22 nt, Homo sapiens
uacugcacuccagcuuaggaga

SEQ ID NO: 117176 - RNA, 22 nt, Homo sapiens
uagaagcuacucuucuuguggc

SEQ ID NO: 117177 - RNA, 22 nt, Homo sapiens
uagaagcugagaauguccucag

SEQ ID NO: 117178 - RNA, 22 nt, Homo sapiens
uagaaugaaacaagcugugccu

SEQ ID NO: 117179 - RNA, 21 nt, Homo sapiens
uagagagcaauaccuccagag

SEQ ID NO: 117180 - RNA, 22 nt, Homo sapiens
uagagcaaugacucuggaaacc

SEQ ID NO: 117181 - RNA, 22 nt, Homo sapiens
uagauaguuaugauuugaugau

SEQ ID NO: 117182 - RNA, 20 nt, Homo sapiens
uagaugcauuuagauucauu

SEQ ID NO: 117183 - RNA, 22 nt, Homo sapiens
uagcaaaucaauggaauugaag

SEQ ID NO: 117184 - RNA, 21 nt, Homo sapiens
uagcaaauugcuauuaaggca

SEQ ID NO: 117185 - RNA, 22 nt, Homo sapiens
uagcacaucccuaaaaugcugu

SEQ ID NO: 117186 - RNA, 22 nt, Homo sapiens
uagcagcauuuuuguagaguau

SEQ ID NO: 117187 - RNA, 22 nt, Homo sapiens
uagcagccaggaagggcuggcu

SEQ ID NO: 117188 - RNA, 22 nt, Homo sapiens
uagcagguggugaccacauuuu

SEQ ID NO: 117189 - RNA, 22 nt, Homo sapiens
uagccucacaaagugcuuaaga

SEQ ID NO: 117190 - RNA, 22 nt, Homo sapiens
uagcugcuguauguacacggau

SEQ ID NO: 117191 - RNA, 17 nt, Homo sapiens
uagcuucacauuaggaa

SEQ ID NO: 117192 - RNA, 22 nt, Homo sapiens
uaggcagccagcuguggauuga

SEQ ID NO: 117193 - RNA, 22 nt, Homo sapiens
uaggcgagauguguguuucaug

SEQ ID NO: 117194 - RNA, 22 nt, Homo sapiens
uaguaaacaccucagguaauuc

SEQ ID NO: 117195 - RNA, 22 nt, Homo sapiens
uagucccuuucuauuaaugaga

SEQ ID NO: 117196 - RNA, 22 nt, Homo sapiens
uagugcugugauaaacauauau

SEQ ID NO: 117197 - RNA, 22 nt, Homo sapiens
uagugguaguagcaguaauauu

SEQ ID NO: 117198 - RNA, 23 nt, Homo sapiens
uauaacuuuuaauuuacuggccu

SEQ ID NO: 117199 - RNA, 22 nt, Homo sapiens
uauacuguuuucuauaguggcu

SEQ ID NO: 117200 - RNA, 22 nt, Homo sapiens
uauagcuugauuauggugaugg

SEQ ID NO: 117201 - RNA, 22 nt, Homo sapiens
uauaucuagagcggaccaggcu

SEQ ID NO: 117202 - RNA, 22 nt, Homo sapiens
uauaugcauugugggguacuga

SEQ ID NO: 117203 - RNA, 22 nt, Homo sapiens
uaucacagaggguauccuagag

SEQ ID NO: 117204 - RNA, 20 nt, Homo sapiens
uaucacaggucagaaacccu

SEQ ID NO: 117205 - RNA, 22 nt, Homo sapiens
uaucaccuugcaguggaugcua

SEQ ID NO: 117206 - RNA, 22 nt, Homo sapiens
uaucagaucccaauuucuggcc

SEQ ID NO: 117207 - RNA, 22 nt, Homo sapiens
uaucagcagagucauacuucaa

SEQ ID NO: 117208 - RNA, 22 nt, Homo sapiens
uaucaucauuggcaggugagaa

SEQ ID NO: 117209 - RNA, 19 nt, Homo sapiens
uaugagcuaugacaugcau

SEQ ID NO: 117210 - RNA, 22 nt, Homo sapiens
uaugauuuuugggagaggucaa

SEQ ID NO: 117211 - RNA, 22 nt, Homo sapiens
uaugcuuauaaacauuugucag

SEQ ID NO: 117212 - RNA, 22 nt, Homo sapiens
uauggcaaugcauaggaaggaa

SEQ ID NO: 117213 - RNA, 22 nt, Homo sapiens
uauggucuuugagaggugacug

SEQ ID NO: 117214 - RNA, 22 nt, Homo sapiens
uaugucuucuuuagagaaaugu

SEQ ID NO: 117215 - RNA, 22 nt, Homo sapiens
uaugugcuuuguuaaacagaug

SEQ ID NO: 117216 - RNA, 20 nt, Homo sapiens
uauuacagaguaauggugga

SEQ ID NO: 117217 - RNA, 20 nt, Homo sapiens
uauucacucuccagucuugc

SEQ ID NO: 117218 - RNA, 22 nt, Homo sapiens
uauuccagcccuggugagccag

SEQ ID NO: 117219 - RNA, 22 nt, Homo sapiens
uauugcaacagaagaaagaguc

SEQ ID NO: 117220 - RNA, 22 nt, Homo sapiens
uauugcauguugagcaguaccu

SEQ ID NO: 117221 - RNA, 22 nt, Homo sapiens
uauugccugucuccaaaaauca

SEQ ID NO: 117222 - RNA, 22 nt, Homo sapiens
uauugcuaaaacucaugguugc

SEQ ID NO: 117223 - RNA, 22 nt, Homo sapiens
uauugcuugaggaaaugguaau

SEQ ID NO: 117224 - RNA, 22 nt, Homo sapiens
uauuguacauguuauagauuuu

SEQ ID NO: 117225 - RNA, 22 nt, Homo sapiens
uauuucaguugcguuucccgag

SEQ ID NO: 117226 - RNA, 22 nt, Homo sapiens
ucaaaguagaaaaggggcaauu

SEQ ID NO: 117227 - RNA, 22 nt, Homo sapiens
ucaaaguauucuucugagaacc

SEQ ID NO: 117228 - RNA, 22 nt, Homo sapiens
ucaaguacuuugcauagugccg

SEQ ID NO: 117229 - RNA, 22 nt, Homo sapiens
ucaaugcaaccuccaccucugg

SEQ ID NO: 117230 - RNA, 22 nt, Homo sapiens
ucacaauucacuacaggcuuga

SEQ ID NO: 117231 - RNA, 21 nt, Homo sapiens
ucacagccuaggaccugaaga

SEQ ID NO: 117232 - RNA, 22 nt, Homo sapiens
ucacagccuaguuuuauacauu

SEQ ID NO: 117233 - RNA, 22 nt, Homo sapiens
ucacaguaaauccagaagaaau

SEQ ID NO: 117234 - RNA, 22 nt, Homo sapiens
ucacaguagcaaauguuagaaa

SEQ ID NO: 117235 - RNA, 22 nt, Homo sapiens
ucacaguauucaugaacaugga

SEQ ID NO: 117236 - RNA, 22 nt, Homo sapiens
ucacagucacugucacguugaa

SEQ ID NO: 117237 - RNA, 22 nt, Homo sapiens
ucacaugaauugucuuguucca

SEQ ID NO: 117238 - RNA, 18 nt, Homo sapiens
ucacauggccgagagaga

SEQ ID NO: 117239 - RNA, 22 nt, Homo sapiens
ucacauggggaagggacuagcu

SEQ ID NO: 117240 - RNA, 22 nt, Homo sapiens
ucaccaguaauaaagagccugc

SEQ ID NO: 117241 - RNA, 16 nt, Homo sapiens
ucaccccuagagaucc

SEQ ID NO: 117242 - RNA, 18 nt, Homo sapiens
ucaccuugcuuuuagaac

SEQ ID NO: 117243 - RNA, 22 nt, Homo sapiens
ucacugagcacaggagaugugc

SEQ ID NO: 117244 - RNA, 22 nt, Homo sapiens
ucacugagcuagaucacuugac

SEQ ID NO: 117245 - RNA, 19 nt, Homo sapiens
ucacuggacagcacacuca

SEQ ID NO: 117246 - RNA, 20 nt, Homo sapiens
ucacugugaacuucuugagg

SEQ ID NO: 117247 - RNA, 22 nt, Homo sapiens
ucacuguugaugggcaugcagg

SEQ ID NO: 117248 - RNA, 22 nt, Homo sapiens
ucacuugguggcaaaguuuaug

SEQ ID NO: 117249 - RNA, 22 nt, Homo sapiens
ucagaacugaacaaaccagucu

SEQ ID NO: 117250 - RNA, 22 nt, Homo sapiens
ucagaguaguuccuggcagaaa

SEQ ID NO: 117251 - RNA, 22 nt, Homo sapiens
ucagaguggagucugcagccuu

SEQ ID NO: 117252 - RNA, 22 nt, Homo sapiens
ucagaguggccucucuugaaga

SEQ ID NO: 117253 - RNA, 22 nt, Homo sapiens
ucagagugguuguaccauuuga

SEQ ID NO: 117254 - RNA, 19 nt, Homo sapiens
ucagaugcauuagggguua

SEQ ID NO: 117255 - RNA, 22 nt, Homo sapiens
ucagauguuugagaaguauacu

SEQ ID NO: 117256 - RNA, 22 nt, Homo sapiens
ucagauugaugcauacuuaaau

SEQ ID NO: 117257 - RNA, 22 nt, Homo sapiens
ucaggugcagagaagaaauggg

SEQ ID NO: 117258 - RNA, 22 nt, Homo sapiens
ucaggugcaguggcucaugcuu

SEQ ID NO: 117259 - RNA, 18 nt, Homo sapiens
ucagucacugccuggcuu

SEQ ID NO: 117260 - RNA, 22 nt, Homo sapiens
ucaguccccucgcugagucuac

SEQ ID NO: 117261 - RNA, 22 nt, Homo sapiens
ucagugaacgaggaggagggug

SEQ ID NO: 117262 - RNA, 22 nt, Homo sapiens
ucagugauugcuuucauggaaa

SEQ ID NO: 117263 - RNA, 22 nt, Homo sapiens
ucagugcaggaauuuccuuaga

SEQ ID NO: 117264 - RNA, 23 nt, Homo sapiens
ucagugucuggauccugcucagu

SEQ ID NO: 117265 - RNA, 22 nt, Homo sapiens
ucaguucauggaggugucugcu

SEQ ID NO: 117266 - RNA, 20 nt, Homo sapiens
ucauagcuuuuuccacuuua

SEQ ID NO: 117267 - RNA, 19 nt, Homo sapiens
ucauagucuaagaugagaa

SEQ ID NO: 117268 - RNA, 16 nt, Homo sapiens
ucaucacagucucugg

SEQ ID NO: 117269 - RNA, 23 nt, Homo sapiens
ucaugaggccauucaaauccauu

SEQ ID NO: 117270 - RNA, 22 nt, Homo sapiens
uccacaauggagaagaguauga

SEQ ID NO: 117271 - RNA, 22 nt, Homo sapiens
uccaguguuccucagucacccc

SEQ ID NO: 117272 - RNA, 22 nt, Homo sapiens
uccaguguuucuuccacuauuu

SEQ ID NO: 117273 - RNA, 22 nt, Homo sapiens
uccaguuauccuguggggagga

SEQ ID NO: 117274 - RNA, 22 nt, Homo sapiens
uccaguuguuauuuuuauaaag

SEQ ID NO: 117275 - RNA, 18 nt, Homo sapiens
uccaguuuucccagcauc

SEQ ID NO: 117276 - RNA, 22 nt, Homo sapiens
uccaugugaaaucuaugaggac

SEQ ID NO: 117277 - RNA, 22 nt, Homo sapiens
ucccagaaacgcauauguucau

SEQ ID NO: 117278 - RNA, 22 nt, Homo sapiens
uccccuuuguaagauggaaacg

SEQ ID NO: 117279 - RNA, 22 nt, Homo sapiens
ucccuggagcaagagaagaagg

SEQ ID NO: 117280 - RNA, 22 nt, Homo sapiens
ucccuuucuggaguuucccaag

SEQ ID NO: 117281 - RNA, 22 nt, Homo sapiens
uccugagacucacaggcucccc

SEQ ID NO: 117282 - RNA, 22 nt, Homo sapiens
uccuugagucugaacuuuggau

SEQ ID NO: 117283 - RNA, 22 nt, Homo sapiens
uccuuggucaaaaagaaagugu

SEQ ID NO: 117284 - RNA, 23 nt, Homo sapiens
ucgcagcauucaauaccaggcag

SEQ ID NO: 117285 - RNA, 22 nt, Homo sapiens
ucgcaguuaauaaugaugugcg

SEQ ID NO: 117286 - RNA, 22 nt, Homo sapiens
ucgguacuugagagagacacag

SEQ ID NO: 117287 - RNA, 17 nt, Homo sapiens
ucuaauaauaugcauuu

SEQ ID NO: 117288 - RNA, 22 nt, Homo sapiens
ucuauugguaggggcugaggca

SEQ ID NO: 117289 - RNA, 22 nt, Homo sapiens
ucucaaguggucgcaguuagau

SEQ ID NO: 117290 - RNA, 22 nt, Homo sapiens
ucucauuggucugagucaccug

SEQ ID NO: 117291 - RNA, 21 nt, Homo sapiens
ucucauugugguuuuaauugg

SEQ ID NO: 117292 - RNA, 20 nt, Homo sapiens
ucucccaaacagcaggcccu

SEQ ID NO: 117293 - RNA, 22 nt, Homo sapiens
ucucccauccguacacggauug

SEQ ID NO: 117294 - RNA, 22 nt, Homo sapiens
ucucuuggugacuuaaaauguu

SEQ ID NO: 117295 - RNA, 22 nt, Homo sapiens
ucucuugguugaacaguuugga

SEQ ID NO: 117296 - RNA, 22 nt, Homo sapiens
ucugacagugugaauauugacu

SEQ ID NO: 117297 - RNA, 22 nt, Homo sapiens
ucugagcaugcaucuugccugg

SEQ ID NO: 117298 - RNA, 21 nt, Homo sapiens
ucuggccccuccaaaucucau

SEQ ID NO: 117299 - RNA, 22 nt, Homo sapiens
ucuggccuacaucauuuuuccg

SEQ ID NO: 117300 - RNA, 23 nt, Homo sapiens
ucugguguugucaaaugcugguu

SEQ ID NO: 117301 - RNA, 22 nt, Homo sapiens
ucugugguaagaaacgcauguc

SEQ ID NO: 117302 - RNA, 18 nt, Homo sapiens
ucugugguguaaauacgu

SEQ ID NO: 117303 - RNA, 22 nt, Homo sapiens
ucuugcuuguuguucccuucau

SEQ ID NO: 117304 - RNA, 20 nt, Homo sapiens
ucuugggaauguagccuagg

SEQ ID NO: 117305 - RNA, 22 nt, Homo sapiens
ucuuugauguucugaaagaugg

SEQ ID NO: 117306 - RNA, 22 nt, Homo sapiens
ucuuugauuuuguuacuaagac

SEQ ID NO: 117307 - RNA, 19 nt, Homo sapiens
ugagaauguuaccaggucc

SEQ ID NO: 117308 - RNA, 22 nt, Homo sapiens
ugagacugaguuucgcucuugu

SEQ ID NO: 117309 - RNA, 22 nt, Homo sapiens
ugagacugaguuuugcucuugu

SEQ ID NO: 117310 - RNA, 22 nt, Homo sapiens
ugagaguauaaauugaugcagc

SEQ ID NO: 117311 - RNA, 18 nt, Homo sapiens
ugagauacuagaauaggu

SEQ ID NO: 117312 - RNA, 22 nt, Homo sapiens
ugagaucugucuuuauaguauu

SEQ ID NO: 117313 - RNA, 22 nt, Homo sapiens
ugagaugaggucucacucuguu

SEQ ID NO: 117314 - RNA, 22 nt, Homo sapiens
ugagauggguaauuaaauggug

SEQ ID NO: 117315 - RNA, 23 nt, Homo sapiens
ugagaugucugauugcgaggguc

SEQ ID NO: 117316 - RNA, 22 nt, Homo sapiens
ugagaugugaucaccugaaggg

SEQ ID NO: 117317 - RNA, 22 nt, Homo sapiens
ugagauguuuguuucagugccu

SEQ ID NO: 117318 - RNA, 22 nt, Homo sapiens
ugagcaagaaauagaaacagau

SEQ ID NO: 117319 - RNA, 22 nt, Homo sapiens
ugagccaugggguaaaugugau

SEQ ID NO: 117320 - RNA, 22 nt, Homo sapiens
ugagcucagcuaguugaggugu

SEQ ID NO: 117321 - RNA, 22 nt, Homo sapiens
ugagcucagcuuucuuuuucac

SEQ ID NO: 117322 - RNA, 22 nt, Homo sapiens
ugagcugagauuaagcugcugc

SEQ ID NO: 117323 - RNA, 22 nt, Homo sapiens
ugagcugguacuaauauuauca

SEQ ID NO: 117324 - RNA, 22 nt, Homo sapiens
ugaggucacuuguuuuaugcuu

SEQ ID NO: 117325 - RNA, 20 nt, Homo sapiens
ugaggucaggaguuacagac

SEQ ID NO: 117326 - RNA, 20 nt, Homo sapiens
ugaggucugagaaagaauga

SEQ ID NO: 117327 - RNA, 22 nt, Homo sapiens
ugaggucuuuauuuagugcuca

SEQ ID NO: 117328 - RNA, 22 nt, Homo sapiens
ugagguuauuuguucaagaagu

SEQ ID NO: 117329 - RNA, 22 nt, Homo sapiens
ugaguacuacuaguuacugcua

SEQ ID NO: 117330 - RNA, 22 nt, Homo sapiens
ugaguaucuugaugaauuugaa

SEQ ID NO: 117331 - RNA, 22 nt, Homo sapiens
ugagugagguucuacucuguga

SEQ ID NO: 117332 - RNA, 22 nt, Homo sapiens
ugaguucuuccuaucucugccu

SEQ ID NO: 117333 - RNA, 23 nt, Homo sapiens
ugauaacagcauaugaagauucu

SEQ ID NO: 117334 - RNA, 22 nt, Homo sapiens
ugauaauuuugucagguuuugg

SEQ ID NO: 117335 - RNA, 18 nt, Homo sapiens
ugauaucaaugauagcca

SEQ ID NO: 117336 - RNA, 22 nt, Homo sapiens
ugauaucucuugccuccaaaug

SEQ ID NO: 117337 - RNA, 22 nt, Homo sapiens
ugauauguagguggcaagcaua

SEQ ID NO: 117338 - RNA, 17 nt, Homo sapiens
ugauauuuucccagaua

SEQ ID NO: 117339 - RNA, 22 nt, Homo sapiens
ugauauuuuugauccuuaaguu

SEQ ID NO: 117340 - RNA, 20 nt, Homo sapiens
ugaugcaaaucuuuaaaagu

SEQ ID NO: 117341 - RNA, 22 nt, Homo sapiens
ugauggcacagugaguuccagg

SEQ ID NO: 117342 - RNA, 22 nt, Homo sapiens
ugaugucuugagauggagcuua

SEQ ID NO: 117343 - RNA, 22 nt, Homo sapiens
ugaugugucaucugagagagug

SEQ ID NO: 117344 - RNA, 18 nt, Homo sapiens
ugauugacuuauuuaggu

SEQ ID NO: 117345 - RNA, 19 nt, Homo sapiens
ugcaaagucagugaagggu

SEQ ID NO: 117346 - RNA, 22 nt, Homo sapiens
ugcaaaugcugcuauuucucuu

SEQ ID NO: 117347 - RNA, 22 nt, Homo sapiens
ugcaaucaucgcuguuggccac

SEQ ID NO: 117348 - RNA, 18 nt, Homo sapiens
ugcaauggagaugcagcc

SEQ ID NO: 117349 - RNA, 22 nt, Homo sapiens
ugcaaugugaaauaagcacauc

SEQ ID NO: 117350 - RNA, 22 nt, Homo sapiens
ugcaccacugcuagccugggua

SEQ ID NO: 117351 - RNA, 20 nt, Homo sapiens
ugcagauucaaccaacugug

SEQ ID NO: 117352 - RNA, 22 nt, Homo sapiens
ugcagcauguaggcacguuauu

SEQ ID NO: 117353 - RNA, 22 nt, Homo sapiens
ugcauccauucuagacucaucu

SEQ ID NO: 117354 - RNA, 22 nt, Homo sapiens
ugcaugaugcugagauuuggga

SEQ ID NO: 117355 - RNA, 22 nt, Homo sapiens
ugcauuagucuguucucacacu

SEQ ID NO: 117356 - RNA, 22 nt, Homo sapiens
ugccaacaugccuggcuguuuu

SEQ ID NO: 117357 - RNA, 22 nt, Homo sapiens
ugccuucuguuaaacgaggaug

SEQ ID NO: 117358 - RNA, 16 nt, Homo sapiens
ugccuucuucuguauu

SEQ ID NO: 117359 - RNA, 21 nt, Homo sapiens
ugccuuuguaguaggugucuu

SEQ ID NO: 117360 - RNA, 22 nt, Homo sapiens
ugccuuuguucuggaaugggaa

SEQ ID NO: 117361 - RNA, 22 nt, Homo sapiens
ugcgauaguuugcugguaaauu

SEQ ID NO: 117362 - RNA, 22 nt, Homo sapiens
ugcguucauuuggccaguggcg

SEQ ID NO: 117363 - RNA, 22 nt, Homo sapiens
ugcucaguuuaaaacuuuugag

SEQ ID NO: 117364 - RNA, 22 nt, Homo sapiens
ugcugguauuuggaccagccug

SEQ ID NO: 117365 - RNA, 22 nt, Homo sapiens
ugcuggugauuaaauccugaag

SEQ ID NO: 117366 - RNA, 22 nt, Homo sapiens
ugcugguggucccauaugauua

SEQ ID NO: 117367 - RNA, 22 nt, Homo sapiens
ugcugguguggucuagccgcuu

SEQ ID NO: 117368 - RNA, 21 nt, Homo sapiens
ugcuuuggucauacuucuucc

SEQ ID NO: 117369 - RNA, 22 nt, Homo sapiens
uggaaacuuauguucuucugug

SEQ ID NO: 117370 - RNA, 22 nt, Homo sapiens
uggaaauaaaugugccaagauc

SEQ ID NO: 117371 - RNA, 22 nt, Homo sapiens
uggaaauuaacagggauugucc

SEQ ID NO: 117372 - RNA, 20 nt, Homo sapiens
uggaacuuaauugauggaca

SEQ ID NO: 117373 - RNA, 22 nt, Homo sapiens
uggaaguuaaaugacucuuucu

SEQ ID NO: 117374 - RNA, 22 nt, Homo sapiens
uggaaguuaaauuaguugauga

SEQ ID NO: 117375 - RNA, 22 nt, Homo sapiens
uggaauguagcguugacacgag

SEQ ID NO: 117376 - RNA, 22 nt, Homo sapiens
uggaauguauaucguuuuuugu

SEQ ID NO: 117377 - RNA, 22 nt, Homo sapiens
uggaaugucuauguuuuugauu

SEQ ID NO: 117378 - RNA, 21 nt, Homo sapiens
uggaauuaauggagagguguu

SEQ ID NO: 117379 - RNA, 22 nt, Homo sapiens
uucuuccagccuugaggggccc

SEQ ID NO: 117380 - RNA, 22 nt, Homo sapiens
uucuugcacugaucccauaagc

SEQ ID NO: 117381 - RNA, 22 nt, Homo sapiens
uucuugcuguauccucacaugg

SEQ ID NO: 117382 - RNA, 22 nt, Homo sapiens
uucuugguuggcaaccaacagu

SEQ ID NO: 117383 - RNA, 22 nt, Homo sapiens
uugaaagucauuucuucuaagu

SEQ ID NO: 117384 - RNA, 22 nt, Homo sapiens
uugaaaguguucacaaugguau

SEQ ID NO: 117385 - RNA, 21 nt, Homo sapiens
uugagaagaauuagcucuucc

SEQ ID NO: 117386 - RNA, 22 nt, Homo sapiens
uugagagaaaaggccaugccuu

SEQ ID NO: 117387 - RNA, 22 nt, Homo sapiens
uugagaguggcagagguggaac

SEQ ID NO: 117388 - RNA, 22 nt, Homo sapiens
uugagauacauaauuaugaaug

SEQ ID NO: 117389 - RNA, 22 nt, Homo sapiens
uugagaucuacuacuguaggag

SEQ ID NO: 117390 - RNA, 22 nt, Homo sapiens
uugagauggagcuucacucuug

SEQ ID NO: 117391 - RNA, 22 nt, Homo sapiens
uugagauggagucucacugugu

SEQ ID NO: 117392 - RNA, 22 nt, Homo sapiens
uugagauggagucucgcacugu

SEQ ID NO: 117393 - RNA, 22 nt, Homo sapiens
uugagauggaguucauuuuugu

SEQ ID NO: 117394 - RNA, 22 nt, Homo sapiens
uugagauggaguuucaauauug

SEQ ID NO: 117395 - RNA, 22 nt, Homo sapiens
uugagauggugccacuguacuc

SEQ ID NO: 117396 - RNA, 21 nt, Homo sapiens
uugagcaacuaggguuauagg

SEQ ID NO: 117397 - RNA, 22 nt, Homo sapiens
uugaggccugauaacacacuga

SEQ ID NO: 117398 - RNA, 22 nt, Homo sapiens
uugaggcuuuugaccucaugug

SEQ ID NO: 117399 - RNA, 22 nt, Homo sapiens
uugagguauaaagguagguugu

SEQ ID NO: 117400 - RNA, 22 nt, Homo sapiens
uugaggucagagguucgagacc

SEQ ID NO: 117401 - RNA, 22 nt, Homo sapiens
uugagguguauuguacagcaca

SEQ ID NO: 117402 - RNA, 22 nt, Homo sapiens
uugaguccccacacuggguccc

SEQ ID NO: 117403 - RNA, 22 nt, Homo sapiens
uugauauggcugcuuaccauaa

SEQ ID NO: 117404 - RNA, 22 nt, Homo sapiens
uugauuuguagaaugccccaac

SEQ ID NO: 117405 - RNA, 22 nt, Homo sapiens
uugcaaaguuugccuccuguag

SEQ ID NO: 117406 - RNA, 22 nt, Homo sapiens
uugcaaggugcagcuuaugcaa

SEQ ID NO: 117407 - RNA, 22 nt, Homo sapiens
uugcacuugcugaggagugauu

SEQ ID NO: 117408 - RNA, 22 nt, Homo sapiens
uugcagagucaguuauuuugcc

SEQ ID NO: 117409 - RNA, 22 nt, Homo sapiens
uugcauauucucugaggcagga

SEQ ID NO: 117410 - RNA, 18 nt, Homo sapiens
uugcaucauuuuguuguu

SEQ ID NO: 117411 - RNA, 22 nt, Homo sapiens
uugcaugcuccuuaugagaauc

SEQ ID NO: 117412 - RNA, 22 nt, Homo sapiens
uugcauguacguacagagagag

SEQ ID NO: 117413 - RNA, 22 nt, Homo sapiens
uugcuauguugcccagucugga

SEQ ID NO: 117414 - RNA, 22 nt, Homo sapiens
uuggaaauauguuaagugucau

SEQ ID NO: 117415 - RNA, 22 nt, Homo sapiens
uuggagagaaaggcaguuccug

SEQ ID NO: 117416 - RNA, 22 nt, Homo sapiens
uuggagugugagagcagccugg

SEQ ID NO: 117417 - RNA, 22 nt, Homo sapiens
uuggagugugcucauaacugcu

SEQ ID NO: 117418 - RNA, 22 nt, Homo sapiens
uuggauagugcaaugccuccag

SEQ ID NO: 117419 - RNA, 22 nt, Homo sapiens
uuggauggugauaugguuugga

SEQ ID NO: 117420 - RNA, 22 nt, Homo sapiens
uuggcaauugcuaugauuugaa

SEQ ID NO: 117421 - RNA, 22 nt, Homo sapiens
uuggcagaguuaauuuguugag

SEQ ID NO: 117422 - RNA, 22 nt, Homo sapiens
uuggcagcacgcaguccagagg

SEQ ID NO: 117423 - RNA, 22 nt, Homo sapiens
uuggcaguaucuacuacagcua

SEQ ID NO: 117424 - RNA, 22 nt, Homo sapiens
uugggguaggaauauggaauga

SEQ ID NO: 117425 - RNA, 22 nt, Homo sapiens
uuggucacugacauguuugaaa

SEQ ID NO: 117426 - RNA, 22 nt, Homo sapiens
uuggucagcucaauggagaggg

SEQ ID NO: 117427 - RNA, 22 nt, Homo sapiens
uugguccccacuccccugccaa

SEQ ID NO: 117428 - RNA, 22 nt, Homo sapiens
uuggucugcucugauguuuucu

SEQ ID NO: 117429 - RNA, 22 nt, Homo sapiens
uugucaaacucauucuccaucc

SEQ ID NO: 117430 - RNA, 22 nt, Homo sapiens
uugucaacaugaaacuguguuu

SEQ ID NO: 117431 - RNA, 22 nt, Homo sapiens
uugucacugcacuccagucugg

SEQ ID NO: 117432 - RNA, 22 nt, Homo sapiens
uuguccccaucugcugccagaa

SEQ ID NO: 117433 - RNA, 22 nt, Homo sapiens
uugugaaaaaccucucguggaa

SEQ ID NO: 117434 - RNA, 22 nt, Homo sapiens
uugugcuuuuuaaauagcuucc

SEQ ID NO: 117435 - RNA, 22 nt, Homo sapiens
uugugguaggcauguaagauga

SEQ ID NO: 117436 - RNA, 22 nt, Homo sapiens
uugugguagugaaugagucuca

SEQ ID NO: 117437 - RNA, 22 nt, Homo sapiens
uuguuuuggagaugagcuaaaa

SEQ ID NO: 117438 - RNA, 22 nt, Homo sapiens
uuuaaggcaugccuguacaugc

SEQ ID NO: 117439 - RNA, 22 nt, Homo sapiens
uuuaaugcacuaggugguguuc

SEQ ID NO: 117440 - RNA, 22 nt, Homo sapiens
uuuaaugcugcccagucauggg

SEQ ID NO: 117441 - RNA, 18 nt, Homo sapiens
uuuacaguagaaggacuu

SEQ ID NO: 117442 - RNA, 22 nt, Homo sapiens
uuuacagucuuuugugugaguc

SEQ ID NO: 117443 - RNA, 22 nt, Homo sapiens
uuuagcaaagcaauuuacacca

SEQ ID NO: 117444 - RNA, 22 nt, Homo sapiens
uuuagcaauggagggugacuuu

SEQ ID NO: 117445 - RNA, 22 nt, Homo sapiens
uuuaguacugcuuuaugugugu

SEQ ID NO: 117446 - RNA, 18 nt, Homo sapiens
uuucaagucuuaggugac

SEQ ID NO: 117447 - RNA, 23 nt, Homo sapiens
uuucacagaaggauuguagggcc

SEQ ID NO: 117448 - RNA, 22 nt, Homo sapiens
uuucacguuggggaguugagug

SEQ ID NO: 117449 - RNA, 22 nt, Homo sapiens
uuucaucaagcacagaguagau

SEQ ID NO: 117450 - RNA, 22 nt, Homo sapiens
uuucccuuacuuaaacuuacuc

SEQ ID NO: 117451 - RNA, 21 nt, Homo sapiens
uuuccuggagcguauggcuuc

SEQ ID NO: 117452 - RNA, 22 nt, Homo sapiens
gugugauggcgcacacagggug

SEQ ID NO: 117453 - RNA, 22 nt, Homo sapiens
guguuugguugauagagccacu

SEQ ID NO: 117454 - RNA, 22 nt, Homo sapiens
guuaagaaguguaacuuaaguu

SEQ ID NO: 117455 - RNA, 22 nt, Homo sapiens
guucaagugauagcugggauua

SEQ ID NO: 117456 - RNA, 22 nt, Homo sapiens
guucacaguuaggacaacugcu

SEQ ID NO: 117457 - RNA, 20 nt, Homo sapiens
guucauguaauuaguucagg

SEQ ID NO: 117458 - RNA, 18 nt, Homo sapiens
guugagcuuuuccuuuag

SEQ ID NO: 117459 - RNA, 22 nt, Homo sapiens
guugcucaggcuggagugcagu

SEQ ID NO: 117460 - RNA, 22 nt, Homo sapiens
guuugcagaucaugaagaaccc

SEQ ID NO: 117461 - RNA, 22 nt, Homo sapiens
guuugccuuuuagauaggaaug

SEQ ID NO: 117462 - RNA, 22 nt, Homo sapiens
guuuggauuuucuaauuucugu

SEQ ID NO: 117463 - RNA, 22 nt, Homo sapiens
guuuggcucuuguuucugucaa

SEQ ID NO: 117464 - RNA, 22 nt, Homo sapiens
guuugugguuaaagccuuucau

SEQ ID NO: 117465 - RNA, 22 nt, Homo sapiens
uaaacugcuugaaaugguguca

SEQ ID NO: 117466 - RNA, 22 nt, Homo sapiens
uaacacccuucuccagguacau

SEQ ID NO: 117467 - RNA, 22 nt, Homo sapiens
uaacauugucuugcuuaguuuu

SEQ ID NO: 117468 - RNA, 21 nt, Homo sapiens
uaacccugaaggagcucugga

SEQ ID NO: 117469 - RNA, 22 nt, Homo sapiens
uaagagagcuccaucuuuuccu

SEQ ID NO: 117470 - RNA, 22 nt, Homo sapiens
uaagcagugcaagaauggaaua

SEQ ID NO: 117471 - RNA, 22 nt, Homo sapiens
uaaggcaaguuuuuaguggaca

SEQ ID NO: 117472 - RNA, 22 nt, Homo sapiens
uaagggacgcccccuucucucu

SEQ ID NO: 117473 - RNA, 22 nt, Homo sapiens
uaagggcaugcugcaugagagu

SEQ ID NO: 117474 - RNA, 22 nt, Homo sapiens
uaagguguagacuggucacaag

SEQ ID NO: 117475 - RNA, 22 nt, Homo sapiens
uaagguuuuugauaugcugcug

SEQ ID NO: 117476 - RNA, 22 nt, Homo sapiens
uaaguaauugcagcaauuugcc

SEQ ID NO: 117477 - RNA, 22 nt, Homo sapiens
uaaguacuuuacagacauuauc

SEQ ID NO: 117478 - RNA, 21 nt, Homo sapiens
uaauaaugucucagacaccua

SEQ ID NO: 117479 - RNA, 22 nt, Homo sapiens
uacaaaguaacaguuccuguau

SEQ ID NO: 117480 - RNA, 22 nt, Homo sapiens
uacaaaucuagguuuguuacug

SEQ ID NO: 117481 - RNA, 22 nt, Homo sapiens
uacaagcaggaaaugguauaug

SEQ ID NO: 117482 - RNA, 22 nt, Homo sapiens
uacaagguaucagugaccguaa

SEQ ID NO: 117483 - RNA, 22 nt, Homo sapiens
uacaggauagacaauuuauuaa

SEQ ID NO: 117484 - RNA, 22 nt, Homo sapiens
uacaguacacagguaccaagcu

SEQ ID NO: 117485 - RNA, 22 nt, Homo sapiens
uacaguggcaugucaggugcuu

SEQ ID NO: 117486 - RNA, 22 nt, Homo sapiens
uacaguggugugaucucagcuc

SEQ ID NO: 117487 - RNA, 22 nt, Homo sapiens
uacauacuucacagacuuuaaa

SEQ ID NO: 117488 - RNA, 22 nt, Homo sapiens
uacauaguaagcacuaugccaa

SEQ ID NO: 117489 - RNA, 22 nt, Homo sapiens
uacuagaguagugcagagggga

SEQ ID NO: 117490 - RNA, 20 nt, Homo sapiens
uacugcacuccaaccuaggc

SEQ ID NO: 117491 - RNA, 19 nt, Homo sapiens
uacugcacuccagucuggg

SEQ ID NO: 117492 - RNA, 22 nt, Homo sapiens
uacugcuuaaaagucaauuacu

SEQ ID NO: 117493 - RNA, 22 nt, Homo sapiens
uacuuuguagagugugagaauu

SEQ ID NO: 117494 - RNA, 22 nt, Homo sapiens
uacuuuguuauagcagcaggaa

SEQ ID NO: 117495 - RNA, 18 nt, Homo sapiens
uagaauauaggucauucu

SEQ ID NO: 117496 - RNA, 22 nt, Homo sapiens
uagagguauguauaguauucuu

SEQ ID NO: 117497 - RNA, 21 nt, Homo sapiens
uagauaguugguucugaaucu

SEQ ID NO: 117498 - RNA, 22 nt, Homo sapiens
uagauuaucccugauuugucca

SEQ ID NO: 117499 - RNA, 22 nt, Homo sapiens
uagauuaucuaugaggcuucca

SEQ ID NO: 117500 - RNA, 22 nt, Homo sapiens
uagauuauuccuuugaauggcc

SEQ ID NO: 117501 - RNA, 22 nt, Homo sapiens
uagcagcaaagcaggaucugcu

SEQ ID NO: 117502 - RNA, 22 nt, Homo sapiens
uagcagcaucucuggcuucuac

SEQ ID NO: 117503 - RNA, 22 nt, Homo sapiens
uagcaguuguuguuacuuguau

SEQ ID NO: 117504 - RNA, 22 nt, Homo sapiens
uagcauaauuuguagaaaauca

SEQ ID NO: 117505 - RNA, 22 nt, Homo sapiens
uagcauccuucucuaaacagga

SEQ ID NO: 117506 - RNA, 22 nt, Homo sapiens
uagcugcugcuaggcuaaggau

SEQ ID NO: 117507 - RNA, 22 nt, Homo sapiens
uagcuguuggugggaagucaga

SEQ ID NO: 117508 - RNA, 22 nt, Homo sapiens
uaggacuuuucuugagagugac

SEQ ID NO: 117509 - RNA, 22 nt, Homo sapiens
uaggcaaaugcaagaguagaac

SEQ ID NO: 117510 - RNA, 22 nt, Homo sapiens
uaggcaauggagauagaggaug

SEQ ID NO: 117511 - RNA, 22 nt, Homo sapiens
uaggcuguguggccguggggcu

SEQ ID NO: 117512 - RNA, 22 nt, Homo sapiens
uagguagaaucuugaagccauu

SEQ ID NO: 117513 - RNA, 22 nt, Homo sapiens
uagguuguccaucucuagaagc

SEQ ID NO: 117514 - RNA, 22 nt, Homo sapiens
uagugcugagauugagaagccc

SEQ ID NO: 117515 - RNA, 22 nt, Homo sapiens
uagugcuguaauucuaaugaaa

SEQ ID NO: 117516 - RNA, 22 nt, Homo sapiens
uagugcugugauuaacauaaug

SEQ ID NO: 117517 - RNA, 22 nt, Homo sapiens
uaguuauggaguaauuuuaagc

SEQ ID NO: 117518 - RNA, 22 nt, Homo sapiens
uauaacaaugcaagaauggccu

SEQ ID NO: 117519 - RNA, 22 nt, Homo sapiens
uauaagguuaggaaaaauuucu

SEQ ID NO: 117520 - RNA, 22 nt, Homo sapiens
uauacugucuuuguaugccuag

SEQ ID NO: 117521 - RNA, 22 nt, Homo sapiens
uauagcuugaaggaauggucau

SEQ ID NO: 117522 - RNA, 22 nt, Homo sapiens
uauaugauugguagacccugca

SEQ ID NO: 117523 - RNA, 22 nt, Homo sapiens
uauaugcucugggauccugaaa

SEQ ID NO: 117524 - RNA, 22 nt, Homo sapiens
uauauguucugugucccuuucg

SEQ ID NO: 117525 - RNA, 22 nt, Homo sapiens
uaucacacuggaagaaguuaag

SEQ ID NO: 117526 - RNA, 22 nt, Homo sapiens
uaucacacuguuggauuugauu

SEQ ID NO: 117527 - RNA, 22 nt, Homo sapiens
uaucacagcgggguguacaccc

SEQ ID NO: 117528 - RNA, 22 nt, Homo sapiens
uaucaccuugcaggagcuauga

SEQ ID NO: 117529 - RNA, 22 nt, Homo sapiens
uaucagagcugucagccuaccu

SEQ ID NO: 117530 - RNA, 22 nt, Homo sapiens
uaucagcagcaggggcugcaga

SEQ ID NO: 117531 - RNA, 21 nt, Homo sapiens
uaucccagucacaucuaccca

SEQ ID NO: 117532 - RNA, 22 nt, Homo sapiens
uaucccaguggauguaccccau

SEQ ID NO: 117533 - RNA, 22 nt, Homo sapiens
uaugaauuuuauccaggauaua

SEQ ID NO: 117534 - RNA, 22 nt, Homo sapiens
uaugacauaguccuuaacccuc

SEQ ID NO: 117535 - RNA, 22 nt, Homo sapiens
uaugacucagaaggcacacaca

SEQ ID NO: 117536 - RNA, 22 nt, Homo sapiens
uaugacuuguuuucuggucugc

SEQ ID NO: 117537 - RNA, 22 nt, Homo sapiens
uaugacuuuggaaaaauuacuu

SEQ ID NO: 117538 - RNA, 22 nt, Homo sapiens
uaugacuuuugaauacagaugg

SEQ ID NO: 117539 - RNA, 22 nt, Homo sapiens
uaugagacugguuaauuuuugu

SEQ ID NO: 117540 - RNA, 22 nt, Homo sapiens
uaugaucauuauguuauugcag

SEQ ID NO: 117541 - RNA, 22 nt, Homo sapiens
uaugccuuuugguucaagcaac

SEQ ID NO: 117542 - RNA, 19 nt, Homo sapiens
uaugcuagagagggaagcu

SEQ ID NO: 117543 - RNA, 22 nt, Homo sapiens
uaugucacagguuuuggugaaa

SEQ ID NO: 117544 - RNA, 22 nt, Homo sapiens
uaugucuuuugcuugcaaauag

SEQ ID NO: 117545 - RNA, 22 nt, Homo sapiens
uauuaagcuaguugucagugcu

SEQ ID NO: 117546 - RNA, 22 nt, Homo sapiens
uauuacuugucugugucucaau

SEQ ID NO: 117547 - RNA, 22 nt, Homo sapiens
uauuagugucuuuugguuagaa

SEQ ID NO: 117548 - RNA, 22 nt, Homo sapiens
uauuccauuugggucaggauga

SEQ ID NO: 117549 - RNA, 22 nt, Homo sapiens
uauuccucuuuguugagguuau

SEQ ID NO: 117550 - RNA, 22 nt, Homo sapiens
uauugauuaauugugauuaggc

SEQ ID NO: 117551 - RNA, 22 nt, Homo sapiens
uauugcuggauguauuacaugu

SEQ ID NO: 117552 - RNA, 22 nt, Homo sapiens
uauugcuggcucugucuucauu

SEQ ID NO: 117553 - RNA, 22 nt, Homo sapiens
uauuguuaaagauguuaaugau

SEQ ID NO: 117554 - RNA, 22 nt, Homo sapiens
ugagauguggcuagagagguug

SEQ ID NO: 117555 - RNA, 22 nt, Homo sapiens
ugagauguguccagaucuaguu

SEQ ID NO: 117556 - RNA, 22 nt, Homo sapiens
ugagauguuccaaugacuauua

SEQ ID NO: 117557 - RNA, 22 nt, Homo sapiens
ugagcaauaaaguuacacaguu

SEQ ID NO: 117558 - RNA, 22 nt, Homo sapiens
ugagcagagaagugcccugcgc

SEQ ID NO: 117559 - RNA, 22 nt, Homo sapiens
ugagcagagaucacggcauugu

SEQ ID NO: 117560 - RNA, 22 nt, Homo sapiens
ugagcagugagugugcugcagg

SEQ ID NO: 117561 - RNA, 23 nt, Homo sapiens
ugagccaugggacuccaagggag

SEQ ID NO: 117562 - RNA, 22 nt, Homo sapiens
ugagcuacuacacccagcuugg

SEQ ID NO: 117563 - RNA, 22 nt, Homo sapiens
ugagcuaggaucacaccugcau

SEQ ID NO: 117564 - RNA, 22 nt, Homo sapiens
ugagcucaguauuucauaaaca

SEQ ID NO: 117565 - RNA, 22 nt, Homo sapiens
ugagcuguuugaagaagcauuu

SEQ ID NO: 117566 - RNA, 22 nt, Homo sapiens
ugaggauaguguugaaggcagg

SEQ ID NO: 117567 - RNA, 22 nt, Homo sapiens
ugaggaucucuaggaauuuauc

SEQ ID NO: 117568 - RNA, 22 nt, Homo sapiens
ugaggucauguucugucagguu

SEQ ID NO: 117569 - RNA, 22 nt, Homo sapiens
ugaggucauucaugugggcgca

SEQ ID NO: 117570 - RNA, 22 nt, Homo sapiens
ugaguucaauuguauuuuauua

SEQ ID NO: 117571 - RNA, 22 nt, Homo sapiens
ugaguucuuuguagauucugug

SEQ ID NO: 117572 - RNA, 22 nt, Homo sapiens
ugaguucuuuuagggauauugc

SEQ ID NO: 117573 - RNA, 22 nt, Homo sapiens
ugauaagaaauuguucauguag

SEQ ID NO: 117574 - RNA, 22 nt, Homo sapiens
ugauauauugaaugaugaaaca

SEQ ID NO: 117575 - RNA, 18 nt, Homo sapiens
ugauaucaucacaauuga

SEQ ID NO: 117576 - RNA, 22 nt, Homo sapiens
ugauaucugaauagauacacaa

SEQ ID NO: 117577 - RNA, 22 nt, Homo sapiens
ugauaugucccucgacaucagg

SEQ ID NO: 117578 - RNA, 22 nt, Homo sapiens
ugauccagugcucaguuggagu

SEQ ID NO: 117579 - RNA, 22 nt, Homo sapiens
ugaucuuuuuaauguccauggg

SEQ ID NO: 117580 - RNA, 22 nt, Homo sapiens
ugaugcugaugccugccagaag

SEQ ID NO: 117581 - RNA, 22 nt, Homo sapiens
ugcaaagucgaaacugcaguuu

SEQ ID NO: 117582 - RNA, 22 nt, Homo sapiens
ugcaaauguuaguaacaccacu

SEQ ID NO: 117583 - RNA, 22 nt, Homo sapiens
ugcaagaaacauauuccacaag

SEQ ID NO: 117584 - RNA, 22 nt, Homo sapiens
ugcaauauccucuacuauaggu

SEQ ID NO: 117585 - RNA, 17 nt, Homo sapiens
ugcaauuuaagcuagau

SEQ ID NO: 117586 - RNA, 22 nt, Homo sapiens
ugcagagaaacauuuuguauuu

SEQ ID NO: 117587 - RNA, 22 nt, Homo sapiens
ugcaggguccauugucccaagu

SEQ ID NO: 117588 - RNA, 22 nt, Homo sapiens
ugcagguaggcaguaucauuua

SEQ ID NO: 117589 - RNA, 20 nt, Homo sapiens
ugcaguguccucacuuguca

SEQ ID NO: 117590 - RNA, 22 nt, Homo sapiens
ugcaguguucuuuagaggaaau

SEQ ID NO: 117591 - RNA, 22 nt, Homo sapiens
ugcauaucuucuuuugagaaau

SEQ ID NO: 117592 - RNA, 18 nt, Homo sapiens
ugcauauguugaaccagc

SEQ ID NO: 117593 - RNA, 22 nt, Homo sapiens
ugcaucaggcugcuuauuacaa

SEQ ID NO: 117594 - RNA, 20 nt, Homo sapiens
ugcauguccucacuuacuug

SEQ ID NO: 117595 - RNA, 22 nt, Homo sapiens
ugcauguucuuacucauacaug

SEQ ID NO: 117596 - RNA, 22 nt, Homo sapiens
ugcauugcacuugcaugagaua

SEQ ID NO: 117597 - RNA, 22 nt, Homo sapiens
ugccaguuuuuacauuuccugu

SEQ ID NO: 117598 - RNA, 22 nt, Homo sapiens
ugcccaguggacagaaagucau

SEQ ID NO: 117599 - RNA, 22 nt, Homo sapiens
ugccuagaaacacuauuucucc

SEQ ID NO: 117600 - RNA, 21 nt, Homo sapiens
ugcuacugucacuuccuuugu

SEQ ID NO: 117601 - RNA, 22 nt, Homo sapiens
ugcuagaugaaguuugaguuuu

SEQ ID NO: 117602 - RNA, 22 nt, Homo sapiens
ugcuaugucuucucucacagag

SEQ ID NO: 117603 - RNA, 22 nt, Homo sapiens
ugcuguuguuugaugaaguaau

SEQ ID NO: 117604 - RNA, 22 nt, Homo sapiens
ugcuuugguagaaaucuuuggu

SEQ ID NO: 117605 - RNA, 22 nt, Homo sapiens
ugcuuuguugaaaaucauuugg

SEQ ID NO: 117606 - RNA, 22 nt, Homo sapiens
uggaaaacaugcacauuggauu

SEQ ID NO: 117607 - RNA, 22 nt, Homo sapiens
uggaaauaaaauagaguuugcc

SEQ ID NO: 117608 - RNA, 22 nt, Homo sapiens
uggaagacucaagguggugaau

SEQ ID NO: 117609 - RNA, 19 nt, Homo sapiens
uggaauggauuuaaaugug

SEQ ID NO: 117610 - RNA, 17 nt, Homo sapiens
uggaaugucuaagccug

SEQ ID NO: 117611 - RNA, 21 nt, Homo sapiens
uggaauguucugacuucaggg

SEQ ID NO: 117612 - RNA, 22 nt, Homo sapiens
uggaauuaauuaaaauauacug

SEQ ID NO: 117613 - RNA, 20 nt, Homo sapiens
uggaccagagagguggggac

SEQ ID NO: 117614 - RNA, 22 nt, Homo sapiens
uggagcccuaguuccucauaac

SEQ ID NO: 117615 - RNA, 21 nt, Homo sapiens
uggagugaagaguuuauugac

SEQ ID NO: 117616 - RNA, 22 nt, Homo sapiens
uggagugagaacuucaaugaug

SEQ ID NO: 117617 - RNA, 22 nt, Homo sapiens
uggagugcgagggugaaacuuu

SEQ ID NO: 117618 - RNA, 22 nt, Homo sapiens
uggaguuugacaugccuuuggg

SEQ ID NO: 117619 - RNA, 22 nt, Homo sapiens
uggauaguaauaaacauauagg

SEQ ID NO: 117620 - RNA, 22 nt, Homo sapiens
uggauauguucuuuguguaagg

SEQ ID NO: 117621 - RNA, 22 nt, Homo sapiens
uggauggucagaggguuucugu

SEQ ID NO: 117622 - RNA, 22 nt, Homo sapiens
uggauggugauuggaucaugga

SEQ ID NO: 117623 - RNA, 22 nt, Homo sapiens
uggcaaaugugagaugagaacu

SEQ ID NO: 117624 - RNA, 22 nt, Homo sapiens
uggcaagaccccaucucuacaa

SEQ ID NO: 117625 - RNA, 22 nt, Homo sapiens
uggcaagauuguuccgguuugg

SEQ ID NO: 117626 - RNA, 17 nt, Homo sapiens
uggcaugaggguguggg

SEQ ID NO: 117627 - RNA, 23 nt, Homo sapiens
uggcauuuuaguuagcuucagug

SEQ ID NO: 117628 - RNA, 22 nt, Homo sapiens
uggccaguguuuuuccugggcu

SEQ ID NO: 117629 - RNA, 22 nt, Homo sapiens
ugggaaacauccagcacauacu

SEQ ID NO: 117630 - RNA, 22 nt, Homo sapiens
ugggaauaugauacaggucuuu

SEQ ID NO: 117631 - RNA, 22 nt, Homo sapiens
ugggcggagacgugcagccgcc

SEQ ID NO: 117632 - RNA, 22 nt, Homo sapiens
uggucaugaggugaggcuucuc

SEQ ID NO: 117633 - RNA, 22 nt, Homo sapiens
ugguccccaauacuucuauaga

SEQ ID NO: 117634 - RNA, 20 nt, Homo sapiens
ugguccccaccaaaucucau

SEQ ID NO: 117635 - RNA, 20 nt, Homo sapiens
ugguccccugagucuggcuu

SEQ ID NO: 117636 - RNA, 22 nt, Homo sapiens
uggucucuuugcuuuagucauc

SEQ ID NO: 117637 - RNA, 22 nt, Homo sapiens
uggugagaaaagaugucuuugu

SEQ ID NO: 117638 - RNA, 22 nt, Homo sapiens
uggugagaaaugagaugcuuuu

SEQ ID NO: 117639 - RNA, 22 nt, Homo sapiens
ugguguuugagaagcugauguc

SEQ ID NO: 117640 - RNA, 22 nt, Homo sapiens
uguaaaccucugaguacaagcu

SEQ ID NO: 117641 - RNA, 22 nt, Homo sapiens
uguaaacuaugagcugauuauu

SEQ ID NO: 117642 - RNA, 22 nt, Homo sapiens
uguaaacucaguauguuuuacu

SEQ ID NO: 117643 - RNA, 20 nt, Homo sapiens
uguaacaaucuggauguugc

SEQ ID NO: 117644 - RNA, 22 nt, Homo sapiens
uguaagcagcagagacuauccu

SEQ ID NO: 117645 - RNA, 22 nt, Homo sapiens
uguaaggcaguuagagcaaauu

SEQ ID NO: 117646 - RNA, 22 nt, Homo sapiens
aaaacgcauccucacaggucug

SEQ ID NO: 117647 - RNA, 22 nt, Homo sapiens
aaaagcauucagagugcugggc

SEQ ID NO: 117648 - RNA, 21 nt, Homo sapiens
aaacuggcccaauuguuccau

SEQ ID NO: 117649 - RNA, 22 nt, Homo sapiens
aaacugucuggaugcuugugga

SEQ ID NO: 117650 - RNA, 22 nt, Homo sapiens
aaaggcaucauuaguaccaagu

SEQ ID NO: 117651 - RNA, 22 nt, Homo sapiens
aaaguaguagcaguuucugcca

SEQ ID NO: 117652 - RNA, 22 nt, Homo sapiens
aaagugaauguaucccguaagu

SEQ ID NO: 117653 - RNA, 18 nt, Homo sapiens
aaagugaugucauucuuu

SEQ ID NO: 117654 - RNA, 22 nt, Homo sapiens
aaagugcaguauuugggcagaa

SEQ ID NO: 117655 - RNA, 22 nt, Homo sapiens
aaagugcaguauuugggcagga

SEQ ID NO: 117656 - RNA, 22 nt, Homo sapiens
aaaguucuugcugaaggauuau

SEQ ID NO: 117657 - RNA, 22 nt, Homo sapiens
aaauaguagcugaaugagggaa

SEQ ID NO: 117658 - RNA, 22 nt, Homo sapiens
aaaugacuuuuuaugcagagua

SEQ ID NO: 117659 - RNA, 22 nt, Homo sapiens
aaaugcagauucugcuuagguu

SEQ ID NO: 117660 - RNA, 22 nt, Homo sapiens
guaugcaagugauaugacauau

SEQ ID NO: 117661 - RNA, 18 nt, Homo sapiens
guauuccagccugaguga

SEQ ID NO: 117662 - RNA, 22 nt, Homo sapiens
gucaaagucuauuggcuaauuc

SEQ ID NO: 117663 - RNA, 22 nt, Homo sapiens
gucacagcacuuuuaguaagug

SEQ ID NO: 117664 - RNA, 22 nt, Homo sapiens
gucagagcacugaguugugggc

SEQ ID NO: 117665 - RNA, 22 nt, Homo sapiens
gucaggcaccgauacaguuuuu

SEQ ID NO: 117666 - RNA, 22 nt, Homo sapiens
gucagugccugucccaggcuuu

SEQ ID NO: 117667 - RNA, 22 nt, Homo sapiens
gucagugucuuugcagcucaga

SEQ ID NO: 117668 - RNA, 22 nt, Homo sapiens
gucauaucauuggccaguggaa

SEQ ID NO: 117669 - RNA, 22 nt, Homo sapiens
gucucacagcuagcugcuuuau

SEQ ID NO: 117670 - RNA, 22 nt, Homo sapiens
gucucccaaccccugugcccag

SEQ ID NO: 117671 - RNA, 20 nt, Homo sapiens
gucugucuccgaguagaauu

SEQ ID NO: 117672 - RNA, 22 nt, Homo sapiens
gucuuggagaacucagcuuggc

SEQ ID NO: 117673 - RNA, 22 nt, Homo sapiens
gugaccagaugggcaggggugu

SEQ ID NO: 117674 - RNA, 22 nt, Homo sapiens
gugaggucagggcuguggacag

SEQ ID NO: 117675 - RNA, 21 nt, Homo sapiens
gugaggucauugggcuuucug

SEQ ID NO: 117676 - RNA, 22 nt, Homo sapiens
gugaggucguagucauaggcaa

SEQ ID NO: 117677 - RNA, 22 nt, Homo sapiens
gugaucaugauccugaagcauu

SEQ ID NO: 117678 - RNA, 18 nt, Homo sapiens
gugcaaugaauagcagag

SEQ ID NO: 117679 - RNA, 22 nt, Homo sapiens
gugcaaugucaggagaugcagc

SEQ ID NO: 117680 - RNA, 22 nt, Homo sapiens
gugcaauguuaauuacuugacu

SEQ ID NO: 117681 - RNA, 22 nt, Homo sapiens
gugcacaugcgugcgcacauau

SEQ ID NO: 117682 - RNA, 22 nt, Homo sapiens
gugcacaugguagguauugagu

SEQ ID NO: 117683 - RNA, 22 nt, Homo sapiens
gugcacuguagaacccuuuguu

SEQ ID NO: 117684 - RNA, 23 nt, Homo sapiens
gugcaguggcgagauuucggcuc

SEQ ID NO: 117685 - RNA, 22 nt, Homo sapiens
gugcauaucugugguuggcuga

SEQ ID NO: 117686 - RNA, 22 nt, Homo sapiens
gugcaugcaucuuuauaguagc

SEQ ID NO: 117687 - RNA, 22 nt, Homo sapiens
gugcccacugucuguccuguag

SEQ ID NO: 117688 - RNA, 22 nt, Homo sapiens
gugccuuuucugagcaaugagc

SEQ ID NO: 117689 - RNA, 22 nt, Homo sapiens
gugcuaggugcuaggaagauag

SEQ ID NO: 117690 - RNA, 22 nt, Homo sapiens
ugagacugagucucccucuguc

SEQ ID NO: 117691 - RNA, 22 nt, Homo sapiens
ugagacugagucucgcucuugu

SEQ ID NO: 117692 - RNA, 22 nt, Homo sapiens
ugagacuguuuuggggaacuuc

SEQ ID NO: 117693 - RNA, 22 nt, Homo sapiens
ugagagacaguuuguuaaaauu

SEQ ID NO: 117694 - RNA, 22 nt, Homo sapiens
ugagagacauuuguuguagagu

SEQ ID NO: 117695 - RNA, 21 nt, Homo sapiens
ugagaguaguguauuauucuc

SEQ ID NO: 117696 - RNA, 22 nt, Homo sapiens
ugagauaacuaaaaacauuuug

SEQ ID NO: 117697 - RNA, 22 nt, Homo sapiens
ugagauaaucaugugauuucau

SEQ ID NO: 117698 - RNA, 22 nt, Homo sapiens
ugagaucaagguuaauauaauc

SEQ ID NO: 117699 - RNA, 19 nt, Homo sapiens
ugagauccacugaagauuc

SEQ ID NO: 117700 - RNA, 23 nt, Homo sapiens
ugagaucuacagaucucagaucu

SEQ ID NO: 117701 - RNA, 22 nt, Homo sapiens
ugagaugauaucuuauuguaau

SEQ ID NO: 117702 - RNA, 22 nt, Homo sapiens
ugagauggaucuuggauuugaa

SEQ ID NO: 117703 - RNA, 21 nt, Homo sapiens
ugagaugugaccagggcauca

SEQ ID NO: 117704 - RNA, 22 nt, Homo sapiens
ucugaguggcagaaugagcuga

SEQ ID NO: 117705 - RNA, 21 nt, Homo sapiens
ucuggcccccucaaaucucau

SEQ ID NO: 117706 - RNA, 22 nt, Homo sapiens
ucuggccccucccaaaucucau

SEQ ID NO: 117707 - RNA, 20 nt, Homo sapiens
ucuggccccucuaaaucuca

SEQ ID NO: 117708 - RNA, 22 nt, Homo sapiens
ucuggccccucucaaaucucau

SEQ ID NO: 117709 - RNA, 22 nt, Homo sapiens
ucuggugugcucuggacuugca

SEQ ID NO: 117710 - RNA, 22 nt, Homo sapiens
ucugguguuacugagccuccca

SEQ ID NO: 117711 - RNA, 19 nt, Homo sapiens
ucugugcuugucccccugu

SEQ ID NO: 117712 - RNA, 22 nt, Homo sapiens
ucuguggucagcauccgccacu

SEQ ID NO: 117713 - RNA, 22 nt, Homo sapiens
ucugugguucaaaccagcaacu

SEQ ID NO: 117714 - RNA, 22 nt, Homo sapiens
ucuguguuugguuggcaauuuc

SEQ ID NO: 117715 - RNA, 22 nt, Homo sapiens
ucuucagucauauuggccugga

SEQ ID NO: 117716 - RNA, 22 nt, Homo sapiens
ucuugguuaggggaaauaggca

SEQ ID NO: 117717 - RNA, 22 nt, Homo sapiens
ucuugguuuauugauggagagg

SEQ ID NO: 117718 - RNA, 22 nt, Homo sapiens
ucuuuaguuaagggacauuuua

SEQ ID NO: 117719 - RNA, 22 nt, Homo sapiens
ucuuuggugaauggucauccag

SEQ ID NO: 117720 - RNA, 22 nt, Homo sapiens
ucuuugguucugugcagccuau

SEQ ID NO: 117721 - RNA, 22 nt, Homo sapiens
ugaaacacacagagaagggaga

SEQ ID NO: 117722 - RNA, 22 nt, Homo sapiens
ugaaacauacacucugaugggg

SEQ ID NO: 117723 - RNA, 22 nt, Homo sapiens
ugaaacugcagugggcuuggca

SEQ ID NO: 117724 - RNA, 22 nt, Homo sapiens
ugaaauguuaaacaaguggcuc

SEQ ID NO: 117725 - RNA, 22 nt, Homo sapiens
ugaaauguugggugauggaauc

SEQ ID NO: 117726 - RNA, 22 nt, Homo sapiens
ugaacacagccugccucugcca

SEQ ID NO: 117727 - RNA, 22 nt, Homo sapiens
ugaacucauccuuucuuauggc

SEQ ID NO: 117728 - RNA, 22 nt, Homo sapiens
ugaaggacauaaggcagaguga

SEQ ID NO: 117729 - RNA, 22 nt, Homo sapiens
ugaaggcaggagggagaaaagu

SEQ ID NO: 117730 - RNA, 22 nt, Homo sapiens
ugaauagaaguggcaggaguag

SEQ ID NO: 117731 - RNA, 21 nt, Homo sapiens
ugaauauuuggguugugucca

SEQ ID NO: 117732 - RNA, 22 nt, Homo sapiens
ugaaugcauggggccaagaagg

SEQ ID NO: 117733 - RNA, 22 nt, Homo sapiens
ugaauggauccaauucuuagua

SEQ ID NO: 117734 - RNA, 22 nt, Homo sapiens
ugaauguacuuaacacuggauu

SEQ ID NO: 117735 - RNA, 23 nt, Homo sapiens
ugaauguaucgaaugugggaaag

SEQ ID NO: 117736 - RNA, 22 nt, Homo sapiens
ugaauguauuuauuaccauuca

SEQ ID NO: 117737 - RNA, 18 nt, Homo sapiens
ugacaaugcuaguccugg

SEQ ID NO: 117738 - RNA, 22 nt, Homo sapiens
ugacagagcaggacuucaucuc

SEQ ID NO: 117739 - RNA, 22 nt, Homo sapiens
ugacagcugaggcccagaguac

SEQ ID NO: 117740 - RNA, 22 nt, Homo sapiens
ugacaggagauuaugugauguu

SEQ ID NO: 117741 - RNA, 19 nt, Homo sapiens
ugacaugaaacccaagauc

SEQ ID NO: 117742 - RNA, 22 nt, Homo sapiens
ugacaugaagucucccucuguu

SEQ ID NO: 117743 - RNA, 23 nt, Homo sapiens
ugacauguaauucaguccagcag

SEQ ID NO: 117744 - RNA, 21 nt, Homo sapiens
ugacauguugguuugcugcac

SEQ ID NO: 117745 - RNA, 22 nt, Homo sapiens
ugacccauagaaauguggauaa

SEQ ID NO: 117746 - RNA, 22 nt, Homo sapiens
ugacuacauaaguaaucucaaa

SEQ ID NO: 117747 - RNA, 22 nt, Homo sapiens
ugacuaguuugaggacauuaua

SEQ ID NO: 117748 - RNA, 22 nt, Homo sapiens
ugagaacagcagcuugggacac

SEQ ID NO: 117749 - RNA, 22 nt, Homo sapiens
ugagacugaaauuaggaaacug

SEQ ID NO: 117750 - RNA, 22 nt, Homo sapiens
ugagacugguaauguguagggc

SEQ ID NO: 117751 - RNA, 22 nt, Homo sapiens
ugagagaugauaaaauguuugu

SEQ ID NO: 117752 - RNA, 22 nt, Homo sapiens
ugagaguagggguugggauugg

SEQ ID NO: 117753 - RNA, 22 nt, Homo sapiens
ugagagucacugaccugguaua

SEQ ID NO: 117754 - RNA, 22 nt, Homo sapiens
ugagauauauauauuugagaca

SEQ ID NO: 117755 - RNA, 22 nt, Homo sapiens
ugagaucagugaagaaguguuu

SEQ ID NO: 117756 - RNA, 22 nt, Homo sapiens
ugagaucugauaggccuggguu

SEQ ID NO: 117757 - RNA, 22 nt, Homo sapiens
ugagaucuuaucagaaauggug

SEQ ID NO: 117758 - RNA, 22 nt, Homo sapiens
ugagaucuuuuguggcugagaa

SEQ ID NO: 117759 - RNA, 22 nt, Homo sapiens
ugagaugaaagcagaaagacuu

SEQ ID NO: 117760 - RNA, 22 nt, Homo sapiens
ugagaugaagcuagaagaaugg

SEQ ID NO: 117761 - RNA, 22 nt, Homo sapiens
ugagaugaguucucgcucuguc

SEQ ID NO: 117762 - RNA, 21 nt, Homo sapiens
ugagaugauccugcaugcaug

SEQ ID NO: 117763 - RNA, 22 nt, Homo sapiens
ugagaugauuuaauggagccca

SEQ ID NO: 117764 - RNA, 22 nt, Homo sapiens
ugagaugcauauucuggcuccu

SEQ ID NO: 117765 - RNA, 22 nt, Homo sapiens
ugagauguagauauggauuaga

SEQ ID NO: 117766 - RNA, 21 nt, Homo sapiens
ugagauuauauuaacauggua

SEQ ID NO: 117767 - RNA, 22 nt, Homo sapiens
ugagauuaucuguacauaggag

SEQ ID NO: 117768 - RNA, 22 nt, Homo sapiens
ugagcagaguuguuucuccuga

SEQ ID NO: 117769 - RNA, 22 nt, Homo sapiens
ugagcagugaguguggugcagg

SEQ ID NO: 117770 - RNA, 22 nt, Homo sapiens
ugagccaaguucacaccauugc

SEQ ID NO: 117771 - RNA, 22 nt, Homo sapiens
ugagccauggcaccuugucuaa

SEQ ID NO: 117772 - RNA, 22 nt, Homo sapiens
ugagccaugguuagcuucucau

SEQ ID NO: 117773 - RNA, 20 nt, Homo sapiens
ugagccccuggacucaagcg

SEQ ID NO: 117774 - RNA, 20 nt, Homo sapiens
ugagcucaauuguugcaagu

SEQ ID NO: 117775 - RNA, 20 nt, Homo sapiens
ugagcucaugacauuuuucu

SEQ ID NO: 117776 - RNA, 22 nt, Homo sapiens
ugaggcaaggcugaaugaaggc

SEQ ID NO: 117777 - RNA, 22 nt, Homo sapiens
ugaggcuaggauaggcugauuc

SEQ ID NO: 117778 - RNA, 22 nt, Homo sapiens
ugaggcuagucagaucagauga

SEQ ID NO: 117779 - RNA, 22 nt, Homo sapiens
ugagggaugcguacccuaugcc

SEQ ID NO: 117780 - RNA, 22 nt, Homo sapiens
ugaguucaugcuuguaguucua

SEQ ID NO: 117781 - RNA, 22 nt, Homo sapiens
ugauaacauugggggaagcuga

SEQ ID NO: 117782 - RNA, 22 nt, Homo sapiens
ugauaugaaagggaaauaagug

SEQ ID NO: 117783 - RNA, 22 nt, Homo sapiens
ugauauguggauucagcucaaa

SEQ ID NO: 117784 - RNA, 22 nt, Homo sapiens
ugauauguguaaacaauguaua

SEQ ID NO: 117785 - RNA, 20 nt, Homo sapiens
ugauauuucuggaaguggag

SEQ ID NO: 117786 - RNA, 22 nt, Homo sapiens
ugcaacauguguaccacucugu

SEQ ID NO: 117787 - RNA, 22 nt, Homo sapiens
ugcaagacacuguccugggcau

SEQ ID NO: 117788 - RNA, 22 nt, Homo sapiens
ugcaagacugcaguuacuuuug

SEQ ID NO: 117789 - RNA, 22 nt, Homo sapiens
ugcagauucguuuugaggggua

SEQ ID NO: 117790 - RNA, 22 nt, Homo sapiens
ugcaggauguucaguaauuucc

SEQ ID NO: 117791 - RNA, 22 nt, Homo sapiens
ugcauagaauguucuguaaaua

SEQ ID NO: 117792 - RNA, 22 nt, Homo sapiens
ugcauaucuuguggaauaucuc

SEQ ID NO: 117793 - RNA, 22 nt, Homo sapiens
ugcauauguauacaugugccau

SEQ ID NO: 117794 - RNA, 22 nt, Homo sapiens
ugcaucacaguacuccagccug

SEQ ID NO: 117795 - RNA, 22 nt, Homo sapiens
ugcauggaagggagggaaagag

SEQ ID NO: 117796 - RNA, 22 nt, Homo sapiens
ugcauggagauauacaguuuuu

SEQ ID NO: 117797 - RNA, 22 nt, Homo sapiens
ugcauuguuccgaauguguccu

SEQ ID NO: 117798 - RNA, 22 nt, Homo sapiens
ugccaggaugaggucaauguuu

SEQ ID NO: 117799 - RNA, 22 nt, Homo sapiens
ugccaugaaguaauggcaaaaa

SEQ ID NO: 117800 - RNA, 22 nt, Homo sapiens
ugccuacuuugcaucugucagg

SEQ ID NO: 117801 - RNA, 23 nt, Homo sapiens
ugccuagaugcugcccugggaca

SEQ ID NO: 117802 - RNA, 22 nt, Homo sapiens
ugccugagccagguuuuaggag

SEQ ID NO: 117803 - RNA, 22 nt, Homo sapiens
ugcgauuauuaugucacuuccu

SEQ ID NO: 117804 - RNA, 21 nt, Homo sapiens
ugcucaugaguaaugcaguga

SEQ ID NO: 117805 - RNA, 22 nt, Homo sapiens
ugcugcaaacaggcaucugugg

SEQ ID NO: 117806 - RNA, 22 nt, Homo sapiens
uucaagaauuaaaguggcuuuu

SEQ ID NO: 117807 - RNA, 22 nt, Homo sapiens
uucaauuaauauuauacucuca

SEQ ID NO: 117808 - RNA, 22 nt, Homo sapiens
uucacaguggugggagacguca

SEQ ID NO: 117809 - RNA, 22 nt, Homo sapiens
uucaccuugggucccacuugcu

SEQ ID NO: 117810 - RNA, 22 nt, Homo sapiens
uucacugagccagacuaagaca

SEQ ID NO: 117811 - RNA, 22 nt, Homo sapiens
uucacugcacuccagccugagc

SEQ ID NO: 117812 - RNA, 22 nt, Homo sapiens
uucagagugguaugaagugaug

SEQ ID NO: 117813 - RNA, 22 nt, Homo sapiens
uucagauugcauaccgaaagua

SEQ ID NO: 117814 - RNA, 22 nt, Homo sapiens
uucagcaggccaggcccugacu

SEQ ID NO: 117815 - RNA, 22 nt, Homo sapiens
uucagguucauuugcugcuauu

SEQ ID NO: 117816 - RNA, 18 nt, Homo sapiens
uucagugaauucuuuuga

SEQ ID NO: 117817 - RNA, 22 nt, Homo sapiens
uucaguucugcucugaucuuag

SEQ ID NO: 117818 - RNA, 19 nt, Homo sapiens
uucauacagugagagcagc

SEQ ID NO: 117819 - RNA, 22 nt, Homo sapiens
uucauaguaacaguaacuaugg

SEQ ID NO: 117820 - RNA, 22 nt, Homo sapiens
uucauagucuaugcaaguaaga

SEQ ID NO: 117821 - RNA, 22 nt, Homo sapiens
uucauagugaaaaauucaaagu

SEQ ID NO: 117822 - RNA, 22 nt, Homo sapiens
uucauaguuuauacugauauuu

SEQ ID NO: 117823 - RNA, 22 nt, Homo sapiens
uucauccccuccaaaucucaug

SEQ ID NO: 117824 - RNA, 22 nt, Homo sapiens
uuccacaaugguugaacuaguu

SEQ ID NO: 117825 - RNA, 22 nt, Homo sapiens
uuccagagucaccuuucugucg

SEQ ID NO: 117826 - RNA, 22 nt, Homo sapiens
uuccauguaguugagcaguuuu

SEQ ID NO: 117827 - RNA, 20 nt, Homo sapiens
uucccucagccuugagggua

SEQ ID NO: 117828 - RNA, 22 nt, Homo sapiens
auacaagcaguccaacuccaua

SEQ ID NO: 117829 - RNA, 22 nt, Homo sapiens
auacagcuaaaauauuaaguua

SEQ ID NO: 117830 - RNA, 22 nt, Homo sapiens
auacaugugugagcgaagaugu

SEQ ID NO: 117831 - RNA, 22 nt, Homo sapiens
auacauguucaagggcauauau

SEQ ID NO: 117832 - RNA, 22 nt, Homo sapiens
auagaaucaucugugcacuagu

SEQ ID NO: 117833 - RNA, 22 nt, Homo sapiens
auagcagugccccaaacuccug

SEQ ID NO: 117834 - RNA, 22 nt, Homo sapiens
auagcagugugagaaugaacua

SEQ ID NO: 117835 - RNA, 22 nt, Homo sapiens
auagcccauuuguugguccugg

SEQ ID NO: 117836 - RNA, 22 nt, Homo sapiens
auagcuguccuuacuagcuagg

SEQ ID NO: 117837 - RNA, 22 nt, Homo sapiens
auauagcaaugaaagagaugaa

SEQ ID NO: 117838 - RNA, 22 nt, Homo sapiens
auaugcacaguggaguacuauu

SEQ ID NO: 117839 - RNA, 22 nt, Homo sapiens
auauuacuggccauaucgcagg

SEQ ID NO: 117840 - RNA, 22 nt, Homo sapiens
auauugcuuagugaugaagucu

SEQ ID NO: 117841 - RNA, 19 nt, Homo sapiens
aucaaacugcucuuugagg

SEQ ID NO: 117842 - RNA, 22 nt, Homo sapiens
aucacagcuacuccucugucuu

SEQ ID NO: 117843 - RNA, 20 nt, Homo sapiens
aucaccacagcucguucaug

SEQ ID NO: 117844 - RNA, 22 nt, Homo sapiens
aucaccugagcaguauacacug

SEQ ID NO: 117845 - RNA, 22 nt, Homo sapiens
aucaccuuucccuuucugaauc

SEQ ID NO: 117846 - RNA, 22 nt, Homo sapiens
aucagagugaugguuuaaguau

SEQ ID NO: 117847 - RNA, 22 nt, Homo sapiens
aucaggaaccuuuuuggugugu

SEQ ID NO: 117848 - RNA, 22 nt, Homo sapiens
aucaggcacacauuggaguuug

SEQ ID NO: 117849 - RNA, 22 nt, Homo sapiens
aucauaucauuggugaacagug

SEQ ID NO: 117850 - RNA, 22 nt, Homo sapiens
auccauugcucaagagaaguca

SEQ ID NO: 117851 - RNA, 22 nt, Homo sapiens
aucccgagacuuugcugaaguu

SEQ ID NO: 117852 - RNA, 22 nt, Homo sapiens
aucccugugauccaaucacuuc

SEQ ID NO: 117853 - RNA, 22 nt, Homo sapiens
auccuacaguccauucuuugug

SEQ ID NO: 117854 - RNA, 22 nt, Homo sapiens
auccuagguuagagaacaaaac

SEQ ID NO: 117855 - RNA, 22 nt, Homo sapiens
auccucaguggcuuaaguauag

SEQ ID NO: 117856 - RNA, 22 nt, Homo sapiens
auccugagacuuugcugaaguu

SEQ ID NO: 117857 - RNA, 22 nt, Homo sapiens
auccuguagagaugagggugga

SEQ ID NO: 117858 - RNA, 22 nt, Homo sapiens
aucuaaaucucauaugggcaca

SEQ ID NO: 117859 - RNA, 22 nt, Homo sapiens
aucuagagaggcagucuggccg

SEQ ID NO: 117860 - RNA, 22 nt, Homo sapiens
aucucauggagguagagaguaa

SEQ ID NO: 117861 - RNA, 22 nt, Homo sapiens
aucuggcuucuuuuaguccaca

SEQ ID NO: 117862 - RNA, 22 nt, Homo sapiens
aucugguguauuggugcugggu

SEQ ID NO: 117863 - RNA, 22 nt, Homo sapiens
augaaagugauaaaugucucua

SEQ ID NO: 117864 - RNA, 22 nt, Homo sapiens
augaacucaucauuuuuuaugg

SEQ ID NO: 117865 - RNA, 22 nt, Homo sapiens
augaaugcagcacuguuuuucu

SEQ ID NO: 117866 - RNA, 22 nt, Homo sapiens
augacagcaucugugaaguugu

SEQ ID NO: 117867 - RNA, 22 nt, Homo sapiens
augacauugaaaagcaagugga

SEQ ID NO: 117868 - RNA, 22 nt, Homo sapiens
augaccagagagugcgcagggu

SEQ ID NO: 117869 - RNA, 22 nt, Homo sapiens
augaccuuguccucagugucau

SEQ ID NO: 117870 - RNA, 22 nt, Homo sapiens
augagaaucauuucagcuugua

SEQ ID NO: 117871 - RNA, 22 nt, Homo sapiens
augagagcaacaccuucacuug

SEQ ID NO: 117872 - RNA, 22 nt, Homo sapiens
augagaucaaauuuaagcuguu

SEQ ID NO: 117873 - RNA, 22 nt, Homo sapiens
augagauuguuugugugaaaua

SEQ ID NO: 117874 - RNA, 22 nt, Homo sapiens
augagcuaguguaggguacuga

SEQ ID NO: 117875 - RNA, 22 nt, Homo sapiens
augagcuauggagacagggcca

SEQ ID NO: 117876 - RNA, 22 nt, Homo sapiens
augagcucauugggugacuggg

SEQ ID NO: 117877 - RNA, 22 nt, Homo sapiens
augaggugaggucaguaaggua

SEQ ID NO: 117878 - RNA, 22 nt, Homo sapiens
augauggaggccgugauggacg

SEQ ID NO: 117879 - RNA, 20 nt, Homo sapiens
augcaaacccugcuuugugg

SEQ ID NO: 117880 - RNA, 22 nt, Homo sapiens
augcaagcacacaagaggaaau

SEQ ID NO: 117881 - RNA, 22 nt, Homo sapiens
augcagugugcaacagauuaag

SEQ ID NO: 117882 - RNA, 18 nt, Homo sapiens
augcauauuuuaaguugu

SEQ ID NO: 117883 - RNA, 22 nt, Homo sapiens
augcauggucugaagucaaccu

SEQ ID NO: 117884 - RNA, 20 nt, Homo sapiens
augccacugagcagugguga

SEQ ID NO: 117885 - RNA, 22 nt, Homo sapiens
augccauugcacuccagccugg

SEQ ID NO: 117886 - RNA, 22 nt, Homo sapiens
augcuacugauaagcaaucauu

SEQ ID NO: 117887 - RNA, 22 nt, Homo sapiens
augcuguuuugaauucucuaga

SEQ ID NO: 117888 - RNA, 22 nt, Homo sapiens
auggaaggagaggaaugaauga

SEQ ID NO: 117889 - RNA, 22 nt, Homo sapiens
auggaaugccauuuauaaugga

SEQ ID NO: 117890 - RNA, 22 nt, Homo sapiens
auggagcaaaacagauuuggga

SEQ ID NO: 117891 - RNA, 22 nt, Homo sapiens
auggcaaaauguuccuaguggu

SEQ ID NO: 117892 - RNA, 22 nt, Homo sapiens
auggcaaugcgauggugacuga

SEQ ID NO: 117893 - RNA, 22 nt, Homo sapiens
auggcacugccuggcuucaugg

SEQ ID NO: 117894 - RNA, 22 nt, Homo sapiens
auggcacuguguccugggguca

SEQ ID NO: 117895 - RNA, 22 nt, Homo sapiens
auggcagcccucuuuauccaug

SEQ ID NO: 117896 - RNA, 22 nt, Homo sapiens
auggcuagaaccuguauauuca

SEQ ID NO: 117897 - RNA, 22 nt, Homo sapiens
auggcuguuccugggaguucua

SEQ ID NO: 117898 - RNA, 22 nt, Homo sapiens
auggcuguuuaagaguuucauu

SEQ ID NO: 117899 - RNA, 22 nt, Homo sapiens
auggcuuuguguucagagcuga

SEQ ID NO: 117900 - RNA, 22 nt, Homo sapiens
augggguagguagcucggggaa

SEQ ID NO: 117901 - RNA, 22 nt, Homo sapiens
augguuuuacugcaaaauggga

SEQ ID NO: 117902 - RNA, 22 nt, Homo sapiens
auguaaacauuuggucuaaauu

SEQ ID NO: 117903 - RNA, 21 nt, Homo sapiens
auguaaugaagaagccacugg

SEQ ID NO: 117904 - RNA, 22 nt, Homo sapiens
augucaacauagacaguagagu

SEQ ID NO: 117905 - RNA, 22 nt, Homo sapiens
augucacagguccuagccaagu

SEQ ID NO: 117906 - RNA, 22 nt, Homo sapiens
augucugguagccaccuggagg

SEQ ID NO: 117907 - RNA, 22 nt, Homo sapiens
augucuuucauagagacccaga

SEQ ID NO: 117908 - RNA, 17 nt, Homo sapiens
augugaauguucaaaua

SEQ ID NO: 117909 - RNA, 22 nt, Homo sapiens
augugcaaagcacuguucagca

SEQ ID NO: 117910 - RNA, 22 nt, Homo sapiens
augugcagauguuacaaauugu

SEQ ID NO: 117911 - RNA, 22 nt, Homo sapiens
augugcauaugaagcacagaca

SEQ ID NO: 117912 - RNA, 20 nt, Homo sapiens
augugcuaauauuaauaugu

SEQ ID NO: 117913 - RNA, 23 nt, Homo sapiens
augugugcuuggagagcaggaug

SEQ ID NO: 117914 - RNA, 22 nt, Homo sapiens
auguuguaguaugagucaaaau

SEQ ID NO: 117915 - RNA, 22 nt, Homo sapiens
auguuugguagugaauauggua

SEQ ID NO: 117916 - RNA, 22 nt, Homo sapiens
auuagggcaggagcaaguacgg

SEQ ID NO: 117917 - RNA, 22 nt, Homo sapiens
auuauaugucaucacagacacc

SEQ ID NO: 117918 - RNA, 22 nt, Homo sapiens
auuauuagucggccagcuguua

SEQ ID NO: 117919 - RNA, 22 nt, Homo sapiens
auucaacuaauuauugaagaug

SEQ ID NO: 117920 - RNA, 22 nt, Homo sapiens
auucacugugcuuggccaaauu

SEQ ID NO: 117921 - RNA, 22 nt, Homo sapiens
auucacuguggcuuucucugau

SEQ ID NO: 117922 - RNA, 22 nt, Homo sapiens
auuccagguggcgccauucaca

SEQ ID NO: 117923 - RNA, 22 nt, Homo sapiens
auucccuuagcugccucagccu

SEQ ID NO: 117924 - RNA, 22 nt, Homo sapiens
auugaacacagaguagcuuucc

SEQ ID NO: 117925 - RNA, 22 nt, Homo sapiens
auugacuugauauauagcugau

SEQ ID NO: 117926 - RNA, 22 nt, Homo sapiens
auugcacuccagccugggcaac

SEQ ID NO: 117927 - RNA, 22 nt, Homo sapiens
auugcacuccagccuugugaca

SEQ ID NO: 117928 - RNA, 23 nt, Homo sapiens
auugcagucuugaacuccugggc

SEQ ID NO: 117929 - RNA, 22 nt, Homo sapiens
auugcccauaaggauauuguca

SEQ ID NO: 117930 - RNA, 22 nt, Homo sapiens
auugcuuacccuguauuagauc

SEQ ID NO: 117931 - RNA, 22 nt, Homo sapiens
uuguccacugcuagccucugca

SEQ ID NO: 117932 - RNA, 21 nt, Homo sapiens
uuguccccacccaaaucucau

SEQ ID NO: 117933 - RNA, 22 nt, Homo sapiens
uuguccccacccaaaugucauc

SEQ ID NO: 117934 - RNA, 22 nt, Homo sapiens
uuguccuccacauuugaucagu

SEQ ID NO: 117935 - RNA, 22 nt, Homo sapiens
uuguccucuccaaaucucaugu

SEQ ID NO: 117936 - RNA, 22 nt, Homo sapiens
uugucuccuagacgaccaggcg

SEQ ID NO: 117937 - RNA, 22 nt, Homo sapiens
uugugcaaaguugugguuucug

SEQ ID NO: 117938 - RNA, 22 nt, Homo sapiens
uugugcaugaugcauacauggu

SEQ ID NO: 117939 - RNA, 20 nt, Homo sapiens
uugugcauugggccauuggg

SEQ ID NO: 117940 - RNA, 22 nt, Homo sapiens
uugugccauucuucugccucag

SEQ ID NO: 117941 - RNA, 22 nt, Homo sapiens
uugugcuccugugagaaucuag

SEQ ID NO: 117942 - RNA, 22 nt, Homo sapiens
uugugcuucaucaccuagcaga

SEQ ID NO: 117943 - RNA, 22 nt, Homo sapiens
uugugguaggaguugccauguu

SEQ ID NO: 117944 - RNA, 22 nt, Homo sapiens
uugugguuuuuaaaacuaggug

SEQ ID NO: 117945 - RNA, 22 nt, Homo sapiens
uuguuugguuagaugggcaagu

SEQ ID NO: 117946 - RNA, 20 nt, Homo sapiens
uuuaagacaugcugaauuga

SEQ ID NO: 117947 - RNA, 22 nt, Homo sapiens
uuuaaugcgucucugaguuuug

SEQ ID NO: 117948 - RNA, 22 nt, Homo sapiens
uuuacaguuuucuaggcuacca

SEQ ID NO: 117949 - RNA, 22 nt, Homo sapiens
uuuacugugggguuucuuagag

SEQ ID NO: 117950 - RNA, 22 nt, Homo sapiens
uuuaggcaugcaguucuauuua

SEQ ID NO: 117951 - RNA, 22 nt, Homo sapiens
uuuagguuacauauaauccaaa

SEQ ID NO: 117952 - RNA, 22 nt, Homo sapiens
uuuaucuguuuaaaacuguuca

SEQ ID NO: 117953 - RNA, 22 nt, Homo sapiens
uuuaugcuacauguguuggaaa

SEQ ID NO: 117954 - RNA, 22 nt, Homo sapiens
uuucagagucaucugcccaagu

SEQ ID NO: 117955 - RNA, 22 nt, Homo sapiens
uuucaggcagggagcuucagug

SEQ ID NO: 117956 - RNA, 20 nt, Homo sapiens
uuucaguacuuucuacuggc

SEQ ID NO: 117957 - RNA, 22 nt, Homo sapiens
uuucccagugguacaguuuaua

SEQ ID NO: 117958 - RNA, 22 nt, Homo sapiens
uuucccuuuagcuuagugauuu

SEQ ID NO: 117959 - RNA, 16 nt, Homo sapiens
uuucccuuugguguuu

SEQ ID NO: 117960 - RNA, 16 nt, Homo sapiens
uuucuauguuuuacua

SEQ ID NO: 117961 - RNA, 22 nt, Homo sapiens
uuucugggggugcugauggaaa

SEQ ID NO: 117962 - RNA, 22 nt, Homo sapiens
uuucugugguccucuugaaggu

SEQ ID NO: 117963 - RNA, 19 nt, Homo sapiens
uuugaauauaaugcagcua

SEQ ID NO: 117964 - RNA, 22 nt, Homo sapiens
uuugagaaugcuaccagagaag

SEQ ID NO: 117965 - RNA, 22 nt, Homo sapiens
uuugagaucuuuagaaucaggc

SEQ ID NO: 117966 - RNA, 22 nt, Homo sapiens
uuugagcuugacucagcuggag

SEQ ID NO: 117967 - RNA, 22 nt, Homo sapiens
uuugcaagaugaaaaaguucua

SEQ ID NO: 117968 - RNA, 22 nt, Homo sapiens
uuugcacauauuugggcaaaag

SEQ ID NO: 117969 - RNA, 22 nt, Homo sapiens
uuugcacuuuuguaauaugguu

SEQ ID NO: 117970 - RNA, 22 nt, Homo sapiens
uuugcuucacuguuuggcaaaa

SEQ ID NO: 117971 - RNA, 22 nt, Homo sapiens
uuuggauagugugguccuuuua

SEQ ID NO: 117972 - RNA, 22 nt, Homo sapiens
uuuggcaugggcuauuugcuuu

SEQ ID NO: 117973 - RNA, 22 nt, Homo sapiens
uuuggcauuugaguuuguagga

SEQ ID NO: 117974 - RNA, 22 nt, Homo sapiens
uuuggcuuaagauugacugcaa

SEQ ID NO: 117975 - RNA, 22 nt, Homo sapiens
uuugggcuuuuaaucuagagca

SEQ ID NO: 117976 - RNA, 22 nt, Homo sapiens
uuuggucagcugcgggucagcu

SEQ ID NO: 117977 - RNA, 22 nt, Homo sapiens
uuuguacacgugggugaauugu

SEQ ID NO: 117978 - RNA, 23 nt, Homo sapiens
uuuguacuaugucaguuuagaua

SEQ ID NO: 117979 - RNA, 22 nt, Homo sapiens
uuuguacuugaagaaucuuuau

SEQ ID NO: 117980 - RNA, 22 nt, Homo sapiens
uuuguggaaugcccuuauuuau

SEQ ID NO: 117981 - RNA, 22 nt, Homo sapiens
uuuuaguggaauauuuacaguu

SEQ ID NO: 117982 - RNA, 22 nt, Homo sapiens
uuuuaguugcucagguauucuc

SEQ ID NO: 117983 - RNA, 22 nt, Homo sapiens
uuuucaguggccauaguggaga

SEQ ID NO: 117984 - RNA, 22 nt, Homo sapiens
uuuuccagugggacucccauua

SEQ ID NO: 117985 - RNA, 22 nt, Homo sapiens
uuuugcaggcauuggaaguuua

SEQ ID NO: 117986 - RNA, 22 nt, Homo sapiens
uuuuggcucugucuguaucuuu

SEQ ID NO: 117987 - RNA, 22 nt, Homo sapiens
uuuuggcuuuuccucagcaagc

SEQ ID NO: 117988 - RNA, 22 nt, Homo sapiens
uuuugguaaugaacuuaggaag

SEQ ID NO: 117989 - RNA, 22 nt, Homo sapiens
uuuugguauacacaaggguccu

SEQ ID NO: 117990 - RNA, 22 nt, Homo sapiens
uuuugucccaugggcuguuccc

SEQ ID NO: 117991 - RNA, 22 nt, Homo sapiens
uuuuugaguaaauauaaauugu

SEQ ID NO: 117992 - RNA, 20 nt, Homo sapiens
agagugcugucuguccugag

SEQ ID NO: 117993 - RNA, 22 nt, Homo sapiens
agaugccuaugaagagaaauua

SEQ ID NO: 117994 - RNA, 22 nt, Homo sapiens
agaugcuguuaucaacuguagc

SEQ ID NO: 117995 - RNA, 22 nt, Homo sapiens
agauggugauaaaugugguacc

SEQ ID NO: 117996 - RNA, 22 nt, Homo sapiens
agcagcauuaugauauaucuua

SEQ ID NO: 117997 - RNA, 22 nt, Homo sapiens
agcagugugaaaugauuuaagg

SEQ ID NO: 117998 - RNA, 22 nt, Homo sapiens
agcaucacacacuacagggaaa

SEQ ID NO: 117999 - RNA, 22 nt, Homo sapiens
agcaucacaugggcugcuuggg

SEQ ID NO: 118000 - RNA, 21 nt, Homo sapiens
agccaguguuccuuguggcuc

SEQ ID NO: 118001 - RNA, 22 nt, Homo sapiens
agccaguuuggcuaauuuuggc

SEQ ID NO: 118002 - RNA, 22 nt, Homo sapiens
agccuguguugaauuauagaaa

SEQ ID NO: 118003 - RNA, 22 nt, Homo sapiens
agcggguuuuagauuucuccug

SEQ ID NO: 118004 - RNA, 22 nt, Homo sapiens
agcuauauugaggaugccauuc

SEQ ID NO: 118005 - RNA, 22 nt, Homo sapiens
agcucauugcaaccuccgccuc

SEQ ID NO: 118006 - RNA, 22 nt, Homo sapiens
agcugauuuuaaguccuugucc

SEQ ID NO: 118007 - RNA, 22 nt, Homo sapiens
agcuggauuguuuaccuggggc

SEQ ID NO: 118008 - RNA, 22 nt, Homo sapiens
agcuggcuguggagaaaccccu

SEQ ID NO: 118009 - RNA, 22 nt, Homo sapiens
agcuggucugauacuuaccucc

SEQ ID NO: 118010 - RNA, 22 nt, Homo sapiens
agcuucauuguuaugaauguca

SEQ ID NO: 118011 - RNA, 22 nt, Homo sapiens
agcuuguccuccacccacacug

SEQ ID NO: 118012 - RNA, 22 nt, Homo sapiens
agcuuuuugggaggccuuagga

SEQ ID NO: 118013 - RNA, 23 nt, Homo sapiens
aggaauggaaaaccaaguaucau

SEQ ID NO: 118014 - RNA, 21 nt, Homo sapiens
aggagcauucucuugcuuugu

SEQ ID NO: 118015 - RNA, 21 nt, Homo sapiens
aggcaaaugaagcagccgcuc

SEQ ID NO: 118016 - RNA, 22 nt, Homo sapiens
aggcaacaugguaaaacccugu

SEQ ID NO: 118017 - RNA, 22 nt, Homo sapiens
aggcagcuguuauauacugagu

SEQ ID NO: 118018 - RNA, 22 nt, Homo sapiens
aggcaugaaauacaugcauuga

SEQ ID NO: 118019 - RNA, 22 nt, Homo sapiens
aggcauguggcucuguucugac

SEQ ID NO: 118020 - RNA, 22 nt, Homo sapiens
aggcaugugugcagacugucug

SEQ ID NO: 118021 - RNA, 22 nt, Homo sapiens
aggccaguuuuuggagggaaac

SEQ ID NO: 118022 - RNA, 22 nt, Homo sapiens
agggcacuguagguccugccuc

SEQ ID NO: 118023 - RNA, 21 nt, Homo sapiens
aggucaugaagauguucuaau

SEQ ID NO: 118024 - RNA, 22 nt, Homo sapiens
aggugcucuuccuguaggucac

SEQ ID NO: 118025 - RNA, 22 nt, Homo sapiens
aguaaagccagaccuguuaauu

SEQ ID NO: 118026 - RNA, 22 nt, Homo sapiens
aguacacuguuaaaaagaagug

SEQ ID NO: 118027 - RNA, 22 nt, Homo sapiens
aguaccauuacucacuuauuuu

SEQ ID NO: 118028 - RNA, 20 nt, Homo sapiens
aguauucacuuuuuucaugg

SEQ ID NO: 118029 - RNA, 22 nt, Homo sapiens
agucauggaucacaguagccuc

SEQ ID NO: 118030 - RNA, 22 nt, Homo sapiens
agugcacuccagccugggcaac

SEQ ID NO: 118031 - RNA, 22 nt, Homo sapiens
agugcauuugcaucucaauaua

SEQ ID NO: 118032 - RNA, 22 nt, Homo sapiens
agugccauggcugcuagauggc

SEQ ID NO: 118033 - RNA, 22 nt, Homo sapiens
agugccuacuauguagaugcug

SEQ ID NO: 118034 - RNA, 22 nt, Homo sapiens
aguggauguuguggccugggag

SEQ ID NO: 118035 - RNA, 19 nt, Homo sapiens
aguggguguuuucuguuug

SEQ ID NO: 118036 - RNA, 22 nt, Homo sapiens
aguggugucugaguggccaggg

SEQ ID NO: 118037 - RNA, 22 nt, Homo sapiens
aguguuuuuacaagcacucugg

SEQ ID NO: 118038 - RNA, 22 nt, Homo sapiens
aguguuuuucaugggauacuuu

SEQ ID NO: 118039 - RNA, 19 nt, Homo sapiens
auaaacuagaacugucccc

SEQ ID NO: 118040 - RNA, 17 nt, Homo sapiens
auaaacucaucauuuuu

SEQ ID NO: 118041 - RNA, 22 nt, Homo sapiens
auaacucuguuuuuuucaugca

SEQ ID NO: 118042 - RNA, 22 nt, Homo sapiens
auaagauaguggaagugggauu

SEQ ID NO: 118043 - RNA, 22 nt, Homo sapiens
auaagaucauuugcuaagaggg

SEQ ID NO: 118044 - RNA, 22 nt, Homo sapiens
auaaggcagcugcuaaaaggca

SEQ ID NO: 118045 - RNA, 22 nt, Homo sapiens
auacaguugccauuucuugugc

SEQ ID NO: 118046 - RNA, 20 nt, Homo sapiens
auacccaguagcacaacagc

SEQ ID NO: 118047 - RNA, 22 nt, Homo sapiens
auacuguauaggauuguagccu

SEQ ID NO: 118048 - RNA, 20 nt, Homo sapiens
auagcagcaugauuuauagu

SEQ ID NO: 118049 - RNA, 22 nt, Homo sapiens
auagcagcucacuuauuuaugg

SEQ ID NO: 118050 - RNA, 22 nt, Homo sapiens
auagcagugugaaaauugacug

SEQ ID NO: 118051 - RNA, 22 nt, Homo sapiens
auaucaaggccauuuucuaaau

SEQ ID NO: 118052 - RNA, 22 nt, Homo sapiens
auaucacucccaauaucgcagg

SEQ ID NO: 118053 - RNA, 22 nt, Homo sapiens
auaucccuguauaagugaaugu

SEQ ID NO: 118054 - RNA, 22 nt, Homo sapiens
auauguaguauggaaacauugu

SEQ ID NO: 118055 - RNA, 22 nt, Homo sapiens
auauguucucauucauaugugg

SEQ ID NO: 118056 - RNA, 22 nt, Homo sapiens
auauuagguuggugcaaaagua

SEQ ID NO: 118057 - RNA, 22 nt, Homo sapiens
auauucaagugaggauggcuaa

SEQ ID NO: 118058 - RNA, 20 nt, Homo sapiens
aucaaagacuuagaggggga

SEQ ID NO: 118059 - RNA, 22 nt, Homo sapiens
aucaaagcagcauggcccaguc

SEQ ID NO: 118060 - RNA, 22 nt, Homo sapiens
aucaaaguuucccagaaguugu

SEQ ID NO: 118061 - RNA, 22 nt, Homo sapiens
aucaaguacuguacugaaagug

SEQ ID NO: 118062 - RNA, 22 nt, Homo sapiens
aucacaggucaaaucauuauuu

SEQ ID NO: 118063 - RNA, 22 nt, Homo sapiens
aucacaguggucagguauagau

SEQ ID NO: 118064 - RNA, 22 nt, Homo sapiens
aucaccauguguacauuagacc

SEQ ID NO: 118065 - RNA, 22 nt, Homo sapiens
aucagaaucucuagugggacca

SEQ ID NO: 118066 - RNA, 22 nt, Homo sapiens
aucagagugaaacaugggagau

SEQ ID NO: 118067 - RNA, 22 nt, Homo sapiens
aucagauuccacauuuuaucag

SEQ ID NO: 118068 - RNA, 22 nt, Homo sapiens
aucagauuccagaggcagcacc

SEQ ID NO: 118069 - RNA, 22 nt, Homo sapiens
aucaucaugcacuacagccugg

SEQ ID NO: 118070 - RNA, 22 nt, Homo sapiens
auccacagugucaauguuguga

SEQ ID NO: 118071 - RNA, 22 nt, Homo sapiens
aucccaguucagccucugacac

SEQ ID NO: 118072 - RNA, 20 nt, Homo sapiens
aucccauuccugaagauacu

SEQ ID NO: 118073 - RNA, 22 nt, Homo sapiens
aucccuagaaaaaucagcacau

SEQ ID NO: 118074 - RNA, 22 nt, Homo sapiens
auccugaagcuuuacugaauuc

SEQ ID NO: 118075 - RNA, 20 nt, Homo sapiens
aucucugggcaaaggaaaau

SEQ ID NO: 118076 - RNA, 22 nt, Homo sapiens
aucuguagauucagcacaagcu

SEQ ID NO: 118077 - RNA, 22 nt, Homo sapiens
augaaagguauguuuucuguga

SEQ ID NO: 118078 - RNA, 22 nt, Homo sapiens
augaaaguguguggaaacuuga

SEQ ID NO: 118079 - RNA, 22 nt, Homo sapiens
augaaauguaugagucuggguu

SEQ ID NO: 118080 - RNA, 20 nt, Homo sapiens
augaaggcaggugugaguuu

SEQ ID NO: 118081 - RNA, 22 nt, Homo sapiens
augaagucguuacuaccaauug

SEQ ID NO: 118082 - RNA, 22 nt, Homo sapiens
augaauacugcugcaaugaaca

SEQ ID NO: 118083 - RNA, 22 nt, Homo sapiens
augacaagaguguucagggaga

SEQ ID NO: 118084 - RNA, 22 nt, Homo sapiens
augaccaaagaaaugcuauagg

SEQ ID NO: 118085 - RNA, 22 nt, Homo sapiens
augacuuuucugaaaaccacca

SEQ ID NO: 118086 - RNA, 22 nt, Homo sapiens
augagcucauaaagagugauuu

SEQ ID NO: 118087 - RNA, 20 nt, Homo sapiens
augagcucaucuugaaaacc

SEQ ID NO: 118088 - RNA, 22 nt, Homo sapiens
augaggauagguuucuauuagg

SEQ ID NO: 118089 - RNA, 22 nt, Homo sapiens
augauauggucacccuuaugaa

SEQ ID NO: 118090 - RNA, 22 nt, Homo sapiens
augauauguuuguagcuaucuc

SEQ ID NO: 118091 - RNA, 22 nt, Homo sapiens
augaucauggaagugcacccau

SEQ ID NO: 118092 - RNA, 22 nt, Homo sapiens
augaucauggaaguuuuccugu

SEQ ID NO: 118093 - RNA, 22 nt, Homo sapiens
augauggagguagauuguccau

SEQ ID NO: 118094 - RNA, 22 nt, Homo sapiens
gauaacagauaaugucaguuau

SEQ ID NO: 118095 - RNA, 22 nt, Homo sapiens
gauaucuuuuguauggugagcu

SEQ ID NO: 118096 - RNA, 22 nt, Homo sapiens
gauauguuucuucaauaccuag

SEQ ID NO: 118097 - RNA, 22 nt, Homo sapiens
gaugaacugucuuacuacucac

SEQ ID NO: 118098 - RNA, 22 nt, Homo sapiens
gaugaggcuagagacaugugua

SEQ ID NO: 118099 - RNA, 22 nt, Homo sapiens
gaugaucaugaccuacagaugg

SEQ ID NO: 118100 - RNA, 22 nt, Homo sapiens
gaugcagcuaggauuugugaca

SEQ ID NO: 118101 - RNA, 22 nt, Homo sapiens
gaugguggucuacccuuucccu

SEQ ID NO: 118102 - RNA, 22 nt, Homo sapiens
gauuagugacguugagcacugu

SEQ ID NO: 118103 - RNA, 22 nt, Homo sapiens
gauuccacuuucugucucuaug

SEQ ID NO: 118104 - RNA, 22 nt, Homo sapiens
gauuguguucauaggcauguua

SEQ ID NO: 118105 - RNA, 22 nt, Homo sapiens
gcaaaugcuaugccauuuuaua

SEQ ID NO: 118106 - RNA, 22 nt, Homo sapiens
gcaagaguauuucaaggaagau

SEQ ID NO: 118107 - RNA, 22 nt, Homo sapiens
gcaauguuacugaauguguuuu

SEQ ID NO: 118108 - RNA, 22 nt, Homo sapiens
gcagaauugguuucuucuaagg

SEQ ID NO: 118109 - RNA, 20 nt, Homo sapiens
gcagcaccauauuucuaaga

SEQ ID NO: 118110 - RNA, 22 nt, Homo sapiens
gcagcagugcccuggauggaaa

SEQ ID NO: 118111 - RNA, 22 nt, Homo sapiens
gcagcagugugggcugaaccua

SEQ ID NO: 118112 - RNA, 22 nt, Homo sapiens
gcagugcaguggcgcgaucucg

SEQ ID NO: 118113 - RNA, 22 nt, Homo sapiens
gcagugcuggagcccccgugug

SEQ ID NO: 118114 - RNA, 22 nt, Homo sapiens
gcaguucuguaguugaaauuua

SEQ ID NO: 118115 - RNA, 22 nt, Homo sapiens
gcaucacagggagacaggccuc

SEQ ID NO: 118116 - RNA, 22 nt, Homo sapiens
gcauggauguugauggcugcug

SEQ ID NO: 118117 - RNA, 22 nt, Homo sapiens
gccauugcacuccagccuaggu

SEQ ID NO: 118118 - RNA, 22 nt, Homo sapiens
gccauugcacucuagccuaggu

SEQ ID NO: 118119 - RNA, 22 nt, Homo sapiens
gccuagagacuugguaucuugc

SEQ ID NO: 118120 - RNA, 23 nt, Homo sapiens
gcuaggagagaugaaacacaggu

SEQ ID NO: 118121 - RNA, 22 nt, Homo sapiens
gcuaggagauccacugcucucu

SEQ ID NO: 118122 - RNA, 22 nt, Homo sapiens
gcucaguuuccucagcugcaaa

SEQ ID NO: 118123 - RNA, 22 nt, Homo sapiens
gcuccuuugaguagcuucugug

SEQ ID NO: 118124 - RNA, 22 nt, Homo sapiens
gcugacagugguuauacuuaga

SEQ ID NO: 118125 - RNA, 22 nt, Homo sapiens
gcugcacuuuaaggcauccccu

SEQ ID NO: 118126 - RNA, 22 nt, Homo sapiens
gcugcguguagaguucucacug

SEQ ID NO: 118127 - RNA, 22 nt, Homo sapiens
gcuguauugacuuuguaucaua

SEQ ID NO: 118128 - RNA, 22 nt, Homo sapiens
gcuucauggaggcugggcgcag

SEQ ID NO: 118129 - RNA, 22 nt, Homo sapiens
gcuuggugugcaagugguacua

SEQ ID NO: 118130 - RNA, 22 nt, Homo sapiens
gcuuguguucaagucacccuua

SEQ ID NO: 118131 - RNA, 22 nt, Homo sapiens
gcuuguguuuacuguaguuacu

SEQ ID NO: 118132 - RNA, 22 nt, Homo sapiens
gcuuguguuugcuccccagaau

SEQ ID NO: 118133 - RNA, 22 nt, Homo sapiens
gcuuugcaauggcauugaccau

SEQ ID NO: 118134 - RNA, 22 nt, Homo sapiens
gcuuugguucaaccaggcaauu

SEQ ID NO: 118135 - RNA, 22 nt, Homo sapiens
ggaauauaaaacuuuugacagg

SEQ ID NO: 118136 - RNA, 22 nt, Homo sapiens
ggaauguuaaagacuacacuga

SEQ ID NO: 118137 - RNA, 22 nt, Homo sapiens
ggacaagagacugggacacuga

SEQ ID NO: 118138 - RNA, 22 nt, Homo sapiens
ggacauuaacugcaagauagau

SEQ ID NO: 118139 - RNA, 22 nt, Homo sapiens
ggacuggaagcauauuuauuuu

SEQ ID NO: 118140 - RNA, 22 nt, Homo sapiens
ggagaguaauuagacugaaaga

SEQ ID NO: 118141 - RNA, 22 nt, Homo sapiens
ggagagugacauauuucuaggc

SEQ ID NO: 118142 - RNA, 22 nt, Homo sapiens
ggagaugaaaugagcuacuuaa

SEQ ID NO: 118143 - RNA, 22 nt, Homo sapiens
ggagaugauuaugaaucacuua

SEQ ID NO: 118144 - RNA, 22 nt, Homo sapiens
ggcaagaaagaaaucaucuguc

SEQ ID NO: 118145 - RNA, 22 nt, Homo sapiens
ggcagaucauuggccucaguuu

SEQ ID NO: 118146 - RNA, 22 nt, Homo sapiens
ggcagcuguguccuucguaagg

SEQ ID NO: 118147 - RNA, 22 nt, Homo sapiens
ggcaguuuggcaguuucauaaa

SEQ ID NO: 118148 - RNA, 22 nt, Homo sapiens
ggcaugaaguagcccacaggca

SEQ ID NO: 118149 - RNA, 21 nt, Homo sapiens
ggcaugaauggaaaagugaga

SEQ ID NO: 118150 - RNA, 22 nt, Homo sapiens
ggcuagagaauagugccacuaa

SEQ ID NO: 118151 - RNA, 22 nt, Homo sapiens
ggcuagagagcucagggauaug

SEQ ID NO: 118152 - RNA, 21 nt, Homo sapiens
ggcucuguggucucagguuuc

SEQ ID NO: 118153 - RNA, 22 nt, Homo sapiens
ggcuuuggucacacaggggcaa

SEQ ID NO: 118154 - RNA, 22 nt, Homo sapiens
gggaggucauuguucaaugcug

SEQ ID NO: 118155 - RNA, 20 nt, Homo sapiens
gggcaaguaugugggaaguc

SEQ ID NO: 118156 - RNA, 18 nt, Homo sapiens
gggcaaguugccuggcuu

SEQ ID NO: 118157 - RNA, 22 nt, Homo sapiens
gggcaugauggugcacacaugu

SEQ ID NO: 118158 - RNA, 22 nt, Homo sapiens
gggccagaugcauuuguuauuu

SEQ ID NO: 118159 - RNA, 22 nt, Homo sapiens
ggucaguuuucuccaggaucca

SEQ ID NO: 118160 - RNA, 22 nt, Homo sapiens
ggucauggauaagauccagaag

SEQ ID NO: 118161 - RNA, 22 nt, Homo sapiens
ggugacagugguuaaaauuugu

SEQ ID NO: 118162 - RNA, 23 nt, Homo sapiens
ggugaggaguacagagucuucau

SEQ ID NO: 118163 - RNA, 22 nt, Homo sapiens
ggugagguaguaagguacaaua

SEQ ID NO: 118164 - RNA, 19 nt, Homo sapiens
gguucaguuuauaaagaug

SEQ ID NO: 118165 - RNA, 22 nt, Homo sapiens
guaacacaugcugcucucuggu

SEQ ID NO: 118166 - RNA, 22 nt, Homo sapiens
guacaguucucuuuguugucag

SEQ ID NO: 118167 - RNA, 22 nt, Homo sapiens
guacaguuuucaguguucacug

SEQ ID NO: 118168 - RNA, 22 nt, Homo sapiens
guagcagccacacuugauaacu

SEQ ID NO: 118169 - RNA, 22 nt, Homo sapiens
guaguggcaugaucuuggcuca

SEQ ID NO: 118170 - RNA, 22 nt, Homo sapiens
guauuagaugguauuugaagau

SEQ ID NO: 118171 - RNA, 22 nt, Homo sapiens
gucaaaugcacagaaccauuaa

SEQ ID NO: 118172 - RNA, 22 nt, Homo sapiens
gucagugugauaucugcagggg

SEQ ID NO: 118173 - RNA, 22 nt, Homo sapiens
gucaguuucacucagcuggaac

SEQ ID NO: 118174 - RNA, 22 nt, Homo sapiens
gucaucaucaguccucugugca

SEQ ID NO: 118175 - RNA, 22 nt, Homo sapiens
gucauccaggcuggagugaagc

SEQ ID NO: 118176 - RNA, 22 nt, Homo sapiens
gucauucauucagcaagcacug

SEQ ID NO: 118177 - RNA, 22 nt, Homo sapiens
gucccaguggaaccuccaagcu

SEQ ID NO: 118178 - RNA, 22 nt, Homo sapiens
gucccugcgauugugggauccu

SEQ ID NO: 118179 - RNA, 22 nt, Homo sapiens
gucuagaacuucugaccuuagg

SEQ ID NO: 118180 - RNA, 22 nt, Homo sapiens
gucucagugcgaaucucaaaga

SEQ ID NO: 118181 - RNA, 22 nt, Homo sapiens
gucucugagaugucaacaccua

SEQ ID NO: 118182 - RNA, 22 nt, Homo sapiens
gucuguuugauccagaucaaaa

SEQ ID NO: 118183 - RNA, 21 nt, Homo sapiens
gucuuacagccagaugccucu

SEQ ID NO: 118184 - RNA, 22 nt, Homo sapiens
gucuuagguuuaaucacuucua

SEQ ID NO: 118185 - RNA, 22 nt, Homo sapiens
gugaaagacagcauuaauggcu

SEQ ID NO: 118186 - RNA, 22 nt, Homo sapiens
gugaaaugaaucuggaaauauu

SEQ ID NO: 118187 - RNA, 22 nt, Homo sapiens
gugaaauguguagaggaucugg

SEQ ID NO: 118188 - RNA, 22 nt, Homo sapiens
gugaacuguuugaggaagagaa

SEQ ID NO: 118189 - RNA, 22 nt, Homo sapiens
gugaagugugaccucagcaucu

SEQ ID NO: 118190 - RNA, 22 nt, Homo sapiens
gugaauagggaauaaugggauc

SEQ ID NO: 118191 - RNA, 22 nt, Homo sapiens
gugagaacugcuggggccacag

SEQ ID NO: 118192 - RNA, 22 nt, Homo sapiens
gugagaaucaaacuacauaaau

SEQ ID NO: 118193 - RNA, 22 nt, Homo sapiens
gugagauggaguuggugucuuu

SEQ ID NO: 118194 - RNA, 22 nt, Homo sapiens
gugaggcuuuuccuguuagacu

SEQ ID NO: 118195 - RNA, 22 nt, Homo sapiens
gugagggagcuggaauauuuau

SEQ ID NO: 118196 - RNA, 21 nt, Homo sapiens
uaauggcaugaucucggcuca

SEQ ID NO: 118197 - RNA, 16 nt, Homo sapiens
uacaauguagaaaaca

SEQ ID NO: 118198 - RNA, 22 nt, Homo sapiens
uacagaauucugucccuugagu

SEQ ID NO: 118199 - RNA, 23 nt, Homo sapiens
uacagcugcagaaucaggcuaag

SEQ ID NO: 118200 - RNA, 22 nt, Homo sapiens
uacaggaaugucagguugcugu

SEQ ID NO: 118201 - RNA, 19 nt, Homo sapiens
uacaggacugagcugaggu

SEQ ID NO: 118202 - RNA, 22 nt, Homo sapiens
uacagucauaaugccuagugac

SEQ ID NO: 118203 - RNA, 22 nt, Homo sapiens
uacagugcauagaggcaugaua

SEQ ID NO: 118204 - RNA, 22 nt, Homo sapiens
uacagugcuugguaucuaguaa

SEQ ID NO: 118205 - RNA, 22 nt, Homo sapiens
uacagugcuuuuugguggagaa

SEQ ID NO: 118206 - RNA, 22 nt, Homo sapiens
uaccaaguauuuucacaugaac

SEQ ID NO: 118207 - RNA, 22 nt, Homo sapiens
uacugcacauaugaagguuccc

SEQ ID NO: 118208 - RNA, 18 nt, Homo sapiens
uacugcacucuccagccu

SEQ ID NO: 118209 - RNA, 22 nt, Homo sapiens
uagacaacugaaacacugugca

SEQ ID NO: 118210 - RNA, 22 nt, Homo sapiens
uagaggaaggauuggaaacgca

SEQ ID NO: 118211 - RNA, 22 nt, Homo sapiens
uagaggaaugaauuuggccaga

SEQ ID NO: 118212 - RNA, 19 nt, Homo sapiens
uagaugucuuugcauagau

SEQ ID NO: 118213 - RNA, 23 nt, Homo sapiens
uagcuucucccagaccugcuccc

SEQ ID NO: 118214 - RNA, 22 nt, Homo sapiens
uaggagugugaacccuaugaac

SEQ ID NO: 118215 - RNA, 22 nt, Homo sapiens
uaggcagccagcuguggauuga

SEQ ID NO: 118216 - RNA, 22 nt, Homo sapiens
uaggcuguguggccguggggcu

SEQ ID NO: 118217 - RNA, 22 nt, Homo sapiens
uagggaguguccuuucgggaaa

SEQ ID NO: 118218 - RNA, 22 nt, Homo sapiens
uaguauguuuauagcauugagu

SEQ ID NO: 118219 - RNA, 22 nt, Homo sapiens
uagugcccuuauaagagcagga

SEQ ID NO: 118220 - RNA, 22 nt, Homo sapiens
uagugcuagaugacuuugccau

SEQ ID NO: 118221 - RNA, 20 nt, Homo sapiens
uaguggaaaucagguccucu

SEQ ID NO: 118222 - RNA, 22 nt, Homo sapiens
uaguggauguucagagauuuga

SEQ ID NO: 118223 - RNA, 22 nt, Homo sapiens
uaguugcaucuuaggucuguga

SEQ ID NO: 118224 - RNA, 23 nt, Homo sapiens
uauaacuuuuaauuuacuggccu

SEQ ID NO: 118225 - RNA, 22 nt, Homo sapiens
uauacaguaggcacucaguggc

SEQ ID NO: 118226 - RNA, 22 nt, Homo sapiens
uauacugucuuuguaugccuag

SEQ ID NO: 118227 - RNA, 22 nt, Homo sapiens
uauacuguuuucuauaguggcu

SEQ ID NO: 118228 - RNA, 22 nt, Homo sapiens
uauagcauuuugauccuguaga

SEQ ID NO: 118229 - RNA, 22 nt, Homo sapiens
uauagcuagucacugcuggauu

SEQ ID NO: 118230 - RNA, 22 nt, Homo sapiens
uauauguucugugucccuuucg

SEQ ID NO: 118231 - RNA, 22 nt, Homo sapiens
uaucacacuggaagaaguuaag

SEQ ID NO: 118232 - RNA, 22 nt, Homo sapiens
uaucacagauucuccaggguuu

SEQ ID NO: 118233 - RNA, 22 nt, Homo sapiens
uaucacaguaucuagcacagug

SEQ ID NO: 118234 - RNA, 22 nt, Homo sapiens
uaucccuuagagcggggugguu

SEQ ID NO: 118235 - RNA, 18 nt, Homo sapiens
uaucucauuucuuagguc

SEQ ID NO: 118236 - RNA, 22 nt, Homo sapiens
uaugaagccaggauuuauuauu

SEQ ID NO: 118237 - RNA, 22 nt, Homo sapiens
uauggcaaugcauaggaaggaa

SEQ ID NO: 118238 - RNA, 22 nt, Homo sapiens
uaugucacuggacauaaguucu

SEQ ID NO: 118239 - RNA, 22 nt, Homo sapiens
uaugugcacaugcccuggugac

SEQ ID NO: 118240 - RNA, 22 nt, Homo sapiens
uauuccuuuugcauuuccacau

SEQ ID NO: 118241 - RNA, 22 nt, Homo sapiens
uauugauuaauugugauuaggc

SEQ ID NO: 118242 - RNA, 22 nt, Homo sapiens
uauugauuuucaguguucagcu

SEQ ID NO: 118243 - RNA, 22 nt, Homo sapiens
uauuucaguugugcagguaguu

SEQ ID NO: 118244 - RNA, 22 nt, Homo sapiens
ucaacauugcugucaggcaucu

SEQ ID NO: 118245 - RNA, 22 nt, Homo sapiens
ucaacguauuuauauagcagag

SEQ ID NO: 118246 - RNA, 22 nt, Homo sapiens
ucaaguaauacucccaucuugg

SEQ ID NO: 118247 - RNA, 22 nt, Homo sapiens
ucacacucucaccaacauuugg

SEQ ID NO: 118248 - RNA, 22 nt, Homo sapiens
ucacacugaauuugaagcaaug

SEQ ID NO: 118249 - RNA, 22 nt, Homo sapiens
ucaccaccuuccaggaccacug

SEQ ID NO: 118250 - RNA, 22 nt, Homo sapiens
ucacugcacuucaggcuuucuc

SEQ ID NO: 118251 - RNA, 22 nt, Homo sapiens
ucacuggacucuagccugggug

SEQ ID NO: 118252 - RNA, 22 nt, Homo sapiens
ucacugggagcauuugagccuu

SEQ ID NO: 118253 - RNA, 22 nt, Homo sapiens
ucacuggucuaaguggaggggg

SEQ ID NO: 118254 - RNA, 22 nt, Homo sapiens
ucacuguguauguauaugcagg

SEQ ID NO: 118255 - RNA, 22 nt, Homo sapiens
ucagagucuagaucacucacug

SEQ ID NO: 118256 - RNA, 22 nt, Homo sapiens
ucagaucacuggcgcuggcgga

SEQ ID NO: 118257 - RNA, 22 nt, Homo sapiens
ucagaugauuccguugacgaga

SEQ ID NO: 118258 - RNA, 22 nt, Homo sapiens
ucagcagugugaaaacaaacua

SEQ ID NO: 118259 - RNA, 22 nt, Homo sapiens
ucaggcacuaguaagaaaaagg

SEQ ID NO: 118260 - RNA, 22 nt, Homo sapiens
ucaggcuuuucccagagugaug

SEQ ID NO: 118261 - RNA, 22 nt, Homo sapiens
ucagguaaucuauuugucuuuu

SEQ ID NO: 118262 - RNA, 22 nt, Homo sapiens
ucaggugcagagaagaaauggg

SEQ ID NO: 118263 - RNA, 22 nt, Homo sapiens
ucagugaauacauguacucaug

SEQ ID NO: 118264 - RNA, 22 nt, Homo sapiens
ucagugacugcugcuuguauac

SEQ ID NO: 118265 - RNA, 22 nt, Homo sapiens
ucaguggacuuagucuuucccc

SEQ ID NO: 118266 - RNA, 22 nt, Homo sapiens
ucaguggagagcuuccaggauu

SEQ ID NO: 118267 - RNA, 22 nt, Homo sapiens
ucaguggauuuaaccugaauca

SEQ ID NO: 118268 - RNA, 22 nt, Homo sapiens
ucagugucaucuggguuguuug

SEQ ID NO: 118269 - RNA, 22 nt, Homo sapiens
ucagugucugcauucuuauugu

SEQ ID NO: 118270 - RNA, 22 nt, Homo sapiens
ucaguguuuggaaucucaauuu

SEQ ID NO: 118271 - RNA, 22 nt, Homo sapiens
ucauaguagucacuuaauaaau

SEQ ID NO: 118272 - RNA, 22 nt, Homo sapiens
ucaugacacagcauacugacuu

SEQ ID NO: 118273 - RNA, 22 nt, Homo sapiens
ucauggcacugaugagaguuuc

SEQ ID NO: 118274 - RNA, 18 nt, Homo sapiens
uccauugcagcauuauuu

SEQ ID NO: 118275 - RNA, 23 nt, Homo sapiens
ucccaagauggaccagaccaagg

SEQ ID NO: 118276 - RNA, 22 nt, Homo sapiens
ucccauguagcuaggauuacag

SEQ ID NO: 118277 - RNA, 22 nt, Homo sapiens
ucccuacugggguacugccuag

SEQ ID NO: 118278 - RNA, 22 nt, Homo sapiens
ucccugacagggucugagcuuu

SEQ ID NO: 118279 - RNA, 22 nt, Homo sapiens
ucccugaguaucuaauguguuu

SEQ ID NO: 118280 - RNA, 22 nt, Homo sapiens
ucccuuuguccaacggauccac

SEQ ID NO: 118281 - RNA, 22 nt, Homo sapiens
uccuucacucuacaucuuuguu

SEQ ID NO: 118282 - RNA, 19 nt, Homo sapiens
ucuaaaucucuugauagac

SEQ ID NO: 118283 - RNA, 17 nt, Homo sapiens
ucuaauaauaugcauuu

SEQ ID NO: 118284 - RNA, 22 nt, Homo sapiens
ucuaauguaaccugcaaauauu

SEQ ID NO: 118285 - RNA, 22 nt, Homo sapiens
ucucaaguaacugggacaauaa

SEQ ID NO: 118286 - RNA, 22 nt, Homo sapiens
ucucacacugaauguguguggg

SEQ ID NO: 118287 - RNA, 22 nt, Homo sapiens
ucuccauuguccagaugaggaa

SEQ ID NO: 118288 - RNA, 20 nt, Homo sapiens
ucucccaaacagcaggcccu

SEQ ID NO: 118289 - RNA, 22 nt, Homo sapiens
ucucccauccaugaacuucugu

SEQ ID NO: 118290 - RNA, 22 nt, Homo sapiens
ucuccggguggcggcgaaggga

SEQ ID NO: 118291 - RNA, 22 nt, Homo sapiens
ucucugagaaaaguuucuccca

SEQ ID NO: 118292 - RNA, 22 nt, Homo sapiens
ucucuggauaucuacuuauguu

SEQ ID NO: 118293 - RNA, 22 nt, Homo sapiens
ucugcaagucuaaacuagccau

SEQ ID NO: 118294 - RNA, 22 nt, Homo sapiens
ucugccacugucauugugugau

SEQ ID NO: 118295 - RNA, 23 nt, Homo sapiens
ucuggaucauucguagugccagc

SEQ ID NO: 118296 - RNA, 22 nt, Homo sapiens
ucugucacugaaucccugucac

SEQ ID NO: 118297 - RNA, 22 nt, Homo sapiens
ucuguugguucuuugaggagga

SEQ ID NO: 118298 - RNA, 22 nt, Homo sapiens
uguuacagugacuaauguuuua

SEQ ID NO: 118299 - RNA, 22 nt, Homo sapiens
uguucacaguguuucuuugaga

SEQ ID NO: 118300 - RNA, 22 nt, Homo sapiens
uguucuggagaguuuagucugg

SEQ ID NO: 118301 - RNA, 22 nt, Homo sapiens
uuaaauacagcaugguguuucu

SEQ ID NO: 118302 - RNA, 22 nt, Homo sapiens
uuaaaugcucacauaaagguag

SEQ ID NO: 118303 - RNA, 22 nt, Homo sapiens
uuaacacugccauugauacugu

SEQ ID NO: 118304 - RNA, 22 nt, Homo sapiens
uuaacagucacuuagcucauuu

SEQ ID NO: 118305 - RNA, 22 nt, Homo sapiens
uuaaggaaggagucuuaaaugg

SEQ ID NO: 118306 - RNA, 22 nt, Homo sapiens
uuaaggcuuguacuuguuuucu

SEQ ID NO: 118307 - RNA, 22 nt, Homo sapiens
uuaaugcuuggggaguaguucu

SEQ ID NO: 118308 - RNA, 22 nt, Homo sapiens
uuaauguaauugauugauugac

SEQ ID NO: 118309 - RNA, 22 nt, Homo sapiens
uuaauguaucuaucacaucaca

SEQ ID NO: 118310 - RNA, 22 nt, Homo sapiens
uuacagauggauggcagcuggc

SEQ ID NO: 118311 - RNA, 22 nt, Homo sapiens
uuacauguuguggguuguggcc

SEQ ID NO: 118312 - RNA, 22 nt, Homo sapiens
uuacugcauaauuccugggaag

SEQ ID NO: 118313 - RNA, 22 nt, Homo sapiens
uuagguagucucugucagaggg

SEQ ID NO: 118314 - RNA, 22 nt, Homo sapiens
uuaguagcacagaguaucagca

SEQ ID NO: 118315 - RNA, 22 nt, Homo sapiens
uuauaaacaugaagauuugggg

SEQ ID NO: 118316 - RNA, 22 nt, Homo sapiens
uuauacacugugggaguguaaa

SEQ ID NO: 118317 - RNA, 22 nt, Homo sapiens
uuauggcuauugaugacaauug

SEQ ID NO: 118318 - RNA, 22 nt, Homo sapiens
uucaauacuguugauccuuaug

SEQ ID NO: 118319 - RNA, 22 nt, Homo sapiens
uucaccuguagcaugcccuugg

SEQ ID NO: 118320 - RNA, 20 nt, Homo sapiens
uucacugggcucucuguugg

SEQ ID NO: 118321 - RNA, 22 nt, Homo sapiens
uucacugggugugguggcucac

SEQ ID NO: 118322 - RNA, 22 nt, Homo sapiens
uucacugugcuuaaauucugcu

SEQ ID NO: 118323 - RNA, 22 nt, Homo sapiens
uucagaugcacacuguagucua

SEQ ID NO: 118324 - RNA, 22 nt, Homo sapiens
uucaggcaccauggucauugau

SEQ ID NO: 118325 - RNA, 22 nt, Homo sapiens
uucagggacuuuagacaagaga

SEQ ID NO: 118326 - RNA, 22 nt, Homo sapiens
uucaguagucaaaagauaaggg

SEQ ID NO: 118327 - RNA, 22 nt, Homo sapiens
uucaguggacuuaguagugcuu

SEQ ID NO: 118328 - RNA, 22 nt, Homo sapiens
uucaguggagaggcugaguggu

SEQ ID NO: 118329 - RNA, 22 nt, Homo sapiens
uucauagaggacauuacuggag

SEQ ID NO: 118330 - RNA, 22 nt, Homo sapiens
uucauaguaacaguaacuaugg

SEQ ID NO: 118331 - RNA, 22 nt, Homo sapiens
uucauagugaaaaauucaaagu

SEQ ID NO: 118332 - RNA, 22 nt, Homo sapiens
uucauaguucuuuuagucauua

SEQ ID NO: 118333 - RNA, 22 nt, Homo sapiens
uucaucagggagaaauaauuuc

SEQ ID NO: 118334 - RNA, 22 nt, Homo sapiens
uucaucuggcaauucagagauu

SEQ ID NO: 118335 - RNA, 20 nt, Homo sapiens
uucaugggagcaaagaggcc

SEQ ID NO: 118336 - RNA, 22 nt, Homo sapiens
uucauguaauuccauaagguaa

SEQ ID NO: 118337 - RNA, 22 nt, Homo sapiens
uuccacuuuuuccuugugcucc

SEQ ID NO: 118338 - RNA, 21 nt, Homo sapiens
uuccagugagccuagaugccu

SEQ ID NO: 118339 - RNA, 22 nt, Homo sapiens
uuccagugggacgagaugugga

SEQ ID NO: 118340 - RNA, 22 nt, Homo sapiens
uuccaguuauuauaccucuuaa

SEQ ID NO: 118341 - RNA, 22 nt, Homo sapiens
uucccugaaguguuacucuaga

SEQ ID NO: 118342 - RNA, 22 nt, Homo sapiens
uucccuugcaggaugaucugga

SEQ ID NO: 118343 - RNA, 22 nt, Homo sapiens
uucccuuucugccuugaaucuu

SEQ ID NO: 118344 - RNA, 22 nt, Homo sapiens
uuccuugagagcuugauaucac

SEQ ID NO: 118345 - RNA, 20 nt, Homo sapiens
uucuacagucacaggaagau

SEQ ID NO: 118346 - RNA, 22 nt, Homo sapiens
uucuacagugacugcagccaua

SEQ ID NO: 118347 - RNA, 22 nt, Homo sapiens
uucucagcccccugacagucag

SEQ ID NO: 118348 - RNA, 22 nt, Homo sapiens
uucucugggacauaggucgggu

SEQ ID NO: 118349 - RNA, 22 nt, Homo sapiens
uucucuguggauugggugagag

SEQ ID NO: 118350 - RNA, 22 nt, Homo sapiens
uucugugcuuguggaugaagug

SEQ ID NO: 118351 - RNA, 22 nt, Homo sapiens
uucugugguugaaaggagagau

SEQ ID NO: 118352 - RNA, 18 nt, Homo sapiens
uucuuguguugauauuuu

SEQ ID NO: 118353 - RNA, 22 nt, Homo sapiens
uucuuuaguucacuugcuccag

SEQ ID NO: 118354 - RNA, 22 nt, Homo sapiens
uucuuugcaugaucucaaaguc

SEQ ID NO: 118355 - RNA, 21 nt, Homo sapiens
uucuuugcucaguguuagagu

SEQ ID NO: 118356 - RNA, 22 nt, Homo sapiens
uugaaagcuaucagagauucca

SEQ ID NO: 118357 - RNA, 22 nt, Homo sapiens
uugaaagucauuucuucuaagu

SEQ ID NO: 118358 - RNA, 22 nt, Homo sapiens
uugaaaucuuccacagcccaag

SEQ ID NO: 118359 - RNA, 22 nt, Homo sapiens
uugaacugguaguuggaaaucu

SEQ ID NO: 118360 - RNA, 22 nt, Homo sapiens
uugaagacuaaguuaucaggau

SEQ ID NO: 118361 - RNA, 22 nt, Homo sapiens
uugaagacuauaugauucuuca

SEQ ID NO: 118362 - RNA, 22 nt, Homo sapiens
uugaaguauagaguuuaagaac

SEQ ID NO: 118363 - RNA, 18 nt, Homo sapiens
uugaauaguguccaaucu

SEQ ID NO: 118364 - RNA, 22 nt, Homo sapiens
uugaauguguugggaagcccuu

SEQ ID NO: 118365 - RNA, 22 nt, Homo sapiens
uugacuguaagauggcuauuac

SEQ ID NO: 118366 - RNA, 22 nt, Homo sapiens
uugagaugauggauaugcuaau

SEQ ID NO: 118367 - RNA, 22 nt, Homo sapiens
uugagauggugccacuguacuc

SEQ ID NO: 118368 - RNA, 19 nt, Homo sapiens
uugagaugugaacucacac

SEQ ID NO: 118369 - RNA, 22 nt, Homo sapiens
uugagcucuucuagcaauucua

SEQ ID NO: 118370 - RNA, 22 nt, Homo sapiens
uugaggaggcagucuucccauu

SEQ ID NO: 118371 - RNA, 23 nt, Homo sapiens
uugaggcauguaccaucaauauc

SEQ ID NO: 118372 - RNA, 22 nt, Homo sapiens
uugaggugggaggaucacuuga

SEQ ID NO: 118373 - RNA, 22 nt, Homo sapiens
uugauauguguauagcaugugg

SEQ ID NO: 118374 - RNA, 22 nt, Homo sapiens
uugauauucuuucuggauccca

SEQ ID NO: 118375 - RNA, 22 nt, Homo sapiens
uugcacagucuagcuccaccuu

SEQ ID NO: 118376 - RNA, 22 nt, Homo sapiens
uugcacuccagccugggugaca

SEQ ID NO: 118377 - RNA, 22 nt, Homo sapiens
uugcacuccagccuuggggaga

SEQ ID NO: 118378 - RNA, 22 nt, Homo sapiens
uugcacuccagcucuaggugac

SEQ ID NO: 118379 - RNA, 22 nt, Homo sapiens
uugcacuccauccuggguugac

SEQ ID NO: 118380 - RNA, 20 nt, Homo sapiens
uugcagagcccaacccugga

SEQ ID NO: 118381 - RNA, 22 nt, Homo sapiens
uugcauugacacaugaagcuca

SEQ ID NO: 118382 - RNA, 22 nt, Homo sapiens
uugccauggaguagaauugaag

SEQ ID NO: 118383 - RNA, 22 nt, Homo sapiens
uugccugagaagccaagaauaa

SEQ ID NO: 118384 - RNA, 22 nt, Homo sapiens
uuggaaaccucugcagguguuu

SEQ ID NO: 118385 - RNA, 22 nt, Homo sapiens
uuggaaagagguguuuaugacu

SEQ ID NO: 118386 - RNA, 22 nt, Homo sapiens
uuggaaaugguaaaggguuaau

SEQ ID NO: 118387 - RNA, 22 nt, Homo sapiens
uuggaauguauggcaucuugcg

SEQ ID NO: 118388 - RNA, 22 nt, Homo sapiens
uuggacagaugguuacauuuuu

SEQ ID NO: 118389 - RNA, 22 nt, Homo sapiens
uuggacugagaguuccaccauu

SEQ ID NO: 118390 - RNA, 22 nt, Homo sapiens
uuggcaauauuuacugaaguug

SEQ ID NO: 118391 - RNA, 22 nt, Homo sapiens
uuggcaauucagauucuuuuau

SEQ ID NO: 118392 - RNA, 22 nt, Homo sapiens
uuggcaauugcuaugauuugaa

SEQ ID NO: 118393 - RNA, 21 nt, Homo sapiens
uuggcacucuucucuccuuau

SEQ ID NO: 118394 - RNA, 22 nt, Homo sapiens
uuggcagcauuccagccaagca

SEQ ID NO: 118395 - RNA, 22 nt, Homo sapiens
uuggccccucccaaauuucaug

SEQ ID NO: 118396 - RNA, 22 nt, Homo sapiens
uuggccccuuucauccacagcu

SEQ ID NO: 118397 - RNA, 22 nt, Homo sapiens
uuggcuucuggacuauugugca

SEQ ID NO: 118398 - RNA, 22 nt, Homo sapiens
uugggacuggaaggaguaaggg

SEQ ID NO: 118399 - RNA, 22 nt, Homo sapiens
uugggcaauaggaagcaggugg

SEQ ID NO: 118400 - RNA, 22 nt, Homo sapiens
aaaacgcauccucacaggucug

SEQ ID NO: 118401 - RNA, 22 nt, Homo sapiens
aaaaggcuagcuaguaacagaa

SEQ ID NO: 118402 - RNA, 22 nt, Homo sapiens
aaacauugaccucauccuggca

SEQ ID NO: 118403 - RNA, 15 nt, Homo sapiens
aaacccugucucaag

SEQ ID NO: 118404 - RNA, 22 nt, Homo sapiens
aaagcaucacuuuuccuacuuu

SEQ ID NO: 118405 - RNA, 22 nt, Homo sapiens
aaagcuagagaagcugcuguca

SEQ ID NO: 118406 - RNA, 22 nt, Homo sapiens
aaaguacugggauuggccgggu

SEQ ID NO: 118407 - RNA, 22 nt, Homo sapiens
aaagucacuggagaaggaauau

SEQ ID NO: 118408 - RNA, 22 nt, Homo sapiens
aaagucuagaggaucaugugug

SEQ ID NO: 118409 - RNA, 22 nt, Homo sapiens
aaagugcaguauuugggcagaa

SEQ ID NO: 118410 - RNA, 22 nt, Homo sapiens
aaagugcaguauuugggcagga

SEQ ID NO: 118411 - RNA, 22 nt, Homo sapiens
aaagugccugacucauaguuag

SEQ ID NO: 118412 - RNA, 22 nt, Homo sapiens
aaagugcugggauuaggccagg

SEQ ID NO: 118413 - RNA, 22 nt, Homo sapiens
aaauccauuuguucagcuaugc

SEQ ID NO: 118414 - RNA, 22 nt, Homo sapiens
aaaugcagauucugcuuagguu

SEQ ID NO: 118415 - RNA, 22 nt, Homo sapiens
aaaugcagcacucaagugggaa

SEQ ID NO: 118416 - RNA, 22 nt, Homo sapiens
aaaugcauggacagcuggucuu

SEQ ID NO: 118417 - RNA, 22 nt, Homo sapiens
aaaugcugucaaauuguguucu

SEQ ID NO: 118418 - RNA, 22 nt, Homo sapiens
aaaugguguuaguagaucuuua

SEQ ID NO: 118419 - RNA, 22 nt, Homo sapiens
aacaccauucucuguaacaaga

SEQ ID NO: 118420 - RNA, 22 nt, Homo sapiens
aacagugcauuccuguccauau

SEQ ID NO: 118421 - RNA, 22 nt, Homo sapiens
aacaucaaccaugaggguugga

SEQ ID NO: 118422 - RNA, 22 nt, Homo sapiens
aacuggcauauucugguugcgg

SEQ ID NO: 118423 - RNA, 22 nt, Homo sapiens
aagcuccauuucugccaugaga

SEQ ID NO: 118424 - RNA, 22 nt, Homo sapiens
aagcuggauuuaguguggagca

SEQ ID NO: 118425 - RNA, 22 nt, Homo sapiens
aagcuguguguaagcucucaca

SEQ ID NO: 118426 - RNA, 22 nt, Homo sapiens
aaggaagcuagcaggaauuggu

SEQ ID NO: 118427 - RNA, 22 nt, Homo sapiens
aaggagcaguggacggguccua

SEQ ID NO: 118428 - RNA, 22 nt, Homo sapiens
aaggauuguaacaccaagguua

SEQ ID NO: 118429 - RNA, 22 nt, Homo sapiens
aaggcaagagaaaauuucgagu

SEQ ID NO: 118430 - RNA, 22 nt, Homo sapiens
aaggcaagauacugguugcuga

SEQ ID NO: 118431 - RNA, 22 nt, Homo sapiens
aaggcaagguggauaaugaagc

SEQ ID NO: 118432 - RNA, 22 nt, Homo sapiens
aaggcagucacuaaauagugag

SEQ ID NO: 118433 - RNA, 22 nt, Homo sapiens
aaggcaguggcagaagauguca

SEQ ID NO: 118434 - RNA, 22 nt, Homo sapiens
aaggcagugugcacauaacacu

SEQ ID NO: 118435 - RNA, 22 nt, Homo sapiens
aagggaauguuguggcugguug

SEQ ID NO: 118436 - RNA, 22 nt, Homo sapiens
aagggagcugcauaaucuugug

SEQ ID NO: 118437 - RNA, 22 nt, Homo sapiens
aaggugguuuucucuuggaguc

SEQ ID NO: 118438 - RNA, 22 nt, Homo sapiens
aagucaguuugggagaagcuau

SEQ ID NO: 118439 - RNA, 22 nt, Homo sapiens
aagugaaugaugugaaguguaa

SEQ ID NO: 118440 - RNA, 22 nt, Homo sapiens
aagugccauguggaugggcccu

SEQ ID NO: 118441 - RNA, 22 nt, Homo sapiens
augacauugaugcucuggcugg

SEQ ID NO: 118442 - RNA, 22 nt, Homo sapiens
augaccagagagugcgcagggu

SEQ ID NO: 118443 - RNA, 22 nt, Homo sapiens
augacuggaacagcaauuuaca

SEQ ID NO: 118444 - RNA, 22 nt, Homo sapiens
augagaugauaggcguucuaac

SEQ ID NO: 118445 - RNA, 22 nt, Homo sapiens
augagcacuuguuuugggcaca

SEQ ID NO: 118446 - RNA, 22 nt, Homo sapiens
augaggaaggagccuuugucug

SEQ ID NO: 118447 - RNA, 22 nt, Homo sapiens
augagggcggacgcccuggaga

SEQ ID NO: 118448 - RNA, 22 nt, Homo sapiens
augaggugcagaggaaaugagu

SEQ ID NO: 118449 - RNA, 22 nt, Homo sapiens
augagguguuuauuguauccug

SEQ ID NO: 118450 - RNA, 22 nt, Homo sapiens
augagugugaccugccaagaga

SEQ ID NO: 118451 - RNA, 22 nt, Homo sapiens
augcauggucugaagucaaccu

SEQ ID NO: 118452 - RNA, 22 nt, Homo sapiens
augccaguguccagaguggguu

SEQ ID NO: 118453 - RNA, 22 nt, Homo sapiens
augcccauuuguuuucugaaag

SEQ ID NO: 118454 - RNA, 22 nt, Homo sapiens
auggaagcauaguauucuauug

SEQ ID NO: 118455 - RNA, 22 nt, Homo sapiens
auggaaugguugggucauaagg

SEQ ID NO: 118456 - RNA, 22 nt, Homo sapiens
auggaauguauagucauguagg

SEQ ID NO: 118457 - RNA, 22 nt, Homo sapiens
auggacagaaaaaaauagaugu

SEQ ID NO: 118458 - RNA, 22 nt, Homo sapiens
auggagaugaauaucaucuguu

SEQ ID NO: 118459 - RNA, 22 nt, Homo sapiens
auggagaugugcgaacugagua

SEQ ID NO: 118460 - RNA, 22 nt, Homo sapiens
auggaggaggaagcugaaacaa

SEQ ID NO: 118461 - RNA, 22 nt, Homo sapiens
auggauugucuccuugugccau

SEQ ID NO: 118462 - RNA, 22 nt, Homo sapiens
auggcaaaaaaugcaauuacuu

SEQ ID NO: 118463 - RNA, 22 nt, Homo sapiens
auggcaauguaagucagaaaaa

SEQ ID NO: 118464 - RNA, 22 nt, Homo sapiens
auggcacuguguauuuuucugu

SEQ ID NO: 118465 - RNA, 22 nt, Homo sapiens
auggcccccuguuugugaacau

SEQ ID NO: 118466 - RNA, 22 nt, Homo sapiens
auggccgggugcgguggcucac

SEQ ID NO: 118467 - RNA, 22 nt, Homo sapiens
auggccuaugacagguauguug

SEQ ID NO: 118468 - RNA, 22 nt, Homo sapiens
auggccuuucuggcacauuucc

SEQ ID NO: 118469 - RNA, 22 nt, Homo sapiens
auggcggugugggcggugcagc

SEQ ID NO: 118470 - RNA, 22 nt, Homo sapiens
auggcucuggauagaaugcagg

SEQ ID NO: 118471 - RNA, 22 nt, Homo sapiens
auggcuugugacccaugcuuca

SEQ ID NO: 118472 - RNA, 22 nt, Homo sapiens
auggcuuuaagagugucugaau

SEQ ID NO: 118473 - RNA, 22 nt, Homo sapiens
auggcuuugggcugcucugccc

SEQ ID NO: 118474 - RNA, 21 nt, Homo sapiens
augggacuaacugaugggucu

SEQ ID NO: 118475 - RNA, 20 nt, Homo sapiens
auguaauguaugauauguac

SEQ ID NO: 118476 - RNA, 22 nt, Homo sapiens
auguagauaucaagaggcauau

SEQ ID NO: 118477 - RNA, 22 nt, Homo sapiens
augucacagguccuagccaagu

SEQ ID NO: 118478 - RNA, 20 nt, Homo sapiens
augucagaguguggguacgg

SEQ ID NO: 118479 - RNA, 22 nt, Homo sapiens
augucuuucauagagacccaga

SEQ ID NO: 118480 - RNA, 22 nt, Homo sapiens
augugcacaacgugcagguuug

SEQ ID NO: 118481 - RNA, 22 nt, Homo sapiens
augugcacauucugguaaauau

SEQ ID NO: 118482 - RNA, 22 nt, Homo sapiens
augugcaugcuguucugccaga

SEQ ID NO: 118483 - RNA, 22 nt, Homo sapiens
augugcuaguaucaaacgagac

SEQ ID NO: 118484 - RNA, 22 nt, Homo sapiens
augugugcuugauguaaaaagu

SEQ ID NO: 118485 - RNA, 22 nt, Homo sapiens
auguuugguagugaauauggua
